United States Patent 7,709,616 (MICRORNAS AND USES THEREOF) - sequence listing, part 18

SEQ ID NO: 538578 - RNA, 64 nt, hsa
cuuuuaggaagcuucguucacaugcuauuuaaaugcacaaaauagacaguaaggauuuaucugu

SEQ ID NO: 538579 - RNA, 64 nt, hsa
aaacagugcagagacguuugacaaugagucaguagcacaaaagagaugacauuuaccuagcacu

SEQ ID NO: 538580 - RNA, 64 nt, hsa
cccugcuuuugcuuuggauuauaccucaccagcugcacaaaaugcauuuuuucguaucaaaaag

SEQ ID NO: 538581 - RNA, 64 nt, hsa
ccauauuuaugugccuuuugucuauuuauaaugccacuggaagaggagggauaacuuuuucugu

SEQ ID NO: 538582 - RNA, 64 nt, hsa
aaaacuugccaacuggaucuuuguuuagcaaacucacuggaaaugaacacuuaauggaauuuuu

SEQ ID NO: 538583 - RNA, 64 nt, hsa
aauaaaggucaaacaucagugagcaagcuguguacacuggaaaacacugaaucaauacaaugcg

SEQ ID NO: 538584 - RNA, 64 nt, hsa
ggcaaaauaccacauggcuucucccgcauaucgucacuggaaacuuccucucucgacauucucu

SEQ ID NO: 538585 - RNA, 64 nt, hsa
uuagcagacugguguguguggaucugcagugcuucacuggaaauaauuuauucauugcagauac

SEQ ID NO: 538586 - RNA, 64 nt, hsa
gcccaggccccacuuacguaaaacauuucagggucacuggaaacagugaagugccauuuguuga

SEQ ID NO: 538587 - RNA, 64 nt, hsa
ggaaacaaacugccccguuaacuccagaucauugcacuggaauguaaucaagaaaguuagucau

SEQ ID NO: 538588 - RNA, 64 nt, hsa
ugaguaccuacuagguaccaaguacucuuuuaggcacuggaaauacagugauggacaaaacagg

SEQ ID NO: 538589 - RNA, 64 nt, hsa
gaaacucacuuuggucaaaugauuauuguguugucacuggaaguacugucaaagacuuuggggg

SEQ ID NO: 538590 - RNA, 64 nt, hsa
uggaguuaucaagugagguccagguagccugcaacacuggaaaugaguucuggguaagugaguu

SEQ ID NO: 538591 - RNA, 64 nt, hsa
ggaugauuauuagucacauagagcuugggaguaccacuggaaacguauggguaggaguuuaggu

SEQ ID NO: 538592 - RNA, 64 nt, hsa
caagcagaauuccaggaguccuugaagcagagggcacuggaagacaauauagcagauuaaaaua

SEQ ID NO: 538593 - RNA, 64 nt, hsa
aaucuuuuccauuccucuuucauacauuccaacccacuggaagucuuuagagguauuuugauuu

SEQ ID NO: 538594 - RNA, 64 nt, hsa
guugauuagcagauuuauuauucuauugagaaagcacuggaauguuuugugagauuauuuuuau

SEQ ID NO: 538595 - RNA, 64 nt, hsa
aacauguuaggcucacacaugcaucagcacugcacacuggaaucauugcucuuccuggacuuug

SEQ ID NO: 538596 - RNA, 64 nt, hsa
augauuccccuugagaauauaacucuguguaggucacuggaaagugauugccauagggcuggga

SEQ ID NO: 538597 - RNA, 64 nt, hsa
gguuggaguuccagggcugggcccugguggaguccacuggaagucccauuauggauguugaaau

SEQ ID NO: 538598 - RNA, 64 nt, hsa
ugugcaauaaugucuguguuucucucccaccugccacuggaacuggagaaugcacuuuauucug

SEQ ID NO: 538599 - RNA, 64 nt, hsa
ggucaggaacacuacacugcacaggaagccuucacacuggaagggggaccugcgcccccacauc

SEQ ID NO: 538600 - RNA, 64 nt, hsa
gagcuccagcugccuuaggaggagucacagcauacacuggaacaggagcugggucagccucugc

SEQ ID NO: 538601 - RNA, 64 nt, hsa
uaaacuuaagggaaaaguucuccuaucuugauuucacuggaauauaggcuuuaggagcucugua

SEQ ID NO: 538602 - RNA, 64 nt, hsa
uuugagagacauuugucuucaugaagcagauuugcacuggaaccauugcuuuacucugguugga

SEQ ID NO: 538603 - RNA, 64 nt, hsa
cccagaggaugucacaaagaucaugaaaguccagcacuggaagccagagaaaauguuggaagag

SEQ ID NO: 538604 - RNA, 64 nt, hsa
uguaaucccagcuaggaggcugaggcaggagaaucacuggaaccugggagccggaggcugcagu

SEQ ID NO: 538605 - RNA, 64 nt, hsa
ccugagucacagauuucugugggacuguggaucucacuggaagcuauccaagagcccacuguca

SEQ ID NO: 538606 - RNA, 64 nt, hsa
aaucaaucaaucaaauucccuuaaauuuguauggcacuggaacuuuggcaaagcacuuuugaca

SEQ ID NO: 538607 - RNA, 64 nt, hsa; identical to SEQ ID NO: 503093

SEQ ID NO: 538608 - RNA, 64 nt, hsa; identical to SEQ ID NO: 503094

SEQ ID NO: 538609 - RNA, 64 nt, hsa; identical to SEQ ID NO: 503095

SEQ ID NO: 538610 - RNA, 64 nt, hsa; identical to SEQ ID NO: 503096

SEQ ID NO: 538611 - RNA, 64 nt, hsa; identical to SEQ ID NO: 503097

SEQ ID NO: 538612 - RNA, 64 nt, hsa; identical to SEQ ID NO: 503098

SEQ ID NO: 538613 - RNA, 64 nt, hsa; identical to SEQ ID NO: 503099

SEQ ID NO: 538614 - RNA, 64 nt, hsa; identical to SEQ ID NO: 503100

SEQ ID NO: 538615 - RNA, 64 nt, hsa; identical to SEQ ID NO: 503101

SEQ ID NO: 538616 - RNA, 64 nt, hsa; identical to SEQ ID NO: 503102

SEQ ID NO: 538617 - RNA, 64 nt, hsa; identical to SEQ ID NO: 503103

SEQ ID NO: 538618 - RNA, 64 nt, hsa; identical to SEQ ID NO: 503104

SEQ ID NO: 538619 - RNA, 64 nt, hsa; identical to SEQ ID NO: 503105

SEQ ID NO: 538620 - RNA, 54 nt, hsa; identical to SEQ ID NO: 375573

SEQ ID NO: 538621 - RNA, 64 nt, hsa; identical to SEQ ID NO: 503107

SEQ ID NO: 538622 - RNA, 64 nt, hsa; identical to SEQ ID NO: 503108

SEQ ID NO: 538623 - RNA, 64 nt, hsa; identical to SEQ ID NO: 503109

SEQ ID NO: 538624 - RNA, 64 nt, hsa; identical to SEQ ID NO: 503110

SEQ ID NO: 538625 - RNA, 64 nt, hsa; identical to SEQ ID NO: 503111

SEQ ID NO: 538626 - RNA, 64 nt, hsa; identical to SEQ ID NO: 503112

SEQ ID NO: 538627 - RNA, 64 nt, hsa; identical to SEQ ID NO: 503113

SEQ ID NO: 538628 - RNA, 64 nt, hsa; identical to SEQ ID NO: 503114

SEQ ID NO: 538629 - RNA, 64 nt, hsa; identical to SEQ ID NO: 503115

SEQ ID NO: 538630 - RNA, 64 nt, hsa; identical to SEQ ID NO: 503116

SEQ ID NO: 538631 - RNA, 64 nt, hsa; identical to SEQ ID NO: 503117

SEQ ID NO: 538632 - RNA, 64 nt, hsa; identical to SEQ ID NO: 503118

SEQ ID NO: 538633 - RNA, 64 nt, hsa; identical to SEQ ID NO: 503119

SEQ ID NO: 538634 - RNA, 64 nt, hsa; identical to SEQ ID NO: 503120

SEQ ID NO: 538635 - RNA, 64 nt, hsa; identical to SEQ ID NO: 503121

SEQ ID NO: 538636 - RNA, 64 nt, hsa; identical to SEQ ID NO: 503122

SEQ ID NO: 538637 - RNA, 64 nt, hsa; identical to SEQ ID NO: 312321

SEQ ID NO: 538638 - RNA, 64 nt, hsa; identical to SEQ ID NO: 312322

SEQ ID NO: 538639 - RNA, 64 nt, hsa; identical to SEQ ID NO: 312323

SEQ ID NO: 538640 - RNA, 64 nt, hsa; identical to SEQ ID NO: 312324

SEQ ID NO: 538641 - RNA, 64 nt, hsa; identical to SEQ ID NO: 312325

SEQ ID NO: 538642 - RNA, 64 nt, hsa; identical to SEQ ID NO: 312326

SEQ ID NO: 538643 - RNA, 64 nt, hsa; identical to SEQ ID NO: 312327

SEQ ID NO: 538644 - RNA, 64 nt, hsa; identical to SEQ ID NO: 312328

SEQ ID NO: 538645 - RNA, 64 nt, hsa; identical to SEQ ID NO: 85116

SEQ ID NO: 538646 - RNA, 64 nt, hsa; identical to SEQ ID NO: 85117

SEQ ID NO: 538647 - RNA, 64 nt, hsa; identical to SEQ ID NO: 85118

SEQ ID NO: 538648 - RNA, 64 nt, hsa; identical to SEQ ID NO: 85119

SEQ ID NO: 538649 - RNA, 64 nt, hsa; identical to SEQ ID NO: 85120

SEQ ID NO: 538650 - RNA, 64 nt, hsa; identical to SEQ ID NO: 85121

SEQ ID NO: 538651 - RNA, 64 nt, hsa
ggaauuacuuuuuguuguuuuugccaccguggagagcaacuauuuggagugcacagccuauuga

SEQ ID NO: 538652 - RNA, 64 nt, hsa
uauuauaaagacuguauuucccauagacguuuacagcaacuauguuuaaaaaacaaaaacaaaa

SEQ ID NO: 538653 - RNA, 64 nt, hsa
ccaaugucaccucagagguuucaaacauugcacaagcaacuaacuuuauuccuccacaggaacc

SEQ ID NO: 538654 - RNA, 64 nt, hsa
aguccaggagaacccguacccccacagagccuuaagcaacuacuucugugaaguauuuuuugac

SEQ ID NO: 538655 - RNA, 64 nt, hsa
uugcacggcaaccacuccucccauggcauugcucagcaacuacuucucccuucccggccacccu

SEQ ID NO: 538656 - RNA, 64 nt, hsa
auugcccaguacugccugccagcugggucucccaagcaacuaccccaagacauaccaacaguga

SEQ ID NO: 538657 - RNA, 64 nt, hsa
cccugcuguuaguaacagucaccaaaauguucuaagcaacuacuuuccuagaguaucauuugcc

SEQ ID NO: 538658 - RNA, 64 nt, hsa
agauguggcuucugaugacaauggccaagacuugagcaacuacaguuucucaacagaugguuuc

SEQ ID NO: 538659 - RNA, 64 nt, hsa
acgauuggccauucuaaaguuggugaguuugucaagcaacuaucgacuugaucaguucagccaa

SEQ ID NO: 538660 - RNA, 64 nt, hsa
aagcuuugaaauuauuguuuggggguuuuauaaaagcaacuacugucaccuccauccagauucu

SEQ ID NO: 538661 - RNA, 64 nt, hsa
ucugacugguuuuaauagucaccuucaugauuauagcaacuaauguuugaacaaagcucaaagu

SEQ ID NO: 538662 - RNA, 64 nt, hsa
uuauuugguuauuuccuaagaauauugaaagugaagcaacuaugugacuguauucuucagguaa

SEQ ID NO: 538663 - RNA, 64 nt, hsa
gucacugcuaagagacagagcacauuuucaggccagcaacuauccuugccagaguuuuuucauu

SEQ ID NO: 538664 - RNA, 64 nt, hsa
acaugauauuucggaauugguuuuacuguucuucagcaacuauuguacaaaauguucacauuua

SEQ ID NO: 538665 - RNA, 64 nt, hsa
uauaauauaaauguauagacauggugguaggaauagcaacuaauacaaaugccaauaugauaau

SEQ ID NO: 538666 - RNA, 64 nt, hsa
cuuucuuaguuauuugcuccuugcaaauuaaaaaagcaacuaagagaaagaaaaacauuguaga

SEQ ID NO: 538667 - RNA, 64 nt, hsa
gaauaaaaagauugguggaagggcucaugugguuagcaacuaugaaacagaaauaggacacuca

SEQ ID NO: 538668 - RNA, 64 nt, hsa
cugcucccccaaagcuguuucugauccugcugggagcaacuaacuaguuauuaugcacaucugc

SEQ ID NO: 538669 - RNA, 64 nt, hsa
uaggaaaccaugaaugggaaggauggcaauaaguagcaacuauacuuuccaaugacuaaagaaa

SEQ ID NO: 538670 - RNA, 64 nt, hsa
cauuucuuuuuuucuaugcgcaaaacugccugaaagcaacuacagaauuucauucauuugugcu

SEQ ID NO: 538671 - RNA, 64 nt, hsa
aucugugcuguuucaaaguucucuguggcaaagcagcaacuauucacaaaauaucaccaaaaac

SEQ ID NO: 538672 - RNA, 64 nt, hsa
cauuguauagagcagacagaaagauguugggucaagcaacuauugaagagaaauacaaagaaaa

SEQ ID NO: 538673 - RNA, 64 nt, hsa
augaagccuuuauuucugaaguaacaagacaccuagcaacuauaggaaucauuuuuaaaaaucu

SEQ ID NO: 538674 - RNA, 62 nt, hsa
uggaacuggagcaagcuugauuuauauuugcaagcaacuaaauuaauugaccugaaaaagcc

SEQ ID NO: 538675 - RNA, 64 nt, hsa
uucugaaguuauaaacuuauaaucaauacaaaccagcaacuaauaaaaccucuaauucugcaac

SEQ ID NO: 538676 - RNA, 64 nt, hsa
cuaaaccaauuaagaaaauaauuaauuucuuucaagcaacuaaaaaauauaugguaauuuaaag

SEQ ID NO: 538677 - RNA, 64 nt, hsa
cuaaggcacaaagacaugucaugcaucacagaaaagcaacuacuuauauuucagagcaaauuag

SEQ ID NO: 538678 - RNA, 64 nt, hsa
augcagcccuauggccgcucagaccaaggcgcagagcaacuaucagggcagcucugccuccucc

SEQ ID NO: 538679 - RNA, 64 nt, hsa
uccgaauagaauguuuucuuuaagaggcaugaaaagcaacuauuguuguguuacaguguuaaaa

SEQ ID NO: 538680 - RNA, 64 nt, hsa
ggaucacugacaaaaaacacugcaccaguaaggaagcaacuaaauuuuguuuuguucuuugaaa

SEQ ID NO: 538681 - RNA, 64 nt, hsa
uggugaauaugcuguuuccucaguucagagagguagcaacuagguaaacuccuuauaaaaagca

SEQ ID NO: 538682 - RNA, 64 nt, hsa
gcuuuuuauauugacauugccauugaauagcucuagcaacuauuauuauucccccaaacccuaa

SEQ ID NO: 538683 - RNA, 64 nt, hsa
uuugccacuuuuaaauaaugugcugaauaagcucagcaacuaaaaaccauuacccaagaacguu

SEQ ID NO: 538684 - RNA, 64 nt, hsa
uguuucauauuuaaaucauguuuuccuaaaauguagcaacuacaugugauaaaagcaaauuaga

SEQ ID NO: 538685 - RNA, 64 nt, hsa
caaagcgcuaaguaaaaauauuaacugacgaagaagcaacuaaguuaauaauaaugacucuaaa

SEQ ID NO: 538686 - RNA, 64 nt, hsa
ggagcugcauuaauucuggaagacgacuccaugcagcaacuacugaagaaaggaccagacuuca

SEQ ID NO: 538687 - RNA, 64 nt, hsa
auuauuuuuggagcugaaaucuuuguaauauuaaagcaacuaguuucuaauucccaguuucugu

SEQ ID NO: 538688 - RNA, 64 nt, hsa
uauugacaggcauugguauuauuagucauugcuaagcaacuaaaacuucaucaguucaaauaag

SEQ ID NO: 538689 - RNA, 64 nt, hsa
aucuuuucugcuuuugaauugggcagaagauuuuagcaacuauauucuacaaauguuacuuaua

SEQ ID NO: 538690 - RNA, 64 nt, hsa
uuagcucuguuagauauguuucuuucuaaggacaagcaacuauguauagacuuguuguuugaau

SEQ ID NO: 538691 - RNA, 64 nt, hsa
ucaaguuauaggaaaggaagcagauaccuugcaaagcaacuagugggugcuugagagacacugg

SEQ ID NO: 538692 - RNA, 64 nt, hsa
uaguacuucaaaguauuauucaacuucaaguuucagcaacuaccuacaaaagauucuaaggccu

SEQ ID NO: 538693 - RNA, 64 nt, hsa
uauugacauaaaauaugaauauggcuuagcaaagagcaacuaauauguuuucugaaaccaggau

SEQ ID NO: 538694 - RNA, 64 nt, hsa
guacugcaguugguaugaccccucuaaggaguguagcaacuacagucuaaagcugguuuaaugu

SEQ ID NO: 538695 - RNA, 64 nt, hsa
aaaacuguucucuuuaaaauauuugucuuuaaacagcaacuacagaaguggaagugcuugauau

SEQ ID NO: 538696 - RNA, 64 nt, hsa
gaaccaagcacugucagcaaaucucagguauuagagcaacuaugguugauugaaaagugucuca

SEQ ID NO: 538697 - RNA, 64 nt, hsa
guuauuuuaucuugucauuuacaacauccauauaagcaacuagccauauaagcaaaauucauag

SEQ ID NO: 538698 - RNA, 64 nt, hsa
augagcgauuaaauaguaauggauacaauuaaggagcaacuauuuuauaugacuguucuguaca

SEQ ID NO: 538699 - RNA, 64 nt, hsa
cauuuucucuuuggauaauuuucaucgcauauccagcaacuauagaccaaaguuugcuuaaggu

SEQ ID NO: 538700 - RNA, 64 nt, hsa
cauccuauauuuuuauucucagauucaaagaaagagcaacuacuuuggaccaaaagcccauggc

SEQ ID NO: 538701 - RNA, 64 nt, hsa
gacaguuccuuauuggugugugugagauuacucuagcaacuauuacaguauaacacagaugauc

SEQ ID NO: 538702 - RNA, 64 nt, hsa
caucaguuacagagaauuucuaaaguaaaauugaagcaacuacaacuucuccuuagacacuuug

SEQ ID NO: 538703 - RNA, 64 nt, hsa
aucaggaacaucccugagaaacgguuuuaaguguagcaacuacucuuccuuaauggacagccac

SEQ ID NO: 538704 - RNA, 64 nt, hsa
uuuuuuguugacuuuagaucuauaauuauuucuaagcaacuaguuuuuauuccccacuacucuu

SEQ ID NO: 538705 - RNA, 64 nt, hsa
auauauaauugauuuauguugaauauauggacuuagcaacuaaaaauaccacagaugguuaacc

SEQ ID NO: 538706 - RNA, 64 nt, hsa
ccuuaaaaagacaaaaaaaauaaggcaaaaggaaagcaacuaagacacuggacuauccuuuaaa

SEQ ID NO: 538707 - RNA, 64 nt, hsa
acaaauccaucuuugaaucuaaugguguacucauagcaacuauuacugguuuaaaugacaaaua

SEQ ID NO: 538708 - RNA, 64 nt, hsa
cacuagggaaagguaaauacaagugaacaaaauaagcaacuaaaugagaccuaauaauuggccu

SEQ ID NO: 538709 - RNA, 64 nt, hsa
cucuggcuucagaagugaacuaugggcugcugggagcaacuagugacuuugauucccauggagg

SEQ ID NO: 538710 - RNA, 64 nt, hsa
guugcggguugucgaaggguggauuuucuccuucagcaacuacaggagauaugaugccucauaa

SEQ ID NO: 538711 - RNA, 64 nt, hsa
ucggccuucacaaucugucaguucuaaccuccuaagcaacuaggccuucaguaaaugugauuca

SEQ ID NO: 538712 - RNA, 64 nt, hsa
ccauguauuaauagucacagaaagacuguaagugagcaacuauuuuuaugaaacguaccacuau

SEQ ID NO: 538713 - RNA, 64 nt, hsa
ugauaauuugcugaagaagcaaauagauuaacauagcaacuaaguagaugauuaguugcauuau

SEQ ID NO: 538714 - RNA, 64 nt, hsa
uggcauagacuccuucacacaucacuguggcaccagcaacuacuucuuuauauuguucuucaua

SEQ ID NO: 538715 - RNA, 64 nt, hsa
aaacggauuuuguaacuagcuuuaaacuaggccaagcaacuaguuuuccugcaaaucaaauuuu

SEQ ID NO: 538716 - RNA, 64 nt, hsa
aagguagcuaccacaucauuuugaaaggaccaugagcaacuauaagcaaagccauaagaagugg

SEQ ID NO: 538717 - RNA, 64 nt, hsa
aagaagaaauuauuguucaugguaaaagauauuuagcaacuaugguauucuuauucugaagauu

SEQ ID NO: 538718 - RNA, 64 nt, hsa
ucaaaaagauauuguuguuuuccaugauuuagcaagcaacuaauuuucucccaagcugauuuua

SEQ ID NO: 538719 - RNA, 64 nt, hsa
cacuaucacuuuaaauacuauuauuugcuaccacagcaacuauauauuuccauagcuuuuggcu

SEQ ID NO: 538720 - RNA, 64 nt, hsa
uuuacauuugcaaauguagcaaacaagguaaugaagcaacuauuucuauugcaguagauauccu

SEQ ID NO: 538721 - RNA, 64 nt, hsa
guauguaacugucccagacuccucugucaguuucagcaacuacaagggauacccugcgaaagua

SEQ ID NO: 538722 - RNA, 63 nt, hsa
aauaaaauaagaaaauagcaauaaacuucuuuucagcaacuacagaaaacuaccucagcaucu

SEQ ID NO: 538723 - RNA, 64 nt, hsa
ugaauuccaaguguauuuuaaaauagaggcuuugagcaacuaacuaaccacauuuuaggaucuc

SEQ ID NO: 538724 - RNA, 64 nt, hsa
ggcuuccagcugcccaguggcucuuaaacaguuuagcaacuaauaaccggagaacuaacaugua

SEQ ID NO: 538725 - RNA, 64 nt, hsa
gcuaaacuaugcaguuuuucuugaaggaacuaaaagcaacuagcucccuaauggucuauaauuu

SEQ ID NO: 538726 - RNA, 64 nt, hsa
cuaucucauugcaauuuguauuuuagcagauuucagcaacuauccuaaacaauguuauuguguu

SEQ ID NO: 538727 - RNA, 64 nt, hsa
guguacccuggggcaauaggguuaaaugguaguuagcaacuagggcuagucuucccuuaccuca

SEQ ID NO: 538728 - RNA, 64 nt, hsa
uuacagaauugaugugcuaacugaauaucauugcagcaacuagacuaagauauucaagaucucu

SEQ ID NO: 538729 - RNA, 64 nt, hsa
ucguucuauguaccagguauuuuauuacugaacuagcaacuagccuuuuccaccuuuaaaaguu

SEQ ID NO: 538730 - RNA, 64 nt, hsa
cuguacuguauaggcaacauguuguacucccaguagcaacuagaucucuuuuaccucuucuuua

SEQ ID NO: 538731 - RNA, 64 nt, hsa
cauuggaaucauuuccauaggagguaauuuccauagcaacuaaucauagugacccaaacaggau

SEQ ID NO: 538732 - RNA, 64 nt, hsa
ugaagagaaacaccugagcuauauauuuuuuuaaagcaacuaacuuauugcuuuauguuuaucu

SEQ ID NO: 538733 - RNA, 64 nt, hsa
caugcuccccccccuccuuauuuguagcaaucguagcaacuaauuccacuaaguacaagggagu

SEQ ID NO: 538734 - RNA, 64 nt, hsa
uuugggucuuuuugagagagcuggggaaaguagcagcaacuagauuaagacugggaggauuuug

SEQ ID NO: 538735 - RNA, 64 nt, hsa
uucaggaccugacuggacagauggaccuggcucaagcaacuacucuggaugcacuuugcugugu

SEQ ID NO: 538736 - RNA, 64 nt, hsa
guccuguaaacacagaauuaaauuaggggacucaagcaacuauuauuauauuucuccuuuuugc

SEQ ID NO: 538737 - RNA, 64 nt, hsa
ucuggccuucucugugggaccucugcuuuugugaagcaacuauuuauuugaagaccaggguaug

SEQ ID NO: 538738 - RNA, 64 nt, hsa
aucauuuaauauuucccugucuuaccccuauucaagcaacuagaggccagaaaaugggcaaauu

SEQ ID NO: 538739 - RNA, 64 nt, hsa
uccauuguuaacugaauguuacuguuuccacuccagcaacuacauguccucccuucaacugccu

SEQ ID NO: 538740 - RNA, 64 nt, hsa
ggccaaaacacuacucagacacuuuccugggaagagcaacuaaaaauguaaaauugguuaaaaa

SEQ ID NO: 538741 - RNA, 64 nt, hsa
uguuaagucaaaucuaaauaguuaugaguuaguuagcaacuauuccuaaagaauauguauuaag

SEQ ID NO: 538742 - RNA, 64 nt, hsa
gcaauaguauuaguauuuaccauuuuuccaaauuagcaacuaccagaccucacguguugcagug

SEQ ID NO: 538743 - RNA, 64 nt, hsa
aaagcuaugauggcauugucgcugaguugacagaagcaacuauuguacaaauuaaaaauaacca

SEQ ID NO: 538744 - RNA, 64 nt, hsa
ugaauauuuuagcuauauuuaguggcuuucugcaagcaacuagaacagagaaguaaugggucaa

SEQ ID NO: 538745 - RNA, 64 nt, hsa
ccagugcuuuugauaaugugguuggcaacaaaccagcaacuauuuagaagugucauaagaguuc

SEQ ID NO: 538746 - RNA, 64 nt, hsa
uagagaagaaacacugguccuucuuucaaaauuaagcaacuauuaaaagcgccauuuuauuuau

SEQ ID NO: 538747 - RNA, 64 nt, hsa
aaccccuucagugcauuuucauuuuuuuauuaacagcaacuaaaauuuuauauauuguaaccag

SEQ ID NO: 538748 - RNA, 64 nt, hsa
uuuuaccaaaacugaagcugguaauuuuaaguaaagcaacuaaauuuacccuuuacuuauuagu

SEQ ID NO: 538749 - RNA, 64 nt, hsa
accccaauaauguucuauauagccuuugcuaaagagcaacuaauaaauuaaaccuauucuuucu

SEQ ID NO: 538750 - RNA, 64 nt, hsa
uguuaacaauuaugacaucugcaauguuuuauaaagcaacuaauuuaauaaaaucacuguugug

SEQ ID NO: 538751 - RNA, 64 nt, hsa
ccgcagggacuagaggcuuucggcuuuuugggacagcaacuaccuugcuuuuggaaaauacauu

SEQ ID NO: 538752 - RNA, 64 nt, hsa
gcacugaagucaccauuaggucacuuaagaaguaagcaacuagcugggcacaguggcucaugcc

SEQ ID NO: 538753 - RNA, 64 nt, hsa
cuggguggcauccaagucuuggaaaaccgugugaagcaacuacuauaaacuugagucaucccga

SEQ ID NO: 538754 - RNA, 64 nt, hsa
cucugggcucacgggguguuuuccaccccccugcagcaacuaagauggugggggagaggggguu

SEQ ID NO: 538755 - RNA, 64 nt, hsa
uagcuaacaguaaacagacaucuuuacaccagcaagcaacuaaggagauucaggaugcagcugg

SEQ ID NO: 538756 - RNA, 64 nt, hsa
ugaguccggcucuucagcaggcugcacaaguggaagcaacuaauucuggugcucaggcugggcu

SEQ ID NO: 538757 - RNA, 62 nt, hsa
gcgccgccgcccagcccugaaccagaagccugagcaacuacggacgcaagccgaggaccgug

SEQ ID NO: 538758 - RNA, 64 nt, hsa
aaaugcaaagacacauuuuucuauaaaaagaaaaagcaacuaagguuaaaagcuauauuguggc

SEQ ID NO: 538759 - RNA, 64 nt, hsa
ggguuuuucugggagcgaauaucaagugccugagagcaacuacaggacuaacuguguuuggguu

SEQ ID NO: 538760 - RNA, 64 nt, hsa
guaaauccuuucuuaaugguuaaauaggauuguuagcaacuauggguuugcaguuuucugagua

SEQ ID NO: 538761 - RNA, 64 nt, hsa
aguguggucguuauaaaccaauauugugaaaaauagcaacuauucauuuguucacaacaugcgu

SEQ ID NO: 538762 - RNA, 64 nt, hsa
accuaagaauucaaaagcuggauagaauuuuagaagcaacuacguacaucauuauuaauauaaa

SEQ ID NO: 538763 - RNA, 64 nt, hsa
agacaucagcccuuggggguccuccuccagggacagcaacuaucagacuaagccagcaccggac

SEQ ID NO: 538764 - RNA, 54 nt, hsa
caguuccaggauauaauugaagucagcaacuaagucuuccuucaaaguugugau

SEQ ID NO: 538765 - RNA, 64 nt, hsa
uaauguaccauaugugaaacauucuggccauagcagcaacuaaaaacugcaagcaacuugguaa

SEQ ID NO: 538766 - RNA, 64 nt, hsa
ucuuagcucauaaaaauauaauaugacuugauaaagcaacuaaacucuuuccacaguguucaga

SEQ ID NO: 538767 - RNA, 64 nt, hsa
cacuacccaacuuuaaaccauacuacaaggcuacagcaacuaaaacagcaugguacugguauaa

SEQ ID NO: 538768 - RNA, 64 nt, hsa
cuuaaaaugauugaaaauaaugcuguucuuuaguagcaacuaaaaugugucuugcugucauuua

SEQ ID NO: 538769 - RNA, 64 nt, hsa
uucuggcaagccugucuucagagaacccacuagaagcaacuaggaaaaucacuugccaaaaucc

SEQ ID NO: 538770 - RNA, 64 nt, hsa
gcuuguuaguggguucagaaaucaguuucuggcuagcaacuagaaguuuuguauguuaacagua

SEQ ID NO: 538771 - RNA, 64 nt, hsa
aagaggaccaaacaauucuuuauacaaauggaguagcaacuaguuuuguagcacuacauuuaau

SEQ ID NO: 538772 - RNA, 64 nt, hsa
guccucugguaggaggcaaagguucuaucugcuuagcaacuaguuaauaagugguaucugacac

SEQ ID NO: 538773 - RNA, 64 nt, hsa
agagucccccagcacacacuccccaacccccuccagcaacuacaugugacugauagcuuuuccc

SEQ ID NO: 538774 - RNA, 64 nt, hsa
aauuuaguauuuguguaaaaccaccuuuugaagcagcaacuaucaagucugaaaagcaauugau

SEQ ID NO: 538775 - RNA, 64 nt, hsa
ggcuguuccuggacacugugcuguccccguccugagcaacuaugcccccgccccaguagguuca

SEQ ID NO: 538776 - RNA, 64 nt, hsa
cuaccuucgaggcaggagcccucucauggugaacagcaacuauuaugucaugguaugaacuaga

SEQ ID NO: 538777 - RNA, 64 nt, hsa
cugcuuucuaagugggaagaggaagggagaggcaagcaacuagguacaaugucuaucaggaaag

SEQ ID NO: 538778 - RNA, 64 nt, hsa
ucgagacacagaagugcaauaacugcccuaauuaagcaacuauuuguuaaaaagggccucuuuu

SEQ ID NO: 538779 - RNA, 64 nt, hsa
agcaugagaaauaugauauuuggauagggauuucagcaacuaaacauucucuguucugagaucu

SEQ ID NO: 538780 - RNA, 64 nt, hsa
uccaauggauuugccuucucaaaauguacaacuaagcaacuaaagaaaauuaaagugaaaguug

SEQ ID NO: 538781 - RNA, 64 nt, hsa
uuuuuuccaggggugagaauaaguauaaacauaaagcaacuaaaaugaaacauaaaaccuuuua

SEQ ID NO: 538782 - RNA, 64 nt, hsa
ucgagacacagaagugcaauaacugcccuaauuaagcaacuauuuguuaaaaagggccccuuuu

SEQ ID NO: 538783 - RNA, 52 nt, hsa
cuacuccccuaucucccugagcagcaacuaaguuuaggcccagcugccagac

SEQ ID NO: 538784 - RNA, 64 nt, hsa
uuggaaauaccuggauauuugcuagaggaaaaaugaaagcaaaacuucguacacagugccuugc

SEQ ID NO: 538785 - RNA, 64 nt, hsa
uggucaaaaaauaagucaucagcacuuaagaaaugaaagcaacuuuugaaauuuucuguuaaaa

SEQ ID NO: 538786 - RNA, 64 nt, hsa
accagcuacggccagaaagggccaggugggaccugaaagcaaagacaauguucuuuaccacacg

SEQ ID NO: 538787 - RNA, 64 nt, hsa
cucuuucauauuguaaguccaggaugaacuaggagaaagcaauuuguugcccugaugauaacug

SEQ ID NO: 538788 - RNA, 64 nt, hsa
agagaaaugaacccuacuugcuaucucuaucuuagaaagcaaaaacaaacaggaguuuccaggg

SEQ ID NO: 538789 - RNA, 64 nt, hsa
ucagagagcuaaaaccagaaauuuccagacucaugaaagcaaccccccagccucuccccaaccc

SEQ ID NO: 538790 - RNA, 64 nt, hsa
acaaauacaagccaagcuagaaggaagcaccuaugaaagcaacaacuuuguuucucauccauag

SEQ ID NO: 538791 - RNA, 64 nt, hsa
gcaaaaaguacauagugaauuuuaaaauguagaagaaagcaaaaaauaaaauaaguccuaaagu

SEQ ID NO: 538792 - RNA, 50 nt, hsa
caacaucaacaaauaaauaagaaagcaaaaagaucugggauauguguugg

SEQ ID NO: 538793 - RNA, 64 nt, hsa
aauucucaucaucucuguuauacaccuguaucaugaaagcaaaaagaaguaaacaucaggaguc

SEQ ID NO: 538794 - RNA, 64 nt, hsa
uaaagcuuucuuaagccucauuaagaaaaaaacugaaagcaaucuauccuugugugccacuggu

SEQ ID NO: 538795 - RNA, 64 nt, hsa
cuugugugccacugguguucuuuccacuuuauacgaaagcaaguagccaugcuuugguugugug

SEQ ID NO: 538796 - RNA, 64 nt, hsa
gaaaucuuacauuuuugcaauaacaaacauuaaugaaagcaaaacauuauaaaaguaauuuuaa

SEQ ID NO: 538797 - RNA, 64 nt, hsa
cuuaaagaugaucaugguucagaauaucuucagagaaagcaaaaucuuuaauauugcagggagc

SEQ ID NO: 538798 - RNA, 64 nt, hsa
caaaggcaugugauugauuaaugauucccccuuagaaagcaaguguuaccaaaguuguguuauc

SEQ ID NO: 538799 - RNA, 64 nt, hsa
uuccaaugaauguacagcacuuccauuaacuuuugaaagcaacacagccuuaaacucaaugcuu

SEQ ID NO: 538800 - RNA, 64 nt, hsa
aggagagcaagaaggaaagauuugugaacuggaagaaagcaacaaagauugagaagccauguac

SEQ ID NO: 538801 - RNA, 64 nt, hsa
aaacagaguauguccgaugguaucuggguaagaagaaagcaaaagcaagggaccuucaugcccu

SEQ ID NO: 538802 - RNA, 64 nt, hsa
gaaaagccuuauauuuuaguuuguuccacauuuugaaagcaaaaaauauauauuugauauaccc

SEQ ID NO: 538803 - RNA, 64 nt, hsa
agaauuuuuuuuuaauggcucaaaaauggaaacugaaagcaagucauggggaaugaauacuuug

SEQ ID NO: 538804 - RNA, 64 nt, hsa
auucuccuguucagaauaauacuuauuuacgugugaaagcaacauggaugugauucccaacaca

SEQ ID NO: 538805 - RNA, 64 nt, hsa
gauugaaaaguuuugagaaaauguuauuuuuacugaaagcaagcaguggccuauaaagaacauu

SEQ ID NO: 538806 - RNA, 64 nt, hsa
aucagaacaauguaacauuuacaaaugacauauugaaagcaaaggcuguuuuauuuagccaaga

SEQ ID NO: 538807 - RNA, 64 nt, hsa
augauuaccauuaggaguuacuuuauguauuguugaaagcaaauuuuaaacaugauguuuuaga

SEQ ID NO: 538808 - RNA, 64 nt, hsa
cuuuuggaacuuguuucaagccaaaaacucucaagaaagcaaauugcaccucagcuggauugau

SEQ ID NO: 538809 - RNA, 64 nt, hsa
acaaaaauuaugaaaagguauauuugcuucucgggaaagcaaagaagcugcuuuaaaaaauaaa

SEQ ID NO: 538810 - RNA, 64 nt, hsa
acaugcauuuaauauuuccuuugauauuauacaggaaagcaauauuuuggaguauguuaaguug

SEQ ID NO: 538811 - RNA, 64 nt, hsa
agauuuuugaaagcgcaaugucagaagcgauuaugaaagcaacaaagaaauccggagaagcugc

SEQ ID NO: 538812 - RNA, 64 nt, hsa
aaaccucacacuacuguauuucauuaucuguacugaaagcaaaugcuuugugacuauuaaaugu

SEQ ID NO: 538813 - RNA, 64 nt, hsa
uguaaguuugcauaucagucaugacuagugccuagaaagcaaugugauggucaggaucucauga

SEQ ID NO: 538814 - RNA, 64 nt, hsa
auuucugaaaaaacacuccauguuauauucuggggaaagcaaaaacaaaaaaaaaaaacaaaaa

SEQ ID NO: 538815 - RNA, 64 nt, hsa
auuugaagaaaacguauaaaucuuucuuaaccgugaaagcaaaagccuuuggguuuauuuuggg

SEQ ID NO: 538816 - RNA, 64 nt, hsa
aggaauuugcugccccccaccaguggcuucuagggaaagcaaggaccucacaugccaggugccc

SEQ ID NO: 538817 - RNA, 64 nt, hsa
ggcuuucaauccuuuguuucuaugccuacagacagaaagcaagaugucuaauauuagacauaca

SEQ ID NO: 538818 - RNA, 64 nt, hsa
ggaggcucucucugccuagucuacaguacugacagaaagcaaggacaugcggccugcauggugg

SEQ ID NO: 538819 - RNA, 64 nt, hsa
ggguucacauaggcucucaggugccagucuuccagaaagcaaggacugcccuucauucagccuu

SEQ ID NO: 538820 - RNA, 64 nt, hsa
cuccauugucagaggaggaaacggggucaggcaggaaagcaacuuaaaggagggccugcaagca

SEQ ID NO: 538821 - RNA, 64 nt, hsa
uuacagugacugcuucuucucagcuucucugguugaaagcaagcuggcgaaguaagaggaggua

SEQ ID NO: 538822 - RNA, 64 nt, hsa
ugcauggguaagguaaagugcgauaguucaaguggaaagcaagagaaugaccagugaccuugcu

SEQ ID NO: 538823 - RNA, 64 nt, hsa
agggccuucaugccggcagcagcuagcaaagccagaaagcaagucuaacaggaucuaagaugac

SEQ ID NO: 538824 - RNA, 64 nt, hsa
gacugcugccucaucgauaccccauuuagcuccagaaagcaaagaaaacucgaguaacacuugu

SEQ ID NO: 538825 - RNA, 64 nt, hsa
guugacggcccuucuccccacgccuguuucuuuugaaagcaaguguagacaccuucgagggcag

SEQ ID NO: 538826 - RNA, 64 nt, hsa
guauuucgguuuguguauccaugcaccuaccucagaaagcaaguauagucagguauucucucca

SEQ ID NO: 538827 - RNA, 64 nt, hsa
cugcggaccccucgucaucaggugcauagcaagugaaagcaaguguucacaacagugaaaaguu

SEQ ID NO: 538828 - RNA, 64 nt, hsa; identical to SEQ ID NO: 175085

SEQ ID NO: 538829 - RNA, 64 nt, hsa; identical to SEQ ID NO: 175086

SEQ ID NO: 538830 - RNA, 64 nt, hsa
uugagggcaagucucuggaaaagaggcuguaggcaucuggcagcuaccaugcaugguagugugu

SEQ ID NO: 538831 - RNA, 64 nt, hsa
ggguggggguccugggcacuggcugugugaagggaucuggcagggcaccacagcgcccccuacu

SEQ ID NO: 538832 - RNA, 64 nt, hsa
auggccuucccaccuucuguuagaaauuaguuuuaucuggcauuuuuaaacauuuaaaaauuau

SEQ ID NO: 538833 - RNA, 64 nt, hsa
auuucauacucugugaauauucaaaaguaauagaaucuggcauauaguuuuauugguuccuuag

SEQ ID NO: 538834 - RNA, 64 nt, hsa
acugcugccuuucauuuauaauaauagcccuuccaucuggcaguggggguagaauacacucuug

SEQ ID NO: 538835 - RNA, 64 nt, hsa
cucagggguaaccugcuuacaucuggacuuuagaaucuggcacacaacaaaagugccuggcauc

SEQ ID NO: 538836 - RNA, 64 nt, hsa
auucuguacaacuuucuguacaauauugauucccaucuggcauauucuaaucagguuauagguc

SEQ ID NO: 538837 - RNA, 64 nt, hsa
acagaauuuaacguugaauauauuaaaauaacaaaucuggcaugguuugcggagguuagauuua

SEQ ID NO: 538838 - RNA, 64 nt, hsa
cuucuucaacagguugcuaauaauuuauacuggaaucuggcauuuuuccaagccaagagaagau

SEQ ID NO: 538839 - RNA, 64 nt, hsa
cuacgugguucaucuacaaugguuaccauaaaaaaucuggcaggauuuuaaaacucaaucaguc

SEQ ID NO: 538840 - RNA, 64 nt, hsa
uguggggugugugugggauguggguuguguguauaucuggcaugugucccagucacuugcagaa

SEQ ID NO: 538841 - RNA, 64 nt, hsa
uguggcguguguguaugauguaugugggcuguguaucuggcacauguguguuggguggugugug

SEQ ID NO: 538842 - RNA, 64 nt, hsa
cucggagccuguuuccaagaaggaauugguugucaucuggcaguguugcgcgucacaagagagc

SEQ ID NO: 538843 - RNA, 64 nt, hsa
aaacgcauccccauugugugauguguucagaugcaucuggcaccaauuagguauuucuuaaaac

SEQ ID NO: 538844 - RNA, 64 nt, hsa
ugauaaccacgauggagcccguguuuguccugccaucuggcacugcacugaguguggcacaggc

SEQ ID NO: 538845 - RNA, 64 nt, hsa
uaauaauaaucuuaaagaugagaaaagccaccccaucuggcaccacagcugcaucuugcuugug

SEQ ID NO: 538846 - RNA, 64 nt, hsa
uaauauaguaugcacugcuauuugcuugauuauguaaugucaaaaguuuaacuauauuccaagu

SEQ ID NO: 538847 - RNA, 64 nt, hsa
uguuaaacuucaauuccuguaaccugguuaguauuaaugucagugacuaaaaaacuuagaguua

SEQ ID NO: 538848 - RNA, 64 nt, hsa
auguauucuaacauuucuauguagugugcaacucuaaugucaugcuuuugaagaagagaauagc

SEQ ID NO: 538849 - RNA, 64 nt, hsa
augucagaacugcuuaaaauuaaccuuuaccauuuaaugucaucuaccugaaaacagugagauu

SEQ ID NO: 538850 - RNA, 64 nt, hsa
guuauguucgaaucugcuuuguguugggacgcuuuaaugucaggguuucacuaaauaaaugaau

SEQ ID NO: 538851 - RNA, 64 nt, hsa
gagauuugcaggggaaacaucaguaaacuaccauuaaugucaaugcccaguuuugacuuuuguu

SEQ ID NO: 538852 - RNA, 64 nt, hsa
uuuugcaauaaaguacauuuugacuuuguuggcauaaugucaguaacauacauauuccaguggu

SEQ ID NO: 538853 - RNA, 64 nt, hsa
uauucuaugucuuuaaaaauuugaucuugacauuuaaugucacaaaguuuuguuuuuuuaaaaa

SEQ ID NO: 538854 - RNA, 64 nt, hsa
uauaagcauguuaaauaccauauuuacauauugauaaugucauugguauaugguggcuguuuac

SEQ ID NO: 538855 - RNA, 64 nt, hsa
uuggaauccuagccuacuaugugaaaauuaagucuaaugucagaauaacuuacagaaaaauaga

SEQ ID NO: 538856 - RNA, 64 nt, hsa
cauguguugugcaucuuguuuaggguauauuucuuaaugucaucuaggucauuaguuuuguuaa

SEQ ID NO: 538857 - RNA, 64 nt, hsa
gcugguauaaucagauuguuuuuaagaucuccauuaaugucauuuuuauggauuguagacccag

SEQ ID NO: 538858 - RNA, 64 nt, hsa
cuacgaacagguaccuugcugucuugacaaauccuaaugucacgccuacagccccaacacaagc

SEQ ID NO: 538859 - RNA, 64 nt, hsa
uuaaaaaaaccuguaguuucauuaccuuuuugaauaaugucauacaaaaaauguauuuguuuuu

SEQ ID NO: 538860 - RNA, 64 nt, hsa
gucuguccauauguauuuguaaauagguuguauauaaugucagguuugggucuuggguucaagu

SEQ ID NO: 538861 - RNA, 64 nt, hsa
uauucagaagcaguuaucaauaaauuccauaaaauaaugucauugguauuuaaaaaugaauauu

SEQ ID NO: 538862 - RNA, 64 nt, hsa
ugugaauucaauacaggcuauguaaaauuuuuacuaaugucauuauuuugaaaaaauaaauuua

SEQ ID NO: 538863 - RNA, 64 nt, hsa
aagcccucauuuuuauaaccuggcaaaaucuuguuaaugucauugcuaaaaaauaaauaaaagc

SEQ ID NO: 538864 - RNA, 64 nt, hsa
aauuuuuggcccugcauaaguucugcauagcaucuaaugucaaaauagaaccaacugguaauca

SEQ ID NO: 538865 - RNA, 64 nt, hsa
aguuuugcuuauuuuuaaauuuggagguccuccauaaugucagauaauauugaccugccauacg

SEQ ID NO: 538866 - RNA, 64 nt, hsa
ccauuugaauaaaaugacaauaacuaaagcuaguuaaugucagugacauuaaacuaacuccagg

SEQ ID NO: 538867 - RNA, 64 nt, hsa
ccuuuuggucauuauuucagugugcauaaguucuuaaugucaaccaucuuuaagguauugugca

SEQ ID NO: 538868 - RNA, 64 nt, hsa
acaugguauguagaagccuaggaucacagggugauaaugucaauuggcagccaguuguguuuuu

SEQ ID NO: 538869 - RNA, 64 nt, hsa
gaagcugccccccaccccucaguuaauugcagucuaaugucaagaggcacuucuuuauuaauua

SEQ ID NO: 538870 - RNA, 64 nt, hsa
caaacacaggaggacuuaauggcagcuuggcauuuaaugucaaaauccaagccguggcauuuaa

SEQ ID NO: 538871 - RNA, 64 nt, hsa
uggcauuuaaugucaaaauccaagccguggcauuuaaugucaaaaugacuucagaccacuucua

SEQ ID NO: 538872 - RNA, 64 nt, hsa; identical to SEQ ID NO: 385426

SEQ ID NO: 538873 - RNA, 64 nt, hsa; identical to SEQ ID NO: 385427

SEQ ID NO: 538874 - RNA, 64 nt, hsa; identical to SEQ ID NO: 385428

SEQ ID NO: 538875 - RNA, 64 nt, hsa; identical to SEQ ID NO: 385429

SEQ ID NO: 538876 - RNA, 64 nt, hsa; identical to SEQ ID NO: 385430

SEQ ID NO: 538877 - RNA, 64 nt, hsa; identical to SEQ ID NO: 385431

SEQ ID NO: 538878 - RNA, 64 nt, hsa; identical to SEQ ID NO: 385432

SEQ ID NO: 538879 - RNA, 64 nt, hsa; identical to SEQ ID NO: 385433

SEQ ID NO: 538880 - RNA, 64 nt, hsa; identical to SEQ ID NO: 385434

SEQ ID NO: 538881 - RNA, 64 nt, hsa; identical to SEQ ID NO: 385435

SEQ ID NO: 538882 - RNA, 64 nt, hsa; identical to SEQ ID NO: 385436

SEQ ID NO: 538883 - RNA, 64 nt, hsa; identical to SEQ ID NO: 385437

SEQ ID NO: 538884 - RNA, 64 nt, hsa; identical to SEQ ID NO: 385438

SEQ ID NO: 538885 - RNA, 64 nt, hsa; identical to SEQ ID NO: 385439

SEQ ID NO: 538886 - RNA, 64 nt, hsa; identical to SEQ ID NO: 385440

SEQ ID NO: 538887 - RNA, 64 nt, hsa; identical to SEQ ID NO: 385441

SEQ ID NO: 538888 - RNA, 64 nt, hsa; identical to SEQ ID NO: 385442

SEQ ID NO: 538889 - RNA, 63 nt, hsa; identical to SEQ ID NO: 65136

SEQ ID NO: 538890 - RNA, 63 nt, hsa; identical to SEQ ID NO: 65137

SEQ ID NO: 538891 - RNA, 63 nt, hsa; identical to SEQ ID NO: 65138

SEQ ID NO: 538892 - RNA, 63 nt, hsa; identical to SEQ ID NO: 65139

SEQ ID NO: 538893 - RNA, 63 nt, hsa; identical to SEQ ID NO: 65140

SEQ ID NO: 538894 - RNA, 63 nt, hsa; identical to SEQ ID NO: 65141

SEQ ID NO: 538895 - RNA, 63 nt, hsa; identical to SEQ ID NO: 65142

SEQ ID NO: 538896 - RNA, 63 nt, hsa; identical to SEQ ID NO: 65143

SEQ ID NO: 538897 - RNA, 63 nt, hsa; identical to SEQ ID NO: 65144

SEQ ID NO: 538898 - RNA, 63 nt, hsa; identical to SEQ ID NO: 65145

SEQ ID NO: 538899 - RNA, 63 nt, hsa; identical to SEQ ID NO: 65146

SEQ ID NO: 538900 - RNA, 63 nt, hsa; identical to SEQ ID NO: 65147

SEQ ID NO: 538901 - RNA, 63 nt, hsa; identical to SEQ ID NO: 65148

SEQ ID NO: 538902 - RNA, 63 nt, hsa; identical to SEQ ID NO: 65149

SEQ ID NO: 538903 - RNA, 63 nt, hsa; identical to SEQ ID NO: 65150

SEQ ID NO: 538904 - RNA, 63 nt, hsa; identical to SEQ ID NO: 65151

SEQ ID NO: 538905 - RNA, 63 nt, hsa; identical to SEQ ID NO: 65152

SEQ ID NO: 538906 - RNA, 63 nt, hsa; identical to SEQ ID NO: 65153

SEQ ID NO: 538907 - RNA, 63 nt, hsa; identical to SEQ ID NO: 65154

SEQ ID NO: 538908 - RNA, 63 nt, hsa; identical to SEQ ID NO: 65155

SEQ ID NO: 538909 - RNA, 63 nt, hsa; identical to SEQ ID NO: 65156

SEQ ID NO: 538910 - RNA, 63 nt, hsa; identical to SEQ ID NO: 65157

SEQ ID NO: 538911 - RNA, 63 nt, hsa; identical to SEQ ID NO: 65158

SEQ ID NO: 538912 - RNA, 63 nt, hsa; identical to SEQ ID NO: 65159

SEQ ID NO: 538913 - RNA, 63 nt, hsa; identical to SEQ ID NO: 65160

SEQ ID NO: 538914 - RNA, 63 nt, hsa; identical to SEQ ID NO: 65161

SEQ ID NO: 538915 - RNA, 63 nt, hsa; identical to SEQ ID NO: 65162

SEQ ID NO: 538916 - RNA, 63 nt, hsa; identical to SEQ ID NO: 65163

SEQ ID NO: 538917 - RNA, 63 nt, hsa; identical to SEQ ID NO: 65164

SEQ ID NO: 538918 - RNA, 63 nt, hsa; identical to SEQ ID NO: 65165

SEQ ID NO: 538919 - RNA, 63 nt, hsa; identical to SEQ ID NO: 65166

SEQ ID NO: 538920 - RNA, 63 nt, hsa; identical to SEQ ID NO: 65167

SEQ ID NO: 538921 - RNA, 63 nt, hsa; identical to SEQ ID NO: 65168

SEQ ID NO: 538922 - RNA, 63 nt, hsa; identical to SEQ ID NO: 65169

SEQ ID NO: 538923 - RNA, 63 nt, hsa; identical to SEQ ID NO: 65170

SEQ ID NO: 538924 - RNA, 63 nt, hsa; identical to SEQ ID NO: 65171

SEQ ID NO: 538925 - RNA, 63 nt, hsa; identical to SEQ ID NO: 65172

SEQ ID NO: 538926 - RNA, 63 nt, hsa; identical to SEQ ID NO: 65173

SEQ ID NO: 538927 - RNA, 63 nt, hsa; identical to SEQ ID NO: 65174

SEQ ID NO: 538928 - RNA, 63 nt, hsa; identical to SEQ ID NO: 65175

SEQ ID NO: 538929 - RNA, 63 nt, hsa; identical to SEQ ID NO: 65176

SEQ ID NO: 538930 - RNA, 63 nt, hsa; identical to SEQ ID NO: 65177

SEQ ID NO: 538931 - RNA, 63 nt, hsa; identical to SEQ ID NO: 65178

SEQ ID NO: 538932 - RNA, 63 nt, hsa; identical to SEQ ID NO: 65179

SEQ ID NO: 538933 - RNA, 63 nt, hsa; identical to SEQ ID NO: 65180

SEQ ID NO: 538934 - RNA, 63 nt, hsa; identical to SEQ ID NO: 65181

SEQ ID NO: 538935 - RNA, 63 nt, hsa; identical to SEQ ID NO: 65182

SEQ ID NO: 538936 - RNA, 63 nt, hsa; identical to SEQ ID NO: 65183

SEQ ID NO: 538937 - RNA, 63 nt, hsa; identical to SEQ ID NO: 65184

SEQ ID NO: 538938 - RNA, 63 nt, hsa; identical to SEQ ID NO: 65185

SEQ ID NO: 538939 - RNA, 63 nt, hsa; identical to SEQ ID NO: 65186

SEQ ID NO: 538940 - RNA, 63 nt, hsa; identical to SEQ ID NO: 65187

SEQ ID NO: 538941 - RNA, 63 nt, hsa; identical to SEQ ID NO: 65188

SEQ ID NO: 538942 - RNA, 63 nt, hsa; identical to SEQ ID NO: 65189

SEQ ID NO: 538943 - RNA, 63 nt, hsa; identical to SEQ ID NO: 65190

SEQ ID NO: 538944 - RNA, 63 nt, hsa; identical to SEQ ID NO: 65191

SEQ ID NO: 538945 - RNA, 63 nt, hsa; identical to SEQ ID NO: 65192

SEQ ID NO: 538946 - RNA, 63 nt, hsa; identical to SEQ ID NO: 65193

SEQ ID NO: 538947 - RNA, 63 nt, hsa; identical to SEQ ID NO: 65194

SEQ ID NO: 538948 - RNA, 63 nt, hsa; identical to SEQ ID NO: 65195

SEQ ID NO: 538949 - RNA, 63 nt, hsa; identical to SEQ ID NO: 65196

SEQ ID NO: 538950 - RNA, 63 nt, hsa; identical to SEQ ID NO: 65197

SEQ ID NO: 538951 - RNA, 63 nt, hsa; identical to SEQ ID NO: 65198

SEQ ID NO: 538952 - RNA, 63 nt, hsa; identical to SEQ ID NO: 65199

SEQ ID NO: 538953 - RNA, 63 nt, hsa; identical to SEQ ID NO: 65200

SEQ ID NO: 538954 - RNA, 63 nt, hsa; identical to SEQ ID NO: 65201

SEQ ID NO: 538955 - RNA, 63 nt, hsa; identical to SEQ ID NO: 65202

SEQ ID NO: 538956 - RNA, 63 nt, hsa; identical to SEQ ID NO: 65203

SEQ ID NO: 538957 - RNA, 63 nt, hsa; identical to SEQ ID NO: 65204

SEQ ID NO: 538958 - RNA, 63 nt, hsa; identical to SEQ ID NO: 65205

SEQ ID NO: 538959 - RNA, 63 nt, hsa; identical to SEQ ID NO: 65206

SEQ ID NO: 538960 - RNA, 63 nt, hsa; identical to SEQ ID NO: 65207

SEQ ID NO: 538961 - RNA, 63 nt, hsa; identical to SEQ ID NO: 65208

SEQ ID NO: 538962 - RNA, 63 nt, hsa; identical to SEQ ID NO: 65209

SEQ ID NO: 538963 - RNA, 63 nt, hsa; identical to SEQ ID NO: 65210

SEQ ID NO: 538964 - RNA, 63 nt, hsa; identical to SEQ ID NO: 65211

SEQ ID NO: 538965 - RNA, 63 nt, hsa; identical to SEQ ID NO: 65212

SEQ ID NO: 538966 - RNA, 63 nt, hsa; identical to SEQ ID NO: 65213

SEQ ID NO: 538967 - RNA, 63 nt, hsa; identical to SEQ ID NO: 65214

SEQ ID NO: 538968 - RNA, 63 nt, hsa; identical to SEQ ID NO: 65215

SEQ ID NO: 538969 - RNA, 63 nt, hsa; identical to SEQ ID NO: 65216

SEQ ID NO: 538970 - RNA, 63 nt, hsa; identical to SEQ ID NO: 65217

SEQ ID NO: 538971 - RNA, 63 nt, hsa; identical to SEQ ID NO: 65218

SEQ ID NO: 538972 - RNA, 63 nt, hsa; identical to SEQ ID NO: 65219

SEQ ID NO: 538973 - RNA, 63 nt, hsa; identical to SEQ ID NO: 65220

SEQ ID NO: 538974 - RNA, 63 nt, hsa; identical to SEQ ID NO: 65221

SEQ ID NO: 538975 - RNA, 63 nt, hsa; identical to SEQ ID NO: 65222

SEQ ID NO: 538976 - RNA, 63 nt, hsa; identical to SEQ ID NO: 65223

SEQ ID NO: 538977 - RNA, 63 nt, hsa; identical to SEQ ID NO: 65224

SEQ ID NO: 538978 - RNA, 63 nt, hsa; identical to SEQ ID NO: 65225

SEQ ID NO: 538979 - RNA, 63 nt, hsa; identical to SEQ ID NO: 65226

SEQ ID NO: 538980 - RNA, 63 nt, hsa; identical to SEQ ID NO: 65227

SEQ ID NO: 538981 - RNA, 63 nt, hsa; identical to SEQ ID NO: 65228

SEQ ID NO: 538982 - RNA, 63 nt, hsa; identical to SEQ ID NO: 65229

SEQ ID NO: 538983 - RNA, 63 nt, hsa; identical to SEQ ID NO: 65230

SEQ ID NO: 538984 - RNA, 63 nt, hsa; identical to SEQ ID NO: 65231

SEQ ID NO: 538985 - RNA, 63 nt, hsa; identical to SEQ ID NO: 65232

SEQ ID NO: 538986 - RNA, 63 nt, hsa; identical to SEQ ID NO: 65233

SEQ ID NO: 538987 - RNA, 63 nt, hsa; identical to SEQ ID NO: 65234

SEQ ID NO: 538988 - RNA, 63 nt, hsa; identical to SEQ ID NO: 65235

SEQ ID NO: 538989 - RNA, 63 nt, hsa; identical to SEQ ID NO: 65236

SEQ ID NO: 538990 - RNA, 63 nt, hsa; identical to SEQ ID NO: 65237

SEQ ID NO: 538991 - RNA, 63 nt, hsa; identical to SEQ ID NO: 65238

SEQ ID NO: 538992 - RNA, 63 nt, hsa; identical to SEQ ID NO: 65239

SEQ ID NO: 538993 - RNA, 63 nt, hsa; identical to SEQ ID NO: 65240

SEQ ID NO: 538994 - RNA, 63 nt, hsa; identical to SEQ ID NO: 65241

SEQ ID NO: 538995 - RNA, 63 nt, hsa; identical to SEQ ID NO: 65242

SEQ ID NO: 538996 - RNA, 63 nt, hsa; identical to SEQ ID NO: 65243

SEQ ID NO: 538997 - RNA, 63 nt, hsa; identical to SEQ ID NO: 65244

SEQ ID NO: 538998 - RNA, 63 nt, hsa; identical to SEQ ID NO: 65245

SEQ ID NO: 538999 - RNA, 63 nt, hsa; identical to SEQ ID NO: 65246

SEQ ID NO: 539000 - RNA, 63 nt, hsa; identical to SEQ ID NO: 65247

SEQ ID NO: 539001 - RNA, 63 nt, hsa; identical to SEQ ID NO: 65248

SEQ ID NO: 539002 - RNA, 63 nt, hsa; identical to SEQ ID NO: 65249

SEQ ID NO: 539003 - RNA, 63 nt, hsa; identical to SEQ ID NO: 65250

SEQ ID NO: 539004 - RNA, 63 nt, hsa; identical to SEQ ID NO: 65251

SEQ ID NO: 539005 - RNA, 63 nt, hsa; identical to SEQ ID NO: 65252

SEQ ID NO: 539006 - RNA, 63 nt, hsa; identical to SEQ ID NO: 65253

SEQ ID NO: 539007 - RNA, 63 nt, hsa; identical to SEQ ID NO: 65254

SEQ ID NO: 539008 - RNA, 63 nt, hsa; identical to SEQ ID NO: 65255

SEQ ID NO: 539009 - RNA, 63 nt, hsa; identical to SEQ ID NO: 65256

SEQ ID NO: 539010 - RNA, 63 nt, hsa; identical to SEQ ID NO: 65257

SEQ ID NO: 539011 - RNA, 63 nt, hsa; identical to SEQ ID NO: 65258

SEQ ID NO: 539012 - RNA, 63 nt, hsa; identical to SEQ ID NO: 65259

SEQ ID NO: 539013 - RNA, 63 nt, hsa; identical to SEQ ID NO: 65260

SEQ ID NO: 539014 - RNA, 63 nt, hsa; identical to SEQ ID NO: 65261

SEQ ID NO: 539015 - RNA, 63 nt, hsa; identical to SEQ ID NO: 65262

SEQ ID NO: 539016 - RNA, 63 nt, hsa; identical to SEQ ID NO: 65263

SEQ ID NO: 539017 - RNA, 63 nt, hsa; identical to SEQ ID NO: 65264

SEQ ID NO: 539018 - RNA, 63 nt, hsa; identical to SEQ ID NO: 65265

SEQ ID NO: 539019 - RNA, 63 nt, hsa; identical to SEQ ID NO: 65266

SEQ ID NO: 539020 - RNA, 63 nt, hsa; identical to SEQ ID NO: 65267

SEQ ID NO: 539021 - RNA, 63 nt, hsa; identical to SEQ ID NO: 65268

SEQ ID NO: 539022 - RNA, 63 nt, hsa; identical to SEQ ID NO: 65269

SEQ ID NO: 539023 - RNA, 63 nt, hsa; identical to SEQ ID NO: 65270

SEQ ID NO: 539024 - RNA, 63 nt, hsa; identical to SEQ ID NO: 65271

SEQ ID NO: 539025 - RNA, 63 nt, hsa; identical to SEQ ID NO: 65272

SEQ ID NO: 539026 - RNA, 63 nt, hsa; identical to SEQ ID NO: 65273

SEQ ID NO: 539027 - RNA, 56 nt, hsa; identical to SEQ ID NO: 61369

SEQ ID NO: 539028 - RNA, 63 nt, hsa; identical to SEQ ID NO: 65275

SEQ ID NO: 539029 - RNA, 63 nt, hsa; identical to SEQ ID NO: 65276

SEQ ID NO: 539030 - RNA, 63 nt, hsa; identical to SEQ ID NO: 65277

SEQ ID NO: 539031 - RNA, 63 nt, hsa; identical to SEQ ID NO: 65278

SEQ ID NO: 539032 - RNA, 63 nt, hsa; identical to SEQ ID NO: 65279

SEQ ID NO: 539033 - RNA, 63 nt, hsa; identical to SEQ ID NO: 65280

SEQ ID NO: 539034 - RNA, 63 nt, hsa; identical to SEQ ID NO: 65281

SEQ ID NO: 539035 - RNA, 63 nt, hsa; identical to SEQ ID NO: 65282

SEQ ID NO: 539036 - RNA, 63 nt, hsa; identical to SEQ ID NO: 65283

SEQ ID NO: 539037 - RNA, 63 nt, hsa; identical to SEQ ID NO: 65284

SEQ ID NO: 539038 - RNA, 63 nt, hsa; identical to SEQ ID NO: 65285

SEQ ID NO: 539039 - RNA, 63 nt, hsa; identical to SEQ ID NO: 65286

SEQ ID NO: 539040 - RNA, 63 nt, hsa; identical to SEQ ID NO: 65287

SEQ ID NO: 539041 - RNA, 63 nt, hsa; identical to SEQ ID NO: 65288

SEQ ID NO: 539042 - RNA, 63 nt, hsa; identical to SEQ ID NO: 65289

SEQ ID NO: 539043 - RNA, 63 nt, hsa; identical to SEQ ID NO: 65290

SEQ ID NO: 539044 - RNA, 63 nt, hsa; identical to SEQ ID NO: 65291

SEQ ID NO: 539045 - RNA, 63 nt, hsa; identical to SEQ ID NO: 65292

SEQ ID NO: 539046 - RNA, 63 nt, hsa; identical to SEQ ID NO: 65293

SEQ ID NO: 539047 - RNA, 63 nt, hsa; identical to SEQ ID NO: 65294

SEQ ID NO: 539048 - RNA, 63 nt, hsa; identical to SEQ ID NO: 65295

SEQ ID NO: 539049 - RNA, 63 nt, hsa; identical to SEQ ID NO: 65296

SEQ ID NO: 539050 - RNA, 63 nt, hsa; identical to SEQ ID NO: 65297

SEQ ID NO: 539051 - RNA, 63 nt, hsa; identical to SEQ ID NO: 65298

SEQ ID NO: 539052 - RNA, 63 nt, hsa; identical to SEQ ID NO: 65299

SEQ ID NO: 539053 - RNA, 63 nt, hsa; identical to SEQ ID NO: 65300

SEQ ID NO: 539054 - RNA, 63 nt, hsa; identical to SEQ ID NO: 65301

SEQ ID NO: 539055 - RNA, 63 nt, hsa; identical to SEQ ID NO: 65302

SEQ ID NO: 539056 - RNA, 63 nt, hsa; identical to SEQ ID NO: 65303

SEQ ID NO: 539057 - RNA, 63 nt, hsa; identical to SEQ ID NO: 65304

SEQ ID NO: 539058 - RNA, 63 nt, hsa; identical to SEQ ID NO: 65305

SEQ ID NO: 539059 - RNA, 63 nt, hsa; identical to SEQ ID NO: 65306

SEQ ID NO: 539060 - RNA, 63 nt, hsa; identical to SEQ ID NO: 65307

SEQ ID NO: 539061 - RNA, 63 nt, hsa; identical to SEQ ID NO: 65308

SEQ ID NO: 539062 - RNA, 63 nt, hsa; identical to SEQ ID NO: 65309

SEQ ID NO: 539063 - RNA, 63 nt, hsa; identical to SEQ ID NO: 65310

SEQ ID NO: 539064 - RNA, 63 nt, hsa; identical to SEQ ID NO: 65311

SEQ ID NO: 539065 - RNA, 63 nt, hsa; identical to SEQ ID NO: 65312

SEQ ID NO: 539066 - RNA, 63 nt, hsa; identical to SEQ ID NO: 65313

SEQ ID NO: 539067 - RNA, 63 nt, hsa; identical to SEQ ID NO: 65314

SEQ ID NO: 539068 - RNA, 63 nt, hsa; identical to SEQ ID NO: 65315

SEQ ID NO: 539069 - RNA, 63 nt, hsa; identical to SEQ ID NO: 65316

SEQ ID NO: 539070 - RNA, 63 nt, hsa; identical to SEQ ID NO: 65317

SEQ ID NO: 539071 - RNA, 63 nt, hsa; identical to SEQ ID NO: 65318

SEQ ID NO: 539072 - RNA, 63 nt, hsa; identical to SEQ ID NO: 65319

SEQ ID NO: 539073 - RNA, 63 nt, hsa; identical to SEQ ID NO: 65320

SEQ ID NO: 539074 - RNA, 63 nt, hsa; identical to SEQ ID NO: 65321

SEQ ID NO: 539075 - RNA, 63 nt, hsa; identical to SEQ ID NO: 65322

SEQ ID NO: 539076 - RNA, 63 nt, hsa; identical to SEQ ID NO: 65323

SEQ ID NO: 539077 - RNA, 63 nt, hsa; identical to SEQ ID NO: 65324

SEQ ID NO: 539078 - RNA, 63 nt, hsa; identical to SEQ ID NO: 65325

SEQ ID NO: 539079 - RNA, 63 nt, hsa; identical to SEQ ID NO: 65326

SEQ ID NO: 539080 - RNA, 63 nt, hsa; identical to SEQ ID NO: 65327

SEQ ID NO: 539081 - RNA, 63 nt, hsa; identical to SEQ ID NO: 65328

SEQ ID NO: 539082 - RNA, 63 nt, hsa; identical to SEQ ID NO: 65329

SEQ ID NO: 539083 - RNA, 63 nt, hsa; identical to SEQ ID NO: 65330

SEQ ID NO: 539084 - RNA, 63 nt, hsa; identical to SEQ ID NO: 65331

SEQ ID NO: 539085 - RNA, 63 nt, hsa; identical to SEQ ID NO: 65332

SEQ ID NO: 539086 - RNA, 63 nt, hsa; identical to SEQ ID NO: 65333

SEQ ID NO: 539087 - RNA, 63 nt, hsa; identical to SEQ ID NO: 65334

SEQ ID NO: 539088 - RNA, 63 nt, hsa; identical to SEQ ID NO: 65335

SEQ ID NO: 539089 - RNA, 63 nt, hsa; identical to SEQ ID NO: 65336

SEQ ID NO: 539090 - RNA, 63 nt, hsa; identical to SEQ ID NO: 65337

SEQ ID NO: 539091 - RNA, 63 nt, hsa; identical to SEQ ID NO: 65338

SEQ ID NO: 539092 - RNA, 63 nt, hsa; identical to SEQ ID NO: 65339

SEQ ID NO: 539093 - RNA, 63 nt, hsa; identical to SEQ ID NO: 65340

SEQ ID NO: 539094 - RNA, 63 nt, hsa; identical to SEQ ID NO: 65341

SEQ ID NO: 539095 - RNA, 63 nt, hsa; identical to SEQ ID NO: 65342

SEQ ID NO: 539096 - RNA, 63 nt, hsa; identical to SEQ ID NO: 65343

SEQ ID NO: 539097 - RNA, 63 nt, hsa; identical to SEQ ID NO: 65344

SEQ ID NO: 539098 - RNA, 63 nt, hsa; identical to SEQ ID NO: 65345

SEQ ID NO: 539099 - RNA, 63 nt, hsa; identical to SEQ ID NO: 65346

SEQ ID NO: 539100 - RNA, 63 nt, hsa; identical to SEQ ID NO: 65347

SEQ ID NO: 539101 - RNA, 63 nt, hsa; identical to SEQ ID NO: 65348

SEQ ID NO: 539102 - RNA, 63 nt, hsa; identical to SEQ ID NO: 65349

SEQ ID NO: 539103 - RNA, 63 nt, hsa; identical to SEQ ID NO: 65350

SEQ ID NO: 539104 - RNA, 63 nt, hsa; identical to SEQ ID NO: 65351

SEQ ID NO: 539105 - RNA, 63 nt, hsa; identical to SEQ ID NO: 65352

SEQ ID NO: 539106 - RNA, 63 nt, hsa; identical to SEQ ID NO: 65353

SEQ ID NO: 539107 - RNA, 63 nt, hsa; identical to SEQ ID NO: 65354

SEQ ID NO: 539108 - RNA, 63 nt, hsa; identical to SEQ ID NO: 65355

SEQ ID NO: 539109 - RNA, 63 nt, hsa; identical to SEQ ID NO: 65356

SEQ ID NO: 539110 - RNA, 63 nt, hsa; identical to SEQ ID NO: 65357

SEQ ID NO: 539111 - RNA, 63 nt, hsa; identical to SEQ ID NO: 65358

SEQ ID NO: 539112 - RNA, 63 nt, hsa; identical to SEQ ID NO: 65359

SEQ ID NO: 539113 - RNA, 63 nt, hsa; identical to SEQ ID NO: 65360

SEQ ID NO: 539114 - RNA, 63 nt, hsa; identical to SEQ ID NO: 65361

SEQ ID NO: 539115 - RNA, 63 nt, hsa; identical to SEQ ID NO: 65362

SEQ ID NO: 539116 - RNA, 63 nt, hsa; identical to SEQ ID NO: 65363

SEQ ID NO: 539117 - RNA, 63 nt, hsa; identical to SEQ ID NO: 65364

SEQ ID NO: 539118 - RNA, 63 nt, hsa; identical to SEQ ID NO: 65365

SEQ ID NO: 539119 - RNA, 60 nt, hsa; identical to SEQ ID NO: 65087

SEQ ID NO: 539120 - RNA, 63 nt, hsa; identical to SEQ ID NO: 65367

SEQ ID NO: 539121 - RNA, 63 nt, hsa; identical to SEQ ID NO: 65368

SEQ ID NO: 539122 - RNA, 63 nt, hsa; identical to SEQ ID NO: 65369

SEQ ID NO: 539123 - RNA, 63 nt, hsa; identical to SEQ ID NO: 65370

SEQ ID NO: 539124 - RNA, 63 nt, hsa; identical to SEQ ID NO: 65371

SEQ ID NO: 539125 - RNA, 63 nt, hsa; identical to SEQ ID NO: 65372

SEQ ID NO: 539126 - RNA, 51 nt, hsa; identical to SEQ ID NO: 65094

SEQ ID NO: 539127 - RNA, 63 nt, hsa; identical to SEQ ID NO: 65374

SEQ ID NO: 539128 - RNA, 63 nt, hsa; identical to SEQ ID NO: 65375

SEQ ID NO: 539129 - RNA, 63 nt, hsa; identical to SEQ ID NO: 65376

SEQ ID NO: 539130 - RNA, 63 nt, hsa; identical to SEQ ID NO: 65377

SEQ ID NO: 539131 - RNA, 63 nt, hsa; identical to SEQ ID NO: 65378

SEQ ID NO: 539132 - RNA, 63 nt, hsa; identical to SEQ ID NO: 65379

SEQ ID NO: 539133 - RNA, 63 nt, hsa; identical to SEQ ID NO: 65380

SEQ ID NO: 539134 - RNA, 63 nt, hsa; identical to SEQ ID NO: 65381

SEQ ID NO: 539135 - RNA, 63 nt, hsa; identical to SEQ ID NO: 65382

SEQ ID NO: 539136 - RNA, 63 nt, hsa; identical to SEQ ID NO: 65383

SEQ ID NO: 539137 - RNA, 63 nt, hsa; identical to SEQ ID NO: 65384

SEQ ID NO: 539138 - RNA, 63 nt, hsa; identical to SEQ ID NO: 65385

SEQ ID NO: 539139 - RNA, 63 nt, hsa; identical to SEQ ID NO: 65386

SEQ ID NO: 539140 - RNA, 63 nt, hsa; identical to SEQ ID NO: 65387

SEQ ID NO: 539141 - RNA, 63 nt, hsa; identical to SEQ ID NO: 65388

SEQ ID NO: 539142 - RNA, 63 nt, hsa; identical to SEQ ID NO: 65389

SEQ ID NO: 539143 - RNA, 63 nt, hsa; identical to SEQ ID NO: 65390

SEQ ID NO: 539144 - RNA, 63 nt, hsa; identical to SEQ ID NO: 65391

SEQ ID NO: 539145 - RNA, 63 nt, hsa; identical to SEQ ID NO: 65392

SEQ ID NO: 539146 - RNA, 63 nt, hsa; identical to SEQ ID NO: 65393

SEQ ID NO: 539147 - RNA, 63 nt, hsa; identical to SEQ ID NO: 65394

SEQ ID NO: 539148 - RNA, 63 nt, hsa; identical to SEQ ID NO: 65395

SEQ ID NO: 539149 - RNA, 63 nt, hsa; identical to SEQ ID NO: 65396

SEQ ID NO: 539150 - RNA, 63 nt, hsa; identical to SEQ ID NO: 65397

SEQ ID NO: 539151 - RNA, 63 nt, hsa; identical to SEQ ID NO: 65398

SEQ ID NO: 539152 - RNA, 63 nt, hsa; identical to SEQ ID NO: 65399

SEQ ID NO: 539153 - RNA, 63 nt, hsa; identical to SEQ ID NO: 65400

SEQ ID NO: 539154 - RNA, 63 nt, hsa; identical to SEQ ID NO: 65401

SEQ ID NO: 539155 - RNA, 63 nt, hsa; identical to SEQ ID NO: 65402

SEQ ID NO: 539156 - RNA, 63 nt, hsa; identical to SEQ ID NO: 65403

SEQ ID NO: 539157 - RNA, 63 nt, hsa; identical to SEQ ID NO: 65404

SEQ ID NO: 539158 - RNA, 63 nt, hsa; identical to SEQ ID NO: 65405

SEQ ID NO: 539159 - RNA, 63 nt, hsa; identical to SEQ ID NO: 65406

SEQ ID NO: 539160 - RNA, 63 nt, hsa; identical to SEQ ID NO: 65407

SEQ ID NO: 539161 - RNA, 63 nt, hsa; identical to SEQ ID NO: 65408

SEQ ID NO: 539162 - RNA, 63 nt, hsa; identical to SEQ ID NO: 65409

SEQ ID NO: 539163 - RNA, 63 nt, hsa; identical to SEQ ID NO: 65410

SEQ ID NO: 539164 - RNA, 63 nt, hsa; identical to SEQ ID NO: 65411

SEQ ID NO: 539165 - RNA, 63 nt, hsa; identical to SEQ ID NO: 65412

SEQ ID NO: 539166 - RNA, 63 nt, hsa; identical to SEQ ID NO: 65413

SEQ ID NO: 539167 - RNA, 63 nt, hsa; identical to SEQ ID NO: 65414

SEQ ID NO: 539168 - RNA, 64 nt, hsa; identical to SEQ ID NO: 315750

SEQ ID NO: 539169 - RNA, 64 nt, hsa; identical to SEQ ID NO: 315751

SEQ ID NO: 539170 - RNA, 64 nt, hsa; identical to SEQ ID NO: 315752

SEQ ID NO: 539171 - RNA, 64 nt, hsa; identical to SEQ ID NO: 315753

SEQ ID NO: 539172 - RNA, 64 nt, hsa; identical to SEQ ID NO: 315754

SEQ ID NO: 539173 - RNA, 64 nt, hsa; identical to SEQ ID NO: 315755

SEQ ID NO: 539174 - RNA, 64 nt, hsa; identical to SEQ ID NO: 315756

SEQ ID NO: 539175 - RNA, 64 nt, hsa; identical to SEQ ID NO: 315757

SEQ ID NO: 539176 - RNA, 64 nt, hsa; identical to SEQ ID NO: 315758

SEQ ID NO: 539177 - RNA, 64 nt, hsa; identical to SEQ ID NO: 315759

SEQ ID NO: 539178 - RNA, 64 nt, hsa; identical to SEQ ID NO: 315760

SEQ ID NO: 539179 - RNA, 64 nt, hsa; identical to SEQ ID NO: 315761

SEQ ID NO: 539180 - RNA, 64 nt, hsa; identical to SEQ ID NO: 315762

SEQ ID NO: 539181 - RNA, 64 nt, hsa; identical to SEQ ID NO: 315763

SEQ ID NO: 539182 - RNA, 64 nt, hsa; identical to SEQ ID NO: 315764

SEQ ID NO: 539183 - RNA, 64 nt, hsa; identical to SEQ ID NO: 315765

SEQ ID NO: 539184 - RNA, 64 nt, hsa; identical to SEQ ID NO: 315766

SEQ ID NO: 539185 - RNA, 64 nt, hsa; identical to SEQ ID NO: 315767

SEQ ID NO: 539186 - RNA, 64 nt, hsa; identical to SEQ ID NO: 315768

SEQ ID NO: 539187 - RNA, 64 nt, hsa; identical to SEQ ID NO: 315769

SEQ ID NO: 539188 - RNA, 64 nt, hsa; identical to SEQ ID NO: 315770

SEQ ID NO: 539189 - RNA, 64 nt, hsa; identical to SEQ ID NO: 315771

SEQ ID NO: 539190 - RNA, 64 nt, hsa; identical to SEQ ID NO: 315772

SEQ ID NO: 539191 - RNA, 64 nt, hsa; identical to SEQ ID NO: 315773

SEQ ID NO: 539192 - RNA, 64 nt, hsa; identical to SEQ ID NO: 315774

SEQ ID NO: 539193 - RNA, 64 nt, hsa; identical to SEQ ID NO: 315775

SEQ ID NO: 539194 - RNA, 64 nt, hsa; identical to SEQ ID NO: 315776

SEQ ID NO: 539195 - RNA, 64 nt, hsa; identical to SEQ ID NO: 315776

SEQ ID NO: 539196 - RNA, 64 nt, hsa; identical to SEQ ID NO: 315778

SEQ ID NO: 539197 - RNA, 64 nt, hsa; identical to SEQ ID NO: 315779

SEQ ID NO: 539198 - RNA, 60 nt, hsa; identical to SEQ ID NO: 315780

SEQ ID NO: 539199 - RNA, 64 nt, hsa; identical to SEQ ID NO: 315781

SEQ ID NO: 539200 - RNA, 64 nt, hsa; identical to SEQ ID NO: 315782

SEQ ID NO: 539201 - RNA, 64 nt, hsa; identical to SEQ ID NO: 315783

SEQ ID NO: 539202 - RNA, 64 nt, hsa; identical to SEQ ID NO: 315784

SEQ ID NO: 539203 - RNA, 64 nt, hsa; identical to SEQ ID NO: 315785

SEQ ID NO: 539204 - RNA, 64 nt, hsa; identical to SEQ ID NO: 315786

SEQ ID NO: 539205 - RNA, 64 nt, hsa; identical to SEQ ID NO: 315787

SEQ ID NO: 539206 - RNA, 64 nt, hsa; identical to SEQ ID NO: 426082

SEQ ID NO: 539207 - RNA, 64 nt, hsa; identical to SEQ ID NO: 426083

SEQ ID NO: 539208 - RNA, 64 nt, hsa; identical to SEQ ID NO: 426084

SEQ ID NO: 539209 - RNA, 64 nt, hsa; identical to SEQ ID NO: 426085

SEQ ID NO: 539210 - RNA, 64 nt, hsa; identical to SEQ ID NO: 426086

SEQ ID NO: 539211 - RNA, 64 nt, hsa; identical to SEQ ID NO: 426087

SEQ ID NO: 539212 - RNA, 64 nt, hsa; identical to SEQ ID NO: 426088

SEQ ID NO: 539213 - RNA, 64 nt, hsa; identical to SEQ ID NO: 426089

SEQ ID NO: 539214 - RNA, 64 nt, hsa; identical to SEQ ID NO: 426090

SEQ ID NO: 539215 - RNA, 64 nt, hsa; identical to SEQ ID NO: 426091

SEQ ID NO: 539216 - RNA, 64 nt, hsa; identical to SEQ ID NO: 426092

SEQ ID NO: 539217 - RNA, 64 nt, hsa; identical to SEQ ID NO: 426093

SEQ ID NO: 539218 - RNA, 64 nt, hsa; identical to SEQ ID NO: 426094

SEQ ID NO: 539219 - RNA, 64 nt, hsa; identical to SEQ ID NO: 426095

SEQ ID NO: 539220 - RNA, 64 nt, hsa; identical to SEQ ID NO: 426096

SEQ ID NO: 539221 - RNA, 64 nt, hsa; identical to SEQ ID NO: 426097

SEQ ID NO: 539222 - RNA, 64 nt, hsa; identical to SEQ ID NO: 426098

SEQ ID NO: 539223 - RNA, 64 nt, hsa; identical to SEQ ID NO: 426099

SEQ ID NO: 539224 - RNA, 59 nt, hsa; identical to SEQ ID NO: 426100

SEQ ID NO: 539225 - RNA, 64 nt, hsa; identical to SEQ ID NO: 426101

SEQ ID NO: 539226 - RNA, 64 nt, hsa; identical to SEQ ID NO: 426102

SEQ ID NO: 539227 - RNA, 64 nt, hsa; identical to SEQ ID NO: 426103

SEQ ID NO: 539228 - RNA, 64 nt, hsa; identical to SEQ ID NO: 426104

SEQ ID NO: 539229 - RNA, 64 nt, hsa; identical to SEQ ID NO: 426105

SEQ ID NO: 539230 - RNA, 64 nt, hsa; identical to SEQ ID NO: 426106

SEQ ID NO: 539231 - RNA, 64 nt, hsa; identical to SEQ ID NO: 426107

SEQ ID NO: 539232 - RNA, 64 nt, hsa; identical to SEQ ID NO: 426108

SEQ ID NO: 539233 - RNA, 64 nt, hsa; identical to SEQ ID NO: 426109

SEQ ID NO: 539234 - RNA, 64 nt, hsa; identical to SEQ ID NO: 426110

SEQ ID NO: 539235 - RNA, 64 nt, hsa; identical to SEQ ID NO: 426111

SEQ ID NO: 539236 - RNA, 64 nt, hsa; identical to SEQ ID NO: 426112

SEQ ID NO: 539237 - RNA, 64 nt, hsa; identical to SEQ ID NO: 426113

SEQ ID NO: 539238 - RNA, 64 nt, hsa; identical to SEQ ID NO: 426114

SEQ ID NO: 539239 - RNA, 64 nt, hsa; identical to SEQ ID NO: 426115

SEQ ID NO: 539240 - RNA, 64 nt, hsa; identical to SEQ ID NO: 426116

SEQ ID NO: 539241 - RNA, 64 nt, hsa; identical to SEQ ID NO: 426117

SEQ ID NO: 539242 - RNA, 64 nt, hsa; identical to SEQ ID NO: 426118

SEQ ID NO: 539243 - RNA, 64 nt, hsa; identical to SEQ ID NO: 426119

SEQ ID NO: 539244 - RNA, 64 nt, hsa; identical to SEQ ID NO: 426120

SEQ ID NO: 539245 - RNA, 64 nt, hsa; identical to SEQ ID NO: 426121

SEQ ID NO: 539246 - RNA, 64 nt, hsa; identical to SEQ ID NO: 426122

SEQ ID NO: 539247 - RNA, 64 nt, hsa; identical to SEQ ID NO: 426123

SEQ ID NO: 539248 - RNA, 64 nt, hsa; identical to SEQ ID NO: 426124

SEQ ID NO: 539249 - RNA, 64 nt, hsa; identical to SEQ ID NO: 21544

SEQ ID NO: 539250 - RNA, 55 nt, hsa; identical to SEQ ID NO: 21545

SEQ ID NO: 539251 - RNA, 64 nt, hsa; identical to SEQ ID NO: 21546

SEQ ID NO: 539252 - RNA, 64 nt, hsa; identical to SEQ ID NO: 21547

SEQ ID NO: 539253 - RNA, 64 nt, hsa; identical to SEQ ID NO: 21548

SEQ ID NO: 539254 - RNA, 64 nt, hsa; identical to SEQ ID NO: 21549

SEQ ID NO: 539255 - RNA, 64 nt, hsa; identical to SEQ ID NO: 21550

SEQ ID NO: 539256 - RNA, 64 nt, hsa; identical to SEQ ID NO: 21551

SEQ ID NO: 539257 - RNA, 64 nt, hsa; identical to SEQ ID NO: 21552

SEQ ID NO: 539258 - RNA, 64 nt, hsa; identical to SEQ ID NO: 21553

SEQ ID NO: 539259 - RNA, 64 nt, hsa; identical to SEQ ID NO: 21554

SEQ ID NO: 539260 - RNA, 64 nt, hsa; identical to SEQ ID NO: 21555

SEQ ID NO: 539261 - RNA, 64 nt, hsa; identical to SEQ ID NO: 21556

SEQ ID NO: 539262 - RNA, 64 nt, hsa; identical to SEQ ID NO: 21557

SEQ ID NO: 539263 - RNA, 64 nt, hsa; identical to SEQ ID NO: 21558

SEQ ID NO: 539264 - RNA, 64 nt, hsa; identical to SEQ ID NO: 21559

SEQ ID NO: 539265 - RNA, 64 nt, hsa
cugggcccagucagcccugcugcucagagugcaggcauugcacauggugugagaaggucuacac

SEQ ID NO: 539266 - RNA, 64 nt, hsa
cugggcccagucagcccugcugcacauggcacaggcauugcacacggugugaggaguguacacc

SEQ ID NO: 539267 - RNA, 64 nt, hsa
ucccugggcucaguccuagcugcauggggugcaggcauugcacagagcaugaaugggccuacac

SEQ ID NO: 539268 - RNA, 64 nt, hsa
cugggcucgaccagcccagcugcgugggguacaggcauugcacacagugugaaugggucuacac

SEQ ID NO: 539269 - RNA, 64 nt, hsa
ccaggcccugccagcccugcugcacagggugcaggcauugcacacggugugaagggucuacacc

SEQ ID NO: 539270 - RNA, 64 nt, hsa
uuuuugaauucagauuuaaaaaccaacuuauaaagcauugcaacaagguuaccucuauuuugcc

SEQ ID NO: 539271 - RNA, 64 nt, hsa
aaaaaaaaaaaggaaacuuuuuuuguuugcucuugcauugcaaaaauuauaaaguaauuuauua

SEQ ID NO: 539272 - RNA, 64 nt, hsa
cauugaauuauuaauuaaauaaauuuauuaauuggcauugcauugaauuuauagguuaauuuug

SEQ ID NO: 539273 - RNA, 64 nt, hsa
cuucuuuccagguucaaaaagcaaaaucugauuggcauugcauugaauuauuaauuaaauaaau

SEQ ID NO: 539274 - RNA, 64 nt, hsa; identical to SEQ ID NO: 111815

SEQ ID NO: 539275 - RNA, 64 nt, hsa; identical to SEQ ID NO: 111816

SEQ ID NO: 539276 - RNA, 64 nt, hsa; identical to SEQ ID NO: 111817

SEQ ID NO: 539277 - RNA, 64 nt, hsa; identical to SEQ ID NO: 111818

SEQ ID NO: 539278 - RNA, 64 nt, hsa; identical to SEQ ID NO: 111819

SEQ ID NO: 539279 - RNA, 64 nt, hsa; identical to SEQ ID NO: 111820

SEQ ID NO: 539280 - RNA, 64 nt, hsa; identical to SEQ ID NO: 111821

SEQ ID NO: 539281 - RNA, 64 nt, hsa; identical to SEQ ID NO: 111822

SEQ ID NO: 539282 - RNA, 64 nt, hsa; identical to SEQ ID NO: 111823

SEQ ID NO: 539283 - RNA, 64 nt, hsa; identical to SEQ ID NO: 111824

SEQ ID NO: 539284 - RNA, 64 nt, hsa; identical to SEQ ID NO: 111825

SEQ ID NO: 539285 - RNA, 64 nt, hsa; identical to SEQ ID NO: 111826

SEQ ID NO: 539286 - RNA, 64 nt, hsa; identical to SEQ ID NO: 111827

SEQ ID NO: 539287 - RNA, 64 nt, hsa; identical to SEQ ID NO: 111828

SEQ ID NO: 539288 - RNA, 64 nt, hsa; identical to SEQ ID NO: 111829

SEQ ID NO: 539289 - RNA, 64 nt, hsa; identical to SEQ ID NO: 373477

SEQ ID NO: 539290 - RNA, 64 nt, hsa; identical to SEQ ID NO: 373478

SEQ ID NO: 539291 - RNA, 64 nt, hsa; identical to SEQ ID NO: 373479

SEQ ID NO: 539292 - RNA, 64 nt, hsa; identical to SEQ ID NO: 373480

SEQ ID NO: 539293 - RNA, 64 nt, hsa; identical to SEQ ID NO: 373481

SEQ ID NO: 539294 - RNA, 64 nt, hsa; identical to SEQ ID NO: 373482

SEQ ID NO: 539295 - RNA, 64 nt, hsa; identical to SEQ ID NO: 373483

SEQ ID NO: 539296 - RNA, 64 nt, hsa; identical to SEQ ID NO: 373484

SEQ ID NO: 539297 - RNA, 64 nt, hsa; identical to SEQ ID NO: 373485

SEQ ID NO: 539298 - RNA, 64 nt, hsa; identical to SEQ ID NO: 373486

SEQ ID NO: 539299 - RNA, 64 nt, hsa; identical to SEQ ID NO: 373487

SEQ ID NO: 539300 - RNA, 64 nt, hsa; identical to SEQ ID NO: 373488

SEQ ID NO: 539301 - RNA, 64 nt, hsa; identical to SEQ ID NO: 373489

SEQ ID NO: 539302 - RNA, 64 nt, hsa; identical to SEQ ID NO: 373490

SEQ ID NO: 539303 - RNA, 64 nt, hsa; identical to SEQ ID NO: 373491

SEQ ID NO: 539304 - RNA, 64 nt, hsa; identical to SEQ ID NO: 373492

SEQ ID NO: 539305 - RNA, 64 nt, hsa; identical to SEQ ID NO: 373493

SEQ ID NO: 539306 - RNA, 64 nt, hsa; identical to SEQ ID NO: 373494

SEQ ID NO: 539307 - RNA, 64 nt, hsa; identical to SEQ ID NO: 373495

SEQ ID NO: 539308 - RNA, 64 nt, hsa; identical to SEQ ID NO: 373496

SEQ ID NO: 539309 - RNA, 64 nt, hsa; identical to SEQ ID NO: 373497

SEQ ID NO: 539310 - RNA, 64 nt, hsa; identical to SEQ ID NO: 373498

SEQ ID NO: 539311 - RNA, 64 nt, hsa; identical to SEQ ID NO: 373499

SEQ ID NO: 539312 - RNA, 64 nt, hsa; identical to SEQ ID NO: 373500

SEQ ID NO: 539313 - RNA, 64 nt, hsa; identical to SEQ ID NO: 373501

SEQ ID NO: 539314 - RNA, 64 nt, hsa; identical to SEQ ID NO: 373502

SEQ ID NO: 539315 - RNA, 64 nt, hsa; identical to SEQ ID NO: 373503

SEQ ID NO: 539316 - RNA, 64 nt, hsa; identical to SEQ ID NO: 373504

SEQ ID NO: 539317 - RNA, 64 nt, hsa; identical to SEQ ID NO: 373505

SEQ ID NO: 539318 - RNA, 64 nt, hsa; identical to SEQ ID NO: 373506

SEQ ID NO: 539319 - RNA, 64 nt, hsa; identical to SEQ ID NO: 373507

SEQ ID NO: 539320 - RNA, 64 nt, hsa; identical to SEQ ID NO: 373508

SEQ ID NO: 539321 - RNA, 64 nt, hsa; identical to SEQ ID NO: 373509

SEQ ID NO: 539322 - RNA, 64 nt, hsa; identical to SEQ ID NO: 373510

SEQ ID NO: 539323 - RNA, 64 nt, hsa; identical to SEQ ID NO: 373511

SEQ ID NO: 539324 - RNA, 64 nt, hsa; identical to SEQ ID NO: 373512

SEQ ID NO: 539325 - RNA, 64 nt, hsa; identical to SEQ ID NO: 373513

SEQ ID NO: 539326 - RNA, 64 nt, hsa; identical to SEQ ID NO: 373514

SEQ ID NO: 539327 - RNA, 64 nt, hsa; identical to SEQ ID NO: 373515

SEQ ID NO: 539328 - RNA, 64 nt, hsa; identical to SEQ ID NO: 373516

SEQ ID NO: 539329 - RNA, 64 nt, hsa; identical to SEQ ID NO: 373517

SEQ ID NO: 539330 - RNA, 64 nt, hsa; identical to SEQ ID NO: 373518

SEQ ID NO: 539331 - RNA, 64 nt, hsa; identical to SEQ ID NO: 373519

SEQ ID NO: 539332 - RNA, 64 nt, hsa; identical to SEQ ID NO: 373520

SEQ ID NO: 539333 - RNA, 64 nt, hsa; identical to SEQ ID NO: 373521

SEQ ID NO: 539334 - RNA, 64 nt, hsa; identical to SEQ ID NO: 373522

SEQ ID NO: 539335 - RNA, 64 nt, hsa; identical to SEQ ID NO: 373523

SEQ ID NO: 539336 - RNA, 64 nt, hsa; identical to SEQ ID NO: 373524

SEQ ID NO: 539337 - RNA, 64 nt, hsa; identical to SEQ ID NO: 373525

SEQ ID NO: 539338 - RNA, 64 nt, hsa; identical to SEQ ID NO: 373526

SEQ ID NO: 539339 - RNA, 64 nt, hsa; identical to SEQ ID NO: 373527

SEQ ID NO: 539340 - RNA, 64 nt, hsa; identical to SEQ ID NO: 373528

SEQ ID NO: 539341 - RNA, 64 nt, hsa; identical to SEQ ID NO: 373529

SEQ ID NO: 539342 - RNA, 64 nt, hsa; identical to SEQ ID NO: 373530

SEQ ID NO: 539343 - RNA, 64 nt, hsa; identical to SEQ ID NO: 373531

SEQ ID NO: 539344 - RNA, 64 nt, hsa; identical to SEQ ID NO: 373532

SEQ ID NO: 539345 - RNA, 64 nt, hsa; identical to SEQ ID NO: 373533

SEQ ID NO: 539346 - RNA, 64 nt, hsa; identical to SEQ ID NO: 373534

SEQ ID NO: 539347 - RNA, 64 nt, hsa; identical to SEQ ID NO: 373535

SEQ ID NO: 539348 - RNA, 64 nt, hsa; identical to SEQ ID NO: 373536

SEQ ID NO: 539349 - RNA, 64 nt, hsa; identical to SEQ ID NO: 373537

SEQ ID NO: 539350 - RNA, 64 nt, hsa; identical to SEQ ID NO: 373538

SEQ ID NO: 539351 - RNA, 64 nt, hsa; identical to SEQ ID NO: 373539

SEQ ID NO: 539352 - RNA, 64 nt, hsa; identical to SEQ ID NO: 373540

SEQ ID NO: 539353 - RNA, 64 nt, hsa; identical to SEQ ID NO: 373541

SEQ ID NO: 539354 - RNA, 64 nt, hsa; identical to SEQ ID NO: 373542

SEQ ID NO: 539355 - RNA, 64 nt, hsa; identical to SEQ ID NO: 373543

SEQ ID NO: 539356 - RNA, 64 nt, hsa; identical to SEQ ID NO: 373544

SEQ ID NO: 539357 - RNA, 64 nt, hsa; identical to SEQ ID NO: 373545

SEQ ID NO: 539358 - RNA, 64 nt, hsa; identical to SEQ ID NO: 373546

SEQ ID NO: 539359 - RNA, 64 nt, hsa; identical to SEQ ID NO: 373547

SEQ ID NO: 539360 - RNA, 64 nt, hsa; identical to SEQ ID NO: 373548

SEQ ID NO: 539361 - RNA, 64 nt, hsa; identical to SEQ ID NO: 373549

SEQ ID NO: 539362 - RNA, 64 nt, hsa; identical to SEQ ID NO: 373550

SEQ ID NO: 539363 - RNA, 64 nt, hsa; identical to SEQ ID NO: 373551

SEQ ID NO: 539364 - RNA, 64 nt, hsa; identical to SEQ ID NO: 373552

SEQ ID NO: 539365 - RNA, 64 nt, hsa; identical to SEQ ID NO: 373553

SEQ ID NO: 539366 - RNA, 64 nt, hsa; identical to SEQ ID NO: 373554

SEQ ID NO: 539367 - RNA, 64 nt, hsa; identical to SEQ ID NO: 373555

SEQ ID NO: 539368 - RNA, 64 nt, hsa; identical to SEQ ID NO: 373556

SEQ ID NO: 539369 - RNA, 64 nt, hsa; identical to SEQ ID NO: 373557

SEQ ID NO: 539370 - RNA, 64 nt, hsa; identical to SEQ ID NO: 373558

SEQ ID NO: 539371 - RNA, 64 nt, hsa; identical to SEQ ID NO: 373559

SEQ ID NO: 539372 - RNA, 64 nt, hsa; identical to SEQ ID NO: 373560

SEQ ID NO: 539373 - RNA, 64 nt, hsa; identical to SEQ ID NO: 373561

SEQ ID NO: 539374 - RNA, 64 nt, hsa; identical to SEQ ID NO: 373562

SEQ ID NO: 539375 - RNA, 64 nt, hsa; identical to SEQ ID NO: 373563

SEQ ID NO: 539376 - RNA, 64 nt, hsa; identical to SEQ ID NO: 373564

SEQ ID NO: 539377 - RNA, 64 nt, hsa; identical to SEQ ID NO: 373565

SEQ ID NO: 539378 - RNA, 64 nt, hsa; identical to SEQ ID NO: 373566

SEQ ID NO: 539379 - RNA, 64 nt, hsa; identical to SEQ ID NO: 373567

SEQ ID NO: 539380 - RNA, 64 nt, hsa; identical to SEQ ID NO: 373568

SEQ ID NO: 539381 - RNA, 64 nt, hsa; identical to SEQ ID NO: 373569

SEQ ID NO: 539382 - RNA, 64 nt, hsa; identical to SEQ ID NO: 373570

SEQ ID NO: 539383 - RNA, 64 nt, hsa; identical to SEQ ID NO: 373571

SEQ ID NO: 539384 - RNA, 64 nt, hsa; identical to SEQ ID NO: 373572

SEQ ID NO: 539385 - RNA, 64 nt, hsa; identical to SEQ ID NO: 373573

SEQ ID NO: 539386 - RNA, 64 nt, hsa; identical to SEQ ID NO: 373574

SEQ ID NO: 539387 - RNA, 64 nt, hsa; identical to SEQ ID NO: 373575

SEQ ID NO: 539388 - RNA, 64 nt, hsa; identical to SEQ ID NO: 373576

SEQ ID NO: 539389 - RNA, 64 nt, hsa; identical to SEQ ID NO: 373577

SEQ ID NO: 539390 - RNA, 64 nt, hsa; identical to SEQ ID NO: 373578

SEQ ID NO: 539391 - RNA, 64 nt, hsa; identical to SEQ ID NO: 373579

SEQ ID NO: 539392 - RNA, 64 nt, hsa; identical to SEQ ID NO: 373580

SEQ ID NO: 539393 - RNA, 64 nt, hsa; identical to SEQ ID NO: 373581

SEQ ID NO: 539394 - RNA, 64 nt, hsa; identical to SEQ ID NO: 373582

SEQ ID NO: 539395 - RNA, 64 nt, hsa; identical to SEQ ID NO: 373583

SEQ ID NO: 539396 - RNA, 64 nt, hsa; identical to SEQ ID NO: 373584

SEQ ID NO: 539397 - RNA, 64 nt, hsa; identical to SEQ ID NO: 373585

SEQ ID NO: 539398 - RNA, 64 nt, hsa; identical to SEQ ID NO: 373586

SEQ ID NO: 539399 - RNA, 64 nt, hsa; identical to SEQ ID NO: 373587

SEQ ID NO: 539400 - RNA, 64 nt, hsa; identical to SEQ ID NO: 373588

SEQ ID NO: 539401 - RNA, 64 nt, hsa; identical to SEQ ID NO: 373589

SEQ ID NO: 539402 - RNA, 64 nt, hsa; identical to SEQ ID NO: 373590

SEQ ID NO: 539403 - RNA, 64 nt, hsa; identical to SEQ ID NO: 373591

SEQ ID NO: 539404 - RNA, 64 nt, hsa; identical to SEQ ID NO: 373592

SEQ ID NO: 539405 - RNA, 64 nt, hsa; identical to SEQ ID NO: 373593

SEQ ID NO: 539406 - RNA, 64 nt, hsa; identical to SEQ ID NO: 373594

SEQ ID NO: 539407 - RNA, 64 nt, hsa; identical to SEQ ID NO: 373595

SEQ ID NO: 539408 - RNA, 64 nt, hsa; identical to SEQ ID NO: 373596

SEQ ID NO: 539409 - RNA, 64 nt, hsa; identical to SEQ ID NO: 373597

SEQ ID NO: 539410 - RNA, 64 nt, hsa; identical to SEQ ID NO: 373598

SEQ ID NO: 539411 - RNA, 64 nt, hsa; identical to SEQ ID NO: 373599

SEQ ID NO: 539412 - RNA, 64 nt, hsa; identical to SEQ ID NO: 373600

SEQ ID NO: 539413 - RNA, 64 nt, hsa; identical to SEQ ID NO: 373601

SEQ ID NO: 539414 - RNA, 64 nt, hsa; identical to SEQ ID NO: 373602

SEQ ID NO: 539415 - RNA, 64 nt, hsa; identical to SEQ ID NO: 373603

SEQ ID NO: 539416 - RNA, 64 nt, hsa; identical to SEQ ID NO: 373604

SEQ ID NO: 539417 - RNA, 64 nt, hsa; identical to SEQ ID NO: 373605

SEQ ID NO: 539418 - RNA, 64 nt, hsa; identical to SEQ ID NO: 373606

SEQ ID NO: 539419 - RNA, 64 nt, hsa; identical to SEQ ID NO: 373607

SEQ ID NO: 539420 - RNA, 64 nt, hsa; identical to SEQ ID NO: 373608

SEQ ID NO: 539421 - RNA, 64 nt, hsa; identical to SEQ ID NO: 373609

SEQ ID NO: 539422 - RNA, 64 nt, hsa; identical to SEQ ID NO: 373610

SEQ ID NO: 539423 - RNA, 64 nt, hsa; identical to SEQ ID NO: 373611

SEQ ID NO: 539424 - RNA, 64 nt, hsa; identical to SEQ ID NO: 373612

SEQ ID NO: 539425 - RNA, 64 nt, hsa; identical to SEQ ID NO: 373613

SEQ ID NO: 539426 - RNA, 64 nt, hsa; identical to SEQ ID NO: 373614

SEQ ID NO: 539427 - RNA, 64 nt, hsa; identical to SEQ ID NO: 373615

SEQ ID NO: 539428 - RNA, 64 nt, hsa; identical to SEQ ID NO: 373616

SEQ ID NO: 539429 - RNA, 64 nt, hsa; identical to SEQ ID NO: 373617

SEQ ID NO: 539430 - RNA, 64 nt, hsa; identical to SEQ ID NO: 373618

SEQ ID NO: 539431 - RNA, 64 nt, hsa; identical to SEQ ID NO: 373619

SEQ ID NO: 539432 - RNA, 64 nt, hsa; identical to SEQ ID NO: 373620

SEQ ID NO: 539433 - RNA, 64 nt, hsa; identical to SEQ ID NO: 373621

SEQ ID NO: 539434 - RNA, 64 nt, hsa; identical to SEQ ID NO: 373622

SEQ ID NO: 539435 - RNA, 64 nt, hsa; identical to SEQ ID NO: 373623

SEQ ID NO: 539436 - RNA, 64 nt, hsa; identical to SEQ ID NO: 373624

SEQ ID NO: 539437 - RNA, 64 nt, hsa; identical to SEQ ID NO: 373625

SEQ ID NO: 539438 - RNA, 64 nt, hsa; identical to SEQ ID NO: 373626

SEQ ID NO: 539439 - RNA, 64 nt, hsa; identical to SEQ ID NO: 373627

SEQ ID NO: 539440 - RNA, 64 nt, hsa; identical to SEQ ID NO: 373628

SEQ ID NO: 539441 - RNA, 64 nt, hsa; identical to SEQ ID NO: 373629

SEQ ID NO: 539442 - RNA, 64 nt, hsa; identical to SEQ ID NO: 373630

SEQ ID NO: 539443 - RNA, 64 nt, hsa; identical to SEQ ID NO: 373631

SEQ ID NO: 539444 - RNA, 64 nt, hsa; identical to SEQ ID NO: 373632

SEQ ID NO: 539445 - RNA, 64 nt, hsa; identical to SEQ ID NO: 373633

SEQ ID NO: 539446 - RNA, 64 nt, hsa; identical to SEQ ID NO: 373634

SEQ ID NO: 539447 - RNA, 64 nt, hsa; identical to SEQ ID NO: 373635

SEQ ID NO: 539448 - RNA, 64 nt, hsa; identical to SEQ ID NO: 373636

SEQ ID NO: 539449 - RNA, 64 nt, hsa; identical to SEQ ID NO: 373637

SEQ ID NO: 539450 - RNA, 64 nt, hsa; identical to SEQ ID NO: 373638

SEQ ID NO: 539451 - RNA, 64 nt, hsa; identical to SEQ ID NO: 373639

SEQ ID NO: 539452 - RNA, 64 nt, hsa; identical to SEQ ID NO: 373640

SEQ ID NO: 539453 - RNA, 64 nt, hsa; identical to SEQ ID NO: 373641

SEQ ID NO: 539454 - RNA, 64 nt, hsa; identical to SEQ ID NO: 373642

SEQ ID NO: 539455 - RNA, 64 nt, hsa; identical to SEQ ID NO: 373643

SEQ ID NO: 539456 - RNA, 64 nt, hsa; identical to SEQ ID NO: 373644

SEQ ID NO: 539457 - RNA, 64 nt, hsa; identical to SEQ ID NO: 373645

SEQ ID NO: 539458 - RNA, 64 nt, hsa; identical to SEQ ID NO: 373646

SEQ ID NO: 539459 - RNA, 64 nt, hsa; identical to SEQ ID NO: 373647

SEQ ID NO: 539460 - RNA, 64 nt, hsa; identical to SEQ ID NO: 373648

SEQ ID NO: 539461 - RNA, 64 nt, hsa; identical to SEQ ID NO: 373649

SEQ ID NO: 539462 - RNA, 64 nt, hsa; identical to SEQ ID NO: 373650

SEQ ID NO: 539463 - RNA, 64 nt, hsa; identical to SEQ ID NO: 373651

SEQ ID NO: 539464 - RNA, 64 nt, hsa; identical to SEQ ID NO: 373652

SEQ ID NO: 539465 - RNA, 64 nt, hsa; identical to SEQ ID NO: 373653

SEQ ID NO: 539466 - RNA, 64 nt, hsa; identical to SEQ ID NO: 373654

SEQ ID NO: 539467 - RNA, 64 nt, hsa; identical to SEQ ID NO: 373655

SEQ ID NO: 539468 - RNA, 64 nt, hsa; identical to SEQ ID NO: 373656

SEQ ID NO: 539469 - RNA, 64 nt, hsa; identical to SEQ ID NO: 373657

SEQ ID NO: 539470 - RNA, 64 nt, hsa; identical to SEQ ID NO: 373658

SEQ ID NO: 539471 - RNA, 64 nt, hsa; identical to SEQ ID NO: 373659

SEQ ID NO: 539472 - RNA, 64 nt, hsa; identical to SEQ ID NO: 373660

SEQ ID NO: 539473 - RNA, 64 nt, hsa; identical to SEQ ID NO: 373661

SEQ ID NO: 539474 - RNA, 64 nt, hsa; identical to SEQ ID NO: 235822

SEQ ID NO: 539475 - RNA, 64 nt, hsa; identical to SEQ ID NO: 235823

SEQ ID NO: 539476 - RNA, 64 nt, hsa; identical to SEQ ID NO: 235824

SEQ ID NO: 539477 - RNA, 64 nt, hsa; identical to SEQ ID NO: 235825

SEQ ID NO: 539478 - RNA, 64 nt, hsa; identical to SEQ ID NO: 235826

SEQ ID NO: 539479 - RNA, 64 nt, hsa; identical to SEQ ID NO: 235827

SEQ ID NO: 539480 - RNA, 64 nt, hsa; identical to SEQ ID NO: 235828

SEQ ID NO: 539481 - RNA, 64 nt, hsa; identical to SEQ ID NO: 235829

SEQ ID NO: 539482 - RNA, 64 nt, hsa; identical to SEQ ID NO: 235830

SEQ ID NO: 539483 - RNA, 64 nt, hsa; identical to SEQ ID NO: 235831

SEQ ID NO: 539484 - RNA, 64 nt, hsa; identical to SEQ ID NO: 235832

SEQ ID NO: 539485 - RNA, 64 nt, hsa; identical to SEQ ID NO: 235833

SEQ ID NO: 539486 - RNA, 64 nt, hsa; identical to SEQ ID NO: 235834

SEQ ID NO: 539487 - RNA, 64 nt, hsa; identical to SEQ ID NO: 235835

SEQ ID NO: 539488 - RNA, 64 nt, hsa; identical to SEQ ID NO: 235836

SEQ ID NO: 539489 - RNA, 64 nt, hsa; identical to SEQ ID NO: 235837

SEQ ID NO: 539490 - RNA, 64 nt, hsa; identical to SEQ ID NO: 235838

SEQ ID NO: 539491 - RNA, 64 nt, hsa; identical to SEQ ID NO: 235839

SEQ ID NO: 539492 - RNA, 64 nt, hsa; identical to SEQ ID NO: 235840

SEQ ID NO: 539493 - RNA, 64 nt, hsa; identical to SEQ ID NO: 235841

SEQ ID NO: 539494 - RNA, 64 nt, hsa; identical to SEQ ID NO: 235842

SEQ ID NO: 539495 - RNA, 64 nt, hsa; identical to SEQ ID NO: 235843

SEQ ID NO: 539496 - RNA, 64 nt, hsa; identical to SEQ ID NO: 235844

SEQ ID NO: 539497 - RNA, 64 nt, hsa; identical to SEQ ID NO: 235845

SEQ ID NO: 539498 - RNA, 55 nt, hsa; identical to SEQ ID NO: 235846

SEQ ID NO: 539499 - RNA, 64 nt, hsa; identical to SEQ ID NO: 235847

SEQ ID NO: 539500 - RNA, 64 nt, hsa; identical to SEQ ID NO: 235848

SEQ ID NO: 539501 - RNA, 64 nt, hsa; identical to SEQ ID NO: 235849

SEQ ID NO: 539502 - RNA, 64 nt, hsa; identical to SEQ ID NO: 235850

SEQ ID NO: 539503 - RNA, 64 nt, hsa; identical to SEQ ID NO: 235851

SEQ ID NO: 539504 - RNA, 64 nt, hsa; identical to SEQ ID NO: 235852

SEQ ID NO: 539505 - RNA, 64 nt, hsa; identical to SEQ ID NO: 235853

SEQ ID NO: 539506 - RNA, 64 nt, hsa; identical to SEQ ID NO: 235854

SEQ ID NO: 539507 - RNA, 64 nt, hsa; identical to SEQ ID NO: 235855

SEQ ID NO: 539508 - RNA, 64 nt, hsa; identical to SEQ ID NO: 235856

SEQ ID NO: 539509 - RNA, 64 nt, hsa; identical to SEQ ID NO: 235857

SEQ ID NO: 539510 - RNA, 64 nt, hsa; identical to SEQ ID NO: 235858

SEQ ID NO: 539511 - RNA, 64 nt, hsa; identical to SEQ ID NO: 235859

SEQ ID NO: 539512 - RNA, 64 nt, hsa; identical to SEQ ID NO: 235860

SEQ ID NO: 539513 - RNA, 64 nt, hsa; identical to SEQ ID NO: 235861

SEQ ID NO: 539514 - RNA, 64 nt, hsa; identical to SEQ ID NO: 235862

SEQ ID NO: 539515 - RNA, 64 nt, hsa; identical to SEQ ID NO: 235863

SEQ ID NO: 539516 - RNA, 64 nt, hsa; identical to SEQ ID NO: 235864

SEQ ID NO: 539517 - RNA, 64 nt, hsa; identical to SEQ ID NO: 235865

SEQ ID NO: 539518 - RNA, 64 nt, hsa; identical to SEQ ID NO: 235866

SEQ ID NO: 539519 - RNA, 64 nt, hsa; identical to SEQ ID NO: 235867

SEQ ID NO: 539520 - RNA, 64 nt, hsa; identical to SEQ ID NO: 235868

SEQ ID NO: 539521 - RNA, 64 nt, hsa; identical to SEQ ID NO: 235869

SEQ ID NO: 539522 - RNA, 64 nt, hsa; identical to SEQ ID NO: 235870

SEQ ID NO: 539523 - RNA, 64 nt, hsa; identical to SEQ ID NO: 235871

SEQ ID NO: 539524 - RNA, 64 nt, hsa; identical to SEQ ID NO: 235872

SEQ ID NO: 539525 - RNA, 64 nt, hsa; identical to SEQ ID NO: 235873

SEQ ID NO: 539526 - RNA, 64 nt, hsa; identical to SEQ ID NO: 235874

SEQ ID NO: 539527 - RNA, 64 nt, hsa; identical to SEQ ID NO: 235875

SEQ ID NO: 539528 - RNA, 64 nt, hsa; identical to SEQ ID NO: 235876

SEQ ID NO: 539529 - RNA, 64 nt, hsa; identical to SEQ ID NO: 235877

SEQ ID NO: 539530 - RNA, 64 nt, hsa; identical to SEQ ID NO: 235878

SEQ ID NO: 539531 - RNA, 64 nt, hsa; identical to SEQ ID NO: 235879

SEQ ID NO: 539532 - RNA, 64 nt, hsa; identical to SEQ ID NO: 235880

SEQ ID NO: 539533 - RNA, 64 nt, hsa; identical to SEQ ID NO: 235881

SEQ ID NO: 539534 - RNA, 64 nt, hsa; identical to SEQ ID NO: 235882

SEQ ID NO: 539535 - RNA, 64 nt, hsa; identical to SEQ ID NO: 235883

SEQ ID NO: 539536 - RNA, 64 nt, hsa; identical to SEQ ID NO: 235884

SEQ ID NO: 539537 - RNA, 64 nt, hsa; identical to SEQ ID NO: 235885

SEQ ID NO: 539538 - RNA, 64 nt, hsa; identical to SEQ ID NO: 235886

SEQ ID NO: 539539 - RNA, 64 nt, hsa
gaaguguuuccaugguagcgugagcauuaggugacguggcuagcggaggacuacccuugcucac

SEQ ID NO: 539540 - RNA, 64 nt, hsa
ccucgggugggagggauggggccaucuccuucaccguggcuaccauugucacucguaggggaug

SEQ ID NO: 539541 - RNA, 64 nt, hsa
ucugcuccaggccacauuuguuuuuuaacaguaacguggcuaggcuuccauuuauaagucuuag

SEQ ID NO: 539542 - RNA, 64 nt, hsa
cugagcuggaguccgagagugguugggggugggccguggcuaguguccugcugcagucagcaca

SEQ ID NO: 539543 - RNA, 64 nt, hsa
ucagugccacugaaaauacagaacccauuaauaucguggcuaucugauuacauuuauauuccaa

SEQ ID NO: 539544 - RNA, 64 nt, hsa
agcacucuggccuucaucacgagagcuccgcagccguggcuaggauuccacuuccugugucaug

SEQ ID NO: 539545 - RNA, 64 nt, hsa
uuuccgagucaagugauugacaacugaagagacacguggcuaggguuccacuggagaauugaaa

SEQ ID NO: 539546 - RNA, 64 nt, hsa
uagagauugucaucucauauauauaaaauggacacguggcuauaaaacaccauauaagagauga

SEQ ID NO: 539547 - RNA, 64 nt, hsa
ugguggugcagaaacaugaugccuggcugauuuucguggcuaaagggguaggccuuauguugau

SEQ ID NO: 539548 - RNA, 64 nt, hsa
ggcugagcuccuccgcgcgucgccggcgcuccaccguggcuacccauccguggucccgacaacc

SEQ ID NO: 539549 - RNA, 64 nt, hsa
auuaacauuugaaguugguuucuuaugaauauuucguggcuaaaaugauuuuauagggaaucua

SEQ ID NO: 539550 - RNA, 64 nt, hsa
cgaauaccugagcaacugugugcaaaucauagaccguggcuauaaccauaacgagaccgcccua

SEQ ID NO: 539551 - RNA, 64 nt, hsa
ucuucuuuugcauauaguagagugaggugagggucguggcuaaaaccccacaauaacuuuacau

SEQ ID NO: 539552 - RNA, 64 nt, hsa
gacucccagucccaccugugcugugacagucccacguggcuaugacagacuguuuaguacuuac

SEQ ID NO: 539553 - RNA, 64 nt, hsa
aguccuggggaaacuuuuccagagccuguuagcccguggcuacggucaggcucuggccagggca

SEQ ID NO: 539554 - RNA, 64 nt, hsa
uccucaggguuuucuagucuugaacuacuggcuacguggcuaccaaaugccuaagggaguucgu

SEQ ID NO: 539555 - RNA, 64 nt, hsa
uuuuaacaucugagaaaagcuuugaacccugggacguggcuagucauaaccuuaccagauuuuu

SEQ ID NO: 539556 - RNA, 64 nt, hsa
ucagcugccuggccaaggacaacucuaucuaugucguggcuaauauuggggacaagaagccaug

SEQ ID NO: 539557 - RNA, 64 nt, hsa
cagucuaacgaggcccaccuccuccaccacagaacguggcuauguuccaagugcuacucucacu

SEQ ID NO: 539558 - RNA, 64 nt, hsa
uuuuggcaacauguacauuucuaacaaaguuuaucguggcuauuaaaguguuuuauuucccaau

SEQ ID NO: 539559 - RNA, 64 nt, hsa
uugucgucccaucuuuuggcagcaaaaccaccugcguggcuaggaugauuaauuaugaggauga

SEQ ID NO: 539560 - RNA, 64 nt, hsa
aacguuucgaagcacaguggccagcgagcgagcacguggcuacucccuguugcaugucaaaucc

SEQ ID NO: 539561 - RNA, 64 nt, hsa
aacauugaauaucaguugacagaauggugccaugcguggcuaacauccugcuuugauucccucu

SEQ ID NO: 539562 - RNA, 64 nt, hsa
cuccuuggccaccagaccaugggccaagagccgccguggcuauaccuggggacuugauguuccu

SEQ ID NO: 539563 - RNA, 64 nt, hsa
aagaaaaacccauaaccaccucagauggaucugacguggcuaagggacaaacagcaaauauuuc

SEQ ID NO: 539564 - RNA, 64 nt, hsa
auguuucuccaggaugccaaaggaaaugcuaccucguggcuacacauauuaugaauaaaugagg

SEQ ID NO: 539565 - RNA, 64 nt, hsa
ccuuccaacaggagcugggauccuaagggcucaccguggcuaagaguguccuaggaguauccuc

SEQ ID NO: 539566 - RNA, 64 nt, hsa
gguuugaggaauuaguuuaacuuauccaaaguuucguggcuauuaaguucuaguauuuggaguc

SEQ ID NO: 539567 - RNA, 64 nt, hsa
ucucgccuuuaagggcuaugguuguagugugacccguggcuaaccugcuuucaaaaucaaguau

SEQ ID NO: 539568 - RNA, 64 nt, hsa
ucucugcaaugcuucuguagcuucuaauguuccccguggcuaggccuuuccugccgagugcucu

SEQ ID NO: 539569 - RNA, 64 nt, hsa
uucuguaagaagcuuguuuaauaauguuguaagccguggcuauaguuuuaucaagacucugaac

SEQ ID NO: 539570 - RNA, 64 nt, hsa
auuuauggucugaaccggcagaugugugucccuccguggcuacagagugguaaacaaaucucac

SEQ ID NO: 539571 - RNA, 64 nt, hsa
cgcguggcguggcccguggccuggcaucugugugcguggcuaucaggaguucuaggaacucagu

SEQ ID NO: 539572 - RNA, 62 nt, hsa
acaucuacuacaagguaugagggcuccucucacguggcuauccugaauccagcccuucuugg

SEQ ID NO: 539573 - RNA, 64 nt, hsa
gggcucucccccugcggccccgcuccaccgggggcguggcuagaucugaccgcgcccuuccagg

SEQ ID NO: 539574 - RNA, 64 nt, hsa
aguucaaccuuuaguacguguggcuuggucacuucguggcuaagguaagaacgugcuuguggaa

SEQ ID NO: 539575 - RNA, 64 nt, hsa
gcugcuauuggcaaagagcacaggacucagcccucguggcuaaaaaugguauuuuggcaguuug

SEQ ID NO: 539576 - RNA, 64 nt, hsa
uacuacuguaggcaguuuccuccucagucuccuccguggcuagugugucuaguucacgaagcaa

SEQ ID NO: 539577 - RNA, 64 nt, hsa
auuuauuggacccagagaaccgggccgggcacagcguggcuacagagggucucccucgaugacg

SEQ ID NO: 539578 - RNA, 64 nt, hsa
cgcugaucccauucauuuagaguugauguuuccacguggcuauuuccaagcuuugccuucaaau

SEQ ID NO: 539579 - RNA, 64 nt, hsa
ugaucugcuauagcuguccaucagagagaauacacguggcuauaacaucuauaacaaaacgacg

SEQ ID NO: 539580 - RNA, 64 nt, hsa
ugugagccuaagugcagccgugcuagcugcgcaccguggcuaaggaugacgucuguguuccugu

SEQ ID NO: 539581 - RNA, 64 nt, hsa
cagugugacaggaaagauucaugucacuacuguccguggcuacaauucaaagguauccaauguc

SEQ ID NO: 539582 - RNA, 64 nt, hsa
guuaggugcccccgccaggcauugcaggcuuagucguggcuacuguucuccugugccgcugcau

SEQ ID NO: 539583 - RNA, 64 nt, hsa
augaaaagaguugauuuuggaccucggaccuugccguggcuaaaucuuuaccuucucauagcug

SEQ ID NO: 539584 - RNA, 64 nt, hsa
ugaguugguuccugcucccccaaaccauguuaaacguggcuaacaguguagguacagaacuaua

SEQ ID NO: 539585 - RNA, 64 nt, hsa; identical to SEQ ID NO: 164072

SEQ ID NO: 539586 - RNA, 64 nt, hsa; identical to SEQ ID NO: 164073

SEQ ID NO: 539587 - RNA, 64 nt, hsa; identical to SEQ ID NO: 164074

SEQ ID NO: 539588 - RNA, 64 nt, hsa; identical to SEQ ID NO: 164075

SEQ ID NO: 539589 - RNA, 64 nt, hsa; identical to SEQ ID NO: 164076

SEQ ID NO: 539590 - RNA, 64 nt, hsa; identical to SEQ ID NO: 164077

SEQ ID NO: 539591 - RNA, 64 nt, hsa; identical to SEQ ID NO: 164078

SEQ ID NO: 539592 - RNA, 64 nt, hsa; identical to SEQ ID NO: 164079

SEQ ID NO: 539593 - RNA, 64 nt, hsa; identical to SEQ ID NO: 164080

SEQ ID NO: 539594 - RNA, 64 nt, hsa; identical to SEQ ID NO: 164081

SEQ ID NO: 539595 - RNA, 64 nt, hsa; identical to SEQ ID NO: 164082

SEQ ID NO: 539596 - RNA, 64 nt, hsa; identical to SEQ ID NO: 164083

SEQ ID NO: 539597 - RNA, 64 nt, hsa; identical to SEQ ID NO: 164084

SEQ ID NO: 539598 - RNA, 64 nt, hsa; identical to SEQ ID NO: 164085

SEQ ID NO: 539599 - RNA, 64 nt, hsa; identical to SEQ ID NO: 164080

SEQ ID NO: 539600 - RNA, 64 nt, hsa; identical to SEQ ID NO: 164081

SEQ ID NO: 539601 - RNA, 64 nt, hsa; identical to SEQ ID NO: 164088

SEQ ID NO: 539602 - RNA, 64 nt, hsa; identical to SEQ ID NO: 164089

SEQ ID NO: 539603 - RNA, 64 nt, hsa; identical to SEQ ID NO: 164090

SEQ ID NO: 539604 - RNA, 64 nt, hsa; identical to SEQ ID NO: 164091

SEQ ID NO: 539605 - RNA, 64 nt, hsa; identical to SEQ ID NO: 164092

SEQ ID NO: 539606 - RNA, 64 nt, hsa; identical to SEQ ID NO: 164093

SEQ ID NO: 539607 - RNA, 64 nt, hsa; identical to SEQ ID NO: 164094

SEQ ID NO: 539608 - RNA, 64 nt, hsa; identical to SEQ ID NO: 164095

SEQ ID NO: 539609 - RNA, 64 nt, hsa; identical to SEQ ID NO: 164096

SEQ ID NO: 539610 - RNA, 64 nt, hsa; identical to SEQ ID NO: 164097

SEQ ID NO: 539611 - RNA, 64 nt, hsa; identical to SEQ ID NO: 164098

SEQ ID NO: 539612 - RNA, 64 nt, hsa; identical to SEQ ID NO: 164099

SEQ ID NO: 539613 - RNA, 64 nt, hsa; identical to SEQ ID NO: 164100

SEQ ID NO: 539614 - RNA, 64 nt, hsa; identical to SEQ ID NO: 164101

SEQ ID NO: 539615 - RNA, 64 nt, hsa
ccagccccucccccugccccaccuccucccuugggacugagagggccccuaccaaccuuugccu

SEQ ID NO: 539616 - RNA, 64 nt, hsa
ucagguggccuucccauuuaagugccuucucugugacugagagcccuagugugaugagaacuaa

SEQ ID NO: 539617 - RNA, 54 nt, hsa
ugaugcucuucucaaggugacacugacugagauguucucuuacugacugagaug

SEQ ID NO: 539618 - RNA, 64 nt, hsa
cucaaggugacacugacugagauguucucuuacugacugagauguucucuuggcaugcuaaauc

SEQ ID NO: 539619 - RNA, 64 nt, hsa
augagaguauauuuuuaugagggagcaaaaguuagacugagaacaaacguuagaaaaucacuuc

SEQ ID NO: 539620 - RNA, 64 nt, hsa
acugccuuuccuucccacagaccugagugugaaagacugagaguugaggaguuacuuuguggau

SEQ ID NO: 539621 - RNA, 64 nt, hsa
gcucacggcaaagucagcagcacugguaagccaagacugagaaauacaagguugcuugucugac

SEQ ID NO: 539622 - RNA, 64 nt, hsa
cuguguucugaagucucuuacccuaccugcucaggacugagacaguuauucacugaacauauuu

SEQ ID NO: 539623 - RNA, 64 nt, hsa
cuuggccugagcuaugccuguugaggcaucuggagacugagaaagaaucaaaggcagagaagac

SEQ ID NO: 539624 - RNA, 64 nt, hsa
ccauggcuuuuguuugaugguuuucaauagaggugacugagauuguagggggggcauuuuuggu

SEQ ID NO: 539625 - RNA, 64 nt, hsa
ugauaacuugucuuaaguucuauuaaggcaguuagacugagauuucuaaugacuucaccauaaa

SEQ ID NO: 539626 - RNA, 64 nt, hsa
aacauuuucccucauccucugaaaguggaaaccagacugagaugguaaguuaacugauaaaacc

SEQ ID NO: 539627 - RNA, 64 nt, hsa
gguccagggaguguggagagcuccuggugucgaggacugagacugagaggggagcccccuccau

SEQ ID NO: 539628 - RNA, 64 nt, hsa
gggaguguggagagcuccuggugucgaggacugagacugagaggggagcccccuccaucuggcc

SEQ ID NO: 539629 - RNA, 64 nt, hsa; identical to SEQ ID NO: 138909

SEQ ID NO: 539630 - RNA, 64 nt, hsa; identical to SEQ ID NO: 138910

SEQ ID NO: 539631 - RNA, 64 nt, hsa; identical to SEQ ID NO: 138911

SEQ ID NO: 539632 - RNA, 64 nt, hsa; identical to SEQ ID NO: 138912

SEQ ID NO: 539633 - RNA, 64 nt, hsa; identical to SEQ ID NO: 138913

SEQ ID NO: 539634 - RNA, 64 nt, hsa; identical to SEQ ID NO: 138914

SEQ ID NO: 539635 - RNA, 64 nt, hsa; identical to SEQ ID NO: 138915

SEQ ID NO: 539636 - RNA, 64 nt, hsa; identical to SEQ ID NO: 138916

SEQ ID NO: 539637 - RNA, 64 nt, hsa; identical to SEQ ID NO: 138917

SEQ ID NO: 539638 - RNA, 64 nt, hsa; identical to SEQ ID NO: 138918

SEQ ID NO: 539639 - RNA, 64 nt, hsa; identical to SEQ ID NO: 138919

SEQ ID NO: 539640 - RNA, 64 nt, hsa; identical to SEQ ID NO: 138920

SEQ ID NO: 539641 - RNA, 64 nt, hsa; identical to SEQ ID NO: 138921

SEQ ID NO: 539642 - RNA, 64 nt, hsa; identical to SEQ ID NO: 138922

SEQ ID NO: 539643 - RNA, 64 nt, hsa; identical to SEQ ID NO: 138923

SEQ ID NO: 539644 - RNA, 64 nt, hsa; identical to SEQ ID NO: 138924

SEQ ID NO: 539645 - RNA, 64 nt, hsa; identical to SEQ ID NO: 138925

SEQ ID NO: 539646 - RNA, 64 nt, hsa; identical to SEQ ID NO: 138926

SEQ ID NO: 539647 - RNA, 64 nt, hsa; identical to SEQ ID NO: 138927

SEQ ID NO: 539648 - RNA, 64 nt, hsa; identical to SEQ ID NO: 138928

SEQ ID NO: 539649 - RNA, 64 nt, hsa; identical to SEQ ID NO: 138929

SEQ ID NO: 539650 - RNA, 64 nt, hsa; identical to SEQ ID NO: 138930

SEQ ID NO: 539651 - RNA, 64 nt, hsa; identical to SEQ ID NO: 138931

SEQ ID NO: 539652 - RNA, 64 nt, hsa; identical to SEQ ID NO: 138932

SEQ ID NO: 539653 - RNA, 64 nt, hsa; identical to SEQ ID NO: 138933

SEQ ID NO: 539654 - RNA, 64 nt, hsa; identical to SEQ ID NO: 138934

SEQ ID NO: 539655 - RNA, 64 nt, hsa; identical to SEQ ID NO: 138935

SEQ ID NO: 539656 - RNA, 64 nt, hsa; identical to SEQ ID NO: 138936

SEQ ID NO: 539657 - RNA, 64 nt, hsa; identical to SEQ ID NO: 138937

SEQ ID NO: 539658 - RNA, 64 nt, hsa; identical to SEQ ID NO: 138938

SEQ ID NO: 539659 - RNA, 64 nt, hsa; identical to SEQ ID NO: 138939

SEQ ID NO: 539660 - RNA, 64 nt, hsa; identical to SEQ ID NO: 138940

SEQ ID NO: 539661 - RNA, 64 nt, hsa
uagggguggacucagcucugucuggcucacccucacgggcuacccccaccucacccugugcucc

SEQ ID NO: 539662 - RNA, 64 nt, hsa
auuuuugaaacccgaauugaaaauguugcaggcaacgggcuacagcuuuauuagugguucucua

SEQ ID NO: 539663 - RNA, 64 nt, hsa
cuugcugaugucuaugguguuacagaagugcuacacgggcuacagcugaagauuggaauacuaa

SEQ ID NO: 539664 - RNA, 62 nt, hsa
cgcagggggccgagggcugaggccaggcaaucacgggcuaugcccggggagcugucgggagu

SEQ ID NO: 539665 - RNA, 64 nt, hsa
ccuuuauuuuuuucucuguaaauauguacagugcacgggcuaugagauagcaacaaaaaaugca

SEQ ID NO: 539666 - RNA, 64 nt, hsa
aggacucauuaacugaugaaacaaauuuguccccacgggcuaguuuaccugugucgugagaagg

SEQ ID NO: 539667 - RNA, 64 nt, hsa
auuauguggcguguucauccccacgccgugugucacgggcuagggcggcguguucauccccaca

SEQ ID NO: 539668 - RNA, 64 nt, hsa
accaggaaaaucacugccggcuagucccaagcaaacgggcuaggaggaaagauuaaaaaaacaa

SEQ ID NO: 539669 - RNA, 64 nt, hsa
ucuacucuggcucaggacccaguccaggccuucuacgggcuaggcccagagacuuggguugcug

SEQ ID NO: 539670 - RNA, 54 nt, hsa
ugagcaaaaugaaaccuugauguuacgggcuaaaucaagagcagcuuaauccug

SEQ ID NO: 539671 - RNA, 64 nt, hsa
gugccguggccagugaacucagaggugcugguggacgggcuaggacuuugggguuaggccaugg

SEQ ID NO: 539672 - RNA, 64 nt, hsa
cagccugggaagaugucucacuguccaccucccaacgggcuaggggagcacgggguuggacagg

SEQ ID NO: 539673 - RNA, 64 nt, hsa
gcuacauuugguuuuuuccccugucccuuugauuacgggcuaagguaggguagaguggguguag

SEQ ID NO: 539674 - RNA, 64 nt, hsa
gggcccagggucugcccgccccugcagccuggccuccccgcacaggcuguggcuugcacuccag

SEQ ID NO: 539675 - RNA, 64 nt, hsa
guggagcuggcugagucacagccaccuccccaccuccccgcaagcuggucccaucgaccagcaa

SEQ ID NO: 539676 - RNA, 64 nt, hsa
cagcgagaacaaacaccuccccagcccccagcccuccccgcagugggaagugaauccuuaaccc

SEQ ID NO: 539677 - RNA, 64 nt, hsa
cuaggccgccuggcagaaucuagcaccguccgaauccccgcaggacccauggagcuaugaccac

SEQ ID NO: 539678 - RNA, 64 nt, hsa; identical to SEQ ID NO: 411269

SEQ ID NO: 539679 - RNA, 64 nt, hsa; identical to SEQ ID NO: 411270

SEQ ID NO: 539680 - RNA, 64 nt, hsa; identical to SEQ ID NO: 411271

SEQ ID NO: 539681 - RNA, 64 nt, hsa; identical to SEQ ID NO: 411272

SEQ ID NO: 539682 - RNA, 64 nt, hsa; identical to SEQ ID NO: 411273

SEQ ID NO: 539683 - RNA, 64 nt, hsa; identical to SEQ ID NO: 411274

SEQ ID NO: 539684 - RNA, 64 nt, hsa; identical to SEQ ID NO: 411275

SEQ ID NO: 539685 - RNA, 64 nt, hsa; identical to SEQ ID NO: 411276

SEQ ID NO: 539686 - RNA, 64 nt, hsa; identical to SEQ ID NO: 411277

SEQ ID NO: 539687 - RNA, 64 nt, hsa; identical to SEQ ID NO: 411278

SEQ ID NO: 539688 - RNA, 64 nt, hsa; identical to SEQ ID NO: 411279

SEQ ID NO: 539689 - RNA, 64 nt, hsa; identical to SEQ ID NO: 411280

SEQ ID NO: 539690 - RNA, 64 nt, hsa; identical to SEQ ID NO: 411281

SEQ ID NO: 539691 - RNA, 64 nt, hsa; identical to SEQ ID NO: 411282

SEQ ID NO: 539692 - RNA, 64 nt, hsa; identical to SEQ ID NO: 411283

SEQ ID NO: 539693 - RNA, 64 nt, hsa; identical to SEQ ID NO: 411284

SEQ ID NO: 539694 - RNA, 64 nt, hsa; identical to SEQ ID NO: 411285

SEQ ID NO: 539695 - RNA, 64 nt, hsa; identical to SEQ ID NO: 411286

SEQ ID NO: 539696 - RNA, 64 nt, hsa; identical to SEQ ID NO: 411287

SEQ ID NO: 539697 - RNA, 64 nt, hsa; identical to SEQ ID NO: 411288

SEQ ID NO: 539698 - RNA, 64 nt, hsa; identical to SEQ ID NO: 411289

SEQ ID NO: 539699 - RNA, 64 nt, hsa; identical to SEQ ID NO: 411290

SEQ ID NO: 539700 - RNA, 64 nt, hsa; identical to SEQ ID NO: 411291

SEQ ID NO: 539701 - RNA, 64 nt, hsa; identical to SEQ ID NO: 411292

SEQ ID NO: 539702 - RNA, 64 nt, hsa; identical to SEQ ID NO: 411293

SEQ ID NO: 539703 - RNA, 64 nt, hsa; identical to SEQ ID NO: 411294

SEQ ID NO: 539704 - RNA, 64 nt, hsa; identical to SEQ ID NO: 411295

SEQ ID NO: 539705 - RNA, 64 nt, hsa; identical to SEQ ID NO: 411296

SEQ ID NO: 539706 - RNA, 64 nt, hsa; identical to SEQ ID NO: 411297

SEQ ID NO: 539707 - RNA, 64 nt, hsa; identical to SEQ ID NO: 411298

SEQ ID NO: 539708 - RNA, 64 nt, hsa; identical to SEQ ID NO: 411299

SEQ ID NO: 539709 - RNA, 64 nt, hsa; identical to SEQ ID NO: 411300

SEQ ID NO: 539710 - RNA, 64 nt, hsa; identical to SEQ ID NO: 411301

SEQ ID NO: 539711 - RNA, 64 nt, hsa; identical to SEQ ID NO: 411302

SEQ ID NO: 539712 - RNA, 64 nt, hsa; identical to SEQ ID NO: 411303

SEQ ID NO: 539713 - RNA, 64 nt, hsa; identical to SEQ ID NO: 411304

SEQ ID NO: 539714 - RNA, 64 nt, hsa; identical to SEQ ID NO: 411305

SEQ ID NO: 539715 - RNA, 64 nt, hsa; identical to SEQ ID NO: 411306

SEQ ID NO: 539716 - RNA, 64 nt, hsa; identical to SEQ ID NO: 411307

SEQ ID NO: 539717 - RNA, 64 nt, hsa; identical to SEQ ID NO: 411308

SEQ ID NO: 539718 - RNA, 64 nt, hsa; identical to SEQ ID NO: 411309

SEQ ID NO: 539719 - RNA, 64 nt, hsa; identical to SEQ ID NO: 411310

SEQ ID NO: 539720 - RNA, 64 nt, hsa; identical to SEQ ID NO: 411311

SEQ ID NO: 539721 - RNA, 64 nt, hsa; identical to SEQ ID NO: 411312

SEQ ID NO: 539722 - RNA, 64 nt, hsa; identical to SEQ ID NO: 411313

SEQ ID NO: 539723 - RNA, 64 nt, hsa; identical to SEQ ID NO: 411314

SEQ ID NO: 539724 - RNA, 64 nt, hsa; identical to SEQ ID NO: 411315

SEQ ID NO: 539725 - RNA, 64 nt, hsa; identical to SEQ ID NO: 411316

SEQ ID NO: 539726 - RNA, 64 nt, hsa; identical to SEQ ID NO: 411317

SEQ ID NO: 539727 - RNA, 64 nt, hsa; identical to SEQ ID NO: 411318

SEQ ID NO: 539728 - RNA, 64 nt, hsa; identical to SEQ ID NO: 411319

SEQ ID NO: 539729 - RNA, 64 nt, hsa; identical to SEQ ID NO: 411320

SEQ ID NO: 539730 - RNA, 64 nt, hsa; identical to SEQ ID NO: 411321

SEQ ID NO: 539731 - RNA, 64 nt, hsa; identical to SEQ ID NO: 411322

SEQ ID NO: 539732 - RNA, 64 nt, hsa; identical to SEQ ID NO: 411323

SEQ ID NO: 539733 - RNA, 64 nt, hsa; identical to SEQ ID NO: 411324

SEQ ID NO: 539734 - RNA, 64 nt, hsa; identical to SEQ ID NO: 411325

SEQ ID NO: 539735 - RNA, 64 nt, hsa; identical to SEQ ID NO: 411326

SEQ ID NO: 539736 - RNA, 64 nt, hsa; identical to SEQ ID NO: 411327

SEQ ID NO: 539737 - RNA, 64 nt, hsa; identical to SEQ ID NO: 411328

SEQ ID NO: 539738 - RNA, 64 nt, hsa; identical to SEQ ID NO: 411329

SEQ ID NO: 539739 - RNA, 64 nt, hsa; identical to SEQ ID NO: 411330

SEQ ID NO: 539740 - RNA, 64 nt, hsa; identical to SEQ ID NO: 411331

SEQ ID NO: 539741 - RNA, 52 nt, hsa; identical to SEQ ID NO: 264778

SEQ ID NO: 539742 - RNA, 64 nt, hsa; identical to SEQ ID NO: 411333

SEQ ID NO: 539743 - RNA, 64 nt, hsa; identical to SEQ ID NO: 411334

SEQ ID NO: 539744 - RNA, 64 nt, hsa; identical to SEQ ID NO: 411335

SEQ ID NO: 539745 - RNA, 64 nt, hsa; identical to SEQ ID NO: 411336

SEQ ID NO: 539746 - RNA, 64 nt, hsa; identical to SEQ ID NO: 411337

SEQ ID NO: 539747 - RNA, 64 nt, hsa; identical to SEQ ID NO: 411338

SEQ ID NO: 539748 - RNA, 64 nt, hsa; identical to SEQ ID NO: 411339

SEQ ID NO: 539749 - RNA, 64 nt, hsa; identical to SEQ ID NO: 411340

SEQ ID NO: 539750 - RNA, 64 nt, hsa; identical to SEQ ID NO: 411341

SEQ ID NO: 539751 - RNA, 64 nt, hsa; identical to SEQ ID NO: 411342

SEQ ID NO: 539752 - RNA, 64 nt, hsa; identical to SEQ ID NO: 411343

SEQ ID NO: 539753 - RNA, 64 nt, hsa; identical to SEQ ID NO: 411344

SEQ ID NO: 539754 - RNA, 64 nt, hsa; identical to SEQ ID NO: 411345

SEQ ID NO: 539755 - RNA, 64 nt, hsa; identical to SEQ ID NO: 411346

SEQ ID NO: 539756 - RNA, 64 nt, hsa; identical to SEQ ID NO: 411347

SEQ ID NO: 539757 - RNA, 64 nt, hsa; identical to SEQ ID NO: 411348

SEQ ID NO: 539758 - RNA, 64 nt, hsa; identical to SEQ ID NO: 411349

SEQ ID NO: 539759 - RNA, 64 nt, hsa
cugggacuuggcauuuaggauuccaucuggcccagccccugaagguccuggggaagcaggucuc

SEQ ID NO: 539760 - RNA, 64 nt, hsa
aacugcagcgcccuccuccccacugcccccugcagccccugagauauuuugcucacuaucccuc

SEQ ID NO: 539761 - RNA, 64 nt, hsa
guuguagcacauuccuuuugcaggucugagcuaagccccugaaagcaggguaaugcucauaaaa

SEQ ID NO: 539762 - RNA, 64 nt, hsa
aaguucccucucugacccaggcugaguccauacugccccugaucccagaaggaaugcugacccc

SEQ ID NO: 539763 - RNA, 64 nt, hsa
guucuccuaaggucuggccuugccccuuugcucugccccugaagucuaucugcaggauggucuu

SEQ ID NO: 539764 - RNA, 64 nt, hsa
ccucaugucugcuaaaacagccaucuucaagacagccccugaaaagagaccaguucagguccug

SEQ ID NO: 539765 - RNA, 64 nt, hsa
gucuucaaggguaggcugagcuccccacccuggagccccugagggcggccccugagcacuccuc

SEQ ID NO: 539766 - RNA, 64 nt, hsa
ggcugagcuccccacccuggagccccugagggcggccccugagcacuccucucucuccacucuc

SEQ ID NO: 539767 - RNA, 64 nt, hsa
caaaagcaggggccagggagggggcgacuugccugccccugaagcccuuguucccauuggcccc

SEQ ID NO: 539768 - RNA, 64 nt, hsa
cuguccaccugcuccauccucuaggguuccacaggccccugaccgcacagggaggcuggggcca

SEQ ID NO: 539769 - RNA, 64 nt, hsa
gcacggagaagaugaaggagaucguaggguggaugccccugauggccgcacagaaggacuucuu

SEQ ID NO: 539770 - RNA, 64 nt, hsa
ggcugaaggaggcgggggugguguagggcccccagccccugagaccuaaucccccucaugcuag

SEQ ID NO: 539771 - RNA, 64 nt, hsa
uccuccacugcugaacuggucccuaacugaaacagccccugacuuaucccaagcaugcuuccuu

SEQ ID NO: 539772 - RNA, 64 nt, hsa
uuuaaguauauuccuucaagugaguuuuccuccagccccugagaguugcugucucccaguggaa

SEQ ID NO: 539773 - RNA, 64 nt, hsa
gucaucagggaggguuaggaaaaccacaaacggagccccugaaagccucacguauuucacagag

SEQ ID NO: 539774 - RNA, 64 nt, hsa
agcagcuaacuccgagagcagugggcagguggccgccccugaggcuucacgccgggagaagcca

SEQ ID NO: 539775 - RNA, 64 nt, hsa
ucaugcccucugugcccacacaggucucugagcggccccugauguuccuguuggacacuccugg

SEQ ID NO: 539776 - RNA, 64 nt, hsa
ccccauaccccacacacucaucagccugaaguuagccccugagugccaccugcaucgugccaua

SEQ ID NO: 539777 - RNA, 64 nt, hsa
gacgacauccuucuccucaggucuucuggguggggccccugaugggagcccuccuggccucacu

SEQ ID NO: 539778 - RNA, 64 nt, hsa
uagagguggggacaggggcaggggcaggggcggagccccugaagaaggaaucccagccggguuc

SEQ ID NO: 539779 - RNA, 64 nt, hsa
uugcuauuuuucuuuaagugcagaguucauuuuugccccugaaaaguuuuugcugaguuugcug

SEQ ID NO: 539780 - RNA, 64 nt, hsa
augaaaauaaaacaccuccuguuguggauggugagccccugaugccgcuuauuugccgugaguu

SEQ ID NO: 539781 - RNA, 64 nt, hsa
uaucauacucagcuuccccugauggcccaucccagccccugaagcucuaugccaagaacacagc

SEQ ID NO: 539782 - RNA, 64 nt, hsa
gacacccauggucuccaugagugcucccucugcugccccugaugcaugcuucugcugauucccg

SEQ ID NO: 539783 - RNA, 64 nt, hsa
uccaauagcucacucccuagagccugacgccggggccccugaccccugagccucagauuccaau

SEQ ID NO: 539784 - RNA, 64 nt, hsa
uccaauaccucacuccccagagccugaugccggggccccugaccccugaucuacggaggccugc

SEQ ID NO: 539785 - RNA, 64 nt, hsa
cacuucucccuggaaguccccaggacagaccgaugccccugacagccccguccaccagccacau

SEQ ID NO: 539786 - RNA, 64 nt, hsa
ugaggcuguugcuagcgugacccccacuggaccagccccugacccagcucgggcccccgacccu

SEQ ID NO: 539787 - RNA, 64 nt, hsa
cacuguuugggucccgcuuuuccuaucuucugcugccccugagcacauccaagcagacagggaa

SEQ ID NO: 539788 - RNA, 64 nt, hsa
cccucuucaguguucuucccccuccauguugccugccccugaagaccuuugaguucagucuaca

SEQ ID NO: 539789 - RNA, 64 nt, hsa; identical to SEQ ID NO: 311389

SEQ ID NO: 539790 - RNA, 64 nt, hsa; identical to SEQ ID NO: 311390

SEQ ID NO: 539791 - RNA, 64 nt, hsa; identical to SEQ ID NO: 311391

SEQ ID NO: 539792 - RNA, 64 nt, hsa; identical to SEQ ID NO: 311392

SEQ ID NO: 539793 - RNA, 64 nt, hsa; identical to SEQ ID NO: 311393

SEQ ID NO: 539794 - RNA, 64 nt, hsa; identical to SEQ ID NO: 311394

SEQ ID NO: 539795 - RNA, 64 nt, hsa; identical to SEQ ID NO: 311395

SEQ ID NO: 539796 - RNA, 64 nt, hsa; identical to SEQ ID NO: 311396

SEQ ID NO: 539797 - RNA, 64 nt, hsa; identical to SEQ ID NO: 311397

SEQ ID NO: 539798 - RNA, 64 nt, hsa; identical to SEQ ID NO: 311398

SEQ ID NO: 539799 - RNA, 64 nt, hsa; identical to SEQ ID NO: 311399

SEQ ID NO: 539800 - RNA, 64 nt, hsa; identical to SEQ ID NO: 311400

SEQ ID NO: 539801 - RNA, 64 nt, hsa; identical to SEQ ID NO: 173401

SEQ ID NO: 539802 - RNA, 64 nt, hsa; identical to SEQ ID NO: 173402

SEQ ID NO: 539803 - RNA, 64 nt, hsa; identical to SEQ ID NO: 173403

SEQ ID NO: 539804 - RNA, 64 nt, hsa; identical to SEQ ID NO: 173404

SEQ ID NO: 539805 - RNA, 64 nt, hsa; identical to SEQ ID NO: 370212

SEQ ID NO: 539806 - RNA, 64 nt, hsa; identical to SEQ ID NO: 370213

SEQ ID NO: 539807 - RNA, 64 nt, hsa; identical to SEQ ID NO: 370214

SEQ ID NO: 539808 - RNA, 64 nt, hsa; identical to SEQ ID NO: 370215

SEQ ID NO: 539809 - RNA, 64 nt, hsa; identical to SEQ ID NO: 119725

SEQ ID NO: 539810 - RNA, 64 nt, hsa; identical to SEQ ID NO: 119726

SEQ ID NO: 539811 - RNA, 64 nt, hsa; identical to SEQ ID NO: 119727

SEQ ID NO: 539812 - RNA, 64 nt, hsa; identical to SEQ ID NO: 119728

SEQ ID NO: 539813 - RNA, 64 nt, hsa; identical to SEQ ID NO: 119729

SEQ ID NO: 539814 - RNA, 64 nt, hsa; identical to SEQ ID NO: 119730

SEQ ID NO: 539815 - RNA, 64 nt, hsa; identical to SEQ ID NO: 119731

SEQ ID NO: 539816 - RNA, 64 nt, hsa; identical to SEQ ID NO: 119732

SEQ ID NO: 539817 - RNA, 64 nt, hsa; identical to SEQ ID NO: 119733

SEQ ID NO: 539818 - RNA, 64 nt, hsa; identical to SEQ ID NO: 119734

SEQ ID NO: 539819 - RNA, 64 nt, hsa; identical to SEQ ID NO: 119735

SEQ ID NO: 539820 - RNA, 64 nt, hsa; identical to SEQ ID NO: 119736

SEQ ID NO: 539821 - RNA, 64 nt, hsa; identical to SEQ ID NO: 119737

SEQ ID NO: 539822 - RNA, 64 nt, hsa; identical to SEQ ID NO: 119738

SEQ ID NO: 539823 - RNA, 64 nt, hsa; identical to SEQ ID NO: 119739

SEQ ID NO: 539824 - RNA, 64 nt, hsa; identical to SEQ ID NO: 119740

SEQ ID NO: 539825 - RNA, 62 nt, hsa; identical to SEQ ID NO: 119741

SEQ ID NO: 539826 - RNA, 64 nt, hsa; identical to SEQ ID NO: 119742

SEQ ID NO: 539827 - RNA, 64 nt, hsa; identical to SEQ ID NO: 119743

SEQ ID NO: 539828 - RNA, 64 nt, hsa; identical to SEQ ID NO: 119744

SEQ ID NO: 539829 - RNA, 64 nt, hsa; identical to SEQ ID NO: 119745

SEQ ID NO: 539830 - RNA, 64 nt, hsa; identical to SEQ ID NO: 119746

SEQ ID NO: 539831 - RNA, 64 nt, hsa; identical to SEQ ID NO: 119747

SEQ ID NO: 539832 - RNA, 64 nt, hsa; identical to SEQ ID NO: 119748

SEQ ID NO: 539833 - RNA, 64 nt, hsa; identical to SEQ ID NO: 119749

SEQ ID NO: 539834 - RNA, 64 nt, hsa; identical to SEQ ID NO: 119750

SEQ ID NO: 539835 - RNA, 64 nt, hsa; identical to SEQ ID NO: 119751

SEQ ID NO: 539836 - RNA, 64 nt, hsa; identical to SEQ ID NO: 119752

SEQ ID NO: 539837 - RNA, 64 nt, hsa; identical to SEQ ID NO: 119753

SEQ ID NO: 539838 - RNA, 64 nt, hsa; identical to SEQ ID NO: 119754

SEQ ID NO: 539839 - RNA, 64 nt, hsa; identical to SEQ ID NO: 119755

SEQ ID NO: 539840 - RNA, 64 nt, hsa; identical to SEQ ID NO: 119756

SEQ ID NO: 539841 - RNA, 64 nt, hsa; identical to SEQ ID NO: 119757

SEQ ID NO: 539842 - RNA, 64 nt, hsa; identical to SEQ ID NO: 119758

SEQ ID NO: 539843 - RNA, 64 nt, hsa; identical to SEQ ID NO: 119759

SEQ ID NO: 539844 - RNA, 64 nt, hsa; identical to SEQ ID NO: 119760

SEQ ID NO: 539845 - RNA, 64 nt, hsa; identical to SEQ ID NO: 119761

SEQ ID NO: 539846 - RNA, 64 nt, hsa; identical to SEQ ID NO: 119762

SEQ ID NO: 539847 - RNA, 64 nt, hsa; identical to SEQ ID NO: 119763

SEQ ID NO: 539848 - RNA, 64 nt, hsa; identical to SEQ ID NO: 119764

SEQ ID NO: 539849 - RNA, 64 nt, hsa; identical to SEQ ID NO: 119765

SEQ ID NO: 539850 - RNA, 64 nt, hsa; identical to SEQ ID NO: 119766

SEQ ID NO: 539851 - RNA, 64 nt, hsa; identical to SEQ ID NO: 119767

SEQ ID NO: 539852 - RNA, 64 nt, hsa; identical to SEQ ID NO: 119768

SEQ ID NO: 539853 - RNA, 64 nt, hsa; identical to SEQ ID NO: 119769

SEQ ID NO: 539854 - RNA, 64 nt, hsa; identical to SEQ ID NO: 119770

SEQ ID NO: 539855 - RNA, 64 nt, hsa; identical to SEQ ID NO: 119771

SEQ ID NO: 539856 - RNA, 64 nt, hsa; identical to SEQ ID NO: 119772

SEQ ID NO: 539857 - RNA, 64 nt, hsa; identical to SEQ ID NO: 119773

SEQ ID NO: 539858 - RNA, 64 nt, hsa; identical to SEQ ID NO: 119774

SEQ ID NO: 539859 - RNA, 64 nt, hsa; identical to SEQ ID NO: 119775

SEQ ID NO: 539860 - RNA, 64 nt, hsa; identical to SEQ ID NO: 119776

SEQ ID NO: 539861 - RNA, 64 nt, hsa; identical to SEQ ID NO: 119777

SEQ ID NO: 539862 - RNA, 64 nt, hsa; identical to SEQ ID NO: 119778

SEQ ID NO: 539863 - RNA, 64 nt, hsa; identical to SEQ ID NO: 119779

SEQ ID NO: 539864 - RNA, 64 nt, hsa; identical to SEQ ID NO: 119780

SEQ ID NO: 539865 - RNA, 64 nt, hsa; identical to SEQ ID NO: 119781

SEQ ID NO: 539866 - RNA, 64 nt, hsa; identical to SEQ ID NO: 119782

SEQ ID NO: 539867 - RNA, 64 nt, hsa; identical to SEQ ID NO: 119783

SEQ ID NO: 539868 - RNA, 64 nt, hsa; identical to SEQ ID NO: 119784

SEQ ID NO: 539869 - RNA, 64 nt, hsa; identical to SEQ ID NO: 119785

SEQ ID NO: 539870 - RNA, 64 nt, hsa; identical to SEQ ID NO: 119786

SEQ ID NO: 539871 - RNA, 64 nt, hsa; identical to SEQ ID NO: 119787

SEQ ID NO: 539872 - RNA, 64 nt, hsa; identical to SEQ ID NO: 119788

SEQ ID NO: 539873 - RNA, 64 nt, hsa; identical to SEQ ID NO: 119789

SEQ ID NO: 539874 - RNA, 64 nt, hsa; identical to SEQ ID NO: 119790

SEQ ID NO: 539875 - RNA, 64 nt, hsa; identical to SEQ ID NO: 119791

SEQ ID NO: 539876 - RNA, 64 nt, hsa; identical to SEQ ID NO: 119792

SEQ ID NO: 539877 - RNA, 64 nt, hsa; identical to SEQ ID NO: 119793

SEQ ID NO: 539878 - RNA, 64 nt, hsa; identical to SEQ ID NO: 119794

SEQ ID NO: 539879 - RNA, 64 nt, hsa; identical to SEQ ID NO: 119795

SEQ ID NO: 539880 - RNA, 64 nt, hsa; identical to SEQ ID NO: 119796

SEQ ID NO: 539881 - RNA, 64 nt, hsa; identical to SEQ ID NO: 119795

SEQ ID NO: 539882 - RNA, 64 nt, hsa; identical to SEQ ID NO: 119798

SEQ ID NO: 539883 - RNA, 64 nt, hsa; identical to SEQ ID NO: 119799

SEQ ID NO: 539884 - RNA, 64 nt, hsa; identical to SEQ ID NO: 119800

SEQ ID NO: 539885 - RNA, 64 nt, hsa; identical to SEQ ID NO: 119801

SEQ ID NO: 539886 - RNA, 64 nt, hsa; identical to SEQ ID NO: 119802

SEQ ID NO: 539887 - RNA, 64 nt, hsa; identical to SEQ ID NO: 119803

SEQ ID NO: 539888 - RNA, 64 nt, hsa; identical to SEQ ID NO: 119804

SEQ ID NO: 539889 - RNA, 64 nt, hsa; identical to SEQ ID NO: 119805

SEQ ID NO: 539890 - RNA, 64 nt, hsa; identical to SEQ ID NO: 119806

SEQ ID NO: 539891 - RNA, 64 nt, hsa; identical to SEQ ID NO: 119807

SEQ ID NO: 539892 - RNA, 64 nt, hsa; identical to SEQ ID NO: 119808

SEQ ID NO: 539893 - RNA, 64 nt, hsa; identical to SEQ ID NO: 119809

SEQ ID NO: 539894 - RNA, 64 nt, hsa; identical to SEQ ID NO: 119810

SEQ ID NO: 539895 - RNA, 64 nt, hsa; identical to SEQ ID NO: 119811

SEQ ID NO: 539896 - RNA, 64 nt, hsa; identical to SEQ ID NO: 119812

SEQ ID NO: 539897 - RNA, 64 nt, hsa; identical to SEQ ID NO: 119813

SEQ ID NO: 539898 - RNA, 64 nt, hsa; identical to SEQ ID NO: 119814

SEQ ID NO: 539899 - RNA, 64 nt, hsa; identical to SEQ ID NO: 119815

SEQ ID NO: 539900 - RNA, 64 nt, hsa; identical to SEQ ID NO: 119816

SEQ ID NO: 539901 - RNA, 64 nt, hsa; identical to SEQ ID NO: 119817

SEQ ID NO: 539902 - RNA, 64 nt, hsa; identical to SEQ ID NO: 119818

SEQ ID NO: 539903 - RNA, 64 nt, hsa; identical to SEQ ID NO: 119819

SEQ ID NO: 539904 - RNA, 64 nt, hsa; identical to SEQ ID NO: 119820

SEQ ID NO: 539905 - RNA, 64 nt, hsa; identical to SEQ ID NO: 119821

SEQ ID NO: 539906 - RNA, 64 nt, hsa; identical to SEQ ID NO: 119822

SEQ ID NO: 539907 - RNA, 64 nt, hsa; identical to SEQ ID NO: 119823

SEQ ID NO: 539908 - RNA, 64 nt, hsa; identical to SEQ ID NO: 119824

SEQ ID NO: 539909 - RNA, 64 nt, hsa; identical to SEQ ID NO: 119825

SEQ ID NO: 539910 - RNA, 64 nt, hsa; identical to SEQ ID NO: 119826

SEQ ID NO: 539911 - RNA, 64 nt, hsa; identical to SEQ ID NO: 119827

SEQ ID NO: 539912 - RNA, 64 nt, hsa; identical to SEQ ID NO: 119828

SEQ ID NO: 539913 - RNA, 64 nt, hsa; identical to SEQ ID NO: 119829

SEQ ID NO: 539914 - RNA, 64 nt, hsa; identical to SEQ ID NO: 119830

SEQ ID NO: 539915 - RNA, 64 nt, hsa; identical to SEQ ID NO: 119831

SEQ ID NO: 539916 - RNA, 64 nt, hsa; identical to SEQ ID NO: 119832

SEQ ID NO: 539917 - RNA, 64 nt, hsa; identical to SEQ ID NO: 119833

SEQ ID NO: 539918 - RNA, 64 nt, hsa; identical to SEQ ID NO: 119834

SEQ ID NO: 539919 - RNA, 64 nt, hsa; identical to SEQ ID NO: 119835

SEQ ID NO: 539920 - RNA, 64 nt, hsa; identical to SEQ ID NO: 119836

SEQ ID NO: 539921 - RNA, 64 nt, hsa; identical to SEQ ID NO: 119837

SEQ ID NO: 539922 - RNA, 64 nt, hsa; identical to SEQ ID NO: 119838

SEQ ID NO: 539923 - RNA, 64 nt, hsa; identical to SEQ ID NO: 119839

SEQ ID NO: 539924 - RNA, 64 nt, hsa
ccaucaaaaaaugcacucucacaguggaguugaagucuaauacaugauacaugugggccuguua

SEQ ID NO: 539925 - RNA, 64 nt, hsa
aaagagaaucuaaaaaaaaaaacaaaaaacuguugucuaauauaucuacaguaaauguuacacu

SEQ ID NO: 539926 - RNA, 64 nt, hsa
gugaacaaaaggaagaaaaucaaggaaagaaugagucuaauaucaagccuguacagacaguuaa

SEQ ID NO: 539927 - RNA, 64 nt, hsa
aagaaaaagaagagaaacuagaaacaguuaaagugucuaauaaugcugaagaccccaaagaucu

SEQ ID NO: 539928 - RNA, 56 nt, hsa; identical to SEQ ID NO: 44915

SEQ ID NO: 539929 - RNA, 64 nt, hsa; identical to SEQ ID NO: 44916

SEQ ID NO: 539930 - RNA, 64 nt, hsa; identical to SEQ ID NO: 44917

SEQ ID NO: 539931 - RNA, 64 nt, hsa; identical to SEQ ID NO: 44918

SEQ ID NO: 539932 - RNA, 64 nt, hsa; identical to SEQ ID NO: 44919

SEQ ID NO: 539933 - RNA, 64 nt, hsa; identical to SEQ ID NO: 44920

SEQ ID NO: 539934 - RNA, 64 nt, hsa; identical to SEQ ID NO: 44921

SEQ ID NO: 539935 - RNA, 64 nt, hsa; identical to SEQ ID NO: 44922

SEQ ID NO: 539936 - RNA, 64 nt, hsa; identical to SEQ ID NO: 44923

SEQ ID NO: 539937 - RNA, 64 nt, hsa; identical to SEQ ID NO: 44924

SEQ ID NO: 539938 - RNA, 64 nt, hsa; identical to SEQ ID NO: 44925

SEQ ID NO: 539939 - RNA, 64 nt, hsa; identical to SEQ ID NO: 44926

SEQ ID NO: 539940 - RNA, 64 nt, hsa; identical to SEQ ID NO: 44927

SEQ ID NO: 539941 - RNA, 64 nt, hsa; identical to SEQ ID NO: 44928

SEQ ID NO: 539942 - RNA, 64 nt, hsa; identical to SEQ ID NO: 44929

SEQ ID NO: 539943 - RNA, 64 nt, hsa; identical to SEQ ID NO: 44930

SEQ ID NO: 539944 - RNA, 64 nt, hsa; identical to SEQ ID NO: 44931

SEQ ID NO: 539945 - RNA, 64 nt, hsa; identical to SEQ ID NO: 44932

SEQ ID NO: 539946 - RNA, 64 nt, hsa; identical to SEQ ID NO: 44933

SEQ ID NO: 539947 - RNA, 64 nt, hsa; identical to SEQ ID NO: 77887

SEQ ID NO: 539948 - RNA, 64 nt, hsa; identical to SEQ ID NO: 77888

SEQ ID NO: 539949 - RNA, 64 nt, hsa; identical to SEQ ID NO: 77889

SEQ ID NO: 539950 - RNA, 64 nt, hsa; identical to SEQ ID NO: 77890

SEQ ID NO: 539951 - RNA, 64 nt, hsa; identical to SEQ ID NO: 77891

SEQ ID NO: 539952 - RNA, 64 nt, hsa; identical to SEQ ID NO: 77892

SEQ ID NO: 539953 - RNA, 64 nt, hsa; identical to SEQ ID NO: 77893

SEQ ID NO: 539954 - RNA, 64 nt, hsa; identical to SEQ ID NO: 77894

SEQ ID NO: 539955 - RNA, 64 nt, hsa; identical to SEQ ID NO: 77895

SEQ ID NO: 539956 - RNA, 64 nt, hsa; identical to SEQ ID NO: 77896

SEQ ID NO: 539957 - RNA, 64 nt, hsa; identical to SEQ ID NO: 77897

SEQ ID NO: 539958 - RNA, 64 nt, hsa; identical to SEQ ID NO: 77898

SEQ ID NO: 539959 - RNA, 64 nt, hsa; identical to SEQ ID NO: 77899

SEQ ID NO: 539960 - RNA, 64 nt, hsa; identical to SEQ ID NO: 77900

SEQ ID NO: 539961 - RNA, 64 nt, hsa; identical to SEQ ID NO: 77901

SEQ ID NO: 539962 - RNA, 64 nt, hsa; identical to SEQ ID NO: 77902

SEQ ID NO: 539963 - RNA, 64 nt, hsa; identical to SEQ ID NO: 77903

SEQ ID NO: 539964 - RNA, 64 nt, hsa; identical to SEQ ID NO: 77904

SEQ ID NO: 539965 - RNA, 64 nt, hsa; identical to SEQ ID NO: 77905

SEQ ID NO: 539966 - RNA, 64 nt, hsa; identical to SEQ ID NO: 77906

SEQ ID NO: 539967 - RNA, 64 nt, hsa; identical to SEQ ID NO: 77907

SEQ ID NO: 539968 - RNA, 64 nt, hsa; identical to SEQ ID NO: 77908

SEQ ID NO: 539969 - RNA, 64 nt, hsa; identical to SEQ ID NO: 77909

SEQ ID NO: 539970 - RNA, 64 nt, hsa; identical to SEQ ID NO: 77910

SEQ ID NO: 539971 - RNA, 64 nt, hsa; identical to SEQ ID NO: 77911

SEQ ID NO: 539972 - RNA, 64 nt, hsa; identical to SEQ ID NO: 77912

SEQ ID NO: 539973 - RNA, 64 nt, hsa; identical to SEQ ID NO: 77913

SEQ ID NO: 539974 - RNA, 64 nt, hsa; identical to SEQ ID NO: 77914

SEQ ID NO: 539975 - RNA, 64 nt, hsa; identical to SEQ ID NO: 77915

SEQ ID NO: 539976 - RNA, 64 nt, hsa; identical to SEQ ID NO: 77916

SEQ ID NO: 539977 - RNA, 64 nt, hsa; identical to SEQ ID NO: 77917

SEQ ID NO: 539978 - RNA, 64 nt, hsa; identical to SEQ ID NO: 77918

SEQ ID NO: 539979 - RNA, 64 nt, hsa; identical to SEQ ID NO: 77919

SEQ ID NO: 539980 - RNA, 64 nt, hsa; identical to SEQ ID NO: 77920

SEQ ID NO: 539981 - RNA, 64 nt, hsa; identical to SEQ ID NO: 77921

SEQ ID NO: 539982 - RNA, 64 nt, hsa; identical to SEQ ID NO: 77922

SEQ ID NO: 539983 - RNA, 64 nt, hsa; identical to SEQ ID NO: 77923

SEQ ID NO: 539984 - RNA, 64 nt, hsa; identical to SEQ ID NO: 77924

SEQ ID NO: 539985 - RNA, 64 nt, hsa; identical to SEQ ID NO: 77925

SEQ ID NO: 539986 - RNA, 64 nt, hsa; identical to SEQ ID NO: 77926

SEQ ID NO: 539987 - RNA, 64 nt, hsa; identical to SEQ ID NO: 77927

SEQ ID NO: 539988 - RNA, 64 nt, hsa; identical to SEQ ID NO: 77928

SEQ ID NO: 539989 - RNA, 64 nt, hsa; identical to SEQ ID NO: 77929

SEQ ID NO: 539990 - RNA, 64 nt, hsa; identical to SEQ ID NO: 77930

SEQ ID NO: 539991 - RNA, 64 nt, hsa; identical to SEQ ID NO: 77931

SEQ ID NO: 539992 - RNA, 64 nt, hsa; identical to SEQ ID NO: 77932

SEQ ID NO: 539993 - RNA, 64 nt, hsa; identical to SEQ ID NO: 77933

SEQ ID NO: 539994 - RNA, 64 nt, hsa; identical to SEQ ID NO: 77934

SEQ ID NO: 539995 - RNA, 64 nt, hsa; identical to SEQ ID NO: 77935

SEQ ID NO: 539996 - RNA, 64 nt, hsa; identical to SEQ ID NO: 77936

SEQ ID NO: 539997 - RNA, 64 nt, hsa; identical to SEQ ID NO: 77937

SEQ ID NO: 539998 - RNA, 64 nt, hsa; identical to SEQ ID NO: 77938

SEQ ID NO: 539999 - RNA, 64 nt, hsa
caaaguacauucuggggaaacaacauuuauauguagccuuuacuguuugauauaccaaauuaaa

SEQ ID NO: 540000 - RNA, 64 nt, hsa
ugaauuuucuaaaagcuuucaugucccagaacuuagccuuuaccugugaaguguuacuacagcc

SEQ ID NO: 540001 - RNA, 64 nt, hsa
uccauuucauaauucucaagauuuuucuaaauacagccuuuaaauuugacucaaauggaaauug

SEQ ID NO: 540002 - RNA, 64 nt, hsa
ccuuuaagcaucuuugaugaauacucugcaaaguagccuuuaaaaaaauguaaauuuuuuaaaa

SEQ ID NO: 540003 - RNA, 64 nt, hsa
agcgguuuccaucauaaaccaagaugaugaguucagccuuuaucccucgugguuccacuagaug

SEQ ID NO: 540004 - RNA, 64 nt, hsa
agcgguuuccaucauaaaccaagaugaugaguucagccuuuaucccucgugguuccgcuagaug

SEQ ID NO: 540005 - RNA, 64 nt, hsa
auaaagcuaauaagcacuuuaaaaaggaaaaggcagccuuuacuauuuuuucugguugagucau

SEQ ID NO: 540006 - RNA, 64 nt, hsa
gugcucagaaauucuauuuugguauguuuguauuagccuuuagaaaaaacacuccguuucagaa

SEQ ID NO: 540007 - RNA, 64 nt, hsa
uggagagaaacuacaaaugugaagaauguguuaaagccuuuaacaagucuucaacuuuuucugc

SEQ ID NO: 540008 - RNA, 64 nt, hsa
gugaaaaauccuagaaaugugaaaaauaucacaaagccuuuaaaugguugucacacuugauugu

SEQ ID NO: 540009 - RNA, 64 nt, hsa
gcaauuuuugucaagagaucuuucagaaaauauaagccuuuaaagugaagaagaggagccaguu

SEQ ID NO: 540010 - RNA, 64 nt, hsa
gagagaaagccuacaaaugugaagaauguggcaaagccuuuaaccaguuuucaacccuuauuac

SEQ ID NO: 540011 - RNA, 64 nt, hsa
gggagaaaccccacaaauguggagaaugcggaaaagccuuuaacugguccucaacucuuauuac

SEQ ID NO: 540012 - RNA, 64 nt, hsa
cagaaaaaugaaaagcaauacaacuuuaccauaaagccuuuaaaaccaguaacgugcugcucaa

SEQ ID NO: 540013 - RNA, 64 nt, hsa
acuuuccauuaaaucaaucaggaaugagucaaucagccuuuaggucuuuaguccgggggacuug

SEQ ID NO: 540014 - RNA, 64 nt, hsa
aagucuaagcauaacagcuuucuuucccagcacgagccuuuauagcucucuuuagcucaaccac

SEQ ID NO: 540015 - RNA, 64 nt, hsa
cuagccuuccaagcaugaagucggggaccaaauuagccuuuaacucauaaagagaggguagggc

SEQ ID NO: 540016 - RNA, 64 nt, hsa
uuguucugugaaauguguauuuuagucucugugaagccuuuacucucuaggugccuuauaaugu

SEQ ID NO: 540017 - RNA, 64 nt, hsa
aaaacuguauauuuagcaguagcacccaaaaccaagccuuuaaccccaacaauguguguaucuu

SEQ ID NO: 540018 - RNA, 64 nt, hsa
uucagacaacugcucugccugugcaaugaaaaauagccuuuaaggguuucuuugcagacugauu

SEQ ID NO: 540019 - RNA, 64 nt, hsa
acaaauaucccuuuuuuuccccuucauuucaccaagccuuuacuuaaaaucuucagugucuugu

SEQ ID NO: 540020 - RNA, 64 nt, hsa
uacaaaaaccccacaagugugaaaaacauggcaaagccuuuaagaagcccucaauucuuaacag

SEQ ID NO: 540021 - RNA, 64 nt, hsa
gugagaaauccuagaaaucugaagagugagauaaagccuuuaaaugguugucacacuucauugu

SEQ ID NO: 540022 - RNA, 64 nt, hsa
gagagaaaaccuacaaaugugaggaauguggcaaagccuuuagccugucccuccaauuuacugc

SEQ ID NO: 540023 - RNA, 64 nt, hsa
gagaaaaaucuuacaaaugugaagaauguggcaaagccuuuauccaguccucaacuccuaguaa

SEQ ID NO: 540024 - RNA, 64 nt, hsa
gagagaaacccuacaaaugugaagaaugugacaaagccuuuaaccaguccucaauuuuuacuaa

SEQ ID NO: 540025 - RNA, 64 nt, hsa
gauugaaacccuacgaaugcaguauaugugggaaagccuuuagucauaggucgucccugcuuca

SEQ ID NO: 540026 - RNA, 64 nt, hsa
ggagagaaacccaauagugugguaaguguggaaaagccuuuagaucauaugaaucccuauacau

SEQ ID NO: 540027 - RNA, 64 nt, hsa
gagagaaaccuuacaaguguaaugaguguggcaaagccuuuagugaccagucaacacuuaccau

SEQ ID NO: 540028 - RNA, 64 nt, hsa
gagagaaaugucacaagugugaugaguguugcaaagccuuuacuucauguucacaccucauuag

SEQ ID NO: 540029 - RNA, 64 nt, hsa
augagaaauccuagaaaugugaagaaugugacaaagccuuuaaauggcugucacacuugauugu

SEQ ID NO: 540030 - RNA, 64 nt, hsa
gagggaauuccuauaauuguguggaauguggcaaagccuuuaaccaguccuuaaggcuuacuac

SEQ ID NO: 540031 - RNA, 64 nt, hsa
uuaggucuacagcucucaugagucucccgcacucagccuuuagcaauucauuaaaaauucuugu

SEQ ID NO: 540032 - RNA, 64 nt, hsa
ugagugaacuuugaagcauauccucccccaguuuagccuuuagaugaggaccacagccaaauag

SEQ ID NO: 540033 - RNA, 64 nt, hsa
aagugaugucggcugcuagcuuccuucagaugacugaugucauaaguguauguaagacuuuuau

SEQ ID NO: 540034 - RNA, 64 nt, hsa
cuacuccuguuggcuaucaguacggucaaggaucugaugucacauccaaaagcuuuccagguac

SEQ ID NO: 540035 - RNA, 64 nt, hsa
ggccuaaguauauguuguguguguuguuugucuuugaugucaugguccccucucuuaggugcuc

SEQ ID NO: 540036 - RNA, 64 nt, hsa
aagaaaugaggugauccuauuaucaaauucaaucugaugucaaauagcacuaagaaguuauugu

SEQ ID NO: 540037 - RNA, 64 nt, hsa
uuaaaucuuaugggucuuuuuuuuuuaucucucuugaugucagauuuuauagucuuuuuaaaua

SEQ ID NO: 540038 - RNA, 64 nt, hsa
cagcaacuucguguuuauacugcaccuugguuguugaugucaaguaaaaaaaagauuguuuugu

SEQ ID NO: 540039 - RNA, 64 nt, hsa
gucuucuggauucuuugugggguuaauuuugauuugaugucaucuguuugcccuucaucuugcu

SEQ ID NO: 540040 - RNA, 64 nt, hsa
uaaagauggaaaggugggaaaauucuuugauauuugaugucauuguauccacauuuguuguaag

SEQ ID NO: 540041 - RNA, 64 nt, hsa
cacccaggugaggugcuguguucaugcacggaacugaugucauuagacaccauccaaggauggg

SEQ ID NO: 540042 - RNA, 64 nt, hsa
acacacgcgagccaucuugccagaauucugacagugaugucauuuuauuccccucccaaaacau

SEQ ID NO: 540043 - RNA, 64 nt, hsa
aacuuuuccagauguaucgaauuuaauuugacauugaugucacucuucauaccaagugaaucua

SEQ ID NO: 540044 - RNA, 64 nt, hsa
aguuaaacaaggguaccacaauaucauuuauaauugaugucaauauuaguaguccacuuuaugc

SEQ ID NO: 540045 - RNA, 64 nt, hsa
aacauuuuuggugagugcugcuuuuauaaauaugugaugucacauauuucagugacagcugaug

SEQ ID NO: 540046 - RNA, 64 nt, hsa
ugccuuuacaugccagaggcugaugcugcacuguugaugucaugugaggaaauaaugcacaugc

SEQ ID NO: 540047 - RNA, 64 nt, hsa
uccuuaucugugugagguuuacaaauaaagcuucugaugucaaauguuuaaaucgugcccucag

SEQ ID NO: 540048 - RNA, 64 nt, hsa
uuuaaaauaaaucuuccuugagagccuugggaggugaugucaggguuauaaauggcacagugca

SEQ ID NO: 540049 - RNA, 64 nt, hsa; identical to SEQ ID NO: 223465

SEQ ID NO: 540050 - RNA, 64 nt, hsa; identical to SEQ ID NO: 223466

SEQ ID NO: 540051 - RNA, 64 nt, hsa; identical to SEQ ID NO: 223467

SEQ ID NO: 540052 - RNA, 64 nt, hsa; identical to SEQ ID NO: 223468

SEQ ID NO: 540053 - RNA, 64 nt, hsa; identical to SEQ ID NO: 223469

SEQ ID NO: 540054 - RNA, 64 nt, hsa; identical to SEQ ID NO: 223470

SEQ ID NO: 540055 - RNA, 64 nt, hsa; identical to SEQ ID NO: 223471

SEQ ID NO: 540056 - RNA, 64 nt, hsa; identical to SEQ ID NO: 223472

SEQ ID NO: 540057 - RNA, 64 nt, hsa; identical to SEQ ID NO: 223473

SEQ ID NO: 540058 - RNA, 64 nt, hsa; identical to SEQ ID NO: 223474

SEQ ID NO: 540059 - RNA, 64 nt, hsa; identical to SEQ ID NO: 223475

SEQ ID NO: 540060 - RNA, 64 nt, hsa; identical to SEQ ID NO: 223476

SEQ ID NO: 540061 - RNA, 64 nt, hsa; identical to SEQ ID NO: 223477

SEQ ID NO: 540062 - RNA, 64 nt, hsa; identical to SEQ ID NO: 223478

SEQ ID NO: 540063 - RNA, 64 nt, hsa; identical to SEQ ID NO: 223479

SEQ ID NO: 540064 - RNA, 64 nt, hsa; identical to SEQ ID NO: 223480

SEQ ID NO: 540065 - RNA, 64 nt, hsa; identical to SEQ ID NO: 223481

SEQ ID NO: 540066 - RNA, 64 nt, hsa; identical to SEQ ID NO: 223482

SEQ ID NO: 540067 - RNA, 64 nt, hsa; identical to SEQ ID NO: 223483

SEQ ID NO: 540068 - RNA, 64 nt, hsa; identical to SEQ ID NO: 223484

SEQ ID NO: 540069 - RNA, 64 nt, hsa; identical to SEQ ID NO: 223485

SEQ ID NO: 540070 - RNA, 64 nt, hsa; identical to SEQ ID NO: 223486

SEQ ID NO: 540071 - RNA, 64 nt, hsa; identical to SEQ ID NO: 223487

SEQ ID NO: 540072 - RNA, 64 nt, hsa; identical to SEQ ID NO: 223488

SEQ ID NO: 540073 - RNA, 64 nt, hsa; identical to SEQ ID NO: 223489

SEQ ID NO: 540074 - RNA, 64 nt, hsa; identical to SEQ ID NO: 223490

SEQ ID NO: 540075 - RNA, 64 nt, hsa; identical to SEQ ID NO: 223491

SEQ ID NO: 540076 - RNA, 64 nt, hsa; identical to SEQ ID NO: 223492

SEQ ID NO: 540077 - RNA, 64 nt, hsa; identical to SEQ ID NO: 223493

SEQ ID NO: 540078 - RNA, 64 nt, hsa; identical to SEQ ID NO: 223494

SEQ ID NO: 540079 - RNA, 64 nt, hsa; identical to SEQ ID NO: 223495

SEQ ID NO: 540080 - RNA, 64 nt, hsa; identical to SEQ ID NO: 223496

SEQ ID NO: 540081 - RNA, 64 nt, hsa; identical to SEQ ID NO: 223497

SEQ ID NO: 540082 - RNA, 64 nt, hsa; identical to SEQ ID NO: 223498

SEQ ID NO: 540083 - RNA, 64 nt, hsa; identical to SEQ ID NO: 223499

SEQ ID NO: 540084 - RNA, 64 nt, hsa; identical to SEQ ID NO: 223500

SEQ ID NO: 540085 - RNA, 64 nt, hsa; identical to SEQ ID NO: 223501

SEQ ID NO: 540086 - RNA, 64 nt, hsa; identical to SEQ ID NO: 223502

SEQ ID NO: 540087 - RNA, 64 nt, hsa; identical to SEQ ID NO: 223503

SEQ ID NO: 540088 - RNA, 64 nt, hsa; identical to SEQ ID NO: 223504

SEQ ID NO: 540089 - RNA, 64 nt, hsa; identical to SEQ ID NO: 223505

SEQ ID NO: 540090 - RNA, 64 nt, hsa; identical to SEQ ID NO: 223506

SEQ ID NO: 540091 - RNA, 64 nt, hsa; identical to SEQ ID NO: 223507

SEQ ID NO: 540092 - RNA, 64 nt, hsa; identical to SEQ ID NO: 223508

SEQ ID NO: 540093 - RNA, 64 nt, hsa; identical to SEQ ID NO: 223509

SEQ ID NO: 540094 - RNA, 64 nt, hsa; identical to SEQ ID NO: 223510

SEQ ID NO: 540095 - RNA, 64 nt, hsa; identical to SEQ ID NO: 223511

SEQ ID NO: 540096 - RNA, 64 nt, hsa; identical to SEQ ID NO: 223512

SEQ ID NO: 540097 - RNA, 64 nt, hsa; identical to SEQ ID NO: 223513

SEQ ID NO: 540098 - RNA, 64 nt, hsa; identical to SEQ ID NO: 223514

SEQ ID NO: 540099 - RNA, 64 nt, hsa; identical to SEQ ID NO: 223515

SEQ ID NO: 540100 - RNA, 64 nt, hsa; identical to SEQ ID NO: 223516

SEQ ID NO: 540101 - RNA, 64 nt, hsa; identical to SEQ ID NO: 223517

SEQ ID NO: 540102 - RNA, 64 nt, hsa; identical to SEQ ID NO: 223518

SEQ ID NO: 540103 - RNA, 64 nt, hsa; identical to SEQ ID NO: 223519

SEQ ID NO: 540104 - RNA, 64 nt, hsa; identical to SEQ ID NO: 223520

SEQ ID NO: 540105 - RNA, 64 nt, hsa; identical to SEQ ID NO: 223521

SEQ ID NO: 540106 - RNA, 64 nt, hsa; identical to SEQ ID NO: 223522

SEQ ID NO: 540107 - RNA, 64 nt, hsa; identical to SEQ ID NO: 223523

SEQ ID NO: 540108 - RNA, 64 nt, hsa; identical to SEQ ID NO: 223524

SEQ ID NO: 540109 - RNA, 64 nt, hsa; identical to SEQ ID NO: 223525

SEQ ID NO: 540110 - RNA, 64 nt, hsa; identical to SEQ ID NO: 223526

SEQ ID NO: 540111 - RNA, 64 nt, hsa; identical to SEQ ID NO: 223527

SEQ ID NO: 540112 - RNA, 64 nt, hsa; identical to SEQ ID NO: 223528

SEQ ID NO: 540113 - RNA, 64 nt, hsa; identical to SEQ ID NO: 223529

SEQ ID NO: 540114 - RNA, 64 nt, hsa; identical to SEQ ID NO: 223530

SEQ ID NO: 540115 - RNA, 64 nt, hsa; identical to SEQ ID NO: 223531

SEQ ID NO: 540116 - RNA, 64 nt, hsa; identical to SEQ ID NO: 223532

SEQ ID NO: 540117 - RNA, 64 nt, hsa; identical to SEQ ID NO: 223533

SEQ ID NO: 540118 - RNA, 64 nt, hsa; identical to SEQ ID NO: 223534

SEQ ID NO: 540119 - RNA, 64 nt, hsa; identical to SEQ ID NO: 223535

SEQ ID NO: 540120 - RNA, 64 nt, hsa; identical to SEQ ID NO: 223536

SEQ ID NO: 540121 - RNA, 64 nt, hsa; identical to SEQ ID NO: 223537

SEQ ID NO: 540122 - RNA, 64 nt, hsa; identical to SEQ ID NO: 223538

SEQ ID NO: 540123 - RNA, 64 nt, hsa; identical to SEQ ID NO: 223539

SEQ ID NO: 540124 - RNA, 64 nt, hsa; identical to SEQ ID NO: 223540

SEQ ID NO: 540125 - RNA, 64 nt, hsa; identical to SEQ ID NO: 223541

SEQ ID NO: 540126 - RNA, 64 nt, hsa; identical to SEQ ID NO: 223542

SEQ ID NO: 540127 - RNA, 64 nt, hsa; identical to SEQ ID NO: 223543

SEQ ID NO: 540128 - RNA, 64 nt, hsa; identical to SEQ ID NO: 223544

SEQ ID NO: 540129 - RNA, 64 nt, hsa; identical to SEQ ID NO: 223545

SEQ ID NO: 540130 - RNA, 64 nt, hsa; identical to SEQ ID NO: 223546

SEQ ID NO: 540131 - RNA, 64 nt, hsa; identical to SEQ ID NO: 223547

SEQ ID NO: 540132 - RNA, 64 nt, hsa; identical to SEQ ID NO: 223548

SEQ ID NO: 540133 - RNA, 64 nt, hsa; identical to SEQ ID NO: 223549

SEQ ID NO: 540134 - RNA, 64 nt, hsa; identical to SEQ ID NO: 223550

SEQ ID NO: 540135 - RNA, 64 nt, hsa; identical to SEQ ID NO: 223551

SEQ ID NO: 540136 - RNA, 64 nt, hsa; identical to SEQ ID NO: 223552

SEQ ID NO: 540137 - RNA, 64 nt, hsa; identical to SEQ ID NO: 223553

SEQ ID NO: 540138 - RNA, 64 nt, hsa; identical to SEQ ID NO: 223554

SEQ ID NO: 540139 - RNA, 64 nt, hsa; identical to SEQ ID NO: 223555

SEQ ID NO: 540140 - RNA, 64 nt, hsa; identical to SEQ ID NO: 223556

SEQ ID NO: 540141 - RNA, 64 nt, hsa; identical to SEQ ID NO: 223557

SEQ ID NO: 540142 - RNA, 64 nt, hsa; identical to SEQ ID NO: 223558

SEQ ID NO: 540143 - RNA, 64 nt, hsa; identical to SEQ ID NO: 223559

SEQ ID NO: 540144 - RNA, 64 nt, hsa; identical to SEQ ID NO: 223560

SEQ ID NO: 540145 - RNA, 64 nt, hsa; identical to SEQ ID NO: 223561

SEQ ID NO: 540146 - RNA, 64 nt, hsa; identical to SEQ ID NO: 223562

SEQ ID NO: 540147 - RNA, 64 nt, hsa; identical to SEQ ID NO: 223563

SEQ ID NO: 540148 - RNA, 64 nt, hsa; identical to SEQ ID NO: 223564

SEQ ID NO: 540149 - RNA, 64 nt, hsa; identical to SEQ ID NO: 223565

SEQ ID NO: 540150 - RNA, 64 nt, hsa; identical to SEQ ID NO: 223566

SEQ ID NO: 540151 - RNA, 64 nt, hsa; identical to SEQ ID NO: 223567

SEQ ID NO: 540152 - RNA, 64 nt, hsa; identical to SEQ ID NO: 223568

SEQ ID NO: 540153 - RNA, 64 nt, hsa; identical to SEQ ID NO: 223569

SEQ ID NO: 540154 - RNA, 64 nt, hsa; identical to SEQ ID NO: 223570

SEQ ID NO: 540155 - RNA, 64 nt, hsa; identical to SEQ ID NO: 223571

SEQ ID NO: 540156 - RNA, 64 nt, hsa; identical to SEQ ID NO: 95526

SEQ ID NO: 540157 - RNA, 64 nt, hsa; identical to SEQ ID NO: 95527

SEQ ID NO: 540158 - RNA, 64 nt, hsa; identical to SEQ ID NO: 95528

SEQ ID NO: 540159 - RNA, 64 nt, hsa; identical to SEQ ID NO: 95529

SEQ ID NO: 540160 - RNA, 64 nt, hsa; identical to SEQ ID NO: 95530

SEQ ID NO: 540161 - RNA, 64 nt, hsa; identical to SEQ ID NO: 95531

SEQ ID NO: 540162 - RNA, 64 nt, hsa; identical to SEQ ID NO: 95532

SEQ ID NO: 540163 - RNA, 64 nt, hsa; identical to SEQ ID NO: 95533

SEQ ID NO: 540164 - RNA, 64 nt, hsa; identical to SEQ ID NO: 95534

SEQ ID NO: 540165 - RNA, 64 nt, hsa; identical to SEQ ID NO: 95535

SEQ ID NO: 540166 - RNA, 64 nt, hsa; identical to SEQ ID NO: 95536

SEQ ID NO: 540167 - RNA, 64 nt, hsa; identical to SEQ ID NO: 95537

SEQ ID NO: 540168 - RNA, 64 nt, hsa; identical to SEQ ID NO: 95538

SEQ ID NO: 540169 - RNA, 64 nt, hsa; identical to SEQ ID NO: 95539

SEQ ID NO: 540170 - RNA, 64 nt, hsa; identical to SEQ ID NO: 95540

SEQ ID NO: 540171 - RNA, 64 nt, hsa; identical to SEQ ID NO: 95541

SEQ ID NO: 540172 - RNA, 64 nt, hsa; identical to SEQ ID NO: 95542

SEQ ID NO: 540173 - RNA, 64 nt, hsa; identical to SEQ ID NO: 95543

SEQ ID NO: 540174 - RNA, 64 nt, hsa; identical to SEQ ID NO: 95544

SEQ ID NO: 540175 - RNA, 64 nt, hsa; identical to SEQ ID NO: 95545

SEQ ID NO: 540176 - RNA, 50 nt, hsa; identical to SEQ ID NO: 95546

SEQ ID NO: 540177 - RNA, 64 nt, hsa; identical to SEQ ID NO: 95547

SEQ ID NO: 540178 - RNA, 64 nt, hsa; identical to SEQ ID NO: 95548

SEQ ID NO: 540179 - RNA, 64 nt, hsa; identical to SEQ ID NO: 95549

SEQ ID NO: 540180 - RNA, 64 nt, hsa; identical to SEQ ID NO: 95550

SEQ ID NO: 540181 - RNA, 64 nt, hsa; identical to SEQ ID NO: 95551

SEQ ID NO: 540182 - RNA, 64 nt, hsa; identical to SEQ ID NO: 95552

SEQ ID NO: 540183 - RNA, 64 nt, hsa; identical to SEQ ID NO: 95553

SEQ ID NO: 540184 - RNA, 64 nt, hsa; identical to SEQ ID NO: 95554

SEQ ID NO: 540185 - RNA, 64 nt, hsa; identical to SEQ ID NO: 95555

SEQ ID NO: 540186 - RNA, 64 nt, hsa; identical to SEQ ID NO: 95556

SEQ ID NO: 540187 - RNA, 64 nt, hsa; identical to SEQ ID NO: 95557

SEQ ID NO: 540188 - RNA, 64 nt, hsa; identical to SEQ ID NO: 95558

SEQ ID NO: 540189 - RNA, 64 nt, hsa; identical to SEQ ID NO: 95559

SEQ ID NO: 540190 - RNA, 64 nt, hsa; identical to SEQ ID NO: 95560

SEQ ID NO: 540191 - RNA, 64 nt, hsa; identical to SEQ ID NO: 95561

SEQ ID NO: 540192 - RNA, 64 nt, hsa; identical to SEQ ID NO: 95562

SEQ ID NO: 540193 - RNA, 64 nt, hsa; identical to SEQ ID NO: 95563

SEQ ID NO: 540194 - RNA, 64 nt, hsa; identical to SEQ ID NO: 95564

SEQ ID NO: 540195 - RNA, 64 nt, hsa; identical to SEQ ID NO: 95565

SEQ ID NO: 540196 - RNA, 64 nt, hsa; identical to SEQ ID NO: 95566

SEQ ID NO: 540197 - RNA, 64 nt, hsa; identical to SEQ ID NO: 95567

SEQ ID NO: 540198 - RNA, 64 nt, hsa; identical to SEQ ID NO: 95568

SEQ ID NO: 540199 - RNA, 64 nt, hsa; identical to SEQ ID NO: 95569

SEQ ID NO: 540200 - RNA, 64 nt, hsa; identical to SEQ ID NO: 95570

SEQ ID NO: 540201 - RNA, 64 nt, hsa; identical to SEQ ID NO: 95571

SEQ ID NO: 540202 - RNA, 64 nt, hsa; identical to SEQ ID NO: 95572

SEQ ID NO: 540203 - RNA, 64 nt, hsa; identical to SEQ ID NO: 95573

SEQ ID NO: 540204 - RNA, 64 nt, hsa; identical to SEQ ID NO: 95574

SEQ ID NO: 540205 - RNA, 64 nt, hsa; identical to SEQ ID NO: 95575

SEQ ID NO: 540206 - RNA, 64 nt, hsa; identical to SEQ ID NO: 95576

SEQ ID NO: 540207 - RNA, 64 nt, hsa; identical to SEQ ID NO: 95577

SEQ ID NO: 540208 - RNA, 64 nt, hsa; identical to SEQ ID NO: 95578

SEQ ID NO: 540209 - RNA, 64 nt, hsa; identical to SEQ ID NO: 95579

SEQ ID NO: 540210 - RNA, 64 nt, hsa; identical to SEQ ID NO: 95580

SEQ ID NO: 540211 - RNA, 64 nt, hsa; identical to SEQ ID NO: 95581

SEQ ID NO: 540212 - RNA, 64 nt, hsa; identical to SEQ ID NO: 95582

SEQ ID NO: 540213 - RNA, 64 nt, hsa; identical to SEQ ID NO: 95583

SEQ ID NO: 540214 - RNA, 64 nt, hsa; identical to SEQ ID NO: 95584

SEQ ID NO: 540215 - RNA, 64 nt, hsa; identical to SEQ ID NO: 95585

SEQ ID NO: 540216 - RNA, 64 nt, hsa; identical to SEQ ID NO: 95586

SEQ ID NO: 540217 - RNA, 64 nt, hsa; identical to SEQ ID NO: 95587

SEQ ID NO: 540218 - RNA, 64 nt, hsa; identical to SEQ ID NO: 95588

SEQ ID NO: 540219 - RNA, 64 nt, hsa; identical to SEQ ID NO: 95589

SEQ ID NO: 540220 - RNA, 64 nt, hsa; identical to SEQ ID NO: 95590

SEQ ID NO: 540221 - RNA, 64 nt, hsa; identical to SEQ ID NO: 95591

SEQ ID NO: 540222 - RNA, 64 nt, hsa; identical to SEQ ID NO: 95592

SEQ ID NO: 540223 - RNA, 64 nt, hsa; identical to SEQ ID NO: 95593

SEQ ID NO: 540224 - RNA, 64 nt, hsa; identical to SEQ ID NO: 95594

SEQ ID NO: 540225 - RNA, 64 nt, hsa; identical to SEQ ID NO: 95595

SEQ ID NO: 540226 - RNA, 64 nt, hsa; identical to SEQ ID NO: 84377

SEQ ID NO: 540227 - RNA, 64 nt, hsa; identical to SEQ ID NO: 84378

SEQ ID NO: 540228 - RNA, 64 nt, hsa; identical to SEQ ID NO: 84379

SEQ ID NO: 540229 - RNA, 64 nt, hsa; identical to SEQ ID NO: 84380

SEQ ID NO: 540230 - RNA, 64 nt, hsa; identical to SEQ ID NO: 84381

SEQ ID NO: 540231 - RNA, 64 nt, hsa; identical to SEQ ID NO: 84382

SEQ ID NO: 540232 - RNA, 64 nt, hsa; identical to SEQ ID NO: 84383

SEQ ID NO: 540233 - RNA, 64 nt, hsa; identical to SEQ ID NO: 84384

SEQ ID NO: 540234 - RNA, 64 nt, hsa; identical to SEQ ID NO: 84385

SEQ ID NO: 540235 - RNA, 64 nt, hsa; identical to SEQ ID NO: 84386

SEQ ID NO: 540236 - RNA, 64 nt, hsa; identical to SEQ ID NO: 84387

SEQ ID NO: 540237 - RNA, 64 nt, hsa; identical to SEQ ID NO: 84388

SEQ ID NO: 540238 - RNA, 64 nt, hsa; identical to SEQ ID NO: 84389

SEQ ID NO: 540239 - RNA, 64 nt, hsa; identical to SEQ ID NO: 84390

SEQ ID NO: 540240 - RNA, 64 nt, hsa; identical to SEQ ID NO: 84391

SEQ ID NO: 540241 - RNA, 64 nt, hsa; identical to SEQ ID NO: 84392

SEQ ID NO: 540242 - RNA, 64 nt, hsa; identical to SEQ ID NO: 84393

SEQ ID NO: 540243 - RNA, 64 nt, hsa; identical to SEQ ID NO: 84394

SEQ ID NO: 540244 - RNA, 64 nt, hsa; identical to SEQ ID NO: 84395

SEQ ID NO: 540245 - RNA, 64 nt, hsa; identical to SEQ ID NO: 84396

SEQ ID NO: 540246 - RNA, 64 nt, hsa; identical to SEQ ID NO: 84397

SEQ ID NO: 540247 - RNA, 64 nt, hsa; identical to SEQ ID NO: 84398

SEQ ID NO: 540248 - RNA, 64 nt, hsa; identical to SEQ ID NO: 84399

SEQ ID NO: 540249 - RNA, 64 nt, hsa; identical to SEQ ID NO: 84400

SEQ ID NO: 540250 - RNA, 64 nt, hsa; identical to SEQ ID NO: 84401

SEQ ID NO: 540251 - RNA, 64 nt, hsa; identical to SEQ ID NO: 84402

SEQ ID NO: 540252 - RNA, 64 nt, hsa; identical to SEQ ID NO: 84403

SEQ ID NO: 540253 - RNA, 64 nt, hsa; identical to SEQ ID NO: 84404

SEQ ID NO: 540254 - RNA, 64 nt, hsa; identical to SEQ ID NO: 84405

SEQ ID NO: 540255 - RNA, 64 nt, hsa; identical to SEQ ID NO: 84406

SEQ ID NO: 540256 - RNA, 64 nt, hsa; identical to SEQ ID NO: 84407

SEQ ID NO: 540257 - RNA, 64 nt, hsa; identical to SEQ ID NO: 84408

SEQ ID NO: 540258 - RNA, 64 nt, hsa; identical to SEQ ID NO: 84409

SEQ ID NO: 540259 - RNA, 64 nt, hsa; identical to SEQ ID NO: 84410

SEQ ID NO: 540260 - RNA, 64 nt, hsa; identical to SEQ ID NO: 84411

SEQ ID NO: 540261 - RNA, 64 nt, hsa; identical to SEQ ID NO: 84412

SEQ ID NO: 540262 - RNA, 64 nt, hsa; identical to SEQ ID NO: 84413

SEQ ID NO: 540263 - RNA, 64 nt, hsa; identical to SEQ ID NO: 84414

SEQ ID NO: 540264 - RNA, 64 nt, hsa; identical to SEQ ID NO: 84415

SEQ ID NO: 540265 - RNA, 64 nt, hsa; identical to SEQ ID NO: 84416

SEQ ID NO: 540266 - RNA, 64 nt, hsa; identical to SEQ ID NO: 84417

SEQ ID NO: 540267 - RNA, 64 nt, hsa; identical to SEQ ID NO: 84418

SEQ ID NO: 540268 - RNA, 64 nt, hsa; identical to SEQ ID NO: 84419

SEQ ID NO: 540269 - RNA, 64 nt, hsa; identical to SEQ ID NO: 84420

SEQ ID NO: 540270 - RNA, 64 nt, hsa; identical to SEQ ID NO: 349054

SEQ ID NO: 540271 - RNA, 64 nt, hsa; identical to SEQ ID NO: 349055

SEQ ID NO: 540272 - RNA, 64 nt, hsa; identical to SEQ ID NO: 349056

SEQ ID NO: 540273 - RNA, 64 nt, hsa; identical to SEQ ID NO: 349057

SEQ ID NO: 540274 - RNA, 64 nt, hsa; identical to SEQ ID NO: 349058

SEQ ID NO: 540275 - RNA, 64 nt, hsa; identical to SEQ ID NO: 349059

SEQ ID NO: 540276 - RNA, 64 nt, hsa; identical to SEQ ID NO: 349060

SEQ ID NO: 540277 - RNA, 64 nt, hsa; identical to SEQ ID NO: 349061

SEQ ID NO: 540278 - RNA, 64 nt, hsa; identical to SEQ ID NO: 349062

SEQ ID NO: 540279 - RNA, 64 nt, hsa; identical to SEQ ID NO: 349063

SEQ ID NO: 540280 - RNA, 64 nt, hsa; identical to SEQ ID NO: 349064

SEQ ID NO: 540281 - RNA, 64 nt, hsa; identical to SEQ ID NO: 349065

SEQ ID NO: 540282 - RNA, 64 nt, hsa; identical to SEQ ID NO: 349066

SEQ ID NO: 540283 - RNA, 64 nt, hsa; identical to SEQ ID NO: 349067

SEQ ID NO: 540284 - RNA, 64 nt, hsa; identical to SEQ ID NO: 349068

SEQ ID NO: 540285 - RNA, 64 nt, hsa; identical to SEQ ID NO: 349069

SEQ ID NO: 540286 - RNA, 65 nt, hsa
ugccauuuucuuuugcaauuguaguuuuauguacuguuaaagaauuguauugaauucuuuuuaga

SEQ ID NO: 540287 - RNA, 65 nt, hsa
uuucauuuucuuuugcaauuuuaguuuuauguacuguuaaagaauuguacugaauucuuuuuaga

SEQ ID NO: 540288 - RNA, 65 nt, hsa
gaauuagauaacuaauuggaggcauuuuauuuuaaguuaaagacagauuucuuuaauaaguuuuu

SEQ ID NO: 540289 - RNA, 65 nt, hsa
uuuuuucuagaaacugggggcagccucaaaaucauguuaaagagggaguuuuguuagaggcaucu

SEQ ID NO: 540290 - RNA, 65 nt, hsa
guuucacacaccacuuaauggggaaauaguuaauuguuaaagaaaacuucuuguagccucacauu

SEQ ID NO: 540291 - RNA, 65 nt, hsa
gccugcaucacaauugagguaauguagagcaacauguuaaagaaugaugguuagcagaagcuguu

SEQ ID NO: 540292 - RNA, 65 nt, hsa
agucaaucagugacuagcuuccuguagccaaucagguuaaagagugcguugguaacuuugcucug

SEQ ID NO: 540293 - RNA, 65 nt, hsa
ugucugcaauguuaucauucaugaacuguuaaaguguuaaagauuaggauugaagucacugacca

SEQ ID NO: 540294 - RNA, 65 nt, hsa
aucuguaacacuggcacugaaauaaagaccacacgguuaaagaaaucuuuccauauuguacuuua

SEQ ID NO: 540295 - RNA, 65 nt, hsa
gauuuuccuaaaguuacugcugaccuugaagcauuguuaaagacuaauguccucuccuccacugu

SEQ ID NO: 540296 - RNA, 65 nt, hsa; identical to SEQ ID NO: 65698

SEQ ID NO: 540297 - RNA, 65 nt, hsa; identical to SEQ ID NO: 65699

SEQ ID NO: 540298 - RNA, 65 nt, hsa; identical to SEQ ID NO: 65706

SEQ ID NO: 540299 - RNA, 65 nt, hsa; identical to SEQ ID NO: 65707

SEQ ID NO: 540300 - RNA, 65 nt, hsa; identical to SEQ ID NO: 65720

SEQ ID NO: 540301 - RNA, 65 nt, hsa; identical to SEQ ID NO: 65721

SEQ ID NO: 540302 - RNA, 65 nt, hsa; identical to SEQ ID NO: 65744

SEQ ID NO: 540303 - RNA, 65 nt, hsa; identical to SEQ ID NO: 65745

SEQ ID NO: 540304 - RNA, 65 nt, hsa; identical to SEQ ID NO: 65788

SEQ ID NO: 540305 - RNA, 65 nt, hsa; identical to SEQ ID NO: 65789

SEQ ID NO: 540306 - RNA, 65 nt, hsa; identical to SEQ ID NO: 65808

SEQ ID NO: 540307 - RNA, 65 nt, hsa; identical to SEQ ID NO: 65809

SEQ ID NO: 540308 - RNA, 65 nt, hsa; identical to SEQ ID NO: 65810

SEQ ID NO: 540309 - RNA, 65 nt, hsa; identical to SEQ ID NO: 65811

SEQ ID NO: 540310 - RNA, 65 nt, hsa; identical to SEQ ID NO: 65827

SEQ ID NO: 540311 - RNA, 65 nt, hsa; identical to SEQ ID NO: 65828

SEQ ID NO: 540312 - RNA, 65 nt, hsa; identical to SEQ ID NO: 65831

SEQ ID NO: 540313 - RNA, 56 nt, hsa; identical to SEQ ID NO: 61369

SEQ ID NO: 540314 - RNA, 65 nt, hsa; identical to SEQ ID NO: 65853

SEQ ID NO: 540315 - RNA, 65 nt, hsa; identical to SEQ ID NO: 65854

SEQ ID NO: 540316 - RNA, 65 nt, hsa; identical to SEQ ID NO: 65891

SEQ ID NO: 540317 - RNA, 65 nt, hsa; identical to SEQ ID NO: 65892

SEQ ID NO: 540318 - RNA, 65 nt, hsa; identical to SEQ ID NO: 65896

SEQ ID NO: 540319 - RNA, 65 nt, hsa; identical to SEQ ID NO: 65897

SEQ ID NO: 540320 - RNA, 64 nt, hsa
aguuccccuggccuaaaugauuacuugcucugggcaaguggauauuuauuaggcuauuucaaag

SEQ ID NO: 540321 - RNA, 64 nt, hsa
cacaucaccugaaaaguaaaacaacaggcuuugccaaguggaugcuuuucaguaacagugaagu

SEQ ID NO: 540322 - RNA, 64 nt, hsa
gccaacgccaacuggcaaccucuuuacucuuagucaaguggaaugugcaugcuggcaucugaau

SEQ ID NO: 540323 - RNA, 64 nt, hsa
agguauguacugccugaggucacaugacagugaccaaguggagacaguaaguuagaucccuccc

SEQ ID NO: 540324 - RNA, 64 nt, hsa
auucuccugcaaguuggaagcacaauuuuccccccaaguggaggaaaaggaaagggccccagcc

SEQ ID NO: 540325 - RNA, 64 nt, hsa
gcagggcgggagggagauaagaagaccccgcagucaaguggagcauggcccucccuggcucccu

SEQ ID NO: 540326 - RNA, 64 nt, hsa
gugggggauucuguaucuggauuccguaucacuccaaguggaggcuggcagguuuuucugcaag

SEQ ID NO: 540327 - RNA, 64 nt, hsa
uauccaucuauagugguagagacccaccagggcucaaguggaguccaucauccucccacggggg

SEQ ID NO: 540328 - RNA, 64 nt, hsa
agccuuccaugaccuccccuccccagcccaaugccaaguggacuuggagcugcacaaagucagc

SEQ ID NO: 540329 - RNA, 64 nt, hsa
cccuuuuccuuucuggccccagccuagguggaggcaaguggaauaucuuauauugggcgauuug

SEQ ID NO: 540330 - RNA, 62 nt, hsa
ugacuuguagcuuccucugguuuucaaguaaacucaacaagguggagucuuaccugguuuuc

SEQ ID NO: 540331 - RNA, 62 nt, hsa
cauauugucaugucaguucuugccaggaacuucucaacaaaauggaauuuuuuuuuucagua

SEQ ID NO: 540332 - RNA, 62 nt, hsa
auuaucugaaaugaagaauaaacugaugcuaucucaacaauaacuguuacuuuuauuuuaua

SEQ ID NO: 540333 - RNA, 62 nt, hsa
ucauaacuuccuaaaacauggaagguuuuccccucaacaauuuugaagcugugaaauuaagu

SEQ ID NO: 540334 - RNA, 62 nt, hsa
ccucgaagcucgguacugucacaguggagccucucaacaacgcugugaggcagcaccauuug

SEQ ID NO: 540335 - RNA, 62 nt, hsa
accacaguaguauuagcagugccugggaccuccucaacaacagaaauugccgguauuuauag

SEQ ID NO: 540336 - RNA, 62 nt, hsa
ucaguaacagggccuugcuaaucggguugucacucaacaaaagugcuuuggauuuaaguuac

SEQ ID NO: 540337 - RNA, 62 nt, hsa
cucugcuucagcuugcuucauugggcuguuuucucaacaaauggaaugccauuugcacuuac

SEQ ID NO: 540338 - RNA, 62 nt, hsa
auaaaauucaacaucccuucauuuuaaaaacccucaacaaauuacacauugagggaacauac

SEQ ID NO: 540339 - RNA, 62 nt, hsa
aaauaaaggcauauaccuacaaccaugugauccucaacaaaacugacaagcaaugaaguaag

SEQ ID NO: 540340 - RNA, 62 nt, hsa
uggcacauucuuaaauauuuccaucagcccaucucaacaauauauguccuauaaauggacca

SEQ ID NO: 540341 - RNA, 62 nt, hsa
gcagucucccagauguugcaucccugaaacaucucaacaaccugaaugucccaacccagaca

SEQ ID NO: 540342 - RNA, 62 nt, hsa
ccugugcgagacccccuguccugugcugcucacucaacaacaucuuuguguugcuuucacca

SEQ ID NO: 540343 - RNA, 62 nt, hsa
caaggaucagaaguauggaauuuucugccaggcucaacaagggucucauaucuaacuuccuc

SEQ ID NO: 540344 - RNA, 64 nt, hsa; identical to SEQ ID NO: 48305

SEQ ID NO: 540345 - RNA, 64 nt, hsa; identical to SEQ ID NO: 48306

SEQ ID NO: 540346 - RNA, 64 nt, hsa; identical to SEQ ID NO: 48307

SEQ ID NO: 540347 - RNA, 64 nt, hsa; identical to SEQ ID NO: 48308

SEQ ID NO: 540348 - RNA, 64 nt, hsa; identical to SEQ ID NO: 48309

SEQ ID NO: 540349 - RNA, 64 nt, hsa; identical to SEQ ID NO: 48310

SEQ ID NO: 540350 - RNA, 64 nt, hsa; identical to SEQ ID NO: 48311

SEQ ID NO: 540351 - RNA, 64 nt, hsa; identical to SEQ ID NO: 48312

SEQ ID NO: 540352 - RNA, 64 nt, hsa; identical to SEQ ID NO: 48313

SEQ ID NO: 540353 - RNA, 64 nt, hsa; identical to SEQ ID NO: 48314

SEQ ID NO: 540354 - RNA, 64 nt, hsa; identical to SEQ ID NO: 48315

SEQ ID NO: 540355 - RNA, 64 nt, hsa; identical to SEQ ID NO: 48316

SEQ ID NO: 540356 - RNA, 64 nt, hsa; identical to SEQ ID NO: 48317

SEQ ID NO: 540357 - RNA, 64 nt, hsa; identical to SEQ ID NO: 48318

SEQ ID NO: 540358 - RNA, 64 nt, hsa; identical to SEQ ID NO: 48319

SEQ ID NO: 540359 - RNA, 64 nt, hsa; identical to SEQ ID NO: 48320

SEQ ID NO: 540360 - RNA, 64 nt, hsa; identical to SEQ ID NO: 48321

SEQ ID NO: 540361 - RNA, 64 nt, hsa; identical to SEQ ID NO: 48322

SEQ ID NO: 540362 - RNA, 64 nt, hsa; identical to SEQ ID NO: 48323

SEQ ID NO: 540363 - RNA, 64 nt, hsa; identical to SEQ ID NO: 48324

SEQ ID NO: 540364 - RNA, 64 nt, hsa; identical to SEQ ID NO: 48325

SEQ ID NO: 540365 - RNA, 64 nt, hsa; identical to SEQ ID NO: 48326

SEQ ID NO: 540366 - RNA, 64 nt, hsa; identical to SEQ ID NO: 48327

SEQ ID NO: 540367 - RNA, 64 nt, hsa; identical to SEQ ID NO: 48328

SEQ ID NO: 540368 - RNA, 64 nt, hsa; identical to SEQ ID NO: 48329

SEQ ID NO: 540369 - RNA, 51 nt, hsa; identical to SEQ ID NO: 48330

SEQ ID NO: 540370 - RNA, 64 nt, hsa; identical to SEQ ID NO: 48331

SEQ ID NO: 540371 - RNA, 64 nt, hsa; identical to SEQ ID NO: 48332

SEQ ID NO: 540372 - RNA, 64 nt, hsa; identical to SEQ ID NO: 48333

SEQ ID NO: 540373 - RNA, 64 nt, hsa; identical to SEQ ID NO: 48334

SEQ ID NO: 540374 - RNA, 64 nt, hsa; identical to SEQ ID NO: 48335

SEQ ID NO: 540375 - RNA, 64 nt, hsa; identical to SEQ ID NO: 48336

SEQ ID NO: 540376 - RNA, 64 nt, hsa; identical to SEQ ID NO: 48337

SEQ ID NO: 540377 - RNA, 64 nt, hsa; identical to SEQ ID NO: 48338

SEQ ID NO: 540378 - RNA, 64 nt, hsa; identical to SEQ ID NO: 48339

SEQ ID NO: 540379 - RNA, 64 nt, hsa; identical to SEQ ID NO: 48340

SEQ ID NO: 540380 - RNA, 64 nt, hsa; identical to SEQ ID NO: 48341

SEQ ID NO: 540381 - RNA, 64 nt, hsa; identical to SEQ ID NO: 48342

SEQ ID NO: 540382 - RNA, 64 nt, hsa; identical to SEQ ID NO: 48343

SEQ ID NO: 540383 - RNA, 64 nt, hsa; identical to SEQ ID NO: 48344

SEQ ID NO: 540384 - RNA, 64 nt, hsa; identical to SEQ ID NO: 48345

SEQ ID NO: 540385 - RNA, 64 nt, hsa; identical to SEQ ID NO: 48346

SEQ ID NO: 540386 - RNA, 64 nt, hsa; identical to SEQ ID NO: 48347

SEQ ID NO: 540387 - RNA, 64 nt, hsa; identical to SEQ ID NO: 48348

SEQ ID NO: 540388 - RNA, 64 nt, hsa; identical to SEQ ID NO: 48349

SEQ ID NO: 540389 - RNA, 64 nt, hsa; identical to SEQ ID NO: 48350

SEQ ID NO: 540390 - RNA, 64 nt, hsa; identical to SEQ ID NO: 48351

SEQ ID NO: 540391 - RNA, 64 nt, hsa; identical to SEQ ID NO: 48352

SEQ ID NO: 540392 - RNA, 64 nt, hsa; identical to SEQ ID NO: 48353

SEQ ID NO: 540393 - RNA, 64 nt, hsa; identical to SEQ ID NO: 48354

SEQ ID NO: 540394 - RNA, 64 nt, hsa; identical to SEQ ID NO: 48355

SEQ ID NO: 540395 - RNA, 64 nt, hsa; identical to SEQ ID NO: 259113

SEQ ID NO: 540396 - RNA, 64 nt, hsa; identical to SEQ ID NO: 259114

SEQ ID NO: 540397 - RNA, 64 nt, hsa; identical to SEQ ID NO: 259115

SEQ ID NO: 540398 - RNA, 64 nt, hsa; identical to SEQ ID NO: 259116

SEQ ID NO: 540399 - RNA, 64 nt, hsa; identical to SEQ ID NO: 259117

SEQ ID NO: 540400 - RNA, 64 nt, hsa; identical to SEQ ID NO: 259118

SEQ ID NO: 540401 - RNA, 64 nt, hsa; identical to SEQ ID NO: 259119

SEQ ID NO: 540402 - RNA, 64 nt, hsa; identical to SEQ ID NO: 259120

SEQ ID NO: 540403 - RNA, 64 nt, hsa; identical to SEQ ID NO: 259121

SEQ ID NO: 540404 - RNA, 64 nt, hsa; identical to SEQ ID NO: 259122

SEQ ID NO: 540405 - RNA, 64 nt, hsa; identical to SEQ ID NO: 259123

SEQ ID NO: 540406 - RNA, 64 nt, hsa; identical to SEQ ID NO: 259124

SEQ ID NO: 540407 - RNA, 64 nt, hsa; identical to SEQ ID NO: 259125

SEQ ID NO: 540408 - RNA, 64 nt, hsa; identical to SEQ ID NO: 259126

SEQ ID NO: 540409 - RNA, 64 nt, hsa; identical to SEQ ID NO: 259127

SEQ ID NO: 540410 - RNA, 64 nt, hsa; identical to SEQ ID NO: 259128

SEQ ID NO: 540411 - RNA, 64 nt, hsa; identical to SEQ ID NO: 259129

SEQ ID NO: 540412 - RNA, 64 nt, hsa; identical to SEQ ID NO: 259130

SEQ ID NO: 540413 - RNA, 64 nt, hsa; identical to SEQ ID NO: 259131

SEQ ID NO: 540414 - RNA, 64 nt, hsa; identical to SEQ ID NO: 259132

SEQ ID NO: 540415 - RNA, 64 nt, hsa; identical to SEQ ID NO: 259133

SEQ ID NO: 540416 - RNA, 64 nt, hsa; identical to SEQ ID NO: 259134

SEQ ID NO: 540417 - RNA, 64 nt, hsa; identical to SEQ ID NO: 259135

SEQ ID NO: 540418 - RNA, 64 nt, hsa; identical to SEQ ID NO: 259136

SEQ ID NO: 540419 - RNA, 64 nt, hsa; identical to SEQ ID NO: 259137

SEQ ID NO: 540420 - RNA, 64 nt, hsa; identical to SEQ ID NO: 259138

SEQ ID NO: 540421 - RNA, 64 nt, hsa; identical to SEQ ID NO: 259139

SEQ ID NO: 540422 - RNA, 64 nt, hsa; identical to SEQ ID NO: 259140

SEQ ID NO: 540423 - RNA, 64 nt, hsa; identical to SEQ ID NO: 259141

SEQ ID NO: 540424 - RNA, 64 nt, hsa; identical to SEQ ID NO: 259142

SEQ ID NO: 540425 - RNA, 64 nt, hsa; identical to SEQ ID NO: 259143

SEQ ID NO: 540426 - RNA, 64 nt, hsa; identical to SEQ ID NO: 259144

SEQ ID NO: 540427 - RNA, 64 nt, hsa; identical to SEQ ID NO: 259145

SEQ ID NO: 540428 - RNA, 64 nt, hsa; identical to SEQ ID NO: 259146

SEQ ID NO: 540429 - RNA, 64 nt, hsa; identical to SEQ ID NO: 259147

SEQ ID NO: 540430 - RNA, 64 nt, hsa; identical to SEQ ID NO: 259148

SEQ ID NO: 540431 - RNA, 64 nt, hsa; identical to SEQ ID NO: 259149

SEQ ID NO: 540432 - RNA, 64 nt, hsa; identical to SEQ ID NO: 259150

SEQ ID NO: 540433 - RNA, 64 nt, hsa; identical to SEQ ID NO: 259151

SEQ ID NO: 540434 - RNA, 64 nt, hsa; identical to SEQ ID NO: 259152

SEQ ID NO: 540435 - RNA, 64 nt, hsa; identical to SEQ ID NO: 259153

SEQ ID NO: 540436 - RNA, 64 nt, hsa; identical to SEQ ID NO: 259154

SEQ ID NO: 540437 - RNA, 64 nt, hsa; identical to SEQ ID NO: 259155

SEQ ID NO: 540438 - RNA, 64 nt, hsa; identical to SEQ ID NO: 259156

SEQ ID NO: 540439 - RNA, 64 nt, hsa; identical to SEQ ID NO: 259157

SEQ ID NO: 540440 - RNA, 64 nt, hsa; identical to SEQ ID NO: 259158

SEQ ID NO: 540441 - RNA, 64 nt, hsa; identical to SEQ ID NO: 259159

SEQ ID NO: 540442 - RNA, 64 nt, hsa; identical to SEQ ID NO: 259160

SEQ ID NO: 540443 - RNA, 64 nt, hsa; identical to SEQ ID NO: 259161

SEQ ID NO: 540444 - RNA, 64 nt, hsa; identical to SEQ ID NO: 259162

SEQ ID NO: 540445 - RNA, 64 nt, hsa; identical to SEQ ID NO: 259163

SEQ ID NO: 540446 - RNA, 64 nt, hsa; identical to SEQ ID NO: 259164

SEQ ID NO: 540447 - RNA, 64 nt, hsa; identical to SEQ ID NO: 259165

SEQ ID NO: 540448 - RNA, 64 nt, hsa; identical to SEQ ID NO: 259166

SEQ ID NO: 540449 - RNA, 64 nt, hsa; identical to SEQ ID NO: 259167

SEQ ID NO: 540450 - RNA, 64 nt, hsa; identical to SEQ ID NO: 259168

SEQ ID NO: 540451 - RNA, 64 nt, hsa; identical to SEQ ID NO: 259169

SEQ ID NO: 540452 - RNA, 64 nt, hsa; identical to SEQ ID NO: 259170

SEQ ID NO: 540453 - RNA, 64 nt, hsa; identical to SEQ ID NO: 292819

SEQ ID NO: 540454 - RNA, 64 nt, hsa; identical to SEQ ID NO: 292820

SEQ ID NO: 540455 - RNA, 64 nt, hsa; identical to SEQ ID NO: 292821

SEQ ID NO: 540456 - RNA, 64 nt, hsa; identical to SEQ ID NO: 292822

SEQ ID NO: 540457 - RNA, 64 nt, hsa; identical to SEQ ID NO: 292823

SEQ ID NO: 540458 - RNA, 64 nt, hsa; identical to SEQ ID NO: 292824

SEQ ID NO: 540459 - RNA, 64 nt, hsa; identical to SEQ ID NO: 292825

SEQ ID NO: 540460 - RNA, 64 nt, hsa; identical to SEQ ID NO: 292826

SEQ ID NO: 540461 - RNA, 64 nt, hsa; identical to SEQ ID NO: 292827

SEQ ID NO: 540462 - RNA, 64 nt, hsa; identical to SEQ ID NO: 292828

SEQ ID NO: 540463 - RNA, 64 nt, hsa; identical to SEQ ID NO: 292829

SEQ ID NO: 540464 - RNA, 64 nt, hsa; identical to SEQ ID NO: 292830

SEQ ID NO: 540465 - RNA, 64 nt, hsa; identical to SEQ ID NO: 292831

SEQ ID NO: 540466 - RNA, 64 nt, hsa; identical to SEQ ID NO: 292832

SEQ ID NO: 540467 - RNA, 64 nt, hsa; identical to SEQ ID NO: 292833

SEQ ID NO: 540468 - RNA, 64 nt, hsa; identical to SEQ ID NO: 292834

SEQ ID NO: 540469 - RNA, 64 nt, hsa; identical to SEQ ID NO: 292835

SEQ ID NO: 540470 - RNA, 64 nt, hsa; identical to SEQ ID NO: 292836

SEQ ID NO: 540471 - RNA, 64 nt, hsa; identical to SEQ ID NO: 260283

SEQ ID NO: 540472 - RNA, 64 nt, hsa; identical to SEQ ID NO: 260284

SEQ ID NO: 540473 - RNA, 64 nt, hsa; identical to SEQ ID NO: 260285

SEQ ID NO: 540474 - RNA, 64 nt, hsa; identical to SEQ ID NO: 260286

SEQ ID NO: 540475 - RNA, 64 nt, hsa; identical to SEQ ID NO: 260287

SEQ ID NO: 540476 - RNA, 64 nt, hsa; identical to SEQ ID NO: 260288

SEQ ID NO: 540477 - RNA, 64 nt, hsa; identical to SEQ ID NO: 260289

SEQ ID NO: 540478 - RNA, 64 nt, hsa; identical to SEQ ID NO: 260290

SEQ ID NO: 540479 - RNA, 64 nt, hsa; identical to SEQ ID NO: 260291

SEQ ID NO: 540480 - RNA, 64 nt, hsa; identical to SEQ ID NO: 260292

SEQ ID NO: 540481 - RNA, 64 nt, hsa; identical to SEQ ID NO: 260293

SEQ ID NO: 540482 - RNA, 64 nt, hsa; identical to SEQ ID NO: 260294

SEQ ID NO: 540483 - RNA, 64 nt, hsa; identical to SEQ ID NO: 260295

SEQ ID NO: 540484 - RNA, 64 nt, hsa; identical to SEQ ID NO: 260296

SEQ ID NO: 540485 - RNA, 64 nt, hsa; identical to SEQ ID NO: 260297

SEQ ID NO: 540486 - RNA, 64 nt, hsa; identical to SEQ ID NO: 260298

SEQ ID NO: 540487 - RNA, 64 nt, hsa; identical to SEQ ID NO: 260299

SEQ ID NO: 540488 - RNA, 64 nt, hsa; identical to SEQ ID NO: 260300

SEQ ID NO: 540489 - RNA, 64 nt, hsa; identical to SEQ ID NO: 260301

SEQ ID NO: 540490 - RNA, 64 nt, hsa; identical to SEQ ID NO: 260302

SEQ ID NO: 540491 - RNA, 64 nt, hsa; identical to SEQ ID NO: 260303

SEQ ID NO: 540492 - RNA, 64 nt, hsa; identical to SEQ ID NO: 260304

SEQ ID NO: 540493 - RNA, 64 nt, hsa; identical to SEQ ID NO: 260305

SEQ ID NO: 540494 - RNA, 64 nt, hsa; identical to SEQ ID NO: 260306

SEQ ID NO: 540495 - RNA, 64 nt, hsa; identical to SEQ ID NO: 260307

SEQ ID NO: 540496 - RNA, 64 nt, hsa; identical to SEQ ID NO: 260308

SEQ ID NO: 540497 - RNA, 64 nt, hsa; identical to SEQ ID NO: 260309

SEQ ID NO: 540498 - RNA, 59 nt, hsa; identical to SEQ ID NO: 260310

SEQ ID NO: 540499 - RNA, 64 nt, hsa; identical to SEQ ID NO: 260311

SEQ ID NO: 540500 - RNA, 64 nt, hsa; identical to SEQ ID NO: 260312

SEQ ID NO: 540501 - RNA, 64 nt, hsa; identical to SEQ ID NO: 260313

SEQ ID NO: 540502 - RNA, 64 nt, hsa; identical to SEQ ID NO: 260314

SEQ ID NO: 540503 - RNA, 64 nt, hsa; identical to SEQ ID NO: 260315

SEQ ID NO: 540504 - RNA, 64 nt, hsa; identical to SEQ ID NO: 260316

SEQ ID NO: 540505 - RNA, 64 nt, hsa; identical to SEQ ID NO: 260317

SEQ ID NO: 540506 - RNA, 64 nt, hsa; identical to SEQ ID NO: 260318

SEQ ID NO: 540507 - RNA, 64 nt, hsa; identical to SEQ ID NO: 260319

SEQ ID NO: 540508 - RNA, 64 nt, hsa; identical to SEQ ID NO: 260320

SEQ ID NO: 540509 - RNA, 64 nt, hsa; identical to SEQ ID NO: 260321

SEQ ID NO: 540510 - RNA, 64 nt, hsa; identical to SEQ ID NO: 260322

SEQ ID NO: 540511 - RNA, 64 nt, hsa; identical to SEQ ID NO: 260323

SEQ ID NO: 540512 - RNA, 64 nt, hsa; identical to SEQ ID NO: 260324

SEQ ID NO: 540513 - RNA, 64 nt, hsa; identical to SEQ ID NO: 260325

SEQ ID NO: 540514 - RNA, 64 nt, hsa; identical to SEQ ID NO: 260326

SEQ ID NO: 540515 - RNA, 64 nt, hsa; identical to SEQ ID NO: 260327

SEQ ID NO: 540516 - RNA, 64 nt, hsa; identical to SEQ ID NO: 260328

SEQ ID NO: 540517 - RNA, 64 nt, hsa; identical to SEQ ID NO: 260329

SEQ ID NO: 540518 - RNA, 64 nt, hsa; identical to SEQ ID NO: 260330

SEQ ID NO: 540519 - RNA, 64 nt, hsa; identical to SEQ ID NO: 260331

SEQ ID NO: 540520 - RNA, 64 nt, hsa; identical to SEQ ID NO: 260332

SEQ ID NO: 540521 - RNA, 64 nt, hsa; identical to SEQ ID NO: 260333

SEQ ID NO: 540522 - RNA, 64 nt, hsa; identical to SEQ ID NO: 260334

SEQ ID NO: 540523 - RNA, 64 nt, hsa; identical to SEQ ID NO: 260335

SEQ ID NO: 540524 - RNA, 64 nt, hsa; identical to SEQ ID NO: 260336

SEQ ID NO: 540525 - RNA, 64 nt, hsa; identical to SEQ ID NO: 260337

SEQ ID NO: 540526 - RNA, 64 nt, hsa; identical to SEQ ID NO: 260338

SEQ ID NO: 540527 - RNA, 64 nt, hsa; identical to SEQ ID NO: 260339

SEQ ID NO: 540528 - RNA, 64 nt, hsa; identical to SEQ ID NO: 260340

SEQ ID NO: 540529 - RNA, 64 nt, hsa; identical to SEQ ID NO: 260341

SEQ ID NO: 540530 - RNA, 64 nt, hsa; identical to SEQ ID NO: 260342

SEQ ID NO: 540531 - RNA, 63 nt, hsa
gggugcccaagcucagaaggcucuucugacuacugggcaaagaguguagaucagagcagcagu

SEQ ID NO: 540532 - RNA, 63 nt, hsa
uaauccagaauaacuagcaccagggacuaugaaugggcaaaacugaauuauaagaggcugaua

SEQ ID NO: 540533 - RNA, 63 nt, hsa
ggaucacuugaggccaggaauuugaaaccagccugggcaaaacccugucucuacuaaaaauau

SEQ ID NO: 540534 - RNA, 63 nt, hsa
gcagaugggcacaggugcuggugaugccucuccugggcaaaacgccccauuuguggcacuuuc

SEQ ID NO: 540535 - RNA, 63 nt, hsa
ugccuguaaucccaguacuuugggaggcugaggugggcaaaucaccugaggucaggaguucca

SEQ ID NO: 540536 - RNA, 63 nt, hsa
aaaacaucggggaaucucuccaggacauuggagugggcaaagauuucuuguguaauaccugac

SEQ ID NO: 540537 - RNA, 63 nt, hsa
auaguuagauauacuuucucuuaggaaaaauaaugggcaaaaauuuuuguugcaacuuuucau

SEQ ID NO: 540538 - RNA, 63 nt, hsa
aaaguugcagauccacaaaacuaacaggauaauugggcaaauaaauuacauauaaacacacac

SEQ ID NO: 540539 - RNA, 63 nt, hsa
gucucucggcuccuuuaauguaggauugagagcugggcaaacaggucccacuggggacuguga

SEQ ID NO: 540540 - RNA, 63 nt, hsa
ccucugcccuagagcuguuuguucaaucacugaugggcaaaggggagauguagcuaacuggug

SEQ ID NO: 540541 - RNA, 63 nt, hsa
ugauugugaugcuauuuaucuucagggucacucugggcaaagagaagguccucagccaugccc

SEQ ID NO: 540542 - RNA, 63 nt, hsa
uaggaugaauggucccuacacaaagaggccuugugggcaaaccuggagaacccuccuaaaucc

SEQ ID NO: 540543 - RNA, 63 nt, hsa
caccucugcucgagagguccgugggggaggccgugggcaaaggugucccgagcugccauguuu

SEQ ID NO: 540544 - RNA, 63 nt, hsa
aaauugcuugaccucaggaauuugaggccugccugggcaaaauggugaaaccaugucucuaca

SEQ ID NO: 540545 - RNA, 63 nt, hsa
aguggcucacgccuguaaucccagcacuuagggugggcaaauugcuugaccucaggaauuuga

SEQ ID NO: 540546 - RNA, 64 nt, hsa; identical to SEQ ID NO: 92187

SEQ ID NO: 540547 - RNA, 64 nt, hsa; identical to SEQ ID NO: 92188

SEQ ID NO: 540548 - RNA, 64 nt, hsa; identical to SEQ ID NO: 92189

SEQ ID NO: 540549 - RNA, 64 nt, hsa; identical to SEQ ID NO: 92190

SEQ ID NO: 540550 - RNA, 64 nt, hsa; identical to SEQ ID NO: 92191

SEQ ID NO: 540551 - RNA, 64 nt, hsa; identical to SEQ ID NO: 92192

SEQ ID NO: 540552 - RNA, 64 nt, hsa; identical to SEQ ID NO: 92193

SEQ ID NO: 540553 - RNA, 64 nt, hsa; identical to SEQ ID NO: 92194

SEQ ID NO: 540554 - RNA, 64 nt, hsa; identical to SEQ ID NO: 92195

SEQ ID NO: 540555 - RNA, 64 nt, hsa; identical to SEQ ID NO: 92196

SEQ ID NO: 540556 - RNA, 64 nt, hsa; identical to SEQ ID NO: 92197

SEQ ID NO: 540557 - RNA, 64 nt, hsa; identical to SEQ ID NO: 92198

SEQ ID NO: 540558 - RNA, 64 nt, hsa; identical to SEQ ID NO: 92199

SEQ ID NO: 540559 - RNA, 64 nt, hsa; identical to SEQ ID NO: 92200

SEQ ID NO: 540560 - RNA, 64 nt, hsa; identical to SEQ ID NO: 92201

SEQ ID NO: 540561 - RNA, 64 nt, hsa; identical to SEQ ID NO: 92202

SEQ ID NO: 540562 - RNA, 64 nt, hsa; identical to SEQ ID NO: 92203

SEQ ID NO: 540563 - RNA, 64 nt, hsa; identical to SEQ ID NO: 92204

SEQ ID NO: 540564 - RNA, 64 nt, hsa; identical to SEQ ID NO: 92205

SEQ ID NO: 540565 - RNA, 64 nt, hsa; identical to SEQ ID NO: 92206

SEQ ID NO: 540566 - RNA, 64 nt, hsa; identical to SEQ ID NO: 92207

SEQ ID NO: 540567 - RNA, 64 nt, hsa; identical to SEQ ID NO: 92208

SEQ ID NO: 540568 - RNA, 64 nt, hsa; identical to SEQ ID NO: 92209

SEQ ID NO: 540569 - RNA, 64 nt, hsa; identical to SEQ ID NO: 92210

SEQ ID NO: 540570 - RNA, 64 nt, hsa; identical to SEQ ID NO: 128751

SEQ ID NO: 540571 - RNA, 64 nt, hsa; identical to SEQ ID NO: 128752

SEQ ID NO: 540572 - RNA, 64 nt, hsa; identical to SEQ ID NO: 128753

SEQ ID NO: 540573 - RNA, 64 nt, hsa; identical to SEQ ID NO: 128754

SEQ ID NO: 540574 - RNA, 64 nt, hsa; identical to SEQ ID NO: 128755

SEQ ID NO: 540575 - RNA, 64 nt, hsa; identical to SEQ ID NO: 128756

SEQ ID NO: 540576 - RNA, 64 nt, hsa; identical to SEQ ID NO: 128757

SEQ ID NO: 540577 - RNA, 64 nt, hsa; identical to SEQ ID NO: 128758

SEQ ID NO: 540578 - RNA, 64 nt, hsa; identical to SEQ ID NO: 128759

SEQ ID NO: 540579 - RNA, 64 nt, hsa; identical to SEQ ID NO: 128760

SEQ ID NO: 540580 - RNA, 64 nt, hsa; identical to SEQ ID NO: 128761

SEQ ID NO: 540581 - RNA, 64 nt, hsa; identical to SEQ ID NO: 128762

SEQ ID NO: 540582 - RNA, 64 nt, hsa; identical to SEQ ID NO: 128763

SEQ ID NO: 540583 - RNA, 64 nt, hsa; identical to SEQ ID NO: 128764

SEQ ID NO: 540584 - RNA, 64 nt, hsa; identical to SEQ ID NO: 128765

SEQ ID NO: 540585 - RNA, 64 nt, hsa; identical to SEQ ID NO: 128766

SEQ ID NO: 540586 - RNA, 64 nt, hsa; identical to SEQ ID NO: 128767

SEQ ID NO: 540587 - RNA, 64 nt, hsa; identical to SEQ ID NO: 128768

SEQ ID NO: 540588 - RNA, 64 nt, hsa; identical to SEQ ID NO: 128769

SEQ ID NO: 540589 - RNA, 64 nt, hsa; identical to SEQ ID NO: 128770

SEQ ID NO: 540590 - RNA, 64 nt, hsa; identical to SEQ ID NO: 128771

SEQ ID NO: 540591 - RNA, 64 nt, hsa; identical to SEQ ID NO: 128772

SEQ ID NO: 540592 - RNA, 64 nt, hsa; identical to SEQ ID NO: 128773

SEQ ID NO: 540593 - RNA, 64 nt, hsa; identical to SEQ ID NO: 128774

SEQ ID NO: 540594 - RNA, 64 nt, hsa; identical to SEQ ID NO: 128775

SEQ ID NO: 540595 - RNA, 64 nt, hsa; identical to SEQ ID NO: 128776

SEQ ID NO: 540596 - RNA, 64 nt, hsa; identical to SEQ ID NO: 128777

SEQ ID NO: 540597 - RNA, 64 nt, hsa; identical to SEQ ID NO: 128778

SEQ ID NO: 540598 - RNA, 64 nt, hsa; identical to SEQ ID NO: 128779

SEQ ID NO: 540599 - RNA, 64 nt, hsa; identical to SEQ ID NO: 128780

SEQ ID NO: 540600 - RNA, 64 nt, hsa; identical to SEQ ID NO: 128781

SEQ ID NO: 540601 - RNA, 64 nt, hsa; identical to SEQ ID NO: 128782

SEQ ID NO: 540602 - RNA, 64 nt, hsa; identical to SEQ ID NO: 128783

SEQ ID NO: 540603 - RNA, 64 nt, hsa; identical to SEQ ID NO: 128784

SEQ ID NO: 540604 - RNA, 64 nt, hsa; identical to SEQ ID NO: 128785

SEQ ID NO: 540605 - RNA, 64 nt, hsa; identical to SEQ ID NO: 128786

SEQ ID NO: 540606 - RNA, 64 nt, hsa; identical to SEQ ID NO: 128787

SEQ ID NO: 540607 - RNA, 64 nt, hsa; identical to SEQ ID NO: 128788

SEQ ID NO: 540608 - RNA, 64 nt, hsa; identical to SEQ ID NO: 128789

SEQ ID NO: 540609 - RNA, 64 nt, hsa; identical to SEQ ID NO: 355656

SEQ ID NO: 540610 - RNA, 64 nt, hsa; identical to SEQ ID NO: 355657

SEQ ID NO: 540611 - RNA, 64 nt, hsa; identical to SEQ ID NO: 355658

SEQ ID NO: 540612 - RNA, 64 nt, hsa; identical to SEQ ID NO: 355659

SEQ ID NO: 540613 - RNA, 64 nt, hsa; identical to SEQ ID NO: 355660

SEQ ID NO: 540614 - RNA, 64 nt, hsa; identical to SEQ ID NO: 355661

SEQ ID NO: 540615 - RNA, 64 nt, hsa; identical to SEQ ID NO: 355662

SEQ ID NO: 540616 - RNA, 64 nt, hsa; identical to SEQ ID NO: 355663

SEQ ID NO: 540617 - RNA, 64 nt, hsa; identical to SEQ ID NO: 355664

SEQ ID NO: 540618 - RNA, 64 nt, hsa; identical to SEQ ID NO: 355665

SEQ ID NO: 540619 - RNA, 64 nt, hsa; identical to SEQ ID NO: 355666

SEQ ID NO: 540620 - RNA, 64 nt, hsa; identical to SEQ ID NO: 355667

SEQ ID NO: 540621 - RNA, 64 nt, hsa; identical to SEQ ID NO: 355668

SEQ ID NO: 540622 - RNA, 64 nt, hsa; identical to SEQ ID NO: 355669

SEQ ID NO: 540623 - RNA, 62 nt, hsa
ucuguuuccuaauucaggaccccacucaucuagcccuccaagagccuccgccaaauuguagc

SEQ ID NO: 540624 - RNA, 62 nt, hsa
gucaacaguccccugauccccuaccucugccugcccuccagccccaucaccagcuucuugcu

SEQ ID NO: 540625 - RNA, 62 nt, hsa
cacaucaguuaaugccagugaggucagcuucugcccuccagcaauacaugugcagggguugc

SEQ ID NO: 540626 - RNA, 62 nt, hsa
ccccaucaugggcaaggaagggaauucccacagcccuccaguguacugaggguacuggccua

SEQ ID NO: 540627 - RNA, 62 nt, hsa
guauuaccaccagacugacuccaggacucacugcccuccagaaaacagaggugacaaaugug

SEQ ID NO: 540628 - RNA, 55 nt, hsa
agauuccagcucaucacuagaggcagcccuccauggacccaugaaaacugagaug

SEQ ID NO: 540629 - RNA, 62 nt, hsa
agggugaauccuucccacacuccuccaugguugcccuccagggucuagcccagccuauuugu

SEQ ID NO: 540630 - RNA, 62 nt, hsa
cccuggcgggccacccugccagccagcagcuggcccuccaccaucuucacauuccaagacug

SEQ ID NO: 540631 - RNA, 62 nt, hsa
accuccuugcucuccccagccugccaagcccagcccuccagagccagcccuccuggguaccg

SEQ ID NO: 540632 - RNA, 62 nt, hsa
gacuuuaugcccuccagagcuccaagauauaagcccuccaagggaucagaagcuccaaguuc

SEQ ID NO: 540633 - RNA, 62 nt, hsa
auccucucucaggaagcuucuagagacuuuaugcccuccagagcuccaagauauaagcccuc

SEQ ID NO: 540634 - RNA, 62 nt, hsa
ccacugcguuccugggaagggcugcgaggccugcccuccaaaccugacuggggaugggcggc

SEQ ID NO: 540635 - RNA, 62 nt, hsa
gagcaggcgaacgccacccucaaucaguacccgcccuccaucaaugguggucgugugauuga

SEQ ID NO: 540636 - RNA, 62 nt, hsa
cagacacagcuguuguucggggcuguggaacugcccuccaagcugcuggucuacuugucggu

SEQ ID NO: 540637 - RNA, 62 nt, hsa
gcagguccagaacuaagugggaguggaggcaggcccuccacagaagcucugcagcaggggcu

SEQ ID NO: 540638 - RNA, 62 nt, hsa
cccguuacucaaauccuuggcacuacuacaaugcccuccauucuucagggcugagaauugac

SEQ ID NO: 540639 - RNA, 62 nt, hsa
guuucaggagaggacugugcuggaucaugcuugcccuccacagggaauacagcauccuuaca

SEQ ID NO: 540640 - RNA, 62 nt, hsa
ucuguggccuucuggggcaccgauucuaccaggcccuccagcugcguggucuccgcagacca

SEQ ID NO: 540641 - RNA, 62 nt, hsa
uccagcccuccggagagugggcuuggcccuaggcccuccagcucagccagaaaaagcccaga

SEQ ID NO: 540642 - RNA, 62 nt, hsa
gcggggugggauuuuugcauaagcacuuugcugcccuccaguggcugcuugaggaaacgcag

SEQ ID NO: 540643 - RNA, 62 nt, hsa
ggcggcugggaucucaggcagggugugcgucagcccuccaacccccagaggggcgccugugg

SEQ ID NO: 540644 - RNA, 62 nt, hsa
uuccgccugccucccagcgaguacgucaucgugcccuccaccuacgagccccaccaggaggg

SEQ ID NO: 540645 - RNA, 62 nt, hsa
gccgguggcacucagcaccuccuugugcuagagcccuccaucaccuucacgcugucccacca

SEQ ID NO: 540646 - RNA, 62 nt, hsa
ucgacaaucugucagccgacgcagggcuggaggcccuccauuucccuccccuuuuaauuuau

SEQ ID NO: 540647 - RNA, 62 nt, hsa
gcugcagcucugcucaacugcgucuucucucagcccuccacacacacucacccccacuccca

SEQ ID NO: 540648 - RNA, 62 nt, hsa
ucuggggccagaauggcuguccuugucguagagcccuccacauuuucuuuuucuuuuuugag

SEQ ID NO: 540649 - RNA, 62 nt, hsa
acuacaagugugagccaccgcgccuggcccaagcccuccacauuuucaauccaggagccuug

SEQ ID NO: 540650 - RNA, 62 nt, hsa
cagauaaaccccaugaggggucaggcugaugugcccuccagcaguaucugagaagcugcuac

SEQ ID NO: 540651 - RNA, 62 nt, hsa
cccuccacuggccccagggcuggagcugcccugcccuccauaggcaacuggugcagggacug

SEQ ID NO: 540652 - RNA, 62 nt, hsa
cacuagcugacugugcuggcuggcucuggcuggcccuccacuggccccagggcuggagcugc

SEQ ID NO: 540653 - RNA, 62 nt, hsa
agccguaccuggugaacugcguccgcaucccugcccuccagucccuccugcuuuuuagccgg

SEQ ID NO: 540654 - RNA, 62 nt, hsa
aggagcccugcccaccuccgugcagcugaccugcccuccagcccaggacuaggggcaggacu

SEQ ID NO: 540655 - RNA, 62 nt, hsa
caggggaccucgggacugcgcgugaggccccggcccuccaaauccaaauccagacgcaggcc

SEQ ID NO: 540656 - RNA, 62 nt, hsa
gcauggacugacugccaggcugcgugcgcccugcccuccacccagccuccuggacucggccu

SEQ ID NO: 540657 - RNA, 62 nt, hsa
gguccccaucccugucucucccuuucacccuugcccuccaguccucuaccucuggccugccc

SEQ ID NO: 540658 - RNA, 62 nt, hsa
guagagccugugcagccugggcugcugucauugcccuccaguaagggcucaggguuuugcuu

SEQ ID NO: 540659 - RNA, 62 nt, hsa
gcaucuccacagccccggguccucugucuaacgcccuccauuucacgcccuccaucucacag

SEQ ID NO: 540660 - RNA, 62 nt, hsa
ccggguccucugucuaacgcccuccauuucacgcccuccaucucacagucaagauaaaggcc

SEQ ID NO: 540661 - RNA, 64 nt, hsa
uacaaagugagaguaggaagacucaaacacgauauuacccaaguuccugagacuagagaagugu

SEQ ID NO: 540662 - RNA, 64 nt, hsa
gcaaauggaaaaacucgacaccacauuucaggcuuuacccaacaucgaaauaauggagagaaaa

SEQ ID NO: 540663 - RNA, 64 nt, hsa; identical to SEQ ID NO: 139174

SEQ ID NO: 540664 - RNA, 64 nt, hsa; identical to SEQ ID NO: 139175

SEQ ID NO: 540665 - RNA, 64 nt, hsa; identical to SEQ ID NO: 139176

SEQ ID NO: 540666 - RNA, 64 nt, hsa; identical to SEQ ID NO: 139177

SEQ ID NO: 540667 - RNA, 64 nt, hsa; identical to SEQ ID NO: 305774

SEQ ID NO: 540668 - RNA, 64 nt, hsa; identical to SEQ ID NO: 305775

SEQ ID NO: 540669 - RNA, 64 nt, hsa; identical to SEQ ID NO: 305776

SEQ ID NO: 540670 - RNA, 64 nt, hsa; identical to SEQ ID NO: 305777

SEQ ID NO: 540671 - RNA, 64 nt, hsa; identical to SEQ ID NO: 305778

SEQ ID NO: 540672 - RNA, 64 nt, hsa; identical to SEQ ID NO: 305779

SEQ ID NO: 540673 - RNA, 64 nt, hsa; identical to SEQ ID NO: 305780

SEQ ID NO: 540674 - RNA, 64 nt, hsa; identical to SEQ ID NO: 305781

SEQ ID NO: 540675 - RNA, 64 nt, hsa; identical to SEQ ID NO: 305782

SEQ ID NO: 540676 - RNA, 64 nt, hsa; identical to SEQ ID NO: 305783

SEQ ID NO: 540677 - RNA, 64 nt, hsa; identical to SEQ ID NO: 305784

SEQ ID NO: 540678 - RNA, 64 nt, hsa; identical to SEQ ID NO: 305785

SEQ ID NO: 540679 - RNA, 64 nt, hsa; identical to SEQ ID NO: 305786

SEQ ID NO: 540680 - RNA, 64 nt, hsa; identical to SEQ ID NO: 305787

SEQ ID NO: 540681 - RNA, 64 nt, hsa; identical to SEQ ID NO: 305788

SEQ ID NO: 540682 - RNA, 64 nt, hsa; identical to SEQ ID NO: 305789

SEQ ID NO: 540683 - RNA, 64 nt, hsa; identical to SEQ ID NO: 305790

SEQ ID NO: 540684 - RNA, 64 nt, hsa; identical to SEQ ID NO: 305791

SEQ ID NO: 540685 - RNA, 64 nt, hsa; identical to SEQ ID NO: 305792

SEQ ID NO: 540686 - RNA, 64 nt, hsa; identical to SEQ ID NO: 305793

SEQ ID NO: 540687 - RNA, 63 nt, hsa; identical to SEQ ID NO: 305794

SEQ ID NO: 540688 - RNA, 64 nt, hsa; identical to SEQ ID NO: 305795

SEQ ID NO: 540689 - RNA, 64 nt, hsa; identical to SEQ ID NO: 305796

SEQ ID NO: 540690 - RNA, 64 nt, hsa; identical to SEQ ID NO: 305797

SEQ ID NO: 540691 - RNA, 64 nt, hsa; identical to SEQ ID NO: 305798

SEQ ID NO: 540692 - RNA, 64 nt, hsa; identical to SEQ ID NO: 305799

SEQ ID NO: 540693 - RNA, 64 nt, hsa; identical to SEQ ID NO: 305800

SEQ ID NO: 540694 - RNA, 64 nt, hsa; identical to SEQ ID NO: 305801

SEQ ID NO: 540695 - RNA, 64 nt, hsa; identical to SEQ ID NO: 305802

SEQ ID NO: 540696 - RNA, 64 nt, hsa; identical to SEQ ID NO: 305803

SEQ ID NO: 540697 - RNA, 64 nt, hsa; identical to SEQ ID NO: 305804

SEQ ID NO: 540698 - RNA, 64 nt, hsa; identical to SEQ ID NO: 305805

SEQ ID NO: 540699 - RNA, 64 nt, hsa; identical to SEQ ID NO: 305806

SEQ ID NO: 540700 - RNA, 64 nt, hsa; identical to SEQ ID NO: 305807

SEQ ID NO: 540701 - RNA, 64 nt, hsa; identical to SEQ ID NO: 305808

SEQ ID NO: 540702 - RNA, 64 nt, hsa; identical to SEQ ID NO: 305809

SEQ ID NO: 540703 - RNA, 64 nt, hsa; identical to SEQ ID NO: 305810

SEQ ID NO: 540704 - RNA, 64 nt, hsa; identical to SEQ ID NO: 305811

SEQ ID NO: 540705 - RNA, 64 nt, hsa; identical to SEQ ID NO: 305812

SEQ ID NO: 540706 - RNA, 64 nt, hsa; identical to SEQ ID NO: 305813

SEQ ID NO: 540707 - RNA, 64 nt, hsa; identical to SEQ ID NO: 305814

SEQ ID NO: 540708 - RNA, 64 nt, hsa; identical to SEQ ID NO: 305815

SEQ ID NO: 540709 - RNA, 64 nt, hsa; identical to SEQ ID NO: 305816

SEQ ID NO: 540710 - RNA, 64 nt, hsa; identical to SEQ ID NO: 305817

SEQ ID NO: 540711 - RNA, 63 nt, hsa
cuuacucugaauuuagaucuccagacccugccuggccacaauucaaauuaaggcaacaaacau

SEQ ID NO: 540712 - RNA, 58 nt, hsa
cuuaccugaugcuaaaauaaugugccucggccacaaaaaagcaugcaaagucauuguu

SEQ ID NO: 540713 - RNA, 63 nt, hsa
gacacaaugccucacucaggccccgggcucccuggccacaagcuuuuucuauccuguuuucau

SEQ ID NO: 540714 - RNA, 63 nt, hsa
gauggcucuuguucagucaagaccccagacucuggccacaaaaaugccauaaugccuguuggu

SEQ ID NO: 540715 - RNA, 63 nt, hsa
acugugcucaucaagaacaauaucgacuuccccggccacaacuacaccacguaagugcccagg

SEQ ID NO: 540716 - RNA, 63 nt, hsa
cauccuggcuggagaauguggagaacuaaagguggccacaaauucuuugacacucaagucccc

SEQ ID NO: 540717 - RNA, 63 nt, hsa
accuaagccuuuaaggcugugucaccaagguauggccacaaggaagaauaguguacagagauu

SEQ ID NO: 540718 - RNA, 63 nt, hsa
ugaugauugaugaagcagaugaguuuguagcagggccacaaaacaaagugaaacguccagggg

SEQ ID NO: 540719 - RNA, 64 nt, hsa; identical to SEQ ID NO: 265889

SEQ ID NO: 540720 - RNA, 64 nt, hsa; identical to SEQ ID NO: 265890

SEQ ID NO: 540721 - RNA, 64 nt, hsa; identical to SEQ ID NO: 265891

SEQ ID NO: 540722 - RNA, 64 nt, hsa; identical to SEQ ID NO: 265892

SEQ ID NO: 540723 - RNA, 64 nt, hsa; identical to SEQ ID NO: 265893

SEQ ID NO: 540724 - RNA, 64 nt, hsa; identical to SEQ ID NO: 265894

SEQ ID NO: 540725 - RNA, 64 nt, hsa; identical to SEQ ID NO: 265895

SEQ ID NO: 540726 - RNA, 64 nt, hsa; identical to SEQ ID NO: 265896

SEQ ID NO: 540727 - RNA, 64 nt, hsa; identical to SEQ ID NO: 265897

SEQ ID NO: 540728 - RNA, 64 nt, hsa; identical to SEQ ID NO: 265898

SEQ ID NO: 540729 - RNA, 64 nt, hsa; identical to SEQ ID NO: 265899

SEQ ID NO: 540730 - RNA, 64 nt, hsa; identical to SEQ ID NO: 265900

SEQ ID NO: 540731 - RNA, 64 nt, hsa; identical to SEQ ID NO: 265901

SEQ ID NO: 540732 - RNA, 64 nt, hsa; identical to SEQ ID NO: 265902

SEQ ID NO: 540733 - RNA, 64 nt, hsa; identical to SEQ ID NO: 265903

SEQ ID NO: 540734 - RNA, 64 nt, hsa; identical to SEQ ID NO: 265904

SEQ ID NO: 540735 - RNA, 64 nt, hsa; identical to SEQ ID NO: 265905

SEQ ID NO: 540736 - RNA, 64 nt, hsa; identical to SEQ ID NO: 265906

SEQ ID NO: 540737 - RNA, 64 nt, hsa; identical to SEQ ID NO: 267144

SEQ ID NO: 540738 - RNA, 64 nt, hsa; identical to SEQ ID NO: 267145

SEQ ID NO: 540739 - RNA, 64 nt, hsa; identical to SEQ ID NO: 267146

SEQ ID NO: 540740 - RNA, 64 nt, hsa; identical to SEQ ID NO: 267147

SEQ ID NO: 540741 - RNA, 64 nt, hsa; identical to SEQ ID NO: 267148

SEQ ID NO: 540742 - RNA, 64 nt, hsa; identical to SEQ ID NO: 267149

SEQ ID NO: 540743 - RNA, 64 nt, hsa; identical to SEQ ID NO: 267150

SEQ ID NO: 540744 - RNA, 64 nt, hsa; identical to SEQ ID NO: 267151

SEQ ID NO: 540745 - RNA, 64 nt, hsa; identical to SEQ ID NO: 267152

SEQ ID NO: 540746 - RNA, 64 nt, hsa; identical to SEQ ID NO: 267153

SEQ ID NO: 540747 - RNA, 64 nt, hsa; identical to SEQ ID NO: 267154

SEQ ID NO: 540748 - RNA, 64 nt, hsa; identical to SEQ ID NO: 267155

SEQ ID NO: 540749 - RNA, 64 nt, hsa; identical to SEQ ID NO: 267156

SEQ ID NO: 540750 - RNA, 64 nt, hsa; identical to SEQ ID NO: 267157

SEQ ID NO: 540751 - RNA, 64 nt, hsa; identical to SEQ ID NO: 267157

SEQ ID NO: 540752 - RNA, 64 nt, hsa; identical to SEQ ID NO: 267159

SEQ ID NO: 540753 - RNA, 64 nt, hsa; identical to SEQ ID NO: 267160

SEQ ID NO: 540754 - RNA, 64 nt, hsa; identical to SEQ ID NO: 267161

SEQ ID NO: 540755 - RNA, 64 nt, hsa; identical to SEQ ID NO: 267162

SEQ ID NO: 540756 - RNA, 64 nt, hsa; identical to SEQ ID NO: 267163

SEQ ID NO: 540757 - RNA, 64 nt, hsa; identical to SEQ ID NO: 267164

SEQ ID NO: 540758 - RNA, 64 nt, hsa; identical to SEQ ID NO: 267165

SEQ ID NO: 540759 - RNA, 64 nt, hsa
cagucucccaaagagccauuucaacagagaagggaaaugacaaaggggcagcuggccagauaag

SEQ ID NO: 540760 - RNA, 64 nt, hsa
uggcagagauaaucgugucuuaaaaguuguuuuuaaaugacaauaaaacaagccagaaugucuu

SEQ ID NO: 540761 - RNA, 64 nt, hsa
uagggaaccuuuccagagaagucccauuaguaagaaaugacauaaaauacgugcuuucucaggu

SEQ ID NO: 540762 - RNA, 64 nt, hsa
uaaauaaaauccaggccuagacucaagguauuguaaaugacaagauaccaaauacaagauuuua

SEQ ID NO: 540763 - RNA, 64 nt, hsa
uuuugccaauuauuaauuugcuaaauaguaauacaaaugacaaacugcauuaaauuuacuaauu

SEQ ID NO: 540764 - RNA, 64 nt, hsa
uguccccccacccuuuuuuccuuaaauaaaguaaaaaugacaccuauuuuauguggcaugaguu

SEQ ID NO: 540765 - RNA, 64 nt, hsa
cccccucacuccacacuggcacguuugugagaagaaaugacauuuugcuaggaagugaccgagu

SEQ ID NO: 540766 - RNA, 64 nt, hsa
cuuauuugcaauaaaagguauugagccauuuuuuaaaugacauuuuugauaaauuauguuugua

SEQ ID NO: 540767 - RNA, 64 nt, hsa
caauuuagaaaaauggggagaaagcuggaagaacaaaugacaugcucaaauguauugcauaagu

SEQ ID NO: 540768 - RNA, 64 nt, hsa
aucgauucagaaaucauauaauagcugguggucaaaaugacauguugagaucauuguuguuuca

SEQ ID NO: 540769 - RNA, 64 nt, hsa
cuuuaccuucuaggucuuaaaaucacacauuggaaaaugacaauaucaacaaaacuguauucuu

SEQ ID NO: 540770 - RNA, 64 nt, hsa
aaaaaaucagcaaaauaauaaaaugaacgaaaaaaaaugacacccagggaguucccaaccccag

SEQ ID NO: 540771 - RNA, 64 nt, hsa
aacaugggaugggaaggaaugggcaaagagauuaaaaugacagaaguuagcuguagaugaccua

SEQ ID NO: 540772 - RNA, 64 nt, hsa
ucauucacuuuugaaauaaaccaucgagaacacaaaaugacaagugaguuagguugggcugaug

SEQ ID NO: 540773 - RNA, 64 nt, hsa
aaggaaucacaaaugaucauacuuaagugagcaaaaaugacaaguuuuacuagcuaaguagaga

SEQ ID NO: 540774 - RNA, 64 nt, hsa
aagcagaacauacauguaccaguuuuuggauacuaaaugacagccuuguuucuccccuuugaau

SEQ ID NO: 540775 - RNA, 64 nt, hsa
gagugcucccagcaaccgccacguacaaggucugaaaugacaagggcaagagugagauaggaaa

SEQ ID NO: 540776 - RNA, 64 nt, hsa
aauaguauaugccacuauauaaauuuguauuaauaaaugacagucuuguugguuuuuuguuugu

SEQ ID NO: 540777 - RNA, 64 nt, hsa
gcuauaaaguugaacuuuguauggcuugaaaaagaaaugacaauauggaacaucccaaggcugu

SEQ ID NO: 540778 - RNA, 64 nt, hsa
agagugaacugauguuucauuuauauuuucauccaaaugacauuaucugcacguuuuuaaaauu

SEQ ID NO: 540779 - RNA, 64 nt, hsa
aaaagagaauuuaucauuacuguuacauuuguacaaaugacaugauaauaaaaguuuuaugaaa

SEQ ID NO: 540780 - RNA, 64 nt, hsa
uagugggagaccauaaugugucagccaccuugauaaaugacaggguggggaacuggaggguggg

SEQ ID NO: 540781 - RNA, 64 nt, hsa
aacuauguaauccaucagggauucauuacuuggaaaaugacaggucaugcauuauccaaaaaca

SEQ ID NO: 540782 - RNA, 64 nt, hsa
auccaaaaacaauaccaaaaagacauauuuuauaaaaugacaaaaaauauuuuacauaauuacu

SEQ ID NO: 540783 - RNA, 64 nt, hsa
gaauguacuaucaggauuuuacagcaaugcugggaaaugacagggaaaaugacaggaaugaauc

SEQ ID NO: 540784 - RNA, 64 nt, hsa
aggauuuuacagcaaugcugggaaaugacagggaaaaugacaggaaugaaucucaccagauuuu

SEQ ID NO: 540785 - RNA, 64 nt, hsa
ggcuuaccguuuugucuauaagauacacaaguauaaaugacaaguacaaauaacaaugaauguu

SEQ ID NO: 540786 - RNA, 64 nt, hsa
ggaaugucucuugacuaauugacaaaguguaaugaaaugacaagcugguugaagcugguaauca

SEQ ID NO: 540787 - RNA, 64 nt, hsa
cccaacuacuguguuaugcaaaagcaagcugauuaaaugacacucauauaauuauauguuguaa

SEQ ID NO: 540788 - RNA, 64 nt, hsa
uuuauuaugaagaaggugaauagccauauuuguaaaaugacaaucauguguguuaacccagugc

SEQ ID NO: 540789 - RNA, 64 nt, hsa
gcagccacuaaaagauuauuuaauuccagauuggaaaugacauuuuaguuuaucagauugguaa

SEQ ID NO: 540790 - RNA, 64 nt, hsa
gccugugacuugguuucucuuuguccuuuuggaaaaaugacaagcauugcaucccagucuugug

SEQ ID NO: 540791 - RNA, 64 nt, hsa
agcaucauuuccuuacaauacuguccgguggacaaaaugacaauugauauguuuuucugauaua

SEQ ID NO: 540792 - RNA, 64 nt, hsa
cucucuagucuaacggucuuguaguuagagaucuaaaugacauuuuaucauguuuuccugcagc

SEQ ID NO: 540793 - RNA, 64 nt, hsa
caguguauuguucugcaguguugaaacagaauggaaaugacaagaaauaucugcaguuauccag

SEQ ID NO: 540794 - RNA, 53 nt, hsa
accacucccuuaaagacugaggaaaaugacaaaguauucucggcugcaaaaau

SEQ ID NO: 540795 - RNA, 64 nt, hsa
cgugugacccguuccagguccccugggcucccucaaaugacagaccuaacuauuccuguguaaa

SEQ ID NO: 540796 - RNA, 64 nt, hsa
uaucgagauguucgcucgugcaguacuguugguuaaaugacaauuuauguggauuuugcaugua

SEQ ID NO: 540797 - RNA, 64 nt, hsa
gaaauguaaaaauuagauuuaaauaguauauuuuaaaugacagaacuauaauuacagagaucag

SEQ ID NO: 540798 - RNA, 64 nt, hsa
caagugcauaaggcuguugucuucggcuugggugaaaugacaguuccucuucauucuaaagguu

SEQ ID NO: 540799 - RNA, 64 nt, hsa
guauacagacuuauuuucauaaugcaaauuaauaaaaugacacuuuuacugcacuauagaaaua

SEQ ID NO: 540800 - RNA, 64 nt, hsa
aucuucacaccuugaauaagcauaauaccauaaaaaaugacacuugacaugucaauguauuugu

SEQ ID NO: 540801 - RNA, 64 nt, hsa
uccaaguauagugcagauucuauguaaaacuacuaaaugacacuggaauauguuuaguagauua

SEQ ID NO: 540802 - RNA, 64 nt, hsa
guuguguacauagagaagaaaauuugguuuuagcaaaugacagagccuucaaaaauauuuuugg

SEQ ID NO: 540803 - RNA, 64 nt, hsa
auggugaaauaaaggaagauacuaguuuugcugaaaaugacauuaaggaaaguucugcuguuuu

SEQ ID NO: 540804 - RNA, 64 nt, hsa
agggacuaauucaugguuguuccaaagauaauagaaaugacacagaaggcuuuaaguauccauu

SEQ ID NO: 540805 - RNA, 64 nt, hsa
accuugcaaaaggagaucuaaaaaacacaaucagaaaugacaaaggggacauuaccaccaaccc

SEQ ID NO: 540806 - RNA, 64 nt, hsa
gcaaaagcuggaagcauuccccuugagaacuggaaaaugacagggaugaccacucucaccacuc

SEQ ID NO: 540807 - RNA, 64 nt, hsa
guucaagcaucuacucuuuuuaucauuuacuucaaaaugacauugcuaaagacugcauuauuuu

SEQ ID NO: 540808 - RNA, 64 nt, hsa
uguauguuuuuuuaacuuuacuauaaagccaugcaaaugacaaaaaucuauauuacuuucucaa

SEQ ID NO: 540809 - RNA, 64 nt, hsa
ccaauuuauuuacauuuaaacuugucaggguauaaaaugacaucccauuaauuauauuguuaau

SEQ ID NO: 540810 - RNA, 64 nt, hsa
aauuaaccagaaauccaguuauuuuccgcccucaaaaugacagccauggccggccgggugcuuc

SEQ ID NO: 540811 - RNA, 64 nt, hsa
ccgaucaucuuuccuugccuaugacauguguauaaaaugacauugugggagcuguucgauuuuu

SEQ ID NO: 540812 - RNA, 64 nt, hsa
caaggcccauuagccaguuuagcauuuacuuuaaaaaugacaugaggcagauucuuauccagga

SEQ ID NO: 540813 - RNA, 62 nt, hsa; identical to SEQ ID NO: 438948

SEQ ID NO: 540814 - RNA, 62 nt, hsa; identical to SEQ ID NO: 438949

SEQ ID NO: 540815 - RNA, 62 nt, hsa; identical to SEQ ID NO: 438950

SEQ ID NO: 540816 - RNA, 62 nt, hsa; identical to SEQ ID NO: 438951

SEQ ID NO: 540817 - RNA, 62 nt, hsa; identical to SEQ ID NO: 438952

SEQ ID NO: 540818 - RNA, 62 nt, hsa; identical to SEQ ID NO: 438953

SEQ ID NO: 540819 - RNA, 62 nt, hsa; identical to SEQ ID NO: 438954

SEQ ID NO: 540820 - RNA, 62 nt, hsa; identical to SEQ ID NO: 438955

SEQ ID NO: 540821 - RNA, 64 nt, hsa; identical to SEQ ID NO: 119503

SEQ ID NO: 540822 - RNA, 64 nt, hsa; identical to SEQ ID NO: 119504

SEQ ID NO: 540823 - RNA, 64 nt, hsa; identical to SEQ ID NO: 119505

SEQ ID NO: 540824 - RNA, 64 nt, hsa; identical to SEQ ID NO: 119506

SEQ ID NO: 540825 - RNA, 64 nt, hsa; identical to SEQ ID NO: 119507

SEQ ID NO: 540826 - RNA, 64 nt, hsa; identical to SEQ ID NO: 119508

SEQ ID NO: 540827 - RNA, 64 nt, hsa; identical to SEQ ID NO: 119509

SEQ ID NO: 540828 - RNA, 64 nt, hsa; identical to SEQ ID NO: 119510

SEQ ID NO: 540829 - RNA, 64 nt, hsa; identical to SEQ ID NO: 119511

SEQ ID NO: 540830 - RNA, 64 nt, hsa; identical to SEQ ID NO: 119512

SEQ ID NO: 540831 - RNA, 64 nt, hsa; identical to SEQ ID NO: 119513

SEQ ID NO: 540832 - RNA, 64 nt, hsa; identical to SEQ ID NO: 119514

SEQ ID NO: 540833 - RNA, 64 nt, hsa; identical to SEQ ID NO: 119515

SEQ ID NO: 540834 - RNA, 64 nt, hsa; identical to SEQ ID NO: 119516

SEQ ID NO: 540835 - RNA, 64 nt, hsa; identical to SEQ ID NO: 119517

SEQ ID NO: 540836 - RNA, 64 nt, hsa; identical to SEQ ID NO: 119518

SEQ ID NO: 540837 - RNA, 64 nt, hsa; identical to SEQ ID NO: 119519

SEQ ID NO: 540838 - RNA, 64 nt, hsa; identical to SEQ ID NO: 119520

SEQ ID NO: 540839 - RNA, 64 nt, hsa; identical to SEQ ID NO: 119521

SEQ ID NO: 540840 - RNA, 64 nt, hsa; identical to SEQ ID NO: 119522

SEQ ID NO: 540841 - RNA, 64 nt, hsa; identical to SEQ ID NO: 119523

SEQ ID NO: 540842 - RNA, 64 nt, hsa; identical to SEQ ID NO: 119524

SEQ ID NO: 540843 - RNA, 64 nt, hsa; identical to SEQ ID NO: 119525

SEQ ID NO: 540844 - RNA, 64 nt, hsa; identical to SEQ ID NO: 119526

SEQ ID NO: 540845 - RNA, 64 nt, hsa; identical to SEQ ID NO: 119527

SEQ ID NO: 540846 - RNA, 64 nt, hsa; identical to SEQ ID NO: 119528

SEQ ID NO: 540847 - RNA, 64 nt, hsa; identical to SEQ ID NO: 119529

SEQ ID NO: 540848 - RNA, 64 nt, hsa; identical to SEQ ID NO: 119530

SEQ ID NO: 540849 - RNA, 64 nt, hsa; identical to SEQ ID NO: 119531

SEQ ID NO: 540850 - RNA, 64 nt, hsa; identical to SEQ ID NO: 119532

SEQ ID NO: 540851 - RNA, 64 nt, hsa; identical to SEQ ID NO: 119533

SEQ ID NO: 540852 - RNA, 64 nt, hsa; identical to SEQ ID NO: 119534

SEQ ID NO: 540853 - RNA, 64 nt, hsa; identical to SEQ ID NO: 119535

SEQ ID NO: 540854 - RNA, 64 nt, hsa; identical to SEQ ID NO: 119536

SEQ ID NO: 540855 - RNA, 64 nt, hsa; identical to SEQ ID NO: 119537

SEQ ID NO: 540856 - RNA, 64 nt, hsa; identical to SEQ ID NO: 119538

SEQ ID NO: 540857 - RNA, 64 nt, hsa; identical to SEQ ID NO: 119539

SEQ ID NO: 540858 - RNA, 64 nt, hsa; identical to SEQ ID NO: 119540

SEQ ID NO: 540859 - RNA, 64 nt, hsa; identical to SEQ ID NO: 119541

SEQ ID NO: 540860 - RNA, 64 nt, hsa; identical to SEQ ID NO: 119542

SEQ ID NO: 540861 - RNA, 64 nt, hsa; identical to SEQ ID NO: 119543

SEQ ID NO: 540862 - RNA, 64 nt, hsa; identical to SEQ ID NO: 119544

SEQ ID NO: 540863 - RNA, 64 nt, hsa; identical to SEQ ID NO: 119545

SEQ ID NO: 540864 - RNA, 64 nt, hsa; identical to SEQ ID NO: 119546

SEQ ID NO: 540865 - RNA, 64 nt, hsa; identical to SEQ ID NO: 119547

SEQ ID NO: 540866 - RNA, 64 nt, hsa; identical to SEQ ID NO: 119548

SEQ ID NO: 540867 - RNA, 64 nt, hsa; identical to SEQ ID NO: 119549

SEQ ID NO: 540868 - RNA, 64 nt, hsa; identical to SEQ ID NO: 119550

SEQ ID NO: 540869 - RNA, 64 nt, hsa; identical to SEQ ID NO: 119551

SEQ ID NO: 540870 - RNA, 64 nt, hsa; identical to SEQ ID NO: 119552

SEQ ID NO: 540871 - RNA, 64 nt, hsa; identical to SEQ ID NO: 119553

SEQ ID NO: 540872 - RNA, 64 nt, hsa; identical to SEQ ID NO: 119554

SEQ ID NO: 540873 - RNA, 64 nt, hsa; identical to SEQ ID NO: 119555

SEQ ID NO: 540874 - RNA, 64 nt, hsa; identical to SEQ ID NO: 119556

SEQ ID NO: 540875 - RNA, 64 nt, hsa; identical to SEQ ID NO: 119557

SEQ ID NO: 540876 - RNA, 64 nt, hsa; identical to SEQ ID NO: 119558

SEQ ID NO: 540877 - RNA, 64 nt, hsa; identical to SEQ ID NO: 119559

SEQ ID NO: 540878 - RNA, 64 nt, hsa; identical to SEQ ID NO: 119560

SEQ ID NO: 540879 - RNA, 64 nt, hsa; identical to SEQ ID NO: 119561

SEQ ID NO: 540880 - RNA, 64 nt, hsa; identical to SEQ ID NO: 119562

SEQ ID NO: 540881 - RNA, 64 nt, hsa; identical to SEQ ID NO: 119563

SEQ ID NO: 540882 - RNA, 64 nt, hsa; identical to SEQ ID NO: 119564

SEQ ID NO: 540883 - RNA, 64 nt, hsa; identical to SEQ ID NO: 119565

SEQ ID NO: 540884 - RNA, 64 nt, hsa; identical to SEQ ID NO: 119566

SEQ ID NO: 540885 - RNA, 64 nt, hsa; identical to SEQ ID NO: 119567

SEQ ID NO: 540886 - RNA, 64 nt, hsa; identical to SEQ ID NO: 119568

SEQ ID NO: 540887 - RNA, 64 nt, hsa; identical to SEQ ID NO: 119569

SEQ ID NO: 540888 - RNA, 64 nt, hsa; identical to SEQ ID NO: 119570

SEQ ID NO: 540889 - RNA, 64 nt, hsa; identical to SEQ ID NO: 119571

SEQ ID NO: 540890 - RNA, 64 nt, hsa; identical to SEQ ID NO: 119572

SEQ ID NO: 540891 - RNA, 64 nt, hsa; identical to SEQ ID NO: 119573

SEQ ID NO: 540892 - RNA, 64 nt, hsa; identical to SEQ ID NO: 119574

SEQ ID NO: 540893 - RNA, 64 nt, hsa; identical to SEQ ID NO: 119575

SEQ ID NO: 540894 - RNA, 64 nt, hsa; identical to SEQ ID NO: 119576

SEQ ID NO: 540895 - RNA, 64 nt, hsa; identical to SEQ ID NO: 119577

SEQ ID NO: 540896 - RNA, 64 nt, hsa; identical to SEQ ID NO: 119578

SEQ ID NO: 540897 - RNA, 64 nt, hsa; identical to SEQ ID NO: 119579

SEQ ID NO: 540898 - RNA, 64 nt, hsa; identical to SEQ ID NO: 119580

SEQ ID NO: 540899 - RNA, 64 nt, hsa; identical to SEQ ID NO: 119581

SEQ ID NO: 540900 - RNA, 64 nt, hsa; identical to SEQ ID NO: 119582

SEQ ID NO: 540901 - RNA, 64 nt, hsa; identical to SEQ ID NO: 119583

SEQ ID NO: 540902 - RNA, 64 nt, hsa; identical to SEQ ID NO: 119584

SEQ ID NO: 540903 - RNA, 64 nt, hsa; identical to SEQ ID NO: 119585

SEQ ID NO: 540904 - RNA, 64 nt, hsa; identical to SEQ ID NO: 119586

SEQ ID NO: 540905 - RNA, 64 nt, hsa; identical to SEQ ID NO: 119587

SEQ ID NO: 540906 - RNA, 64 nt, hsa; identical to SEQ ID NO: 119588

SEQ ID NO: 540907 - RNA, 64 nt, hsa; identical to SEQ ID NO: 119589

SEQ ID NO: 540908 - RNA, 64 nt, hsa; identical to SEQ ID NO: 119590

SEQ ID NO: 540909 - RNA, 64 nt, hsa; identical to SEQ ID NO: 119591

SEQ ID NO: 540910 - RNA, 64 nt, hsa; identical to SEQ ID NO: 119592

SEQ ID NO: 540911 - RNA, 64 nt, hsa; identical to SEQ ID NO: 119593

SEQ ID NO: 540912 - RNA, 64 nt, hsa; identical to SEQ ID NO: 119594

SEQ ID NO: 540913 - RNA, 64 nt, hsa; identical to SEQ ID NO: 119595

SEQ ID NO: 540914 - RNA, 64 nt, hsa; identical to SEQ ID NO: 119596

SEQ ID NO: 540915 - RNA, 64 nt, hsa; identical to SEQ ID NO: 119597

SEQ ID NO: 540916 - RNA, 64 nt, hsa; identical to SEQ ID NO: 205933

SEQ ID NO: 540917 - RNA, 64 nt, hsa; identical to SEQ ID NO: 205934

SEQ ID NO: 540918 - RNA, 64 nt, hsa; identical to SEQ ID NO: 205935

SEQ ID NO: 540919 - RNA, 64 nt, hsa; identical to SEQ ID NO: 205936

SEQ ID NO: 540920 - RNA, 64 nt, hsa; identical to SEQ ID NO: 205937

SEQ ID NO: 540921 - RNA, 64 nt, hsa; identical to SEQ ID NO: 205938

SEQ ID NO: 540922 - RNA, 64 nt, hsa; identical to SEQ ID NO: 205939

SEQ ID NO: 540923 - RNA, 64 nt, hsa; identical to SEQ ID NO: 205940

SEQ ID NO: 540924 - RNA, 64 nt, hsa; identical to SEQ ID NO: 205941

SEQ ID NO: 540925 - RNA, 64 nt, hsa; identical to SEQ ID NO: 205942

SEQ ID NO: 540926 - RNA, 64 nt, hsa; identical to SEQ ID NO: 205943

SEQ ID NO: 540927 - RNA, 64 nt, hsa; identical to SEQ ID NO: 205944

SEQ ID NO: 540928 - RNA, 64 nt, hsa; identical to SEQ ID NO: 205945

SEQ ID NO: 540929 - RNA, 64 nt, hsa; identical to SEQ ID NO: 205946

SEQ ID NO: 540930 - RNA, 64 nt, hsa; identical to SEQ ID NO: 205947

SEQ ID NO: 540931 - RNA, 64 nt, hsa; identical to SEQ ID NO: 205948

SEQ ID NO: 540932 - RNA, 64 nt, hsa; identical to SEQ ID NO: 205949

SEQ ID NO: 540933 - RNA, 64 nt, hsa; identical to SEQ ID NO: 205950

SEQ ID NO: 540934 - RNA, 64 nt, hsa; identical to SEQ ID NO: 205951

SEQ ID NO: 540935 - RNA, 64 nt, hsa; identical to SEQ ID NO: 205952

SEQ ID NO: 540936 - RNA, 64 nt, hsa; identical to SEQ ID NO: 205953

SEQ ID NO: 540937 - RNA, 64 nt, hsa; identical to SEQ ID NO: 205954

SEQ ID NO: 540938 - RNA, 64 nt, hsa; identical to SEQ ID NO: 205955

SEQ ID NO: 540939 - RNA, 64 nt, hsa; identical to SEQ ID NO: 205956

SEQ ID NO: 540940 - RNA, 64 nt, hsa; identical to SEQ ID NO: 205957

SEQ ID NO: 540941 - RNA, 64 nt, hsa; identical to SEQ ID NO: 205958

SEQ ID NO: 540942 - RNA, 64 nt, hsa; identical to SEQ ID NO: 205959

SEQ ID NO: 540943 - RNA, 64 nt, hsa; identical to SEQ ID NO: 205960

SEQ ID NO: 540944 - RNA, 64 nt, hsa; identical to SEQ ID NO: 205961

SEQ ID NO: 540945 - RNA, 64 nt, hsa; identical to SEQ ID NO: 205962

SEQ ID NO: 540946 - RNA, 64 nt, hsa; identical to SEQ ID NO: 205963

SEQ ID NO: 540947 - RNA, 64 nt, hsa; identical to SEQ ID NO: 205964

SEQ ID NO: 540948 - RNA, 64 nt, hsa; identical to SEQ ID NO: 205965

SEQ ID NO: 540949 - RNA, 64 nt, hsa; identical to SEQ ID NO: 205966

SEQ ID NO: 540950 - RNA, 64 nt, hsa; identical to SEQ ID NO: 205967

SEQ ID NO: 540951 - RNA, 64 nt, hsa; identical to SEQ ID NO: 205968

SEQ ID NO: 540952 - RNA, 64 nt, hsa; identical to SEQ ID NO: 205969

SEQ ID NO: 540953 - RNA, 64 nt, hsa; identical to SEQ ID NO: 205970

SEQ ID NO: 540954 - RNA, 64 nt, hsa; identical to SEQ ID NO: 205971

SEQ ID NO: 540955 - RNA, 64 nt, hsa; identical to SEQ ID NO: 205972

SEQ ID NO: 540956 - RNA, 64 nt, hsa; identical to SEQ ID NO: 205973

SEQ ID NO: 540957 - RNA, 64 nt, hsa; identical to SEQ ID NO: 205974

SEQ ID NO: 540958 - RNA, 64 nt, hsa; identical to SEQ ID NO: 205975

SEQ ID NO: 540959 - RNA, 64 nt, hsa; identical to SEQ ID NO: 205976

SEQ ID NO: 540960 - RNA, 64 nt, hsa; identical to SEQ ID NO: 205977

SEQ ID NO: 540961 - RNA, 64 nt, hsa; identical to SEQ ID NO: 205978

SEQ ID NO: 540962 - RNA, 64 nt, hsa; identical to SEQ ID NO: 205979

SEQ ID NO: 540963 - RNA, 64 nt, hsa; identical to SEQ ID NO: 205980

SEQ ID NO: 540964 - RNA, 64 nt, hsa; identical to SEQ ID NO: 205981

SEQ ID NO: 540965 - RNA, 64 nt, hsa; identical to SEQ ID NO: 205982

SEQ ID NO: 540966 - RNA, 64 nt, hsa; identical to SEQ ID NO: 205983

SEQ ID NO: 540967 - RNA, 54 nt, hsa; identical to SEQ ID NO: 205984

SEQ ID NO: 540968 - RNA, 64 nt, hsa; identical to SEQ ID NO: 205985

SEQ ID NO: 540969 - RNA, 64 nt, hsa; identical to SEQ ID NO: 205986

SEQ ID NO: 540970 - RNA, 64 nt, hsa; identical to SEQ ID NO: 205987

SEQ ID NO: 540971 - RNA, 64 nt, hsa; identical to SEQ ID NO: 205988

SEQ ID NO: 540972 - RNA, 64 nt, hsa; identical to SEQ ID NO: 205989

SEQ ID NO: 540973 - RNA, 64 nt, hsa
ccucaaagguaaauugcaguuguagacaccgaggaugguugacaacccaugguugagaugggca

SEQ ID NO: 540974 - RNA, 64 nt, hsa
ugcaguuguagacaccgaggaugguugacaacccaugguugagaugggcaccguuuugcaggaa

SEQ ID NO: 540975 - RNA, 64 nt, hsa
agcaaaugaaaggugguuuaguuauaagugaagcaugguugaauaccagcuggggagacacuag

SEQ ID NO: 540976 - RNA, 64 nt, hsa
uuugaguguccagugaaacuuaugacuuggauauaugguugaagaaucaaaacaaaagcaaaaa

SEQ ID NO: 540977 - RNA, 64 nt, hsa
agauagcucuguagaaacacacaggaacagagaaaugguugaugucagacccagacauagaaug

SEQ ID NO: 540978 - RNA, 64 nt, hsa
agagaacucuguggauacucauggguacagagaaaugguugauucuggacccagaucaagaaug

SEQ ID NO: 540979 - RNA, 64 nt, hsa
guguguguucuuggugcuguggccugugugucucugugccuauguggcugugcuaugguuucua

SEQ ID NO: 540980 - RNA, 64 nt, hsa
ggcugggggcaucugccugucuaugugcuguuggugugccuaugccugggggaggucaguaggg

SEQ ID NO: 540981 - RNA, 64 nt, hsa
agcucauuugguuuaguuaaaugucuuacucuacugugccuaugcuuuuagcugcguuacuaag

SEQ ID NO: 540982 - RNA, 64 nt, hsa
uagcuuuaaaauaacagggucuaaguauuuuaaaugugccuauuucacagcucucuuggucaca

SEQ ID NO: 540983 - RNA, 64 nt, hsa
cuuccucccucccugcccugcugaauccuaaagcugugccuauaucugugauuugaaugaggga

SEQ ID NO: 540984 - RNA, 64 nt, hsa
cagacuuuuaaauagaugaccccuucagaucaucugugccuaccuccugcccaucaggcgucua

SEQ ID NO: 540985 - RNA, 64 nt, hsa
gcguuugucccuuggcucucaucucccccauuccugugccuacuuugccugaguucuucuaccc

SEQ ID NO: 540986 - RNA, 64 nt, hsa
agaagcccugaucagucaaccagcuguggcuuccugugccuagacuggaccuaauuauaugggg

SEQ ID NO: 540987 - RNA, 64 nt, hsa
uauuaugccuaacccugcccaacaaauuaagguuugugccuaaaauguuagauuggacuguaug

SEQ ID NO: 540988 - RNA, 64 nt, hsa
ucaguacaaugcgucaaaaguugcugaaagaugcugugccuaugggguucuagagaguguugag

SEQ ID NO: 540989 - RNA, 64 nt, hsa; identical to SEQ ID NO: 182986

SEQ ID NO: 540990 - RNA, 64 nt, hsa; identical to SEQ ID NO: 182987

SEQ ID NO: 540991 - RNA, 64 nt, hsa; identical to SEQ ID NO: 182988

SEQ ID NO: 540992 - RNA, 64 nt, hsa; identical to SEQ ID NO: 182989

SEQ ID NO: 540993 - RNA, 64 nt, hsa; identical to SEQ ID NO: 182990

SEQ ID NO: 540994 - RNA, 64 nt, hsa; identical to SEQ ID NO: 182991

SEQ ID NO: 540995 - RNA, 64 nt, hsa; identical to SEQ ID NO: 182992

SEQ ID NO: 540996 - RNA, 64 nt, hsa; identical to SEQ ID NO: 182993

SEQ ID NO: 540997 - RNA, 64 nt, hsa; identical to SEQ ID NO: 182994

SEQ ID NO: 540998 - RNA, 64 nt, hsa; identical to SEQ ID NO: 182995

SEQ ID NO: 540999 - RNA, 64 nt, hsa; identical to SEQ ID NO: 182996

SEQ ID NO: 541000 - RNA, 64 nt, hsa; identical to SEQ ID NO: 182997

SEQ ID NO: 541001 - RNA, 64 nt, hsa; identical to SEQ ID NO: 182998

SEQ ID NO: 541002 - RNA, 64 nt, hsa; identical to SEQ ID NO: 182999

SEQ ID NO: 541003 - RNA, 64 nt, hsa; identical to SEQ ID NO: 183000

SEQ ID NO: 541004 - RNA, 64 nt, hsa; identical to SEQ ID NO: 183001

SEQ ID NO: 541005 - RNA, 64 nt, hsa; identical to SEQ ID NO: 183002

SEQ ID NO: 541006 - RNA, 64 nt, hsa; identical to SEQ ID NO: 183003

SEQ ID NO: 541007 - RNA, 64 nt, hsa; identical to SEQ ID NO: 183004

SEQ ID NO: 541008 - RNA, 64 nt, hsa; identical to SEQ ID NO: 183005

SEQ ID NO: 541009 - RNA, 64 nt, hsa; identical to SEQ ID NO: 183006

SEQ ID NO: 541010 - RNA, 64 nt, hsa; identical to SEQ ID NO: 183007

SEQ ID NO: 541011 - RNA, 64 nt, hsa; identical to SEQ ID NO: 183008

SEQ ID NO: 541012 - RNA, 64 nt, hsa; identical to SEQ ID NO: 183009

SEQ ID NO: 541013 - RNA, 64 nt, hsa; identical to SEQ ID NO: 183010

SEQ ID NO: 541014 - RNA, 64 nt, hsa; identical to SEQ ID NO: 183011

SEQ ID NO: 541015 - RNA, 64 nt, hsa; identical to SEQ ID NO: 183012

SEQ ID NO: 541016 - RNA, 64 nt, hsa; identical to SEQ ID NO: 183013

SEQ ID NO: 541017 - RNA, 64 nt, hsa; identical to SEQ ID NO: 183014

SEQ ID NO: 541018 - RNA, 64 nt, hsa; identical to SEQ ID NO: 183015

SEQ ID NO: 541019 - RNA, 64 nt, hsa; identical to SEQ ID NO: 183016

SEQ ID NO: 541020 - RNA, 64 nt, hsa; identical to SEQ ID NO: 183017

SEQ ID NO: 541021 - RNA, 64 nt, hsa; identical to SEQ ID NO: 183018

SEQ ID NO: 541022 - RNA, 64 nt, hsa; identical to SEQ ID NO: 183019

SEQ ID NO: 541023 - RNA, 64 nt, hsa; identical to SEQ ID NO: 183020

SEQ ID NO: 541024 - RNA, 64 nt, hsa; identical to SEQ ID NO: 183021

SEQ ID NO: 541025 - RNA, 64 nt, hsa; identical to SEQ ID NO: 183022

SEQ ID NO: 541026 - RNA, 64 nt, hsa; identical to SEQ ID NO: 183023

SEQ ID NO: 541027 - RNA, 64 nt, hsa; identical to SEQ ID NO: 183024

SEQ ID NO: 541028 - RNA, 64 nt, hsa; identical to SEQ ID NO: 183025

SEQ ID NO: 541029 - RNA, 64 nt, hsa; identical to SEQ ID NO: 183026

SEQ ID NO: 541030 - RNA, 64 nt, hsa; identical to SEQ ID NO: 183027

SEQ ID NO: 541031 - RNA, 64 nt, hsa; identical to SEQ ID NO: 183028

SEQ ID NO: 541032 - RNA, 64 nt, hsa; identical to SEQ ID NO: 183029

SEQ ID NO: 541033 - RNA, 64 nt, hsa; identical to SEQ ID NO: 183030

SEQ ID NO: 541034 - RNA, 64 nt, hsa; identical to SEQ ID NO: 183031

SEQ ID NO: 541035 - RNA, 64 nt, hsa; identical to SEQ ID NO: 183032

SEQ ID NO: 541036 - RNA, 64 nt, hsa; identical to SEQ ID NO: 183033

SEQ ID NO: 541037 - RNA, 64 nt, hsa; identical to SEQ ID NO: 183034

SEQ ID NO: 541038 - RNA, 64 nt, hsa; identical to SEQ ID NO: 183035

SEQ ID NO: 541039 - RNA, 64 nt, hsa; identical to SEQ ID NO: 183036

SEQ ID NO: 541040 - RNA, 64 nt, hsa; identical to SEQ ID NO: 183037

SEQ ID NO: 541041 - RNA, 64 nt, hsa; identical to SEQ ID NO: 183038

SEQ ID NO: 541042 - RNA, 64 nt, hsa; identical to SEQ ID NO: 183039

SEQ ID NO: 541043 - RNA, 64 nt, hsa; identical to SEQ ID NO: 183040

SEQ ID NO: 541044 - RNA, 64 nt, hsa; identical to SEQ ID NO: 183041

SEQ ID NO: 541045 - RNA, 64 nt, hsa; identical to SEQ ID NO: 183042

SEQ ID NO: 541046 - RNA, 64 nt, hsa; identical to SEQ ID NO: 183043

SEQ ID NO: 541047 - RNA, 64 nt, hsa; identical to SEQ ID NO: 183044

SEQ ID NO: 541048 - RNA, 64 nt, hsa; identical to SEQ ID NO: 183045

SEQ ID NO: 541049 - RNA, 64 nt, hsa; identical to SEQ ID NO: 183046

SEQ ID NO: 541050 - RNA, 64 nt, hsa; identical to SEQ ID NO: 183047

SEQ ID NO: 541051 - RNA, 64 nt, hsa; identical to SEQ ID NO: 183048

SEQ ID NO: 541052 - RNA, 64 nt, hsa; identical to SEQ ID NO: 183049

SEQ ID NO: 541053 - RNA, 64 nt, hsa; identical to SEQ ID NO: 183050

SEQ ID NO: 541054 - RNA, 64 nt, hsa; identical to SEQ ID NO: 183051

SEQ ID NO: 541055 - RNA, 64 nt, hsa; identical to SEQ ID NO: 183052

SEQ ID NO: 541056 - RNA, 64 nt, hsa; identical to SEQ ID NO: 183053

SEQ ID NO: 541057 - RNA, 64 nt, hsa; identical to SEQ ID NO: 183054

SEQ ID NO: 541058 - RNA, 64 nt, hsa; identical to SEQ ID NO: 183055

SEQ ID NO: 541059 - RNA, 64 nt, hsa; identical to SEQ ID NO: 183056

SEQ ID NO: 541060 - RNA, 64 nt, hsa; identical to SEQ ID NO: 183057

SEQ ID NO: 541061 - RNA, 64 nt, hsa; identical to SEQ ID NO: 183058

SEQ ID NO: 541062 - RNA, 64 nt, hsa; identical to SEQ ID NO: 183059

SEQ ID NO: 541063 - RNA, 64 nt, hsa; identical to SEQ ID NO: 183060

SEQ ID NO: 541064 - RNA, 64 nt, hsa; identical to SEQ ID NO: 183061

SEQ ID NO: 541065 - RNA, 64 nt, hsa; identical to SEQ ID NO: 183062

SEQ ID NO: 541066 - RNA, 64 nt, hsa; identical to SEQ ID NO: 183063

SEQ ID NO: 541067 - RNA, 64 nt, hsa; identical to SEQ ID NO: 183064

SEQ ID NO: 541068 - RNA, 64 nt, hsa; identical to SEQ ID NO: 183065

SEQ ID NO: 541069 - RNA, 64 nt, hsa; identical to SEQ ID NO: 183066

SEQ ID NO: 541070 - RNA, 64 nt, hsa; identical to SEQ ID NO: 183067

SEQ ID NO: 541071 - RNA, 64 nt, hsa; identical to SEQ ID NO: 183068

SEQ ID NO: 541072 - RNA, 64 nt, hsa; identical to SEQ ID NO: 183069

SEQ ID NO: 541073 - RNA, 64 nt, hsa; identical to SEQ ID NO: 183070

SEQ ID NO: 541074 - RNA, 64 nt, hsa; identical to SEQ ID NO: 183071

SEQ ID NO: 541075 - RNA, 64 nt, hsa; identical to SEQ ID NO: 183072

SEQ ID NO: 541076 - RNA, 64 nt, hsa; identical to SEQ ID NO: 183073

SEQ ID NO: 541077 - RNA, 64 nt, hsa; identical to SEQ ID NO: 183074

SEQ ID NO: 541078 - RNA, 64 nt, hsa; identical to SEQ ID NO: 183075

SEQ ID NO: 541079 - RNA, 64 nt, hsa; identical to SEQ ID NO: 183076

SEQ ID NO: 541080 - RNA, 64 nt, hsa; identical to SEQ ID NO: 183077

SEQ ID NO: 541081 - RNA, 64 nt, hsa; identical to SEQ ID NO: 183078

SEQ ID NO: 541082 - RNA, 64 nt, hsa; identical to SEQ ID NO: 183079

SEQ ID NO: 541083 - RNA, 64 nt, hsa; identical to SEQ ID NO: 183080

SEQ ID NO: 541084 - RNA, 64 nt, hsa; identical to SEQ ID NO: 183081

SEQ ID NO: 541085 - RNA, 64 nt, hsa; identical to SEQ ID NO: 183082

SEQ ID NO: 541086 - RNA, 64 nt, hsa; identical to SEQ ID NO: 183083

SEQ ID NO: 541087 - RNA, 64 nt, hsa; identical to SEQ ID NO: 183084

SEQ ID NO: 541088 - RNA, 64 nt, hsa; identical to SEQ ID NO: 183085

SEQ ID NO: 541089 - RNA, 64 nt, hsa; identical to SEQ ID NO: 183086

SEQ ID NO: 541090 - RNA, 64 nt, hsa; identical to SEQ ID NO: 183087

SEQ ID NO: 541091 - RNA, 64 nt, hsa; identical to SEQ ID NO: 183088

SEQ ID NO: 541092 - RNA, 64 nt, hsa; identical to SEQ ID NO: 183089

SEQ ID NO: 541093 - RNA, 64 nt, hsa; identical to SEQ ID NO: 183090

SEQ ID NO: 541094 - RNA, 64 nt, hsa; identical to SEQ ID NO: 183091

SEQ ID NO: 541095 - RNA, 64 nt, hsa; identical to SEQ ID NO: 183092

SEQ ID NO: 541096 - RNA, 64 nt, hsa; identical to SEQ ID NO: 183093

SEQ ID NO: 541097 - RNA, 64 nt, hsa; identical to SEQ ID NO: 183094

SEQ ID NO: 541098 - RNA, 64 nt, hsa; identical to SEQ ID NO: 183095

SEQ ID NO: 541099 - RNA, 64 nt, hsa; identical to SEQ ID NO: 183096

SEQ ID NO: 541100 - RNA, 64 nt, hsa; identical to SEQ ID NO: 183097

SEQ ID NO: 541101 - RNA, 64 nt, hsa; identical to SEQ ID NO: 183098

SEQ ID NO: 541102 - RNA, 64 nt, hsa; identical to SEQ ID NO: 183099

SEQ ID NO: 541103 - RNA, 64 nt, hsa; identical to SEQ ID NO: 183100

SEQ ID NO: 541104 - RNA, 64 nt, hsa; identical to SEQ ID NO: 183101

SEQ ID NO: 541105 - RNA, 64 nt, hsa; identical to SEQ ID NO: 183102

SEQ ID NO: 541106 - RNA, 64 nt, hsa; identical to SEQ ID NO: 183103

SEQ ID NO: 541107 - RNA, 64 nt, hsa; identical to SEQ ID NO: 183104

SEQ ID NO: 541108 - RNA, 64 nt, hsa; identical to SEQ ID NO: 183105

SEQ ID NO: 541109 - RNA, 64 nt, hsa; identical to SEQ ID NO: 183106

SEQ ID NO: 541110 - RNA, 64 nt, hsa; identical to SEQ ID NO: 183107

SEQ ID NO: 541111 - RNA, 64 nt, hsa; identical to SEQ ID NO: 183108

SEQ ID NO: 541112 - RNA, 64 nt, hsa; identical to SEQ ID NO: 183109

SEQ ID NO: 541113 - RNA, 64 nt, hsa; identical to SEQ ID NO: 183110

SEQ ID NO: 541114 - RNA, 64 nt, hsa; identical to SEQ ID NO: 183111

SEQ ID NO: 541115 - RNA, 64 nt, hsa; identical to SEQ ID NO: 183112

SEQ ID NO: 541116 - RNA, 64 nt, hsa; identical to SEQ ID NO: 183113

SEQ ID NO: 541117 - RNA, 64 nt, hsa; identical to SEQ ID NO: 183114

SEQ ID NO: 541118 - RNA, 64 nt, hsa; identical to SEQ ID NO: 183115

SEQ ID NO: 541119 - RNA, 64 nt, hsa; identical to SEQ ID NO: 183116

SEQ ID NO: 541120 - RNA, 64 nt, hsa; identical to SEQ ID NO: 183117

SEQ ID NO: 541121 - RNA, 64 nt, hsa; identical to SEQ ID NO: 183118

SEQ ID NO: 541122 - RNA, 64 nt, hsa; identical to SEQ ID NO: 183119

SEQ ID NO: 541123 - RNA, 64 nt, hsa; identical to SEQ ID NO: 183120

SEQ ID NO: 541124 - RNA, 64 nt, hsa; identical to SEQ ID NO: 183121

SEQ ID NO: 541125 - RNA, 64 nt, hsa; identical to SEQ ID NO: 183122

SEQ ID NO: 541126 - RNA, 64 nt, hsa; identical to SEQ ID NO: 183123

SEQ ID NO: 541127 - RNA, 64 nt, hsa; identical to SEQ ID NO: 183124

SEQ ID NO: 541128 - RNA, 64 nt, hsa; identical to SEQ ID NO: 183125

SEQ ID NO: 541129 - RNA, 64 nt, hsa; identical to SEQ ID NO: 183126

SEQ ID NO: 541130 - RNA, 64 nt, hsa; identical to SEQ ID NO: 183127

SEQ ID NO: 541131 - RNA, 64 nt, hsa; identical to SEQ ID NO: 183128

SEQ ID NO: 541132 - RNA, 64 nt, hsa; identical to SEQ ID NO: 183129

SEQ ID NO: 541133 - RNA, 64 nt, hsa; identical to SEQ ID NO: 183130

SEQ ID NO: 541134 - RNA, 64 nt, hsa; identical to SEQ ID NO: 183131

SEQ ID NO: 541135 - RNA, 64 nt, hsa; identical to SEQ ID NO: 183132

SEQ ID NO: 541136 - RNA, 64 nt, hsa; identical to SEQ ID NO: 183133

SEQ ID NO: 541137 - RNA, 64 nt, hsa; identical to SEQ ID NO: 183134

SEQ ID NO: 541138 - RNA, 64 nt, hsa; identical to SEQ ID NO: 183135

SEQ ID NO: 541139 - RNA, 64 nt, hsa; identical to SEQ ID NO: 183136

SEQ ID NO: 541140 - RNA, 64 nt, hsa; identical to SEQ ID NO: 183137

SEQ ID NO: 541141 - RNA, 64 nt, hsa; identical to SEQ ID NO: 183138

SEQ ID NO: 541142 - RNA, 64 nt, hsa; identical to SEQ ID NO: 183139

SEQ ID NO: 541143 - RNA, 64 nt, hsa; identical to SEQ ID NO: 183140

SEQ ID NO: 541144 - RNA, 64 nt, hsa; identical to SEQ ID NO: 183141

SEQ ID NO: 541145 - RNA, 64 nt, hsa; identical to SEQ ID NO: 183142

SEQ ID NO: 541146 - RNA, 64 nt, hsa; identical to SEQ ID NO: 183143

SEQ ID NO: 541147 - RNA, 64 nt, hsa; identical to SEQ ID NO: 183144

SEQ ID NO: 541148 - RNA, 64 nt, hsa; identical to SEQ ID NO: 183145

SEQ ID NO: 541149 - RNA, 64 nt, hsa; identical to SEQ ID NO: 183146

SEQ ID NO: 541150 - RNA, 64 nt, hsa; identical to SEQ ID NO: 183147

SEQ ID NO: 541151 - RNA, 64 nt, hsa; identical to SEQ ID NO: 183148

SEQ ID NO: 541152 - RNA, 64 nt, hsa; identical to SEQ ID NO: 183149

SEQ ID NO: 541153 - RNA, 64 nt, hsa; identical to SEQ ID NO: 183150

SEQ ID NO: 541154 - RNA, 64 nt, hsa; identical to SEQ ID NO: 183151

SEQ ID NO: 541155 - RNA, 64 nt, hsa; identical to SEQ ID NO: 183152

SEQ ID NO: 541156 - RNA, 64 nt, hsa; identical to SEQ ID NO: 183153

SEQ ID NO: 541157 - RNA, 64 nt, hsa; identical to SEQ ID NO: 183154

SEQ ID NO: 541158 - RNA, 64 nt, hsa; identical to SEQ ID NO: 183155

SEQ ID NO: 541159 - RNA, 64 nt, hsa; identical to SEQ ID NO: 183156

SEQ ID NO: 541160 - RNA, 64 nt, hsa; identical to SEQ ID NO: 183157

SEQ ID NO: 541161 - RNA, 64 nt, hsa; identical to SEQ ID NO: 183158

SEQ ID NO: 541162 - RNA, 64 nt, hsa; identical to SEQ ID NO: 183159

SEQ ID NO: 541163 - RNA, 64 nt, hsa; identical to SEQ ID NO: 183160

SEQ ID NO: 541164 - RNA, 64 nt, hsa; identical to SEQ ID NO: 183161

SEQ ID NO: 541165 - RNA, 64 nt, hsa; identical to SEQ ID NO: 183162

SEQ ID NO: 541166 - RNA, 64 nt, hsa; identical to SEQ ID NO: 183163

SEQ ID NO: 541167 - RNA, 64 nt, hsa; identical to SEQ ID NO: 183164

SEQ ID NO: 541168 - RNA, 64 nt, hsa; identical to SEQ ID NO: 183165

SEQ ID NO: 541169 - RNA, 64 nt, hsa; identical to SEQ ID NO: 183166

SEQ ID NO: 541170 - RNA, 64 nt, hsa; identical to SEQ ID NO: 183167

SEQ ID NO: 541171 - RNA, 64 nt, hsa; identical to SEQ ID NO: 183168

SEQ ID NO: 541172 - RNA, 64 nt, hsa; identical to SEQ ID NO: 183169

SEQ ID NO: 541173 - RNA, 64 nt, hsa; identical to SEQ ID NO: 183170

SEQ ID NO: 541174 - RNA, 64 nt, hsa; identical to SEQ ID NO: 183171

SEQ ID NO: 541175 - RNA, 64 nt, hsa; identical to SEQ ID NO: 183172

SEQ ID NO: 541176 - RNA, 64 nt, hsa; identical to SEQ ID NO: 183173

SEQ ID NO: 541177 - RNA, 64 nt, hsa; identical to SEQ ID NO: 183174

SEQ ID NO: 541178 - RNA, 64 nt, hsa; identical to SEQ ID NO: 183175

SEQ ID NO: 541179 - RNA, 64 nt, hsa; identical to SEQ ID NO: 183176

SEQ ID NO: 541180 - RNA, 64 nt, hsa; identical to SEQ ID NO: 183177

SEQ ID NO: 541181 - RNA, 64 nt, hsa; identical to SEQ ID NO: 183178

SEQ ID NO: 541182 - RNA, 64 nt, hsa; identical to SEQ ID NO: 183179

SEQ ID NO: 541183 - RNA, 64 nt, hsa; identical to SEQ ID NO: 183180

SEQ ID NO: 541184 - RNA, 64 nt, hsa; identical to SEQ ID NO: 183181

SEQ ID NO: 541185 - RNA, 64 nt, hsa; identical to SEQ ID NO: 183182

SEQ ID NO: 541186 - RNA, 64 nt, hsa; identical to SEQ ID NO: 183183

SEQ ID NO: 541187 - RNA, 64 nt, hsa; identical to SEQ ID NO: 183184

SEQ ID NO: 541188 - RNA, 64 nt, hsa; identical to SEQ ID NO: 183185

SEQ ID NO: 541189 - RNA, 64 nt, hsa; identical to SEQ ID NO: 183186

SEQ ID NO: 541190 - RNA, 64 nt, hsa; identical to SEQ ID NO: 183187

SEQ ID NO: 541191 - RNA, 64 nt, hsa; identical to SEQ ID NO: 183188

SEQ ID NO: 541192 - RNA, 64 nt, hsa; identical to SEQ ID NO: 183189

SEQ ID NO: 541193 - RNA, 64 nt, hsa; identical to SEQ ID NO: 183190

SEQ ID NO: 541194 - RNA, 64 nt, hsa; identical to SEQ ID NO: 183191

SEQ ID NO: 541195 - RNA, 64 nt, hsa; identical to SEQ ID NO: 183192

SEQ ID NO: 541196 - RNA, 64 nt, hsa; identical to SEQ ID NO: 183193

SEQ ID NO: 541197 - RNA, 64 nt, hsa; identical to SEQ ID NO: 183194

SEQ ID NO: 541198 - RNA, 64 nt, hsa; identical to SEQ ID NO: 183195

SEQ ID NO: 541199 - RNA, 64 nt, hsa; identical to SEQ ID NO: 183196

SEQ ID NO: 541200 - RNA, 64 nt, hsa; identical to SEQ ID NO: 183197

SEQ ID NO: 541201 - RNA, 64 nt, hsa; identical to SEQ ID NO: 183198

SEQ ID NO: 541202 - RNA, 64 nt, hsa; identical to SEQ ID NO: 183199

SEQ ID NO: 541203 - RNA, 64 nt, hsa; identical to SEQ ID NO: 183200

SEQ ID NO: 541204 - RNA, 64 nt, hsa; identical to SEQ ID NO: 183201

SEQ ID NO: 541205 - RNA, 64 nt, hsa; identical to SEQ ID NO: 183202

SEQ ID NO: 541206 - RNA, 64 nt, hsa; identical to SEQ ID NO: 183203

SEQ ID NO: 541207 - RNA, 64 nt, hsa; identical to SEQ ID NO: 183204

SEQ ID NO: 541208 - RNA, 64 nt, hsa; identical to SEQ ID NO: 183205

SEQ ID NO: 541209 - RNA, 64 nt, hsa; identical to SEQ ID NO: 183206

SEQ ID NO: 541210 - RNA, 64 nt, hsa; identical to SEQ ID NO: 183207

SEQ ID NO: 541211 - RNA, 64 nt, hsa; identical to SEQ ID NO: 183208

SEQ ID NO: 541212 - RNA, 64 nt, hsa; identical to SEQ ID NO: 183209

SEQ ID NO: 541213 - RNA, 64 nt, hsa; identical to SEQ ID NO: 183210

SEQ ID NO: 541214 - RNA, 64 nt, hsa; identical to SEQ ID NO: 183211

SEQ ID NO: 541215 - RNA, 64 nt, hsa; identical to SEQ ID NO: 183212

SEQ ID NO: 541216 - RNA, 64 nt, hsa; identical to SEQ ID NO: 183213

SEQ ID NO: 541217 - RNA, 64 nt, hsa; identical to SEQ ID NO: 183214

SEQ ID NO: 541218 - RNA, 64 nt, hsa; identical to SEQ ID NO: 183215

SEQ ID NO: 541219 - RNA, 64 nt, hsa; identical to SEQ ID NO: 183216

SEQ ID NO: 541220 - RNA, 64 nt, hsa; identical to SEQ ID NO: 183217

SEQ ID NO: 541221 - RNA, 64 nt, hsa; identical to SEQ ID NO: 183218

SEQ ID NO: 541222 - RNA, 64 nt, hsa; identical to SEQ ID NO: 183219

SEQ ID NO: 541223 - RNA, 64 nt, hsa; identical to SEQ ID NO: 183220

SEQ ID NO: 541224 - RNA, 64 nt, hsa; identical to SEQ ID NO: 183221

SEQ ID NO: 541225 - RNA, 64 nt, hsa; identical to SEQ ID NO: 183222

SEQ ID NO: 541226 - RNA, 64 nt, hsa; identical to SEQ ID NO: 183223

SEQ ID NO: 541227 - RNA, 64 nt, hsa; identical to SEQ ID NO: 183224

SEQ ID NO: 541228 - RNA, 64 nt, hsa; identical to SEQ ID NO: 183225

SEQ ID NO: 541229 - RNA, 64 nt, hsa; identical to SEQ ID NO: 183226

SEQ ID NO: 541230 - RNA, 64 nt, hsa; identical to SEQ ID NO: 183227

SEQ ID NO: 541231 - RNA, 64 nt, hsa; identical to SEQ ID NO: 183228

SEQ ID NO: 541232 - RNA, 64 nt, hsa; identical to SEQ ID NO: 183229

SEQ ID NO: 541233 - RNA, 64 nt, hsa; identical to SEQ ID NO: 183230

SEQ ID NO: 541234 - RNA, 64 nt, hsa; identical to SEQ ID NO: 183231

SEQ ID NO: 541235 - RNA, 64 nt, hsa; identical to SEQ ID NO: 183232

SEQ ID NO: 541236 - RNA, 64 nt, hsa; identical to SEQ ID NO: 183233

SEQ ID NO: 541237 - RNA, 64 nt, hsa; identical to SEQ ID NO: 183234

SEQ ID NO: 541238 - RNA, 64 nt, hsa; identical to SEQ ID NO: 183235

SEQ ID NO: 541239 - RNA, 64 nt, hsa; identical to SEQ ID NO: 183236

SEQ ID NO: 541240 - RNA, 64 nt, hsa; identical to SEQ ID NO: 183237

SEQ ID NO: 541241 - RNA, 64 nt, hsa; identical to SEQ ID NO: 183238

SEQ ID NO: 541242 - RNA, 64 nt, hsa; identical to SEQ ID NO: 183239

SEQ ID NO: 541243 - RNA, 64 nt, hsa; identical to SEQ ID NO: 183240

SEQ ID NO: 541244 - RNA, 64 nt, hsa; identical to SEQ ID NO: 183241

SEQ ID NO: 541245 - RNA, 64 nt, hsa; identical to SEQ ID NO: 183242

SEQ ID NO: 541246 - RNA, 64 nt, hsa; identical to SEQ ID NO: 183243

SEQ ID NO: 541247 - RNA, 64 nt, hsa; identical to SEQ ID NO: 183244

SEQ ID NO: 541248 - RNA, 64 nt, hsa; identical to SEQ ID NO: 183245

SEQ ID NO: 541249 - RNA, 64 nt, hsa; identical to SEQ ID NO: 183246

SEQ ID NO: 541250 - RNA, 64 nt, hsa; identical to SEQ ID NO: 183247

SEQ ID NO: 541251 - RNA, 64 nt, hsa; identical to SEQ ID NO: 183248

SEQ ID NO: 541252 - RNA, 64 nt, hsa; identical to SEQ ID NO: 183249

SEQ ID NO: 541253 - RNA, 64 nt, hsa; identical to SEQ ID NO: 183250

SEQ ID NO: 541254 - RNA, 64 nt, hsa; identical to SEQ ID NO: 183251

SEQ ID NO: 541255 - RNA, 64 nt, hsa; identical to SEQ ID NO: 183252

SEQ ID NO: 541256 - RNA, 64 nt, hsa; identical to SEQ ID NO: 183253

SEQ ID NO: 541257 - RNA, 64 nt, hsa; identical to SEQ ID NO: 183254

SEQ ID NO: 541258 - RNA, 64 nt, hsa; identical to SEQ ID NO: 183255

SEQ ID NO: 541259 - RNA, 64 nt, hsa; identical to SEQ ID NO: 183256

SEQ ID NO: 541260 - RNA, 64 nt, hsa; identical to SEQ ID NO: 183257

SEQ ID NO: 541261 - RNA, 64 nt, hsa; identical to SEQ ID NO: 183258

SEQ ID NO: 541262 - RNA, 64 nt, hsa; identical to SEQ ID NO: 183259

SEQ ID NO: 541263 - RNA, 64 nt, hsa; identical to SEQ ID NO: 183260

SEQ ID NO: 541264 - RNA, 64 nt, hsa; identical to SEQ ID NO: 183261

SEQ ID NO: 541265 - RNA, 64 nt, hsa; identical to SEQ ID NO: 183262

SEQ ID NO: 541266 - RNA, 64 nt, hsa; identical to SEQ ID NO: 183263

SEQ ID NO: 541267 - RNA, 64 nt, hsa; identical to SEQ ID NO: 183264

SEQ ID NO: 541268 - RNA, 64 nt, hsa; identical to SEQ ID NO: 183265

SEQ ID NO: 541269 - RNA, 64 nt, hsa; identical to SEQ ID NO: 183266

SEQ ID NO: 541270 - RNA, 64 nt, hsa; identical to SEQ ID NO: 183267

SEQ ID NO: 541271 - RNA, 64 nt, hsa; identical to SEQ ID NO: 183268

SEQ ID NO: 541272 - RNA, 64 nt, hsa; identical to SEQ ID NO: 183269

SEQ ID NO: 541273 - RNA, 64 nt, hsa; identical to SEQ ID NO: 183270

SEQ ID NO: 541274 - RNA, 64 nt, hsa; identical to SEQ ID NO: 183271

SEQ ID NO: 541275 - RNA, 64 nt, hsa; identical to SEQ ID NO: 183272

SEQ ID NO: 541276 - RNA, 64 nt, hsa; identical to SEQ ID NO: 183273

SEQ ID NO: 541277 - RNA, 64 nt, hsa; identical to SEQ ID NO: 183274

SEQ ID NO: 541278 - RNA, 64 nt, hsa; identical to SEQ ID NO: 183275

SEQ ID NO: 541279 - RNA, 64 nt, hsa; identical to SEQ ID NO: 183276

SEQ ID NO: 541280 - RNA, 64 nt, hsa; identical to SEQ ID NO: 183277

SEQ ID NO: 541281 - RNA, 64 nt, hsa; identical to SEQ ID NO: 183278

SEQ ID NO: 541282 - RNA, 64 nt, hsa; identical to SEQ ID NO: 183279

SEQ ID NO: 541283 - RNA, 64 nt, hsa; identical to SEQ ID NO: 183280

SEQ ID NO: 541284 - RNA, 64 nt, hsa; identical to SEQ ID NO: 183281

SEQ ID NO: 541285 - RNA, 64 nt, hsa; identical to SEQ ID NO: 183282

SEQ ID NO: 541286 - RNA, 64 nt, hsa; identical to SEQ ID NO: 183283

SEQ ID NO: 541287 - RNA, 64 nt, hsa; identical to SEQ ID NO: 183284

SEQ ID NO: 541288 - RNA, 64 nt, hsa; identical to SEQ ID NO: 183285

SEQ ID NO: 541289 - RNA, 64 nt, hsa; identical to SEQ ID NO: 183286

SEQ ID NO: 541290 - RNA, 64 nt, hsa; identical to SEQ ID NO: 183287

SEQ ID NO: 541291 - RNA, 64 nt, hsa; identical to SEQ ID NO: 183288

SEQ ID NO: 541292 - RNA, 64 nt, hsa; identical to SEQ ID NO: 183289

SEQ ID NO: 541293 - RNA, 64 nt, hsa; identical to SEQ ID NO: 183290

SEQ ID NO: 541294 - RNA, 64 nt, hsa; identical to SEQ ID NO: 183291

SEQ ID NO: 541295 - RNA, 64 nt, hsa; identical to SEQ ID NO: 183292

SEQ ID NO: 541296 - RNA, 64 nt, hsa; identical to SEQ ID NO: 183293

SEQ ID NO: 541297 - RNA, 64 nt, hsa; identical to SEQ ID NO: 183294

SEQ ID NO: 541298 - RNA, 64 nt, hsa; identical to SEQ ID NO: 183295

SEQ ID NO: 541299 - RNA, 64 nt, hsa; identical to SEQ ID NO: 183296

SEQ ID NO: 541300 - RNA, 64 nt, hsa; identical to SEQ ID NO: 183297

SEQ ID NO: 541301 - RNA, 64 nt, hsa; identical to SEQ ID NO: 183298

SEQ ID NO: 541302 - RNA, 64 nt, hsa; identical to SEQ ID NO: 183299

SEQ ID NO: 541303 - RNA, 64 nt, hsa; identical to SEQ ID NO: 183300

SEQ ID NO: 541304 - RNA, 64 nt, hsa; identical to SEQ ID NO: 183301

SEQ ID NO: 541305 - RNA, 64 nt, hsa; identical to SEQ ID NO: 183302

SEQ ID NO: 541306 - RNA, 64 nt, hsa; identical to SEQ ID NO: 183303

SEQ ID NO: 541307 - RNA, 64 nt, hsa; identical to SEQ ID NO: 183304

SEQ ID NO: 541308 - RNA, 64 nt, hsa; identical to SEQ ID NO: 183305

SEQ ID NO: 541309 - RNA, 64 nt, hsa; identical to SEQ ID NO: 183306

SEQ ID NO: 541310 - RNA, 64 nt, hsa; identical to SEQ ID NO: 183307

SEQ ID NO: 541311 - RNA, 64 nt, hsa; identical to SEQ ID NO: 183308

SEQ ID NO: 541312 - RNA, 64 nt, hsa; identical to SEQ ID NO: 183309

SEQ ID NO: 541313 - RNA, 64 nt, hsa; identical to SEQ ID NO: 183310

SEQ ID NO: 541314 - RNA, 64 nt, hsa; identical to SEQ ID NO: 183311

SEQ ID NO: 541315 - RNA, 64 nt, hsa; identical to SEQ ID NO: 183312

SEQ ID NO: 541316 - RNA, 64 nt, hsa; identical to SEQ ID NO: 183313

SEQ ID NO: 541317 - RNA, 64 nt, hsa; identical to SEQ ID NO: 183314

SEQ ID NO: 541318 - RNA, 64 nt, hsa; identical to SEQ ID NO: 183315

SEQ ID NO: 541319 - RNA, 64 nt, hsa; identical to SEQ ID NO: 183316

SEQ ID NO: 541320 - RNA, 64 nt, hsa; identical to SEQ ID NO: 183317

SEQ ID NO: 541321 - RNA, 64 nt, hsa; identical to SEQ ID NO: 183318

SEQ ID NO: 541322 - RNA, 64 nt, hsa; identical to SEQ ID NO: 183319

SEQ ID NO: 541323 - RNA, 64 nt, hsa; identical to SEQ ID NO: 183320

SEQ ID NO: 541324 - RNA, 64 nt, hsa; identical to SEQ ID NO: 183321

SEQ ID NO: 541325 - RNA, 64 nt, hsa; identical to SEQ ID NO: 183322

SEQ ID NO: 541326 - RNA, 64 nt, hsa; identical to SEQ ID NO: 183323

SEQ ID NO: 541327 - RNA, 64 nt, hsa; identical to SEQ ID NO: 183324

SEQ ID NO: 541328 - RNA, 64 nt, hsa; identical to SEQ ID NO: 183325

SEQ ID NO: 541329 - RNA, 64 nt, hsa; identical to SEQ ID NO: 183326

SEQ ID NO: 541330 - RNA, 64 nt, hsa; identical to SEQ ID NO: 183327

SEQ ID NO: 541331 - RNA, 64 nt, hsa; identical to SEQ ID NO: 183328

SEQ ID NO: 541332 - RNA, 64 nt, hsa; identical to SEQ ID NO: 183329

SEQ ID NO: 541333 - RNA, 64 nt, hsa; identical to SEQ ID NO: 183330

SEQ ID NO: 541334 - RNA, 64 nt, hsa; identical to SEQ ID NO: 183331

SEQ ID NO: 541335 - RNA, 64 nt, hsa; identical to SEQ ID NO: 183332

SEQ ID NO: 541336 - RNA, 64 nt, hsa; identical to SEQ ID NO: 183333

SEQ ID NO: 541337 - RNA, 64 nt, hsa; identical to SEQ ID NO: 183334

SEQ ID NO: 541338 - RNA, 64 nt, hsa; identical to SEQ ID NO: 183335

SEQ ID NO: 541339 - RNA, 64 nt, hsa; identical to SEQ ID NO: 183336

SEQ ID NO: 541340 - RNA, 64 nt, hsa; identical to SEQ ID NO: 183337

SEQ ID NO: 541341 - RNA, 64 nt, hsa; identical to SEQ ID NO: 183338

SEQ ID NO: 541342 - RNA, 64 nt, hsa; identical to SEQ ID NO: 183339

SEQ ID NO: 541343 - RNA, 64 nt, hsa; identical to SEQ ID NO: 183340

SEQ ID NO: 541344 - RNA, 64 nt, hsa; identical to SEQ ID NO: 183341

SEQ ID NO: 541345 - RNA, 64 nt, hsa; identical to SEQ ID NO: 183342

SEQ ID NO: 541346 - RNA, 64 nt, hsa; identical to SEQ ID NO: 183343

SEQ ID NO: 541347 - RNA, 64 nt, hsa; identical to SEQ ID NO: 183344

SEQ ID NO: 541348 - RNA, 64 nt, hsa; identical to SEQ ID NO: 183345

SEQ ID NO: 541349 - RNA, 64 nt, hsa; identical to SEQ ID NO: 183346

SEQ ID NO: 541350 - RNA, 64 nt, hsa; identical to SEQ ID NO: 183347

SEQ ID NO: 541351 - RNA, 64 nt, hsa; identical to SEQ ID NO: 183348

SEQ ID NO: 541352 - RNA, 64 nt, hsa; identical to SEQ ID NO: 183349

SEQ ID NO: 541353 - RNA, 64 nt, hsa; identical to SEQ ID NO: 183350

SEQ ID NO: 541354 - RNA, 64 nt, hsa; identical to SEQ ID NO: 183351

SEQ ID NO: 541355 - RNA, 64 nt, hsa; identical to SEQ ID NO: 183352

SEQ ID NO: 541356 - RNA, 64 nt, hsa; identical to SEQ ID NO: 183353

SEQ ID NO: 541357 - RNA, 64 nt, hsa; identical to SEQ ID NO: 183354

SEQ ID NO: 541358 - RNA, 64 nt, hsa; identical to SEQ ID NO: 183355

SEQ ID NO: 541359 - RNA, 64 nt, hsa; identical to SEQ ID NO: 183356

SEQ ID NO: 541360 - RNA, 64 nt, hsa; identical to SEQ ID NO: 183357

SEQ ID NO: 541361 - RNA, 64 nt, hsa; identical to SEQ ID NO: 183358

SEQ ID NO: 541362 - RNA, 64 nt, hsa; identical to SEQ ID NO: 183359

SEQ ID NO: 541363 - RNA, 64 nt, hsa; identical to SEQ ID NO: 183360

SEQ ID NO: 541364 - RNA, 64 nt, hsa; identical to SEQ ID NO: 183361

SEQ ID NO: 541365 - RNA, 64 nt, hsa; identical to SEQ ID NO: 183362

SEQ ID NO: 541366 - RNA, 64 nt, hsa; identical to SEQ ID NO: 183363

SEQ ID NO: 541367 - RNA, 64 nt, hsa; identical to SEQ ID NO: 183364

SEQ ID NO: 541368 - RNA, 64 nt, hsa; identical to SEQ ID NO: 183365

SEQ ID NO: 541369 - RNA, 64 nt, hsa; identical to SEQ ID NO: 183366

SEQ ID NO: 541370 - RNA, 64 nt, hsa; identical to SEQ ID NO: 183367

SEQ ID NO: 541371 - RNA, 64 nt, hsa; identical to SEQ ID NO: 183368

SEQ ID NO: 541372 - RNA, 63 nt, hsa; identical to SEQ ID NO: 183369

SEQ ID NO: 541373 - RNA, 64 nt, hsa; identical to SEQ ID NO: 183370

SEQ ID NO: 541374 - RNA, 64 nt, hsa; identical to SEQ ID NO: 183371

SEQ ID NO: 541375 - RNA, 64 nt, hsa; identical to SEQ ID NO: 183372

SEQ ID NO: 541376 - RNA, 64 nt, hsa; identical to SEQ ID NO: 183373

SEQ ID NO: 541377 - RNA, 64 nt, hsa; identical to SEQ ID NO: 183374

SEQ ID NO: 541378 - RNA, 64 nt, hsa; identical to SEQ ID NO: 183375

SEQ ID NO: 541379 - RNA, 64 nt, hsa; identical to SEQ ID NO: 183376

SEQ ID NO: 541380 - RNA, 64 nt, hsa; identical to SEQ ID NO: 183377

SEQ ID NO: 541381 - RNA, 64 nt, hsa; identical to SEQ ID NO: 183378

SEQ ID NO: 541382 - RNA, 64 nt, hsa; identical to SEQ ID NO: 183379

SEQ ID NO: 541383 - RNA, 64 nt, hsa; identical to SEQ ID NO: 183380

SEQ ID NO: 541384 - RNA, 64 nt, hsa; identical to SEQ ID NO: 183381

SEQ ID NO: 541385 - RNA, 64 nt, hsa; identical to SEQ ID NO: 183382

SEQ ID NO: 541386 - RNA, 64 nt, hsa; identical to SEQ ID NO: 183383

SEQ ID NO: 541387 - RNA, 64 nt, hsa; identical to SEQ ID NO: 183384

SEQ ID NO: 541388 - RNA, 64 nt, hsa; identical to SEQ ID NO: 183385

SEQ ID NO: 541389 - RNA, 64 nt, hsa; identical to SEQ ID NO: 183386

SEQ ID NO: 541390 - RNA, 64 nt, hsa; identical to SEQ ID NO: 183387

SEQ ID NO: 541391 - RNA, 64 nt, hsa; identical to SEQ ID NO: 183388

SEQ ID NO: 541392 - RNA, 64 nt, hsa; identical to SEQ ID NO: 183389

SEQ ID NO: 541393 - RNA, 64 nt, hsa; identical to SEQ ID NO: 183390

SEQ ID NO: 541394 - RNA, 64 nt, hsa; identical to SEQ ID NO: 183391

SEQ ID NO: 541395 - RNA, 64 nt, hsa; identical to SEQ ID NO: 183392

SEQ ID NO: 541396 - RNA, 64 nt, hsa; identical to SEQ ID NO: 183393

SEQ ID NO: 541397 - RNA, 64 nt, hsa; identical to SEQ ID NO: 183394

SEQ ID NO: 541398 - RNA, 64 nt, hsa; identical to SEQ ID NO: 183395

SEQ ID NO: 541399 - RNA, 64 nt, hsa; identical to SEQ ID NO: 183396

SEQ ID NO: 541400 - RNA, 64 nt, hsa; identical to SEQ ID NO: 183397

SEQ ID NO: 541401 - RNA, 64 nt, hsa; identical to SEQ ID NO: 183398

SEQ ID NO: 541402 - RNA, 64 nt, hsa; identical to SEQ ID NO: 183399

SEQ ID NO: 541403 - RNA, 64 nt, hsa; identical to SEQ ID NO: 183400

SEQ ID NO: 541404 - RNA, 64 nt, hsa; identical to SEQ ID NO: 183401

SEQ ID NO: 541405 - RNA, 64 nt, hsa; identical to SEQ ID NO: 183402

SEQ ID NO: 541406 - RNA, 64 nt, hsa; identical to SEQ ID NO: 183403

SEQ ID NO: 541407 - RNA, 64 nt, hsa; identical to SEQ ID NO: 183404

SEQ ID NO: 541408 - RNA, 64 nt, hsa; identical to SEQ ID NO: 183405

SEQ ID NO: 541409 - RNA, 64 nt, hsa; identical to SEQ ID NO: 183406

SEQ ID NO: 541410 - RNA, 64 nt, hsa; identical to SEQ ID NO: 183407

SEQ ID NO: 541411 - RNA, 64 nt, hsa; identical to SEQ ID NO: 183408

SEQ ID NO: 541412 - RNA, 64 nt, hsa; identical to SEQ ID NO: 183409

SEQ ID NO: 541413 - RNA, 64 nt, hsa; identical to SEQ ID NO: 183410

SEQ ID NO: 541414 - RNA, 64 nt, hsa; identical to SEQ ID NO: 183411

SEQ ID NO: 541415 - RNA, 64 nt, hsa; identical to SEQ ID NO: 183412

SEQ ID NO: 541416 - RNA, 64 nt, hsa; identical to SEQ ID NO: 183413

SEQ ID NO: 541417 - RNA, 64 nt, hsa; identical to SEQ ID NO: 183414

SEQ ID NO: 541418 - RNA, 64 nt, hsa; identical to SEQ ID NO: 183415

SEQ ID NO: 541419 - RNA, 64 nt, hsa; identical to SEQ ID NO: 183416

SEQ ID NO: 541420 - RNA, 64 nt, hsa; identical to SEQ ID NO: 183417

SEQ ID NO: 541421 - RNA, 64 nt, hsa; identical to SEQ ID NO: 183418

SEQ ID NO: 541422 - RNA, 64 nt, hsa; identical to SEQ ID NO: 183419

SEQ ID NO: 541423 - RNA, 64 nt, hsa; identical to SEQ ID NO: 183420

SEQ ID NO: 541424 - RNA, 64 nt, hsa; identical to SEQ ID NO: 183421

SEQ ID NO: 541425 - RNA, 64 nt, hsa; identical to SEQ ID NO: 183422

SEQ ID NO: 541426 - RNA, 64 nt, hsa; identical to SEQ ID NO: 183423

SEQ ID NO: 541427 - RNA, 64 nt, hsa; identical to SEQ ID NO: 183424

SEQ ID NO: 541428 - RNA, 64 nt, hsa; identical to SEQ ID NO: 183425

SEQ ID NO: 541429 - RNA, 64 nt, hsa; identical to SEQ ID NO: 183426

SEQ ID NO: 541430 - RNA, 64 nt, hsa; identical to SEQ ID NO: 183427

SEQ ID NO: 541431 - RNA, 64 nt, hsa; identical to SEQ ID NO: 183428

SEQ ID NO: 541432 - RNA, 64 nt, hsa; identical to SEQ ID NO: 183429

SEQ ID NO: 541433 - RNA, 64 nt, hsa; identical to SEQ ID NO: 183430

SEQ ID NO: 541434 - RNA, 64 nt, hsa; identical to SEQ ID NO: 183431

SEQ ID NO: 541435 - RNA, 64 nt, hsa; identical to SEQ ID NO: 183432

SEQ ID NO: 541436 - RNA, 64 nt, hsa; identical to SEQ ID NO: 183433

SEQ ID NO: 541437 - RNA, 64 nt, hsa; identical to SEQ ID NO: 183434

SEQ ID NO: 541438 - RNA, 64 nt, hsa; identical to SEQ ID NO: 183435

SEQ ID NO: 541439 - RNA, 64 nt, hsa; identical to SEQ ID NO: 183436

SEQ ID NO: 541440 - RNA, 64 nt, hsa; identical to SEQ ID NO: 183437

SEQ ID NO: 541441 - RNA, 64 nt, hsa; identical to SEQ ID NO: 183438

SEQ ID NO: 541442 - RNA, 64 nt, hsa; identical to SEQ ID NO: 183439

SEQ ID NO: 541443 - RNA, 64 nt, hsa; identical to SEQ ID NO: 183440

SEQ ID NO: 541444 - RNA, 64 nt, hsa; identical to SEQ ID NO: 183441

SEQ ID NO: 541445 - RNA, 64 nt, hsa; identical to SEQ ID NO: 183442

SEQ ID NO: 541446 - RNA, 64 nt, hsa; identical to SEQ ID NO: 183443

SEQ ID NO: 541447 - RNA, 64 nt, hsa; identical to SEQ ID NO: 183444

SEQ ID NO: 541448 - RNA, 64 nt, hsa; identical to SEQ ID NO: 183445

SEQ ID NO: 541449 - RNA, 64 nt, hsa; identical to SEQ ID NO: 183446

SEQ ID NO: 541450 - RNA, 64 nt, hsa; identical to SEQ ID NO: 183447

SEQ ID NO: 541451 - RNA, 64 nt, hsa; identical to SEQ ID NO: 183448

SEQ ID NO: 541452 - RNA, 64 nt, hsa; identical to SEQ ID NO: 183449

SEQ ID NO: 541453 - RNA, 64 nt, hsa; identical to SEQ ID NO: 183450

SEQ ID NO: 541454 - RNA, 64 nt, hsa; identical to SEQ ID NO: 183451

SEQ ID NO: 541455 - RNA, 64 nt, hsa; identical to SEQ ID NO: 183452

SEQ ID NO: 541456 - RNA, 64 nt, hsa; identical to SEQ ID NO: 183453

SEQ ID NO: 541457 - RNA, 64 nt, hsa; identical to SEQ ID NO: 183454

SEQ ID NO: 541458 - RNA, 64 nt, hsa; identical to SEQ ID NO: 183455

SEQ ID NO: 541459 - RNA, 64 nt, hsa; identical to SEQ ID NO: 183456

SEQ ID NO: 541460 - RNA, 64 nt, hsa; identical to SEQ ID NO: 183457

SEQ ID NO: 541461 - RNA, 64 nt, hsa; identical to SEQ ID NO: 183458

SEQ ID NO: 541462 - RNA, 64 nt, hsa; identical to SEQ ID NO: 183459

SEQ ID NO: 541463 - RNA, 64 nt, hsa; identical to SEQ ID NO: 183460

SEQ ID NO: 541464 - RNA, 64 nt, hsa; identical to SEQ ID NO: 183461

SEQ ID NO: 541465 - RNA, 64 nt, hsa; identical to SEQ ID NO: 183462

SEQ ID NO: 541466 - RNA, 64 nt, hsa; identical to SEQ ID NO: 183463

SEQ ID NO: 541467 - RNA, 64 nt, hsa; identical to SEQ ID NO: 183464

SEQ ID NO: 541468 - RNA, 64 nt, hsa; identical to SEQ ID NO: 183465

SEQ ID NO: 541469 - RNA, 64 nt, hsa; identical to SEQ ID NO: 183466

SEQ ID NO: 541470 - RNA, 64 nt, hsa; identical to SEQ ID NO: 183467

SEQ ID NO: 541471 - RNA, 64 nt, hsa; identical to SEQ ID NO: 183468

SEQ ID NO: 541472 - RNA, 64 nt, hsa; identical to SEQ ID NO: 183469

SEQ ID NO: 541473 - RNA, 64 nt, hsa; identical to SEQ ID NO: 183470

SEQ ID NO: 541474 - RNA, 64 nt, hsa; identical to SEQ ID NO: 183471

SEQ ID NO: 541475 - RNA, 64 nt, hsa; identical to SEQ ID NO: 183472

SEQ ID NO: 541476 - RNA, 64 nt, hsa; identical to SEQ ID NO: 183473

SEQ ID NO: 541477 - RNA, 64 nt, hsa; identical to SEQ ID NO: 183474

SEQ ID NO: 541478 - RNA, 64 nt, hsa; identical to SEQ ID NO: 183475

SEQ ID NO: 541479 - RNA, 64 nt, hsa; identical to SEQ ID NO: 183476

SEQ ID NO: 541480 - RNA, 64 nt, hsa; identical to SEQ ID NO: 183477

SEQ ID NO: 541481 - RNA, 64 nt, hsa; identical to SEQ ID NO: 183478

SEQ ID NO: 541482 - RNA, 64 nt, hsa; identical to SEQ ID NO: 183479

SEQ ID NO: 541483 - RNA, 64 nt, hsa; identical to SEQ ID NO: 183480

SEQ ID NO: 541484 - RNA, 64 nt, hsa; identical to SEQ ID NO: 183481

SEQ ID NO: 541485 - RNA, 64 nt, hsa; identical to SEQ ID NO: 183482

SEQ ID NO: 541486 - RNA, 64 nt, hsa; identical to SEQ ID NO: 183483

SEQ ID NO: 541487 - RNA, 64 nt, hsa; identical to SEQ ID NO: 183484

SEQ ID NO: 541488 - RNA, 64 nt, hsa; identical to SEQ ID NO: 183485

SEQ ID NO: 541489 - RNA, 64 nt, hsa; identical to SEQ ID NO: 183486

SEQ ID NO: 541490 - RNA, 64 nt, hsa; identical to SEQ ID NO: 183487

SEQ ID NO: 541491 - RNA, 64 nt, hsa; identical to SEQ ID NO: 183488

SEQ ID NO: 541492 - RNA, 64 nt, hsa; identical to SEQ ID NO: 183489

SEQ ID NO: 541493 - RNA, 64 nt, hsa; identical to SEQ ID NO: 183490

SEQ ID NO: 541494 - RNA, 64 nt, hsa; identical to SEQ ID NO: 183491

SEQ ID NO: 541495 - RNA, 64 nt, hsa; identical to SEQ ID NO: 183492

SEQ ID NO: 541496 - RNA, 64 nt, hsa; identical to SEQ ID NO: 183493

SEQ ID NO: 541497 - RNA, 64 nt, hsa; identical to SEQ ID NO: 183494

SEQ ID NO: 541498 - RNA, 64 nt, hsa; identical to SEQ ID NO: 183495

SEQ ID NO: 541499 - RNA, 64 nt, hsa; identical to SEQ ID NO: 183496

SEQ ID NO: 541500 - RNA, 64 nt, hsa; identical to SEQ ID NO: 183497

SEQ ID NO: 541501 - RNA, 64 nt, hsa; identical to SEQ ID NO: 183498

SEQ ID NO: 541502 - RNA, 64 nt, hsa; identical to SEQ ID NO: 183499

SEQ ID NO: 541503 - RNA, 64 nt, hsa; identical to SEQ ID NO: 183500

SEQ ID NO: 541504 - RNA, 64 nt, hsa; identical to SEQ ID NO: 183501

SEQ ID NO: 541505 - RNA, 64 nt, hsa; identical to SEQ ID NO: 183502

SEQ ID NO: 541506 - RNA, 64 nt, hsa; identical to SEQ ID NO: 183503

SEQ ID NO: 541507 - RNA, 64 nt, hsa; identical to SEQ ID NO: 183504

SEQ ID NO: 541508 - RNA, 64 nt, hsa; identical to SEQ ID NO: 183505

SEQ ID NO: 541509 - RNA, 64 nt, hsa; identical to SEQ ID NO: 183506

SEQ ID NO: 541510 - RNA, 64 nt, hsa; identical to SEQ ID NO: 183507

SEQ ID NO: 541511 - RNA, 64 nt, hsa; identical to SEQ ID NO: 183508

SEQ ID NO: 541512 - RNA, 64 nt, hsa; identical to SEQ ID NO: 183509

SEQ ID NO: 541513 - RNA, 64 nt, hsa; identical to SEQ ID NO: 183510

SEQ ID NO: 541514 - RNA, 64 nt, hsa; identical to SEQ ID NO: 183511

SEQ ID NO: 541515 - RNA, 64 nt, hsa; identical to SEQ ID NO: 183512

SEQ ID NO: 541516 - RNA, 64 nt, hsa; identical to SEQ ID NO: 183513

SEQ ID NO: 541517 - RNA, 64 nt, hsa; identical to SEQ ID NO: 183514

SEQ ID NO: 541518 - RNA, 64 nt, hsa; identical to SEQ ID NO: 183515

SEQ ID NO: 541519 - RNA, 64 nt, hsa; identical to SEQ ID NO: 183516

SEQ ID NO: 541520 - RNA, 64 nt, hsa; identical to SEQ ID NO: 183517

SEQ ID NO: 541521 - RNA, 64 nt, hsa; identical to SEQ ID NO: 183518

SEQ ID NO: 541522 - RNA, 64 nt, hsa; identical to SEQ ID NO: 183519

SEQ ID NO: 541523 - RNA, 64 nt, hsa; identical to SEQ ID NO: 183520

SEQ ID NO: 541524 - RNA, 64 nt, hsa; identical to SEQ ID NO: 183521

SEQ ID NO: 541525 - RNA, 64 nt, hsa; identical to SEQ ID NO: 183522

SEQ ID NO: 541526 - RNA, 64 nt, hsa; identical to SEQ ID NO: 183523

SEQ ID NO: 541527 - RNA, 64 nt, hsa; identical to SEQ ID NO: 183524

SEQ ID NO: 541528 - RNA, 64 nt, hsa; identical to SEQ ID NO: 183525

SEQ ID NO: 541529 - RNA, 64 nt, hsa; identical to SEQ ID NO: 183526

SEQ ID NO: 541530 - RNA, 64 nt, hsa; identical to SEQ ID NO: 183527

SEQ ID NO: 541531 - RNA, 64 nt, hsa; identical to SEQ ID NO: 183528

SEQ ID NO: 541532 - RNA, 64 nt, hsa; identical to SEQ ID NO: 183529

SEQ ID NO: 541533 - RNA, 64 nt, hsa; identical to SEQ ID NO: 183530

SEQ ID NO: 541534 - RNA, 64 nt, hsa; identical to SEQ ID NO: 183531

SEQ ID NO: 541535 - RNA, 64 nt, hsa; identical to SEQ ID NO: 183532

SEQ ID NO: 541536 - RNA, 64 nt, hsa; identical to SEQ ID NO: 183533

SEQ ID NO: 541537 - RNA, 64 nt, hsa; identical to SEQ ID NO: 183534

SEQ ID NO: 541538 - RNA, 64 nt, hsa; identical to SEQ ID NO: 183535

SEQ ID NO: 541539 - RNA, 64 nt, hsa; identical to SEQ ID NO: 183536

SEQ ID NO: 541540 - RNA, 64 nt, hsa; identical to SEQ ID NO: 183537

SEQ ID NO: 541541 - RNA, 64 nt, hsa; identical to SEQ ID NO: 183538

SEQ ID NO: 541542 - RNA, 64 nt, hsa; identical to SEQ ID NO: 183539

SEQ ID NO: 541543 - RNA, 64 nt, hsa; identical to SEQ ID NO: 183540

SEQ ID NO: 541544 - RNA, 64 nt, hsa; identical to SEQ ID NO: 183541

SEQ ID NO: 541545 - RNA, 64 nt, hsa; identical to SEQ ID NO: 183542

SEQ ID NO: 541546 - RNA, 64 nt, hsa; identical to SEQ ID NO: 183543

SEQ ID NO: 541547 - RNA, 64 nt, hsa; identical to SEQ ID NO: 183544

SEQ ID NO: 541548 - RNA, 64 nt, hsa; identical to SEQ ID NO: 183545

SEQ ID NO: 541549 - RNA, 64 nt, hsa; identical to SEQ ID NO: 183546

SEQ ID NO: 541550 - RNA, 64 nt, hsa; identical to SEQ ID NO: 183547

SEQ ID NO: 541551 - RNA, 64 nt, hsa; identical to SEQ ID NO: 183548

SEQ ID NO: 541552 - RNA, 64 nt, hsa; identical to SEQ ID NO: 183549

SEQ ID NO: 541553 - RNA, 64 nt, hsa; identical to SEQ ID NO: 183550

SEQ ID NO: 541554 - RNA, 64 nt, hsa; identical to SEQ ID NO: 183551

SEQ ID NO: 541555 - RNA, 64 nt, hsa; identical to SEQ ID NO: 183552

SEQ ID NO: 541556 - RNA, 64 nt, hsa; identical to SEQ ID NO: 183553

SEQ ID NO: 541557 - RNA, 64 nt, hsa; identical to SEQ ID NO: 183554

SEQ ID NO: 541558 - RNA, 64 nt, hsa; identical to SEQ ID NO: 183555

SEQ ID NO: 541559 - RNA, 64 nt, hsa; identical to SEQ ID NO: 183556

SEQ ID NO: 541560 - RNA, 64 nt, hsa; identical to SEQ ID NO: 183557

SEQ ID NO: 541561 - RNA, 64 nt, hsa; identical to SEQ ID NO: 183558

SEQ ID NO: 541562 - RNA, 64 nt, hsa; identical to SEQ ID NO: 183559

SEQ ID NO: 541563 - RNA, 64 nt, hsa; identical to SEQ ID NO: 183560

SEQ ID NO: 541564 - RNA, 64 nt, hsa; identical to SEQ ID NO: 183561

SEQ ID NO: 541565 - RNA, 64 nt, hsa; identical to SEQ ID NO: 183562

SEQ ID NO: 541566 - RNA, 64 nt, hsa; identical to SEQ ID NO: 183563

SEQ ID NO: 541567 - RNA, 64 nt, hsa; identical to SEQ ID NO: 183564

SEQ ID NO: 541568 - RNA, 64 nt, hsa; identical to SEQ ID NO: 183565

SEQ ID NO: 541569 - RNA, 64 nt, hsa; identical to SEQ ID NO: 183566

SEQ ID NO: 541570 - RNA, 64 nt, hsa; identical to SEQ ID NO: 183567

SEQ ID NO: 541571 - RNA, 64 nt, hsa; identical to SEQ ID NO: 183568

SEQ ID NO: 541572 - RNA, 64 nt, hsa; identical to SEQ ID NO: 183569

SEQ ID NO: 541573 - RNA, 64 nt, hsa; identical to SEQ ID NO: 183570

SEQ ID NO: 541574 - RNA, 64 nt, hsa; identical to SEQ ID NO: 183571

SEQ ID NO: 541575 - RNA, 64 nt, hsa; identical to SEQ ID NO: 183572

SEQ ID NO: 541576 - RNA, 64 nt, hsa; identical to SEQ ID NO: 183573

SEQ ID NO: 541577 - RNA, 64 nt, hsa; identical to SEQ ID NO: 183574

SEQ ID NO: 541578 - RNA, 64 nt, hsa; identical to SEQ ID NO: 183575

SEQ ID NO: 541579 - RNA, 64 nt, hsa; identical to SEQ ID NO: 183576

SEQ ID NO: 541580 - RNA, 64 nt, hsa; identical to SEQ ID NO: 183577

SEQ ID NO: 541581 - RNA, 64 nt, hsa; identical to SEQ ID NO: 183578

SEQ ID NO: 541582 - RNA, 64 nt, hsa; identical to SEQ ID NO: 183579

SEQ ID NO: 541583 - RNA, 64 nt, hsa; identical to SEQ ID NO: 183580

SEQ ID NO: 541584 - RNA, 64 nt, hsa; identical to SEQ ID NO: 183581

SEQ ID NO: 541585 - RNA, 64 nt, hsa; identical to SEQ ID NO: 183582

SEQ ID NO: 541586 - RNA, 64 nt, hsa; identical to SEQ ID NO: 183583

SEQ ID NO: 541587 - RNA, 64 nt, hsa; identical to SEQ ID NO: 183584

SEQ ID NO: 541588 - RNA, 64 nt, hsa; identical to SEQ ID NO: 183585

SEQ ID NO: 541589 - RNA, 64 nt, hsa; identical to SEQ ID NO: 183586

SEQ ID NO: 541590 - RNA, 64 nt, hsa; identical to SEQ ID NO: 183587

SEQ ID NO: 541591 - RNA, 64 nt, hsa; identical to SEQ ID NO: 183588

SEQ ID NO: 541592 - RNA, 64 nt, hsa; identical to SEQ ID NO: 183589

SEQ ID NO: 541593 - RNA, 64 nt, hsa; identical to SEQ ID NO: 183590

SEQ ID NO: 541594 - RNA, 64 nt, hsa; identical to SEQ ID NO: 183591

SEQ ID NO: 541595 - RNA, 64 nt, hsa; identical to SEQ ID NO: 183592

SEQ ID NO: 541596 - RNA, 64 nt, hsa; identical to SEQ ID NO: 183593

SEQ ID NO: 541597 - RNA, 64 nt, hsa; identical to SEQ ID NO: 183594

SEQ ID NO: 541598 - RNA, 64 nt, hsa; identical to SEQ ID NO: 183595

SEQ ID NO: 541599 - RNA, 64 nt, hsa; identical to SEQ ID NO: 183596

SEQ ID NO: 541600 - RNA, 64 nt, hsa; identical to SEQ ID NO: 183597

SEQ ID NO: 541601 - RNA, 64 nt, hsa; identical to SEQ ID NO: 183598

SEQ ID NO: 541602 - RNA, 64 nt, hsa; identical to SEQ ID NO: 183599

SEQ ID NO: 541603 - RNA, 64 nt, hsa; identical to SEQ ID NO: 183600

SEQ ID NO: 541604 - RNA, 64 nt, hsa; identical to SEQ ID NO: 183601

SEQ ID NO: 541605 - RNA, 64 nt, hsa; identical to SEQ ID NO: 183602

SEQ ID NO: 541606 - RNA, 64 nt, hsa; identical to SEQ ID NO: 183603

SEQ ID NO: 541607 - RNA, 64 nt, hsa
ugaguugaaaauaccaaaagucaaacaucauagcuuagccuaccuuaaaagggcuccgaacacu

SEQ ID NO: 541608 - RNA, 64 nt, hsa
cuuagccuaccuuaaaagggcuccgaacacuacauuagccuacaguugggcaaaaucgucuaau

SEQ ID NO: 541609 - RNA, 64 nt, hsa
cuagccugccuuaaacaugcucagaacacuuacauuagccuacagugggcaaaacuauccaaca

SEQ ID NO: 541610 - RNA, 64 nt, hsa
uauuuaauauaccuaaccuaccaaacaucauagcuuagccuagccugccuuaaacaugcucaga

SEQ ID NO: 541611 - RNA, 64 nt, hsa; identical to SEQ ID NO: 182986

SEQ ID NO: 541612 - RNA, 64 nt, hsa; identical to SEQ ID NO: 182987

SEQ ID NO: 541613 - RNA, 64 nt, hsa; identical to SEQ ID NO: 182988

SEQ ID NO: 541614 - RNA, 64 nt, hsa; identical to SEQ ID NO: 182989

SEQ ID NO: 541615 - RNA, 64 nt, hsa; identical to SEQ ID NO: 182990

SEQ ID NO: 541616 - RNA, 64 nt, hsa; identical to SEQ ID NO: 182991

SEQ ID NO: 541617 - RNA, 64 nt, hsa; identical to SEQ ID NO: 182992

SEQ ID NO: 541618 - RNA, 64 nt, hsa; identical to SEQ ID NO: 182993

SEQ ID NO: 541619 - RNA, 64 nt, hsa; identical to SEQ ID NO: 182994

SEQ ID NO: 541620 - RNA, 64 nt, hsa; identical to SEQ ID NO: 182995

SEQ ID NO: 541621 - RNA, 64 nt, hsa; identical to SEQ ID NO: 182996

SEQ ID NO: 541622 - RNA, 64 nt, hsa; identical to SEQ ID NO: 182997

SEQ ID NO: 541623 - RNA, 64 nt, hsa; identical to SEQ ID NO: 182998

SEQ ID NO: 541624 - RNA, 64 nt, hsa; identical to SEQ ID NO: 182999

SEQ ID NO: 541625 - RNA, 64 nt, hsa; identical to SEQ ID NO: 183000

SEQ ID NO: 541626 - RNA, 64 nt, hsa; identical to SEQ ID NO: 183001

SEQ ID NO: 541627 - RNA, 64 nt, hsa; identical to SEQ ID NO: 183002

SEQ ID NO: 541628 - RNA, 64 nt, hsa; identical to SEQ ID NO: 183003

SEQ ID NO: 541629 - RNA, 64 nt, hsa; identical to SEQ ID NO: 183004

SEQ ID NO: 541630 - RNA, 64 nt, hsa; identical to SEQ ID NO: 183005

SEQ ID NO: 541631 - RNA, 64 nt, hsa; identical to SEQ ID NO: 183006

SEQ ID NO: 541632 - RNA, 64 nt, hsa; identical to SEQ ID NO: 183007

SEQ ID NO: 541633 - RNA, 64 nt, hsa; identical to SEQ ID NO: 183008

SEQ ID NO: 541634 - RNA, 64 nt, hsa; identical to SEQ ID NO: 183009

SEQ ID NO: 541635 - RNA, 64 nt, hsa; identical to SEQ ID NO: 183010

SEQ ID NO: 541636 - RNA, 64 nt, hsa; identical to SEQ ID NO: 183011

SEQ ID NO: 541637 - RNA, 64 nt, hsa; identical to SEQ ID NO: 183012

SEQ ID NO: 541638 - RNA, 64 nt, hsa; identical to SEQ ID NO: 183013

SEQ ID NO: 541639 - RNA, 64 nt, hsa; identical to SEQ ID NO: 183014

SEQ ID NO: 541640 - RNA, 64 nt, hsa; identical to SEQ ID NO: 183015

SEQ ID NO: 541641 - RNA, 64 nt, hsa; identical to SEQ ID NO: 183016

SEQ ID NO: 541642 - RNA, 64 nt, hsa; identical to SEQ ID NO: 183017

SEQ ID NO: 541643 - RNA, 64 nt, hsa; identical to SEQ ID NO: 183018

SEQ ID NO: 541644 - RNA, 64 nt, hsa; identical to SEQ ID NO: 183019

SEQ ID NO: 541645 - RNA, 64 nt, hsa; identical to SEQ ID NO: 183020

SEQ ID NO: 541646 - RNA, 64 nt, hsa; identical to SEQ ID NO: 183021

SEQ ID NO: 541647 - RNA, 64 nt, hsa; identical to SEQ ID NO: 183022

SEQ ID NO: 541648 - RNA, 64 nt, hsa; identical to SEQ ID NO: 183023

SEQ ID NO: 541649 - RNA, 64 nt, hsa; identical to SEQ ID NO: 183024

SEQ ID NO: 541650 - RNA, 64 nt, hsa; identical to SEQ ID NO: 183025

SEQ ID NO: 541651 - RNA, 64 nt, hsa; identical to SEQ ID NO: 183026

SEQ ID NO: 541652 - RNA, 64 nt, hsa; identical to SEQ ID NO: 183027

SEQ ID NO: 541653 - RNA, 64 nt, hsa; identical to SEQ ID NO: 183028

SEQ ID NO: 541654 - RNA, 64 nt, hsa; identical to SEQ ID NO: 183029

SEQ ID NO: 541655 - RNA, 64 nt, hsa; identical to SEQ ID NO: 183030

SEQ ID NO: 541656 - RNA, 64 nt, hsa; identical to SEQ ID NO: 183031

SEQ ID NO: 541657 - RNA, 64 nt, hsa; identical to SEQ ID NO: 183032

SEQ ID NO: 541658 - RNA, 64 nt, hsa; identical to SEQ ID NO: 183033

SEQ ID NO: 541659 - RNA, 64 nt, hsa; identical to SEQ ID NO: 183034

SEQ ID NO: 541660 - RNA, 64 nt, hsa; identical to SEQ ID NO: 183035

SEQ ID NO: 541661 - RNA, 64 nt, hsa; identical to SEQ ID NO: 183036

SEQ ID NO: 541662 - RNA, 64 nt, hsa; identical to SEQ ID NO: 183037

SEQ ID NO: 541663 - RNA, 64 nt, hsa; identical to SEQ ID NO: 183038

SEQ ID NO: 541664 - RNA, 64 nt, hsa; identical to SEQ ID NO: 183039

SEQ ID NO: 541665 - RNA, 64 nt, hsa; identical to SEQ ID NO: 183040

SEQ ID NO: 541666 - RNA, 64 nt, hsa; identical to SEQ ID NO: 183041

SEQ ID NO: 541667 - RNA, 64 nt, hsa; identical to SEQ ID NO: 183042

SEQ ID NO: 541668 - RNA, 64 nt, hsa; identical to SEQ ID NO: 183043

SEQ ID NO: 541669 - RNA, 64 nt, hsa; identical to SEQ ID NO: 183044

SEQ ID NO: 541670 - RNA, 64 nt, hsa; identical to SEQ ID NO: 183045

SEQ ID NO: 541671 - RNA, 64 nt, hsa; identical to SEQ ID NO: 183046

SEQ ID NO: 541672 - RNA, 64 nt, hsa; identical to SEQ ID NO: 183047

SEQ ID NO: 541673 - RNA, 64 nt, hsa; identical to SEQ ID NO: 183048

SEQ ID NO: 541674 - RNA, 64 nt, hsa; identical to SEQ ID NO: 183049

SEQ ID NO: 541675 - RNA, 64 nt, hsa; identical to SEQ ID NO: 183050

SEQ ID NO: 541676 - RNA, 64 nt, hsa; identical to SEQ ID NO: 183051

SEQ ID NO: 541677 - RNA, 64 nt, hsa; identical to SEQ ID NO: 183052

SEQ ID NO: 541678 - RNA, 64 nt, hsa; identical to SEQ ID NO: 183053

SEQ ID NO: 541679 - RNA, 64 nt, hsa; identical to SEQ ID NO: 183054

SEQ ID NO: 541680 - RNA, 64 nt, hsa; identical to SEQ ID NO: 183055

SEQ ID NO: 541681 - RNA, 64 nt, hsa; identical to SEQ ID NO: 183056

SEQ ID NO: 541682 - RNA, 64 nt, hsa; identical to SEQ ID NO: 183057

SEQ ID NO: 541683 - RNA, 64 nt, hsa; identical to SEQ ID NO: 183058

SEQ ID NO: 541684 - RNA, 64 nt, hsa; identical to SEQ ID NO: 183059

SEQ ID NO: 541685 - RNA, 64 nt, hsa; identical to SEQ ID NO: 183060

SEQ ID NO: 541686 - RNA, 64 nt, hsa; identical to SEQ ID NO: 183061

SEQ ID NO: 541687 - RNA, 64 nt, hsa; identical to SEQ ID NO: 183062

SEQ ID NO: 541688 - RNA, 64 nt, hsa; identical to SEQ ID NO: 183063

SEQ ID NO: 541689 - RNA, 64 nt, hsa; identical to SEQ ID NO: 183064

SEQ ID NO: 541690 - RNA, 64 nt, hsa; identical to SEQ ID NO: 183065

SEQ ID NO: 541691 - RNA, 64 nt, hsa; identical to SEQ ID NO: 183066

SEQ ID NO: 541692 - RNA, 64 nt, hsa; identical to SEQ ID NO: 183067

SEQ ID NO: 541693 - RNA, 64 nt, hsa; identical to SEQ ID NO: 183068

SEQ ID NO: 541694 - RNA, 64 nt, hsa; identical to SEQ ID NO: 183069

SEQ ID NO: 541695 - RNA, 64 nt, hsa; identical to SEQ ID NO: 183070

SEQ ID NO: 541696 - RNA, 64 nt, hsa; identical to SEQ ID NO: 183071

SEQ ID NO: 541697 - RNA, 64 nt, hsa; identical to SEQ ID NO: 183072

SEQ ID NO: 541698 - RNA, 64 nt, hsa; identical to SEQ ID NO: 183073

SEQ ID NO: 541699 - RNA, 64 nt, hsa; identical to SEQ ID NO: 183074

SEQ ID NO: 541700 - RNA, 64 nt, hsa; identical to SEQ ID NO: 183075

SEQ ID NO: 541701 - RNA, 64 nt, hsa; identical to SEQ ID NO: 183076

SEQ ID NO: 541702 - RNA, 64 nt, hsa; identical to SEQ ID NO: 183077

SEQ ID NO: 541703 - RNA, 64 nt, hsa; identical to SEQ ID NO: 183078

SEQ ID NO: 541704 - RNA, 64 nt, hsa; identical to SEQ ID NO: 183079

SEQ ID NO: 541705 - RNA, 64 nt, hsa; identical to SEQ ID NO: 183080

SEQ ID NO: 541706 - RNA, 64 nt, hsa; identical to SEQ ID NO: 183081

SEQ ID NO: 541707 - RNA, 64 nt, hsa; identical to SEQ ID NO: 183082

SEQ ID NO: 541708 - RNA, 64 nt, hsa; identical to SEQ ID NO: 183083

SEQ ID NO: 541709 - RNA, 64 nt, hsa; identical to SEQ ID NO: 183084

SEQ ID NO: 541710 - RNA, 64 nt, hsa; identical to SEQ ID NO: 183085

SEQ ID NO: 541711 - RNA, 64 nt, hsa; identical to SEQ ID NO: 183086

SEQ ID NO: 541712 - RNA, 64 nt, hsa; identical to SEQ ID NO: 183087

SEQ ID NO: 541713 - RNA, 64 nt, hsa; identical to SEQ ID NO: 183088

SEQ ID NO: 541714 - RNA, 64 nt, hsa; identical to SEQ ID NO: 183089

SEQ ID NO: 541715 - RNA, 64 nt, hsa; identical to SEQ ID NO: 183090

SEQ ID NO: 541716 - RNA, 64 nt, hsa; identical to SEQ ID NO: 183091

SEQ ID NO: 541717 - RNA, 64 nt, hsa; identical to SEQ ID NO: 183092

SEQ ID NO: 541718 - RNA, 64 nt, hsa; identical to SEQ ID NO: 183093

SEQ ID NO: 541719 - RNA, 64 nt, hsa; identical to SEQ ID NO: 183094

SEQ ID NO: 541720 - RNA, 64 nt, hsa; identical to SEQ ID NO: 183095

SEQ ID NO: 541721 - RNA, 64 nt, hsa; identical to SEQ ID NO: 183096

SEQ ID NO: 541722 - RNA, 64 nt, hsa; identical to SEQ ID NO: 183097

SEQ ID NO: 541723 - RNA, 64 nt, hsa; identical to SEQ ID NO: 183098

SEQ ID NO: 541724 - RNA, 64 nt, hsa; identical to SEQ ID NO: 183099

SEQ ID NO: 541725 - RNA, 64 nt, hsa; identical to SEQ ID NO: 183100

SEQ ID NO: 541726 - RNA, 64 nt, hsa; identical to SEQ ID NO: 183101

SEQ ID NO: 541727 - RNA, 64 nt, hsa; identical to SEQ ID NO: 183102

SEQ ID NO: 541728 - RNA, 64 nt, hsa; identical to SEQ ID NO: 183103

SEQ ID NO: 541729 - RNA, 64 nt, hsa; identical to SEQ ID NO: 183104

SEQ ID NO: 541730 - RNA, 64 nt, hsa; identical to SEQ ID NO: 183105

SEQ ID NO: 541731 - RNA, 64 nt, hsa; identical to SEQ ID NO: 183106

SEQ ID NO: 541732 - RNA, 64 nt, hsa; identical to SEQ ID NO: 183107

SEQ ID NO: 541733 - RNA, 64 nt, hsa; identical to SEQ ID NO: 183108

SEQ ID NO: 541734 - RNA, 64 nt, hsa; identical to SEQ ID NO: 183109

SEQ ID NO: 541735 - RNA, 64 nt, hsa; identical to SEQ ID NO: 183110

SEQ ID NO: 541736 - RNA, 64 nt, hsa; identical to SEQ ID NO: 183111

SEQ ID NO: 541737 - RNA, 64 nt, hsa; identical to SEQ ID NO: 183112

SEQ ID NO: 541738 - RNA, 64 nt, hsa; identical to SEQ ID NO: 183113

SEQ ID NO: 541739 - RNA, 64 nt, hsa; identical to SEQ ID NO: 183114

SEQ ID NO: 541740 - RNA, 64 nt, hsa; identical to SEQ ID NO: 183115

SEQ ID NO: 541741 - RNA, 64 nt, hsa; identical to SEQ ID NO: 183116

SEQ ID NO: 541742 - RNA, 64 nt, hsa; identical to SEQ ID NO: 183117

SEQ ID NO: 541743 - RNA, 64 nt, hsa; identical to SEQ ID NO: 183118

SEQ ID NO: 541744 - RNA, 64 nt, hsa; identical to SEQ ID NO: 183119

SEQ ID NO: 541745 - RNA, 64 nt, hsa; identical to SEQ ID NO: 183120

SEQ ID NO: 541746 - RNA, 64 nt, hsa; identical to SEQ ID NO: 183121

SEQ ID NO: 541747 - RNA, 64 nt, hsa; identical to SEQ ID NO: 183122

SEQ ID NO: 541748 - RNA, 64 nt, hsa; identical to SEQ ID NO: 183123

SEQ ID NO: 541749 - RNA, 64 nt, hsa; identical to SEQ ID NO: 183124

SEQ ID NO: 541750 - RNA, 64 nt, hsa; identical to SEQ ID NO: 183125

SEQ ID NO: 541751 - RNA, 64 nt, hsa; identical to SEQ ID NO: 183126

SEQ ID NO: 541752 - RNA, 64 nt, hsa; identical to SEQ ID NO: 183127

SEQ ID NO: 541753 - RNA, 64 nt, hsa; identical to SEQ ID NO: 183128

SEQ ID NO: 541754 - RNA, 64 nt, hsa; identical to SEQ ID NO: 183129

SEQ ID NO: 541755 - RNA, 64 nt, hsa; identical to SEQ ID NO: 183130

SEQ ID NO: 541756 - RNA, 64 nt, hsa; identical to SEQ ID NO: 183131

SEQ ID NO: 541757 - RNA, 64 nt, hsa; identical to SEQ ID NO: 183132

SEQ ID NO: 541758 - RNA, 64 nt, hsa; identical to SEQ ID NO: 183133

SEQ ID NO: 541759 - RNA, 64 nt, hsa; identical to SEQ ID NO: 183134

SEQ ID NO: 541760 - RNA, 64 nt, hsa; identical to SEQ ID NO: 183135

SEQ ID NO: 541761 - RNA, 64 nt, hsa; identical to SEQ ID NO: 183136

SEQ ID NO: 541762 - RNA, 64 nt, hsa; identical to SEQ ID NO: 183137

SEQ ID NO: 541763 - RNA, 64 nt, hsa; identical to SEQ ID NO: 183138

SEQ ID NO: 541764 - RNA, 64 nt, hsa; identical to SEQ ID NO: 183139

SEQ ID NO: 541765 - RNA, 64 nt, hsa; identical to SEQ ID NO: 183140

SEQ ID NO: 541766 - RNA, 64 nt, hsa; identical to SEQ ID NO: 183141

SEQ ID NO: 541767 - RNA, 64 nt, hsa; identical to SEQ ID NO: 183142

SEQ ID NO: 541768 - RNA, 64 nt, hsa; identical to SEQ ID NO: 183143

SEQ ID NO: 541769 - RNA, 64 nt, hsa; identical to SEQ ID NO: 183144

SEQ ID NO: 541770 - RNA, 64 nt, hsa; identical to SEQ ID NO: 183145

SEQ ID NO: 541771 - RNA, 64 nt, hsa; identical to SEQ ID NO: 183146

SEQ ID NO: 541772 - RNA, 64 nt, hsa; identical to SEQ ID NO: 183147

SEQ ID NO: 541773 - RNA, 64 nt, hsa; identical to SEQ ID NO: 183148

SEQ ID NO: 541774 - RNA, 64 nt, hsa; identical to SEQ ID NO: 183149

SEQ ID NO: 541775 - RNA, 64 nt, hsa; identical to SEQ ID NO: 183150

SEQ ID NO: 541776 - RNA, 64 nt, hsa; identical to SEQ ID NO: 183151

SEQ ID NO: 541777 - RNA, 64 nt, hsa; identical to SEQ ID NO: 183152

SEQ ID NO: 541778 - RNA, 64 nt, hsa; identical to SEQ ID NO: 183153

SEQ ID NO: 541779 - RNA, 64 nt, hsa; identical to SEQ ID NO: 183154

SEQ ID NO: 541780 - RNA, 64 nt, hsa; identical to SEQ ID NO: 183155

SEQ ID NO: 541781 - RNA, 64 nt, hsa; identical to SEQ ID NO: 183156

SEQ ID NO: 541782 - RNA, 64 nt, hsa; identical to SEQ ID NO: 183157

SEQ ID NO: 541783 - RNA, 64 nt, hsa; identical to SEQ ID NO: 183158

SEQ ID NO: 541784 - RNA, 64 nt, hsa; identical to SEQ ID NO: 183159

SEQ ID NO: 541785 - RNA, 64 nt, hsa; identical to SEQ ID NO: 183160

SEQ ID NO: 541786 - RNA, 64 nt, hsa; identical to SEQ ID NO: 183161

SEQ ID NO: 541787 - RNA, 64 nt, hsa; identical to SEQ ID NO: 183162

SEQ ID NO: 541788 - RNA, 64 nt, hsa; identical to SEQ ID NO: 183163

SEQ ID NO: 541789 - RNA, 64 nt, hsa; identical to SEQ ID NO: 183164

SEQ ID NO: 541790 - RNA, 64 nt, hsa; identical to SEQ ID NO: 183165

SEQ ID NO: 541791 - RNA, 64 nt, hsa; identical to SEQ ID NO: 183166

SEQ ID NO: 541792 - RNA, 64 nt, hsa; identical to SEQ ID NO: 183167

SEQ ID NO: 541793 - RNA, 64 nt, hsa; identical to SEQ ID NO: 183168

SEQ ID NO: 541794 - RNA, 64 nt, hsa; identical to SEQ ID NO: 183169

SEQ ID NO: 541795 - RNA, 64 nt, hsa; identical to SEQ ID NO: 183170

SEQ ID NO: 541796 - RNA, 64 nt, hsa; identical to SEQ ID NO: 183171

SEQ ID NO: 541797 - RNA, 64 nt, hsa; identical to SEQ ID NO: 183172

SEQ ID NO: 541798 - RNA, 64 nt, hsa; identical to SEQ ID NO: 183173

SEQ ID NO: 541799 - RNA, 64 nt, hsa; identical to SEQ ID NO: 183174

SEQ ID NO: 541800 - RNA, 64 nt, hsa; identical to SEQ ID NO: 183175

SEQ ID NO: 541801 - RNA, 64 nt, hsa; identical to SEQ ID NO: 183176

SEQ ID NO: 541802 - RNA, 64 nt, hsa; identical to SEQ ID NO: 183177

SEQ ID NO: 541803 - RNA, 64 nt, hsa; identical to SEQ ID NO: 183178

SEQ ID NO: 541804 - RNA, 64 nt, hsa; identical to SEQ ID NO: 183179

SEQ ID NO: 541805 - RNA, 64 nt, hsa; identical to SEQ ID NO: 183180

SEQ ID NO: 541806 - RNA, 64 nt, hsa; identical to SEQ ID NO: 183181

SEQ ID NO: 541807 - RNA, 64 nt, hsa; identical to SEQ ID NO: 183182

SEQ ID NO: 541808 - RNA, 64 nt, hsa; identical to SEQ ID NO: 183183

SEQ ID NO: 541809 - RNA, 64 nt, hsa; identical to SEQ ID NO: 183184

SEQ ID NO: 541810 - RNA, 64 nt, hsa; identical to SEQ ID NO: 183185

SEQ ID NO: 541811 - RNA, 64 nt, hsa; identical to SEQ ID NO: 183186

SEQ ID NO: 541812 - RNA, 64 nt, hsa; identical to SEQ ID NO: 183187

SEQ ID NO: 541813 - RNA, 64 nt, hsa; identical to SEQ ID NO: 183188

SEQ ID NO: 541814 - RNA, 64 nt, hsa; identical to SEQ ID NO: 183189

SEQ ID NO: 541815 - RNA, 64 nt, hsa; identical to SEQ ID NO: 183190

SEQ ID NO: 541816 - RNA, 64 nt, hsa; identical to SEQ ID NO: 183191

SEQ ID NO: 541817 - RNA, 64 nt, hsa; identical to SEQ ID NO: 183192

SEQ ID NO: 541818 - RNA, 64 nt, hsa; identical to SEQ ID NO: 183193

SEQ ID NO: 541819 - RNA, 64 nt, hsa; identical to SEQ ID NO: 183194

SEQ ID NO: 541820 - RNA, 64 nt, hsa; identical to SEQ ID NO: 183195

SEQ ID NO: 541821 - RNA, 64 nt, hsa; identical to SEQ ID NO: 183196

SEQ ID NO: 541822 - RNA, 64 nt, hsa; identical to SEQ ID NO: 183197

SEQ ID NO: 541823 - RNA, 64 nt, hsa; identical to SEQ ID NO: 183198

SEQ ID NO: 541824 - RNA, 64 nt, hsa; identical to SEQ ID NO: 183199

SEQ ID NO: 541825 - RNA, 64 nt, hsa; identical to SEQ ID NO: 183200

SEQ ID NO: 541826 - RNA, 64 nt, hsa; identical to SEQ ID NO: 183201

SEQ ID NO: 541827 - RNA, 64 nt, hsa; identical to SEQ ID NO: 183202

SEQ ID NO: 541828 - RNA, 64 nt, hsa; identical to SEQ ID NO: 183203

SEQ ID NO: 541829 - RNA, 64 nt, hsa; identical to SEQ ID NO: 183204

SEQ ID NO: 541830 - RNA, 64 nt, hsa; identical to SEQ ID NO: 183205

SEQ ID NO: 541831 - RNA, 64 nt, hsa; identical to SEQ ID NO: 183206

SEQ ID NO: 541832 - RNA, 64 nt, hsa; identical to SEQ ID NO: 183207

SEQ ID NO: 541833 - RNA, 64 nt, hsa; identical to SEQ ID NO: 183208

SEQ ID NO: 541834 - RNA, 64 nt, hsa; identical to SEQ ID NO: 183209

SEQ ID NO: 541835 - RNA, 64 nt, hsa; identical to SEQ ID NO: 183210

SEQ ID NO: 541836 - RNA, 64 nt, hsa; identical to SEQ ID NO: 183211

SEQ ID NO: 541837 - RNA, 64 nt, hsa; identical to SEQ ID NO: 183212

SEQ ID NO: 541838 - RNA, 64 nt, hsa; identical to SEQ ID NO: 183213

SEQ ID NO: 541839 - RNA, 64 nt, hsa; identical to SEQ ID NO: 183214

SEQ ID NO: 541840 - RNA, 64 nt, hsa; identical to SEQ ID NO: 183215

SEQ ID NO: 541841 - RNA, 64 nt, hsa; identical to SEQ ID NO: 183216

SEQ ID NO: 541842 - RNA, 64 nt, hsa; identical to SEQ ID NO: 183217

SEQ ID NO: 541843 - RNA, 64 nt, hsa; identical to SEQ ID NO: 183218

SEQ ID NO: 541844 - RNA, 64 nt, hsa; identical to SEQ ID NO: 183219

SEQ ID NO: 541845 - RNA, 64 nt, hsa; identical to SEQ ID NO: 183220

SEQ ID NO: 541846 - RNA, 64 nt, hsa; identical to SEQ ID NO: 183221

SEQ ID NO: 541847 - RNA, 64 nt, hsa; identical to SEQ ID NO: 183222

SEQ ID NO: 541848 - RNA, 64 nt, hsa; identical to SEQ ID NO: 183223

SEQ ID NO: 541849 - RNA, 64 nt, hsa; identical to SEQ ID NO: 183224

SEQ ID NO: 541850 - RNA, 64 nt, hsa; identical to SEQ ID NO: 183225

SEQ ID NO: 541851 - RNA, 64 nt, hsa; identical to SEQ ID NO: 183226

SEQ ID NO: 541852 - RNA, 64 nt, hsa; identical to SEQ ID NO: 183227

SEQ ID NO: 541853 - RNA, 64 nt, hsa; identical to SEQ ID NO: 183228

SEQ ID NO: 541854 - RNA, 64 nt, hsa; identical to SEQ ID NO: 183229

SEQ ID NO: 541855 - RNA, 64 nt, hsa; identical to SEQ ID NO: 183230

SEQ ID NO: 541856 - RNA, 64 nt, hsa; identical to SEQ ID NO: 183231

SEQ ID NO: 541857 - RNA, 64 nt, hsa; identical to SEQ ID NO: 183232

SEQ ID NO: 541858 - RNA, 64 nt, hsa; identical to SEQ ID NO: 183233

SEQ ID NO: 541859 - RNA, 64 nt, hsa; identical to SEQ ID NO: 183234

SEQ ID NO: 541860 - RNA, 64 nt, hsa; identical to SEQ ID NO: 183235

SEQ ID NO: 541861 - RNA, 64 nt, hsa; identical to SEQ ID NO: 183236

SEQ ID NO: 541862 - RNA, 64 nt, hsa; identical to SEQ ID NO: 183237

SEQ ID NO: 541863 - RNA, 64 nt, hsa; identical to SEQ ID NO: 183238

SEQ ID NO: 541864 - RNA, 64 nt, hsa; identical to SEQ ID NO: 183239

SEQ ID NO: 541865 - RNA, 64 nt, hsa; identical to SEQ ID NO: 183240

SEQ ID NO: 541866 - RNA, 64 nt, hsa; identical to SEQ ID NO: 183241

SEQ ID NO: 541867 - RNA, 64 nt, hsa; identical to SEQ ID NO: 183242

SEQ ID NO: 541868 - RNA, 64 nt, hsa; identical to SEQ ID NO: 183243

SEQ ID NO: 541869 - RNA, 64 nt, hsa; identical to SEQ ID NO: 183244

SEQ ID NO: 541870 - RNA, 64 nt, hsa; identical to SEQ ID NO: 183245

SEQ ID NO: 541871 - RNA, 64 nt, hsa; identical to SEQ ID NO: 183246

SEQ ID NO: 541872 - RNA, 64 nt, hsa; identical to SEQ ID NO: 183247

SEQ ID NO: 541873 - RNA, 64 nt, hsa; identical to SEQ ID NO: 183248

SEQ ID NO: 541874 - RNA, 64 nt, hsa; identical to SEQ ID NO: 183249

SEQ ID NO: 541875 - RNA, 64 nt, hsa; identical to SEQ ID NO: 183250

SEQ ID NO: 541876 - RNA, 64 nt, hsa; identical to SEQ ID NO: 183251

SEQ ID NO: 541877 - RNA, 64 nt, hsa; identical to SEQ ID NO: 183252

SEQ ID NO: 541878 - RNA, 64 nt, hsa; identical to SEQ ID NO: 183253

SEQ ID NO: 541879 - RNA, 64 nt, hsa; identical to SEQ ID NO: 183254

SEQ ID NO: 541880 - RNA, 64 nt, hsa; identical to SEQ ID NO: 183255

SEQ ID NO: 541881 - RNA, 64 nt, hsa; identical to SEQ ID NO: 183256

SEQ ID NO: 541882 - RNA, 64 nt, hsa; identical to SEQ ID NO: 183257

SEQ ID NO: 541883 - RNA, 64 nt, hsa; identical to SEQ ID NO: 183258

SEQ ID NO: 541884 - RNA, 64 nt, hsa; identical to SEQ ID NO: 183259

SEQ ID NO: 541885 - RNA, 64 nt, hsa; identical to SEQ ID NO: 183260

SEQ ID NO: 541886 - RNA, 64 nt, hsa; identical to SEQ ID NO: 183261

SEQ ID NO: 541887 - RNA, 64 nt, hsa; identical to SEQ ID NO: 183262

SEQ ID NO: 541888 - RNA, 64 nt, hsa; identical to SEQ ID NO: 183263

SEQ ID NO: 541889 - RNA, 64 nt, hsa; identical to SEQ ID NO: 183264

SEQ ID NO: 541890 - RNA, 64 nt, hsa; identical to SEQ ID NO: 183265

SEQ ID NO: 541891 - RNA, 64 nt, hsa; identical to SEQ ID NO: 183266

SEQ ID NO: 541892 - RNA, 64 nt, hsa; identical to SEQ ID NO: 183267

SEQ ID NO: 541893 - RNA, 64 nt, hsa; identical to SEQ ID NO: 183268

SEQ ID NO: 541894 - RNA, 64 nt, hsa; identical to SEQ ID NO: 183269

SEQ ID NO: 541895 - RNA, 64 nt, hsa; identical to SEQ ID NO: 183270

SEQ ID NO: 541896 - RNA, 64 nt, hsa; identical to SEQ ID NO: 183271

SEQ ID NO: 541897 - RNA, 64 nt, hsa; identical to SEQ ID NO: 183272

SEQ ID NO: 541898 - RNA, 64 nt, hsa; identical to SEQ ID NO: 183273

SEQ ID NO: 541899 - RNA, 64 nt, hsa; identical to SEQ ID NO: 183274

SEQ ID NO: 541900 - RNA, 64 nt, hsa; identical to SEQ ID NO: 183275

SEQ ID NO: 541901 - RNA, 64 nt, hsa; identical to SEQ ID NO: 183276

SEQ ID NO: 541902 - RNA, 64 nt, hsa; identical to SEQ ID NO: 183277

SEQ ID NO: 541903 - RNA, 64 nt, hsa; identical to SEQ ID NO: 183278

SEQ ID NO: 541904 - RNA, 64 nt, hsa; identical to SEQ ID NO: 183279

SEQ ID NO: 541905 - RNA, 64 nt, hsa; identical to SEQ ID NO: 183280

SEQ ID NO: 541906 - RNA, 64 nt, hsa; identical to SEQ ID NO: 183281

SEQ ID NO: 541907 - RNA, 64 nt, hsa; identical to SEQ ID NO: 183282

SEQ ID NO: 541908 - RNA, 64 nt, hsa; identical to SEQ ID NO: 183283

SEQ ID NO: 541909 - RNA, 64 nt, hsa; identical to SEQ ID NO: 183284

SEQ ID NO: 541910 - RNA, 64 nt, hsa; identical to SEQ ID NO: 183285

SEQ ID NO: 541911 - RNA, 64 nt, hsa; identical to SEQ ID NO: 183286

SEQ ID NO: 541912 - RNA, 64 nt, hsa; identical to SEQ ID NO: 183287

SEQ ID NO: 541913 - RNA, 64 nt, hsa; identical to SEQ ID NO: 183288

SEQ ID NO: 541914 - RNA, 64 nt, hsa; identical to SEQ ID NO: 183289

SEQ ID NO: 541915 - RNA, 64 nt, hsa; identical to SEQ ID NO: 183290

SEQ ID NO: 541916 - RNA, 64 nt, hsa; identical to SEQ ID NO: 183291

SEQ ID NO: 541917 - RNA, 64 nt, hsa; identical to SEQ ID NO: 183292

SEQ ID NO: 541918 - RNA, 64 nt, hsa; identical to SEQ ID NO: 183293

SEQ ID NO: 541919 - RNA, 64 nt, hsa; identical to SEQ ID NO: 183294

SEQ ID NO: 541920 - RNA, 64 nt, hsa; identical to SEQ ID NO: 183295

SEQ ID NO: 541921 - RNA, 64 nt, hsa; identical to SEQ ID NO: 183296

SEQ ID NO: 541922 - RNA, 64 nt, hsa; identical to SEQ ID NO: 183297

SEQ ID NO: 541923 - RNA, 64 nt, hsa; identical to SEQ ID NO: 183298

SEQ ID NO: 541924 - RNA, 64 nt, hsa; identical to SEQ ID NO: 183299

SEQ ID NO: 541925 - RNA, 64 nt, hsa; identical to SEQ ID NO: 183300

SEQ ID NO: 541926 - RNA, 64 nt, hsa; identical to SEQ ID NO: 183301

SEQ ID NO: 541927 - RNA, 64 nt, hsa; identical to SEQ ID NO: 183302

SEQ ID NO: 541928 - RNA, 64 nt, hsa; identical to SEQ ID NO: 183303

SEQ ID NO: 541929 - RNA, 64 nt, hsa; identical to SEQ ID NO: 183304

SEQ ID NO: 541930 - RNA, 64 nt, hsa; identical to SEQ ID NO: 183305

SEQ ID NO: 541931 - RNA, 64 nt, hsa; identical to SEQ ID NO: 183306

SEQ ID NO: 541932 - RNA, 64 nt, hsa; identical to SEQ ID NO: 183307

SEQ ID NO: 541933 - RNA, 64 nt, hsa; identical to SEQ ID NO: 183308

SEQ ID NO: 541934 - RNA, 64 nt, hsa; identical to SEQ ID NO: 183309

SEQ ID NO: 541935 - RNA, 64 nt, hsa; identical to SEQ ID NO: 183310

SEQ ID NO: 541936 - RNA, 64 nt, hsa; identical to SEQ ID NO: 183311

SEQ ID NO: 541937 - RNA, 64 nt, hsa; identical to SEQ ID NO: 183312

SEQ ID NO: 541938 - RNA, 64 nt, hsa; identical to SEQ ID NO: 183313

SEQ ID NO: 541939 - RNA, 64 nt, hsa; identical to SEQ ID NO: 183314

SEQ ID NO: 541940 - RNA, 64 nt, hsa; identical to SEQ ID NO: 183315

SEQ ID NO: 541941 - RNA, 64 nt, hsa; identical to SEQ ID NO: 183316

SEQ ID NO: 541942 - RNA, 64 nt, hsa; identical to SEQ ID NO: 183317

SEQ ID NO: 541943 - RNA, 64 nt, hsa; identical to SEQ ID NO: 183318

SEQ ID NO: 541944 - RNA, 64 nt, hsa; identical to SEQ ID NO: 183319

SEQ ID NO: 541945 - RNA, 64 nt, hsa; identical to SEQ ID NO: 183320

SEQ ID NO: 541946 - RNA, 64 nt, hsa; identical to SEQ ID NO: 183321

SEQ ID NO: 541947 - RNA, 64 nt, hsa; identical to SEQ ID NO: 183322

SEQ ID NO: 541948 - RNA, 64 nt, hsa; identical to SEQ ID NO: 183323

SEQ ID NO: 541949 - RNA, 64 nt, hsa; identical to SEQ ID NO: 183324

SEQ ID NO: 541950 - RNA, 64 nt, hsa; identical to SEQ ID NO: 183325

SEQ ID NO: 541951 - RNA, 64 nt, hsa; identical to SEQ ID NO: 183326

SEQ ID NO: 541952 - RNA, 64 nt, hsa; identical to SEQ ID NO: 183327

SEQ ID NO: 541953 - RNA, 64 nt, hsa; identical to SEQ ID NO: 183328

SEQ ID NO: 541954 - RNA, 64 nt, hsa; identical to SEQ ID NO: 183329

SEQ ID NO: 541955 - RNA, 64 nt, hsa; identical to SEQ ID NO: 183330

SEQ ID NO: 541956 - RNA, 64 nt, hsa; identical to SEQ ID NO: 183331

SEQ ID NO: 541957 - RNA, 64 nt, hsa; identical to SEQ ID NO: 183332

SEQ ID NO: 541958 - RNA, 64 nt, hsa; identical to SEQ ID NO: 183333

SEQ ID NO: 541959 - RNA, 64 nt, hsa; identical to SEQ ID NO: 183334

SEQ ID NO: 541960 - RNA, 64 nt, hsa; identical to SEQ ID NO: 183335

SEQ ID NO: 541961 - RNA, 64 nt, hsa; identical to SEQ ID NO: 183336

SEQ ID NO: 541962 - RNA, 64 nt, hsa; identical to SEQ ID NO: 183337

SEQ ID NO: 541963 - RNA, 64 nt, hsa; identical to SEQ ID NO: 183338

SEQ ID NO: 541964 - RNA, 64 nt, hsa; identical to SEQ ID NO: 183339

SEQ ID NO: 541965 - RNA, 64 nt, hsa; identical to SEQ ID NO: 183340

SEQ ID NO: 541966 - RNA, 64 nt, hsa; identical to SEQ ID NO: 183341

SEQ ID NO: 541967 - RNA, 64 nt, hsa; identical to SEQ ID NO: 183342

SEQ ID NO: 541968 - RNA, 64 nt, hsa; identical to SEQ ID NO: 183343

SEQ ID NO: 541969 - RNA, 64 nt, hsa; identical to SEQ ID NO: 183344

SEQ ID NO: 541970 - RNA, 64 nt, hsa; identical to SEQ ID NO: 183345

SEQ ID NO: 541971 - RNA, 64 nt, hsa; identical to SEQ ID NO: 183346

SEQ ID NO: 541972 - RNA, 64 nt, hsa; identical to SEQ ID NO: 183347

SEQ ID NO: 541973 - RNA, 64 nt, hsa; identical to SEQ ID NO: 183348

SEQ ID NO: 541974 - RNA, 64 nt, hsa; identical to SEQ ID NO: 183349

SEQ ID NO: 541975 - RNA, 64 nt, hsa; identical to SEQ ID NO: 183350

SEQ ID NO: 541976 - RNA, 64 nt, hsa; identical to SEQ ID NO: 183351

SEQ ID NO: 541977 - RNA, 64 nt, hsa; identical to SEQ ID NO: 183352

SEQ ID NO: 541978 - RNA, 64 nt, hsa; identical to SEQ ID NO: 183353

SEQ ID NO: 541979 - RNA, 64 nt, hsa; identical to SEQ ID NO: 183354

SEQ ID NO: 541980 - RNA, 64 nt, hsa; identical to SEQ ID NO: 183355

SEQ ID NO: 541981 - RNA, 64 nt, hsa; identical to SEQ ID NO: 183356

SEQ ID NO: 541982 - RNA, 64 nt, hsa; identical to SEQ ID NO: 183357

SEQ ID NO: 541983 - RNA, 64 nt, hsa; identical to SEQ ID NO: 183358

SEQ ID NO: 541984 - RNA, 64 nt, hsa; identical to SEQ ID NO: 183359

SEQ ID NO: 541985 - RNA, 64 nt, hsa; identical to SEQ ID NO: 183360

SEQ ID NO: 541986 - RNA, 64 nt, hsa; identical to SEQ ID NO: 183361

SEQ ID NO: 541987 - RNA, 64 nt, hsa; identical to SEQ ID NO: 183362

SEQ ID NO: 541988 - RNA, 64 nt, hsa; identical to SEQ ID NO: 183363

SEQ ID NO: 541989 - RNA, 64 nt, hsa; identical to SEQ ID NO: 183364

SEQ ID NO: 541990 - RNA, 64 nt, hsa; identical to SEQ ID NO: 183365

SEQ ID NO: 541991 - RNA, 64 nt, hsa; identical to SEQ ID NO: 183366

SEQ ID NO: 541992 - RNA, 64 nt, hsa; identical to SEQ ID NO: 183367

SEQ ID NO: 541993 - RNA, 64 nt, hsa; identical to SEQ ID NO: 183368

SEQ ID NO: 541994 - RNA, 63 nt, hsa; identical to SEQ ID NO: 183369

SEQ ID NO: 541995 - RNA, 64 nt, hsa; identical to SEQ ID NO: 183370

SEQ ID NO: 541996 - RNA, 64 nt, hsa; identical to SEQ ID NO: 183371

SEQ ID NO: 541997 - RNA, 64 nt, hsa; identical to SEQ ID NO: 183372

SEQ ID NO: 541998 - RNA, 64 nt, hsa; identical to SEQ ID NO: 183373

SEQ ID NO: 541999 - RNA, 64 nt, hsa; identical to SEQ ID NO: 183374

SEQ ID NO: 542000 - RNA, 64 nt, hsa; identical to SEQ ID NO: 183375

SEQ ID NO: 542001 - RNA, 64 nt, hsa; identical to SEQ ID NO: 183376

SEQ ID NO: 542002 - RNA, 64 nt, hsa; identical to SEQ ID NO: 183377

SEQ ID NO: 542003 - RNA, 64 nt, hsa; identical to SEQ ID NO: 183378

SEQ ID NO: 542004 - RNA, 64 nt, hsa; identical to SEQ ID NO: 183379

SEQ ID NO: 542005 - RNA, 64 nt, hsa; identical to SEQ ID NO: 183380

SEQ ID NO: 542006 - RNA, 64 nt, hsa; identical to SEQ ID NO: 183381

SEQ ID NO: 542007 - RNA, 64 nt, hsa; identical to SEQ ID NO: 183382

SEQ ID NO: 542008 - RNA, 64 nt, hsa; identical to SEQ ID NO: 183383

SEQ ID NO: 542009 - RNA, 64 nt, hsa; identical to SEQ ID NO: 183384

SEQ ID NO: 542010 - RNA, 64 nt, hsa; identical to SEQ ID NO: 183385

SEQ ID NO: 542011 - RNA, 64 nt, hsa; identical to SEQ ID NO: 183386

SEQ ID NO: 542012 - RNA, 64 nt, hsa; identical to SEQ ID NO: 183387

SEQ ID NO: 542013 - RNA, 64 nt, hsa; identical to SEQ ID NO: 183388

SEQ ID NO: 542014 - RNA, 64 nt, hsa; identical to SEQ ID NO: 183389

SEQ ID NO: 542015 - RNA, 64 nt, hsa; identical to SEQ ID NO: 183390

SEQ ID NO: 542016 - RNA, 64 nt, hsa; identical to SEQ ID NO: 183391

SEQ ID NO: 542017 - RNA, 64 nt, hsa; identical to SEQ ID NO: 183392

SEQ ID NO: 542018 - RNA, 64 nt, hsa; identical to SEQ ID NO: 183393

SEQ ID NO: 542019 - RNA, 64 nt, hsa; identical to SEQ ID NO: 183394

SEQ ID NO: 542020 - RNA, 64 nt, hsa; identical to SEQ ID NO: 183395

SEQ ID NO: 542021 - RNA, 64 nt, hsa; identical to SEQ ID NO: 183396

SEQ ID NO: 542022 - RNA, 64 nt, hsa; identical to SEQ ID NO: 183397

SEQ ID NO: 542023 - RNA, 64 nt, hsa; identical to SEQ ID NO: 183398

SEQ ID NO: 542024 - RNA, 64 nt, hsa; identical to SEQ ID NO: 183399

SEQ ID NO: 542025 - RNA, 64 nt, hsa; identical to SEQ ID NO: 183400

SEQ ID NO: 542026 - RNA, 64 nt, hsa; identical to SEQ ID NO: 183401

SEQ ID NO: 542027 - RNA, 64 nt, hsa; identical to SEQ ID NO: 183402

SEQ ID NO: 542028 - RNA, 64 nt, hsa; identical to SEQ ID NO: 183403

SEQ ID NO: 542029 - RNA, 64 nt, hsa; identical to SEQ ID NO: 183404

SEQ ID NO: 542030 - RNA, 64 nt, hsa; identical to SEQ ID NO: 183405

SEQ ID NO: 542031 - RNA, 64 nt, hsa; identical to SEQ ID NO: 183406

SEQ ID NO: 542032 - RNA, 64 nt, hsa; identical to SEQ ID NO: 183407

SEQ ID NO: 542033 - RNA, 64 nt, hsa; identical to SEQ ID NO: 183408

SEQ ID NO: 542034 - RNA, 64 nt, hsa; identical to SEQ ID NO: 183409

SEQ ID NO: 542035 - RNA, 64 nt, hsa; identical to SEQ ID NO: 183410

SEQ ID NO: 542036 - RNA, 64 nt, hsa; identical to SEQ ID NO: 183411

SEQ ID NO: 542037 - RNA, 64 nt, hsa; identical to SEQ ID NO: 183412

SEQ ID NO: 542038 - RNA, 64 nt, hsa; identical to SEQ ID NO: 183413

SEQ ID NO: 542039 - RNA, 64 nt, hsa; identical to SEQ ID NO: 183414

SEQ ID NO: 542040 - RNA, 64 nt, hsa; identical to SEQ ID NO: 183415

SEQ ID NO: 542041 - RNA, 64 nt, hsa; identical to SEQ ID NO: 183416

SEQ ID NO: 542042 - RNA, 64 nt, hsa; identical to SEQ ID NO: 183417

SEQ ID NO: 542043 - RNA, 64 nt, hsa; identical to SEQ ID NO: 183418

SEQ ID NO: 542044 - RNA, 64 nt, hsa; identical to SEQ ID NO: 183419

SEQ ID NO: 542045 - RNA, 64 nt, hsa; identical to SEQ ID NO: 183420

SEQ ID NO: 542046 - RNA, 64 nt, hsa; identical to SEQ ID NO: 183421

SEQ ID NO: 542047 - RNA, 64 nt, hsa; identical to SEQ ID NO: 183422

SEQ ID NO: 542048 - RNA, 64 nt, hsa; identical to SEQ ID NO: 183423

SEQ ID NO: 542049 - RNA, 64 nt, hsa; identical to SEQ ID NO: 183424

SEQ ID NO: 542050 - RNA, 64 nt, hsa; identical to SEQ ID NO: 183425

SEQ ID NO: 542051 - RNA, 64 nt, hsa; identical to SEQ ID NO: 183426

SEQ ID NO: 542052 - RNA, 64 nt, hsa; identical to SEQ ID NO: 183427

SEQ ID NO: 542053 - RNA, 64 nt, hsa; identical to SEQ ID NO: 183428

SEQ ID NO: 542054 - RNA, 64 nt, hsa; identical to SEQ ID NO: 183429

SEQ ID NO: 542055 - RNA, 64 nt, hsa; identical to SEQ ID NO: 183430

SEQ ID NO: 542056 - RNA, 64 nt, hsa; identical to SEQ ID NO: 183431

SEQ ID NO: 542057 - RNA, 64 nt, hsa; identical to SEQ ID NO: 183432

SEQ ID NO: 542058 - RNA, 64 nt, hsa; identical to SEQ ID NO: 183433

SEQ ID NO: 542059 - RNA, 64 nt, hsa; identical to SEQ ID NO: 183434

SEQ ID NO: 542060 - RNA, 64 nt, hsa; identical to SEQ ID NO: 183435

SEQ ID NO: 542061 - RNA, 64 nt, hsa; identical to SEQ ID NO: 183436

SEQ ID NO: 542062 - RNA, 64 nt, hsa; identical to SEQ ID NO: 183437

SEQ ID NO: 542063 - RNA, 64 nt, hsa; identical to SEQ ID NO: 183438

SEQ ID NO: 542064 - RNA, 64 nt, hsa; identical to SEQ ID NO: 183439

SEQ ID NO: 542065 - RNA, 64 nt, hsa; identical to SEQ ID NO: 183440

SEQ ID NO: 542066 - RNA, 64 nt, hsa; identical to SEQ ID NO: 183441

SEQ ID NO: 542067 - RNA, 64 nt, hsa; identical to SEQ ID NO: 183442

SEQ ID NO: 542068 - RNA, 64 nt, hsa; identical to SEQ ID NO: 183443

SEQ ID NO: 542069 - RNA, 64 nt, hsa; identical to SEQ ID NO: 183444

SEQ ID NO: 542070 - RNA, 64 nt, hsa; identical to SEQ ID NO: 183445

SEQ ID NO: 542071 - RNA, 64 nt, hsa; identical to SEQ ID NO: 183446

SEQ ID NO: 542072 - RNA, 64 nt, hsa; identical to SEQ ID NO: 183447

SEQ ID NO: 542073 - RNA, 64 nt, hsa; identical to SEQ ID NO: 183448

SEQ ID NO: 542074 - RNA, 64 nt, hsa; identical to SEQ ID NO: 183449

SEQ ID NO: 542075 - RNA, 64 nt, hsa; identical to SEQ ID NO: 183450

SEQ ID NO: 542076 - RNA, 64 nt, hsa; identical to SEQ ID NO: 183451

SEQ ID NO: 542077 - RNA, 64 nt, hsa; identical to SEQ ID NO: 183452

SEQ ID NO: 542078 - RNA, 64 nt, hsa; identical to SEQ ID NO: 183453

SEQ ID NO: 542079 - RNA, 64 nt, hsa; identical to SEQ ID NO: 183454

SEQ ID NO: 542080 - RNA, 64 nt, hsa; identical to SEQ ID NO: 183455

SEQ ID NO: 542081 - RNA, 64 nt, hsa; identical to SEQ ID NO: 183456

SEQ ID NO: 542082 - RNA, 64 nt, hsa; identical to SEQ ID NO: 183457

SEQ ID NO: 542083 - RNA, 64 nt, hsa; identical to SEQ ID NO: 183458

SEQ ID NO: 542084 - RNA, 64 nt, hsa; identical to SEQ ID NO: 183459

SEQ ID NO: 542085 - RNA, 64 nt, hsa; identical to SEQ ID NO: 183460

SEQ ID NO: 542086 - RNA, 64 nt, hsa; identical to SEQ ID NO: 183461

SEQ ID NO: 542087 - RNA, 64 nt, hsa; identical to SEQ ID NO: 183462

SEQ ID NO: 542088 - RNA, 64 nt, hsa; identical to SEQ ID NO: 183463

SEQ ID NO: 542089 - RNA, 64 nt, hsa; identical to SEQ ID NO: 183464

SEQ ID NO: 542090 - RNA, 64 nt, hsa; identical to SEQ ID NO: 183465

SEQ ID NO: 542091 - RNA, 64 nt, hsa; identical to SEQ ID NO: 183466

SEQ ID NO: 542092 - RNA, 64 nt, hsa; identical to SEQ ID NO: 183467

SEQ ID NO: 542093 - RNA, 64 nt, hsa; identical to SEQ ID NO: 183468

SEQ ID NO: 542094 - RNA, 64 nt, hsa; identical to SEQ ID NO: 183469

SEQ ID NO: 542095 - RNA, 64 nt, hsa; identical to SEQ ID NO: 183470

SEQ ID NO: 542096 - RNA, 64 nt, hsa; identical to SEQ ID NO: 183471

SEQ ID NO: 542097 - RNA, 64 nt, hsa; identical to SEQ ID NO: 183472

SEQ ID NO: 542098 - RNA, 64 nt, hsa; identical to SEQ ID NO: 183473

SEQ ID NO: 542099 - RNA, 64 nt, hsa; identical to SEQ ID NO: 183474

SEQ ID NO: 542100 - RNA, 64 nt, hsa; identical to SEQ ID NO: 183475

SEQ ID NO: 542101 - RNA, 64 nt, hsa; identical to SEQ ID NO: 183476

SEQ ID NO: 542102 - RNA, 64 nt, hsa; identical to SEQ ID NO: 183477

SEQ ID NO: 542103 - RNA, 64 nt, hsa; identical to SEQ ID NO: 183478

SEQ ID NO: 542104 - RNA, 64 nt, hsa; identical to SEQ ID NO: 183479

SEQ ID NO: 542105 - RNA, 64 nt, hsa; identical to SEQ ID NO: 183480

SEQ ID NO: 542106 - RNA, 64 nt, hsa; identical to SEQ ID NO: 183481

SEQ ID NO: 542107 - RNA, 64 nt, hsa; identical to SEQ ID NO: 183482

SEQ ID NO: 542108 - RNA, 64 nt, hsa; identical to SEQ ID NO: 183483

SEQ ID NO: 542109 - RNA, 64 nt, hsa; identical to SEQ ID NO: 183484

SEQ ID NO: 542110 - RNA, 64 nt, hsa; identical to SEQ ID NO: 183485

SEQ ID NO: 542111 - RNA, 64 nt, hsa; identical to SEQ ID NO: 183486

SEQ ID NO: 542112 - RNA, 64 nt, hsa; identical to SEQ ID NO: 183487

SEQ ID NO: 542113 - RNA, 64 nt, hsa; identical to SEQ ID NO: 183488

SEQ ID NO: 542114 - RNA, 64 nt, hsa; identical to SEQ ID NO: 183489

SEQ ID NO: 542115 - RNA, 64 nt, hsa; identical to SEQ ID NO: 183490

SEQ ID NO: 542116 - RNA, 64 nt, hsa; identical to SEQ ID NO: 183491

SEQ ID NO: 542117 - RNA, 64 nt, hsa; identical to SEQ ID NO: 183492

SEQ ID NO: 542118 - RNA, 64 nt, hsa; identical to SEQ ID NO: 183493

SEQ ID NO: 542119 - RNA, 64 nt, hsa; identical to SEQ ID NO: 183494

SEQ ID NO: 542120 - RNA, 64 nt, hsa; identical to SEQ ID NO: 183495

SEQ ID NO: 542121 - RNA, 64 nt, hsa; identical to SEQ ID NO: 183496

SEQ ID NO: 542122 - RNA, 64 nt, hsa; identical to SEQ ID NO: 183497

SEQ ID NO: 542123 - RNA, 64 nt, hsa; identical to SEQ ID NO: 183498

SEQ ID NO: 542124 - RNA, 64 nt, hsa; identical to SEQ ID NO: 183499

SEQ ID NO: 542125 - RNA, 64 nt, hsa; identical to SEQ ID NO: 183500

SEQ ID NO: 542126 - RNA, 64 nt, hsa; identical to SEQ ID NO: 183501

SEQ ID NO: 542127 - RNA, 64 nt, hsa; identical to SEQ ID NO: 183502

SEQ ID NO: 542128 - RNA, 64 nt, hsa; identical to SEQ ID NO: 183503

SEQ ID NO: 542129 - RNA, 64 nt, hsa; identical to SEQ ID NO: 183504

SEQ ID NO: 542130 - RNA, 64 nt, hsa; identical to SEQ ID NO: 183505

SEQ ID NO: 542131 - RNA, 64 nt, hsa; identical to SEQ ID NO: 183506

SEQ ID NO: 542132 - RNA, 64 nt, hsa; identical to SEQ ID NO: 183507

SEQ ID NO: 542133 - RNA, 64 nt, hsa; identical to SEQ ID NO: 183508

SEQ ID NO: 542134 - RNA, 64 nt, hsa; identical to SEQ ID NO: 183509

SEQ ID NO: 542135 - RNA, 64 nt, hsa; identical to SEQ ID NO: 183510

SEQ ID NO: 542136 - RNA, 64 nt, hsa; identical to SEQ ID NO: 183511

SEQ ID NO: 542137 - RNA, 64 nt, hsa; identical to SEQ ID NO: 183512

SEQ ID NO: 542138 - RNA, 64 nt, hsa; identical to SEQ ID NO: 183513

SEQ ID NO: 542139 - RNA, 64 nt, hsa; identical to SEQ ID NO: 183514

SEQ ID NO: 542140 - RNA, 64 nt, hsa; identical to SEQ ID NO: 183515

SEQ ID NO: 542141 - RNA, 64 nt, hsa; identical to SEQ ID NO: 183516

SEQ ID NO: 542142 - RNA, 64 nt, hsa; identical to SEQ ID NO: 183517

SEQ ID NO: 542143 - RNA, 64 nt, hsa; identical to SEQ ID NO: 183518

SEQ ID NO: 542144 - RNA, 64 nt, hsa; identical to SEQ ID NO: 183519

SEQ ID NO: 542145 - RNA, 64 nt, hsa; identical to SEQ ID NO: 183520

SEQ ID NO: 542146 - RNA, 64 nt, hsa; identical to SEQ ID NO: 183521

SEQ ID NO: 542147 - RNA, 64 nt, hsa; identical to SEQ ID NO: 183522

SEQ ID NO: 542148 - RNA, 64 nt, hsa; identical to SEQ ID NO: 183523

SEQ ID NO: 542149 - RNA, 64 nt, hsa; identical to SEQ ID NO: 183524

SEQ ID NO: 542150 - RNA, 64 nt, hsa; identical to SEQ ID NO: 183525

SEQ ID NO: 542151 - RNA, 64 nt, hsa; identical to SEQ ID NO: 183526

SEQ ID NO: 542152 - RNA, 64 nt, hsa; identical to SEQ ID NO: 183527

SEQ ID NO: 542153 - RNA, 64 nt, hsa; identical to SEQ ID NO: 183528

SEQ ID NO: 542154 - RNA, 64 nt, hsa; identical to SEQ ID NO: 183529

SEQ ID NO: 542155 - RNA, 64 nt, hsa; identical to SEQ ID NO: 183530

SEQ ID NO: 542156 - RNA, 64 nt, hsa; identical to SEQ ID NO: 183531

SEQ ID NO: 542157 - RNA, 64 nt, hsa; identical to SEQ ID NO: 183532

SEQ ID NO: 542158 - RNA, 64 nt, hsa; identical to SEQ ID NO: 183533

SEQ ID NO: 542159 - RNA, 64 nt, hsa; identical to SEQ ID NO: 183534

SEQ ID NO: 542160 - RNA, 64 nt, hsa; identical to SEQ ID NO: 183535

SEQ ID NO: 542161 - RNA, 64 nt, hsa; identical to SEQ ID NO: 183536

SEQ ID NO: 542162 - RNA, 64 nt, hsa; identical to SEQ ID NO: 183537

SEQ ID NO: 542163 - RNA, 64 nt, hsa; identical to SEQ ID NO: 183538

SEQ ID NO: 542164 - RNA, 64 nt, hsa; identical to SEQ ID NO: 183539

SEQ ID NO: 542165 - RNA, 64 nt, hsa; identical to SEQ ID NO: 183540

SEQ ID NO: 542166 - RNA, 64 nt, hsa; identical to SEQ ID NO: 183541

SEQ ID NO: 542167 - RNA, 64 nt, hsa; identical to SEQ ID NO: 183542

SEQ ID NO: 542168 - RNA, 64 nt, hsa; identical to SEQ ID NO: 183543

SEQ ID NO: 542169 - RNA, 64 nt, hsa; identical to SEQ ID NO: 183544

SEQ ID NO: 542170 - RNA, 64 nt, hsa; identical to SEQ ID NO: 183545

SEQ ID NO: 542171 - RNA, 64 nt, hsa; identical to SEQ ID NO: 183546

SEQ ID NO: 542172 - RNA, 64 nt, hsa; identical to SEQ ID NO: 183547

SEQ ID NO: 542173 - RNA, 64 nt, hsa; identical to SEQ ID NO: 183548

SEQ ID NO: 542174 - RNA, 64 nt, hsa; identical to SEQ ID NO: 183549

SEQ ID NO: 542175 - RNA, 64 nt, hsa; identical to SEQ ID NO: 183550

SEQ ID NO: 542176 - RNA, 64 nt, hsa; identical to SEQ ID NO: 183551

SEQ ID NO: 542177 - RNA, 64 nt, hsa; identical to SEQ ID NO: 183552

SEQ ID NO: 542178 - RNA, 64 nt, hsa; identical to SEQ ID NO: 183553

SEQ ID NO: 542179 - RNA, 64 nt, hsa; identical to SEQ ID NO: 183554

SEQ ID NO: 542180 - RNA, 64 nt, hsa; identical to SEQ ID NO: 183555

SEQ ID NO: 542181 - RNA, 64 nt, hsa; identical to SEQ ID NO: 183556

SEQ ID NO: 542182 - RNA, 64 nt, hsa; identical to SEQ ID NO: 183557

SEQ ID NO: 542183 - RNA, 64 nt, hsa; identical to SEQ ID NO: 183558

SEQ ID NO: 542184 - RNA, 64 nt, hsa; identical to SEQ ID NO: 183559

SEQ ID NO: 542185 - RNA, 64 nt, hsa; identical to SEQ ID NO: 183560

SEQ ID NO: 542186 - RNA, 64 nt, hsa; identical to SEQ ID NO: 183561

SEQ ID NO: 542187 - RNA, 64 nt, hsa; identical to SEQ ID NO: 183562

SEQ ID NO: 542188 - RNA, 64 nt, hsa; identical to SEQ ID NO: 183563

SEQ ID NO: 542189 - RNA, 64 nt, hsa; identical to SEQ ID NO: 183564

SEQ ID NO: 542190 - RNA, 64 nt, hsa; identical to SEQ ID NO: 183565

SEQ ID NO: 542191 - RNA, 64 nt, hsa; identical to SEQ ID NO: 183566

SEQ ID NO: 542192 - RNA, 64 nt, hsa; identical to SEQ ID NO: 183567

SEQ ID NO: 542193 - RNA, 64 nt, hsa; identical to SEQ ID NO: 183568

SEQ ID NO: 542194 - RNA, 64 nt, hsa; identical to SEQ ID NO: 183569

SEQ ID NO: 542195 - RNA, 64 nt, hsa; identical to SEQ ID NO: 183570

SEQ ID NO: 542196 - RNA, 64 nt, hsa; identical to SEQ ID NO: 183571

SEQ ID NO: 542197 - RNA, 64 nt, hsa; identical to SEQ ID NO: 183572

SEQ ID NO: 542198 - RNA, 64 nt, hsa; identical to SEQ ID NO: 183573

SEQ ID NO: 542199 - RNA, 64 nt, hsa; identical to SEQ ID NO: 183574

SEQ ID NO: 542200 - RNA, 64 nt, hsa; identical to SEQ ID NO: 183575

SEQ ID NO: 542201 - RNA, 64 nt, hsa; identical to SEQ ID NO: 183576

SEQ ID NO: 542202 - RNA, 64 nt, hsa; identical to SEQ ID NO: 183577

SEQ ID NO: 542203 - RNA, 64 nt, hsa; identical to SEQ ID NO: 183578

SEQ ID NO: 542204 - RNA, 64 nt, hsa; identical to SEQ ID NO: 183579

SEQ ID NO: 542205 - RNA, 64 nt, hsa; identical to SEQ ID NO: 183580

SEQ ID NO: 542206 - RNA, 64 nt, hsa; identical to SEQ ID NO: 183581

SEQ ID NO: 542207 - RNA, 64 nt, hsa; identical to SEQ ID NO: 183582

SEQ ID NO: 542208 - RNA, 64 nt, hsa; identical to SEQ ID NO: 183583

SEQ ID NO: 542209 - RNA, 64 nt, hsa; identical to SEQ ID NO: 183584

SEQ ID NO: 542210 - RNA, 64 nt, hsa; identical to SEQ ID NO: 183585

SEQ ID NO: 542211 - RNA, 64 nt, hsa; identical to SEQ ID NO: 183586

SEQ ID NO: 542212 - RNA, 64 nt, hsa; identical to SEQ ID NO: 183587

SEQ ID NO: 542213 - RNA, 64 nt, hsa; identical to SEQ ID NO: 183588

SEQ ID NO: 542214 - RNA, 64 nt, hsa; identical to SEQ ID NO: 183589

SEQ ID NO: 542215 - RNA, 64 nt, hsa; identical to SEQ ID NO: 183590

SEQ ID NO: 542216 - RNA, 64 nt, hsa; identical to SEQ ID NO: 183591

SEQ ID NO: 542217 - RNA, 64 nt, hsa; identical to SEQ ID NO: 183592

SEQ ID NO: 542218 - RNA, 64 nt, hsa; identical to SEQ ID NO: 183593

SEQ ID NO: 542219 - RNA, 64 nt, hsa; identical to SEQ ID NO: 183594

SEQ ID NO: 542220 - RNA, 64 nt, hsa; identical to SEQ ID NO: 183595

SEQ ID NO: 542221 - RNA, 64 nt, hsa; identical to SEQ ID NO: 183596

SEQ ID NO: 542222 - RNA, 64 nt, hsa; identical to SEQ ID NO: 183597

SEQ ID NO: 542223 - RNA, 64 nt, hsa; identical to SEQ ID NO: 183598

SEQ ID NO: 542224 - RNA, 64 nt, hsa; identical to SEQ ID NO: 183599

SEQ ID NO: 542225 - RNA, 64 nt, hsa; identical to SEQ ID NO: 183600

SEQ ID NO: 542226 - RNA, 64 nt, hsa; identical to SEQ ID NO: 183601

SEQ ID NO: 542227 - RNA, 64 nt, hsa; identical to SEQ ID NO: 183602

SEQ ID NO: 542228 - RNA, 64 nt, hsa; identical to SEQ ID NO: 183603

SEQ ID NO: 542229 - RNA, 64 nt, hsa; identical to SEQ ID NO: 541607

SEQ ID NO: 542230 - RNA, 64 nt, hsa; identical to SEQ ID NO: 541608

SEQ ID NO: 542231 - RNA, 64 nt, hsa; identical to SEQ ID NO: 541609

SEQ ID NO: 542232 - RNA, 64 nt, hsa; identical to SEQ ID NO: 541610

SEQ ID NO: 542233 - RNA, 64 nt, hsa; identical to SEQ ID NO: 84166

SEQ ID NO: 542234 - RNA, 64 nt, hsa; identical to SEQ ID NO: 84167

SEQ ID NO: 542235 - RNA, 64 nt, hsa; identical to SEQ ID NO: 84168

SEQ ID NO: 542236 - RNA, 64 nt, hsa; identical to SEQ ID NO: 84169

SEQ ID NO: 542237 - RNA, 64 nt, hsa; identical to SEQ ID NO: 84170

SEQ ID NO: 542238 - RNA, 64 nt, hsa; identical to SEQ ID NO: 84171

SEQ ID NO: 542239 - RNA, 64 nt, hsa; identical to SEQ ID NO: 84172

SEQ ID NO: 542240 - RNA, 64 nt, hsa; identical to SEQ ID NO: 84173

SEQ ID NO: 542241 - RNA, 64 nt, hsa; identical to SEQ ID NO: 84174

SEQ ID NO: 542242 - RNA, 64 nt, hsa; identical to SEQ ID NO: 84175

SEQ ID NO: 542243 - RNA, 64 nt, hsa; identical to SEQ ID NO: 84176

SEQ ID NO: 542244 - RNA, 64 nt, hsa; identical to SEQ ID NO: 84177

SEQ ID NO: 542245 - RNA, 64 nt, hsa; identical to SEQ ID NO: 84178

SEQ ID NO: 542246 - RNA, 64 nt, hsa; identical to SEQ ID NO: 84179

SEQ ID NO: 542247 - RNA, 64 nt, hsa; identical to SEQ ID NO: 84180

SEQ ID NO: 542248 - RNA, 64 nt, hsa; identical to SEQ ID NO: 84181

SEQ ID NO: 542249 - RNA, 64 nt, hsa; identical to SEQ ID NO: 84182

SEQ ID NO: 542250 - RNA, 64 nt, hsa; identical to SEQ ID NO: 84183

SEQ ID NO: 542251 - RNA, 64 nt, hsa; identical to SEQ ID NO: 84184

SEQ ID NO: 542252 - RNA, 64 nt, hsa; identical to SEQ ID NO: 84185

SEQ ID NO: 542253 - RNA, 64 nt, hsa; identical to SEQ ID NO: 84186

SEQ ID NO: 542254 - RNA, 64 nt, hsa; identical to SEQ ID NO: 84187

SEQ ID NO: 542255 - RNA, 64 nt, hsa; identical to SEQ ID NO: 84188

SEQ ID NO: 542256 - RNA, 64 nt, hsa; identical to SEQ ID NO: 84189

SEQ ID NO: 542257 - RNA, 64 nt, hsa; identical to SEQ ID NO: 84190

SEQ ID NO: 542258 - RNA, 64 nt, hsa; identical to SEQ ID NO: 84191

SEQ ID NO: 542259 - RNA, 64 nt, hsa; identical to SEQ ID NO: 84192

SEQ ID NO: 542260 - RNA, 64 nt, hsa; identical to SEQ ID NO: 84193

SEQ ID NO: 542261 - RNA, 64 nt, hsa; identical to SEQ ID NO: 84194

SEQ ID NO: 542262 - RNA, 64 nt, hsa; identical to SEQ ID NO: 84195

SEQ ID NO: 542263 - RNA, 64 nt, hsa; identical to SEQ ID NO: 84196

SEQ ID NO: 542264 - RNA, 64 nt, hsa; identical to SEQ ID NO: 84197

SEQ ID NO: 542265 - RNA, 64 nt, hsa; identical to SEQ ID NO: 84198

SEQ ID NO: 542266 - RNA, 64 nt, hsa; identical to SEQ ID NO: 84199

SEQ ID NO: 542267 - RNA, 64 nt, hsa; identical to SEQ ID NO: 84200

SEQ ID NO: 542268 - RNA, 64 nt, hsa; identical to SEQ ID NO: 84201

SEQ ID NO: 542269 - RNA, 64 nt, hsa; identical to SEQ ID NO: 84202

SEQ ID NO: 542270 - RNA, 64 nt, hsa; identical to SEQ ID NO: 84203

SEQ ID NO: 542271 - RNA, 64 nt, hsa; identical to SEQ ID NO: 84204

SEQ ID NO: 542272 - RNA, 64 nt, hsa; identical to SEQ ID NO: 84205

SEQ ID NO: 542273 - RNA, 64 nt, hsa; identical to SEQ ID NO: 84206

SEQ ID NO: 542274 - RNA, 64 nt, hsa; identical to SEQ ID NO: 84207

SEQ ID NO: 542275 - RNA, 64 nt, hsa; identical to SEQ ID NO: 84208

SEQ ID NO: 542276 - RNA, 64 nt, hsa; identical to SEQ ID NO: 84209

SEQ ID NO: 542277 - RNA, 64 nt, hsa; identical to SEQ ID NO: 84210

SEQ ID NO: 542278 - RNA, 64 nt, hsa; identical to SEQ ID NO: 84211

SEQ ID NO: 542279 - RNA, 64 nt, hsa; identical to SEQ ID NO: 84212

SEQ ID NO: 542280 - RNA, 64 nt, hsa; identical to SEQ ID NO: 84213

SEQ ID NO: 542281 - RNA, 64 nt, hsa; identical to SEQ ID NO: 84214

SEQ ID NO: 542282 - RNA, 64 nt, hsa; identical to SEQ ID NO: 84215

SEQ ID NO: 542283 - RNA, 64 nt, hsa; identical to SEQ ID NO: 84216

SEQ ID NO: 542284 - RNA, 64 nt, hsa; identical to SEQ ID NO: 84217

SEQ ID NO: 542285 - RNA, 64 nt, hsa; identical to SEQ ID NO: 84218

SEQ ID NO: 542286 - RNA, 64 nt, hsa; identical to SEQ ID NO: 84219

SEQ ID NO: 542287 - RNA, 64 nt, hsa; identical to SEQ ID NO: 84220

SEQ ID NO: 542288 - RNA, 64 nt, hsa; identical to SEQ ID NO: 84221

SEQ ID NO: 542289 - RNA, 64 nt, hsa; identical to SEQ ID NO: 84222

SEQ ID NO: 542290 - RNA, 64 nt, hsa; identical to SEQ ID NO: 84223

SEQ ID NO: 542291 - RNA, 64 nt, hsa; identical to SEQ ID NO: 84224

SEQ ID NO: 542292 - RNA, 64 nt, hsa; identical to SEQ ID NO: 84225

SEQ ID NO: 542293 - RNA, 64 nt, hsa; identical to SEQ ID NO: 84226

SEQ ID NO: 542294 - RNA, 64 nt, hsa; identical to SEQ ID NO: 84227

SEQ ID NO: 542295 - RNA, 64 nt, hsa; identical to SEQ ID NO: 84228

SEQ ID NO: 542296 - RNA, 64 nt, hsa; identical to SEQ ID NO: 84229

SEQ ID NO: 542297 - RNA, 64 nt, hsa; identical to SEQ ID NO: 84230

SEQ ID NO: 542298 - RNA, 64 nt, hsa; identical to SEQ ID NO: 84231

SEQ ID NO: 542299 - RNA, 64 nt, hsa; identical to SEQ ID NO: 84232

SEQ ID NO: 542300 - RNA, 64 nt, hsa; identical to SEQ ID NO: 84233

SEQ ID NO: 542301 - RNA, 64 nt, hsa
aaaguggcuccuuuaauuggugacuuggagaaagcuaggucaaggguuuauuauagcacccucu

SEQ ID NO: 542302 - RNA, 64 nt, hsa
uucuauaaugccaucaugcagcaauuaugagaggcuaggucauccaaagagaagacccuaucaa

SEQ ID NO: 542303 - RNA, 64 nt, hsa
ugucuaaaaguaaaaaaaaauaucagccugucuccuaggucaguccccuccuggacccacccgc

SEQ ID NO: 542304 - RNA, 64 nt, hsa
cucuccugaggaaccuacaggauucuaagguuuccuaggucacugaacaacuaaucuugguccc

SEQ ID NO: 542305 - RNA, 64 nt, hsa
gagcucagaugaagagaaauccuaaguuaccuuucuaggucaaggccugucccuggccaucucu

SEQ ID NO: 542306 - RNA, 64 nt, hsa
aacugugagagucuuuguaaguaaacugcccugucuaggucaguacccaccugagcuuuggacg

SEQ ID NO: 542307 - RNA, 64 nt, hsa
aaugugaagaguccagugguagaauuugagcuuucuaggucacauuggguuaaguuuguaugac

SEQ ID NO: 542308 - RNA, 64 nt, hsa
gagauagguuuggucguaucauuuugugaguuuccuaggucaguguuggguuugguuggguugu

SEQ ID NO: 542309 - RNA, 64 nt, hsa; identical to SEQ ID NO: 265126

SEQ ID NO: 542310 - RNA, 64 nt, hsa; identical to SEQ ID NO: 265127

SEQ ID NO: 542311 - RNA, 64 nt, hsa; identical to SEQ ID NO: 265128

SEQ ID NO: 542312 - RNA, 64 nt, hsa; identical to SEQ ID NO: 265129

SEQ ID NO: 542313 - RNA, 64 nt, hsa; identical to SEQ ID NO: 265130

SEQ ID NO: 542314 - RNA, 64 nt, hsa; identical to SEQ ID NO: 265131

SEQ ID NO: 542315 - RNA, 64 nt, hsa; identical to SEQ ID NO: 265132

SEQ ID NO: 542316 - RNA, 64 nt, hsa; identical to SEQ ID NO: 265133

SEQ ID NO: 542317 - RNA, 64 nt, hsa; identical to SEQ ID NO: 265134

SEQ ID NO: 542318 - RNA, 64 nt, hsa; identical to SEQ ID NO: 265135

SEQ ID NO: 542319 - RNA, 64 nt, hsa; identical to SEQ ID NO: 265136

SEQ ID NO: 542320 - RNA, 64 nt, hsa; identical to SEQ ID NO: 265137

SEQ ID NO: 542321 - RNA, 64 nt, hsa; identical to SEQ ID NO: 265138

SEQ ID NO: 542322 - RNA, 64 nt, hsa; identical to SEQ ID NO: 265139

SEQ ID NO: 542323 - RNA, 64 nt, hsa; identical to SEQ ID NO: 265140

SEQ ID NO: 542324 - RNA, 64 nt, hsa; identical to SEQ ID NO: 265141

SEQ ID NO: 542325 - RNA, 64 nt, hsa; identical to SEQ ID NO: 265142

SEQ ID NO: 542326 - RNA, 64 nt, hsa; identical to SEQ ID NO: 265143

SEQ ID NO: 542327 - RNA, 64 nt, hsa; identical to SEQ ID NO: 265144

SEQ ID NO: 542328 - RNA, 64 nt, hsa; identical to SEQ ID NO: 265145

SEQ ID NO: 542329 - RNA, 64 nt, hsa; identical to SEQ ID NO: 265146

SEQ ID NO: 542330 - RNA, 64 nt, hsa; identical to SEQ ID NO: 265147

SEQ ID NO: 542331 - RNA, 64 nt, hsa; identical to SEQ ID NO: 265148

SEQ ID NO: 542332 - RNA, 64 nt, hsa; identical to SEQ ID NO: 265149

SEQ ID NO: 542333 - RNA, 63 nt, hsa; identical to SEQ ID NO: 265150

SEQ ID NO: 542334 - RNA, 64 nt, hsa; identical to SEQ ID NO: 265151

SEQ ID NO: 542335 - RNA, 64 nt, hsa; identical to SEQ ID NO: 265152

SEQ ID NO: 542336 - RNA, 64 nt, hsa; identical to SEQ ID NO: 265153

SEQ ID NO: 542337 - RNA, 64 nt, hsa; identical to SEQ ID NO: 265154

SEQ ID NO: 542338 - RNA, 64 nt, hsa; identical to SEQ ID NO: 265155

SEQ ID NO: 542339 - RNA, 64 nt, hsa; identical to SEQ ID NO: 265156

SEQ ID NO: 542340 - RNA, 64 nt, hsa; identical to SEQ ID NO: 265157

SEQ ID NO: 542341 - RNA, 64 nt, hsa; identical to SEQ ID NO: 265158

SEQ ID NO: 542342 - RNA, 64 nt, hsa; identical to SEQ ID NO: 265159

SEQ ID NO: 542343 - RNA, 64 nt, hsa; identical to SEQ ID NO: 265160

SEQ ID NO: 542344 - RNA, 64 nt, hsa; identical to SEQ ID NO: 265161

SEQ ID NO: 542345 - RNA, 64 nt, hsa; identical to SEQ ID NO: 265162

SEQ ID NO: 542346 - RNA, 64 nt, hsa; identical to SEQ ID NO: 265163

SEQ ID NO: 542347 - RNA, 64 nt, hsa; identical to SEQ ID NO: 265164

SEQ ID NO: 542348 - RNA, 64 nt, hsa; identical to SEQ ID NO: 265165

SEQ ID NO: 542349 - RNA, 64 nt, hsa; identical to SEQ ID NO: 265166

SEQ ID NO: 542350 - RNA, 64 nt, hsa; identical to SEQ ID NO: 265167

SEQ ID NO: 542351 - RNA, 64 nt, hsa; identical to SEQ ID NO: 265168

SEQ ID NO: 542352 - RNA, 64 nt, hsa; identical to SEQ ID NO: 265169

SEQ ID NO: 542353 - RNA, 64 nt, hsa; identical to SEQ ID NO: 265170

SEQ ID NO: 542354 - RNA, 64 nt, hsa; identical to SEQ ID NO: 265171

SEQ ID NO: 542355 - RNA, 64 nt, hsa; identical to SEQ ID NO: 265172

SEQ ID NO: 542356 - RNA, 64 nt, hsa; identical to SEQ ID NO: 265173

SEQ ID NO: 542357 - RNA, 64 nt, hsa; identical to SEQ ID NO: 265174

SEQ ID NO: 542358 - RNA, 64 nt, hsa; identical to SEQ ID NO: 265175

SEQ ID NO: 542359 - RNA, 64 nt, hsa; identical to SEQ ID NO: 265176

SEQ ID NO: 542360 - RNA, 64 nt, hsa; identical to SEQ ID NO: 265177

SEQ ID NO: 542361 - RNA, 64 nt, hsa; identical to SEQ ID NO: 265178

SEQ ID NO: 542362 - RNA, 64 nt, hsa; identical to SEQ ID NO: 265179

SEQ ID NO: 542363 - RNA, 64 nt, hsa; identical to SEQ ID NO: 328787

SEQ ID NO: 542364 - RNA, 64 nt, hsa; identical to SEQ ID NO: 328788

SEQ ID NO: 542365 - RNA, 64 nt, hsa; identical to SEQ ID NO: 328789

SEQ ID NO: 542366 - RNA, 64 nt, hsa; identical to SEQ ID NO: 328790

SEQ ID NO: 542367 - RNA, 64 nt, hsa; identical to SEQ ID NO: 328791

SEQ ID NO: 542368 - RNA, 64 nt, hsa; identical to SEQ ID NO: 328792

SEQ ID NO: 542369 - RNA, 64 nt, hsa; identical to SEQ ID NO: 328793

SEQ ID NO: 542370 - RNA, 64 nt, hsa; identical to SEQ ID NO: 328794

SEQ ID NO: 542371 - RNA, 64 nt, hsa; identical to SEQ ID NO: 328795

SEQ ID NO: 542372 - RNA, 64 nt, hsa; identical to SEQ ID NO: 328796

SEQ ID NO: 542373 - RNA, 64 nt, hsa; identical to SEQ ID NO: 328797

SEQ ID NO: 542374 - RNA, 64 nt, hsa; identical to SEQ ID NO: 328798

SEQ ID NO: 542375 - RNA, 64 nt, hsa; identical to SEQ ID NO: 328799

SEQ ID NO: 542376 - RNA, 64 nt, hsa; identical to SEQ ID NO: 328800

SEQ ID NO: 542377 - RNA, 64 nt, hsa; identical to SEQ ID NO: 328801

SEQ ID NO: 542378 - RNA, 64 nt, hsa; identical to SEQ ID NO: 328802

SEQ ID NO: 542379 - RNA, 64 nt, hsa; identical to SEQ ID NO: 328803

SEQ ID NO: 542380 - RNA, 64 nt, hsa; identical to SEQ ID NO: 328804

SEQ ID NO: 542381 - RNA, 64 nt, hsa; identical to SEQ ID NO: 532305

SEQ ID NO: 542382 - RNA, 64 nt, hsa; identical to SEQ ID NO: 532306

SEQ ID NO: 542383 - RNA, 64 nt, hsa; identical to SEQ ID NO: 532307

SEQ ID NO: 542384 - RNA, 64 nt, hsa; identical to SEQ ID NO: 532308

SEQ ID NO: 542385 - RNA, 64 nt, hsa; identical to SEQ ID NO: 532309

SEQ ID NO: 542386 - RNA, 57 nt, hsa; identical to SEQ ID NO: 83127

SEQ ID NO: 542387 - RNA, 64 nt, hsa; identical to SEQ ID NO: 532311

SEQ ID NO: 542388 - RNA, 64 nt, hsa; identical to SEQ ID NO: 532312

SEQ ID NO: 542389 - RNA, 64 nt, hsa; identical to SEQ ID NO: 532313

SEQ ID NO: 542390 - RNA, 64 nt, hsa; identical to SEQ ID NO: 532314

SEQ ID NO: 542391 - RNA, 64 nt, hsa; identical to SEQ ID NO: 532315

SEQ ID NO: 542392 - RNA, 64 nt, hsa; identical to SEQ ID NO: 532316

SEQ ID NO: 542393 - RNA, 64 nt, hsa; identical to SEQ ID NO: 532317

SEQ ID NO: 542394 - RNA, 64 nt, hsa; identical to SEQ ID NO: 532318

SEQ ID NO: 542395 - RNA, 59 nt, hsa; identical to SEQ ID NO: 83136

SEQ ID NO: 542396 - RNA, 64 nt, hsa; identical to SEQ ID NO: 532320

SEQ ID NO: 542397 - RNA, 64 nt, hsa; identical to SEQ ID NO: 532321

SEQ ID NO: 542398 - RNA, 64 nt, hsa; identical to SEQ ID NO: 532322

SEQ ID NO: 542399 - RNA, 64 nt, hsa; identical to SEQ ID NO: 532323

SEQ ID NO: 542400 - RNA, 64 nt, hsa; identical to SEQ ID NO: 532324

SEQ ID NO: 542401 - RNA, 64 nt, hsa; identical to SEQ ID NO: 532325

SEQ ID NO: 542402 - RNA, 64 nt, hsa; identical to SEQ ID NO: 532326

SEQ ID NO: 542403 - RNA, 64 nt, hsa; identical to SEQ ID NO: 532327

SEQ ID NO: 542404 - RNA, 64 nt, hsa; identical to SEQ ID NO: 532328

SEQ ID NO: 542405 - RNA, 64 nt, hsa; identical to SEQ ID NO: 532329

SEQ ID NO: 542406 - RNA, 64 nt, hsa; identical to SEQ ID NO: 532330

SEQ ID NO: 542407 - RNA, 64 nt, hsa; identical to SEQ ID NO: 532331

SEQ ID NO: 542408 - RNA, 64 nt, hsa; identical to SEQ ID NO: 532332

SEQ ID NO: 542409 - RNA, 64 nt, hsa; identical to SEQ ID NO: 532333

SEQ ID NO: 542410 - RNA, 64 nt, hsa; identical to SEQ ID NO: 532334

SEQ ID NO: 542411 - RNA, 64 nt, hsa; identical to SEQ ID NO: 532335

SEQ ID NO: 542412 - RNA, 64 nt, hsa; identical to SEQ ID NO: 532336

SEQ ID NO: 542413 - RNA, 64 nt, hsa; identical to SEQ ID NO: 532337

SEQ ID NO: 542414 - RNA, 64 nt, hsa; identical to SEQ ID NO: 532338

SEQ ID NO: 542415 - RNA, 64 nt, hsa
uaagguagcuuaauaaacuaaguaaaacguaugacuugaguacaaaaggauuguuuuaaucccc

SEQ ID NO: 542416 - RNA, 64 nt, hsa
cauccuagucucccagucuauaacaucauaauaccuugaguauaaguccaaauauuagguuaua

SEQ ID NO: 542417 - RNA, 64 nt, hsa
cucacagguucaagugguucuccugccucagccucuugaguagcugggauuacaggcaugcgcc

SEQ ID NO: 542418 - RNA, 64 nt, hsa
ucuaaaacauuccagaauacccgguaguuccacucuugaguaugguaguccccuauuuucugca

SEQ ID NO: 542419 - RNA, 64 nt, hsa
cccguccgggaggugaggggcgccucugcccagcugccccuacugggaagugaggagccccucu

SEQ ID NO: 542420 - RNA, 64 nt, hsa
cccguccgggaggcgaggggcgccucugcccggcugccccuacugggaagugaggagccccucu

SEQ ID NO: 542421 - RNA, 64 nt, hsa
uucugguuugagguuugacucuggacccuggcugugccccuagguggagacagcccucuuucuc

SEQ ID NO: 542422 - RNA, 64 nt, hsa
ugaguugcaagcagggagaaaaccugaaggucggugccccuauggggcugaccaguagagaauu

SEQ ID NO: 542423 - RNA, 64 nt, hsa
cacaggcucacacugcccuuacuuuaggcucucaugccccuaagaaaagugaauuuccuuuaac

SEQ ID NO: 542424 - RNA, 64 nt, hsa
uuccccuccaguguucccuccuugagagcugagcugccccuaggaccccuccuuugccucauga

SEQ ID NO: 542425 - RNA, 64 nt, hsa
ccucgauugaggucugagccgacgcccuugccccugccccuaccccugccagcgcccaccccca

SEQ ID NO: 542426 - RNA, 64 nt, hsa
auaucccgaugggcacaaauggaaggugcgcacuugccccuacuauugcccuuuuaagggccaa

SEQ ID NO: 542427 - RNA, 59 nt, hsa
auaaaaguuuacaugaauuuuacaacaaacuagugcaugauucaccaagcaguacuaca

SEQ ID NO: 542428 - RNA, 59 nt, hsa
auaucugccauauuuuuacaaaauuuguucuagugcauuuccaugguccccaauucaua

SEQ ID NO: 542429 - RNA, 59 nt, hsa
uccuucucuuugacuucuguggcauggugcuagugcauguacccugugguauugccccu

SEQ ID NO: 542430 - RNA, 59 nt, hsa
uugaaucauauucugugcuuuuucaaucacuagugcagaauaggcugcauuugacacag

SEQ ID NO: 542431 - RNA, 59 nt, hsa
cugauccaaaaauuauaacggcagggaaccuagugcauuuggcacugagauuuaaaugc

SEQ ID NO: 542432 - RNA, 59 nt, hsa
gauaacucacuggaauguacaguauuuugcuagugcauuucaaggaauggaaucuucuc

SEQ ID NO: 542433 - RNA, 64 nt, hsa; identical to SEQ ID NO: 131478

SEQ ID NO: 542434 - RNA, 64 nt, hsa; identical to SEQ ID NO: 131479

SEQ ID NO: 542435 - RNA, 64 nt, hsa; identical to SEQ ID NO: 131480

SEQ ID NO: 542436 - RNA, 64 nt, hsa; identical to SEQ ID NO: 131481

SEQ ID NO: 542437 - RNA, 64 nt, hsa; identical to SEQ ID NO: 131482

SEQ ID NO: 542438 - RNA, 64 nt, hsa; identical to SEQ ID NO: 131483

SEQ ID NO: 542439 - RNA, 64 nt, hsa; identical to SEQ ID NO: 131484

SEQ ID NO: 542440 - RNA, 64 nt, hsa; identical to SEQ ID NO: 131485

SEQ ID NO: 542441 - RNA, 64 nt, hsa
aaggacaggcuguccaagguagaaacuguacauagccggugaccgaaugcgaccuuugccagcc

SEQ ID NO: 542442 - RNA, 64 nt, hsa
cauuugccaucaccccaaacaacucagcuucggggccggugaggggaggggccucccccagcac

SEQ ID NO: 542443 - RNA, 64 nt, hsa
ggaguagggaucuaauuuauuuauuuauugccuggccggugacucgggggaggaggcgacccug

SEQ ID NO: 542444 - RNA, 64 nt, hsa
cuguccccuuucagcccaccagucccucucugcugccggugaugggaggccuuucuagaccugg

SEQ ID NO: 542445 - RNA, 64 nt, hsa
ugacgugcagugacaguugauuuccucuugaacugccggugaaaacagucuaguacacaggugc

SEQ ID NO: 542446 - RNA, 64 nt, hsa
uguauucagguccccgaugggcauauacaucuuagccggugauacacuaccucuuacguguugc

SEQ ID NO: 542447 - RNA, 64 nt, hsa
gcauauuagccgaggagguagucacgcggcacgcgccggugauugccacgaugugauugcaaua

SEQ ID NO: 542448 - RNA, 64 nt, hsa
aagaaaacauugaaaaauucuaugaauuguuguagccggugaauugagucguauucugucacau

SEQ ID NO: 542449 - RNA, 64 nt, hsa
gggagaaagcaagcaaaagcuacccuagggaagagccggugacgugcacaggccgagcagcacg

SEQ ID NO: 542450 - RNA, 64 nt, hsa
gucuuuuacguuguuaugaugaaucccacauggggccggugaugguaugcugaaguucagccgu

SEQ ID NO: 542451 - RNA, 64 nt, hsa
cacgccuguaaucccagcacuuugggaggccgaggccggugauucacaaggucaggaguucaag

SEQ ID NO: 542452 - RNA, 64 nt, hsa
aagagggagcgaacgagcgaacaacugagcccaagccggugagaaugugaaacaguuucucaaa

SEQ ID NO: 542453 - RNA, 64 nt, hsa
cgugccagagucgggggccacacgagggccuggugccggugaggggggcgugcgcuagaggggg

SEQ ID NO: 542454 - RNA, 64 nt, hsa
ccacacuguacuuuuucccccugcccccguuacugccggugauuauuauuaaaaauuaguuuuu

SEQ ID NO: 542455 - RNA, 64 nt, hsa
auguggauuuggccagagccuucaggagguggaggccggugaggucaggagcccagcucuccag

SEQ ID NO: 542456 - RNA, 64 nt, hsa
agauuuccccauuuagguuucugaguuccugcaugccggugaucccuagcugugaccucucccc

SEQ ID NO: 542457 - RNA, 64 nt, hsa
gggaggagaacaucaucgauaacccuuaucugcggccggugaagaagcccaagauccgcaggaa

SEQ ID NO: 542458 - RNA, 64 nt, hsa
caaagagagaguacgggcucagcagccagaggaggccggugaagugcaucuucugcguguucuc

SEQ ID NO: 542459 - RNA, 64 nt, hsa
cucaauuaucacgagcacaugguggaaaacgugggccggugaaaacaacuuaacauguaaaugu

SEQ ID NO: 542460 - RNA, 64 nt, hsa
gagaggcgagccagggggcuccccggaccgcauggccggugagaguagagucggaggcggagag

SEQ ID NO: 542461 - RNA, 64 nt, hsa
gauguuuuagaguuaacaaugauauauggauaaugccggugagaauaagagagucauaaaccuu

SEQ ID NO: 542462 - RNA, 64 nt, hsa
cggagccccgaagacucggagggagcugcucagggccggugagcgcagccagaagcccuggcca

SEQ ID NO: 542463 - RNA, 61 nt, hsa
ccucugggcccuggcuguagccgaggccgcagccggugagaggcggagccucgagcgggcc

SEQ ID NO: 542464 - RNA, 64 nt, hsa
ggggccgggccaucccugacacgaagcucccugggccggugaagucacacaucgccuucucgcc

SEQ ID NO: 542465 - RNA, 64 nt, hsa
cagccgcuucgacagcccugaccugcugcuggaagccggugacccggccacgucccccugccgc

SEQ ID NO: 542466 - RNA, 64 nt, hsa
gcccugccagaggcuggagggugcccaaggcgaggccggugaggcccagcucuacaaauaaagu

SEQ ID NO: 542467 - RNA, 64 nt, hsa
uguguguggauggugacgcagaggacgucucuaugccggugacuggacauaucaccucuacuua

SEQ ID NO: 542468 - RNA, 64 nt, hsa
uguuuuaacuuccaaggugguuuuacuucugauagccggugauuuucccuccuagcagacaugc

SEQ ID NO: 542469 - RNA, 64 nt, hsa
ugugcccucugcgcauagcgcugggcguggacaggccggugagggcgggcaaggggccccagcc

SEQ ID NO: 542470 - RNA, 64 nt, hsa
uuaagaccuggucuucuuucucuguuggaucauggccggugaaacaguuuugucuugcagugga

SEQ ID NO: 542471 - RNA, 64 nt, hsa
cauucugugugugugguucagacccuggccuagggccggugauguggaugagugaagggagcca

SEQ ID NO: 542472 - RNA, 64 nt, hsa
gcgccuagaaggcgaggacgcagaccugaaggcggccggugagcggggcggguucugcuggguc

SEQ ID NO: 542473 - RNA, 64 nt, hsa
ucacucggguuucucuguggcuccaggccaaagugccggugagacccauggcuguguuggugug

SEQ ID NO: 542474 - RNA, 64 nt, hsa
uccaggggccccagccccccaggaacuuggggcugccggugagcaggauggugaguagagcucu

SEQ ID NO: 542475 - RNA, 64 nt, hsa
cgaguggccugcgcgcugacccugcccuucaucugccggugagugggaagugggugccuugcgg

SEQ ID NO: 542476 - RNA, 64 nt, hsa
ggguauugucugaaaucccagaggacccauaagugccggugacaagcugucugucaggggagag

SEQ ID NO: 542477 - RNA, 64 nt, hsa
cagccacccugaccucccccagggcuccuccccagccggugacuuacuguacagcaggcaggag

SEQ ID NO: 542478 - RNA, 64 nt, hsa
ugcgcgugcuggugggcaugugagaugagugacugccggugaauguguccacaguugagagguu

SEQ ID NO: 542479 - RNA, 52 nt, hsa
ggaguguuugcuucaagugauggccggugagcugcggagagcucauggaagg

SEQ ID NO: 542480 - RNA, 64 nt, hsa
agcugggugccaggggcaggggauccucaguauagccggugaacccugauaccaggagccuggg

SEQ ID NO: 542481 - RNA, 64 nt, hsa
ggggguggggguggggguggugguggggguaguggccggugagggcccaggcuggucagcgucc

SEQ ID NO: 542482 - RNA, 64 nt, hsa
cgcuuguacacugcugcuguggggcuccgcgccugccggugaagagcugcagaugccgagaagc

SEQ ID NO: 542483 - RNA, 64 nt, hsa
gcgagaggcacccuacccgacgcagcugugaauggccggugauguaugucaggaggccacaggg

SEQ ID NO: 542484 - RNA, 64 nt, hsa
gacagcugccccgguagccucgagagcaccccuugccggugaaggaugcggcaggugcucugug

SEQ ID NO: 542485 - RNA, 64 nt, hsa
ucgcucccagccauuugcugggaugaccgugcaggccggugacacggccgcaccugccccaaag

SEQ ID NO: 542486 - RNA, 64 nt, hsa; identical to SEQ ID NO: 217679

SEQ ID NO: 542487 - RNA, 64 nt, hsa; identical to SEQ ID NO: 217680

SEQ ID NO: 542488 - RNA, 64 nt, hsa; identical to SEQ ID NO: 217681

SEQ ID NO: 542489 - RNA, 64 nt, hsa; identical to SEQ ID NO: 217682

SEQ ID NO: 542490 - RNA, 64 nt, hsa; identical to SEQ ID NO: 217683

SEQ ID NO: 542491 - RNA, 64 nt, hsa; identical to SEQ ID NO: 217684

SEQ ID NO: 542492 - RNA, 64 nt, hsa; identical to SEQ ID NO: 217685

SEQ ID NO: 542493 - RNA, 64 nt, hsa; identical to SEQ ID NO: 217686

SEQ ID NO: 542494 - RNA, 64 nt, hsa; identical to SEQ ID NO: 217687

SEQ ID NO: 542495 - RNA, 64 nt, hsa; identical to SEQ ID NO: 217688

SEQ ID NO: 542496 - RNA, 64 nt, hsa; identical to SEQ ID NO: 217689

SEQ ID NO: 542497 - RNA, 64 nt, hsa; identical to SEQ ID NO: 217690

SEQ ID NO: 542498 - RNA, 64 nt, hsa; identical to SEQ ID NO: 217691

SEQ ID NO: 542499 - RNA, 64 nt, hsa; identical to SEQ ID NO: 217692

SEQ ID NO: 542500 - RNA, 64 nt, hsa; identical to SEQ ID NO: 217693

SEQ ID NO: 542501 - RNA, 64 nt, hsa; identical to SEQ ID NO: 217694

SEQ ID NO: 542502 - RNA, 64 nt, hsa; identical to SEQ ID NO: 217695

SEQ ID NO: 542503 - RNA, 64 nt, hsa; identical to SEQ ID NO: 217696

SEQ ID NO: 542504 - RNA, 64 nt, hsa; identical to SEQ ID NO: 217697

SEQ ID NO: 542505 - RNA, 64 nt, hsa; identical to SEQ ID NO: 217698

SEQ ID NO: 542506 - RNA, 64 nt, hsa; identical to SEQ ID NO: 217699

SEQ ID NO: 542507 - RNA, 64 nt, hsa; identical to SEQ ID NO: 217700

SEQ ID NO: 542508 - RNA, 64 nt, hsa; identical to SEQ ID NO: 217701

SEQ ID NO: 542509 - RNA, 64 nt, hsa; identical to SEQ ID NO: 217702

SEQ ID NO: 542510 - RNA, 64 nt, hsa; identical to SEQ ID NO: 217703

SEQ ID NO: 542511 - RNA, 64 nt, hsa; identical to SEQ ID NO: 217704

SEQ ID NO: 542512 - RNA, 64 nt, hsa; identical to SEQ ID NO: 217705

SEQ ID NO: 542513 - RNA, 64 nt, hsa; identical to SEQ ID NO: 217706

SEQ ID NO: 542514 - RNA, 64 nt, hsa; identical to SEQ ID NO: 217707

SEQ ID NO: 542515 - RNA, 64 nt, hsa; identical to SEQ ID NO: 217708

SEQ ID NO: 542516 - RNA, 64 nt, hsa; identical to SEQ ID NO: 217709

SEQ ID NO: 542517 - RNA, 64 nt, hsa; identical to SEQ ID NO: 217710

SEQ ID NO: 542518 - RNA, 64 nt, hsa; identical to SEQ ID NO: 217711

SEQ ID NO: 542519 - RNA, 64 nt, hsa; identical to SEQ ID NO: 217712

SEQ ID NO: 542520 - RNA, 64 nt, hsa; identical to SEQ ID NO: 217713

SEQ ID NO: 542521 - RNA, 58 nt, hsa; identical to SEQ ID NO: 217714

SEQ ID NO: 542522 - RNA, 64 nt, hsa; identical to SEQ ID NO: 217715

SEQ ID NO: 542523 - RNA, 64 nt, hsa; identical to SEQ ID NO: 217716

SEQ ID NO: 542524 - RNA, 64 nt, hsa; identical to SEQ ID NO: 217717

SEQ ID NO: 542525 - RNA, 64 nt, hsa; identical to SEQ ID NO: 217718

SEQ ID NO: 542526 - RNA, 64 nt, hsa; identical to SEQ ID NO: 217719

SEQ ID NO: 542527 - RNA, 64 nt, hsa; identical to SEQ ID NO: 217720

SEQ ID NO: 542528 - RNA, 64 nt, hsa; identical to SEQ ID NO: 217721

SEQ ID NO: 542529 - RNA, 64 nt, hsa; identical to SEQ ID NO: 217722

SEQ ID NO: 542530 - RNA, 64 nt, hsa; identical to SEQ ID NO: 217723

SEQ ID NO: 542531 - RNA, 64 nt, hsa; identical to SEQ ID NO: 217724

SEQ ID NO: 542532 - RNA, 64 nt, hsa; identical to SEQ ID NO: 217725

SEQ ID NO: 542533 - RNA, 64 nt, hsa; identical to SEQ ID NO: 217726

SEQ ID NO: 542534 - RNA, 64 nt, hsa; identical to SEQ ID NO: 217727

SEQ ID NO: 542535 - RNA, 64 nt, hsa; identical to SEQ ID NO: 217728

SEQ ID NO: 542536 - RNA, 64 nt, hsa; identical to SEQ ID NO: 217729

SEQ ID NO: 542537 - RNA, 64 nt, hsa; identical to SEQ ID NO: 217730

SEQ ID NO: 542538 - RNA, 64 nt, hsa; identical to SEQ ID NO: 217731

SEQ ID NO: 542539 - RNA, 64 nt, hsa; identical to SEQ ID NO: 217732

SEQ ID NO: 542540 - RNA, 64 nt, hsa; identical to SEQ ID NO: 217733

SEQ ID NO: 542541 - RNA, 64 nt, hsa; identical to SEQ ID NO: 217734

SEQ ID NO: 542542 - RNA, 64 nt, hsa; identical to SEQ ID NO: 217735

SEQ ID NO: 542543 - RNA, 64 nt, hsa; identical to SEQ ID NO: 217736

SEQ ID NO: 542544 - RNA, 64 nt, hsa; identical to SEQ ID NO: 217737

SEQ ID NO: 542545 - RNA, 64 nt, hsa; identical to SEQ ID NO: 217738

SEQ ID NO: 542546 - RNA, 64 nt, hsa; identical to SEQ ID NO: 217739

SEQ ID NO: 542547 - RNA, 64 nt, hsa; identical to SEQ ID NO: 217740

SEQ ID NO: 542548 - RNA, 64 nt, hsa; identical to SEQ ID NO: 217741

SEQ ID NO: 542549 - RNA, 64 nt, hsa; identical to SEQ ID NO: 217742

SEQ ID NO: 542550 - RNA, 64 nt, hsa; identical to SEQ ID NO: 217743

SEQ ID NO: 542551 - RNA, 64 nt, hsa; identical to SEQ ID NO: 217744

SEQ ID NO: 542552 - RNA, 64 nt, hsa; identical to SEQ ID NO: 217745

SEQ ID NO: 542553 - RNA, 64 nt, hsa; identical to SEQ ID NO: 217746

SEQ ID NO: 542554 - RNA, 64 nt, hsa; identical to SEQ ID NO: 217747

SEQ ID NO: 542555 - RNA, 64 nt, hsa; identical to SEQ ID NO: 217748

SEQ ID NO: 542556 - RNA, 64 nt, hsa; identical to SEQ ID NO: 217749

SEQ ID NO: 542557 - RNA, 64 nt, hsa; identical to SEQ ID NO: 217750

SEQ ID NO: 542558 - RNA, 64 nt, hsa; identical to SEQ ID NO: 217751

SEQ ID NO: 542559 - RNA, 64 nt, hsa; identical to SEQ ID NO: 217752

SEQ ID NO: 542560 - RNA, 64 nt, hsa; identical to SEQ ID NO: 217753

SEQ ID NO: 542561 - RNA, 64 nt, hsa; identical to SEQ ID NO: 217754

SEQ ID NO: 542562 - RNA, 64 nt, hsa; identical to SEQ ID NO: 217755

SEQ ID NO: 542563 - RNA, 64 nt, hsa; identical to SEQ ID NO: 217756

SEQ ID NO: 542564 - RNA, 64 nt, hsa; identical to SEQ ID NO: 217757

SEQ ID NO: 542565 - RNA, 64 nt, hsa; identical to SEQ ID NO: 217758

SEQ ID NO: 542566 - RNA, 64 nt, hsa; identical to SEQ ID NO: 217759

SEQ ID NO: 542567 - RNA, 64 nt, hsa; identical to SEQ ID NO: 217760

SEQ ID NO: 542568 - RNA, 64 nt, hsa; identical to SEQ ID NO: 217761

SEQ ID NO: 542569 - RNA, 64 nt, hsa; identical to SEQ ID NO: 217762

SEQ ID NO: 542570 - RNA, 64 nt, hsa; identical to SEQ ID NO: 217763

SEQ ID NO: 542571 - RNA, 64 nt, hsa; identical to SEQ ID NO: 217764

SEQ ID NO: 542572 - RNA, 64 nt, hsa; identical to SEQ ID NO: 217765

SEQ ID NO: 542573 - RNA, 64 nt, hsa; identical to SEQ ID NO: 217766

SEQ ID NO: 542574 - RNA, 64 nt, hsa; identical to SEQ ID NO: 217767

SEQ ID NO: 542575 - RNA, 64 nt, hsa; identical to SEQ ID NO: 217768

SEQ ID NO: 542576 - RNA, 64 nt, hsa; identical to SEQ ID NO: 217769

SEQ ID NO: 542577 - RNA, 64 nt, hsa; identical to SEQ ID NO: 217770

SEQ ID NO: 542578 - RNA, 64 nt, hsa; identical to SEQ ID NO: 217771

SEQ ID NO: 542579 - RNA, 64 nt, hsa; identical to SEQ ID NO: 217772

SEQ ID NO: 542580 - RNA, 64 nt, hsa; identical to SEQ ID NO: 217773

SEQ ID NO: 542581 - RNA, 64 nt, hsa; identical to SEQ ID NO: 217774

SEQ ID NO: 542582 - RNA, 64 nt, hsa; identical to SEQ ID NO: 217775

SEQ ID NO: 542583 - RNA, 64 nt, hsa; identical to SEQ ID NO: 217776

SEQ ID NO: 542584 - RNA, 64 nt, hsa; identical to SEQ ID NO: 217777

SEQ ID NO: 542585 - RNA, 64 nt, hsa; identical to SEQ ID NO: 217778

SEQ ID NO: 542586 - RNA, 64 nt, hsa; identical to SEQ ID NO: 217779

SEQ ID NO: 542587 - RNA, 64 nt, hsa; identical to SEQ ID NO: 217780

SEQ ID NO: 542588 - RNA, 64 nt, hsa; identical to SEQ ID NO: 217781

SEQ ID NO: 542589 - RNA, 64 nt, hsa; identical to SEQ ID NO: 217782

SEQ ID NO: 542590 - RNA, 64 nt, hsa; identical to SEQ ID NO: 217783

SEQ ID NO: 542591 - RNA, 64 nt, hsa; identical to SEQ ID NO: 217784

SEQ ID NO: 542592 - RNA, 64 nt, hsa; identical to SEQ ID NO: 217785

SEQ ID NO: 542593 - RNA, 64 nt, hsa; identical to SEQ ID NO: 217786

SEQ ID NO: 542594 - RNA, 64 nt, hsa; identical to SEQ ID NO: 217787

SEQ ID NO: 542595 - RNA, 64 nt, hsa; identical to SEQ ID NO: 217788

SEQ ID NO: 542596 - RNA, 64 nt, hsa; identical to SEQ ID NO: 217789

SEQ ID NO: 542597 - RNA, 64 nt, hsa; identical to SEQ ID NO: 217790

SEQ ID NO: 542598 - RNA, 64 nt, hsa; identical to SEQ ID NO: 217791

SEQ ID NO: 542599 - RNA, 64 nt, hsa; identical to SEQ ID NO: 217792

SEQ ID NO: 542600 - RNA, 64 nt, hsa; identical to SEQ ID NO: 217793

SEQ ID NO: 542601 - RNA, 64 nt, hsa; identical to SEQ ID NO: 217794

SEQ ID NO: 542602 - RNA, 64 nt, hsa; identical to SEQ ID NO: 50725

SEQ ID NO: 542603 - RNA, 64 nt, hsa; identical to SEQ ID NO: 50726

SEQ ID NO: 542604 - RNA, 64 nt, hsa; identical to SEQ ID NO: 50727

SEQ ID NO: 542605 - RNA, 64 nt, hsa; identical to SEQ ID NO: 50728

SEQ ID NO: 542606 - RNA, 64 nt, hsa; identical to SEQ ID NO: 50729

SEQ ID NO: 542607 - RNA, 64 nt, hsa; identical to SEQ ID NO: 50730

SEQ ID NO: 542608 - RNA, 64 nt, hsa; identical to SEQ ID NO: 50731

SEQ ID NO: 542609 - RNA, 64 nt, hsa; identical to SEQ ID NO: 50732

SEQ ID NO: 542610 - RNA, 64 nt, hsa; identical to SEQ ID NO: 50733

SEQ ID NO: 542611 - RNA, 64 nt, hsa; identical to SEQ ID NO: 50734

SEQ ID NO: 542612 - RNA, 51 nt, hsa; identical to SEQ ID NO: 50735

SEQ ID NO: 542613 - RNA, 64 nt, hsa; identical to SEQ ID NO: 50736

SEQ ID NO: 542614 - RNA, 64 nt, hsa; identical to SEQ ID NO: 50737

SEQ ID NO: 542615 - RNA, 64 nt, hsa; identical to SEQ ID NO: 50738

SEQ ID NO: 542616 - RNA, 64 nt, hsa
ugaugaagugauccuuaacccccaaguaaucauuaacccccagaccagccucagaacugaagga

SEQ ID NO: 542617 - RNA, 64 nt, hsa
cuagauccccugaggacuugaugaagugauccuuaacccccaaguaaucauuaacccccagacc

SEQ ID NO: 542618 - RNA, 64 nt, hsa
auacaguuuuguuuguuauacucuuugcaccuuaaacccccaccacuccccgacacuauugccu

SEQ ID NO: 542619 - RNA, 64 nt, hsa
agugggcuguaggcaggguccuccauggguuuccaacccccaucacuggcaccaggaucuccca

SEQ ID NO: 542620 - RNA, 64 nt, hsa
agacuuguuggugcuaccccuuacuccccucugcaacccccauuuugggaguugaccccagcaa

SEQ ID NO: 542621 - RNA, 64 nt, hsa
cugauaugcuggugauucccaaauacauagcuccaacccccaacuucccccagacuuuagaucu

SEQ ID NO: 542622 - RNA, 64 nt, hsa
guuaugaguagccuaccacccccucccuuacaguaacccccaccccuucaggaucagucaaggg

SEQ ID NO: 542623 - RNA, 64 nt, hsa
cccuacugcaacuaacuguugccccccaaccccgaacccccaguugaggaguugagagagugca

SEQ ID NO: 542624 - RNA, 64 nt, hsa
aacagacaaaacaauccccaucagguagcugucuaacccccagcugggucuaauccuucucauu

SEQ ID NO: 542625 - RNA, 64 nt, hsa
accacaugccacugccugcaccuuucggcagaggaacccccaccagacaucacccuuugccuua

SEQ ID NO: 542626 - RNA, 64 nt, hsa
cuuaccugcacccaggccucagaguuucagggcuaacccccagaauacugguaggggccaaggc

SEQ ID NO: 542627 - RNA, 64 nt, hsa
aggggguugaauaugcaaaagcaguuccgcugggaacccccauccaaucaacugcuguacccau

SEQ ID NO: 542628 - RNA, 64 nt, hsa
gucucaaaaaaacaaaacaaaaaaacaccaaaaaaacccccaaaccugaagaaauucagauaca

SEQ ID NO: 542629 - RNA, 64 nt, hsa
ugccugguuugcgggagauuuccuccccucagucaacccccauaaccuggggauugggcagugu

SEQ ID NO: 542630 - RNA, 64 nt, hsa
caggaguucaagaccagccuguccaacauggugaaacccccaucucuacuaaaaauaccaaaaa

SEQ ID NO: 542631 - RNA, 64 nt, hsa
ggguugugagacuucuguuugaucacugugaaccaacccccaucucccuagcccaccccccucc

SEQ ID NO: 542632 - RNA, 64 nt, hsa
uggggccuaggcagggcugggaugaggcuuguacaacccccaccaccaauuucccagggacucc

SEQ ID NO: 542633 - RNA, 64 nt, hsa
ucugaggccaguauccuccagcccucccaaugccaacccccaccccguuucccuggugcccaga

SEQ ID NO: 542634 - RNA, 64 nt, hsa
cccccaagucuuccuacccucugcacccucaagaaacccccagugccuuguaugaagcccaccc

SEQ ID NO: 542635 - RNA, 64 nt, hsa
uugaggccccauuauuaacagauacucccauaauaacccccaaauacagaccccaugucaccca

SEQ ID NO: 542636 - RNA, 64 nt, hsa
cgcuccuccuccguccuaucccaacucacccccaaacccccaucccuuccccaccuccagcagu

SEQ ID NO: 542637 - RNA, 64 nt, hsa
gggacccccggcccggcccggaacuuuucuccccaacccccaaacccacgacucacuuccacac

SEQ ID NO: 542638 - RNA, 64 nt, hsa
ccccugggcuucggaggggggugcuugugccccuaacccccaugcucuugugccuucccccucu

SEQ ID NO: 542639 - RNA, 64 nt, hsa
ccugcuccuuuucugggcccuagcacagguggguaacccccacccaacccagcuccugcugcug

SEQ ID NO: 542640 - RNA, 64 nt, hsa
aggaagaaagccccagacgcuugguuuuucucagaacccccaaaagaugugcaauagcuguugu

SEQ ID NO: 542641 - RNA, 64 nt, hsa
aagacaguaagacaguaaacuauuuuaggaagucaacccccauugcacucuguggcaguuauuc

SEQ ID NO: 542642 - RNA, 64 nt, hsa
acugaaggagguggagcucccacagccagcaguaaucagggagcugagagccugguucugugau

SEQ ID NO: 542643 - RNA, 64 nt, hsa
ucaguugcccuuucugaggcaacuaaacuacagaaucagggaaagaaccauuaggaguggaacu

SEQ ID NO: 542644 - RNA, 64 nt, hsa
uuagggagguuggugucagaggcaggagugggggaucagggaagguggauucuaggaaaaggga

SEQ ID NO: 542645 - RNA, 64 nt, hsa
uacucugccagucucagccuucaaagcacuugacaucagggacccugaacccuuccccugggag

SEQ ID NO: 542646 - RNA, 64 nt, hsa
cugaggcuuaggagagcugccuucgcugcaggaaaucagggauuaucccuuaacagaagugucu

SEQ ID NO: 542647 - RNA, 64 nt, hsa
ggagcccuaccccagaaguguaucccacgagggcaucagggacgcagugaguguugcucaaggg

SEQ ID NO: 542648 - RNA, 64 nt, hsa
aaacccucaggcaguuguuaaaauuuuguugaacaucagggaguuuaagaaaacccugcaagua

SEQ ID NO: 542649 - RNA, 64 nt, hsa
aagauauucaauccaaaauuaagucuauguaaauaucagggaauaauucacaguagaaauaucu

SEQ ID NO: 542650 - RNA, 64 nt, hsa
cuguccugccucgaaggagcagccugggcagccaucacaccacgaggacaggaagcaccagcac

SEQ ID NO: 542651 - RNA, 64 nt, hsa
gugcuaaugagcauugagacugaugcuuuguaagucacaccacaacaaauauugauugagggcg

SEQ ID NO: 542652 - RNA, 64 nt, hsa
ugacggcuccgugcugacauucugagcucuggagucacaccagcgcaggggcguggaggaacug

SEQ ID NO: 542653 - RNA, 64 nt, hsa
gugugccccuccacccucccuccagcagcccugaucacaccaugagagccaggaacgggucacc

SEQ ID NO: 542654 - RNA, 64 nt, hsa
uucccaccgguagagaaacuuccagaccagccccucacaccacagccaagagaagccuuuccag

SEQ ID NO: 542655 - RNA, 64 nt, hsa
uuaccaccuggagagaagcuuccagaccagccccucacaccacagccaggagaggccuuuccca

SEQ ID NO: 542656 - RNA, 64 nt, hsa
uucucaccuggagagaaacuuccagaccagccccucacaccaccgccaggagaggccuuuccca

SEQ ID NO: 542657 - RNA, 64 nt, hsa
uucccaccgggagagaaacuuccagaccagccccucacaccacagccaggagaggccuuuccca

SEQ ID NO: 542658 - RNA, 64 nt, hsa
uucccaccgggagaggaacuuccagaccagccccucacaccacagccaggagaggccuuucccg

SEQ ID NO: 542659 - RNA, 64 nt, hsa
uuucccgccuggagagaagcuucaggccagcuccucacaccacagccaggagagaccuuuucug

SEQ ID NO: 542660 - RNA, 64 nt, hsa
uuccugccuggagagaagcuuccagaccagcccuucacaccacagccaggagaggccuuuccca

SEQ ID NO: 542661 - RNA, 64 nt, hsa
gcacguuccucccggccuaguccguggaggcccaucacaccagcauccgugacgccagcuuccc

SEQ ID NO: 542662 - RNA, 64 nt, hsa
gcccuuaauccacgucggagccggcaggugcuucucacaccaggagccucugggggcaggggcu

SEQ ID NO: 542663 - RNA, 64 nt, hsa
ccuccagguccugagcccuuccucuguaaaagugucacaccaccucccucagcacuuccccauc

SEQ ID NO: 542664 - RNA, 64 nt, hsa
augauuagaucgggucucggaagggaaguagccaucacaccauuaaaaagccuguggaccuuuu

SEQ ID NO: 542665 - RNA, 64 nt, hsa
guccaagcucaggcauaauucagcauaagaaaauucacaccagagccaaaucuuacaaauguag

SEQ ID NO: 542666 - RNA, 64 nt, hsa
uaucaaauucaggcuucauucagcaucugagaguucacaccagggagaaaucauguauguacug

SEQ ID NO: 542667 - RNA, 64 nt, hsa
gucauagcucagccauugcucagcaucagauaauucacaccagagagaaacccucugaauguga

SEQ ID NO: 542668 - RNA, 64 nt, hsa
gaagauugaaagggacuuuuuuauaucucacacuucacaccagugcauuacacuaacuuguuca

SEQ ID NO: 542669 - RNA, 64 nt, hsa
gaacccgggaagugaagguugccgugagcugagaucacaccacugccauaaacaugacaggcuu

SEQ ID NO: 542670 - RNA, 64 nt, hsa
cacaugcacaccacaacacacaacacaccucaccucacaccacagcacaccucaccacaccaca

SEQ ID NO: 542671 - RNA, 64 nt, hsa
gagcccaggaguuugaggcugcaaugaacuaugaucacaccacugcacuccagccucggcgaca

SEQ ID NO: 542672 - RNA, 64 nt, hsa
gaacccgggaggcaaagguugcagugagcugagaucacaccacugcacuccagccuggcgacag

SEQ ID NO: 542673 - RNA, 64 nt, hsa
uaaagaaaauaccaguguuucucaucccauugacucacaccacgucaucuggauuuuggauuuc

SEQ ID NO: 542674 - RNA, 64 nt, hsa
ugacaagcacaggaacggucagaaacugggcucaucacaccaaggcaaagcaacgggcgagucu

SEQ ID NO: 542675 - RNA, 64 nt, hsa
uaauacugccaaaucucaaaaguuaagcugaauuucacaccagauccuaccccuuucccugagc

SEQ ID NO: 542676 - RNA, 64 nt, hsa
cccaccauccugugagccccacuccuggccccacucacaccauccuaugagcccacgcccggcc

SEQ ID NO: 542677 - RNA, 64 nt, hsa
cacuccauccugugagccccacucccagccccacucacaccaaccugugagccccacucccggc

SEQ ID NO: 542678 - RNA, 64 nt, hsa
ucccaccauccugugagcccaugcccggccccacucacaccaaccugugagccccacucccggc

SEQ ID NO: 542679 - RNA, 64 nt, hsa
ugcaccauccugugagccccgcacccggccccucucacaccauccugugagaccacgcccggcc

SEQ ID NO: 542680 - RNA, 64 nt, hsa
uaaacuauuuuauaaacacugucuucuuucgucuucacaccaacaugcagaaaaguuucuaauc

SEQ ID NO: 542681 - RNA, 64 nt, hsa
uucauaccgacaacaucugaaaggacuagaauguucacaccacgaucuggauuucuuaauuuuu

SEQ ID NO: 542682 - RNA, 64 nt, hsa
aagcgaaauacuugaaaagaggugaccauaaagaucacaccaauuuagaaugaauauuaaaguc

SEQ ID NO: 542683 - RNA, 64 nt, hsa
gccauucuuuagucauuccaaguguauauuuguaucacaccaguuacuuguguucauugacacc

SEQ ID NO: 542684 - RNA, 64 nt, hsa
uuaacuucuccccauuuuguuuuuuuccgccucaucacaccaugcugccuuucccucauaugau

SEQ ID NO: 542685 - RNA, 64 nt, hsa
gaaccugggagguggugguugcagugagccaagaucacaccauugcacuccagccugggugaca

SEQ ID NO: 542686 - RNA, 61 nt, hsa
aaccgauccagaauaccgaagguauggacaggacagaaaagcgagucgcaggaggaaggga

SEQ ID NO: 542687 - RNA, 61 nt, hsa
cacaccaaggcuggaggcuggucugucauaagacagaaagaaagacgcugggcccaauuuu

SEQ ID NO: 542688 - RNA, 61 nt, hsa
cagggccguuguguagauauuugacuucacugacagaaaagaaaccagggaguuuguagag

SEQ ID NO: 542689 - RNA, 61 nt, hsa
ccccucucgggccuuuguggcugagaagugggacagaaagaugauuaagguaauguguccu

SEQ ID NO: 542690 - RNA, 61 nt, hsa
acaauacuccaaucacaguuaaauuaauuuagacagaaaagcaaauagcaauugacuugaa

SEQ ID NO: 542691 - RNA, 61 nt, hsa
auaucuaggagucucuugaugagcauuggucgacagaaagaagucucuucuaaaaauuguu

SEQ ID NO: 542692 - RNA, 61 nt, hsa
guauccaauaaaggagacaguuuagagucaggacagaaaagcuuccauaauugaacuagau

SEQ ID NO: 542693 - RNA, 61 nt, hsa
gacgugacguccugccagaaagagaaugaaugacagaaaaaaaaaagagagacaaacucua

SEQ ID NO: 542694 - RNA, 61 nt, hsa
uacuauggguuugccauuaauuucugagugggacagaaauuauaauugugcuuuuucgugu

SEQ ID NO: 542695 - RNA, 61 nt, hsa
cuauuggaauauaguauguagggugaaaguugacagaaaucuguacuucuucaggaaaucc

SEQ ID NO: 542696 - RNA, 61 nt, hsa
gcugcuaguaucagaggggcaguagagcuuggacagaaagaaaagaaacuugguguuaggu

SEQ ID NO: 542697 - RNA, 61 nt, hsa
guugcauggauccuguguuugcaacuggggagacagaaacugugguugauagccagucacu

SEQ ID NO: 542698 - RNA, 61 nt, hsa
caggguugguucucauuucgugccgaaaugagacagaaauucagugacgaaggugcguugu

SEQ ID NO: 542699 - RNA, 61 nt, hsa
gcaguuucaaaaaugacaaagucaguuuggagacagaaaaagacaaaagguccagucucau

SEQ ID NO: 542700 - RNA, 61 nt, hsa
ucgucaaaagauuuuugcuuggaauaagcaugacagaaagauuuaaccuaaguguuagaca

SEQ ID NO: 542701 - RNA, 61 nt, hsa
uguuacagcaauccuaggaagcuaauacucugacagaaaaaaaucuuggauaauaugcaug

SEQ ID NO: 542702 - RNA, 61 nt, hsa
uaaagaugucuuaacauuuauagugaggauugacagaaauuaagcaguguuaagaauacca

SEQ ID NO: 542703 - RNA, 61 nt, hsa
auuuccccauggaaaggagaaagugguuugggacagaaagaaauggaaugucuucagucau

SEQ ID NO: 542704 - RNA, 61 nt, hsa
gcauacauuccugucagacaacuaguugucugacagaaauguuaggcuucauguauguuac

SEQ ID NO: 542705 - RNA, 61 nt, hsa
auuuuaaauuuaacuuugacauccagcuauagacagaaauaauaagccacccuggguguaa

SEQ ID NO: 542706 - RNA, 61 nt, hsa
guucugauauccuccuacaguaguuuaaauugacagaaaaauuugaauguuuucuucuuaa

SEQ ID NO: 542707 - RNA, 61 nt, hsa
uaccugaacuguagugguuugaucggauggagacagaaaacccgauuuuuauucucauaaa

SEQ ID NO: 542708 - RNA, 61 nt, hsa
aauugaaagaaucgauaaaaguucaucuuuggacagaaagccuuuaaaaaaaaaaucacuc

SEQ ID NO: 542709 - RNA, 61 nt, hsa
aaaacaugucaagugucacauuagugucacagacagaaagcacacaccuaugcaauauggc

SEQ ID NO: 542710 - RNA, 61 nt, hsa
ccugacuccugcggggguauggggaagcugugacagaaacgaugggugcugugguccucug

SEQ ID NO: 542711 - RNA, 61 nt, hsa
uaggguaaaaggcaugugcugcaacacugaagacagaaagaagaagccucuggacacugcc

SEQ ID NO: 542712 - RNA, 61 nt, hsa
aaacaccccacugucaacauuagaucaaugagacagaaaguuaacaaggauauccaggaau

SEQ ID NO: 542713 - RNA, 61 nt, hsa
aaauguaauccagcauauaaacagaaccaaagacagaaaccacaugauuaucucaauagau

SEQ ID NO: 542714 - RNA, 64 nt, hsa
caggacacaagacuucugauuucuacccucaagauacucccagauccuaaauccaguagccucc

SEQ ID NO: 542715 - RNA, 64 nt, hsa
ccugcccuuccacccggaggccaaaggccaacuguacucccaaaggcaugggagaagguuggcg

SEQ ID NO: 542716 - RNA, 64 nt, hsa
uccuucuugaggggcugccuggcccgcuccauccuacucccacuaacuacaccucagggcgggu

SEQ ID NO: 542717 - RNA, 64 nt, hsa
gccugcgcucugcccugcccugccuagccucugcuacucccacuucccaacuccagggaaugca

SEQ ID NO: 542718 - RNA, 64 nt, hsa
ucugcuuucucuguacuguauaggcaacauguuguacucccaguagcaacuagaucucuuuuac

SEQ ID NO: 542719 - RNA, 64 nt, hsa
uauacagucuaucaaauuugcccccuggcuuuauuacucccaauugaauuaucuaccucauuuu

SEQ ID NO: 542720 - RNA, 64 nt, hsa
uuaaaauugaauucauucugaugcuugacccccauacucccaaccuuguccaguggagcccaac

SEQ ID NO: 542721 - RNA, 64 nt, hsa
ucuucaaugcucaagugaagucacaucuaccuauuacucccagcauugauugacuauaagaaag

SEQ ID NO: 542722 - RNA, 64 nt, hsa
ucaggccucauggaaggugagacaguaaagacauuacucccauaaaaaugugaggagagagacu

SEQ ID NO: 542723 - RNA, 64 nt, hsa
gguuauagcugcuuucagauuguuccauuaucuguacucccaacaacccugccggauauauuug

SEQ ID NO: 542724 - RNA, 64 nt, hsa
acaggcuguccaagguagaaacuguacauagccggugaccgaaugcgaccuuugccagccagag

SEQ ID NO: 542725 - RNA, 64 nt, hsa
gagaaguuguauagcacuauggugcgcuuccucagugaccgaaagaacccggugugccgggaga

SEQ ID NO: 542726 - RNA, 64 nt, hsa
acuguuggagcuacugcaaaugcuauauugcacugugaccgagaacuuuuaagaggauagaaua

SEQ ID NO: 542727 - RNA, 64 nt, hsa
gagggggugcuggagcgcgagaggcuggcugauugugaccgaaaccagaggguuguccaccccg

SEQ ID NO: 542728 - RNA, 64 nt, hsa
acguuugugagaagaaaugacauuuugcuaggaagugaccgagucuaggaaugcuuuuauucaa

SEQ ID NO: 542729 - RNA, 64 nt, hsa
guuccucuuguucuaaucuugucaaccagugcaagugaccgacaaaauuccaguuauuuauuuc

SEQ ID NO: 542730 - RNA, 64 nt, hsa
aaaucauuacaguagcuuagcuacuuuaguugaugugaccgaggaaucccuucuagaaucauag

SEQ ID NO: 542731 - RNA, 64 nt, hsa
ggaggugaucugccaggugcugcaccuggggacugugaccgacuuuaagcaaaccgucaacaaa

SEQ ID NO: 542732 - RNA, 64 nt, hsa
cugcugcugccccugccaccacagcugcuuaugugugaccgaugggguugagaggggcaagagu

SEQ ID NO: 542733 - RNA, 64 nt, hsa
aagcccuuuaauuagagauagcaacuuucccagggugaccgaggaaucaguacguguugaaccc

SEQ ID NO: 542734 - RNA, 64 nt, hsa
auuggcuuccuuucuugcaggcuugauuugcuuggugaccgaauuacuagugacuaguuuacua

SEQ ID NO: 542735 - RNA, 64 nt, hsa
uauuuuuuaaaaaccauccuuucgauuucuuuuggugaccgaagcugcucucuuuuccuuuuaa

SEQ ID NO: 542736 - RNA, 64 nt, hsa
guaagcugugaucgugacauggccuccagccugggugaccgagugagacuguuucuaaaaauaa

SEQ ID NO: 542737 - RNA, 64 nt, hsa
uauaugcccugaccaccauaggaugcuagucuuugugaccgauugcuaaucuucugcacuuuaa

SEQ ID NO: 542738 - RNA, 64 nt, hsa
ggccaccugcaccagcgucagggcccagggugcugugaccgaugagaccucagcucagcccuca

SEQ ID NO: 542739 - RNA, 64 nt, hsa
ccuuuuuauagucuuauaagauacauuaugaaaggugaccgacucuauuuuaaaucucagaauu

SEQ ID NO: 542740 - RNA, 64 nt, hsa
cuuccgcauccuagucucuaucauuaaaguucuagugaccgagacccgggcugcguucucuggg

SEQ ID NO: 542741 - RNA, 64 nt, hsa
aaguaguuugaaacucauuguuuccuugugguaagugaccgagaugcugccacaggaccugaga

SEQ ID NO: 542742 - RNA, 64 nt, hsa
aauuaauaucuccuggaacacuauagagaaccaagugaccgacucauuuacaacugaaaccuag

SEQ ID NO: 542743 - RNA, 64 nt, hsa
uguggggaagaggggcuggggcauggcaggcugggugaccgacuaccccagucccagggaaggu

SEQ ID NO: 542744 - RNA, 64 nt, hsa
gcccauccuuccaaaauguaaauccagucgcggugugaccgagcuggcuaacaggcuugucugc

SEQ ID NO: 542745 - RNA, 64 nt, hsa
uaaauggcaucuaggaagguaaacuccaaucccggugaccgaccccaaaccagacuguuggugg

SEQ ID NO: 542746 - RNA, 64 nt, hsa
accgucacaggccccucugguuagacuagcaugagugaccgaagccauccaucaacauuuucua

SEQ ID NO: 542747 - RNA, 64 nt, hsa
aucccucucagauaggugggguaggauuuuccuggugaccgaguaaagugagaggcaggugaga

SEQ ID NO: 542748 - RNA, 64 nt, hsa
caggauggggaugggaaaacuaaaggggcccccugugaccgaggagcaggguccccagggggca

SEQ ID NO: 542749 - RNA, 64 nt, hsa
uacaugggaaaaacaaaccagcuuuuuucagagagugaccgaauaggaagaagggauucagaaa

SEQ ID NO: 542750 - RNA, 64 nt, hsa
ugcggccucugagacaugaagacaccaucuccaugugaccgaacacugcagcugucugaccuuc

SEQ ID NO: 542751 - RNA, 64 nt, hsa
agaggggggcuucgagguggucccugguacuggggugaccgaguggacagcccagggugcagcu

SEQ ID NO: 542752 - RNA, 64 nt, hsa
agccaugaaggcugugaacgagcagggcaaggaggugaccgaguucggcaauaaguacuggcuc

SEQ ID NO: 542753 - RNA, 64 nt, hsa
aacagucaagaggaaccauuggccuagagcuccugugaccgagagcgccacggaagccugggga

SEQ ID NO: 542754 - RNA, 64 nt, hsa
ccuuccuacugaugugauuguggauuaggaauucgugaccgagugauuuuuggccagugguugg

SEQ ID NO: 542755 - RNA, 64 nt, hsa
aaguuaacaugucaccuccacgaggccauccucugugaccgaaggcagcugcugcggacccgcc

SEQ ID NO: 542756 - RNA, 64 nt, hsa
cuacuauuggcccuaaauagcagaaagaagagaagugaccgagagaaccucagauucuucauug

SEQ ID NO: 542757 - RNA, 64 nt, hsa
cuccuccugucuggcccgaggccgccccgugacugugaccgagggagggagggcugccugaucc

SEQ ID NO: 542758 - RNA, 64 nt, hsa
cuucaggacaagccccugcuugcugaagcgucaggugaccgaguucagcuccguaagguggcgg

SEQ ID NO: 542759 - RNA, 64 nt, hsa
cuucaaauuauagaaacaauacuguucuauacgagugaccgauuaugcuuucuuuggccuacau

SEQ ID NO: 542760 - RNA, 64 nt, hsa
uagagaugccugaacaauauuauuuaaguaguaugugaccgagcuauaaauuuuuguuuuuguu

SEQ ID NO: 542761 - RNA, 62 nt, hsa
gggagggggagugggacugagcguccgcagaggugaccgaaaagccguaugaugauguuccc

SEQ ID NO: 542762 - RNA, 64 nt, hsa
cucccagauggccaccauccucaaucuggagcgggugaccgagauccucgauuacuggggaccc

SEQ ID NO: 542763 - RNA, 64 nt, hsa
guaguuuaguuuuccuccuugccuucccuucugugugaccgaccccuuggccaaaaaaaaacaa

SEQ ID NO: 542764 - RNA, 64 nt, hsa
ccaguccccucccacuuugcuucuuguaugcauugugaccgaccccacuuccucagaauguaac

SEQ ID NO: 542765 - RNA, 64 nt, hsa
gccccucugugaagugaaaccucacuccuguccagugaccgagccacugcaaagcacagcugau

SEQ ID NO: 542766 - RNA, 64 nt, hsa
uagcuguggcuucuaggugcccgcguggcauccugugaccgaccccuccccagugccucuccug

SEQ ID NO: 542767 - RNA, 64 nt, hsa
accacccacuacauggcagaggcugaggcggugugugaccgaguggccaucauggugucaggaa

SEQ ID NO: 542768 - RNA, 64 nt, hsa
agguggagaccccgcagggacgcggcggcgcccggugaccgaggccucgcacagccggccgccc

SEQ ID NO: 542769 - RNA, 64 nt, hsa
ucugaauauugauuucuaacaccuggaugaggcugugaccgaucaacuuggaacacuguaaagg

SEQ ID NO: 542770 - RNA, 64 nt, hsa
ugagccaugaucgcaccacugcacucuagccugggugaccgagggaggcucugucucaaaagca

SEQ ID NO: 542771 - RNA, 64 nt, hsa
uuccaccaacccuccugcauccuugccuugcagcgugaccgagauaggucaucagcccagggcu

SEQ ID NO: 542772 - RNA, 64 nt, hsa
ggacggcugauggacucagcaucggaagguggcggugaccgaggggguggggacugagccgccc

SEQ ID NO: 542773 - RNA, 64 nt, hsa
acaaauguaauaugcauccugaggccauuacccagugaccgaugguaagugaggauuccuagga

SEQ ID NO: 542774 - RNA, 64 nt, hsa
cguccccuagugcacccugagagggggcucacaagugaccgauccugggugccucagggagcuc

SEQ ID NO: 542775 - RNA, 64 nt, hsa
uuauaaacacaggagaauaaucaauagaauaaaagugaccgacugucacuucgggccuugugau

SEQ ID NO: 542776 - RNA, 64 nt, hsa
cgggauccggcacucggacuaccuggccccgcuggugaccgacgcggacaacugacccgccagg

SEQ ID NO: 542777 - RNA, 64 nt, hsa
acagaccuuccuagaguguuuggucggguucacagugaccgagagucagguccagcacacaccu

SEQ ID NO: 542778 - RNA, 64 nt, hsa
agggccacgcggccccacauugcacuucuggggggugaccgacuucguacacggguuuaaaguu

SEQ ID NO: 542779 - RNA, 64 nt, hsa
cccuccacccugugucccuguuuugguagcaagagugaccgaugucaagaacgagcaucaaagc

SEQ ID NO: 542780 - RNA, 64 nt, hsa
gcuuugagauauaauauugaacuucaguaugaaugugaccgaaucugaaacuuugggaauuugc

SEQ ID NO: 542781 - RNA, 64 nt, hsa; identical to SEQ ID NO: 123549

SEQ ID NO: 542782 - RNA, 64 nt, hsa; identical to SEQ ID NO: 123550

SEQ ID NO: 542783 - RNA, 64 nt, hsa; identical to SEQ ID NO: 123551

SEQ ID NO: 542784 - RNA, 64 nt, hsa; identical to SEQ ID NO: 123552

SEQ ID NO: 542785 - RNA, 64 nt, hsa; identical to SEQ ID NO: 123553

SEQ ID NO: 542786 - RNA, 64 nt, hsa; identical to SEQ ID NO: 123554

SEQ ID NO: 542787 - RNA, 64 nt, hsa; identical to SEQ ID NO: 123555

SEQ ID NO: 542788 - RNA, 64 nt, hsa; identical to SEQ ID NO: 123556

SEQ ID NO: 542789 - RNA, 64 nt, hsa; identical to SEQ ID NO: 123557

SEQ ID NO: 542790 - RNA, 64 nt, hsa; identical to SEQ ID NO: 123558

SEQ ID NO: 542791 - RNA, 64 nt, hsa; identical to SEQ ID NO: 123559

SEQ ID NO: 542792 - RNA, 64 nt, hsa; identical to SEQ ID NO: 123560

SEQ ID NO: 542793 - RNA, 64 nt, hsa; identical to SEQ ID NO: 123561

SEQ ID NO: 542794 - RNA, 64 nt, hsa; identical to SEQ ID NO: 123562

SEQ ID NO: 542795 - RNA, 64 nt, hsa; identical to SEQ ID NO: 123563

SEQ ID NO: 542796 - RNA, 64 nt, hsa; identical to SEQ ID NO: 123564

SEQ ID NO: 542797 - RNA, 64 nt, hsa; identical to SEQ ID NO: 123565

SEQ ID NO: 542798 - RNA, 64 nt, hsa; identical to SEQ ID NO: 123566

SEQ ID NO: 542799 - RNA, 64 nt, hsa; identical to SEQ ID NO: 123567

SEQ ID NO: 542800 - RNA, 64 nt, hsa; identical to SEQ ID NO: 123568

SEQ ID NO: 542801 - RNA, 64 nt, hsa; identical to SEQ ID NO: 123569

SEQ ID NO: 542802 - RNA, 64 nt, hsa; identical to SEQ ID NO: 123570

SEQ ID NO: 542803 - RNA, 64 nt, hsa; identical to SEQ ID NO: 123571

SEQ ID NO: 542804 - RNA, 64 nt, hsa; identical to SEQ ID NO: 123572

SEQ ID NO: 542805 - RNA, 64 nt, hsa; identical to SEQ ID NO: 123573

SEQ ID NO: 542806 - RNA, 64 nt, hsa; identical to SEQ ID NO: 123574

SEQ ID NO: 542807 - RNA, 64 nt, hsa; identical to SEQ ID NO: 123575

SEQ ID NO: 542808 - RNA, 64 nt, hsa; identical to SEQ ID NO: 123576

SEQ ID NO: 542809 - RNA, 64 nt, hsa; identical to SEQ ID NO: 123577

SEQ ID NO: 542810 - RNA, 64 nt, hsa; identical to SEQ ID NO: 123578

SEQ ID NO: 542811 - RNA, 64 nt, hsa; identical to SEQ ID NO: 123579

SEQ ID NO: 542812 - RNA, 64 nt, hsa; identical to SEQ ID NO: 123580

SEQ ID NO: 542813 - RNA, 64 nt, hsa; identical to SEQ ID NO: 123581

SEQ ID NO: 542814 - RNA, 64 nt, hsa; identical to SEQ ID NO: 123582

SEQ ID NO: 542815 - RNA, 64 nt, hsa; identical to SEQ ID NO: 123583

SEQ ID NO: 542816 - RNA, 64 nt, hsa; identical to SEQ ID NO: 123584

SEQ ID NO: 542817 - RNA, 64 nt, hsa; identical to SEQ ID NO: 123585

SEQ ID NO: 542818 - RNA, 64 nt, hsa; identical to SEQ ID NO: 123586

SEQ ID NO: 542819 - RNA, 64 nt, hsa; identical to SEQ ID NO: 123587

SEQ ID NO: 542820 - RNA, 64 nt, hsa; identical to SEQ ID NO: 123588

SEQ ID NO: 542821 - RNA, 64 nt, hsa; identical to SEQ ID NO: 123589

SEQ ID NO: 542822 - RNA, 64 nt, hsa; identical to SEQ ID NO: 123590

SEQ ID NO: 542823 - RNA, 64 nt, hsa; identical to SEQ ID NO: 123591

SEQ ID NO: 542824 - RNA, 64 nt, hsa; identical to SEQ ID NO: 123592

SEQ ID NO: 542825 - RNA, 64 nt, hsa; identical to SEQ ID NO: 123593

SEQ ID NO: 542826 - RNA, 64 nt, hsa; identical to SEQ ID NO: 123594

SEQ ID NO: 542827 - RNA, 64 nt, hsa; identical to SEQ ID NO: 123595

SEQ ID NO: 542828 - RNA, 64 nt, hsa; identical to SEQ ID NO: 123596

SEQ ID NO: 542829 - RNA, 64 nt, hsa; identical to SEQ ID NO: 123597

SEQ ID NO: 542830 - RNA, 64 nt, hsa; identical to SEQ ID NO: 123598

SEQ ID NO: 542831 - RNA, 64 nt, hsa; identical to SEQ ID NO: 123599

SEQ ID NO: 542832 - RNA, 64 nt, hsa; identical to SEQ ID NO: 123600

SEQ ID NO: 542833 - RNA, 64 nt, hsa; identical to SEQ ID NO: 123601

SEQ ID NO: 542834 - RNA, 64 nt, hsa; identical to SEQ ID NO: 76484

SEQ ID NO: 542835 - RNA, 64 nt, hsa; identical to SEQ ID NO: 76485

SEQ ID NO: 542836 - RNA, 64 nt, hsa
uggccaaugugcauaaccuacucggauccccaccugacacuaaccagagucagcacaggccccg

SEQ ID NO: 542837 - RNA, 64 nt, hsa
uacccacuaggcugccccacgugcucccgagagaugacacuagucagaaaauuggcaguggcag

SEQ ID NO: 542838 - RNA, 62 nt, hsa
gcagguuuccacugugggcgguuggcacucugccaucugaguccucugccuaaagcauuccu

SEQ ID NO: 542839 - RNA, 62 nt, hsa
caagcaaaccugggguauuuauccacugacuuccaucugacacugguugaggaccacugcca

SEQ ID NO: 542840 - RNA, 62 nt, hsa
uuaaaguauggcccgaccauuuaagaaaacaaccaucugagacacgcaggaaauugugagca

SEQ ID NO: 542841 - RNA, 62 nt, hsa
aacuuugauuuauagaaggaaaauggaaacccccaucugaguauuuugggaggagcccccag

SEQ ID NO: 542842 - RNA, 62 nt, hsa
aggguuuuuuuuguuuguuuguuucaaauaagccaucugauuguggugacuggggcccaugu

SEQ ID NO: 542843 - RNA, 62 nt, hsa
cuccugauugacccgacuccacuccaggaaggccaucugacccugugacaggcauagcucau

SEQ ID NO: 542844 - RNA, 62 nt, hsa
cauuuuauaaaacacaagguuucaauuugagcccaucugagccuuaaagauccauucugaau

SEQ ID NO: 542845 - RNA, 62 nt, hsa
uucaauguaugacuccugggagaaucaaggguccaucugagccucugaguaaagaucccaau

SEQ ID NO: 542846 - RNA, 62 nt, hsa
cacaugcuuuucuuuuucuaauaaaccaggguccaucugaccccagcgcuaauucaggcucc

SEQ ID NO: 542847 - RNA, 62 nt, hsa
ucagcagugacguagcaucugaaucccuagacccaucugaugaagaggcaucuucgagccca

SEQ ID NO: 542848 - RNA, 62 nt, hsa
gguggggauuucugaguucuaagaccaagucuccaucugagacucccaaauugcuccccacc

SEQ ID NO: 542849 - RNA, 62 nt, hsa
ggcguccuaacgccuccauggccucaguuuccccaucugaagaauggguacaggaaaggauu

SEQ ID NO: 542850 - RNA, 62 nt, hsa
ugagccagcuuuauauuucaaccauggcuggcccaucugagagcaucuccccacucucgcca

SEQ ID NO: 542851 - RNA, 62 nt, hsa
uuuucucuuauuuuguuuucucuggaucuuuuccaucugaggguacaggaaguaccaggacc

SEQ ID NO: 542852 - RNA, 62 nt, hsa
uacaggcacuaaaguuaguaaagaaaaguuuaccaucugaaaaagcuggauuuucuuuaaga

SEQ ID NO: 542853 - RNA, 62 nt, hsa
cuuacuugcauaccaaguugauacuugaauaaccaucugaaagugguacuugaucauuuuua

SEQ ID NO: 542854 - RNA, 62 nt, hsa
aacuguagucaucuuaaauuucaaaccauuuaccaucugaaaguuuugauuugaauguaaaa

SEQ ID NO: 542855 - RNA, 62 nt, hsa
ucauagcugucugaccucuacggaccucacauccaucugaggcuucauggacaaagauucuc

SEQ ID NO: 542856 - RNA, 62 nt, hsa
gguuagaauagagggcagaguaaaaggaagcuccaucugagcaaguacaccaaaugaucuca

SEQ ID NO: 542857 - RNA, 60 nt, hsa
aucagauaggccggucucagacauuaauccuaccaucugauauuuuuggugaaggaaaaa

SEQ ID NO: 542858 - RNA, 64 nt, hsa
ucuccucuuucagagcacuggcucuccagccccaggaggagaacaggagggaggaggagaugaa

SEQ ID NO: 542859 - RNA, 64 nt, hsa
uggcucuccagccccaggaggagaacaggagggaggaggagaugaaagaggagggacagguucu

SEQ ID NO: 542860 - RNA, 64 nt, hsa
gggaagcaaaaaccaaaaugugugacugggcuuuggaggagacuggagccucagcccuguccug

SEQ ID NO: 542861 - RNA, 64 nt, hsa
auaaagucuuuugugaauuauuuccugaagucguggaggagauuaaacaaaaacagaaagcaca

SEQ ID NO: 542862 - RNA, 64 nt, hsa
ggacaacagaagccccaugccgccuguccaguucggaggagaacuagcugcugccuugccuucc

SEQ ID NO: 542863 - RNA, 64 nt, hsa
ggugcgaguuccuccugcauaugaaccgaggggaggaggagaagcugagcacgugugacauugc

SEQ ID NO: 542864 - RNA, 64 nt, hsa
aaagccaucugggcagucaggggcaaggacuguuggaggagaguuagcccaaguauaggcucug

SEQ ID NO: 542865 - RNA, 64 nt, hsa
accagcaugaugauaauauucaugaccugaugugggaggagacagccaaccucaggcuuagauc

SEQ ID NO: 542866 - RNA, 64 nt, hsa
gggguggggggacauucagacgggcaguguuagaggaggagaugggagcggugacuacacacac

SEQ ID NO: 542867 - RNA, 64 nt, hsa
gcuaggagaucugagggcaggcgggcagcugcagggaggagaggugagaaaggaagcgucuucu

SEQ ID NO: 542868 - RNA, 64 nt, hsa
ccugcuccaggguagaccugagaugaaccucccuggaggagacuuauuucaaugaguccaccau

SEQ ID NO: 542869 - RNA, 62 nt, hsa
ugcaggagucacacggucauaggccaucaaagcuggaggagaccucagaaucauucauucac

SEQ ID NO: 542870 - RNA, 64 nt, hsa
agagagagagagagagagagagagagagaaagauggaggagaagaacuuggauuccccugggua

SEQ ID NO: 542871 - RNA, 64 nt, hsa
cuugaacccagaaggaggacuuugggccaauuucggaggagagaagaaagugcaacguggggag

SEQ ID NO: 542872 - RNA, 64 nt, hsa
ucugucccccuccagguucggcacccaggucuccggaggagacacaguuacccgaacccuucgc

SEQ ID NO: 542873 - RNA, 64 nt, hsa
gagcuccuggcccuggccagaagcaggagugugaggaggagacagccucagcggacaagcagcu

SEQ ID NO: 542874 - RNA, 64 nt, hsa
aggaagagaggagauggauuucaguugggaguuaggaggagaguaggugagaugaucagacacc

SEQ ID NO: 542875 - RNA, 64 nt, hsa
aauccuagagccagcugauaauauuuaauaaucuggaggagagaauaaugauguaccaauaagu

SEQ ID NO: 542876 - RNA, 64 nt, hsa
aguaugucagcuuuucucacccucuucugugcugggaggagagucuaacuguaaccuuuagguu

SEQ ID NO: 542877 - RNA, 64 nt, hsa
aguggacagcguggugagccguggccggacggcaggaggagaggggagcccccucuggcugugu

SEQ ID NO: 542878 - RNA, 64 nt, hsa
acuggccuuggccacacugggauucggagaggaaggaggagagccccaugcuuccugucugccu

SEQ ID NO: 542879 - RNA, 64 nt, hsa
ugcuucagccuggccugggcagcccuggaagcucggaggagaggccaccuucuuaggugccugu

SEQ ID NO: 542880 - RNA, 64 nt, hsa
cagaagggaggggagacagaggggauuaaagaggggaggagagagugcagagcuccaggaaagg

SEQ ID NO: 542881 - RNA, 64 nt, hsa
gcugucugcugggaggucagcuggucaaggcagaggaggagaggaggaaaggaugggggcugaa

SEQ ID NO: 542882 - RNA, 64 nt, hsa
acaaauccagacaccagccuuuaggguggccuugggaggagagggccaggcuguccugggugug

SEQ ID NO: 542883 - RNA, 64 nt, hsa
uuugaaauguuggguuuccagagagagucaugcuggaggagaaggaaguaggccagaaguccag

SEQ ID NO: 542884 - RNA, 64 nt, hsa
gacuuugagcuaaggcugaaguacaggaggaggaggaggagagggccggauguggguguggaca

SEQ ID NO: 542885 - RNA, 64 nt, hsa
agggccggauguggguguggacagcaguaguggcggaggagagcucggggcugggcugccuggc

SEQ ID NO: 542886 - RNA, 51 nt, hsa
aagauggaacagaaguuuaauggaggagaccuauguguauuuuuuucuaaa

SEQ ID NO: 542887 - RNA, 64 nt, hsa
gggaagugagagaguaugguggcaauaucacaagggaggagagaggaaaacaauuaucuucucu

SEQ ID NO: 542888 - RNA, 64 nt, hsa
ggagcucaagcagugaggaggaggagaaggaggaggaggagagcgcgagugagcaggggccaag

SEQ ID NO: 542889 - RNA, 53 nt, hsa
cccuggagcucaagcagugaggaggaggagaaggaggaggaggagagcgcgag

SEQ ID NO: 542890 - RNA, 64 nt, hsa
aaugacagaaugcuuuuaggcacauucaauggaaggaggagauguaggucuguauauguuaccc

SEQ ID NO: 542891 - RNA, 64 nt, hsa
uaaauaauuccaaacucucaucgggucauaaagaggaggagaaacagggugagucaagguaaag

SEQ ID NO: 542892 - RNA, 64 nt, hsa
ucccucuuuuccccuugcccccucugcagccggaggaggagauguugaggggaggaggccagcc

SEQ ID NO: 542893 - RNA, 64 nt, hsa
cagugaggugagacuucccagaccccggaggcguggaggagaggagacuguuugaugugguaca

SEQ ID NO: 542894 - RNA, 64 nt, hsa
guguccacccuccggcccccgucuuguaaaaaggggaggagaauuagccaaacacuguaagcuu

SEQ ID NO: 542895 - RNA, 64 nt, hsa
gcucuguccuuacauguauuugaugugcaucagcggaggagaacacuggcuuggcccugcuccg

SEQ ID NO: 542896 - RNA, 64 nt, hsa
gggcuggaugacgggguuggcacuguggcguccaggaggagaugccugguucugcccaaaauaa

SEQ ID NO: 542897 - RNA, 64 nt, hsa
gggaggagggggaggaagacaagaaggaagaggaggaggagaaggaagacgaggagcuggacug

SEQ ID NO: 542898 - RNA, 64 nt, hsa
ggccugcucagcugcccggagagccgccgccgcuggaggagaccgacuggucgcacucgcagcu

SEQ ID NO: 542899 - RNA, 64 nt, hsa
uaccuucccaagcccgcccagugggaugggaggaggaggagaaggggggccuugggccgcugca

SEQ ID NO: 542900 - RNA, 64 nt, hsa
gccucucacugugaauuuguggugggcgggggcuggaggagagggugggggacuggcuccgucc

SEQ ID NO: 542901 - RNA, 64 nt, hsa
ucugagacucacgucccccagggcaagugcuuguggaggagagcaagucucaagagcgcaguau

SEQ ID NO: 542902 - RNA, 64 nt, hsa
cggccagagggaauguucuggagcugccaaggagggaggagacucggguuggcuaauccccgga

SEQ ID NO: 542903 - RNA, 64 nt, hsa
acaguucuacaagacugcaggaauucuccuuaagggaggagagcaagcagguguggccccagcu

SEQ ID NO: 542904 - RNA, 64 nt, hsa
aucagucccuucauuucuugagacucaacuccugggaggagagggucucaagaguugucccugg

SEQ ID NO: 542905 - RNA, 64 nt, hsa
uaaucaaggccccagaguguguaugcuuccagguggaggagaaaggggaaucucccaaaauuua

SEQ ID NO: 542906 - RNA, 64 nt, hsa
aacaccauucuggaaguuuggcugcccacaggcaggaggagaagcaugaagagaaaaccuguuu

SEQ ID NO: 542907 - RNA, 64 nt, hsa
uuacuguugcagcuugugcugagccugcccaguuggaggagacugggcaccccugccuccugcc

SEQ ID NO: 542908 - RNA, 64 nt, hsa
cagacagggagaaguugagcagguaucaacuaggggaggagagagggucuccaguguucccccc

SEQ ID NO: 542909 - RNA, 62 nt, hsa
aggacuuccugggcccauaggugaagccuucuggaggagaaggugacguggcccagcgucca

SEQ ID NO: 542910 - RNA, 64 nt, hsa
agacucagcuccaggcugcuuggcagcccagccuggaggagaaggcuaaugacggaggggcccc

SEQ ID NO: 542911 - RNA, 64 nt, hsa
ucuguuuguaacucaucauagaaacauuguggugggaggagaggggauagucuacagcuaauga

SEQ ID NO: 542912 - RNA, 64 nt, hsa
gccuaggccaaagcuagcccaaggcuggggaaggggaggagacuccaggucagaaugugagguc

SEQ ID NO: 542913 - RNA, 64 nt, hsa
gguugggcaugcugugguugcugagggaugagggggaggagagagguaggagcuggagaugaag

SEQ ID NO: 542914 - RNA, 64 nt, hsa
caugcuuccuggggccuccagcagcuccacuaauggaggagaggcaguagccuccgacacagaa

SEQ ID NO: 542915 - RNA, 64 nt, hsa
ugcaaguaggcuuugaggggugaaggagauugguggaggagaguaaauaaucuagaggcaagag

SEQ ID NO: 542916 - RNA, 64 nt, hsa
cucacugccuauaagaggaaauaagagagaaaguggaggagagggacaaaaggaguaauuauuu

SEQ ID NO: 542917 - RNA, 64 nt, hsa
cugugccacccucagagaagaagaaaggagcugaggaggagaagccaaagaggaggaggcagga

SEQ ID NO: 542918 - RNA, 64 nt, hsa
gucugcggggauccuguuacaaaggugaaacccaggaggagaguguggaguccagagugcugcc

SEQ ID NO: 542919 - RNA, 64 nt, hsa
caaggucccuacucuuguggaguuuacuucugguggaggagacagaugauaaguaaacaaauaa

SEQ ID NO: 542920 - RNA, 64 nt, hsa
aggccuuuccgcggugggauguugagcugaggccggaggagaaguagcagucgcuggcagagca

SEQ ID NO: 542921 - RNA, 64 nt, hsa
augauuuugaggacgacugugacagccugacuugggaggagacugaggagacccugcugcuuug

SEQ ID NO: 542922 - RNA, 64 nt, hsa
agagugaggggccccgccagcccgauggggaugaggaggagagcacagcccucagcaucaacga

SEQ ID NO: 542923 - RNA, 64 nt, hsa
acacucgacccagucuaaagugggugccauucacggaggagagggagguuggagacuucaaccg

SEQ ID NO: 542924 - RNA, 64 nt, hsa
ucagacaggccuccacggcuauggagagaaggcuggaggagacacaauggaugguucauguucu

SEQ ID NO: 542925 - RNA, 64 nt, hsa
caagccuggaaggaggcaauaagugggaaagguaggaggagagaaggcuggggagggcugggca

SEQ ID NO: 542926 - RNA, 64 nt, hsa
ugucugaaaucacauggugagaaggaggaugaagggaggagagagcuuuugcucugggucucca

SEQ ID NO: 542927 - RNA, 64 nt, hsa
guggaggccacaguuguagcaggcgcuaggcccgggaggagagugcauggugcagagggggcug

SEQ ID NO: 542928 - RNA, 64 nt, hsa
ggcacugaggaugcuguucucaguuugacuguggggaggagagagaaugggguacuagcacccc

SEQ ID NO: 542929 - RNA, 64 nt, hsa
cagagagaggagacgaagaguuugggacagugggggaggagaugggaagggaugggauuucugg

SEQ ID NO: 542930 - RNA, 64 nt, hsa
cuugugaauuuuucuaaaggugcuauuuaacaugggaggagagcgugugcggcuccagcccagc

SEQ ID NO: 542931 - RNA, 64 nt, hsa
augccgggggagccaccagccccucacuggguucggaggagagucaggaagggccacgacaaag

SEQ ID NO: 542932 - RNA, 64 nt, hsa
acaugggggagagagacuuggaagaggaggaggaggaggagaaggaggagagagaggggaagag

SEQ ID NO: 542933 - RNA, 64 nt, hsa
agagagacuuggaagaggaggaggaggaggagaaggaggagagagaggggaagagacaaagugg

SEQ ID NO: 542934 - RNA, 64 nt, hsa
ccccgaugcuccgaagccugaucuuccaggguggggaggagaaaaucccaccuccccugaccuc

SEQ ID NO: 542935 - RNA, 64 nt, hsa
cccaucccuaggcuaaagagccaugaguccuggaggaggagaggaccccucccaaaggacugga

SEQ ID NO: 542936 - RNA, 64 nt, hsa
gccgcuguguccccgcgggcagugacgugaguggggaggagacucaggcccacauugcccacac

SEQ ID NO: 542937 - RNA, 64 nt, hsa
ggcguguccccugccugugagugacaucgguucaggaggagacagucaggaagccuccugcuga

SEQ ID NO: 542938 - RNA, 64 nt, hsa
gacaucgccgggggagguugugggcaacgguggaggaggagagacgggaggggaccauuuggga

SEQ ID NO: 542939 - RNA, 64 nt, hsa
ugagcugugggucugaucaccccaagucccgcccggaggagaggcacagccagggcgugugguu

SEQ ID NO: 542940 - RNA, 64 nt, hsa
uaauaaaucuguaucagaugacuccggaaaugugggaggagagaauuacugcuugguacgcaga

SEQ ID NO: 542941 - RNA, 64 nt, hsa
cuuuggaaguucagcagaugaaagcccaggccagggaggagaaggcuagaaagcaggugagcac

SEQ ID NO: 542942 - RNA, 64 nt, hsa
ugcagcgcaucaaggccacagcgauucgcacggaggaggagaagcgccugauggagcagaaggu

SEQ ID NO: 542943 - RNA, 64 nt, hsa
gacuggggggaucagcugcccauugcucccaagaggaggagagggaggcugcagaugccuggga

SEQ ID NO: 542944 - RNA, 64 nt, hsa
gccaccuucaggccugggaaggaagacacugggaggaggagaggccuggaaagcuuugguaggu

SEQ ID NO: 542945 - RNA, 64 nt, hsa
aaacuaaugaaaacaaucucuguaauggcagauaggaggagaugaaaaguucuguugcauggau

SEQ ID NO: 542946 - RNA, 64 nt, hsa
cugugccuacuaaagguaucuucuggaguuuuugggaggagagaaacuggaaaauuaaauugua

SEQ ID NO: 542947 - RNA, 64 nt, hsa
gucaggcuggucucaaacuccugaccucaggugauccgcccaccucagccucccaaagugcugg

SEQ ID NO: 542948 - RNA, 64 nt, hsa
cgaccugacuuacuugcacugugaucccccuugcuccgcccacugugaccuugaaccccaugca

SEQ ID NO: 542949 - RNA, 64 nt, hsa
uuggcuacucuagcguggugcgcccuaguacgacuccgcccaguguguggaccaaccaaauagc

SEQ ID NO: 542950 - RNA, 64 nt, hsa
ggcuggaauggaacuccucacuagcugcuggggcuccgcccacccugcucccuuccggacaaug

SEQ ID NO: 542951 - RNA, 64 nt, hsa
gggcagggacugccuccucccggaauuccuaagauccgcccagcugccaccauuuucauugcuu

SEQ ID NO: 542952 - RNA, 64 nt, hsa
ugaacagaugaguccugggagagacccucagagauccgcccagaccccucuccugcccucugca

SEQ ID NO: 542953 - RNA, 64 nt, hsa
guuaggcuggucucgaacucccaaccucaggugauccgcccaccucagcucucaaagugcuggg

SEQ ID NO: 542954 - RNA, 64 nt, hsa
cucccucuuuguguccauuccccaaauuaaccucuccgcccaggcccagaggaggggcugccug

SEQ ID NO: 542955 - RNA, 64 nt, hsa
gggguccccuccagcaugggacuggccugccuccuccgcccagcucggcgagcuccuccagacc

SEQ ID NO: 542956 - RNA, 64 nt, hsa
gccaggcuggucucgaacugcuggauucaagugauccgcccaucuccgucucccaaagugcugg

SEQ ID NO: 542957 - RNA, 64 nt, hsa
accaccccuccugcuuccccgagccugacccuguuccgcccacuggcaaucagggcugcgcacu

SEQ ID NO: 542958 - RNA, 64 nt, hsa
uaugaggugugcagggggagcuggguggcuucacuccgcccauuccaaagagggcucucccucc

SEQ ID NO: 542959 - RNA, 64 nt, hsa
cgucugacagccauguccaccugugcccacagcuuccgcccacagaccuccagggacaggagca

SEQ ID NO: 542960 - RNA, 64 nt, hsa
gccaggcugguuucaaacuccugaccucaggugauccgcccaccucagccucccaaaauggugg

SEQ ID NO: 542961 - RNA, 64 nt, hsa
guugauuccagugcuaaaagggaaaaaccugugguccgcccagaagagauuccuccagugccug

SEQ ID NO: 542962 - RNA, 64 nt, hsa
gucaggcuggucucgaacuccagaccucaggugauccgcccaccucggccucccaaacugcugg

SEQ ID NO: 542963 - RNA, 64 nt, hsa
gaaaugaaauauguugcugggugcguuaaucaccuccgcccaggauuuagucacuugcaggacc

SEQ ID NO: 542964 - RNA, 64 nt, hsa
ugggacugucauguuauccagaagggcugguacauccgcccaccaugucccccugcugggucag

SEQ ID NO: 542965 - RNA, 64 nt, hsa
gccaggcuggucuugaacuccugaccucaacugauccgcccaccuuggccucccaagugcuggg

SEQ ID NO: 542966 - RNA, 64 nt, hsa
caaguccucgccccccgcccggccuccuagccucuccgcccacgcggcugcugcuucucccugg

SEQ ID NO: 542967 - RNA, 64 nt, hsa
uguccccagggaagagaaugaggaccacguggacuccgcccacacagagcuggcugcugugccc

SEQ ID NO: 542968 - RNA, 64 nt, hsa
uaaaauaaaccuucacugcuccacuccaggugaauccgcccacucccacugaccuaguagaauu

SEQ ID NO: 542969 - RNA, 64 nt, hsa
gucaggcuggucuugaacucccgaccucaggugauccgcccaccuaggccucucaaaguguugg

SEQ ID NO: 542970 - RNA, 64 nt, hsa
cauuaucugcacuauaagcucaaagaaugucacauccgcccagacagcucuuugaugaggguga

SEQ ID NO: 542971 - RNA, 64 nt, hsa
cgccgcuaaccggccgcucguccccgcgccacgguccgcccaccgccgccgccgcugucccaga

SEQ ID NO: 542972 - RNA, 50 nt, hsa
ucuccaagaggaagcccuaauccgcccacaggaagccugcaguccuggaa

SEQ ID NO: 542973 - RNA, 64 nt, hsa
uuuggcacuugaggcacggagaagggaagggaaguccgcccagccagaacucccagacccgcuc

SEQ ID NO: 542974 - RNA, 64 nt, hsa
cuuaggcuggucuugaacuccugaacucaagugauccgcccaccucagccucccaaaguguugg

SEQ ID NO: 542975 - RNA, 64 nt, hsa
uuuuuuuuuuuuuuuugagacggagucucacucuuccgcccaggcugcagugcaguggcaugau

SEQ ID NO: 542976 - RNA, 56 nt, hsa
augcccucagccagcucugacccagguccgcccagggacccacauggacuaaaggc

SEQ ID NO: 542977 - RNA, 64 nt, hsa
uagccaggauggucucgaucuccugaccucgugauccgcccaccuuggccucccagagugcugg

SEQ ID NO: 542978 - RNA, 64 nt, hsa
gaguggcacugauaacuggugaagccuacagccauccgcccaaaagucuguucugauggcacug

SEQ ID NO: 542979 - RNA, 64 nt, hsa
ggcugcuggaaggcagcuuguggaggccguugguuccgcccacucauuccuucucgugcacugc

SEQ ID NO: 542980 - RNA, 64 nt, hsa
guuggccaggauggucucaaucucgaccucgugauccgcccaccuuggccucccaaaguguugg

SEQ ID NO: 542981 - RNA, 64 nt, hsa
aggccagccugcucccuggcugaggcucaggcuauccgcccaagcucuuugcucauucuagggc

SEQ ID NO: 542982 - RNA, 64 nt, hsa
ccugaggaccaucuuagcggcccuguccucuuuuuccgcccauucucccucgggucuccccaga

SEQ ID NO: 542983 - RNA, 64 nt, hsa
guuggccaggauggucucaaucucgaccucgugauccgcccaccucggccucccaaaguguugg

SEQ ID NO: 542984 - RNA, 64 nt, hsa
ucucaggaagcucccggaguccccgccucucuccuccgcccacagggguucgugggcacagggc

SEQ ID NO: 542985 - RNA, 64 nt, hsa
gggucucuggugugaacacccccgacagcagcccuccgcccacucugcccccugggagcccucg

SEQ ID NO: 542986 - RNA, 64 nt, hsa
caaguaaccaggccccagccuccaggcccccaacuccgcccagccucuccccgcucuggauccu

SEQ ID NO: 542987 - RNA, 64 nt, hsa
gucaggcuggucucaaacucccaccuucaggugauccgcccaccucggccuccugaggugcuga

SEQ ID NO: 542988 - RNA, 64 nt, hsa
cccacgcuggccccaacugcugcagcucucggcuuccgcccaacagccucuggaggugaggcgg

SEQ ID NO: 542989 - RNA, 64 nt, hsa
uggccaggauggucucgaucuccugaccucgugauccgcccaccucggccucccaaaucgcuag

SEQ ID NO: 542990 - RNA, 64 nt, hsa
gaagcgcuuccgagcugugcccagucccgggaauuccgcccagucugcccacacuucccucggu

SEQ ID NO: 542991 - RNA, 64 nt, hsa
gugggaccucaggagggucagaggagaagcagccuccgcccagccgcuaggccagggaccaucu

SEQ ID NO: 542992 - RNA, 62 nt, hsa
acuuugacgacguccugugaggggcagaggccuccgcccagucaccaucaggccacucccuc

SEQ ID NO: 542993 - RNA, 64 nt, hsa
cccguccucuguuaaagggagccagccccgcggcuccgcccaggcaugguagccugagcgcgcc

SEQ ID NO: 542994 - RNA, 64 nt, hsa
cagugccaaacuugggccgcugcaccgcggcgccuccgcccaaaucaauaaacugugucugucc

SEQ ID NO: 542995 - RNA, 64 nt, hsa
ggcauggcguucaagauuuuggagaugaacugauuccgcccaaauagaaucauguuuauuuuuu

SEQ ID NO: 542996 - RNA, 64 nt, hsa
gccgggcuggucuugaacuccugaccucagguaauccgcccaucucggcuucccaaagugcuga

SEQ ID NO: 542997 - RNA, 64 nt, hsa
gccaggcuggucucaaacuccugacucgaagugauccgcccaccuuggccucccaaagcguugg

SEQ ID NO: 542998 - RNA, 64 nt, hsa
guuuuguuuuguuuugagacaaagacucacucuguccgcccaggcugggugcagucacggcuca

SEQ ID NO: 542999 - RNA, 64 nt, hsa
cccaggcuggucgcgaacuccugagcucaggcaauccgcccaccucagccucccaaaguguugg

SEQ ID NO: 543000 - RNA, 64 nt, hsa
cccucucaggggcacuggccucucugcagggccuuccgcccagcgcuggccuuaaugcuaaagc

SEQ ID NO: 543001 - RNA, 64 nt, hsa
ccuccugcaggucagcagcugauccugauccaccuccgcccaggcccuccaagcucuacucacc

SEQ ID NO: 543002 - RNA, 64 nt, hsa
uggucucgaucuucugacagaucugaccucgugauccgcccaucuccaccucccgcagugcugg

SEQ ID NO: 543003 - RNA, 64 nt, hsa
cggaaggcuuggucccaucggaaguuuuggguuuuccgcccacagccgccggaaguggcuccgu

SEQ ID NO: 543004 - RNA, 64 nt, hsa
gcgccuguaucaugacugaggugccucccaacgcuccgcccacgcugacaauaaaguugcucug

SEQ ID NO: 543005 - RNA, 64 nt, hsa
gcaggcagcgcgagggaggagcugcgccgccggcuccgcccaaccagguggugcugagcuuccg

SEQ ID NO: 543006 - RNA, 64 nt, hsa
uagccaggauggucucgaucuccugaccucgugauccgcccaccucggccucccaaagugcugg

SEQ ID NO: 543007 - RNA, 64 nt, hsa
ggguaagagcacagguuagggcauggaaggcuucuccgcccauucugacccagggccuaggacg

SEQ ID NO: 543008 - RNA, 64 nt, hsa
ggucccgcccaccagcggacucggcccccaaggcuccgcccacacugaccacgccccucggcgg

SEQ ID NO: 543009 - RNA, 64 nt, hsa
agcacaagaugcccugugcagcugcccgagggucuccgcccaccccggccggacuuugaucccc

SEQ ID NO: 543010 - RNA, 64 nt, hsa
gccaggcuagucucgaacuccugaccucagaugauccgcccacauuggccucccaaagugcugg

SEQ ID NO: 543011 - RNA, 64 nt, hsa
uucucccccuccaguaguagcugggugagaccuguccgcccaccuucccuccacuacagaaccu

SEQ ID NO: 543012 - RNA, 64 nt, hsa
cugcaggaacugcaugcugcagguguccugcccuuccgcccacgagugcgccauguuucagcgg

SEQ ID NO: 543013 - RNA, 64 nt, hsa
uagccaggauggucuugaucuccugaccucaugauccgcccaccuuggccucccaaagugcugg

SEQ ID NO: 543014 - RNA, 64 nt, hsa
accuugugguguagugggggcugggugggguggcuccgcccaggaggcggcugcacgguucucu

SEQ ID NO: 543015 - RNA, 64 nt, hsa
uuuauacgucuaaagaaaauauucaguagcugaauccgcccagugauagccugugggcaccagc

SEQ ID NO: 543016 - RNA, 64 nt, hsa
ucggaaaaacagaaagauccauaaagaugcagaguccgcccagucaugcacagacuccagugga

SEQ ID NO: 543017 - RNA, 64 nt, hsa
uguccauccauuccuccauccacccaucuguccauccgcccaucugcccguccauccauccauc

SEQ ID NO: 543018 - RNA, 64 nt, hsa
uggccaggauggccucgaucucuugaccucgugauccgcccaccucagccucccaaagugcuag

SEQ ID NO: 543019 - RNA, 64 nt, hsa
gccaggcuagucucgaacucaugaccucaagugauccgcccacuucggucucccaaagugcugg

SEQ ID NO: 543020 - RNA, 64 nt, hsa
gccaggcuggucucgaacuccuguccucagguaauccgcccaccucagccucccaaagugcugg

SEQ ID NO: 543021 - RNA, 64 nt, hsa
cgccugcccugggagcaccggcucugcuuaccuguccgcccaccugucuggaacaagggccagg

SEQ ID NO: 543022 - RNA, 64 nt, hsa
caggggccaaccucaggcuccuaaagagacauuuuccgcccacuccugggacacuccgucugcu

SEQ ID NO: 543023 - RNA, 64 nt, hsa
ggaaauaacaggcgggcuucacggugcggcucuguccgcccaugccccgcugggucugcaggga

SEQ ID NO: 543024 - RNA, 64 nt, hsa
cugccaggggcgccuggcaagugcugugcccacguccgcccaggacccagccguguugagugaa

SEQ ID NO: 543025 - RNA, 64 nt, hsa
ugucugucuuugccuggugucuuccuuucccguguccgcccaccccagcgucuguugguacuua

SEQ ID NO: 543026 - RNA, 64 nt, hsa
ucugucacguucuccacacgggggagagacgcaguccgcccagguccccgcuuucuuuggaggc

SEQ ID NO: 543027 - RNA, 64 nt, hsa
cggugcccuguggcuucaccgcccuacuuccaccuccgcccagccuguaauguuuauauaagca

SEQ ID NO: 543028 - RNA, 64 nt, hsa
gccaggcuggucucgaacuccugaccucaggugauccgcccaccucggccucccaaagugcugg

SEQ ID NO: 543029 - RNA, 64 nt, hsa
cuguaaauaaacgcugggcuccccagagcaccuguccgcccacugcccuugcuguucugggauc

SEQ ID NO: 543030 - RNA, 64 nt, hsa
gccucgaccugccgcagggguccgggauugggaauccgcccaucugggggccucuucugcuuuc

SEQ ID NO: 543031 - RNA, 64 nt, hsa
gugcugcacggcgagguggugucccccuuuguccuccgcccagggcagggaaagugcuuaguau

SEQ ID NO: 543032 - RNA, 64 nt, hsa
uggccaggcuggucucaaacuccugaccuugugauccgcccaccucagccuccgaaagugcugg

SEQ ID NO: 543033 - RNA, 64 nt, hsa
gccaggcucgucucgaacuccugaccucaggugauccgcccaccuuggccucccaaagugcugg

SEQ ID NO: 543034 - RNA, 64 nt, hsa
gugaugggcaccucucacugaccucacagcgcaguccgcccaucugagcacagggucuguccuu

SEQ ID NO: 543035 - RNA, 64 nt, hsa
ugcugagccuccuggccuggcccccaccggugcauccgcccagugcguccaccugcccuggcua

SEQ ID NO: 543036 - RNA, 64 nt, hsa
uuucacuuauucuuagaaaacaagcaugaaagauuccgcccauucagauaaugccaaaaauaug

SEQ ID NO: 543037 - RNA, 64 nt, hsa
caaagccaugccauugcgcugccccggccgccaguccgcccagaagccauagacgagacguagg

SEQ ID NO: 543038 - RNA, 64 nt, hsa
gacgccgggacccccugcccgaucgcgcgcggccuccgcccaccgccuccugccgcaaggggcc

SEQ ID NO: 543039 - RNA, 64 nt, hsa
uauuuaacuuuauuuucuguuuuaugaguguguguccgcccacccccacccccuucaguguuaa

SEQ ID NO: 543040 - RNA, 64 nt, hsa
gugaauaucgagaacugccauugucgucuuuauguccgcccaccuagugcuuccacuucuaugc

SEQ ID NO: 543041 - RNA, 64 nt, hsa
ccugacagucccagccgccacccaaggagccccauccgcccacccacccugggacccacgcggc

SEQ ID NO: 543042 - RNA, 64 nt, hsa
caaggggcuggaaucucaugauuccaugcccgaguccgcccaucccugaccaugguuuuggcuc

SEQ ID NO: 543043 - RNA, 64 nt, hsa
gaaugucaccgucucccucuucuaccgcaaugacuccgcccaccugccccugccucucagccuc

SEQ ID NO: 543044 - RNA, 64 nt, hsa
ggacaggacagugaccuugggaggaaggggcuacuccgcccacgucagggagagaugugagcau

SEQ ID NO: 543045 - RNA, 64 nt, hsa
cgccagcuuuaggccccgcccuccucccaauggcuccgcccacagacucccuuauuucaauggc

SEQ ID NO: 543046 - RNA, 64 nt, hsa
gcacggucugguucauuucuguaucuaccccccuuccgcccacgcccccgacccuuugcucaau

SEQ ID NO: 543047 - RNA, 64 nt, hsa
ccccuuccaaagaccccugggggggguggggcauuccgcccaccccuuucccccaucacuucuc

SEQ ID NO: 543048 - RNA, 64 nt, hsa
uggccaggccgcucucaaacuccugaccucgggauccgcccaccucggccucccaaagugcugg

SEQ ID NO: 543049 - RNA, 64 nt, hsa
cuccucaggcucccucuauuaaagccgaucugacuccgcccagccagaugucccgagugcgcca

SEQ ID NO: 543050 - RNA, 64 nt, hsa
caaaggcuggucuugaacucccgaccucaggugauccgcccaccuuggccucccgaagugcugg

SEQ ID NO: 543051 - RNA, 64 nt, hsa
gccugccaguucacaaccgcuccgagcgugggucuccgcccagcuccaguccugugauccgggc

SEQ ID NO: 543052 - RNA, 64 nt, hsa
aucuuggcccccagccccucgucgcggguucagguccgcccauuacuccuugucgugcggucaa

SEQ ID NO: 543053 - RNA, 50 nt, hsa
ugcuacaauccagcuucuaauccgcccaaaagcggcagccaaucggagcg

SEQ ID NO: 543054 - RNA, 64 nt, hsa
aucucgccccucgugaugucaggggcgcaguagcuccgcccacguggagcucgggcgguguaga

SEQ ID NO: 543055 - RNA, 64 nt, hsa
uggccaggcuggucuugaacuccugaccucaugauccgcccaccucagccucccaaaguguugg

SEQ ID NO: 543056 - RNA, 64 nt, hsa
uugugaggcuggcgauuacauaaguauaagcagguccgcccagggcuuggcuacuguagguguc

SEQ ID NO: 543057 - RNA, 64 nt, hsa
cccagaaccaagcucucggugucucgggccaccauccgcccaccucgggcugaccccaccuccu

SEQ ID NO: 543058 - RNA, 64 nt, hsa
ccuggcucuggacuguggccaaccuucuccacauuccgcccaaucuguaccggaugcuggcagg

SEQ ID NO: 543059 - RNA, 64 nt, hsa
cccaggcuggucucgaacuccuggacucaagcaauccgcccaccuugacuucccaaagugcugg

SEQ ID NO: 543060 - RNA, 64 nt, hsa
cugccaccugaagccgagcuccuccagagcuuucuccgcccaccucacugcaucccaaguggag

SEQ ID NO: 543061 - RNA, 64 nt, hsa
ccgcuacuccggggacagugacuccucagccuccuccgcccagagcggcccccuugguacccgc

SEQ ID NO: 543062 - RNA, 64 nt, hsa
ccccacucuccgggcaccgucuccugccugugcguccgcccaccgcugcccugucuguugcgac

SEQ ID NO: 543063 - RNA, 64 nt, hsa
gcucuugcugccauggucucaagccugaagaggcuccgcccacaagcuggcccaugaaguuagc

SEQ ID NO: 543064 - RNA, 64 nt, hsa
gguggccugcccuucuccccagagggaggcggccuccgcccauuggugcucaugcagacucugg

SEQ ID NO: 543065 - RNA, 64 nt, hsa
uagccaggauggucuccaucuccugaccucaugauccgcccaccuuggccucccaaaaugcugg

SEQ ID NO: 543066 - RNA, 64 nt, hsa
uacuucaagggccaagcugccccuuucccuccucuccgcccaugaaaaugccuccaaacugaga

SEQ ID NO: 543067 - RNA, 64 nt, hsa
gucaggcuggucucaaacuccugaccucaggugauccgcccaccucggccuugcaaaaugcugg

SEQ ID NO: 543068 - RNA, 64 nt, hsa; identical to SEQ ID NO: 423381

SEQ ID NO: 543069 - RNA, 64 nt, hsa; identical to SEQ ID NO: 423382

SEQ ID NO: 543070 - RNA, 64 nt, hsa; identical to SEQ ID NO: 423383

SEQ ID NO: 543071 - RNA, 64 nt, hsa; identical to SEQ ID NO: 423384

SEQ ID NO: 543072 - RNA, 64 nt, hsa; identical to SEQ ID NO: 423385

SEQ ID NO: 543073 - RNA, 64 nt, hsa; identical to SEQ ID NO: 423386

SEQ ID NO: 543074 - RNA, 64 nt, hsa; identical to SEQ ID NO: 423387

SEQ ID NO: 543075 - RNA, 64 nt, hsa; identical to SEQ ID NO: 423388

SEQ ID NO: 543076 - RNA, 64 nt, hsa; identical to SEQ ID NO: 423389

SEQ ID NO: 543077 - RNA, 64 nt, hsa; identical to SEQ ID NO: 423390

SEQ ID NO: 543078 - RNA, 64 nt, hsa; identical to SEQ ID NO: 423391

SEQ ID NO: 543079 - RNA, 64 nt, hsa; identical to SEQ ID NO: 423392

SEQ ID NO: 543080 - RNA, 64 nt, hsa; identical to SEQ ID NO: 423393

SEQ ID NO: 543081 - RNA, 64 nt, hsa; identical to SEQ ID NO: 423394

SEQ ID NO: 543082 - RNA, 64 nt, hsa; identical to SEQ ID NO: 423395

SEQ ID NO: 543083 - RNA, 64 nt, hsa; identical to SEQ ID NO: 423396

SEQ ID NO: 543084 - RNA, 64 nt, hsa; identical to SEQ ID NO: 423397

SEQ ID NO: 543085 - RNA, 64 nt, hsa; identical to SEQ ID NO: 423398

SEQ ID NO: 543086 - RNA, 64 nt, hsa; identical to SEQ ID NO: 423399

SEQ ID NO: 543087 - RNA, 64 nt, hsa; identical to SEQ ID NO: 423400

SEQ ID NO: 543088 - RNA, 64 nt, hsa; identical to SEQ ID NO: 423401

SEQ ID NO: 543089 - RNA, 64 nt, hsa; identical to SEQ ID NO: 423402

SEQ ID NO: 543090 - RNA, 64 nt, hsa; identical to SEQ ID NO: 245345

SEQ ID NO: 543091 - RNA, 64 nt, hsa; identical to SEQ ID NO: 245346

SEQ ID NO: 543092 - RNA, 64 nt, hsa; identical to SEQ ID NO: 245347

SEQ ID NO: 543093 - RNA, 64 nt, hsa; identical to SEQ ID NO: 245348

SEQ ID NO: 543094 - RNA, 64 nt, hsa; identical to SEQ ID NO: 245349

SEQ ID NO: 543095 - RNA, 64 nt, hsa; identical to SEQ ID NO: 245350

SEQ ID NO: 543096 - RNA, 64 nt, hsa; identical to SEQ ID NO: 245351

SEQ ID NO: 543097 - RNA, 64 nt, hsa; identical to SEQ ID NO: 245352

SEQ ID NO: 543098 - RNA, 64 nt, hsa; identical to SEQ ID NO: 245353

SEQ ID NO: 543099 - RNA, 64 nt, hsa; identical to SEQ ID NO: 245354

SEQ ID NO: 543100 - RNA, 64 nt, hsa; identical to SEQ ID NO: 245355

SEQ ID NO: 543101 - RNA, 64 nt, hsa; identical to SEQ ID NO: 245356

SEQ ID NO: 543102 - RNA, 64 nt, hsa; identical to SEQ ID NO: 245357

SEQ ID NO: 543103 - RNA, 64 nt, hsa; identical to SEQ ID NO: 245358

SEQ ID NO: 543104 - RNA, 64 nt, hsa; identical to SEQ ID NO: 245359

SEQ ID NO: 543105 - RNA, 64 nt, hsa; identical to SEQ ID NO: 245360

SEQ ID NO: 543106 - RNA, 64 nt, hsa; identical to SEQ ID NO: 245361

SEQ ID NO: 543107 - RNA, 64 nt, hsa; identical to SEQ ID NO: 245362

SEQ ID NO: 543108 - RNA, 64 nt, hsa; identical to SEQ ID NO: 245363

SEQ ID NO: 543109 - RNA, 64 nt, hsa; identical to SEQ ID NO: 245364

SEQ ID NO: 543110 - RNA, 64 nt, hsa; identical to SEQ ID NO: 245365

SEQ ID NO: 543111 - RNA, 64 nt, hsa; identical to SEQ ID NO: 245366

SEQ ID NO: 543112 - RNA, 64 nt, hsa; identical to SEQ ID NO: 245367

SEQ ID NO: 543113 - RNA, 64 nt, hsa; identical to SEQ ID NO: 245368

SEQ ID NO: 543114 - RNA, 64 nt, hsa; identical to SEQ ID NO: 245369

SEQ ID NO: 543115 - RNA, 64 nt, hsa; identical to SEQ ID NO: 245370

SEQ ID NO: 543116 - RNA, 64 nt, hsa; identical to SEQ ID NO: 245371

SEQ ID NO: 543117 - RNA, 64 nt, hsa; identical to SEQ ID NO: 245372

SEQ ID NO: 543118 - RNA, 64 nt, hsa; identical to SEQ ID NO: 245373

SEQ ID NO: 543119 - RNA, 64 nt, hsa; identical to SEQ ID NO: 245374

SEQ ID NO: 543120 - RNA, 64 nt, hsa; identical to SEQ ID NO: 245375

SEQ ID NO: 543121 - RNA, 64 nt, hsa; identical to SEQ ID NO: 245376

SEQ ID NO: 543122 - RNA, 64 nt, hsa; identical to SEQ ID NO: 245377

SEQ ID NO: 543123 - RNA, 64 nt, hsa; identical to SEQ ID NO: 245378

SEQ ID NO: 543124 - RNA, 64 nt, hsa; identical to SEQ ID NO: 245379

SEQ ID NO: 543125 - RNA, 64 nt, hsa; identical to SEQ ID NO: 245380

SEQ ID NO: 543126 - RNA, 64 nt, hsa; identical to SEQ ID NO: 245381

SEQ ID NO: 543127 - RNA, 64 nt, hsa; identical to SEQ ID NO: 245382

SEQ ID NO: 543128 - RNA, 64 nt, hsa; identical to SEQ ID NO: 245383

SEQ ID NO: 543129 - RNA, 64 nt, hsa; identical to SEQ ID NO: 245384

SEQ ID NO: 543130 - RNA, 64 nt, hsa; identical to SEQ ID NO: 245385

SEQ ID NO: 543131 - RNA, 51 nt, hsa; identical to SEQ ID NO: 245386

SEQ ID NO: 543132 - RNA, 64 nt, hsa; identical to SEQ ID NO: 245387

SEQ ID NO: 543133 - RNA, 64 nt, hsa; identical to SEQ ID NO: 245388

SEQ ID NO: 543134 - RNA, 64 nt, hsa; identical to SEQ ID NO: 245389

SEQ ID NO: 543135 - RNA, 64 nt, hsa; identical to SEQ ID NO: 245390

SEQ ID NO: 543136 - RNA, 64 nt, hsa; identical to SEQ ID NO: 245391

SEQ ID NO: 543137 - RNA, 64 nt, hsa; identical to SEQ ID NO: 245392

SEQ ID NO: 543138 - RNA, 57 nt, hsa; identical to SEQ ID NO: 245393

SEQ ID NO: 543139 - RNA, 64 nt, hsa; identical to SEQ ID NO: 245394

SEQ ID NO: 543140 - RNA, 64 nt, hsa; identical to SEQ ID NO: 245395

SEQ ID NO: 543141 - RNA, 64 nt, hsa; identical to SEQ ID NO: 245396

SEQ ID NO: 543142 - RNA, 64 nt, hsa; identical to SEQ ID NO: 245397

SEQ ID NO: 543143 - RNA, 64 nt, hsa; identical to SEQ ID NO: 245398

SEQ ID NO: 543144 - RNA, 64 nt, hsa; identical to SEQ ID NO: 245399

SEQ ID NO: 543145 - RNA, 64 nt, hsa; identical to SEQ ID NO: 245400

SEQ ID NO: 543146 - RNA, 64 nt, hsa; identical to SEQ ID NO: 245401

SEQ ID NO: 543147 - RNA, 64 nt, hsa; identical to SEQ ID NO: 245402

SEQ ID NO: 543148 - RNA, 64 nt, hsa; identical to SEQ ID NO: 245403

SEQ ID NO: 543149 - RNA, 64 nt, hsa; identical to SEQ ID NO: 245404

SEQ ID NO: 543150 - RNA, 64 nt, hsa; identical to SEQ ID NO: 245405

SEQ ID NO: 543151 - RNA, 64 nt, hsa; identical to SEQ ID NO: 219840

SEQ ID NO: 543152 - RNA, 64 nt, hsa; identical to SEQ ID NO: 219841

SEQ ID NO: 543153 - RNA, 64 nt, hsa; identical to SEQ ID NO: 219842

SEQ ID NO: 543154 - RNA, 64 nt, hsa; identical to SEQ ID NO: 219843

SEQ ID NO: 543155 - RNA, 64 nt, hsa; identical to SEQ ID NO: 219844

SEQ ID NO: 543156 - RNA, 64 nt, hsa; identical to SEQ ID NO: 219845

SEQ ID NO: 543157 - RNA, 64 nt, hsa; identical to SEQ ID NO: 219846

SEQ ID NO: 543158 - RNA, 64 nt, hsa; identical to SEQ ID NO: 219847

SEQ ID NO: 543159 - RNA, 64 nt, hsa; identical to SEQ ID NO: 219848

SEQ ID NO: 543160 - RNA, 64 nt, hsa; identical to SEQ ID NO: 219849

SEQ ID NO: 543161 - RNA, 64 nt, hsa; identical to SEQ ID NO: 219850

SEQ ID NO: 543162 - RNA, 64 nt, hsa; identical to SEQ ID NO: 219851

SEQ ID NO: 543163 - RNA, 64 nt, hsa; identical to SEQ ID NO: 219852

SEQ ID NO: 543164 - RNA, 64 nt, hsa; identical to SEQ ID NO: 219853

SEQ ID NO: 543165 - RNA, 64 nt, hsa; identical to SEQ ID NO: 219854

SEQ ID NO: 543166 - RNA, 64 nt, hsa; identical to SEQ ID NO: 219855

SEQ ID NO: 543167 - RNA, 64 nt, hsa; identical to SEQ ID NO: 219856

SEQ ID NO: 543168 - RNA, 64 nt, hsa; identical to SEQ ID NO: 219857

SEQ ID NO: 543169 - RNA, 64 nt, hsa; identical to SEQ ID NO: 219858

SEQ ID NO: 543170 - RNA, 64 nt, hsa; identical to SEQ ID NO: 219859

SEQ ID NO: 543171 - RNA, 64 nt, hsa; identical to SEQ ID NO: 219860

SEQ ID NO: 543172 - RNA, 64 nt, hsa; identical to SEQ ID NO: 219861

SEQ ID NO: 543173 - RNA, 64 nt, hsa; identical to SEQ ID NO: 219862

SEQ ID NO: 543174 - RNA, 64 nt, hsa; identical to SEQ ID NO: 219863

SEQ ID NO: 543175 - RNA, 64 nt, hsa; identical to SEQ ID NO: 219864

SEQ ID NO: 543176 - RNA, 64 nt, hsa; identical to SEQ ID NO: 219865

SEQ ID NO: 543177 - RNA, 64 nt, hsa; identical to SEQ ID NO: 219866

SEQ ID NO: 543178 - RNA, 64 nt, hsa; identical to SEQ ID NO: 219867

SEQ ID NO: 543179 - RNA, 64 nt, hsa; identical to SEQ ID NO: 219868

SEQ ID NO: 543180 - RNA, 64 nt, hsa; identical to SEQ ID NO: 219869

SEQ ID NO: 543181 - RNA, 64 nt, hsa; identical to SEQ ID NO: 219870

SEQ ID NO: 543182 - RNA, 64 nt, hsa; identical to SEQ ID NO: 219871

SEQ ID NO: 543183 - RNA, 64 nt, hsa; identical to SEQ ID NO: 219872

SEQ ID NO: 543184 - RNA, 64 nt, hsa; identical to SEQ ID NO: 219873

SEQ ID NO: 543185 - RNA, 64 nt, hsa; identical to SEQ ID NO: 219874

SEQ ID NO: 543186 - RNA, 64 nt, hsa; identical to SEQ ID NO: 219875

SEQ ID NO: 543187 - RNA, 64 nt, hsa; identical to SEQ ID NO: 219876

SEQ ID NO: 543188 - RNA, 64 nt, hsa; identical to SEQ ID NO: 219877

SEQ ID NO: 543189 - RNA, 64 nt, hsa; identical to SEQ ID NO: 219878

SEQ ID NO: 543190 - RNA, 64 nt, hsa; identical to SEQ ID NO: 219879

SEQ ID NO: 543191 - RNA, 64 nt, hsa; identical to SEQ ID NO: 219880

SEQ ID NO: 543192 - RNA, 64 nt, hsa; identical to SEQ ID NO: 219881

SEQ ID NO: 543193 - RNA, 64 nt, hsa; identical to SEQ ID NO: 219882

SEQ ID NO: 543194 - RNA, 64 nt, hsa; identical to SEQ ID NO: 219883

SEQ ID NO: 543195 - RNA, 64 nt, hsa
aagaaaaaaugaugauagagucccaaaaagaagagaaaaaaaaugcccaaguugcccuuuaaaa

SEQ ID NO: 543196 - RNA, 64 nt, hsa
ucuuuucugucacugauccguauuaccacuuuuggaaaaaaauaaauaaauaaauaaauaaaag

SEQ ID NO: 543197 - RNA, 64 nt, hsa
ggaggagacaucuggccuuuuuagaaccugagaggaaaaaaagagucuuuuuuuccccucuguc

SEQ ID NO: 543198 - RNA, 64 nt, hsa
uccagccugggugacagagcaagacucugccucagaaaaaaaaaaaaauaauaaugcuggguag

SEQ ID NO: 543199 - RNA, 64 nt, hsa
agccugggcgacagagcgagagucugucucaaaagaaaaaaaaaagcaccgccuccaaaugcca

SEQ ID NO: 543200 - RNA, 64 nt, hsa
gccugagcaacagagugagacccugucucuuaaagaaaaaaaaagucagacugcugggacuggc

SEQ ID NO: 543201 - RNA, 64 nt, hsa
uuagugucugagcuucucaaauuagcugcaauaggaaaaaaacaaauugggaaaugaaaaaaaa

SEQ ID NO: 543202 - RNA, 64 nt, hsa
uuagcugcaauaggaaaaaaacaaauugggaaaugaaaaaaaaaugggaagauuaaaaagcaca

SEQ ID NO: 543203 - RNA, 64 nt, hsa
aaccaaaguuacuguuguuuacagugaguuuggggaaaaaaaauaaaauaaaaauggcuuuccc

SEQ ID NO: 543204 - RNA, 64 nt, hsa
guuuuuaaaaauguuuuuaguuaaacguugaggagaaaaaaaaaaaaggcuuuucccccaaagu

SEQ ID NO: 543205 - RNA, 64 nt, hsa
guuagcauaguagauaaauuguuaugaaauaccagaaaaaaaaaucuguaucuuuuacugagaa

SEQ ID NO: 543206 - RNA, 64 nt, hsa
aaauuguguaaaauuacauuuuuuuuccaggggagaaaaaaacaucaaacaaaaacaucuaaau

SEQ ID NO: 543207 - RNA, 64 nt, hsa
aagcugccucaaggaauuuuuuuaacuuaagggagaaaaaaagggaucuggggauggggugggc

SEQ ID NO: 543208 - RNA, 64 nt, hsa
uguucagcuacucccacucccggccugucauucagaaaaaaauaaauguucuaauaagcuccau

SEQ ID NO: 543209 - RNA, 64 nt, hsa
aaagcuaucuaccuauccugagucuaucuuaaaggaaaaaaagaaaaaaaccuuaucucuugcc

SEQ ID NO: 543210 - RNA, 64 nt, hsa
cuaccuauccugagucuaucuuaaaggaaaaaaagaaaaaaaccuuaucucuugcccuuauuuu

SEQ ID NO: 543211 - RNA, 64 nt, hsa
auuucacugguccaucuauauuuaaaacgugcaagaaaaaaauaaaauacucugcucuagcaag

SEQ ID NO: 543212 - RNA, 64 nt, hsa
ugcccauuggccugaaaauacucauuguaagccugaaaaaaaaaaucuuucccacuguuuuuuc

SEQ ID NO: 543213 - RNA, 64 nt, hsa
guuuuuguccuaauguugcuacucccauggcaaagaaaaaaaaaagaaugaaaaaaagaaaaaa

SEQ ID NO: 543214 - RNA, 64 nt, hsa
uugcuacucccauggcaaagaaaaaaaaaagaaugaaaaaaagaaaaaaauuuggaaaaaaaaa

SEQ ID NO: 543215 - RNA, 64 nt, hsa
cccauggcaaagaaaaaaaaaagaaugaaaaaaagaaaaaaauuuggaaaaaaaaaucaggcuc

SEQ ID NO: 543216 - RNA, 64 nt, hsa
aaaaaaaaaagaaugaaaaaaagaaaaaaauuuggaaaaaaaaaucaggcucauagcagcuacu

SEQ ID NO: 543217 - RNA, 64 nt, hsa
gaaaauucccccuacuucuaauuugcugaaugaagaaaaaaaaaaaucuuuuauuugugauauu

SEQ ID NO: 543218 - RNA, 64 nt, hsa
aaaaauuguucaucaacuucuuuauguuuuauuagaaaaaaacuguuuuaaugugcuuuaucau

SEQ ID NO: 543219 - RNA, 64 nt, hsa
uuuaucauaaauaaauauccugacaaaugguauugaaaaaaaucugagaucaugugaacauaua

SEQ ID NO: 543220 - RNA, 64 nt, hsa
uagaucuuauauugguuugcacaaguucccuggagaaaaaaauugcucuguguauaucucuugg

SEQ ID NO: 543221 - RNA, 64 nt, hsa
ugcauaaugcuuuggaaaaaugggucuuuuauaggaaaaaaacugggauaacugauuucuaugg

SEQ ID NO: 543222 - RNA, 64 nt, hsa
ugaaggaucuaacacugcucucucuuccaaaggggaaaaaaagauucauuuguuuugagcaaua

SEQ ID NO: 543223 - RNA, 64 nt, hsa
uuacuuuaugauguuuacauacacguuucacuuugaaaaaaaaugcaaaucgacuuuuuaacaa

SEQ ID NO: 543224 - RNA, 64 nt, hsa
ggcuuuauuaucuugucagucacuaccuccuaaagaaaaaaaaaaaggcuagaagaaaaaacau

SEQ ID NO: 543225 - RNA, 64 nt, hsa
uaaucuuugacauuuuggaaaaauaagaauugaggaaaaaaaguguaucuuucaaguagaugca

SEQ ID NO: 543226 - RNA, 64 nt, hsa
acuaacuccaguuuuacuauuauuauuuugguuggaaaaaaaauucacucuuuacgugcuaauu

SEQ ID NO: 543227 - RNA, 64 nt, hsa
ccucucguaucucaccccaaaccccaaacugggggaaaaaaaguuaacucuuugugaauggaac

SEQ ID NO: 543228 - RNA, 64 nt, hsa
cuguuuaucucacuugcuuugaaagccaaugggggaaaaaaauccaugaaaaaaaaaagauuga

SEQ ID NO: 543229 - RNA, 64 nt, hsa
uugcuuugaaagccaaugggggaaaaaaauccaugaaaaaaaaaagauugauaaaguagaugau

SEQ ID NO: 543230 - RNA, 64 nt, hsa
gacccacugcuaacuguagcaacaaaauuuaaaagaaaaaaaacauacuuuaucuggcuauuau

SEQ ID NO: 543231 - RNA, 64 nt, hsa
aguuuuuuuuuugccuuagcaaagggugguguuugaaaaaaaaaauguguagccccuuuuuaac

SEQ ID NO: 543232 - RNA, 64 nt, hsa
aaugcaugauuucucugugaccaaaauuaagcaugaaaaaaauguuuccauugccauauuugau

SEQ ID NO: 543233 - RNA, 64 nt, hsa
uuuuuuuuucuaucgaaauuacuaaucaguuggggaaaaaaauacuauagcagacagcacuaau

SEQ ID NO: 543234 - RNA, 64 nt, hsa
aaacccugggcugaaguuggcauuucaguuaaaagaaaaaaagaaacuagucccagauuugaaa

SEQ ID NO: 543235 - RNA, 64 nt, hsa
aggcuagacaacugaaaggggcuaccaaggcugggaaaaaaaugcaauuguugcugugagugac

SEQ ID NO: 543236 - RNA, 64 nt, hsa
auguucuuuauacagccuaguuaauguuuaaaaagaaaaaaauagcuugguuuuauuugucauc

SEQ ID NO: 543237 - RNA, 64 nt, hsa
acauugaaagguaaaaucugauuauuuagcaugagaaaaaaaaauccaacucugcuuuuggucu

SEQ ID NO: 543238 - RNA, 64 nt, hsa
gguuuaacaaaaaaaaaaagcuuuaaaaaaaaaagaaaaaaaggaaaagguuuuuagcucauuu

SEQ ID NO: 543239 - RNA, 64 nt, hsa
uuuuauuauacaaaguuuguacaguaccaaaaaagaaaaaaaaaaagguguaaauuuuuuuuuc

SEQ ID NO: 543240 - RNA, 64 nt, hsa
caucuacgccauauacccaucaccaucccaugaggaaaaaaaaaaaaguaaaacaaagacaaaa

SEQ ID NO: 543241 - RNA, 64 nt, hsa
caaugggagcccacggaacuaaguagggucccaagaaaaaaaacgggagcuauuucacagagcu

SEQ ID NO: 543242 - RNA, 64 nt, hsa
uagagcgaccuuuucaauuacaaagaaccuccuggaaaaaaaaacaaaagcugaacagaggcgg

SEQ ID NO: 543243 - RNA, 64 nt, hsa
uguuuuuguacuuuacuaaucuuuaaacuaucaggaaaaaaaccaaaacuuuauaccaaugauu

SEQ ID NO: 543244 - RNA, 64 nt, hsa
cuuccccagccacagguauguggaauacggugaggaaaaaaaaaauuaaaaaaaaaaugcaagc

SEQ ID NO: 543245 - RNA, 64 nt, hsa
ucagcugccaguuuuuacuuuuuuaaauaguugggaaaaaaauuccaaagacugauauuuugug

SEQ ID NO: 543246 - RNA, 64 nt, hsa
uggguacuuucuacucucauuuuuguuagccuaugaaaaaaaaaacauuuuguuaaccuaugga

SEQ ID NO: 543247 - RNA, 64 nt, hsa
uguauguguuguuuaagaaauguauaaaaaaccugaaaaaaaugaguaagaacuggcagaaguu

SEQ ID NO: 543248 - RNA, 64 nt, hsa
augaauuuuaucuacuccagaagucucuacaauagaaaaaaaagugcagugcuucuaggauaua

SEQ ID NO: 543249 - RNA, 64 nt, hsa
cucuuaaaacaaggaguguauuuuagagacaagggaaaaaaaccacaucugcuauccaaagauu

SEQ ID NO: 543250 - RNA, 64 nt, hsa
uuuagcaaauuaaguuauuuuccuaaaaaaaaaagaaaaaaagaauucagaacuacuuuccucu

SEQ ID NO: 543251 - RNA, 64 nt, hsa
uucaaacaaugguuucucugcguuaauuauugaggaaaaaaaaagaugggguaagaaaacuacc

SEQ ID NO: 543252 - RNA, 64 nt, hsa
caaauauguaaagcaauuguaggaaauuugaaaggaaaaaaagaaaccgaagccaguauuuuaa

SEQ ID NO: 543253 - RNA, 64 nt, hsa
guggucuuaacacuuuuauauaaaaaugaaaauggaaaaaaagucccacugaacucucucuucc

SEQ ID NO: 543254 - RNA, 64 nt, hsa
guguuugguauuuuucugacaaaauuaagaaaaagaaaaaaaauuauuugugggcaaauguuaa

SEQ ID NO: 543255 - RNA, 64 nt, hsa
cuuuuuuugguuacaguguaugauggauguguaugaaaaaaauguaucuuugggaaaacaauua

SEQ ID NO: 543256 - RNA, 64 nt, hsa
uugcaggacaaugauggcuauucuaaacgcuaaggaaaaaaaacaaacacagaacuguuucaag

SEQ ID NO: 543257 - RNA, 64 nt, hsa
aauggaaauaggagaauaugguucucacucuugagaaaaaaaccuaagauuagcccagguaguu

SEQ ID NO: 543258 - RNA, 64 nt, hsa
acuucugaaaguuuuuggaaacuuagaaaagagggaaaaaaauccaguguuacuaguaauuucc

SEQ ID NO: 543259 - RNA, 64 nt, hsa
acucuccuacacuuccauuaacuuagcauguguugaaaaaaaaguuucagagaaguucuggcug

SEQ ID NO: 543260 - RNA, 64 nt, hsa
auaagaaugaauaauaauuauccagaguuuagaggaaaaaaaugacuaaaaauauuauaacuua

SEQ ID NO: 543261 - RNA, 64 nt, hsa
uuuuuuucuaauuuacugaucuuacuacuacaaagaaaaaaaaacccaaccaaucugcaauuca

SEQ ID NO: 543262 - RNA, 64 nt, hsa
uuauuuaaaaucuaagauugcucuaacgucuagugaaaaaaauauuuuuaaaauuucagccaaa

SEQ ID NO: 543263 - RNA, 64 nt, hsa
uugaggguuugccuucuaaagucugcaacuucaagaaaaaaaaucgacacuguggauugacuuu

SEQ ID NO: 543264 - RNA, 64 nt, hsa
uacugaccuuucacagagaaaaaauauuucccuugaaaaaaacugggcuugucauuuuuucccu

SEQ ID NO: 543265 - RNA, 64 nt, hsa
cugauuacagauaauaguauuuauauaaauaauugaaaaaaauuuucuuuugggaagagggaga

SEQ ID NO: 543266 - RNA, 64 nt, hsa
cugcuauuuagcuccucuuaagaagauuaaaagagaaaaaaaaaggcccuuuuaaaaauaguau

SEQ ID NO: 543267 - RNA, 64 nt, hsa
uccuucuuuuuaccuuuuuaaaaaucuguuagaagaaaaaaagcagcagacgaaagagaaaaac

SEQ ID NO: 543268 - RNA, 64 nt, hsa
ucacuguuacaucaccaagaggcccugaaaagaggaaaaaaaaaaaaaaagaggccaggcaugg

SEQ ID NO: 543269 - RNA, 64 nt, hsa
aaaaaauccaauuuugucaguauuuucuuagucugaaaaaaacagcaguaguaaucuggugaau

SEQ ID NO: 543270 - RNA, 64 nt, hsa
uuuaaauaaucagaauauccugcaauugaaaggagaaaaaaauccaauuuugucaguauuuucu

SEQ ID NO: 543271 - RNA, 64 nt, hsa
gguguuuguuugccuuuauaaacuguugcaaauagaaaaaaaauagaauaaguauauauuuuug

SEQ ID NO: 543272 - RNA, 64 nt, hsa
uccugcaauuccagcugccauuugcaaaaacaaggaaaaaaauccgaaacuuucuuuuguugca

SEQ ID NO: 543273 - RNA, 64 nt, hsa
uauuuaugaauccugucgguauuccuugguaucugaaaaaaauaccaaauaguaccauacauga

SEQ ID NO: 543274 - RNA, 64 nt, hsa
guuuaacuggaguugucaaguaugagucccucaggaaaaaaaaaaaauucuguuuuaaaaagca

SEQ ID NO: 543275 - RNA, 64 nt, hsa
cugcaccguuacgcugugauggcaacuggggauagaaaaaaaauggggaaagacaggaauccua

SEQ ID NO: 543276 - RNA, 64 nt, hsa
cccaggcaacaagagugaaacccugucucaaaaagaaaaaaaaaguugaccuugagaauuuaua

SEQ ID NO: 543277 - RNA, 64 nt, hsa
ccugggcaacauggcuaaacucugucucuauuaagaaaaaaaauguuaacauuaugauuuaaaa

SEQ ID NO: 543278 - RNA, 64 nt, hsa
cagaacugugaaaaauaaauuuguuauuuaaaaagaaaaaaaaaaaaacaaaaaccugaguuuc

SEQ ID NO: 543279 - RNA, 64 nt, hsa
guucuaaaaaaaaaaaaaaaaaaaaaaaaaaaaggaaaaaaaaaaagaaaaagaaaacgugugc

SEQ ID NO: 543280 - RNA, 64 nt, hsa
aaaguuuuaccacagucugcacuugcagaagaaagaaaaaaauucaaaccacauguuuauuuuu

SEQ ID NO: 543281 - RNA, 64 nt, hsa
gccuccacaacaccuccugauaguaguaaaauuagaaaaaaacaaacucuacuaauuuuuagau

SEQ ID NO: 543282 - RNA, 64 nt, hsa
aauugucccaacaaccacacuuaaauccaguggggaaaaaaagguuaacaguaaaaauuucuuc

SEQ ID NO: 543283 - RNA, 64 nt, hsa
augucaguguuaaaaugcuucucccugaaaaagagaaaaaaaaaaggaaaaaaagaaaagaaaa

SEQ ID NO: 543284 - RNA, 64 nt, hsa
aaaugcuucucccugaaaaagagaaaaaaaaaaggaaaaaaagaaaagaaaagugaaaagaaaa

SEQ ID NO: 543285 - RNA, 64 nt, hsa
ugcccagcacacauuaauguuagcuucuuucugagaaaaaaauaccucuuccaggcccugaaac

SEQ ID NO: 543286 - RNA, 64 nt, hsa
cauuugcugugaagauugaaaaugaacaaaguuagaaaaaaaaacagcaaaaucagugauuuag

SEQ ID NO: 543287 - RNA, 64 nt, hsa
uuuaagugaaaaucugaauuguucuaaauggaaagaaaaaaaguugcaaucugugcccuucauu

SEQ ID NO: 543288 - RNA, 64 nt, hsa
auuuaguugcaugauuagucagaaacugccauuugaaaaaaaguuauuuuuauagcagcaaaaa

SEQ ID NO: 543289 - RNA, 64 nt, hsa
uguguugauuggagaauuuuucuguauguaauuagaaaaaaauguaaaacaugauuuaugugaa

SEQ ID NO: 543290 - RNA, 64 nt, hsa
uaaucacuacuauuucugcucgguuuccuaaaaggaaaaaaaaggcgcaguggugaugacccuc

SEQ ID NO: 543291 - RNA, 64 nt, hsa
cucaucagcgucaaaauaguucaaauaauuuuacgaaaaaaaacucagcuucuguuguuuauca

SEQ ID NO: 543292 - RNA, 64 nt, hsa
ccagaaucuacaaugaacucaaacaaauuuacaagaaaaaaacaaacaaccccaucaaaaagug

SEQ ID NO: 543293 - RNA, 64 nt, hsa
uaaagcugaucauguuuugcuacaguuugcaggugaaaaaaaauaaauauuauaaaauaugcua

SEQ ID NO: 543294 - RNA, 64 nt, hsa
cuggggauagagugagaucccaucucuaaaaaaugaaaaaaagaagagagguagcuuuaaagug

SEQ ID NO: 543295 - RNA, 64 nt, hsa
gcccaacuuuucuaagugagcuuagcaaugagaagaaaaaaaaacaugaauucuuuuucuggaa

SEQ ID NO: 543296 - RNA, 64 nt, hsa
cagaaguauuuuaaagggcuuaaugugccaaaaagaaaaaaagcuagagacccuuuuugcaaac

SEQ ID NO: 543297 - RNA, 64 nt, hsa
cacugcaagcucugaaucaguuuuuuaaaaaaaagaaaaaaaaaaaaaaggagcugugccccau

SEQ ID NO: 543298 - RNA, 64 nt, hsa
accugggcaacauaguaagaucuugucucuuaaagaaaaaaaaaaaagguacuuagaggucgca

SEQ ID NO: 543299 - RNA, 64 nt, hsa
ggaaaaaaaugggucagaacucagcaucugucaugaaaaaaaucaauugaaaaacaagcagauu

SEQ ID NO: 543300 - RNA, 64 nt, hsa
cauguagucgggcagccuauugauacugucaggggaaaaaaaugggucagaacucagcaucugu

SEQ ID NO: 543301 - RNA, 64 nt, hsa
ucauaugcaguaaaagaaagaaagaaaaaaaaaggaaaaaaaaaaaaaaaccaauguuuugcag

SEQ ID NO: 543302 - RNA, 64 nt, hsa
gcaucuuaccuucauaugcaguaaaagaaagaaagaaaaaaaaaggaaaaaaaaaaaaaaacca

SEQ ID NO: 543303 - RNA, 64 nt, hsa
cuuaaaagguaucaauguaccuuuuuugguaguggaaaaaaaaaagacaggcugccacaguaua

SEQ ID NO: 543304 - RNA, 64 nt, hsa
ggucuauacuuaagggaaaaguugcaagaaugcugaaaaaaaauugaacacaaucucauugagg

SEQ ID NO: 543305 - RNA, 64 nt, hsa
ggauuaacccucuauagacagaauagauagcacugaaaaaaaaucucuaugagcuaaaugucug

SEQ ID NO: 543306 - RNA, 64 nt, hsa
aaggaaaaaaaggagacagacaagaagaggaagagaaaaaaaggggcccacgaggacugugaug

SEQ ID NO: 543307 - RNA, 64 nt, hsa
ccuggccuggauugacaacauccucccagagaaggaaaaaaaggagacagacaagaagaggaag

SEQ ID NO: 543308 - RNA, 64 nt, hsa
cuagcuugccuggagaugauguuucuugcuuuuggaaaaaaaaaaaaagucucugaaauuugau

SEQ ID NO: 543309 - RNA, 64 nt, hsa
acauguugagaucauuguuguuucauuguuuaaggaaaaaaaaaaaugccuguaccuacaaugu

SEQ ID NO: 543310 - RNA, 64 nt, hsa
aauguacuucaaaaagcaaauauauauuacuaaggaaaaaaaguuauuuauaauugccuuguca

SEQ ID NO: 543311 - RNA, 64 nt, hsa
ucauauauuuaugcauuacacaccuuagcuauaagaaaaaaaggguuuugauuauaugcuucuu

SEQ ID NO: 543312 - RNA, 64 nt, hsa
agaaagcaguagugagagugagaguaacaauaaagaaaaaaaaauacaaaggaagaaaagaaag

SEQ ID NO: 543313 - RNA, 64 nt, hsa
uucccaauuacaggaaauuagaucgacuggagaagaaaaaaaagaaaaaagauagaaaaaagaa

SEQ ID NO: 543314 - RNA, 64 nt, hsa
guaucccuuucaaaugccuuugagaagaauagaagaaaaaaaguuuguauauauuuuaaaaaau

SEQ ID NO: 543315 - RNA, 64 nt, hsa
auuaacugauuaauuucccuuauguugaggcauggaaaaaaaauuggaaaagaaaaacucaguu

SEQ ID NO: 543316 - RNA, 64 nt, hsa
cacaauuucccgccuuuuuuuuuuuuugugaaaugaaaaaaacaaauuguguuuuauugcggua

SEQ ID NO: 543317 - RNA, 64 nt, hsa
gagguauguauuuaacaaaauaaacgacacugccgaaaaaaaaaaaagugaagugaaaacaauc

SEQ ID NO: 543318 - RNA, 64 nt, hsa
uauaagcuauaacaucaaaucagggaaaaaugaggaaaaaaaauagauucugaaccauuuauug

SEQ ID NO: 543319 - RNA, 64 nt, hsa
cuguggcuuuuagggcuugguucauaccaugggggaaaaaaaaguccuaggagaaagcgacgug

SEQ ID NO: 543320 - RNA, 64 nt, hsa
uuacuucgucuucgcccucugaaauuaaagaaaugaaaaaaaaaaacaauaucugcagcguugc

SEQ ID NO: 543321 - RNA, 64 nt, hsa
aaaaaaauguuuuaugguagcuuuuacuuuuuaugaaaaaaaaauuauuugccuuuuaaauucu

SEQ ID NO: 543322 - RNA, 64 nt, hsa
gcggcuuuucagaagaaauuuaaucagugugacagaaaaaaaaauguuuuaugguagcuuuuac

SEQ ID NO: 543323 - RNA, 64 nt, hsa
acuuuggcaacccuuuugaaaaguagcaauuauggaaaaaaaauauucaauaagagauuaggag

SEQ ID NO: 543324 - RNA, 64 nt, hsa
accaugacgcaaagagagauuuuuuuuuaaagaagaaaaaaaaaaauucacacugccagcguua

SEQ ID NO: 543325 - RNA, 64 nt, hsa
gauuccauuuguguaaaaacuagggugguaaccggaaaaaaauauugucaguauuucaagcugu

SEQ ID NO: 543326 - RNA, 64 nt, hsa
gcaaaaaaaaaaucagcaaaauaauaaaaugaacgaaaaaaaaugacacccagggaguucccaa

SEQ ID NO: 543327 - RNA, 64 nt, hsa
ccccuuugacugaucagugugauaaggacuuuaggaaaaaaagcauguauguuuuuuacuguuu

SEQ ID NO: 543328 - RNA, 64 nt, hsa
ucguuaaucuugcugcuuaugugccaauuuaguggaaaaaaacaacccuugcugaaaaauuccc

SEQ ID NO: 543329 - RNA, 64 nt, hsa
acuggguuugcuuuucuuaaaacauaccaaaaaagaaaaaaauagaaaaaaaaaaaaaaaaagc

SEQ ID NO: 543330 - RNA, 64 nt, hsa
cuuuucuuaaaacauaccaaaaaagaaaaaaauagaaaaaaaaaaaaaaaaagcuugaucucua

SEQ ID NO: 543331 - RNA, 64 nt, hsa
aagugguaacuuuaaaggauucuguaugccaagugaaaaaaaaagaugucugaccuccuuacau

SEQ ID NO: 543332 - RNA, 64 nt, hsa
aaauaaaauaaaauauauugguauguaacuacaggaaaaaaauaaaaaauauauaguggacagu

SEQ ID NO: 543333 - RNA, 64 nt, hsa
ucugaagauacaugucuuucuccagggacauguggaaaaaaaaaagauguuauacaaccaucaa

SEQ ID NO: 543334 - RNA, 64 nt, hsa
aaaaggguaucccaaaaauaaaacuauccuuuuggaaaaaaaaagauuuaaaauaauuccuggu

SEQ ID NO: 543335 - RNA, 64 nt, hsa
uacuugccacaaaaucaauaaaagauguuuuugagaaaaaaaggaagaaaccaacucauucaga

SEQ ID NO: 543336 - RNA, 64 nt, hsa
aagacacucuggccaccauaaaaaacgcagaaaagaaaaaaagguuaagcauaaaaagaaaggg

SEQ ID NO: 543337 - RNA, 64 nt, hsa
agagacugguagcucaucauccuaccauaaaagagaaaaaaauucggaaagugaucagagcacu

SEQ ID NO: 543338 - RNA, 64 nt, hsa
gaaggcgagcuaagaggagacuuagauccagugggaaaaaaaauagcguuucacauaaaaagca

SEQ ID NO: 543339 - RNA, 64 nt, hsa
gcagggccaaauggaaagaacacauaauaaacaagaaaaaaacagaggugaagaaaaauccaag

SEQ ID NO: 543340 - RNA, 64 nt, hsa
cccacucagggcuggggccaagaggaaaaacagggaaaaaaagaaaaaaaaaagaaaaaggaaa

SEQ ID NO: 543341 - RNA, 64 nt, hsa
gggcuggggccaagaggaaaaacagggaaaaaaagaaaaaaaaaagaaaaaggaaaaggaagcg

SEQ ID NO: 543342 - RNA, 64 nt, hsa
auucucguagcuuuuuaaaaaaaugaaaguaaaggaaaaaaaaaaaacugcaaaucuagaaaac

SEQ ID NO: 543343 - RNA, 64 nt, hsa
uguucaccugguuugaaauaauaaaauguagaaagaaaaaaaauaccgagaacugauggguauu

SEQ ID NO: 543344 - RNA, 64 nt, hsa
cggcuuuuacagcaacaauacgauuaucuuauaggaaaaaaaaaaucauuguaaaguaucaaga

SEQ ID NO: 543345 - RNA, 64 nt, hsa
ucuauuuaccuugcacauuuuuuguuguuacagugaaaaaaaugguccaagaaaauguuugcca

SEQ ID NO: 543346 - RNA, 64 nt, hsa
aaguuuaauugaaagaauguaaagcaaccaaaaagaaaaaaaaaaagaaagaaagaggaaaaga

SEQ ID NO: 543347 - RNA, 64 nt, hsa
gcaaacuauuuaaagaaauauguauucuguaaaagaaaaaaaaaaugcggccuuuucaugagga

SEQ ID NO: 543348 - RNA, 64 nt, hsa
acacaauauaugaaauaguacccucuaaaaaagagaaaaaaaaaaucaggcggucaaacuuaga

SEQ ID NO: 543349 - RNA, 64 nt, hsa
uuuguaucuacugauaacagaaucugggucacaugaaaaaaaaucauuuuauccgucuuuuaag

SEQ ID NO: 543350 - RNA, 64 nt, hsa
aaaucaugaguaaaauuggaaaacacuuuuaacugaaaaaaacaaaagcacaacaaaccaaaac

SEQ ID NO: 543351 - RNA, 64 nt, hsa
aaauaaaugaaauagagaauagaaaagcaauacagaaaaaaaauuaugaaaucaaaagcugguu

SEQ ID NO: 543352 - RNA, 64 nt, hsa
uucugcaaaaaggaaaaagaaaccacaaauuggggaaaaaaaaagaagaaaaaccuguuuccgu

SEQ ID NO: 543353 - RNA, 64 nt, hsa
ggaagagaggagagggagaaaaauaaaaugaaaggaaaaaaaaaaguuugcaaauucagacagg

SEQ ID NO: 543354 - RNA, 64 nt, hsa
agcuugacacccaccaagcaaaaguuucagccuggaaaaaaaaugggggggaaggguggaugaa

SEQ ID NO: 543355 - RNA, 64 nt, hsa
guggggugccagaaagugucugcugauauuuguggaaaaaaaaucuauuuuguuuaccuacugu

SEQ ID NO: 543356 - RNA, 64 nt, hsa
gagaaugguaguauuuuuuuuuuuuaucagcugugaaaaaaauguuacagaucugcacauuuuc

SEQ ID NO: 543357 - RNA, 64 nt, hsa
cuauaugaaucaauuauuacaucuguuuuacuaugaaaaaaaaauuaauacuacuagcuuccag

SEQ ID NO: 543358 - RNA, 64 nt, hsa
caguugaauggaaaauuacucaguguauagaaaggaaaaaaaccagaaauuuaaaauagauaca

SEQ ID NO: 543359 - RNA, 64 nt, hsa
uugauuuauauacucuguuuuacagauuuagcuagaaaaaaaaugucaguguuuuggugcaccu

SEQ ID NO: 543360 - RNA, 64 nt, hsa
aaagguuaaacuggauuuuuuuuuuuaaaaaaaagaaaaaaaaagaagaaaaguauaccagaua

SEQ ID NO: 543361 - RNA, 64 nt, hsa
ugugaauauacauaucaagaacuuuggggguuuugaaaaaaaugaauuguauauauacaaauca

SEQ ID NO: 543362 - RNA, 64 nt, hsa
guauaguggugaauacucgcugauaugaaucccagaaaaaaauuuccuguuuuuaauguucuuu

SEQ ID NO: 543363 - RNA, 64 nt, hsa
uauugcuguuuugucuuucuuuuuucuaaaaaaagaaaaaaaagaaaaaaaggaaaagaagaac

SEQ ID NO: 543364 - RNA, 64 nt, hsa
uuugucuuucuuuuuucuaaaaaaagaaaaaaaagaaaaaaaggaaaagaagaacaaagaaaca

SEQ ID NO: 543365 - RNA, 64 nt, hsa
auggagaaaacccgguacgcucaaaaagaaaaaggaaaaaaaaaaaucccaucacccacagcaa

SEQ ID NO: 543366 - RNA, 64 nt, hsa
uaccaauaauauuuagagcuagucuccaagcgacgaaaaaaauguuuuaauauuugcaagcaac

SEQ ID NO: 543367 - RNA, 64 nt, hsa
caacaagagugaaacugcaucucaaaaaaaaaaagaaaaaaaauuuacgcuucuuaaccauuuu

SEQ ID NO: 543368 - RNA, 64 nt, hsa
uccuggcuggccucuaaaucaccuggagagccucgaaaaaaacagcaguggccaguccaccggg

SEQ ID NO: 543369 - RNA, 64 nt, hsa
uaccauucucuguggccuguuuuuccuggaagaagaaaaaaaaagguuuggcaggccaucuuuu

SEQ ID NO: 543370 - RNA, 64 nt, hsa
uccuauuguaaucauucauuuuuuuuguuguucggaaaaaaaaaguugaucuuuuuuuuugucg

SEQ ID NO: 543371 - RNA, 64 nt, hsa
uuacauaucuagagaaacaacauaguggaaaaccgaaaaaaaaaaacagaaaaaucuaccggua

SEQ ID NO: 543372 - RNA, 64 nt, hsa
uaagggcucuguccuguuauacauauuuaaggcagaaaaaaaguuacaugucgauuagguacuu

SEQ ID NO: 543373 - RNA, 64 nt, hsa
uuuuccaguucaaaaugccuuauacaaucaagaggaaaaaaaauuacacaauuucaggcaagcu

SEQ ID NO: 543374 - RNA, 64 nt, hsa
uuaugucucaaguaaaauggcugagcauugcagagaaaaaaaaaaguccccacauuuuauuuuu

SEQ ID NO: 543375 - RNA, 64 nt, hsa
cuggcuaucuuaaacaaguucauacauuugaaaagaaaaaaaaauguuguuuaaaaaauguuuu

SEQ ID NO: 543376 - RNA, 64 nt, hsa
uuuauauuaacgauacuaaaaaaaaauagcuuuggaaaaaaaacuacuguauguaacggaauug

SEQ ID NO: 543377 - RNA, 64 nt, hsa
uugcagguaucacagccuugcagaagaaccaacugaaaaaaaaauucucaggcuuuacagcaag

SEQ ID NO: 543378 - RNA, 64 nt, hsa
cauucuaccagcacaaggaaacauaggcagcacugaaaaaaaaaaaaaagcucauauuaauuag

SEQ ID NO: 543379 - RNA, 64 nt, hsa
acgugacguccugccagaaagagaaugaaugacagaaaaaaaaaagagagacaaacucuaggaa

SEQ ID NO: 543380 - RNA, 64 nt, hsa
gcgggccaaccccgagaaugaagauuggaaaaaggaaaaaaaaaaaaacacgucaaaaguuagc

SEQ ID NO: 543381 - RNA, 64 nt, hsa
aauaucauugauuuuauaauuggugcuauuugaagaaaaaaauguacauuuauucauagauaga

SEQ ID NO: 543382 - RNA, 64 nt, hsa
gaaccaaaugguucuuacuuuuccuggacuuaaagaaaaaaagagguuuaaguuuguuguggcc

SEQ ID NO: 543383 - RNA, 64 nt, hsa
aaccauuguaacuauuaaccuuuuuugucuuauugaaaaaaaaaauguugagaagcguuuuuaa

SEQ ID NO: 543384 - RNA, 64 nt, hsa
uugaagaccagcuuucucauaaauuucucuuuuugaaaaaaagaaagcauuuguacuaagcucc

SEQ ID NO: 543385 - RNA, 64 nt, hsa
gaaaacugagcauacuagcaagacagcucuucuugaaaaaaaaaauauguauacacaaauauau

SEQ ID NO: 543386 - RNA, 64 nt, hsa
agcauagagaaacaaaaaucuuuuaugauguacggaaaaaaaccaugcugauacagcuggcuau

SEQ ID NO: 543387 - RNA, 64 nt, hsa
aagagccaaaauaaauauacuuuggcacuuuuuggaaaaaaaguuugcagacaccugcccuaaa

SEQ ID NO: 543388 - RNA, 64 nt, hsa
aaaacacagcuuaucuaaucuaaugagaaacucagaaaaaaauguuuugaugaauacaauguau

SEQ ID NO: 543389 - RNA, 64 nt, hsa
uuuuuuuuuuaaguaagaagggaacuguaaaagagaaaaaaagaaauucaugcauagcuucugu

SEQ ID NO: 543390 - RNA, 64 nt, hsa
gauucccuuguucauuuuugcugugaaaugcacugaaaaaaauccucaaaaugaguuauaguuc

SEQ ID NO: 543391 - RNA, 64 nt, hsa
augcuaaagaaacaacgaaaugaaaagguaucaggaaaaaaagaucaggaaguuguauucaggu

SEQ ID NO: 543392 - RNA, 64 nt, hsa
aaaagaggaaaaaaaggcaaaaaauauugugaaagaaaaaaaacaacuuaauauauuuuggauu

SEQ ID NO: 543393 - RNA, 64 nt, hsa
ugugcauuguuuacaaagcaaaaagaaaaaagaggaaaaaaaggcaaaaaauauugugaaagaa

SEQ ID NO: 543394 - RNA, 64 nt, hsa
caauuggggaaguuucacccucucccuaucugaagaaaaaaaucaaaaacaaauguccccggau

SEQ ID NO: 543395 - RNA, 64 nt, hsa
aacuuuuuaagagaguauuuaaaaaaaaaaaaaggaaaaaaaauucaccgggcaaccggggaag

SEQ ID NO: 543396 - RNA, 64 nt, hsa
uuuugugccccuuaaauguagauaugugcugaaagaaaaaaaaaacgcccaacucuugaagucc

SEQ ID NO: 543397 - RNA, 64 nt, hsa
uuccguagauaauguggaaaucaaauuuaaccaagaaaaaaagauuggaacaaaugcucucuua

SEQ ID NO: 543398 - RNA, 64 nt, hsa
caguguucugugacaaaaaaaaaaaaaaaaaaaagaaaaaaaaagaaaaaacagaaauauaucc

SEQ ID NO: 543399 - RNA, 64 nt, hsa
agcauuuuuuuauuuuuuuaauaaaaaugaguuggaaaaaaaauaagauaucaacugccagccu

SEQ ID NO: 543400 - RNA, 64 nt, hsa
guuuuauuaugacacuagauacaguaaauuuuuagaaaaaaauaccauuuacaguauuauugug

SEQ ID NO: 543401 - RNA, 64 nt, hsa
cucaaaaaaaaaccccacgaaauuuaaagauggggaaaaaaagaugguauaaaaauggcucugg

SEQ ID NO: 543402 - RNA, 64 nt, hsa
caauauggccuaaacugccauaguuuuagaaugugaaaaaaaugcauguuuacuuaccuguaua

SEQ ID NO: 543403 - RNA, 64 nt, hsa
auucauauugcugcccaaaaguaugacuguggaggaaaaaaaaauacuuuaaaaauccacacuu

SEQ ID NO: 543404 - RNA, 64 nt, hsa
aauuuuugcuccaauauccauucuguagacuuuugaaaaaaaaguuuuuaauuugaugcccaau

SEQ ID NO: 543405 - RNA, 64 nt, hsa
uauuauuaauuuuuauuuauuuuucuugggaauugaaaaaaauugaaauaaauaaaaaugcauu

SEQ ID NO: 543406 - RNA, 64 nt, hsa
uacaaccugccaacccacacacuggaguaauucugaaaaaaauuauuccuaaacucucuaagug

SEQ ID NO: 543407 - RNA, 64 nt, hsa
uugaaaacaacaacuaaaaaaguggaccuucucagaaaaaaagggcagcaaaugaccaagggcg

SEQ ID NO: 543408 - RNA, 64 nt, hsa
cuagacaacauagugagacuuggucucuaaaaaagaaaaaaaaaaauaaaacugauguaaugaa

SEQ ID NO: 543409 - RNA, 64 nt, hsa
uuauguuuuuggcaugaacaaaagaaacaagagagaaaaaaaucaaaauaauuaaaauaaauug

SEQ ID NO: 543410 - RNA, 64 nt, hsa
ugugacaaccacaagcacuuuuuuuuuuuuuaaagaaaaaaagguagugaauuuuuaaucaucu

SEQ ID NO: 543411 - RNA, 64 nt, hsa
agcugaaauucagaggacccauaagaguucacaugaaaaaaaucaauuuauuugaaaaggcaag

SEQ ID NO: 543412 - RNA, 64 nt, hsa
aagcacuccucgguacucccauaauccucucggagaaaaaaaucacaaggcaacugugaguccg

SEQ ID NO: 543413 - RNA, 64 nt, hsa
aacaugauuauuugaacuuauuuacacauaguuugaaaaaaaaaagacaaaaauaguauucagg

SEQ ID NO: 543414 - RNA, 64 nt, hsa
gucuuuuuuucaagaugcuuuguuucuuucauaugaaaaaaaugcauuuuauaaauucagaaag

SEQ ID NO: 543415 - RNA, 64 nt, hsa
agccaacaacccagaaagguuuaaaaaacauaaggaaaaaaaagacaaauuaaaggaggggcua

SEQ ID NO: 543416 - RNA, 64 nt, hsa
auggggggccucaaccaacuuagugacuuguuuagaaaaaaaagacaaaaaaguaaaaauaaaa

SEQ ID NO: 543417 - RNA, 64 nt, hsa
uagcuuuuccuucugaaccacguucuauguaaaagaaaaaaaauagcuuugauuuucucacugg

SEQ ID NO: 543418 - RNA, 64 nt, hsa
ucuauuuuuuuuuucacuugcucauaaacuucuggaaaaaaauaagcaugaaucaaaugguaau

SEQ ID NO: 543419 - RNA, 64 nt, hsa
uaaaauauacuuauuugucuucuuuuugcauugugaaaaaaacaaaauaaauuuugugugauaa

SEQ ID NO: 543420 - RNA, 64 nt, hsa
gaauauauucaguaucauuuaaugucugaauucagaaaaaaaugccgaaauuuuuauucagaug

SEQ ID NO: 543421 - RNA, 64 nt, hsa
ugaaauguauaagagaagaaccaagucuuacauagaaaaaaaagguagauaugaaaagaaaaau

SEQ ID NO: 543422 - RNA, 64 nt, hsa
ucucaagguacucacagaucuguuuaacccacuugaaaaaaaaacacuaaaaaugaagaaaugc

SEQ ID NO: 543423 - RNA, 64 nt, hsa
aaaaaaaaaaaaucugccuaugcauguuuuuuaagaaaaaaaaaauggcuguaucggccuguau

SEQ ID NO: 543424 - RNA, 64 nt, hsa
uaggcagucuuaaaaaaaaaaaaaaacagaaaaagaaaaaaaagaacguugcaaauuuguuaaa

SEQ ID NO: 543425 - RNA, 64 nt, hsa
ucuuuuggguaugccuuuuaaaaaugcuuauagagaaaaaaaauuuuaaaaagaaagcuaaugc

SEQ ID NO: 543426 - RNA, 64 nt, hsa
uguucagccuauacuuuuccauaugguauaccuugaaaaaaauuagcacaccaugguuauuuuu

SEQ ID NO: 543427 - RNA, 64 nt, hsa
aauauaaauuauuccaagucuuuaaggagccaaagaaaaaaaagauuucucacagcuuuuuguu

SEQ ID NO: 543428 - RNA, 64 nt, hsa
uucccccugcaaaaagaaaaaaagaaaagaaaaagaaaaaaaucccuuguucucaguggugcag

SEQ ID NO: 543429 - RNA, 64 nt, hsa
gacgauauacucccugcccuucccccugcaaaaagaaaaaaagaaaagaaaaagaaaaaaaucc

SEQ ID NO: 543430 - RNA, 64 nt, hsa
cugguaaacaauaaagaagauucagacacugagggaaaaaaauaaagcuuuuuacuuaaauaau

SEQ ID NO: 543431 - RNA, 64 nt, hsa
gaccccauccuccaccccccccaaaaaauagaaagaaaaaaaaaguuugcacuaauugagguac

SEQ ID NO: 543432 - RNA, 64 nt, hsa
ccugcuugcauaacugaucauauugcuugucucagaaaaaaacaccaucagcaaagugggccuc

SEQ ID NO: 543433 - RNA, 64 nt, hsa
gcaccuguaguucuguuuauuggucaguggaaaugaaaaaaaaaaaaaaaaaaagucugcguuc

SEQ ID NO: 543434 - RNA, 64 nt, hsa
ucacagacaccaacacaccacucauuggaaaauggaaaaaaaaaacaaaaaaaaaacaaaaaaa

SEQ ID NO: 543435 - RNA, 64 nt, hsa
aaucaguaugaagacacugucaaugagguuaugagaaaaaaacagcaggggcauuaguuucagg

SEQ ID NO: 543436 - RNA, 64 nt, hsa
ggaagcauuacuuuguagauguauuuucaauaaagaaaaaaauaguuuuacauuaacaucuuug

SEQ ID NO: 543437 - RNA, 64 nt, hsa
guauuauaguuuaacaaaaauuguuuauaucuuggaaaaaaaacuuucuguuuaaaaaaaauaa

SEQ ID NO: 543438 - RNA, 64 nt, hsa
ggcagaaucuccuggauauauaauuuauucuguugaaaaaaaaaaaagcaugcaguaucuauga

SEQ ID NO: 543439 - RNA, 64 nt, hsa
ccaguauaugcuauucaaugaucuuagaaguacugaaaaaaaaagacguuuuuaaaacguagag

SEQ ID NO: 543440 - RNA, 64 nt, hsa
aaugacuguuuucucucucuauggaaauaaaaaggaaaaaaaaaaaggaaacuuuuuuuguuug

SEQ ID NO: 543441 - RNA, 64 nt, hsa
uucaugucauuugacauuuuuuguuugcugaagugaaaaaaaaagauaaagguuguacgguggu

SEQ ID NO: 543442 - RNA, 64 nt, hsa
acccacagauuaaaccaaccacagaucaaaaauagaaaaaaaaaaaaaaagaaaaaaagaaugu

SEQ ID NO: 543443 - RNA, 64 nt, hsa
aaccacagaucaaaaauagaaaaaaaaaaaaaaagaaaaaaagaauguaaaauuuuaaaaauac

SEQ ID NO: 543444 - RNA, 64 nt, hsa
uuaauuaugacaugagaaugaagaaauuauuuuggaaaaaaaaaaugaccuaauuuaccuauca

SEQ ID NO: 543445 - RNA, 64 nt, hsa
ugacuuuccacuuuguccuuucugcucuugugaagaaaaaaaaaagcauuuucgaggaaagaau

SEQ ID NO: 543446 - RNA, 64 nt, hsa
uaacaucuccacgucccuagcauaaaaagaaaaagaaaaaaauuuaaacugcuuuuucggaaga

SEQ ID NO: 543447 - RNA, 64 nt, hsa
gagacugggaucccccaccccaacagugauuuuggaaaaaaaaaugaaaguucuguucguuuau

SEQ ID NO: 543448 - RNA, 64 nt, hsa
uaucaucuauaagggagggcugggggcgggaaaagaaaaaaaaaagucauuuugaaauuaaccu

SEQ ID NO: 543449 - RNA, 64 nt, hsa
aauuaaccuccuaaaaggaauucauauuuuaaaggaaaaaaauacaacuaaugaugcacauuuc

SEQ ID NO: 543450 - RNA, 64 nt, hsa
gggggaagaugguucaaagauacaagaaaaaguagaaaaaaaaauaacacuuaacuaaaacccc

SEQ ID NO: 543451 - RNA, 64 nt, hsa
uuuccaaagcugaagauccccauucuuucucuuugaaaaaaaaaaaggccuaaugcauuauuuu

SEQ ID NO: 543452 - RNA, 64 nt, hsa
uuaagaaauagucuauguaaagucacaaauuaaugaaaaaaauucgcaugaaaaugacagauaa

SEQ ID NO: 543453 - RNA, 64 nt, hsa
ucagagaugucugcucuuuuaaauuauauauaaggaaaaaaaauagccugccuugggacaggug

SEQ ID NO: 543454 - RNA, 64 nt, hsa
agauauuucaacucaucucaucaguuucuuguaagaaaaaaacauuuucacuuuguagcacauu

SEQ ID NO: 543455 - RNA, 64 nt, hsa
uacauaaccuauggcaguugguugaauaauuauugaaaaaaagaacacgacugaaaaaguucau

SEQ ID NO: 543456 - RNA, 64 nt, hsa
aagagugugcuaacaccauucacagaggucccuggaaaaaaauauauaauuuucucacaaacaa

SEQ ID NO: 543457 - RNA, 64 nt, hsa
cauaagaaaaugcaauaucuggguacuguauggggaaaaaaauguccaaguuuguguaaaacca

SEQ ID NO: 543458 - RNA, 64 nt, hsa
cucuguaaagaucagaugguaaucuuucaaauaagaaaaaaauaaagacguauguuugaccaag

SEQ ID NO: 543459 - RNA, 64 nt, hsa
aaaauauuuuugaaaggcauguuccucugucaaugaaaaaaaguacauguauguguugugauau

SEQ ID NO: 543460 - RNA, 64 nt, hsa
aauguugggagaaaugauauauaccacuuucccagaaaaaaaaaaacuuacacuugggacuugg

SEQ ID NO: 543461 - RNA, 64 nt, hsa
aaauacauugcccacuuccaaaaauguucagcaugaaaaaaagggcuucagugucgauugagau

SEQ ID NO: 543462 - RNA, 64 nt, hsa
guuccaugucaucagagaugguaaaauaggccgggaaaaaaaaaucuuugguaccaaagauuac

SEQ ID NO: 543463 - RNA, 64 nt, hsa
aaagagcaaaaccguuuuaaauaaacucccccuggaaaaaaacccaaaacacuggcaucugagu

SEQ ID NO: 543464 - RNA, 64 nt, hsa
cuuuggguucuuucuguuugaaaggauauuugucgaaaaaaagagcaaaaccguuuuaaauaaa

SEQ ID NO: 543465 - RNA, 64 nt, hsa
auuuuuaaugcugucauuacacuuaaagucacaggaaaaaaauauacaugcuuacucaggcuuu

SEQ ID NO: 543466 - RNA, 64 nt, hsa
uuuuauucucugaauuuugaucucaaaggacacagaaaaaaaauggccccaggagaucugauca

SEQ ID NO: 543467 - RNA, 64 nt, hsa
cauagccaaggcuagcgaggcauacuuuccaguugaaaaaaaucaaaauuuuuugccuuccauu

SEQ ID NO: 543468 - RNA, 64 nt, hsa
aacacugauucuuauuguauuacaaaggaaccaugaaaaaaaacacuuuccaacuauuauauaa

SEQ ID NO: 543469 - RNA, 64 nt, hsa
agucuacuauuguaagaguucuucuguuugugaagaaaaaaacaaguuaaaaacugaauguacu

SEQ ID NO: 543470 - RNA, 64 nt, hsa
auggauguucuugaacauuucagaaggagugguagaaaaaaacacacauucagccaaccacuua

SEQ ID NO: 543471 - RNA, 64 nt, hsa
uuuuuucaggacugcucuaugguuuccuuuaaaagaaaaaaacuucuguuuguuuuuagcaguc

SEQ ID NO: 543472 - RNA, 64 nt, hsa
ucaguuuuuuauaaaaauauauauuuuuguccaagaaaaaaaaaagcauacauaugugauuaug

SEQ ID NO: 543473 - RNA, 64 nt, hsa
acaaaaaaguaaaaaaaaaaaaaaagaaaaaaaggaaaaaaaaaaaagcuuguaugggacagaa

SEQ ID NO: 543474 - RNA, 64 nt, hsa
gugauauuuacaaaaaaguaaaaaaaaaaaaaaagaaaaaaaggaaaaaaaaaaaagcuuguau

SEQ ID NO: 543475 - RNA, 64 nt, hsa
auccuuaagauuuaaaaaaaaaaaaaaaaaaaaggaaaaaaaagugauggaagccguaagugcu

SEQ ID NO: 543476 - RNA, 64 nt, hsa
uuuuucucuucauguuguaacaaaaaggaaaaaagaaaaaaaaaucccaucccuuuuguacaua

SEQ ID NO: 543477 - RNA, 64 nt, hsa
ccauggggaagauuguguuacugcccuucacagugaaaaaaagaaaaaucuuucauuuuuaaaa

SEQ ID NO: 543478 - RNA, 64 nt, hsa
guauuugcaccgagauuuugauucccaaaguuuggaaaaaaaugacaaaacaacgagggaagaa

SEQ ID NO: 543479 - RNA, 64 nt, hsa
ccuuccgauuuuacccaaguauauauauaggauagaaaaaaaugcauuauauuugagagcuacu

SEQ ID NO: 543480 - RNA, 64 nt, hsa
cacuagagagggagggggaagagcagaaguuagagaaaaaaagccaccggaggaaaggaaaaaa

SEQ ID NO: 543481 - RNA, 64 nt, hsa
aaggaguuuacgaaaucugcuguuuuaucaaagugaaaaaaaauugcuuauuacucuucauuuu

SEQ ID NO: 543482 - RNA, 64 nt, hsa
ucaugucuguacagauuauuuaaaucauggaaaugaaaaaaauguucucugcuugcuaccaaag

SEQ ID NO: 543483 - RNA, 64 nt, hsa
ccuuccuccaaagaauuaauaggcaacagugggagaaaaaaaaggcauaauggcaaauccuuca

SEQ ID NO: 543484 - RNA, 64 nt, hsa
ggcagggagaagggccgggggggguaggagaggagaaaaaaaaagugaaaaaaagaaacgaaaa

SEQ ID NO: 543485 - RNA, 64 nt, hsa
ggccgggggggguaggagaggagaaaaaaaaagugaaaaaaagaaacgaaaaggacagacgaag

SEQ ID NO: 543486 - RNA, 64 nt, hsa
uacaggggcagucaguggagggcgagugguuucggaaaaaaaaaaagaaaaaaagaaaaaaaaa

SEQ ID NO: 543487 - RNA, 64 nt, hsa
caguggagggcgagugguuucggaaaaaaaaaaagaaaaaaagaaaaaaaaagaaaaaaaaaag

SEQ ID NO: 543488 - RNA, 64 nt, hsa
ggcgagugguuucggaaaaaaaaaaagaaaaaaagaaaaaaaaagaaaaaaaaaagauuuuuuu

SEQ ID NO: 543489 - RNA, 64 nt, hsa
uucggaaaaaaaaaaagaaaaaaagaaaaaaaaagaaaaaaaaaagauuuuuuucuucucuuaa

SEQ ID NO: 543490 - RNA, 64 nt, hsa
uuaaaauucaaggccacaaaaacaauguuugggggaaaaaaaagaaaaaaucaugccagcuaau

SEQ ID NO: 543491 - RNA, 64 nt, hsa
ucaggacccuugcccccacccccauuuuuuuaaugaaaaaaaaaaacaaaaaaaacggauccaa

SEQ ID NO: 543492 - RNA, 64 nt, hsa
uuuauuuccuucuccacucucuccaugcccuggagaaaaaaaaguccagaagaaaucauaaaua

SEQ ID NO: 543493 - RNA, 64 nt, hsa
uaggauuguguguauauuugggauaucuauugaagaaaaaaagaaaaccccuuaaagauaaugu

SEQ ID NO: 543494 - RNA, 64 nt, hsa
uuguuauaccauacugguuagugaauaauuacaugaaaaaaaagagucuguacaucuucagagu

SEQ ID NO: 543495 - RNA, 64 nt, hsa
aauaccuggcaaaacuaaauaaauuaccaaaaaggaaaaaaaauccaccaaaccaugauaaaca

SEQ ID NO: 543496 - RNA, 64 nt, hsa
ugcccccucuuucacuaaggaaggcaaaugaagugaaaaaaaaaaaugccauuuucaauccuuc

SEQ ID NO: 543497 - RNA, 64 nt, hsa
gacaguuguggaguaucccauucugaugaguacagaaaaaaaaagaaaaagaaaagaagagaaa

SEQ ID NO: 543498 - RNA, 64 nt, hsa
aaaaaaagaaaaagaaaagaagagaaaaaauuaagaaaaaaaucaaaaaaggaagaaaacuaaa

SEQ ID NO: 543499 - RNA, 64 nt, hsa
ugucagauucaucaaacaaaaaauaaaucucgaagaaaaaaaaugcacuuacaugugcuuauuu

SEQ ID NO: 543500 - RNA, 64 nt, hsa
aggaagcauauaccggggaauguguagccuucaggaaaaaaaugccaauugacacaaagcauuc

SEQ ID NO: 543501 - RNA, 64 nt, hsa
uucacauuuugauuuauuagguacuagcacugaggaaaaaaaauucagcacuuggacuaucaua

SEQ ID NO: 543502 - RNA, 64 nt, hsa
ugggaaggaggguaauaaugaacaaaaaguuugagaaaaaaaugcuuuaauggguuuuacaggc

SEQ ID NO: 543503 - RNA, 64 nt, hsa
gcagaauuuggcauaucgaugcaugcaauggaaagaaaaaaaauuuguuaaaauuuguaaaugu

SEQ ID NO: 543504 - RNA, 64 nt, hsa
uugugaaccuagacuuagaacaaauccugcuuuugaaaaaaaauguuuugcuucuuacaaaauc

SEQ ID NO: 543505 - RNA, 64 nt, hsa
ccaauugucuugguuucuugauucauuuauuugagaaaaaaacaauacaaagaaaugcauucau

SEQ ID NO: 543506 - RNA, 64 nt, hsa
acaccaucugcaaccauaugcuauuaauaaaauggaaaaaaacaaaauggucauuuugcauaua

SEQ ID NO: 543507 - RNA, 64 nt, hsa
gugcuuugugguugcugucauauuugcucuagaagaaaaaaaaaaaaggaggggaaaugcauuu

SEQ ID NO: 543508 - RNA, 64 nt, hsa
auuuuguguugaucauuauuuccauucuuaaugugaaaaaaaguaauuauuuauacuuauuaua

SEQ ID NO: 543509 - RNA, 64 nt, hsa
uuuguucaaaaguuagaacaucuggcugcaccaggaaaaaaaaaaaaaaaaaguccuguucuuc

SEQ ID NO: 543510 - RNA, 64 nt, hsa
ucacugcugccauguguguacuguauuauuuucagaaaaaaauauaauagucugaguccaaguu

SEQ ID NO: 543511 - RNA, 64 nt, hsa
uccagccugggcgacagagugaaacuacaucucagaaaaaaaaaaaaaaaaaaaaaaaaaaagu

SEQ ID NO: 543512 - RNA, 64 nt, hsa
aagggucaaaacuagauuggaucuugguuugaaugaaaaaaagcauaaaauauucuugcaauaa

SEQ ID NO: 543513 - RNA, 64 nt, hsa
auccauuuccuaugcguuuuacuccucagagaaugaaaaaaacugcaucccaucacccaaaguu

SEQ ID NO: 543514 - RNA, 64 nt, hsa
aaaugguuaccaguacagucaaaaaagagaaaaugaaaaaaauacaacuaaaaggaagaaacac

SEQ ID NO: 543515 - RNA, 64 nt, hsa
auuucaagauaauguaguuuaaaaaaaaaaaaaagaaaaaaacuugauguaaauuccuccuuuu

SEQ ID NO: 543516 - RNA, 64 nt, hsa
ugguuaguaaacacuaauguauaacauguuaauggaaaaaaauggauuuagaauaauaaaugga

SEQ ID NO: 543517 - RNA, 64 nt, hsa
uuguucaguguuuuaaccuguauuuguuaaaaaagaaaaaaaaacacacauaaaguuccaugug

SEQ ID NO: 543518 - RNA, 64 nt, hsa
uacguuuucaugcugcuuauuguuuuauucuacugaaaaaaaugaauuucaagauucucaacuu

SEQ ID NO: 543519 - RNA, 64 nt, hsa
gaugagauaucaagguaauuaaaauagcaugcuugaaaaaaaaauacguaaucuguuucaccug

SEQ ID NO: 543520 - RNA, 64 nt, hsa
augagauucaaaaguugaccugaaagucaagugugaaaaaaaaaaagagauuaaacaagauaau

SEQ ID NO: 543521 - RNA, 64 nt, hsa
uuucuuuuuggaacugcuacaaacaaaauuagaagaaaaaaaggucaagcaguuuucacuuguc

SEQ ID NO: 543522 - RNA, 64 nt, hsa
agaaaacauugauuugagcauagacgcagagacugaaaaaaaaauuuacuuugaucucuguuuu

SEQ ID NO: 543523 - RNA, 64 nt, hsa
agucuacuuuauguaaauaagaacagguuuuggggaaaaaaaucuuaugauuucuggauugaua

SEQ ID NO: 543524 - RNA, 64 nt, hsa
aagucuuuacaaugcuuguuucaaagaaccaacagaaaaaaaagcuaagaaaacugagaacuaa

SEQ ID NO: 543525 - RNA, 64 nt, hsa
guaaaugucacgagaucauuuuuacauuaaacgugaaaaaaaaucaacuuugccggaucacuua

SEQ ID NO: 543526 - RNA, 64 nt, hsa
agcauugcaugugaauaagaaaauaauguuuaaagaaaaaaaaaaaaaagcaaaccuccaaaac

SEQ ID NO: 543527 - RNA, 64 nt, hsa
uuucucucacuauaguauaagaaucuauuuuggagaaaaaaagaaaauaugagggucucgaagc

SEQ ID NO: 543528 - RNA, 64 nt, hsa
caaaagcaaaaaaaaaaagcaaaaaaagaaaagagaaaaaaagaaaaaaugcaaauggaauaau

SEQ ID NO: 543529 - RNA, 64 nt, hsa
auuuauaauuacauucaaaguauacuuuuuucuugaaaaaaauuacagauuuuuugaaaagcaa

SEQ ID NO: 543530 - RNA, 64 nt, hsa
auguucagacuaacauucuuuugcaguauagugagaaaaaaacauuuuaaaauuaauuaucauu

SEQ ID NO: 543531 - RNA, 64 nt, hsa
uccuuccaggauuaaguugucaucauucugggaagaaaaaaaaaacauuaaugaagaggccaau

SEQ ID NO: 543532 - RNA, 64 nt, hsa
uuguugacuuaaaaauaugagauacauaggaugugaaaaaaaauguuugcaguacucagcaaaa

SEQ ID NO: 543533 - RNA, 64 nt, hsa
gucauuugaccaagacacagaagaugaugaaugggaaaaaaaacauagagaucacaccgcaaag

SEQ ID NO: 543534 - RNA, 64 nt, hsa
uguauaaauguuuuuacugcuuuuagaaaauaaagaaaaaaaacuugguucauguuuacaugcc

SEQ ID NO: 543535 - RNA, 64 nt, hsa
gcaacagagcaagagucugucucaaaaaaaaaaagaaaaaaagaaaaaaagaaaaaagaaaaau

SEQ ID NO: 543536 - RNA, 64 nt, hsa
gcaagagucugucucaaaaaaaaaaagaaaaaaagaaaaaaagaaaaaagaaaaaucucauuau

SEQ ID NO: 543537 - RNA, 64 nt, hsa
uaauauguaaauuaaaauauuucuacauuuuauugaaaaaaaaaccuuuuuuuuugccuaaaua

SEQ ID NO: 543538 - RNA, 64 nt, hsa
cacauuaauguugaauuuuacagacaguauauuugaaaaaaauugauuccauguagucuucaau

SEQ ID NO: 543539 - RNA, 64 nt, hsa
augaacauuggcuaugaugaagauuauuacauaugaaaaaaaaacucacacaacauauuuguau

SEQ ID NO: 543540 - RNA, 64 nt, hsa
aguagcuugucaucaauccccuugucgaaaacuagaaaaaaaggaguugacccauauaaauuau

SEQ ID NO: 543541 - RNA, 64 nt, hsa
ccaaaauuauuaauuuuauuaggcuuuuggaaaagaaaaaaaacuuuuugauguuuuaggugau

SEQ ID NO: 543542 - RNA, 64 nt, hsa
uuucaaaggauagcauaauaucugcauuaugcuggaaaaaaauagaccuuuggagaauacuuaa

SEQ ID NO: 543543 - RNA, 64 nt, hsa
uuuggucagugcuauuuuaaaggaaguaugaguugaaaaaaaauugaaauaaacuauaucauau

SEQ ID NO: 543544 - RNA, 64 nt, hsa
aaauaagaaaauuaauaauuguauuaagugguaugaaaaaaagggggaggauuguucacucacu

SEQ ID NO: 543545 - RNA, 64 nt, hsa
ccccucaauaucaugaucauccaaucucaaaugugaaaaaaaaaaagaaauuugauuuuaggga

SEQ ID NO: 543546 - RNA, 64 nt, hsa
uccagccugggcgacagagugagacuccaucucagaaaaaaaaaaaaaaaaaaacagaaucuca

SEQ ID NO: 543547 - RNA, 64 nt, hsa
acagugauuuagguuuguaacauccggcaaaacugaaaaaaaaaaucuguaaacgcgaaaaaua

SEQ ID NO: 543548 - RNA, 64 nt, hsa
uuuuuuuuuuaauugcacuucuuguaaagagugagaaaaaaaaucaaaggcgcuuugaaacagg

SEQ ID NO: 543549 - RNA, 64 nt, hsa
uuacuugaaguaacuauaacaaaaaaagaaaagagaaaaaaaaacacacaaaaagucccccuuc

SEQ ID NO: 543550 - RNA, 64 nt, hsa
cuguucaucucuuuguccugaauggcuuugucuugaaaaaaaauagauguuuuaacuuauuuau

SEQ ID NO: 543551 - RNA, 64 nt, hsa
gcauaaaagggucaaaccuguagaugcagaaaaagaaaaaaacuauaaauacaaaucuguauaa

SEQ ID NO: 543552 - RNA, 64 nt, hsa
uuccuuccucuguaagauaucccagcuuuaaaaagaaaaaaaaagaauuaccaagagaagggga

SEQ ID NO: 543553 - RNA, 64 nt, hsa
auccucugacuuuauuuuccauguauuacaaaaggaaaaaaaaauugagauuacacuggcauaa

SEQ ID NO: 543554 - RNA, 64 nt, hsa
gaucaaaucauauuucuguacauuuucagugguagaaaaaaaagguuuuaaaaauuguauccua

SEQ ID NO: 543555 - RNA, 64 nt, hsa
cacagagagacagugcaguguagcuuuaguuuaagaaaaaaaaauauuccuccccacugcauga

SEQ ID NO: 543556 - RNA, 64 nt, hsa
gauggaauaucagaaguauaucuguacagaucaagaaaaaaagggagaauaaaauuccuaucuc

SEQ ID NO: 543557 - RNA, 64 nt, hsa
gacguuucuucuuucuagagcaguuggccaagcagaaaaaaaagugucucaaaggagcuuucuc

SEQ ID NO: 543558 - RNA, 64 nt, hsa
uucuacuauucaguuccucaaacugaagcuuauugaaaaaaaaauguauaauguuauuuguuuu

SEQ ID NO: 543559 - RNA, 64 nt, hsa
uuaauuauaguuuuguuauaaauauaacuuaugagaaaaaaauuugauaggaauaauacuguau

SEQ ID NO: 543560 - RNA, 64 nt, hsa
guuuuuuuuaaaugugcaaauacuguauucaagugaaaaaaauacaguauuuguagauaaccau

SEQ ID NO: 543561 - RNA, 64 nt, hsa
uaaucuuaagugaaaugggugcagcauuccuuuggaaaaaaaaaucuuuuuauuuucaagugau

SEQ ID NO: 543562 - RNA, 64 nt, hsa
auccuguuccaaugaaaaaauuaaaaccugauacgaaaaaaaaaaaauuccaguuaaccuauuu

SEQ ID NO: 543563 - RNA, 64 nt, hsa
ugacauacuuuugcuuucaguaguuucauguaaagaaaaaaacuugaaaauaguaauaccugag

SEQ ID NO: 543564 - RNA, 64 nt, hsa
ggccaaaaaaaaaaagaaaaagaaaaagaaaaaagaaaaaaaaagaaaaaacugggaccuaagu

SEQ ID NO: 543565 - RNA, 64 nt, hsa
agcuugaaucugggaaacaagcucaaaaaacagugaaaaaaaaaguacugguuuaggaguucaa

SEQ ID NO: 543566 - RNA, 64 nt, hsa
acaaagaucacuacagaccaaaacagaagaagaagaaaaaaaagaaaaagaaaucuaagcaaca

SEQ ID NO: 543567 - RNA, 64 nt, hsa
gaaaagaccaagaucaaauaauagcugggguggagaaaaaaauagcucaagacacaguuaaucg

SEQ ID NO: 543568 - RNA, 64 nt, hsa
guuugauccugaguaugcuugguguuugccuucagaaaaaaaaaaauacauuguaaauaaccuc

SEQ ID NO: 543569 - RNA, 64 nt, hsa
uuaaaacuacuuuguugaaacaucaaccugggcagaaaaaaaaaaaaaaagacauguaaaauuu

SEQ ID NO: 543570 - RNA, 64 nt, hsa
ccagucuguauaugaaaaaauaggucaucaaaaggaaaaaaaauaacuuugauuaacuaguguu

SEQ ID NO: 543571 - RNA, 64 nt, hsa
caucucuguaggaucguaaaaaaauagaaaaaaagaaaaaaaaaagaaagaaagagggaaaaag

SEQ ID NO: 543572 - RNA, 64 nt, hsa
agcuggaccaucucuguaggaucguaaaaaaauagaaaaaaagaaaaaaaaaagaaagaaagag

SEQ ID NO: 543573 - RNA, 64 nt, hsa
augaagccuuucagauaccaauuuaguuuaugcagaaaaaaauugaacaaaacaggguaccagc

SEQ ID NO: 543574 - RNA, 64 nt, hsa
uaauauuuuggauacuauuuguuuuucuuuguaggaaaaaaaaguugaaaguuucuauuuucua

SEQ ID NO: 543575 - RNA, 64 nt, hsa
uuuuuuaagacucugucuuaaaaaaaacuaaaaagaaaaaaagaagccccuucacucuacaggg

SEQ ID NO: 543576 - RNA, 57 nt, hsa
aaaaagcaggaaagauguaaaucagcagaaaaaaaacaccgagacguuucugugacu

SEQ ID NO: 543577 - RNA, 64 nt, hsa
uaauuuuuuggaauuuuuguagacuuuacaccuggaaaaaaagauuuguaaaaucaccggaaca

SEQ ID NO: 543578 - RNA, 64 nt, hsa
aagggcauuugaggggaggauuauugcuaugaaugaaaaaaauauuuuagcuuagacuaagcua

SEQ ID NO: 543579 - RNA, 64 nt, hsa
gacuucaaaaauaugucugcuauagaaauaacuugaaaaaaaaaauuaaaaccguggccagcca

SEQ ID NO: 543580 - RNA, 64 nt, hsa
agacuuugcuuacagcuagaugaaacuuucuauagaaaaaaaaaauuguugaaagguccaguuc

SEQ ID NO: 543581 - RNA, 64 nt, hsa
uuaucaccuuagcaacuuagaauaguuugaaauagaaaaaaaguauuuaauuuggaucuggauc

SEQ ID NO: 543582 - RNA, 64 nt, hsa
gaaagaaguauuaaaaagagugaggauggauuuagaaaaaaacaugaauuuagaaauauucaaa

SEQ ID NO: 543583 - RNA, 64 nt, hsa
gcuauggaaagacagcuuuuccuacacugauaaagaaaaaaaaugaggaaauuauuucaucccc

SEQ ID NO: 543584 - RNA, 64 nt, hsa
uuuauguucaaugccuaauuucucaaaagugccagaaaaaaauguauauuagcuauuuugauuu

SEQ ID NO: 543585 - RNA, 64 nt, hsa
uucuguaaguuggaacuuauuuccaaacaugauugaaaaaaaaccccgcacuuggcaacuucuu

SEQ ID NO: 543586 - RNA, 64 nt, hsa
uaguuucuggggaaagaauaguaaccaugcaauggaaaaaaauggacaaccucuugacuagguu

SEQ ID NO: 543587 - RNA, 64 nt, hsa
aauaauugagaaaaauaaauaacaagauaauugagaaaaaaauaaaauaaauucccaauuccau

SEQ ID NO: 543588 - RNA, 64 nt, hsa
gugauauuucucuaguaguuaaaaaaaaaaaaaggaaaaaaagacucuuuuugguuguccucaa

SEQ ID NO: 543589 - RNA, 64 nt, hsa
cauugggucuauuccagcucauucauuuuauauugaaaaaaauaauuuuaaaaaugguggcuuc

SEQ ID NO: 543590 - RNA, 64 nt, hsa
ugauuugcaaugggauguaugaauacagcagcaagaaaaaaaaaugccauaauacaaaaggcuc

SEQ ID NO: 543591 - RNA, 64 nt, hsa
uuaaaagucacaauguucuuuauauacaauaauggaaaaaaaaaaaagaggaaaacccucaagg

SEQ ID NO: 543592 - RNA, 64 nt, hsa
uccuauuuuuucugggagagggggggauugauuagaaaaaaauguaguguguuccauuuaaaau

SEQ ID NO: 543593 - RNA, 64 nt, hsa
augucccaugauccccucucuuccuccccacccugaaaaaaaugaguuccuauuuuuucuggga

SEQ ID NO: 543594 - RNA, 64 nt, hsa
uguaaucuuuuaaaaauauuaucuugcagauaaagaaaaaaauuaagaguguguuuacaacugu

SEQ ID NO: 543595 - RNA, 64 nt, hsa
aacugauaauaucuguaaugacaucagaaugaaagaaaaaaaauuguacaguguauauuccuuu

SEQ ID NO: 543596 - RNA, 64 nt, hsa
agaaggaaaugaaaauauuuuuaugccuacuuaggaaaaaaaggguagcacuuauucauuccaa

SEQ ID NO: 543597 - RNA, 64 nt, hsa
cuuauuucauuaaagaaguugggagaacaaauaggaaaaaaaaaacuuauuuuucuaguaaaua

SEQ ID NO: 543598 - RNA, 64 nt, hsa
gaaaguucuagcuuaaguguugaaacuuuugugggaaaaaaaaaucacuuuugaaacucagacu

SEQ ID NO: 543599 - RNA, 64 nt, hsa
uuuaauuuaaaacuaugguguaagucuuugacaagaaaaaaaaacaaacaaacacuucuuucca

SEQ ID NO: 543600 - RNA, 64 nt, hsa
aauuccagucauuuugggaauuccugcuuaacuugaaaaaaauaugggaaagacaugcagcuuu

SEQ ID NO: 543601 - RNA, 64 nt, hsa
aaacaugugggaaaaaauauuacauuuuaagggggaaaaaaaaacccaccauucucuucucccc

SEQ ID NO: 543602 - RNA, 64 nt, hsa
caucccuuccuauaaccucuagguaaaaagaaaagaaaaaaagaaauuucgagauauuuucaac

SEQ ID NO: 543603 - RNA, 64 nt, hsa
acauuguuagaguuugggcuaaaaugagcaaggagaaaaaaaccaccaagaacauuuccugggg

SEQ ID NO: 543604 - RNA, 64 nt, hsa
gucuaucucaaaccgcagaaaggcuuuaauacuggaaaaaaagaauucaagacuacaggcagcu

SEQ ID NO: 543605 - RNA, 64 nt, hsa
cuuucaaguaaauauagcauuccuuuggcaaaaagaaaaaaaaaguaaaagaaaagaaaaaaaa

SEQ ID NO: 543606 - RNA, 64 nt, hsa
ccuuuggcaaaaagaaaaaaaaaguaaaagaaaagaaaaaaaauguauuaccacccgaugagcc

SEQ ID NO: 543607 - RNA, 64 nt, hsa
agauggugggggcauuuuuagagcggcaauaauugaaaaaaaaggcgaacucugccuuggagag

SEQ ID NO: 543608 - RNA, 64 nt, hsa
ggaugagaaaauuuucaauucuggccaugagaaagaaaaaaaaauaaacagccuucuuuuuuuu

SEQ ID NO: 543609 - RNA, 64 nt, hsa
caacuaaagaauggauuuaauuaaacuauguauugaaaaaaaaguagccuaaguguuagagaug

SEQ ID NO: 543610 - RNA, 64 nt, hsa
cuaaaauuaucagacuuccuuuuuccaauauaaagaaaaaaaguaaguuuucagaauucucuca

SEQ ID NO: 543611 - RNA, 64 nt, hsa
uuguacuuuuugugcaugaccuggaccugcuaaggaaaaaaaaaucuuguggauugauugcuuu

SEQ ID NO: 543612 - RNA, 64 nt, hsa
auaaacuauuuuaaucaaccauacuauucuuauggaaaaaaauaucuauuuuggcagguuucug

SEQ ID NO: 543613 - RNA, 64 nt, hsa
uuggcagguuucugugccuuuauuucccucuucugaaaaaaagucuguguuuucauaguuuggu

SEQ ID NO: 543614 - RNA, 64 nt, hsa
aaaaaaugaaaaaaaaaggaaaaaaagaaaaaaggaaaaaaacaguuugaacacaaaggcucua

SEQ ID NO: 543615 - RNA, 64 nt, hsa
gaaaucuuaaaaaaagaaaaaaugaaaaaaaaaggaaaaaaagaaaaaaggaaaaaaacaguuu

SEQ ID NO: 543616 - RNA, 64 nt, hsa
uaacccaguuugaaaucuuaaaaaaagaaaaaaugaaaaaaaaaggaaaaaaagaaaaaaggaa

SEQ ID NO: 543617 - RNA, 64 nt, hsa
uuuauguuagcauuaaugcacauuuuuaaaaaaagaaaaaaacauggucuuguuuuuacuaccu

SEQ ID NO: 543618 - RNA, 64 nt, hsa
uguacccaugacuguugccugcaaaaauaaaagggaaaaaaaagaaaaaagaaacaaaaaggaa

SEQ ID NO: 543619 - RNA, 64 nt, hsa
agagguacuuuccuggaauaauugucuaccugaagaaaaaaaauuuauauauacauugugugug

SEQ ID NO: 543620 - RNA, 64 nt, hsa
uuuuuggucaguaaaacuuaaugaaaaaagcaaagaaaaaaauauucugaacaaagcuauaggg

SEQ ID NO: 543621 - RNA, 64 nt, hsa
ugaaaauguauuuaacauagcuguuuuaacaaaugaaaaaaagacguagaaaaauguuuagaug

SEQ ID NO: 543622 - RNA, 64 nt, hsa
uuuuuaaaaauguagcacuugacuuuuugccaaggaaaaaaauaaaaauuauuccagugcacaa

SEQ ID NO: 543623 - RNA, 64 nt, hsa
ucccccucuucucuggguguaagaagggaaauuggaaaaaaaauuauauauauauucuccuuuu

SEQ ID NO: 543624 - RNA, 64 nt, hsa
cauacaaaucacauauaguuuaaucuuuuuuaaugaaaaaaaaucauguuuaaaauggcaaaag

SEQ ID NO: 543625 - RNA, 64 nt, hsa
ucucuuuauuggugguccuaagugggucacuuaagaaaaaaaaguguaacaaauucucgcucca

SEQ ID NO: 543626 - RNA, 64 nt, hsa
uuaaugauaccccaaaaugauuacacccagggaggaaaaaaaggagcgcuuucuagggucagaa

SEQ ID NO: 543627 - RNA, 64 nt, hsa
acauuagagacuaacuguaacuuaagugcugggggaaaaaaaaugugaacuaacuuauuuaauu

SEQ ID NO: 543628 - RNA, 64 nt, hsa
accuuugcucugguuaaaacaguaauaggcacuugaaaaaaaaagauaaauuauugaaugagua

SEQ ID NO: 543629 - RNA, 64 nt, hsa
uucaaaauagcauuccccagguuuuuaaugggaggaaaaaaagcuuuaauguugagcaugcugc

SEQ ID NO: 543630 - RNA, 64 nt, hsa
ucuaaguuaaaucauuuucauuaaaaggaaaaaagaaaaaaaauuuuguaugucaauaacuuua

SEQ ID NO: 543631 - RNA, 64 nt, hsa
uuuacagaauauuauauaacccacugcugaaaaagaaaaaaaugauuguuuuagaaguuaaagu

SEQ ID NO: 543632 - RNA, 64 nt, hsa
uuuuaaaaguuauuuuugguaaggucuucuuuuagaaaaaaauuaaucucaaggguuuuuugua

SEQ ID NO: 543633 - RNA, 64 nt, hsa
cuacuuauaaacuacuuuuuuauaauuguuuucagaaaaaaaguuuacagucuuaaggaaaaua

SEQ ID NO: 543634 - RNA, 64 nt, hsa
cuacaaaaauaaccuucaggaaaaagaaaaucaggaaaaaaauuuuuuuucaauaaucuuauuc

SEQ ID NO: 543635 - RNA, 64 nt, hsa
cauauccccuauuuaacagggucucuagugcugugaaaaaaaaaaugcugaacauugcauauaa

SEQ ID NO: 543636 - RNA, 64 nt, hsa
uuaaaagaaaauaaaaaaaagaaaaaagagaaaagaaaaaaaaagaaaaaaguuguaggcgaau

SEQ ID NO: 543637 - RNA, 64 nt, hsa
gguuucuaacagacuacuuccaaaaacaguuugagaaaaaaacugucugauuuuaagucucuag

SEQ ID NO: 543638 - RNA, 64 nt, hsa
aaaguuguuugcuuaaaaaaaauuucaugugagggaaaaaaaaaaaaccuauuccagaauaagu

SEQ ID NO: 543639 - RNA, 64 nt, hsa
uguucagcaaaaugugauguuuuuuucuuuuaaagaaaaaaagugaaaauauauagugccaaau

SEQ ID NO: 543640 - RNA, 64 nt, hsa
cucaaaaaauaaauaaauagaaagagagagagaggaaaaaaaaagaaaagaacacuucuuuauu

SEQ ID NO: 543641 - RNA, 64 nt, hsa
aaaacgauuuaccaauguuguuuuuuuuuaacaagaaaaaaaauaaaagcacauugucauuuuu

SEQ ID NO: 543642 - RNA, 64 nt, hsa
uaaagaaguaccugaucaggaucugggagaauuugaaaaaaaaagaaaaacuagaaaaauaaac

SEQ ID NO: 543643 - RNA, 64 nt, hsa
aaagaaaaacuagaaaaauaaacaaaauuaaaaagaaaaaaaaauaccugagacugaguaacuu

SEQ ID NO: 543644 - RNA, 64 nt, hsa
gaccagaaaccagaagaacaaucaagacugcaaugaaaaaaauggauacauuaggagcuucaaa

SEQ ID NO: 543645 - RNA, 64 nt, hsa
agucucauagauuuagaugcaaaauccuaaaauugaaaaaaacaucuagccauauccauaaacu

SEQ ID NO: 543646 - RNA, 64 nt, hsa
ggaagacagagugagaccccaucucaggaaaaaagaaaaaaaaaaagaugucauucagcagguu

SEQ ID NO: 543647 - RNA, 64 nt, hsa
uuuauagcauugacuuuuacacacauucacacaagaaaaaaauccuuucaaaauucuuaaaucu

SEQ ID NO: 543648 - RNA, 64 nt, hsa
ucauuuuguuuuuuuaagaaaaagaaaaugaaaggaaaaaaauaaaagauccagugucuuucuu

SEQ ID NO: 543649 - RNA, 64 nt, hsa
agcagcaguggccucuacguuuuacuccuuugcugaaaaaaaaucaucuugcccacaggccugu

SEQ ID NO: 543650 - RNA, 64 nt, hsa
cccaaucuauucuaauuaccuuaaaucuaaaggggaaaaaaaaaaucacaaacaggacugggua

SEQ ID NO: 543651 - RNA, 64 nt, hsa
ccuucaauuccauauauccuuuucuucuauguaggaaaaaaauagucuaguguaguauucuucc

SEQ ID NO: 543652 - RNA, 64 nt, hsa
uaggcuuucagcuuacacaaaucuauuuaauuaggaaaaaaacuauuaaggauguagcuuuuca

SEQ ID NO: 543653 - RNA, 64 nt, hsa
ccagcugccugucguuuggcccagaccacccucagaaaaaaaccagcugccucucccauucucc

SEQ ID NO: 543654 - RNA, 64 nt, hsa
augaucccauuaccagauaagauugacugacggggaaaaaaaaaaaaaaagaauggggugugaa

SEQ ID NO: 543655 - RNA, 64 nt, hsa
auuugugugcagauaccaaaagaggaggaaagaagaaaaaaauuaaugugugggagcugcacgu

SEQ ID NO: 543656 - RNA, 64 nt, hsa
cgugugucuacuagccaacaggcagagcaggguugaaaaaaauaucagcucccaaagggcccau

SEQ ID NO: 543657 - RNA, 64 nt, hsa
acucaacuguguuuaauacucugaauuuuaauuagaaaaaaauacaauagcagcaaggcccugg

SEQ ID NO: 543658 - RNA, 64 nt, hsa
ccccccaggcaucuucacucagcaggauauaaaagaaaaaaauguucaaaugagagagcuuucu

SEQ ID NO: 543659 - RNA, 64 nt, hsa
aaaaagaagagcaaauuaaauccaaaguaaccuggaaaaaaauuagaguaaaaaucagugaaau

SEQ ID NO: 543660 - RNA, 64 nt, hsa
uuuaaaaguuauaaaucaaaauaacagauuaucugaaaaaaaaucuauccuguacgugugaaga

SEQ ID NO: 543661 - RNA, 64 nt, hsa
uuuuauuuucuacuuuugauuauuaacaucuuaugaaaaaaauauuuuaaaaaacccagccaaa

SEQ ID NO: 543662 - RNA, 64 nt, hsa
ugguugggguccauuuuguauauaacuuuuaugagaaaaaaaugguaauuauuucacgcaucaa

SEQ ID NO: 543663 - RNA, 64 nt, hsa
cuuuagucuguuauuuuguuucuuuuuauacaaagaaaaaaaauucagcuuucauguuucugau

SEQ ID NO: 543664 - RNA, 59 nt, hsa
caucuccagcaguggccugaagaggaagagaaaaaaaacaaaaaacagaaaccaaucgg

SEQ ID NO: 543665 - RNA, 64 nt, hsa
cgcaaaugaaacaccaaacagucuugaauuacaagaaaaaaaggggauuuuuuuuuuuucuaau

SEQ ID NO: 543666 - RNA, 64 nt, hsa
uccuacucucuuauacuggcugcuuuuauaauaggaaaaaaaaauaugcauuugcuuaguuuau

SEQ ID NO: 543667 - RNA, 64 nt, hsa
cgagguguuuuuuacauuuaagaaaaaaaaaaaagaaaaaaagauuguuuaaaaaaaaaaggaa

SEQ ID NO: 543668 - RNA, 64 nt, hsa
gucucugcuguaccgagguguuuuuuacauuuaagaaaaaaaaaaaagaaaaaaagauuguuua

SEQ ID NO: 543669 - RNA, 64 nt, hsa
acuaauuaaacaauaauucaaguagagugucccagaaaaaaaccacuugggcucccuguuugga

SEQ ID NO: 543670 - RNA, 64 nt, hsa
acucaaacagugaaugccuauagaaauaauaaaugaaaaaaacuaguauuuuuauaucauaaaa

SEQ ID NO: 543671 - RNA, 64 nt, hsa
uuucauuguuauuuuuagaaagauuuuuugcuaagaaaaaaauuaaacauauuuacauauuuuu

SEQ ID NO: 543672 - RNA, 64 nt, hsa
ugcaauacuguuuguacuguuuguauaaaaaauagaaaaaaaaaagaaaagaaaaaaggcauaa

SEQ ID NO: 543673 - RNA, 64 nt, hsa
uccguuucaagaccuuuuucuuuuauugcaaggggaaaaaaaugucaucuccccccaccucauc

SEQ ID NO: 543674 - RNA, 64 nt, hsa
uuucucauuuuuaaacagcacauauuuauuaagagaaaaaaaguaauuuaugacuauuuaaaau

SEQ ID NO: 543675 - RNA, 64 nt, hsa
cauauauugggauuuucaccaaaauaaugcuuuugaaaaaaagaaaaaaaaaacggauauauug

SEQ ID NO: 543676 - RNA, 64 nt, hsa
gggauuuucaccaaaauaaugcuuuugaaaaaaagaaaaaaaaaacggauauauugagaaucaa

SEQ ID NO: 543677 - RNA, 64 nt, hsa
uaguuaauaugaacacagcacagauuuguuagaagaaaaaaaauuugcuguaauaccaaaacua

SEQ ID NO: 543678 - RNA, 64 nt, hsa
cuguaauaccaaaacuaaccucaucaaagauacagaaaaaaagaaauauagugagcccuaaagg

SEQ ID NO: 543679 - RNA, 64 nt, hsa
aucaucgccguugaaaugaaaagagagacagagagaaaaaaaaaaagagaacccacaugaagcu

SEQ ID NO: 543680 - RNA, 64 nt, hsa
acucauuuguguggaugcgugaccaugggaaaaagaaaaaaaaaaagauccauuuuuuagguuc

SEQ ID NO: 543681 - RNA, 64 nt, hsa
uauuacaacuuuguacugguuguaacuugcauuagaaaaaaaagagauauauacaccacaaaga

SEQ ID NO: 543682 - RNA, 64 nt, hsa
uguuuaaaaaaaugcaaaucauucuuuaccuuaagaaaaaaaaaauacccuuugcuuugugccu

SEQ ID NO: 543683 - RNA, 64 nt, hsa
aaucugaacaauccuacagggaaaucagaauuaggaaaaaaaucuggagaacaauaugguugaa

SEQ ID NO: 543684 - RNA, 64 nt, hsa
guuacagcaauccuaggaagcuaauacucugacagaaaaaaaucuuggauaauaugcaugagaa

SEQ ID NO: 543685 - RNA, 64 nt, hsa
ccugaccccagauucaacuuugcaaacaacaggggaaaaaaauggggaaaagaaaaaccacgag

SEQ ID NO: 543686 - RNA, 64 nt, hsa
aaaaaaauggggaaaagaaaaaccacgagagagggaaaaaaaauuauucugcaccuguaaaaaa

SEQ ID NO: 543687 - RNA, 64 nt, hsa
ggacuugauauucauaauucagugcuguggaaaugaaaaaaaugauugaagagguggaacggaa

SEQ ID NO: 543688 - RNA, 64 nt, hsa
gauugaagagguggaacggaaaugaccuuagggggaaaaaaaaggaccaaagaagucugauuaa

SEQ ID NO: 543689 - RNA, 64 nt, hsa
gauuuaacuguuugauuauaacugugcaaauacagaaaaaaagaaggcuggcugaaaguugagu

SEQ ID NO: 543690 - RNA, 64 nt, hsa
uuuagccuaaguauaagaguccuacagauggacugaaaaaaaucagucugagaguauuagucac

SEQ ID NO: 543691 - RNA, 64 nt, hsa
auuacccaaaaacugucuuuaaaagagagagagagaaaaaaaaaauaguauuugcauaacccug

SEQ ID NO: 543692 - RNA, 64 nt, hsa
guuuauuuuuaaagauagauccuuuuauaggugagaaaaaaacaaucuggaagaaaaaaaccac

SEQ ID NO: 543693 - RNA, 64 nt, hsa
auccuuuuauaggugagaaaaaaacaaucuggaagaaaaaaaccacacaaagacauugauucag

SEQ ID NO: 543694 - RNA, 64 nt, hsa
guaaguucuucaaacacccauuuuugcucuaugggaaaaaaacgauuuaccaauuaauauuacu

SEQ ID NO: 543695 - RNA, 64 nt, hsa
agguauugcacuacauuauggaaucaugcaaaaggaaaaaaaguuucaugauaucuguuguugg

SEQ ID NO: 543696 - RNA, 64 nt, hsa
uggcggaaucuuaaagugauacaugcuaacuguagaaaaaaauagaaaaugcacauaagcaaaa

SEQ ID NO: 543697 - RNA, 64 nt, hsa
aauuguauaaaauuagguacuucgauuaguaaaagaaaaaaauuugaauguuuuuuuuuuuuau

SEQ ID NO: 543698 - RNA, 64 nt, hsa
uaauauaacaauauaugauauauaaaccuuaaaugaaaaaaaugaucuauugcagauauuugau

SEQ ID NO: 543699 - RNA, 64 nt, hsa
ucagccucauucacuguccuggcuuuuauuuaaagaaaaaaaaggcaguauucccuuuuuaaau

SEQ ID NO: 543700 - RNA, 64 nt, hsa
auaagucuccagagcacacaagaguauuucuucugaaaaaaauguuacaauuauacuagaugga

SEQ ID NO: 543701 - RNA, 50 nt, hsa
augaaagcauucauacuugagaaaaaaauaaacaaauauaaaaauaggca

SEQ ID NO: 543702 - RNA, 64 nt, hsa
auuauaaaagagcacuucuguggcucauuuaaaagaaaaaaaagguuaagucuuuuaaauuuug

SEQ ID NO: 543703 - RNA, 64 nt, hsa
ccaaucuuuuauuguuccuuugcuacuuugaaaggaaaaaaaagguugucucuugauuucugua

SEQ ID NO: 543704 - RNA, 64 nt, hsa
uuguauuuuaguauauuuauauaauuauguuauugaaaaaaauuggcauuaaaacuuaaccgca

SEQ ID NO: 543705 - RNA, 64 nt, hsa
gaauugauaauaaacuguccucuuucagaaaacagaaaaaaaacacacacacacacaacaaaaa

SEQ ID NO: 543706 - RNA, 64 nt, hsa
uauauauacauaacaggguaaauuauucaguuaagaaaaaaauaauuuuaugaacugcauguau

SEQ ID NO: 543707 - RNA, 64 nt, hsa
uuuuuaugcaagggcaaaaaucuuuguaucuggggaaaaaaaacuuuuuuuuaaauuaaaaagg

SEQ ID NO: 543708 - RNA, 64 nt, hsa
aaggcagggaagaaggauguguguguccaggaaggaaaaaaagguggaucagugauuuuacuug

SEQ ID NO: 543709 - RNA, 64 nt, hsa
uacccucaguuaagcauguuaacauuuauaggaggaaaaaaaucacuuugggagaaaauaaaau

SEQ ID NO: 543710 - RNA, 64 nt, hsa
gccucugagccuacucuaguucaagaggcuaccugaaaaaaaauaaauaagauaaagggucagc

SEQ ID NO: 543711 - RNA, 64 nt, hsa
uugcuccaaauucuuauuuuacuuaaccagaagggaaaaaaaguuguauuuuccugaagcuaca

SEQ ID NO: 543712 - RNA, 64 nt, hsa
aaaugaagaaaaacugaagaaaaaaaaaaaacaggaaaaaaagaaccauacaaaauuuuuccac

SEQ ID NO: 543713 - RNA, 64 nt, hsa
auuuugcagcgaagagaaaugaagaaaaacugaagaaaaaaaaaaaacaggaaaaaaagaacca

SEQ ID NO: 543714 - RNA, 64 nt, hsa
agccuuugugccacuucagugcuagaaaguuaaagaaaaaaaaacuuuugugauuuaauaauac

SEQ ID NO: 543715 - RNA, 64 nt, hsa
guuguacagauaguuuauaagcacaauauuuuaagaaaaaaaaguggcuggucuacuaggcagc

SEQ ID NO: 543716 - RNA, 64 nt, hsa
uagaauugugucauuuaucaaaccuuuuauuacagaaaaaaaucugaacugagaaaggagcucu

SEQ ID NO: 543717 - RNA, 64 nt, hsa
ucuguaucucguaauuguguauagcaugguaaaagaaaaaaaaaaagacagguaaauguuauau

SEQ ID NO: 543718 - RNA, 64 nt, hsa
aaguacuaggaauucagaugaucagcucuuaaaagaaaaaaaaaagcaaaaagacuaaagcccu

SEQ ID NO: 543719 - RNA, 64 nt, hsa
cuaggaaccaccuaaugguagguggacagaaaaggaaaaaaaaaaaaauuuacuugcaaguacu

SEQ ID NO: 543720 - RNA, 64 nt, hsa
aacuguuguuugguuaaaggacacagauuugaaggaaaaaaauuuugauguaacaauuuuuuaa

SEQ ID NO: 543721 - RNA, 64 nt, hsa
aauuaaaaauuuucuaaauauuaauacuaacugggaaaaaaaaacuagugugaaguuuacaguu

SEQ ID NO: 543722 - RNA, 64 nt, hsa
aaauugaugacuuuauaaugcaaccaggaguauugaaaaaaaaguaagcaaugagcucaaauaa

SEQ ID NO: 543723 - RNA, 64 nt, hsa
aaugcugaaaagaagagaaauaccccaaguucuugaaaaaaaauuuuuugauaugacuacucua

SEQ ID NO: 543724 - RNA, 64 nt, hsa
ucauuauuuguuuuggauaaugaagucagcagaggaaaaaaaaauaugaccaucucaaaagaug

SEQ ID NO: 543725 - RNA, 64 nt, hsa
uaaacaaacaaaaaaaaauuuuaaacaaagaaaggaaaaaaauugacaauaaaagucacucuuc

SEQ ID NO: 543726 - RNA, 64 nt, hsa
aagauucuuucuucugaaagccaagcaccacaaggaaaaaaaaaauuauuaauagcucagguua

SEQ ID NO: 543727 - RNA, 64 nt, hsa
aaagcagaaacaugacugaauugaauugguagaugaaaaaaaccugguucaaguuuuuuuuaaa

SEQ ID NO: 543728 - RNA, 64 nt, hsa
aauuuaaaugggaagggaagaaaacaccaaauaagaaaaaaauuugccuuuaagaguuacuuuu

SEQ ID NO: 543729 - RNA, 64 nt, hsa
agcaugugccucacuuuaagaaaguccuguaggggaaaaaaaaaacugucagagcgaauucaug

SEQ ID NO: 543730 - RNA, 64 nt, hsa
aaacacaggaaaggggaauucugugauggcaaaugaaaaaaauguuaacauuugguagacaugu

SEQ ID NO: 543731 - RNA, 64 nt, hsa
uuuacacguaaugagggaaguccuaggauggauagaaaaaaagcacuuacauuggggcacacag

SEQ ID NO: 543732 - RNA, 64 nt, hsa
ggaacauauucugucuggguuuuuaaugucuguggaaaaaaacuaaacaagucucugucucagu

SEQ ID NO: 543733 - RNA, 64 nt, hsa
gcaaaguuaagaucgaauccauccgcuuguaggggaaaaaaaggaaaaaaauuaaccagagagg

SEQ ID NO: 543734 - RNA, 64 nt, hsa
agaucgaauccauccgcuuguaggggaaaaaaaggaaaaaaauuaaccagagagggucuguaau

SEQ ID NO: 543735 - RNA, 64 nt, hsa
uguuguaucuuuugcauguagcuuccuuaauggagaaaaaaaaaccuaauaaauuuccagaauc

SEQ ID NO: 543736 - RNA, 64 nt, hsa
uacuagauguacuuuuucuaaaaaggaaaggacagaaaaaaaugaagaaaggaaaggaagacaa

SEQ ID NO: 543737 - RNA, 64 nt, hsa
aaaaagagaaaaauuuuaaaauccugcuauaggagaaaaaaagagaaaaaaauaaaaaucaaaa

SEQ ID NO: 543738 - RNA, 64 nt, hsa
aaauuuuaaaauccugcuauaggagaaaaaaagagaaaaaaauaaaaaucaaaaaaaaaaaaaa

SEQ ID NO: 543739 - RNA, 64 nt, hsa
ucuugaauucucuguuuaugcaaugugcucgaaagaaaaaaauguuaaaaauauaucuauaaua

SEQ ID NO: 543740 - RNA, 64 nt, hsa
gcaccgucaguguuccuauccaauuucaaaaaaggaaaaaaaagagggaaaauuacaaaaagag

SEQ ID NO: 543741 - RNA, 64 nt, hsa
aaggaaaaaaaagagggaaaauuacaaaaagagagaaaaaaagugaaugacguuuguuuagcca

SEQ ID NO: 543742 - RNA, 64 nt, hsa
acuuauuacaugcugcuauacacaagcaaugcaagaaaaaaacuuacuggguaggugauucuaa

SEQ ID NO: 543743 - RNA, 64 nt, hsa
cucuuaagucccaguauaccucauuuuucauacugaaaaaaaaagcuuguggccaauggaacag

SEQ ID NO: 543744 - RNA, 64 nt, hsa
ccacauuuguucuuccuuccucaggguuagugaugaaaaaaaguaaauaucuuuuucauauguc

SEQ ID NO: 543745 - RNA, 64 nt, hsa
uaaauaucuuuuucauauguccauuagaauguaugaaaaaaaucauuuuaacuaaaagcaaaag

SEQ ID NO: 543746 - RNA, 64 nt, hsa
ugucaguggcguugggagggggagaaaaggaaaagaaaaaaaaaagaagaagaagaagaaaaga

SEQ ID NO: 543747 - RNA, 64 nt, hsa
aaaaaaaaagaagaagaagaagaaaagagaagaagaaaaaaacgaaaacagucaaccaacccca

SEQ ID NO: 543748 - RNA, 64 nt, hsa
auguauuaacucauacugccugucuuuuauaggggaaaaaaauaaccuuuuuuauuuuaaaguu

SEQ ID NO: 543749 - RNA, 64 nt, hsa
ucaccagcagguuccaaauugauguguaugauaggaaaaaaaccuuaauuuuaaauauaauaua

SEQ ID NO: 543750 - RNA, 64 nt, hsa
gccgacggaggaggaggagccuuccaaacagagagaaaaaaaugaggccgaaaauuuagaggaa

SEQ ID NO: 543751 - RNA, 64 nt, hsa
gcuacacuguccuggcagaaaacaaaagugacgagaaaaaaaaaucaggagucagcucugacaa

SEQ ID NO: 543752 - RNA, 64 nt, hsa
aaucaaggccaaagaaaaugaucugcuuccccuggaaaaaaaucguguuaagcuagaugaugac

SEQ ID NO: 543753 - RNA, 64 nt, hsa
gugucuugggaauuuucuuccaaacagaacuauggaaaaaaaggaagaaauuccaggaaaaucu

SEQ ID NO: 543754 - RNA, 64 nt, hsa
cucugugguccgaagucuuccauagagacuuugugaaaaaaaauuuuauagugucuugggaauu

SEQ ID NO: 543755 - RNA, 64 nt, hsa
aauauuauauuuuuucuauaaaaagaaaaaaauggaaaaaaauuacaaggcaauggaaacuauu

SEQ ID NO: 543756 - RNA, 64 nt, hsa
cucuccccaaaauauuauauuuuuucuauaaaaagaaaaaaauggaaaaaaauuacaaggcaau

SEQ ID NO: 543757 - RNA, 64 nt, hsa
agccugaaggaaauaagugaaacuacaucuaugggaaaaaaaaaaacauugagaagugcaaaug

SEQ ID NO: 543758 - RNA, 64 nt, hsa
acaaauaagcagaaaacauacuuauuuuaaaaaagaaaaaaaaggauaaaaaaacccaaacuga

SEQ ID NO: 543759 - RNA, 64 nt, hsa
uuaggaccaaucucauuuuuaauaagguuaaaaagaaaaaaaaagucuagcgaaaaaacuccug

SEQ ID NO: 543760 - RNA, 64 nt, hsa
cuuuucucuucucccaaaucuuuucccuucaaaggaaaaaaaaauguucagaggucccugucuu

SEQ ID NO: 543761 - RNA, 64 nt, hsa
gagguccuucuggacuaaaagccaaaaaaagaaagaaaaaaauaauuuuucuuuucuguuuuau

SEQ ID NO: 543762 - RNA, 64 nt, hsa
auaagaauuaagggguaaagcacuaaacagaaaagaaaaaaaaaauagcaacucuggugagcag

SEQ ID NO: 543763 - RNA, 64 nt, hsa
uccuaacagcacuacaaaguaccuuuuuuuaucagaaaaaaauuuuaccauuaggacucaauuu

SEQ ID NO: 543764 - RNA, 64 nt, hsa
aguuuugaaccaagaauuggugauuuguuuauaagaaaaaaacuggcuucauuucugugaaauu

SEQ ID NO: 543765 - RNA, 64 nt, hsa
uucuaccagaaauuuccagagcauuauguagguagaaaaaaaugcaagcaagcuguuaaagauc

SEQ ID NO: 543766 - RNA, 64 nt, hsa
aaauagauaacacuaaugcuuuguuuaaaaaaacgaaaaaaacaaaacaaaacaaaaaaacaug

SEQ ID NO: 543767 - RNA, 64 nt, hsa
aaaauuaguccuucaaauacugcuguauuuucaggaaaaaaaaaaaaagggguguuucuauuga

SEQ ID NO: 543768 - RNA, 64 nt, hsa
aagaaaguacuugacuaaaaaaaaaagaaaaaaagaaaaaaaagaaagcauagacauauuuuuu

SEQ ID NO: 543769 - RNA, 64 nt, hsa
guuucuuuaagaaaguacuugacuaaaaaaaaaagaaaaaaagaaaaaaaagaaagcauagaca

SEQ ID NO: 543770 - RNA, 64 nt, hsa
cucccacugggucaccucaaggaucagaggccaggaaaaaaaaaaaaaagacucccuggaucuc

SEQ ID NO: 543771 - RNA, 64 nt, hsa
uguugaucuuuuaucaauaauguucuauagaaaagaaaaaaaaaauauauauauauauauaucu

SEQ ID NO: 543772 - RNA, 64 nt, hsa
guagggauuuacuggcaugguaucauuccuagaagaaaaaaagagagaaacuugacugcacauu

SEQ ID NO: 543773 - RNA, 64 nt, hsa
accuccuuccugaacucuaauagagguuaaaagggaaaaaaaaaauucuguagauagcaaauug

SEQ ID NO: 543774 - RNA, 64 nt, hsa
gaaaaaccaacaaacaauaguucuagggagaugagaaaaaaauucaccuuacagugcuaagaaa

SEQ ID NO: 543775 - RNA, 64 nt, hsa
aaaagcgaaacucugucucaaaaaagaaaaaaaagaaaaaaaagcacgugaccuuaugaggcuc

SEQ ID NO: 543776 - RNA, 64 nt, hsa
cugggcaacaaaagcgaaacucugucucaaaaaagaaaaaaaagaaaaaaaagcacgugaccuu

SEQ ID NO: 543777 - RNA, 64 nt, hsa
ugaaccuuaaaaaaaaaaaaaaagguuuugaagggaaaaaaagugguuucacaccucuuguuau

SEQ ID NO: 543778 - RNA, 64 nt, hsa
agaccaaaaaaugagguuuugcuuuuguaaucaggaaaaaaaaaaauuaaugaaccuuaaaaaa

SEQ ID NO: 543779 - RNA, 64 nt, hsa
gcuuuuggcucucuguuucauuuuuuuccauuaagaaaaaaaaaaguccccuuuuaaaacaagc

SEQ ID NO: 543780 - RNA, 64 nt, hsa
ucuuuucaaaaugagaggcuuucauugaagaaaagaaaaaaacaacaguuaaaagcuuuuggcu

SEQ ID NO: 543781 - RNA, 64 nt, hsa
ucaaacuguguauuuucuuacaauaaaaaaugaugaaaaaaaaaaaggcuuuacuucuuuugca

SEQ ID NO: 543782 - RNA, 64 nt, hsa
gccauuuacaaaaaaaaaaaaaaaaaagaaaacagaaaaaaauucagacccugcaaaaccacau

SEQ ID NO: 543783 - RNA, 64 nt, hsa
aaacaaguuguauauuuuucaccccugauuaugggaaaaaaaucaguucugucuuuguggguug

SEQ ID NO: 543784 - RNA, 64 nt, hsa
uaggaaauuuuuuuaauuuuuuuuuuuuaaagaagaaaaaaaacuacauaauuucuaccagggc

SEQ ID NO: 543785 - RNA, 64 nt, hsa
gugcuguauauuuuccaugcccucacuccuuuaagaaaaaaaaaaaggaaaaaagcaacacaau

SEQ ID NO: 543786 - RNA, 64 nt, hsa
gagucuuucuagaacuuuugaacacuaaaaggaugaaaaaaauuagcaaaccgaaguuucuuca

SEQ ID NO: 543787 - RNA, 64 nt, hsa
cacugauaaacagaauacuuuuaaaacaccuugagaaaaaaagauaauacauacacaugaacaa

SEQ ID NO: 543788 - RNA, 64 nt, hsa
uaagaauaaaaacuaccaaagugauauacagagagaaaaaaagacuuagagaagaggaagagaa

SEQ ID NO: 543789 - RNA, 64 nt, hsa
guguuuguauuuguauucucugcaauuuuacugugaaaaaaaauuuguuuucaacaauuggugu

SEQ ID NO: 543790 - RNA, 64 nt, hsa
guguuuuguauuuuauagugaguugcauguuuuugaaaaaaagugcugaaaaugggaugugcug

SEQ ID NO: 543791 - RNA, 64 nt, hsa
uaugcaauuuuaaguauacacucagcaauaauuagaaaaaaaggagagagaaaagugauuuaaa

SEQ ID NO: 543792 - RNA, 64 nt, hsa
aaccaaagaaacaaugaucuacucaaacauuggagaaaaaaacugccagaggaggaguugccaa

SEQ ID NO: 543793 - RNA, 64 nt, hsa
cccuaaauuacaaaugagaaaauugaagcacaaggaaaaaaauaacuaguuugaaauauuuuga

SEQ ID NO: 543794 - RNA, 64 nt, hsa
caccaaacauugaugcuuaaggaccacacugaaggaaaaaaaaagaggggacuucgaaaaaaaa

SEQ ID NO: 543795 - RNA, 64 nt, hsa
gaccacacugaaggaaaaaaaaagaggggacuucgaaaaaaaaaaaagcccugcaaaauauucu

SEQ ID NO: 543796 - RNA, 64 nt, hsa
aauaauaauaauaauaauaaugaugauacucuaagaaaaaaaucucaacauacuucauuuaaua

SEQ ID NO: 543797 - RNA, 64 nt, hsa
ccugggugaaaaagacaggcugugucuccaaaaagaaaaaaaaaagucaaauucaaauaucauc

SEQ ID NO: 543798 - RNA, 64 nt, hsa
gaaacgacccuguggcugugagaaagugaaaaaagaaaaaaaaaaaggcauuggcauuuucuug

SEQ ID NO: 543799 - RNA, 64 nt, hsa
auuaggacagaauuaaugaugcuuaaagagaaaagaaaaaaagagagaagaaaaaggagagaug

SEQ ID NO: 543800 - RNA, 64 nt, hsa
acuuucaaugugaggaaugaaugauaaauuaagagaaaaaaauaucaggaaggucaauauaugc

SEQ ID NO: 543801 - RNA, 64 nt, hsa
uaucagugucaaaagcccaagaaaagacaaaaaagaaaaaaacaauccccagggguucuaugac

SEQ ID NO: 543802 - RNA, 64 nt, hsa
guuggauuaaaggguuguaacugacuacagcauggaaaaaaauaguucuuuuaauucuuucacc

SEQ ID NO: 543803 - RNA, 64 nt, hsa
cuagaugcaccaaccguaucauuauuuguuugaggaaaaaaagaaaucugcauuuuaauucaug

SEQ ID NO: 543804 - RNA, 64 nt, hsa
ccuccuacccagcaaaccaguagacccaaaaguugaaaaaaacugaugacagacaacaagcaug

SEQ ID NO: 543805 - RNA, 64 nt, hsa
auauuuggagcuuuauagccuguauuccuugggagaaaaaaaugggaauuggaguaaaaagugu

SEQ ID NO: 543806 - RNA, 64 nt, hsa
ucacugaggaugaaacugacuuuugucuuuuggagaaaaaaaacuguacugcuuguucaagagg

SEQ ID NO: 543807 - RNA, 64 nt, hsa
gauauuuagaaauuuuguguauuauauggaaaaagaaaaaaagcuuaagucuguagucuuuaug

SEQ ID NO: 543808 - RNA, 64 nt, hsa
caacacagugcaucuuuuuaaaacaaggaaaagggaaaaaaaggagaaaaaacgaugcaucaag

SEQ ID NO: 543809 - RNA, 64 nt, hsa
uagagauugauaagauuuagcaacugguguuggagaaaaaaagaaaagcaaaugaguguuuuca

SEQ ID NO: 543810 - RNA, 64 nt, hsa
caaauuuucuaguauaacagaaauuuuuguagaugaaaaaaaucauuauguuuagaggucuaau

SEQ ID NO: 543811 - RNA, 64 nt, hsa
uucaacuguaaauaauguacauuuaaugucacaagaaaaaaaugucuucugcaaauuuucuagu

SEQ ID NO: 543812 - RNA, 64 nt, hsa
aaaaaaaaaaaaaaaaaaaaggaaaaaaaaaaaagaaaaaaaaccauauguguauuagggugac

SEQ ID NO: 543813 - RNA, 64 nt, hsa
gacuccgucucaaaaaaaaaaaaaaaaaaaaaaggaaaaaaaaaaaagaaaaaaaaccauaugu

SEQ ID NO: 543814 - RNA, 64 nt, hsa
uuugggaaguuuuacuuuuguuuucuucuaugaagaaaaaaaugcaggcugggcgcgguggcuc

SEQ ID NO: 543815 - RNA, 64 nt, hsa
uuuaaaacuuacuaugguauauauuuugaaaggagaaaaaaaaagccacuaaggucaguguuau

SEQ ID NO: 543816 - RNA, 64 nt, hsa
uggaaggcacacugagcaaguuuucaccuaucuggaaaaaaaaaaauaugagauuggaaaaaau

SEQ ID NO: 543817 - RNA, 64 nt, hsa
acgaaugaacuuguagggggcauagaggauucuugaaaaaaaaaaaugcaagagugauuuucug

SEQ ID NO: 543818 - RNA, 64 nt, hsa
cuuugcagucagacauucgucaugggaaaguucagaaaaaaauaaaguccuuuuaagggaacuu

SEQ ID NO: 543819 - RNA, 64 nt, hsa
uacuaaaaaaaguguguauuaggaggagagagaggaaaaaaagaggaaagaaggaaaaaaaaaa

SEQ ID NO: 543820 - RNA, 64 nt, hsa
uaggaggagagagaggaaaaaaagaggaaagaaggaaaaaaaaaagaauuaaaaaaaaaaaaaa

SEQ ID NO: 543821 - RNA, 64 nt, hsa
aaaaaaaaaagaaaaacagaagaugaccuugauggaaaaaaaauauuuuuuaaaaaaaagauau

SEQ ID NO: 543822 - RNA, 52 nt, hsa
ccaugaggacagugaucugauugaaaaaaaacgacagucuggggaagcgauc

SEQ ID NO: 543823 - RNA, 64 nt, hsa
ccaugcaacuaugagucucuaaaucucucuguaagaaaaaaauuucaaaguaaagauuuuacuc

SEQ ID NO: 543824 - RNA, 64 nt, hsa
uauagcuuacucuaccugcagacagaaaaugaaagaaaaaaauggacuugccuagaauaauaua

SEQ ID NO: 543825 - RNA, 64 nt, hsa
cuugcauccagaaaggccagauuuuaccuaccaagaaaaaaagauauuuuuccagagaguuagg

SEQ ID NO: 543826 - RNA, 64 nt, hsa
uuaauaccagaccaaagacauuuucuguuuccuggaaaaaaaaaaugaaucauguuaggcuuua

SEQ ID NO: 543827 - RNA, 64 nt, hsa
aauuaguaggcuccugcugccaaaaugcaaaggggaaaaaaaggcagggauugggggggauggg

SEQ ID NO: 543828 - RNA, 64 nt, hsa
uguuaaaacaugaaaaugcuggugagcugagguagaaaaaaaacaagaaaaaaauuuuaaaaau

SEQ ID NO: 543829 - RNA, 64 nt, hsa
aaaaugcuggugagcugagguagaaaaaaaacaagaaaaaaauuuuaaaaauagcguuaaaaug

SEQ ID NO: 543830 - RNA, 64 nt, hsa
acuacaacaacaaaaaaagaaaaaaguuaaaaaagaaaaaaacaccaaaaaacaaaaacaaaca

SEQ ID NO: 543831 - RNA, 64 nt, hsa
uuauuuuuuugauaaugacuggacaucagaagaggaaaaaaacucaaaacaaaagcgagagaga

SEQ ID NO: 543832 - RNA, 64 nt, hsa
agaaugaagucaaacugugccacacauggugaaugaaaaaaaaaaaaagaggcuguguuuuguc

SEQ ID NO: 543833 - RNA, 64 nt, hsa
gucuccaagcuuuugugauuguauauuccuauaggaaaaaaagaauugauuaugcauacccagu

SEQ ID NO: 543834 - RNA, 64 nt, hsa
ugaacucuggaaaaaaaaaaaaaaaugaaaaaaagaaaaaaaaaagagcuauagaaauccuugu

SEQ ID NO: 543835 - RNA, 64 nt, hsa
caucugguugaacucuggaaaaaaaaaaaaaaaugaaaaaaagaaaaaaaaaagagcuauagaa

SEQ ID NO: 543836 - RNA, 64 nt, hsa
uaaaaagauuacagcgucaucugguugaacucuggaaaaaaaaaaaaaaaugaaaaaaagaaaa

SEQ ID NO: 543837 - RNA, 64 nt, hsa
aaauuuauccuaaacagauggucuuucucugagggaaaaaaaaaaaugugucaugugaggcaau

SEQ ID NO: 543838 - RNA, 64 nt, hsa
uuuguacagugucaauuuguaaaaaagaaaaaacgaaaaaaaaucucaaauaaaacaugagaua

SEQ ID NO: 543839 - RNA, 64 nt, hsa
uauaucaaaggugcaucgugaccaaauuguuuaagaaaaaaaaacaaaaaaaacaaaaucuagg

SEQ ID NO: 543840 - RNA, 64 nt, hsa
auuuguuaccaaaagugguucuacaaaugcuacugaaaaaaaucuggaaauuccuaauguccug

SEQ ID NO: 543841 - RNA, 64 nt, hsa
ugcuaagcuguuaaauguauuuauaguaaaggaagaaaaaaagacugucauuuccuuauaaguu

SEQ ID NO: 543842 - RNA, 64 nt, hsa
cuauuucucuuucuuugugugaauuuauuuaaaagaaaaaaaaacuuuuuguaacgacuauuug

SEQ ID NO: 543843 - RNA, 64 nt, hsa
gaaaacaacuuuuuauguauagcuucuaaaaggggaaaaaaaaaaaaagagaaacccuuugacu

SEQ ID NO: 543844 - RNA, 64 nt, hsa
auagaaaaaguauuuuuucuccaccagacaaauggaaaaaaagaggaaagauuaacuauuugca

SEQ ID NO: 543845 - RNA, 64 nt, hsa
agugacaguuuacaaaauuauuuucugcaaaaaagaaaaaaaaguuacguuaaaaaccaaaaaa

SEQ ID NO: 543846 - RNA, 64 nt, hsa
uuaauaacugaauaaaaaauaaauaaaauggauagaaaaaaacuaaaguugaaaauacauucuu

SEQ ID NO: 543847 - RNA, 64 nt, hsa
uaugcuccuagagaggagaaaggggugauugaaagaaaaaaaaauacuuaaauauuuguaauug

SEQ ID NO: 543848 - RNA, 64 nt, hsa
gcauggauuccuuugaagaaaaaaaagaaaaagagaaaaaaaucacaaaaacaaacuuuuuuua

SEQ ID NO: 543849 - RNA, 64 nt, hsa
aauuucugauccacaaugcauggauuccuuugaagaaaaaaaagaaaaagagaaaaaaaucaca

SEQ ID NO: 543850 - RNA, 64 nt, hsa
cuuuuucugucuaucaaaacuauuugauccaagugaaaaaaaaaaaaaaacuagaaagcuacgg

SEQ ID NO: 543851 - RNA, 64 nt, hsa
agauaaaugugaagucugaguaagguugcucucagaaaaaaaaaaaaagcauauauauauauaa

SEQ ID NO: 543852 - RNA, 64 nt, hsa
uaaugcauaaugcuuucucaccaacagaaaaaaggaaaaaaauuguuuucaguuaaacacuaca

SEQ ID NO: 543853 - RNA, 64 nt, hsa
ugcuugcugccuuuaauugucuugcucucuaugggaaaaaaacaaaagggcuucagucucaugg

SEQ ID NO: 543854 - RNA, 64 nt, hsa
uaccucauuucaagaaaauaugcuuaacagagaggaaaaaaaugugguuuggccuugcugcugu

SEQ ID NO: 543855 - RNA, 64 nt, hsa
agcuuguugaaauguuuugcaucugucaauuaaggaaaaaaaaaaucacucuauguugccccac

SEQ ID NO: 543856 - RNA, 64 nt, hsa
auaaacuagcucauuauuuccaucuuuggaaaaggaaaaaaaaaaaaacuucuuuaggcauuug

SEQ ID NO: 543857 - RNA, 64 nt, hsa
agcagaccagaugggaaauuauuuguguugaguggaaaaaaaucaguuuuuguaaagaugucag

SEQ ID NO: 543858 - RNA, 64 nt, hsa
uguaccuuuuuguuagugaauuuggaaauaaaaagaaaaaaaaaacaaaaacaaacaggcugcc

SEQ ID NO: 543859 - RNA, 64 nt, hsa
gaaaaaaagugcuuaauauuguuauugcuuugcagaaaaaaaaaaaaucacauuucugaccugu

SEQ ID NO: 543860 - RNA, 64 nt, hsa
aggggauugcuacaccauguagaaaaaguauguagaaaaaaagugcuuaauauuguuauugcuu

SEQ ID NO: 543861 - RNA, 64 nt, hsa
auaaucgagaaugccugggcauuuuacaaaacaagaaaaaaaauacccuuuucuuuuccuugaa

SEQ ID NO: 543862 - RNA, 64 nt, hsa
guauccagaaaagcuuuaagcaguuaaagaaacagaaaaaaaccgacacuuugucgacacugaa

SEQ ID NO: 543863 - RNA, 64 nt, hsa
guuauuagaagaaaaguacuguacugaaaauucagaaaaaaaaucucaaccuuaugccaaaaug

SEQ ID NO: 543864 - RNA, 64 nt, hsa
uggugacagagcaagacuccgucuccaaaaaaaagaaaaaaaaauuucuugaaguggaaugaug

SEQ ID NO: 543865 - RNA, 64 nt, hsa
ugaauugguacuugggagacuucuguucuuuguugaaaaaaauugccuuuguuuugaaauuaua

SEQ ID NO: 543866 - RNA, 64 nt, hsa
uaaaccuaaaacuguucuaaaauagaaagucugugaaaaaaaacaaaaguaaaguuauaaaagg

SEQ ID NO: 543867 - RNA, 64 nt, hsa
auuuuauaaaaugaauuuuguaauuuuuuucugagaaaaaaaaguucuuaaauacaauaaaauu

SEQ ID NO: 543868 - RNA, 64 nt, hsa
caguuauuggugagucuaaggauccaaggcuacagaaaaaaaagaaauauaacaggaauuaaug

SEQ ID NO: 543869 - RNA, 64 nt, hsa
cacugaagaugaaaagauaggacggaugugauaugaaaaaaacccaaacauuuuggcauugaau

SEQ ID NO: 543870 - RNA, 64 nt, hsa
uacuugaaauauuuucauuaucauacuauucuuugaaaaaaaagaugcuuacuguauacuuguu

SEQ ID NO: 543871 - RNA, 64 nt, hsa
aauugaauaguacccaauuaaaguuccucaguaagaaaaaaaauguguuuuuguaggcaaaaag

SEQ ID NO: 543872 - RNA, 64 nt, hsa
uucauguuagauauucuauguguuuaccucaauugaaaaaaaaaagaauguuuuugcuaguauc

SEQ ID NO: 543873 - RNA, 64 nt, hsa
acgccguuauguugccucaaauaguuuuagaagagaaaaaaaaauauauccuuguuuuccacac

SEQ ID NO: 543874 - RNA, 64 nt, hsa
uuucugucucaaaauguauaauauagaaaugcaagaaaaaaacaaauguacagauuguaaaguu

SEQ ID NO: 543875 - RNA, 64 nt, hsa
agcaacauggggcuagugggaucacagaaaucuggaaaaaaaaaaaaaaggcuuuggcuuauca

SEQ ID NO: 543876 - RNA, 64 nt, hsa
uggacuuauuucuccccaggaaaugauucuuacggaaaaaaauugcuuuuguauguagaacagg

SEQ ID NO: 543877 - RNA, 64 nt, hsa
gguauuucucccacagaaaugaugaaagugaccagaaaaaaacaaaaacaaaaccccuuuacuc

SEQ ID NO: 543878 - RNA, 64 nt, hsa
aauguuuccauguucccaacuauguugagaaguggaaaaaaacccagguucuagaugggugaau

SEQ ID NO: 543879 - RNA, 64 nt, hsa
caaaaaagaagagaaaagaucgucugagaaaucugaaaaaaaagaaagcaaggauacuaagaaa

SEQ ID NO: 543880 - RNA, 64 nt, hsa
aaaccuugcagcauuuuuauuuaaaagaaaagaagaaaaaaaacacccaaccacacaaagaaca

SEQ ID NO: 543881 - RNA, 64 nt, hsa
acauuuggaaucaguagcagagcaaagccucuuugaaaaaaaccacguagcugauuggguuuua

SEQ ID NO: 543882 - RNA, 64 nt, hsa
caacucuaaaaaaaaaaaaaauacaaauaaaaaggaaaaaaaauuacauuuuuuaucuuauacc

SEQ ID NO: 543883 - RNA, 64 nt, hsa
ggcuuaggggauuggaacugggguuuggcugaaagaaaaaaaaaaaaauguaacugaugaaucu

SEQ ID NO: 543884 - RNA, 64 nt, hsa
gcaguauucagcuucuuaaccagucgcuauuuaggaaaaaaaacccacuaguuaggccaucaac

SEQ ID NO: 543885 - RNA, 64 nt, hsa
uuuuguuucuguuguuguucaaaugcaaaaaaaagaaaaaaaaagaaaaaaaaaggugacucac

SEQ ID NO: 543886 - RNA, 64 nt, hsa
guuguuguucaaaugcaaaaaaaagaaaaaaaaagaaaaaaaaaggugacucacauuguuacac

SEQ ID NO: 543887 - RNA, 64 nt, hsa
uucuuguuuacagauuuuuuuguuuguuuuuugagaaaaaaaaauguuuacucuuccaucauuu

SEQ ID NO: 543888 - RNA, 64 nt, hsa
aaaaaaaaaaaaaauuccuuguaguuucuuagaggaaaaaaagaaaaaccccaacuuuuagcac

SEQ ID NO: 543889 - RNA, 64 nt, hsa
uuucagcucccuucccuugagaugaguuucuggggaaaaaaaagagacugguuagugaugcagu

SEQ ID NO: 543890 - RNA, 64 nt, hsa
ugaaauagcuuuacuguuucucaaguguuuuggagaaaaaaaucaacccugcaaucacuuuuug

SEQ ID NO: 543891 - RNA, 64 nt, hsa
uuuuuuaaaggaaacaaacagacaacaaaaagaagaaaaaaaaaaagaaccuccuuggaaaaau

SEQ ID NO: 543892 - RNA, 64 nt, hsa
acccccccacuaugcccucauuuuuuuaaaaaaggaaaaaaaaaagaaacuggguuccagucuu

SEQ ID NO: 543893 - RNA, 64 nt, hsa
aaaaaaauaaauaaaaauaaaaaaaauaaaaaaggaaaaaaaaaaaagaagaaacaagacaugc

SEQ ID NO: 543894 - RNA, 64 nt, hsa
cagcucuucuagaauuguuuaaacccuuaccaaggaaaaaaaagggauguuaccaacugagauc

SEQ ID NO: 543895 - RNA, 64 nt, hsa
caguaagauuccuguaagaaauacugcuuuuuaagaaaaaaaauaacaugcugaggggugaccu

SEQ ID NO: 543896 - RNA, 64 nt, hsa
acuacaguagaagaacuuacuucugaaaugaagggaaaaaaaccaccccaucguucccuacucc

SEQ ID NO: 543897 - RNA, 64 nt, hsa
cuccauuccaccugacccuguguguacaauccaggaaaaaaacaaaccccacucagaaacagag

SEQ ID NO: 543898 - RNA, 64 nt, hsa
uuuucucuuuacacuucguauguauuuuaaagaagaaaaaaaacaaaaaaaauucccuggcuau

SEQ ID NO: 543899 - RNA, 64 nt, hsa
cgucgcauaagcacucuugucaaucauggaauuggaaaaaaagauguacauuuaguuaaacaag

SEQ ID NO: 543900 - RNA, 64 nt, hsa
uuauuuuguauugaaacuuuuaaacaauacugaagaaaaaaaaacuuuuccgacaucuguucuu

SEQ ID NO: 543901 - RNA, 64 nt, hsa
uuauacaaaaaucuagaaauaauagauuuguacagaaaaaaaugauaauaaaugagaacacaaa

SEQ ID NO: 543902 - RNA, 64 nt, hsa
uuuucuuuuagaaauaauguauugugucugugcagaaaaaaaaaaaaccaaaaaggauugcuuu

SEQ ID NO: 543903 - RNA, 64 nt, hsa
ucuguauauuuuuuuaaaaaucugguaguuucuggaaaaaaaagagaaggggguuuguaguacu

SEQ ID NO: 543904 - RNA, 64 nt, hsa
aaauugauguuacuguauauaacuauggaauuuugaaaaaaaauuucaaaaagaaaaaaauaua

SEQ ID NO: 543905 - RNA, 64 nt, hsa
auaacuauggaauuuugaaaaaaaauuucaaaaagaaaaaaauauauauaauuuaaaacuacuu

SEQ ID NO: 543906 - RNA, 64 nt, hsa
auuuacacuaauuuuuuuaucuuuauugcuaccagaaaaaaaugcgaacgaaugcauugcuuug

SEQ ID NO: 543907 - RNA, 64 nt, hsa
ugcuuugauaucugguucagacuaucaucaggaagaaaaaaaaaucccacaguaccugaaaugu

SEQ ID NO: 543908 - RNA, 64 nt, hsa
cuugaaauaauugacuugucuaaaaggacaaagagaaaaaaaaaauaccucaugacugcauucu

SEQ ID NO: 543909 - RNA, 64 nt, hsa
gaguagaguguugguuuuuccauaacuacagggggaaaaaaagucauuaggcuuucccuuugug

SEQ ID NO: 543910 - RNA, 64 nt, hsa
aguaacccagcugcaauaccugucuguaauaugagaaaaaaaaaaugaaucuauuuaaucauuu

SEQ ID NO: 543911 - RNA, 64 nt, hsa
cauuucaucauugucccgggccugcauugcacuggaaaaaaaaaucgccaccuguucuuacacc

SEQ ID NO: 543912 - RNA, 64 nt, hsa
uuccuuauauuuuuuuccucaacaguuuuaaaaagaaaaaaaggucuauuuuuuuuucuccuau

SEQ ID NO: 543913 - RNA, 64 nt, hsa
aaaaagcauuauacuguggguaaugaaaagggaggaaaaaaaaagaaggaaaaggaauuauaga

SEQ ID NO: 543914 - RNA, 64 nt, hsa
gaauuugucagcuggaacucagaaacaacaacuugaaaaaaaaauaauaauuagaacauauuug

SEQ ID NO: 543915 - RNA, 64 nt, hsa
cuauuguggcagaagcgagaaaacuuuguuuauugaaaaaaaaagaaaaagaaagcaagaaaaa

SEQ ID NO: 543916 - RNA, 64 nt, hsa
uuuguuuauugaaaaaaaaagaaaaagaaagcaagaaaaaaagauacuauggggucaaguguaa

SEQ ID NO: 543917 - RNA, 64 nt, hsa
ugucaguuuugagggggacauguguuaaaucacagaaaaaaauggugccuucuucugcguuugu

SEQ ID NO: 543918 - RNA, 64 nt, hsa
aaggaaggacagaggguuuugauuuuaaaaagaagaaaaaaaaaccuuauuuuuucuuucuugg

SEQ ID NO: 543919 - RNA, 64 nt, hsa
ggagggaaaucuuucaacuuauuucugaaaaagagaaaaaaauauaaaauuucuggugcacagg

SEQ ID NO: 543920 - RNA, 64 nt, hsa
cuuuuucacucugugucuaauaauguuaaggugggaaaaaaaaaaguguggcauagcuaccugc

SEQ ID NO: 543921 - RNA, 64 nt, hsa
gcuggaagcauuuuucccuuagcaaaccauaacagaaaaaaauaagacccaauauuggcaaaga

SEQ ID NO: 543922 - RNA, 64 nt, hsa
aauucauaaaagaaaucugaauggauaaaaccaugaaaaaaaguaugcuucauuaguaauuaaa

SEQ ID NO: 543923 - RNA, 64 nt, hsa
aaauaacaaaagaggaaaaaaaaaaucccuccuggaaaaaaaaaaaaacccuggaaaauagaaa

SEQ ID NO: 543924 - RNA, 64 nt, hsa
ggcgagcaagccuuuuugaaaaauaacaaaagaggaaaaaaaaaaucccuccuggaaaaaaaaa

SEQ ID NO: 543925 - RNA, 64 nt, hsa
aaauugauaguuguucuagcagugaagagauaaagaaaaaaaaguacaaccaaaugccagucag

SEQ ID NO: 543926 - RNA, 64 nt, hsa
ggaaacauguaaugauaggcggacucccagcacagaaaaaaagguagaucugaaugcugauccc

SEQ ID NO: 543927 - RNA, 64 nt, hsa
acuagugcuuaaaaaaaaaaaagaaggaaaaauugaaaaaaauaaaaaaaaaaguuacagaaug

SEQ ID NO: 543928 - RNA, 64 nt, hsa
uuagcauugaaaaaaaaaacaaaaacaaaaaauggaaaaaaaaaaccuuguauuuuguaaauau

SEQ ID NO: 543929 - RNA, 64 nt, hsa
aagguugaaaauucugaauaacccuuuuagcauugaaaaaaaaaacaaaaacaaaaaauggaaa

SEQ ID NO: 543930 - RNA, 64 nt, hsa
aguuuucuuuuaacaugcauguugggugagaggggaaaaaaaucuaagcugucugccacauuga

SEQ ID NO: 543931 - RNA, 64 nt, hsa
uuuuuaaaaaauucauuuugcagaaagccugaaagaaaaaaaauaccccuaaauaaaacuauuu

SEQ ID NO: 543932 - RNA, 64 nt, hsa
aaacuuugcuaguuaaaaaaaaaagaaaaaaaaagaaaaaaaaucccuuucuuguaaacuuacg

SEQ ID NO: 543933 - RNA, 64 nt, hsa
aguauaauagaaacuuugcuaguuaaaaaaaaaagaaaaaaaaagaaaaaaaaucccuuucuug

SEQ ID NO: 543934 - RNA, 64 nt, hsa
aagagcugcagaguauuuauaaaacugucuuuuagaaaaaaaacaagcaagaagaccauuugac

SEQ ID NO: 543935 - RNA, 64 nt, hsa
gcacaugacuuuacauaaugacuuucuagacucugaaaaaaaugcuuuuaucauuuuugcaauu

SEQ ID NO: 543936 - RNA, 64 nt, hsa
uagagggaacuaacauuuuaggaaugcuuauucagaaaaaaauccuagaguugauucauuguuu

SEQ ID NO: 543937 - RNA, 64 nt, hsa
auacaguauaaacuaccucacuugccuuucuugggaaaaaaaaaaugaauggacuuuaacaauu

SEQ ID NO: 543938 - RNA, 64 nt, hsa
auguauguugcauuuuauccauaagaaauaaagagaaaaaaacuaaaaacauuguaugagaauu

SEQ ID NO: 543939 - RNA, 64 nt, hsa
uuuuuucaucucacaguaaagccuauuuccccaggaaaaaaauaaaugccuuugaaugaaaauu

SEQ ID NO: 543940 - RNA, 64 nt, hsa
gguauuaaagauauucugaagcucugaaaugcuagaaaaaaauuuggaauggaguauaugccug

SEQ ID NO: 543941 - RNA, 64 nt, hsa
cugguggacucccaauugacaagauugagcaauagaaaaaaauuccuuuccuuugaaugauagc

SEQ ID NO: 543942 - RNA, 64 nt, hsa
uugugacucguuggccauuauuugauuuuuguacgaaaaaaagcuuuguuauagaaaucagcau

SEQ ID NO: 543943 - RNA, 64 nt, hsa
agauuuguagugcauagguguguguuucaagaaggaaaaaaaaagacuucuguucaaaguuaac

SEQ ID NO: 543944 - RNA, 64 nt, hsa
uauuauacacuguacauuuuuuucacagcaauuggaaaaaaacaaccacuugcaaucauucaau

SEQ ID NO: 543945 - RNA, 64 nt, hsa
aagaaagggcauuuuuacuuuugaaccaaaaagagaaaaaaaaaucagaaguguugcaucuuga

SEQ ID NO: 543946 - RNA, 64 nt, hsa
cagaaauauucugagaccaaauuuacaaaaaaacgaaaaaaauaaggauugacugggcuaccuc

SEQ ID NO: 543947 - RNA, 64 nt, hsa
cuccgaaaaucaugguaaagaauacugagacaaugaaaaaaaaucaacaaaauaugcuuucugg

SEQ ID NO: 543948 - RNA, 64 nt, hsa
gcuuuuauuuuccuuggggugcugaaauugagcugaaaaaaaaaggcucuuugaauauaguuuu

SEQ ID NO: 543949 - RNA, 64 nt, hsa
augagagaaaaggaaaaaggaaucaaagguggaagaaaaaaaaagccaaauucuguuuacggug

SEQ ID NO: 543950 - RNA, 64 nt, hsa
cuagagcgauuucagcugauagaaaaacaaaaaugaaaaaaaaaacacaaaaaacaaaaaacau

SEQ ID NO: 543951 - RNA, 64 nt, hsa
uuccauuuugaggaauggggaaggcuauucuaaagaaaaaaaugggauuuguuuucucggcaga

SEQ ID NO: 543952 - RNA, 64 nt, hsa
cuaagaauaucaaguauuucucuggcucuugacagaaaaaaaucaguugacuuaacccuuugcu

SEQ ID NO: 543953 - RNA, 64 nt, hsa
gaggacuguaauugcauuucugugccuuucacuugaaaaaaaaaaaagaagaaaaaaaggcuua

SEQ ID NO: 543954 - RNA, 64 nt, hsa
uuucugugccuuucacuugaaaaaaaaaaaagaagaaaaaaaggcuuaaaggcauuucauucag

SEQ ID NO: 543955 - RNA, 64 nt, hsa
gcugaccuuucuauagcgugcugcauugguaaaugaaaaaaaauggggcaaacguuggaguccu

SEQ ID NO: 543956 - RNA, 64 nt, hsa
aucuaaagaaucauugucuuucagagacucauaggaaaaaaaaacuaggaaaagugucaccgca

SEQ ID NO: 543957 - RNA, 64 nt, hsa
acaaagcaagcguaagauugaggcaugaaguucagaaaaaaaaguguuacaacacacagggaag

SEQ ID NO: 543958 - RNA, 64 nt, hsa
auuugcagucuacauuuuaaagccaauuuauuuagaaaaaaaaauuugagcuuuaauucuuuaa

SEQ ID NO: 543959 - RNA, 64 nt, hsa
uuugccuugaauggaaccuacuaaaaagagagaugaaaaaaaaucagcgagguugauguagaua

SEQ ID NO: 543960 - RNA, 64 nt, hsa
auugaaaaaaaaaaagcacugaaaaccaauuacugaaaaaaaauugacagcuaguguuuuuuac

SEQ ID NO: 543961 - RNA, 64 nt, hsa
cuccuuucuaauugcaucaccuucucaucagauugaaaaaaaaaaagcacugaaaaccaauuac

SEQ ID NO: 543962 - RNA, 64 nt, hsa
aggacuccugaaaaaaaaccugagauuuauuaaagaaaaaaauguauuuuauguuauauauaaa

SEQ ID NO: 543963 - RNA, 64 nt, hsa
agcauuguagugcuuugagagagaaaggacuccugaaaaaaaaccugagauuuauuaaagaaaa

SEQ ID NO: 543964 - RNA, 64 nt, hsa
aaaggcugaugaugguauaaaguuugcucauuaagaaaaaaagacaaggcugauuuugaagaga

SEQ ID NO: 543965 - RNA, 64 nt, hsa
cugcuguaauauuuuuguaaaaaaaaaaaaaaaggaaaaaaaagaccagcuaaaauuuucgacu

SEQ ID NO: 543966 - RNA, 64 nt, hsa
uugaucauuaccuguaaaugaaagaccuuaauaggaaaaaaagaguaaagcucagugugaaugc

SEQ ID NO: 543967 - RNA, 64 nt, hsa
aucauaaaauuuucauauaugccuagauaauggggaaaaaaagucuugugauugacuuucgcaa

SEQ ID NO: 543968 - RNA, 64 nt, hsa
guuuuguuuuguuuucauuuuuccaaaaaaaaaagaaaaaaaaauagaaaaaaaaggaguaaaa

SEQ ID NO: 543969 - RNA, 64 nt, hsa
uuucauuuuuccaaaaaaaaaagaaaaaaaaauagaaaaaaaaggaguaaaaggggcggguuug

SEQ ID NO: 543970 - RNA, 64 nt, hsa
cuggcgugaguuucauguaugaaaacauaaaauugaaaaaaaaaaaaaaaccuacacgagcacc

SEQ ID NO: 543971 - RNA, 64 nt, hsa
agggcaacaggagauguggggacguguuaggagagaaaaaaaaaaaaacaaaaauauauauggg

SEQ ID NO: 543972 - RNA, 64 nt, hsa
agaguuuuccuaucuuuguauguuaagagauuaagaaaaaaaaauucuauuuuuguuguaaugu

SEQ ID NO: 543973 - RNA, 64 nt, hsa
ccagccugggcaacaagaguggcacuccaucucagaaaaaaaaaaaaaagauaauucauacuga

SEQ ID NO: 543974 - RNA, 64 nt, hsa
ucacaccuuauugcacaggagagcauuuauacuugaaaaaaauuguacaaauauaaagaccaug

SEQ ID NO: 543975 - RNA, 64 nt, hsa
ucacagguuagucagucuaagaauauuuauacaggaaaaaaaucaccccaaauaaaauaaauau

SEQ ID NO: 543976 - RNA, 64 nt, hsa
uuuuggaaaauucuuacuugugaauguuaaaaaugaaaaaaaaaucauuuauuauauuuugccu

SEQ ID NO: 543977 - RNA, 64 nt, hsa
aaacagcuuucccucaucauaauguagauaaaaagaaaaaaaggauaugguuaccuguaaucuu

SEQ ID NO: 543978 - RNA, 64 nt, hsa
uugggcucugucucuuucuacccugcguuaagcggaaaaaaaaaauucugacaguguuuuucuu

SEQ ID NO: 543979 - RNA, 64 nt, hsa
auuuguaaggcuuagaugagauaguguuuuuuuagaaaaaaacuuuaucuuaccauuaaguaaa

SEQ ID NO: 543980 - RNA, 64 nt, hsa
ucaaaagaauacauacauguggcaauaagcauaugaaaaaaaugguuaauaucgcuaaucauua

SEQ ID NO: 543981 - RNA, 64 nt, hsa
uguacacauacuccuugaaccuaaaauaaaacaugaaaaaaagcaaauuucacaccuuguaaaa

SEQ ID NO: 543982 - RNA, 64 nt, hsa
gaaaaggugaaaguucucaacuuaaaaaagaaaagaaaaaaaucauauacugagguugcuaaga

SEQ ID NO: 543983 - RNA, 64 nt, hsa
aaaauguaguauauaguaucguauauauguacaggaaaaaaacguacuaucugugguuucaggu

SEQ ID NO: 543984 - RNA, 64 nt, hsa
acucucauagaaaauauaaagaaucccucaaguugaaaaaaaaaucaauuuaaaggggagaaaa

SEQ ID NO: 543985 - RNA, 64 nt, hsa
agaaaaaaaaaagguuuuacaaaaugaaaggaaggaaaaaaaaaaaggcaaccaaccacauuag

SEQ ID NO: 543986 - RNA, 64 nt, hsa
aauuccaaugucacaaaagcaauaaaacaaacuagaaaaaaaaaagguuuuacaaaaugaaagg

SEQ ID NO: 543987 - RNA, 64 nt, hsa
acagaaacccgagaaagagagagacagagagagagaaaaaaaaucacccaccacccccccaaaa

SEQ ID NO: 543988 - RNA, 64 nt, hsa
gaaaacacacagaagagauuuaaaaaaaaaaaaggaaaaaaaaaaaagacauaaacuggcacca

SEQ ID NO: 543989 - RNA, 64 nt, hsa
ucaaaaaagcgacaaaaaaacacaaacagaagaggaaaaaaaagcaacaaaaaaagaaaacaca

SEQ ID NO: 543990 - RNA, 64 nt, hsa
cgucuguggagcuucugcugcaaggaacaaaaaagaaaaaaaucaaaaaagcgacaaaaaaaca

SEQ ID NO: 543991 - RNA, 64 nt, hsa
ucguggagaauuuuuacuggggauucuugaacuugaaaaaaaaaaacacaaaaaaagacaaaaa

SEQ ID NO: 543992 - RNA, 64 nt, hsa
gagcaggcaguggggcuggaagcagaaacaaaaugaaaaaaaaaggggggugggaggggaagaa

SEQ ID NO: 543993 - RNA, 64 nt, hsa
aaaacaaaaggcucauaacaacaagaacguuucagaaaaaaacaaaaaguuuuaaaaaaauugu

SEQ ID NO: 543994 - RNA, 64 nt, hsa
gaaaaaaaaaagacaaaaaaaaaaaaaaagaaaagaaaaaaaaucucaucacuugaagccaccg

SEQ ID NO: 543995 - RNA, 64 nt, hsa
cccauugcuguaaauauuucaacgaaauggaaaagaaaaaaaaaagacaaaaaaaaaaaaaaag

SEQ ID NO: 543996 - RNA, 64 nt, hsa
gggaagcuuaucuugaaaaagcaucacagaaguagaaaaaaaugucgaaagcauuauaacugua

SEQ ID NO: 543997 - RNA, 64 nt, hsa
guauaucgcgauaagacagugcacagguggaggggaaaaaaagggggagggggaagcuuaucuu

SEQ ID NO: 543998 - RNA, 64 nt, hsa
agauacuguagugauucaaauaaguuuucuauuugaaaaaaaaaaucacuugauuguauccuug

SEQ ID NO: 543999 - RNA, 64 nt, hsa
uggauuggacguugugacucuugccuuuuaagaagaaaaaaaagauaggacaaaguauuugaag

SEQ ID NO: 544000 - RNA, 64 nt, hsa
ucuuuauuucugucauucaaaugggugauauccugaaaaaaaaaaaaaaaaaaaaacugggaca

SEQ ID NO: 544001 - RNA, 64 nt, hsa
uuuucuggggcuccucacauagcuacccaaaagagaaaaaaaauuaagacaagccuggcaacac

SEQ ID NO: 544002 - RNA, 64 nt, hsa
agacaaauugaagaacuggugggauuuuuuucaagaaaaaaaauuauauaauaacuauaauccc

SEQ ID NO: 544003 - RNA, 64 nt, hsa
agcagcaagacacgcacagucaaccauuuuccgagaaaaaaagaaaauuccccacuuggaaaga

SEQ ID NO: 544004 - RNA, 64 nt, hsa
uggaaucuacuuucauuguuaacacugagcuaaagaaaaaaagccguguguuuuaugaaugacc

SEQ ID NO: 544005 - RNA, 64 nt, hsa
uuuaugcacugauuuaaaacaaaccaaaaaaaaagaaaaaaacaaaaaaaaaaaucccuccuuu

SEQ ID NO: 544006 - RNA, 64 nt, hsa
aaaucuugggcaagaugaccuacuaguuuuccuugaaaaaaaguugcuuuguuauuaauauugu

SEQ ID NO: 544007 - RNA, 64 nt, hsa
cauaauugcaauauuucccccuuacuacuucuuggaaaaaaauuacaaaaugaaguuuuauaga

SEQ ID NO: 544008 - RNA, 64 nt, hsa
uaauaggaagucaauauaauauagauuauccccagaaaaaaaucaacaaucuucaaacacugcc

SEQ ID NO: 544009 - RNA, 64 nt, hsa
uguuuuguuuuuguugacagguugaaagcauguugaaaaaaauaaauauuuaagaaaagcacac

SEQ ID NO: 544010 - RNA, 64 nt, hsa
agggagaagagaaggcauuaguaagaaaaaaauagaaaaaaauaugaacagacucagcuuuggg

SEQ ID NO: 544011 - RNA, 64 nt, hsa
ccacaggggcagggagaagagaaggcauuaguaagaaaaaaauagaaaaaaauaugaacagacu

SEQ ID NO: 544012 - RNA, 64 nt, hsa
aauguaagggucuguuguaaaugaccaagaaaaagaaaaaaaaagcauucccaaucuugacacg

SEQ ID NO: 544013 - RNA, 64 nt, hsa
agaaccagaggguuguacuauuguuuaaaaacaggaaaaaaaauaauguaagggucuguuguaa

SEQ ID NO: 544014 - RNA, 64 nt, hsa
ccauggcauaugacaaagaccaaugagggaccaggaaaaaaagugauguccccuuucccugcca

SEQ ID NO: 544015 - RNA, 64 nt, hsa
cucccuuccuaaaaucuggggggucggggggaaagaaaaaaaaagccuuaguggccugguuguu

SEQ ID NO: 544016 - RNA, 64 nt, hsa
accuuuuaaguacuaauuuucuuuuuaucaaguagaaaaaaaaauguauuugcccuaaauccuu

SEQ ID NO: 544017 - RNA, 64 nt, hsa
ugagcaucucaaagaagucuguuaaaucaugacugaaaaaaaucaaucagauguaucuucaaaa

SEQ ID NO: 544018 - RNA, 64 nt, hsa
gugccaagucagaaaguguguauuaccuuguaaagaaaaaaauuacaaagcagggguuuagagu

SEQ ID NO: 544019 - RNA, 64 nt, hsa
uuaaaaaaaaaaguuguuuucugaacuagaagaggaaaaaaauggcaauuuuugagugccaagu

SEQ ID NO: 544020 - RNA, 64 nt, hsa
cguuucuuuguugagcugugucuugaaggcaaaagaaaaaaaauuucuacaguagucuuucuug

SEQ ID NO: 544021 - RNA, 64 nt, hsa
agcuaagagagcuugcaaaaaaaaaaagaaaaaagaaaaaaaaaaaccacguuucuuuguugag

SEQ ID NO: 544022 - RNA, 64 nt, hsa
agcuacugggaauauuuuuguagagcugcauugugaaaaaaagauggucuuaccugaaucuuag

SEQ ID NO: 544023 - RNA, 64 nt, hsa
ugcauguggacacucagucacauuaacaacuugggaaaaaaauggcaauguuacggugaauucu

SEQ ID NO: 544024 - RNA, 64 nt, hsa
ccaaggguagauguaguugcuuaguagcauuuuggaaaaaaaagaaaaaaagguuugguuuggu

SEQ ID NO: 544025 - RNA, 64 nt, hsa
gauguaguugcuuaguagcauuuuggaaaaaaaagaaaaaaagguuugguuugguuuugugacg

SEQ ID NO: 544026 - RNA, 64 nt, hsa
aauauaugcuuacauuuuucacuuuugcuaaaaagaaaaaaaaaagguguuuauuuuuaacucu

SEQ ID NO: 544027 - RNA, 64 nt, hsa
gaacuugagaucuguauaaauaagagcaugauuugaaaaaaagcaugguauaauugaaacuuuu

SEQ ID NO: 544028 - RNA, 64 nt, hsa
uggaucagaauaaagguuauucuaacuguggggagaaaaaaaaaauuguaucaaguuccacagg

SEQ ID NO: 544029 - RNA, 64 nt, hsa
gggcuaggugaagaaaguuucaguauugauccuggaaaaaaagaagaucuaaguaggaugggag

SEQ ID NO: 544030 - RNA, 64 nt, hsa
auaacauauuuauuuuuauacauuuauuucuaaugaaaaaaacuuuuaaauuauaucgcuuuug

SEQ ID NO: 544031 - RNA, 64 nt, hsa
auguauuuauucaagugcauuaaagucuacaauggaaaaaaagcagugaagcauuagaugcugg

SEQ ID NO: 544032 - RNA, 64 nt, hsa
caagggcagaaagcaaaccuaguuaaauaggugagaaaaaaaauaauaaucccagugccauuug

SEQ ID NO: 544033 - RNA, 64 nt, hsa
aaaaacuaguuuccuuguguuggaaauuuaaaaggaaaaaaaucguauuucacuguguuuucaa

SEQ ID NO: 544034 - RNA, 64 nt, hsa
uauuuguguuauucuggauguauaaaaaucaauggaaaaaaauaaacuuucaaauugaaaugac

SEQ ID NO: 544035 - RNA, 64 nt, hsa
aggacuuuuucuuagguuugcuaaauacuguagggaaaaaaaugcuucuuucuacuuuguuuau

SEQ ID NO: 544036 - RNA, 64 nt, hsa
gccaaaguuaaauguaucacauugaagaaggcuagaaaaaaagaaugaguaaugugaucgcuug

SEQ ID NO: 544037 - RNA, 64 nt, hsa
guaagaaggcagggcaggggggcuuuuuacaggagaaaaaaaaaugacuuauaagagaaagagc

SEQ ID NO: 544038 - RNA, 64 nt, hsa
ugacuuauaagagaaagagccuggaguauuuuuggaaaaaaaaauaauauuuuuauguuaaaac

SEQ ID NO: 544039 - RNA, 64 nt, hsa
guuuuuuaaccuuuuguuccgccauuuaaaaaaagaaaaaaaaaaagcuuauguuucuugucaa

SEQ ID NO: 544040 - RNA, 64 nt, hsa
cccgccaccuguacucacccucacgcucuuugaagaaaaaaaaaaaaaucaccuuguguguugu

SEQ ID NO: 544041 - RNA, 64 nt, hsa
agggucauggggguggguuuccuggcaccuacaugaaaaaaaagacaaguuauaugggugauga

SEQ ID NO: 544042 - RNA, 64 nt, hsa
cgugguuugaauucuggcuacauguuuuaaguaagaaaaaaaaagacguauuuuugcuuacuca

SEQ ID NO: 544043 - RNA, 64 nt, hsa
cuugaaauuacuugaauuuucuugucuuaaaacugaaaaaaaaauguaguuacacguuaaaauc

SEQ ID NO: 544044 - RNA, 64 nt, hsa
uaaucugauugcuguuguuuuguuuguuuggaaagaaaaaaaaugucuggcuucuucuacuauu

SEQ ID NO: 544045 - RNA, 64 nt, hsa
caggacucucacaaagcugaugagcuguacuucagaaaaaaauaauaauuuccauguuuuguau

SEQ ID NO: 544046 - RNA, 64 nt, hsa
ucaucugucuuuucccccuucagaauuuuccuuggaaaaaaaauacuagccuagcuggucauuu

SEQ ID NO: 544047 - RNA, 64 nt, hsa
ucuguugccauuuguguaaauacuagucuuuuuggaaaaaaaauaauguaaagauguuuuguau

SEQ ID NO: 544048 - RNA, 64 nt, hsa
aacucugaauuauuuucuuguugcuuuuuucuuagaaaaaaaugagaacuaaaaaaaaaaaauu

SEQ ID NO: 544049 - RNA, 64 nt, hsa
gacaguuuccuucuggaguuccaaaugcaauauagaaaaaaaaacccugugacucuggauuuua

SEQ ID NO: 544050 - RNA, 64 nt, hsa
aagacuccuaccuugagaucuuagucuagguaaagaaaaaaaaaaaaaggucaugaaacacaaa

SEQ ID NO: 544051 - RNA, 64 nt, hsa
agccugggugacagagugagauccugucucugaagaaaaaaaaaaccugccuggcaagguccuu

SEQ ID NO: 544052 - RNA, 64 nt, hsa
aacaccuccaccagggggaaggcuggcacaaggagaaaaaaaaagcaagcaucagcgaauagua

SEQ ID NO: 544053 - RNA, 64 nt, hsa
aagagaaaaaagaaaaaaaaugagaaaaaaguaagaaaaaaaaaaauccuguccuaggcuuuua

SEQ ID NO: 544054 - RNA, 64 nt, hsa
aaauauacuugcuaucuauaaaaaagagaaaaaagaaaaaaaaugagaaaaaaguaagaaaaaa

SEQ ID NO: 544055 - RNA, 64 nt, hsa
ugaguuuaaacaaaaaccacaaacagacaaacaagaaaaaaagcuuuuauugguguuuucacuu

SEQ ID NO: 544056 - RNA, 64 nt, hsa
uccucaaguuacuuuccuucauuuucuuaaaaaagaaaaaaaauuauuaaauguuucucacaua

SEQ ID NO: 544057 - RNA, 64 nt, hsa
ucaacuuuuuaguuuuguuccuucaaaguugaaggaaaaaaaguuugguuuuauaaaauucaug

SEQ ID NO: 544058 - RNA, 64 nt, hsa
uuuuguauaaaaauuuaaauugaauuaaaagaaggaaaaaaaaagcccaaacuuaaccucugag

SEQ ID NO: 544059 - RNA, 64 nt, hsa
ugaauguuuaguuuuguuuacccaagguugaauugaaaaaaaaaaacagucaauauggauuuag

SEQ ID NO: 544060 - RNA, 64 nt, hsa
aggucaguucaggaaagcuuaagcaucgaaaaaagaaaaaaagccaugauguacccuccgagaa

SEQ ID NO: 544061 - RNA, 64 nt, hsa
cuuucuaucguucucucuuugcauggauuucuuugaaaaaaaauaaauugcucaaauaaaaaug

SEQ ID NO: 544062 - RNA, 64 nt, hsa
gugguagcauauagauuguccuuuugcaaagaaagaaaaaaaaccaucaaguugugccaaauua

SEQ ID NO: 544063 - RNA, 64 nt, hsa
ucaauguaaucacccuauuugugacagagaaagggaaaaaaauauaauaagaucaucuaccuau

SEQ ID NO: 544064 - RNA, 64 nt, hsa
aaaguguuaacuuacggguauuuuugugggaauagaaaaaaauuguuuauuuuuuauucuucug

SEQ ID NO: 544065 - RNA, 64 nt, hsa
gauuuagauacuucucccugagguggggauaaaagaaaaaaaaaaacaacuucuuuuuuucuuc

SEQ ID NO: 544066 - RNA, 64 nt, hsa
ucccucuguuauugucggcaggcggugagggguagaaaaaaaacaaacaaacaaacagaaaaaa

SEQ ID NO: 544067 - RNA, 64 nt, hsa
ggugagggguagaaaaaaaacaaacaaacaaacagaaaaaaaaaccaaaaaaaaccacccugag

SEQ ID NO: 544068 - RNA, 64 nt, hsa
ugacagaugagaggucugaagccuuccuggccacaggcaucacuuucuccuccuccucaugccc

SEQ ID NO: 544069 - RNA, 64 nt, hsa
cuccuguccggcccuggguuucuagcggugccugaggcaucacucuggcccauugacagaugag

SEQ ID NO: 544070 - RNA, 64 nt, hsa
ugcagcugugaugguuucagagcucagacugaucaggcaucaagcuacccucaagaguuucugg

SEQ ID NO: 544071 - RNA, 64 nt, hsa
ugaguauaaauccugugcauagauuccucuagaaaggcaucaaaaggcucaacagacugaaugg

SEQ ID NO: 544072 - RNA, 64 nt, hsa
ccaccaaaaaccuucuuagcaggacagcugugagaggcaucagaaccucacguucggacugccu

SEQ ID NO: 544073 - RNA, 64 nt, hsa
cuguccccugagaucugaaggcuaccuugggaagaggcaucagccaucuugcuugagaaccacc

SEQ ID NO: 544074 - RNA, 64 nt, hsa
uacaaauguaacgugcaugcuuaagcuuuuacccaggcaucaaaaccggaacaucacaggguuu

SEQ ID NO: 544075 - RNA, 64 nt, hsa
gugauagagauuuuccgcaggccaaagucucacuaggcaucaaaaacuuuuuugaugaaaccau

SEQ ID NO: 544076 - RNA, 61 nt, hsa
gaacaaauugaaaaucugaagaccgaugcugcaagcagaccauaugcagaugugcgaguua

SEQ ID NO: 544077 - RNA, 61 nt, hsa
uuugaagcaggauauggcaacggaacauccucaagcagagguaguaaaacaggaaagcagc

SEQ ID NO: 544078 - RNA, 61 nt, hsa
gaaugaagagaaugguggcagaaugagugagcaagcagauugccccagaggggccgguaau

SEQ ID NO: 544079 - RNA, 61 nt, hsa
uuuauuuugauuuuauuaaaugggaagaaagcaagcagaaauaguaaaauucaguagguuu

SEQ ID NO: 544080 - RNA, 61 nt, hsa
agugagaaguuaaaauacccuuaaggagguucaagcagagugagaaguuaaaauacccuua

SEQ ID NO: 544081 - RNA, 61 nt, hsa
cugaauccuugcgucccgaaggacggagguucaagcagagugagaaguuaaaauacccuua

SEQ ID NO: 544082 - RNA, 61 nt, hsa
uggggcucugggggaaugcugggaaaaugggcaagcagagugcacagcccucguucugcca

SEQ ID NO: 544083 - RNA, 61 nt, hsa
uggacuuucaacuggcuuuccuuaggucaggcaagcagacagcuccccacugaagaggucu

SEQ ID NO: 544084 - RNA, 61 nt, hsa
cugcucuggccaaugggacugugcaagcacccaagcagaagggagacugagugccucagcc

SEQ ID NO: 544085 - RNA, 61 nt, hsa
cccuuucucucccaagcucuuugcugaagagcaagcagagggucccaaccgccugcuguac

SEQ ID NO: 544086 - RNA, 61 nt, hsa
agcagggcccuccgagguggagcagcagcuacaagcagaggcugaacaccugcggaaggag

SEQ ID NO: 544087 - RNA, 61 nt, hsa
agcagggcccuccgagguggaacagcagcuacaagcagaggcugaacaccugcggaaggag

SEQ ID NO: 544088 - RNA, 61 nt, hsa
cccgggagaaagcccaggccagccugcuggacaagcagagaccaugagaaggagaguucag

SEQ ID NO: 544089 - RNA, 61 nt, hsa
auuuuccuauuuuaauugcuuuagggaagagcaagcagagucaugaccagggacacagcug

SEQ ID NO: 544090 - RNA, 61 nt, hsa
uccagcaaagugauucccugcacaccagagacaagcagaguaacaggaucagugggucuaa

SEQ ID NO: 544091 - RNA, 61 nt, hsa
agccgcgggccaggaggcugccacacggaagcaagcagaugaacuaauuucauuucaaggc

SEQ ID NO: 544092 - RNA, 61 nt, hsa
uccacccucagcucuuccuugccugguuuaucaagcagagcugaggccccacguuuccaac

SEQ ID NO: 544093 - RNA, 61 nt, hsa
cuugucucucaacguauuggcuaugacgcagcaagcagaaugaauuuggacucaguuacag

SEQ ID NO: 544094 - RNA, 61 nt, hsa
cacucaguggaugacuauggagaagagccugcaagcagagaccaacuacccuuaggucuac

SEQ ID NO: 544095 - RNA, 61 nt, hsa
guuggccaaugggacauuaacaaguaugauacaagcagaggcuugagaagugccugcacaa

SEQ ID NO: 544096 - RNA, 64 nt, hsa
cucuuguaccaauuuuagucaggcagaaaaugguaaacaugagggugcucuugugacuuaauuu

SEQ ID NO: 544097 - RNA, 64 nt, hsa
guggugguaguggaaggggauaauuguaaauaggaaacaugaauguucauuuuuuucuuuaaag

SEQ ID NO: 544098 - RNA, 63 nt, hsa
uguuuucuucaaacagaugaaaacuuuauucucaaacaugacagagcguuccuuuuaucaaug

SEQ ID NO: 544099 - RNA, 64 nt, hsa
aacugagaaauccagugaagaggaccuuucagguaaacaugauacagugacuguuucaucagau

SEQ ID NO: 544100 - RNA, 64 nt, hsa
aucacaaggauugaaacuaugcaguguguucuccaaacaugauggaacgaaauuagaaaucaau

SEQ ID NO: 544101 - RNA, 64 nt, hsa
uccuccucucccuuccuucugccaugggaggaugaaacaugaaggcccuggccagguguggccc

SEQ ID NO: 544102 - RNA, 64 nt, hsa
cagaauuacuugaauuucuugaaucccaacaagaaaacaugauuaaaaaaguauguuauuguuu

SEQ ID NO: 544103 - RNA, 64 nt, hsa
ccguucuucagucuggagugccuucaaagaucagaaacaugauuuguucauuucugagucacaa

SEQ ID NO: 544104 - RNA, 64 nt, hsa
uaaucuggauaaugacuauuaguccaaugcuaagaaacaugaucuuugcucauuaaagagcuaa

SEQ ID NO: 544105 - RNA, 64 nt, hsa
gaaaaaaaagaaaaaaaggaaaagaagaacaaagaaacaugacugucucaaagaguaauuuuuc

SEQ ID NO: 544106 - RNA, 64 nt, hsa
gauaacucauagucuacguaacuucagagucuuuaaacaugacaauccacauugucauauguga

SEQ ID NO: 544107 - RNA, 64 nt, hsa
auuaaagcuagguguauagaaucaugcuaaaagaaaacaugauaacucauagucuacguaacuu

SEQ ID NO: 544108 - RNA, 64 nt, hsa
cuucuuugauuguagaaaagcagacacuucucugaaacaugaccuuauucuuccaaacaguauc

SEQ ID NO: 544109 - RNA, 64 nt, hsa
acacuuuucaaaagaagaccuacaauuggccaacaaacaugaaaaaaugcucaguaucacuaau

SEQ ID NO: 544110 - RNA, 64 nt, hsa
uucaguucuuguguuuuggaguccuagucauauuaaacaugagagauacucuuaauuucaguag

SEQ ID NO: 544111 - RNA, 64 nt, hsa
uaauuucauuucuugcuuugccaccuaagcaguaaaacaugauauugaccacuuggagaacuca

SEQ ID NO: 544112 - RNA, 64 nt, hsa
uuuucuuuauaauaaaauauuugagccacuguauaaacaugagggugcacaugucaaguacuua

SEQ ID NO: 544113 - RNA, 64 nt, hsa
uggauucaaauuuauuuccaauguuucaagcgggaaacaugacucuuuauugucuguaaaucua

SEQ ID NO: 544114 - RNA, 64 nt, hsa
caaauuuuaauuauaaucucuucuuauacagauaaaacaugacuccuacaaggccccaagguuu

SEQ ID NO: 544115 - RNA, 64 nt, hsa
aaagugcaauauguauagcauacuuugacauuuuaaacaugauaguccauaaccauuuugaaau

SEQ ID NO: 544116 - RNA, 64 nt, hsa
gauaauaaaaauuguagcuuuuuauuaagccaggaaacaugaagcauaauuuguuuaaaauucu

SEQ ID NO: 544117 - RNA, 64 nt, hsa
gccuagguuuccaaaucuugugauucuuuaggagaaacaugaaaccuggauuucgugugaaaug

SEQ ID NO: 544118 - RNA, 64 nt, hsa
gucugugggcugccaguuuauuacuuuugucuuaaaacaugaucauuguucucucacgguaucc

SEQ ID NO: 544119 - RNA, 64 nt, hsa
uacugauguagccacaacuuuuuagaggccuauuaaacaugacguuauccaauugcaggucaac

SEQ ID NO: 544120 - RNA, 64 nt, hsa
auaccacugauguucaucaaaaguaugcgaucuaaaacaugacuaucauuuccugacaaugggg

SEQ ID NO: 544121 - RNA, 64 nt, hsa
acuugauccucaacauauacuauaauugcaaaggaaacaugaggccaucuucccuuguucacug

SEQ ID NO: 544122 - RNA, 64 nt, hsa
ucaacaguauugccagguuccuaaaauugucuaaaaacaugauuuggcuuccauuuuugcagcu

SEQ ID NO: 544123 - RNA, 64 nt, hsa
cccauugcuuucuccuuuccccgacgcacagaauaaacaugaagcucagcaguagaagcguaau

SEQ ID NO: 544124 - RNA, 64 nt, hsa
aacaguuugcggugcuuagaggccucuauaauuuaaacaugaacauauauuacaccaugauuua

SEQ ID NO: 544125 - RNA, 64 nt, hsa
gguuccaaauauucacugcuuuguaaaaaugaacaaacaugagacuguaagaaacaguuugcgg

SEQ ID NO: 544126 - RNA, 64 nt, hsa
ugggaaagccuucaguuaccacuguacugcucaaaaacaugagaggaaucacacugcacagaaa

SEQ ID NO: 544127 - RNA, 64 nt, hsa
uggaaaagcauuccgauaccaccaaucugcucaaaaacaugaaaaggcucauacuggagagaaa

SEQ ID NO: 544128 - RNA, 64 nt, hsa
cagguagaucccagaacagacaaaauuuuccuaaaaacaugagaguccaggcugucugagucag

SEQ ID NO: 544129 - RNA, 64 nt, hsa
agccagucaugcuaaaugccauauacucacacugaaacaugaggaagcagguagaucccagaac

SEQ ID NO: 544130 - RNA, 64 nt, hsa
accccacuccuaggcugccuuggaggguacaagauccacugaggguggccaccacagccuuggc

SEQ ID NO: 544131 - RNA, 64 nt, hsa
uaugugccgaguuaccccacuugccuugggcguguccacugagccuuccccagccagucuuguu

SEQ ID NO: 544132 - RNA, 64 nt, hsa
ugguucagugccuuccucucucuaccagucuauuuccacugaacaaaaccuacgcacauaccuu

SEQ ID NO: 544133 - RNA, 64 nt, hsa
ugauucacugccuuccucucucuaccagucuauuuccacugaacaaaaccuacacacauaccuu

SEQ ID NO: 544134 - RNA, 64 nt, hsa
gcuccaaguauucuaaaugugucccaucaugcuuuccacugacccaaaauucaccacagcauuu

SEQ ID NO: 544135 - RNA, 64 nt, hsa
auuaaguuccacauagcaauuacaguaugccaguuccacugaagacaugaaaucuuuagagguu

SEQ ID NO: 544136 - RNA, 64 nt, hsa
ucuccagcugucaccucccccaggagaucaggauuccacugacguccugggcagccagugaauu

SEQ ID NO: 544137 - RNA, 64 nt, hsa
ucuguuccaccucuccugcgauaguccugggugcuccacugauuggaggauagagccagcuguc

SEQ ID NO: 544138 - RNA, 64 nt, hsa
guggcuagugcgauuucacagucuacugccuguuuccacugaaaacauuuuugucauauucuug

SEQ ID NO: 544139 - RNA, 64 nt, hsa
aaaguuauuaggagagauacucucuccuguuuucuccacugaacgagacucaucuugcucuucu

SEQ ID NO: 544140 - RNA, 64 nt, hsa
gaccgggaguccaaaccaccuuggugcucugaaguccacugacucaucacaccuuucuuagccu

SEQ ID NO: 544141 - RNA, 64 nt, hsa
guagaaggggcuggucugcugggcagggcuuacauccacugaguucuaagauuccuuuccugau

SEQ ID NO: 544142 - RNA, 64 nt, hsa
acuuccccuccugggucaccucugauggcugcuguccacugagaacgugggcaguguccaaauu

SEQ ID NO: 544143 - RNA, 64 nt, hsa
cuuuucagagaacuguaaaccgaggcugacgugcuccacugacugugccgaggggcgggggcag

SEQ ID NO: 544144 - RNA, 64 nt, hsa; identical to SEQ ID NO: 270536

SEQ ID NO: 544145 - RNA, 64 nt, hsa; identical to SEQ ID NO: 270537

SEQ ID NO: 544146 - RNA, 64 nt, hsa; identical to SEQ ID NO: 270538

SEQ ID NO: 544147 - RNA, 64 nt, hsa; identical to SEQ ID NO: 270539

SEQ ID NO: 544148 - RNA, 64 nt, hsa; identical to SEQ ID NO: 270540

SEQ ID NO: 544149 - RNA, 64 nt, hsa; identical to SEQ ID NO: 270541

SEQ ID NO: 544150 - RNA, 64 nt, hsa; identical to SEQ ID NO: 270542

SEQ ID NO: 544151 - RNA, 64 nt, hsa; identical to SEQ ID NO: 270543

SEQ ID NO: 544152 - RNA, 64 nt, hsa; identical to SEQ ID NO: 270544

SEQ ID NO: 544153 - RNA, 64 nt, hsa; identical to SEQ ID NO: 270545

SEQ ID NO: 544154 - RNA, 64 nt, hsa; identical to SEQ ID NO: 270546

SEQ ID NO: 544155 - RNA, 64 nt, hsa; identical to SEQ ID NO: 270547

SEQ ID NO: 544156 - RNA, 64 nt, hsa; identical to SEQ ID NO: 270548

SEQ ID NO: 544157 - RNA, 64 nt, hsa; identical to SEQ ID NO: 270549

SEQ ID NO: 544158 - RNA, 64 nt, hsa
accagccaguagauugucugucagugaccuucuguaguaauaaaguuuuugccacuguaaauaa

SEQ ID NO: 544159 - RNA, 64 nt, hsa
auuuguaauuaacucugaauuuguuuuuaaucauuaguaauauuucaguuggguaucuuuuuaa

SEQ ID NO: 544160 - RNA, 64 nt, hsa
uauuauuggguuacuacuaacccugucccaagaauaguaauaucaccucuaguuauaagccagc

SEQ ID NO: 544161 - RNA, 64 nt, hsa
ugaaauguaaaaugugaaaacuuuagaucauuuguaguaauaaauauuuuuaacuucauucaua

SEQ ID NO: 544162 - RNA, 64 nt, hsa
auguuucuucaugaaaaguauguuguuguuuugauaguaauaauaauaaauguaggcucagcuc

SEQ ID NO: 544163 - RNA, 64 nt, hsa
uggugauauuuuccuuacaagauggguaccaguauaguaauaucuguauacuaacuagggcuuu

SEQ ID NO: 544164 - RNA, 64 nt, hsa
ugcacuuuuuugagaugcagauauagcaaaggauuaguaauauagccugaaaacaaaugggagc

SEQ ID NO: 544165 - RNA, 64 nt, hsa
uuugggauauuuuaaaaucuacuaaaaugaggauuaguaauauaaugaccugcuaauauauuuu

SEQ ID NO: 544166 - RNA, 64 nt, hsa
uguguauaucuaaauacaaaugcaaaugaagcauuaguaauacuuaaauaauuuuacugugcua

SEQ ID NO: 544167 - RNA, 64 nt, hsa
aaaacaguccuuaaaauaguuugacucuuccuguuaguaauauauuaaucuuucauuuaaccag

SEQ ID NO: 544168 - RNA, 64 nt, hsa
ugagcauucauuuaaggauaaauaaaaaauaaaguaguaauaaagaauaaaauacuuuacuaaa

SEQ ID NO: 544169 - RNA, 64 nt, hsa
ucuuaaauaugugcuauuagcauuguuuuuagacuaguaauaugcagaaaacaguuuuaggccu

SEQ ID NO: 544170 - RNA, 64 nt, hsa
cacauaaagacaaaagcaucuguuaugaaaugaguaguaauauugggugguugauuuguucuua

SEQ ID NO: 544171 - RNA, 64 nt, hsa
ucuccuccccuaaaauaaaaauaguggucaacuuuaguaauauaaaaggcugcuggaugcugag

SEQ ID NO: 544172 - RNA, 64 nt, hsa
auuggaacuuugcuagaacaagacccuguaguaauaguaauaauaguugaaguuuggccaacuc

SEQ ID NO: 544173 - RNA, 64 nt, hsa
auaaauauuggaacuuugcuagaacaagacccuguaguaauaguaauaauaguugaaguuuggc

SEQ ID NO: 544174 - RNA, 64 nt, hsa
aaagugcauuauuauggaagaauguauuugcagguaguaauagcauuaaaaaauauacucgugu

SEQ ID NO: 544175 - RNA, 64 nt, hsa
uaugucuauagaguaaguauaagagauaauucauuaguaauaggaauuaacugaccccuuuugg

SEQ ID NO: 544176 - RNA, 64 nt, hsa
uuuucccugggaaaaccuucagcugcuuuauuuuuaguaauaaauuucucuugucaauucuguu

SEQ ID NO: 544177 - RNA, 64 nt, hsa
aauugaggacaacacaaaugggauugguacuuuauaguaauaaaucugaccagcagagggaggg

SEQ ID NO: 544178 - RNA, 64 nt, hsa
cccaggcacugugggacugagaguccuauuccccuaguaauaggucauauuccccuaguaauau

SEQ ID NO: 544179 - RNA, 64 nt, hsa
aguccuauuccccuaguaauaggucauauuccccuaguaauaugaguucucaaagccuacauuc

SEQ ID NO: 544180 - RNA, 64 nt, hsa
aaugcaaaagaaacuggaacuugacaauuauaaauaguaauagugaagaaaaaauagaaagguu

SEQ ID NO: 544181 - RNA, 64 nt, hsa
aauaaauccuugcauguaaaucauucaaggauuauaguaauauuucauauacugaaaagugucu

SEQ ID NO: 544182 - RNA, 64 nt, hsa
gaugaagccaucuuaauaauuaguaauaauuaauuaguaauaauuaguaagcauuuucucaaug

SEQ ID NO: 544183 - RNA, 64 nt, hsa
uuagaccauuuggggaugaagccaucuuaauaauuaguaauaauuaauuaguaauaauuaguaa

SEQ ID NO: 544184 - RNA, 64 nt, hsa
auuaaauguguauauaucucuacacuuuauggauuaguaauaaugugauucucuauggcuucua

SEQ ID NO: 544185 - RNA, 64 nt, hsa
ugccuauuaagaggcuuuuuacaaauuacuuacuuaguaauaucuguuaaauuaagcauuaucu

SEQ ID NO: 544186 - RNA, 64 nt, hsa
gaauagaacaacauauacaacaccaaaaaauaucuaguaauauauuuaaagggaaauugagcug

SEQ ID NO: 544187 - RNA, 64 nt, hsa
ucuuccaaccauuuaucuugaaggaaaaauucaauaguaauauaauacacaaaaucaaauaaua

SEQ ID NO: 544188 - RNA, 64 nt, hsa
uaccacucugguguagacagaggacuuuguccaagucucacacuaaacaugcccgggcuucgau

SEQ ID NO: 544189 - RNA, 64 nt, hsa
ccuguaacagccaccuggagaacuucauaaagaugucucacagcccuggggacaccugcccagu

SEQ ID NO: 544190 - RNA, 64 nt, hsa
acaccugauacuguaaacauacuguaauaauaaugucucacauggaaacagaaaacgcuggguc

SEQ ID NO: 544191 - RNA, 64 nt, hsa
gaauguucagguggucaguguucuacucagaaaugucucacagcccagcuggguugcaauucca

SEQ ID NO: 544192 - RNA, 64 nt, hsa
caaccauuuuaagccucuaaaagaccucgggcaagucucacagaaacugagcugcagacgggga

SEQ ID NO: 544193 - RNA, 64 nt, hsa
gccccuucucugggugugggcccuuauugcagcugucucacagccugagcugugguacagagaa

SEQ ID NO: 544194 - RNA, 64 nt, hsa
agcacuggugugaaugaaagagagacccagccgcgucucacacagguggaauugcacuucuuaa

SEQ ID NO: 544195 - RNA, 64 nt, hsa
uuuaaaagaaaguuagguuauaagaaacagaggcgucucacauuuuuacuugguguaauuaaua

SEQ ID NO: 544196 - RNA, 64 nt, hsa
gguauuguuuggaauuguuuuaaagucaguuugagucucacaagaagguaaguagaguuucuua

SEQ ID NO: 544197 - RNA, 64 nt, hsa
cuccccaguuuccuggcgaugagccauuuauugugucucacaccagccucauuuccaacuccga

SEQ ID NO: 544198 - RNA, 64 nt, hsa
ccuuggccuuugggaacuuugcuccaacuggugugucucacacaaugccucccaaaacacugcu

SEQ ID NO: 544199 - RNA, 64 nt, hsa
gauuccuguacauuuuacagucgcacagcaagcagucucacagaaggcaggcuaguccauucac

SEQ ID NO: 544200 - RNA, 64 nt, hsa
uuuccucugaauuauaauaacauagccagauguagucucacacuguuuuucauacucuuaagug

SEQ ID NO: 544201 - RNA, 63 nt, hsa
cugacgcuggaaccuguauacacaauaaaggacagucucacagacuucuggaggccgccugcc

SEQ ID NO: 544202 - RNA, 64 nt, hsa
acauggcugggggagggacugcugacccaccaaggucucacacuccuccugccagcucugucac

SEQ ID NO: 544203 - RNA, 64 nt, hsa
gucagcuaggccaauaggaacagaccgggaccuugucucacacugaugauaccucacauguuga

SEQ ID NO: 544204 - RNA, 64 nt, hsa
cccuggaggagaaguauuccuguugcugucuucagucucacagagaagcuccugcuacuucccc

SEQ ID NO: 544205 - RNA, 64 nt, hsa
ugauuugcucucuaaacuucccucuaguuggcaagucucacauauucaucagcaggaguggagg

SEQ ID NO: 544206 - RNA, 64 nt, hsa
ccuuuccccuccugucuucccgguaucccuuggagucucacaagguuuacuuugguaugguucu

SEQ ID NO: 544207 - RNA, 64 nt, hsa
acucagauggagcuuccuacucacguugauuuaugucucacaauccuggguauuguuaauucaa

SEQ ID NO: 544208 - RNA, 64 nt, hsa
uuggcuucuaaugcuucagauagaauacaguugggucucacauaacccuuuacauugugaaaua

SEQ ID NO: 544209 - RNA, 64 nt, hsa
gaucucugucuagaaauaccauagaccauauauagucucacauugauaauugaaacuagaaggg

SEQ ID NO: 544210 - RNA, 64 nt, hsa
ugcuaauuucauuuuacaguguauguaacgcuuagucucacagugucuuuaacucaucuuugca

SEQ ID NO: 544211 - RNA, 64 nt, hsa
cccacuuccuguuugggccccucucccauccagugucucacagcccugcuuaccagauaaugcu

SEQ ID NO: 544212 - RNA, 64 nt, hsa
cugaaaacucuaugcuggccacugauuccuuugagucucacaaaacccuacuuaggucaucagg

SEQ ID NO: 544213 - RNA, 64 nt, hsa
cuuaauacuaggagaagacugaaucauuaaugaugucucacaaauuacuguguaccuaaguggu

SEQ ID NO: 544214 - RNA, 64 nt, hsa
cuugugucuccuuucccccgaaguagaugaaacagucucacauacccaacugcucaucaacaga

SEQ ID NO: 544215 - RNA, 64 nt, hsa
gauacaauaucuuuaaaugaacacacgaguguaugucucacaauauauauacacaagugugcau

SEQ ID NO: 544216 - RNA, 64 nt, hsa
auauauagcaguguagcuguucucucuagauggugucucacaauggauuucuguugcuugacua

SEQ ID NO: 544217 - RNA, 64 nt, hsa
agaccuuuuuccuccguuuuuuuuuugagauggagucucacacagucacccgggauuggaaugc

SEQ ID NO: 544218 - RNA, 64 nt, hsa
uuuaaaguuccagaauaaucuccuuugacuccaggucucacauccaggucauacugaugcaaga

SEQ ID NO: 544219 - RNA, 64 nt, hsa
ugaacuaaucaggcaggaaaaaagcccagccacugucucacagauuguuuuuuguauauuguag

SEQ ID NO: 544220 - RNA, 64 nt, hsa
ugaccuguuaaaagccacgcagcagacucauggggucucacaaauccguguccgggugcgcucc

SEQ ID NO: 544221 - RNA, 64 nt, hsa
guagaaugcuccaugcuauuuuauggaaacuuuggucucacauccguagcugauuauccucuuu

SEQ ID NO: 544222 - RNA, 64 nt, hsa
uaaauaaugcaaaaauugcacaguggaagaaggggucucacaaaaagcaauccauccuguagua

SEQ ID NO: 544223 - RNA, 64 nt, hsa
cauuuugugaaugguguucagccuauaagacgaagucucacaagaccuauaggaaaguuuacca

SEQ ID NO: 544224 - RNA, 64 nt, hsa
uauugcauauugcccaauaagcagaagccauaaggucucacacuuuucuuauaaugcaauagaa

SEQ ID NO: 544225 - RNA, 64 nt, hsa
cuccucuucugauaguuggggaaacugaggccuugucucacaguuggaugcuuuucccaguugu

SEQ ID NO: 544226 - RNA, 64 nt, hsa
augcugauacacagcacacagggaaaggaagacagucucacagaggaagggcagguguccuacg

SEQ ID NO: 544227 - RNA, 64 nt, hsa
uucaacaaguagcuaaagucuggcuaugcucacagucucacaucugguuggggugggcuccuua

SEQ ID NO: 544228 - RNA, 64 nt, hsa
acguuuucuagcauguuuccuuuuacuugguucugucucacaaagcugggagguagaugauucu

SEQ ID NO: 544229 - RNA, 64 nt, hsa
ucuuuauggauauacaagcaaaugggaauguagagucucacauucucucuuuauacacaaaagu

SEQ ID NO: 544230 - RNA, 64 nt, hsa
uaagacacaggaaucacuguuuuccuugaccagggucucacacccuggaggaauguuaaguaag

SEQ ID NO: 544231 - RNA, 64 nt, hsa
agucugcaacuuuaagcagcucuugcuaaucagugucucacacuggcguagaaguuuuuguacu

SEQ ID NO: 544232 - RNA, 64 nt, hsa
gcuaguagacccauuuuacaggugagagaaccaagucucacagaggccuggguucaagucccac

SEQ ID NO: 544233 - RNA, 64 nt, hsa
gccaaaugucugaguaaacagauaucccuuccaagucucacaccucccuuagucccacucuugc

SEQ ID NO: 544234 - RNA, 64 nt, hsa
ggacgucccaucaacaaagcaucgaugauggacagucucacacuauuuuuaucauauguuucuu

SEQ ID NO: 544235 - RNA, 64 nt, hsa
ggaggacaagaagucuauuguuuggacuguguuugucucacaaucaccacaaaauaaaagugua

SEQ ID NO: 544236 - RNA, 64 nt, hsa
uguaacucauaggugcauucuuuuuuucuuuggugucucacaaauuacccaauuguugaauaaa

SEQ ID NO: 544237 - RNA, 64 nt, hsa
uugugagaguucccucaucugaaaucauguaucugucucacaaauacaagcauaaguagaagau

SEQ ID NO: 544238 - RNA, 64 nt, hsa
caaaagaauaauuuggaaucagcuaugcaaaucagucucacaauagcgugagcuaacugagaga

SEQ ID NO: 544239 - RNA, 64 nt, hsa
gucauuuuuagaaaggggcaguuuaaagcacaaugucucacaugggacaaaguuccaaaaugcc

SEQ ID NO: 544240 - RNA, 64 nt, hsa
uauaagcuaugaguugaaauguucugucaaaugugucucacaucuacacguggcuuggaggcuu

SEQ ID NO: 544241 - RNA, 64 nt, hsa
ggaguuggggugaugggcuucuuucugcacuggagucucacaucuguuagcuuugacacucaag

SEQ ID NO: 544242 - RNA, 64 nt, hsa
aaacuuuacugccgagaaacuuucaguagaugaagucucacaguuggugauuucuccgcucugu

SEQ ID NO: 544243 - RNA, 64 nt, hsa
caucugccuaauagggucccccagggccccaccugucucacaagaacuucacucaaccccgugc

SEQ ID NO: 544244 - RNA, 64 nt, hsa
cacaaaguuguguuucuuuuguguccuuaagcuugucucacaagaaagaugccaggccucuaaa

SEQ ID NO: 544245 - RNA, 64 nt, hsa
aaaugaauaaauggacaaaugaguaaaugagaaagucucacaccaugaaagaugcuaguccaau

SEQ ID NO: 544246 - RNA, 64 nt, hsa
agauauacugagguuugaguuucacuuucuuuaagucucacauugcuaacaugacauuagcugu

SEQ ID NO: 544247 - RNA, 64 nt, hsa
cauucccagcuuaaauuaacaauuguuaguauuagucucacacauaagugccauacauuuuauc

SEQ ID NO: 544248 - RNA, 64 nt, hsa
uaagacuuacuuuuaaauauacucuuuggaguuagucucacaauguccauuccccuagcuccug

SEQ ID NO: 544249 - RNA, 64 nt, hsa
cuucucagccacucuucuuaaugaggcucccccugucucacauugaguugggcccauugguuau

SEQ ID NO: 544250 - RNA, 64 nt, hsa
gggacccaccagagccuauagaaucaauuccuuggucucacagccauguagacaagcccugguc

SEQ ID NO: 544251 - RNA, 64 nt, hsa
guauuuaccuuccuucccuuccugcucccagacagucucacaaguaaacaccagcagcucauag

SEQ ID NO: 544252 - RNA, 64 nt, hsa
guuuuuauccauagccauugcucccuugucaagugucucacaaggacauggaagaauguguuau

SEQ ID NO: 544253 - RNA, 64 nt, hsa
uuaaaacucaaaggcucuuuucagagccacucaagucucacauaaagagcuuuaauauugaauu

SEQ ID NO: 544254 - RNA, 64 nt, hsa
acuucagacaucuccaaacucauccuuguguauagucucacacccuuccccauaaguauaaaug

SEQ ID NO: 544255 - RNA, 64 nt, hsa
gcaaauugcagcacuacuuuaaauauuagauuaugucucacauagcacugcucauuuuacuuuu

SEQ ID NO: 544256 - RNA, 64 nt, hsa
aagucaagaugggcaacucagauggagcagcuuagucucacaguuugcuugucuauuuauuuua

SEQ ID NO: 544257 - RNA, 64 nt, hsa
ccagccuuguccacacacacaucucacgccccuggucucacagccucacaccuuguccuuccac

SEQ ID NO: 544258 - RNA, 64 nt, hsa
agaggaguggccaugugagggcauggagucauuagucucacaaacacacuuuggacugaagagg

SEQ ID NO: 544259 - RNA, 64 nt, hsa
uucggguaugcaagccuaaaucuuuguacacuuugucucacagaauaguucugaggcuccauga

SEQ ID NO: 544260 - RNA, 64 nt, hsa
uggaucuucuuggagcgagcagaugcaaucucuugucucacaugcuagcaacauaccagguaac

SEQ ID NO: 544261 - RNA, 64 nt, hsa
uguugccauuuauuuaguaccagacauagugcuggucucacagcuuaauauuugguaaugaaua

SEQ ID NO: 544262 - RNA, 64 nt, hsa
gaaagagaagagcucugcacuucccuuuguuguagucucacaguauaacagauauucuaauucu

SEQ ID NO: 544263 - RNA, 64 nt, hsa
uuuguuuacauaagagaaagaggccagacauggugucucacacguuuaaucccagcacuuuggg

SEQ ID NO: 544264 - RNA, 64 nt, hsa
gaauccacagcauucaaggucaggucuacucaaagucucacauggaaaagugaguucugccuuu

SEQ ID NO: 544265 - RNA, 64 nt, hsa
cucccuaucuucagguuaccauugcgcccucagggucucacaccuugggguugucagguucccg

SEQ ID NO: 544266 - RNA, 64 nt, hsa
auucuuauuauacauguuaacaccuuuuacaguugucucacaggucuuggauauuucauucuau

SEQ ID NO: 544267 - RNA, 64 nt, hsa
guggugcuaacuguaugugucuuuaucagugauggucucacagagccaacucacucuuaugaaa

SEQ ID NO: 544268 - RNA, 64 nt, hsa
agccugccagggaggcagcuaccucgggaggaaggucucacaucugucucugggcacccaugcu

SEQ ID NO: 544269 - RNA, 64 nt, hsa
uuuucuaggcccuuuucuaugucuuuacaucucugucucacacacacacacguauacacacaca

SEQ ID NO: 544270 - RNA, 64 nt, hsa
aggcagcggguagggcacagggaagagggagggugucucacaaccaaccaguucagaaugauac

SEQ ID NO: 544271 - RNA, 64 nt, hsa
uaggcaaaagucacuaucaaaugguugcuuauuugucucacacagccauauaguuuuuccugga

SEQ ID NO: 544272 - RNA, 64 nt, hsa
ggugcugugguuuugucccuugccuuccugccuagucucacaugucccuguuccucuuccccug

SEQ ID NO: 544273 - RNA, 64 nt, hsa
ggugcugugauuuugucccuugccuuccugccuagucucacaugucccugucccucucgcccug

SEQ ID NO: 544274 - RNA, 64 nt, hsa
ucaugcccguuccccucugccuggcagaaucacagucucacauacugucuuguacugacacauc

SEQ ID NO: 544275 - RNA, 64 nt, hsa
gaaaccacucagagauggaucccauucccuaaaggucucacagcaaaggagcaggacucccagg

SEQ ID NO: 544276 - RNA, 64 nt, hsa
ugcauccggagaauugccucuaccuggaccuuuugucucacacagcaguacccugaccugcugu

SEQ ID NO: 544277 - RNA, 64 nt, hsa
cauuuauauugagauucuuuguggcuauuggugugucucacaggcaaaauuugauuuggcuaaa

SEQ ID NO: 544278 - RNA, 64 nt, hsa
aaaaaaauuuuuuuagaugauucuauauaacuucgucucacaaauaguguagguaucuggguuu

SEQ ID NO: 544279 - RNA, 64 nt, hsa
uuuaaaccuccaaaaugaucaccuuugacuccacgucucacaaucaucucucucaaguucgaag

SEQ ID NO: 544280 - RNA, 64 nt, hsa
gagauucuugccucuagcaaugacaaccugugaugucucacaguagagcacuuagcgcagaauc

SEQ ID NO: 544281 - RNA, 64 nt, hsa
uaaugacgaugccgugugucucgucuccugacaugucucacagacgcuccugaaguuaggucau

SEQ ID NO: 544282 - RNA, 64 nt, hsa
ucaugugucacuggauuaauuuaucugauaaugugucucacaagaaucuguuagaucguuuauu

SEQ ID NO: 544283 - RNA, 64 nt, hsa
guuucccccauauuguucuugugguagugaauaagucucacaagaucugaugguuuuaucaggg

SEQ ID NO: 544284 - RNA, 64 nt, hsa
uuucuagcgcauuugauuucuccagguuugcugugucucacagaggcaguaggaacccagcucu

SEQ ID NO: 544285 - RNA, 64 nt, hsa
cucugucccucuucaggaagaaagagcucauucugucucacaagccaccggcauccuguaucag

SEQ ID NO: 544286 - RNA, 64 nt, hsa
cccagcccugggacccuccgaggugggugugcgggucucacaggugcuuccugggacuuccugu

SEQ ID NO: 544287 - RNA, 64 nt, hsa
cucugcggaaggggucaggcucaacugcugaugugucucacacguagcagacaaggggugucug

SEQ ID NO: 544288 - RNA, 64 nt, hsa
ccacugcaccagccuggcaacagagcaagacuccgucucacaaaaaugaauaaauaaaauaaaa

SEQ ID NO: 544289 - RNA, 64 nt, hsa
uucucuccaugcccugggucacuuccuuuuuugggucucacagaccccuccaggggcugacacc

SEQ ID NO: 544290 - RNA, 64 nt, hsa
gaaggugaaacauuuucucccuggauuuuuaccagucucacaugauuccagccaucaccuuaga

SEQ ID NO: 544291 - RNA, 64 nt, hsa
ucuucuuuuacaaugaaaggggugaagagugagggucucacaguuccuuaccucaaagucccuu

SEQ ID NO: 544292 - RNA, 64 nt, hsa
uggacacagccccauguacacggccucaagggaugucucacauccucugucuauuugagacuua

SEQ ID NO: 544293 - RNA, 64 nt, hsa
uuugcauugcugcauccugggaaggggguauauggucucacaaguuguugucauuguuuuuuug

SEQ ID NO: 544294 - RNA, 64 nt, hsa
uguaauugaugcauuguggccccugaucuucccugucucacacuucuuuucucccaucccgguu

SEQ ID NO: 544295 - RNA, 64 nt, hsa
gauucagaaaccaaggcuaagggacuggucuaaagucucacagguaguauaugguggagccaac

SEQ ID NO: 544296 - RNA, 64 nt, hsa
cuguugguucaaggacaacaccagaaugaagagggucucacaagacaccuguuauccucuucuu

SEQ ID NO: 544297 - RNA, 64 nt, hsa
ggagaggccgguagggcaggggcugcuaguggcugucucacauacaccaguaauccuguuaaag

SEQ ID NO: 544298 - RNA, 64 nt, hsa
aggagggugaauguuucuucuuucucaucuacucgucucacacugagugguguuagucacugag

SEQ ID NO: 544299 - RNA, 64 nt, hsa
agcugcuuugcucuguaucuggcuggacugaucugucucacaagaagccaugaggccauaggga

SEQ ID NO: 544300 - RNA, 64 nt, hsa
uuuuuuuguuuauguguuuguuuuuugagacagagucucacacuguggcccaggcuggacucca

SEQ ID NO: 544301 - RNA, 64 nt, hsa
uuccagguauaaauguuucucuuuuuuuaaacaugucucacauagaguaucuccgaaugcagcu

SEQ ID NO: 544302 - RNA, 64 nt, hsa
cguuguacaauugagaucaagugaauuggccccggucucacauuuucagugaagucagacucag

SEQ ID NO: 544303 - RNA, 64 nt, hsa
gggcaaaauuagaccucaagucugccucuacugugucucacaucaccauguagaagaaugggcg

SEQ ID NO: 544304 - RNA, 64 nt, hsa
cauacucuucauugaauuuaguuugucuaaaauagucucacagguaaaaaacauaacaacaaug

SEQ ID NO: 544305 - RNA, 64 nt, hsa
uuagaagaagcagagcucuaguuuagccuuucuugucucacagaugugcuguaucccaggcaua

SEQ ID NO: 544306 - RNA, 64 nt, hsa
guggugacaguuugugacauucugucuucaugaggucucacagucgacgcuccuguaaucauuc

SEQ ID NO: 544307 - RNA, 64 nt, hsa
uugaaaauuacgacaguuaagggcugggugcggugucucacaccuguaaucccagcacuuuggg

SEQ ID NO: 544308 - RNA, 64 nt, hsa
ucccugucucagcaccuccucccccaauucccaggucucacaucccaccccuccugcccuccaa

SEQ ID NO: 544309 - RNA, 64 nt, hsa
accuuuuuuucugaaucugcuguucuacccaugugucucacauucauuuguauuauuucaagaa

SEQ ID NO: 544310 - RNA, 64 nt, hsa
ucucugugaaaaacuuguauacacaagcguccaugucucacacaaauauugaugugauuauucu

SEQ ID NO: 544311 - RNA, 64 nt, hsa
ccuugagccugcagcacacacuaggccaccugcagucucacaggccaugcccuggguagacagg

SEQ ID NO: 544312 - RNA, 64 nt, hsa
auaaagauaauuauaguuacauguauugauuuaagucucacacacugugcuaauaaguccuuug

SEQ ID NO: 544313 - RNA, 64 nt, hsa
accugagcaggaccucugaaacccuggaccaguggucucacauggugcuacgccugcauguaaa

SEQ ID NO: 544314 - RNA, 63 nt, hsa
gggcuuugcucuuucagugagcuaggcaaucaagucucacagauugcugccucagagcaaugg

SEQ ID NO: 544315 - RNA, 64 nt, hsa
uuuuauuuagcaagcccagaccuuccggucuaacgucucacaccacgacggacuccccuuccua

SEQ ID NO: 544316 - RNA, 64 nt, hsa
ggaaaagagcauuugccuucuuuaaugaaugauggucucacaauucaguugacuuugaccuaau

SEQ ID NO: 544317 - RNA, 64 nt, hsa
aaaugaaauaauacuucagccaccagguuuuucugucucacauacauaagcagcauuucauugc

SEQ ID NO: 544318 - RNA, 64 nt, hsa
aaaauaagagccugaagcaaugcuuacaauagaugucucacacagaacaauacaaauauguaaa

SEQ ID NO: 544319 - RNA, 64 nt, hsa
gguuuuguugaguuuucacucuucuaaugcaagggucucacacugugaaccacuuaggauguga

SEQ ID NO: 544320 - RNA, 64 nt, hsa
cucgaggccuacaacuuaggggcuggaaucacaggucucacauagagaaauagccagcuugaau

SEQ ID NO: 544321 - RNA, 64 nt, hsa
uucucauuacaccuauauuagcuugcuugaaguugucucacagcucacuuguauucuguugacu

SEQ ID NO: 544322 - RNA, 64 nt, hsa
gugcacacuggaucaaaaugcugcuuuccucugugucucacagcuuggcugagcucugucucug

SEQ ID NO: 544323 - RNA, 64 nt, hsa
auucaaacagcuuccugaauuuuaauuuuguguugucucacagaaagccuuaucauaaauucca

SEQ ID NO: 544324 - RNA, 64 nt, hsa
uccuuuaaaaacuacaucuuuccuaugcaagagugucucacaugugcuuaaccgaggugcuucu

SEQ ID NO: 544325 - RNA, 64 nt, hsa
ugccucaggcuucugcagcccagggcacuagaacgucucacacucagagccggcuggcccggga

SEQ ID NO: 544326 - RNA, 64 nt, hsa
agaaggcauuuacucuaugucggggggucccugugucucacagcgguaaucguguguugcaucg

SEQ ID NO: 544327 - RNA, 64 nt, hsa
ugugcacauggccacucuuggccuaauaaaggaggucucacagucuucugucugggaugugcgc

SEQ ID NO: 544328 - RNA, 64 nt, hsa
ugccuagccauggugaaugaccagggcgaaguuagucucacagaauaccagggcuagaagacau

SEQ ID NO: 544329 - RNA, 64 nt, hsa
ccaguccuggcagugccguggauggcggcaggaagucucacaucauagaggaccccuccuccuc

SEQ ID NO: 544330 - RNA, 64 nt, hsa
acaguugcauuuguugagacuuuaauggagauuugucucacaagugggaaagacugaagaaaca

SEQ ID NO: 544331 - RNA, 64 nt, hsa
guagagacagggucucaccauguuggccaggcuggucucacacugaccucaggugauccacccg

SEQ ID NO: 544332 - RNA, 64 nt, hsa
guaggccgaccuucucggaaaauucacccuaaaagucucacaaaagaaugaguucauggggaga

SEQ ID NO: 544333 - RNA, 64 nt, hsa
cacgucugcucuucagugaagaagcugguuuagagucucacagaaaacuuuugacuguauuuau

SEQ ID NO: 544334 - RNA, 64 nt, hsa
uugccuuacucauuucuaagugcaauaagggagugucucacaggauugcaccugugacauccug

SEQ ID NO: 544335 - RNA, 64 nt, hsa
uucccucagcucccacaagcuacccugggugacagucucacaucacgacccggagguccccuuc

SEQ ID NO: 544336 - RNA, 64 nt, hsa
gccagccaacuuuugcauguuuuguagagauggggucucacaguguugcccaggcuggucucaa

SEQ ID NO: 544337 - RNA, 64 nt, hsa
cugcagggcaugguggacaguaaugcugaguucugucucacacugaucaggcucagggccagag

SEQ ID NO: 544338 - RNA, 64 nt, hsa
ccauuuugcuugccuggaauuuuaaaguucuuccgucucacaacucacaagaaacuuucugggu

SEQ ID NO: 544339 - RNA, 64 nt, hsa
uuaauucuuggucuaugauaaauaaaguucaguagucucacauuccccaucuauuacccuaggu

SEQ ID NO: 544340 - RNA, 64 nt, hsa
ggcucaguaaccccaucaacuugguggcccuggugucucacacuuguauccuucugcccucgag

SEQ ID NO: 544341 - RNA, 64 nt, hsa
gauuguaaggaagcgguggcggcuggugaagcaagucucacaugucggcguucuuggccaaugg

SEQ ID NO: 544342 - RNA, 64 nt, hsa
gaggccuuacgaagguuaagagaacuuuccccgugucucacagguagguagaggcagagcugga

SEQ ID NO: 544343 - RNA, 64 nt, hsa
gugaaugaguuaaauaucauugauagucuugugugucucacauaucagcuuuuucauaaggaaa

SEQ ID NO: 544344 - RNA, 64 nt, hsa
aacaaggaaaaauacugaauuaguaauuuuaaaagucucacaaagaaaaucccaggccuagaug

SEQ ID NO: 544345 - RNA, 64 nt, hsa
gucacugucacauagacagcccugcaugcccccugucucacacaguuuguaaugaagacagcuc

SEQ ID NO: 544346 - RNA, 64 nt, hsa
gcccuuaauuucuuaguccucaccagaagaacaggucucacaaguauauauuugaugucuguaa

SEQ ID NO: 544347 - RNA, 64 nt, hsa
cagaggcacauucgugcacauucucacagacaccgucucacacguuggcuuuggacaaccaggc

SEQ ID NO: 544348 - RNA, 64 nt, hsa
ccugccaggagcccccuuucaggacacagcgggggucucacacuugcuguccccauccauggcc

SEQ ID NO: 544349 - RNA, 64 nt, hsa
ucuuacagguuuucuugcagcugguaccauccaugucucacagcccuggccacugacagaucag

SEQ ID NO: 544350 - RNA, 64 nt, hsa
uauauauauauauguucuuguuuuuugagacagagucucacacuguugcccaggcuggagugca

SEQ ID NO: 544351 - RNA, 64 nt, hsa
ggaugagucacugaaaggccuucauggucucucggucucacaaggaccucuuaaccccucaaua

SEQ ID NO: 544352 - RNA, 64 nt, hsa
uuaugugcaaggauucccuucauguaaauucuuggucucacaugacacuuggucauucuuccag

SEQ ID NO: 544353 - RNA, 64 nt, hsa
uacaaaaaguuuacuuucuucauggauauucuuggucucacauacuuguaaucaaguuuuucca

SEQ ID NO: 544354 - RNA, 64 nt, hsa
uuucuaaggauuacuuuuuuaaggaacauugucggucucacaugaugcuuguaaugaauuuuuc

SEQ ID NO: 544355 - RNA, 64 nt, hsa
uggaagagcccaggggcuggucccagaacaggcagucucacaagcacgcagcacacuggagugg

SEQ ID NO: 544356 - RNA, 64 nt, hsa
gcaugccgggcccucacucucucgccuguucugugucucacaugcuuuuucuuucaaaauuggg

SEQ ID NO: 544357 - RNA, 64 nt, hsa
acugcuaagcuuucacuuauuuccuauuguguuggucucacaacacaccaauccugauacaaug

SEQ ID NO: 544358 - RNA, 64 nt, hsa
caaaguucucuuggcagaucuggguaaugugugugucucacauuuuuaucauguuuuuaugacu

SEQ ID NO: 544359 - RNA, 64 nt, hsa
ccugagucucagagcaggggaguggcuucccaaggucucacagcuuguccccaggggccaggca

SEQ ID NO: 544360 - RNA, 64 nt, hsa
auauuuucaaggagcuaaaagaagauuuuaaauggucucacaaaaacagauaaauauuugcaca

SEQ ID NO: 544361 - RNA, 64 nt, hsa
cuguuuauguuaagaggauugggccaggcguggugucucacaccuguaaucccagcacuuugag

SEQ ID NO: 544362 - RNA, 64 nt, hsa
auacaccuaacuguguggcagaggcuucauuuaggucucacaacucacuagacaucaaaaugug

SEQ ID NO: 544363 - RNA, 64 nt, hsa
gugcuccucugauggggaacacccugaaguagucgucucacaaaggcuuuccuuggccacagug

SEQ ID NO: 544364 - RNA, 64 nt, hsa
gaaaagagggacuacauauuucaggauauuguuggucucacaugacucuugauagaguuugcca

SEQ ID NO: 544365 - RNA, 64 nt, hsa
caguuuucuuuucuuuuuucuuuuuugagacagggucucacacugucacccaggcuggagugca

SEQ ID NO: 544366 - RNA, 64 nt, hsa
guccaauuccagagcugucuggugaucacuuuaugucucacagggacccacauccaaacaugua

SEQ ID NO: 544367 - RNA, 64 nt, hsa
cccggacagggccacauuugcaugagacauggcugucucacaggucacagagccauuacaacag

SEQ ID NO: 544368 - RNA, 64 nt, hsa
ggcucauuccccaccuucaacucccaccuuacaugucucacacuaucccaugguuggcauuaca

SEQ ID NO: 544369 - RNA, 64 nt, hsa
caguggggagaauugagaauagucaggccuaucagucucacagaaucaccccucuaccuuugau

SEQ ID NO: 544370 - RNA, 64 nt, hsa
agcuuagggaugugcuugcaaacccuucucaagggucucacaaccccaacaucuucagacuggc

SEQ ID NO: 544371 - RNA, 64 nt, hsa
aguguucccgauuuacuaaaauagguaaccaggcgucucacagucgccguccugucaagagcgc

SEQ ID NO: 544372 - RNA, 64 nt, hsa
cagcacccccucuaguucuaauaaagccgccucugucucacaccaaccucuguccugucugugg

SEQ ID NO: 544373 - RNA, 64 nt, hsa
ccuugcugcuguaucuccuggccucugcuuuugugucucacaaaaacagagcuugucucaccau

SEQ ID NO: 544374 - RNA, 64 nt, hsa
aggcugccagagaaaguuggugcugcucauacuggucucacagucuaaguaagugucugugaug

SEQ ID NO: 544375 - RNA, 64 nt, hsa
cuuucuucuucccauggugcuuuccuguuucucagucucacauuucucaacaaggcaaaaacaa

SEQ ID NO: 544376 - RNA, 64 nt, hsa
gacgggguguguguguggcguugaucuuuagccugucucacaccaguucagaaaacacuagacc

SEQ ID NO: 544377 - RNA, 64 nt, hsa
cgcuaauaauuucugccaucuuuauaauuucuuugucucacagaagacuaggagaaagaucuuu

SEQ ID NO: 544378 - RNA, 64 nt, hsa
auucauuaauuucaccuuuuuggagguguacagggucucacacauaaauuauugugcauggcau

SEQ ID NO: 544379 - RNA, 64 nt, hsa
aaagaauacaagaaauguuucuggagcuaguuaugucucacaauuuuguagaaucuuacagcau

SEQ ID NO: 544380 - RNA, 64 nt, hsa
uaucaacggguuuccuaccuguagaauucuggcagucucacaaucuucuuucauuuuuuucugu

SEQ ID NO: 544381 - RNA, 64 nt, hsa
aggccucacaauugugguggaaggugaaaggcaugucucacauggcagcagacaagagaagaaa

SEQ ID NO: 544382 - RNA, 64 nt, hsa
uguauuagaguauauuagggaaaguguguauuuggucucacaggcuguucagggauaaucuaaa

SEQ ID NO: 544383 - RNA, 64 nt, hsa
gaucucagaggaccagagugacugaggguaaagugucucacagcccaugcugaauuuucugcau

SEQ ID NO: 544384 - RNA, 64 nt, hsa
cuuuuugcuuauauguacuuuuuaaugaacacgugucucacacacaaaaagaauuaaggauuuu

SEQ ID NO: 544385 - RNA, 64 nt, hsa
gcauaaaguacuaagggaucaugcuuauccuagggucucacagaagagaggacauauuuaauua

SEQ ID NO: 544386 - RNA, 64 nt, hsa
gagggccacucaccgaccugagucaguguccucugucucacagggccccucucccuucuguuca

SEQ ID NO: 544387 - RNA, 64 nt, hsa; identical to SEQ ID NO: 196032

SEQ ID NO: 544388 - RNA, 64 nt, hsa; identical to SEQ ID NO: 196033

SEQ ID NO: 544389 - RNA, 64 nt, hsa; identical to SEQ ID NO: 196034

SEQ ID NO: 544390 - RNA, 64 nt, hsa; identical to SEQ ID NO: 196035

SEQ ID NO: 544391 - RNA, 64 nt, hsa; identical to SEQ ID NO: 196036

SEQ ID NO: 544392 - RNA, 64 nt, hsa; identical to SEQ ID NO: 196037

SEQ ID NO: 544393 - RNA, 64 nt, hsa; identical to SEQ ID NO: 196038

SEQ ID NO: 544394 - RNA, 64 nt, hsa; identical to SEQ ID NO: 196039

SEQ ID NO: 544395 - RNA, 64 nt, hsa; identical to SEQ ID NO: 196040

SEQ ID NO: 544396 - RNA, 64 nt, hsa; identical to SEQ ID NO: 196041

SEQ ID NO: 544397 - RNA, 64 nt, hsa; identical to SEQ ID NO: 196042

SEQ ID NO: 544398 - RNA, 64 nt, hsa; identical to SEQ ID NO: 196043

SEQ ID NO: 544399 - RNA, 64 nt, hsa; identical to SEQ ID NO: 196044

SEQ ID NO: 544400 - RNA, 64 nt, hsa; identical to SEQ ID NO: 196045

SEQ ID NO: 544401 - RNA, 64 nt, hsa; identical to SEQ ID NO: 196046

SEQ ID NO: 544402 - RNA, 64 nt, hsa; identical to SEQ ID NO: 196047

SEQ ID NO: 544403 - RNA, 64 nt, hsa; identical to SEQ ID NO: 196048

SEQ ID NO: 544404 - RNA, 64 nt, hsa; identical to SEQ ID NO: 196049

SEQ ID NO: 544405 - RNA, 64 nt, hsa; identical to SEQ ID NO: 196050

SEQ ID NO: 544406 - RNA, 64 nt, hsa; identical to SEQ ID NO: 196051

SEQ ID NO: 544407 - RNA, 64 nt, hsa; identical to SEQ ID NO: 196052

SEQ ID NO: 544408 - RNA, 64 nt, hsa; identical to SEQ ID NO: 196053

SEQ ID NO: 544409 - RNA, 64 nt, hsa; identical to SEQ ID NO: 196054

SEQ ID NO: 544410 - RNA, 64 nt, hsa; identical to SEQ ID NO: 196055

SEQ ID NO: 544411 - RNA, 64 nt, hsa
aucagcucucugcugggucucccuuuccauggcaaaugggcagcuccauccucuugacucuucu

SEQ ID NO: 544412 - RNA, 64 nt, hsa
acgucauguauuuuaugauacuugaauuuuuugaaaugggcauuuauuuuauaacauguuaaaa

SEQ ID NO: 544413 - RNA, 64 nt, hsa
auaauauaaagauugaugaacauuauucacagaaaaugggcaccuucucucucucuuccagcau

SEQ ID NO: 544414 - RNA, 64 nt, hsa
ccacuggacguuuauauauuauaggcagggaugaaaugggcaccuagucagaucuucucagcuu

SEQ ID NO: 544415 - RNA, 64 nt, hsa
agucgaccaagggaaaccauuuggccccgugaggaaugggcauugucaguauccguccugaacg

SEQ ID NO: 544416 - RNA, 64 nt, hsa
uugaaguuuauguggugaugguguggcuuuccgaaaugggcaaauauucagaagaucuuuugca

SEQ ID NO: 544417 - RNA, 64 nt, hsa
aacaacuagauauuaaugucaaucauuuaagauuaaugggcaugcaauuaagucuccauuuaag

SEQ ID NO: 544418 - RNA, 64 nt, hsa
uaaugggcaugcaauuaagucuccauuuaagauuaaugggcaugcaaugaagucuccagcagac

SEQ ID NO: 544419 - RNA, 64 nt, hsa
ccugcuuucccuccccaaacccaucagacagguaaaugggcagugccuccugggaccauggaca

SEQ ID NO: 544420 - RNA, 64 nt, hsa
cuuuucuuuauugcugugaauagucugugugcacaaugggcaauucugacuucucccaucuagu

SEQ ID NO: 544421 - RNA, 64 nt, hsa
cgagaaagccucauugucagaaguaucuucauucaaugggcacaauaugcuguguaucucacca

SEQ ID NO: 544422 - RNA, 64 nt, hsa
guagcugucaggggccaccgagagugucguuaaaaaugggcaugguuguaauaaaggaggaaag

SEQ ID NO: 544423 - RNA, 64 nt, hsa; identical to SEQ ID NO: 144505

SEQ ID NO: 544424 - RNA, 64 nt, hsa; identical to SEQ ID NO: 144505

SEQ ID NO: 544425 - RNA, 64 nt, hsa; identical to SEQ ID NO: 144507

SEQ ID NO: 544426 - RNA, 64 nt, hsa; identical to SEQ ID NO: 144508

SEQ ID NO: 544427 - RNA, 64 nt, hsa
aggaggcaucauugaggccaggagcucugcccgugaccuguaucccacguacucuaucuuccau

SEQ ID NO: 544428 - RNA, 64 nt, hsa
cgcccugcccccagaggccaggagcucugcccuugaccuguauuccacuuacuccaccuuccau

SEQ ID NO: 544429 - RNA, 64 nt, hsa
cucuaguggggagauauuaacuuggagaccuaaugcucuguaaauagucauuuaaacuguuggu

SEQ ID NO: 544430 - RNA, 64 nt, hsa
cuuaguaaaaaauuucauuucauaauuuuggcaagcucuguaguggauccaaaguaucuuugag

SEQ ID NO: 544431 - RNA, 64 nt, hsa
uguaccuguauuuauaguuuaugguuaucaggaagcucuguaagaaagaaaaggucagccuccc

SEQ ID NO: 544432 - RNA, 64 nt, hsa
uucaguaaucuuugucauuauauguaacuuuguugcucuguauggcauaauauuguauccauaa

SEQ ID NO: 544433 - RNA, 64 nt, hsa
uccaucacuguguagcuaccguucacauguucuggcucuguacuccacgcuuaucgcgugaacc

SEQ ID NO: 544434 - RNA, 64 nt, hsa
uacagagaugacacaguauugaaauggcaggugggcucuguaaguuauuuuggauuaaugacau

SEQ ID NO: 544435 - RNA, 64 nt, hsa
gcagaacaguaaauucuguguguugguacagagugcucuguaccagugcucaucaucccuucuu

SEQ ID NO: 544436 - RNA, 64 nt, hsa
ccuuuauauaaugacuaauuugggaguaaugugugcucuguaaguuuguuuuaaauugcacugu

SEQ ID NO: 544437 - RNA, 64 nt, hsa
auuuugcauauagaggagccaaagagagauuucagcucuguauuugugguaucaguuuggaaaa

SEQ ID NO: 544438 - RNA, 64 nt, hsa
caggacaugcuguauagauacaggcaguagguuugcucuguacccauguguacagccuacccau

SEQ ID NO: 544439 - RNA, 64 nt, hsa
ucuuacaagaggauuguaaaaugcacccaucagugcucuguaaaacacaccaaucagcgcucug

SEQ ID NO: 544440 - RNA, 64 nt, hsa
acccaucagugcucuguaaaacacaccaaucagcgcucuguagcuagcaauagguuuguaaaau

SEQ ID NO: 544441 - RNA, 64 nt, hsa
caugcaguccuccccucccuggucuccugcuucagcucuguacaacgagggcaaagaugcuaaa

SEQ ID NO: 544442 - RNA, 64 nt, hsa
uucuuaaguggaaggaaaagagugcugagaaauggcucuguauaaucuauggcuauccgaauuc

SEQ ID NO: 544443 - RNA, 64 nt, hsa; identical to SEQ ID NO: 506536

SEQ ID NO: 544444 - RNA, 64 nt, hsa; identical to SEQ ID NO: 506537

SEQ ID NO: 544445 - RNA, 64 nt, hsa; identical to SEQ ID NO: 506538

SEQ ID NO: 544446 - RNA, 64 nt, hsa; identical to SEQ ID NO: 506539

SEQ ID NO: 544447 - RNA, 64 nt, hsa; identical to SEQ ID NO: 506540

SEQ ID NO: 544448 - RNA, 64 nt, hsa; identical to SEQ ID NO: 506541

SEQ ID NO: 544449 - RNA, 64 nt, hsa; identical to SEQ ID NO: 506542

SEQ ID NO: 544450 - RNA, 52 nt, hsa; identical to SEQ ID NO: 506543

SEQ ID NO: 544451 - RNA, 64 nt, hsa; identical to SEQ ID NO: 506544

SEQ ID NO: 544452 - RNA, 64 nt, hsa; identical to SEQ ID NO: 506545

SEQ ID NO: 544453 - RNA, 64 nt, hsa; identical to SEQ ID NO: 506546

SEQ ID NO: 544454 - RNA, 64 nt, hsa; identical to SEQ ID NO: 506547

SEQ ID NO: 544455 - RNA, 64 nt, hsa; identical to SEQ ID NO: 506548

SEQ ID NO: 544456 - RNA, 64 nt, hsa; identical to SEQ ID NO: 506549

SEQ ID NO: 544457 - RNA, 64 nt, hsa; identical to SEQ ID NO: 506550

SEQ ID NO: 544458 - RNA, 64 nt, hsa; identical to SEQ ID NO: 506551

SEQ ID NO: 544459 - RNA, 64 nt, hsa; identical to SEQ ID NO: 506552

SEQ ID NO: 544460 - RNA, 64 nt, hsa; identical to SEQ ID NO: 506553

SEQ ID NO: 544461 - RNA, 64 nt, hsa; identical to SEQ ID NO: 506554

SEQ ID NO: 544462 - RNA, 64 nt, hsa; identical to SEQ ID NO: 506555

SEQ ID NO: 544463 - RNA, 64 nt, hsa; identical to SEQ ID NO: 506556

SEQ ID NO: 544464 - RNA, 64 nt, hsa; identical to SEQ ID NO: 506557

SEQ ID NO: 544465 - RNA, 64 nt, hsa; identical to SEQ ID NO: 506558

SEQ ID NO: 544466 - RNA, 64 nt, hsa; identical to SEQ ID NO: 506559

SEQ ID NO: 544467 - RNA, 64 nt, hsa; identical to SEQ ID NO: 506560

SEQ ID NO: 544468 - RNA, 64 nt, hsa; identical to SEQ ID NO: 506561

SEQ ID NO: 544469 - RNA, 64 nt, hsa; identical to SEQ ID NO: 506562

SEQ ID NO: 544470 - RNA, 64 nt, hsa; identical to SEQ ID NO: 506563

SEQ ID NO: 544471 - RNA, 64 nt, hsa; identical to SEQ ID NO: 506564

SEQ ID NO: 544472 - RNA, 64 nt, hsa; identical to SEQ ID NO: 506565

SEQ ID NO: 544473 - RNA, 64 nt, hsa; identical to SEQ ID NO: 506566

SEQ ID NO: 544474 - RNA, 59 nt, hsa; identical to SEQ ID NO: 506567

SEQ ID NO: 544475 - RNA, 64 nt, hsa; identical to SEQ ID NO: 506568

SEQ ID NO: 544476 - RNA, 64 nt, hsa; identical to SEQ ID NO: 506569

SEQ ID NO: 544477 - RNA, 64 nt, hsa; identical to SEQ ID NO: 506570

SEQ ID NO: 544478 - RNA, 64 nt, hsa; identical to SEQ ID NO: 506571

SEQ ID NO: 544479 - RNA, 64 nt, hsa; identical to SEQ ID NO: 506572

SEQ ID NO: 544480 - RNA, 64 nt, hsa; identical to SEQ ID NO: 506573

SEQ ID NO: 544481 - RNA, 64 nt, hsa; identical to SEQ ID NO: 506574

SEQ ID NO: 544482 - RNA, 64 nt, hsa; identical to SEQ ID NO: 506575

SEQ ID NO: 544483 - RNA, 64 nt, hsa; identical to SEQ ID NO: 506576

SEQ ID NO: 544484 - RNA, 64 nt, hsa; identical to SEQ ID NO: 506577

SEQ ID NO: 544485 - RNA, 64 nt, hsa; identical to SEQ ID NO: 506578

SEQ ID NO: 544486 - RNA, 64 nt, hsa; identical to SEQ ID NO: 506579

SEQ ID NO: 544487 - RNA, 64 nt, hsa; identical to SEQ ID NO: 506580

SEQ ID NO: 544488 - RNA, 64 nt, hsa; identical to SEQ ID NO: 506581

SEQ ID NO: 544489 - RNA, 64 nt, hsa; identical to SEQ ID NO: 506582

SEQ ID NO: 544490 - RNA, 64 nt, hsa; identical to SEQ ID NO: 506583

SEQ ID NO: 544491 - RNA, 64 nt, hsa; identical to SEQ ID NO: 506584

SEQ ID NO: 544492 - RNA, 64 nt, hsa; identical to SEQ ID NO: 506585

SEQ ID NO: 544493 - RNA, 64 nt, hsa; identical to SEQ ID NO: 506586

SEQ ID NO: 544494 - RNA, 64 nt, hsa; identical to SEQ ID NO: 506587

SEQ ID NO: 544495 - RNA, 64 nt, hsa; identical to SEQ ID NO: 506588

SEQ ID NO: 544496 - RNA, 64 nt, hsa; identical to SEQ ID NO: 506589

SEQ ID NO: 544497 - RNA, 64 nt, hsa; identical to SEQ ID NO: 506590

SEQ ID NO: 544498 - RNA, 64 nt, hsa; identical to SEQ ID NO: 506591

SEQ ID NO: 544499 - RNA, 64 nt, hsa; identical to SEQ ID NO: 506592

SEQ ID NO: 544500 - RNA, 64 nt, hsa; identical to SEQ ID NO: 506593

SEQ ID NO: 544501 - RNA, 64 nt, hsa; identical to SEQ ID NO: 506594

SEQ ID NO: 544502 - RNA, 64 nt, hsa; identical to SEQ ID NO: 506595

SEQ ID NO: 544503 - RNA, 64 nt, hsa; identical to SEQ ID NO: 506596

SEQ ID NO: 544504 - RNA, 64 nt, hsa; identical to SEQ ID NO: 506597

SEQ ID NO: 544505 - RNA, 64 nt, hsa; identical to SEQ ID NO: 506598

SEQ ID NO: 544506 - RNA, 64 nt, hsa; identical to SEQ ID NO: 506599

SEQ ID NO: 544507 - RNA, 64 nt, hsa; identical to SEQ ID NO: 506600

SEQ ID NO: 544508 - RNA, 64 nt, hsa; identical to SEQ ID NO: 506601

SEQ ID NO: 544509 - RNA, 64 nt, hsa; identical to SEQ ID NO: 506602

SEQ ID NO: 544510 - RNA, 64 nt, hsa; identical to SEQ ID NO: 506603

SEQ ID NO: 544511 - RNA, 64 nt, hsa; identical to SEQ ID NO: 506604

SEQ ID NO: 544512 - RNA, 64 nt, hsa; identical to SEQ ID NO: 506605

SEQ ID NO: 544513 - RNA, 64 nt, hsa; identical to SEQ ID NO: 506606

SEQ ID NO: 544514 - RNA, 64 nt, hsa; identical to SEQ ID NO: 506607

SEQ ID NO: 544515 - RNA, 64 nt, hsa; identical to SEQ ID NO: 506608

SEQ ID NO: 544516 - RNA, 64 nt, hsa; identical to SEQ ID NO: 506609

SEQ ID NO: 544517 - RNA, 64 nt, hsa; identical to SEQ ID NO: 506610

SEQ ID NO: 544518 - RNA, 64 nt, hsa; identical to SEQ ID NO: 506611

SEQ ID NO: 544519 - RNA, 64 nt, hsa; identical to SEQ ID NO: 506612

SEQ ID NO: 544520 - RNA, 64 nt, hsa; identical to SEQ ID NO: 506613

SEQ ID NO: 544521 - RNA, 64 nt, hsa; identical to SEQ ID NO: 506614

SEQ ID NO: 544522 - RNA, 64 nt, hsa; identical to SEQ ID NO: 506615

SEQ ID NO: 544523 - RNA, 64 nt, hsa; identical to SEQ ID NO: 506616

SEQ ID NO: 544524 - RNA, 64 nt, hsa; identical to SEQ ID NO: 506617

SEQ ID NO: 544525 - RNA, 64 nt, hsa; identical to SEQ ID NO: 506618

SEQ ID NO: 544526 - RNA, 64 nt, hsa; identical to SEQ ID NO: 506619

SEQ ID NO: 544527 - RNA, 64 nt, hsa; identical to SEQ ID NO: 506620

SEQ ID NO: 544528 - RNA, 64 nt, hsa; identical to SEQ ID NO: 506621

SEQ ID NO: 544529 - RNA, 64 nt, hsa; identical to SEQ ID NO: 506622

SEQ ID NO: 544530 - RNA, 64 nt, hsa; identical to SEQ ID NO: 506623

SEQ ID NO: 544531 - RNA, 64 nt, hsa; identical to SEQ ID NO: 506624

SEQ ID NO: 544532 - RNA, 64 nt, hsa; identical to SEQ ID NO: 506625

SEQ ID NO: 544533 - RNA, 64 nt, hsa; identical to SEQ ID NO: 506626

SEQ ID NO: 544534 - RNA, 64 nt, hsa; identical to SEQ ID NO: 506627

SEQ ID NO: 544535 - RNA, 64 nt, hsa; identical to SEQ ID NO: 506628

SEQ ID NO: 544536 - RNA, 64 nt, hsa; identical to SEQ ID NO: 506629

SEQ ID NO: 544537 - RNA, 64 nt, hsa; identical to SEQ ID NO: 506630

SEQ ID NO: 544538 - RNA, 64 nt, hsa; identical to SEQ ID NO: 506631

SEQ ID NO: 544539 - RNA, 64 nt, hsa; identical to SEQ ID NO: 506632

SEQ ID NO: 544540 - RNA, 64 nt, hsa; identical to SEQ ID NO: 506633

SEQ ID NO: 544541 - RNA, 64 nt, hsa; identical to SEQ ID NO: 506634

SEQ ID NO: 544542 - RNA, 64 nt, hsa; identical to SEQ ID NO: 506635

SEQ ID NO: 544543 - RNA, 64 nt, hsa; identical to SEQ ID NO: 506636

SEQ ID NO: 544544 - RNA, 64 nt, hsa; identical to SEQ ID NO: 506637

SEQ ID NO: 544545 - RNA, 64 nt, hsa; identical to SEQ ID NO: 506638

SEQ ID NO: 544546 - RNA, 64 nt, hsa; identical to SEQ ID NO: 506639

SEQ ID NO: 544547 - RNA, 64 nt, hsa; identical to SEQ ID NO: 506640

SEQ ID NO: 544548 - RNA, 64 nt, hsa; identical to SEQ ID NO: 506641

SEQ ID NO: 544549 - RNA, 64 nt, hsa; identical to SEQ ID NO: 506642

SEQ ID NO: 544550 - RNA, 64 nt, hsa; identical to SEQ ID NO: 506643

SEQ ID NO: 544551 - RNA, 64 nt, hsa; identical to SEQ ID NO: 506644

SEQ ID NO: 544552 - RNA, 64 nt, hsa; identical to SEQ ID NO: 506645

SEQ ID NO: 544553 - RNA, 64 nt, hsa; identical to SEQ ID NO: 506646

SEQ ID NO: 544554 - RNA, 64 nt, hsa; identical to SEQ ID NO: 506647

SEQ ID NO: 544555 - RNA, 64 nt, hsa; identical to SEQ ID NO: 506648

SEQ ID NO: 544556 - RNA, 64 nt, hsa; identical to SEQ ID NO: 506649

SEQ ID NO: 544557 - RNA, 64 nt, hsa; identical to SEQ ID NO: 506650

SEQ ID NO: 544558 - RNA, 64 nt, hsa; identical to SEQ ID NO: 506651

SEQ ID NO: 544559 - RNA, 64 nt, hsa; identical to SEQ ID NO: 506652

SEQ ID NO: 544560 - RNA, 64 nt, hsa; identical to SEQ ID NO: 506653

SEQ ID NO: 544561 - RNA, 64 nt, hsa; identical to SEQ ID NO: 506654

SEQ ID NO: 544562 - RNA, 64 nt, hsa; identical to SEQ ID NO: 506655

SEQ ID NO: 544563 - RNA, 64 nt, hsa; identical to SEQ ID NO: 506656

SEQ ID NO: 544564 - RNA, 64 nt, hsa; identical to SEQ ID NO: 506657

SEQ ID NO: 544565 - RNA, 64 nt, hsa; identical to SEQ ID NO: 506658

SEQ ID NO: 544566 - RNA, 64 nt, hsa; identical to SEQ ID NO: 506659

SEQ ID NO: 544567 - RNA, 64 nt, hsa; identical to SEQ ID NO: 506660

SEQ ID NO: 544568 - RNA, 64 nt, hsa; identical to SEQ ID NO: 506661

SEQ ID NO: 544569 - RNA, 64 nt, hsa; identical to SEQ ID NO: 506662

SEQ ID NO: 544570 - RNA, 64 nt, hsa; identical to SEQ ID NO: 506663

SEQ ID NO: 544571 - RNA, 64 nt, hsa; identical to SEQ ID NO: 506664

SEQ ID NO: 544572 - RNA, 64 nt, hsa; identical to SEQ ID NO: 506665

SEQ ID NO: 544573 - RNA, 64 nt, hsa; identical to SEQ ID NO: 506666

SEQ ID NO: 544574 - RNA, 64 nt, hsa; identical to SEQ ID NO: 506667

SEQ ID NO: 544575 - RNA, 64 nt, hsa; identical to SEQ ID NO: 506668

SEQ ID NO: 544576 - RNA, 64 nt, hsa; identical to SEQ ID NO: 506669

SEQ ID NO: 544577 - RNA, 64 nt, hsa; identical to SEQ ID NO: 506670

SEQ ID NO: 544578 - RNA, 64 nt, hsa; identical to SEQ ID NO: 506671

SEQ ID NO: 544579 - RNA, 64 nt, hsa; identical to SEQ ID NO: 506672

SEQ ID NO: 544580 - RNA, 64 nt, hsa; identical to SEQ ID NO: 506673

SEQ ID NO: 544581 - RNA, 64 nt, hsa; identical to SEQ ID NO: 506674

SEQ ID NO: 544582 - RNA, 64 nt, hsa; identical to SEQ ID NO: 506675

SEQ ID NO: 544583 - RNA, 64 nt, hsa; identical to SEQ ID NO: 506676

SEQ ID NO: 544584 - RNA, 64 nt, hsa; identical to SEQ ID NO: 506677

SEQ ID NO: 544585 - RNA, 64 nt, hsa; identical to SEQ ID NO: 506678

SEQ ID NO: 544586 - RNA, 64 nt, hsa; identical to SEQ ID NO: 506679

SEQ ID NO: 544587 - RNA, 64 nt, hsa; identical to SEQ ID NO: 506680

SEQ ID NO: 544588 - RNA, 52 nt, hsa; identical to SEQ ID NO: 506681

SEQ ID NO: 544589 - RNA, 64 nt, hsa; identical to SEQ ID NO: 506682

SEQ ID NO: 544590 - RNA, 64 nt, hsa; identical to SEQ ID NO: 506683

SEQ ID NO: 544591 - RNA, 64 nt, hsa; identical to SEQ ID NO: 506684

SEQ ID NO: 544592 - RNA, 64 nt, hsa; identical to SEQ ID NO: 506685

SEQ ID NO: 544593 - RNA, 64 nt, hsa; identical to SEQ ID NO: 506686

SEQ ID NO: 544594 - RNA, 64 nt, hsa; identical to SEQ ID NO: 506687

SEQ ID NO: 544595 - RNA, 64 nt, hsa; identical to SEQ ID NO: 506688

SEQ ID NO: 544596 - RNA, 64 nt, hsa; identical to SEQ ID NO: 506689

SEQ ID NO: 544597 - RNA, 64 nt, hsa; identical to SEQ ID NO: 506690

SEQ ID NO: 544598 - RNA, 64 nt, hsa; identical to SEQ ID NO: 506691

SEQ ID NO: 544599 - RNA, 64 nt, hsa; identical to SEQ ID NO: 506692

SEQ ID NO: 544600 - RNA, 64 nt, hsa; identical to SEQ ID NO: 506693

SEQ ID NO: 544601 - RNA, 64 nt, hsa; identical to SEQ ID NO: 506694

SEQ ID NO: 544602 - RNA, 64 nt, hsa; identical to SEQ ID NO: 506695

SEQ ID NO: 544603 - RNA, 64 nt, hsa; identical to SEQ ID NO: 506696

SEQ ID NO: 544604 - RNA, 64 nt, hsa; identical to SEQ ID NO: 506697

SEQ ID NO: 544605 - RNA, 64 nt, hsa; identical to SEQ ID NO: 506698

SEQ ID NO: 544606 - RNA, 64 nt, hsa; identical to SEQ ID NO: 506699

SEQ ID NO: 544607 - RNA, 64 nt, hsa; identical to SEQ ID NO: 506700

SEQ ID NO: 544608 - RNA, 64 nt, hsa; identical to SEQ ID NO: 506701

SEQ ID NO: 544609 - RNA, 64 nt, hsa; identical to SEQ ID NO: 506702

SEQ ID NO: 544610 - RNA, 64 nt, hsa; identical to SEQ ID NO: 506703

SEQ ID NO: 544611 - RNA, 64 nt, hsa; identical to SEQ ID NO: 506704

SEQ ID NO: 544612 - RNA, 64 nt, hsa; identical to SEQ ID NO: 506705

SEQ ID NO: 544613 - RNA, 64 nt, hsa; identical to SEQ ID NO: 506706

SEQ ID NO: 544614 - RNA, 64 nt, hsa; identical to SEQ ID NO: 506707

SEQ ID NO: 544615 - RNA, 64 nt, hsa; identical to SEQ ID NO: 506708

SEQ ID NO: 544616 - RNA, 64 nt, hsa; identical to SEQ ID NO: 506709

SEQ ID NO: 544617 - RNA, 64 nt, hsa; identical to SEQ ID NO: 506710

SEQ ID NO: 544618 - RNA, 64 nt, hsa; identical to SEQ ID NO: 506711

SEQ ID NO: 544619 - RNA, 64 nt, hsa; identical to SEQ ID NO: 506712

SEQ ID NO: 544620 - RNA, 64 nt, hsa; identical to SEQ ID NO: 506713

SEQ ID NO: 544621 - RNA, 64 nt, hsa; identical to SEQ ID NO: 506714

SEQ ID NO: 544622 - RNA, 64 nt, hsa; identical to SEQ ID NO: 506715

SEQ ID NO: 544623 - RNA, 64 nt, hsa; identical to SEQ ID NO: 506716

SEQ ID NO: 544624 - RNA, 64 nt, hsa; identical to SEQ ID NO: 506717

SEQ ID NO: 544625 - RNA, 64 nt, hsa; identical to SEQ ID NO: 506718

SEQ ID NO: 544626 - RNA, 64 nt, hsa; identical to SEQ ID NO: 506719

SEQ ID NO: 544627 - RNA, 64 nt, hsa; identical to SEQ ID NO: 506720

SEQ ID NO: 544628 - RNA, 64 nt, hsa; identical to SEQ ID NO: 506721

SEQ ID NO: 544629 - RNA, 64 nt, hsa; identical to SEQ ID NO: 506722

SEQ ID NO: 544630 - RNA, 64 nt, hsa; identical to SEQ ID NO: 506723

SEQ ID NO: 544631 - RNA, 64 nt, hsa; identical to SEQ ID NO: 506724

SEQ ID NO: 544632 - RNA, 64 nt, hsa; identical to SEQ ID NO: 506725

SEQ ID NO: 544633 - RNA, 64 nt, hsa; identical to SEQ ID NO: 506726

SEQ ID NO: 544634 - RNA, 64 nt, hsa; identical to SEQ ID NO: 506727

SEQ ID NO: 544635 - RNA, 64 nt, hsa; identical to SEQ ID NO: 506728

SEQ ID NO: 544636 - RNA, 64 nt, hsa; identical to SEQ ID NO: 506729

SEQ ID NO: 544637 - RNA, 64 nt, hsa; identical to SEQ ID NO: 506730

SEQ ID NO: 544638 - RNA, 64 nt, hsa; identical to SEQ ID NO: 506731

SEQ ID NO: 544639 - RNA, 64 nt, hsa; identical to SEQ ID NO: 506732

SEQ ID NO: 544640 - RNA, 64 nt, hsa; identical to SEQ ID NO: 506733

SEQ ID NO: 544641 - RNA, 64 nt, hsa; identical to SEQ ID NO: 506734

SEQ ID NO: 544642 - RNA, 64 nt, hsa; identical to SEQ ID NO: 506735

SEQ ID NO: 544643 - RNA, 64 nt, hsa; identical to SEQ ID NO: 506736

SEQ ID NO: 544644 - RNA, 64 nt, hsa; identical to SEQ ID NO: 506737

SEQ ID NO: 544645 - RNA, 64 nt, hsa; identical to SEQ ID NO: 506738

SEQ ID NO: 544646 - RNA, 64 nt, hsa; identical to SEQ ID NO: 506739

SEQ ID NO: 544647 - RNA, 64 nt, hsa; identical to SEQ ID NO: 506740

SEQ ID NO: 544648 - RNA, 64 nt, hsa; identical to SEQ ID NO: 506741

SEQ ID NO: 544649 - RNA, 64 nt, hsa; identical to SEQ ID NO: 506742

SEQ ID NO: 544650 - RNA, 64 nt, hsa; identical to SEQ ID NO: 506743

SEQ ID NO: 544651 - RNA, 64 nt, hsa; identical to SEQ ID NO: 506744

SEQ ID NO: 544652 - RNA, 64 nt, hsa; identical to SEQ ID NO: 506745

SEQ ID NO: 544653 - RNA, 64 nt, hsa; identical to SEQ ID NO: 506746

SEQ ID NO: 544654 - RNA, 64 nt, hsa; identical to SEQ ID NO: 506747

SEQ ID NO: 544655 - RNA, 64 nt, hsa; identical to SEQ ID NO: 506748

SEQ ID NO: 544656 - RNA, 64 nt, hsa; identical to SEQ ID NO: 506749

SEQ ID NO: 544657 - RNA, 64 nt, hsa; identical to SEQ ID NO: 506750

SEQ ID NO: 544658 - RNA, 64 nt, hsa; identical to SEQ ID NO: 506751

SEQ ID NO: 544659 - RNA, 64 nt, hsa; identical to SEQ ID NO: 506752

SEQ ID NO: 544660 - RNA, 64 nt, hsa; identical to SEQ ID NO: 506753

SEQ ID NO: 544661 - RNA, 64 nt, hsa; identical to SEQ ID NO: 506754

SEQ ID NO: 544662 - RNA, 64 nt, hsa; identical to SEQ ID NO: 506755

SEQ ID NO: 544663 - RNA, 64 nt, hsa; identical to SEQ ID NO: 506756

SEQ ID NO: 544664 - RNA, 64 nt, hsa; identical to SEQ ID NO: 506757

SEQ ID NO: 544665 - RNA, 64 nt, hsa; identical to SEQ ID NO: 506758

SEQ ID NO: 544666 - RNA, 64 nt, hsa; identical to SEQ ID NO: 506759

SEQ ID NO: 544667 - RNA, 64 nt, hsa; identical to SEQ ID NO: 506760

SEQ ID NO: 544668 - RNA, 64 nt, hsa; identical to SEQ ID NO: 506761

SEQ ID NO: 544669 - RNA, 64 nt, hsa; identical to SEQ ID NO: 506762

SEQ ID NO: 544670 - RNA, 64 nt, hsa; identical to SEQ ID NO: 506763

SEQ ID NO: 544671 - RNA, 64 nt, hsa; identical to SEQ ID NO: 506764

SEQ ID NO: 544672 - RNA, 64 nt, hsa; identical to SEQ ID NO: 506765

SEQ ID NO: 544673 - RNA, 64 nt, hsa; identical to SEQ ID NO: 506766

SEQ ID NO: 544674 - RNA, 64 nt, hsa; identical to SEQ ID NO: 506767

SEQ ID NO: 544675 - RNA, 64 nt, hsa; identical to SEQ ID NO: 506768

SEQ ID NO: 544676 - RNA, 64 nt, hsa; identical to SEQ ID NO: 506769

SEQ ID NO: 544677 - RNA, 64 nt, hsa; identical to SEQ ID NO: 506770

SEQ ID NO: 544678 - RNA, 64 nt, hsa; identical to SEQ ID NO: 506771

SEQ ID NO: 544679 - RNA, 64 nt, hsa; identical to SEQ ID NO: 506772

SEQ ID NO: 544680 - RNA, 64 nt, hsa; identical to SEQ ID NO: 506773

SEQ ID NO: 544681 - RNA, 64 nt, hsa; identical to SEQ ID NO: 506774

SEQ ID NO: 544682 - RNA, 62 nt, hsa; identical to SEQ ID NO: 506775

SEQ ID NO: 544683 - RNA, 64 nt, hsa; identical to SEQ ID NO: 506776

SEQ ID NO: 544684 - RNA, 64 nt, hsa; identical to SEQ ID NO: 506777

SEQ ID NO: 544685 - RNA, 64 nt, hsa; identical to SEQ ID NO: 506778

SEQ ID NO: 544686 - RNA, 64 nt, hsa; identical to SEQ ID NO: 506779

SEQ ID NO: 544687 - RNA, 64 nt, hsa; identical to SEQ ID NO: 506780

SEQ ID NO: 544688 - RNA, 64 nt, hsa; identical to SEQ ID NO: 506781

SEQ ID NO: 544689 - RNA, 64 nt, hsa; identical to SEQ ID NO: 506782

SEQ ID NO: 544690 - RNA, 64 nt, hsa; identical to SEQ ID NO: 506783

SEQ ID NO: 544691 - RNA, 64 nt, hsa; identical to SEQ ID NO: 506784

SEQ ID NO: 544692 - RNA, 64 nt, hsa; identical to SEQ ID NO: 506785

SEQ ID NO: 544693 - RNA, 64 nt, hsa; identical to SEQ ID NO: 506786

SEQ ID NO: 544694 - RNA, 64 nt, hsa; identical to SEQ ID NO: 506787

SEQ ID NO: 544695 - RNA, 64 nt, hsa; identical to SEQ ID NO: 506788

SEQ ID NO: 544696 - RNA, 64 nt, hsa; identical to SEQ ID NO: 506789

SEQ ID NO: 544697 - RNA, 64 nt, hsa; identical to SEQ ID NO: 506790

SEQ ID NO: 544698 - RNA, 64 nt, hsa; identical to SEQ ID NO: 506791

SEQ ID NO: 544699 - RNA, 64 nt, hsa; identical to SEQ ID NO: 506792

SEQ ID NO: 544700 - RNA, 64 nt, hsa; identical to SEQ ID NO: 506793

SEQ ID NO: 544701 - RNA, 64 nt, hsa; identical to SEQ ID NO: 506794

SEQ ID NO: 544702 - RNA, 63 nt, hsa
uagagcuccuaaaaaugagaaauauuuauugaaauaagaaaaaagcccucagacauguugaau

SEQ ID NO: 544703 - RNA, 63 nt, hsa
uuguuuguauaaaacaauuauaaugaaguguuuauaagaaauuguaaacaaauguaaaacuaa

SEQ ID NO: 544704 - RNA, 63 nt, hsa
ccaccgcugccagcccagaguuacccucuaaagauaagaaaaaggcuauuaauaucauacuaa

SEQ ID NO: 544705 - RNA, 63 nt, hsa
ugauuaauuaugaagaugaaacacuagagucauauaagaaauaaaaauugggcaauaaaauaa

SEQ ID NO: 544706 - RNA, 63 nt, hsa
uucaggggagaaaagugaaugaaaugacucauaauaagaaagcuugcucccuugggacaguua

SEQ ID NO: 544707 - RNA, 63 nt, hsa
uuuauugaguaaagguuauaguuugacuuuaagauaagaaauuuucuagaaucauguuugaau

SEQ ID NO: 544708 - RNA, 63 nt, hsa
ggaagagucuaauaguaauuauggauauaaaaaauaagaaauuuuguauagaaaugaagguuu

SEQ ID NO: 544709 - RNA, 63 nt, hsa
uuuaacuuuuuuggucuucagcuaaaaaauaggauaagaaauuaaggucuauuccauucucca

SEQ ID NO: 544710 - RNA, 63 nt, hsa
caaacuuuuagaguaaaaagccaaauuuaaauuauaagaaagaagggaaaaaagagaaaaacu

SEQ ID NO: 544711 - RNA, 63 nt, hsa
uuuugggaauuuuacagagucaaaguaggcagaauaagaaaauaguucuucaggagggccgac

SEQ ID NO: 544712 - RNA, 63 nt, hsa
uuuuaacuucuaaagaaaauauguuucagcauuauaagaaaggcagaaugcagaacaccuaca

SEQ ID NO: 544713 - RNA, 63 nt, hsa
agucuccuacauagcaguguuauuuauguacagauaagaaaaccauaugucagccaaagauuu

SEQ ID NO: 544714 - RNA, 63 nt, hsa
uaauaauagcccugagauguuucuaacauuuaaauaagaaaaaaaucaaaucgaagucagccu

SEQ ID NO: 544715 - RNA, 63 nt, hsa
agugguguuuacugcugcagcauguaucacaagauaagaaaugaaaaaucaaucuuucuuacc

SEQ ID NO: 544716 - RNA, 63 nt, hsa
gauuguuauuguuggauguuauacugauuauuaauaagaaauuuggauuuuugccuuuuuacc

SEQ ID NO: 544717 - RNA, 63 nt, hsa
gcaaaacacaagcugcauuuuuauuuauuuugcauaagaaagguaaaucuuuuuacaaaaaaa

SEQ ID NO: 544718 - RNA, 63 nt, hsa
aacuguagaugauauuuuauguuuaaucuguaaauaagaaauguauuuaaauuaaaagggauc

SEQ ID NO: 544719 - RNA, 63 nt, hsa
aauguuuugguuauucaugaucacuugggcaguauaagaaaauguagcuucugaauauuggcc

SEQ ID NO: 544720 - RNA, 63 nt, hsa
acaauguuuggaugcaacgcagaauaaaagaauauaagaaauagcuuuuuguugcauuaaugu

SEQ ID NO: 544721 - RNA, 63 nt, hsa
aauugguauggccauuagguucaguccuugaagauaagaaacuuguucucuguuuguugucuu

SEQ ID NO: 544722 - RNA, 63 nt, hsa
ggaauucaauguauguuuguuuuauacuguuugauaagaaaaguagguccagccuuaagcagc

SEQ ID NO: 544723 - RNA, 63 nt, hsa
augauaauuugcuuaugucuuauaaaacucagcauaagaaaaauacugcccuaccuugacugu

SEQ ID NO: 544724 - RNA, 63 nt, hsa
aguuugaaaccagugaggaaaaaagguauguugauaagaaaccuauauugcuagguagaauuu

SEQ ID NO: 544725 - RNA, 63 nt, hsa
uaacaauaagaaauaagaaauaauuuuuuucaaauaagaaaauuguguacucuagaaauggag

SEQ ID NO: 544726 - RNA, 63 nt, hsa
uacuguaaagucuauucuguuuaacaauaagaaauaagaaauaauuuuuuucaaauaagaaaa

SEQ ID NO: 544727 - RNA, 63 nt, hsa
uuguuguuacuguaaagucuauucuguuuaacaauaagaaauaagaaauaauuuuuuucaaau

SEQ ID NO: 544728 - RNA, 63 nt, hsa
gucagagaugguauuaccuuuuaaaaaaugcuaauaagaaaauuggaagauucuuuuaaaaau

SEQ ID NO: 544729 - RNA, 63 nt, hsa
auggauagauuuuuggaacgaaaaaggguaaguauaagaaaauauugcaaacacauuaaaaca

SEQ ID NO: 544730 - RNA, 63 nt, hsa
augguuggucucuaauauauuuggaacugauucauaagaaaaguuauuaaaauuaucuuugaa

SEQ ID NO: 544731 - RNA, 63 nt, hsa
ugaugguaauuucauuagucccaaaacaccggcauaagaaauuugacauuucacagaugcacu

SEQ ID NO: 544732 - RNA, 63 nt, hsa
auucaaucagauuuuccaaaguaccuuuccaccauaagaaaugaauuuucuacuucuacaccc

SEQ ID NO: 544733 - RNA, 63 nt, hsa
cuacuucugcuguucaaucaagagucuugguagauaagaaaaaaaucagucaauauuuccaaa

SEQ ID NO: 544734 - RNA, 63 nt, hsa
aaaauaagguucagaugcagaagaauggcuaaaauaagaaacgugauaagaauauagaugauc

SEQ ID NO: 544735 - RNA, 63 nt, hsa
gccauagaaauguagguccucagaaaguguauaauaagaaacuuauuucucauaucaacuuag

SEQ ID NO: 544736 - RNA, 63 nt, hsa
auaagaaacuuauuucucauaucaacuuagucaauaagaaaauauauucuuucaaaggaacau

SEQ ID NO: 544737 - RNA, 63 nt, hsa
gaugcauaguauuuuagucuacuuguauuguuuauaagaaacccaagcaaaaauauauagcaa

SEQ ID NO: 544738 - RNA, 63 nt, hsa
auuguucagcaaccuucaguaucuauuauuuuaauaagaaagaaacuuccccuaaacuuuaga

SEQ ID NO: 544739 - RNA, 63 nt, hsa
uuuuacaaguggcuuuacauuuccuaaaaugccauaagaaaaugcaauaucuggguacuguau

SEQ ID NO: 544740 - RNA, 63 nt, hsa
uuccucuguaaagaucagaugguaaucuuucaaauaagaaaaaaauaaagacguauguuugac

SEQ ID NO: 544741 - RNA, 63 nt, hsa
auacaguagcaucauaccuauaguuggucuuagauaagaaaugaacuacuugauauagcaaag

SEQ ID NO: 544742 - RNA, 63 nt, hsa
cagcuuguccagaccuggaacaaaauuucuggaauaagaaauuuguauuaaaguccuuuuuug

SEQ ID NO: 544743 - RNA, 63 nt, hsa
aaaucuauucccaugccagaaucuuaucaauacauaagaaauuuaggaagauuaggugccaaa

SEQ ID NO: 544744 - RNA, 63 nt, hsa
uaauguugauguaaguaaugcgguuacugaaucauaagaaaaugccaucucuuuuuaguugaa

SEQ ID NO: 544745 - RNA, 63 nt, hsa
auuauggaaauguugucuuuuauacuuaguuauauaagaaaaaagggaguuaugcaauuaaua

SEQ ID NO: 544746 - RNA, 63 nt, hsa
guuuuauuuuuuucccuuuagcauugcaugugaauaagaaaauaauguuuaaagaaaaaaaaa

SEQ ID NO: 544747 - RNA, 63 nt, hsa; identical to SEQ ID NO: 289563

SEQ ID NO: 544748 - RNA, 63 nt, hsa
aagcuuuucaccgauacucaauccuuaguacacauaagaaaauucauacuggggagaaacccc

SEQ ID NO: 544749 - RNA, 63 nt, hsa
aagcuuuuaaccaguccucacaccuuaugagacauaagaaaauucauaguaaagagaaacccu

SEQ ID NO: 544750 - RNA, 63 nt, hsa
guuguuuuaacuaguucucgaacuuuacuaugcauaagaaaauucaaacuggagagaaacucu

SEQ ID NO: 544751 - RNA, 63 nt, hsa
aaaaauguauguugguuuagcguuguuuuguggauaagaaaaaugcuugacccugaaauauuu

SEQ ID NO: 544752 - RNA, 63 nt, hsa
guuguaauaucaguuacaguggcaguauugacaauaagaaacaguuuaacagaaaaaugaaau

SEQ ID NO: 544753 - RNA, 63 nt, hsa
uuugauaaagcauauuuaugaacauauuucuuaauaagaaaaauauccauuuuauuaccauuu

SEQ ID NO: 544754 - RNA, 63 nt, hsa
ugugacuuugaggccaaugagucauaaacaaauauaagaaagcugucaaugaguuucuucaaa

SEQ ID NO: 544755 - RNA, 63 nt, hsa
auuuuccccaaagauaauauccucuuagggaacauaagaaaaauguauaauaaaaauguggug

SEQ ID NO: 544756 - RNA, 63 nt, hsa
uuaagaccuucauuuaagaggcagaagauuaagauaagaaauauaagauagaaaagcuuuguu

SEQ ID NO: 544757 - RNA, 63 nt, hsa
cucauauuuaguauugaauacuuacauucucuaauaagaaaaccaccccuuagauugaaguaa

SEQ ID NO: 544758 - RNA, 63 nt, hsa
cacuucuggucaaucaacacuaccagcguauauauaagaaagacaucuuucucuuuucuaaaa

SEQ ID NO: 544759 - RNA, 63 nt, hsa
ccugacagacaagcagaugaccucacaggagugauaagaaacaucugcuccacgccaacuccc

SEQ ID NO: 544760 - RNA, 63 nt, hsa
gaagacaucauugguucuguguuuccuacggaaauaagaaacgauaaauauugcacugaaugu

SEQ ID NO: 544761 - RNA, 63 nt, hsa
guuguaaauuuguaaagauuaccuugccacuuuauaagaaaguguauuuaacuaaaaagucau

SEQ ID NO: 544762 - RNA, 63 nt, hsa
cacaaaauaguacuuuguggaucauuucaagauauaagaaauuuuggaaauuccaccauaaau

SEQ ID NO: 544763 - RNA, 63 nt, hsa
aggaggcuaugucucuaauucacuuuagagauaauaagaaauuguucugguagauauauccug

SEQ ID NO: 544764 - RNA, 63 nt, hsa
agcaaacaaaaaaaauuuguauguaaacugaaaauaagaaaauacauuagcaagcuuaauggu

SEQ ID NO: 544765 - RNA, 63 nt, hsa
uucauuaauuacacuuuaaaauuggaaagugggauaagaaaucuaaaguaaaccagcuuaucu

SEQ ID NO: 544766 - RNA, 63 nt, hsa
uuaugugaauaucccuugccaauuuuuuuuauaauaagaaaacaucugacuaaagucaaagaa

SEQ ID NO: 544767 - RNA, 63 nt, hsa
gugucaggcugucacuguucacacaaauuuuuaauaagaaacauuuaccaagggagcaucuuu

SEQ ID NO: 544768 - RNA, 63 nt, hsa
gaacuggcauccugcuuuagccugagacuugccauaagaaacugcugaguacuuggcaaaccc

SEQ ID NO: 544769 - RNA, 63 nt, hsa
uaguauuccugagaacuuuauuuuggaaaauuuauaagaaaguaauccaaauaagaaacacga

SEQ ID NO: 544770 - RNA, 63 nt, hsa
uuauuuuggaaaauuuauaagaaaguaauccaaauaagaaacacgauaguugaaaauaauuuu

SEQ ID NO: 544771 - RNA, 63 nt, hsa
cuguaagguggaaauuucaucaguuugcaaacgauaagaaaugcagacuugcucuugauagaa

SEQ ID NO: 544772 - RNA, 63 nt, hsa
acacaaguuuuugccuaucccuuuccuuaaaauauaagaaauaaaggagcucuuacgaaaaac

SEQ ID NO: 544773 - RNA, 63 nt, hsa
aagcuuuuaaacaguccucaaucuuuauuacacauaagaaaauucaugcuggagagaaacacu

SEQ ID NO: 544774 - RNA, 63 nt, hsa
uaaauccuucagcugauucucagucuaguaaacauaagaaaauucauacuggagagaaaaucu

SEQ ID NO: 544775 - RNA, 63 nt, hsa
ugacagauuuuagagcaaaaauuaguaauaaaaauaagaaauaaaauuacaggagcaauuaag

SEQ ID NO: 544776 - RNA, 63 nt, hsa
ccuaaaaggaugucuaaauguuuguuaauaaaaauaagaaauagcuacagugacagauuuuag

SEQ ID NO: 544777 - RNA, 63 nt, hsa
auuuaacacuugggacaacauuuauuauaaaugauaagaaaaaucuuagagguuugucuaccc

SEQ ID NO: 544778 - RNA, 63 nt, hsa
uguuggaauugggacuuaggaguuuugauuuugauaagaaacugggauaauuuucugaacuuu

SEQ ID NO: 544779 - RNA, 63 nt, hsa
aguagagcugcaccuaaagaggaaauuggguuuauaagaaaauggaggcaaagaacuuaaguu

SEQ ID NO: 544780 - RNA, 63 nt, hsa
aauguaucuuuauuagugacuucuaguccaaauauaagaaacugucauguuuugugggaaaau

SEQ ID NO: 544781 - RNA, 64 nt, hsa; identical to SEQ ID NO: 519022

SEQ ID NO: 544782 - RNA, 64 nt, hsa; identical to SEQ ID NO: 519023

SEQ ID NO: 544783 - RNA, 64 nt, hsa; identical to SEQ ID NO: 519024

SEQ ID NO: 544784 - RNA, 64 nt, hsa; identical to SEQ ID NO: 519025

SEQ ID NO: 544785 - RNA, 64 nt, hsa; identical to SEQ ID NO: 519026

SEQ ID NO: 544786 - RNA, 64 nt, hsa; identical to SEQ ID NO: 519027

SEQ ID NO: 544787 - RNA, 64 nt, hsa; identical to SEQ ID NO: 519028

SEQ ID NO: 544788 - RNA, 64 nt, hsa; identical to SEQ ID NO: 519029

SEQ ID NO: 544789 - RNA, 64 nt, hsa; identical to SEQ ID NO: 519030

SEQ ID NO: 544790 - RNA, 64 nt, hsa; identical to SEQ ID NO: 519031

SEQ ID NO: 544791 - RNA, 64 nt, hsa; identical to SEQ ID NO: 519032

SEQ ID NO: 544792 - RNA, 64 nt, hsa; identical to SEQ ID NO: 519033

SEQ ID NO: 544793 - RNA, 64 nt, hsa; identical to SEQ ID NO: 512337

SEQ ID NO: 544794 - RNA, 64 nt, hsa; identical to SEQ ID NO: 512338

SEQ ID NO: 544795 - RNA, 64 nt, hsa; identical to SEQ ID NO: 512339

SEQ ID NO: 544796 - RNA, 64 nt, hsa; identical to SEQ ID NO: 512340

SEQ ID NO: 544797 - RNA, 64 nt, hsa; identical to SEQ ID NO: 512341

SEQ ID NO: 544798 - RNA, 64 nt, hsa; identical to SEQ ID NO: 512342

SEQ ID NO: 544799 - RNA, 64 nt, hsa; identical to SEQ ID NO: 512343

SEQ ID NO: 544800 - RNA, 64 nt, hsa; identical to SEQ ID NO: 512344

SEQ ID NO: 544801 - RNA, 64 nt, hsa; identical to SEQ ID NO: 512345

SEQ ID NO: 544802 - RNA, 64 nt, hsa; identical to SEQ ID NO: 512346

SEQ ID NO: 544803 - RNA, 64 nt, hsa; identical to SEQ ID NO: 512347

SEQ ID NO: 544804 - RNA, 64 nt, hsa; identical to SEQ ID NO: 512348

SEQ ID NO: 544805 - RNA, 64 nt, hsa; identical to SEQ ID NO: 512349

SEQ ID NO: 544806 - RNA, 64 nt, hsa; identical to SEQ ID NO: 512350

SEQ ID NO: 544807 - RNA, 64 nt, hsa; identical to SEQ ID NO: 512351

SEQ ID NO: 544808 - RNA, 64 nt, hsa; identical to SEQ ID NO: 512352

SEQ ID NO: 544809 - RNA, 64 nt, hsa; identical to SEQ ID NO: 512353

SEQ ID NO: 544810 - RNA, 64 nt, hsa; identical to SEQ ID NO: 512354

SEQ ID NO: 544811 - RNA, 64 nt, hsa; identical to SEQ ID NO: 512355

SEQ ID NO: 544812 - RNA, 64 nt, hsa; identical to SEQ ID NO: 512356

SEQ ID NO: 544813 - RNA, 64 nt, hsa; identical to SEQ ID NO: 512357

SEQ ID NO: 544814 - RNA, 64 nt, hsa; identical to SEQ ID NO: 377795

SEQ ID NO: 544815 - RNA, 64 nt, hsa; identical to SEQ ID NO: 377796

SEQ ID NO: 544816 - RNA, 64 nt, hsa; identical to SEQ ID NO: 377797

SEQ ID NO: 544817 - RNA, 64 nt, hsa; identical to SEQ ID NO: 377798

SEQ ID NO: 544818 - RNA, 64 nt, hsa; identical to SEQ ID NO: 377799

SEQ ID NO: 544819 - RNA, 64 nt, hsa; identical to SEQ ID NO: 377800

SEQ ID NO: 544820 - RNA, 64 nt, hsa; identical to SEQ ID NO: 377801

SEQ ID NO: 544821 - RNA, 62 nt, hsa; identical to SEQ ID NO: 377802

SEQ ID NO: 544822 - RNA, 64 nt, hsa; identical to SEQ ID NO: 377803

SEQ ID NO: 544823 - RNA, 64 nt, hsa; identical to SEQ ID NO: 377804

SEQ ID NO: 544824 - RNA, 64 nt, hsa; identical to SEQ ID NO: 377805

SEQ ID NO: 544825 - RNA, 64 nt, hsa; identical to SEQ ID NO: 377806

SEQ ID NO: 544826 - RNA, 64 nt, hsa; identical to SEQ ID NO: 377807

SEQ ID NO: 544827 - RNA, 64 nt, hsa; identical to SEQ ID NO: 377808

SEQ ID NO: 544828 - RNA, 64 nt, hsa; identical to SEQ ID NO: 377809

SEQ ID NO: 544829 - RNA, 64 nt, hsa; identical to SEQ ID NO: 377810

SEQ ID NO: 544830 - RNA, 64 nt, hsa; identical to SEQ ID NO: 377811

SEQ ID NO: 544831 - RNA, 64 nt, hsa; identical to SEQ ID NO: 377812

SEQ ID NO: 544832 - RNA, 64 nt, hsa; identical to SEQ ID NO: 377813

SEQ ID NO: 544833 - RNA, 64 nt, hsa; identical to SEQ ID NO: 377814

SEQ ID NO: 544834 - RNA, 64 nt, hsa; identical to SEQ ID NO: 377815

SEQ ID NO: 544835 - RNA, 64 nt, hsa; identical to SEQ ID NO: 377816

SEQ ID NO: 544836 - RNA, 64 nt, hsa; identical to SEQ ID NO: 377817

SEQ ID NO: 544837 - RNA, 64 nt, hsa; identical to SEQ ID NO: 377818

SEQ ID NO: 544838 - RNA, 64 nt, hsa; identical to SEQ ID NO: 377819

SEQ ID NO: 544839 - RNA, 64 nt, hsa; identical to SEQ ID NO: 377820

SEQ ID NO: 544840 - RNA, 64 nt, hsa
cuuaggaauaaucacuucaacuccugauuggucccgggccaagcugaauagcccuuaugaauca

SEQ ID NO: 544841 - RNA, 64 nt, hsa
cuuaugaaucaucacuucgguuccugauuggucccgggccaaggucccagaccaagcugaauca

SEQ ID NO: 544842 - RNA, 64 nt, hsa
auuggccaggccugacccucuuggaccuuucuucuuugccgacaaccacugcccagcagccucu

SEQ ID NO: 544843 - RNA, 64 nt, hsa
gagcagcauuucauguucuuuugcuguuuugugcuuugccgauuuuggauuuuauuuuucacaa

SEQ ID NO: 544844 - RNA, 64 nt, hsa
ugguuuuauuuauaauaauuuguuucugaagaaauuugccgagaguuacaggucaaaaagccuu

SEQ ID NO: 544845 - RNA, 64 nt, hsa
aucaucuccccaccucuccuccccucuccucaguuuugccgacugcuuuucaucugagucacca

SEQ ID NO: 544846 - RNA, 64 nt, hsa
aucggaggcggcgccccguucuagggccguggccuuugccgagacuguagcagagaaaacguau

SEQ ID NO: 544847 - RNA, 64 nt, hsa
aaauccuugaugauugacaacacccauuuuuccuuuugccgaccccaagaguuuugggaguugu

SEQ ID NO: 544848 - RNA, 64 nt, hsa
ucuuuucuuuucuugccuuuuuuuuuuuuugaaauuugccgagcaguggagcccucugacaauu

SEQ ID NO: 544849 - RNA, 64 nt, hsa
gaccugaugcccugagagcccacugcaguuggacuuugccgaugcugcaagaaggggugcagag

SEQ ID NO: 544850 - RNA, 64 nt, hsa
guuuuuuccgacuguaagagauauuugauguccuuuugccgagguggauguguuagucucaggc

SEQ ID NO: 544851 - RNA, 64 nt, hsa
aaagcuuacacagcuucuuagcaauuuuuuuuuuuuugccgaaacaauaaauugccuuuagcag

SEQ ID NO: 544852 - RNA, 64 nt, hsa
ggaaaaggcucuuuagagauccuauuagauuugcuuugccgauugucacucuucaucacaggca

SEQ ID NO: 544853 - RNA, 64 nt, hsa
ggagggagaacucauuuuacagaacuugguuuccuuugccgaucuuauguacauacccauuuua

SEQ ID NO: 544854 - RNA, 64 nt, hsa
ugugugucaccuuggcuggcuggcuggccaggguuuugccgauuucccuccucacaucccuccc

SEQ ID NO: 544855 - RNA, 64 nt, hsa
gcuggaaaagaagauccaguugcuagaagcuaaauuugccgaguuagaagguggagaugaugau

SEQ ID NO: 544856 - RNA, 64 nt, hsa
cauguaguuuauagaaaguauacucuaaagggaauuugccgaagaccuuuuacugauugaacag

SEQ ID NO: 544857 - RNA, 64 nt, hsa
uaccagccgcccgcccugggcuguggacccugcguuugccgagcgcuaugccccggacaaaacg

SEQ ID NO: 544858 - RNA, 64 nt, hsa
gauuuuaugcacagccuaguuaucaaggggaugauuugccgacauguuugagaacccccuaacc

SEQ ID NO: 544859 - RNA, 64 nt, hsa
gcuucacggaggauguuggggagagaggauuugauuugccgagugguuuggagaucuuuagggg

SEQ ID NO: 544860 - RNA, 64 nt, hsa
aguauuuuuuauguagccauaauuuuuuuuuuuuuuugccgaaaucugaauaaacuacauauau

SEQ ID NO: 544861 - RNA, 61 nt, hsa
cgauucccagacuggcuugaccacuggaugcuuugccgaaagcagcuuggcuugguagcuc

SEQ ID NO: 544862 - RNA, 64 nt, hsa
auucaaaugcaugauauuguauguaccugggaaauuugccgauuuccuaagcuguuggaagggg

SEQ ID NO: 544863 - RNA, 64 nt, hsa
aaauaucucccaccuaaaauagagaauguugucuuuugccgaccaggagcacuacagauugagc

SEQ ID NO: 544864 - RNA, 64 nt, hsa
auugaggcccaguaagacacucauguggcuaguguuugccgaaugaaacucaacucaauaaaaa

SEQ ID NO: 544865 - RNA, 64 nt, hsa
agggcaggcuggcugcacggggagagggaaguauuuugccgaaauaugagaacuggggccuccu

SEQ ID NO: 544866 - RNA, 64 nt, hsa
cucaguauccagagcuuacaaggagcugcaaggguuugccgagggcugcccagcucugcuucug

SEQ ID NO: 544867 - RNA, 64 nt, hsa
uguuaguugggaaagauugaguuaucagauuuaauuugccgaugggagccuuuaucugucauua

SEQ ID NO: 544868 - RNA, 64 nt, hsa
cugcccaaucuucaccagcuucagaaaucugaccuuugccgaugcugcaauaaaguguuguaau

SEQ ID NO: 544869 - RNA, 64 nt, hsa
gaucuuuuauuuuuccuucauguuugauuuuuguuuugccgaggauuuugguuagaucuuuuag

SEQ ID NO: 544870 - RNA, 64 nt, hsa
uuccaggaauccaacugagcauugaaaucucucauuugccgacuuauuuuuauaggaagccaau

SEQ ID NO: 544871 - RNA, 64 nt, hsa
uccccucccgucuacucauuccccggggcguuucuuugccgauuuuugaaugugauuuuaaaga

SEQ ID NO: 544872 - RNA, 64 nt, hsa
gugggggccagccucgcuggagggagagcaacccuuugccgaugaccacgcuugccgccaucuc

SEQ ID NO: 544873 - RNA, 64 nt, hsa
cucagcuggccacccugcacguugugcacugaccuuugccgaccuccagcggaaccccccaggg

SEQ ID NO: 544874 - RNA, 64 nt, hsa
agaccugucuucucaucagccaccgcuguuuucuuuugccgaacgaugguugcaucucucggac

SEQ ID NO: 544875 - RNA, 64 nt, hsa
ucuauacccaccaccucccuucauaaccuuuauauuugccgaauuuggccuccucaaaagcagc

SEQ ID NO: 544876 - RNA, 64 nt, hsa
aaauacgacauuaacaggagagcagcaguacgauuuugccgauggaauaacagauuugccggca

SEQ ID NO: 544877 - RNA, 64 nt, hsa
uaaguuauucgacggaggacagaguaugugagccuuugccgaacaaacaaacguaaguuauugu

SEQ ID NO: 544878 - RNA, 64 nt, hsa
aacccaggggacuggcaacuauaacaucgaagacuuugccgaccugggcauguuuccaccguuu

SEQ ID NO: 544879 - RNA, 64 nt, hsa
gguauuugaaguguccagcaguugcuugaaaugcuuugccgaaucugacuccaguaagaaugug

SEQ ID NO: 544880 - RNA, 64 nt, hsa; identical to SEQ ID NO: 544876

SEQ ID NO: 544881 - RNA, 64 nt, hsa
ggguuaguuggcaguuaguucuauggucaucucuuuugccgagacuguauauuuaucagacucc

SEQ ID NO: 544882 - RNA, 64 nt, hsa
gagcuggcagcauggagcccucggcuccccagacuuugccgaggggcugcuccggaccccguug

SEQ ID NO: 544883 - RNA, 64 nt, hsa
guaucggggugggucagaaaaagucucaccucaauuugccgacagugucaccugcuugccuuag

SEQ ID NO: 544884 - RNA, 64 nt, hsa
caaccaaauaaaacugaacuuggcaaaaaagaacuuugccgagaaaauuguguaccugccagaa

SEQ ID NO: 544885 - RNA, 64 nt, hsa
cuuugacauucacauccucagugucucagucuuuuuugccgagaaagcacaguagucugggacu

SEQ ID NO: 544886 - RNA, 64 nt, hsa
ucaacuccuugguccccuguugucugggucaacauuugccgagacgccuuggcuggcacccucu

SEQ ID NO: 544887 - RNA, 64 nt, hsa
gaagauaaaaagcacuguugaggcaguguuugcuuuugccgagcugguguccgacagcucccug

SEQ ID NO: 544888 - RNA, 64 nt, hsa
uuacaguugagggagcugagcucagauucaguucuuugccgaagcccucauagcugguaagugg

SEQ ID NO: 544889 - RNA, 64 nt, hsa
auuucuuuuuuacuuagagaaucguucuaguguuuuugccgaagauuaccgcuggccuacugug

SEQ ID NO: 544890 - RNA, 64 nt, hsa
aggagcaaagcuguauccuggaguuggucugugauuugccgacagccuugcaggcugggcucag

SEQ ID NO: 544891 - RNA, 64 nt, hsa
aauuucuucugcaauucaggucuccuuuugcauuuuugccgagaccagcugggucguggagacc

SEQ ID NO: 544892 - RNA, 64 nt, hsa
aaggaacgacaauguucucuuuguuucuuuaaguuuugccgagacaugguuaugccuaauuuau

SEQ ID NO: 544893 - RNA, 64 nt, hsa
acugggaaaucauuagaaaggaggcuguagaauauuugccgagccucuacuguauaccaggggc

SEQ ID NO: 544894 - RNA, 64 nt, hsa
ggagcugcguagucuccucagacauagucaaagcuuugccgagaaaagaaauguaugaacuaua

SEQ ID NO: 544895 - RNA, 64 nt, hsa
ccuuucugaagcugcuuccucuuauaaaauagcuuuugccgaaacauaguuuuuuuuuagcaga

SEQ ID NO: 544896 - RNA, 64 nt, hsa
ugcugcguggcagauuuccuguucuuguucgcaguuugccgacugaagagugugggauuuccga

SEQ ID NO: 544897 - RNA, 64 nt, hsa
agcugggagucuggcaggcccuuuuuuuuuuuucuuugccgaaaccugcaggcguucucucucu

SEQ ID NO: 544898 - RNA, 64 nt, hsa
aaaggagaaaggacuauuucucaguuagaaaacuuuugccgauaccuuguacacuuagcggaua

SEQ ID NO: 544899 - RNA, 64 nt, hsa
gaguauccuuugcuuaucuuuguaguacugaaaauuugccgaaguaacuggcugugcagaaugu

SEQ ID NO: 544900 - RNA, 64 nt, hsa; identical to SEQ ID NO: 106200

SEQ ID NO: 544901 - RNA, 64 nt, hsa; identical to SEQ ID NO: 106201

SEQ ID NO: 544902 - RNA, 64 nt, hsa; identical to SEQ ID NO: 106202

SEQ ID NO: 544903 - RNA, 64 nt, hsa; identical to SEQ ID NO: 106203

SEQ ID NO: 544904 - RNA, 64 nt, hsa; identical to SEQ ID NO: 106204

SEQ ID NO: 544905 - RNA, 64 nt, hsa; identical to SEQ ID NO: 106205

SEQ ID NO: 544906 - RNA, 64 nt, hsa; identical to SEQ ID NO: 106206

SEQ ID NO: 544907 - RNA, 64 nt, hsa; identical to SEQ ID NO: 106207

SEQ ID NO: 544908 - RNA, 64 nt, hsa; identical to SEQ ID NO: 193524

SEQ ID NO: 544909 - RNA, 64 nt, hsa; identical to SEQ ID NO: 193525

SEQ ID NO: 544910 - RNA, 64 nt, hsa; identical to SEQ ID NO: 193526

SEQ ID NO: 544911 - RNA, 64 nt, hsa; identical to SEQ ID NO: 193527

SEQ ID NO: 544912 - RNA, 64 nt, hsa; identical to SEQ ID NO: 193528

SEQ ID NO: 544913 - RNA, 64 nt, hsa; identical to SEQ ID NO: 193529

SEQ ID NO: 544914 - RNA, 64 nt, hsa; identical to SEQ ID NO: 193530

SEQ ID NO: 544915 - RNA, 64 nt, hsa; identical to SEQ ID NO: 193531

SEQ ID NO: 544916 - RNA, 64 nt, hsa; identical to SEQ ID NO: 193532

SEQ ID NO: 544917 - RNA, 64 nt, hsa; identical to SEQ ID NO: 193533

SEQ ID NO: 544918 - RNA, 64 nt, hsa; identical to SEQ ID NO: 193534

SEQ ID NO: 544919 - RNA, 64 nt, hsa; identical to SEQ ID NO: 193535

SEQ ID NO: 544920 - RNA, 64 nt, hsa; identical to SEQ ID NO: 193536

SEQ ID NO: 544921 - RNA, 64 nt, hsa; identical to SEQ ID NO: 193537

SEQ ID NO: 544922 - RNA, 64 nt, hsa; identical to SEQ ID NO: 193538

SEQ ID NO: 544923 - RNA, 64 nt, hsa; identical to SEQ ID NO: 193539

SEQ ID NO: 544924 - RNA, 64 nt, hsa; identical to SEQ ID NO: 193540

SEQ ID NO: 544925 - RNA, 64 nt, hsa; identical to SEQ ID NO: 193541

SEQ ID NO: 544926 - RNA, 64 nt, hsa; identical to SEQ ID NO: 193542

SEQ ID NO: 544927 - RNA, 64 nt, hsa; identical to SEQ ID NO: 193543

SEQ ID NO: 544928 - RNA, 64 nt, hsa; identical to SEQ ID NO: 193544

SEQ ID NO: 544929 - RNA, 64 nt, hsa; identical to SEQ ID NO: 193545

SEQ ID NO: 544930 - RNA, 64 nt, hsa; identical to SEQ ID NO: 193546

SEQ ID NO: 544931 - RNA, 64 nt, hsa; identical to SEQ ID NO: 193547

SEQ ID NO: 544932 - RNA, 64 nt, hsa; identical to SEQ ID NO: 193548

SEQ ID NO: 544933 - RNA, 64 nt, hsa; identical to SEQ ID NO: 193549

SEQ ID NO: 544934 - RNA, 64 nt, hsa; identical to SEQ ID NO: 193550

SEQ ID NO: 544935 - RNA, 64 nt, hsa; identical to SEQ ID NO: 193551

SEQ ID NO: 544936 - RNA, 64 nt, hsa; identical to SEQ ID NO: 193552

SEQ ID NO: 544937 - RNA, 64 nt, hsa; identical to SEQ ID NO: 193553

SEQ ID NO: 544938 - RNA, 64 nt, hsa; identical to SEQ ID NO: 193554

SEQ ID NO: 544939 - RNA, 64 nt, hsa; identical to SEQ ID NO: 193555

SEQ ID NO: 544940 - RNA, 64 nt, hsa; identical to SEQ ID NO: 193556

SEQ ID NO: 544941 - RNA, 64 nt, hsa; identical to SEQ ID NO: 193557

SEQ ID NO: 544942 - RNA, 64 nt, hsa; identical to SEQ ID NO: 193558

SEQ ID NO: 544943 - RNA, 64 nt, hsa; identical to SEQ ID NO: 193559

SEQ ID NO: 544944 - RNA, 64 nt, hsa; identical to SEQ ID NO: 193560

SEQ ID NO: 544945 - RNA, 64 nt, hsa; identical to SEQ ID NO: 193561

SEQ ID NO: 544946 - RNA, 64 nt, hsa; identical to SEQ ID NO: 193562

SEQ ID NO: 544947 - RNA, 64 nt, hsa; identical to SEQ ID NO: 193563

SEQ ID NO: 544948 - RNA, 64 nt, hsa; identical to SEQ ID NO: 193564

SEQ ID NO: 544949 - RNA, 64 nt, hsa; identical to SEQ ID NO: 193565

SEQ ID NO: 544950 - RNA, 64 nt, hsa; identical to SEQ ID NO: 193566

SEQ ID NO: 544951 - RNA, 64 nt, hsa; identical to SEQ ID NO: 193567

SEQ ID NO: 544952 - RNA, 64 nt, hsa; identical to SEQ ID NO: 193568

SEQ ID NO: 544953 - RNA, 64 nt, hsa; identical to SEQ ID NO: 193569

SEQ ID NO: 544954 - RNA, 64 nt, hsa; identical to SEQ ID NO: 193570

SEQ ID NO: 544955 - RNA, 64 nt, hsa; identical to SEQ ID NO: 193571

SEQ ID NO: 544956 - RNA, 64 nt, hsa; identical to SEQ ID NO: 193572

SEQ ID NO: 544957 - RNA, 64 nt, hsa; identical to SEQ ID NO: 193573

SEQ ID NO: 544958 - RNA, 64 nt, hsa; identical to SEQ ID NO: 193574

SEQ ID NO: 544959 - RNA, 64 nt, hsa; identical to SEQ ID NO: 193575

SEQ ID NO: 544960 - RNA, 64 nt, hsa; identical to SEQ ID NO: 193576

SEQ ID NO: 544961 - RNA, 64 nt, hsa; identical to SEQ ID NO: 193577

SEQ ID NO: 544962 - RNA, 64 nt, hsa; identical to SEQ ID NO: 193578

SEQ ID NO: 544963 - RNA, 64 nt, hsa; identical to SEQ ID NO: 193579

SEQ ID NO: 544964 - RNA, 64 nt, hsa; identical to SEQ ID NO: 193580

SEQ ID NO: 544965 - RNA, 64 nt, hsa; identical to SEQ ID NO: 193581

SEQ ID NO: 544966 - RNA, 64 nt, hsa; identical to SEQ ID NO: 193582

SEQ ID NO: 544967 - RNA, 64 nt, hsa; identical to SEQ ID NO: 193583

SEQ ID NO: 544968 - RNA, 64 nt, hsa; identical to SEQ ID NO: 193584

SEQ ID NO: 544969 - RNA, 64 nt, hsa; identical to SEQ ID NO: 193585

SEQ ID NO: 544970 - RNA, 64 nt, hsa; identical to SEQ ID NO: 193586

SEQ ID NO: 544971 - RNA, 64 nt, hsa; identical to SEQ ID NO: 193587

SEQ ID NO: 544972 - RNA, 64 nt, hsa; identical to SEQ ID NO: 193588

SEQ ID NO: 544973 - RNA, 64 nt, hsa; identical to SEQ ID NO: 193589

SEQ ID NO: 544974 - RNA, 64 nt, hsa; identical to SEQ ID NO: 193590

SEQ ID NO: 544975 - RNA, 64 nt, hsa; identical to SEQ ID NO: 193591

SEQ ID NO: 544976 - RNA, 64 nt, hsa; identical to SEQ ID NO: 193592

SEQ ID NO: 544977 - RNA, 64 nt, hsa; identical to SEQ ID NO: 193593

SEQ ID NO: 544978 - RNA, 64 nt, hsa; identical to SEQ ID NO: 193594

SEQ ID NO: 544979 - RNA, 64 nt, hsa; identical to SEQ ID NO: 193595

SEQ ID NO: 544980 - RNA, 64 nt, hsa; identical to SEQ ID NO: 193596

SEQ ID NO: 544981 - RNA, 64 nt, hsa
uaaaaaugauuuuaauaauucauuucuuaaaacacugaaugaauuuugaagcuuaauguuuuua

SEQ ID NO: 544982 - RNA, 64 nt, hsa
auauguuucacugcuucauaucucuguccacuuucugaaugagaacuuauuuugugccuagagc

SEQ ID NO: 544983 - RNA, 64 nt, hsa
caucccagauugcuaaauguucuuuccaagaagucugaaugaauuauuauauacauuugcuauc

SEQ ID NO: 544984 - RNA, 64 nt, hsa
ccccgcuguuacacagguguuuagauacguguuccugaaugaagcugcuuuugaauuuuguuau

SEQ ID NO: 544985 - RNA, 64 nt, hsa
cacaugaaaaaucauaaucugacuaauuuugggacugaaugaauaaguacaagagguuggauuu

SEQ ID NO: 544986 - RNA, 64 nt, hsa
uugaagucaugaccaacaacacuguaacucaugccugaaugaagcuuaucugacacauaagcuu

SEQ ID NO: 544987 - RNA, 64 nt, hsa
aaacccauaggucugaaacugagacccagagaggcugaaugacaugcucacagucacacagcag

SEQ ID NO: 544988 - RNA, 64 nt, hsa
aggaugaggacgugucuaucacagucaguaugcccugaaugaaugggugucacccuccuccccc

SEQ ID NO: 544989 - RNA, 64 nt, hsa
auguagcuuuggugaaacugggguuuuguaaccucugaaugauauggacuuagugaauucuaag

SEQ ID NO: 544990 - RNA, 64 nt, hsa
ccuggugaaacuuugcgguucacauuuuaaauuccugaaugaccuuuucauucucucuuucuuu

SEQ ID NO: 544991 - RNA, 64 nt, hsa
uuguaauuaugcauccuagcuaaggcacagaagacugaaugaaugcaaggauucauuaacucuu

SEQ ID NO: 544992 - RNA, 64 nt, hsa
uuggucugucauuauauugcaaaauauuuuuccucugaaugaaauuaucacagguugucucaag

SEQ ID NO: 544993 - RNA, 64 nt, hsa
aauguggcaugguacaagauaaagaagucugugccugaaugaauacacgcagcaaaauucuccu

SEQ ID NO: 544994 - RNA, 64 nt, hsa
acaggcuucuguuuucagaguacuauggauaggccugaaugaagucauacccuauuagauagcu

SEQ ID NO: 544995 - RNA, 64 nt, hsa
ccaaguggcccucagauuacacuucuccagauagcugaaugagucugcuuucacugugacuggg

SEQ ID NO: 544996 - RNA, 64 nt, hsa
agcugaaugagucugcuuucacugugacugggaccugaaugaccugcagucagggcccagaguu

SEQ ID NO: 544997 - RNA, 64 nt, hsa
gcacaaagaacguugaaguucagauuaaucucuucugaaugauguuuuuuuccucugugaugag

SEQ ID NO: 544998 - RNA, 64 nt, hsa
uuaggcagcuuucaguaagugggugaaugaaugacugaaugaaugaaugaauggcucagcugag

SEQ ID NO: 544999 - RNA, 64 nt, hsa
cuuaagaauuugcagguacuacagauuuucaaaacugaaugagagaaaauuguauaaccauccu

SEQ ID NO: 545000 - RNA, 64 nt, hsa
gaacuugcacuucuuaaggaacagccauaauccucugaaugaugcauuaauuacugacuguccu

SEQ ID NO: 545001 - RNA, 64 nt, hsa
ugcucagugaggaaaucucuuccaauuucugcuucugaaugauucaauguugggagcaauagaa

SEQ ID NO: 545002 - RNA, 64 nt, hsa
agaaaucugucaccuuucugccugcccuuguuuccugaaugaaaugcuucugggguuauuuaug

SEQ ID NO: 545003 - RNA, 64 nt, hsa
cuuauguguucauuaagggcucaauaaauguuagcugaaugaaugaauagcagcaacuagucuu

SEQ ID NO: 545004 - RNA, 64 nt, hsa
gauuggaauaaagcaggaggcucaugggugguugcugaaugaagaacagaaucuuggugcuuug

SEQ ID NO: 545005 - RNA, 64 nt, hsa; identical to SEQ ID NO: 199877

SEQ ID NO: 545006 - RNA, 64 nt, hsa; identical to SEQ ID NO: 199878

SEQ ID NO: 545007 - RNA, 64 nt, hsa; identical to SEQ ID NO: 199879

SEQ ID NO: 545008 - RNA, 64 nt, hsa; identical to SEQ ID NO: 199880

SEQ ID NO: 545009 - RNA, 64 nt, hsa; identical to SEQ ID NO: 199881

SEQ ID NO: 545010 - RNA, 64 nt, hsa; identical to SEQ ID NO: 199882

SEQ ID NO: 545011 - RNA, 64 nt, hsa; identical to SEQ ID NO: 199883

SEQ ID NO: 545012 - RNA, 64 nt, hsa; identical to SEQ ID NO: 199884

SEQ ID NO: 545013 - RNA, 64 nt, hsa; identical to SEQ ID NO: 199885

SEQ ID NO: 545014 - RNA, 64 nt, hsa; identical to SEQ ID NO: 199886

SEQ ID NO: 545015 - RNA, 64 nt, hsa; identical to SEQ ID NO: 199887

SEQ ID NO: 545016 - RNA, 64 nt, hsa; identical to SEQ ID NO: 199888

SEQ ID NO: 545017 - RNA, 64 nt, hsa; identical to SEQ ID NO: 199889

SEQ ID NO: 545018 - RNA, 64 nt, hsa; identical to SEQ ID NO: 199890

SEQ ID NO: 545019 - RNA, 64 nt, hsa; identical to SEQ ID NO: 199891

SEQ ID NO: 545020 - RNA, 64 nt, hsa; identical to SEQ ID NO: 199892

SEQ ID NO: 545021 - RNA, 64 nt, hsa; identical to SEQ ID NO: 199893

SEQ ID NO: 545022 - RNA, 64 nt, hsa; identical to SEQ ID NO: 199894

SEQ ID NO: 545023 - RNA, 64 nt, hsa; identical to SEQ ID NO: 199895

SEQ ID NO: 545024 - RNA, 64 nt, hsa; identical to SEQ ID NO: 199896

SEQ ID NO: 545025 - RNA, 64 nt, hsa; identical to SEQ ID NO: 199897

SEQ ID NO: 545026 - RNA, 64 nt, hsa; identical to SEQ ID NO: 76340

SEQ ID NO: 545027 - RNA, 64 nt, hsa; identical to SEQ ID NO: 76341

SEQ ID NO: 545028 - RNA, 64 nt, hsa; identical to SEQ ID NO: 76342

SEQ ID NO: 545029 - RNA, 64 nt, hsa; identical to SEQ ID NO: 76343

SEQ ID NO: 545030 - RNA, 64 nt, hsa; identical to SEQ ID NO: 76344

SEQ ID NO: 545031 - RNA, 64 nt, hsa; identical to SEQ ID NO: 76345

SEQ ID NO: 545032 - RNA, 64 nt, hsa; identical to SEQ ID NO: 76346

SEQ ID NO: 545033 - RNA, 64 nt, hsa; identical to SEQ ID NO: 76347

SEQ ID NO: 545034 - RNA, 64 nt, hsa; identical to SEQ ID NO: 76348

SEQ ID NO: 545035 - RNA, 64 nt, hsa; identical to SEQ ID NO: 76349

SEQ ID NO: 545036 - RNA, 64 nt, hsa; identical to SEQ ID NO: 76350

SEQ ID NO: 545037 - RNA, 64 nt, hsa; identical to SEQ ID NO: 76351

SEQ ID NO: 545038 - RNA, 64 nt, hsa; identical to SEQ ID NO: 76352

SEQ ID NO: 545039 - RNA, 64 nt, hsa; identical to SEQ ID NO: 76353

SEQ ID NO: 545040 - RNA, 64 nt, hsa; identical to SEQ ID NO: 76354

SEQ ID NO: 545041 - RNA, 64 nt, hsa; identical to SEQ ID NO: 76355

SEQ ID NO: 545042 - RNA, 64 nt, hsa; identical to SEQ ID NO: 76356

SEQ ID NO: 545043 - RNA, 64 nt, hsa; identical to SEQ ID NO: 76357

SEQ ID NO: 545044 - RNA, 64 nt, hsa; identical to SEQ ID NO: 76358

SEQ ID NO: 545045 - RNA, 64 nt, hsa; identical to SEQ ID NO: 76359

SEQ ID NO: 545046 - RNA, 64 nt, hsa; identical to SEQ ID NO: 76360

SEQ ID NO: 545047 - RNA, 64 nt, hsa; identical to SEQ ID NO: 76361

SEQ ID NO: 545048 - RNA, 64 nt, hsa; identical to SEQ ID NO: 76362

SEQ ID NO: 545049 - RNA, 64 nt, hsa; identical to SEQ ID NO: 76363

SEQ ID NO: 545050 - RNA, 64 nt, hsa; identical to SEQ ID NO: 76364

SEQ ID NO: 545051 - RNA, 64 nt, hsa; identical to SEQ ID NO: 76365

SEQ ID NO: 545052 - RNA, 64 nt, hsa; identical to SEQ ID NO: 76366

SEQ ID NO: 545053 - RNA, 64 nt, hsa; identical to SEQ ID NO: 76367

SEQ ID NO: 545054 - RNA, 64 nt, hsa; identical to SEQ ID NO: 76368

SEQ ID NO: 545055 - RNA, 64 nt, hsa; identical to SEQ ID NO: 76369

SEQ ID NO: 545056 - RNA, 64 nt, hsa; identical to SEQ ID NO: 76370

SEQ ID NO: 545057 - RNA, 64 nt, hsa; identical to SEQ ID NO: 76371

SEQ ID NO: 545058 - RNA, 64 nt, hsa; identical to SEQ ID NO: 76372

SEQ ID NO: 545059 - RNA, 64 nt, hsa; identical to SEQ ID NO: 76373

SEQ ID NO: 545060 - RNA, 64 nt, hsa; identical to SEQ ID NO: 76374

SEQ ID NO: 545061 - RNA, 64 nt, hsa; identical to SEQ ID NO: 76375

SEQ ID NO: 545062 - RNA, 64 nt, hsa; identical to SEQ ID NO: 76376

SEQ ID NO: 545063 - RNA, 64 nt, hsa; identical to SEQ ID NO: 76377

SEQ ID NO: 545064 - RNA, 64 nt, hsa; identical to SEQ ID NO: 76378

SEQ ID NO: 545065 - RNA, 64 nt, hsa; identical to SEQ ID NO: 76379

SEQ ID NO: 545066 - RNA, 64 nt, hsa; identical to SEQ ID NO: 76380

SEQ ID NO: 545067 - RNA, 64 nt, hsa; identical to SEQ ID NO: 76381

SEQ ID NO: 545068 - RNA, 64 nt, hsa
uuggacaucuguuuucacucuuaggcuuuuaaacaauaguuauugcuuuuaucccucucagauu

SEQ ID NO: 545069 - RNA, 64 nt, hsa
guaauaagaccauuuggaauuacuggacuaauugaauaguuaagguuucuauucgggacaauaa

SEQ ID NO: 545070 - RNA, 64 nt, hsa
uuaccucgugcauuguauaauuugauguaaaagaaauaguuaccaaugcuagcuuguguggucu

SEQ ID NO: 545071 - RNA, 64 nt, hsa
cccuagcuucaugaugugacucuuaaaaaacuauaauaguuaacaacuguuaguaagauagacc

SEQ ID NO: 545072 - RNA, 64 nt, hsa
auacauauucaccacuugagauucauaacauaucaauaguuauuucauaaauauagaaaugaaa

SEQ ID NO: 545073 - RNA, 64 nt, hsa
cuggaacaggccuuagaaacaauugauuuauuccaauaguuaaccacuggcuggcucccaacuc

SEQ ID NO: 545074 - RNA, 64 nt, hsa
auauaacacauccauucuugcuguuuaaauuuucaauaguuaauggaaaguugucuuugaccuu

SEQ ID NO: 545075 - RNA, 64 nt, hsa
auagcaacagugucucaugauuuaauggcucagaaauaguuauucauuaguuuuuaauuuuuaa

SEQ ID NO: 545076 - RNA, 64 nt, hsa
agcugccuguuucuuaaugcauugauuaaaguuuaauaguuaucaaaaucaccuaauuuuuaaa

SEQ ID NO: 545077 - RNA, 64 nt, hsa
uugaacccaccaugacagaaaguaaauuuuaggaaauaguuaugagauuaagggaaaaucuaua

SEQ ID NO: 545078 - RNA, 64 nt, hsa
uuacauguuugugugcaacugcuucauugcuauuaauaguuaaaugaaaucugcauauucugga

SEQ ID NO: 545079 - RNA, 64 nt, hsa
ucccuuccuuuacaguuuaaaaaaaaaaucuaaaaauaguuaagcacugugucaaagaguguuu

SEQ ID NO: 545080 - RNA, 64 nt, hsa
ccuaaguaccuuuaaggaaaauuaauaaaucauuaauaguuaaaauguuuacauugagcacuag

SEQ ID NO: 545081 - RNA, 64 nt, hsa
ggccauccaauuaccauuuuuucuuucaguccaaaauaguuagacccuugcauacagaaguggu

SEQ ID NO: 545082 - RNA, 56 nt, hsa
uggaagaacaucccuuguaaagcuaaaauaguuacuucaaauuuucagaaaagaug

SEQ ID NO: 545083 - RNA, 64 nt, hsa
auaccagaauaaaucuacagcuagacccuuagucaauaguuaaccaaaaaauugcaauuuguuu

SEQ ID NO: 545084 - RNA, 56 nt, hsa
uggaaacacaucccuuguaaagcuaaaauaguuacuucaaauuuucagaaaagaug

SEQ ID NO: 545085 - RNA, 64 nt, hsa; identical to SEQ ID NO: 545083

SEQ ID NO: 545086 - RNA, 64 nt, hsa
uccccccacacucucccucccccaucaccaucuucaauucuaauaaauaaugcugauguucaac

SEQ ID NO: 545087 - RNA, 64 nt, hsa
aacauuuucagaaacuuagugauaacauuaugaacaauucuaaaagcccugugauuugaaaaau

SEQ ID NO: 545088 - RNA, 64 nt, hsa
agcauagacauauuuuuuuaaaguauaaaaacaacaauucuauagauagauggcuuaauaaaau

SEQ ID NO: 545089 - RNA, 64 nt, hsa
cucaaaagcagcagcaagucgucaagaagcacaccaauucuaacccacaagauuccaucugugg

SEQ ID NO: 545090 - RNA, 64 nt, hsa
auauauguuggaccucugaaaaguuguaaggggccaauucuaaguauucuucacggcagccaga

SEQ ID NO: 545091 - RNA, 64 nt, hsa
caaacaaauguaagacuacaaaaucguucaagagcaauucuaauauaauuuacauauguucacg

SEQ ID NO: 545092 - RNA, 64 nt, hsa; identical to SEQ ID NO: 94750

SEQ ID NO: 545093 - RNA, 64 nt, hsa; identical to SEQ ID NO: 94751

SEQ ID NO: 545094 - RNA, 64 nt, hsa; identical to SEQ ID NO: 94752

SEQ ID NO: 545095 - RNA, 64 nt, hsa; identical to SEQ ID NO: 94753

SEQ ID NO: 545096 - RNA, 64 nt, hsa; identical to SEQ ID NO: 94754

SEQ ID NO: 545097 - RNA, 64 nt, hsa; identical to SEQ ID NO: 94755

SEQ ID NO: 545098 - RNA, 64 nt, hsa; identical to SEQ ID NO: 94756

SEQ ID NO: 545099 - RNA, 64 nt, hsa; identical to SEQ ID NO: 94757

SEQ ID NO: 545100 - RNA, 64 nt, hsa; identical to SEQ ID NO: 94758

SEQ ID NO: 545101 - RNA, 64 nt, hsa; identical to SEQ ID NO: 94759

SEQ ID NO: 545102 - RNA, 64 nt, hsa; identical to SEQ ID NO: 94760

SEQ ID NO: 545103 - RNA, 64 nt, hsa; identical to SEQ ID NO: 94761

SEQ ID NO: 545104 - RNA, 64 nt, hsa; identical to SEQ ID NO: 94762

SEQ ID NO: 545105 - RNA, 64 nt, hsa; identical to SEQ ID NO: 94763

SEQ ID NO: 545106 - RNA, 64 nt, hsa; identical to SEQ ID NO: 94764

SEQ ID NO: 545107 - RNA, 64 nt, hsa; identical to SEQ ID NO: 94765

SEQ ID NO: 545108 - RNA, 64 nt, hsa; identical to SEQ ID NO: 94766

SEQ ID NO: 545109 - RNA, 64 nt, hsa; identical to SEQ ID NO: 94767

SEQ ID NO: 545110 - RNA, 64 nt, hsa; identical to SEQ ID NO: 94768

SEQ ID NO: 545111 - RNA, 64 nt, hsa; identical to SEQ ID NO: 94769

SEQ ID NO: 545112 - RNA, 64 nt, hsa; identical to SEQ ID NO: 94770

SEQ ID NO: 545113 - RNA, 64 nt, hsa; identical to SEQ ID NO: 94771

SEQ ID NO: 545114 - RNA, 64 nt, hsa; identical to SEQ ID NO: 94772

SEQ ID NO: 545115 - RNA, 64 nt, hsa; identical to SEQ ID NO: 94773

SEQ ID NO: 545116 - RNA, 64 nt, hsa; identical to SEQ ID NO: 94774

SEQ ID NO: 545117 - RNA, 64 nt, hsa; identical to SEQ ID NO: 94775

SEQ ID NO: 545118 - RNA, 64 nt, hsa; identical to SEQ ID NO: 94776

SEQ ID NO: 545119 - RNA, 64 nt, hsa; identical to SEQ ID NO: 94777

SEQ ID NO: 545120 - RNA, 64 nt, hsa; identical to SEQ ID NO: 94778

SEQ ID NO: 545121 - RNA, 64 nt, hsa; identical to SEQ ID NO: 94779

SEQ ID NO: 545122 - RNA, 64 nt, hsa; identical to SEQ ID NO: 94780

SEQ ID NO: 545123 - RNA, 64 nt, hsa; identical to SEQ ID NO: 94781

SEQ ID NO: 545124 - RNA, 64 nt, hsa; identical to SEQ ID NO: 94782

SEQ ID NO: 545125 - RNA, 64 nt, hsa; identical to SEQ ID NO: 94783

SEQ ID NO: 545126 - RNA, 64 nt, hsa; identical to SEQ ID NO: 94784

SEQ ID NO: 545127 - RNA, 64 nt, hsa; identical to SEQ ID NO: 94785

SEQ ID NO: 545128 - RNA, 64 nt, hsa; identical to SEQ ID NO: 94786

SEQ ID NO: 545129 - RNA, 64 nt, hsa; identical to SEQ ID NO: 94787

SEQ ID NO: 545130 - RNA, 64 nt, hsa; identical to SEQ ID NO: 94788

SEQ ID NO: 545131 - RNA, 64 nt, hsa; identical to SEQ ID NO: 94789

SEQ ID NO: 545132 - RNA, 64 nt, hsa; identical to SEQ ID NO: 94790

SEQ ID NO: 545133 - RNA, 64 nt, hsa; identical to SEQ ID NO: 94791

SEQ ID NO: 545134 - RNA, 64 nt, hsa; identical to SEQ ID NO: 94792

SEQ ID NO: 545135 - RNA, 64 nt, hsa; identical to SEQ ID NO: 94793

SEQ ID NO: 545136 - RNA, 64 nt, hsa; identical to SEQ ID NO: 94794

SEQ ID NO: 545137 - RNA, 64 nt, hsa; identical to SEQ ID NO: 94795

SEQ ID NO: 545138 - RNA, 64 nt, hsa; identical to SEQ ID NO: 94796

SEQ ID NO: 545139 - RNA, 64 nt, hsa; identical to SEQ ID NO: 94797

SEQ ID NO: 545140 - RNA, 64 nt, hsa; identical to SEQ ID NO: 94798

SEQ ID NO: 545141 - RNA, 64 nt, hsa; identical to SEQ ID NO: 94799

SEQ ID NO: 545142 - RNA, 64 nt, hsa; identical to SEQ ID NO: 94800

SEQ ID NO: 545143 - RNA, 64 nt, hsa; identical to SEQ ID NO: 94801

SEQ ID NO: 545144 - RNA, 64 nt, hsa; identical to SEQ ID NO: 94802

SEQ ID NO: 545145 - RNA, 64 nt, hsa; identical to SEQ ID NO: 94803

SEQ ID NO: 545146 - RNA, 64 nt, hsa; identical to SEQ ID NO: 94804

SEQ ID NO: 545147 - RNA, 64 nt, hsa; identical to SEQ ID NO: 94805

SEQ ID NO: 545148 - RNA, 64 nt, hsa; identical to SEQ ID NO: 94806

SEQ ID NO: 545149 - RNA, 64 nt, hsa; identical to SEQ ID NO: 94807

SEQ ID NO: 545150 - RNA, 64 nt, hsa; identical to SEQ ID NO: 94808

SEQ ID NO: 545151 - RNA, 64 nt, hsa; identical to SEQ ID NO: 94809

SEQ ID NO: 545152 - RNA, 64 nt, hsa; identical to SEQ ID NO: 94810

SEQ ID NO: 545153 - RNA, 64 nt, hsa; identical to SEQ ID NO: 94811

SEQ ID NO: 545154 - RNA, 64 nt, hsa; identical to SEQ ID NO: 94812

SEQ ID NO: 545155 - RNA, 64 nt, hsa; identical to SEQ ID NO: 94813

SEQ ID NO: 545156 - RNA, 64 nt, hsa; identical to SEQ ID NO: 94814

SEQ ID NO: 545157 - RNA, 64 nt, hsa; identical to SEQ ID NO: 94815

SEQ ID NO: 545158 - RNA, 64 nt, hsa; identical to SEQ ID NO: 94816

SEQ ID NO: 545159 - RNA, 64 nt, hsa; identical to SEQ ID NO: 94817

SEQ ID NO: 545160 - RNA, 64 nt, hsa; identical to SEQ ID NO: 94818

SEQ ID NO: 545161 - RNA, 64 nt, hsa; identical to SEQ ID NO: 94819

SEQ ID NO: 545162 - RNA, 64 nt, hsa; identical to SEQ ID NO: 94820

SEQ ID NO: 545163 - RNA, 64 nt, hsa; identical to SEQ ID NO: 94821

SEQ ID NO: 545164 - RNA, 64 nt, hsa; identical to SEQ ID NO: 94822

SEQ ID NO: 545165 - RNA, 64 nt, hsa; identical to SEQ ID NO: 94823

SEQ ID NO: 545166 - RNA, 64 nt, hsa; identical to SEQ ID NO: 94824

SEQ ID NO: 545167 - RNA, 64 nt, hsa; identical to SEQ ID NO: 94825

SEQ ID NO: 545168 - RNA, 64 nt, hsa; identical to SEQ ID NO: 94826

SEQ ID NO: 545169 - RNA, 64 nt, hsa; identical to SEQ ID NO: 94827

SEQ ID NO: 545170 - RNA, 64 nt, hsa; identical to SEQ ID NO: 94828

SEQ ID NO: 545171 - RNA, 64 nt, hsa; identical to SEQ ID NO: 94829

SEQ ID NO: 545172 - RNA, 64 nt, hsa; identical to SEQ ID NO: 94830

SEQ ID NO: 545173 - RNA, 64 nt, hsa; identical to SEQ ID NO: 94831

SEQ ID NO: 545174 - RNA, 64 nt, hsa; identical to SEQ ID NO: 94832

SEQ ID NO: 545175 - RNA, 64 nt, hsa; identical to SEQ ID NO: 94833

SEQ ID NO: 545176 - RNA, 64 nt, hsa; identical to SEQ ID NO: 94834

SEQ ID NO: 545177 - RNA, 64 nt, hsa; identical to SEQ ID NO: 94835

SEQ ID NO: 545178 - RNA, 64 nt, hsa; identical to SEQ ID NO: 102085

SEQ ID NO: 545179 - RNA, 64 nt, hsa; identical to SEQ ID NO: 102086

SEQ ID NO: 545180 - RNA, 64 nt, hsa; identical to SEQ ID NO: 102087

SEQ ID NO: 545181 - RNA, 64 nt, hsa; identical to SEQ ID NO: 102088

SEQ ID NO: 545182 - RNA, 64 nt, hsa; identical to SEQ ID NO: 109461

SEQ ID NO: 545183 - RNA, 64 nt, hsa; identical to SEQ ID NO: 109462

SEQ ID NO: 545184 - RNA, 64 nt, hsa; identical to SEQ ID NO: 109463

SEQ ID NO: 545185 - RNA, 64 nt, hsa; identical to SEQ ID NO: 109464

SEQ ID NO: 545186 - RNA, 64 nt, hsa; identical to SEQ ID NO: 109465

SEQ ID NO: 545187 - RNA, 64 nt, hsa; identical to SEQ ID NO: 109466

SEQ ID NO: 545188 - RNA, 64 nt, hsa
uaugaacuuuuuauccaaugacucaacucuaauuacaucuaaguuagacuugcucacguucagu

SEQ ID NO: 545189 - RNA, 64 nt, hsa
auugauuucauacagaagaugacugugauccaugacaucuaauaaugcccuuucuuuaucugag

SEQ ID NO: 545190 - RNA, 64 nt, hsa
aaaagaaauggguuucugcuaaugaauugagcagacaucuaauauuuuauaugccuuuugagcu

SEQ ID NO: 545191 - RNA, 64 nt, hsa
caccagcuuguaaaaacuuagugcgagagcugaaacaucuaaauaaauaaugacaugcauuuau

SEQ ID NO: 545192 - RNA, 64 nt, hsa
aguaacacauauguaguauaauuucuagaaacaaacaucuaauaaguauauaauccugugaaaa

SEQ ID NO: 545193 - RNA, 64 nt, hsa
ucagaggauaaauaucaauggaacucagagaugaacaucuaacccacuagaggaaaccaguuug

SEQ ID NO: 545194 - RNA, 59 nt, hsa
gccgaguauggucacugugacguguuagaacaucuaauccacaaagguaugugaaaagg

SEQ ID NO: 545195 - RNA, 64 nt, hsa
uucuuuuagugcacugaaauaucuuaucccaguaacaucuaaaaaugcaauucggaaaaguggg

SEQ ID NO: 545196 - RNA, 64 nt, hsa
uauuuuuuuauaucccgauuugcacuuugagaauacaucuaaggucaucuuucaaaagagaaaa

SEQ ID NO: 545197 - RNA, 64 nt, hsa
gguuucuaauucugcagagacacccguuucagccacaucuaaaagagcacaguuuauguggugc

SEQ ID NO: 545198 - RNA, 64 nt, hsa
uuaaacuauugacuugguaagucuacuguauauaacaucuaauauauauauauuauaggccagc

SEQ ID NO: 545199 - RNA, 64 nt, hsa
uuaaacuauugacuugguaagucuacuguauauaacaucuaauauauauauuacaggccaaaug

SEQ ID NO: 545200 - RNA, 64 nt, hsa
guggaauuuaucccaggaauucaagguugguucaacaucuaaaaaucaaauaagcuaauauaca

SEQ ID NO: 545201 - RNA, 64 nt, hsa
acagcaguuagguuaggaauucaagguuuguucaacaucuaaaaaucaaauaagcuaauaaaga

SEQ ID NO: 545202 - RNA, 64 nt, hsa; identical to SEQ ID NO: 300148

SEQ ID NO: 545203 - RNA, 64 nt, hsa; identical to SEQ ID NO: 300149

SEQ ID NO: 545204 - RNA, 64 nt, hsa; identical to SEQ ID NO: 300150

SEQ ID NO: 545205 - RNA, 64 nt, hsa; identical to SEQ ID NO: 300151

SEQ ID NO: 545206 - RNA, 64 nt, hsa; identical to SEQ ID NO: 300152

SEQ ID NO: 545207 - RNA, 64 nt, hsa; identical to SEQ ID NO: 300153

SEQ ID NO: 545208 - RNA, 64 nt, hsa; identical to SEQ ID NO: 300154

SEQ ID NO: 545209 - RNA, 64 nt, hsa; identical to SEQ ID NO: 300155

SEQ ID NO: 545210 - RNA, 64 nt, hsa; identical to SEQ ID NO: 300156

SEQ ID NO: 545211 - RNA, 64 nt, hsa; identical to SEQ ID NO: 300157

SEQ ID NO: 545212 - RNA, 64 nt, hsa; identical to SEQ ID NO: 300158

SEQ ID NO: 545213 - RNA, 64 nt, hsa; identical to SEQ ID NO: 300159

SEQ ID NO: 545214 - RNA, 64 nt, hsa; identical to SEQ ID NO: 300160

SEQ ID NO: 545215 - RNA, 64 nt, hsa; identical to SEQ ID NO: 300161

SEQ ID NO: 545216 - RNA, 64 nt, hsa; identical to SEQ ID NO: 300162

SEQ ID NO: 545217 - RNA, 64 nt, hsa; identical to SEQ ID NO: 300163

SEQ ID NO: 545218 - RNA, 64 nt, hsa; identical to SEQ ID NO: 300164

SEQ ID NO: 545219 - RNA, 64 nt, hsa; identical to SEQ ID NO: 300165

SEQ ID NO: 545220 - RNA, 64 nt, hsa; identical to SEQ ID NO: 300166

SEQ ID NO: 545221 - RNA, 64 nt, hsa; identical to SEQ ID NO: 300167

SEQ ID NO: 545222 - RNA, 64 nt, hsa; identical to SEQ ID NO: 300168

SEQ ID NO: 545223 - RNA, 64 nt, hsa; identical to SEQ ID NO: 300169

SEQ ID NO: 545224 - RNA, 64 nt, hsa; identical to SEQ ID NO: 300170

SEQ ID NO: 545225 - RNA, 64 nt, hsa; identical to SEQ ID NO: 300171

SEQ ID NO: 545226 - RNA, 64 nt, hsa; identical to SEQ ID NO: 300172

SEQ ID NO: 545227 - RNA, 64 nt, hsa; identical to SEQ ID NO: 300173

SEQ ID NO: 545228 - RNA, 64 nt, hsa; identical to SEQ ID NO: 300174

SEQ ID NO: 545229 - RNA, 64 nt, hsa; identical to SEQ ID NO: 300175

SEQ ID NO: 545230 - RNA, 64 nt, hsa; identical to SEQ ID NO: 300176

SEQ ID NO: 545231 - RNA, 64 nt, hsa; identical to SEQ ID NO: 300177

SEQ ID NO: 545232 - RNA, 64 nt, hsa; identical to SEQ ID NO: 300178

SEQ ID NO: 545233 - RNA, 64 nt, hsa; identical to SEQ ID NO: 300179

SEQ ID NO: 545234 - RNA, 64 nt, hsa; identical to SEQ ID NO: 300180

SEQ ID NO: 545235 - RNA, 64 nt, hsa; identical to SEQ ID NO: 300181

SEQ ID NO: 545236 - RNA, 64 nt, hsa; identical to SEQ ID NO: 300182

SEQ ID NO: 545237 - RNA, 64 nt, hsa; identical to SEQ ID NO: 300183

SEQ ID NO: 545238 - RNA, 64 nt, hsa; identical to SEQ ID NO: 300184

SEQ ID NO: 545239 - RNA, 64 nt, hsa; identical to SEQ ID NO: 300185

SEQ ID NO: 545240 - RNA, 64 nt, hsa; identical to SEQ ID NO: 300186

SEQ ID NO: 545241 - RNA, 64 nt, hsa; identical to SEQ ID NO: 300187

SEQ ID NO: 545242 - RNA, 64 nt, hsa; identical to SEQ ID NO: 300188

SEQ ID NO: 545243 - RNA, 64 nt, hsa; identical to SEQ ID NO: 300189

SEQ ID NO: 545244 - RNA, 64 nt, hsa; identical to SEQ ID NO: 300190

SEQ ID NO: 545245 - RNA, 64 nt, hsa; identical to SEQ ID NO: 300191

SEQ ID NO: 545246 - RNA, 64 nt, hsa
caucugcuuccaucccagugaaauuuaccuguagcccagugaaggguguguuuggaacauucau

SEQ ID NO: 545247 - RNA, 64 nt, hsa
guacuguuugauugggugguucaucugcuuccaucccagugaaauuuaccuguagcccagugaa

SEQ ID NO: 545248 - RNA, 64 nt, hsa
cgacuggacugucacgggguucccuccuagcucucccagugaacuccugccaggcacacacagc

SEQ ID NO: 545249 - RNA, 64 nt, hsa
uuccaccaggccgugccuuguuugaguuuuuccucccagugagacugccccacggagacagagg

SEQ ID NO: 545250 - RNA, 64 nt, hsa
acagugggcccagccaccuauuuuaacaagcccucccagugauugugauacauacuaaaguuug

SEQ ID NO: 545251 - RNA, 64 nt, hsa
acauuagggugagaguuugauuauuuaggaugaucccagugauuucaugugugcucucugaccu

SEQ ID NO: 545252 - RNA, 64 nt, hsa
uaggccagcugccgagcugggcuauguucuggaacccagugaaucuugggggccaggcacugug

SEQ ID NO: 545253 - RNA, 64 nt, hsa
ggugagcuauggagacccaggccaacaaauuauccccagugauauggggggaggaggggcuaga

SEQ ID NO: 545254 - RNA, 64 nt, hsa
gagccugaaauagugguucuuggaaaaauggauccccagugaaaacuagagcucuaagcccauu

SEQ ID NO: 545255 - RNA, 64 nt, hsa
aagaggccaggacagagcugacaaaauuuugcuccccagugaaggccacagcaaccuucugccc

SEQ ID NO: 545256 - RNA, 64 nt, hsa
uacauucugcugccaccagucaccaaaggcccuucccagugagggguggaagggaucucugggg

SEQ ID NO: 545257 - RNA, 64 nt, hsa
gggaggcuuccccagccuuaagagacccucucagcccagugacuguccccaaacccaagucucc

SEQ ID NO: 545258 - RNA, 64 nt, hsa
gaaaaagugaaaaaggcuuccgggcuguccucugcccagugagauggaggacgcuagagaaagu

SEQ ID NO: 545259 - RNA, 64 nt, hsa
gcagcucccaacggcgaugcuacuacuaagaauccccagugaucugauucuucuguuuuuuaau

SEQ ID NO: 545260 - RNA, 64 nt, hsa
acggagggaaggucagaggagaaggcaggcagggcccagugagaggggagcaugccuuccccca

SEQ ID NO: 545261 - RNA, 64 nt, hsa
ucgggugaaggagggcccaggucaguucuggggucccagugaccugcuuugccauucuccuggu

SEQ ID NO: 545262 - RNA, 64 nt, hsa
cccaucccuggauccacaggggcuaucgaggagacccagugagaauguagcauuuuguucaucc

SEQ ID NO: 545263 - RNA, 64 nt, hsa
cggugacuguccuggacagcaaggagcaugcuaccccagugagcacuucuuuuugagggacuug

SEQ ID NO: 545264 - RNA, 64 nt, hsa
cucuugcucaauccgagguggaaaaagaucaccucccagugaccucccucagcccccaggggag

SEQ ID NO: 545265 - RNA, 64 nt, hsa
ccuugaugggggcugugaguggggcagugugauacccagugacuagacgcacucugcguuuucc

SEQ ID NO: 545266 - RNA, 64 nt, hsa
cccggauccgguggggugaaagcagccagcucaucccagugacucacaggacacagccauccag

SEQ ID NO: 545267 - RNA, 64 nt, hsa
aaauguagucccuggacuggagguucccugcacucccagugagccagccaccaccacaaccugu

SEQ ID NO: 545268 - RNA, 64 nt, hsa
aauaaaaaggacaaauggauacagccuugacccucccagugaggagaccccaauucagcaauaa

SEQ ID NO: 545269 - RNA, 64 nt, hsa
ggaaggagcuugccucuuugagaaaccaaggagucccagugaucuguuaccauuugguuaugac

SEQ ID NO: 545270 - RNA, 64 nt, hsa
agucuuuuuagagaaggggccaggguggaacaaucccagugaguaaauuauuucucagcgugga

SEQ ID NO: 545271 - RNA, 64 nt, hsa
ucccucuuuguuccaagcagaagcauucuggcaucccagugaagagcucaggcccucaggaagu

SEQ ID NO: 545272 - RNA, 64 nt, hsa
ccauucauucccaugggcacagcuaacauuaucccccagugauuacuuucgauuacacugaaga

SEQ ID NO: 545273 - RNA, 64 nt, hsa
uggggaggacuugguggcgauccgcaaccuggaccccagugagaggcggugggcugacugggaa

SEQ ID NO: 545274 - RNA, 64 nt, hsa
ugggaacggggagccucuggggggcaccuguuuccccagugacucagagagagcaagacugcag

SEQ ID NO: 545275 - RNA, 64 nt, hsa
uuaagaaaauaugccuguugaugaaagcuaaaagcaaauuuaugaaacuaaaagggugauugac

SEQ ID NO: 545276 - RNA, 64 nt, hsa
uuuuaucaucugcagucaaauaacugagccaauccaaauuuaaaugauagaugcuuuaauugag

SEQ ID NO: 545277 - RNA, 64 nt, hsa
aagcaauaacaaagaagaaaaccaaauuauuguucaaauuuagguuuaaacuuuugaagcaaac

SEQ ID NO: 545278 - RNA, 64 nt, hsa
gugacuguuaaaacuuccuuuuaaaucaaaaugccaaauuuauuaaggugguggagccacugca

SEQ ID NO: 545279 - RNA, 64 nt, hsa
cuuaaaauguuucauuuucauuaaaaaugaaagccaaauuuauaugccaccgauugcaggacac

SEQ ID NO: 545280 - RNA, 64 nt, hsa
augucacgucuugaaaagccuauuagauguuuuacaaauuuaauuuugcagauuauuuuagucu

SEQ ID NO: 545281 - RNA, 64 nt, hsa
ugcuuucaguuuuagccuauuaauuuuagguggacaaauuuaacaaguuuucuguuacuuuuua

SEQ ID NO: 545282 - RNA, 64 nt, hsa
acaggaugcaaacuaaaaaccuaaucccugccaucaaauuuauuagaagagaccuauauaugaa

SEQ ID NO: 545283 - RNA, 64 nt, hsa
guaguuauuccuagcuccauuucuuauuuuccaccaaauuuaauugaagggcauuaauuagaug

SEQ ID NO: 545284 - RNA, 64 nt, hsa
uacacaauaugcacauuuuuaccauugugggguccaaauuuaagauaccuuccacucacuaaua

SEQ ID NO: 545285 - RNA, 64 nt, hsa
auucaggcuccacaauaaauuuuaaugagcacuacaaauuuagaauauauaaaaauaucaguaa

SEQ ID NO: 545286 - RNA, 64 nt, hsa
auacucuauuuggaguugugcaagugagaagccccaaauuuauaagucaauauccucauucaga

SEQ ID NO: 545287 - RNA, 64 nt, hsa
guuugacaugagauaguuuaaguuccacaaaauccaaauuuaccauauuauuguuuuuaaaaaa

SEQ ID NO: 545288 - RNA, 64 nt, hsa
uagaugcagggacagggaucagaugggacaauaucaaauuuacuuugugcccuacaaguuaaaa

SEQ ID NO: 545289 - RNA, 64 nt, hsa
gccuaaacuaauuuuuagauaguuccuggucacucaaauuuaagaaugucagcaaugucaauuu

SEQ ID NO: 545290 - RNA, 64 nt, hsa
cacuaaaagcaugaauuggaacugcaaugaaagucaaauuuacuuuaaaaagaaauuaauaugg

SEQ ID NO: 545291 - RNA, 64 nt, hsa
uucuugagaaguaacuguccgcuagaagucuguccaaauuuaaaaugugugccauauucugguu

SEQ ID NO: 545292 - RNA, 64 nt, hsa
ugacaguaacuuucaugacauaggauucugccgccaaauuuauaucauuaacaaugugugccuu

SEQ ID NO: 545293 - RNA, 64 nt, hsa
uuauuguaaauacugcccuagugucuccauggaccaaauuuauauuuauaauuguagauuuuua

SEQ ID NO: 545294 - RNA, 64 nt, hsa
augauugucauguccuccuuuaaggcuuuucccucaaauuuauuacaaauuuaguauuuuuagu

SEQ ID NO: 545295 - RNA, 64 nt, hsa
guccuccuuuaaggcuuuucccucaaauuuauuacaaauuuaguauuuuuaguacuugaugacu

SEQ ID NO: 545296 - RNA, 64 nt, hsa
ugguucagcuacuuuccauuugguauuacacagucaaauuuacauuuaucuauuaaaauugcca

SEQ ID NO: 545297 - RNA, 64 nt, hsa
cacuuacaccaguuugacugugcuagcuaaaagacaaauuuaaggggagcucuucaacauuaag

SEQ ID NO: 545298 - RNA, 64 nt, hsa
uugaggaaguuccaaauuuguagccaguuccaaacaaauuuaaauauugaguugagaccuguau

SEQ ID NO: 545299 - RNA, 64 nt, hsa
uugguauaauggagaagaugguuuagguguacagcaaauuuaaaauagucaguggauugugucu

SEQ ID NO: 545300 - RNA, 64 nt, hsa
cuuugcaguaaaaugacgguuguaacuacuaaaccaaauuuaguuuucacagcaugguuuuguu

SEQ ID NO: 545301 - RNA, 64 nt, hsa
gauuaagcuggaauuauaaugagagcaauaagaacaaauuuauuuugcuuaccacaguguuaua

SEQ ID NO: 545302 - RNA, 64 nt, hsa
ucgucaguacgagcugcucuaagaagggaacccccaaauuuaauuaaagccuuaagcacaauua

SEQ ID NO: 545303 - RNA, 64 nt, hsa
aacccccuuuucccuucagcuugcuuagauguuccaaauuuagaaagcuuaaggcggccuacag

SEQ ID NO: 545304 - RNA, 64 nt, hsa
guucuugugaauuuccacuuuccagguagaugaccaaauuuagguggucaagauauaaaggugu

SEQ ID NO: 545305 - RNA, 64 nt, hsa
ucacuuucacacugccuucaggccagaagcaaaccaaauuuaccagguuuggcuggaggaguuu

SEQ ID NO: 545306 - RNA, 64 nt, hsa
aaguuaggguuaggacauccuuuuuuaaaaauuacaaauuuaguccguuuugguuuuuguaauc

SEQ ID NO: 545307 - RNA, 64 nt, hsa
cccgcucccucuggcagcgaauguaggaagucgccaaauuuacccacucuucaacaagucauug

SEQ ID NO: 545308 - RNA, 64 nt, hsa
uuacuacuuuaagugauauucauuuaaaacauugcaaauuuauuuuauuuauuuaauuuucuuu

SEQ ID NO: 545309 - RNA, 64 nt, hsa
caggcuugagccaccacgcccggcuaaaacauugcaaauuuaaaugagaguuuuaaaaauuaaa

SEQ ID NO: 545310 - RNA, 64 nt, hsa; identical to SEQ ID NO: 80933

SEQ ID NO: 545311 - RNA, 64 nt, hsa; identical to SEQ ID NO: 80934

SEQ ID NO: 545312 - RNA, 64 nt, hsa; identical to SEQ ID NO: 80935

SEQ ID NO: 545313 - RNA, 64 nt, hsa; identical to SEQ ID NO: 80936

SEQ ID NO: 545314 - RNA, 64 nt, hsa; identical to SEQ ID NO: 80937

SEQ ID NO: 545315 - RNA, 64 nt, hsa; identical to SEQ ID NO: 80938

SEQ ID NO: 545316 - RNA, 64 nt, hsa; identical to SEQ ID NO: 80939

SEQ ID NO: 545317 - RNA, 64 nt, hsa; identical to SEQ ID NO: 80940

SEQ ID NO: 545318 - RNA, 64 nt, hsa; identical to SEQ ID NO: 80941

SEQ ID NO: 545319 - RNA, 64 nt, hsa; identical to SEQ ID NO: 80942

SEQ ID NO: 545320 - RNA, 64 nt, hsa; identical to SEQ ID NO: 80943

SEQ ID NO: 545321 - RNA, 64 nt, hsa; identical to SEQ ID NO: 80944

SEQ ID NO: 545322 - RNA, 64 nt, hsa; identical to SEQ ID NO: 80945

SEQ ID NO: 545323 - RNA, 64 nt, hsa; identical to SEQ ID NO: 80946

SEQ ID NO: 545324 - RNA, 64 nt, hsa; identical to SEQ ID NO: 80947

SEQ ID NO: 545325 - RNA, 64 nt, hsa; identical to SEQ ID NO: 80948

SEQ ID NO: 545326 - RNA, 64 nt, hsa; identical to SEQ ID NO: 80949

SEQ ID NO: 545327 - RNA, 64 nt, hsa; identical to SEQ ID NO: 80950

SEQ ID NO: 545328 - RNA, 64 nt, hsa; identical to SEQ ID NO: 80951

SEQ ID NO: 545329 - RNA, 64 nt, hsa; identical to SEQ ID NO: 80952

SEQ ID NO: 545330 - RNA, 64 nt, hsa; identical to SEQ ID NO: 80953

SEQ ID NO: 545331 - RNA, 64 nt, hsa; identical to SEQ ID NO: 80954

SEQ ID NO: 545332 - RNA, 63 nt, hsa; identical to SEQ ID NO: 80955

SEQ ID NO: 545333 - RNA, 64 nt, hsa; identical to SEQ ID NO: 80956

SEQ ID NO: 545334 - RNA, 64 nt, hsa; identical to SEQ ID NO: 80957

SEQ ID NO: 545335 - RNA, 64 nt, hsa; identical to SEQ ID NO: 80958

SEQ ID NO: 545336 - RNA, 64 nt, hsa; identical to SEQ ID NO: 80959

SEQ ID NO: 545337 - RNA, 64 nt, hsa; identical to SEQ ID NO: 80960

SEQ ID NO: 545338 - RNA, 64 nt, hsa; identical to SEQ ID NO: 80961

SEQ ID NO: 545339 - RNA, 64 nt, hsa; identical to SEQ ID NO: 80962

SEQ ID NO: 545340 - RNA, 64 nt, hsa; identical to SEQ ID NO: 80963

SEQ ID NO: 545341 - RNA, 64 nt, hsa; identical to SEQ ID NO: 80964

SEQ ID NO: 545342 - RNA, 64 nt, hsa; identical to SEQ ID NO: 80965

SEQ ID NO: 545343 - RNA, 64 nt, hsa; identical to SEQ ID NO: 80966

SEQ ID NO: 545344 - RNA, 64 nt, hsa; identical to SEQ ID NO: 80967

SEQ ID NO: 545345 - RNA, 64 nt, hsa; identical to SEQ ID NO: 80968

SEQ ID NO: 545346 - RNA, 64 nt, hsa; identical to SEQ ID NO: 80969

SEQ ID NO: 545347 - RNA, 64 nt, hsa; identical to SEQ ID NO: 80970

SEQ ID NO: 545348 - RNA, 64 nt, hsa; identical to SEQ ID NO: 80971

SEQ ID NO: 545349 - RNA, 64 nt, hsa; identical to SEQ ID NO: 80972

SEQ ID NO: 545350 - RNA, 64 nt, hsa; identical to SEQ ID NO: 80973

SEQ ID NO: 545351 - RNA, 64 nt, hsa; identical to SEQ ID NO: 80974

SEQ ID NO: 545352 - RNA, 64 nt, hsa; identical to SEQ ID NO: 80975

SEQ ID NO: 545353 - RNA, 64 nt, hsa; identical to SEQ ID NO: 80976

SEQ ID NO: 545354 - RNA, 64 nt, hsa; identical to SEQ ID NO: 80977

SEQ ID NO: 545355 - RNA, 64 nt, hsa; identical to SEQ ID NO: 80978

SEQ ID NO: 545356 - RNA, 64 nt, hsa; identical to SEQ ID NO: 80979

SEQ ID NO: 545357 - RNA, 64 nt, hsa; identical to SEQ ID NO: 80980

SEQ ID NO: 545358 - RNA, 64 nt, hsa; identical to SEQ ID NO: 80981

SEQ ID NO: 545359 - RNA, 64 nt, hsa; identical to SEQ ID NO: 80982

SEQ ID NO: 545360 - RNA, 64 nt, hsa; identical to SEQ ID NO: 80983

SEQ ID NO: 545361 - RNA, 64 nt, hsa; identical to SEQ ID NO: 80984

SEQ ID NO: 545362 - RNA, 64 nt, hsa; identical to SEQ ID NO: 80985

SEQ ID NO: 545363 - RNA, 64 nt, hsa; identical to SEQ ID NO: 80986

SEQ ID NO: 545364 - RNA, 64 nt, hsa; identical to SEQ ID NO: 80987

SEQ ID NO: 545365 - RNA, 64 nt, hsa; identical to SEQ ID NO: 80988

SEQ ID NO: 545366 - RNA, 64 nt, hsa; identical to SEQ ID NO: 80989

SEQ ID NO: 545367 - RNA, 64 nt, hsa; identical to SEQ ID NO: 80990

SEQ ID NO: 545368 - RNA, 64 nt, hsa; identical to SEQ ID NO: 80991

SEQ ID NO: 545369 - RNA, 64 nt, hsa; identical to SEQ ID NO: 80992

SEQ ID NO: 545370 - RNA, 64 nt, hsa; identical to SEQ ID NO: 80993

SEQ ID NO: 545371 - RNA, 64 nt, hsa; identical to SEQ ID NO: 80994

SEQ ID NO: 545372 - RNA, 64 nt, hsa; identical to SEQ ID NO: 80995

SEQ ID NO: 545373 - RNA, 64 nt, hsa; identical to SEQ ID NO: 80996

SEQ ID NO: 545374 - RNA, 64 nt, hsa; identical to SEQ ID NO: 80997

SEQ ID NO: 545375 - RNA, 64 nt, hsa; identical to SEQ ID NO: 80998

SEQ ID NO: 545376 - RNA, 64 nt, hsa; identical to SEQ ID NO: 80999

SEQ ID NO: 545377 - RNA, 64 nt, hsa; identical to SEQ ID NO: 81000

SEQ ID NO: 545378 - RNA, 64 nt, hsa; identical to SEQ ID NO: 81001

SEQ ID NO: 545379 - RNA, 64 nt, hsa; identical to SEQ ID NO: 81002

SEQ ID NO: 545380 - RNA, 64 nt, hsa; identical to SEQ ID NO: 81003

SEQ ID NO: 545381 - RNA, 64 nt, hsa; identical to SEQ ID NO: 81004

SEQ ID NO: 545382 - RNA, 64 nt, hsa; identical to SEQ ID NO: 81005

SEQ ID NO: 545383 - RNA, 64 nt, hsa; identical to SEQ ID NO: 81006

SEQ ID NO: 545384 - RNA, 64 nt, hsa; identical to SEQ ID NO: 81007

SEQ ID NO: 545385 - RNA, 64 nt, hsa; identical to SEQ ID NO: 81008

SEQ ID NO: 545386 - RNA, 64 nt, hsa; identical to SEQ ID NO: 81009

SEQ ID NO: 545387 - RNA, 64 nt, hsa; identical to SEQ ID NO: 81010

SEQ ID NO: 545388 - RNA, 64 nt, hsa; identical to SEQ ID NO: 81011

SEQ ID NO: 545389 - RNA, 64 nt, hsa; identical to SEQ ID NO: 81012

SEQ ID NO: 545390 - RNA, 64 nt, hsa; identical to SEQ ID NO: 81013

SEQ ID NO: 545391 - RNA, 64 nt, hsa; identical to SEQ ID NO: 81014

SEQ ID NO: 545392 - RNA, 64 nt, hsa; identical to SEQ ID NO: 81015

SEQ ID NO: 545393 - RNA, 64 nt, hsa; identical to SEQ ID NO: 81016

SEQ ID NO: 545394 - RNA, 64 nt, hsa; identical to SEQ ID NO: 81017

SEQ ID NO: 545395 - RNA, 64 nt, hsa; identical to SEQ ID NO: 81018

SEQ ID NO: 545396 - RNA, 64 nt, hsa; identical to SEQ ID NO: 81019

SEQ ID NO: 545397 - RNA, 64 nt, hsa; identical to SEQ ID NO: 81020

SEQ ID NO: 545398 - RNA, 64 nt, hsa; identical to SEQ ID NO: 81021

SEQ ID NO: 545399 - RNA, 64 nt, hsa; identical to SEQ ID NO: 81022

SEQ ID NO: 545400 - RNA, 64 nt, hsa; identical to SEQ ID NO: 81023

SEQ ID NO: 545401 - RNA, 64 nt, hsa; identical to SEQ ID NO: 81024

SEQ ID NO: 545402 - RNA, 64 nt, hsa; identical to SEQ ID NO: 81025

SEQ ID NO: 545403 - RNA, 64 nt, hsa; identical to SEQ ID NO: 81026

SEQ ID NO: 545404 - RNA, 64 nt, hsa; identical to SEQ ID NO: 81027

SEQ ID NO: 545405 - RNA, 64 nt, hsa; identical to SEQ ID NO: 81028

SEQ ID NO: 545406 - RNA, 64 nt, hsa; identical to SEQ ID NO: 81029

SEQ ID NO: 545407 - RNA, 64 nt, hsa; identical to SEQ ID NO: 81030

SEQ ID NO: 545408 - RNA, 64 nt, hsa; identical to SEQ ID NO: 81031

SEQ ID NO: 545409 - RNA, 64 nt, hsa; identical to SEQ ID NO: 81032

SEQ ID NO: 545410 - RNA, 64 nt, hsa; identical to SEQ ID NO: 81033

SEQ ID NO: 545411 - RNA, 64 nt, hsa; identical to SEQ ID NO: 81034

SEQ ID NO: 545412 - RNA, 64 nt, hsa; identical to SEQ ID NO: 81035

SEQ ID NO: 545413 - RNA, 64 nt, hsa; identical to SEQ ID NO: 81036

SEQ ID NO: 545414 - RNA, 64 nt, hsa; identical to SEQ ID NO: 81037

SEQ ID NO: 545415 - RNA, 64 nt, hsa; identical to SEQ ID NO: 81038

SEQ ID NO: 545416 - RNA, 64 nt, hsa; identical to SEQ ID NO: 81039

SEQ ID NO: 545417 - RNA, 64 nt, hsa; identical to SEQ ID NO: 81040

SEQ ID NO: 545418 - RNA, 64 nt, hsa; identical to SEQ ID NO: 81041

SEQ ID NO: 545419 - RNA, 64 nt, hsa; identical to SEQ ID NO: 81042

SEQ ID NO: 545420 - RNA, 64 nt, hsa; identical to SEQ ID NO: 82841

SEQ ID NO: 545421 - RNA, 64 nt, hsa; identical to SEQ ID NO: 82842

SEQ ID NO: 545422 - RNA, 64 nt, hsa; identical to SEQ ID NO: 82843

SEQ ID NO: 545423 - RNA, 64 nt, hsa; identical to SEQ ID NO: 82844

SEQ ID NO: 545424 - RNA, 64 nt, hsa; identical to SEQ ID NO: 82845

SEQ ID NO: 545425 - RNA, 64 nt, hsa; identical to SEQ ID NO: 82846

SEQ ID NO: 545426 - RNA, 64 nt, hsa; identical to SEQ ID NO: 82847

SEQ ID NO: 545427 - RNA, 64 nt, hsa; identical to SEQ ID NO: 82848

SEQ ID NO: 545428 - RNA, 64 nt, hsa; identical to SEQ ID NO: 82849

SEQ ID NO: 545429 - RNA, 64 nt, hsa; identical to SEQ ID NO: 82850

SEQ ID NO: 545430 - RNA, 64 nt, hsa; identical to SEQ ID NO: 215681

SEQ ID NO: 545431 - RNA, 64 nt, hsa; identical to SEQ ID NO: 215682

SEQ ID NO: 545432 - RNA, 64 nt, hsa; identical to SEQ ID NO: 215683

SEQ ID NO: 545433 - RNA, 64 nt, hsa; identical to SEQ ID NO: 215684

SEQ ID NO: 545434 - RNA, 64 nt, hsa; identical to SEQ ID NO: 215685

SEQ ID NO: 545435 - RNA, 64 nt, hsa; identical to SEQ ID NO: 215686

SEQ ID NO: 545436 - RNA, 64 nt, hsa; identical to SEQ ID NO: 215687

SEQ ID NO: 545437 - RNA, 64 nt, hsa; identical to SEQ ID NO: 215688

SEQ ID NO: 545438 - RNA, 64 nt, hsa; identical to SEQ ID NO: 215689

SEQ ID NO: 545439 - RNA, 64 nt, hsa; identical to SEQ ID NO: 215690

SEQ ID NO: 545440 - RNA, 64 nt, hsa; identical to SEQ ID NO: 215691

SEQ ID NO: 545441 - RNA, 64 nt, hsa; identical to SEQ ID NO: 215692

SEQ ID NO: 545442 - RNA, 64 nt, hsa; identical to SEQ ID NO: 215693

SEQ ID NO: 545443 - RNA, 64 nt, hsa; identical to SEQ ID NO: 215694

SEQ ID NO: 545444 - RNA, 64 nt, hsa; identical to SEQ ID NO: 215695

SEQ ID NO: 545445 - RNA, 64 nt, hsa; identical to SEQ ID NO: 215696

SEQ ID NO: 545446 - RNA, 64 nt, hsa; identical to SEQ ID NO: 215697

SEQ ID NO: 545447 - RNA, 64 nt, hsa; identical to SEQ ID NO: 215698

SEQ ID NO: 545448 - RNA, 64 nt, hsa; identical to SEQ ID NO: 215699

SEQ ID NO: 545449 - RNA, 64 nt, hsa; identical to SEQ ID NO: 215700

SEQ ID NO: 545450 - RNA, 64 nt, hsa; identical to SEQ ID NO: 215701

SEQ ID NO: 545451 - RNA, 64 nt, hsa; identical to SEQ ID NO: 215702

SEQ ID NO: 545452 - RNA, 64 nt, hsa
agcaaguacugagaacucauuuucuacccugccucgucuuaagacauauuuauguaauaccaug

SEQ ID NO: 545453 - RNA, 64 nt, hsa
gcccucuccaugucuucguccuggcaaacagggucgucuuaaaauuaugcgcuaauucuguaug

SEQ ID NO: 545454 - RNA, 64 nt, hsa
uaccgacuuuuuuugguuuggaaacauauuaccacgucuuaauaggauggugcccauauaggug

SEQ ID NO: 545455 - RNA, 64 nt, hsa
cugcacuccagccugggcgacaagagugaaacuccgucuuaaaaaagcccauggcaggcugggc

SEQ ID NO: 545456 - RNA, 64 nt, hsa
uacccaaauacucacaagggucuuaucagacgcccgucuuaaaguccagcaugcucagggaccc

SEQ ID NO: 545457 - RNA, 64 nt, hsa
aagugaugggagaauugguauacugguaugacuacgucuuaagucagauuuuuauuuaugaguc

SEQ ID NO: 545458 - RNA, 64 nt, hsa
uugacuaugggggagagacgcugcauuccagaaacgucuuaacacuugagugaaucuucaaagg

SEQ ID NO: 545459 - RNA, 64 nt, hsa
cauucuuaacuauagagaagaguuacuccccuggcgucuuaaccuauggaaaacaugcacggau

SEQ ID NO: 545460 - RNA, 64 nt, hsa
aguacaccagcuccaaguaaacauuccaaguaagcgucuuaacaccuaaccccaaaggcucuuu

SEQ ID NO: 545461 - RNA, 64 nt, hsa
gugaaauuauggacaagagaaauaauuguaaaaucgucuuaaaggaaaauuuaauuuuuacucc

SEQ ID NO: 545462 - RNA, 64 nt, hsa
guauuacaguggggaaugaagauacugaaauaaacgucuuaaauauucauuuacugguuaucau

SEQ ID NO: 545463 - RNA, 64 nt, hsa
cacugcacuccggccugaugacagagcgagauuccgucuuaaaaaaaaaaaaaaaaaaguuugu

SEQ ID NO: 545464 - RNA, 64 nt, hsa
caugucccugucuaaagagacuuucucuuucauacgucuuaaaucucaucaaugaaauccagug

SEQ ID NO: 545465 - RNA, 64 nt, hsa
auaauugguuuuccccccuaagaacauuuauuuacgucuuaagagcagauaagugacuaagacu

SEQ ID NO: 545466 - RNA, 64 nt, hsa
gugggaagccuggcauuuggggugcuccuugcaacgucuuaagcaagcgaccccccgacauagc

SEQ ID NO: 545467 - RNA, 64 nt, hsa
ugaagaaaaaccuuuaacugagaaauauggaaaccgucuuaauuuuccauuggcuaugauggaa

SEQ ID NO: 545468 - RNA, 64 nt, hsa
uccaccucagggcacgggcaaacacauaggcuugcgucuuaaagccagcuccucugccagaccc

SEQ ID NO: 545469 - RNA, 64 nt, hsa
gauaguaagacagcugaguuuuccucaguuuucucgucuuaacacuaguggacaauucuagcau

SEQ ID NO: 545470 - RNA, 64 nt, hsa
ggguaaauaauuaucuuaucuguuuuuauuaauccgucuuaaauguguauauagcucagauuua

SEQ ID NO: 545471 - RNA, 64 nt, hsa
uguugguguguaugucacuagggcaguggggagacgucuuaacucugcugcuucccaaggaugg

SEQ ID NO: 545472 - RNA, 64 nt, hsa
uaaauuuugugccaguauuuuuuuucuuaaaaaucgucuuaagcucuaagguggucucaguauu

SEQ ID NO: 545473 - RNA, 64 nt, hsa
acuucugcagggcugcugguuccgagcugacacccgucuuaacaaaaggcccaggagugccucu

SEQ ID NO: 545474 - RNA, 64 nt, hsa
aaauguaaaauauuugagaauaaguucauacaaucgucuuaaguuuuuuaugccuuuauauacu

SEQ ID NO: 545475 - RNA, 64 nt, hsa
ucaagaggaggagcugacacauuucacuuggcugcgucuuaauaaacaugaaugcaagcauugg

SEQ ID NO: 545476 - RNA, 64 nt, hsa
cuuuauuguaacgaugaugguuacccuucauggacgucuuaaucuuccacacacauccccuuuu

SEQ ID NO: 545477 - RNA, 64 nt, hsa
acacugcaggcaucacagcuaacaauugugaagucgucuuaacucaccauaaaaaggaauccac

SEQ ID NO: 545478 - RNA, 64 nt, hsa
agacaguuuaguuuuggggaacagaagcucucuucgucuuaagccagauucucugauucuuuua

SEQ ID NO: 545479 - RNA, 64 nt, hsa
uccguguuucagguuccacgcgagucaccucuuucgucuuaauguucaccguccacagcuuugg

SEQ ID NO: 545480 - RNA, 64 nt, hsa
aaaaaaaaguguugcuuucuuaaggaaagcaagacgucuuaaaguauauuuucuugagaugagu

SEQ ID NO: 545481 - RNA, 64 nt, hsa
acuuuuccauaagcagaacaagaaccaaaucaaacgucuuaacgcguauagagagaucacguuc

SEQ ID NO: 545482 - RNA, 64 nt, hsa
ucauuuuucaccuguacaaggaauacuaauggaucgucuuaaaauuggucuaggaaaaaaccuu

SEQ ID NO: 545483 - RNA, 64 nt, hsa
cuuggguguagacaugaaaccaucuuacuaaaagcgucuuaaaaugaccaauuccagaaucaag

SEQ ID NO: 545484 - RNA, 64 nt, hsa
ugcuuuaaagcaauuggucuaaaauauauguaaucgucuuaauuaaaaaguugcaguaggguug

SEQ ID NO: 545485 - RNA, 64 nt, hsa
uccuguuacguguuucaggugagaagcagcaaagcgucuuaauguucaaaacgccucucuuugg

SEQ ID NO: 545486 - RNA, 64 nt, hsa
uucccugugcccccuacuggauccuggaccucuacgucuuaaccacuggaucccacacaaauca

SEQ ID NO: 545487 - RNA, 64 nt, hsa
auugcacccuagccugggcaacagagcaagacaccgucuuaaaaccaaaaguuaaccgggcgug

SEQ ID NO: 545488 - RNA, 64 nt, hsa
uaaauuuuacaccuuuucuuaagaauucuaaugccgucuuaaguuuuuauaccaauaaugcuga

SEQ ID NO: 545489 - RNA, 64 nt, hsa
acugcacuccagccugggugacagcacgagaugccgucuuaaaaaaacaaaaaagaggugugcu

SEQ ID NO: 545490 - RNA, 64 nt, hsa
ugcuuuuuggagguucuaaucauuucagcaguagcgucuuaaacagcaguauuacuauaagcag

SEQ ID NO: 545491 - RNA, 64 nt, hsa
gaagagguaccaaugacuuccaaacaugugauuccgucuuaaaaguuuuccauuuuuacccugu

SEQ ID NO: 545492 - RNA, 64 nt, hsa
uagcauaacuuugugugacgagacugcacaagacaaagcucaggcaaguggcucaguaguuggc

SEQ ID NO: 545493 - RNA, 64 nt, hsa
ugagacuugaaucguagaaaauugaaugucaaaaaaagcucauuucuuuuugaagugaugaggu

SEQ ID NO: 545494 - RNA, 64 nt, hsa
ucaccaauugguuaaucuuuccugaugguacaggaaagcucagcuacugauuuuugugauuuag

SEQ ID NO: 545495 - RNA, 64 nt, hsa
aaucuccaguauucuugucaaaaaaaaaaaaaaaaaagcucauauuuuguauauaucugcuuca

SEQ ID NO: 545496 - RNA, 64 nt, hsa
agaggauguaaggcagcugguguuaauggggagaaaagcucagagagaugcauuuuaaagcuaa

SEQ ID NO: 545497 - RNA, 64 nt, hsa
gacagaucugaagugaagacaggagaugaugagaaaagcucaccgcaucagcugguugcccagg

SEQ ID NO: 545498 - RNA, 64 nt, hsa
cacuuguuauuggccuaugaacuaaaagcaaaucaaagcucauaaaucaaagcucaucaguucc

SEQ ID NO: 545499 - RNA, 64 nt, hsa
cuaugaacuaaaagcaaaucaaagcucauaaaucaaagcucaucaguucccauaaaugcaguug

SEQ ID NO: 545500 - RNA, 64 nt, hsa
aaauugaucauaaaaccuuuaggaaauguauuugaaagcucaaaauagaaauuagguuaaaaug

SEQ ID NO: 545501 - RNA, 64 nt, hsa
uguaauuagagcuugcuacguguuuauggaacugaaagcucaacaggggagcaauaaaccgaga

SEQ ID NO: 545502 - RNA, 64 nt, hsa; identical to SEQ ID NO: 112259

SEQ ID NO: 545503 - RNA, 64 nt, hsa; identical to SEQ ID NO: 112260

SEQ ID NO: 545504 - RNA, 64 nt, hsa; identical to SEQ ID NO: 112261

SEQ ID NO: 545505 - RNA, 64 nt, hsa; identical to SEQ ID NO: 112262

SEQ ID NO: 545506 - RNA, 64 nt, hsa; identical to SEQ ID NO: 112263

SEQ ID NO: 545507 - RNA, 64 nt, hsa; identical to SEQ ID NO: 112264

SEQ ID NO: 545508 - RNA, 64 nt, hsa; identical to SEQ ID NO: 112265

SEQ ID NO: 545509 - RNA, 64 nt, hsa; identical to SEQ ID NO: 112266

SEQ ID NO: 545510 - RNA, 64 nt, hsa; identical to SEQ ID NO: 112267

SEQ ID NO: 545511 - RNA, 64 nt, hsa; identical to SEQ ID NO: 112268

SEQ ID NO: 545512 - RNA, 64 nt, hsa; identical to SEQ ID NO: 112269

SEQ ID NO: 545513 - RNA, 64 nt, hsa; identical to SEQ ID NO: 112270

SEQ ID NO: 545514 - RNA, 64 nt, hsa; identical to SEQ ID NO: 112271

SEQ ID NO: 545515 - RNA, 64 nt, hsa; identical to SEQ ID NO: 112272

SEQ ID NO: 545516 - RNA, 64 nt, hsa; identical to SEQ ID NO: 112273

SEQ ID NO: 545517 - RNA, 64 nt, hsa; identical to SEQ ID NO: 112274

SEQ ID NO: 545518 - RNA, 64 nt, hsa; identical to SEQ ID NO: 112275

SEQ ID NO: 545519 - RNA, 64 nt, hsa; identical to SEQ ID NO: 112276

SEQ ID NO: 545520 - RNA, 64 nt, hsa; identical to SEQ ID NO: 112277

SEQ ID NO: 545521 - RNA, 64 nt, hsa; identical to SEQ ID NO: 112278

SEQ ID NO: 545522 - RNA, 64 nt, hsa; identical to SEQ ID NO: 112279

SEQ ID NO: 545523 - RNA, 64 nt, hsa; identical to SEQ ID NO: 112280

SEQ ID NO: 545524 - RNA, 64 nt, hsa; identical to SEQ ID NO: 112281

SEQ ID NO: 545525 - RNA, 64 nt, hsa; identical to SEQ ID NO: 112282

SEQ ID NO: 545526 - RNA, 64 nt, hsa; identical to SEQ ID NO: 112283

SEQ ID NO: 545527 - RNA, 64 nt, hsa; identical to SEQ ID NO: 112284

SEQ ID NO: 545528 - RNA, 64 nt, hsa; identical to SEQ ID NO: 112285

SEQ ID NO: 545529 - RNA, 64 nt, hsa; identical to SEQ ID NO: 112286

SEQ ID NO: 545530 - RNA, 64 nt, hsa; identical to SEQ ID NO: 112287

SEQ ID NO: 545531 - RNA, 64 nt, hsa; identical to SEQ ID NO: 112288

SEQ ID NO: 545532 - RNA, 64 nt, hsa; identical to SEQ ID NO: 112289

SEQ ID NO: 545533 - RNA, 64 nt, hsa; identical to SEQ ID NO: 112290

SEQ ID NO: 545534 - RNA, 64 nt, hsa; identical to SEQ ID NO: 112291

SEQ ID NO: 545535 - RNA, 64 nt, hsa; identical to SEQ ID NO: 112292

SEQ ID NO: 545536 - RNA, 64 nt, hsa; identical to SEQ ID NO: 112293

SEQ ID NO: 545537 - RNA, 64 nt, hsa; identical to SEQ ID NO: 112294

SEQ ID NO: 545538 - RNA, 64 nt, hsa; identical to SEQ ID NO: 112295

SEQ ID NO: 545539 - RNA, 64 nt, hsa; identical to SEQ ID NO: 112296

SEQ ID NO: 545540 - RNA, 64 nt, hsa; identical to SEQ ID NO: 112297

SEQ ID NO: 545541 - RNA, 64 nt, hsa; identical to SEQ ID NO: 112298

SEQ ID NO: 545542 - RNA, 64 nt, hsa; identical to SEQ ID NO: 112299

SEQ ID NO: 545543 - RNA, 64 nt, hsa; identical to SEQ ID NO: 112300

SEQ ID NO: 545544 - RNA, 64 nt, hsa; identical to SEQ ID NO: 112301

SEQ ID NO: 545545 - RNA, 64 nt, hsa; identical to SEQ ID NO: 112302

SEQ ID NO: 545546 - RNA, 64 nt, hsa; identical to SEQ ID NO: 112303

SEQ ID NO: 545547 - RNA, 64 nt, hsa; identical to SEQ ID NO: 112304

SEQ ID NO: 545548 - RNA, 64 nt, hsa; identical to SEQ ID NO: 112305

SEQ ID NO: 545549 - RNA, 64 nt, hsa; identical to SEQ ID NO: 112306

SEQ ID NO: 545550 - RNA, 64 nt, hsa; identical to SEQ ID NO: 112307

SEQ ID NO: 545551 - RNA, 64 nt, hsa; identical to SEQ ID NO: 112308

SEQ ID NO: 545552 - RNA, 64 nt, hsa; identical to SEQ ID NO: 112309

SEQ ID NO: 545553 - RNA, 59 nt, hsa; identical to SEQ ID NO: 112310

SEQ ID NO: 545554 - RNA, 64 nt, hsa; identical to SEQ ID NO: 112311

SEQ ID NO: 545555 - RNA, 64 nt, hsa; identical to SEQ ID NO: 112312

SEQ ID NO: 545556 - RNA, 64 nt, hsa; identical to SEQ ID NO: 112313

SEQ ID NO: 545557 - RNA, 64 nt, hsa; identical to SEQ ID NO: 112314

SEQ ID NO: 545558 - RNA, 64 nt, hsa; identical to SEQ ID NO: 112315

SEQ ID NO: 545559 - RNA, 64 nt, hsa; identical to SEQ ID NO: 112316

SEQ ID NO: 545560 - RNA, 64 nt, hsa; identical to SEQ ID NO: 112317

SEQ ID NO: 545561 - RNA, 64 nt, hsa; identical to SEQ ID NO: 112318

SEQ ID NO: 545562 - RNA, 64 nt, hsa; identical to SEQ ID NO: 112319

SEQ ID NO: 545563 - RNA, 64 nt, hsa; identical to SEQ ID NO: 112320

SEQ ID NO: 545564 - RNA, 64 nt, hsa; identical to SEQ ID NO: 112321

SEQ ID NO: 545565 - RNA, 64 nt, hsa; identical to SEQ ID NO: 112322

SEQ ID NO: 545566 - RNA, 64 nt, hsa; identical to SEQ ID NO: 112323

SEQ ID NO: 545567 - RNA, 64 nt, hsa; identical to SEQ ID NO: 112324

SEQ ID NO: 545568 - RNA, 64 nt, hsa; identical to SEQ ID NO: 112325

SEQ ID NO: 545569 - RNA, 64 nt, hsa; identical to SEQ ID NO: 112326

SEQ ID NO: 545570 - RNA, 64 nt, hsa; identical to SEQ ID NO: 112327

SEQ ID NO: 545571 - RNA, 64 nt, hsa; identical to SEQ ID NO: 112328

SEQ ID NO: 545572 - RNA, 64 nt, hsa; identical to SEQ ID NO: 112329

SEQ ID NO: 545573 - RNA, 64 nt, hsa; identical to SEQ ID NO: 112330

SEQ ID NO: 545574 - RNA, 64 nt, hsa; identical to SEQ ID NO: 112331

SEQ ID NO: 545575 - RNA, 64 nt, hsa; identical to SEQ ID NO: 112332

SEQ ID NO: 545576 - RNA, 64 nt, hsa; identical to SEQ ID NO: 112333

SEQ ID NO: 545577 - RNA, 64 nt, hsa; identical to SEQ ID NO: 112334

SEQ ID NO: 545578 - RNA, 64 nt, hsa; identical to SEQ ID NO: 112335

SEQ ID NO: 545579 - RNA, 64 nt, hsa; identical to SEQ ID NO: 112336

SEQ ID NO: 545580 - RNA, 64 nt, hsa; identical to SEQ ID NO: 112337

SEQ ID NO: 545581 - RNA, 64 nt, hsa; identical to SEQ ID NO: 112338

SEQ ID NO: 545582 - RNA, 64 nt, hsa; identical to SEQ ID NO: 112339

SEQ ID NO: 545583 - RNA, 64 nt, hsa; identical to SEQ ID NO: 112340

SEQ ID NO: 545584 - RNA, 64 nt, hsa; identical to SEQ ID NO: 112341

SEQ ID NO: 545585 - RNA, 64 nt, hsa; identical to SEQ ID NO: 112342

SEQ ID NO: 545586 - RNA, 64 nt, hsa; identical to SEQ ID NO: 112343

SEQ ID NO: 545587 - RNA, 64 nt, hsa; identical to SEQ ID NO: 112344

SEQ ID NO: 545588 - RNA, 64 nt, hsa; identical to SEQ ID NO: 112345

SEQ ID NO: 545589 - RNA, 64 nt, hsa; identical to SEQ ID NO: 112346

SEQ ID NO: 545590 - RNA, 64 nt, hsa; identical to SEQ ID NO: 112347

SEQ ID NO: 545591 - RNA, 64 nt, hsa; identical to SEQ ID NO: 112348

SEQ ID NO: 545592 - RNA, 64 nt, hsa; identical to SEQ ID NO: 112349

SEQ ID NO: 545593 - RNA, 64 nt, hsa; identical to SEQ ID NO: 112350

SEQ ID NO: 545594 - RNA, 64 nt, hsa; identical to SEQ ID NO: 112351

SEQ ID NO: 545595 - RNA, 64 nt, hsa; identical to SEQ ID NO: 112352

SEQ ID NO: 545596 - RNA, 64 nt, hsa; identical to SEQ ID NO: 112353

SEQ ID NO: 545597 - RNA, 64 nt, hsa; identical to SEQ ID NO: 112354

SEQ ID NO: 545598 - RNA, 64 nt, hsa; identical to SEQ ID NO: 112355

SEQ ID NO: 545599 - RNA, 64 nt, hsa; identical to SEQ ID NO: 112356

SEQ ID NO: 545600 - RNA, 64 nt, hsa; identical to SEQ ID NO: 112357

SEQ ID NO: 545601 - RNA, 64 nt, hsa; identical to SEQ ID NO: 112358

SEQ ID NO: 545602 - RNA, 64 nt, hsa; identical to SEQ ID NO: 112359

SEQ ID NO: 545603 - RNA, 64 nt, hsa; identical to SEQ ID NO: 112360

SEQ ID NO: 545604 - RNA, 64 nt, hsa; identical to SEQ ID NO: 112361

SEQ ID NO: 545605 - RNA, 64 nt, hsa; identical to SEQ ID NO: 112362

SEQ ID NO: 545606 - RNA, 64 nt, hsa; identical to SEQ ID NO: 112363

SEQ ID NO: 545607 - RNA, 64 nt, hsa; identical to SEQ ID NO: 112364

SEQ ID NO: 545608 - RNA, 64 nt, hsa; identical to SEQ ID NO: 112365

SEQ ID NO: 545609 - RNA, 64 nt, hsa; identical to SEQ ID NO: 112366

SEQ ID NO: 545610 - RNA, 64 nt, hsa; identical to SEQ ID NO: 112367

SEQ ID NO: 545611 - RNA, 64 nt, hsa; identical to SEQ ID NO: 112368

SEQ ID NO: 545612 - RNA, 64 nt, hsa; identical to SEQ ID NO: 112369

SEQ ID NO: 545613 - RNA, 64 nt, hsa; identical to SEQ ID NO: 112370

SEQ ID NO: 545614 - RNA, 64 nt, hsa; identical to SEQ ID NO: 112371

SEQ ID NO: 545615 - RNA, 64 nt, hsa; identical to SEQ ID NO: 112372

SEQ ID NO: 545616 - RNA, 64 nt, hsa; identical to SEQ ID NO: 112373

SEQ ID NO: 545617 - RNA, 64 nt, hsa; identical to SEQ ID NO: 112374

SEQ ID NO: 545618 - RNA, 64 nt, hsa; identical to SEQ ID NO: 112375

SEQ ID NO: 545619 - RNA, 64 nt, hsa; identical to SEQ ID NO: 112376

SEQ ID NO: 545620 - RNA, 64 nt, hsa; identical to SEQ ID NO: 112377

SEQ ID NO: 545621 - RNA, 64 nt, hsa; identical to SEQ ID NO: 112378

SEQ ID NO: 545622 - RNA, 64 nt, hsa; identical to SEQ ID NO: 112379

SEQ ID NO: 545623 - RNA, 64 nt, hsa; identical to SEQ ID NO: 112380

SEQ ID NO: 545624 - RNA, 64 nt, hsa; identical to SEQ ID NO: 112381

SEQ ID NO: 545625 - RNA, 64 nt, hsa; identical to SEQ ID NO: 112382

SEQ ID NO: 545626 - RNA, 64 nt, hsa; identical to SEQ ID NO: 112383

SEQ ID NO: 545627 - RNA, 64 nt, hsa; identical to SEQ ID NO: 112384

SEQ ID NO: 545628 - RNA, 64 nt, hsa; identical to SEQ ID NO: 112385

SEQ ID NO: 545629 - RNA, 64 nt, hsa; identical to SEQ ID NO: 112386

SEQ ID NO: 545630 - RNA, 64 nt, hsa; identical to SEQ ID NO: 112387

SEQ ID NO: 545631 - RNA, 64 nt, hsa; identical to SEQ ID NO: 112388

SEQ ID NO: 545632 - RNA, 64 nt, hsa; identical to SEQ ID NO: 112389

SEQ ID NO: 545633 - RNA, 64 nt, hsa; identical to SEQ ID NO: 112390

SEQ ID NO: 545634 - RNA, 64 nt, hsa; identical to SEQ ID NO: 112391

SEQ ID NO: 545635 - RNA, 64 nt, hsa; identical to SEQ ID NO: 112392

SEQ ID NO: 545636 - RNA, 64 nt, hsa; identical to SEQ ID NO: 112393

SEQ ID NO: 545637 - RNA, 64 nt, hsa; identical to SEQ ID NO: 112394

SEQ ID NO: 545638 - RNA, 64 nt, hsa; identical to SEQ ID NO: 112395

SEQ ID NO: 545639 - RNA, 64 nt, hsa; identical to SEQ ID NO: 112396

SEQ ID NO: 545640 - RNA, 64 nt, hsa; identical to SEQ ID NO: 112397

SEQ ID NO: 545641 - RNA, 64 nt, hsa; identical to SEQ ID NO: 112398

SEQ ID NO: 545642 - RNA, 64 nt, hsa; identical to SEQ ID NO: 112399

SEQ ID NO: 545643 - RNA, 64 nt, hsa; identical to SEQ ID NO: 112400

SEQ ID NO: 545644 - RNA, 64 nt, hsa; identical to SEQ ID NO: 112401

SEQ ID NO: 545645 - RNA, 64 nt, hsa; identical to SEQ ID NO: 112402

SEQ ID NO: 545646 - RNA, 64 nt, hsa; identical to SEQ ID NO: 112403

SEQ ID NO: 545647 - RNA, 64 nt, hsa; identical to SEQ ID NO: 112404

SEQ ID NO: 545648 - RNA, 64 nt, hsa; identical to SEQ ID NO: 112405

SEQ ID NO: 545649 - RNA, 64 nt, hsa; identical to SEQ ID NO: 112406

SEQ ID NO: 545650 - RNA, 64 nt, hsa; identical to SEQ ID NO: 112407

SEQ ID NO: 545651 - RNA, 64 nt, hsa; identical to SEQ ID NO: 112408

SEQ ID NO: 545652 - RNA, 64 nt, hsa; identical to SEQ ID NO: 112409

SEQ ID NO: 545653 - RNA, 64 nt, hsa; identical to SEQ ID NO: 112410

SEQ ID NO: 545654 - RNA, 64 nt, hsa; identical to SEQ ID NO: 112411

SEQ ID NO: 545655 - RNA, 64 nt, hsa; identical to SEQ ID NO: 112412

SEQ ID NO: 545656 - RNA, 64 nt, hsa; identical to SEQ ID NO: 112413

SEQ ID NO: 545657 - RNA, 64 nt, hsa; identical to SEQ ID NO: 112414

SEQ ID NO: 545658 - RNA, 64 nt, hsa; identical to SEQ ID NO: 112415

SEQ ID NO: 545659 - RNA, 64 nt, hsa; identical to SEQ ID NO: 112416

SEQ ID NO: 545660 - RNA, 64 nt, hsa; identical to SEQ ID NO: 112417

SEQ ID NO: 545661 - RNA, 64 nt, hsa; identical to SEQ ID NO: 112418

SEQ ID NO: 545662 - RNA, 64 nt, hsa; identical to SEQ ID NO: 112419

SEQ ID NO: 545663 - RNA, 64 nt, hsa; identical to SEQ ID NO: 112420

SEQ ID NO: 545664 - RNA, 64 nt, hsa; identical to SEQ ID NO: 112421

SEQ ID NO: 545665 - RNA, 64 nt, hsa; identical to SEQ ID NO: 112422

SEQ ID NO: 545666 - RNA, 64 nt, hsa; identical to SEQ ID NO: 112423

SEQ ID NO: 545667 - RNA, 64 nt, hsa; identical to SEQ ID NO: 112424

SEQ ID NO: 545668 - RNA, 64 nt, hsa; identical to SEQ ID NO: 112425

SEQ ID NO: 545669 - RNA, 64 nt, hsa; identical to SEQ ID NO: 112426

SEQ ID NO: 545670 - RNA, 64 nt, hsa; identical to SEQ ID NO: 112427

SEQ ID NO: 545671 - RNA, 64 nt, hsa; identical to SEQ ID NO: 112428

SEQ ID NO: 545672 - RNA, 64 nt, hsa; identical to SEQ ID NO: 112429

SEQ ID NO: 545673 - RNA, 64 nt, hsa; identical to SEQ ID NO: 112430

SEQ ID NO: 545674 - RNA, 64 nt, hsa; identical to SEQ ID NO: 112431

SEQ ID NO: 545675 - RNA, 64 nt, hsa; identical to SEQ ID NO: 112432

SEQ ID NO: 545676 - RNA, 64 nt, hsa; identical to SEQ ID NO: 112433

SEQ ID NO: 545677 - RNA, 64 nt, hsa; identical to SEQ ID NO: 112434

SEQ ID NO: 545678 - RNA, 64 nt, hsa; identical to SEQ ID NO: 112435

SEQ ID NO: 545679 - RNA, 64 nt, hsa; identical to SEQ ID NO: 112293

SEQ ID NO: 545680 - RNA, 64 nt, hsa; identical to SEQ ID NO: 112294

SEQ ID NO: 545681 - RNA, 64 nt, hsa; identical to SEQ ID NO: 112438

SEQ ID NO: 545682 - RNA, 64 nt, hsa; identical to SEQ ID NO: 112439

SEQ ID NO: 545683 - RNA, 64 nt, hsa; identical to SEQ ID NO: 112294

SEQ ID NO: 545684 - RNA, 64 nt, hsa; identical to SEQ ID NO: 112293

SEQ ID NO: 545685 - RNA, 64 nt, hsa; identical to SEQ ID NO: 112442

SEQ ID NO: 545686 - RNA, 64 nt, hsa; identical to SEQ ID NO: 112443

SEQ ID NO: 545687 - RNA, 64 nt, hsa; identical to SEQ ID NO: 112444

SEQ ID NO: 545688 - RNA, 64 nt, hsa; identical to SEQ ID NO: 112445

SEQ ID NO: 545689 - RNA, 64 nt, hsa; identical to SEQ ID NO: 112446

SEQ ID NO: 545690 - RNA, 64 nt, hsa; identical to SEQ ID NO: 112447

SEQ ID NO: 545691 - RNA, 64 nt, hsa; identical to SEQ ID NO: 112448

SEQ ID NO: 545692 - RNA, 64 nt, hsa; identical to SEQ ID NO: 112449

SEQ ID NO: 545693 - RNA, 64 nt, hsa; identical to SEQ ID NO: 112450

SEQ ID NO: 545694 - RNA, 64 nt, hsa; identical to SEQ ID NO: 112451

SEQ ID NO: 545695 - RNA, 64 nt, hsa; identical to SEQ ID NO: 112452

SEQ ID NO: 545696 - RNA, 64 nt, hsa; identical to SEQ ID NO: 112453

SEQ ID NO: 545697 - RNA, 64 nt, hsa; identical to SEQ ID NO: 112454

SEQ ID NO: 545698 - RNA, 64 nt, hsa; identical to SEQ ID NO: 112455

SEQ ID NO: 545699 - RNA, 64 nt, hsa; identical to SEQ ID NO: 112456

SEQ ID NO: 545700 - RNA, 64 nt, hsa; identical to SEQ ID NO: 112457

SEQ ID NO: 545701 - RNA, 64 nt, hsa; identical to SEQ ID NO: 112458

SEQ ID NO: 545702 - RNA, 64 nt, hsa; identical to SEQ ID NO: 112459

SEQ ID NO: 545703 - RNA, 64 nt, hsa; identical to SEQ ID NO: 112460

SEQ ID NO: 545704 - RNA, 64 nt, hsa; identical to SEQ ID NO: 112461

SEQ ID NO: 545705 - RNA, 64 nt, hsa; identical to SEQ ID NO: 112462

SEQ ID NO: 545706 - RNA, 64 nt, hsa; identical to SEQ ID NO: 112463

SEQ ID NO: 545707 - RNA, 64 nt, hsa; identical to SEQ ID NO: 112464

SEQ ID NO: 545708 - RNA, 64 nt, hsa; identical to SEQ ID NO: 112465

SEQ ID NO: 545709 - RNA, 64 nt, hsa; identical to SEQ ID NO: 112466

SEQ ID NO: 545710 - RNA, 64 nt, hsa; identical to SEQ ID NO: 112467

SEQ ID NO: 545711 - RNA, 64 nt, hsa; identical to SEQ ID NO: 112468

SEQ ID NO: 545712 - RNA, 64 nt, hsa; identical to SEQ ID NO: 112469

SEQ ID NO: 545713 - RNA, 64 nt, hsa; identical to SEQ ID NO: 112470

SEQ ID NO: 545714 - RNA, 64 nt, hsa; identical to SEQ ID NO: 112471

SEQ ID NO: 545715 - RNA, 64 nt, hsa; identical to SEQ ID NO: 112472

SEQ ID NO: 545716 - RNA, 64 nt, hsa; identical to SEQ ID NO: 112473

SEQ ID NO: 545717 - RNA, 64 nt, hsa; identical to SEQ ID NO: 112474

SEQ ID NO: 545718 - RNA, 64 nt, hsa; identical to SEQ ID NO: 112475

SEQ ID NO: 545719 - RNA, 64 nt, hsa; identical to SEQ ID NO: 112476

SEQ ID NO: 545720 - RNA, 64 nt, hsa; identical to SEQ ID NO: 112477

SEQ ID NO: 545721 - RNA, 64 nt, hsa; identical to SEQ ID NO: 112478

SEQ ID NO: 545722 - RNA, 64 nt, hsa; identical to SEQ ID NO: 112479

SEQ ID NO: 545723 - RNA, 64 nt, hsa; identical to SEQ ID NO: 112480

SEQ ID NO: 545724 - RNA, 64 nt, hsa; identical to SEQ ID NO: 112481

SEQ ID NO: 545725 - RNA, 64 nt, hsa; identical to SEQ ID NO: 112482

SEQ ID NO: 545726 - RNA, 64 nt, hsa; identical to SEQ ID NO: 112483

SEQ ID NO: 545727 - RNA, 64 nt, hsa; identical to SEQ ID NO: 112484

SEQ ID NO: 545728 - RNA, 64 nt, hsa; identical to SEQ ID NO: 112485

SEQ ID NO: 545729 - RNA, 64 nt, hsa; identical to SEQ ID NO: 112486

SEQ ID NO: 545730 - RNA, 64 nt, hsa; identical to SEQ ID NO: 112487

SEQ ID NO: 545731 - RNA, 64 nt, hsa; identical to SEQ ID NO: 112488

SEQ ID NO: 545732 - RNA, 64 nt, hsa; identical to SEQ ID NO: 112489

SEQ ID NO: 545733 - RNA, 64 nt, hsa; identical to SEQ ID NO: 112490

SEQ ID NO: 545734 - RNA, 64 nt, hsa; identical to SEQ ID NO: 112491

SEQ ID NO: 545735 - RNA, 64 nt, hsa; identical to SEQ ID NO: 112492

SEQ ID NO: 545736 - RNA, 64 nt, hsa; identical to SEQ ID NO: 112493

SEQ ID NO: 545737 - RNA, 64 nt, hsa; identical to SEQ ID NO: 112494

SEQ ID NO: 545738 - RNA, 64 nt, hsa; identical to SEQ ID NO: 112495

SEQ ID NO: 545739 - RNA, 64 nt, hsa; identical to SEQ ID NO: 112496

SEQ ID NO: 545740 - RNA, 64 nt, hsa; identical to SEQ ID NO: 112497

SEQ ID NO: 545741 - RNA, 64 nt, hsa; identical to SEQ ID NO: 112498

SEQ ID NO: 545742 - RNA, 64 nt, hsa; identical to SEQ ID NO: 112499

SEQ ID NO: 545743 - RNA, 64 nt, hsa; identical to SEQ ID NO: 112500

SEQ ID NO: 545744 - RNA, 64 nt, hsa; identical to SEQ ID NO: 112501

SEQ ID NO: 545745 - RNA, 64 nt, hsa; identical to SEQ ID NO: 112502

SEQ ID NO: 545746 - RNA, 64 nt, hsa; identical to SEQ ID NO: 112503

SEQ ID NO: 545747 - RNA, 64 nt, hsa; identical to SEQ ID NO: 112504

SEQ ID NO: 545748 - RNA, 64 nt, hsa; identical to SEQ ID NO: 112505

SEQ ID NO: 545749 - RNA, 64 nt, hsa; identical to SEQ ID NO: 112506

SEQ ID NO: 545750 - RNA, 64 nt, hsa; identical to SEQ ID NO: 112507

SEQ ID NO: 545751 - RNA, 64 nt, hsa; identical to SEQ ID NO: 112508

SEQ ID NO: 545752 - RNA, 64 nt, hsa; identical to SEQ ID NO: 112509

SEQ ID NO: 545753 - RNA, 64 nt, hsa; identical to SEQ ID NO: 112510

SEQ ID NO: 545754 - RNA, 64 nt, hsa; identical to SEQ ID NO: 112511

SEQ ID NO: 545755 - RNA, 64 nt, hsa; identical to SEQ ID NO: 112512

SEQ ID NO: 545756 - RNA, 64 nt, hsa; identical to SEQ ID NO: 112513

SEQ ID NO: 545757 - RNA, 64 nt, hsa; identical to SEQ ID NO: 112514

SEQ ID NO: 545758 - RNA, 64 nt, hsa; identical to SEQ ID NO: 112515

SEQ ID NO: 545759 - RNA, 64 nt, hsa; identical to SEQ ID NO: 112516

SEQ ID NO: 545760 - RNA, 64 nt, hsa; identical to SEQ ID NO: 112517

SEQ ID NO: 545761 - RNA, 64 nt, hsa; identical to SEQ ID NO: 112518

SEQ ID NO: 545762 - RNA, 64 nt, hsa; identical to SEQ ID NO: 112519

SEQ ID NO: 545763 - RNA, 64 nt, hsa; identical to SEQ ID NO: 112520

SEQ ID NO: 545764 - RNA, 64 nt, hsa; identical to SEQ ID NO: 112521

SEQ ID NO: 545765 - RNA, 64 nt, hsa; identical to SEQ ID NO: 112522

SEQ ID NO: 545766 - RNA, 64 nt, hsa; identical to SEQ ID NO: 112523

SEQ ID NO: 545767 - RNA, 64 nt, hsa; identical to SEQ ID NO: 112524

SEQ ID NO: 545768 - RNA, 64 nt, hsa; identical to SEQ ID NO: 112525

SEQ ID NO: 545769 - RNA, 64 nt, hsa; identical to SEQ ID NO: 112526

SEQ ID NO: 545770 - RNA, 64 nt, hsa; identical to SEQ ID NO: 112527

SEQ ID NO: 545771 - RNA, 64 nt, hsa; identical to SEQ ID NO: 112528

SEQ ID NO: 545772 - RNA, 64 nt, hsa; identical to SEQ ID NO: 112529

SEQ ID NO: 545773 - RNA, 64 nt, hsa; identical to SEQ ID NO: 112530

SEQ ID NO: 545774 - RNA, 64 nt, hsa; identical to SEQ ID NO: 112531

SEQ ID NO: 545775 - RNA, 64 nt, hsa; identical to SEQ ID NO: 112532

SEQ ID NO: 545776 - RNA, 64 nt, hsa; identical to SEQ ID NO: 112533

SEQ ID NO: 545777 - RNA, 64 nt, hsa; identical to SEQ ID NO: 112534

SEQ ID NO: 545778 - RNA, 64 nt, hsa; identical to SEQ ID NO: 112535

SEQ ID NO: 545779 - RNA, 64 nt, hsa; identical to SEQ ID NO: 112536

SEQ ID NO: 545780 - RNA, 64 nt, hsa; identical to SEQ ID NO: 112537

SEQ ID NO: 545781 - RNA, 64 nt, hsa; identical to SEQ ID NO: 112538

SEQ ID NO: 545782 - RNA, 64 nt, hsa; identical to SEQ ID NO: 112539

SEQ ID NO: 545783 - RNA, 64 nt, hsa; identical to SEQ ID NO: 112540

SEQ ID NO: 545784 - RNA, 64 nt, hsa; identical to SEQ ID NO: 112541

SEQ ID NO: 545785 - RNA, 64 nt, hsa; identical to SEQ ID NO: 112542

SEQ ID NO: 545786 - RNA, 64 nt, hsa; identical to SEQ ID NO: 112543

SEQ ID NO: 545787 - RNA, 64 nt, hsa; identical to SEQ ID NO: 112544

SEQ ID NO: 545788 - RNA, 64 nt, hsa; identical to SEQ ID NO: 112545

SEQ ID NO: 545789 - RNA, 64 nt, hsa; identical to SEQ ID NO: 112546

SEQ ID NO: 545790 - RNA, 64 nt, hsa; identical to SEQ ID NO: 112547

SEQ ID NO: 545791 - RNA, 64 nt, hsa; identical to SEQ ID NO: 112548

SEQ ID NO: 545792 - RNA, 64 nt, hsa; identical to SEQ ID NO: 112549

SEQ ID NO: 545793 - RNA, 64 nt, hsa; identical to SEQ ID NO: 112550

SEQ ID NO: 545794 - RNA, 64 nt, hsa; identical to SEQ ID NO: 112551

SEQ ID NO: 545795 - RNA, 64 nt, hsa; identical to SEQ ID NO: 112552

SEQ ID NO: 545796 - RNA, 64 nt, hsa; identical to SEQ ID NO: 112553

SEQ ID NO: 545797 - RNA, 64 nt, hsa; identical to SEQ ID NO: 112554

SEQ ID NO: 545798 - RNA, 64 nt, hsa; identical to SEQ ID NO: 112555

SEQ ID NO: 545799 - RNA, 64 nt, hsa; identical to SEQ ID NO: 112556

SEQ ID NO: 545800 - RNA, 64 nt, hsa; identical to SEQ ID NO: 112557

SEQ ID NO: 545801 - RNA, 64 nt, hsa; identical to SEQ ID NO: 112558

SEQ ID NO: 545802 - RNA, 64 nt, hsa; identical to SEQ ID NO: 112559

SEQ ID NO: 545803 - RNA, 64 nt, hsa; identical to SEQ ID NO: 112560

SEQ ID NO: 545804 - RNA, 64 nt, hsa; identical to SEQ ID NO: 112561

SEQ ID NO: 545805 - RNA, 64 nt, hsa; identical to SEQ ID NO: 112540

SEQ ID NO: 545806 - RNA, 64 nt, hsa; identical to SEQ ID NO: 112563

SEQ ID NO: 545807 - RNA, 64 nt, hsa; identical to SEQ ID NO: 112564

SEQ ID NO: 545808 - RNA, 64 nt, hsa; identical to SEQ ID NO: 112565

SEQ ID NO: 545809 - RNA, 64 nt, hsa
aucuguuuaguauuugugcauuuuacuaaaauggcagcuuaaaguuguguaucugcuauuguga

SEQ ID NO: 545810 - RNA, 64 nt, hsa
gaaaaguaaagaaaaacccuuuuuauggcucacacagcuuaagaguagcugucucucaaacgug

SEQ ID NO: 545811 - RNA, 64 nt, hsa
aaauuauuuuuuaaaagucuuucucucucugauucagcuuaaauuuuuuuaucgaaaaagccau

SEQ ID NO: 545812 - RNA, 64 nt, hsa
agcuggccugggucacagugaccugaccucaaaccagcuuaaggcuuuaaguccucucucagaa

SEQ ID NO: 545813 - RNA, 64 nt, hsa
guuucaucauuuuaguuacacuaaacacuuuuggcagcuuaauaugaccuuuuuaaauuuuuuu

SEQ ID NO: 545814 - RNA, 64 nt, hsa
cuuggauguggagguuuuacuuuuuaaaaacauucagcuuaauuaccuuaccuuaauuaccuua

SEQ ID NO: 545815 - RNA, 64 nt, hsa
uugcaugggaggagaguuacucuugaaaggcaggcagcuuaaguggacaauguuuuguauauag

SEQ ID NO: 545816 - RNA, 64 nt, hsa
uauagggccaugcauugguaacuugaaaauagaccagcuuaaugucuucaggauguaaaacucu

SEQ ID NO: 545817 - RNA, 64 nt, hsa
gcacucccuuuucaccaucugucaccuucccuugcagcuuaaggagcccaguaaguuuugaaaa

SEQ ID NO: 545818 - RNA, 64 nt, hsa
ugucuaacuaaaaguuucugacuuuuaguaaauucagcuuaaauauaaguugaaauuugggaaa

SEQ ID NO: 545819 - RNA, 64 nt, hsa; identical to SEQ ID NO: 104916

SEQ ID NO: 545820 - RNA, 64 nt, hsa; identical to SEQ ID NO: 104917

SEQ ID NO: 545821 - RNA, 64 nt, hsa; identical to SEQ ID NO: 104918

SEQ ID NO: 545822 - RNA, 64 nt, hsa; identical to SEQ ID NO: 104919

SEQ ID NO: 545823 - RNA, 64 nt, hsa; identical to SEQ ID NO: 104920

SEQ ID NO: 545824 - RNA, 64 nt, hsa; identical to SEQ ID NO: 104921

SEQ ID NO: 545825 - RNA, 64 nt, hsa; identical to SEQ ID NO: 104922

SEQ ID NO: 545826 - RNA, 64 nt, hsa; identical to SEQ ID NO: 104923

SEQ ID NO: 545827 - RNA, 64 nt, hsa; identical to SEQ ID NO: 104924

SEQ ID NO: 545828 - RNA, 64 nt, hsa; identical to SEQ ID NO: 104925

SEQ ID NO: 545829 - RNA, 64 nt, hsa; identical to SEQ ID NO: 104926

SEQ ID NO: 545830 - RNA, 64 nt, hsa; identical to SEQ ID NO: 104927

SEQ ID NO: 545831 - RNA, 64 nt, hsa
guggaugaugugucaugaaugaggaggugugugagcagggaacucagugugacaccgccagguc

SEQ ID NO: 545832 - RNA, 64 nt, hsa
ggugagaaagccccaucccgggggccguuggcaggcagggaagcaggaaccccaccgugugccc

SEQ ID NO: 545833 - RNA, 64 nt, hsa
acuggaugggcugcagugaggugggggcgggugggcagggaaugggagaggggaagucuuggca

SEQ ID NO: 545834 - RNA, 64 nt, hsa
cgggugggcagggaaugggagaggggaagucuuggcagggaaaucccuuuuggccacacaguuu

SEQ ID NO: 545835 - RNA, 64 nt, hsa
ggcacagacuucuggaaggcuggcugaguggaaugcagggaagagggcaguaccugggaaagga

SEQ ID NO: 545836 - RNA, 64 nt, hsa
uccccugaaaacgaaggggccccggggcuggcaagcagggaaagcuccacggugcguggcugug

SEQ ID NO: 545837 - RNA, 64 nt, hsa
auggucgugagugcaggugucccuguuguaauuugcagggaaauugacugcaggugauaguguu

SEQ ID NO: 545838 - RNA, 64 nt, hsa
uccggacagaggugggcaggguggauggcuucgggcagggaaggcggguagaggcugcaugugg

SEQ ID NO: 545839 - RNA, 64 nt, hsa
agaauuuaaauguguuagauggaaaaugcuauuggcagggaauaauaauaaaaaaaaaagaaaa

SEQ ID NO: 545840 - RNA, 64 nt, hsa
uugguacagguguuauucaguacugggugguucagcagggaagccgggugggaccagugugucu

SEQ ID NO: 545841 - RNA, 64 nt, hsa
gguucuugggagggaaugggacagggugaauaaagcagggaauauuuuagaaccacaagagauc

SEQ ID NO: 545842 - RNA, 64 nt, hsa
cuucauacccucuaccuggauggauggucuuugggcagggaauuaaugacagaaugagcagucc

SEQ ID NO: 545843 - RNA, 64 nt, hsa
caucucaaccauccccuccguggcaucaccuuaggcagggaaguguaagaaacacacugaggca

SEQ ID NO: 545844 - RNA, 64 nt, hsa
accuuaggcagggaaguguaagaaacacacugaggcagggaaguccccaggccccaggaagccg

SEQ ID NO: 545845 - RNA, 64 nt, hsa
acaagauccuuaaugcagagcuagaggacuucuggcagggaaguggggaaguguuccagauagc

SEQ ID NO: 545846 - RNA, 64 nt, hsa
gggcucugggagacuuugaagaccaguccuguuugcagggaagccccacuugaaggaagaaguc

SEQ ID NO: 545847 - RNA, 64 nt, hsa
ucugcccgacucacucacagugcagggaaaggaggcagggaaaagaccaggauucugugaguuc

SEQ ID NO: 545848 - RNA, 64 nt, hsa
gggagcagcuccuucugcccgacucacucacagugcagggaaaggaggcagggaaaagaccagg

SEQ ID NO: 545849 - RNA, 64 nt, hsa
cugagucugggccacuugcuuaauugcauuucuggcagggaaggagaggagggauggagaagcu

SEQ ID NO: 545850 - RNA, 64 nt, hsa
ccuugcuuagcgcccaagguagaugagagacagggcagggaaucugcguggugcugggaugugg

SEQ ID NO: 545851 - RNA, 64 nt, hsa
cagcaggucccacagccgacagugcccagagcaugcagggaacccucgugcagcugagcugggg

SEQ ID NO: 545852 - RNA, 64 nt, hsa
cuuccccgagggugcauguugcaggagggagagggcagggaagacucacagcagagcaggaggg

SEQ ID NO: 545853 - RNA, 64 nt, hsa
guacaguggggucaccuguuguuucuauacaacagcagggaaggggccauggagcuuuucccug

SEQ ID NO: 545854 - RNA, 64 nt, hsa
cagggguccugaccuaccucagguggaacggugagcagggaacaugucggaguccuucagagaa

SEQ ID NO: 545855 - RNA, 64 nt, hsa
acugggcgaggucagauuagacaggcuugggacagcagggaaacaucaaccgacgugucacaga

SEQ ID NO: 545856 - RNA, 64 nt, hsa
guagcaggagaaaugaaggaagaugaaaaagcaggcagggaaggggguaguaaaggacugagag

SEQ ID NO: 545857 - RNA, 64 nt, hsa
gcacgagcuagugaguggcacaccagagccaucugcagggaagggcguggcggggaaauggcug

SEQ ID NO: 545858 - RNA, 64 nt, hsa
ggacucaucugucagagugcacaugaaaaaucaggcagggaaucgaaacgacagugcuggagga

SEQ ID NO: 545859 - RNA, 64 nt, hsa
uuuuugcugcuuuugcucuggaacuuugcuuuuagcagggaaagcagcuguccccugagugcuu

SEQ ID NO: 545860 - RNA, 64 nt, hsa
cuagcgcucccaaaaaagcacuauggccuuauaugcagggaaggcacauaccaccaaguucaau

SEQ ID NO: 545861 - RNA, 64 nt, hsa
cccaucccacucccacccaugucugggcucccaggcagggaacccgaucucuuccuuugugcug

SEQ ID NO: 545862 - RNA, 64 nt, hsa
aacccugccccugcacccagcaugcuccgacacagcagggaagcuccuccuguggcccggacac

SEQ ID NO: 545863 - RNA, 64 nt, hsa
ucuauugcuucuuucucccuugagucccuugaaggcagggaauagacuucuagaaaaccugaga

SEQ ID NO: 545864 - RNA, 64 nt, hsa
aacaaauuaagaugaugcugccaaaacaagucuagcagggaaaacagguucuacauuuuucuua

SEQ ID NO: 545865 - RNA, 64 nt, hsa
uguuuuccucacuacauuguacaugugggaauuacagauaaacggaagccggcugggguggugg

SEQ ID NO: 545866 - RNA, 64 nt, hsa
guccuaggcuggacagcaaugggcugcaauuaggcagauaaagacaucagucccaguaaaugaa

SEQ ID NO: 545867 - RNA, 64 nt, hsa
aaauccaguguuacuaguaauuuccaugguaauacagauaaaauacauucuuuuaauucuggga

SEQ ID NO: 545868 - RNA, 64 nt, hsa
auugcaugcaauuguguaggauugacaaggaacucagauaaaaauuuccagggugcacuuccag

SEQ ID NO: 545869 - RNA, 64 nt, hsa
aacuuuaugcuaagugaaauaagccagacaucaacagauaaauaguuuaugauuccaccuacau

SEQ ID NO: 545870 - RNA, 64 nt, hsa
caggguuuauguuuaggauguugaaaaaguucugcagauaaacaguagugauaguuguaccgca

SEQ ID NO: 545871 - RNA, 64 nt, hsa
uguuaguugauuuaaauccuuucugaauaaagaucagauaaacaguaacugaaggagcauguau

SEQ ID NO: 545872 - RNA, 64 nt, hsa
aaggauauaaacuuuccacaccuuccugucgugacagauaaaagcacagaaaggacaacccuug

SEQ ID NO: 545873 - RNA, 64 nt, hsa
aagucguauuauucacuuguaaaaaugauuguaacagauaaaaaauguaucugcagcaacucug

SEQ ID NO: 545874 - RNA, 64 nt, hsa
aucuacaugauuuucaaguuguaaugcagauggacagauaaaaaagauuuuacguuugucuuuu

SEQ ID NO: 545875 - RNA, 64 nt, hsa
guuuucucucuuuuugugguauuagcagcugcugcagauaaaugcauuaauucaugaugcuucu

SEQ ID NO: 545876 - RNA, 64 nt, hsa
acaauaauuggaguaguuuaaucuuauucaugugcagauaaaagagguuuaugaaguuuagggu

SEQ ID NO: 545877 - RNA, 64 nt, hsa
gugaaaaacaaaaaguagauguacuucuguaaaucagauaaaugcuuggaauuugauugucuac

SEQ ID NO: 545878 - RNA, 64 nt, hsa
uaugacaaauguuucuaagguaacaagaugagaacagauaaagauugugugguguuuuggauuu

SEQ ID NO: 545879 - RNA, 64 nt, hsa
aguagagguauaauugugugauauuucagaaauacagauaaaugauucaaaaagucacaguuaa

SEQ ID NO: 545880 - RNA, 64 nt, hsa; identical to SEQ ID NO: 300694

SEQ ID NO: 545881 - RNA, 64 nt, hsa; identical to SEQ ID NO: 300695

SEQ ID NO: 545882 - RNA, 64 nt, hsa; identical to SEQ ID NO: 300696

SEQ ID NO: 545883 - RNA, 64 nt, hsa; identical to SEQ ID NO: 300697

SEQ ID NO: 545884 - RNA, 64 nt, hsa; identical to SEQ ID NO: 300698

SEQ ID NO: 545885 - RNA, 64 nt, hsa; identical to SEQ ID NO: 300699

SEQ ID NO: 545886 - RNA, 64 nt, hsa; identical to SEQ ID NO: 300700

SEQ ID NO: 545887 - RNA, 64 nt, hsa; identical to SEQ ID NO: 300701

SEQ ID NO: 545888 - RNA, 64 nt, hsa; identical to SEQ ID NO: 91418

SEQ ID NO: 545889 - RNA, 64 nt, hsa; identical to SEQ ID NO: 91419

SEQ ID NO: 545890 - RNA, 56 nt, hsa; identical to SEQ ID NO: 91420

SEQ ID NO: 545891 - RNA, 64 nt, hsa; identical to SEQ ID NO: 91421

SEQ ID NO: 545892 - RNA, 64 nt, hsa; identical to SEQ ID NO: 91422

SEQ ID NO: 545893 - RNA, 64 nt, hsa; identical to SEQ ID NO: 91423

SEQ ID NO: 545894 - RNA, 64 nt, hsa; identical to SEQ ID NO: 91424

SEQ ID NO: 545895 - RNA, 64 nt, hsa; identical to SEQ ID NO: 91425

SEQ ID NO: 545896 - RNA, 64 nt, hsa; identical to SEQ ID NO: 91426

SEQ ID NO: 545897 - RNA, 64 nt, hsa; identical to SEQ ID NO: 91427

SEQ ID NO: 545898 - RNA, 64 nt, hsa; identical to SEQ ID NO: 91428

SEQ ID NO: 545899 - RNA, 64 nt, hsa; identical to SEQ ID NO: 91429

SEQ ID NO: 545900 - RNA, 64 nt, hsa; identical to SEQ ID NO: 91430

SEQ ID NO: 545901 - RNA, 64 nt, hsa; identical to SEQ ID NO: 91431

SEQ ID NO: 545902 - RNA, 64 nt, hsa; identical to SEQ ID NO: 91432

SEQ ID NO: 545903 - RNA, 64 nt, hsa; identical to SEQ ID NO: 91433

SEQ ID NO: 545904 - RNA, 64 nt, hsa; identical to SEQ ID NO: 91434

SEQ ID NO: 545905 - RNA, 64 nt, hsa; identical to SEQ ID NO: 91435

SEQ ID NO: 545906 - RNA, 64 nt, hsa; identical to SEQ ID NO: 91436

SEQ ID NO: 545907 - RNA, 64 nt, hsa
cagccugggacaccuagguggagagaguggucuccgcucugaauuggauccaggggaccugggc

SEQ ID NO: 545908 - RNA, 64 nt, hsa
ccucuuugucccuacaggccagcuugcugugcugcgcucugagcuccugcuucaugcuucuucu

SEQ ID NO: 545909 - RNA, 64 nt, hsa
gcuagcccaucaagccggcagagaaucccccacacgcucugaaggacccacuuucagcuggaca

SEQ ID NO: 545910 - RNA, 64 nt, hsa
agcuauuaagcacuugcagccuucggaggcucugcgcucugauccgcuguuugagcccaacacu

SEQ ID NO: 545911 - RNA, 64 nt, hsa
cucgaugucagcuuuuugugcuggacuuggcacacgcucugaaaacugagauuuugucauugaa

SEQ ID NO: 545912 - RNA, 64 nt, hsa
gcagacccccaacccugguuucugugccauguugcgcucugaccgucucuguugcuucucuucu

SEQ ID NO: 545913 - RNA, 64 nt, hsa
ggcaacggggaaagaccugacagcuaguuacauacgcucugacauaguacucccaugauggcuu

SEQ ID NO: 545914 - RNA, 64 nt, hsa
cucaaugacugggacuuagacuggggcucggccucgcucugaaaagugcuuaagaaaaucuucu

SEQ ID NO: 545915 - RNA, 64 nt, hsa
auggaagccucccaggcgcgcgaggcuucccgggcgcucugaggcuucuuucuccucgcccgcu

SEQ ID NO: 545916 - RNA, 64 nt, hsa
ugaaguucuucccagagccgcgcugccugcagugcgcucugaccuucucuucauguguguaaau

SEQ ID NO: 545917 - RNA, 64 nt, hsa
aacuaacugggagaccuuaggcaaagcaugcaaucgcucugaauggcaguuuccucauuuuuaa

SEQ ID NO: 545918 - RNA, 64 nt, hsa
aggaagauggagaaugaggaacugaagaaacugccgcucugagacugcacauccaggaaaaaag

SEQ ID NO: 545919 - RNA, 64 nt, hsa
cagacccaggacuccggaaaagccguccgcgcuccgcucugaggacuccuugcauuuggaauca

SEQ ID NO: 545920 - RNA, 64 nt, hsa
cucuuuucagugcacuggguggucaaugcccacucgcucugaaaucaucugacugugaugcccu

SEQ ID NO: 545921 - RNA, 64 nt, hsa
caugggucaggccauguauuaacagaugccagugcgcucugacaaguauuccaaaguguucugu

SEQ ID NO: 545922 - RNA, 64 nt, hsa
agacuccuucuccccaaucacgagaucuuccuuccgcucugaggcaacccccucggagccugug

SEQ ID NO: 545923 - RNA, 64 nt, hsa
gccugagcagggggccugccaccagacccacccacgcucugacgagaggcuuuuccaccuccag

SEQ ID NO: 545924 - RNA, 64 nt, hsa
ucaggcacugagccacugcgcccagccaacaauccgcucugaggaaagcguaagcaggaagacc

SEQ ID NO: 545925 - RNA, 64 nt, hsa
ugucccuaguucgggaggcggaaaaagaugagcgcgcucugaagcaggagauucacgagcugcg

SEQ ID NO: 545926 - RNA, 64 nt, hsa
ggaauaugggaggauuaucuccuaucacagggagcgcucugagggcaaggcugugucuccgauu

SEQ ID NO: 545927 - RNA, 64 nt, hsa
gggcugcagccucagcaguguacagaguccccggcgcucugagguuggagagaaagaacagacc

SEQ ID NO: 545928 - RNA, 64 nt, hsa
gccugugugcuacugaacugucgaaggaaauagccgcucugauagguagaugugaguaaaaaga

SEQ ID NO: 545929 - RNA, 64 nt, hsa
uuccaacaucucucaaaauaaaaaucccucuucccgcucugagcgauucagcucugcccgcagc

SEQ ID NO: 545930 - RNA, 64 nt, hsa
cucccacauuccuccccgcgggggaggaccucgccgcucugaagagcaccgugcacaugugggu

SEQ ID NO: 545931 - RNA, 64 nt, hsa
guccgcacguggcuggaggagguggucuuccauccgcucugaaaucauguuucuuagagaaaug

SEQ ID NO: 545932 - RNA, 64 nt, hsa
acagggagcuauggugcacucuaguuuauacuugcgcucugaaauguguaaacauagggugccu

SEQ ID NO: 545933 - RNA, 64 nt, hsa
caucuugcucuguggccuuggcccugacccccaucgcucugagcauauguuccaugccuggccc

SEQ ID NO: 545934 - RNA, 64 nt, hsa
cuggaggcagccaaguaacguagucauaucaucgcgcucugaucugguggcaucuggcugugca

SEQ ID NO: 545935 - RNA, 64 nt, hsa
cucuaccgccaccuucuggcgcaacaagaaguugcgcucugacagggcucuagucagggccuug

SEQ ID NO: 545936 - RNA, 64 nt, hsa
ggagugaggcuccccgccugugucccccuggcugcgcucugagccuucagggccaccgcccgcu

SEQ ID NO: 545937 - RNA, 64 nt, hsa
cuguuucacaugaggagauguuaccaaucccguucgcucugacccuugcuggcugaucaccuug

SEQ ID NO: 545938 - RNA, 64 nt, hsa
ugacaauucuaagaucaaccagguuacuuaaguccgcucugaugaaacccagucucucaauacc

SEQ ID NO: 545939 - RNA, 64 nt, hsa
uggcggcccacgcagcuucugcugaggagcugaccgcucugagcuguucuguuucguauugcug

SEQ ID NO: 545940 - RNA, 64 nt, hsa
gaggccgcagcaccuucuggaagacuuggccuuccgcucugacgcagggccgaggugggcaguc

SEQ ID NO: 545941 - RNA, 64 nt, hsa
gucaacagcagaacagaggcaggucaggguuguccgcucugauuagcagaacgacagccccuuc

SEQ ID NO: 545942 - RNA, 64 nt, hsa
gauacacucccgaugccacauuuuuaacuccucucgcucugaugggacauuuguuacccuuuuu

SEQ ID NO: 545943 - RNA, 64 nt, hsa
ggcgacuucucucccccguccccguggacguaagcgcucugagagggaacggggggggugucca

SEQ ID NO: 545944 - RNA, 62 nt, hsa
cagaaauguuugaauuuuaaggguuucuaaaacgcucugacagaugcaaguggugguggaag

SEQ ID NO: 545945 - RNA, 64 nt, hsa
gaaaugucagagcgaggguuguguggacaccccucgcucugaugccaacugcagauaauacaca

SEQ ID NO: 545946 - RNA, 64 nt, hsa
ggaggcaccaggcaggcccuguaucaggcuaggacgcucugagcugugcauguacauauauaca

SEQ ID NO: 545947 - RNA, 64 nt, hsa
aggcauggagauccugguugugccgucucagcuccgcucugaaggcacugugugggugcugcgu

SEQ ID NO: 545948 - RNA, 64 nt, hsa
gaaacaccuguggcuucuuggcccuccuguugcccgcucugaaucucucugcagucuacaaaau

SEQ ID NO: 545949 - RNA, 64 nt, hsa
gcugaagacccccugacucccaugcugugcuugccgcucugaaacaaacagaggcuggaacuuu

SEQ ID NO: 545950 - RNA, 64 nt, hsa
cuugaaacugagccuuugcaagcauugaagcccacgcucugagucucagcgccgacgagaccau

SEQ ID NO: 545951 - RNA, 64 nt, hsa
uggggagaggucgcggcggcggguuugcuuccugcgcucugagaugagcugcccuccgcucccu

SEQ ID NO: 545952 - RNA, 64 nt, hsa
agaacauuuucgccugaugcccaucugcugaccccgcucugaaagccgggggugaguguggcuc

SEQ ID NO: 545953 - RNA, 64 nt, hsa
ccccccccccccuuuuuuuuuugagacggagucucgcucugacgcacaggcuggagugcagugg

SEQ ID NO: 545954 - RNA, 64 nt, hsa
ugccagccgacccuccuggccuuccucguugggccgcucugauuucaggcagcaggggcugcug

SEQ ID NO: 545955 - RNA, 64 nt, hsa
ccuccucuucuccuucaagacccaacugagcacccgcucugauuccccacagccuuucucccug

SEQ ID NO: 545956 - RNA, 64 nt, hsa
agugagggguugggggaucggcaguugggaggggcgcucugagauuaaagaguuuuaccucuga

SEQ ID NO: 545957 - RNA, 64 nt, hsa
aggcggauacagaaacuugugagaaugugaugaacgcucugaacccccuauaaaaaaugugcau

SEQ ID NO: 545958 - RNA, 64 nt, hsa
caccugccaugucccuccuuuccccagcuauccccgcucugaccuugauuuucauucuuauguu

SEQ ID NO: 545959 - RNA, 64 nt, hsa
ugggauuguccccgcacuaguagagaauccaugucgcucugacaccccaaggaagccgacgauc

SEQ ID NO: 545960 - RNA, 64 nt, hsa
agccuguguuguccccagcgacccugcagcugcucgcucugauguacccugugccauucaagga

SEQ ID NO: 545961 - RNA, 64 nt, hsa
cugaaacccccacgccuccgcuucagcaucuccacgcucugaagcugucuuucaaaaugugugc

SEQ ID NO: 545962 - RNA, 64 nt, hsa
agcaccccgccgcuucccccacacgcuugcucggcgcucugacuucuaggagcacaagagagga

SEQ ID NO: 545963 - RNA, 64 nt, hsa
accagagucuagcagugauaaaauguacaauuuacgcucugaauagaaacaugacaccaaagaa

SEQ ID NO: 545964 - RNA, 64 nt, hsa; identical to SEQ ID NO: 165842

SEQ ID NO: 545965 - RNA, 64 nt, hsa; identical to SEQ ID NO: 165843

SEQ ID NO: 545966 - RNA, 64 nt, hsa
uuccuacauugaggagcugacauagggguaagguaugggagagguagguggauccagggaaaag

SEQ ID NO: 545967 - RNA, 64 nt, hsa
agagagagaauaaggagccuuucuuauggaagaaaugggagaagagagacaggguucuuuucag

SEQ ID NO: 545968 - RNA, 64 nt, hsa
uggagagaagggcgugccacccuugcugugcaacaugggagagaaguucuuauuguuggccaug

SEQ ID NO: 545969 - RNA, 51 nt, hsa
aauaauuguuguuucagugauaugggagaaccaaaucgucauccaagcaug

SEQ ID NO: 545970 - RNA, 64 nt, hsa
uuuugcucuaaucucucugccgaaagucaaagugaugggagaauugguauacugguaugacuac

SEQ ID NO: 545971 - RNA, 64 nt, hsa
aauauauucugaccguuaaaaaauucuuguucauaugggagaagggggaguaaugacuuguaca

SEQ ID NO: 545972 - RNA, 64 nt, hsa
ccuugacaucaccugagcccccaccuagccauccaugggagagagaaggcccagccccuucuag

SEQ ID NO: 545973 - RNA, 64 nt, hsa
gccccucccuuggucagacucugggacuccugagaugggagaggcagggaucagaggacgaaca

SEQ ID NO: 545974 - RNA, 64 nt, hsa
acuuaaacaucuugcgaggcagccugccugguuuaugggagaacucugaagcccaugauguuuu

SEQ ID NO: 545975 - RNA, 64 nt, hsa
aaacaagccccguuggaacuuccuagugggaaugaugggagaaguuuggggcaggguauccaag

SEQ ID NO: 545976 - RNA, 64 nt, hsa
gaguggaucgguggugaaccuguugccuucaccaaugggagaagagggcccucucaacgcucca

SEQ ID NO: 545977 - RNA, 64 nt, hsa
cuucauauuccuccaaccaaagcaagcacagcacaugggagaagggcauuuggcaucugcugcc

SEQ ID NO: 545978 - RNA, 64 nt, hsa
ccacuccccacuacccucggagagagguggugggaugggagagagccccugugaaagccuguga

SEQ ID NO: 545979 - RNA, 64 nt, hsa
ccagggacuacauaacaggcaccuuugagagagcaugggagaagguggauaagaggaugcugcu

SEQ ID NO: 545980 - RNA, 64 nt, hsa
ugucaccuaugaccacauugggcccaacgucugcaugggagaccacaaggugacauagacugag

SEQ ID NO: 545981 - RNA, 64 nt, hsa
ggugccaaguauccuacguuacaacaauaauaucaugggagaaauagaaauagccuaguuugcu

SEQ ID NO: 545982 - RNA, 64 nt, hsa
aaaagcaaacugcauuuuuaaaaaucuuucugagaugggagaaaauguauucuccuuuccuaua

SEQ ID NO: 545983 - RNA, 64 nt, hsa
ugccuguuguaaugugcaggacccuucuccuuucaugggagagacagguaguuaccugaauaua

SEQ ID NO: 545984 - RNA, 64 nt, hsa
ggaggacccagccaagcuagaaggaauuuuguggaugggagacagcaggauuagcuucagcuug

SEQ ID NO: 545985 - RNA, 64 nt, hsa
ugcuaggacugagaggcugcaccauagggaauguaugggagauggugaggggugccagugaggg

SEQ ID NO: 545986 - RNA, 64 nt, hsa
uccugcacagccaaccuggaauaccaaagauuagaugggagauagauaccaaugauuuagaugg

SEQ ID NO: 545987 - RNA, 64 nt, hsa
cacccuuccuggacgggacuauugaaggaggagaaugggagagccuccccugggccugaaaacu

SEQ ID NO: 545988 - RNA, 64 nt, hsa
cuuacaaagagacuuacacucccacacaauaauaaugggagacuuaaacaccccacugucaaca

SEQ ID NO: 545989 - RNA, 64 nt, hsa
aaacuaccaucagagucaacaggcaaccuacaaaaugggagaaaauuuucgcaaccuacucauc

SEQ ID NO: 545990 - RNA, 64 nt, hsa
aagucuccuguucgcucauaaagaaguuuuugggaugggagagaauccagaccaucuuggggca

SEQ ID NO: 545991 - RNA, 64 nt, hsa
uuuuuuuuaaagcaaauccuguauauguaucuacaugggagacagguagacacuacuuauuugu

SEQ ID NO: 545992 - RNA, 64 nt, hsa
gggcucuucacugagccauaagggacagggagguaugggagagcgcugggggcccaucccccug

SEQ ID NO: 545993 - RNA, 64 nt, hsa
agcacgaaagggggaaugccccucccaggaguuuaugggagaagggacugggccggcugccucc

SEQ ID NO: 545994 - RNA, 64 nt, hsa
aaaauguaaaccuauuuuuauuacuuaagacuuuaugggagagauuagacacuggagguuuuua

SEQ ID NO: 545995 - RNA, 64 nt, hsa
cugaugaaaaugugagcacuguuagcagaugccuaugggagaggaaaagcguaucugaaaaugg

SEQ ID NO: 545996 - RNA, 64 nt, hsa
guccaguggacaugccccaccuccagacuugcucaugggagaaggcuguggucucugcccccuc

SEQ ID NO: 545997 - RNA, 64 nt, hsa
auccugccugccuucuccacugaggagcagguaaaugggagagguuuccagcugacuagaaccc

SEQ ID NO: 545998 - RNA, 64 nt, hsa
auugucugacccuagaggcagaugcugcacugcacuacuccaaugucuuccauggagccucagg

SEQ ID NO: 545999 - RNA, 64 nt, hsa
uuccccgguccaggggagagucacuaguuguacccuacuccauuaggucccaaaugggggcccc

SEQ ID NO: 546000 - RNA, 64 nt, hsa
ugggccaccagggcccuguguggugucucugcgucuacuccaugggugaccugcucuucagugg

SEQ ID NO: 546001 - RNA, 64 nt, hsa
gcauccacguccugcagacgucugguggcagcgucuacuccauugcugugacaaaucaccacau

SEQ ID NO: 546002 - RNA, 64 nt, hsa
cccacugccugccggggguuccugcagcaccccccuacuccaggcuccccaucucccugaagcu

SEQ ID NO: 546003 - RNA, 64 nt, hsa
uccuuguccacuucuuuaaggaaugcaguuuauucuacuccaagagauucugccucccuugugu

SEQ ID NO: 546004 - RNA, 64 nt, hsa; identical to SEQ ID NO: 237135

SEQ ID NO: 546005 - RNA, 64 nt, hsa; identical to SEQ ID NO: 237136

SEQ ID NO: 546006 - RNA, 64 nt, hsa; identical to SEQ ID NO: 237137

SEQ ID NO: 546007 - RNA, 64 nt, hsa; identical to SEQ ID NO: 237138

SEQ ID NO: 546008 - RNA, 64 nt, hsa; identical to SEQ ID NO: 237139

SEQ ID NO: 546009 - RNA, 64 nt, hsa; identical to SEQ ID NO: 237140

SEQ ID NO: 546010 - RNA, 64 nt, hsa; identical to SEQ ID NO: 237141

SEQ ID NO: 546011 - RNA, 64 nt, hsa; identical to SEQ ID NO: 237142

SEQ ID NO: 546012 - RNA, 64 nt, hsa; identical to SEQ ID NO: 237143

SEQ ID NO: 546013 - RNA, 64 nt, hsa; identical to SEQ ID NO: 237144

SEQ ID NO: 546014 - RNA, 64 nt, hsa; identical to SEQ ID NO: 237145

SEQ ID NO: 546015 - RNA, 64 nt, hsa; identical to SEQ ID NO: 237146

SEQ ID NO: 546016 - RNA, 64 nt, hsa; identical to SEQ ID NO: 237147

SEQ ID NO: 546017 - RNA, 64 nt, hsa; identical to SEQ ID NO: 237148

SEQ ID NO: 546018 - RNA, 64 nt, hsa; identical to SEQ ID NO: 237149

SEQ ID NO: 546019 - RNA, 64 nt, hsa; identical to SEQ ID NO: 237150

SEQ ID NO: 546020 - RNA, 64 nt, hsa; identical to SEQ ID NO: 533518

SEQ ID NO: 546021 - RNA, 64 nt, hsa; identical to SEQ ID NO: 533519

SEQ ID NO: 546022 - RNA, 64 nt, hsa; identical to SEQ ID NO: 533520

SEQ ID NO: 546023 - RNA, 64 nt, hsa; identical to SEQ ID NO: 533521

SEQ ID NO: 546024 - RNA, 64 nt, hsa; identical to SEQ ID NO: 533522

SEQ ID NO: 546025 - RNA, 64 nt, hsa; identical to SEQ ID NO: 533523

SEQ ID NO: 546026 - RNA, 64 nt, hsa; identical to SEQ ID NO: 533524

SEQ ID NO: 546027 - RNA, 64 nt, hsa; identical to SEQ ID NO: 533525

SEQ ID NO: 546028 - RNA, 64 nt, hsa; identical to SEQ ID NO: 533526

SEQ ID NO: 546029 - RNA, 64 nt, hsa; identical to SEQ ID NO: 533527

SEQ ID NO: 546030 - RNA, 64 nt, hsa; identical to SEQ ID NO: 533528

SEQ ID NO: 546031 - RNA, 51 nt, hsa; identical to SEQ ID NO: 533529

SEQ ID NO: 546032 - RNA, 64 nt, hsa; identical to SEQ ID NO: 533530

SEQ ID NO: 546033 - RNA, 64 nt, hsa; identical to SEQ ID NO: 533531

SEQ ID NO: 546034 - RNA, 64 nt, hsa; identical to SEQ ID NO: 533532

SEQ ID NO: 546035 - RNA, 64 nt, hsa; identical to SEQ ID NO: 533533

SEQ ID NO: 546036 - RNA, 64 nt, hsa; identical to SEQ ID NO: 533534

SEQ ID NO: 546037 - RNA, 64 nt, hsa; identical to SEQ ID NO: 533535

SEQ ID NO: 546038 - RNA, 64 nt, hsa; identical to SEQ ID NO: 533536

SEQ ID NO: 546039 - RNA, 64 nt, hsa; identical to SEQ ID NO: 533537

SEQ ID NO: 546040 - RNA, 64 nt, hsa; identical to SEQ ID NO: 533538

SEQ ID NO: 546041 - RNA, 64 nt, hsa; identical to SEQ ID NO: 533539

SEQ ID NO: 546042 - RNA, 64 nt, hsa; identical to SEQ ID NO: 533540

SEQ ID NO: 546043 - RNA, 64 nt, hsa; identical to SEQ ID NO: 533541

SEQ ID NO: 546044 - RNA, 64 nt, hsa; identical to SEQ ID NO: 533542

SEQ ID NO: 546045 - RNA, 64 nt, hsa; identical to SEQ ID NO: 533543

SEQ ID NO: 546046 - RNA, 64 nt, hsa; identical to SEQ ID NO: 533544

SEQ ID NO: 546047 - RNA, 64 nt, hsa; identical to SEQ ID NO: 533545

SEQ ID NO: 546048 - RNA, 64 nt, hsa; identical to SEQ ID NO: 533546

SEQ ID NO: 546049 - RNA, 64 nt, hsa; identical to SEQ ID NO: 533547

SEQ ID NO: 546050 - RNA, 64 nt, hsa; identical to SEQ ID NO: 533548

SEQ ID NO: 546051 - RNA, 64 nt, hsa; identical to SEQ ID NO: 533549

SEQ ID NO: 546052 - RNA, 64 nt, hsa; identical to SEQ ID NO: 533550

SEQ ID NO: 546053 - RNA, 64 nt, hsa; identical to SEQ ID NO: 533551

SEQ ID NO: 546054 - RNA, 64 nt, hsa; identical to SEQ ID NO: 533552

SEQ ID NO: 546055 - RNA, 64 nt, hsa; identical to SEQ ID NO: 533553

SEQ ID NO: 546056 - RNA, 64 nt, hsa; identical to SEQ ID NO: 533554

SEQ ID NO: 546057 - RNA, 64 nt, hsa; identical to SEQ ID NO: 533555

SEQ ID NO: 546058 - RNA, 64 nt, hsa; identical to SEQ ID NO: 533556

SEQ ID NO: 546059 - RNA, 64 nt, hsa; identical to SEQ ID NO: 52866

SEQ ID NO: 546060 - RNA, 64 nt, hsa; identical to SEQ ID NO: 52867

SEQ ID NO: 546061 - RNA, 64 nt, hsa; identical to SEQ ID NO: 52868

SEQ ID NO: 546062 - RNA, 64 nt, hsa; identical to SEQ ID NO: 52869

SEQ ID NO: 546063 - RNA, 64 nt, hsa
cuccacagugguggcugucagacccgaagggguggggagccaaggguggacuuuaagcauggug

SEQ ID NO: 546064 - RNA, 64 nt, hsa
ggguaagccccacagcgggcagcacaaacagccugggagccacugugccugugcuucucugucc

SEQ ID NO: 546065 - RNA, 64 nt, hsa
gagaggaccugaucauguagggagggacggggaggggagccaggacccaggagcugcauggcug

SEQ ID NO: 546066 - RNA, 64 nt, hsa
cacccuagacagagacccacccgugauacucugagggagccagacuuucacaugcaacggggca

SEQ ID NO: 546067 - RNA, 64 nt, hsa
ggcagccccucuccguccucagggcugugccucugggagccacugggccaggggccccgggucg

SEQ ID NO: 546068 - RNA, 64 nt, hsa
gcggugagcggcucccaugggcccugugucugcagggagccagggcugcggcacaugugcugug

SEQ ID NO: 546069 - RNA, 64 nt, hsa
gcgccucaucuuuaaacuguccuuaguagcccaggggagccacacccucacucccugccucccc

SEQ ID NO: 546070 - RNA, 64 nt, hsa
cgcggcucaggggcuccucacagcccgggcuggugggagccaagaccagacagagugggggucu

SEQ ID NO: 546071 - RNA, 64 nt, hsa
ugcagucuggagacaagcucuuccggagugcucugggagccaggccagggugugagggaggugc

SEQ ID NO: 546072 - RNA, 64 nt, hsa
ggcauguuucugccgccacuccgcaagauggacagggagccagcaggcaggcgggaagggccaa

SEQ ID NO: 546073 - RNA, 64 nt, hsa
ucuccaucucaggaaauucuagcccuugcccucagggagccacgguugagggugaggcccaaca

SEQ ID NO: 546074 - RNA, 64 nt, hsa
ucgcugggaccuacugcucgggaggcagcagacagggagccaccagcaguggcuuccuggcccu

SEQ ID NO: 546075 - RNA, 64 nt, hsa
aggacuaugccagaagcgaugggguaccguguaggggagccaaggccaguaguuuggggguagg

SEQ ID NO: 546076 - RNA, 50 nt, hsa
cgugggcccaggugggcugagggagccacacuggggccccccccccgugg

SEQ ID NO: 546077 - RNA, 64 nt, hsa
ucagagagacccgggaaggaaggcucucgggugggggagccaggagaccugcucuccggcgcag

SEQ ID NO: 546078 - RNA, 64 nt, hsa
ggaguuacaaaguuugcaaagucccagccgcacugggagccauggggagcaagugugcucuccu

SEQ ID NO: 546079 - RNA, 64 nt, hsa
acccagccuccagggacugaaccgugcugcuguugggagccaagaccggcccuuuggagccggc

SEQ ID NO: 546080 - RNA, 64 nt, hsa
gaaggugggagccaacacccuucugauggaaggugggagccaacacccuucugauggaaggcgg

SEQ ID NO: 546081 - RNA, 64 nt, hsa
gaaggugggagccaacacccuucugauggaaggugggagccaacacccuucugauggaaggugg

SEQ ID NO: 546082 - RNA, 64 nt, hsa; identical to SEQ ID NO: 546081

SEQ ID NO: 546083 - RNA, 64 nt, hsa; identical to SEQ ID NO: 546081

SEQ ID NO: 546084 - RNA, 64 nt, hsa
gguuucccugggccagcaucuucugauggaaggugggagccaacacccuucugauggaaggugg

SEQ ID NO: 546085 - RNA, 64 nt, hsa
gaggauggcuugagccuaggaguucgaggcugcagggagccaugaucaugccauuguacuccag

SEQ ID NO: 546086 - RNA, 64 nt, hsa
ggucaugaauuugagaccagccuggccaacagacgggagccacuuuucccagccuguauguucu

SEQ ID NO: 546087 - RNA, 64 nt, hsa
cucuccgagcacugggcccugccugggggcucccgggagccaggggagaugcuaccucggaagc

SEQ ID NO: 546088 - RNA, 64 nt, hsa
acgaggcugcagaagcucucccucccuacucccugggagccacgugcuggccauguggccaggg

SEQ ID NO: 546089 - RNA, 64 nt, hsa
acuggacaagagaagaggcauugagagcccccuugggagccauuagccuugcucuggucugcug

SEQ ID NO: 546090 - RNA, 64 nt, hsa
ggacaucugaaugcugauacgaauggacaggaaagggagccagagcuguauaccugggacaggc

SEQ ID NO: 546091 - RNA, 64 nt, hsa
ugaggcagagauugaagccaucagagcugggguugggagccagaaugccugaguccuucugucc

SEQ ID NO: 546092 - RNA, 64 nt, hsa
auggagagagugagcuggggaacaggaaagucuggggagccacaggagagggaccuugcacccu

SEQ ID NO: 546093 - RNA, 64 nt, hsa
ucuuuaagagcuaacaagagaagagaguccaguuuucuggaaauaugucuuuaaguauuuuaga

SEQ ID NO: 546094 - RNA, 64 nt, hsa
uggggguaaggguaugaggugaucaggaaguuucuucuggaauuuuaucaaguccuuguauucu

SEQ ID NO: 546095 - RNA, 64 nt, hsa
guuccagccccuuggaucaacgaaaaucagaggauucuggaaaggcagccaacuugcgccucuu

SEQ ID NO: 546096 - RNA, 64 nt, hsa
uugcugauucagacuuauuaguuaaaucggauuuuucuggaauuugaaucagauuucauuuggg

SEQ ID NO: 546097 - RNA, 64 nt, hsa
ccuaguuagacuuugggaagccaccuucaacguuuucuggaacaaggcagguacaaauaaaaaa

SEQ ID NO: 546098 - RNA, 64 nt, hsa
uugggguccuuucaucuggcuccguuucuggugcuucuggaagucucugcucagcacagggaag

SEQ ID NO: 546099 - RNA, 64 nt, hsa
gcaugauuuauauauggcauauuuauauuguauauucuggaaaaaaaauauauauauauauuua

SEQ ID NO: 546100 - RNA, 64 nt, hsa
caaacugaguaaauuggaaacauuuucuuucuuuuucuggaaauuuuguccauuuuaaaaacca

SEQ ID NO: 546101 - RNA, 64 nt, hsa
ugaagacacugaaaaauaagugauuucaguaaccuucuggaaagcuaucaguuucaaauaauau

SEQ ID NO: 546102 - RNA, 64 nt, hsa
uauucauagagcuccuucucugugccagacacuguucuggaagauagcuagaugaaaaucuuug

SEQ ID NO: 546103 - RNA, 64 nt, hsa
aaugucuggagagggccagcaggcccucugaggguucuggaaucugugcaccuuauuugaccac

SEQ ID NO: 546104 - RNA, 64 nt, hsa
cucccaauguuguuaaugcucugucuuccauuuguucuggaauccuacguguuggucugugguu

SEQ ID NO: 546105 - RNA, 64 nt, hsa
uacccagcugggacuccaaaacucaaccaucaccuucuggaauaucacccuggaggaugaaggg

SEQ ID NO: 546106 - RNA, 64 nt, hsa
uugcucugccacugcccgcccagcccccauggucuucuggaaggucccucggucagggauugaa

SEQ ID NO: 546107 - RNA, 64 nt, hsa
caucaccauuuuuccugaguagggcuuaguuuuauucuggaaagacaucuccaaggugaggucc

SEQ ID NO: 546108 - RNA, 64 nt, hsa
uuuggccaaacaaccggcuacaaugcucuuccucuucuggaauguugcugacccaggccgugga

SEQ ID NO: 546109 - RNA, 64 nt, hsa
guaaagcuguauuuucuggaaggaagacuguaucuucuggaauaguuuucuagaaaacuaguca

SEQ ID NO: 546110 - RNA, 64 nt, hsa
augauuaggcacuuaaggacaguaaagcuguauuuucuggaaggaagacuguaucuucuggaau

SEQ ID NO: 546111 - RNA, 64 nt, hsa
uuauuuaaaaucagaacaauuuccuacaaaauuuuucuggaaaauagacuccuaacagaccuac

SEQ ID NO: 546112 - RNA, 64 nt, hsa
agggggggaggggaguguugcagcaggcauucucuucuggaaggagucgcugggagcagugcgg

SEQ ID NO: 546113 - RNA, 64 nt, hsa
ucuggaguuuuagugaaaggauuuauugagcagcuucuggaauauaaugugcauguccaaaaug

SEQ ID NO: 546114 - RNA, 64 nt, hsa
cuggcagaugaauaauuuucacucauuuauugucuucuggaaaccauuuaacuuuuacuguuuu

SEQ ID NO: 546115 - RNA, 64 nt, hsa
agaaggagucccucacccuaggugugagaugggauucuggaagcuuccugaaggauuugagugg

SEQ ID NO: 546116 - RNA, 64 nt, hsa
agaguccaugaagggggugugagggggaggguauuucuggaaaguggaccagcaugugcaaaaa

SEQ ID NO: 546117 - RNA, 64 nt, hsa
auguauggggcuuccauuuggggugaggagaaaguucuggaacuagauaguggucaugguuaua

SEQ ID NO: 546118 - RNA, 64 nt, hsa
ggccacuuugcuucucuaccugagcaccccugauuucuggaacgcugcugagcccugccuuacu

SEQ ID NO: 546119 - RNA, 64 nt, hsa
aucagcaccguuguuccuaggauucgugaggggauucuggaaccaauaagggaguugaacuggu

SEQ ID NO: 546120 - RNA, 64 nt, hsa
ucacuucuuggccacagcacaucacagacacaguuucuggaauacagguuugaggauacagugu

SEQ ID NO: 546121 - RNA, 64 nt, hsa
gucuacuuguucuccagcuucuggguagcugggcuucuggaaggguggcagugggcuacucccu

SEQ ID NO: 546122 - RNA, 64 nt, hsa
ugagccgcuguacccgaacuuuuuuuguuuuugcuucuggaacuuugaaacacaaaacacaagu

SEQ ID NO: 546123 - RNA, 64 nt, hsa
aguacaaacgcugcuuggauaaggagagcaaagcuucuggaacuuuauuuacucuuucuuuuua

SEQ ID NO: 546124 - RNA, 64 nt, hsa
ucaagguucucuuggcuggacaucauuaagaaaguucuggaaacuguguuuguuugaugcuggu

SEQ ID NO: 546125 - RNA, 64 nt, hsa
ugggaaaugucuacaaaugucuauuucuacugaguucuggaagaaauaugcaaaaguggguacu

SEQ ID NO: 546126 - RNA, 64 nt, hsa
agaacuugaacuucaccuuuuaggauuugagcuguucuggaacacauugcugcacuuuggaaag

SEQ ID NO: 546127 - RNA, 64 nt, hsa
uuccugaccugcuguagaacauagggauacugcauucuggaaauuacucaauuuaguggcaggg

SEQ ID NO: 546128 - RNA, 64 nt, hsa
aacagguuugaaaauauguauuaaguacuuuguauucuggaagcgugaauugcuuuugaagucu

SEQ ID NO: 546129 - RNA, 64 nt, hsa
auaugaccugaugccuuuccuucauuaaagaugauucuggaaugaucagcagauauagucuaca

SEQ ID NO: 546130 - RNA, 64 nt, hsa
ggggaccaugcugccuucucugggcucacgacuguucuggaaaggaccccauggcagacuuggc

SEQ ID NO: 546131 - RNA, 64 nt, hsa
gcccguguuucucagacuuuaaagccaccagggcuucuggaacaccugucauagaagcaauaac

SEQ ID NO: 546132 - RNA, 64 nt, hsa
uuccaucuggcaucccacgcguuguccccugcacuucuggaaggcacagggugcugcugccucc

SEQ ID NO: 546133 - RNA, 64 nt, hsa
uucaggaagucagaccuucccugguuuaccuuuuuucuggaaaaagcccaacuggacuccaguc

SEQ ID NO: 546134 - RNA, 64 nt, hsa
auacaauauagaguaugcacauuugggacugcauuucuggaaacauacugcaauaggcucucug

SEQ ID NO: 546135 - RNA, 64 nt, hsa
caguaagauguguggguuuuucuguauuuuucuuuucuggaacagugggaauuaaggcuacugc

SEQ ID NO: 546136 - RNA, 64 nt, hsa
acccuugcauacaaguuucuaguugccagugauguucuggaaauaaugggagauauuacaauaa

SEQ ID NO: 546137 - RNA, 64 nt, hsa
cagcauucgcaaugagaucuuuaguuggcggauuuucuggaacauuuguuuuucaacuuguccc

SEQ ID NO: 546138 - RNA, 64 nt, hsa
ucaaucuacucaugauguguuaugcauaaaacauuucuggaacauggauuuguguucaccuuaa

SEQ ID NO: 546139 - RNA, 64 nt, hsa
aaauccuauuuucuauggaagacugguaccugguuucuggaagaggggucugugacuuggagcu

SEQ ID NO: 546140 - RNA, 64 nt, hsa
uagaacuguuaacugagauggcuucgagucuuccuucuggaaucuguuaaauuucacaaaguca

SEQ ID NO: 546141 - RNA, 64 nt, hsa
uaauuacugugauggacacagaaauguagcuguguucuggaacugaaucuuacaugguauacuu

SEQ ID NO: 546142 - RNA, 64 nt, hsa
caaauggauuucuccuggggaauuuucuuggcuguucuggaaaugcuuucccacagcuggguaa

SEQ ID NO: 546143 - RNA, 64 nt, hsa
uucuaaaacacuacuguuuugcagggcaggaguauucuggaaucuuuuuacuuagauauaaaau

SEQ ID NO: 546144 - RNA, 64 nt, hsa
caggucacccugaaaagcccccaggggcuugcaauucuggaaaauauuuugacuagcugcuugg

SEQ ID NO: 546145 - RNA, 64 nt, hsa
cugcugguuuuaggggccaaaguaaauggguggauucuggaaccucaggccuagacuagguugc

SEQ ID NO: 546146 - RNA, 64 nt, hsa
uucagugugauacagagcugccauuuccaaaguauucuggaagcaagccauugccuuacucuug

SEQ ID NO: 546147 - RNA, 64 nt, hsa
uacuccaaagccuagaaccuucacgucaugaagguucuggaagguuuuucagauugcuuaagau

SEQ ID NO: 546148 - RNA, 64 nt, hsa
agcgcacggguugguuguucuagcaugaauacaauucuggaaacuguuaugcaauuucccuuuu

SEQ ID NO: 546149 - RNA, 64 nt, hsa
acugacuuaugguuuugauucaagaaucgucuuauucuggaaguagaucugaauaggcuaccgg

SEQ ID NO: 546150 - RNA, 64 nt, hsa
ucuggauccuccacuccuggggauuaugaagauauucuggaaagauuugugcuucagagguaga

SEQ ID NO: 546151 - RNA, 64 nt, hsa
ccuguugcugcuuugcaaugaauuuccuuuaccuuucuggaacacaagcugcugugaaccaaac

SEQ ID NO: 546152 - RNA, 64 nt, hsa
aagacugaucauaaaccaaugcugguauugcaccuucuggaacuaugggcuugagaaaaccccc

SEQ ID NO: 546153 - RNA, 64 nt, hsa
ugcuuuacgauguaaaauauuuauuuuuuacuuauucuggaagaucuggcugaaggauuauuca

SEQ ID NO: 546154 - RNA, 64 nt, hsa
uucuacuccucccucugacucuaagaauucucucuucuggaaucgcuugaacccaggaggcgga

SEQ ID NO: 546155 - RNA, 64 nt, hsa
gcuguaacugugugagauugugaaguggucugaauucuggaaucacaaaccaagccaugcuggu

SEQ ID NO: 546156 - RNA, 64 nt, hsa
aucccucuccuaaaaaguucaguuuggaaucucauucuggaaaagauggaaucgcauggagauu

SEQ ID NO: 546157 - RNA, 64 nt, hsa
ggaguuaccuuuguuuuucuaucguaaauuuagauucuggaauugggguuugguggugcaaugu

SEQ ID NO: 546158 - RNA, 64 nt, hsa
ucccuacucuaccuucuaccuuggucuggacacauucuggaacacuggacacccucgccagggc

SEQ ID NO: 546159 - RNA, 64 nt, hsa
cccgccuucuugagugauaccuauuacggaugaguucuggaaaagacccagcuaugauucauaa

SEQ ID NO: 546160 - RNA, 64 nt, hsa
ccaagaggcucuucagagaucauggaugcucucuuucuggaagcuguggccugauggagcagcc

SEQ ID NO: 546161 - RNA, 64 nt, hsa
gcaauaucccaaguucuugugacugagggagauuuucuggaagggccacaggagguugcggagc

SEQ ID NO: 546162 - RNA, 64 nt, hsa
agcaagauggguuuuuaaggaaaauaaugugaaauucuggaaauuuucuuuggggcagagaaga

SEQ ID NO: 546163 - RNA, 64 nt, hsa
ggcggggauaggggagggcauugaaguucuacaauucuggaauaguuaguugaugguacauagu

SEQ ID NO: 546164 - RNA, 64 nt, hsa
gaaaaguuaagccaucuccuccucuggcccuuccuucuggaaucuucagaugccuguuaggccu

SEQ ID NO: 546165 - RNA, 64 nt, hsa
ugcucccugacucccagggccccguaguuagcaauucuggaaaaguuaagccaucuccuccucu

SEQ ID NO: 546166 - RNA, 64 nt, hsa
cugcaggugggcugcugagggucugggaucuguuuucuggaagugugcagguauaaacacaccc

SEQ ID NO: 546167 - RNA, 64 nt, hsa
agaacccugcagggcccuuauggacaggaugggguucuggaaauccagauaacuaaggugaaga

SEQ ID NO: 546168 - RNA, 64 nt, hsa
uucuaguugggagaguuggagagaagggggacguuucuggaacugucugaauauucuagaacua

SEQ ID NO: 546169 - RNA, 64 nt, hsa
ccucaaauuguagucucugucggcuucugcagaauucuggaaaaugccaguuuuccucccccgc

SEQ ID NO: 546170 - RNA, 64 nt, hsa
uggcuucagugauuccucugugucccuuuuugguuucuggaaagauucuuugucaacauuagua

SEQ ID NO: 546171 - RNA, 64 nt, hsa
ugagagaauacuguaauaauaucaaaagcacuuuuucuggaaacacauuuauggcuuuuauaau

SEQ ID NO: 546172 - RNA, 64 nt, hsa
uauauugucauagugguuuuuauuccugcuuuguuucuggaaaggaaauccugaauuacuuaag

SEQ ID NO: 546173 - RNA, 64 nt, hsa
cgccucagcggugaggugguuuagggauaaauguuucuggaacccuguggucccccauaauguu

SEQ ID NO: 546174 - RNA, 64 nt, hsa
ccuuccccaguguaauguagcuuucucucuuaccuucuggaagagggaauguuucauuuauuac

SEQ ID NO: 546175 - RNA, 64 nt, hsa
ccggaagacauggauugucuggaagauguggauuuucuggaagcucaggauuaucuggaagacc

SEQ ID NO: 546176 - RNA, 64 nt, hsa
uggaagacuuggauuugguggaagacacagauuuuucuggaagacauggauuagcuggaagauc

SEQ ID NO: 546177 - RNA, 54 nt, hsa
ugauugacuggaagaucuagauuuuucuggaagaacuagauuuacuggaagacu

SEQ ID NO: 546178 - RNA, 64 nt, hsa
uuuauguauuauacuuagucaaauguaauguggcuucuggaaucauuguccagagcugcuuccc

SEQ ID NO: 546179 - RNA, 64 nt, hsa
aaucaguagcuuaagaaaaaaccguguuugucucuucuggaaugguuagaagugagggaguuug

SEQ ID NO: 546180 - RNA, 64 nt, hsa; identical to SEQ ID NO: 379135

SEQ ID NO: 546181 - RNA, 64 nt, hsa; identical to SEQ ID NO: 379136

SEQ ID NO: 546182 - RNA, 64 nt, hsa; identical to SEQ ID NO: 379137

SEQ ID NO: 546183 - RNA, 64 nt, hsa; identical to SEQ ID NO: 379138

SEQ ID NO: 546184 - RNA, 64 nt, hsa; identical to SEQ ID NO: 379139

SEQ ID NO: 546185 - RNA, 64 nt, hsa; identical to SEQ ID NO: 379140

SEQ ID NO: 546186 - RNA, 64 nt, hsa; identical to SEQ ID NO: 379141

SEQ ID NO: 546187 - RNA, 64 nt, hsa; identical to SEQ ID NO: 379142

SEQ ID NO: 546188 - RNA, 64 nt, hsa; identical to SEQ ID NO: 379143

SEQ ID NO: 546189 - RNA, 64 nt, hsa; identical to SEQ ID NO: 379144

SEQ ID NO: 546190 - RNA, 64 nt, hsa; identical to SEQ ID NO: 379145

SEQ ID NO: 546191 - RNA, 64 nt, hsa; identical to SEQ ID NO: 379146

SEQ ID NO: 546192 - RNA, 64 nt, hsa; identical to SEQ ID NO: 379147

SEQ ID NO: 546193 - RNA, 64 nt, hsa; identical to SEQ ID NO: 379148

SEQ ID NO: 546194 - RNA, 64 nt, hsa; identical to SEQ ID NO: 379149

SEQ ID NO: 546195 - RNA, 64 nt, hsa; identical to SEQ ID NO: 379150

SEQ ID NO: 546196 - RNA, 64 nt, hsa; identical to SEQ ID NO: 379151

SEQ ID NO: 546197 - RNA, 64 nt, hsa; identical to SEQ ID NO: 379152

SEQ ID NO: 546198 - RNA, 64 nt, hsa; identical to SEQ ID NO: 379153

SEQ ID NO: 546199 - RNA, 64 nt, hsa; identical to SEQ ID NO: 379154

SEQ ID NO: 546200 - RNA, 64 nt, hsa; identical to SEQ ID NO: 379155

SEQ ID NO: 546201 - RNA, 64 nt, hsa; identical to SEQ ID NO: 379156

SEQ ID NO: 546202 - RNA, 64 nt, hsa; identical to SEQ ID NO: 379157

SEQ ID NO: 546203 - RNA, 64 nt, hsa; identical to SEQ ID NO: 379158

SEQ ID NO: 546204 - RNA, 64 nt, hsa; identical to SEQ ID NO: 379159

SEQ ID NO: 546205 - RNA, 64 nt, hsa; identical to SEQ ID NO: 379160

SEQ ID NO: 546206 - RNA, 64 nt, hsa; identical to SEQ ID NO: 379161

SEQ ID NO: 546207 - RNA, 64 nt, hsa; identical to SEQ ID NO: 379162

SEQ ID NO: 546208 - RNA, 64 nt, hsa; identical to SEQ ID NO: 379163

SEQ ID NO: 546209 - RNA, 64 nt, hsa; identical to SEQ ID NO: 379164

SEQ ID NO: 546210 - RNA, 64 nt, hsa; identical to SEQ ID NO: 379165

SEQ ID NO: 546211 - RNA, 64 nt, hsa; identical to SEQ ID NO: 379166

SEQ ID NO: 546212 - RNA, 64 nt, hsa; identical to SEQ ID NO: 379167

SEQ ID NO: 546213 - RNA, 64 nt, hsa; identical to SEQ ID NO: 379168

SEQ ID NO: 546214 - RNA, 64 nt, hsa; identical to SEQ ID NO: 379169

SEQ ID NO: 546215 - RNA, 64 nt, hsa; identical to SEQ ID NO: 379170

SEQ ID NO: 546216 - RNA, 64 nt, hsa; identical to SEQ ID NO: 379171

SEQ ID NO: 546217 - RNA, 64 nt, hsa; identical to SEQ ID NO: 379172

SEQ ID NO: 546218 - RNA, 64 nt, hsa; identical to SEQ ID NO: 379173

SEQ ID NO: 546219 - RNA, 64 nt, hsa; identical to SEQ ID NO: 379174

SEQ ID NO: 546220 - RNA, 64 nt, hsa; identical to SEQ ID NO: 379175

SEQ ID NO: 546221 - RNA, 64 nt, hsa; identical to SEQ ID NO: 379176

SEQ ID NO: 546222 - RNA, 51 nt, hsa; identical to SEQ ID NO: 379177

SEQ ID NO: 546223 - RNA, 64 nt, hsa; identical to SEQ ID NO: 379178

SEQ ID NO: 546224 - RNA, 64 nt, hsa; identical to SEQ ID NO: 379179

SEQ ID NO: 546225 - RNA, 64 nt, hsa; identical to SEQ ID NO: 379180

SEQ ID NO: 546226 - RNA, 64 nt, hsa; identical to SEQ ID NO: 379181

SEQ ID NO: 546227 - RNA, 64 nt, hsa; identical to SEQ ID NO: 379182

SEQ ID NO: 546228 - RNA, 64 nt, hsa; identical to SEQ ID NO: 379183

SEQ ID NO: 546229 - RNA, 64 nt, hsa; identical to SEQ ID NO: 379184

SEQ ID NO: 546230 - RNA, 64 nt, hsa; identical to SEQ ID NO: 379185

SEQ ID NO: 546231 - RNA, 64 nt, hsa; identical to SEQ ID NO: 379186

SEQ ID NO: 546232 - RNA, 64 nt, hsa; identical to SEQ ID NO: 379187

SEQ ID NO: 546233 - RNA, 64 nt, hsa; identical to SEQ ID NO: 379188

SEQ ID NO: 546234 - RNA, 64 nt, hsa; identical to SEQ ID NO: 379189

SEQ ID NO: 546235 - RNA, 64 nt, hsa; identical to SEQ ID NO: 379190

SEQ ID NO: 546236 - RNA, 64 nt, hsa; identical to SEQ ID NO: 379191

SEQ ID NO: 546237 - RNA, 64 nt, hsa; identical to SEQ ID NO: 379192

SEQ ID NO: 546238 - RNA, 64 nt, hsa; identical to SEQ ID NO: 379193

SEQ ID NO: 546239 - RNA, 64 nt, hsa; identical to SEQ ID NO: 379194

SEQ ID NO: 546240 - RNA, 64 nt, hsa; identical to SEQ ID NO: 379195

SEQ ID NO: 546241 - RNA, 64 nt, hsa; identical to SEQ ID NO: 379196

SEQ ID NO: 546242 - RNA, 64 nt, hsa; identical to SEQ ID NO: 379197

SEQ ID NO: 546243 - RNA, 64 nt, hsa; identical to SEQ ID NO: 379198

SEQ ID NO: 546244 - RNA, 64 nt, hsa; identical to SEQ ID NO: 379199

SEQ ID NO: 546245 - RNA, 64 nt, hsa; identical to SEQ ID NO: 379200

SEQ ID NO: 546246 - RNA, 64 nt, hsa; identical to SEQ ID NO: 379201

SEQ ID NO: 546247 - RNA, 64 nt, hsa; identical to SEQ ID NO: 411830

SEQ ID NO: 546248 - RNA, 64 nt, hsa; identical to SEQ ID NO: 411831

SEQ ID NO: 546249 - RNA, 64 nt, hsa; identical to SEQ ID NO: 411832

SEQ ID NO: 546250 - RNA, 64 nt, hsa; identical to SEQ ID NO: 411833

SEQ ID NO: 546251 - RNA, 64 nt, hsa; identical to SEQ ID NO: 411834

SEQ ID NO: 546252 - RNA, 64 nt, hsa; identical to SEQ ID NO: 411835

SEQ ID NO: 546253 - RNA, 64 nt, hsa; identical to SEQ ID NO: 411836

SEQ ID NO: 546254 - RNA, 64 nt, hsa; identical to SEQ ID NO: 411837

SEQ ID NO: 546255 - RNA, 64 nt, hsa; identical to SEQ ID NO: 411838

SEQ ID NO: 546256 - RNA, 64 nt, hsa; identical to SEQ ID NO: 411839

SEQ ID NO: 546257 - RNA, 64 nt, hsa; identical to SEQ ID NO: 411840

SEQ ID NO: 546258 - RNA, 64 nt, hsa; identical to SEQ ID NO: 411841

SEQ ID NO: 546259 - RNA, 64 nt, hsa; identical to SEQ ID NO: 411842

SEQ ID NO: 546260 - RNA, 64 nt, hsa; identical to SEQ ID NO: 411843

SEQ ID NO: 546261 - RNA, 64 nt, hsa; identical to SEQ ID NO: 411844

SEQ ID NO: 546262 - RNA, 64 nt, hsa; identical to SEQ ID NO: 411845

SEQ ID NO: 546263 - RNA, 64 nt, hsa; identical to SEQ ID NO: 411846

SEQ ID NO: 546264 - RNA, 64 nt, hsa; identical to SEQ ID NO: 411847

SEQ ID NO: 546265 - RNA, 64 nt, hsa; identical to SEQ ID NO: 411848

SEQ ID NO: 546266 - RNA, 64 nt, hsa; identical to SEQ ID NO: 411849

SEQ ID NO: 546267 - RNA, 64 nt, hsa; identical to SEQ ID NO: 411850

SEQ ID NO: 546268 - RNA, 64 nt, hsa; identical to SEQ ID NO: 411851

SEQ ID NO: 546269 - RNA, 64 nt, hsa; identical to SEQ ID NO: 411852

SEQ ID NO: 546270 - RNA, 64 nt, hsa; identical to SEQ ID NO: 411853

SEQ ID NO: 546271 - RNA, 64 nt, hsa; identical to SEQ ID NO: 411854

SEQ ID NO: 546272 - RNA, 64 nt, hsa; identical to SEQ ID NO: 411855

SEQ ID NO: 546273 - RNA, 64 nt, hsa; identical to SEQ ID NO: 411856

SEQ ID NO: 546274 - RNA, 64 nt, hsa; identical to SEQ ID NO: 266922

SEQ ID NO: 546275 - RNA, 64 nt, hsa; identical to SEQ ID NO: 266923

SEQ ID NO: 546276 - RNA, 64 nt, hsa; identical to SEQ ID NO: 266924

SEQ ID NO: 546277 - RNA, 64 nt, hsa; identical to SEQ ID NO: 266925

SEQ ID NO: 546278 - RNA, 64 nt, hsa; identical to SEQ ID NO: 266926

SEQ ID NO: 546279 - RNA, 64 nt, hsa; identical to SEQ ID NO: 266927

SEQ ID NO: 546280 - RNA, 64 nt, hsa; identical to SEQ ID NO: 266928

SEQ ID NO: 546281 - RNA, 64 nt, hsa; identical to SEQ ID NO: 266929

SEQ ID NO: 546282 - RNA, 64 nt, hsa; identical to SEQ ID NO: 266930

SEQ ID NO: 546283 - RNA, 64 nt, hsa; identical to SEQ ID NO: 266931

SEQ ID NO: 546284 - RNA, 64 nt, hsa; identical to SEQ ID NO: 266932

SEQ ID NO: 546285 - RNA, 64 nt, hsa; identical to SEQ ID NO: 266933

SEQ ID NO: 546286 - RNA, 64 nt, hsa; identical to SEQ ID NO: 266934

SEQ ID NO: 546287 - RNA, 64 nt, hsa; identical to SEQ ID NO: 266935

SEQ ID NO: 546288 - RNA, 64 nt, hsa; identical to SEQ ID NO: 266936

SEQ ID NO: 546289 - RNA, 64 nt, hsa; identical to SEQ ID NO: 266937

SEQ ID NO: 546290 - RNA, 64 nt, hsa; identical to SEQ ID NO: 266938

SEQ ID NO: 546291 - RNA, 64 nt, hsa; identical to SEQ ID NO: 266939

SEQ ID NO: 546292 - RNA, 64 nt, hsa; identical to SEQ ID NO: 266940

SEQ ID NO: 546293 - RNA, 64 nt, hsa; identical to SEQ ID NO: 266941

SEQ ID NO: 546294 - RNA, 64 nt, hsa; identical to SEQ ID NO: 266942

SEQ ID NO: 546295 - RNA, 64 nt, hsa; identical to SEQ ID NO: 266943

SEQ ID NO: 546296 - RNA, 64 nt, hsa; identical to SEQ ID NO: 266944

SEQ ID NO: 546297 - RNA, 64 nt, hsa; identical to SEQ ID NO: 266945

SEQ ID NO: 546298 - RNA, 64 nt, hsa; identical to SEQ ID NO: 266946

SEQ ID NO: 546299 - RNA, 64 nt, hsa; identical to SEQ ID NO: 266947

SEQ ID NO: 546300 - RNA, 64 nt, hsa; identical to SEQ ID NO: 266948

SEQ ID NO: 546301 - RNA, 64 nt, hsa; identical to SEQ ID NO: 266949

SEQ ID NO: 546302 - RNA, 64 nt, hsa; identical to SEQ ID NO: 266950

SEQ ID NO: 546303 - RNA, 64 nt, hsa; identical to SEQ ID NO: 266951

SEQ ID NO: 546304 - RNA, 64 nt, hsa; identical to SEQ ID NO: 266952

SEQ ID NO: 546305 - RNA, 64 nt, hsa; identical to SEQ ID NO: 266953

SEQ ID NO: 546306 - RNA, 64 nt, hsa; identical to SEQ ID NO: 266954

SEQ ID NO: 546307 - RNA, 64 nt, hsa; identical to SEQ ID NO: 266955

SEQ ID NO: 546308 - RNA, 64 nt, hsa; identical to SEQ ID NO: 266956

SEQ ID NO: 546309 - RNA, 64 nt, hsa; identical to SEQ ID NO: 266957

SEQ ID NO: 546310 - RNA, 64 nt, hsa; identical to SEQ ID NO: 266958

SEQ ID NO: 546311 - RNA, 63 nt, hsa; identical to SEQ ID NO: 266959

SEQ ID NO: 546312 - RNA, 64 nt, hsa; identical to SEQ ID NO: 266960

SEQ ID NO: 546313 - RNA, 64 nt, hsa; identical to SEQ ID NO: 266961

SEQ ID NO: 546314 - RNA, 64 nt, hsa; identical to SEQ ID NO: 266962

SEQ ID NO: 546315 - RNA, 64 nt, hsa; identical to SEQ ID NO: 266963

SEQ ID NO: 546316 - RNA, 64 nt, hsa; identical to SEQ ID NO: 266964

SEQ ID NO: 546317 - RNA, 64 nt, hsa; identical to SEQ ID NO: 266965

SEQ ID NO: 546318 - RNA, 64 nt, hsa; identical to SEQ ID NO: 266966

SEQ ID NO: 546319 - RNA, 64 nt, hsa; identical to SEQ ID NO: 266967

SEQ ID NO: 546320 - RNA, 64 nt, hsa; identical to SEQ ID NO: 266968

SEQ ID NO: 546321 - RNA, 64 nt, hsa; identical to SEQ ID NO: 266969

SEQ ID NO: 546322 - RNA, 64 nt, hsa; identical to SEQ ID NO: 266970

SEQ ID NO: 546323 - RNA, 64 nt, hsa; identical to SEQ ID NO: 266971

SEQ ID NO: 546324 - RNA, 64 nt, hsa; identical to SEQ ID NO: 266972

SEQ ID NO: 546325 - RNA, 64 nt, hsa; identical to SEQ ID NO: 266973

SEQ ID NO: 546326 - RNA, 64 nt, hsa; identical to SEQ ID NO: 266974

SEQ ID NO: 546327 - RNA, 64 nt, hsa; identical to SEQ ID NO: 266975

SEQ ID NO: 546328 - RNA, 64 nt, hsa; identical to SEQ ID NO: 266976

SEQ ID NO: 546329 - RNA, 64 nt, hsa; identical to SEQ ID NO: 266977

SEQ ID NO: 546330 - RNA, 64 nt, hsa; identical to SEQ ID NO: 266978

SEQ ID NO: 546331 - RNA, 64 nt, hsa; identical to SEQ ID NO: 266979

SEQ ID NO: 546332 - RNA, 64 nt, hsa; identical to SEQ ID NO: 266980

SEQ ID NO: 546333 - RNA, 64 nt, hsa; identical to SEQ ID NO: 266981

SEQ ID NO: 546334 - RNA, 64 nt, hsa; identical to SEQ ID NO: 266982

SEQ ID NO: 546335 - RNA, 64 nt, hsa; identical to SEQ ID NO: 266983

SEQ ID NO: 546336 - RNA, 64 nt, hsa
ucuucuucucccuuagggaggcucuugaaggagcaggagguacaguacuggguagcagucuggc

SEQ ID NO: 546337 - RNA, 64 nt, hsa
ggcauucaaguugugagcucagaauuacuuuaaaaggagguaacagccagccauuacaccuaaa

SEQ ID NO: 546338 - RNA, 64 nt, hsa
aagugugacauucaguguuagaggugggccuaguaggagguauuugggucaugggggcggaucc

SEQ ID NO: 546339 - RNA, 64 nt, hsa
auauguagcaaaaugguuuuuaaguacuuggaaaaggagguaaucgccaaauaguuccauuuuu

SEQ ID NO: 546340 - RNA, 64 nt, hsa
cggcccaggccccacgcuagaaggcuggcgagaccgaaggcagcaugugaggccucuccuggga

SEQ ID NO: 546341 - RNA, 64 nt, hsa
aguggccucagcugcgcccccgcucaggugagcccgaaggcaggagccgggaggcacuccuccc

SEQ ID NO: 546342 - RNA, 64 nt, hsa
cuucuguuugccggugggaaacucacagagcaggacgcucuaggccaaaucuauuuuuguaaaa

SEQ ID NO: 546343 - RNA, 64 nt, hsa
gaaggaaggcccccgugguagaaugagcuggagcacgcucuaagagagaugccugcuuccuaaa

SEQ ID NO: 546344 - RNA, 64 nt, hsa
ucucuuucccucuucucuaguguggauucuuuaaacgcucuagguacgaugacaguguuccccg

SEQ ID NO: 546345 - RNA, 64 nt, hsa
ugugggcuggggacgccugcccuucugucuccggacgcucuaggcgaguucagcuuggggugug

SEQ ID NO: 546346 - RNA, 64 nt, hsa
ucucuugcuccuuucuaucuguggucacacauacacgcucuauuaacuuugccuaauaagucuc

SEQ ID NO: 546347 - RNA, 64 nt, hsa
gccacucagcccauuggcagcugacaacgcagacacgcucuacggaggccugcugauaaagggc

SEQ ID NO: 546348 - RNA, 64 nt, hsa
guugagguaccagguaguguuaaguagguucaucacgcucuaaggccguuuuuuccuuagccag

SEQ ID NO: 546349 - RNA, 64 nt, hsa
ccucaugcugcccagcuucuacucagagcucuucacgcucuaccugcugcuucaugagcgggag

SEQ ID NO: 546350 - RNA, 64 nt, hsa
uccaaaugcaacuaagaaaauacucauagugaguacgcucuaugcauaguaugacuucuauuuu

SEQ ID NO: 546351 - RNA, 64 nt, hsa
aaggauggcugcaccuggcccccuggcauuccugacgcucuaggagggaagggggaggcagugc

SEQ ID NO: 546352 - RNA, 64 nt, hsa
gcccaccacgggcaggggccugcucccagcugccacgcucuaucauauggagcgagguguuggg

SEQ ID NO: 546353 - RNA, 64 nt, hsa
cagccugauggggcaguuccccuucuuacgguucacgcucuaaggcaggauguggcuuaugaga

SEQ ID NO: 546354 - RNA, 64 nt, hsa
uccaaauguuaccagaacgaugacaaaaggggagacgcucuauuuuuucacaguuaaaugacag

SEQ ID NO: 546355 - RNA, 64 nt, hsa
ucuuccauaguuuuguuuugguuuauuuuuaacaacgcucuagaaacaaagucaaauuaaucac

SEQ ID NO: 546356 - RNA, 64 nt, hsa
agaucuggucccucuccuugaacuaccccuccacacgcucuagucccuucaaccuaccggucua

SEQ ID NO: 546357 - RNA, 64 nt, hsa
uucuagguagcuuguuuguuauuauuuuuaaaggacgcucuaggaaaguaauugcuauucacua

SEQ ID NO: 546358 - RNA, 64 nt, hsa
ugcuugaggggccaaauuguguucugucccaugcacgcucuauuugguguuaaaauggaaccuu

SEQ ID NO: 546359 - RNA, 64 nt, hsa
acuguuucaugagcccaaacacccuccuggcacaacgcucuacccugcagcuuggagaacuccg

SEQ ID NO: 546360 - RNA, 64 nt, hsa
auuaugcuaagacauuuuaaaguaauuaugagaaacgcucuacuaaugauuuguuuuuauuugu

SEQ ID NO: 546361 - RNA, 64 nt, hsa
gcccugauccaggaaaaugugaggggaaucuggaacgcucuaggcagaagaagcugggagggag

SEQ ID NO: 546362 - RNA, 64 nt, hsa
uuagauaauccuuaaaucugacauccagccuguuacgcucuagggcucgcugcuuggccugcgu

SEQ ID NO: 546363 - RNA, 64 nt, hsa
uucuuuuuuuaguguugcccuugcuguguaauaaacgcucuaucuaguuuaccuagcaaaagcu

SEQ ID NO: 546364 - RNA, 64 nt, hsa
guuaagaaaauuacuugggugggcagacuuaggaacgcucuacucgguaaaagcguuauacaaa

SEQ ID NO: 546365 - RNA, 64 nt, hsa
gguaagaaaauuacuuggguggguagacuuaggaacgcucuacuucguaaaagcauuauacaaa

SEQ ID NO: 546366 - RNA, 64 nt, hsa
uuauuuguauuacuagauucauaccuugaugguaacgcucuaucugguuuuggguguuuuucau

SEQ ID NO: 546367 - RNA, 64 nt, hsa
auaccucaguuuuguguccuguuuuuaaugacuuacgcucuaaguaauccauuaguaguuaucu

SEQ ID NO: 546368 - RNA, 64 nt, hsa; identical to SEQ ID NO: 295046

SEQ ID NO: 546369 - RNA, 64 nt, hsa; identical to SEQ ID NO: 295047

SEQ ID NO: 546370 - RNA, 64 nt, hsa; identical to SEQ ID NO: 295048

SEQ ID NO: 546371 - RNA, 64 nt, hsa; identical to SEQ ID NO: 295049

SEQ ID NO: 546372 - RNA, 64 nt, hsa; identical to SEQ ID NO: 295050

SEQ ID NO: 546373 - RNA, 64 nt, hsa; identical to SEQ ID NO: 295051

SEQ ID NO: 546374 - RNA, 64 nt, hsa; identical to SEQ ID NO: 295052

SEQ ID NO: 546375 - RNA, 64 nt, hsa; identical to SEQ ID NO: 295053

SEQ ID NO: 546376 - RNA, 64 nt, hsa; identical to SEQ ID NO: 295054

SEQ ID NO: 546377 - RNA, 64 nt, hsa; identical to SEQ ID NO: 295055

SEQ ID NO: 546378 - RNA, 64 nt, hsa; identical to SEQ ID NO: 295056

SEQ ID NO: 546379 - RNA, 64 nt, hsa; identical to SEQ ID NO: 295057

SEQ ID NO: 546380 - RNA, 64 nt, hsa; identical to SEQ ID NO: 295058

SEQ ID NO: 546381 - RNA, 64 nt, hsa; identical to SEQ ID NO: 295059

SEQ ID NO: 546382 - RNA, 64 nt, hsa; identical to SEQ ID NO: 295060

SEQ ID NO: 546383 - RNA, 64 nt, hsa; identical to SEQ ID NO: 295061

SEQ ID NO: 546384 - RNA, 64 nt, hsa; identical to SEQ ID NO: 295062

SEQ ID NO: 546385 - RNA, 64 nt, hsa; identical to SEQ ID NO: 295063

SEQ ID NO: 546386 - RNA, 64 nt, hsa; identical to SEQ ID NO: 295064

SEQ ID NO: 546387 - RNA, 64 nt, hsa; identical to SEQ ID NO: 295065

SEQ ID NO: 546388 - RNA, 64 nt, hsa; identical to SEQ ID NO: 295066

SEQ ID NO: 546389 - RNA, 64 nt, hsa; identical to SEQ ID NO: 295067

SEQ ID NO: 546390 - RNA, 64 nt, hsa; identical to SEQ ID NO: 295068

SEQ ID NO: 546391 - RNA, 64 nt, hsa; identical to SEQ ID NO: 295069

SEQ ID NO: 546392 - RNA, 64 nt, hsa; identical to SEQ ID NO: 295070

SEQ ID NO: 546393 - RNA, 64 nt, hsa; identical to SEQ ID NO: 295071

SEQ ID NO: 546394 - RNA, 64 nt, hsa; identical to SEQ ID NO: 295072

SEQ ID NO: 546395 - RNA, 64 nt, hsa; identical to SEQ ID NO: 295073

SEQ ID NO: 546396 - RNA, 64 nt, hsa; identical to SEQ ID NO: 295074

SEQ ID NO: 546397 - RNA, 64 nt, hsa; identical to SEQ ID NO: 295075

SEQ ID NO: 546398 - RNA, 64 nt, hsa; identical to SEQ ID NO: 295076

SEQ ID NO: 546399 - RNA, 64 nt, hsa; identical to SEQ ID NO: 295077

SEQ ID NO: 546400 - RNA, 64 nt, hsa; identical to SEQ ID NO: 295078

SEQ ID NO: 546401 - RNA, 64 nt, hsa; identical to SEQ ID NO: 295079

SEQ ID NO: 546402 - RNA, 64 nt, hsa; identical to SEQ ID NO: 295080

SEQ ID NO: 546403 - RNA, 64 nt, hsa; identical to SEQ ID NO: 295081

SEQ ID NO: 546404 - RNA, 64 nt, hsa; identical to SEQ ID NO: 295082

SEQ ID NO: 546405 - RNA, 64 nt, hsa; identical to SEQ ID NO: 295083

SEQ ID NO: 546406 - RNA, 64 nt, hsa; identical to SEQ ID NO: 295084

SEQ ID NO: 546407 - RNA, 64 nt, hsa; identical to SEQ ID NO: 295085

SEQ ID NO: 546408 - RNA, 64 nt, hsa
uauccaaagaacauugggcuagaagauagauuucuauccuuagcuuuggcauuauugacuggau

SEQ ID NO: 546409 - RNA, 64 nt, hsa
cuuuagaauugccuaccuaaaagguaaacuauacuauccuuauaaauacugaucaaucccaguu

SEQ ID NO: 546410 - RNA, 64 nt, hsa
ucacucuccaucaucugugauaaguugacaaauuuauccuuacacaaauuuguccucauugagu

SEQ ID NO: 546411 - RNA, 64 nt, hsa
aauuauacaaaggaacauaaagaccacuguaggcuauccuuaucuguggcuuugggaucuuuuu

SEQ ID NO: 546412 - RNA, 64 nt, hsa
gccuaacuaccagauggagagcuucagaaugggcuauccuuagagucuaguacaucuugaggcc

SEQ ID NO: 546413 - RNA, 64 nt, hsa
uugagucuacuuguuaaugaaugacuagcccaauuauccuuauaaauugaauauggugaccaaa

SEQ ID NO: 546414 - RNA, 64 nt, hsa
gagacuacuggaauugucgagacuuuuggauuauuauccuuauccuuauccuaaucuuccuagc

SEQ ID NO: 546415 - RNA, 64 nt, hsa
acuggaauugucgagacuuuuggauuauuauccuuauccuuauccuaaucuuccuagcccuuca

SEQ ID NO: 546416 - RNA, 64 nt, hsa
gauugaauauuguuacauaguuaaaugugcuauauauccuuaauauuuuauauugauccugcaa

SEQ ID NO: 546417 - RNA, 64 nt, hsa
ccauuaagugguaguaauuuccuuuauuauucuguauccuuaaugguguucucucucucucucu

SEQ ID NO: 546418 - RNA, 64 nt, hsa
aacuucgggaggccgagacaggcagaucacgaggucaacagauugagaccauccuggcaaacau

SEQ ID NO: 546419 - RNA, 64 nt, hsa
aucacuugaagccaggaguuuaaaaccagaaugaucaacagagugagaccccugucuauauauu

SEQ ID NO: 546420 - RNA, 64 nt, hsa
gacaacugccaugucacaagaaaauaccugccagucaacagaguuugccuucugccagguggau

SEQ ID NO: 546421 - RNA, 64 nt, hsa
uauauugauauucucuuccuauugacuugcugccucaacagaucugcaaaggacaaccagccag

SEQ ID NO: 546422 - RNA, 64 nt, hsa
aaacaaagccuacauuaguucaauuuaagccuauucaacagaaauauagaaauauaguagcuaa

SEQ ID NO: 546423 - RNA, 64 nt, hsa
gauaaauauggcuuugaaauuaaagauauuccacucaacagacaauauuucauauuugauauua

SEQ ID NO: 546424 - RNA, 64 nt, hsa
uaugcacugccaauuagcuucuacuaaccacgguucaacagaaaauaaauguguauuugugaau

SEQ ID NO: 546425 - RNA, 64 nt, hsa
ccgcugagggcuggggggcggucuccgaggccccucaacagagaagccuccaccugaggauggg

SEQ ID NO: 546426 - RNA, 64 nt, hsa
cugcccauagacggggaugacucagcacuaccccucaacagagaugacuuugaugacucugccc

SEQ ID NO: 546427 - RNA, 64 nt, hsa
cugccccucagcaaggaugacucagcacugccgcucaacagacaugacucagggauggcuuagu

SEQ ID NO: 546428 - RNA, 64 nt, hsa; identical to SEQ ID NO: 546427

SEQ ID NO: 546429 - RNA, 64 nt, hsa
cugccccucaccaaggaugacucagcacugccgcucaacagacaugacucagggauggcuuagu

SEQ ID NO: 546430 - RNA, 64 nt, hsa
agcagacucagcagggaugacucagcacugccccucaacagacaugacucagcagggaugacuc

SEQ ID NO: 546431 - RNA, 64 nt, hsa; identical to SEQ ID NO: 175850

SEQ ID NO: 546432 - RNA, 64 nt, hsa; identical to SEQ ID NO: 175851

SEQ ID NO: 546433 - RNA, 64 nt, hsa; identical to SEQ ID NO: 175852

SEQ ID NO: 546434 - RNA, 64 nt, hsa; identical to SEQ ID NO: 175853

SEQ ID NO: 546435 - RNA, 64 nt, hsa; identical to SEQ ID NO: 175854

SEQ ID NO: 546436 - RNA, 64 nt, hsa; identical to SEQ ID NO: 175855

SEQ ID NO: 546437 - RNA, 64 nt, hsa; identical to SEQ ID NO: 175856

SEQ ID NO: 546438 - RNA, 64 nt, hsa; identical to SEQ ID NO: 175857

SEQ ID NO: 546439 - RNA, 64 nt, hsa; identical to SEQ ID NO: 175858

SEQ ID NO: 546440 - RNA, 64 nt, hsa; identical to SEQ ID NO: 175859

SEQ ID NO: 546441 - RNA, 64 nt, hsa; identical to SEQ ID NO: 175860

SEQ ID NO: 546442 - RNA, 64 nt, hsa; identical to SEQ ID NO: 175861

SEQ ID NO: 546443 - RNA, 64 nt, hsa; identical to SEQ ID NO: 175862

SEQ ID NO: 546444 - RNA, 64 nt, hsa; identical to SEQ ID NO: 175863

SEQ ID NO: 546445 - RNA, 64 nt, hsa
cgcuugaaggcagaacgcuguuaccucacuggauagaagaaagcuuuccaagccccaggagcug

SEQ ID NO: 546446 - RNA, 64 nt, hsa
ggagccuuaaucagaaaaggacuagauuuguuuaagaagaaaaaugaaaccagacccagaucaa

SEQ ID NO: 546447 - RNA, 64 nt, hsa
gacaaacauuguauaaaaacuaagagugucuuuaagaagaaaacuauagcaggguacaaugcuu

SEQ ID NO: 546448 - RNA, 64 nt, hsa
gcugggaggacaggcauaugccaccacaucacugagaagaaauuuuugauugucugacagauac

SEQ ID NO: 546449 - RNA, 64 nt, hsa
cagagaaguggacuccaaaccucauuuuaguuguagaagaaaauuucuuacaaaacaaauucca

SEQ ID NO: 546450 - RNA, 64 nt, hsa
ucucuggagaauuucucccacuccccaccucugcagaagaaaauuuugcucuuauaaaaccuca

SEQ ID NO: 546451 - RNA, 64 nt, hsa
auaccccaugaaauguaaauacuguaucauaaguagaagaaaauaauuuuuguuuucuaaaaau

SEQ ID NO: 546452 - RNA, 64 nt, hsa
ucaacugaggaaaaaaaauaauuaaacaggccuaagaagaaaucaaaaaccauaagacaccuau

SEQ ID NO: 546453 - RNA, 64 nt, hsa
ucuuugaaugauuugcugucacagacuauuugguagaagaaauauuuuucaccugagagaggaa

SEQ ID NO: 546454 - RNA, 64 nt, hsa
gaucuaauuguaaaaaguaaagcauacaaauacuagaagaaaauggaggaaaacgacauuauau

SEQ ID NO: 546455 - RNA, 64 nt, hsa
ggaggaaaacgacauuauaugugacuuaaaaccuagaagaaauaaauaaaacuauugaucaauu

SEQ ID NO: 546456 - RNA, 64 nt, hsa
caucuuuugauauucuuauaaauggaacuuacacagaagaaauagggauaugauaaccacuaaa

SEQ ID NO: 546457 - RNA, 64 nt, hsa
agagaacaguuaaucccuaaggucuugacaaaacagaagaaaaacaagccuccucguccuaguc

SEQ ID NO: 546458 - RNA, 64 nt, hsa
aggacuucaacgccagugacuguguaccuccagcagaagaaaaucaggugucuggucuuggggg

SEQ ID NO: 546459 - RNA, 64 nt, hsa
ucuggucuugggggcacugugcucacuucuagagagaagaaaaaggcuggguuuggacuucaug

SEQ ID NO: 546460 - RNA, 64 nt, hsa
uuacaaaucuugcauggacuccugccacagugaaagaagaaaaucuucaugucuucaaaaauua

SEQ ID NO: 546461 - RNA, 64 nt, hsa
uuaggggcagaaggcuuguuucaagagguuugacagaagaaaggaauauaugaacuuaaugaga

SEQ ID NO: 546462 - RNA, 64 nt, hsa
uuguuccuucacugccacagaaucagaaagagcuagaagaaaaggcucaccuggccacuguuua

SEQ ID NO: 546463 - RNA, 64 nt, hsa
gagaaaauauuaauuuucaaggggaaaaaaccugagaagaaagggagaaaagaccaugaaauuu

SEQ ID NO: 546464 - RNA, 64 nt, hsa
guaauguauuauaccuaaauguuuauuaaaaguuagaagaaaugaguaccaacaggaaggaaug

SEQ ID NO: 546465 - RNA, 64 nt, hsa
guugguguucuugauaagggaagugagacaaaggagaagaaauuacucccugcaacaggaggaa

SEQ ID NO: 546466 - RNA, 64 nt, hsa
gccuuuguuuuuacuagugucugcuguugcaaaaagaagaaaacauucuuugccugaguuuuaa

SEQ ID NO: 546467 - RNA, 64 nt, hsa
gggaaggggaagaaaagaaggggaagaagaucaaagaagaaaagaagaaggggaagaaaagaag

SEQ ID NO: 546468 - RNA, 64 nt, hsa
agagcaugcagugauggaagaagcaggaaaagcaagaagaaaagacagcagcaucaagaggagg

SEQ ID NO: 546469 - RNA, 64 nt, hsa
gaacaugcugagcagaacaucagaaaaagcaagaagaagaaaaggcgacaucaagaaggaaagg

SEQ ID NO: 546470 - RNA, 64 nt, hsa
aauuaggauaugacauauaugaaagguuuaucuaagaagaaagaaacagagauaauauauauau

SEQ ID NO: 546471 - RNA, 64 nt, hsa
gacucaagccucuagacucuuggaugaaacagugagaagaaaacauuuucugacuuacccuuuu

SEQ ID NO: 546472 - RNA, 64 nt, hsa
caagggucacaugccaauaaacaauaaauuuuccagaagaaaugaaauccaacuagacaaauaa

SEQ ID NO: 546473 - RNA, 64 nt, hsa
aguaacugcuacuguauuuagugggguggaauucagaagaaauuugaagaccagaucaugggug

SEQ ID NO: 546474 - RNA, 64 nt, hsa
gaacugccaagaaaaggcauggagacagcgaacuagaagaaagggcaagaaggaaauagccacc

SEQ ID NO: 546475 - RNA, 64 nt, hsa
cgguccccccucacuccacacuggcacguuugugagaagaaaugacauuuugcuaggaagugac

SEQ ID NO: 546476 - RNA, 64 nt, hsa
uacugcaaaaaguacauagugaauuuuaaaauguagaagaaagcaaaaaauaaaauaaguccua

SEQ ID NO: 546477 - RNA, 64 nt, hsa
aaucugggaaggcaacaccuguggauaaaacauuagaagaaaacauauauuuuauuuucauacu

SEQ ID NO: 546478 - RNA, 64 nt, hsa
aauaucucauuaaaaagcccauaaauaauaggggagaagaaagccuuagguaucaauuccaaaa

SEQ ID NO: 546479 - RNA, 64 nt, hsa
ggaaacuguaacugcuaugucuuuaggaaaauguagaagaaagaacauuauuguucuuuaauuc

SEQ ID NO: 546480 - RNA, 64 nt, hsa
agcaaagugugguauccacagacauuuuaguugcagaagaaaggcuaggaaaucauuccuuuug

SEQ ID NO: 546481 - RNA, 64 nt, hsa
ugagauguuucuuacucacucugcacagaaacaaagaagaaauguuauacagggaaguccguuu

SEQ ID NO: 546482 - RNA, 64 nt, hsa
aaagccaggaaagucaaaaaaacgaaagagaaggagaagaaaaaggaaaagggcaaauugaaag

SEQ ID NO: 546483 - RNA, 64 nt, hsa
aagaagggcuucggcgccaugcugagauuuggaaagaagaaagaggauaaggguggaaaggcug

SEQ ID NO: 546484 - RNA, 64 nt, hsa
aucgauugccaaagagcaucuaccuuaccuccuaagaagaaaagccacuuucuuccaauccaag

SEQ ID NO: 546485 - RNA, 64 nt, hsa
uucacuuuuucuuuuuuacggaauucaucaucagagaagaaaauaacaaaaauggaagcaaaca

SEQ ID NO: 546486 - RNA, 64 nt, hsa
aacucagcccuguugcaaugcuuagggcccuuaaagaagaaaaucuccccagaaggcauccauc

SEQ ID NO: 546487 - RNA, 64 nt, hsa
cuauuuuuucuauaaguuuuauugcaagagguaaagaagaaaacuauauauauauaucuuauuu

SEQ ID NO: 546488 - RNA, 64 nt, hsa
auuuuugaccaguuccuuuuagagauucuuucagagaagaaaccagaucugaccuguuuauugu

SEQ ID NO: 546489 - RNA, 64 nt, hsa
uagaggaagaugaggggggaugcgaguaccuccaagaagaaaaaucacacucugaauggugcuu

SEQ ID NO: 546490 - RNA, 64 nt, hsa
cuaaagugacacaaagagaaugaagcagaaguagagaagaaagacuguaugugacaauuaccug

SEQ ID NO: 546491 - RNA, 64 nt, hsa
acgggcacagcgaaauccuggugaagagcaaagcagaagaaaugacagcagaagccauggcaca

SEQ ID NO: 546492 - RNA, 64 nt, hsa
uuauuucccaauuacaggaaauuagaucgacuggagaagaaaaaaaagaaaaaagauagaaaaa

SEQ ID NO: 546493 - RNA, 64 nt, hsa
aauauguaagcuaaacauauaacuauauguuuuaagaagaaaacaucuacgaaagguaaaaaga

SEQ ID NO: 546494 - RNA, 64 nt, hsa
agguucuaucucuguagaaugucuccaagauugaagaagaaacugagcaguugaaaaaugcuaa

SEQ ID NO: 546495 - RNA, 64 nt, hsa
aaaaauuauuuucucaauuuuacugaguaggcacagaagaaaaguacagauaggcugaugguua

SEQ ID NO: 546496 - RNA, 64 nt, hsa
aagcuuuugggcacuguguaccaggaugaggaagagaagaaaugaggagccugucuuuuaauau

SEQ ID NO: 546497 - RNA, 64 nt, hsa
uagugcuuuguuuccgugcacuuaaaaauaauugagaagaaaaacucaauuaaaauuuuguuua

SEQ ID NO: 546498 - RNA, 64 nt, hsa
uaaaaccaugacgcaaagagagauuuuuuuuuaaagaagaaaaaaaaaaauucacacugccagc

SEQ ID NO: 546499 - RNA, 64 nt, hsa
gccuguaccacuguuguaacaugggaagacgugaagaagaaauaaucugagcuuuaauuauuua

SEQ ID NO: 546500 - RNA, 64 nt, hsa
acgaaugggcucuggacauaugccuguugauuugagaagaaaucuggcugguuugaggguuucc

SEQ ID NO: 546501 - RNA, 64 nt, hsa
gaucacaaaauuuguccaggauagacauagagcuagaagaaacagacuucguaaagaucaacuu

SEQ ID NO: 546502 - RNA, 64 nt, hsa
aaggcgauucagacucugacacagacaguagucaagaagaaaaugaagugacagaacauacccc

SEQ ID NO: 546503 - RNA, 64 nt, hsa
cagccacaagacauccacauauugcauguuaaccagaagaaaagacaacauuuuccggaaaucc

SEQ ID NO: 546504 - RNA, 64 nt, hsa
ucacagucacauucaaaauagugacucuaaacaaagaagaaagcagcacugucaucagaugcau

SEQ ID NO: 546505 - RNA, 64 nt, hsa
gcgaugacauuucuaagcuacagcguacuccaggagaagaaaagauuaauaccuuaaaagaaga

SEQ ID NO: 546506 - RNA, 64 nt, hsa
guacuccaggagaagaaaagauuaauaccuuaaaagaagaaaacacucaagaagcagcaguccu

SEQ ID NO: 546507 - RNA, 64 nt, hsa
aaaucuuaaaaguguuguuaucaugacuggugagagaagaaaacauuuuguuuuuauuaaaugg

SEQ ID NO: 546508 - RNA, 64 nt, hsa
aaaguaaacaaaacccacauuuccuauccugguuagaagaaaauuaauguucugacaguuguga

SEQ ID NO: 546509 - RNA, 64 nt, hsa
uaagcaccauggccuugaugauucacuguuggggagaagaaacaagaaaaguaacugguuguca

SEQ ID NO: 546510 - RNA, 64 nt, hsa
aaaaacaagucaucuuaaguucacaauugcuacaagaagaaaguuguggauaacuaggaaauua

SEQ ID NO: 546511 - RNA, 54 nt, hsa
cuggucuucuggagaaaugaauucagaagaaaacucaucaggugcuucuuuuua

SEQ ID NO: 546512 - RNA, 64 nt, hsa
uaaguuucacagacaucauagauccuuuucuuaaagaagaaaaacauguauaaaauaguuuuag

SEQ ID NO: 546513 - RNA, 64 nt, hsa
aaugagaggaggcagagagagggaggcagauggaagaagaaaaacaguuaaauaagacauaccc

SEQ ID NO: 546514 - RNA, 64 nt, hsa
guuggucaaaaucugcaaacucuaaaagaagaaaagaagaaaaaaccaagcuuaggguauuuuu

SEQ ID NO: 546515 - RNA, 64 nt, hsa
ccaugucuguuggucaaaaucugcaaacucuaaaagaagaaaagaagaaaaaaccaagcuuagg

SEQ ID NO: 546516 - RNA, 64 nt, hsa
auguggcuuacugugucugaagauacugacaugcagaagaaauaagugcauucuucugcuuuuc

SEQ ID NO: 546517 - RNA, 64 nt, hsa
ucuccuuugcuauaccucaauuuuuggaauuuagagaagaaaucaguaguuuugcaauguuaau

SEQ ID NO: 546518 - RNA, 64 nt, hsa
cucuaacccuuagugagggcaaaguguaguugguagaagaaauugcuaaauaccuaucuaaugu

SEQ ID NO: 546519 - RNA, 64 nt, hsa
cuugagucuugaucaaacaagugucuuuuacuuaagaagaaacuugguaaucauuguggcaccc

SEQ ID NO: 546520 - RNA, 64 nt, hsa
acuucuguuuuaaacuuuggguaccaaaccaaaaagaagaaaaaagaaaggaaaagaucuucuu

SEQ ID NO: 546521 - RNA, 64 nt, hsa
acgauccaucucccuuugugagucaaauguuaagagaagaaacuuguauuugcagcuagagguu

SEQ ID NO: 546522 - RNA, 64 nt, hsa
cuugccugaauuuacuccuuucacagcaaguguuagaagaaagauaacauuuucaaauacuuag

SEQ ID NO: 546523 - RNA, 64 nt, hsa
auucugguuuggagucccuccaccaagauucaguagaagaaauacagacuguagaaaugagagg

SEQ ID NO: 546524 - RNA, 64 nt, hsa
uggaagaguuguaauauauacuuuaagaaagaagagaagaaaacuaguaucucuaagcgguaac

SEQ ID NO: 546525 - RNA, 64 nt, hsa
cauguaaacaaagauaucuuugcuuuaagaugugagaagaaaugaauuuacuuuguuugcauua

SEQ ID NO: 546526 - RNA, 64 nt, hsa
uugauauggaccuguuggucuaugucaucuuuucagaagaaaagcauuuaauugccaaugggag

SEQ ID NO: 546527 - RNA, 64 nt, hsa
cucuuuaaaaauaacuuagauucaaauuuauaguagaagaaaaaaaaucuuucagauaagaggu

SEQ ID NO: 546528 - RNA, 64 nt, hsa
acucauuuuucaugauaaugaacagaacauagacagaagaaacaagguuuucaguccccacaga

SEQ ID NO: 546529 - RNA, 64 nt, hsa
cucucugaguggacuggccucaaagcaagcauucagaagaaaaagaagcaaccucaguaauuua

SEQ ID NO: 546530 - RNA, 64 nt, hsa
uugauauggaccuguugguccauaucaucuuuucagaagaaaagcauuuaauugccaaugggag

SEQ ID NO: 546531 - RNA, 64 nt, hsa; identical to SEQ ID NO: 546527

SEQ ID NO: 546532 - RNA, 64 nt, hsa
augaaucauacacuauuuucacacuuuuaaucucagaagaaacauaugugacaugguauuuuag

SEQ ID NO: 546533 - RNA, 64 nt, hsa
ggauaucaccuggcaaguuucugccuaacuaaagagaagaaaaguuuuuaucguauucauacua

SEQ ID NO: 546534 - RNA, 64 nt, hsa
ccuguuucuggaauuccuuguuagggaacuuuaaagaagaaaagaaaaacuugaauuguguuga

SEQ ID NO: 546535 - RNA, 64 nt, hsa
gacagaacucaagaaagccacuggggaaaacucgagaagaaagggaguauacuaguagguuaga

SEQ ID NO: 546536 - RNA, 64 nt, hsa
ugauaagcaaggaggguguaaguuuaggggacaaagaagaaagaaugaauaauacgagcagaca

SEQ ID NO: 546537 - RNA, 64 nt, hsa
uuaaugaaaaaaaaaaacaaaaaaaacggauccaagaagaaaagagaauuuauuuccuucucca

SEQ ID NO: 546538 - RNA, 64 nt, hsa
ccacucucuccaugcccuggagaaaaaaaaguccagaagaaaucauaaauaucucucaucuaca

SEQ ID NO: 546539 - RNA, 64 nt, hsa
uauggagugccauccugcuaggugaguacagaccagaagaaaauuuaguugggaaaauacuugu

SEQ ID NO: 546540 - RNA, 64 nt, hsa
cccuauuaccuuuguagcagccacaucagaaagcagaagaaaacaguauuucugaaggcauugu

SEQ ID NO: 546541 - RNA, 64 nt, hsa
uaugugugcaggauuacccaagaauaacuuaaguagaagaaacaagaaagggaaucuuguauau

SEQ ID NO: 546542 - RNA, 64 nt, hsa
acuuuugcauccauuguauuaucagaaaaugugaagaagaaaaaaaugccauguuuuaaaacca

SEQ ID NO: 546543 - RNA, 64 nt, hsa
cuauaagauguaacaacgaaaugaugacaucuggagaagaaacaucuuuuccuuauaaaaaugu

SEQ ID NO: 546544 - RNA, 64 nt, hsa
guaacuuacuuccaaaaacaaaaucauacuuauuagaagaaaauucugauuuuauagaaaaaaa

SEQ ID NO: 546545 - RNA, 64 nt, hsa
uacuguguuguaccuuuauuucuguauuucuaaaagaagaaaguucuuuccuagcaggguuuga

SEQ ID NO: 546546 - RNA, 64 nt, hsa
uccauccccaaggcaaacaaggaaaggaaaggaaagaagaaaaggugccuuaguccuuuguugc

SEQ ID NO: 546547 - RNA, 64 nt, hsa
ucacugaggauguuggggaagggacgaaggguaaagaagaaacugcacguauacacagguucac

SEQ ID NO: 546548 - RNA, 64 nt, hsa
aaaaucuuugaaaugaaagcuacaaauacaugugagaagaaaaaaauggauuuuuuuagcaaau

SEQ ID NO: 546549 - RNA, 64 nt, hsa
augcugaaucacaggaaugguguugaggcuaccaagaagaaauccaugcagccacuuuggguuu

SEQ ID NO: 546550 - RNA, 63 nt, hsa
accccuucggccagucuuaaacgggugucagcaagaagaaaaauuaacaaaagacagaaggcc

SEQ ID NO: 546551 - RNA, 64 nt, hsa
gacaacucuuuacaagcuaagaagagagggccucagaagaaaccaacccugccaacaccuugau

SEQ ID NO: 546552 - RNA, 64 nt, hsa
auuauaucaaauaaguaucacaaaucuuuuacgcagaagaaauaaaaacuacggguagaaaaca

SEQ ID NO: 546553 - RNA, 64 nt, hsa
auucgagcccuggcugugaaaagaaucucaacauagaagaaagaagaaacaauaaauauucugc

SEQ ID NO: 546554 - RNA, 64 nt, hsa
cccuggcugugaaaagaaucucaacauagaagaaagaagaaacaauaaauauucugcagauuaa

SEQ ID NO: 546555 - RNA, 64 nt, hsa
ucuuguuuuauaaucucuuuguuuaauaauaaguagaagaaauaauuuaaaugaacugcuuagc

SEQ ID NO: 546556 - RNA, 64 nt, hsa
aagagucggagggguagacccugcagcccuguugagaagaaagauuccagugaaguugcugaug

SEQ ID NO: 546557 - RNA, 64 nt, hsa
gacccuaugaaaaaauuaguugagaaagaagagaagaagaaaaucaaccagcaggaaaguacag

SEQ ID NO: 546558 - RNA, 64 nt, hsa
gugcuccagccugggcgacagaagucuugucucaagaagaaaacgaacugggaaaauuucuucg

SEQ ID NO: 546559 - RNA, 64 nt, hsa
aacuggaccauccugucuuauggugaaaaaguaaagaagaaagauaacauuaguguauuucucc

SEQ ID NO: 546560 - RNA, 64 nt, hsa
uugaacaacugcagagagaaaggcggcgggucuuagaagaaaaucauguggagcaccagccucg

SEQ ID NO: 546561 - RNA, 64 nt, hsa
auuucaaauaaaccucauguacuuguguuuauaaagaagaaaccacucugguggcuguuugugc

SEQ ID NO: 546562 - RNA, 64 nt, hsa
cccacccacauaccagucaagcucuuaggggagcagaagaaaagcaggaagaauuuaaauguuu

SEQ ID NO: 546563 - RNA, 64 nt, hsa
augcccuaacucucuuauuaaggagaaauagaaaagaagaaauuuauaaugaaaagaagaugaa

SEQ ID NO: 546564 - RNA, 64 nt, hsa
caugccuauuaaggauguaagacauuacagccuuagaagaaagauugugaaaagcuggggagaa

SEQ ID NO: 546565 - RNA, 64 nt, hsa
agagacaaagaucacuacagaccaaaacagaagaagaagaaaaaaaagaaaaagaaaucuaagc

SEQ ID NO: 546566 - RNA, 64 nt, hsa
uggagaaaaaaauagcucaagacacaguuaaucgagaagaaaagaaauauguacagaaccauaa

SEQ ID NO: 546567 - RNA, 64 nt, hsa
ggauucagugcuuaccgaugaugcaguacuugauagaagaaaacagucugggaggauagcgcuc

SEQ ID NO: 546568 - RNA, 64 nt, hsa
aaucaaucagcauauacauuucagccaaagccauagaagaaaaagcaauaguugcuugaauuau

SEQ ID NO: 546569 - RNA, 64 nt, hsa
cuuugggauaauuuauuuccuguggcaucuagccagaagaaauugaggauguuuccuuucacag

SEQ ID NO: 546570 - RNA, 64 nt, hsa
caccacgcauuggcauccaaggccacggacuaugagaagaaaccaaacguguuuaaacuuaaaa

SEQ ID NO: 546571 - RNA, 64 nt, hsa
cauuagacugaauuuaacuacuaagaauaaauaaagaagaaaauaaccuuaaucucuuguauuu

SEQ ID NO: 546572 - RNA, 64 nt, hsa
guaauauacaguuuuuguaaccauaugauugaaaagaagaaagucuaugcuuaggccagucagu

SEQ ID NO: 546573 - RNA, 64 nt, hsa
ggggacccacaaacaagagugcucuuguauguccagaagaaagagaaagaccaucaaucagggg

SEQ ID NO: 546574 - RNA, 64 nt, hsa
uaagaaauaauaccaggcuuuuauaaacuuuucuagaagaaaaaagauggaacuuuuccaauuc

SEQ ID NO: 546575 - RNA, 64 nt, hsa
guuaaacaccugcucauggucacauagcccaggcagaagaaaaucucggacuuggaauagaucc

SEQ ID NO: 546576 - RNA, 64 nt, hsa
ccugagcaacaagagcgaaacugucucaaaaaaaagaagaaaauaaauaaauaaaaaucagagc

SEQ ID NO: 546577 - RNA, 64 nt, hsa
ugcacgccgggauuccucugcugccauuugaauuagaagaaaauaauuuauaugcaugcacagg

SEQ ID NO: 546578 - RNA, 64 nt, hsa
ccagcucauguguaccucauaucccauccuuaagagaagaaauguuauaaaguagaacuaaaua

SEQ ID NO: 546579 - RNA, 64 nt, hsa
cccuucaaccuuuuuucucugucugcuucaccugagaagaaaguguacgaagagaguguccucc

SEQ ID NO: 546580 - RNA, 64 nt, hsa
ucucagcucugggggucauuuaccaguuuguuguagaagaaauaaucagguaaguuaaaaguuc

SEQ ID NO: 546581 - RNA, 64 nt, hsa
ggguugucucaaauccuguccacaaggcaacuccagaagaaagaagcccuuuacauuuccauaa

SEQ ID NO: 546582 - RNA, 64 nt, hsa
acagcccugauuuggaccagaaucucagaugcucagaagaaagauccuguuuagugaugaccca

SEQ ID NO: 546583 - RNA, 64 nt, hsa
uguaucuuuuaaacucaguucugcauccaacuugagaagaaaaaaagcuucuuuccauaucaag

SEQ ID NO: 546584 - RNA, 64 nt, hsa
gugcuuaagaauuuaagcucuguuuuaaagccgaagaagaaaacauuugaauuuaccuucauau

SEQ ID NO: 546585 - RNA, 64 nt, hsa
caaaaauaaaauaaaaaaagaaagaaagaaaagaagaagaaaagagaagaaggagaaggagaug

SEQ ID NO: 546586 - RNA, 64 nt, hsa
uaagagacuuuuugacucuauauccuugcaguuaagaagaaagcacuuuuuuguaauguuuguu

SEQ ID NO: 546587 - RNA, 64 nt, hsa
ccaugaggggaacaagaaacuacuucuaacgggaagaagaaacacuacggucgauuaaaaaaau

SEQ ID NO: 546588 - RNA, 64 nt, hsa
uagcuagucaauaugaggauggugguuuauucucagaagaaaaagauauguaaggucuuuuagc

SEQ ID NO: 546589 - RNA, 64 nt, hsa
cagaacacugacaaacaaggaaagcggcagagaaagaagaaagaccuagaagguuguagauggg

SEQ ID NO: 546590 - RNA, 64 nt, hsa
gggagcuguuuugucagugucuuggggucacaggagaagaaagcgggacuuuggugggaaggag

SEQ ID NO: 546591 - RNA, 64 nt, hsa
gacagcaaccaaucagauauauacaaaugaaauuagaagaaacacagccucaugggacagaaau

SEQ ID NO: 546592 - RNA, 64 nt, hsa
uuauuucccaccuuugugugaguguguaugaaagagaagaaaaugcaauuuuuagguaaucuuu

SEQ ID NO: 546593 - RNA, 64 nt, hsa
gaggauccugaacggaaaaggaagaagaaagagaagaagaaaaagaagguagaguagaggccua

SEQ ID NO: 546594 - RNA, 64 nt, hsa
aagaaaaaagaagaggauccugaacggaaaaggaagaagaaagagaagaagaaaaagaagguag

SEQ ID NO: 546595 - RNA, 64 nt, hsa
ccuacagaaacaccaucugauucagaucacaagaagaagaaaaagaaaaaagaagaggauccug

SEQ ID NO: 546596 - RNA, 64 nt, hsa
ccguauggagcucuggacuccuaaauuccccugaagaagaaaccaauguacuguggucucuugg

SEQ ID NO: 546597 - RNA, 64 nt, hsa
gcagguaaaaaaucauucacccaauuugaagcauagaagaaaauaguugcugagguuuuuuaau

SEQ ID NO: 546598 - RNA, 64 nt, hsa
ugcaaggcuucaggaaacagaguugugaggagaaagaagaaaauggcugcccauuucaguaccc

SEQ ID NO: 546599 - RNA, 64 nt, hsa
ucagacugagguaauaagaccagaauuaagugauagaagaaacuguuguuugguuaaaggacac

SEQ ID NO: 546600 - RNA, 64 nt, hsa
cugggaaaaaaaaacuagugugaaguuuacaguuagaagaaacagacccaaaguugccagaagg

SEQ ID NO: 546601 - RNA, 64 nt, hsa
uguuagacuuaggaugauaccuucagccacuugaagaagaaauagaaggcgcucauuccaauau

SEQ ID NO: 546602 - RNA, 64 nt, hsa
caucucaagcuagccaggcagucuccucucuaucagaagaaagcacugguaauuggcuagacug

SEQ ID NO: 546603 - RNA, 64 nt, hsa
auaauucuucaaaugaagucuucccccaaggagcagaagaaagaauguguuaccaaugugagag

SEQ ID NO: 546604 - RNA, 64 nt, hsa
agacuuuugguggugaggaggaagaacaaauaauagaagaaaauaaaaaugagauagaagaaaa

SEQ ID NO: 546605 - RNA, 64 nt, hsa
aagaacaaauaauagaagaaaauaaaaaugagauagaagaaaaguaagaaccaagauucauaug

SEQ ID NO: 546606 - RNA, 64 nt, hsa
ucaaagagcuaaacuuauucagaaaggaaugacuagaagaaaaaggagacaauaccauguuguu

SEQ ID NO: 546607 - RNA, 64 nt, hsa
guucauugauuuuaaacauuuuauuccuacuuucagaagaaaaauauaauacggaaaaaauuau

SEQ ID NO: 546608 - RNA, 64 nt, hsa
gggagaaaaggaaaagaaaaaaaaaagaagaagaagaagaaaagagaagaagaaaaaaacgaaa

SEQ ID NO: 546609 - RNA, 64 nt, hsa
aagaaaaaaaaaagaagaagaagaagaaaagagaagaagaaaaaaacgaaaacagucaaccaac

SEQ ID NO: 546610 - RNA, 64 nt, hsa
auaccugcuucccaauuacucauuuccucagauaagaagaaaucaucucuacaauguagacaac

SEQ ID NO: 546611 - RNA, 64 nt, hsa
uuaauuuuuuuuuuccucauuguuggggaugaugagaagaaaugauuugggaaaauuaaguaac

SEQ ID NO: 546612 - RNA, 64 nt, hsa
augaugaugaugaugaugaugguuuuuucuaaucagaagaaagcugggguaugcccucuacuua

SEQ ID NO: 546613 - RNA, 64 nt, hsa
uucagguuuugcccacgcugcucccaagaacggaagaagaaauagauaagggccuuggauucca

SEQ ID NO: 546614 - RNA, 64 nt, hsa
ucucccucuucccuagaaggccggacucaaaaggagaagaaagcugcucgugcucguuccaaag

SEQ ID NO: 546615 - RNA, 64 nt, hsa
uauccuaggugaggguagcaguccacaauggaauagaagaaaaucccauuauaacaaaugacaa

SEQ ID NO: 546616 - RNA, 64 nt, hsa
gacccaauggucugugaucauugaaaaagaggaaagaagaaaaaauguaugggugagaggaagg

SEQ ID NO: 546617 - RNA, 64 nt, hsa
ugccuggccccuaaucugcugaagaaagaagaauagaagaaaaucaaccugaguaaaagcagca

SEQ ID NO: 546618 - RNA, 64 nt, hsa
uugaagaaauugcugaaaggaaguaaaaccccauagaagaaacaugggaauacagaauauauuc

SEQ ID NO: 546619 - RNA, 64 nt, hsa
gaaaguguaaugugcgauggcuauguagacauaaagaagaaacuuguaaauaucuuuuuucuuu

SEQ ID NO: 546620 - RNA, 64 nt, hsa
aauuuucuggccuuucauggcaaugaaaauuuuaagaagaaagauuuaaaguauuuuaauuuua

SEQ ID NO: 546621 - RNA, 64 nt, hsa
uccgacuuuauagcaggaacuuucugguaguaugagaagaaaucauugggugacuaugacuaau

SEQ ID NO: 546622 - RNA, 64 nt, hsa
gcauuggcaggaaaaagcucuagaggcuauacagagaagaaaaaaagagcaaaaaugagaccug

SEQ ID NO: 546623 - RNA, 64 nt, hsa
agcaguaagguuucaagguacaguuauggaggaaagaagaaaaugacacauugauaacacaggu

SEQ ID NO: 546624 - RNA, 64 nt, hsa
aaacugccuacaggccauaguuaaccugcaauagagaagaaagggaaguagggcagugcaugac

SEQ ID NO: 546625 - RNA, 64 nt, hsa
ugacagaacaagacugucucaaaaaaaaaaaaagagaagaaaaacugccuacaggccauaguua

SEQ ID NO: 546626 - RNA, 64 nt, hsa
uuuucuuuucuuuuguugauuuucuuguucccguagaagaaagaagaaagguguuuggagaauu

SEQ ID NO: 546627 - RNA, 64 nt, hsa
uucuuuuguugauuuucuuguucccguagaagaaagaagaaagguguuuggagaauucgagugc

SEQ ID NO: 546628 - RNA, 64 nt, hsa
uaaaaagccaacauuugaauugguugcagcauagagaagaaacacugguccuucuuucaaaauu

SEQ ID NO: 546629 - RNA, 64 nt, hsa
uggaauauucaugaaacuucauugcagggguaauagaagaaaaaguaaauugggaggacuuaau

SEQ ID NO: 546630 - RNA, 64 nt, hsa
ucagguuuguugaacaaugccuuuucagguuggaagaagaaaaauagccucaaucucccacccc

SEQ ID NO: 546631 - RNA, 64 nt, hsa
ccaauaaggauaacauuaucuacccagagaguuuagaagaaaaguaggaguccaaaggaagagu

SEQ ID NO: 546632 - RNA, 64 nt, hsa
ccuucaggaacccuuuaguuuauuaaucuuauacagaagaaacuaacuuagaaacaaaggauuc

SEQ ID NO: 546633 - RNA, 64 nt, hsa
uuugggggggugggggaggguguuguuggggcugagaagaaagagauuuauaugcuguauauaa

SEQ ID NO: 546634 - RNA, 64 nt, hsa
aucuacucuguauaacgcaugagaggggaggcaaagaagaaaaagacacacagaagggccuuua

SEQ ID NO: 546635 - RNA, 64 nt, hsa
ucuacuguuguguugccauugcuuuuccauugggagaagaaagaauuaaccagucauuaaacca

SEQ ID NO: 546636 - RNA, 64 nt, hsa
uucauuccaguguugagaugcuuugcaucucugcagaagaaauuuauuuuaaauuguuuaaaua

SEQ ID NO: 546637 - RNA, 64 nt, hsa
aagaaaacacacacccacccacacacacacacacagaagaaaaugaaagcugacacaccucgaa

SEQ ID NO: 546638 - RNA, 64 nt, hsa
uuggcagagaugaguggccauaucuggggguaaaagaagaaauccuguccucuuggugggaggu

SEQ ID NO: 546639 - RNA, 64 nt, hsa
uuauuuuuuuaaaggaaacaaacagacaacaaaaagaagaaaaaaaaaaagaaccuccuuggaa

SEQ ID NO: 546640 - RNA, 64 nt, hsa
aaaaauaaaaaaaauaaaaaaggaaaaaaaaaaaagaagaaacaagacaugccaccuuuccccu

SEQ ID NO: 546641 - RNA, 64 nt, hsa
gaaacugcuuucuucucgagguauaaccgucggcagaagaaaaggguuccaccucuccccaacc

SEQ ID NO: 546642 - RNA, 64 nt, hsa
uuccggccaauggcagaagugggggaaaauuuuuagaagaaaagcaaacaugugagaccaauca

SEQ ID NO: 546643 - RNA, 64 nt, hsa
gaccguggauuguauuuaaaaaaauaaaaauagaagaagaaaaggccgggcaugguggcucaug

SEQ ID NO: 546644 - RNA, 64 nt, hsa
gaauccaugaugccggacagaguucgcuccugugagaagaaaacugacccgcaggcuccuccca

SEQ ID NO: 546645 - RNA, 64 nt, hsa
uuuuauuuuuuaaguucaauugugucugugguccagaagaaauuauuuaauaugcaucuuugag

SEQ ID NO: 546646 - RNA, 64 nt, hsa
ggacaaggaaggacagaggguuuugauuuuaaaaagaagaaaaaaaaaccuuauuuuuucuuuc

SEQ ID NO: 546647 - RNA, 64 nt, hsa
uggcauccaaagcaacaucagagagagagaacacagaagaaaagcaauugccccagguccuccc

SEQ ID NO: 546648 - RNA, 64 nt, hsa
caauucucugaagucuacgauggagcauuuuuugagaagaaacuaaaccauacaaaguguuggc

SEQ ID NO: 546649 - RNA, 64 nt, hsa
aacuuaaagaauuugucaauccuagccuuccaagagaagaaaaagaagagaaacuagaaacagu

SEQ ID NO: 546650 - RNA, 64 nt, hsa
auuuauagauuuugcaugcugaaacuucucaaccagaagaaagggccuucacaguguccuuuau

SEQ ID NO: 546651 - RNA, 64 nt, hsa
ucuuuacugggaagcuggagagucacagucuaguagaagaaagauuagaaaaauuucaacugua

SEQ ID NO: 546652 - RNA, 64 nt, hsa
gugagcugaucauccacuuucuucuaaaauaaagagaagaaaauggccaguauucauccugucc

SEQ ID NO: 546653 - RNA, 64 nt, hsa
gcaggccagaagaaaaguugcuuuucaaagaggaagaagaaaauagcagcaagaaauaucucuu

SEQ ID NO: 546654 - RNA, 64 nt, hsa
auugccagcugucuacacaaagaauaugcaggccagaagaaaaguugcuuuucaaagaggaaga

SEQ ID NO: 546655 - RNA, 64 nt, hsa
uauaaaaguaaaggaaagaugaugugguccuuccagaagaaagaccaaucuagaauauggaacu

SEQ ID NO: 546656 - RNA, 64 nt, hsa
gucucaaaacgugauaauauuuaagcccauuuguagaagaaaucuuguauauacuauuauuaca

SEQ ID NO: 546657 - RNA, 64 nt, hsa
aaaagagaagaggagaggacacagagacacacagagaagaaagccauguggcggcagaggcaga

SEQ ID NO: 546658 - RNA, 64 nt, hsa
cugauuucagggauacccaggacgcgugaaacacagaagaaacgugaucccauuuucuuuuuuu

SEQ ID NO: 546659 - RNA, 64 nt, hsa
acaaacaccucuaugcaaauaaacuagaaaaucuagaagaaauggauaaauuccucaacacgua

SEQ ID NO: 546660 - RNA, 64 nt, hsa
acuuacauguuagaccuaaaaccauaaaaacccuagaagaaaaccuaggcaauaccauucagga

SEQ ID NO: 546661 - RNA, 64 nt, hsa
uccuugaaagauauaaccccccaagauugaaccaagaagaaauugcaucccugaacagaccaau

SEQ ID NO: 546662 - RNA, 64 nt, hsa
cuaucaaacuaccaauggcauuuuucacagaaucagaagaaaacauucugaaauuuauuuggaa

SEQ ID NO: 546663 - RNA, 64 nt, hsa
acuuaaauauaaaaccuaaaaguauuaaauuccuagaagaaaacccaggaaaugccauucugga

SEQ ID NO: 546664 - RNA, 64 nt, hsa
gaaaaacacagcaugagaacuucgugaagcauacagaagaaaaaccuucagccagauugaaugc

SEQ ID NO: 546665 - RNA, 64 nt, hsa
guccaaccuuuugucuucccugggccacauuggaagaagaaaaauugucuugugccacacauac

SEQ ID NO: 546666 - RNA, 64 nt, hsa
agacuuaaaaccaaauucagggacaaauggauagagaagaaaagggucaaacaucgagauuaca

SEQ ID NO: 546667 - RNA, 64 nt, hsa
gugauggauuggacguugugacucuugccuuuuaagaagaaaaaaaagauaggacaaaguauuu

SEQ ID NO: 546668 - RNA, 54 nt, hsa
cuuucagaacagcacauuaguuccagaagaaagauggaaauucugaaaacugaa

SEQ ID NO: 546669 - RNA, 64 nt, hsa
ucaagaaaaggagucaagaacaauucacaguaugagaagaaaaauggaaaaaaaaaacuuuauu

SEQ ID NO: 546670 - RNA, 64 nt, hsa
uaucacauccauucucaagguaguuauaugcuggagaagaaaaauccucuagacacaugaaggc

SEQ ID NO: 546671 - RNA, 64 nt, hsa
auaaaggcaacuugcaggagaggagagccagccaagaagaaaauuuuaaaaccaaaccucguuu

SEQ ID NO: 546672 - RNA, 64 nt, hsa
gcugaaauugaaaaagaaaaagaagaaaacgaaaagaagaaacaaaagaaagcaucaugaugaa

SEQ ID NO: 546673 - RNA, 64 nt, hsa
uugagaaguauguugcugaaauugaaaaagaaaaagaagaaaacgaaaagaagaaacaaaagaa

SEQ ID NO: 546674 - RNA, 64 nt, hsa
agaaagccgaagaguuagaacuuuuggauacagcagaagaaacagcggcuccacuaccgaccug

SEQ ID NO: 546675 - RNA, 64 nt, hsa
gaggagaggggacuggagaguguggggaauaggaagaagaaauuuccuuuagacuaacgaauau

SEQ ID NO: 546676 - RNA, 64 nt, hsa
cuucucuuucuaaaaaaaaaaaaaaaaaagaaagagaagaaagaagugauuccuacccccuacc

SEQ ID NO: 546677 - RNA, 64 nt, hsa
uaaggggccuacaaaaauguuuuauuuuauaaucagaagaaaaggaaaugaacauuggggauug

SEQ ID NO: 546678 - RNA, 64 nt, hsa
uuuuuuuacauuaaaacaaacuaaagcaaaauuuagaagaaagaacuacacauauguaaauacc

SEQ ID NO: 546679 - RNA, 64 nt, hsa
uucacuguggaaaagaguauugaguuacaaacugagaagaaaaagcaggaaguucccuaauaau

SEQ ID NO: 546680 - RNA, 64 nt, hsa
uaaauguguaagucacccccaccaaaaacaaaagagaagaaaaagaauagaaagaauuauccag

SEQ ID NO: 546681 - RNA, 64 nt, hsa
ccacucucuuuccaauuucacuuugguggucugaagaagaaaaagaaauuuuauguauguaugu

SEQ ID NO: 546682 - RNA, 64 nt, hsa
uuucacccauuuuuaagcugguuuucuccugauaagaagaaaggaagaaagccccagacgcuug

SEQ ID NO: 546683 - RNA, 64 nt, hsa
ugauauuucauggucaguuuauuuuguaagagacagaagaaauuauaucuauacauuaccuugu

SEQ ID NO: 546684 - RNA, 64 nt, hsa
cuugaguucucaacugagugagcaucauggagggagaagaaagaaagaaguucagccugggugu

SEQ ID NO: 546685 - RNA, 64 nt, hsa
aguugcagguugaacccaaacccauuuuagagacagaagaaacuacccucuggagauaaaauaa

SEQ ID NO: 546686 - RNA, 64 nt, hsa
aacuuaaacggaugggauucacuuaacaaaagcaagaagaaaagcacacgaacaggugucuuaa

SEQ ID NO: 546687 - RNA, 64 nt, hsa
uagugcuucuuaccugguaacuugagacuuuaaaagaagaaacaaagaggggaagauaugggag

SEQ ID NO: 546688 - RNA, 64 nt, hsa
gggucuuuuuaauuccagugagaagcucuggcugagaagaaaaucaccacuauuaaaaaagcug

SEQ ID NO: 546689 - RNA, 64 nt, hsa
aguacauuuucuugacuuuucuguuaagccuaucagaagaaagagcaacucccaaauagguuuu

SEQ ID NO: 546690 - RNA, 64 nt, hsa
uucuccugauaauucaagggagcucaaagucacaagaagaaaaaugaaaggaaaaaacagcagc

SEQ ID NO: 546691 - RNA, 64 nt, hsa
cuaaauuuuauuggggaccauggaaugguaguugagaagaaaacuauuugcacacaacagauuu

SEQ ID NO: 546692 - RNA, 64 nt, hsa; identical to SEQ ID NO: 495003

SEQ ID NO: 546693 - RNA, 64 nt, hsa; identical to SEQ ID NO: 495004

SEQ ID NO: 546694 - RNA, 64 nt, hsa; identical to SEQ ID NO: 495005

SEQ ID NO: 546695 - RNA, 64 nt, hsa; identical to SEQ ID NO: 495006

SEQ ID NO: 546696 - RNA, 64 nt, hsa; identical to SEQ ID NO: 495007

SEQ ID NO: 546697 - RNA, 64 nt, hsa; identical to SEQ ID NO: 495008

SEQ ID NO: 546698 - RNA, 64 nt, hsa; identical to SEQ ID NO: 495009

SEQ ID NO: 546699 - RNA, 64 nt, hsa; identical to SEQ ID NO: 495010

SEQ ID NO: 546700 - RNA, 64 nt, hsa; identical to SEQ ID NO: 495011

SEQ ID NO: 546701 - RNA, 64 nt, hsa; identical to SEQ ID NO: 495012

SEQ ID NO: 546702 - RNA, 64 nt, hsa
gggugagucaaaggaacuccaaccaugcucuguccaaaugcaagugaggguucugggggcaacc

SEQ ID NO: 546703 - RNA, 64 nt, hsa
caccgcaaaccuaccuuacuguguugaaacgggacaaaugcaauagaacgcauuggguggugug

SEQ ID NO: 546704 - RNA, 64 nt, hsa
acugaggcacucuagaaucugccacauucauuuucaaaugcaaaugcagaagacuuaccuuagu

SEQ ID NO: 546705 - RNA, 64 nt, hsa
gcacucuagaaucugccacauucauuuucaaaugcaaaugcagaagacuuaccuuaguucaagg

SEQ ID NO: 546706 - RNA, 64 nt, hsa
ggaacuggccuucggagccagccagcacuuugggcaaaugcaaacaacaaugagugcuugagau

SEQ ID NO: 546707 - RNA, 64 nt, hsa
augcuucgaauuuuuaaaacggaaucucugcacccaaaugcaggacuggugacuuaaggagcug

SEQ ID NO: 546708 - RNA, 64 nt, hsa
caucuggugcuuuucaugugucauuugugagccacaaaugcaaaguugccauuugaauucaguc

SEQ ID NO: 546709 - RNA, 64 nt, hsa
aggugggggagaaauugguuagggcucccacugccaaaugcaagcagauagcauaaccugacug

SEQ ID NO: 546710 - RNA, 64 nt, hsa
ccccugauaagugaggacagccugacccuggccucaaaugcagccaucccugaguucaugcgau

SEQ ID NO: 546711 - RNA, 64 nt, hsa
auuucucuggcugguuccacuaaaugugccagcccaaaugcagggcaugggcucugguucugcc

SEQ ID NO: 546712 - RNA, 64 nt, hsa
auaaauaacugagaauaauuaaaacaaaauuaagcaaaugcacaagcaaaaagaugcuugauac

SEQ ID NO: 546713 - RNA, 64 nt, hsa
guggcaauuaauugccauaaaauaacaauguuuccaaaugcaacuaagaaaauacucauaguga

SEQ ID NO: 546714 - RNA, 64 nt, hsa
cugaauacuuggaagaggaccauaaagacuauuccaaaugcaauauuucugaauuuuguauaaa

SEQ ID NO: 546715 - RNA, 64 nt, hsa
gaguacaucaacuauuuucagcccaaaaaggugccaaaugcauauaaaucuugauaaacaaagu

SEQ ID NO: 546716 - RNA, 64 nt, hsa
gaaauguccugagcaaucaccuaugaacuuguuucaaaugcaugaucaaaugcaaccucacaac

SEQ ID NO: 546717 - RNA, 64 nt, hsa
gcaaucaccuaugaacuuguuucaaaugcaugaucaaaugcaaccucacaaccuuggcugaguc

SEQ ID NO: 546718 - RNA, 64 nt, hsa
ucacccuuuuuagugucuagucugugaauuuugacaaaugcaugguuuuguaaccaaucgauag

SEQ ID NO: 546719 - RNA, 64 nt, hsa
aaucuacuuuuugguguacaguucugaguuuuggcaaaugcagucaagucacuaccaccaccac

SEQ ID NO: 546720 - RNA, 64 nt, hsa
auuaauguacuuaaacuauuucaaaugcauaccacaaaugcaauaauacaauaccccuuccaag

SEQ ID NO: 546721 - RNA, 64 nt, hsa
uucuuacaaauucauuaauguacuuaaacuauuucaaaugcauaccacaaaugcaauaauacaa

SEQ ID NO: 546722 - RNA, 64 nt, hsa
cauacauuuuugguuuucuaagcagagacuaauacaaaugcagccacauaaaggcaguguacug

SEQ ID NO: 546723 - RNA, 64 nt, hsa
uaaaaacuaucaucuuugcagauuacucugccuccaaaugcagggccuuucagagaugcauugu

SEQ ID NO: 546724 - RNA, 64 nt, hsa
guauaaccaagcauccuuuugggcaauuccuuaccaaaugcagaagcuuuucuguucgaugcac

SEQ ID NO: 546725 - RNA, 64 nt, hsa
ugaaaacugaucuuccuauuugagucucuugagacaaaugcaaaacuuuuuuuuugaaaugaaa

SEQ ID NO: 546726 - RNA, 64 nt, hsa
ucucuuauuaaaaauuuuuaacaaaauuguauuacaaaugcauuucaucagaacucaaauuuaa

SEQ ID NO: 546727 - RNA, 64 nt, hsa
aacacagccccuuaucccagauagaaaagugucucaaaugcauucuacugcgggacagucagua

SEQ ID NO: 546728 - RNA, 64 nt, hsa
cacccacguggggugugccaggcacccccagauacaaaugcagccacgcacagacguaacacac

SEQ ID NO: 546729 - RNA, 64 nt, hsa
uaaaagcugaucuguauguagggcagaaguguggcaaaugcaucaggaaccgguuagaacagaa

SEQ ID NO: 546730 - RNA, 64 nt, hsa
gcccucagcaugacucugccaagcauccagaccacaaaugcaggaauuuggcugaggagcagcu

SEQ ID NO: 546731 - RNA, 64 nt, hsa
gcuggacuggacucuuguucacuuuaccuucugccaaaugcagagagggaggccagugucaggg

SEQ ID NO: 546732 - RNA, 64 nt, hsa
uauuguuucuccugauuuuguggauuuaaauguccaaaugcaaaccuuugugacuuccuuugga

SEQ ID NO: 546733 - RNA, 64 nt, hsa
guuuccccaccuaauaauauauccuacaaccagccaaaugcacuuuugugaaaaugggguguga

SEQ ID NO: 546734 - RNA, 64 nt, hsa
ugcaagaaccuaacuaacgugaugauaugaagaguuuucuuaagaccugucgucaaacuuaaaa

SEQ ID NO: 546735 - RNA, 64 nt, hsa
uuuuauuuaaguauagguacugcuaaugaaucuguuuucuuagugaguaaauuugcauaauuuu

SEQ ID NO: 546736 - RNA, 64 nt, hsa
uguuagccaugucuauuguuuuuccucuggauucuuuucuuauaacuuggaauacacaaaagug

SEQ ID NO: 546737 - RNA, 64 nt, hsa
ugucuuguuucuuguuuuuuuuucuuguaguuucuuuucuuaauugucauuuuugcaacaaaaa

SEQ ID NO: 546738 - RNA, 64 nt, hsa
uauuuuacuaaagccauuuuuauagucaacuaucuuuucuuauuugugugauuagaacuuagaa

SEQ ID NO: 546739 - RNA, 64 nt, hsa
guguuuugaaaaggccacacaauuauacuuuaucuuuucuuaauaauccugcaaaucucugccc

SEQ ID NO: 546740 - RNA, 64 nt, hsa
guguuggucacuggaaagagccuuuuccuucuccuuuucuuacucuccccucaugguguucccc

SEQ ID NO: 546741 - RNA, 64 nt, hsa
cuaauauuguuggguuaauuuuuccaucccacccuuuucuuaaucgcuuccguggauggaugaa

SEQ ID NO: 546742 - RNA, 64 nt, hsa
uuuaauucaaaguuuguggcauacaaccugagccuuuucuuauauaagacaagaauauguucac

SEQ ID NO: 546743 - RNA, 64 nt, hsa
uucaucccuauuuauaguuuuuauauuaauuuguuuuucuuauccaaguaaagaugucaauagg

SEQ ID NO: 546744 - RNA, 64 nt, hsa
ugcaaaacgucuauauuuuuagaugccacuacuuuuuucuuaaauauucauuuugagacuguca

SEQ ID NO: 546745 - RNA, 64 nt, hsa
cauugcauuuuucccugccuauaccugugcuccuuuuucuuacuguguuuucagucacuuccuu

SEQ ID NO: 546746 - RNA, 64 nt, hsa
cauccucauccuacugacaugcccauuucuccaguuuucuuaaucugagacucccuucccuugu

SEQ ID NO: 546747 - RNA, 64 nt, hsa
gagucacuguucagaauuuugcucuuguuagauguuuucuuacauuggguagaguccagccuag

SEQ ID NO: 546748 - RNA, 64 nt, hsa
auggcugcuuuugaauggggaggaaagaagacauuuuucuuaauauccuuuuugucccaucucu

SEQ ID NO: 546749 - RNA, 64 nt, hsa
auugaaaggagaaaaaaauccaauuuugucaguauuuucuuagucugaaaaaaacagcaguagu

SEQ ID NO: 546750 - RNA, 64 nt, hsa
uaaaauauauguuacaguuuaucugguacuucauuuuucuuaacuaaaauuacuuuuuacuuua

SEQ ID NO: 546751 - RNA, 64 nt, hsa
cauacuuaaacugggauuaaaaccucauagucauuuuucuuaauugcccuuaauauuuugacau

SEQ ID NO: 546752 - RNA, 64 nt, hsa
ucaucaggcuuuuagcgacaaggaacacacacauuuuucuuaaaggcccaauccuaacagacuc

SEQ ID NO: 546753 - RNA, 64 nt, hsa
uuucucacacucaguauugcaugcuuagugcugguuuucuuacaacauuuuggcagguguagcu

SEQ ID NO: 546754 - RNA, 64 nt, hsa
aaaaucacuuuaagaucuuuucgaagcuguuaauuuuucuuaguguuguggacacugcagacuu

SEQ ID NO: 546755 - RNA, 64 nt, hsa
ggggucgggggguggggcggggaagugcucuaacuuuucuuaagguuuuguugcuagcccuuca

SEQ ID NO: 546756 - RNA, 64 nt, hsa
cuucauuccagagcuaugcuugugauacagccccuuuucuuauaaagucaguuagaaggacuuc

SEQ ID NO: 546757 - RNA, 64 nt, hsa
uauaucuucuucugcaagaccuggggcuauuuuuuuuucuuaagguaugaaaucaauuucaaua

SEQ ID NO: 546758 - RNA, 64 nt, hsa
cuuugacacguaguaauucugugacauacuuuuuuuuucuuauagcaauacacuguaauaucag

SEQ ID NO: 546759 - RNA, 64 nt, hsa
guuuagaacauaugaacugaaugaaauggacauuuuuucuuaauuuauguauaaauccauauga

SEQ ID NO: 546760 - RNA, 64 nt, hsa
acaugcaacugaaaaugucucaccuuucaucuuuuuuucuuaauucauaaaguuaucuuguaga

SEQ ID NO: 546761 - RNA, 64 nt, hsa
uggugucucacaauggauuucuguugcuugacuauuuucuuagugaauauuuauacuaagguag

SEQ ID NO: 546762 - RNA, 64 nt, hsa
gcuuaguguuaacggggacuuaaauaugauuuuuuuuucuuacucauuucaccuucccuguacu

SEQ ID NO: 546763 - RNA, 64 nt, hsa
uuuauuuuuuauuuucaggaaaguuauacuaguauuuucuuaaguguggaaucaaaugagcaca

SEQ ID NO: 546764 - RNA, 64 nt, hsa
uuucuaauuuugcagaucuuuacauuuuuauugcuuuucuuaaaauaagggauagcuuugcaac

SEQ ID NO: 546765 - RNA, 64 nt, hsa
uuaauuuuguaaauuuggauuuuuauauaucauauuuucuuaauucauuguacacauuugacuu

SEQ ID NO: 546766 - RNA, 64 nt, hsa
uuuuucacuuucuaugccauuauuuuuguauucuuuuucuuagugugagcucuaaaaucaaugu

SEQ ID NO: 546767 - RNA, 64 nt, hsa
gagguuugguaaugugauauuuuaagcuuauucuuuuucuuaaaagagagaggugacgaaggaa

SEQ ID NO: 546768 - RNA, 64 nt, hsa
uuaaaaugcaauaaacaucucaguauuugaaggguuuucuuaaaguaugucaaaugacuacaau

SEQ ID NO: 546769 - RNA, 64 nt, hsa
auugguuuaacaaaccauagaggcauugaaggguuuuucuuagaugccuagaaaaagcgcacug

SEQ ID NO: 546770 - RNA, 64 nt, hsa
cuuuuuuagccuaagcaauaacugguuuuguauuuuuucuuaauccuucacuuuaauacaauag

SEQ ID NO: 546771 - RNA, 64 nt, hsa
uuuuuaguaguuccaauuuuauaucacaguuuuauuuucuuaugaaaucaaaaaaugcauugau

SEQ ID NO: 546772 - RNA, 64 nt, hsa
uuuuuaacuugagagcugacuguugcuuaagaaguuuucuuauggcaaaaauaauguaaauaag

SEQ ID NO: 546773 - RNA, 64 nt, hsa
uuugguuagcagacugcauguguugauacuuuuuuuuucuuaaagccaauuauuuugaugcaaa

SEQ ID NO: 546774 - RNA, 64 nt, hsa
aaaauuuaccuaaaucucaauguaaaauucuuuuuuuucuuauuacuaugaaauggauggaaua

SEQ ID NO: 546775 - RNA, 64 nt, hsa
uggccauuuguaauuauuucugaaauauccaucuuuuucuuauggacuuuaagaccuuuauauu

SEQ ID NO: 546776 - RNA, 64 nt, hsa
uguuucccuuugauucuuuuggcuggucuuucaauuuucuuaagaggggaacuggagaaaccuu

SEQ ID NO: 546777 - RNA, 64 nt, hsa
ugaaaagguguccuuuuccuuucuucuaguauuuuuuucuuaccaaaauucacuaaucuugaau

SEQ ID NO: 546778 - RNA, 64 nt, hsa
uccacuugaagcacuuaagucuuccuuaaaugacuuuucuuaaguaaugauacuguguguuuuc

SEQ ID NO: 546779 - RNA, 64 nt, hsa
aaaagcagcuaaauguaacuuauuccaagugcauuuuucuuauuuauaucuuuauguagcacua

SEQ ID NO: 546780 - RNA, 64 nt, hsa
guaauaugcauaaaguaaaucaaauagcguugaguuuucuuaugcauuuugaugugaaagaugu

SEQ ID NO: 546781 - RNA, 64 nt, hsa
cggcccaauaacucuuuguguuuauggaguguuguuuucuuagaauaauggagaugcagauaua

SEQ ID NO: 546782 - RNA, 64 nt, hsa
agucaaauuauauuacccaucuacaugguuuucuuuuucuuaguaugggaguguccaugaauaa

SEQ ID NO: 546783 - RNA, 64 nt, hsa
aacuguguccaauaucguucaguuuccugggucuuuuucuuauuagcacauuugagaaaaauau

SEQ ID NO: 546784 - RNA, 64 nt, hsa
caguaggaggcagugugagcuuuuuauuuuuuauuuuucuuaagguggucuuaguaauauaaca

SEQ ID NO: 546785 - RNA, 64 nt, hsa
gcaaaauugagagaaauuaggaacacugcuauuuuuuucuuaaaaauguuuuuaagaauauguu

SEQ ID NO: 546786 - RNA, 64 nt, hsa
aucugaaaacucacaaccaagaaaauccauucuauuuucuuaucuuggacuggagucaccuauu

SEQ ID NO: 546787 - RNA, 64 nt, hsa
gacuaaauucagugaaggaaaggaauugagagauuuuucuuaguaaauagauuauuguuaagua

SEQ ID NO: 546788 - RNA, 64 nt, hsa
uauguuugucucacuuuucaucugguugaauggcuuuucuuagugugguauuugcugucacaua

SEQ ID NO: 546789 - RNA, 64 nt, hsa
uauagcuuuuaagagcuuccuuugaccacugucuuuuucuuacccuaguucucuuaucuuugau

SEQ ID NO: 546790 - RNA, 64 nt, hsa
gcauuuuuuuuucuuugcuucauggaaugauuucuuuucuuaaccuucgacuuauccugagguc

SEQ ID NO: 546791 - RNA, 64 nt, hsa
uguggauuuuucucugaauugacugauuuuguuuuuuucuuacugaaaauggaccugccuuuca

SEQ ID NO: 546792 - RNA, 64 nt, hsa
ucuguagauguccaucguguuucacuaacuggcguuuucuuagccauagagaugacuguagaac

SEQ ID NO: 546793 - RNA, 64 nt, hsa
aauagaaggauguggagaaaugcuuucagucuacuuuucuuaaaucucuguucaucaguggcaa

SEQ ID NO: 546794 - RNA, 64 nt, hsa
uauucaaaacucagaagcaucagcaauguuucucuuuucuuaguucauucugcagaauggaaac

SEQ ID NO: 546795 - RNA, 64 nt, hsa
gguuggcuugaacauaaaugaaaauauccuguuauuuucuuagggauacuugguuaguaaauua

SEQ ID NO: 546796 - RNA, 64 nt, hsa
cauauaaaauuuuauaaaauauguauuuaaagcuuuuucuuauuuuuuguauuaauugguaagu

SEQ ID NO: 546797 - RNA, 64 nt, hsa
uaaauaauaguacugaaaauugauauuauuuuccuuuucuuauaugaaggaccuuauuuggcau

SEQ ID NO: 546798 - RNA, 64 nt, hsa
gagugauaaauaacauuuuuuccuaaaaauuauguuuucuuaguuucauaauaaucugcacugu

SEQ ID NO: 546799 - RNA, 64 nt, hsa
caguuuuucauaguguaggauuuugaagaaguguuuuucuuaaagcagauacgaugacauaagg

SEQ ID NO: 546800 - RNA, 64 nt, hsa
guguaaauuuaaaaaggggaaauacuuuaauuuuuuuucuuaauaguguaaaaauucccugagc

SEQ ID NO: 546801 - RNA, 64 nt, hsa
augucuugucccaguucuucaaacacucuuaaauuuuucuuaaguaauguaaaaauggaacugc

SEQ ID NO: 546802 - RNA, 64 nt, hsa
uuuaaaaaaccaguuggaaauauagguuggguuuuuuucuuauuguuuucuccccaggguuaga

SEQ ID NO: 546803 - RNA, 64 nt, hsa
aaaaaugaugcaguacccauuuuucguauccugcuuuucuuauauuggaguaaaaaggacaggg

SEQ ID NO: 546804 - RNA, 64 nt, hsa
aaauauuuuguuaacuuuuguuuuuuuuuguuuguuuucuuaaaaguaccucugcauugagcau

SEQ ID NO: 546805 - RNA, 64 nt, hsa
uuguuuucuuaaaaguaccucugcauugagcauauuuucuuacuuuuauuauuuuaauuaauau

SEQ ID NO: 546806 - RNA, 64 nt, hsa
uuaaacauguuuaaaguguacuuauaaacuauuuuuuucuuaaagcaaacuaugauuuauuuug

SEQ ID NO: 546807 - RNA, 64 nt, hsa
cuggauuguugacaugaguggaauacuugguuucuuuucuuacuuaucaaaagacagcacuaca

SEQ ID NO: 546808 - RNA, 64 nt, hsa
uguaaaugcagccuucuuuucaaaacugcuaaauuuuucuuaaucaagaauauucaaauguaau

SEQ ID NO: 546809 - RNA, 64 nt, hsa
guaauuuauuuacaggaaauguuaaugagauguauuuucuuauagagauauuucuuacagaaag

SEQ ID NO: 546810 - RNA, 64 nt, hsa
aauuauuauauuuacaauuugguuucugcaauauuuuucuuauguccacccuuuuaaaaauuau

SEQ ID NO: 546811 - RNA, 64 nt, hsa
aauaacaagagaucguguuacagucacaaucuacuuuucuuaaacuuuguaucucuaggaacga

SEQ ID NO: 546812 - RNA, 64 nt, hsa
gcacaguaaaccaauaguuugagauuuaaaacuauuuucuuauaguauaguuacaaaaugggaa

SEQ ID NO: 546813 - RNA, 64 nt, hsa
ucuacaggcauuaccuaggugugagacuaaaagcuuuucuuauugacuuaaauuuggauaacag

SEQ ID NO: 546814 - RNA, 64 nt, hsa
guuucucaguuaauacauagcuaauagcucuuauuuuucuuauguuuuuaaccgcuuaggucua

SEQ ID NO: 546815 - RNA, 64 nt, hsa
cuuugcguauuaugcuuaacuucacaaguuaacuuuuucuuauuuuguauccugaugaggcauu

SEQ ID NO: 546816 - RNA, 64 nt, hsa
acaggcaugagccaccgcacccagccuacaauaauuuucuuaaacuuuaccuuuuauuuuaaag

SEQ ID NO: 546817 - RNA, 64 nt, hsa
cuggaaaccaagaggauccaaacuuccugcaacauuuucuuagaggagagagagaaauauuaaa

SEQ ID NO: 546818 - RNA, 64 nt, hsa
cauuuuuuaauauaaauaauuuuaauaaauuuuauuuucuuauauucugcuuuuuauacauuuc

SEQ ID NO: 546819 - RNA, 64 nt, hsa
ugugccuuuucuuagguauaauaauuuauaaauguuuucuuaacugacuuucagucaccuuuac

SEQ ID NO: 546820 - RNA, 64 nt, hsa
aaucaauaaaaauaaguaaaaggcuuuuugugccuuuucuuagguauaauaauuuauaaauguu

SEQ ID NO: 546821 - RNA, 64 nt, hsa
auuuagaaguuuuaaauaaugccuccacuauuuuuuuucuuagacauagcuuuuaauggggaaa

SEQ ID NO: 546822 - RNA, 64 nt, hsa
cauucuucccugauucucaggcuagaagugucacuuuucuuaucuguacuuccaaagcacuuuc

SEQ ID NO: 546823 - RNA, 64 nt, hsa
uaacuuaaugucuguguuuauuuauggaauucgguuuucuuaauaaauguuugagcuaauauaa

SEQ ID NO: 546824 - RNA, 64 nt, hsa
auaacgcuuuuauuuuuauuuuaucuuauuuucauuuucuuaagcacaacugugugagagugua

SEQ ID NO: 546825 - RNA, 64 nt, hsa
gcaguuauuuuaaaaacuacagaucauuucauuauuuucuuaauuuugguaauuauuaaagucu

SEQ ID NO: 546826 - RNA, 64 nt, hsa
gcaguugucauuuguucccaagugagcuggcuuuuuuucuuagaaauuaaagauuaugaaagcc

SEQ ID NO: 546827 - RNA, 64 nt, hsa
cugaauuuacagguaugauaauuuuuguaauuaauuuucuuagaauugugcaggcuggaugaga

SEQ ID NO: 546828 - RNA, 64 nt, hsa
aagacaaauggauuauagacuuaaaaauagucauuuuucuuauucauaaaucugacaggcauaa

SEQ ID NO: 546829 - RNA, 64 nt, hsa
ugcagcaguuggucaacuucaacucaaaacacuguuuucuuauguuuguuacaaacuuaauuuu

SEQ ID NO: 546830 - RNA, 64 nt, hsa
uagaggaggagaugguuuucauugcauagugacauuuucuuagccuuaacguucugauaguagc

SEQ ID NO: 546831 - RNA, 64 nt, hsa
gauccuugaguaaagacauuuugcuuaauuucuuuuuucuuauuccccacuuguauauccccua

SEQ ID NO: 546832 - RNA, 64 nt, hsa
uacccauguuuugcaugcaaugacucaugcaugguuuucuuaacuagcuaauauuaacaauuua

SEQ ID NO: 546833 - RNA, 64 nt, hsa
aggaaaaucuucauacugaauucuucuguugccuuuuucuuacagaaugacugaaaauuugaaa

SEQ ID NO: 546834 - RNA, 64 nt, hsa
gaaguaguagugugcccugaaaaauguacacguuuuuucuuauuguuaccacauguucaccuuu

SEQ ID NO: 546835 - RNA, 64 nt, hsa
aauaucagaugccuuguaaauuaugucuuuaacguuuucuuauagacuaauuuccucuuuucca

SEQ ID NO: 546836 - RNA, 64 nt, hsa
agauguucaguaccuuaugauacagggaagauaguuuucuuacaaguaguuugguaauauuuuu

SEQ ID NO: 546837 - RNA, 64 nt, hsa
gauaguuuucuuacaaguaguuugguaauauuuuuuuucuuaaguuguacauuugacucagcug

SEQ ID NO: 546838 - RNA, 64 nt, hsa
ucugggucuuaggauuuuaaaagugaagggauauuuuucuuauauuugugaguucaguuccgau

SEQ ID NO: 546839 - RNA, 64 nt, hsa
gggagagcacaagacuaacuuuggucucuugaccuuuucuuaccuugcaacugucagugccucc

SEQ ID NO: 546840 - RNA, 64 nt, hsa
caugcucccugaaagccuuuuugagauuaagaaauuuucuuaccaggaggcaacuuuccgucug

SEQ ID NO: 546841 - RNA, 64 nt, hsa
ugcacucucuuuuacauuuuuuuacuucuuuccuuuuucuuaaguucggauccaaguuugucuu

SEQ ID NO: 546842 - RNA, 64 nt, hsa
uucuuggacuguuguuagaaaagugauccucugcuuuucuuaguaggucauugguuugauuuuu

SEQ ID NO: 546843 - RNA, 64 nt, hsa
uaaaauuauuuuauucuaaaacugggucccauuauuuucuuaaacaacagcauuuuguauauau

SEQ ID NO: 546844 - RNA, 64 nt, hsa
acaguacaguaacauuugguuguucuuaaggcucuuuucuuacaaaaauaagagacccuccaac

SEQ ID NO: 546845 - RNA, 64 nt, hsa
uuugccacuugcacugaguuuugggucaaaccuauuuucuuaaaugaaguuguaacuucgguau

SEQ ID NO: 546846 - RNA, 64 nt, hsa
gaacugggcagaaugguuuguucuauuuucuuauuuuucuuaggcaacacaguuguuaccacaa

SEQ ID NO: 546847 - RNA, 64 nt, hsa
auuuugguugaacugggcagaaugguuuguucuauuuucuuauuuuucuuaggcaacacaguug

SEQ ID NO: 546848 - RNA, 64 nt, hsa
uguccgagaggcuuuggugcuuaguuaaggugcauuuucuuacucuagguuuauagagugaugu

SEQ ID NO: 546849 - RNA, 64 nt, hsa
uaccuuaaaauuaucugcuuucccuacucuuaauuuuucuuauuguuaaaguuuuuauauguug

SEQ ID NO: 546850 - RNA, 64 nt, hsa
augaugcaagggaauuaagagagguaauguguacuuuucuuaugauaagaucacucauaaaaca

SEQ ID NO: 546851 - RNA, 64 nt, hsa
augaugaaagaaagguugguauuaucaggaaauguuuucuuaagcuuuuccuuucucuuacacc

SEQ ID NO: 546852 - RNA, 64 nt, hsa
ugguuguucuguuagucgcuaacuuaguaagugcuuuucuuauagaaccccuucugacugagca

SEQ ID NO: 546853 - RNA, 64 nt, hsa
ccagauaaacacacagccuuucccauaccuuuuuuuuucuuacuauaaaauauuauaagaucca

SEQ ID NO: 546854 - RNA, 64 nt, hsa
uugcuaaugcccaguuuucuucuccauuuccacuuuuucuuaggcucccuauuuacuauucauu

SEQ ID NO: 546855 - RNA, 64 nt, hsa
ucagcugcuaauagccuaagauuuauuuuuuuuuuuuucuuaagccuauggaaccggcuuugcu

SEQ ID NO: 546856 - RNA, 64 nt, hsa
gugaacuaaugaaaauaacagcguauuuucaauauuuucuuauuccuuaaauuccacucuuuua

SEQ ID NO: 546857 - RNA, 64 nt, hsa
guuuaguugcuuuauuuuaccucuaugugauuauuuuucuuaauuguuauuuuuuauaaucauu

SEQ ID NO: 546858 - RNA, 64 nt, hsa
gcucccucaaaaagggaggggacagauggggagcuuuucuuaccuauucaaggaauacgugccu

SEQ ID NO: 546859 - RNA, 64 nt, hsa
gagcuuuucuuaccuauucaaggaauacgugccuuuuucuuaaaugcuuucauuuauugaaaaa

SEQ ID NO: 546860 - RNA, 64 nt, hsa
auacuuuccaguuaaauauauauauauauauauuuuuucuuacuuuaucuuuuaagaauuaaug

SEQ ID NO: 546861 - RNA, 64 nt, hsa
acuauuaaaaaaaaaacacccuuccuaacccuucuuuucuuaaaauuccacauucauccacaau

SEQ ID NO: 546862 - RNA, 64 nt, hsa
aaaacugaaauagccucccuuuagaaugucacauuuuucuuagaaaacauuuuggaauugguua

SEQ ID NO: 546863 - RNA, 64 nt, hsa
ccaaaaaauaauaagagcauucauuaaauacugauuuucuuaaacuuaaauguuguauuucaua

SEQ ID NO: 546864 - RNA, 64 nt, hsa
auuuuuaaagauaaagaauaucuaaaauguguuuuuuucuuagcuuuuuaguugucuagaacau

SEQ ID NO: 546865 - RNA, 64 nt, hsa
gaugaauucuagugaaaugaccccuugacuuugcuuuucuuaauacagauauuuacugagagga

SEQ ID NO: 546866 - RNA, 64 nt, hsa
uaaagaagaaugauggguacaguuaggaaaguuuuuuucuuacaccgugacugagggaaacauu

SEQ ID NO: 546867 - RNA, 64 nt, hsa
uguggaaguuaguuuucuggcccguggccuuuaauuuucuuaaucaaccuaauuacaucaggau

SEQ ID NO: 546868 - RNA, 64 nt, hsa
uuuuagucauuauugaauuauaccauuuacucuguuuucuuauagucuuaauuuuauuauauuu

SEQ ID NO: 546869 - RNA, 64 nt, hsa
auauaauuugccaaagguaauuaauuuauucuuuuuuucuuaaagaagaaaaagacauugguug

SEQ ID NO: 546870 - RNA, 64 nt, hsa
ggguuuuugucaaauagcaugugaagaguuacauuuuucuuaaaagauugguggucccaauguc

SEQ ID NO: 546871 - RNA, 64 nt, hsa
acuauuuucauacccuacuuuuucuguaccuaaauuuucuuaaaaaaaaaucuaguauagcacu

SEQ ID NO: 546872 - RNA, 64 nt, hsa
ccuaauggaauaagcuauucauuuaugauauauauuuucuuauauuuuguuucauugguuagua

SEQ ID NO: 546873 - RNA, 64 nt, hsa
gcugcauaguauuccaugguguauaugugccacauuuucuuaauccagucuauuguuguuggac

SEQ ID NO: 546874 - RNA, 64 nt, hsa
gaaauagcuucaaaagcacuuguguaucuugauuuuuucuuauaugcuguugcagauauaugua

SEQ ID NO: 546875 - RNA, 64 nt, hsa
uuugcauuuguauguagcuguauguuuccguccauuuucuuaauccugaaccuguauguuaaau

SEQ ID NO: 546876 - RNA, 64 nt, hsa
agaugguauuuuaaacagguacauuuuuacaguguuuucuuaucaauuugcuauauugcacaga

SEQ ID NO: 546877 - RNA, 64 nt, hsa
guguauuuuugccuauuuguugcuugugcuuuauuuuucuuagucauuuguggaauauagugau

SEQ ID NO: 546878 - RNA, 64 nt, hsa
uauaaaaaguuugugaauaacucaaggguuuaaauuuucuuacuagcuucuaaauggauuaaua

SEQ ID NO: 546879 - RNA, 64 nt, hsa
uaucuauugguuccauaacucuguaucauguguauuuucuuauucugguauaccacaaaugauu

SEQ ID NO: 546880 - RNA, 64 nt, hsa
gcuuuguuuuauuuugcuuucagagaaugguauguuuucuuaacuauagguuauuuuauagaga

SEQ ID NO: 546881 - RNA, 64 nt, hsa
acagaauuuguuuuuuuuucaaauaaauuaguuguuuucuuauuuuuuuggcuuaguauguuga

SEQ ID NO: 546882 - RNA, 64 nt, hsa
uggguuuugcuguccaauuauauacaauaauaguuuuucuuacaacuaagcuggccccagccuu

SEQ ID NO: 546883 - RNA, 64 nt, hsa
guauauauauuuuaaaaugccugaggaaauacauuuuucuuaauaaacugaagagucucaguau

SEQ ID NO: 546884 - RNA, 64 nt, hsa
aagagaggagauucccccaaacaacaauauuuaauuuucuuaguaaaaagaauaacagaaugca

SEQ ID NO: 546885 - RNA, 64 nt, hsa
uaagacaauuuaaggacuacuuguuuucuauuuuuuuucuuaauaaaauggaauccacuguguu

SEQ ID NO: 546886 - RNA, 64 nt, hsa
gaacguaugcuaaaugaaagcagacaaauuucuauuuucuuaccugagcaaauauuuuauugaa

SEQ ID NO: 546887 - RNA, 64 nt, hsa
ugugacacuuaagaacagugauuuuuauugggaauuuucuuaggguuauuacacuuaaagcaac

SEQ ID NO: 546888 - RNA, 64 nt, hsa
uuuuuuguuauuucuaagcaaaccucuuuuguacuuuucuuacuucuaauauccaucccuggac

SEQ ID NO: 546889 - RNA, 64 nt, hsa
ccacuaccaccaccaccucuugcccccuucccucuuuucuuaaacuucuggcauuucagagcuc

SEQ ID NO: 546890 - RNA, 64 nt, hsa
uggccuucugaugauucuuaaagaguuuucaauuuuuucuuaugugaagaguugacacugaaau

SEQ ID NO: 546891 - RNA, 64 nt, hsa
aaccauuguuguugaguguaagauguccuucauguuuucuuauaaagucaguguuuagaaaugu

SEQ ID NO: 546892 - RNA, 64 nt, hsa
gguaugcaaccacugcaaucacugugcauaugucuuuucuuagcaaaaggauuuuaaaacuuga

SEQ ID NO: 546893 - RNA, 64 nt, hsa
gugaaauagguuagaauuuuucuuuaaauuaugguuuucuuauucgugaaaauucggagagugc

SEQ ID NO: 546894 - RNA, 64 nt, hsa
auauauuugucuuugcugggcaucucguaaucacuuuucuuaggggacagaaucccaucuuuuc

SEQ ID NO: 546895 - RNA, 54 nt, hsa
agcugguccucaucguaugagccuuuuucuuacaagcaccacccaacaacuucu

SEQ ID NO: 546896 - RNA, 64 nt, hsa
cuguuccaucuuugcacuguugcuuaccugcugauuuucuuaacuguucuugugcaaucgacaa

SEQ ID NO: 546897 - RNA, 64 nt, hsa
guuuuggauaaauuuccuguuguguggguggcauuuuucuuaacgagauuugcuucugucuuag

SEQ ID NO: 546898 - RNA, 64 nt, hsa
cagaaauaaaacauacuaccuugaugugacauuuuuuucuuaaccuuguugagcugguuuuguu

SEQ ID NO: 546899 - RNA, 64 nt, hsa
caggguugacacagcagggcuaguccugcauauuuuuucuuaaauauuucccaauuguguuuuu

SEQ ID NO: 546900 - RNA, 64 nt, hsa
aaucaagugcagcugaacuggaacauaaaagauuuuuucuuaacuuuuuuuuuuuaacacacua

SEQ ID NO: 546901 - RNA, 64 nt, hsa
uuggaaaguaguuguuuaacuuuguuuuaagccguuuucuuagugauucuguaucaaguagagg

SEQ ID NO: 546902 - RNA, 64 nt, hsa
aggguuuauuuuccacucaugcccuuaugccuuuuuuucuuauaguuuuuuaacuuauugacug

SEQ ID NO: 546903 - RNA, 64 nt, hsa
uaguuugaaaauaaaauucuagauaugcaaaugauuuucuuagaaaacuucacaaaauaaaaga

SEQ ID NO: 546904 - RNA, 64 nt, hsa
ucauucgggugguaacaauguauguguaauauuuuuuucuuagugauuuugacaguuuaaaugu

SEQ ID NO: 546905 - RNA, 64 nt, hsa
aaauuauuugguaggaaauuuuugggagaucugauuuucuuauccaaguuuuguaaauaguugu

SEQ ID NO: 546906 - RNA, 64 nt, hsa
auucaugcauaucauugaaaauuucucguuuucauuuucuuagaugacuucuugucugagacag

SEQ ID NO: 546907 - RNA, 64 nt, hsa
ggcaauacuugcuucuucccaauugcuuuaccuuuuuucuuaccuuauugcacugguuagcaac

SEQ ID NO: 546908 - RNA, 64 nt, hsa
uuuuuguauuuuguuuaaauuaguuagccaauauuuuucuuacugauuuuuaaguuauuuuuac

SEQ ID NO: 546909 - RNA, 64 nt, hsa
aaacaaauuuugccuucaugguacaguucucaguuuuucuuauaggagaaauaugguauauguu

SEQ ID NO: 546910 - RNA, 64 nt, hsa
ugguuucacuuugcaguggaacacugagucacucuuuucuuaacacgugcaacaucuuaauuuu

SEQ ID NO: 546911 - RNA, 64 nt, hsa
cagugaugagggaauugauuuuuuuuaaaagucuuuuucuuagaaagccaaaauguuuguuuuu

SEQ ID NO: 546912 - RNA, 64 nt, hsa
aaugacagaugauuuuguucaggaauuuugcuguuuuucuuagugcuaauaccuugccucuuau

SEQ ID NO: 546913 - RNA, 64 nt, hsa
uguuuucccuugcuuuagggguuuuauaggucauuuuucuuaauagaagcugugaucgacuuag

SEQ ID NO: 546914 - RNA, 64 nt, hsa
uuugcguagguuucuauuaaauauuugacuuuuuuuuucuuauuaagaaaaugaaaucccuuac

SEQ ID NO: 546915 - RNA, 64 nt, hsa
uaaguaagaguagauacauuguacccauuuuacauuuucuuauuuuaacuacaguaaucuacau

SEQ ID NO: 546916 - RNA, 64 nt, hsa
uauuuuuuguuuuguagaauugcacuucaguuuauuuucuuacaaauaaccuuacauuuuguuu

SEQ ID NO: 546917 - RNA, 64 nt, hsa
cugcccaccucaaguuuaauaaauaagguuguacuuuucuuacuauaaaauaaaugucuguaac

SEQ ID NO: 546918 - RNA, 64 nt, hsa
uggguaaaagguacccuugccuuacuccaucuuauuuucuuagcccccuuugaguguuuuaacu

SEQ ID NO: 546919 - RNA, 64 nt, hsa
uguguguaugccucaaaugcagaaacaguugggcuuuucuuaacagguuaacaguuugugcugg

SEQ ID NO: 546920 - RNA, 64 nt, hsa
auccugagcuacaguuucaaaaggaaaaucauuuuuuucuuaugcaaagaugguaaaacacugu

SEQ ID NO: 546921 - RNA, 64 nt, hsa
gccugaagcccuaguaccauaauucaagauugcauuuucuuaaaugaaaauugaaagggugcuu

SEQ ID NO: 546922 - RNA, 64 nt, hsa
uuacuaaguagccuuaauuuguauuuuaguaguauuuucuuaguagaaaauauuuguggaauca

SEQ ID NO: 546923 - RNA, 64 nt, hsa
uuaagcuccaucugguccucauaaccugcaagauuuuucuuaaaaccuuucagcugaaaguggg

SEQ ID NO: 546924 - RNA, 64 nt, hsa
cagaaaugugcuuuaacaucaguugaaaccuaaauuuucuuauguuguggugauuguauuaaaa

SEQ ID NO: 546925 - RNA, 64 nt, hsa
ccccgaauacccccaaaaugagaaacaaaauuuuuuuucuuacuccauuuguuacucucuguuc

SEQ ID NO: 546926 - RNA, 64 nt, hsa
aauaguauuuaaaaguuaaugaacacuucucuaguuuucuuaguuauggccuuaauaauuaguc

SEQ ID NO: 546927 - RNA, 64 nt, hsa
ucauguauuugaauauaguuaaaucguauuauuuuuuucuuaacagaaauauuuuuaaaaauga

SEQ ID NO: 546928 - RNA, 64 nt, hsa
guuugguuugcagagaacacagccugauacuuaauuuucuuaaaacuauuuuuaaugauccacu

SEQ ID NO: 546929 - RNA, 64 nt, hsa
ucaaaucaguuuuagcaugaccuuuccuuguggauuuucuuauucucguugucaaguuuucuag

SEQ ID NO: 546930 - RNA, 64 nt, hsa
ugagauaaucaggccuaaucauguugugauucucuuuucuuaguggaguggaauguucuauccc

SEQ ID NO: 546931 - RNA, 64 nt, hsa
gggcuuuuggugcaugcaguugauuacuucuuauuuuucuuaccaauugugaauguugguguga

SEQ ID NO: 546932 - RNA, 64 nt, hsa
aaaguguguaauuauguaaauacaauuuguacuuuuuucuuaaggcauacuaguacaaguggua

SEQ ID NO: 546933 - RNA, 62 nt, hsa
gaaaaaaaaaagauacauagauuugucucuguguuuuucuuauucuuggcuuaguuuuuccu

SEQ ID NO: 546934 - RNA, 64 nt, hsa
uauugguguuuguuuaauaaaaauaaugggacuuuuuucuuaacuuuuuauuagcucuuccuaa

SEQ ID NO: 546935 - RNA, 64 nt, hsa
agaucucagcccaccaaugccaagacaaaauuauuuuucuuauacuuauuuuuuauuaaacaaa

SEQ ID NO: 546936 - RNA, 64 nt, hsa
uaauguucaaaaaugauaaguaaucuggauaccuuuuucuuauacuuucuccuaggaaaacuuu

SEQ ID NO: 546937 - RNA, 64 nt, hsa
ugcauuuuagcuaucugaauggccaacucacuucuuuucuuacacucuuggacaauggaccaug

SEQ ID NO: 546938 - RNA, 64 nt, hsa
gagaauucuuacucaaauuuuucguaccaggagauuuucuuaccuucauuugcuuuuaugcugc

SEQ ID NO: 546939 - RNA, 64 nt, hsa
uuaccuuuaauuuuccuggagaauuauauaaagguuuucuuagaacaauuuugcccugauuacu

SEQ ID NO: 546940 - RNA, 64 nt, hsa
agccagcaucugaucaaaaguauuacauaaaauauuuucuuaaacuauugaaaggugcuuugau

SEQ ID NO: 546941 - RNA, 63 nt, hsa
auaucucucaccagaacuaaugcacuucugagcuuuucuuaacaaaugcuuguuguaucgcag

SEQ ID NO: 546942 - RNA, 64 nt, hsa
uuucuuaacaaaugcuuguuguaucgcagccugcuuuucuuagauguuuucuugcuguuccuug

SEQ ID NO: 546943 - RNA, 64 nt, hsa
ugcuauugacuuugauuucaauugcggcuugccauuuucuuaguguuuuuaaccuguacauugu

SEQ ID NO: 546944 - RNA, 64 nt, hsa
auguaauuuuuaugaaaugugugcaguauuuaauuuuucuuaugcuauugacuuugauuucaau

SEQ ID NO: 546945 - RNA, 64 nt, hsa
auuacucagagcuuuggaucaaguuaacugagcuuuuucuuaauuucauuccuuuuuuuggaca

SEQ ID NO: 546946 - RNA, 64 nt, hsa
cagcaguacgugguagccacaauugcacaauauauuuucuuaaaaaauaccagcaguuacucau

SEQ ID NO: 546947 - RNA, 64 nt, hsa
uuggaaguccuuuucauaaaagguaccucuuuccuuuucuuauugaauucuuagaacuuaguua

SEQ ID NO: 546948 - RNA, 64 nt, hsa
uugaauucuuagaacuuaguuaacccucccugccuuuucuuaacaaaaaggacuuuucuaagga

SEQ ID NO: 546949 - RNA, 64 nt, hsa
ccugggugugagcacuuaaucacucaacgcuuuguuuucuuacacuugaaaaucaagggaaaga

SEQ ID NO: 546950 - RNA, 64 nt, hsa
caucugacuccuacacuuucauuacaagucagauuuuucuuaaacuagcaggcaaaaacaguac

SEQ ID NO: 546951 - RNA, 64 nt, hsa
gcauacagggucaauaucuaauuuacuguuguguuuuucuuaauauguucaauguauggucaua

SEQ ID NO: 546952 - RNA, 64 nt, hsa
caaguggagaauucacugcuucccuaaaaugcguuuuucuuaccuguaauggugaauauuuaca

SEQ ID NO: 546953 - RNA, 64 nt, hsa
gacguucaaguuucuuaaagaugcuguuggucuuuuuucuuauguuauuguuuuaguuuuguga

SEQ ID NO: 546954 - RNA, 64 nt, hsa
uuggaagggcaaugugugagcuaaggacuguuuuuuuucuuacucuccaauguaaauauaugag

SEQ ID NO: 546955 - RNA, 64 nt, hsa
aauccaugugcauuggauugcacacuaagauguauuuucuuacgaaauaguucuguguuuauuu

SEQ ID NO: 546956 - RNA, 64 nt, hsa
gccaaaugaaaagagguaacuuugcuuuuuuccuuuuucuuaccuaucaaauagcauuuauuac

SEQ ID NO: 546957 - RNA, 64 nt, hsa
acagaaaagggcuacauuuaaaauuuguauuuguuuuucuuacuuagugaagguuguguuuuuu

SEQ ID NO: 546958 - RNA, 64 nt, hsa
aagaauggauaaauguccuuauuuucuucuaguauuuucuuauuucacuuuuacaccuaucuuu

SEQ ID NO: 546959 - RNA, 64 nt, hsa
guggccccuggggaugugugcuucauugugcccuuuuucuuauugguuuagaacucuugauuuu

SEQ ID NO: 546960 - RNA, 64 nt, hsa
uaaacauauauugaggaaaaauaaagcgauugguuuuucuuaagguaucccauguguauuuauu

SEQ ID NO: 546961 - RNA, 64 nt, hsa
cuuguuucuugacaguacauuuuuagaucuggccuuuucuuaacaaaaucugugcaaaagaugc

SEQ ID NO: 546962 - RNA, 64 nt, hsa
gucuuccucucccuucuccucugcugcagcaugauuuucuuaaucuucagacacucacuauuuu

SEQ ID NO: 546963 - RNA, 64 nt, hsa
aaaaaacugaaaucuaccaaaagagcauggagauuuuucuuaaauaauaauauugugcucucca

SEQ ID NO: 546964 - RNA, 64 nt, hsa
ucuccagggccaggcuauuuacuugggaaaguauuuuucuuacaguucuuggccacaguuuuuu

SEQ ID NO: 546965 - RNA, 64 nt, hsa
uuagcaucagaagguucacccagcaccuugcagauuuucuuaaggaauuuugucucacuuuuaa

SEQ ID NO: 546966 - RNA, 64 nt, hsa
acagaaaaccgagaauauucaaaauuccaaauuuuuuucuuaggagcaagaagaaaauguggcc

SEQ ID NO: 546967 - RNA, 64 nt, hsa
caauuuaucucaauuuuauauggcuugugauucauuuucuuaauccaaauauauauaaacgugu

SEQ ID NO: 546968 - RNA, 64 nt, hsa
ggacuacaggcaugcaccaccacgcccagcuaauuuuucuuauuuuuuguagagacagggucuc

SEQ ID NO: 546969 - RNA, 64 nt, hsa
aaaaaauugugaaaguaagauauguuuguauuguuuuucuuaaagaggaaccucguauaagcuu

SEQ ID NO: 546970 - RNA, 64 nt, hsa
agauugcauuuuuuucuuuucaaauugcuuuaguuuuucuuagggagcuaugagggggaaaaau

SEQ ID NO: 546971 - RNA, 64 nt, hsa
uaauuuguuuucuuacggguuuacgauuuugaauuuuucuuauuugguugaaagaauuuugauu

SEQ ID NO: 546972 - RNA, 64 nt, hsa
ggagugacguauuuucaucaccguuuuuaauuuguuuucuuacggguuuacgauuuugaauuuu

SEQ ID NO: 546973 - RNA, 64 nt, hsa
ugauauuaauccuuugucauuauguagcagauguuuuucuuaaucuagcauuugucuuuauacu

SEQ ID NO: 546974 - RNA, 64 nt, hsa
uguauuugccuauuuuucuauucauuuaucugucuuuucuuauaaaccuggaggugcuuuuuau

SEQ ID NO: 546975 - RNA, 64 nt, hsa
gauguuuguguguguguuggcaacaugccuaauguuuucuuaaugaugacaacaaauauuuuaa

SEQ ID NO: 546976 - RNA, 64 nt, hsa
ggauaauuucuuaaaccacauuguuuuaauugauuuuucuuaucuugauuucuuucauuagaaa

SEQ ID NO: 546977 - RNA, 64 nt, hsa
uccuccuuuaccuuugcuaauaucauggcagaauuuuucuuaucccuugugaggcaguuguuga

SEQ ID NO: 546978 - RNA, 64 nt, hsa
aucuucuaccacuuuagagacauucaaguaauaguuuucuuagagcuuugcacauuccuauuca

SEQ ID NO: 546979 - RNA, 64 nt, hsa
uguaggagauacucaguggagccucugcccuucuuuuucuuacuugagaacuuguaaugguguu

SEQ ID NO: 546980 - RNA, 64 nt, hsa
aaauauuuauuguucaccuguuuguaccaggaacuuuucuuagucuuuggguaaaggugaacaa

SEQ ID NO: 546981 - RNA, 64 nt, hsa
caauuaagauguagauagaaauuaauuuaaggucuuuucuuaaaaaaaaaauccaccucauuuu

SEQ ID NO: 546982 - RNA, 64 nt, hsa
augaaaguuugacaguauuaauauuuuuuuuauauuuucuuaaaucauuaaaccauuuuaauau

SEQ ID NO: 546983 - RNA, 64 nt, hsa
uucuuaagcaauauuugugguuauuucuuccuuuuuuucuuacgaauaaaauauacucagaugu

SEQ ID NO: 546984 - RNA, 64 nt, hsa
gcuccgucucuuguagccaagucagcugaauuuauuuucuuaagcaauauuugugguuauuucu

SEQ ID NO: 546985 - RNA, 64 nt, hsa
aacccagauaggaccaaacucuaugucuauguuuuuuucuuauauauacauaccuaugauaaaa

SEQ ID NO: 546986 - RNA, 64 nt, hsa
gaaaaauaauaucucccaucauaauauaaaauauuuuucuuaugaauucuuaaaguacuaaaga

SEQ ID NO: 546987 - RNA, 64 nt, hsa
agaaaacuugaucugugguguuuuguuuuguuuuuuuucuuaaaacaacagcaacgugaucuug

SEQ ID NO: 546988 - RNA, 64 nt, hsa
gucugagguuuaacaguuuguuguccuggagggauuuucuuacagcgaagacuugaguuccucc

SEQ ID NO: 546989 - RNA, 64 nt, hsa
cauuuucgacaguguaauggaaauuuuucuguaauuuucuuaccaucggguauuuuuuaaagua

SEQ ID NO: 546990 - RNA, 64 nt, hsa
aagccauuuguuaccaaacugggaaaacagaggcuuuucuuaacuauuucacauacuguaacaa

SEQ ID NO: 546991 - RNA, 64 nt, hsa
aaaaaaaagaaagaaaggaaaacaaaaagcacuuuuuucuuaaugguagcaguauaauguauuu

SEQ ID NO: 546992 - RNA, 64 nt, hsa
acuauuccaugcuuuuaaguaguuuucuccaccuuuuucuuaugagucucacuagauugacuga

SEQ ID NO: 546993 - RNA, 64 nt, hsa
ggccaggaaaauagaugucuugcuguuuucaguauuuucuuaagaaauugcuuuuaaaacaaau

SEQ ID NO: 546994 - RNA, 64 nt, hsa
uuuuucaauuuuuuuguguguguuucuaaggacuuuuucuuagguuugcuaaauacuguaggga

SEQ ID NO: 546995 - RNA, 64 nt, hsa
cagcuggacuuauuuaaaacaacuuguuuuugaguuuucuuauauauauauugauuauuuguuu

SEQ ID NO: 546996 - RNA, 64 nt, hsa
ugacaagcacuuuacuuucacggugguuuuuguuuuuucuuauugcuguggaaccucuuuugga

SEQ ID NO: 546997 - RNA, 64 nt, hsa
ucucuccccugaaaucaaaaccuggaagacuuuuuuuucuuauuuuaguugagaaguuucauaa

SEQ ID NO: 546998 - RNA, 64 nt, hsa
gcguucgcuuguggcaguuacuaacuuucuacaguuuucuuaaucaaaaguggucuagguaacc

SEQ ID NO: 546999 - RNA, 64 nt, hsa
aaggagaaaagacugcccuggcgguccugguggcuuuucuuagcauguguggcacuguugccca

SEQ ID NO: 547000 - RNA, 64 nt, hsa
acguaaaaaacauaauuuuuuucuuuucaagauuuuuucuuaaaaagaugagagaaacauauuu

SEQ ID NO: 547001 - RNA, 64 nt, hsa
ugguuuggguuuuauauuucuuuuucuuuuuuuuuuuucuuacauguaguuuucuauauaacau

SEQ ID NO: 547002 - RNA, 64 nt, hsa
gcaaguguucacaacggugaaacuugagcgucauuuuucuuagugugccaagaguucgauguua

SEQ ID NO: 547003 - RNA, 64 nt, hsa
gugccaagaguucgauguuaguguuuccauuguauuuucuuacagugugccauucuguuagaua

SEQ ID NO: 547004 - RNA, 64 nt, hsa
caaguguucacaacagugaaaaguugagcgucauuuuucuuagugugccaagaguucgauguua

SEQ ID NO: 547005 - RNA, 64 nt, hsa
gugccaagaguucgauguuaguguuuccauuguauuuucuuacacugugccauucuguuagaua

SEQ ID NO: 547006 - RNA, 64 nt, hsa; identical to SEQ ID NO: 547004

SEQ ID NO: 547007 - RNA, 64 nt, hsa
gugccaagaguucgauguuagcguuuacguuguauuuucuuacacugugucauucuguuagaua

SEQ ID NO: 547008 - RNA, 64 nt, hsa
gucuucaagaagucacguuuuucauuuauaacaauuuucuuauaaaaacauguugcuuuuaaaa

SEQ ID NO: 547009 - RNA, 64 nt, hsa
uagaaaagauuaaagcaaaauauucauuuuuacuuuuucuuauuuuuaaaauuaggcugaaugu

SEQ ID NO: 547010 - RNA, 64 nt, hsa
uauuacacaaguuuaaaaauauuauuaacuuguauuuucuuaauauacaaucuaucuuuuccac

SEQ ID NO: 547011 - RNA, 64 nt, hsa
ugcuuggcaaaugagugacaauagaagaaauaauuuuucuuacacauuuuaaaacguuuucucu

SEQ ID NO: 547012 - RNA, 64 nt, hsa
aggacaaguaaacaauuugaugauaagcuacaguuuuucuuagaaaguaaauauuuuauuuaug

SEQ ID NO: 547013 - RNA, 64 nt, hsa
gugcugauuuuauaauugcgcaguuuguuuaguuuuuucuuacuuuuaaauuccaacuuaaaau

SEQ ID NO: 547014 - RNA, 64 nt, hsa
gcauugggugaucauucaccaguacauucucaguuuuucuuaauauauagcauuuaugguaauc

SEQ ID NO: 547015 - RNA, 64 nt, hsa
auaugugaaggaccuucacucuaagauguuauauuuuucuuaaaaaguaacuccuaguaggggu

SEQ ID NO: 547016 - RNA, 64 nt, hsa
uuaaguaauuuaaauuaggguugguauuucauuuuuuucuuaucuaaaucuuaguuuccuggaa

SEQ ID NO: 547017 - RNA, 64 nt, hsa
aaauaucuuucacagaauuuuguuccauaaauguuuuucuuaauuauuaagaaguguuaccuua

SEQ ID NO: 547018 - RNA, 64 nt, hsa
aaguauuuacugagagcuuacugugugcuaggcauuuucuuaauauuucaauguguauuuaauc

SEQ ID NO: 547019 - RNA, 64 nt, hsa
aguuaugaaaaugccaaacuuguuuauuuaauuguuuucuuauguuuuggguguaauaguccuu

SEQ ID NO: 547020 - RNA, 64 nt, hsa
gugacaagaguucgauguuaguguuuccauuguauuuucuuacagugugccauucuguuagaua

SEQ ID NO: 547021 - RNA, 64 nt, hsa
caaguguucacaacagugaaaaguugagcgucguuuuucuuagugugacaagaguucgauguua

SEQ ID NO: 547022 - RNA, 64 nt, hsa
gagguuagagcacuagaaugcaaaagaggauuuauuuucuuaaguuuagguagauaagucagcu

SEQ ID NO: 547023 - RNA, 64 nt, hsa
gauggcaaaaggcuuuuaaaaguugguguuuucuuuuucuuaaaaaaauaauaaaacuacagac

SEQ ID NO: 547024 - RNA, 64 nt, hsa; identical to SEQ ID NO: 76382

SEQ ID NO: 547025 - RNA, 64 nt, hsa; identical to SEQ ID NO: 76383

SEQ ID NO: 547026 - RNA, 64 nt, hsa; identical to SEQ ID NO: 76384

SEQ ID NO: 547027 - RNA, 64 nt, hsa; identical to SEQ ID NO: 76385

SEQ ID NO: 547028 - RNA, 64 nt, hsa; identical to SEQ ID NO: 76386

SEQ ID NO: 547029 - RNA, 64 nt, hsa; identical to SEQ ID NO: 76387

SEQ ID NO: 547030 - RNA, 64 nt, hsa; identical to SEQ ID NO: 76388

SEQ ID NO: 547031 - RNA, 64 nt, hsa; identical to SEQ ID NO: 76389

SEQ ID NO: 547032 - RNA, 64 nt, hsa; identical to SEQ ID NO: 76390

SEQ ID NO: 547033 - RNA, 64 nt, hsa; identical to SEQ ID NO: 76391

SEQ ID NO: 547034 - RNA, 64 nt, hsa; identical to SEQ ID NO: 76392

SEQ ID NO: 547035 - RNA, 64 nt, hsa; identical to SEQ ID NO: 76393

SEQ ID NO: 547036 - RNA, 64 nt, hsa; identical to SEQ ID NO: 76394

SEQ ID NO: 547037 - RNA, 64 nt, hsa; identical to SEQ ID NO: 76395

SEQ ID NO: 547038 - RNA, 64 nt, hsa; identical to SEQ ID NO: 76396

SEQ ID NO: 547039 - RNA, 64 nt, hsa; identical to SEQ ID NO: 76397

SEQ ID NO: 547040 - RNA, 64 nt, hsa; identical to SEQ ID NO: 76398

SEQ ID NO: 547041 - RNA, 64 nt, hsa; identical to SEQ ID NO: 76399

SEQ ID NO: 547042 - RNA, 64 nt, hsa; identical to SEQ ID NO: 76400

SEQ ID NO: 547043 - RNA, 64 nt, hsa; identical to SEQ ID NO: 76401

SEQ ID NO: 547044 - RNA, 64 nt, hsa; identical to SEQ ID NO: 76402

SEQ ID NO: 547045 - RNA, 64 nt, hsa; identical to SEQ ID NO: 76403

SEQ ID NO: 547046 - RNA, 64 nt, hsa; identical to SEQ ID NO: 76404

SEQ ID NO: 547047 - RNA, 64 nt, hsa; identical to SEQ ID NO: 76405

SEQ ID NO: 547048 - RNA, 64 nt, hsa; identical to SEQ ID NO: 76406

SEQ ID NO: 547049 - RNA, 64 nt, hsa; identical to SEQ ID NO: 76407

SEQ ID NO: 547050 - RNA, 64 nt, hsa; identical to SEQ ID NO: 76408

SEQ ID NO: 547051 - RNA, 64 nt, hsa; identical to SEQ ID NO: 76409

SEQ ID NO: 547052 - RNA, 64 nt, hsa; identical to SEQ ID NO: 76410

SEQ ID NO: 547053 - RNA, 64 nt, hsa; identical to SEQ ID NO: 76411

SEQ ID NO: 547054 - RNA, 64 nt, hsa; identical to SEQ ID NO: 76412

SEQ ID NO: 547055 - RNA, 64 nt, hsa; identical to SEQ ID NO: 76413

SEQ ID NO: 547056 - RNA, 64 nt, hsa; identical to SEQ ID NO: 76414

SEQ ID NO: 547057 - RNA, 64 nt, hsa; identical to SEQ ID NO: 76415

SEQ ID NO: 547058 - RNA, 64 nt, hsa; identical to SEQ ID NO: 76416

SEQ ID NO: 547059 - RNA, 64 nt, hsa; identical to SEQ ID NO: 76417

SEQ ID NO: 547060 - RNA, 64 nt, hsa; identical to SEQ ID NO: 76418

SEQ ID NO: 547061 - RNA, 64 nt, hsa; identical to SEQ ID NO: 76419

SEQ ID NO: 547062 - RNA, 64 nt, hsa; identical to SEQ ID NO: 76420

SEQ ID NO: 547063 - RNA, 64 nt, hsa; identical to SEQ ID NO: 76421

SEQ ID NO: 547064 - RNA, 64 nt, hsa; identical to SEQ ID NO: 76422

SEQ ID NO: 547065 - RNA, 64 nt, hsa; identical to SEQ ID NO: 76423

SEQ ID NO: 547066 - RNA, 62 nt, hsa; identical to SEQ ID NO: 76424

SEQ ID NO: 547067 - RNA, 64 nt, hsa; identical to SEQ ID NO: 76425

SEQ ID NO: 547068 - RNA, 64 nt, hsa
ccacaucucacuucugcuuccucaucucagcccacucugaaaaugugcagcacccucacugguu

SEQ ID NO: 547069 - RNA, 64 nt, hsa
ccccccaacgcaaggaggaugcccaauuguugcccucugaaaaugcacaguucuccuggcccua

SEQ ID NO: 547070 - RNA, 64 nt, hsa
acuauaaaagugcaaugacuaagauccuucacuucucugaaaguaaggcccuagaugccucagg

SEQ ID NO: 547071 - RNA, 64 nt, hsa
gcuggucuccaggcugacaaggauucaaaguugucucugaaacuccucuuugucauacugcaca

SEQ ID NO: 547072 - RNA, 64 nt, hsa
caguacacauuguccuuuuuuuaagacgugaaagcucugaaauuacuuuuagaggauauuaauu

SEQ ID NO: 547073 - RNA, 64 nt, hsa
aaauucaaagacccauaaaaggcuuuuaaggauucucugaaagugcugauggcuggauccaauc

SEQ ID NO: 547074 - RNA, 64 nt, hsa
acuguggcuucaagcaccucuguucauagagcgucucugaaauugagucucggucaugacuuau

SEQ ID NO: 547075 - RNA, 64 nt, hsa
cuuuauuuaagauucacuuauuagucugcuguuucucugaaaaauuuuagagcuagguauagug

SEQ ID NO: 547076 - RNA, 64 nt, hsa
auauaacacauuuuuuugcaugcaugcaaaugagcucugaaaucuucccaugcauucuggucaa

SEQ ID NO: 547077 - RNA, 64 nt, hsa
ccagcguggcucuaaaagguaauguguggauugccucugaaaaguguguauauauuuuguguga

SEQ ID NO: 547078 - RNA, 64 nt, hsa
acagccucucaacugcuuugacagagacaaccuccucugaaauauuaaaguucugguauauuuu

SEQ ID NO: 547079 - RNA, 64 nt, hsa
uucauggaucauuuaaugcauucuucaaguuuugcucugaaauuugucuuuuaaaauuauucug

SEQ ID NO: 547080 - RNA, 64 nt, hsa
uagcugaaucuuugguguauugaaauaggcagcacucugaaagacagaagcuucguccagccac

SEQ ID NO: 547081 - RNA, 64 nt, hsa
aauugucuguuaaauuuauuaugcccaaaucaaccucugaaaaaagguuuuuccaggaagauuu

SEQ ID NO: 547082 - RNA, 64 nt, hsa
ucagagaauauaaagugaaugccuuuagggguagcucugaaagagaaacccaacaacuucauuc

SEQ ID NO: 547083 - RNA, 64 nt, hsa
aaaaucaacaaacaaaucaaagccaggcucagagcucugaaauuaaaaagcacugaaauaguua

SEQ ID NO: 547084 - RNA, 64 nt, hsa
cuauaguuuaaaagcacaucuauguucacugccacucugaaaaagggaauuauuucucagucuu

SEQ ID NO: 547085 - RNA, 64 nt, hsa
aagaaacccaagguuggagggugggaugaguacccucugaaaaagggaauuugcuggugaaaag

SEQ ID NO: 547086 - RNA, 64 nt, hsa
auuucuaacaguaccaguguaaauucagucuuuucucugaaaagcaaaggauguguuuucaguc

SEQ ID NO: 547087 - RNA, 64 nt, hsa
cuuucuaucaaauauuaucuuuguucuccuaaugcucugaaaggauguagaaacaauauuuaac

SEQ ID NO: 547088 - RNA, 64 nt, hsa
guguuugaaauuauguccaugaaaucacagggaucucugaaauaucuuuaggaaacuugaaauu

SEQ ID NO: 547089 - RNA, 64 nt, hsa
aaaugguaagguacaaguguguuaaaauugaaaacucugaaaauaacucuuuaaaaagcccucu

SEQ ID NO: 547090 - RNA, 64 nt, hsa
gccaauagguggauuuuacaaaaccacagacaaccucugaaagauucugagacccuuuugagac

SEQ ID NO: 547091 - RNA, 64 nt, hsa
aaguggaaaaucaaacguuuaagaagaauuacaacucugaaaagcauuuauauguggaacuucu

SEQ ID NO: 547092 - RNA, 64 nt, hsa
acaacucagugaauaauuuuugcuuaugugcacacucugaaaccuccauguagaucaaagaaca

SEQ ID NO: 547093 - RNA, 64 nt, hsa
aaaguaucuacuguguaacaggcacuaugcuauucucugaaagaugcagcaguggacaagacag

SEQ ID NO: 547094 - RNA, 64 nt, hsa
ugcauaaaagacuuuuuuuuaacacuuuggacuucucugaaauauuuagaagugcuaauuucug

SEQ ID NO: 547095 - RNA, 64 nt, hsa
cagacaggaaaguuccagaaacuuuaagaacaaacucugaaagaccuaugagcaaauggugcug

SEQ ID NO: 547096 - RNA, 64 nt, hsa
uuugaaaaugauuuaaaguguuuuccuuaauguucucugaaaacaaguuucuuuuguaguuuua

SEQ ID NO: 547097 - RNA, 64 nt, hsa
acuccugucucugugagaauguauacuuuaugcucucugaaauguaugacacccagcuuuaaaa

SEQ ID NO: 547098 - RNA, 64 nt, hsa
gagggacaucuggguggaggaguaaauuccugugcucugaaaugccacuugguagcucuggaca

SEQ ID NO: 547099 - RNA, 64 nt, hsa
cauacuuauaaagaaaacuguauguucacuugaacucugaaaauguacauguauggcuggacgc

SEQ ID NO: 547100 - RNA, 64 nt, hsa
gccugaaguuuuaguauuuguuuucuagguggaccucugaaaaccaaaccaguaccuggggagg

SEQ ID NO: 547101 - RNA, 64 nt, hsa
cacaacacagaacgauguugaccuguuaaguauucucugaaacauggccaaaaugcauuuuaug

SEQ ID NO: 547102 - RNA, 64 nt, hsa
agagauucuugaccuuauuucuaaacgucuagagcucugaaaugucuugauggaagguauuaaa

SEQ ID NO: 547103 - RNA, 64 nt, hsa
uaagugauucagaagagaggagggaaguugugcacucugaaaaugcaugaaaaacaaaggcaaa

SEQ ID NO: 547104 - RNA, 64 nt, hsa
agacucuucuuauugguaauuuuccacacaaucccucugaaauaagggagaggauauagaccuu

SEQ ID NO: 547105 - RNA, 64 nt, hsa
acuuaaagaacuuccuuuauguaaagaucugugacucugaaauauccuccaaaaggagagugca

SEQ ID NO: 547106 - RNA, 64 nt, hsa
auaacaagagcucuguaauaacaguaauaaauagcucugaaauaacaguccuaagaacuccuaa

SEQ ID NO: 547107 - RNA, 64 nt, hsa
ucuuucuguugguugugcccaagggcuacaguagcucugaaauaacaagagcucuguaauaaca

SEQ ID NO: 547108 - RNA, 64 nt, hsa
uuguugaaccaauuuuguuuuuaaaaccuuuagacucugaaaguaauauuuugacuaagaaugu

SEQ ID NO: 547109 - RNA, 64 nt, hsa
gggugcuggauuggaucuuaaagaucccuuccagcucugaaaugcugauuguacaguauauucu

SEQ ID NO: 547110 - RNA, 64 nt, hsa
uaaauuuauguagugaguaaaguugcucucuagucucugaaaagcaaaaaaagugagaaaauaa

SEQ ID NO: 547111 - RNA, 64 nt, hsa
guguggcugagaaagugcggaacuccacuaaaaacucugaaacuucaguauaaauguaaauaua

SEQ ID NO: 547112 - RNA, 64 nt, hsa
auccucucucuaaggcuccaugguuccuacgaagcucugaaaggugggaacaccacagaggcca

SEQ ID NO: 547113 - RNA, 64 nt, hsa
cccaccaggagggggaauucauccuccgggucuucucugaaaagaggaaccucucugagugagu

SEQ ID NO: 547114 - RNA, 64 nt, hsa
cccaaacuacuugaaaagggcauuuggcaccacucucugaaacaacacagucacucuagcaagg

SEQ ID NO: 547115 - RNA, 64 nt, hsa
gguuuguuacuggcuucagaaagcuaauuaagugcucugaaaaagacaccguuucuugaaacaa

SEQ ID NO: 547116 - RNA, 64 nt, hsa
ggcagccuuccaugaggcagaaggggucgucguucucugaaaacagugacucugaaauguuggg

SEQ ID NO: 547117 - RNA, 64 nt, hsa
ggcagaaggggucgucguucucugaaaacagugacucugaaauguugggacaggggaaggggug

SEQ ID NO: 547118 - RNA, 64 nt, hsa
acgcuuuccugaaccuucucagugguuuacaugccucugaaacuaugugcaauauuuuugguug

SEQ ID NO: 547119 - RNA, 64 nt, hsa
uaaguaaaagaaauauaggaauauuccagucaaucucugaaauguuuaugaaaaacagguuaau

SEQ ID NO: 547120 - RNA, 64 nt, hsa
guuaagggcuuuugguauuaaagauauucugaagcucugaaaugcuagaaaaaaauuuggaaug

SEQ ID NO: 547121 - RNA, 64 nt, hsa
ccaaucuuccaagggugccagccccuccguucaucucugaaacccagcauccuuuucagcugcu

SEQ ID NO: 547122 - RNA, 64 nt, hsa
uuccggguuggaacagcagaggcucagaaacuggcucugaaauaggcagaccuagcaagaggaa

SEQ ID NO: 547123 - RNA, 64 nt, hsa
uaugugauuagauauuaauuuaaugauaaaaccacucugaaagcucuucucacuucuggguguu

SEQ ID NO: 547124 - RNA, 64 nt, hsa
gggcccaccccgccccaccccaccccaccccacccucugaaaugugaaaagccugcacucuucc

SEQ ID NO: 547125 - RNA, 64 nt, hsa
uaagccucugcaauuuuaacuucucaaaggaugucucugaaaagaaucacuuuaaaccaaugcc

SEQ ID NO: 547126 - RNA, 64 nt, hsa
aggauuuggagcuuuuaagccaguuucagauuuacucugaaauguggagcauuccugcaagacu

SEQ ID NO: 547127 - RNA, 64 nt, hsa
ucagaagacaggcuggaugagaucucaggccgagcucugaaauagggagguaauccuccagcac

SEQ ID NO: 547128 - RNA, 64 nt, hsa
uguccacguuugucaaaagguggugcuggcccaccucugaaagcagaacacuugcucaacaacc

SEQ ID NO: 547129 - RNA, 64 nt, hsa
uauaccuauguauuuguuuuugauggguuguuuacucugaaauaaaauguaugguuuucuuaaa

SEQ ID NO: 547130 - RNA, 64 nt, hsa
gucuucagcacccucccauguaccuuauaucccucucugaaacagaacagcuccaauagcaaca

SEQ ID NO: 547131 - RNA, 64 nt, hsa; identical to SEQ ID NO: 283773

SEQ ID NO: 547132 - RNA, 64 nt, hsa; identical to SEQ ID NO: 283774

SEQ ID NO: 547133 - RNA, 64 nt, hsa; identical to SEQ ID NO: 283775

SEQ ID NO: 547134 - RNA, 64 nt, hsa; identical to SEQ ID NO: 283776

SEQ ID NO: 547135 - RNA, 64 nt, hsa; identical to SEQ ID NO: 283777

SEQ ID NO: 547136 - RNA, 64 nt, hsa; identical to SEQ ID NO: 283778

SEQ ID NO: 547137 - RNA, 64 nt, hsa; identical to SEQ ID NO: 283779

SEQ ID NO: 547138 - RNA, 64 nt, hsa; identical to SEQ ID NO: 283780

SEQ ID NO: 547139 - RNA, 64 nt, hsa; identical to SEQ ID NO: 283781

SEQ ID NO: 547140 - RNA, 64 nt, hsa; identical to SEQ ID NO: 283782

SEQ ID NO: 547141 - RNA, 64 nt, hsa; identical to SEQ ID NO: 283783

SEQ ID NO: 547142 - RNA, 64 nt, hsa; identical to SEQ ID NO: 283784

SEQ ID NO: 547143 - RNA, 64 nt, hsa; identical to SEQ ID NO: 283785

SEQ ID NO: 547144 - RNA, 64 nt, hsa; identical to SEQ ID NO: 283786

SEQ ID NO: 547145 - RNA, 64 nt, hsa; identical to SEQ ID NO: 283787

SEQ ID NO: 547146 - RNA, 64 nt, hsa; identical to SEQ ID NO: 283788

SEQ ID NO: 547147 - RNA, 64 nt, hsa; identical to SEQ ID NO: 283789

SEQ ID NO: 547148 - RNA, 64 nt, hsa; identical to SEQ ID NO: 283790

SEQ ID NO: 547149 - RNA, 64 nt, hsa; identical to SEQ ID NO: 283791

SEQ ID NO: 547150 - RNA, 64 nt, hsa; identical to SEQ ID NO: 283792

SEQ ID NO: 547151 - RNA, 64 nt, hsa; identical to SEQ ID NO: 283793

SEQ ID NO: 547152 - RNA, 64 nt, hsa; identical to SEQ ID NO: 283794

SEQ ID NO: 547153 - RNA, 64 nt, hsa; identical to SEQ ID NO: 283795

SEQ ID NO: 547154 - RNA, 64 nt, hsa; identical to SEQ ID NO: 283796

SEQ ID NO: 547155 - RNA, 64 nt, hsa; identical to SEQ ID NO: 283797

SEQ ID NO: 547156 - RNA, 64 nt, hsa; identical to SEQ ID NO: 283798

SEQ ID NO: 547157 - RNA, 64 nt, hsa; identical to SEQ ID NO: 283799

SEQ ID NO: 547158 - RNA, 64 nt, hsa; identical to SEQ ID NO: 283800

SEQ ID NO: 547159 - RNA, 64 nt, hsa; identical to SEQ ID NO: 283801

SEQ ID NO: 547160 - RNA, 64 nt, hsa; identical to SEQ ID NO: 283802

SEQ ID NO: 547161 - RNA, 64 nt, hsa; identical to SEQ ID NO: 283803

SEQ ID NO: 547162 - RNA, 64 nt, hsa; identical to SEQ ID NO: 283804

SEQ ID NO: 547163 - RNA, 64 nt, hsa; identical to SEQ ID NO: 283805

SEQ ID NO: 547164 - RNA, 64 nt, hsa; identical to SEQ ID NO: 283806

SEQ ID NO: 547165 - RNA, 64 nt, hsa; identical to SEQ ID NO: 283807

SEQ ID NO: 547166 - RNA, 64 nt, hsa; identical to SEQ ID NO: 283808

SEQ ID NO: 547167 - RNA, 64 nt, hsa; identical to SEQ ID NO: 168567

SEQ ID NO: 547168 - RNA, 64 nt, hsa; identical to SEQ ID NO: 168568

SEQ ID NO: 547169 - RNA, 64 nt, hsa; identical to SEQ ID NO: 168569

SEQ ID NO: 547170 - RNA, 64 nt, hsa; identical to SEQ ID NO: 168570

SEQ ID NO: 547171 - RNA, 64 nt, hsa; identical to SEQ ID NO: 168571

SEQ ID NO: 547172 - RNA, 64 nt, hsa; identical to SEQ ID NO: 168572

SEQ ID NO: 547173 - RNA, 64 nt, hsa; identical to SEQ ID NO: 168573

SEQ ID NO: 547174 - RNA, 64 nt, hsa; identical to SEQ ID NO: 168574

SEQ ID NO: 547175 - RNA, 64 nt, hsa; identical to SEQ ID NO: 168575

SEQ ID NO: 547176 - RNA, 64 nt, hsa; identical to SEQ ID NO: 168576

SEQ ID NO: 547177 - RNA, 64 nt, hsa; identical to SEQ ID NO: 168577

SEQ ID NO: 547178 - RNA, 64 nt, hsa; identical to SEQ ID NO: 168578

SEQ ID NO: 547179 - RNA, 64 nt, hsa; identical to SEQ ID NO: 168579

SEQ ID NO: 547180 - RNA, 64 nt, hsa; identical to SEQ ID NO: 168580

SEQ ID NO: 547181 - RNA, 64 nt, hsa; identical to SEQ ID NO: 168581

SEQ ID NO: 547182 - RNA, 64 nt, hsa; identical to SEQ ID NO: 168582

SEQ ID NO: 547183 - RNA, 64 nt, hsa; identical to SEQ ID NO: 168583

SEQ ID NO: 547184 - RNA, 64 nt, hsa; identical to SEQ ID NO: 168584

SEQ ID NO: 547185 - RNA, 64 nt, hsa; identical to SEQ ID NO: 168585

SEQ ID NO: 547186 - RNA, 64 nt, hsa; identical to SEQ ID NO: 168586

SEQ ID NO: 547187 - RNA, 64 nt, hsa; identical to SEQ ID NO: 168587

SEQ ID NO: 547188 - RNA, 64 nt, hsa; identical to SEQ ID NO: 168588

SEQ ID NO: 547189 - RNA, 64 nt, hsa; identical to SEQ ID NO: 168589

SEQ ID NO: 547190 - RNA, 64 nt, hsa; identical to SEQ ID NO: 168590

SEQ ID NO: 547191 - RNA, 64 nt, hsa; identical to SEQ ID NO: 168591

SEQ ID NO: 547192 - RNA, 64 nt, hsa; identical to SEQ ID NO: 44407

SEQ ID NO: 547193 - RNA, 64 nt, hsa; identical to SEQ ID NO: 44408

SEQ ID NO: 547194 - RNA, 64 nt, hsa; identical to SEQ ID NO: 44409

SEQ ID NO: 547195 - RNA, 64 nt, hsa; identical to SEQ ID NO: 44410

SEQ ID NO: 547196 - RNA, 64 nt, hsa; identical to SEQ ID NO: 44411

SEQ ID NO: 547197 - RNA, 64 nt, hsa; identical to SEQ ID NO: 44412

SEQ ID NO: 547198 - RNA, 64 nt, hsa; identical to SEQ ID NO: 44413

SEQ ID NO: 547199 - RNA, 64 nt, hsa; identical to SEQ ID NO: 44414

SEQ ID NO: 547200 - RNA, 64 nt, hsa; identical to SEQ ID NO: 44415

SEQ ID NO: 547201 - RNA, 64 nt, hsa; identical to SEQ ID NO: 44416

SEQ ID NO: 547202 - RNA, 63 nt, hsa
auuacaauuuaguuuucaguaaucaaaaagauuucuaugaauucuaaaaaauauuuuuuucua

SEQ ID NO: 547203 - RNA, 63 nt, hsa
aaagauuucuaugaauucuaaaaaauauuuuuuucuaugaaauuacuagugcccagcuguaga

SEQ ID NO: 547204 - RNA, 63 nt, hsa
ggcagucagcucuccauccaucccccucuuuaaucuaugaaucuauaggcucgguguguguaa

SEQ ID NO: 547205 - RNA, 63 nt, hsa
ucugcaggacagacagacagacaaacccucugaucuaugaagucucugcagggcaaggggacc

SEQ ID NO: 547206 - RNA, 63 nt, hsa
uggaggauauauuuuggagaaugcuucauaaaaucuaugaauacuguacaaugcugauaauaa

SEQ ID NO: 547207 - RNA, 63 nt, hsa
gccaucuggaggaaauaaaaaaaaaaggaagacucuaugaagaaacagagaagucucagaaaa

SEQ ID NO: 547208 - RNA, 63 nt, hsa
caggcucuaugaauguacauggaaugaccaggcucuaugaauguacauggaaaaccccuaaaa

SEQ ID NO: 547209 - RNA, 63 nt, hsa
uacgcaacaaggacuccucgcugcugaccaggcucuaugaauguacauggaaugaccaggcuc

SEQ ID NO: 547210 - RNA, 63 nt, hsa
uuuccacauugaaacacuuugcagacacaaauaucuaugaaaagaugcuuugucagccacugu

SEQ ID NO: 547211 - RNA, 63 nt, hsa
aaaaaauaagagacuauuuguuuucuuuuaauuucuaugaauaaaagaaauuuuuaaaaacuu

SEQ ID NO: 547212 - RNA, 63 nt, hsa
ucauucaauuuacuuguuuuuaauacaugauucucuaugaaauugaugggcucaaacuagcug

SEQ ID NO: 547213 - RNA, 63 nt, hsa
gucccguguguccuaaaaaucuccuaaaaccagucuaugaacucagggcuuuaaaacauuuuu

SEQ ID NO: 547214 - RNA, 63 nt, hsa
auucuuuuuuauuaggcauuauuuaugaccuuuucuaugaaaagauaaggacauuaaaaugua

SEQ ID NO: 547215 - RNA, 63 nt, hsa
aaguuagucauauguuauuuuauuaauuguacuucuaugaaauaauaugcagucuauuuuuaa

SEQ ID NO: 547216 - RNA, 63 nt, hsa
aaaaaaaauaaaaaaaaagaaaaagaaauaaacucuaugaauguaaaccauguggugaaggcu

SEQ ID NO: 547217 - RNA, 63 nt, hsa
gucaugaaagaacucacacuggagagaagaaacucuaugaaugcaagcagugugggaaagcgu

SEQ ID NO: 547218 - RNA, 64 nt, hsa; identical to SEQ ID NO: 129010

SEQ ID NO: 547219 - RNA, 64 nt, hsa; identical to SEQ ID NO: 129011

SEQ ID NO: 547220 - RNA, 64 nt, hsa; identical to SEQ ID NO: 290755

SEQ ID NO: 547221 - RNA, 64 nt, hsa; identical to SEQ ID NO: 290756

SEQ ID NO: 547222 - RNA, 64 nt, hsa; identical to SEQ ID NO: 225462

SEQ ID NO: 547223 - RNA, 64 nt, hsa; identical to SEQ ID NO: 225463

SEQ ID NO: 547224 - RNA, 64 nt, hsa; identical to SEQ ID NO: 225464

SEQ ID NO: 547225 - RNA, 64 nt, hsa; identical to SEQ ID NO: 225465

SEQ ID NO: 547226 - RNA, 64 nt, hsa; identical to SEQ ID NO: 225466

SEQ ID NO: 547227 - RNA, 64 nt, hsa; identical to SEQ ID NO: 225467

SEQ ID NO: 547228 - RNA, 64 nt, hsa; identical to SEQ ID NO: 225468

SEQ ID NO: 547229 - RNA, 64 nt, hsa; identical to SEQ ID NO: 225469

SEQ ID NO: 547230 - RNA, 56 nt, hsa; identical to SEQ ID NO: 225470

SEQ ID NO: 547231 - RNA, 64 nt, hsa; identical to SEQ ID NO: 225471

SEQ ID NO: 547232 - RNA, 64 nt, hsa; identical to SEQ ID NO: 225472

SEQ ID NO: 547233 - RNA, 64 nt, hsa; identical to SEQ ID NO: 225473

SEQ ID NO: 547234 - RNA, 64 nt, hsa; identical to SEQ ID NO: 225474

SEQ ID NO: 547235 - RNA, 64 nt, hsa; identical to SEQ ID NO: 225475

SEQ ID NO: 547236 - RNA, 64 nt, hsa; identical to SEQ ID NO: 225476

SEQ ID NO: 547237 - RNA, 64 nt, hsa; identical to SEQ ID NO: 225477

SEQ ID NO: 547238 - RNA, 64 nt, hsa; identical to SEQ ID NO: 225478

SEQ ID NO: 547239 - RNA, 64 nt, hsa; identical to SEQ ID NO: 225479

SEQ ID NO: 547240 - RNA, 64 nt, hsa; identical to SEQ ID NO: 225480

SEQ ID NO: 547241 - RNA, 64 nt, hsa; identical to SEQ ID NO: 225481

SEQ ID NO: 547242 - RNA, 64 nt, hsa; identical to SEQ ID NO: 225482

SEQ ID NO: 547243 - RNA, 64 nt, hsa; identical to SEQ ID NO: 225483

SEQ ID NO: 547244 - RNA, 64 nt, hsa; identical to SEQ ID NO: 225484

SEQ ID NO: 547245 - RNA, 64 nt, hsa; identical to SEQ ID NO: 225485

SEQ ID NO: 547246 - RNA, 64 nt, hsa; identical to SEQ ID NO: 225486

SEQ ID NO: 547247 - RNA, 64 nt, hsa; identical to SEQ ID NO: 225487

SEQ ID NO: 547248 - RNA, 64 nt, hsa
ccguauugacugcagagucuauuuaagcaugugguuuuaaaaauagacaguauuuuuuaaaaau

SEQ ID NO: 547249 - RNA, 64 nt, hsa
auuuaagcaugugguuuuaaaaauagacaguauuuuuuaaaaaucaaaaaaugacuugcaaauu

SEQ ID NO: 547250 - RNA, 64 nt, hsa
uuuuuaaaaaucaaaaaaugacuugcaaauuguuuuuuaaaaguaauuuugcauugcuuugaaa

SEQ ID NO: 547251 - RNA, 64 nt, hsa
uuucagggaaaugaagauggaauuugaaggucacuuuuaaaauuaagucauugaugcugcuguu

SEQ ID NO: 547252 - RNA, 64 nt, hsa
ugacuuaggucuuucaguuuuccuuucgguucccuuuuaaaaaugugauuguuaaccugccucu

SEQ ID NO: 547253 - RNA, 64 nt, hsa
aaacuacuugggcagagcaaaggaaaaccucuuguuuuaaaaaaauuuuuuucagaguguuuug

SEQ ID NO: 547254 - RNA, 64 nt, hsa
agagggaggacacaucuggaggaaauggccuucuuuuuaaaagcaaaaaacacaaaaccucaca

SEQ ID NO: 547255 - RNA, 64 nt, hsa
guuaucuuaaaauauacacuccuaagcaguauuauuuuaaaauccuuuacccuggcuaccuccc

SEQ ID NO: 547256 - RNA, 64 nt, hsa
gugccauucauuuggaacuuuauugcauucuuuauuuuaaaaagcuuguuuuuacguaaucaua

SEQ ID NO: 547257 - RNA, 64 nt, hsa
gcugaaaauaaaacuuugcuauguauuuacucuuuuuuaaaagacaaaagcaaaaccagacuuu

SEQ ID NO: 547258 - RNA, 64 nt, hsa
gagaggggagcauccauuauugauacaugugggcuuuuaaaaacuccauccuuuauaaauaguc

SEQ ID NO: 547259 - RNA, 64 nt, hsa
uaguggugauuuggggaaggaaaguuaaugagguuuuuaaaauaagguuuucuaguuuugagag

SEQ ID NO: 547260 - RNA, 64 nt, hsa
uuggugacaaaaaugaaggagcuuuguaaauuuuuuuuaaaauuaugaaucauaucaaguaguu

SEQ ID NO: 547261 - RNA, 64 nt, hsa
uggugcucaccaaacgaaggguaucagcuauuuuuuuuaaaauucaaaaagaauaucccuuuua

SEQ ID NO: 547262 - RNA, 64 nt, hsa
uggcaucauguugaagcaccgaaagauaaaugauuuuuaaaaggcuauagaguccaaaggaaua

SEQ ID NO: 547263 - RNA, 64 nt, hsa
uuuuucuagauuguuaaaauuggcaaaugaacuuuuuuaaaaaucaucuuccauguugcaguua

SEQ ID NO: 547264 - RNA, 64 nt, hsa
guugauuacauaaguaaguauuccccauauaaucuuuuaaaaaguuguguaugauuauuuuaaa

SEQ ID NO: 547265 - RNA, 64 nt, hsa
cccauauaaucuuuuaaaaaguuguguaugauuauuuuaaaaucucucucucuauauauaccug

SEQ ID NO: 547266 - RNA, 64 nt, hsa
cagcaaaggccauaaccuuuugggauuuuuuuuuuuuuaaaauacuuuagggacuguuguaauu

SEQ ID NO: 547267 - RNA, 64 nt, hsa
gaaaauggcaaacuacuacuacuacuguucaguuuuuuaaaaguuuugaaaugcugcacuuaca

SEQ ID NO: 547268 - RNA, 64 nt, hsa
acacuuggauuuacaccagucuuuuguguuugcuuuuuaaaauaaagugcucguauuuguauuc

SEQ ID NO: 547269 - RNA, 64 nt, hsa
ucaaacuuagaggugugaccuuaaauuuaacuuuuuuuaaaaacugggaggucaauaaaauuua

SEQ ID NO: 547270 - RNA, 64 nt, hsa
uagacccauuaaauuauuacagugggcuuuuuuguuuuaaaagugguuggggauccacaggaac

SEQ ID NO: 547271 - RNA, 64 nt, hsa
ucuucaaagguucaugcucaauauugugaaaagcuuuuaaaaguuguuuugaaaagacaaucau

SEQ ID NO: 547272 - RNA, 64 nt, hsa
uuuacuuuaaagcugucagacucuuuuaaggguauuuuaaaaauuaguaaauuugaaugaacua

SEQ ID NO: 547273 - RNA, 64 nt, hsa
cauuuuucagccaucaguucaagagccaaugccuuuuuaaaauaaagcuucuguggucuuguuu

SEQ ID NO: 547274 - RNA, 64 nt, hsa
aauuguugcaguguuggagaugccauuuucaccuuuuuaaaaagaugcauuuuauuugcagguu

SEQ ID NO: 547275 - RNA, 64 nt, hsa
ugaagaaacaacccaucguucuuuuuuuucucuuuuuuaaaaaguccuauaagaucuguuuuug

SEQ ID NO: 547276 - RNA, 64 nt, hsa
aauaaggaucaauuguaauauucauucaaaagguuuuuaaaaguaaguuuuaaggaguauuucu

SEQ ID NO: 547277 - RNA, 64 nt, hsa
auaauagaguaagauacacuuuuuagcagugaacuuuuaaaaaauucuuuuacuuuuaacuucu

SEQ ID NO: 547278 - RNA, 64 nt, hsa
uuaaaggaagagcauauugcaauaauaaaaauauuuuuaaaauuauguucagguuauuuauuga

SEQ ID NO: 547279 - RNA, 64 nt, hsa
gaaagaguucaguucuguaguaucugaauuugucuuuuaaaaugaguacauauauaggcaauaa

SEQ ID NO: 547280 - RNA, 64 nt, hsa
ugaagugcauuuggaugagauagaagaaauuguuuuuuaaaaaguuuaaguaccaaagguaguc

SEQ ID NO: 547281 - RNA, 64 nt, hsa
uauguaaaugccuuauaugcacaggcucaaguuguuuuaaaaaucucauuuauuauaauauuga

SEQ ID NO: 547282 - RNA, 64 nt, hsa
caguggcucauuuauaccuaauaaaauaaugguauuuuaaaauaaugcuacuuucaaaguagca

SEQ ID NO: 547283 - RNA, 64 nt, hsa
gcugcuaaguaguucucuguauuaaaggagauauuuuuaaaacaggguacaacccccugcugca

SEQ ID NO: 547284 - RNA, 64 nt, hsa
ugcuucaucaaaacaucuuguucauguuuuauguuuuuaaaaaaggcauuugaaugaauguuug

SEQ ID NO: 547285 - RNA, 64 nt, hsa
ugguacuguacgauccaaaacauuguacccagcuuuuuaaaagagagaaauuaucacuacaacu

SEQ ID NO: 547286 - RNA, 64 nt, hsa
cugcuuucauucccacaaaaccaguauuacuuuuuuuuaaaaaaagaaagaaauuggaaaucug

SEQ ID NO: 547287 - RNA, 64 nt, hsa
uaucuucacagaaaauaaaagguguuaauuugcuuuuuaaaacaaauuuaauuaucacauuuua

SEQ ID NO: 547288 - RNA, 64 nt, hsa
acaaaacucguaucugaguguaacuuugccaauauuuuaaaagccaaaauauucucuggacaac

SEQ ID NO: 547289 - RNA, 64 nt, hsa
uauuuugucucucugacuugauuucuauaaaugcuuuuaaaaacaagugaagccccucuuuauu

SEQ ID NO: 547290 - RNA, 64 nt, hsa
uuguuuguuuauaaacucagacuugccuauuuuauuuuaaaagcggcuuacacaaucucccuuu

SEQ ID NO: 547291 - RNA, 64 nt, hsa
aaaugaagcaccaugaauucuuuuuuaaauuauuuuuuaaaagucuuucucucucugauucagc

SEQ ID NO: 547292 - RNA, 64 nt, hsa
auauaauaagugcauguaggaauugcaaaaaauauuuuaaaaauuuauuacugaauuuaaaaau

SEQ ID NO: 547293 - RNA, 64 nt, hsa
cagccuaccaggaacauguuguguuuucuuuauuuuuuaaaaucauuauauugaguuguguuuu

SEQ ID NO: 547294 - RNA, 64 nt, hsa
aaaugagccuggcaagaauguguuuaaacuugguuuuuaaaaaacugcugacuguuuucucuug

SEQ ID NO: 547295 - RNA, 64 nt, hsa
ccugaaagcccugagcuuucugcuaucaaagagguuuuaaaaaaaucccauuuaaaaaaaaucc

SEQ ID NO: 547296 - RNA, 64 nt, hsa
agcacaguaucaguaccauuuauuugucugccgcuuuuaaaaaauacccauuggcuaugccacu

SEQ ID NO: 547297 - RNA, 64 nt, hsa
cccauuuucugaauuuuuuuuuaaauuuccccccuuuuaaaauuguucgaaagcccacaguuau

SEQ ID NO: 547298 - RNA, 64 nt, hsa
gguucagcccacccacccccaugauuguaugaaguuuuaaaaaaaacuacagcagccaaagaaa

SEQ ID NO: 547299 - RNA, 64 nt, hsa
acaagcucucaauuuuguucauuuauuaucaaauuuuuaaaauacaaguuugguaugugauuug

SEQ ID NO: 547300 - RNA, 64 nt, hsa
ccuuuuuauuucauaagacugcuaggaagugauuuuuuaaaauuaggacuccuuaagaauaaac

SEQ ID NO: 547301 - RNA, 64 nt, hsa
ugaauggaaccaaugugcaagauacauacugcauuuuuaaaauagugucucagcuaaauggaaa

SEQ ID NO: 547302 - RNA, 64 nt, hsa
guguauuuuauguccauuugaguagguagguagguuuuaaaaauacuaguuaaaaugccacaag

SEQ ID NO: 547303 - RNA, 64 nt, hsa
uggaaauaauggaguuuauagagaaaagauauauuuuuaaaagcucuaggucagaaguacuaca

SEQ ID NO: 547304 - RNA, 64 nt, hsa
uuaaaagcucuaggucagaaguacuacacagugcuuuuaaaaaguguuuaaugagaguuuacag

SEQ ID NO: 547305 - RNA, 64 nt, hsa
uggaagcugcauguaacaaaucauuauuaucuauuuuuaaaagcuucaaaaugaugggauauga

SEQ ID NO: 547306 - RNA, 64 nt, hsa
agguauuguaaaugacaagauaccaaauacaagauuuuaaaagcaaccauggggagaaaaagau

SEQ ID NO: 547307 - RNA, 64 nt, hsa
aaacauuucucaccaacuuucuuauguguguucuuuuuaaaaauuuuuuuucuuuuaaaauauu

SEQ ID NO: 547308 - RNA, 64 nt, hsa
uucuuauguguguucuuuuuaaaaauuuuuuuucuuuuaaaauauuuaacaguucaaucucaau

SEQ ID NO: 547309 - RNA, 64 nt, hsa
auagaagcaauuucuguuuacauguccuugcuacuuuuaaaaacuugcauuuauuccucagauu

SEQ ID NO: 547310 - RNA, 64 nt, hsa
ugcuacuuuuaaaaacuugcauuuauuccucagauuuuaaaaauaaauaaauaauucauuuaag

SEQ ID NO: 547311 - RNA, 64 nt, hsa
aucucaacuauaaccaguuuagcuuuuuccuuacuuuuaaaauaaaauuuuuuacuuuuaacua

SEQ ID NO: 547312 - RNA, 64 nt, hsa
auuuuuuacuuuuaacuauuuuuuuaguuaauauuuuuaaaaguauacaugucaauggccucuu

SEQ ID NO: 547313 - RNA, 64 nt, hsa
uuuugccagaacaguuuguacagacguaugcuuauuuuaaaauuuuaucucuuauucaguaaaa

SEQ ID NO: 547314 - RNA, 64 nt, hsa
uauuagaaguguuaacuuagcuugaaggaucuguuuuuaaaaaucauaaacugugugcagacuc

SEQ ID NO: 547315 - RNA, 64 nt, hsa
aauuuuuaaacauguacaaagggcuacauuuuaauuuuaaaauagcuucacauuauuuuacuua

SEQ ID NO: 547316 - RNA, 64 nt, hsa
aaagaacuaaugucucauaugauguauuuacuuauuuuaaaaaaaagaauaggaaugagauguc

SEQ ID NO: 547317 - RNA, 64 nt, hsa
uuuuuauuauggugcagcuuuuuuuuaauuauguuuuuaaaauuauacaguugaaaaauaugcc

SEQ ID NO: 547318 - RNA, 64 nt, hsa
ccugacagguuacccuugagggcuugugucuacuuuuuaaaagucaaugguuuuuuuucuugug

SEQ ID NO: 547319 - RNA, 64 nt, hsa
ggcaugacaggugacuuaguauauuuguaauugguuuuaaaaccaauacaccauacuuucuuuc

SEQ ID NO: 547320 - RNA, 64 nt, hsa
ggagggaaggaacaggcccaugggaagaaggggguuuuaaaaacaugucuucaacucagcagag

SEQ ID NO: 547321 - RNA, 64 nt, hsa
ggcagguuuauguugauguuuacccacuacaauuuuuuaaaaauauaagcucacaugccuuuuc

SEQ ID NO: 547322 - RNA, 64 nt, hsa
ggaauuucugguuuguaagguggucacuguucuuuuuuaaaauauuuguaauauggaaugggcu

SEQ ID NO: 547323 - RNA, 64 nt, hsa
cuuuuguauggauucagaauauacuaaauuaacuuuuuaaaacacaacuuuuaaaaaauguauc

SEQ ID NO: 547324 - RNA, 64 nt, hsa
cagaauauacuaaauuaacuuuuuaaaacacaacuuuuaaaaaauguaucaaaauaauaaacgu

SEQ ID NO: 547325 - RNA, 64 nt, hsa
gcuagaaaguguauguguggcauuuguuuucacuuuuuaaaacaucccuaacugaucgaauaua

SEQ ID NO: 547326 - RNA, 64 nt, hsa
aagucucacugauagagguucuuuauugcucauuuuuuaaaaaauggacucuugaaaucuguua

SEQ ID NO: 547327 - RNA, 64 nt, hsa
cagucauuuuaugaaaaaucaaaauuauaagugauuuuaaaaaccagaauuuuaguugcaauac

SEQ ID NO: 547328 - RNA, 64 nt, hsa
auuuucauacaggaauuuuuuuaauauguuauuuuuuuaaaaguucauuuuucauuugccuccg

SEQ ID NO: 547329 - RNA, 64 nt, hsa
uuaaguuaaggauguuuggcuuuuuucuuuaauuuuuuaaaaaccauuuuccuauguuaggagu

SEQ ID NO: 547330 - RNA, 64 nt, hsa
uuaucauuuuugagaaaucuacaccaaagugguuuuuuaaaauuacauaacuaaaaauaaacca

SEQ ID NO: 547331 - RNA, 64 nt, hsa
aauguucuucccuguuauuuacauucugguggguuuuuaaaauucuuaccuccaucaugcaauu

SEQ ID NO: 547332 - RNA, 64 nt, hsa
ccuuuacaauuguagcauggaccuuuaaaaauuguuuuaaaaucuuauuuaaauuuaaaccaga

SEQ ID NO: 547333 - RNA, 64 nt, hsa
uacugugauguagcuuucuucuguaacaguuauguuuuaaaauuaagugaguuuuuuuuuugcc

SEQ ID NO: 547334 - RNA, 64 nt, hsa
uacuguaaggagggaaauggaugaaucuggcucguuuuaaaaucacguuuucugacgaauccuu

SEQ ID NO: 547335 - RNA, 64 nt, hsa
aaucaucaggacuaucucacccucccacuccuguuuuuaaaacucagaauucuuuccuaagagc

SEQ ID NO: 547336 - RNA, 64 nt, hsa
aaauauaguuugguaauuuuuuuuuccaguugauuuuuaaaaagaacugcuguacagagcuugu

SEQ ID NO: 547337 - RNA, 64 nt, hsa
guauguuaauugcaauuacugguuggggggugcauuuuaaaagaugaaacaugcagcuucccua

SEQ ID NO: 547338 - RNA, 64 nt, hsa
uacauacugcagcagaaccagcaauacacuugauuuuuaaaagcacauuuagugaaauguuuuc

SEQ ID NO: 547339 - RNA, 64 nt, hsa
uugaaaauaaugaucucagacuuucuaaguuaaauuuuaaaaauuuugauuguuugccauauug

SEQ ID NO: 547340 - RNA, 64 nt, hsa
uuguagcaagauuuuggaagcauucauauuuccuuuuuaaaauguauuccuuuguguucaacag

SEQ ID NO: 547341 - RNA, 64 nt, hsa
caucgucuuuguuuucuuuuuugucuugaaugaauuuuaaaaggaaauauauaauaaaaauguu

SEQ ID NO: 547342 - RNA, 64 nt, hsa
cugcauuagaauuuacggugucuaaaauucauguuuuuaaaagagcuugccuacagaugguuuc

SEQ ID NO: 547343 - RNA, 64 nt, hsa
guggaggugugggcugaagguagugacuguuugauuuuaaaaagugugacugucaguuguaucu

SEQ ID NO: 547344 - RNA, 64 nt, hsa
cggguuguccaauucuguaacauucaucuccauuuuuuaaaaagguuucucugacggccccacg

SEQ ID NO: 547345 - RNA, 64 nt, hsa
ucgauacagauggauaaacugccaagaaccagauuuuuaaaaggccgcaaaaaaucuuuuccug

SEQ ID NO: 547346 - RNA, 64 nt, hsa
aaaggucauuuuguugcauuuccccauuucuuguuuuuaaaagaccaacaaaucucaagcccua

SEQ ID NO: 547347 - RNA, 64 nt, hsa
aaguauugcuuucuacaaauaauugcccccuuuguuuuaaaaagaagaaaugcauauugaagua

SEQ ID NO: 547348 - RNA, 64 nt, hsa
aggugugagccauggcacccggucuugguuuauauuuuaaaaagacaacuguguagcugggcgu

SEQ ID NO: 547349 - RNA, 64 nt, hsa
aaguucuucugguucauccaguaaucucuuucuuuuuuaaaaauguggcgacaaggucuugcuc

SEQ ID NO: 547350 - RNA, 64 nt, hsa
aguuaucuacuagauuauuuccucuaauaaaaucuuuuaaaauagucuacuggaaucucuuuca

SEQ ID NO: 547351 - RNA, 64 nt, hsa
ggcgugggagagcagacuggauagaugagaauuguuuuaaaacaauugugaacagaaacugaag

SEQ ID NO: 547352 - RNA, 64 nt, hsa
accugcaguugggagccagcuacaacccaaaucauuuuaaaauuuucaauucuuugaucucaug

SEQ ID NO: 547353 - RNA, 64 nt, hsa
aauucaagaucaacaaagcauuccucaagaucacuuuuaaaaaagguuagaagugaagcaaaua

SEQ ID NO: 547354 - RNA, 64 nt, hsa
aaaguccuaaucuaaaguccugcucccugucacuuuuuaaaagccaggguagcaguaacaugac

SEQ ID NO: 547355 - RNA, 64 nt, hsa
uaauagacaucuaaaauuccacuccucauagagcuuuuaaaaugguuucauuggauauaggccu

SEQ ID NO: 547356 - RNA, 59 nt, hsa
uugcucauucugaaauuuaagcauuuuucuuuuaaaagacaaguguaauagacaucuaa

SEQ ID NO: 547357 - RNA, 64 nt, hsa
uagaaauguucuaccuguauaugguaauguccaguuuuaaaaauauuggacaucuucaaucuua

SEQ ID NO: 547358 - RNA, 64 nt, hsa
uucugccacauuuauugauaaacagugaaggaauuuuuaaaaaauuuuuaagaauuguuuguca

SEQ ID NO: 547359 - RNA, 64 nt, hsa
gcuauauuuacuuuuuaaaugcuugaguuucccauuuuaaaaucuaaacuagacaucuuaauug

SEQ ID NO: 547360 - RNA, 64 nt, hsa
auaccauucacaccuaaagacugaauuuuaucuguuuuaaaaaugaacuucucccgcuacacag

SEQ ID NO: 547361 - RNA, 64 nt, hsa
cuaguuuuuuuuuuucuucuaaaaaaugucagguuuuuaaaaucauuuaccuuauuaaaaugaa

SEQ ID NO: 547362 - RNA, 64 nt, hsa
aauuuuguacaaucuguccuggaaagcaaaccccuuuuaaaaucuaaugucugggcuuugagua

SEQ ID NO: 547363 - RNA, 64 nt, hsa
uggguuacuguuuaaggaaaguugaucugggccuuuuuaaaaacauaauuauauacuuuagaaa

SEQ ID NO: 547364 - RNA, 64 nt, hsa
uucaaacugguacacauuagacucacccgaggaauuuuaaaacagccuauaugcccagggccua

SEQ ID NO: 547365 - RNA, 64 nt, hsa
uccacuuuugaucuauuuauauauauguauguguuuuuaaaauauguguauauuuuaucagauu

SEQ ID NO: 547366 - RNA, 64 nt, hsa
guauaaucugaaguggaaauuguuugcuuagaguuuuuaaaaaccuagucuuugaaaagcaguu

SEQ ID NO: 547367 - RNA, 64 nt, hsa
auaguaaaauauaugcucacgaaucaaugcugauuuuuaaaauauguauaaucugaaguggaaa

SEQ ID NO: 547368 - RNA, 64 nt, hsa
cucaaauuggaaagaaagauuccuugagacguacuuuuaaaaucuaaagugugaaagaaacagc

SEQ ID NO: 547369 - RNA, 64 nt, hsa
agauuuuuauuuuguauauguagaauauuauaauuuuuaaaaggacuauugaugauagaagaau

SEQ ID NO: 547370 - RNA, 64 nt, hsa
ggguguaguuaucauuuauacaguaaucauugcauuuuaaaaucuucucuugaaaggaagaaua

SEQ ID NO: 547371 - RNA, 64 nt, hsa
auuuaaugucuuugcaacuuuaugcugggauuguuuuuaaaaaaacuuuaaugaggaaagcuau

SEQ ID NO: 547372 - RNA, 64 nt, hsa
uugagaccuauaauucaccaauaacuguuuauauuuuuaaaagcaauauuuaaugucuuugcaa

SEQ ID NO: 547373 - RNA, 64 nt, hsa
cagacacgagccaccucaccuagccugaugagauuuuuaaaaaauauuuucucuguacuuuuca

SEQ ID NO: 547374 - RNA, 64 nt, hsa
ggcuguaaucauuuguuuacauuugaugcaugucuuuuaaaaugcaauguaagcauacuuugua

SEQ ID NO: 547375 - RNA, 64 nt, hsa
cacgugaaacuauuuaugugaaguccuuguuuuauuuuaaaauucucuuuguguauuuggaauc

SEQ ID NO: 547376 - RNA, 64 nt, hsa
uuuaaaggacuaugauugauaaaguauuuaauucuuuuaaaaauuauauucaucucagcuuucu

SEQ ID NO: 547377 - RNA, 64 nt, hsa
ugcaggugucuuggucaugauaaauugugauucuuuuuaaaaauuuuuuccaaaaacaauuagg

SEQ ID NO: 547378 - RNA, 64 nt, hsa
cuauuuacccuuuacauuuuuguaucauaauagauuuuaaaaaucuaauguucuuuauugcaag

SEQ ID NO: 547379 - RNA, 64 nt, hsa
agaguacuauucuaucuagauguguaaguguuuuuuuuaaaaucacauggaacgguuuuuuuua

SEQ ID NO: 547380 - RNA, 64 nt, hsa
uaugucuccucaaaugaaaauucuuuaucugaaauuuuaaaagacauugauuccacauguaagg

SEQ ID NO: 547381 - RNA, 64 nt, hsa
uuaacagcucauuuugucuuuuucaauauacaaauuuuaaaaauacuacaauauuuaacuaagg

SEQ ID NO: 547382 - RNA, 64 nt, hsa
agaagagcagcuuagauuucccuacuggcaagguuuuuaaaaaugagguaaaugccguauauga

SEQ ID NO: 547383 - RNA, 64 nt, hsa
cacauuuucucuaacccuuaacuaaaguguaggauuuuaaaauuaaaugugagguaaaauaagu

SEQ ID NO: 547384 - RNA, 64 nt, hsa
uggaugggaugcaugacauacagguagcucucuuuuuuaaaauauagguaucucuuugcauaua

SEQ ID NO: 547385 - RNA, 64 nt, hsa
aaaguuuuaagaauuguuccuuggggaaaaauuuuuuuaaaauucaccuagaaucauagggccu

SEQ ID NO: 547386 - RNA, 64 nt, hsa
guuuuauuaugcaguuaaaucuguaucaguggacuuuuaaaacuugguacuacuacuaaaucua

SEQ ID NO: 547387 - RNA, 64 nt, hsa
agauuaagugcuuuugucauuugagcugacaaguuuuuaaaacuucagugcuuccuaaauguuu

SEQ ID NO: 547388 - RNA, 64 nt, hsa
caacauagugagaucccaucucaaaaaacauuauuuuuaaaauuagccugguggcucacgccug

SEQ ID NO: 547389 - RNA, 64 nt, hsa
aauaucuacuugguuuuucucaaaauggaaauaauuuuaaaaucaggaaagaauaaaucagcca

SEQ ID NO: 547390 - RNA, 64 nt, hsa
guacuuuaaauguagcagccacugacauuucuuuuuuuaaaaaaaauuugagaagucuacuucc

SEQ ID NO: 547391 - RNA, 64 nt, hsa
uauaaagaccuauaaaucauuaagacaacugaguuuuuaaaaauggacaaaauccaugaacaau

SEQ ID NO: 547392 - RNA, 64 nt, hsa
ugccuguggaguagccauucuuuauucuuuuacuuuuuaaaauaauaacaaucacaaaggaaag

SEQ ID NO: 547393 - RNA, 64 nt, hsa
guggccuuaguuuguuuauugacauuaacgaguguuuuaaaaagguuuuuaaugaauagucuua

SEQ ID NO: 547394 - RNA, 64 nt, hsa
uaucuuucuaaucuguuuuaucauugcuacagguuuuuaaaaaagaaccuuucacuagcuagca

SEQ ID NO: 547395 - RNA, 64 nt, hsa
gugcaaaguaaaauucuucucaggcaacauuugcuuuuaaaaauaaucaugaagagaaggcugu

SEQ ID NO: 547396 - RNA, 64 nt, hsa
auaggcaaaccauuucuuaaaguugauggccaaauuuuaaaauguuauuuuucauaucauuuau

SEQ ID NO: 547397 - RNA, 64 nt, hsa
uucugaggaccauaugaggguagaauauauuaucuuuuaaaaauuacaaaaauuuguauaggca

SEQ ID NO: 547398 - RNA, 64 nt, hsa
ccugaagggcauaccuaaccucaauaguguuggcuuuuaaaacguauguuuguaugguagagaa

SEQ ID NO: 547399 - RNA, 64 nt, hsa
aaggguugaguaacuuagaacugaaaaugaucucuuuuaaaaagaaauuaaaucagacaccaca

SEQ ID NO: 547400 - RNA, 64 nt, hsa
cauuacauacuaugccagauuacaaaauacuuauuuuuaaaaugaaaucuauauauugacuuuc

SEQ ID NO: 547401 - RNA, 64 nt, hsa
uggaauccccaaaaagauaacauuuuucuucugcuuuuaaaaacugaaauucccuguucuaguu

SEQ ID NO: 547402 - RNA, 64 nt, hsa
acucugcaaaguauuucuaaccuuuaauucccaguuuuaaaacagauauaauaauagcauuuaa

SEQ ID NO: 547403 - RNA, 64 nt, hsa
uugcuuuucucucuuccacaaaauuggaagcuuuuuuuaaaaauguuuuccccacaagucaucu

SEQ ID NO: 547404 - RNA, 64 nt, hsa
gggagggggguuaauggaacugggucugggauuauuuuaaaauuauauauauauauauaaagau

SEQ ID NO: 547405 - RNA, 64 nt, hsa
uuuuuaaaauuaaguaauuuuuuaaagaaggcacuuuuaaaauuaacacacacaugaacugcac

SEQ ID NO: 547406 - RNA, 64 nt, hsa
gaaagucaccugaggaaguuuccccacuuuuauuuuuuaaaauuaaguaauuuuuuaaagaagg

SEQ ID NO: 547407 - RNA, 64 nt, hsa
auucuuuguaaaauucucccucaccccacccugcuuuuaaaaauucuaaucuauccccucuaac

SEQ ID NO: 547408 - RNA, 64 nt, hsa
uuaagguguacguaucauuucuaauuuuaaguuauuuuaaaaaaauucaucauaugaauguucu

SEQ ID NO: 547409 - RNA, 64 nt, hsa
gaugacuuuuuuucugauucaaaagugaacuugauuuuaaaaaccagucaagagcaaucaaagc

SEQ ID NO: 547410 - RNA, 64 nt, hsa
caaaacaugacccauaguauuaaauacauaucauuuuuaaaaauaaaaaaaaacccaaaaauaa

SEQ ID NO: 547411 - RNA, 64 nt, hsa
cuaagauugcucuaacgucuagugaaaaaaauauuuuuaaaauuucagccaaauaaugcauuuu

SEQ ID NO: 547412 - RNA, 64 nt, hsa
cugcagaaaauuauguguauccacaaccuaguuauuuuaaaaauuauguugacuaaauacaaag

SEQ ID NO: 547413 - RNA, 64 nt, hsa
auuacuuggcacaauuuauuucuacacagaaaguuuuuaaaaugaauuuuaccguaacuauaaa

SEQ ID NO: 547414 - RNA, 64 nt, hsa
caauaugcuuguauaaaacacuguucacuguuuuuuuuaaaaaaaaaacuugauuuguuauuaa

SEQ ID NO: 547415 - RNA, 64 nt, hsa
gucucauuagccugaaugugccauaagacugaccuuuuaaaauguuuugagggaucuguggaug

SEQ ID NO: 547416 - RNA, 64 nt, hsa
ucuuaagaagauuaaaagagaaaaaaaaaggcccuuuuaaaaauaguauacacuuauuuuaagu

SEQ ID NO: 547417 - RNA, 64 nt, hsa
uaaauuagacauuaccaguaauuucaugucuacuuuuuaaaaucagcaaugaaacaauaauuug

SEQ ID NO: 547418 - RNA, 64 nt, hsa
gaugaacaauguauacaaugcacuuuuaugaaguuuuuaaaaauaaaggaaaacaaaaaacuuu

SEQ ID NO: 547419 - RNA, 64 nt, hsa
uuucaucaaugcaguucucacgaaaguauuuacuuuuuaaaaauaacugagauauuauuuuaaa

SEQ ID NO: 547420 - RNA, 64 nt, hsa
augcuuauaaaagacuuuuaaugaaauguugccuuuuuaaaauaauuauacuugcacaugaaaa

SEQ ID NO: 547421 - RNA, 64 nt, hsa
auuuccuauauaacuaaaaauuuuguuucauaaauuuuaaaauaauuauuuuugacuaugaaca

SEQ ID NO: 547422 - RNA, 64 nt, hsa
uauaucuauauaguaaauuucacuagaaaaauucuuuuaaaauugacagaagauaauuuauacc

SEQ ID NO: 547423 - RNA, 64 nt, hsa
uuguuuuauaauaauccaaacucuaugaaagcaauuuuaaaaauuauuaagguuuuaugaaguu

SEQ ID NO: 547424 - RNA, 64 nt, hsa
agaagcacaguugaaguccuagaauaauggauuuuuuuaaaaaaaaaaaguuguuaguuugaau

SEQ ID NO: 547425 - RNA, 64 nt, hsa
agguacuguuagucuguuagucuuucaaauugacuuuuaaaaauacauaucuuuaugauuuuca

SEQ ID NO: 547426 - RNA, 64 nt, hsa
ugucauuuguacauaaacuaguagaaaauagcaguuuuaaaaguuuucuauuucaguuuuguuu

SEQ ID NO: 547427 - RNA, 64 nt, hsa
cuuauccuaagauucaauauuacguuauacaaauuuuuaaaauugaaauuaggaauuugaauuu

SEQ ID NO: 547428 - RNA, 64 nt, hsa
uugaaaaaagccuuuugacaacauacaggcauucuuuuaaaaccaggcugaaacauuuuauuuc

SEQ ID NO: 547429 - RNA, 64 nt, hsa
aguguuaaugaauaucaugccucagcacugucacuuuuaaaaccugucaggaucccacuguaaa

SEQ ID NO: 547430 - RNA, 64 nt, hsa
gcuagcauacacuaccucuuaccugagaggugucuuuuaaaaacaaaucuuggcagcuguccuu

SEQ ID NO: 547431 - RNA, 64 nt, hsa
gauuucucccgcaauuuguuccuucuuuuuaccuuuuuaaaaaucuguuagaagaaaaaaagca

SEQ ID NO: 547432 - RNA, 64 nt, hsa
uauguacaaacauacuggaagaaaaccagcuuguuuuuaaaacuuaacacaaucagaaauuuuu

SEQ ID NO: 547433 - RNA, 64 nt, hsa
auauaaugaccugcuaauauauuuuaagaacauguuuuaaaaagauacacucuaucacauauuu

SEQ ID NO: 547434 - RNA, 64 nt, hsa
auggauggauuaauauuuaucccccuuugggauauuuuaaaaucuacuaaaaugaggauuagua

SEQ ID NO: 547435 - RNA, 64 nt, hsa
uaagucuuuguacuaaagcauuugcuauaauuauuuuuaaaaaaacaaacagaugaaaaccuca

SEQ ID NO: 547436 - RNA, 64 nt, hsa
uuuaauaaauccucuauacaaguguuugaaucaauuuuaaaacauaaaaaguggaaauuuccuu

SEQ ID NO: 547437 - RNA, 64 nt, hsa
auuacaggcgggagccacugcacauggcagcauuuuuuaaaaauucaguuuuaagaucucuggu

SEQ ID NO: 547438 - RNA, 64 nt, hsa
aauaaugaaggacaaaugaauccugaaggaagauuuuuaaaaauguuuuguuucuucuuacaaa

SEQ ID NO: 547439 - RNA, 64 nt, hsa
uccaucuuucuuuuucuuccuucugcugcugaacuuuuaaaagaggucucuaacugaagagaga

SEQ ID NO: 547440 - RNA, 64 nt, hsa
uuauuuaauccuagcucuuuguuauucaccagcuuuuuaaaaaaguguuugaaaauuauacauu

SEQ ID NO: 547441 - RNA, 64 nt, hsa
uuuucuggaaucucacucuuguuuuucacaguaauuuuaaaaacguuucuacuccaauuaagaa

SEQ ID NO: 547442 - RNA, 64 nt, hsa
ucagagugcuucugaaguacaguuuaaaaacacuuuuuaaaaaguggaguaaaagugaggcaca

SEQ ID NO: 547443 - RNA, 64 nt, hsa
cuuguugccccguaaaaggguuaacagcacaauuuuuuaaaaauaaauuaagaaguauuuauag

SEQ ID NO: 547444 - RNA, 64 nt, hsa
gagaaaaauacuguauuuaaaauguaaaauaaacuuuuaaaaagcaggcacuaauauauauuuc

SEQ ID NO: 547445 - RNA, 64 nt, hsa
uuguuauuguauguuguuacugaaguacuuagauuuuuaaaauuucaaauccuaaaucacuucu

SEQ ID NO: 547446 - RNA, 64 nt, hsa
auaucaggugcagcuggcuuugauuaaaggccauuuuuaaaacuuaaaaacucaacaccucaca

SEQ ID NO: 547447 - RNA, 64 nt, hsa
uaagacauuuuuaaguuauauuuauuuuguuggguuuuaaaauugcacagaacacuaagaccga

SEQ ID NO: 547448 - RNA, 64 nt, hsa
gagggugggacacaugaggauguauaaguacagauuuuaaaaaaggaaaucaacuuacacuucc

SEQ ID NO: 547449 - RNA, 64 nt, hsa
uuuaaaugguugcuucuucauagaauugucugcuuuuuaaaacuggaaguacaggauuuucuuc

SEQ ID NO: 547450 - RNA, 64 nt, hsa
ugaguuuccagcuguagcuuuugucuuugucacauuuuaaaaaauaauaagcaagacacauugg

SEQ ID NO: 547451 - RNA, 64 nt, hsa
guccccuauuagaauaggguugcuacucaucuuuuuuuaaaaaccgaauuucaucauuuaucua

SEQ ID NO: 547452 - RNA, 64 nt, hsa
guugauuguuuauauaaaacacacuaaaauuauauuuuaaaaguuuacugccaugaaauacucc

SEQ ID NO: 547453 - RNA, 64 nt, hsa
cagaauuauuguggggauuaaguuagauaauguguuuuaaaauauaaagcuacauccaaagaaa

SEQ ID NO: 547454 - RNA, 64 nt, hsa
aaagacuaauucaagaaguugcaggauacacaauuuuuaaaaaucucauuucuacaucuuagca

SEQ ID NO: 547455 - RNA, 64 nt, hsa
uacuuaaaguagcaaagucauggauuguauugacuuuuaaaaauauaguaaaagucauauuuaa

SEQ ID NO: 547456 - RNA, 64 nt, hsa
agagagaaugagaacuaagugaaaagggaaacccuuuuaaaaccaucagauaucgugagacuua

SEQ ID NO: 547457 - RNA, 64 nt, hsa
uuuuucucuuuccaguaaguucacauuuggauaauuuuaaaaagaaaaguaauuaccuuugugu

SEQ ID NO: 547458 - RNA, 64 nt, hsa
auuaaacuagacagauaguuuagguggaguauauuuuuaaaacucagaacauguauauuggucc

SEQ ID NO: 547459 - RNA, 64 nt, hsa
uguaacccaaauguccaauauaaauuggcuuauuuuuuaaaauaauuuuaaaaguugggaaaag

SEQ ID NO: 547460 - RNA, 64 nt, hsa
uguccaauauaaauuggcuuauuuuuuaaaauaauuuuaaaaguugggaaaaguguuauuauuu

SEQ ID NO: 547461 - RNA, 64 nt, hsa
gaaacauuuuugauacauaacagaccucagucuuuuuuaaaaauuaauauauuuucaggcguau

SEQ ID NO: 547462 - RNA, 64 nt, hsa
gguacguuauguccugguuuaaaaaggauuaaaauuuuaaaauaauccuugcaucuaaaggccu

SEQ ID NO: 547463 - RNA, 64 nt, hsa
gggggcuagggaagagccugccagauuuucacauuuuuaaaauguucuagucauuuugagaaau

SEQ ID NO: 547464 - RNA, 64 nt, hsa
aacaggcaaauauuguagcuauauuacagugggauuuuaaaaaucuuguuaaacauucuauaaa

SEQ ID NO: 547465 - RNA, 64 nt, hsa
uuuuaucucaguuauuugcccaucacaagcacauuuuuaaaauguugcuuuguguguguuugac

SEQ ID NO: 547466 - RNA, 64 nt, hsa
acucgugugcaugagaaugucauuugcuaaugaauuuuaaaagcauauauaaaacaaaacaaac

SEQ ID NO: 547467 - RNA, 64 nt, hsa
acaauugauuuucccccuaauucuuauuuuauaauuuuaaaauugcagcaguugcuagcaacaa

SEQ ID NO: 547468 - RNA, 64 nt, hsa
gcuuuguaaaaaauaacuguaauugauauuucauuuuuaaaauuuauaaauuccaaucauuguc

SEQ ID NO: 547469 - RNA, 64 nt, hsa
ugaagcacucugacauguacauuuaaagugacaguuuuaaaaguaaaaugguguuaaaucucug

SEQ ID NO: 547470 - RNA, 64 nt, hsa
auggcaaauacuucuaauuuuuuucccuaaacauuuuuaaaagugaaauaugggaagagcuuua

SEQ ID NO: 547471 - RNA, 64 nt, hsa
cauuacauuaaaaaggaauuuuagagauugauuguuuuaaaaaaaaauacgcacauuguccaau

SEQ ID NO: 547472 - RNA, 64 nt, hsa
ccagaauuucuaaauaaauccccugguuaggaaauuuuaaaagucaaagcuuguuuucuucaac

SEQ ID NO: 547473 - RNA, 64 nt, hsa
uuuacuguccuuuccuccugggauaugagaaacauuuuaaaaaacguauuuaacagaagagagc

SEQ ID NO: 547474 - RNA, 64 nt, hsa
uauuuuaaaucuaaauucugucacuucgcugccuuuuuaaaauagugugguauuucaaauauug

SEQ ID NO: 547475 - RNA, 64 nt, hsa
ccacaggcucuccacuuugaaacuuuaguuugaauuuuaaaagauaggaaguaauacaguuuaa

SEQ ID NO: 547476 - RNA, 64 nt, hsa
guuuuuucuuuuucuuuucuuuuuuuuuuuuuuuuuuuaaaaaagcaccuuuuuuuguuguuuc

SEQ ID NO: 547477 - RNA, 64 nt, hsa
uuuuuuuuaagaucauuaugugcaaaacaccaaguuuuaaaaauaacucacagaauggccuuag

SEQ ID NO: 547478 - RNA, 64 nt, hsa
guuccuuggcuacuguuuuucuuuuacuucaguuuuuuaaaaaucucaaaugaaaaagucuucg

SEQ ID NO: 547479 - RNA, 64 nt, hsa
guauuguaauauguaaaguaagcccaacaaaaauuuuuaaaaauuugaugauccccaauauauc

SEQ ID NO: 547480 - RNA, 64 nt, hsa
uuuuuguugaagcucuagcuuaagaagaaacuuuuuuuaaaaagacuguuuggggauucuuuuu

SEQ ID NO: 547481 - RNA, 64 nt, hsa
uauacuaauuaacccauuugugcauugaguuuucuuuuaaaaaugcuuguugugaaagacacag

SEQ ID NO: 547482 - RNA, 64 nt, hsa
guagccucucugggcccaauaaaacaacacacauuuuuaaaaaauauggguauugauguccggc

SEQ ID NO: 547483 - RNA, 64 nt, hsa
aacuuacaaagcuaguugccauauuucuauuuuauuuuaaaaaguaaacaugcggcugggcgug

SEQ ID NO: 547484 - RNA, 64 nt, hsa
ggcaugagccaccgugcccagccucaaaaauauuuuuuaaaagaaaagagaaaauaauucuucu

SEQ ID NO: 547485 - RNA, 64 nt, hsa
ucccuguggcaauguacuguucucacauuaagccuuuuaaaaauguuccauacuguauuagcau

SEQ ID NO: 547486 - RNA, 64 nt, hsa
ggauucuuuguauuguuuauuucauuuugguuuauuuuaaaagauguaaacauauauuaagcua

SEQ ID NO: 547487 - RNA, 64 nt, hsa
uaaugaugacauucaguucucuuuuguuuuuauuuuuuaaaaacucagguguaauuauuaucug

SEQ ID NO: 547488 - RNA, 64 nt, hsa
acuuauuucuuucaaaacauuuuugguuuuugguuuuuaaaauuuuuauuaaacaauugcuguu

SEQ ID NO: 547489 - RNA, 64 nt, hsa
uuauuuuggcaaaacugucaaaugagaaaaaugauuuuaaaaacuuuuuuuucaauugacaaga

SEQ ID NO: 547490 - RNA, 64 nt, hsa
uguagguuuccuuaugcuguuuuuacugugcacuuuuuaaaauuagguuuuaauuucaguaugu

SEQ ID NO: 547491 - RNA, 64 nt, hsa
uucuuauuauaguugaaggcauucuccagauucuuuuuaaaagauuuguucauauuucucucuc

SEQ ID NO: 547492 - RNA, 64 nt, hsa
cuaguuaacauauuuguguauauuaaauaugaauuuuuaaaauuuauaaauacuauuuuccaaa

SEQ ID NO: 547493 - RNA, 64 nt, hsa
auuuccuuucagcauuuacagugaaaagugagaauuuuaaaauuuaugaaaucuauauuccagg

SEQ ID NO: 547494 - RNA, 64 nt, hsa
aucaaaguauaguugauaauguuauaaaggaugauuuuaaaaauaggguauaaucaugacucac

SEQ ID NO: 547495 - RNA, 64 nt, hsa
guuugccugcaguugaacaauacuuuagaguacuuuuuaaaauuauuucucacaaagaaaugaa

SEQ ID NO: 547496 - RNA, 64 nt, hsa
augcacaguuugguacaguagagaucauuaauacuuuuaaaaguucugcauuaauugacuugga

SEQ ID NO: 547497 - RNA, 64 nt, hsa
augauugguucugaucuuaccggcuaguggucauuuuuaaaaaacuuguacccucuuaucugaa

SEQ ID NO: 547498 - RNA, 64 nt, hsa
guaacauauguuaaauaaaacuguuauuuuugaauuuuaaaauuuguuuuuuggggguaugaac

SEQ ID NO: 547499 - RNA, 64 nt, hsa
uuccauuacuauguggcuuagggauuuauuuguuuuuuaaaaucaaccauguuagcugggauua

SEQ ID NO: 547500 - RNA, 64 nt, hsa
aaaauacaaguucuggaaaaaauauuuuucuucauuuuaaaacuuuuuuuuaacuaauaauagc

SEQ ID NO: 547501 - RNA, 64 nt, hsa
gauugacuuggccuucaggcuccuuuggucauaauuuuaaaauaugggaguagaaaacaacaaa

SEQ ID NO: 547502 - RNA, 64 nt, hsa
aguaugagucccucaggaaaaaaaaaaaauucuguuuuaaaaagcaaucugauucuuagcucuu

SEQ ID NO: 547503 - RNA, 64 nt, hsa
gauuuuaaaguagaaauaaauauguauuccauguuuuuaaaagauuacuuucuacuuuguguuu

SEQ ID NO: 547504 - RNA, 64 nt, hsa
gauauaaagaaaacuuuuuugugcuaaaaauacuuuuuaaaaucaauuuuguugauuguaguaa

SEQ ID NO: 547505 - RNA, 64 nt, hsa
uggcauucuaguauuaaauccucacuucaggagcuuuuaaaaauacugagacccccccauaacc

SEQ ID NO: 547506 - RNA, 64 nt, hsa
ggcaacauggugaaaccccaucucuacaaaaaauuuuuaaaaaguuggccaggcaugguaaugc

SEQ ID NO: 547507 - RNA, 64 nt, hsa
ucaccgaaagcucacagauugcagaaauuagcuuuuuuaaaaaacaaaccccaguaaauauaau

SEQ ID NO: 547508 - RNA, 64 nt, hsa
ucucucuccucuuuuccuccucaaaauguauauauuuuaaaagccuuaacuguuaguuaugccu

SEQ ID NO: 547509 - RNA, 64 nt, hsa
cagggcacuucagaguagagggcuugggaagaucuuuuaaaaaggcaguaggcccgguguggug

SEQ ID NO: 547510 - RNA, 64 nt, hsa
auucuaauuuuauauauagagaaagugaccuauuuuuuaaaaaaaucacacucuaaguucuauu

SEQ ID NO: 547511 - RNA, 64 nt, hsa
ugaauagcaaaaaacugauaguuacuugcuuguuuuuuaaaaauuacauauuaaaaaugcccuu

SEQ ID NO: 547512 - RNA, 64 nt, hsa
guuaaaugucuuaaauguauacauuagauguguguuuuaaaaugcauaaaacacguugaaauac

SEQ ID NO: 547513 - RNA, 64 nt, hsa
ucauauaaaauugaauucuacucauuagaguacuuuuuaaaaguacagcagaaagaaaagaagu

SEQ ID NO: 547514 - RNA, 64 nt, hsa
gagcaaacuagaaauuggcuucaaagucuaauacuuuuaaaagcauguguuuuguguauaugcu

SEQ ID NO: 547515 - RNA, 64 nt, hsa
agacaaauaacuacugcaaaaaguacauagugaauuuuaaaauguagaagaaagcaaaaaauaa

SEQ ID NO: 547516 - RNA, 64 nt, hsa
uaucauuaaacaugaauuuaaugucuaggauaauuuuuaaaagaggaaauuaaauaauuuuaca

SEQ ID NO: 547517 - RNA, 64 nt, hsa
ucugugaugauuaacaguaugucaccacuucauuuuuuaaaaaggaucacgucuaaugcccauu

SEQ ID NO: 547518 - RNA, 64 nt, hsa
ugaaugcuuuuuguuggauuucguaggguauuuuuuuuaaaauagggucuugcuauguugccca

SEQ ID NO: 547519 - RNA, 64 nt, hsa
cuuaaaauuuuugaaaacuccaucguuaaacaacuuuuaaaagaaauaacuaaauuuucaaaug

SEQ ID NO: 547520 - RNA, 64 nt, hsa
aaguaugccucccguggguauacguuuuuaccuuuuuuaaaaaacauuuuuguagaaaaaauaa

SEQ ID NO: 547521 - RNA, 64 nt, hsa
guagagaaacagaugacaaaucucugaaagagguuuuuaaaacuuuugauccaacugcuucacc

SEQ ID NO: 547522 - RNA, 64 nt, hsa
gcuaauuaaaauguaaaaucaaguaaagaaaacauuuuaaaauuacaauuagcagagcaguuca

SEQ ID NO: 547523 - RNA, 64 nt, hsa
ggcuuccaauaaguaucuuaggaacuuauuuccuuuuuaaaaaauauuuuuuaaauuuuuaaaa

SEQ ID NO: 547524 - RNA, 64 nt, hsa
aacuuauuuccuuuuuaaaaaauauuuuuuaaauuuuuaaaauuugauuuuaaauuucaaauaa

SEQ ID NO: 547525 - RNA, 64 nt, hsa
caacacugacuacaugcuggaaugacugugaagcuuuuaaaaaauguuagugcccacucuuccc

SEQ ID NO: 547526 - RNA, 64 nt, hsa
uaauaaaaaacagaguauuuuauguaauuucuguuuuuaaaaagacauuauuaaaugggucaaa

SEQ ID NO: 547527 - RNA, 64 nt, hsa
agauaaaucuaggcaggauacugcauuuuugugguuuuaaaaaaguccuuaggacagacugaau

SEQ ID NO: 547528 - RNA, 64 nt, hsa
uagugaacacauuuuuuaacaaaauaaguuguaauuuuaaaaggaaaguuuugccuauuuuauu

SEQ ID NO: 547529 - RNA, 64 nt, hsa
cugcucuugugauuuuucucaggcuguuuugucauuuuaaaauccagugguagauguagcuuag

SEQ ID NO: 547530 - RNA, 64 nt, hsa
guaucagauuaaacaccgaauucagccacuggacuuuuaaaaguacuuaagaugguuuaucucg

SEQ ID NO: 547531 - RNA, 64 nt, hsa
uuuuggugguagcuucuagucccagaaucuguguuuuuaaaauacuacaugacauucugucuau

SEQ ID NO: 547532 - RNA, 64 nt, hsa
ugguuauacugaagcauaaaccuugccuguguaauuuuaaaaaauuaauagagcugugcaaacc

SEQ ID NO: 547533 - RNA, 64 nt, hsa
cuuucuauuuuuuaccugugaaauaacagugacuuuuuaaaauggugacaguguuggcaaggaa

SEQ ID NO: 547534 - RNA, 64 nt, hsa
uuugucaucuuuaaaaauacagcaauaugugacuuuuuaaaaaagcugucaaauaggugugacc

SEQ ID NO: 547535 - RNA, 64 nt, hsa
uuuggaguaggagguucccuccucaauuuuguauuuuuaaaaguacaugguaaaaaaaaaaauu

SEQ ID NO: 547536 - RNA, 64 nt, hsa
ucuuaagggcucagauuuagcaaacacggaagaauuuuaaaaugagcucuccuuucaacccuug

SEQ ID NO: 547537 - RNA, 64 nt, hsa
ccaccuaagccucuggguaauauuguaaauauuguuuuaaaaugcaucagccuaugcuauacaa

SEQ ID NO: 547538 - RNA, 64 nt, hsa
uugggggaaaauauuaacuuugcugaauugaaaguuuuaaaaauccuuuuaguauucuaaaaca

SEQ ID NO: 547539 - RNA, 64 nt, hsa
guguaacuguaucauacuuuuuuuguauuuuaaauuuuaaaauaaaggcuaauauauuuagaca

SEQ ID NO: 547540 - RNA, 64 nt, hsa
uaauaccaaauauuuuagccuuaaauuuuugucauuuuaaaaucugauuuaauguuuucugcug

SEQ ID NO: 547541 - RNA, 64 nt, hsa
aguacucaguauagcauugaacauuucuuaugauuuuuaaaaguugcuaguacuggggagaaau

SEQ ID NO: 547542 - RNA, 64 nt, hsa
aacauuuucuuucuuuuucuggaaauuuuguccauuuuaaaaaccaaucauuuuaagaagacau

SEQ ID NO: 547543 - RNA, 64 nt, hsa
aauaaaaugcuauauggcaccuaauuauuuuuucuuuuaaaaugccuuaaguugcagucucauu

SEQ ID NO: 547544 - RNA, 64 nt, hsa
ugaauuccaaauucaccuagcaauaaaaucuaauuuuuaaaaaguauauaaauauaaaauguau

SEQ ID NO: 547545 - RNA, 64 nt, hsa
cuguggcauugcacaaauacagucucuguagggauuuuaaaagauuucagacuguuuugauaga

SEQ ID NO: 547546 - RNA, 64 nt, hsa
aagauuucagacuguuuugauagaaaaagcuaaauuuuaaaaugcauaucucacaguugccuac

SEQ ID NO: 547547 - RNA, 64 nt, hsa
uuauuuugauauuggugaauuagucaccaguaaauuuuaaaaaagcacuugguugaaaauugua

SEQ ID NO: 547548 - RNA, 64 nt, hsa
ccauaacuuuuauaagucccauuuauaaacccacuuuuaaaaauaacagguccaaguuagagug

SEQ ID NO: 547549 - RNA, 64 nt, hsa
guacaaugugcugugaaaaaucugaugacuuuaauuuuaaaaucuugugacauuuugcuuauac

SEQ ID NO: 547550 - RNA, 64 nt, hsa
uuaguugaauauuuucuuuuggagagauuguauauuuuaaaauacuguuuagaguuuaugagca

SEQ ID NO: 547551 - RNA, 64 nt, hsa
ggaaucccuagggcuagagccuagaaaucucacuuuuuaaaaugcuuccaagguaagucugaug

SEQ ID NO: 547552 - RNA, 64 nt, hsa
ccuucuuuugaaaauaaacugagucaauuuagccuuuuaaaaauauagucaucucuuuuaaaua

SEQ ID NO: 547553 - RNA, 64 nt, hsa
uuguauuugacuuuauuuccuuuauucaaaucauuuuuaaaaacuuacauuuugaacaaacacu

SEQ ID NO: 547554 - RNA, 64 nt, hsa
uaaagaucauuuggaagacuuuagacucuauuaauuuuaaaaggaauauuuauuagccauaugc

SEQ ID NO: 547555 - RNA, 64 nt, hsa
uacaguguacaauguguauuucuucaaccauauauuuuaaaaagacguacauagaaacuuaggc

SEQ ID NO: 547556 - RNA, 64 nt, hsa
caguauuuuucauuugauucccuauuagaauuaauuuuaaaacuugaagacuuccagacuuauc

SEQ ID NO: 547557 - RNA, 64 nt, hsa
gacuuagaagauaucauugccauguagguuuuauuuuuaaaagucuugagcucuucuuaaauau

SEQ ID NO: 547558 - RNA, 64 nt, hsa
ccauggggauaaaucacucugucauuccuaguuauuuuaaaaaaagaacuuuaugauuacgguc

SEQ ID NO: 547559 - RNA, 64 nt, hsa
uuuccucaccuucacuauugaucuguaauuuuuauuuuaaaaacagcuuacuguaaaguagauc

SEQ ID NO: 547560 - RNA, 64 nt, hsa
gcauuucauuauugaugugcugaugaaccuggacuuuuaaaaauauuuguuuccuauaccuuua

SEQ ID NO: 547561 - RNA, 64 nt, hsa
gugcuuaguacuguuuucccugcacguaggggucuuuuaaaaauauaaagcuugugauaaagag

SEQ ID NO: 547562 - RNA, 64 nt, hsa
gcggggguaggugaggguuuggagcauguggucuuuuuaaaaaauuguaacccucuagaaaaua

SEQ ID NO: 547563 - RNA, 64 nt, hsa
cuuuauaaaagcaauagcuggaauauacucccaguuuuaaaauaaaugccugauugauuuaaag

SEQ ID NO: 547564 - RNA, 64 nt, hsa
uguuuaguauagguuuuuguaugcuggguuugccuuuuaaaaugggaaauacuuuuuaaguuau

SEQ ID NO: 547565 - RNA, 64 nt, hsa
uaccuguuaacuuuccccaauugagauaaaaguguuuuaaaauucuguuuauaguuuuugauau

SEQ ID NO: 547566 - RNA, 64 nt, hsa
gacuacaggggcccgccaccacaccuggcuaauuuuuuaaaaauauuuuuaguagagacagggu

SEQ ID NO: 547567 - RNA, 64 nt, hsa
uuuuuuuuuaauaaaacaaaauuuguuugaaaucuuuuaaaaauucaaaugauuuuuacaaguu

SEQ ID NO: 547568 - RNA, 64 nt, hsa
cuuuuaguaauaaaaugacuugaaaucauauuauuuuuaaaagcccuuugcuucuuucauuacu

SEQ ID NO: 547569 - RNA, 64 nt, hsa
aucauuuuuauaaauuuuaaauuguacaucagacuuuuaaaaucuguaauauacaagcaagcaa

SEQ ID NO: 547570 - RNA, 64 nt, hsa
aagauggugaaaccccgucucuauuaaaaauauuuuuuaaaaauuaacugagcguggugguggg

SEQ ID NO: 547571 - RNA, 64 nt, hsa
uaaauugaugggagaaaugaggaaaagaaaaucuuuuuaaaaaugauuucaagguuugugcuga

SEQ ID NO: 547572 - RNA, 64 nt, hsa
acucuuaaaaaaaaaaaaaaaagacuaagguggauuuuaaaaauuggaaacugacauaauguua

SEQ ID NO: 547573 - RNA, 64 nt, hsa
uuccagcuugccuguuuuugaguauguuugauguuuuuaaaauuuugucuucucuguggaagac

SEQ ID NO: 547574 - RNA, 64 nt, hsa
cagcaauuaacuuuaagccuccuuuuagagauauuuuuaaaacuuguuuaaaauuuuugugcaa

SEQ ID NO: 547575 - RNA, 64 nt, hsa
uaaggaacuucuuguuuaauagcauuuuuguuuauuuuaaaaagugaucagaaguaguaaacua

SEQ ID NO: 547576 - RNA, 64 nt, hsa
augacuaaugugaugcuaaguuccacuuggccccuuuuaaaaacguguaugugccuuuugaaga

SEQ ID NO: 547577 - RNA, 64 nt, hsa
acaauaguugcugccuugcaaagguaaucucucauuuuaaaauuggacaguauuaaugaagggg

SEQ ID NO: 547578 - RNA, 64 nt, hsa
agaauuuuucugaaucauauuggggaagcagugauuuuaaaaccucaaguuuuuaaacaugauu

SEQ ID NO: 547579 - RNA, 64 nt, hsa
uuuauauguucuguauaauguucaguuuguaacuuuuuaaaaguuuggauguauagagggauaa

SEQ ID NO: 547580 - RNA, 64 nt, hsa
aagucuccuuuuagucuagauaaucauuauuucauuuuaaaauuaguguuuuuccuaguuugca

SEQ ID NO: 547581 - RNA, 64 nt, hsa
uaaagagcucuucuauuuauacaugccuaaauucuuuuaaaauguagagggauaccugucugca

SEQ ID NO: 547582 - RNA, 64 nt, hsa
agacugcaaaaggccuauuuuaacuauugauuuuuuuuaaaaaaaauugucuuugaauguauug

SEQ ID NO: 547583 - RNA, 64 nt, hsa
aaccgaacacaacucagaaacuuggaaucguuuuuuuuaaaaaugccucugagcaacccauaua

SEQ ID NO: 547584 - RNA, 64 nt, hsa
aggugaaauugcauacacagauauguaguacauauuuuaaaaguuuuaucuuaaauugauuaaa

SEQ ID NO: 547585 - RNA, 64 nt, hsa
auuuuaaaaguuuuaucuuaaauugauuaaaacuuuuuaaaaagcuuugguauuaaaagaggua

SEQ ID NO: 547586 - RNA, 64 nt, hsa
uuuuugcaaugaugacugaguuguuaucauaguauuuuaaaaccuguauaguguuuuagacuug

SEQ ID NO: 547587 - RNA, 64 nt, hsa
acauuuuaacaguaccugugccugagaauuuaauuuuuaaaagacuuugauguguuuuuguaug

SEQ ID NO: 547588 - RNA, 64 nt, hsa
uuaaagaagucucuuaauucugaugcuagguuguuuuuaaaaccacuaugcaaagaacucacca

SEQ ID NO: 547589 - RNA, 64 nt, hsa
auuuugcaugaucuuuaacaaauguuuuaagcaauuuuaaaaaggcaggauguuauugacauua

SEQ ID NO: 547590 - RNA, 64 nt, hsa
aguucuggggaaggaucauaagaaaggaaauacuuuuuaaaaaaaaauuuggaaacauguaaca

SEQ ID NO: 547591 - RNA, 64 nt, hsa
gucacugcagcaacgccuuguguuuguuucauuuuuuuaaaacccacacaaagccgcugucuca

SEQ ID NO: 547592 - RNA, 64 nt, hsa
aauguaaauuuauuucuccaaaucgagagugauuuuuuaaaaauuuuuuaucuuuauaugguuu

SEQ ID NO: 547593 - RNA, 64 nt, hsa
agauuaacaaucaacugcauaaauauuauuaauauuuuaaaaagaguuaaguuguauuuugaua

SEQ ID NO: 547594 - RNA, 64 nt, hsa
uaaguaagcagccacugcaagcucugaaucaguuuuuuaaaaaaaagaaaaaaaaaaaaaagga

SEQ ID NO: 547595 - RNA, 64 nt, hsa
cuugaaaguauauaaaaucuuccuguccugugaauuuuaaaaagcuaucccauaucgauugcca

SEQ ID NO: 547596 - RNA, 64 nt, hsa
gguuuggaauauuaaaaaacuucauguaauuuuauuuuaaaauuucauagcuguacuucuugaa

SEQ ID NO: 547597 - RNA, 64 nt, hsa
uuuuauuaagcuuuuuggaaucuuuguaccaaaauuuuaaaaaagggaguuuuugauaguugug

SEQ ID NO: 547598 - RNA, 64 nt, hsa
gauuuaugaucuucauuuauuuuaaugauaaugguuuuaaaauauguuccugauuguacauauu

SEQ ID NO: 547599 - RNA, 64 nt, hsa
uguaauuuaguaauaugaauauaaaucuuguaacuuuuaaaauuguaauggaggcuguaaucau

SEQ ID NO: 547600 - RNA, 64 nt, hsa
auuacacauuuuuaaaaaauacauuauuugaacauuuuaaaacagaaagguacuauuuuccaaa

SEQ ID NO: 547601 - RNA, 64 nt, hsa
acuuguuuucccguuuccuugaaugauuacacauuuuuaaaaaauacauuauuugaacauuuua

SEQ ID NO: 547602 - RNA, 64 nt, hsa
agaaaucugauuguuguguguauucaaugugugauuuuaaaaauaaacagcaacaacaauaaaa

SEQ ID NO: 547603 - RNA, 64 nt, hsa
cccucagguaccaucugugguggcucucugcaaguuuuaaaacugccucugcugagcucucauc

SEQ ID NO: 547604 - RNA, 64 nt, hsa
auccaacucaugacaagagauaccacuguuuguuuuuuaaaaaacauuuuucauuuuguuucuc

SEQ ID NO: 547605 - RNA, 64 nt, hsa
uagcaccuuucaugcaaggcaugcaaaaagccuauuuuaaaaucacugugcauauuauagaguu

SEQ ID NO: 547606 - RNA, 64 nt, hsa
aucuucaaggucugaaaugagaaacauacugacuuuuuaaaauuuuaacaguguacuucuuagg

SEQ ID NO: 547607 - RNA, 64 nt, hsa
aaguaacaagacaccuagcaacuauaggaaucauuuuuaaaaaucuuuaaggagacuuuuaaca

SEQ ID NO: 547608 - RNA, 64 nt, hsa
aacuuuuuuaaauauaaauguuaagaaaaauuuuuuuuaaaaaacacuucauuauguuuagggg

SEQ ID NO: 547609 - RNA, 64 nt, hsa
aaaaaaauugaacacaaucucauugaggagcauuuuuuaaaaacuaaaaaaaaaaaaacuuugc

SEQ ID NO: 547610 - RNA, 64 nt, hsa
ucauuuuaugaagauauuugcuuuaauaaugucuuuuuaaaaauacuggcaccaaaagaaauag

SEQ ID NO: 547611 - RNA, 64 nt, hsa
cagaaaaacagaacaaguuuauucuaucauuugguuuuaaaauaugagugccuuggaucuauua

SEQ ID NO: 547612 - RNA, 64 nt, hsa
auuuuauuuuacuucaacugucgaaacuuccuuguuuuaaaaaaugaucauuuggguucacuca

SEQ ID NO: 547613 - RNA, 64 nt, hsa
ccuauuacaaaacuguucugaauuuucuuuugguuuuuaaaaaacaaaacuuguugcuuagaag

SEQ ID NO: 547614 - RNA, 64 nt, hsa
ucugcucuggucauuugcauuaagaugaagaauuuuuuaaaacauuuauaauaaauaguagcaa

SEQ ID NO: 547615 - RNA, 64 nt, hsa
uaaaauguaccucuuguuuacauaauuugcauaauuuuaaaagauaauguugccaaacuuugga

SEQ ID NO: 547616 - RNA, 64 nt, hsa
gucuuucccuuuauaguuucucuauaaaaacugguuuuaaaaucaguggaaaagggcagguuga

SEQ ID NO: 547617 - RNA, 64 nt, hsa
ugaaaagcccccauuuaaaaaaauaacaaacauuuuuuaaaaggccuccaauacucuuauggag

SEQ ID NO: 547618 - RNA, 64 nt, hsa
uccauuuuguugcuugguugguuuguugcuuuauuuuuaaaaggagaaguuuaacuuugcuauu

SEQ ID NO: 547619 - RNA, 64 nt, hsa
cucucuuccuccucagcgaaccacuaggcccccuuuuuaaaaacaccuuuagagccuaauuacu

SEQ ID NO: 547620 - RNA, 64 nt, hsa
cugagauggcgaaacccuguguguggggugcaguuuuuaaaaaucagagcgcucuagccacuac

SEQ ID NO: 547621 - RNA, 64 nt, hsa
ugaccagagcacagauuacuuaugcuucuuaauuuuuuaaaaucuuaaauccucuguccaacug

SEQ ID NO: 547622 - RNA, 64 nt, hsa
ugaaggcucucagacugggaaagaaacuuacccauuuuaaaauucagcauugcucaacuuaccu

SEQ ID NO: 547623 - RNA, 64 nt, hsa
acucugcaaaguagccuuuaaaaaaauguaaauuuuuuaaaaaguccacagaggagaauuugcu

SEQ ID NO: 547624 - RNA, 64 nt, hsa
caaaauguacuccacaaguauguacaauuaaguauuuuaaaaauaaauggcaaacauuaaaaac

SEQ ID NO: 547625 - RNA, 64 nt, hsa
uuuuuuuuuaaguuuauaaaaguuuauuauacuuuuuuaaaauuacucuuuaguaauuuauuuu

SEQ ID NO: 547626 - RNA, 64 nt, hsa
aagaugagaaauaaagaaagccuuuguaaggugguuuuaaaagccuuauaugcaaaccuuuuaa

SEQ ID NO: 547627 - RNA, 64 nt, hsa
cuuuaaaaaacuaugucuaauuuauauuaauacauuuuaaaaaggugcccgcacuaccauacau

SEQ ID NO: 547628 - RNA, 64 nt, hsa
gaaacaaaucuucuguuauuuacaaaauaauaauuuuuaaaaaacauuuaaaaaaaauccaaag

SEQ ID NO: 547629 - RNA, 64 nt, hsa
cauauucagauugggaaaaacaauggacauuaguuuuuaaaaaguuacguggaagcaagauuuc

SEQ ID NO: 547630 - RNA, 64 nt, hsa
uaauuaaaagaauauuuuaacuuccuuggacucauuuuaaaaaauggaacauaaaauacaaugu

SEQ ID NO: 547631 - RNA, 64 nt, hsa
cagcaagggugaugggaaagcauuguaaaugugcuuuuaaaaaaaaauacugauguuccuagug

SEQ ID NO: 547632 - RNA, 64 nt, hsa
ugauaaaguuccuuaagcaucugauagaaugauguuuuaaaaaaauuugacgcuugcuuaggag

SEQ ID NO: 547633 - RNA, 64 nt, hsa
uuaaguaaugauacuguguguuuucccaaagcacuuuuaaaaaaauuuuuauaaauuacuaucu

SEQ ID NO: 547634 - RNA, 64 nt, hsa
aagaguauuuuuaacacuuaaauuucuuggcaaauuuuaaaacauuuuuuagucuguaauacac

SEQ ID NO: 547635 - RNA, 64 nt, hsa
aaauuaagauuuauuagccaaacuugaauucuaguuuuaaaacugacugugaauuuuauuuuuc

SEQ ID NO: 547636 - RNA, 64 nt, hsa
gccggcuucaacaaaaugggauaaaaaaauaauuuuuuaaaacuuacaacacuccgaguucugc

SEQ ID NO: 547637 - RNA, 64 nt, hsa
ugugaacacugcaaaaauguguuuaaauuaucuuuuuuaaaaccuauucaggauuauuagccug

SEQ ID NO: 547638 - RNA, 64 nt, hsa
uccaucaccaguggaguuuuuuuauuuguuauuuuuuuaaaaguuuaggugccuuugcggauga

SEQ ID NO: 547639 - RNA, 64 nt, hsa
agcagagaaauaagaauaaaacuaaugaaggguuuuuuaaaagaacuaaauaaaacaaauaaaa

SEQ ID NO: 547640 - RNA, 64 nt, hsa
cugauuuugaaauacuaagaucagacuuugaaaauuuuaaaaauucuuucauucuuacuuuuca

SEQ ID NO: 547641 - RNA, 64 nt, hsa
ugggaaucuuugacaaacaaauuauuuuuauuuguuuuaaaauuaaaauacuguguaccccccc

SEQ ID NO: 547642 - RNA, 64 nt, hsa
cagauaaacauacaacuuccaaaaggcaucugauuuuuaaaaaauuaaaauuucugaaaaccaa

SEQ ID NO: 547643 - RNA, 64 nt, hsa
aauaagguauaacaagcuuggcaaaguguuggcuuuuuaaaaaaaaauuuuuuuaaucucuagc

SEQ ID NO: 547644 - RNA, 64 nt, hsa
uacaugguuuuguuuaaaauuaccauuacuuguuuuuuaaaaacacaugaccacauauguauau

SEQ ID NO: 547645 - RNA, 64 nt, hsa
acuugcuaucuauucugugugcugcagccugaguuuuuaaaaaacagaaaaugaggggccaggu

SEQ ID NO: 547646 - RNA, 64 nt, hsa
aaauaggaaacugaaacucuguggaauauaaacuuuuuaaaaauaauuucaucagguuuuuugu

SEQ ID NO: 547647 - RNA, 64 nt, hsa
gagcacuaugauuaucaaggugacuuuggaaaccuuuuaaaaaugcauuuuugcaaaacaagau

SEQ ID NO: 547648 - RNA, 64 nt, hsa
uauuaaguguggaagcuuauuaauauuuuugguuuuuuaaaaacugaaauuuuuaauuuuuacu

SEQ ID NO: 547649 - RNA, 64 nt, hsa
aaauauuacaaaaaugauuguauuuaaagaaauuuuuuaaaauccagaaagucauuuaaaauag

SEQ ID NO: 547650 - RNA, 64 nt, hsa
agaaugacuagccuuuuuauaacgauacaaaguuuuuuaaaaauacauaaaugucauaaaguuu

SEQ ID NO: 547651 - RNA, 64 nt, hsa
aauaacccaucccugucuucuuaaagugguaggguuuuaaaauucaugauacaaguaacaaagu

SEQ ID NO: 547652 - RNA, 64 nt, hsa
aagaaaaaaaguuuguauauauuuuaaaaaauuguuuuaaaagucaguuugcaacaugucugua

SEQ ID NO: 547653 - RNA, 64 nt, hsa
uugagaagaauagaagaaaaaaaguuuguauauauuuuaaaaaauuguuuuaaaagucaguuug

SEQ ID NO: 547654 - RNA, 64 nt, hsa
gacuagcuaauuuauuuuuuugcaucuuaguuauuuuuaaaaacaaauucuucaaguaugaaga

SEQ ID NO: 547655 - RNA, 64 nt, hsa
cugcuguuuaaauuucccgcauauuccaauucacuuuuaaaaaauaccauuugaauuuguauuu

SEQ ID NO: 547656 - RNA, 64 nt, hsa
acaguagccaaggaauacaaacauaauugcauguuuuuaaaaauuccuuggaggcuggaagggg

SEQ ID NO: 547657 - RNA, 64 nt, hsa
ccacaauaccuuuuuaauacucaguguucuguuuuuuuaaaaacuugauauuccuguauggugc

SEQ ID NO: 547658 - RNA, 64 nt, hsa
gauggcuucacugaagaaaaggcauuuuaagauuuuuuaaaaaucuugucagaagaucccagaa

SEQ ID NO: 547659 - RNA, 64 nt, hsa
guggaaaaaugaccuuuccuuaacuugaagcuacuuuuaaaauuugagggucuggaccaaaaga

SEQ ID NO: 547660 - RNA, 64 nt, hsa
ucaagccucaguccccuucauauuacccucuccuuuuuaaaaauuacgugugcacagagagguc

SEQ ID NO: 547661 - RNA, 64 nt, hsa
uuauuuuuuuucuuuucccucaauccuuuuuuauuuuuaaaaauaguucuuuuguaauguggug

SEQ ID NO: 547662 - RNA, 64 nt, hsa
auuuuaauuuuguacaauaaccugcuagacacauuuuuaaaaugcaacauguguacuuaauuuc

SEQ ID NO: 547663 - RNA, 64 nt, hsa
aauaaaauagauaaauaaauauaugauuaacuaauuuuaaaaauguuaaaauguauucuuaaau

SEQ ID NO: 547664 - RNA, 64 nt, hsa
ccucuugacuccuugugauguggcaauaaauuuuuuuuaaaaaacugaaaauacuuaggaagga

SEQ ID NO: 547665 - RNA, 64 nt, hsa
ccaauuaaugugucucaugaagagaagacaccaguuuuaaaaugagccacaaacaguaaagccc

SEQ ID NO: 547666 - RNA, 64 nt, hsa
uaaacauacacacacacacacaccccuauguaguuuuuaaaacacuggcaaugacccacucccc

SEQ ID NO: 547667 - RNA, 64 nt, hsa
ggguuuguuguuguuuuugagcuggcuguauauauuuuaaaauuauaaauagauaauauauuau

SEQ ID NO: 547668 - RNA, 64 nt, hsa
cgccagaguaguuuagagcagaggaaaauauuuguuuuaaaacuagcuuuaaaguuuuguuuca

SEQ ID NO: 547669 - RNA, 64 nt, hsa
gguaaggaaaugccgauucuucauuauaaacaaguuuuaaaauuguucuuucuuaguucaaaug

SEQ ID NO: 547670 - RNA, 64 nt, hsa
agaguuuucguguuacaucaccuaaagagauuucuuuuaaaaacuuucuagacucuuugcaaaa

SEQ ID NO: 547671 - RNA, 64 nt, hsa
aauggacaguagccacuuacaaacaaaucaacauuuuuaaaaagaaaauguaaagguguguuuu

SEQ ID NO: 547672 - RNA, 64 nt, hsa
auuaggaugauuagauugaaacacauguuguauguuuuaaaaacuacauugcuucauuacuuuc

SEQ ID NO: 547673 - RNA, 64 nt, hsa
auauagaccauucauuugccugagcguggcacaguuuuaaaaauaguucucuugauugauuuca

SEQ ID NO: 547674 - RNA, 64 nt, hsa
ugucaucuacugggacuaggguuuuaaauacagcuuuuaaaaacaaaaacagggaauaaaagcu

SEQ ID NO: 547675 - RNA, 64 nt, hsa
uuuggaaagugcaaauaagcaaaaaugaaaacaauuuuaaaaauguaaaaccucucuugccagg

SEQ ID NO: 547676 - RNA, 64 nt, hsa
guggaggacgugguacaggguugcagauguuuaguuuuaaaaauucaauuauaaaaauaauaaa

SEQ ID NO: 547677 - RNA, 64 nt, hsa
cuuccugcuugaaacccaauucuuauaugaaauuuuuuaaaagcagaaaccuagcagcccaucu

SEQ ID NO: 547678 - RNA, 64 nt, hsa
aaagaagaauaaauacauauuuuuaauaauguaauuuuaaaaauccuuuauaaucaggacugag

SEQ ID NO: 547679 - RNA, 64 nt, hsa
cgaacaaagagcgaaccaaagcgaugcuucgaauuuuuaaaacggaaucucugcacccaaaugc

SEQ ID NO: 547680 - RNA, 64 nt, hsa
uuuccacuuuuguucuacuccuucccuaauagcuuuuuaaaaaaaucuccccaguagagaaaca

SEQ ID NO: 547681 - RNA, 64 nt, hsa
gggcucauagugagaacccaucuauacaaaaaauuuuuaaaaauuagcauggcggcacacaucu

SEQ ID NO: 547682 - RNA, 64 nt, hsa
gugugacuuuaucuucugggugguuugauaguguuuuuaaaaguaauauauaauguggggugaa

SEQ ID NO: 547683 - RNA, 64 nt, hsa
cuuuauuuuauuauuaacuaauuaacuaugagauuuuuaaaaaauggggccgcugaugugcaau

SEQ ID NO: 547684 - RNA, 64 nt, hsa
accauaacugauuuuaauuuugcauuauuuaugauuuuaaaauauuuguugcccagguguuaug

SEQ ID NO: 547685 - RNA, 64 nt, hsa
agaacuuaaagaaauucacuacugcaguuuuuauuuuuaaaaaacaguaauugagauauugaag

SEQ ID NO: 547686 - RNA, 64 nt, hsa
auaaaaacccaucaggacagaaugaugcucaauauuuuaaaauucuaaaaauagggugggauuu

SEQ ID NO: 547687 - RNA, 64 nt, hsa
uuagguggacaaauuuaacaaguuuucuguuacuuuuuaaaaagaaaaaauccagaacauaaga

SEQ ID NO: 547688 - RNA, 64 nt, hsa
uuauucugaaggacuuuaaggaagggauacaugauuuuaaaaaagccuguaagaggugaaauau

SEQ ID NO: 547689 - RNA, 64 nt, hsa
uuugaagucucuuuauagacuuuuuauauauauuuuuuaaaacacucaucuagaugaggugcuu

SEQ ID NO: 547690 - RNA, 64 nt, hsa
gguuccuaaggaagaaauucuaaauaaugcaaacuuuuaaaauaagcaucuagguuuuugauaa

SEQ ID NO: 547691 - RNA, 64 nt, hsa
caaauuuauacacugauuuuuguaaaggacaaaguuuuaaaagcguauuuaacuugauguuuuc

SEQ ID NO: 547692 - RNA, 64 nt, hsa
auauuguacugguacaaaauaguuuuaaauuauauuuuaaaaagcuuccaaucuuguggugugu

SEQ ID NO: 547693 - RNA, 64 nt, hsa
auuuugcauaaucaaggcacuguaaaucuuauaauuuuaaaauaaauuacuuaagaacaguugu

SEQ ID NO: 547694 - RNA, 64 nt, hsa
auucaggcuuuauuucugguaugaaguuuauauuuuuuaaaaaaauccuauauuaucacaccag

SEQ ID NO: 547695 - RNA, 64 nt, hsa
uuuccuuuuuuuuucuuuacuuuuaaauuuuaacuuuuaaaaucuauuucauuucuuaguuaug

SEQ ID NO: 547696 - RNA, 64 nt, hsa
guauuuuguacauaccaguuguuaaauaaauaauuuuuaaaaucucagcucucacauugaauua

SEQ ID NO: 547697 - RNA, 64 nt, hsa
auuuggggaaaggucuuuuuugcuuaauuuuguuuuuuaaaacucugaugauugcuugagcaac

SEQ ID NO: 547698 - RNA, 64 nt, hsa
gaauguuuauaagcuuuccauuuccuagguaauuuuuuaaaagccagucaaaacaaaaacuuua

SEQ ID NO: 547699 - RNA, 64 nt, hsa
caauuuaauuagcuguugcagaauaaguaauauauuuuaaaaaccuagcuccuuucauuauuua

SEQ ID NO: 547700 - RNA, 64 nt, hsa
aggugugaugagagaauucagauauacuuuaucuuuuuaaaaaaguguaaauaaaaucaaagaa

SEQ ID NO: 547701 - RNA, 64 nt, hsa
uaagcuuuauauuugcuuauuuguuguagcuacauuuuaaaaaaaagauugaacuugaugacuu

SEQ ID NO: 547702 - RNA, 64 nt, hsa
acacuuaaugguguuagaaaucaacaaaacuccuuuuuaaaaagaaaagauauuaagccugccu

SEQ ID NO: 547703 - RNA, 64 nt, hsa
cugcacagagcauaaugugaaguuuuauaccuacuuuuaaaauucugcuuuccagaaacaaaau

SEQ ID NO: 547704 - RNA, 64 nt, hsa
guauucacuugaaagcaaacuggcaugguucguauuuuaaaaaucuugcacaaauuguaaugug

SEQ ID NO: 547705 - RNA, 64 nt, hsa
gaaguuaaaauggacagcauuucuagaauuaacauuuuaaaaucuagucuuagcuagauaugug

SEQ ID NO: 547706 - RNA, 64 nt, hsa
acuucuuucaucaggaaaccuuauucaggaggguuuuuaaaaaguguuuaaaugucaaauguga

SEQ ID NO: 547707 - RNA, 64 nt, hsa
augauguuaguuuuccuuagcugauuuugaggguuuuuaaaaauaaagcaagguugacuaaccu

SEQ ID NO: 547708 - RNA, 64 nt, hsa
uaacuccaaagugaaagucucuuucucuggauuauuuuaaaauuuuggcguguuuaaccauuaa

SEQ ID NO: 547709 - RNA, 64 nt, hsa
auacuugugaugucugacgcaugauggccuaugguuuuaaaaauaguauuguggaauauauuuu

SEQ ID NO: 547710 - RNA, 64 nt, hsa
uuucagauuuuuugaaccauccacuuacauauauuuuuaaaaaaugaaauccuuuuccuguuca

SEQ ID NO: 547711 - RNA, 64 nt, hsa
agaauucuguauuggauauauaagagcaugaaauuuuuaaaaauacacuugugauuauaaaauu

SEQ ID NO: 547712 - RNA, 64 nt, hsa
uagaagggggacuucuaggaauuuauaaccaaaauuuuaaaacuauuuuuauauuuuuuuaaau

SEQ ID NO: 547713 - RNA, 64 nt, hsa
gaaaauugcauagcuuuuuguaacauuuacuuaauuuuaaaacuaaacucauacuuuugcuauc

SEQ ID NO: 547714 - RNA, 64 nt, hsa
uuuuaauauuuaucucguuugggaguauacguguuuuuaaaauuuguguuuucuaucuguuuac

SEQ ID NO: 547715 - RNA, 64 nt, hsa
gcucucucaaaaauuaauuuuuauuccuuaagcauuuuaaaaacauuuuaaaaaauguuuugua

SEQ ID NO: 547716 - RNA, 64 nt, hsa
aauuaauuuuuauuccuuaagcauuuuaaaaacauuuuaaaaaauguuuuguaaauccaggugu

SEQ ID NO: 547717 - RNA, 64 nt, hsa
aucuuuggagccgcuuuuuuuuucuuuuucauuuuuuuaaaagauugagugguacacuaauaaa

SEQ ID NO: 547718 - RNA, 64 nt, hsa
cagaacuugaggcaaaucguaaggaagcuguuucuuuuaaaacacaaaccaccaccaaaaauuu

SEQ ID NO: 547719 - RNA, 64 nt, hsa
guacauauugcuuaaguauuuggcuguuuuuauuuuuuaaaagguauaaacaccaaaaaaaaaa

SEQ ID NO: 547720 - RNA, 64 nt, hsa
uuguaauaaauuugacucauuaaaaaccuuuuuuuuuuaaaaaaaaaaaaaaagaaaaucucau

SEQ ID NO: 547721 - RNA, 64 nt, hsa
ugaacuuaucuuugcagcugaguacuuaaauucuuuuuaaaaagauacccuuuggauugaucac

SEQ ID NO: 547722 - RNA, 64 nt, hsa
cuggcauugacauuauugguaaucaacuggcuuuuuuuaaaaaagguagcauuuuguugacagu

SEQ ID NO: 547723 - RNA, 64 nt, hsa
agugaaggacaaaaaucaugauuguggaagauauuuuuaaaaucugauuuugcagcgaucacuu

SEQ ID NO: 547724 - RNA, 64 nt, hsa
gugagccaccgcgccuggccagggacuauacucuuuuuaaaauagacauuuguggggcucacac

SEQ ID NO: 547725 - RNA, 64 nt, hsa
aggacuauuacauacuucauuacuaggaaguucuuuuuaaaaugacacuuaaaacaaucacuga

SEQ ID NO: 547726 - RNA, 64 nt, hsa
ucuuuaguaagaauguguuaaaauuacaaugaucuuuuaaaaagaugaugcaguucuguauuua

SEQ ID NO: 547727 - RNA, 64 nt, hsa
guuucgccuuguugcccaggcugaauuuggguuuuuuuaaaaugagacuuucaguccuaauuug

SEQ ID NO: 547728 - RNA, 64 nt, hsa
gaaauuuauagcuucaaauacuuauauacauauuuuuuaaaaguagcuuuacauaggaaggaag

SEQ ID NO: 547729 - RNA, 64 nt, hsa
ucaaaacaacccccacacagaccccgcaauccuuuuuuaaaaaaucugccaauagacccaggac

SEQ ID NO: 547730 - RNA, 64 nt, hsa
agacccaggacgaguaagagaggaagcaucaaccuuuuaaaaauuuccuuucgcuuucauuauu

SEQ ID NO: 547731 - RNA, 64 nt, hsa
uuaaauacuguuucagaguucuaaaaaggcaguuuuuuaaaaaacuuaaguugauaaaaacugu

SEQ ID NO: 547732 - RNA, 64 nt, hsa
auuuuaaacauggugugguauucuaaagccuuuuuuuuaaaaaaagagaucuuuuugagagaaa

SEQ ID NO: 547733 - RNA, 64 nt, hsa
gaaaaucuauaguaaaacauguagcuauaacauauuuuaaaaauaaaaucugaaaaccucagaa

SEQ ID NO: 547734 - RNA, 64 nt, hsa
uucugagauuuuccuucuuacacuguuaaucuuauuuuaaaaaauauuacauucuuguauacuu

SEQ ID NO: 547735 - RNA, 64 nt, hsa
uuuugguuggcaguaaccgauuuuaaugacuagcuuuuaaaaauacaguacaaagacuuuguaa

SEQ ID NO: 547736 - RNA, 64 nt, hsa
cuaauauacauuuugucugugaaaauauaguaaauuuuaaaauacuaauauaaugugguauucu

SEQ ID NO: 547737 - RNA, 64 nt, hsa
cagacccauuuuuuaaagugcuagaaaaugcuuuuuuuaaaaaaaaaauacaaguuuuaaaaug

SEQ ID NO: 547738 - RNA, 64 nt, hsa
cuagaaaaugcuuuuuuuaaaaaaaaaauacaaguuuuaaaaugaccacuuacucuuuaauuau

SEQ ID NO: 547739 - RNA, 64 nt, hsa
gccaguuaaugugauucaguugugaccugugggauuuuaaaauuuuccugcccucauaauuuaa

SEQ ID NO: 547740 - RNA, 64 nt, hsa
uuuugguaagccucucuuacuccuguuaugcacuuuuuaaaauaaauacugaauuccagaaaga

SEQ ID NO: 547741 - RNA, 64 nt, hsa
ucaugucaaaauuuaguugaacugguuuuucaguuuuuaaaaggccuacagaugaguaaugaag

SEQ ID NO: 547742 - RNA, 64 nt, hsa
uuuuaggaaaguuaucuaguuuaaauuucaaauguuuuaaaauuuguaggcauuuaauaaauua

SEQ ID NO: 547743 - RNA, 64 nt, hsa
uauuuaauauguuucucuuaacaccugaaacuuguuuuaaaacaaaaagcaguauucacuucaa

SEQ ID NO: 547744 - RNA, 64 nt, hsa
ccaaaugaaugaaaauguauguuucuuuguacuuuuuuaaaaaaaucagcuuaguaacaauacu

SEQ ID NO: 547745 - RNA, 64 nt, hsa
uauauuucuaaugcaaacuuaacaauuguguacuuuuuaaaagcugcaauauguguuggaaaau

SEQ ID NO: 547746 - RNA, 64 nt, hsa
gcaaaacuaggaaaagguuaaacuggauuuuuuuuuuuaaaaaaaagaaaaaaaaagaagaaaa

SEQ ID NO: 547747 - RNA, 64 nt, hsa
guaguauuauuaaucuucugacauuuucuuauguuuuuaaaaagauaagagcaucuagugcauu

SEQ ID NO: 547748 - RNA, 64 nt, hsa
ucuucucaagcguuuucaagaucuagcauguggauuuuaaaagauuugcccucauuaacaagaa

SEQ ID NO: 547749 - RNA, 64 nt, hsa
cacuucugagaguaguaaaugacucuuugcuacauuuuaaaagcaauuguauuaguaagaacuu

SEQ ID NO: 547750 - RNA, 64 nt, hsa
aguuuuccuuccuuaaccaugggugcuaguaacuuuuuaaaacucaagacaagauuaguuuuuu

SEQ ID NO: 547751 - RNA, 64 nt, hsa
gaagaaaagauuugguuuucauggcagucuguuuuuuuaaaaaaaaauuuuugagccacuaucu

SEQ ID NO: 547752 - RNA, 64 nt, hsa
uauagaucuggaggaaagaaagcuacgaaaaacuuuuuaaaaguucuagugguacgguaggagc

SEQ ID NO: 547753 - RNA, 64 nt, hsa
uaagguuuuccccccuuuauuuuccguaguuguauuuuaaaagauucggcucuguauuauuuga

SEQ ID NO: 547754 - RNA, 64 nt, hsa
gagaagaguaucuguaaauaaaaggguuccaaccuuuuaaaaaagaaggaaaaaacuuuuuggu

SEQ ID NO: 547755 - RNA, 64 nt, hsa
aaaaacuuuuuggugcuccaguguagggcuaucuuuuuaaaaaaugucaacaaagggaaaauaa

SEQ ID NO: 547756 - RNA, 64 nt, hsa
auugucuaucccuguuuuuauaugucuccauucuuuuuaaaaucuuaacauauggagcagccuu

SEQ ID NO: 547757 - RNA, 64 nt, hsa
uuuagagaacaagaacaaaccaugucucaaauuuuuuuaaaaaaaauuaaugguuuuaaauaua

SEQ ID NO: 547758 - RNA, 64 nt, hsa
uagucacuacuguuaucacaucccuuuguauaaguuuuaaaaagagauggagggagaucuucau

SEQ ID NO: 547759 - RNA, 64 nt, hsa
augauauccaaacuuaauuuggcuaggacuucaauuuuaaaaaucaguguaccuaggcagugca

SEQ ID NO: 547760 - RNA, 64 nt, hsa
cacuugugcacugugaaugaacuuuguauuauuuuuuuaaaaccuucacauuacguguagauau

SEQ ID NO: 547761 - RNA, 64 nt, hsa
aucuuaaaaguaauacagaauugugauuuauuaauuuuaaaacauucagaacuuguugaaagaa

SEQ ID NO: 547762 - RNA, 64 nt, hsa
uuaaagaauuugcauccauuuuugagucuaaaucuuuuaaaauauacugagauccacaucuagu

SEQ ID NO: 547763 - RNA, 64 nt, hsa
aauaacucuuauuuuuauuuuugaagguuuuuuuuuuuaaaaaaaaaaacguauaaaauaaugc

SEQ ID NO: 547764 - RNA, 64 nt, hsa
guuaucugauagggccuuggaggagaagguccaguuuuaaaaaaugacaguuuguguuuaauaa

SEQ ID NO: 547765 - RNA, 64 nt, hsa
uguaauccuuguucaguucuuaaguuucgguuuuuuuuaaaaacaggaugcaacuuaaacuuuu

SEQ ID NO: 547766 - RNA, 64 nt, hsa
ccuggugucuccgacucaucaauucucgggucuuuuuuaaaagccaggcuccccaaagcacucu

SEQ ID NO: 547767 - RNA, 64 nt, hsa
gagagagcaaauacagcaaucuagaguuuagccuuuuuaaaaaugugacuuuaacccgcccacc

SEQ ID NO: 547768 - RNA, 64 nt, hsa
ugauuucuccagaaauuuaccacaaaagcaaaauuuuuaaaacugcauuuuuaaucaguggaac

SEQ ID NO: 547769 - RNA, 64 nt, hsa
guuuaaaagcaaauacugauuuucaaaaaaauguuuuuaaaaaccuauuuugaaaggucagaau

SEQ ID NO: 547770 - RNA, 64 nt, hsa
gacugaaagaaacuaagauuuaucugcaaggauuuuuuaaaaauuggcauuuuaaguguuuaaa

SEQ ID NO: 547771 - RNA, 64 nt, hsa
aacauaguuggaaauguaaucauccaaagaucauuuuuaaaaugaaauuuaauuagcacauauu

SEQ ID NO: 547772 - RNA, 64 nt, hsa
ugaaugauacugaucuuauaucuguuaaaaguuguuuuaaaaagcuguggcaucccauuguuca

SEQ ID NO: 547773 - RNA, 64 nt, hsa
gggguaacaacuguacuuacuuuacaggaagaaauuuuaaaacugaaaacuaccugggaucaua

SEQ ID NO: 547774 - RNA, 64 nt, hsa
aauuauuuccaaagaccccaguauuugcugcuauuuuuaaaacuccccugauguaccugaacaa

SEQ ID NO: 547775 - RNA, 64 nt, hsa
uacaucuuugauauaaagcacugccauauuuauauuuuaaaaggaaauuagacauuuuauaugu

SEQ ID NO: 547776 - RNA, 64 nt, hsa
gauuacauuuaauagcuuguuaccugugauuuuauuuuaaaauauuuauuuugauaugaugcuu

SEQ ID NO: 547777 - RNA, 64 nt, hsa
uguaugucaugcuguuuaugugugacuaccggguuuuuaaaaguagugucuggaguuuguaaug

SEQ ID NO: 547778 - RNA, 64 nt, hsa
uuaaaaaauaagauuaauggaagacuuuaagguauuuuaaaauucgaaggguauccaagguucu

SEQ ID NO: 547779 - RNA, 64 nt, hsa
ugauugcugcagguaacugaaacaaaccuagcauuuuuaaaaaauaagauuaauggaagacuuu

SEQ ID NO: 547780 - RNA, 64 nt, hsa
ggcaccucuucccuucaauaucuguucuucguauuuuuaaaaaaauuuguuuuagacugccuug

SEQ ID NO: 547781 - RNA, 64 nt, hsa
auuuuaaaaaauccugccuaaaguaaacacuuuguuuuaaaaugauacaguaucagauuuuguu

SEQ ID NO: 547782 - RNA, 64 nt, hsa
uuuuugucuuaucugcguggguauugcugcuuuauuuuaaaaaauccugccuaaaguaaacacu

SEQ ID NO: 547783 - RNA, 64 nt, hsa
gcagcaugggacugaaacaugagaaugccaccuuuuuuaaaacuuaguuuagugacaaagucau

SEQ ID NO: 547784 - RNA, 64 nt, hsa
auuucuuuuggugaccgaagcugcucucuuuuccuuuuaaaaucacuucucuggccucugguuu

SEQ ID NO: 547785 - RNA, 64 nt, hsa
uugcagagaaaaaaaaaaguccccacauuuuauuuuuuaaaaaccauccuuucgauuucuuuug

SEQ ID NO: 547786 - RNA, 64 nt, hsa
uguuauuuuacauuuuauguucaauaagaacacuuuuuaaaagacguauauucaacauaaaauc

SEQ ID NO: 547787 - RNA, 64 nt, hsa
aagagaguuauuacaaauaaauaugucucuuuauuuuuaaaaaugaaaucuuaauucauuuacu

SEQ ID NO: 547788 - RNA, 64 nt, hsa
cugaauuaauaauucucucuuuccucuuaagcacuuuuaaaauaauaaaguacaucuugaaauu

SEQ ID NO: 547789 - RNA, 64 nt, hsa
gauguccacugaugaaauuuuaaaggaguuucaguuuuaaaagugcgcaugauucuacauauga

SEQ ID NO: 547790 - RNA, 64 nt, hsa
ucauauaacucaagaauaaaugguguuuuggaaauuuuaaaauuaucaucgaagguggugaaac

SEQ ID NO: 547791 - RNA, 64 nt, hsa
guccuugggaucccagaucacucuuuuuuuuuuuuuuuaaaaggggcagccccuugauggcuca

SEQ ID NO: 547792 - RNA, 64 nt, hsa
cacugcucuuccucaccugucacauaaagcauuuuuuuaaaaagucagcugcuccaaaaucauc

SEQ ID NO: 547793 - RNA, 64 nt, hsa
gauuuuuauuuucucugucugaagaaccagccauuuuuaaaaagguuauuauugacaucccaau

SEQ ID NO: 547794 - RNA, 64 nt, hsa
uauacuuuuuuccaaauaaugcacauuuaauauguuuuaaaaugucuuauuuuuaagaauuaua

SEQ ID NO: 547795 - RNA, 64 nt, hsa
uaucagugcuucauugucauuguguuuuuaaacuuuuuaaaauuaaaacaguucauuuugggga

SEQ ID NO: 547796 - RNA, 64 nt, hsa
aaauguggacaucucuuguucagcagauggcaguuuuuaaaaaauaaagguugugaggaaaaga

SEQ ID NO: 547797 - RNA, 64 nt, hsa
gucuaaaauacuacauugucacuguaagcuauacuuuuaaaauauuuauuuuuuuuaaaguauu

SEQ ID NO: 547798 - RNA, 64 nt, hsa
guuuaugaagagaguugaguuuaacaauccuagcuuuuaaaagaaacuauuuaauguaaaauau

SEQ ID NO: 547799 - RNA, 64 nt, hsa
ccaucaaauauguucuuaucucagacuuacguuguuuuaaaaguuuggaaagauacacaucuuu

SEQ ID NO: 547800 - RNA, 64 nt, hsa
uauguguugcauaaacaauccaaaugcauucauguuuuaaaaguuuguccuuuaacuaucagag

SEQ ID NO: 547801 - RNA, 64 nt, hsa
aagucuugcauugaauuuagucauuauuauuacuuuuuaaaauguuggugcaauuaacucugga

SEQ ID NO: 547802 - RNA, 64 nt, hsa
aaauguuuuauuguuacuuuuuuaaaaugaauuuuuuuaaaacaaucuagccaucaucaaggug

SEQ ID NO: 547803 - RNA, 64 nt, hsa
uuacuuuucaucuguaaauguuuuauuguuacuuuuuuaaaaugaauuuuuuuaaaacaaucua

SEQ ID NO: 547804 - RNA, 64 nt, hsa
auggaguaacaaauuacagaauagcuaaauaauuuuuuaaaaauauuuuacaguuguaaaaaau

SEQ ID NO: 547805 - RNA, 64 nt, hsa
gaguagucugauuuagagacuaguuacuucuauuuuuuaaaauaauggaguaacaaauuacaga

SEQ ID NO: 547806 - RNA, 64 nt, hsa
uuuaaucucucucucuuuuuuuuuuuuuuuuugguuuuaaaagcacaaucacuaaacuuuauuu

SEQ ID NO: 547807 - RNA, 64 nt, hsa
aauugucguuuuuauuccucuuauugggauaucauuuuaaaaacuuuauuggguuuuuauuguu

SEQ ID NO: 547808 - RNA, 64 nt, hsa
gcaagaccccauccuuuaaaaaauuuuagaacuuuuuuaaaaucaaagugcagauugcuuguau

SEQ ID NO: 547809 - RNA, 64 nt, hsa
uuucuauaauaauuaguacuauuuaauggugagcuuuuaaaaauguaggauagaggguacagug

SEQ ID NO: 547810 - RNA, 64 nt, hsa
auuauaaaacagggggaaagcagacugacccucuuuuuaaaaguuuacccccucuucaacugaa

SEQ ID NO: 547811 - RNA, 64 nt, hsa
uugaaacaaaaaauuuuaccugugcaaaauaguuuuuuaaaaauuauacauguagcucaacuug

SEQ ID NO: 547812 - RNA, 64 nt, hsa
gcagcucaagcaugcaguaugaauacuguguauuuuuuaaaaaaauaauuuaguaucaaggcuu

SEQ ID NO: 547813 - RNA, 64 nt, hsa
ggauuuuuuuauaaacaguuuuacuugugucauauuuuaaaauuacuaacugccaucaccugcu

SEQ ID NO: 547814 - RNA, 64 nt, hsa
ucuauuaguuuuuuggccuugcucuucuccuugauuuuaaaauuccuucuauagcuagagcuuu

SEQ ID NO: 547815 - RNA, 64 nt, hsa
uuauauuugaugcaaauauuugaucacuuaaaacuuuuaaaacuucuagguaauuugccacgcu

SEQ ID NO: 547816 - RNA, 64 nt, hsa
aaggcagaaaacccaccaugggaaaauaagcauuuuuuaaaaucugaaguugcucuuuuccugu

SEQ ID NO: 547817 - RNA, 64 nt, hsa
uaagaaugcuuuauguuuaggacaacaaaaauaauuuuaaaaaguuauuuuuuacccuaauacu

SEQ ID NO: 547818 - RNA, 64 nt, hsa
uuuaaaaaaugcuaauaagaaaauuggaagauucuuuuaaaaauuuuucuuuuuuguuguuguu

SEQ ID NO: 547819 - RNA, 64 nt, hsa
gacuucggaaaauuaagucagagaugguauuaccuuuuaaaaaaugcuaauaagaaaauuggaa

SEQ ID NO: 547820 - RNA, 64 nt, hsa
uuaugaauagugcugcgauaaacagugcaggugauuuuaaaauauaauuuccuuuggguagaua

SEQ ID NO: 547821 - RNA, 64 nt, hsa
aaagacgguuucuuuuaauuuuggcaguuugguauuuuaaaaauugucuauuguuaaauuuuga

SEQ ID NO: 547822 - RNA, 64 nt, hsa
cuaguuuuauuaaauauuacacuugagagacacuuuuuaaaaauguguuaaugucaauaugaug

SEQ ID NO: 547823 - RNA, 64 nt, hsa
aacuuaccuauuauccaccucuguuggaacucucuuuuaaaaaguacauuuauagauugaucag

SEQ ID NO: 547824 - RNA, 64 nt, hsa
aaauuuaaagaaaagcuagaggaaaaaaaaauuuuuuuaaaaauacuuauuagaagcaaacugc

SEQ ID NO: 547825 - RNA, 64 nt, hsa
cuagggguacauucuuacaaaauaaauaaacaguuuuuaaaauuguuuagacacagauauuugg

SEQ ID NO: 547826 - RNA, 64 nt, hsa
ugaaaggguuuuuguaaauuuuuuggccaaaauuuuuuaaaacauacuuacuuuggacuagggg

SEQ ID NO: 547827 - RNA, 64 nt, hsa
uuaaauuuagacuauguaguaugugacagaauuuuuuuaaaauuauaaaaagauuuuauuuagu

SEQ ID NO: 547828 - RNA, 64 nt, hsa
aaaauucccccucauuagaauguuuaagaaaucuuuuuaaaaaguaaaauucugucagacuaca

SEQ ID NO: 547829 - RNA, 64 nt, hsa
uuuaaaaaccguuuuaacauuuugccuuuuuauguuuuaaaagcuaaccauuuuuauuaaaccu

SEQ ID NO: 547830 - RNA, 64 nt, hsa
uguguuuuucuggagggaggaagaaauuuuaaauuuuuaaaacagcugucaagauaaacacugu

SEQ ID NO: 547831 - RNA, 64 nt, hsa
cucugccaugacucuuaaaguagucuuacuuguuuuuuaaaaugcugguauuaaacuaaaugga

SEQ ID NO: 547832 - RNA, 64 nt, hsa
uuauauuuuuaaggaaguaaguuauagcauacuuuuuuaaaaguaggaaccacaaucuuuauau

SEQ ID NO: 547833 - RNA, 64 nt, hsa
cauaucuaugucucauaaaaauuagaauguacuauuuuaaaauaauauguguaaauugaaauuu

SEQ ID NO: 547834 - RNA, 64 nt, hsa
uauuuagcauaagacgugauauuuuuaauuucuuuuuuaaaaaauuauauuugucucuuagagu

SEQ ID NO: 547835 - RNA, 64 nt, hsa
augcucauuuuuacaugcugcuacuagcuuuuuuuuuuaaaaaaaguaaaaguugcugcuuucu

SEQ ID NO: 547836 - RNA, 64 nt, hsa
cugaagacaaacuuguuucaaugauagucuucauuuuuaaaaacaaaaaggcaggcagacagaa

SEQ ID NO: 547837 - RNA, 64 nt, hsa
uuuguuuuguacaguucuguuagauguuguuauauuuuaaaaguuuaauuuaaaaaauuuaauu

SEQ ID NO: 547838 - RNA, 64 nt, hsa
gcuugcuucuuugcccagacauuuacaaaguuguuuuuaaaacacacucauaaguaaguuuggc

SEQ ID NO: 547839 - RNA, 64 nt, hsa
uguguuugcuuuguuaauugccucaggauauuucuuuuaaaauaagcuguuuuaagaggaacag

SEQ ID NO: 547840 - RNA, 64 nt, hsa
ccuaguuuugccacaaccuuuagcaucuaaaaaguuuuaaaagcuucuaaaugucuaauauaaa

SEQ ID NO: 547841 - RNA, 64 nt, hsa
guccacuauuuguuaccagaguugggccacuaucuuuuaaaauugcuggugaaaacuugccacu

SEQ ID NO: 547842 - RNA, 64 nt, hsa
guacaguuaggguaacacuuuagagguuuauuauuuuuaaaaaacuuuucuugaacuccuggcc

SEQ ID NO: 547843 - RNA, 64 nt, hsa
gagacuggggggaguuaccaacuuaaauguguguuuuuaaaaaugcgcuaagaaggcaaagcag

SEQ ID NO: 547844 - RNA, 64 nt, hsa
agcugaaauuggagaaccaaggagcaaaaacaaauuuuaaaauuaaaguauuuuauacauuuaa

SEQ ID NO: 547845 - RNA, 64 nt, hsa
cucccuugacacuuauucuauacuaaaggauaaauuuuaaaaaaucuuuauaggcuacugucag

SEQ ID NO: 547846 - RNA, 64 nt, hsa
cuggagaacugcgaacgagcugcagaaaaccagauuuuaaaauguagaagucguugggcugcau

SEQ ID NO: 547847 - RNA, 64 nt, hsa
cuauaacuagcaaauaauucuauaaacugaauuauuuuaaaagguauuuuaggugacaccacug

SEQ ID NO: 547848 - RNA, 64 nt, hsa
uugugcuggguuaguuuugcaagcaauugauaauuuuuaaaaaauuaucaauauguauaauuuu

SEQ ID NO: 547849 - RNA, 64 nt, hsa
aaauaaauaaaaauuaaaaaaaucugugcaauaauuuuaaaaugugcucccaggaauagacaca

SEQ ID NO: 547850 - RNA, 64 nt, hsa
guuguuaguggggacuaugauacuguaauaauauuuuuaaaaauuuacaucaagagaggcaguc

SEQ ID NO: 547851 - RNA, 64 nt, hsa
uuuaagugaucaaacuaagaauauuguuuauagguuuuaaaaaccaaaccaauaaaauuuuuau

SEQ ID NO: 547852 - RNA, 64 nt, hsa
gucacgguuagaagaagcuaauauuugaaacagauuuuaaaaacuugaaaaauuacaggugaga

SEQ ID NO: 547853 - RNA, 64 nt, hsa
uaccccauccuccugaagccuucguuuucaagacuuuuaaaaagcacuucuacuugguuuuuug

SEQ ID NO: 547854 - RNA, 64 nt, hsa
agaagaaacaacaaaagccaauuagaaccacuauuuuuaaaaagugcuuacugugcacagauac

SEQ ID NO: 547855 - RNA, 64 nt, hsa
gccugggggucccuguguucaccccuagaguuuguuuuaaaauuuuuaauugaagcaugugaag

SEQ ID NO: 547856 - RNA, 64 nt, hsa
augugauguuucuagucugaguuugcuaaguauauuuuaaaauaaucaguaaaguuagauuuua

SEQ ID NO: 547857 - RNA, 64 nt, hsa
aaaaccuuacacccauuauugauuuauuuuucuguuuuaaaauaucuuccugcacuggcuaaaa

SEQ ID NO: 547858 - RNA, 64 nt, hsa
uuuugauuugucauugcuauuguagauggcaucuuuuuaaaaaguuauauuuucuaaagaaaaa

SEQ ID NO: 547859 - RNA, 64 nt, hsa
uacacauucagaaucuggccaauuuaaguuuguauuuuaaaaauauuuuaugcauguuaaguau

SEQ ID NO: 547860 - RNA, 64 nt, hsa
cauuauaacauuuaugugcuuaagauuucuaagguuuuaaaaaguuaccuuuaauacaauccuu

SEQ ID NO: 547861 - RNA, 64 nt, hsa
aaugauauuauugauacucuuucuaaauaagagguuuuaaaauauauaaaaacuuuaugaucca

SEQ ID NO: 547862 - RNA, 54 nt, hsa
aagauucacagaaauucugaauuuuuuuaaaaaugggaaaauaugaaaucuggu

SEQ ID NO: 547863 - RNA, 64 nt, hsa
guuuuugguacacugggcagacuucagagcaguuuuuuaaaaaaauaaauauucuaauguagcu

SEQ ID NO: 547864 - RNA, 64 nt, hsa
auaagaguuacuguugcauuuucugaccuacuauuuuuaaaauuccuguugaguuucuuugugu

SEQ ID NO: 547865 - RNA, 64 nt, hsa
gugguagcucuuacaaaguuuauugauuugauuuuuuuaaaaaucaaaagccaauugaacaaca

SEQ ID NO: 547866 - RNA, 64 nt, hsa
cuuugcaaacauuuaaugaggauacacuguucauuuuuaaaauuccuucacacuguaauuuaau

SEQ ID NO: 547867 - RNA, 64 nt, hsa
ucucucccguuaaacugaguguagaaaucugaauuuuuaaaagagcuguaacuaguuguaagug

SEQ ID NO: 547868 - RNA, 64 nt, hsa
uuuucauuuucagugauguugggaauggacuggguuuuaaaagggagcuugaagagggaauguu

SEQ ID NO: 547869 - RNA, 64 nt, hsa
auauaaacuuguauuauuuuucuuauuuuaaauuuuuuaaaauuucuguagguacauaguaugu

SEQ ID NO: 547870 - RNA, 64 nt, hsa
aauuauaauucacacauuucuaagucaugaaugcuuuuaaaaaauguuccauauuuaucuuuga

SEQ ID NO: 547871 - RNA, 64 nt, hsa
ccagcucagugcugguuuacggaacaacucuuacuuuuaaaaauuacuuguucccccaaauugu

SEQ ID NO: 547872 - RNA, 64 nt, hsa
uuaauuccaucugagugauugucaguguaaggccuuuuaaaacaaaagcaaguucuuuguuagg

SEQ ID NO: 547873 - RNA, 64 nt, hsa
uuuugccuuagugugaaaauguaacauuuuaugcuuuuaaaaucaauagauucaucaccuuagu

SEQ ID NO: 547874 - RNA, 64 nt, hsa
ugcuuuuaaaaucaauagauucaucaccuuaguuuuuuaaaaaaaaucuauaaauaggguaauu

SEQ ID NO: 547875 - RNA, 64 nt, hsa
aaucuaagcaaagcacccaacaaugguaaauguuuuuuaaaaaugcagaacuaagauuuuugac

SEQ ID NO: 547876 - RNA, 64 nt, hsa
guagaaaauuauuaauuuugauuguauuuuuguauuuuaaaagcuucuucacuuguguucccua

SEQ ID NO: 547877 - RNA, 64 nt, hsa
aguaagagaaacaaacuguuuagaauuaucauguuuuuaaaacaucauaguaauauaaaucugc

SEQ ID NO: 547878 - RNA, 64 nt, hsa
guagugaggaaaaaaccuaagaaauuuccccuuuuuuuaaaaaauggaaauauucaauugagac

SEQ ID NO: 547879 - RNA, 64 nt, hsa
auuuauaugugaaaaguuggacauuucuguaaguuuuuaaaauuauccauuuguuacuuuaaca

SEQ ID NO: 547880 - RNA, 64 nt, hsa
aaguuuuuaaaauuauccauuuguuacuuuaacauuuuaaaauuaugguguuuuccugauuuua

SEQ ID NO: 547881 - RNA, 64 nt, hsa
acuuuaacauuuuaaaauuaugguguuuuccugauuuuaaaagcaauauuuuccuuacuguaaa

SEQ ID NO: 547882 - RNA, 64 nt, hsa
agaagucuguaucuagugauaaauauaccaguuuuuuuaaaaagaugcuguugugccuauauca

SEQ ID NO: 547883 - RNA, 64 nt, hsa
uauuuccguaaguacuucuguggccuugaguauuuuuuaaaaggcucaacuguaagccucuuag

SEQ ID NO: 547884 - RNA, 64 nt, hsa
gcucagccuguggcccauugggugauuuccuguauuuuaaaacugacaguagccugaucaaagu

SEQ ID NO: 547885 - RNA, 64 nt, hsa
uggagguuucuaugagguucuuagaaaaauuugguuuuaaaaucauuugaggacaggaaugucu

SEQ ID NO: 547886 - RNA, 64 nt, hsa
uauauuucauuacugaaugcuaaacuguauuucuuuuuaaaauuuggaaaauuuuuaauucuga

SEQ ID NO: 547887 - RNA, 64 nt, hsa
ugaugcuguguuacuaaaauuacaaggaccugcuuuuuaaaaggccagaacaauugucugaaau

SEQ ID NO: 547888 - RNA, 64 nt, hsa
agcauuggaaggucaaauuauuuugaagugauuuuuuuaaaaaaaagucuucuguuuauuaaca

SEQ ID NO: 547889 - RNA, 64 nt, hsa
ugucaccaaaaaguugacuuugaauuuguuggacuuuuaaaaaaccaguuggaaauauagguug

SEQ ID NO: 547890 - RNA, 64 nt, hsa
agaaaaauuaaguaccaaaccuauuaggaaauuuuuuuaaaaaguggauuuaacuuaaauuacu

SEQ ID NO: 547891 - RNA, 64 nt, hsa
guuuuuaaucguuuuuguuuuaaggaaaaaagauuuuuaaaaugaaucuuaugcaaaacuuuuu

SEQ ID NO: 547892 - RNA, 64 nt, hsa
aacuuuuugaccaguuucuuuucuuuuguuuuuuuuuuaaaaaagacauuuaaagacaaagaca

SEQ ID NO: 547893 - RNA, 64 nt, hsa
ccuuuccauuuuacguuuuagaaaauuuuauguauuuuaaaauaaggggaagagucauuuucac

SEQ ID NO: 547894 - RNA, 64 nt, hsa
ugauuuuuaguaaccuuuaaaaauguauaaugacuuuuaaaauuuguagaauugaaaagacgcu

SEQ ID NO: 547895 - RNA, 64 nt, hsa
auggggccuaaccugccacuuauuuuuugucaauuuuuaaaacuuuuuuuuaauuacuguaaag

SEQ ID NO: 547896 - RNA, 64 nt, hsa
aaauccuuucaauauucugggaacccagggaaguuuuuaaaaaugucauuacuuucaaaggaac

SEQ ID NO: 547897 - RNA, 64 nt, hsa
uaaaguacuugaaauguauugacugcugacuauauuuuaaaaacaaaaugaaauaauuugaguu

SEQ ID NO: 547898 - RNA, 64 nt, hsa
agaugauuucauugagcuucauugcagccugaaauuuuaaaaaaguuguguaauacgccaacca

SEQ ID NO: 547899 - RNA, 64 nt, hsa
aaucacagcccaaaauuugauggacuaauuauuauuuuaaaauauaugaagacaauaauucuac

SEQ ID NO: 547900 - RNA, 64 nt, hsa
guauuuuuccaaaugaaaaaucucaauugaaagcuuuuaaaauguagaaacuuaaacacaccuu

SEQ ID NO: 547901 - RNA, 64 nt, hsa
agugucugacuuuuguuaaauucaguaaugcaguuuuuaaaaaccuguaucugacccacuuugu

SEQ ID NO: 547902 - RNA, 64 nt, hsa
guacaaacaguauuucugguguauauuuuaauguuuuuaaaaagaguaauuucauuuaaauauc

SEQ ID NO: 547903 - RNA, 64 nt, hsa
cucugagaauaacacauagugaagaucugugggcuuuuaaaauuguucacagccaauuuaagaa

SEQ ID NO: 547904 - RNA, 64 nt, hsa
uuuguauuuuauauguaaaguaguauugcugacauuuuaaaaaaauacaaaauacaaaagaaac

SEQ ID NO: 547905 - RNA, 64 nt, hsa
guauuguuuaucauaaaacauauuauguuccuaguuuuaaaaagacccaaaguaugauuaauau

SEQ ID NO: 547906 - RNA, 64 nt, hsa
auuuuugcugaauagguuuaagucagauaauagauuuuaaaaaagcaaaugaggcaauguguca

SEQ ID NO: 547907 - RNA, 64 nt, hsa
cacuuuuaaauugucucuugcaucacuaaaauuuuuuuaaaaugagcauaacaacgaaaggcau

SEQ ID NO: 547908 - RNA, 64 nt, hsa
uaaaaagucaaaagaaacaaauagaagcuuuuuuuuuuaaaaaauguauugcuucugaacuuuu

SEQ ID NO: 547909 - RNA, 64 nt, hsa
ugugaacagcauuagaacuuugucuauuucuuaauuuuaaaauaugcugauaugccuuaaacug

SEQ ID NO: 547910 - RNA, 64 nt, hsa
uagccauaccucagauaauauguuuaguuuuacauuuuaaaauguuuaaauucucuuucacagc

SEQ ID NO: 547911 - RNA, 64 nt, hsa
ugauaauuuaaaauccauuuuaggugauaaaauuuuuuaaaaguuuugaaggaaaccucuggau

SEQ ID NO: 547912 - RNA, 64 nt, hsa
auuuauaaaaaguguauaugcaguaugauaccacuuuuaaaaaaagauaaauuuauagaaaaaa

SEQ ID NO: 547913 - RNA, 64 nt, hsa
ccucgagguuccuuagugaguuuuguaccuucuauuuuaaaagaggcuuucccaaacugugcca

SEQ ID NO: 547914 - RNA, 64 nt, hsa
aauacagucgaaucaccaggaaccuuugagcugcuuuuaaaauucuuccccuggcaccacucag

SEQ ID NO: 547915 - RNA, 64 nt, hsa
gacaguaucacuuuccuguuaaaacauacaauaauuuuaaaaggugaaugccuaaaguuccaau

SEQ ID NO: 547916 - RNA, 64 nt, hsa
guuauuauuggaaacauuacuuugagugcaguguuuuuaaaagccaauucuuuuuuaucccuuu

SEQ ID NO: 547917 - RNA, 64 nt, hsa
uaaagcaaagcccugguccuuuuuaaacuacuaguuuuaaaaaccuguguuaaaugaacaguaa

SEQ ID NO: 547918 - RNA, 64 nt, hsa
ugcuguuacgguuguauauagaggucugaaggauuuuuaaaaugauuugcacuuuuucacugca

SEQ ID NO: 547919 - RNA, 64 nt, hsa
agauucuuuauuuucccaaacacuacaaaaaaacuuuuaaaacuuugccauuucaucuguuuac

SEQ ID NO: 547920 - RNA, 64 nt, hsa
agaauuuaugggagccuauauaaacauaucuugcuuuuaaaaaguucuugagggaauagcaacu

SEQ ID NO: 547921 - RNA, 64 nt, hsa
caacuuucccauggcugugccuauuuccuagaccuuuuaaaagaugugcagagcagcuuagcau

SEQ ID NO: 547922 - RNA, 64 nt, hsa
uuaggggggauuguguuuaaaucaaauauauguauuuuaaaaauaaugacaugcucaaccuucc

SEQ ID NO: 547923 - RNA, 64 nt, hsa
ugaaggauuguagauuuuugcuuuuucuuuuuguuuuuaaaacuuauuccaauugcuaaauugg

SEQ ID NO: 547924 - RNA, 64 nt, hsa
uuugcauucaaauuaaggguuaagaaaagagauauuuuaaaaugagagucacuugaugugccau

SEQ ID NO: 547925 - RNA, 64 nt, hsa
agauauuuuaaaaugagagucacuugaugugccauuuuaaaaaaaaaggcauauugcuuuuucu

SEQ ID NO: 547926 - RNA, 64 nt, hsa
agaaacugauuucuucagaauuagauggcuuauuuuuuaaaauauuugaaugaaaacauuuuau

SEQ ID NO: 547927 - RNA, 64 nt, hsa
uauuuuuuaaaauauuugaaugaaaacauuuuauuuuuaaaauauuacacaggaggcuucggag

SEQ ID NO: 547928 - RNA, 64 nt, hsa
aguuagaagaacggaucaugugccaacuguaguuuuuuaaaaaaaacgcuccuuuguaggguuu

SEQ ID NO: 547929 - RNA, 64 nt, hsa
gugagccaccacaccuggccuuucugcaacauuuuuuuaaaaaaaucuaauaaaucuuagauuu

SEQ ID NO: 547930 - RNA, 64 nt, hsa
acauuuuuuuaaaaaaaucuaauaaaucuuagauuuuuaaaaaagaauuaaaaugugggaguuc

SEQ ID NO: 547931 - RNA, 64 nt, hsa
aaguacuaauaucuacaugguccacacuuuucuauuuuaaaaaauuguguucucuuguuaaaua

SEQ ID NO: 547932 - RNA, 64 nt, hsa
uuuaaucaucaucuagacuuguuaaguagaaaaauuuuaaaaauuugcuuaugaaaauauaacc

SEQ ID NO: 547933 - RNA, 64 nt, hsa
cuuaauuuuauuuauaaguuuugguguuuaccuguuuuaaaaugauaauguuggcaucugugau

SEQ ID NO: 547934 - RNA, 64 nt, hsa
cuuuuucacgcauuugcuuuauucgaaaagaggcuuuuaaaaugugcauguuuagaaacaaaau

SEQ ID NO: 547935 - RNA, 64 nt, hsa
uagcuauggaaagaugcauagaaagaguauaauguuuuaaaacauaaggcauuugucugccauu

SEQ ID NO: 547936 - RNA, 64 nt, hsa
uuaauacuuaucagaucuacaaaaaucauuauuauuuuaaaagaguuauuugaguuucuuucuu

SEQ ID NO: 547937 - RNA, 64 nt, hsa
gcacauuuaugguuuuuuauuacuauuauuaugguuuuaaaaagaguaacuuuauuucuuuuug

SEQ ID NO: 547938 - RNA, 64 nt, hsa
aaaggacuuauuuuuuaacuguaauauuuauuaguuuuaaaauauuuguaucucauuuguaaca

SEQ ID NO: 547939 - RNA, 64 nt, hsa
aauuuguuuuaauuuuuuauauauauguuuuuauuuuuaaaaaacauaccaguugaaugggguu

SEQ ID NO: 547940 - RNA, 64 nt, hsa
agaauugaugcuagagguaaaaaaaaauacuuguuuuuaaaaaauccuuuacgucuuguguaau

SEQ ID NO: 547941 - RNA, 64 nt, hsa
agcaucacugugucuguauuucaaguacaaauguuuuuaaaaaggauucuuuauacauaugugc

SEQ ID NO: 547942 - RNA, 64 nt, hsa
ugcuaacuuuauaguauuucuaauuguucaaggauuuuaaaauucuauuucagggaguauaucu

SEQ ID NO: 547943 - RNA, 64 nt, hsa
aaccccuauaugcguuguugcauaacagaugauuuuuuaaaauauauacuuccuuaugcaaagu

SEQ ID NO: 547944 - RNA, 64 nt, hsa
uucaaguguuuuauaauuaaaucauaauagcauauuuuaaaaucaaucuuccuaaaaggucugc

SEQ ID NO: 547945 - RNA, 64 nt, hsa
ugccaaguaugccaguguaaugaaacugcccuuauuuuaaaagccagucaaagauuccacugau

SEQ ID NO: 547946 - RNA, 64 nt, hsa
uagaaaguaugguuuaacuggacccuauuaugccuuuuaaaaauaauuucaguaacccauaaau

SEQ ID NO: 547947 - RNA, 64 nt, hsa
aaggaaugugcauaauggagagaagacauauuuuuuuuaaaacugaagauauuggcacaaaugu

SEQ ID NO: 547948 - RNA, 64 nt, hsa
uuauuauuguugauguugucaugguuaaucuauuuuuuaaaauugaaaugaagcagaaguaggc

SEQ ID NO: 547949 - RNA, 64 nt, hsa
gaggaugaauuuucugcuuuaaaggcauguguguuuuuaaaauuaaugaauguagaugugugau

SEQ ID NO: 547950 - RNA, 64 nt, hsa
ccagacuugaugguuuuaagucggaaccgauaaauuuuaaaaaggagaaaaaauaauuugaccu

SEQ ID NO: 547951 - RNA, 64 nt, hsa
ucuuagcucaguuacucaauucauacguaguauuuuuuaaaauaauuuuauaucuguguaccac

SEQ ID NO: 547952 - RNA, 64 nt, hsa
uaaauauuaauaaauggauacacauucaaaauacuuuuaaaaaaaagaaaauguuaccaguuuu

SEQ ID NO: 547953 - RNA, 64 nt, hsa
gguugaauuuuuggauauauuauguugauuuaacuuuuaaaauguuguuuaaaagugugaagcu

SEQ ID NO: 547954 - RNA, 64 nt, hsa
uuuauuaucuuuaaacuuguugcauuuaaaauauuuuuaaaaccuucuuaacaaaacuucuuaa

SEQ ID NO: 547955 - RNA, 64 nt, hsa
aauggcagucucaauccuacugucauucuuuuuauuuuaaaauaaauaaauaagccuaucuuuu

SEQ ID NO: 547956 - RNA, 64 nt, hsa
gaggugaguauguacucugacuucagcucucagguuuuaaaaauuauauuagugggaccaguua

SEQ ID NO: 547957 - RNA, 64 nt, hsa
uuugauaggcaauacaucuacccacuccauuauuuuuuaaaacuucauuuaauaguuuaaacaa

SEQ ID NO: 547958 - RNA, 64 nt, hsa
uuuuagugacagcucugccuguuagacucuuacuuuuuaaaaucuuuucuauuuucccucgcug

SEQ ID NO: 547959 - RNA, 64 nt, hsa
cuggaugcauuucucugggguauuuggggcuuauuuuuaaaauuuuaauauggguucuuuuuug

SEQ ID NO: 547960 - RNA, 64 nt, hsa
gaacuggugcuuuaguaauguggauuuuuuucuuuuuuaaaagagauguagcagaauaauucuu

SEQ ID NO: 547961 - RNA, 64 nt, hsa
caacaguaguuuugaaacuagaagucaaaaaucuuuuuaaaaugcuguuuuguuuuaauuuuug

SEQ ID NO: 547962 - RNA, 64 nt, hsa
gauauuuauucuuuaaaucaaaguaaauuagaauuuuuaaaaagcacaaaacugcaggacaguu

SEQ ID NO: 547963 - RNA, 64 nt, hsa
uuuauuguaguggcugccuaaaaaccacuggaguuuuuaaaagaagcaaggaguuaaauguccu

SEQ ID NO: 547964 - RNA, 64 nt, hsa
cuugugcugcacaugggcugaauuuuuaaauuuuuuuuaaaaacuugaagcagaaccuuguaau

SEQ ID NO: 547965 - RNA, 64 nt, hsa
ucaccagauuuuuauuaauguaaaaaaaaucaauuuuuaaaaaauaguuggacuuuggcagcuu

SEQ ID NO: 547966 - RNA, 64 nt, hsa
acacaggaaaaaauagaagucuacugaauuaauuuuuuaaaagaaaagagaucagauuaaauau

SEQ ID NO: 547967 - RNA, 64 nt, hsa
gacauacaaauuuagacucucguugacauugucguuuuaaaaggaaguugcuaaggcgaucaau

SEQ ID NO: 547968 - RNA, 64 nt, hsa
gccuuucuuuuccgaugguuuucaaacugauuauuuuuaaaagagauuaauaaaaucauaaugc

SEQ ID NO: 547969 - RNA, 64 nt, hsa
uauuuuaaguuaaagacagauuucuuuaauaaguuuuuaaaauugaucaacuuuaaauuaagca

SEQ ID NO: 547970 - RNA, 64 nt, hsa
caaguauaaguuucaccaccuugagaaauaauuuuuuuaaaaaaucuuccucuuucucugggga

SEQ ID NO: 547971 - RNA, 64 nt, hsa
gggacucuuucaaguguaucugagcaugacuguauuuuaaaauacuuaaaagugcuugauauaa

SEQ ID NO: 547972 - RNA, 64 nt, hsa
caucucacuggauguaaaaucuaucaguuaauaguuuuaaaaaugucucuuuuguuaagaauaa

SEQ ID NO: 547973 - RNA, 64 nt, hsa
caauaaucaagauaccuaauauuuaagugaauauuuuuaaaacucaaaauuaaugcaaaagauu

SEQ ID NO: 547974 - RNA, 64 nt, hsa
agguauaaacauauauuuacaugauuaauccacauuuuaaaaugacuugcacuugugcauauac

SEQ ID NO: 547975 - RNA, 64 nt, hsa
gaguuuuuuuaagguuuaauaacuaaggggaauauuuuaaaauuaagagagcagcaaaugaaag

SEQ ID NO: 547976 - RNA, 64 nt, hsa
uuuuuucauugauauuugaaaacagacuaugacauuuuaaaaaucugcccuaugaguaucaacc

SEQ ID NO: 547977 - RNA, 64 nt, hsa
aaaaagugaacuauguuuuuuuucagaaaaauuauuuuaaaagaacucagcauucaguuagaua

SEQ ID NO: 547978 - RNA, 64 nt, hsa
cugaaguuggcauguuucguaaaacuugcgugucuuuuaaaaauaauaaaaggaagaugaguau

SEQ ID NO: 547979 - RNA, 64 nt, hsa
agaguacuuuucuugauacuguuaacuuugugcuuuuuaaaaaaagugauucucuaacagaccu

SEQ ID NO: 547980 - RNA, 64 nt, hsa
cuuaguuuuuucauuuaauaauucaaaccaacacuuuuaaaaaaauaauucagaugagacugag

SEQ ID NO: 547981 - RNA, 64 nt, hsa
uugaaaacagugcaaagaucacaguuuuuaaaaguuuuaaaaauuuaagaauauucacacaauc

SEQ ID NO: 547982 - RNA, 64 nt, hsa
ugcugacucuugaaaacagugcaaagaucacaguuuuuaaaaguuuuaaaaauuuaagaauauu

SEQ ID NO: 547983 - RNA, 64 nt, hsa
auguaaaaccacacaaaacggacugcugauaauauuuuaaaauauacuuauuugucuucuuuuu

SEQ ID NO: 547984 - RNA, 64 nt, hsa
cauauucauuacuuaucugcucuauuuagauuuauuuuaaaaguuuauuuaaguaaauauuuuu

SEQ ID NO: 547985 - RNA, 64 nt, hsa
caaauaaaaucaaaagucauguuuaaagacguguuuuuaaaauuccacuaucccuuuucuaaag

SEQ ID NO: 547986 - RNA, 64 nt, hsa
aaaagcauauugagacucugucucuacaaaaaaauuuuaaaaaguaaaaauuagcugggcgugg

SEQ ID NO: 547987 - RNA, 64 nt, hsa
caaaggaagacauauacauggucaauaaguauauuuuuaaaaugcucaacauuaacuauucaua

SEQ ID NO: 547988 - RNA, 64 nt, hsa
ggcuuuuccauguuguuuuauuaccuuuucucacuuuuaaaacuaauacagacuuaucuccuca

SEQ ID NO: 547989 - RNA, 64 nt, hsa
ugggcauuaucauuggauguuuccccacauuggcuuuuaaaauacccaucuugcuuucuuuuug

SEQ ID NO: 547990 - RNA, 64 nt, hsa
guuacuguaguguuuauauaauuuuauguucuacuuuuaaaaaaauaaauuaauaucuaauugu

SEQ ID NO: 547991 - RNA, 64 nt, hsa
ucuuuaacaaugucuauugguaaaggaaaguuauuuuuaaaaauuguauuguaauuccaugacc

SEQ ID NO: 547992 - RNA, 64 nt, hsa
auauaacuaguuucugagguauuuaaaaauuugguuuuaaaaauauuaagcuuuuugcucauuu

SEQ ID NO: 547993 - RNA, 64 nt, hsa
aggcaagauauguaaguaaagacaagcccuacaauuuuaaaauaacaaagcuuaugucuuaagu

SEQ ID NO: 547994 - RNA, 64 nt, hsa
agaacauuuuauuuucucuuauuucuguugugauuuuuaaaaacuuuuuuuuggaccuaaauaa

SEQ ID NO: 547995 - RNA, 64 nt, hsa
uucuucuuaauucggcaauggaauaucuuuuaaguuuuaaaaaaacuggaauaauuauaucuau

SEQ ID NO: 547996 - RNA, 64 nt, hsa
uaugccuuuuaaaaaugcuuauagagaaaaaaaauuuuaaaaagaaagcuaaugcuaguauaua

SEQ ID NO: 547997 - RNA, 64 nt, hsa
gggauggugauuaaacaccucuuuuggguaugccuuuuaaaaaugcuuauagagaaaaaaaauu

SEQ ID NO: 547998 - RNA, 64 nt, hsa
gcauuuuuuuaaaagaagcuuuguaauaaaacauuuuuaaaaauugucauuuuauuaagaguga

SEQ ID NO: 547999 - RNA, 64 nt, hsa
gucauuccaguuugaguuaaugugcugagcauuuuuuuaaaagaagcuuuguaauaaaacauuu

SEQ ID NO: 548000 - RNA, 64 nt, hsa
gccaguuguuaaaaugagcauugauguacccauuuuuuaaaaaagcaaggcacagccuuugccc

SEQ ID NO: 548001 - RNA, 64 nt, hsa
agagccaaguuccaaaauaaagcauaaaaagguuuuuuaaaaggaaauguaaaagcacaugaga

SEQ ID NO: 548002 - RNA, 64 nt, hsa
auugcguccauguugcuuuauauguagccuugccuuuuaaaagaaaaaguaugugaauaugaau

SEQ ID NO: 548003 - RNA, 64 nt, hsa
cuaagauauauauuuacuaaaagaauuugugacauuuuaaaaaacaaaaauaaauauugcgucc

SEQ ID NO: 548004 - RNA, 64 nt, hsa
acuuaaccucugugugccuaaacaaguugugcuuuuuuaaaaggaguuauguuugggcaaagcc

SEQ ID NO: 548005 - RNA, 64 nt, hsa
aaauuuugccuaaaauucaguauguuccuuaaguuuuuaaaauucugaguguguacaaauaucu

SEQ ID NO: 548006 - RNA, 64 nt, hsa
aagagaaauaauuguauuuguuaacagugucuuuuuuuaaaaaguuaaggcacucugaaacaaa

SEQ ID NO: 548007 - RNA, 64 nt, hsa
ucauauuuauuaauuucaagggaauauugaaagguuuuaaaauggcauacagauaauggaaaau

SEQ ID NO: 548008 - RNA, 64 nt, hsa
auugaacuuucuaaaacuaaaagagucuuuuuauuuuuaaaacacaaguagaaugauuuaaaua

SEQ ID NO: 548009 - RNA, 64 nt, hsa
ucagccauuuacucucccacuaauugggauuauuuuuuaaaagaggucuuucuccccgaaauac

SEQ ID NO: 548010 - RNA, 64 nt, hsa
ugaccucuggaauaaaagaacugacuuuugauaguuuuaaaauuaaucuuugcaugaagguugg

SEQ ID NO: 548011 - RNA, 64 nt, hsa
gcucaaacaauucucagccuaaaacacuguugucuuuuaaaaugcuuccaacccaaaggccuuu

SEQ ID NO: 548012 - RNA, 64 nt, hsa
aaauaaacuacuuugaauagaggccaaauuaaucuuuuaaaaaugaugauaaucaucagguuua

SEQ ID NO: 548013 - RNA, 64 nt, hsa
gagauagagggguuuuagauuuuuaaaagguagguuuuaaaaauaaguuuuauacauaaacagu

SEQ ID NO: 548014 - RNA, 64 nt, hsa
ggcauggagaccgggagauagagggguuuuagauuuuuaaaagguagguuuuaaaaauaaguuu

SEQ ID NO: 548015 - RNA, 64 nt, hsa
acuaugccguguaguuucugguaucguucgcuuguuuuaaaaggguucaaggacuaacgaacgu

SEQ ID NO: 548016 - RNA, 64 nt, hsa
uucucguauggugcuagaguuagauuaaucugcauuuuaaaaaacugaauuggaauagaauugg

SEQ ID NO: 548017 - RNA, 64 nt, hsa
uaaaccagaacauucuauguacuacaaaccugguuuuuaaaaaggaacuauguugcuaugaauu

SEQ ID NO: 548018 - RNA, 64 nt, hsa
cuuuauuuugggaaauuaguguauuuuauaaaaauuuuaaaaagaaaaaagacuacuacagguu

SEQ ID NO: 548019 - RNA, 64 nt, hsa
guugaagaugaaaucauuccuaaauuaaccuuuuuuuuaaaaaaaaacaauguauauuauguuc

SEQ ID NO: 548020 - RNA, 64 nt, hsa
aauuuuggguuuuuuaggauguugcauuucguuuuuuuaaaaaaaauuuuguaauaaaauuaug

SEQ ID NO: 548021 - RNA, 64 nt, hsa
guauagcugauaagauucucuguagagaaaauacuuuuaaaaaaugcagguuguagcuuuuuga

SEQ ID NO: 548022 - RNA, 64 nt, hsa
caagucucgguaaguccuuuaaaccauuuaggauuuuuaaaacaucaaaauuuaugauuuacau

SEQ ID NO: 548023 - RNA, 64 nt, hsa
uuuuuauaauauaaauuuauaauuugauuuuuuauuuuaaaaacuggguuaaucaagucucggu

SEQ ID NO: 548024 - RNA, 64 nt, hsa
uucacaaaagauuucuaaagauuuauguaauguguuuuaaaagcgccaguaaaccaucggauca

SEQ ID NO: 548025 - RNA, 64 nt, hsa
agggcgacccccaucucuacaaaacauaaaagauuuuuaaaaaauuagccaggcaugguggcac

SEQ ID NO: 548026 - RNA, 64 nt, hsa
auuguuucuuugugcuucagcucauuuuccauauuuuuaaaacccugugguaaaagccucaaug

SEQ ID NO: 548027 - RNA, 64 nt, hsa
gucauuuaaaauuuaaauuuucagucauuuaaaauuuuaaaaauuuaaaauuucacaaaacuaa

SEQ ID NO: 548028 - RNA, 64 nt, hsa
cuauagugcaaaugcuuuuauuagccaauaggaauuuuaaaauaacauggaacuuacacaaaag

SEQ ID NO: 548029 - RNA, 64 nt, hsa
aacuuacacaaaaggcuuuucaugugccuuacuuuuuuaaaaaggaguuuauuguauucauugg

SEQ ID NO: 548030 - RNA, 64 nt, hsa
uugguugcaucuuguaggccaucugacuuccuguuuuuaaaacgggggucuggucuugcuaaac

SEQ ID NO: 548031 - RNA, 64 nt, hsa
cgggucuggcagugcgugucccguggggugugcauuuuaaaacucgauucauagacacagguac

SEQ ID NO: 548032 - RNA, 64 nt, hsa
guuguauucacacaaaccugaacaaagcaaauuuuuuuaaaagcagcguauguaagcaccgaca

SEQ ID NO: 548033 - RNA, 64 nt, hsa
agcacuuugcauaggcaaaauacuuuucaggccuuuuuaaaaaauucauuacagcaaacagcug

SEQ ID NO: 548034 - RNA, 64 nt, hsa
accaaaccaaaggucucacuaggaaauuuaucuguuuuaaaacauugcuuccuuccuggcucug

SEQ ID NO: 548035 - RNA, 64 nt, hsa
guuacuguaacuuggguauuauguuaaaugucuguuuuaaaagaaaguagcguuaagauagauc

SEQ ID NO: 548036 - RNA, 64 nt, hsa
ugcugggcuccagagagaagggaaaacuaagagguuuuaaaaccccuacccuccuugguuuacc

SEQ ID NO: 548037 - RNA, 64 nt, hsa
gacaauaugcugaacauuagacauaauuaaaucuuuuuaaaaauugauaauuuaucucuguuuu

SEQ ID NO: 548038 - RNA, 64 nt, hsa
agaguaagugcaauaauaugaaauagccuguacauuuuaaaaauguugucaccaaguuauauaa

SEQ ID NO: 548039 - RNA, 64 nt, hsa
auccacaucucuguaaacaaccuuuuuuaaguaauuuuaaaaaaaauaaacacucugcuuacua

SEQ ID NO: 548040 - RNA, 64 nt, hsa
aagaauucauaauuuuaagcaguuaguaauuucauuuuaaaauuucuguagaagcucaggaauu

SEQ ID NO: 548041 - RNA, 64 nt, hsa
auacuguuucaagcccauaugauuagauuuauguuuuuaaaaucuguugucuccauaucuugau

SEQ ID NO: 548042 - RNA, 64 nt, hsa
ucuuguaaaaacacuuuuuugguuuaauauauauuuuuaaaacauuucacuagugauugaauuc

SEQ ID NO: 548043 - RNA, 64 nt, hsa
guuaauacuucauaauaugugaaaaacucggaucuuuuaaaaagcaucauagaucauuuuucca

SEQ ID NO: 548044 - RNA, 64 nt, hsa
cauagaucauuuuuccauaugacacugguuccgauuuuaaaaauuauuuuuaaauaaccgauua

SEQ ID NO: 548045 - RNA, 64 nt, hsa
aauauuuucaacuuuuucccucacuaauugguacuuuuaaaaacauaacauaaauuuuuugaag

SEQ ID NO: 548046 - RNA, 64 nt, hsa
aauaacccauaauugaaguguauaauauaaaaaauuuuaaaaaucuaagcagcuuauuguuucu

SEQ ID NO: 548047 - RNA, 64 nt, hsa
guaauuauuuucuuuauuguugguaaacuccauauuuuaaaaauuuaccuguauacauagugcu

SEQ ID NO: 548048 - RNA, 64 nt, hsa
gccagauuuuauccuagacccugaggauauagcuuuuuaaaacccccuccuguuucagagcuua

SEQ ID NO: 548049 - RNA, 64 nt, hsa
uuaaaaggcauucuuagauucauuuuaaccacauuuuuaaaaacucacaguugguuaacaugau

SEQ ID NO: 548050 - RNA, 64 nt, hsa
auagagagauuuuucaaaagcaguaaucccucaauuuuaaaaaaggauugaaaauucuaaaugu

SEQ ID NO: 548051 - RNA, 64 nt, hsa
uggauuuuuuaugccuccucaguaaccagaaauguuuuaaaaaacuaaguguuuaggauuucaa

SEQ ID NO: 548052 - RNA, 64 nt, hsa
ucauuuuuguugaguaagcaaaauuacaaaguguuuuuaaaaaaaccuguacaaauauguuuau

SEQ ID NO: 548053 - RNA, 64 nt, hsa
cccccaagcugugagaguguguuuauuuuuaauuuuuuaaaagguauuuaauuuccaaccacac

SEQ ID NO: 548054 - RNA, 64 nt, hsa
cggauuuuuguuaauauucauuuuuguuauccuuuuuuaaaaguaaauguacaggaugccagua

SEQ ID NO: 548055 - RNA, 64 nt, hsa
gugagaaguucauauuucuuuggcuuuuuuguguuuuuaaaaguuacuccuuuuagggagcugg

SEQ ID NO: 548056 - RNA, 64 nt, hsa
augggacaaaguuccaaaaugccaaauucuuauuuuuuaaaaagcuaguucuauaaaauacugg

SEQ ID NO: 548057 - RNA, 64 nt, hsa
uguguauuuuuuaaagcuacaaucuguucaauguuuuuaaaaaucuguuuauaugacauuguua

SEQ ID NO: 548058 - RNA, 64 nt, hsa
auauuaauaaaguauaagugauguuuuauaugauuuuuaaaaaaaauucucaagugcaaugugu

SEQ ID NO: 548059 - RNA, 64 nt, hsa
augauuuuuaaaaaaaauucucaagugcaauguguuuuaaaauaagcuugcaaaugacagcaga

SEQ ID NO: 548060 - RNA, 64 nt, hsa
auuuauuuuuauauggaauugcauaaugugugccuuuuaaaacaauaacaaaaaccagagaugu

SEQ ID NO: 548061 - RNA, 64 nt, hsa
auacuugacauuaaccucaucaaaagugugugaauuuuaaaacaaauucuaaaaaaacuauagu

SEQ ID NO: 548062 - RNA, 64 nt, hsa
caugaguuuuaugguauuuugugagggaugcauuuuuuaaaagauuaauuuuggaaacagaagg

SEQ ID NO: 548063 - RNA, 64 nt, hsa
uuuugccacuuagaauagcauuugccacuuaguauuuuaaaaaauaauuguuggaguauuuauu

SEQ ID NO: 548064 - RNA, 64 nt, hsa
caaaaugacuuuauacaacgauuguauuugugacuuuuaaaaauaauuauuuuauuguguaauu

SEQ ID NO: 548065 - RNA, 64 nt, hsa
ugaaggcuaaucauagaaaaaaaaccucuaguuuuuuuaaaaauagaauuuggaaacuuauuuu

SEQ ID NO: 548066 - RNA, 64 nt, hsa
ucuuccugauucagaaauguguaugguuugcagcuuuuaaaaaccauuuuuuuaaaacuaauaa

SEQ ID NO: 548067 - RNA, 64 nt, hsa
aauguguaugguuugcagcuuuuaaaaaccauuuuuuuaaaacuaauaaauagugacugaacca

SEQ ID NO: 548068 - RNA, 64 nt, hsa
guuaaugcaguagaaaguagugguaauaauuccuuuuuaaaaaaauuucgguagucauauagua

SEQ ID NO: 548069 - RNA, 64 nt, hsa
aggauugugauauuagaggcuggaaauccuuauuuuuuaaaaaaucagauaggcauaaauaguu

SEQ ID NO: 548070 - RNA, 64 nt, hsa
ccacauaucuuuuuuuguguggauggggaaaauguuuuaaaauccaguuauuuaauaugaguuu

SEQ ID NO: 548071 - RNA, 64 nt, hsa
guuauuuaauaugaguuugagagagaaaauuguuuuuuaaaaauauaugugcauugaaaugaug

SEQ ID NO: 548072 - RNA, 64 nt, hsa
agguuugauguauauagaaauuccauguuugauuuuuuaaaauauguguauaagucugucaugu

SEQ ID NO: 548073 - RNA, 64 nt, hsa
ugcuuuuuucauaguucuuguuuucauguuuuauuuuuaaaaagacauauaaagauugcauauu

SEQ ID NO: 548074 - RNA, 64 nt, hsa
uuuccuaauaaaccccuuugauuuaaaaauguauuuuuaaaaauguuuacauugaugaugagua

SEQ ID NO: 548075 - RNA, 64 nt, hsa
uuuauuuauugacagacuuugcagccuugcuaaauuuuaaaagcauuuuuaaaaaaacuucuac

SEQ ID NO: 548076 - RNA, 64 nt, hsa
cagacuuugcagccuugcuaaauuuuaaaagcauuuuuaaaaaaacuucuacaaaacucuagua

SEQ ID NO: 548077 - RNA, 64 nt, hsa
ucacauuuguauuaauaauuguuuaaaaugccucuuuuaaaagcuuauauaaauuuuuuucuuc

SEQ ID NO: 548078 - RNA, 64 nt, hsa
aagauaauuuacuuaauauaucuucccugauuuguuuuaaaagaucagagggugacugaugaua

SEQ ID NO: 548079 - RNA, 64 nt, hsa
gaguauauguguguguguguaacuaucauguggguuuuaaaaauccuuuuuuacagugguaucc

SEQ ID NO: 548080 - RNA, 64 nt, hsa
cuauuuaauuggguuccacugaaccucaugggacuuuuaaaagaagggcuauuuaaggaauuca

SEQ ID NO: 548081 - RNA, 64 nt, hsa
uguuccaaggugcagugcacugugaaucuuuuauuuuuaaaaaaauuuguaggugcuuuuaugu

SEQ ID NO: 548082 - RNA, 64 nt, hsa
uuuuaaacaaacaauuugaaguuaaacauuucauuuuuaaaaacacugaauuacaguucuuauu

SEQ ID NO: 548083 - RNA, 64 nt, hsa
caacaaaaaaccagugaaauucuacaagugucccuuuuaaaaauagugugugcuaacuaagggc

SEQ ID NO: 548084 - RNA, 64 nt, hsa
aacaaguucaaaauuuaaacaaguucauacaaguuuuuaaaaauucucaacugguagcuugcuu

SEQ ID NO: 548085 - RNA, 64 nt, hsa
aucuaaauauucagguuuuaagccugcugcaaacuuuuaaaauauuaugauagauucuguacua

SEQ ID NO: 548086 - RNA, 64 nt, hsa
ucaaccaaaaguaauaguuggguauuggagauuuuuuuaaaauguuuuuauguuauuagcuauu

SEQ ID NO: 548087 - RNA, 64 nt, hsa
aaaaucauaaaaaaucaaguuuuaagguuauauuuuuuaaaauaaugaauuuucuaucucuagg

SEQ ID NO: 548088 - RNA, 64 nt, hsa
cuucauuuugauaugacugaauugcaaucuauauuuuuaaaaagaaaaaucaaaauacauuagg

SEQ ID NO: 548089 - RNA, 64 nt, hsa
gguggcuauuuugauuuggcaugacuacuuaauuuuuuaaaaaaauugugguuugugaauugca

SEQ ID NO: 548090 - RNA, 64 nt, hsa
cuguucuguacaaacaaaaaguauguaauacccauuuuaaaaaaccauuugaaaguagacaacu

SEQ ID NO: 548091 - RNA, 64 nt, hsa
gaaaaaaaaaaaaaaagaaaaaaagaauguaaaauuuuaaaaauacaguuuaacagcuguaaaa

SEQ ID NO: 548092 - RNA, 64 nt, hsa
acuuuguuaguacauuuuuuagugucacacugacuuuuaaaauuugaaugauauauagacuuug

SEQ ID NO: 548093 - RNA, 64 nt, hsa
uucaugcuauauaucuuuuguaagacauuuccuuuuuuaaaaaaauuuuugcaaauaacugauc

SEQ ID NO: 548094 - RNA, 64 nt, hsa
uaaaugaaucagcaguggauguagggauagcugauuuuaaaacacucggcugggcacaguggcu

SEQ ID NO: 548095 - RNA, 64 nt, hsa
ucuauguauaggagauaaaauuugcuaguaagauuuuuaaaaacuggcuagugaaaggaaagua

SEQ ID NO: 548096 - RNA, 64 nt, hsa
aacacagccuucauuucaacuuauauaaaauauguuuuaaaaugccugacaauguagauaauuc

SEQ ID NO: 548097 - RNA, 64 nt, hsa
uucugucaguaauccauaagacagaaaucuguuuuuuuaaaaauaucuuuuucuccucucagcu

SEQ ID NO: 548098 - RNA, 64 nt, hsa
agugcaagcuauuuguuuguuuucuaauuuauaguuuuaaaaacuucgcuuauugaguuuuugu

SEQ ID NO: 548099 - RNA, 64 nt, hsa
agaagcauagacuguagaguaucuuuuuaagcauuuuuaaaaaaugcuuuuaaugcaucauaca

SEQ ID NO: 548100 - RNA, 64 nt, hsa
auuuguaauacauuuuccugauuugaaaguuuguuuuuaaaaguuuucuauuaauuauagugca

SEQ ID NO: 548101 - RNA, 64 nt, hsa
gauuuagacccuuaaaaaacaaguaaauaugcacuuuuaaaaugcaaucaaaagacuggugguu

SEQ ID NO: 548102 - RNA, 64 nt, hsa
cauucacugacuuauuuuccuuccauuuucugguuuuuaaaauuagccacaccacaggaaaccc

SEQ ID NO: 548103 - RNA, 64 nt, hsa
ccaaaaauccagauuuguauaugaaaucuuaccauuuuaaaagauuggcagcuaauuauuuuuu

SEQ ID NO: 548104 - RNA, 64 nt, hsa
cuuaccauuuuaaaagauuggcagcuaauuauuuuuuuaaaaagcugugcagugugaugugucc

SEQ ID NO: 548105 - RNA, 64 nt, hsa
aaggguaaauuauaaauguuucaugaagaaaaaauuuuaaaaaucuacgucuuuauuacacaaa

SEQ ID NO: 548106 - RNA, 64 nt, hsa
aaggccuaaugcauuauuuugucauaaaaugcuauuuuaaaauucauggaacuuucauacguaa

SEQ ID NO: 548107 - RNA, 64 nt, hsa
aaauauacagcaugagauuguacauuuuuuacuuuuuuaaaauuguguucuuaaaauauugugu

SEQ ID NO: 548108 - RNA, 64 nt, hsa
uucaaaaaauuauuuuaggcaaaguccauacuccuuuuaaaacaauauuuauguccuauguuug

SEQ ID NO: 548109 - RNA, 64 nt, hsa
uagcauucugugcgaaaaaguauugaagauuagcuuuuaaaaacugaaaaaaaaaaaugaauga

SEQ ID NO: 548110 - RNA, 64 nt, hsa
caguaugaaaagaccaggaauccagauuucuggcuuuuaaaagucagaggcucucacuacacug

SEQ ID NO: 548111 - RNA, 64 nt, hsa
gauaauuuccagagacuguuuauaugcaccacuguuuuaaaauuacggugauuggccaggugca

SEQ ID NO: 548112 - RNA, 64 nt, hsa
uaggcagagcuagguuuauuuucucuuaaacaauuuuuaaaauucagaauguaaaaauugggua

SEQ ID NO: 548113 - RNA, 64 nt, hsa
aaauaacaaaauugucuacagcuucuuacuaaguuuuuaaaauuauucauaaaaugcagacauu

SEQ ID NO: 548114 - RNA, 64 nt, hsa
aucaaucuuucuacuaauguaaauuugagauuauuuuuaaaaauggaauaaaagagguuuuggu

SEQ ID NO: 548115 - RNA, 64 nt, hsa
acaauauuguauucaacuguuuuauuuuuuauauuuuuaaaauuuaaaguauaauuaguuuuua

SEQ ID NO: 548116 - RNA, 64 nt, hsa
ucagugagacuaugaagagcacugacuuguuaaauuuuaaaagaaccauaaauucuaagguauc

SEQ ID NO: 548117 - RNA, 64 nt, hsa
aguauuuaauucauagaaaaaauguaaaaggucuuuuuaaaaaucaugaaaaauaguugaauau

SEQ ID NO: 548118 - RNA, 64 nt, hsa
cuuuaaaagaguaagcuucaauaugugaauuuucuuuuaaaaacagucacugaguuaauaaugu

SEQ ID NO: 548119 - RNA, 64 nt, hsa
agcaaacuaacuuuuuuuuuuuuaacaucuuuguuuuuaaaauagaaugauagaacuuugccag

SEQ ID NO: 548120 - RNA, 64 nt, hsa
uguucaaauuuuuuuuuaacguggcuuguagaauuuuuaaaaaagugaucuuagguuuguuuuu

SEQ ID NO: 548121 - RNA, 64 nt, hsa
caugcagagaaaaucugugcauccucuuuuauauuuuuaaaauacuguuuaacauuugugagaa

SEQ ID NO: 548122 - RNA, 64 nt, hsa
caaaacaggucccuaagacaauucuucagaucauuuuuaaaaugacuaagucauuuuaguaugu

SEQ ID NO: 548123 - RNA, 64 nt, hsa
caacgaguucaccuaaguaaggcucagauccuaguuuuaaaaaccauuucccauuaaaaugaag

SEQ ID NO: 548124 - RNA, 64 nt, hsa
uaauccaugaguucaugcugauacucaaauuucuuuuuaaaaaggagaaacaggaagguuucuu

SEQ ID NO: 548125 - RNA, 64 nt, hsa
ugcuaauguuuuauauuuauauuuuuguauuuauuuuuaaaaaaauaaaccaguuuuuacaacu

SEQ ID NO: 548126 - RNA, 64 nt, hsa
uguuagguacauguccugcccuugcaaaugaagcuuuuaaaaaggugaagaaaaauuuuacagu

SEQ ID NO: 548127 - RNA, 64 nt, hsa
aguugaaugugcauugacauauuuuucuaugauuuuuuaaaauuacaauagaaaaauaagcugu

SEQ ID NO: 548128 - RNA, 64 nt, hsa
acuagcgaggucaguguuaggcuugcaauagggauuuuaaaauacacuaacuaguuccuuagcu

SEQ ID NO: 548129 - RNA, 64 nt, hsa
cagaagugaugauuaucauaugauaccucagugauuuuaaaagccauagaagaaacuugacuau

SEQ ID NO: 548130 - RNA, 64 nt, hsa
ucaauuaauuuuuuuugaagcucauauuguaucuuuuuaaaaaccauguuguggaaaaaagcca

SEQ ID NO: 548131 - RNA, 64 nt, hsa
aaaauuuacacuucuaagacuagagacccacauuuuuuaaaaaucauuuuauuuugugauacag

SEQ ID NO: 548132 - RNA, 64 nt, hsa
guuuacuccuuucuagaugaaaaccaagcacagauuuuaaaacuucuaagauuauucuccucua

SEQ ID NO: 548133 - RNA, 64 nt, hsa
auugagaauuauguaaauucaguacaaugucaguuuuuaaaagucaaaguuagaucaagagaau

SEQ ID NO: 548134 - RNA, 64 nt, hsa
uguuucaauuaccgcuagauuuuuuuuucucuuuuuuuaaaauccauuuuacuggaaaguuggc

SEQ ID NO: 548135 - RNA, 64 nt, hsa
uuauaucuuauauucucuauucaagugaccugucuuuuaaaaaggcagugcugucuuaccucuu

SEQ ID NO: 548136 - RNA, 64 nt, hsa
auaaguaaugaucuacauuuuuuaugaagaugguuuuuaaaacuuuuguuuuauuggaaugcau

SEQ ID NO: 548137 - RNA, 64 nt, hsa
uuacaguaaguaauccuuaccacaaaugagucauuuuuaaaauaugcauuuuuaaaugaauggc

SEQ ID NO: 548138 - RNA, 64 nt, hsa
ggggaagaaaaggaggaaccaauuaaauaggaccuuuuaaaaauuguuaauuuuguaaacuuug

SEQ ID NO: 548139 - RNA, 64 nt, hsa
auaugacuucccccccaaauuuuauuaugaacauuuuuaaaaacagaaaaauugaaaaacuguu

SEQ ID NO: 548140 - RNA, 64 nt, hsa
gcgugagccaccgcacccggccuccauaucccccuuuuaaaauucuguaguguaugguaaguca

SEQ ID NO: 548141 - RNA, 64 nt, hsa
acauguggcugaggccaaagagaaugaagauauauuuuaaaauucuggauuuggcaaaauuuag

SEQ ID NO: 548142 - RNA, 64 nt, hsa
gguuuauugacaggguuggggguuuuuuuuguuuuuuuaaaaugaagggacaaagucaacugga

SEQ ID NO: 548143 - RNA, 64 nt, hsa
augucaacgauuagucaugcaauaaauguucugguuuuaaaaaauacauaucugguuuugguaa

SEQ ID NO: 548144 - RNA, 64 nt, hsa
acaauaauguaaaugcagagaaugaggaggcaucuuuuaaaagccuuaggauauucuauaugau

SEQ ID NO: 548145 - RNA, 64 nt, hsa
caccugcucuuuaugugaaaauguauaugaauccuuuuaaaaugauuaggauuauugaaaugua

SEQ ID NO: 548146 - RNA, 64 nt, hsa
uuuguaaaagaauucuaguguaggacuuaauuauuuuuaaaauauauuucuucucuucuuucca

SEQ ID NO: 548147 - RNA, 64 nt, hsa
agaaagccuuugccauuugucuuagaaaguuauuuuuuaaaaaaaaaucauacuuacuauuagu

SEQ ID NO: 548148 - RNA, 64 nt, hsa
uuauccuuccuguuaagagccucugaguuuuuaguuuuaaaaggaugaaaagcuuaugcaacau

SEQ ID NO: 548149 - RNA, 64 nt, hsa
uagagaaaauaauuuuuaaaauaauagauaaaaauuuuaaaaacagccagaaaaaguauaauuu

SEQ ID NO: 548150 - RNA, 64 nt, hsa
acuucaaguguuugauuaaaauagagaaaauaauuuuuaaaauaauagauaaaaauuuuaaaaa

SEQ ID NO: 548151 - RNA, 64 nt, hsa
uugaaaguaagugaaauguaaauaaacuuauuuuuuuuaaaaaugccauaccucguguuucuuu

SEQ ID NO: 548152 - RNA, 64 nt, hsa
agacuacugaaauauagauaaagauugccuuaguuuuuaaaaauguuuggccauuaguauuuuu

SEQ ID NO: 548153 - RNA, 64 nt, hsa
guauacuucagugcucacccguaggcaaaucucuuuuuaaaaaacucuuuggugcacaaguaac

SEQ ID NO: 548154 - RNA, 64 nt, hsa
gcauaacuggaggguggguuggggagggguggauuuuuaaaaugucaagacagggaaggaugac

SEQ ID NO: 548155 - RNA, 64 nt, hsa
cuccaugcuuugaauacuauguggcugaaugaauuuuuaaaaucucaaagcaguuaaacagcag

SEQ ID NO: 548156 - RNA, 64 nt, hsa
agcauuaguaauuuuuaaaaacacuuuaucaguauuuuaaaaauguuaaugcaggagaaaagau

SEQ ID NO: 548157 - RNA, 64 nt, hsa
ggcgugagccacugagccagccagcauuaguaauuuuuaaaaacacuuuaucaguauuuuaaaa

SEQ ID NO: 548158 - RNA, 64 nt, hsa
ccccccagauuugggggacaaaauaaaauuaaucuuuuaaaaugugucagccauauguaugggg

SEQ ID NO: 548159 - RNA, 64 nt, hsa
auuacaggcaugagucaccaugccuggccucauuuuuuaaaacaaaugaauaaauggacaaaug

SEQ ID NO: 548160 - RNA, 64 nt, hsa
gucaacagcaaaaugccugcaccaugacuguggcuuuuaaaauaaagaaauguguuuuuaucgu

SEQ ID NO: 548161 - RNA, 64 nt, hsa
uuucuuuauaugauauauuucuuuuacgaagcuauuuuaaaaguaagccaagugcugucuaguc

SEQ ID NO: 548162 - RNA, 64 nt, hsa
ucagugaacagguuuuaauguuguuuugauguaauuuuaaaagacuuuuagcaaacaugcauuu

SEQ ID NO: 548163 - RNA, 64 nt, hsa
ccuuauuaaucauuugaaauuaugcuauaauauuuuuuaaaacucaccuguuugguucugggug

SEQ ID NO: 548164 - RNA, 64 nt, hsa
acaguuuuucaucaacugucaaaaacuucaacccuuuuaaaaccuagauauaaaugcuuacaug

SEQ ID NO: 548165 - RNA, 64 nt, hsa
aauuuaaaaauuuuaaauuuuaaagaauuaaaaauuuuaaaaauuuaaauuaaaaaaauuaaaa

SEQ ID NO: 548166 - RNA, 64 nt, hsa
guacauaguaauuauuuaauuacuguggcuuuuauuuuaaaaaguaauuagagguuuuuccauu

SEQ ID NO: 548167 - RNA, 64 nt, hsa
auucaucauggauaaaaacuaagcgcuugccuucuuuuaaaaagaaaaacugaugauuagauua

SEQ ID NO: 548168 - RNA, 64 nt, hsa
aucaaagaaagaaggccacguauguugggguaauuuuuaaaaauuuucagauuggcuaaauauu

SEQ ID NO: 548169 - RNA, 64 nt, hsa
cccuuuaaaauguauuucuuuagaggcauuacuuuuuuaaaaauauuggucaauuccugacaua

SEQ ID NO: 548170 - RNA, 64 nt, hsa
ugcuccaacaugcuugaagaucuaagcuuuucucuuuuaaaacuggcacauacucagagcaguc

SEQ ID NO: 548171 - RNA, 64 nt, hsa
guuguacauuuagguuauucaaaguuuucagcucuuuuaaaauugcucugaauaaguucuagug

SEQ ID NO: 548172 - RNA, 64 nt, hsa
ucucuugaccaaauagacucauaauaacauauaauuuuaaaagaaauuuaaauucuuucuucuc

SEQ ID NO: 548173 - RNA, 64 nt, hsa
aguuccacaaaauccaaauuuaccauauuauuguuuuuaaaaaagcaguuuagagcaaacuguc

SEQ ID NO: 548174 - RNA, 64 nt, hsa
agaaaucagaauuaacauuuuuauguugaauaaauuuuaaaauuuaggaaauguucuauuuaaa

SEQ ID NO: 548175 - RNA, 64 nt, hsa
uuuuaaagguaacaguaauuuucaacacauuuuauuuuaaaauauuauuuuaacaaaaguuaca

SEQ ID NO: 548176 - RNA, 64 nt, hsa
aaauuaauguuuaaaauguuuuuguaacaauaauuuuuaaaacccacacucuuccauauauggg

SEQ ID NO: 548177 - RNA, 64 nt, hsa
aaaauacuuaggauuaaauaaauaauauggauuguuuuaaaaaauauccaaggaucagagucuc

SEQ ID NO: 548178 - RNA, 64 nt, hsa
aguuuucccaucaaacauuaucaauauaccaauguuuuaaaaauugagugaggguuauuauuug

SEQ ID NO: 548179 - RNA, 64 nt, hsa
auuacaggcgugagccaccgugccuggccgacauuuuuaaaaaaguuuuauuuugcacggcucu

SEQ ID NO: 548180 - RNA, 64 nt, hsa
aacuuuaaguaauuauuuuuaaaguucuuauacuuuuuaaaagcuaucacacaaagacuuuuuu

SEQ ID NO: 548181 - RNA, 64 nt, hsa
ugaggcaaauuaacuguauguguguagguuaucuuuuuaaaaacucuucagugcaaauuguauc

SEQ ID NO: 548182 - RNA, 64 nt, hsa
guuuaaaagccauguauaaccaagugugcucuuuuuuuaaaagguagagucuuacaaucaaauc

SEQ ID NO: 548183 - RNA, 64 nt, hsa
ugccaaacuuggggcaauugaugcuaaaugguauuuuuaaaauaaauguuuuuauucuuuacuc

SEQ ID NO: 548184 - RNA, 64 nt, hsa
uaaaaucagaaauagaugugagaaugguggaacuuuuuaaaagaacccagucaaauguauuuuc

SEQ ID NO: 548185 - RNA, 64 nt, hsa
uugaaccuugaacaaaaacuuguaugacagacauuuuuaaaaaugugacaacacuuuuauucuc

SEQ ID NO: 548186 - RNA, 64 nt, hsa
gugcuuuuacaaggaaaaaaggugauauguuuaauuuuaaaauuuuaauuggcuagcucuugcc

SEQ ID NO: 548187 - RNA, 64 nt, hsa
cauuuaagacuacuuuucuuauagguaguugauauuuuaaaaacuuuagauuuaaugucuacau

SEQ ID NO: 548188 - RNA, 64 nt, hsa
uuuauaaauuugagcuauuuuuuuuagaggugcuuuuuaaaaauccaauagauacaagagaugu

SEQ ID NO: 548189 - RNA, 64 nt, hsa
caaccgugguuacuguauuuuuuauauaacuucauuuuaaaauauauuaaaagaaaccuaaaug

SEQ ID NO: 548190 - RNA, 64 nt, hsa
ugccuuuaaaacacuuuuuuauuuuguuuuucuauuuuaaaaauaaaauauuauuuucugaauu

SEQ ID NO: 548191 - RNA, 64 nt, hsa
aauacugcucaguuaucuuugccugcguguauauuuuuaaaaauucacucugaaguguuaugga

SEQ ID NO: 548192 - RNA, 64 nt, hsa
ccuaagucaaagaccaguuugacccaaacuggccuuuuaaaauaaucaggagugacagagucaa

SEQ ID NO: 548193 - RNA, 64 nt, hsa
aggggugcgccuagacagguacgucuguuuuuuauuuuaaaagauaugcuauguagauauaagu

SEQ ID NO: 548194 - RNA, 64 nt, hsa
guuuuguguauuuaucugccauuugcaucaugguuuuuaaaauuuauuauuauuauuauuauug

SEQ ID NO: 548195 - RNA, 64 nt, hsa
uuuaaaaauaccauauucaagggagucugcugaauuuuaaaacgcagucacugguguuucuuga

SEQ ID NO: 548196 - RNA, 64 nt, hsa
ucaguagcuccagguagaugagccuuuuuuuuuuuuuuaaaaauaccauauucaagggagucug

SEQ ID NO: 548197 - RNA, 64 nt, hsa
ccuuggauuugaggcuuccuaagaugugcuugcauuuuaaaaagggagcuuggugagagcuuug

SEQ ID NO: 548198 - RNA, 64 nt, hsa
uaguauauucauuuauggaguuagcuguauuuuuuuuuaaaaaagaaaaguaguaaauuagcag

SEQ ID NO: 548199 - RNA, 64 nt, hsa
ggguguccaagagaaaugguuuuugccaaacucuuuuuaaaaaacaaauuguugcuauuuccua

SEQ ID NO: 548200 - RNA, 64 nt, hsa
auuuagucauuucuguuucuaaauauuuuuaucauuuuaaaauauuuuuuuuccauuuggcaua

SEQ ID NO: 548201 - RNA, 64 nt, hsa
ggaggaagaagaaaaagugcucagggauuuauaauuuuaaaacaaauaugcacagaaaauaaac

SEQ ID NO: 548202 - RNA, 64 nt, hsa
aguuuacacagcuacagaaacaauuuggggcaaguuuuaaaacacugaaacaguaauaguuauu

SEQ ID NO: 548203 - RNA, 64 nt, hsa
cuugaagucuaguagugcacuguaauaauucauuuuuuaaaagauuauuuaaugcccauuucaa

SEQ ID NO: 548204 - RNA, 64 nt, hsa
guuuauugaguuggcuuugcuuuuuuaguuuuucuuuuaaaaauaaaauccuuccuucccaugu

SEQ ID NO: 548205 - RNA, 64 nt, hsa
gugugguuuguguguguuuuuaaugagaaucuuguuuuaaaauguaauuucuaagguuuaacac

SEQ ID NO: 548206 - RNA, 64 nt, hsa
uucucuguccagggcuucagauauuuugcacgaauuuuaaaacauggcaauaaauggcucgugg

SEQ ID NO: 548207 - RNA, 64 nt, hsa
cccacagggccugacuuuuacagcuuuucucuuuuuuuaaaaaguugauaggagacuuguacag

SEQ ID NO: 548208 - RNA, 64 nt, hsa
uacuucugugguuaauguauauuuuuauucuggcuuuuaaaaugggaauaauuuguauguaucu

SEQ ID NO: 548209 - RNA, 64 nt, hsa
cuuuuuuuaaacuuaagcauugucauaugcuauuuuuuaaaauuuggcuuuccuaggauuuuaa

SEQ ID NO: 548210 - RNA, 64 nt, hsa
gcaagaagaaaaacucagagaauauaaaaucaacuuuuaaaauugugugcucucuucuucacgu

SEQ ID NO: 548211 - RNA, 64 nt, hsa
ucaaaggcaagagggcaaggcauuuuuuaacacuuuuuaaaauaaaaauuuauaccacaacuuu

SEQ ID NO: 548212 - RNA, 64 nt, hsa
cauaaaccuuccacucuugaacaaagcagcugcuuuuuaaaagcgguaauugcuucuuuaccuu

SEQ ID NO: 548213 - RNA, 64 nt, hsa
uaaagucuuuugugaacaaggcauuuguagccauuuuuaaaaguuuuugucuucagugcuggua

SEQ ID NO: 548214 - RNA, 64 nt, hsa
cuaucucauuucacucuacugucucaaaauuuuguuuuaaaauaauagaaauguuuugccauua

SEQ ID NO: 548215 - RNA, 64 nt, hsa
cagucagauuuuggaaacugccguauagucacuguuuuaaaaaccccggaggggcuguauuaau

SEQ ID NO: 548216 - RNA, 64 nt, hsa
guuugacaccuucacaagucagcauuaaucuuucuuuuaaaacuuguuucauuuaugaucaugu

SEQ ID NO: 548217 - RNA, 64 nt, hsa
aucaagucauauugcuauguuaauugguuuuuuuuuuuaaaagguaaguuagugauuacuguua

SEQ ID NO: 548218 - RNA, 64 nt, hsa
gcccuucacagugaaaaaaagaaaaaucuuucauuuuuaaaauuaggagauguuacguaacuug

SEQ ID NO: 548219 - RNA, 64 nt, hsa
cuaagaacauggcaaguauuuacuuuuaucuuuuuuuuaaaaacacucaugacagaaaacaguu

SEQ ID NO: 548220 - RNA, 64 nt, hsa
auaugacuuuaaagagacuucaaaauauugaguauuuuaaaaauuuaaaaguaggucaguuuau

SEQ ID NO: 548221 - RNA, 64 nt, hsa
aaacuucagaagaaagcugacauuuuaaugaauuuuuuaaaaaauuaauaaacaaauugucuaa

SEQ ID NO: 548222 - RNA, 64 nt, hsa
gaauuuuuucauaauguaaugccguauuuauuguuuuuaaaaugaaaggaauacuaauaagucu

SEQ ID NO: 548223 - RNA, 64 nt, hsa
uuuuaaagauuucuguauaagacuguugagcaguuuuuaaaauaguguaggauaauauaaaaag

SEQ ID NO: 548224 - RNA, 64 nt, hsa
uaauuuuuuauauuuaaauguagacuuuugacacuuuuaaaaaacaaaaaaagacaagagagau

SEQ ID NO: 548225 - RNA, 64 nt, hsa
uuuuuuuagaggcaggaucuugcuguccaauuuuuuuuaaaaagcuaaaauugccaacuuuaga

SEQ ID NO: 548226 - RNA, 64 nt, hsa
uccaaccccagcaauuuauacaacgcugucauauuuuuaaaaaaacaaaaguaagccauccuca

SEQ ID NO: 548227 - RNA, 64 nt, hsa
uguuuuuuaaauaaaguagccauauguaacgggauuuuaaaaauauauacauuuuacaacaugg

SEQ ID NO: 548228 - RNA, 64 nt, hsa
gaaugagugugguaagaaauuuauaaaguuuugcuuuuaaaacguggacauaacucauuuuucu

SEQ ID NO: 548229 - RNA, 64 nt, hsa
uggggagaucacugccauuuuuacacacuugacuuuuuaaaaauacaaccaaccaaccaccaca

SEQ ID NO: 548230 - RNA, 64 nt, hsa
cucugaauauuuuagucucucucugagucucauuuuuuaaaaugcucuuuuagaacgggaaacg

SEQ ID NO: 548231 - RNA, 64 nt, hsa
acacccuuguacauauaucuuuagagagaagauauuuuaaaaagaaauaccuuuuuaaaaauua

SEQ ID NO: 548232 - RNA, 64 nt, hsa
cuuuagagagaagauauuuuaaaaagaaauaccuuuuuaaaaauuauuuuauuauuuuuuaaua

SEQ ID NO: 548233 - RNA, 64 nt, hsa
cuuauuucuuaacugugcugggauugcaaacacuuuuuaaaaaauuguuugcuugaaaauacua

SEQ ID NO: 548234 - RNA, 64 nt, hsa
guaacaucuaaaacacaaguggguuuauuuaaauuuuuaaaauuugaaauuuuuuauuugcaaa

SEQ ID NO: 548235 - RNA, 55 nt, hsa
aggagaaacacaggaaaugaaaaauuuuuaaaaaaagaaggaaaaauguuuuaaa

SEQ ID NO: 548236 - RNA, 64 nt, hsa
aauuauauuagguagaauacacauacaaucaaaauuuuaaaaaaaaaagcuaaauaacuuaaaa

SEQ ID NO: 548237 - RNA, 64 nt, hsa
uugcaccagggaaucgccauauuugaccagcauguuuuaaaagcucuugguaggauuaguuggu

SEQ ID NO: 548238 - RNA, 64 nt, hsa
gugggcagagaucuuuaguucaaauccacguauuuuuuaaaagagagaaccggagguagagcaa

SEQ ID NO: 548239 - RNA, 64 nt, hsa
uuuuuaacuacucagacuuuugaggaauuaauccuuuuaaaacauuuuuguuaaaguuagugua

SEQ ID NO: 548240 - RNA, 64 nt, hsa
aaggaaaugugcugcuaaaaaucaacuuaugccauuuuaaaauuagauaaaauauggagugcca

SEQ ID NO: 548241 - RNA, 64 nt, hsa
uacauaauuuguuuuuguuauaagccauuugaauuuuuaaaaaauuucauacaugcaauggaau

SEQ ID NO: 548242 - RNA, 64 nt, hsa
aauuuuaaugccaacaaaauugguuguaaucaaauuuuaaaauaauaauaauuuggcccccccu

SEQ ID NO: 548243 - RNA, 64 nt, hsa
ucaaauuuuaaaauaauaauaauuuggcccccccuuuuaaaauagucuugacucuuugugugug

SEQ ID NO: 548244 - RNA, 64 nt, hsa
cuccccagaggaacuuagggauuucaccccuggcuuuuaaaaaaaacgaaauaccgacaagcca

SEQ ID NO: 548245 - RNA, 64 nt, hsa
auggauuggaacacaaaaaaucuuuuuuuaaucuuuuuaaaaacugcugugguuuugcugcuac

SEQ ID NO: 548246 - RNA, 64 nt, hsa
agcuugggggacacaccuggcgagcaagcucgcuuuuuaaaaaugaaauuugggggcaggggaa

SEQ ID NO: 548247 - RNA, 64 nt, hsa
gcccuuacggagugucuguuuuuagaaauuuagauuuuaaaaggcgugggacauacgaccaggc

SEQ ID NO: 548248 - RNA, 64 nt, hsa
cuguuucuaaaguaaguguguauaaaagucuccuuuuuaaaaagaucauauuuuuaaauaaagc

SEQ ID NO: 548249 - RNA, 64 nt, hsa
uaucccaaaucuuuucugaagaugaagaguuuaguuuuaaaacugcacugccaacaaguucacu

SEQ ID NO: 548250 - RNA, 64 nt, hsa
uccagugacagaaaaauauauuaucucaaguauuuuuuaaaaauauaugaauucucucuccaaa

SEQ ID NO: 548251 - RNA, 64 nt, hsa
aaauacauccuuuaaauauauaucuaagcauauauuuuaaaaggagcaaaaauaaaaccaaagu

SEQ ID NO: 548252 - RNA, 64 nt, hsa
uuagauauuuuagaaaaauaauagaauucugaaguuuuaaaaaugucaguaauuaauuuauuuu

SEQ ID NO: 548253 - RNA, 64 nt, hsa
gaacuuucauguaugauccagaaaauagguacgguuuuaaaauauuuuauauagaaaagcuaca

SEQ ID NO: 548254 - RNA, 64 nt, hsa
caauuaaucuacaaagggaauuaauauuguugacuuuuaaaacaucugcuggauauauuauaug

SEQ ID NO: 548255 - RNA, 64 nt, hsa
gaagucuucuuggauuucacccaacuaaaaggauuuuuaaaaauaaauaacagucuuaccuaaa

SEQ ID NO: 548256 - RNA, 64 nt, hsa
uuguagccaguuguuaauaucuuaaugcagauuuuuuuaaaaaaaacauaaaaugauuuaucug

SEQ ID NO: 548257 - RNA, 64 nt, hsa
ucacuuuucucgaucacuaaacauaugcauauauuuuuaaaaaucaguaaaagcauuacucuaa

SEQ ID NO: 548258 - RNA, 64 nt, hsa
aauaucauauuuacucugauucuacucacuuguuuuuuaaaaauaaguguccuauuauuguauu

SEQ ID NO: 548259 - RNA, 64 nt, hsa
aaucaugaagucugaaguuugcuuucaguaauuauuuuaaaaguuguuuugguucauugcuuua

SEQ ID NO: 548260 - RNA, 64 nt, hsa
ccuucaagaaaaacuacagugggauucauuuacuuuuuaaaauacacuggguaaaucaccuaua

SEQ ID NO: 548261 - RNA, 64 nt, hsa
accuaauuacauaguuuuaaucauuuguacauaauuuuaaaaacuuacuuuguauugauuuuga

SEQ ID NO: 548262 - RNA, 64 nt, hsa
caccaagaaugaacugcauuuccuuuaaaaauuauuuuaaaacaccuuuauugaaaagaucuca

SEQ ID NO: 548263 - RNA, 64 nt, hsa
caucccuaauaucacagggcuugugcauucagauuuuuaaaaaauuaggauagauaaggaaaca

SEQ ID NO: 548264 - RNA, 64 nt, hsa
aggugauguauuuuuuucaugcauuaguaugcauuuuuaaaaaauaaugcauguuucuuuaaua

SEQ ID NO: 548265 - RNA, 64 nt, hsa
gagguuguuuuuacuuuauuguguuguuuaaauauuuuaaaaauaucuuuagcguuuggucuuu

SEQ ID NO: 548266 - RNA, 64 nt, hsa
ugcaauugcuucagcccaagaaagcuguguauuguuuuaaaaauuguaaaaauuauugugauga

SEQ ID NO: 548267 - RNA, 64 nt, hsa
aacacuuuacaaagaacaugcccggguuuuuacauuuuaaaaguuauucuagacaaucacuauu

SEQ ID NO: 548268 - RNA, 64 nt, hsa
uucuagacaaucacuauuggcuuuuuucuuuuauuuuuaaaaaacucacauagaggagacaauc

SEQ ID NO: 548269 - RNA, 64 nt, hsa
uucucacucuuugcaggcacucuucaaauuuuuauuuuaaaaauuauaaugcaaacaucuggcc

SEQ ID NO: 548270 - RNA, 64 nt, hsa
guggguucuuuuuaauguuuauacuuagauuuucuuuuaaaaaaauuaaaauaaaacaaaaaaa

SEQ ID NO: 548271 - RNA, 64 nt, hsa
cuauucuuuuuuuugcauccaauugugccugaacuuuuaaaauauguaaaugcugccauguucc

SEQ ID NO: 548272 - RNA, 64 nt, hsa
aaaucccauggauucugauuucugggucuuaggauuuuaaaagugaagggauauuuuucuuaua

SEQ ID NO: 548273 - RNA, 64 nt, hsa
aucuuuucagaugcagucuauauuuuaugcugaguuuuaaaaaugaaauacuuuaugcaaacag

SEQ ID NO: 548274 - RNA, 64 nt, hsa
auacugauuuuuucaaucaauguauaucaugaguuuuuaaaauaaugcuacaaucuucauaacu

SEQ ID NO: 548275 - RNA, 64 nt, hsa
gaggcuugugucuguugcacauuucuugaagcauuuuuaaaauaacauguaaccuguaaccuug

SEQ ID NO: 548276 - RNA, 64 nt, hsa
gcaugcuauuuaugucacaucucacauuaaauuauuuuaaaauaagcagugcccuucaaaacag

SEQ ID NO: 548277 - RNA, 64 nt, hsa
auagaugcauauauacaugacauauugugguuaauuuuaaaacuacugugccuuaacguguuuc

SEQ ID NO: 548278 - RNA, 64 nt, hsa
uuauuuucauuaauaacuuuugcuaaaauuuaccuuuuaaaaguucugaaauuugggguuggua

SEQ ID NO: 548279 - RNA, 64 nt, hsa
gacuacagcugugacacuuaagauugauuggagauuuuaaaacuggaggaugcauuuagaggga

SEQ ID NO: 548280 - RNA, 64 nt, hsa
agauguuucccugccaucuugagauuuuuuacuuuuuuaaaaaaauuuuuugaucuuagucacu

SEQ ID NO: 548281 - RNA, 64 nt, hsa
auuuacugucuuaaaucaguuuauuaaaucugaauuuuaaaacaugcuguuuaugacacaauga

SEQ ID NO: 548282 - RNA, 64 nt, hsa
agcaugacaaaagugacagauguuauuuuuguauuuuuaaaaaacaauugguuguauauaaagu

SEQ ID NO: 548283 - RNA, 64 nt, hsa
acuaaaggauaauuacuuacuuuuauugcauguguuuuaaaagucauauagaaauauuaaauaa

SEQ ID NO: 548284 - RNA, 55 nt, hsa
acuaugcugccguggcuuagaacauuuuuaaaaagagaguauauggaucgcaaga

SEQ ID NO: 548285 - RNA, 64 nt, hsa
auguauuuaguauaaucugugacuaauaaagacauuuuaaaaaaccaugcccacaauaccauua

SEQ ID NO: 548286 - RNA, 64 nt, hsa
uagcaccuaaauugcaagaucuaaggauauguguuuuuaaaaaucuaaagcugaauuccuuuuc

SEQ ID NO: 548287 - RNA, 64 nt, hsa
gccaagucagcauaugaggaauuaaagacauuguuuuuaaaaaaaaaaaaucauuuagaugcac

SEQ ID NO: 548288 - RNA, 64 nt, hsa
cauuuaugcuuuugucuuuuuuaugaaauauuucuuuuaaaagccccagucucaccuacgaaau

SEQ ID NO: 548289 - RNA, 64 nt, hsa
aaaaaaauuuugacuuuuuaguacuaagcuuaauuuuuaaaaacaaaaucuguaggguugacaa

SEQ ID NO: 548290 - RNA, 64 nt, hsa
gaaaaauguggaggcuccauauuaaugcauuauuuuuuaaaaaguuuugauaacucuuaaagca

SEQ ID NO: 548291 - RNA, 64 nt, hsa
ggaagagaagcaucaugagccaauuugauagguguuuuaaaaauaacuugaguuuuccuaaguu

SEQ ID NO: 548292 - RNA, 64 nt, hsa
uggucuuccccgccaugauucacauuugaugaguuuuuaaaaaucaaagugauuuugaaaaucu

SEQ ID NO: 548293 - RNA, 64 nt, hsa
uuacuucccuucaaaucugccuuugaaucaucauuuuuaaaaaaaaauuaacauguuuuuguug

SEQ ID NO: 548294 - RNA, 64 nt, hsa
gagagaaaguauuugaaaaugauuuuuaaauguuuuuuaaaagacacaucugacauuuuuaaca

SEQ ID NO: 548295 - RNA, 64 nt, hsa
aauccugaguuuccauaaggaaaaugaaaacuccuuuuaaaaauaaaaucugaggaguguacaa

SEQ ID NO: 548296 - RNA, 64 nt, hsa
ucuuuguauauuuguacaaauguuucagcugugcuuuuaaaaaaucuggauguuuuuuauuuag

SEQ ID NO: 548297 - RNA, 64 nt, hsa
uguuccccagaugaaagaacucuaaguaaauacauuuuaaaaaauuuuucugacacccuuuaau

SEQ ID NO: 548298 - RNA, 64 nt, hsa
uuagcauuuuauacagucaacuuuguaaugaacuuuuuaaaaauuaauugauuuuccuuugggg

SEQ ID NO: 548299 - RNA, 64 nt, hsa
cuaagacaugucaauauucuuuuuuaaaguuuuuuuuuaaaauauugauuugaaugcaguaggc

SEQ ID NO: 548300 - RNA, 64 nt, hsa
ucuagucagaguauaauuuugguuguaauuaaauuuuuaaaaucugcugaucucuguagaaucu

SEQ ID NO: 548301 - RNA, 64 nt, hsa
guuuuauuuaugaaguuuuuauuuuaaacauuuuuuuuaaaaauuagccuugauauucuccaga

SEQ ID NO: 548302 - RNA, 64 nt, hsa
uuauucugaacaguuuagucccaagagaauagcguuuuaaaaaagaaaaacaagauuuggaguc

SEQ ID NO: 548303 - RNA, 64 nt, hsa
uugguguaauaguugugucaccauucuuguugcuuuuuaaaaaucaggcuaaucauguggucca

SEQ ID NO: 548304 - RNA, 64 nt, hsa
auucugcggauguuauuucuguuauacaucugaauuuuaaaauguuuacugauagauaauggau

SEQ ID NO: 548305 - RNA, 64 nt, hsa
uuagaaguuguguuacaacuguagcaaauuuuccuuuuaaaaaauccaggcaauggcauuaaac

SEQ ID NO: 548306 - RNA, 64 nt, hsa
acuguggcuugauguugauacacauuugaauuuuuuuuaaaaaaagaaaguuaucguagccagc

SEQ ID NO: 548307 - RNA, 64 nt, hsa
cuggggaccagaauccaaacggccucaaguggaauuuuaaaaccuagccugucucuuuucccug

SEQ ID NO: 548308 - RNA, 64 nt, hsa
cuauuguugccuuuccaagugaccucuccucuucuuuuaaaaaaagaacacuuucugcucauau

SEQ ID NO: 548309 - RNA, 64 nt, hsa
aaaaaaaaaggcuuuucuuuuuaaacaguuccacuuuuaaaaccugccucuggguuuuuguuuu

SEQ ID NO: 548310 - RNA, 64 nt, hsa
caagaaaaugcaaguugccaagagcucugauauuuuuuaaaaagaauuuuuuuguaaagaucag

SEQ ID NO: 548311 - RNA, 64 nt, hsa
auuuuccuuaaauaugugauuucagacuauuccuuuuuaaaaucauuuguguuuauucuucaua

SEQ ID NO: 548312 - RNA, 64 nt, hsa
ugagcucucuaaccuccuuuuugucuuauagacuuuuuaaaauguacauaaagaauuuaagaaa

SEQ ID NO: 548313 - RNA, 64 nt, hsa
gagauuauuuucuguaaugcugggaacaaaccuguuuuaaaagcacacugcuaaaaguagguga

SEQ ID NO: 548314 - RNA, 64 nt, hsa
uuccagauuguucaucuagaggcagagacaucucuuuuaaaaaagugccagaugccccagugcc

SEQ ID NO: 548315 - RNA, 64 nt, hsa
uaacuuucuuuaucuccuuggaauuaaagagggcuuuuaaaagauaauuugacugauccaugcu

SEQ ID NO: 548316 - RNA, 64 nt, hsa
uuguaaagauuucauaaaaugauaguauugguuauuuuaaaaaggcuuuggcuuaugcugaauu

SEQ ID NO: 548317 - RNA, 64 nt, hsa
aaauuguaagcuuuauuuggauuuuuaaauacauuuuuaaaauuucagauguaauuuaacauca

SEQ ID NO: 548318 - RNA, 64 nt, hsa
uuugaaaccacugauugcaaaccucccugacaauuuuuaaaaguaguaagccacauuacauuua

SEQ ID NO: 548319 - RNA, 64 nt, hsa
uuaagaauaacagucugauuuaauaaaugguucauuuuaaaaguucaucaguguugcucuuuga

SEQ ID NO: 548320 - RNA, 64 nt, hsa
ugucuacuaaugagccuuauuccauuuccugauguuuuaaaagaagaaacacugccuugauuau

SEQ ID NO: 548321 - RNA, 64 nt, hsa
gucacaaauauaacaaaguucauuguuuuaggguuuuuaaaaaacguguuguaccuaaggccau

SEQ ID NO: 548322 - RNA, 64 nt, hsa
ucugauagucuccugcuguuuuaccccuuccauuuuuuaaaauaagaaauuagcagcccucugc

SEQ ID NO: 548323 - RNA, 64 nt, hsa
auagcugauuauuguauaugcaaauuacaugcauuuuuaaaaacuauucuuucugaacuuaucu

SEQ ID NO: 548324 - RNA, 64 nt, hsa
gguuacucaaguagaagccugaaaauuaaucugcuuuuaaaauaaagagcaguguucuccauuc

SEQ ID NO: 548325 - RNA, 64 nt, hsa
cagugcauuguuuuuuaaacuggaaaucauuuuguuuuaaaaguuaauaauggaaaccauauua

SEQ ID NO: 548326 - RNA, 64 nt, hsa
aguaccacguguagcauuuugaaacauuauuuuuuuuuaaaaaaugcugucuugcuuuagcuau

SEQ ID NO: 548327 - RNA, 64 nt, hsa
uguucuucugaaaacagacccuuggcuucacacauuuuaaaaauguuugcuacuuguuaaggga

SEQ ID NO: 548328 - RNA, 64 nt, hsa
aauaaagugacccagggaauuuagaaaaaaauuauuuuaaaaaauauguuugaugcuauuuugu

SEQ ID NO: 548329 - RNA, 64 nt, hsa
guuauuuguaugugucacuagugucuaaugaagcuuuuaaaaucuacaauuucuucuuuaaaaa

SEQ ID NO: 548330 - RNA, 64 nt, hsa
uugccuggcaggauacugcaaagaacaugguuuauuuuaaaauuuauaaacaagucacuuaaau

SEQ ID NO: 548331 - RNA, 64 nt, hsa
ugaaaugaagaguaaaaacaaauuuguuugacuauuuuaaaauuauauuagaccuuaagcuguu

SEQ ID NO: 548332 - RNA, 64 nt, hsa
aucaugcuuaaaugguugauucuccaauuucuuuuuuuaaaaauaaguuaauugcuuuugcagg

SEQ ID NO: 548333 - RNA, 64 nt, hsa
uugcauuguaggagcaaacaaggcuucauauucuuuuuaaaaugacuugaaauuuuauuauaaa

SEQ ID NO: 548334 - RNA, 64 nt, hsa
cuugacuuuuauauuucuuuaaaaaauuccuuccuuuuaaaaaauauaaaagggacuacuguuc

SEQ ID NO: 548335 - RNA, 64 nt, hsa
aauaaaauaaaacuggccugacuuaagauaaccauuuuaaaaaauugggcugucaugugggaau

SEQ ID NO: 548336 - RNA, 64 nt, hsa
ucaaaauauguagaaacauuacuaugaaaucaguuuuuaaaagauauacuuucucuuuguccug

SEQ ID NO: 548337 - RNA, 64 nt, hsa
ugcuccuggccuuaaacaucaccguaggaaggguuuuuaaaauuuuacgcgcaaaacuccgugg

SEQ ID NO: 548338 - RNA, 64 nt, hsa
uuucagauccaagcauauaaaaagccuguauauuuuuuaaaaacacaucuuaacuccacgcuuu

SEQ ID NO: 548339 - RNA, 64 nt, hsa
auagagaaacacagcauacuguucauuaauaguauuuuaaaaaaauuguuuuucaaaugucacc

SEQ ID NO: 548340 - RNA, 64 nt, hsa
aaaauuguuacguaccauauuuguaacuaucaacuuuuaaaacuuuuaacguuuuuguuacaug

SEQ ID NO: 548341 - RNA, 64 nt, hsa
cuugcaacuccuuuugcaaaagcagacuaaaauguuuuaaaaugugaaaaaacauuauuuuuuc

SEQ ID NO: 548342 - RNA, 64 nt, hsa
guagaaugaauaggagaagaguuuaagccuguuuuuuuaaaauauuauugcaaagagcucuauu

SEQ ID NO: 548343 - RNA, 64 nt, hsa
auuuuuuuaacuaugcauuugaguacagacuaauuuuuaaaauaugcuaaacuggaagauuaaa

SEQ ID NO: 548344 - RNA, 64 nt, hsa
gaaacaaaguaaacuauaaacuuguacaaauugguuuuaaaaaaaauugcugccacuuuuuuuu

SEQ ID NO: 548345 - RNA, 64 nt, hsa
gcuggauugacuauaacuuaagugcugauugugauuuuaaaaugauaguaccguaaagcauuaa

SEQ ID NO: 548346 - RNA, 64 nt, hsa
acaaaauuugaaauuaaccuauugggucugguacuuuuaaaauuguacagauguuugugccuuu

SEQ ID NO: 548347 - RNA, 64 nt, hsa
gcacaagcauuaacuuuuguuuuauaguuaugcuuuuuaaaauucauuguuuuuaaauuuagac

SEQ ID NO: 548348 - RNA, 64 nt, hsa
cuccugguauuauauauuugcuaguuaucuaauguuuuaaaagaaaauauaccucauuuagguu

SEQ ID NO: 548349 - RNA, 64 nt, hsa
guaaaaucauaaaguuugguaaugcaguuuaucguuuuaaaaauaauccacaaagauguuuuua

SEQ ID NO: 548350 - RNA, 64 nt, hsa
uuuuccauauugguauuuuugaugcugcuuccaauuuuaaaagggaacaaagcugccauaaauc

SEQ ID NO: 548351 - RNA, 64 nt, hsa
aaaccugguaucuauuuguauauaugcuaaauaauuuuaaaauacaagaguuuuugaaauuuuu

SEQ ID NO: 548352 - RNA, 64 nt, hsa
acaauauuuuauuuuccuaaauuaugggaaauccuuuuaaaauguuaauuuauuccagccguuu

SEQ ID NO: 548353 - RNA, 64 nt, hsa
acaaaaugcuguauuugaguuucugacaaauuuguuuuaaaaaucaaauuugaauguacuauuc

SEQ ID NO: 548354 - RNA, 63 nt, hsa
aaaccgucuuacuagacugaaugucacuuaucuuuuuaaaaaacucucauuuuuacaaagacu

SEQ ID NO: 548355 - RNA, 64 nt, hsa
uagauaggccuuucaguaacacaggugaagaaauuuuuaaaaauacauugauuauuaucuaggu

SEQ ID NO: 548356 - RNA, 64 nt, hsa
ugugaacuuaaaacugcucuaaaaaaaauaucuuuuuuaaaaaagagagaauuagcauuguguc

SEQ ID NO: 548357 - RNA, 64 nt, hsa
cauccauaaauaacuauucaguucccuuuuucccuuuuaaaaugcuuccucaacgaaggggaac

SEQ ID NO: 548358 - RNA, 64 nt, hsa
uagcaaaguuggcucuacauaaacauuguucuuauuuuaaaauuaacacuauguguucaguuuu

SEQ ID NO: 548359 - RNA, 64 nt, hsa
uuugguugaccaguauuacuauacaauguaaguguuuuaaaaaauacgaaaguaauacucugca

SEQ ID NO: 548360 - RNA, 64 nt, hsa
cagaacuucaaguagcaguucaaaagaugucaguuuuuaaaauuguuuuuguuguugucuuggc

SEQ ID NO: 548361 - RNA, 64 nt, hsa
auuucugugguuucuauucagcuuggguuucauguuuuaaaauaaauuuuaaaaagcaagccuc

SEQ ID NO: 548362 - RNA, 64 nt, hsa
ucuauucagcuuggguuucauguuuuaaaauaaauuuuaaaaagcaagccucucuuccugagcu

SEQ ID NO: 548363 - RNA, 64 nt, hsa
uaucugcucauguaugugauuugacaaaccaguuuuuuaaaauaaauggcuuuuuaaaaaucug

SEQ ID NO: 548364 - RNA, 64 nt, hsa
gauuugacaaaccaguuuuuuaaaauaaauggcuuuuuaaaaaucugggcuuauauugucagag

SEQ ID NO: 548365 - RNA, 64 nt, hsa
uuaaaaauguuacugcuaaagauacauuauccuuuuuuaaaaagucuccauucaaauuaaauua

SEQ ID NO: 548366 - RNA, 64 nt, hsa
uuuuuucaaucucauaaaaaagggauagugcaucuuuuaaaauacauuuuauuuggggaggaac

SEQ ID NO: 548367 - RNA, 64 nt, hsa
uuaaauaaucuuagaauuaauugauaaaugucucuuuuaaaaucuacuguauuuauuauaauuu

SEQ ID NO: 548368 - RNA, 63 nt, hsa
guuauaagucucuuccuuucucaaauaaaguuuuuuuuaaaagauccccuuucauacacuugg

SEQ ID NO: 548369 - RNA, 64 nt, hsa
uggaauuguuaauaauugcuccuaaagauuauaauuuuaaaagucacaggaggagacaaauugc

SEQ ID NO: 548370 - RNA, 64 nt, hsa
cuaauaauacaaugucacuuuaucagaauacuaguuuuaaaagcugaauguuaauaggggacac

SEQ ID NO: 548371 - RNA, 64 nt, hsa
caagaucuugcccuccaaugaaaugacuuacauguuuuaaaaaaccgaguugguuuuauugaau

SEQ ID NO: 548372 - RNA, 64 nt, hsa
ugucgacuugcuaauuucagaaauaauuauucauuuuuaaaaagccccuuuuaaagcaucuacu

SEQ ID NO: 548373 - RNA, 64 nt, hsa
auaaccaugccuggcuaauuuauuuuuacuuuuauuuuaaaauaaaagaugaggucugucuuau

SEQ ID NO: 548374 - RNA, 64 nt, hsa
uguguguguguguguguguguguguguucauggguuuuaaaagaacaguauuuuacaaaaggug

SEQ ID NO: 548375 - RNA, 64 nt, hsa
cuuuacugcaugcauagcacuuaauaaaauggauuuuuaaaaaauccacuaguaauaucagaau

SEQ ID NO: 548376 - RNA, 64 nt, hsa
aaaucuaauuauucaguuauucaugacaauauuuuuuuaaaaguaagaaauucugaguugucuu

SEQ ID NO: 548377 - RNA, 64 nt, hsa
auuauuaagucaccuaucaccuuuaaacgccuuuuuuuaaaauuauaaaauauuguaaagcagg

SEQ ID NO: 548378 - RNA, 64 nt, hsa
aaaaucaccaauuuuuuacauauaaaagauaccuuuuuaaaaaaauagguuuuaagagcucuuu

SEQ ID NO: 548379 - RNA, 64 nt, hsa
acaggcgugagccaccguguccggccguaguuuauuuuaaaauauauuuuuaaaagcuuuguaa

SEQ ID NO: 548380 - RNA, 64 nt, hsa
accguguccggccguaguuuauuuuaaaauauauuuuuaaaagcuuuguaaaaauuaugucauu

SEQ ID NO: 548381 - RNA, 64 nt, hsa
ucugaauccucaauagaaaaucacauuaaucuuauuuuaaaauuuggccuuuuucaacacuaac

SEQ ID NO: 548382 - RNA, 64 nt, hsa
guggaauaaaggaggagauuuuauuuacagauuuuuuuaaaagccaccuggguugacaccuucc

SEQ ID NO: 548383 - RNA, 64 nt, hsa
uauucacaauuguguucucuaaaaugugucuaaauuuuaaaaauauguacaugcauaaugucau

SEQ ID NO: 548384 - RNA, 64 nt, hsa
cuaaauuuuaaaaauauguacaugcauaaugucauuuuaaaaucugaaggaaagaauuugaagu

SEQ ID NO: 548385 - RNA, 64 nt, hsa
cuguugaaauuuggaaguucugaaauuauaguauuuuuaaaaauugcacugaaguguauacaca

SEQ ID NO: 548386 - RNA, 64 nt, hsa
aaauuauccaacuacccuauuguuaagcauuugguuuuaaaauuuuuaugcuaauauaaaugcu

SEQ ID NO: 548387 - RNA, 64 nt, hsa
auaaucagauauaaauauauacuuaauuuuuuaauuuuaaaaauagauaccuguuugacuuuga

SEQ ID NO: 548388 - RNA, 64 nt, hsa
agccuggcugcaaagaagaaucaacagggacacuuuuuaaaaacacucuuaucagccugggcaa

SEQ ID NO: 548389 - RNA, 64 nt, hsa
cuauuggugaaaugguauaaaauaucauaugcaguuuuaaaacuuuuuauauuuuugcaauaaa

SEQ ID NO: 548390 - RNA, 64 nt, hsa
ugaucuugacauuuaaugucacaaaguuuuguuuuuuuaaaaagugauuuaaacuuaagauccg

SEQ ID NO: 548391 - RNA, 64 nt, hsa
caugaagaugacuuguuuuauauuucagauuuuauuuuaaaagccaugucuguuaaacaagaaa

SEQ ID NO: 548392 - RNA, 64 nt, hsa
uaguaagaaaguaugguucuguauggcaauagguuuuuaaaauuauuagcuauucaucaugugu

SEQ ID NO: 548393 - RNA, 64 nt, hsa
aaauuuuaguauaaaaacaauuccugggagcguuuuuuaaaaaucaguuguagacaccacccuc

SEQ ID NO: 548394 - RNA, 64 nt, hsa
gagugggaauuuuuuccuaaucauguuuuuaacauuuuaaaauaaaauuuaauacuaagaaauu

SEQ ID NO: 548395 - RNA, 64 nt, hsa
uaaauaaauaaauaaauaaacaaaccagucuuuauuuuaaaagaaacuuuaggaaacaaaccca

SEQ ID NO: 548396 - RNA, 64 nt, hsa
guuacaggcgguguccuuuuaaauguggaaaggcuuuuaaaauauuuuaaaacuggaccuguau

SEQ ID NO: 548397 - RNA, 64 nt, hsa
guguccuuuuaaauguggaaaggcuuuuaaaauauuuuaaaacuggaccuguauuauccugaau

SEQ ID NO: 548398 - RNA, 64 nt, hsa
accuguauuauccugaauacacuauuuugaaaauuuuuaaaaaugacuucuuuauuuugcuuua

SEQ ID NO: 548399 - RNA, 64 nt, hsa
gaucauugacaugugauuucaaaacacaguguucuuuuaaaaaucuauaauaugucaaaauaca

SEQ ID NO: 548400 - RNA, 64 nt, hsa
ugaguagaaaaucacuuaccagugagcauauauauuuuaaaauacuuucuuuggauauuguaau

SEQ ID NO: 548401 - RNA, 64 nt, hsa
aauaaaauauuucauuagcuugaauuguauagauuuuuaaaaauucaaugaaagcauguuguuu

SEQ ID NO: 548402 - RNA, 64 nt, hsa
uaaaaauucaaugaaagcauguuguuuaauuucuuuuuaaaaucacuguugggcuuugaaagca

SEQ ID NO: 548403 - RNA, 64 nt, hsa
ucugccucagaaaacaaggaugaauuaaguuuuuuuuuaaaaaagaaacauuugguaaggggaa

SEQ ID NO: 548404 - RNA, 64 nt, hsa
uaauaauguuucaaacauauauaacaaugcuguauuuuaaaagaaugauuaugaauuacauuug

SEQ ID NO: 548405 - RNA, 64 nt, hsa
gucagugcuucuaaaaagaauuuaagauaaugguuuuuaaaaugccuuuauaauaagcuuuguu

SEQ ID NO: 548406 - RNA, 64 nt, hsa
aaaauugcaauuguauuagguguuaaaauaaaguuuuuaaaaaauuacuuguauuuauacuuua

SEQ ID NO: 548407 - RNA, 64 nt, hsa
caggacucaauaauggugggugaacauuagucauuuuuaaaagacaccucuuauagcaauaagg

SEQ ID NO: 548408 - RNA, 64 nt, hsa
uaaauauuucaguauuauauagaaaaaaauagauuuuuaaaauucagaauggacaaagagaaua

SEQ ID NO: 548409 - RNA, 64 nt, hsa
uguugcccugaguggaucuccaaggaccagguuauuuuaaaaagauuuguuuugucaaguguca

SEQ ID NO: 548410 - RNA, 64 nt, hsa
auuccgucuuaaaaaaaaaaaaaaaaaaguuuguuuuuaaaaaaaucuaaauaaaauaacuuug

SEQ ID NO: 548411 - RNA, 64 nt, hsa
cccaaauuuggggauggggcccaggaauaugcauuuuuaaaaagucaucugcccuucccaggug

SEQ ID NO: 548412 - RNA, 64 nt, hsa
guauguauuugcuggugucguguaaauauugguauuuuaaaauaaaaacuguuacaucacuauu

SEQ ID NO: 548413 - RNA, 64 nt, hsa
augguguaauaggaauaauauuuauccaaaagauuuuuaaaaauagggcuguguuuaaaaaaaa

SEQ ID NO: 548414 - RNA, 64 nt, hsa
uccuggaguuaauuuguuuuacaggaauuuuguuuuuuaaaaaaauaggaucauucugaacuuu

SEQ ID NO: 548415 - RNA, 64 nt, hsa
cauuucuuaucaucacuuuuugucuuuucuuguuuuuuaaaauauacauuuuauuuuugaaggu

SEQ ID NO: 548416 - RNA, 64 nt, hsa
aauaguuuuacguuguacauaauaguguaaaccuuuuuaaaaaggaaaguauaaaaacaaaagu

SEQ ID NO: 548417 - RNA, 64 nt, hsa
cugaaaggaaaggcaucacuauggacuuucucuauuuuaaaaugguaacaaucagaggaacuau

SEQ ID NO: 548418 - RNA, 64 nt, hsa
auccaaauucaaagaaacagggcguggggcgcacuuuuaaaagagaaagcgagacaggcccgug

SEQ ID NO: 548419 - RNA, 64 nt, hsa
acccaggaaaugcuuaguaaguguucccuucacauuuuaaaauuugaguauacaaucauguuug

SEQ ID NO: 548420 - RNA, 64 nt, hsa
gcuucaccuuauuacaugcuauuuuauuuugcuuuuuuaaaaacucaggacauuaacuaauuuu

SEQ ID NO: 548421 - RNA, 64 nt, hsa
aauuuucuuuaguguauuuuaaacacgauucaguuuuuaaaagaucgaucuacauacaauagau

SEQ ID NO: 548422 - RNA, 64 nt, hsa
cucaguauuugauuuuuuuccccaauauuugauuuuuuaaaaauauacacauaggugcugcauu

SEQ ID NO: 548423 - RNA, 64 nt, hsa
uuauauacuuuauaaugauagaaguccaaccguuuuuuaaaaaauaaauuuaaaauuuaacagc

SEQ ID NO: 548424 - RNA, 64 nt, hsa
acgaauuaaaauaugauagagaacuauaugcagauuuuaaaaucuagucaguacuagcaucuau

SEQ ID NO: 548425 - RNA, 64 nt, hsa
uguguagccuucuggaaucugcacgugacuggcauuuuaaaacaacucauuaaauauuggauuc

SEQ ID NO: 548426 - RNA, 64 nt, hsa
gcgugagccaccacgccuggccaauuauguaauuuuuuaaaaaggacauuucuaucagggauau

SEQ ID NO: 548427 - RNA, 64 nt, hsa
uuaaaaggauuaaaguaacggagauauacacaaauuuuaaaauuaugugugaucacaagacuaa

SEQ ID NO: 548428 - RNA, 64 nt, hsa
cucucacaucuuacagaucuauaaggucacaugcuuuuaaaauaguagcaaguuaaacuucacu

SEQ ID NO: 548429 - RNA, 64 nt, hsa
uuauuucuguucagaucuccaccggccuuuguucuuuuaaaacuugaauauaggugggagacau

SEQ ID NO: 548430 - RNA, 64 nt, hsa
uaaagauucuaaacauguaucugagcugguaauauuuuaaaaucuccauuauuuguguaaaacu

SEQ ID NO: 548431 - RNA, 64 nt, hsa
uauauauauauuucccugaaggaaccaaagcgaauuuuaaaagaugcaauguagaggggaaaag

SEQ ID NO: 548432 - RNA, 64 nt, hsa
gaccuuccaagagccugagagugagguggaauuauuuuaaaagauaaauauuauauuauauaua

SEQ ID NO: 548433 - RNA, 64 nt, hsa
gaauuauauauuauguaucuuuuaaaaauugaaauuuuaaaauauggagaauaucacuaagcug

SEQ ID NO: 548434 - RNA, 64 nt, hsa
guuuauaauuauuaggaauuauauauuauguaucuuuuaaaaauugaaauuuuaaaauauggag

SEQ ID NO: 548435 - RNA, 64 nt, hsa
aaauuucauaauuguggacaauuggaggcauuuauuuuaaaaaacaauuuuauuggccuuuugc

SEQ ID NO: 548436 - RNA, 64 nt, hsa
ccuuuugauaucuguuguugcaauguuagugauguuuuaaaaugugaucgaaaauauaaugcuu

SEQ ID NO: 548437 - RNA, 64 nt, hsa
ggcgggaaauaauuguguacauaaaauuaggcuuuuuuaaaaaaauagauuaugaugcagaaua

SEQ ID NO: 548438 - RNA, 64 nt, hsa
auccucagguccagaauuccagcaucauuuauucuuuuaaaauuuuuaagaacuugauccauug

SEQ ID NO: 548439 - RNA, 64 nt, hsa
caucuaagaauacagaaccaaauuggauccauuuuuuuaaaaaaaugguuuugcauggaaccug

SEQ ID NO: 548440 - RNA, 64 nt, hsa
uucacaauuauuaaauuguguacacuuucauuacuuuuaaaaauguagaaauucuucaugaaca

SEQ ID NO: 548441 - RNA, 64 nt, hsa
uaguuaaaaugcugacauaacaccaaacuucauuuuuuaaaaaaucuguuguuccaaaugugua

SEQ ID NO: 548442 - RNA, 64 nt, hsa
aaugugaaaaaaauuauucaugcucucauauauauuuuaaaaacacuacuuuugcuuuuuuauu

SEQ ID NO: 548443 - RNA, 64 nt, hsa
cuguucccuauaaccucuucauuguuuucuuuucuuuuaaaaauaauaaacuuuucuaugauca

SEQ ID NO: 548444 - RNA, 64 nt, hsa
aagauaucuuaccuguuuguuauuaaccaaauauuuuuaaaaauauuuccuccauaaauauuca

SEQ ID NO: 548445 - RNA, 64 nt, hsa
uacaaauaauuauuuaaacauuuuuauacaauguuuuuaaaacuguuggauuaucaccagauua

SEQ ID NO: 548446 - RNA, 64 nt, hsa
aagaaagaaagcaggauuuucuccuguaucugaauuuuaaaauuaaaaaggcagauaagacaua

SEQ ID NO: 548447 - RNA, 64 nt, hsa
auaauaacugaaaagacuauguagugaaauguauuuuuaaaaacuauauucaguaaaagccugc

SEQ ID NO: 548448 - RNA, 64 nt, hsa
guuagcaaucaauuuugaauuuauaauucugcuauuuuaaaagaaauguagucuuguaguauga

SEQ ID NO: 548449 - RNA, 64 nt, hsa
auaaccaaugauauuucaguauauauuuucucucuuuuaaaaaauauuuaucauacucuguaua

SEQ ID NO: 548450 - RNA, 64 nt, hsa
guaagcagguacuacauuuauaauggaaggaauuuuuuaaaaaauuuuaagcuguacacuuuca

SEQ ID NO: 548451 - RNA, 64 nt, hsa
ucuauaugcuuuccuuuuaaaaucagauuuuaguuuuuaaaauacugauacauccauuuugaua

SEQ ID NO: 548452 - RNA, 64 nt, hsa
uaucaguauuuuucagauuuucuauaugcuuuccuuuuaaaaucagauuuuaguuuuuaaaaua

SEQ ID NO: 548453 - RNA, 64 nt, hsa
ccaaaauauuuugcuuuauguauauuacaguucuuuuuaaaacacuggaagacucauguuaaac

SEQ ID NO: 548454 - RNA, 64 nt, hsa
cauauugauuaaaacaguuaacaaacuuuuuucuuuuuaaaaugugagaucagugaacucuggu

SEQ ID NO: 548455 - RNA, 64 nt, hsa
aucauaguugcaaaauauaauaaauacaaguucuuuuuaaaauccaagcuuguguguauuuauc

SEQ ID NO: 548456 - RNA, 64 nt, hsa
ucgcuugccaaagcagauuuuccuaaggccacuguuuuaaaagaucauaguugcaaaauauaau

SEQ ID NO: 548457 - RNA, 64 nt, hsa
uuauccuuguaauguauuuuacaaggauaauguauuuuaaaaugggaguugcauaggagagaug

SEQ ID NO: 548458 - RNA, 64 nt, hsa
acauacaaaucuaggaauauuaugcguuaaaguauuuuaaaauacauuauccuuguaauguauu

SEQ ID NO: 548459 - RNA, 64 nt, hsa
uggcucuuguuccacuauuaacauuguuuuuaauuuuuaaaauccuaucagcagccuccuaauu

SEQ ID NO: 548460 - RNA, 64 nt, hsa
uggcugcacauucauaccaaucaccaggggauuuuuuuaaaauccugaugcccaacuugcacuc

SEQ ID NO: 548461 - RNA, 64 nt, hsa
gugcaacagauuugguauuaaaaauuaaaugugguuuuaaaaguuccucucucuuuuguaauuu

SEQ ID NO: 548462 - RNA, 64 nt, hsa
caguaagaaagaugucaacaugcuagaaaauuaauuuuaaaacuaaguuauuccaacacuaaaa

SEQ ID NO: 548463 - RNA, 64 nt, hsa
ggguccuagauuacugucauugucuaaaaguaacuuuuaaaaagcagaguucaugaaaacugca

SEQ ID NO: 548464 - RNA, 64 nt, hsa
auaaaaaucauggcaacauaauucacuuuccaucuuuuaaaaauauauuuugccauuaauccaa

SEQ ID NO: 548465 - RNA, 64 nt, hsa
cuucuccuaugcauuuuuaauaugacaaaacaaauuuuaaaagauuugaaauaauuguauuucu

SEQ ID NO: 548466 - RNA, 64 nt, hsa
uuuuccccuugagaguauauauuuuccccuacgguuuuaaaaaacagauaaaacauggacaaug

SEQ ID NO: 548467 - RNA, 64 nt, hsa
cuuguagaucagguguuuuguuuuguuuuuuuaauuuuaaaaugcaacccugcccccuccccag

SEQ ID NO: 548468 - RNA, 64 nt, hsa
gaugaaauaggcuauccacucgggauggcuuacuuuuuaaaaggguagggggaggggcugggga

SEQ ID NO: 548469 - RNA, 64 nt, hsa
aaggaaauaugucuaauggacaccaguuaauacuuuuuaaaacuacucuuuaaaaaaaaaauac

SEQ ID NO: 548470 - RNA, 64 nt, hsa
gacggugcuagaaauauccaaguguuaaauaaccuuuuaaaagcaacaaaagcuacuuuuuucu

SEQ ID NO: 548471 - RNA, 64 nt, hsa
aauaggucagaucuuggccucccaaaccccuuauuuuuaaaauacuuugcgccuugcuuugaua

SEQ ID NO: 548472 - RNA, 64 nt, hsa
ugcuguguuuucuucagagcaagaagguuauauuuuuuaaaauuuacuuaguaaugcacauuca

SEQ ID NO: 548473 - RNA, 64 nt, hsa
aggugcuuggccuccaguagcugccuccauucucuuuuaaaaaaagggggugauucugaggcac

SEQ ID NO: 548474 - RNA, 64 nt, hsa
uugcuuucccuuaguauuagauuuguugaggguuuuuuaaaaaucaggucuguugaaagucuuc

SEQ ID NO: 548475 - RNA, 64 nt, hsa
cuuuagagcuguguguugagcuaaaaauauaauuuuuuaaaaauugacuagcaaaaucuauggc

SEQ ID NO: 548476 - RNA, 64 nt, hsa
aggagauacguaaaguaggccccacaaauaauauuuuuaaaauacaaaggaucaccacaauccu

SEQ ID NO: 548477 - RNA, 64 nt, hsa
uuaaucagaagaacauuguuguuugauuauauguuuuuaaaaaccugaagcuuuuuugguggca

SEQ ID NO: 548478 - RNA, 64 nt, hsa
cuauauaaaacaauuguuuacguguacuuuuaacuuuuaaaaguacuuaauuaacauauguugu

SEQ ID NO: 548479 - RNA, 64 nt, hsa
uuaauuaacauauguuguuugacuuguauaaaguuuuuaaaaauuguuguuuauuugccaaagu

SEQ ID NO: 548480 - RNA, 64 nt, hsa
uacauuguuuaucuaauauuauuuaugacaguaauuuuaaaauauauuauucauaaguucaagg

SEQ ID NO: 548481 - RNA, 64 nt, hsa
ugauacugauuuugagaauuuaaagcagauuaccuuuuaaaacuggaccaacuaaguaauuggu

SEQ ID NO: 548482 - RNA, 64 nt, hsa
uuuuaacuuucauuuuagagcacguuuuggucauuuuuaaaaauaccuaaagugccagaccgga

SEQ ID NO: 548483 - RNA, 64 nt, hsa
auaugcuuauaccuaauuuuuaguuuuuaaacuauuuuaaaauauacuaugauuuuauauguau

SEQ ID NO: 548484 - RNA, 64 nt, hsa
uuguuuucuuuuaauuucuaugaauaaaagaaauuuuuaaaaacuuuaaaauuuuaaauauuag

SEQ ID NO: 548485 - RNA, 64 nt, hsa
aagugaauugcccagagcugccuuuuucuuuucuuuuuaaaaauuuuaagaaguuuucuuugug

SEQ ID NO: 548486 - RNA, 64 nt, hsa
guuguuuauuuguuauuuuaaagguaaauugcacuuuuaaaaaaauaauugguugacuuaauau

SEQ ID NO: 548487 - RNA, 64 nt, hsa
uauuaaauguuacaaaguuccaaaugaaucaguauuuuaaaaaauaaaacuaugaaagcauuaa

SEQ ID NO: 548488 - RNA, 62 nt, hsa
auaaaacuaugaaagcauuaaaauauaggugaauuuuuaaaacuguaucuaucucaucauuu

SEQ ID NO: 548489 - RNA, 64 nt, hsa
cuaagcaaauauuuuuccaggcugugcugugcauuuuuaaaaggucuaauuuaauugcuuuuaa

SEQ ID NO: 548490 - RNA, 64 nt, hsa
ugccuuuccgcccuaugaaaaucaagaaaaucuuuuuuaaaaauggaguccugcuauuuuccac

SEQ ID NO: 548491 - RNA, 64 nt, hsa
ucagugaaauaggagauacauaguaguauuuuauuuuuaaaauuaauuucucauuugguuuuga

SEQ ID NO: 548492 - RNA, 64 nt, hsa
cuauuugugcuagaauaguuguaucuaaaucauauuuuaaaauuauuuuuauuuuuaaaaaauu

SEQ ID NO: 548493 - RNA, 64 nt, hsa
uuguaucuaaaucauauuuuaaaauuauuuuuauuuuuaaaaaauuaugguaaaaacauauaaa

SEQ ID NO: 548494 - RNA, 64 nt, hsa
ucuaaacuuguguuguuucuuuuuuaaaucaacuuuuuaaaaaaauaaaguguaaauuaaccga

SEQ ID NO: 548495 - RNA, 64 nt, hsa
ucuagaauacauagcagcucugcaaaggaacaguuuuuaaaaaugggaacuucuacauugaaaa

SEQ ID NO: 548496 - RNA, 64 nt, hsa
cagaaaucucaguuuaauauaaaaugagcuaaguuuuuaaaaauaaauuauaaacuuggagauu

SEQ ID NO: 548497 - RNA, 64 nt, hsa
uaaacucucugauaucacuuaaagcuggaguuuauuuuaaaacaaaugaagcaugggccaccuc

SEQ ID NO: 548498 - RNA, 64 nt, hsa
uggaaaaacuggucgaguaauuaucaauaauuuuuuuuaaaaagaggaucccaaacuguaaaag

SEQ ID NO: 548499 - RNA, 64 nt, hsa
gauguacauuacugugaauuuuuauaccacucauuuuuaaaagggcugucuuuucauuuuaguu

SEQ ID NO: 548500 - RNA, 64 nt, hsa
uacuguggugguguacacaggauagaacacccuuuuuuaaaacacagucuuuccccuugcucau

SEQ ID NO: 548501 - RNA, 64 nt, hsa
uagguuauaggaaagaucuguuuauguaguuuguuuuuaaaaugugccaaugccuguacauuaa

SEQ ID NO: 548502 - RNA, 64 nt, hsa
uuaaaaugugccaaugccuguacauuaacaagauuuuuaaaaauaaaauuguauaaaacauuca

SEQ ID NO: 548503 - RNA, 64 nt, hsa
uuuucagaauuuucucuuuuaaucacaagaagccuuuuaaaaaaugacuuacacauauucucaa

SEQ ID NO: 548504 - RNA, 64 nt, hsa
uauuuuauauucugauuuuaucagaauuauucuauuuuaaaauuguuuuaaaauuuaaaacauu

SEQ ID NO: 548505 - RNA, 64 nt, hsa
cugauuuuaucagaauuauucuauuuuaaaauuguuuuaaaauuuaaaacauuuaauucaugau

SEQ ID NO: 548506 - RNA, 64 nt, hsa
guauacucucaguucucauucaguauaaauaaaauuuuaaaauccuuucauaguucuauuagaa

SEQ ID NO: 548507 - RNA, 64 nt, hsa
ugcaaagcugaaacugauuagaaaauucuuuauauuuuaaaauagcucuuucucauuuuuagag

SEQ ID NO: 548508 - RNA, 64 nt, hsa
aacuagaacugucaaauaacaaaacggcucauguuuuuaaaauauauguaacucauuuuaaaau

SEQ ID NO: 548509 - RNA, 64 nt, hsa
aaacggcucauguuuuuaaaauauauguaacucauuuuaaaauauauuaaauuguauuccaaac

SEQ ID NO: 548510 - RNA, 64 nt, hsa
ucacaaguaaaaugaauucuaauguacaaguuuguuuuaaaaaguguaugucaagcuuuuauuu

SEQ ID NO: 548511 - RNA, 64 nt, hsa
aauucucaaaugauauacauuuaaagggcagauuuuuuaaaaagauacuacuauaauaaacauu

SEQ ID NO: 548512 - RNA, 64 nt, hsa
uaaacuuucaugguauuuagccuuucuuaaauuuuuuuaaaauuuaaacuuucuaaccuaugua

SEQ ID NO: 548513 - RNA, 64 nt, hsa
acauguacagaguuuuauauaaauuuaaaccaauuuuuaaaacaaaacugcggacaccaccaua

SEQ ID NO: 548514 - RNA, 64 nt, hsa
uguuuaacuaaacugucaugguuuaguuuacaauuuuuaaaaaguucuuaaaauacugaaaaug

SEQ ID NO: 548515 - RNA, 64 nt, hsa
ccucucugagcuuguuuguugcugaaaugcuacuuuuuaaaauuuagauguuagauugaaaacu

SEQ ID NO: 548516 - RNA, 64 nt, hsa
uacugcuuugaacuuccaaguaugucuagucaccuuuuaaaauguaaacauuuucagaaaaaug

SEQ ID NO: 548517 - RNA, 64 nt, hsa
gggcugcauuuugccaccauaaagggcugcauuuuuuuaaaaagccuaggcagcucuaacauca

SEQ ID NO: 548518 - RNA, 64 nt, hsa
ccaccacagguaugcaccaccauaccuggcugauuuuuaaaauuuuuucuagagaugaggucuc

SEQ ID NO: 548519 - RNA, 64 nt, hsa
aguuugauagaaaugaauuucuuguaacauucuuuuuuaaaaguggaagucauuaacagugauu

SEQ ID NO: 548520 - RNA, 64 nt, hsa
aaauugccaaaaauuucuaccacuuuuuacuagauuuuaaaaagcuacuuucuuuuauauugcc

SEQ ID NO: 548521 - RNA, 64 nt, hsa
guaauguuuuugcacuggugacagacaaaaucuguuuuaaaaucauauccagcacaaaaacuau

SEQ ID NO: 548522 - RNA, 64 nt, hsa
gucuuagcuguaaaaaugagaaaguguugguugguuuuaaaaucugguaacuccaugaugaaaa

SEQ ID NO: 548523 - RNA, 64 nt, hsa
cuggaaaagcuucauuucugaagaugaauuuuauuuuuaaaaaauacaugcacacucaaaacuu

SEQ ID NO: 548524 - RNA, 64 nt, hsa
gguuaacaugaaauguuaccuuuuaacagacuguuuuuaaaaauuaaaaauguauguauagguu

SEQ ID NO: 548525 - RNA, 64 nt, hsa
aaaauuaaaaauguauguauagguuuugaaauuuuuuuaaaaggggagaaagacuguuaagagg

SEQ ID NO: 548526 - RNA, 64 nt, hsa
cgugagccaccaugccuggccuucauuaucucuuuuuuaaaaaugaaaaaguuuauaauuuaca

SEQ ID NO: 548527 - RNA, 64 nt, hsa
gguguuuucugucccucuuguucauugacauuuauuuuaaaauaaaauauuuuaaaaucuacuu

SEQ ID NO: 548528 - RNA, 64 nt, hsa
ucuuguucauugacauuuauuuuaaaauaaaauauuuuaaaaucuacuuuuugguguacaguuc

SEQ ID NO: 548529 - RNA, 64 nt, hsa
uuuguguaauuuauaguuugacaugauguguuuguuuuaaaaaaaaaugcauaguauaaaccca

SEQ ID NO: 548530 - RNA, 64 nt, hsa
ggguaguguguguguauuuucucuggcuuuaaaauuuuaaaacaaacaaacaaaaaagccauag

SEQ ID NO: 548531 - RNA, 64 nt, hsa
acuaauaauaguacuauuacuauuacuauuuuuauuuuaaaauaaaauuuaccuuuaaaauaau

SEQ ID NO: 548532 - RNA, 64 nt, hsa
ccuagauugcaaaaucuccaauccacacauauuguuuuaaaauaagaauguuauccaacuauua

SEQ ID NO: 548533 - RNA, 64 nt, hsa
aaugccaauauaauauaguuaaugaaaacagcauuuuuaaaaaccgaaauauugaaauggugua

SEQ ID NO: 548534 - RNA, 64 nt, hsa
guggggagaaagagcagccaucgcugagccugccuuuuaaaauauauguguauuuccuuagccc

SEQ ID NO: 548535 - RNA, 64 nt, hsa
gguagccugaauugcuuucugcucuuuacauuucuuuuaaaauaagcauuuagugcucaguccc

SEQ ID NO: 548536 - RNA, 64 nt, hsa
ggggcagauucugaauuggcuaaaagacaugcauuuuuaaaacuagcaacucuuauuucuuucc

SEQ ID NO: 548537 - RNA, 64 nt, hsa
uuuccgucuccccaaagcuuuaucugucuugacuuuuuaaaaaaguuugggggcagauucugaa

SEQ ID NO: 548538 - RNA, 64 nt, hsa
auccugaaaggcaacauaauucuuccuucccuccuuuuaaaauuuuguguuccuuuuugcagca

SEQ ID NO: 548539 - RNA, 64 nt, hsa
gaaaauaucagcuuuucuuauuccuuuuuauuccuuuuaaaaugguaugccaacuuaaguauuu

SEQ ID NO: 548540 - RNA, 64 nt, hsa
cugaagaauauccugagauuguaagaaaagcauuuuuuaaaagguaucacuugugaucauuuau

SEQ ID NO: 548541 - RNA, 64 nt, hsa
guacguauccaaacuucuuuuaauuguucacagauuuuaaaagcgguagcaccacaugguugug

SEQ ID NO: 548542 - RNA, 64 nt, hsa
gucuuccaaguauuauuuuuacuguuaaaaaauuuuuuaaaaaugugaaauguaauguuuuuac

SEQ ID NO: 548543 - RNA, 64 nt, hsa
aauggcuucuucuuaaagcccagagaaagagguuuuuuaaaagacugucgccaaauagcugagc

SEQ ID NO: 548544 - RNA, 64 nt, hsa
aagcaauuuucucccauugugcgaacauuuuauuuuuuaaaaaaaagaaacaaaaauauuuuuc

SEQ ID NO: 548545 - RNA, 64 nt, hsa
gaggaagaaagggaagaauuagguuugaauugcuuuuuaaaaaaaaaagaaaagaaaaagacag

SEQ ID NO: 548546 - RNA, 64 nt, hsa
uuguugucguuguuguaguuaaaggaauuucauuuuuuaaaagaaaucuucgaaggugugguuu

SEQ ID NO: 548547 - RNA, 64 nt, hsa
uauuaaaaacaaaaaagaaaaaaaaggaaaauguuuuuaaaaaggucauauauuuuuugcuacu

SEQ ID NO: 548548 - RNA, 64 nt, hsa
aaguguauaaaucugaguauauauuuacaugucuuuuuaaaagggucguuaccagagauuuacc

SEQ ID NO: 548549 - RNA, 64 nt, hsa
agcaugggaggugaggauuccaaaaacauuuuauuuuuaaaauauccuguguaacacuuggcuc

SEQ ID NO: 548550 - RNA, 64 nt, hsa
agaacaaugacaaacacccacuuauuuuucaagguuuuaaaacagucuacauugagcauuugaa

SEQ ID NO: 548551 - RNA, 64 nt, hsa
aggauucuaaucucauguuuuuuccuuuucacauuuuuaaaagaacaaugacaaacacccacuu

SEQ ID NO: 548552 - RNA, 64 nt, hsa
cuugaaucaaguguaauauaauuuuuuucuucuuuuuuaaaauauucccacucagcacucagag

SEQ ID NO: 548553 - RNA, 64 nt, hsa
uuauuaauaaagugaggcaggaaaaugcuucuccuuuuaaaauccccuccacuccucacacaca

SEQ ID NO: 548554 - RNA, 64 nt, hsa
uggacagaauuuguguaaaagugaauuaucuuuauuuuaaaauguauguuuccccucacuguuu

SEQ ID NO: 548555 - RNA, 64 nt, hsa
uguaauuucagguuuuuuacauuuuaacaaaauauuuuaaaaguuauaaacuaaccucagaccu

SEQ ID NO: 548556 - RNA, 64 nt, hsa
uugauuacuuauauaaaaacaguucagaauauuuuuuuaaaaaaaauucuauauauacuguaaa

SEQ ID NO: 548557 - RNA, 64 nt, hsa
aacaaccugaagacuugugaaaucaauguuucuuuuuuaaaaaacaauuuucaaguuuuuuuua

SEQ ID NO: 548558 - RNA, 64 nt, hsa
gaacauuccuggcgcaugcuccauugucuuacuauuuuaaaacauuuuaauaauuuuugaaaau

SEQ ID NO: 548559 - RNA, 64 nt, hsa
uuuuuuugauuaccuguagugcuuuaaaguauauuuuuaaaagggaggaaaaaaauaacaagaa

SEQ ID NO: 548560 - RNA, 64 nt, hsa
uagugagcaauacacauauuauaggccaauauuuuuuuaaaaaauagagcuuggucaaccucua

SEQ ID NO: 548561 - RNA, 64 nt, hsa
agugauauauuguguuaauuuggacaguagcgguuuuuaaaaaccauauacugacugaaacaug

SEQ ID NO: 548562 - RNA, 64 nt, hsa
cuuucauuuuaaaauccuauuaccaaguucaguuuuuuaaaacuucaauuguccuggcugauua

SEQ ID NO: 548563 - RNA, 64 nt, hsa
ccuuuauaguuaucgaucacuguuaaaacuuucauuuuaaaauccuauuaccaaguucaguuuu

SEQ ID NO: 548564 - RNA, 64 nt, hsa
cacuucagaguaagagggaauucagcuaauuuguuuuuaaaauugacuguaguggucacuaaac

SEQ ID NO: 548565 - RNA, 64 nt, hsa
cucucauuccccauacucccuauuuucauuccuuuuuuaaaaaauaauauaagcuacagaaacc

SEQ ID NO: 548566 - RNA, 64 nt, hsa
gauuaagauuuuaucugggggaaagaaaagaauuuuuuaaaaaauuaaacuaaagauguuuuaa

SEQ ID NO: 548567 - RNA, 64 nt, hsa
cacagcaucuuagaaaaguuuaaccugcaaacacuuuuaaaacauaaugccuacuugauuuaua

SEQ ID NO: 548568 - RNA, 64 nt, hsa
uuuauagguagugguuauuaguauuacauccccauuuuaaaaacaaaaacauaauaaucguuac

SEQ ID NO: 548569 - RNA, 64 nt, hsa
ugauuuuuacauacuaaugaauauaaacaggugauuuuaaaauauuacugugcuucuuugguug

SEQ ID NO: 548570 - RNA, 64 nt, hsa
gucugcuucccucauuauugcauugcuaaggccuuuuuaaaaagcuuaugcuuacauaauauac

SEQ ID NO: 548571 - RNA, 64 nt, hsa
acauauuacuuguuucugguaaucaagucuuauuuuuuaaaagccuauuguuuuucagaauuga

SEQ ID NO: 548572 - RNA, 64 nt, hsa
gagagaaggauuguuuucaguuuuuaagagaauuuuuuaaaaauacauuuuaugguucucuuaa

SEQ ID NO: 548573 - RNA, 64 nt, hsa
cacuguuuauauacugcuaguuaacaauuaccacuuuuaaaaaauuauaaccguuuuuguucua

SEQ ID NO: 548574 - RNA, 64 nt, hsa
guaaaaccauucaaucaauaauugguaaauaauauuuuaaaauuguuuuuaaucuguauagaug

SEQ ID NO: 548575 - RNA, 64 nt, hsa
accaugugaguuaaugauacuacaacuaaguucuuuuuaaaaagugauuaauguauuuuauaaa

SEQ ID NO: 548576 - RNA, 64 nt, hsa
uuaauguuuuaacaaaagaguguggacauuuuuauuuuaaaauuuaggcaaaagucacuaucaa

SEQ ID NO: 548577 - RNA, 64 nt, hsa
cccauuuauaaauauauguaugauuuauaagcuuuuuuaaaacaaagcucaaauuguugguauu

SEQ ID NO: 548578 - RNA, 64 nt, hsa
aacccuauagcuccuuacgcugggaaagcugguuuuuuaaaaaaauaauaauaaaauauuuaau

SEQ ID NO: 548579 - RNA, 64 nt, hsa
aggugaauuauuuaugcacuuaggaagugcuaaauuuuaaaagcugaaacacaacagaauucua

SEQ ID NO: 548580 - RNA, 64 nt, hsa
ccauguuggagagcaaaacuuaauaauaauucuuuuuuaaaaucugcugaagcagccccauccg

SEQ ID NO: 548581 - RNA, 64 nt, hsa
uuacuucaguauaaauuaucuuaugaaaaccaaauuuuaaaagccacagguguugauuguuaua

SEQ ID NO: 548582 - RNA, 64 nt, hsa
guuaacugccaagcuuggagugaccuaaagcauuuuuuaaaagcauggcuagauuuacuucagu

SEQ ID NO: 548583 - RNA, 64 nt, hsa
uaaucauauagcuaaagugauaagauagccuugauuuuaaaagcugauucauuaauaucaaaau

SEQ ID NO: 548584 - RNA, 64 nt, hsa
acuauucaaaaauuuagaagaguggcaaauacuauuuuaaaagaagaaccaagaacuguaaaac

SEQ ID NO: 548585 - RNA, 64 nt, hsa
cagcugcaagggaguuagggaaaugaaggucuuuuuuuaaaagcuucucagccuuccuagggaa

SEQ ID NO: 548586 - RNA, 57 nt, hsa
auuuaaaaaggagaagauaacugaggauuuuaaaaagaagccauggaaaaacuuccu

SEQ ID NO: 548587 - RNA, 64 nt, hsa
uaaaauuguuuaaucaauggaauuuguaccagccuuuuaaaaaguuuuaguuuuuccuaaguga

SEQ ID NO: 548588 - RNA, 64 nt, hsa
uugguucagauuguaauuaucaguuaggcaauguuuuuaaaacuuaguaaugagaaacugugaa

SEQ ID NO: 548589 - RNA, 64 nt, hsa
cuuaguucuuaaagaaucaagaaguuguguaaucuuuuaaaaauauuaucuugcagauaaagaa

SEQ ID NO: 548590 - RNA, 64 nt, hsa
accagcaauugacuuaggcuguguuucuuuaugguuuuaaaacucuugagcuguuauaagagau

SEQ ID NO: 548591 - RNA, 61 nt, hsa
ccuuggaugcagauuuuuaaaaaaccucuuguuuuaaaacucuauaaacuugucauuggua

SEQ ID NO: 548592 - RNA, 64 nt, hsa
auaguuucuuuuuuuaaaaaaaugguuacauuaguuuuaaaauagcucugugauuuuacuuuuu

SEQ ID NO: 548593 - RNA, 64 nt, hsa
uuaaaaaucauuuucuuguuuaaauaguuucuuuuuuuaaaaaaaugguuacauuaguuuuaaa

SEQ ID NO: 548594 - RNA, 64 nt, hsa
caucuuugcuuguacuagauuucuuacuuagaauuuuuaaaaaucauuuucuuguuuaaauagu

SEQ ID NO: 548595 - RNA, 64 nt, hsa
cuccuucaguccauucccuuaggcaauuuuuaauuuuuaaaaauuauuaucaggggagaaaaau

SEQ ID NO: 548596 - RNA, 64 nt, hsa
acuugcauguguauacauacauguaacuucauuauuuuaaaaauauuuuuagaacuccaauacu

SEQ ID NO: 548597 - RNA, 64 nt, hsa
aaauacagcuccaaaaauauuaaauguauauauauuuuaaaaugccugaggaaauacauuuuuc

SEQ ID NO: 548598 - RNA, 64 nt, hsa
gcuaaaauugugugccauuuaaaaacugaaaauauuuuaaaauuauuugucuauauucuaaauu

SEQ ID NO: 548599 - RNA, 64 nt, hsa
cgguuuagauucauuuuguccacacauguacccauuuuaaaaaacaauguccucgaugcuucug

SEQ ID NO: 548600 - RNA, 64 nt, hsa
aaugagaaagaauggaagaugguaaacaaucacuuuuuaaaaccuguuaagucaaaaccaucuu

SEQ ID NO: 548601 - RNA, 64 nt, hsa
gauagaaagaauaaaauguuucucucucucuaccuuuuaaaauugaauaguuuauuucugugaa

SEQ ID NO: 548602 - RNA, 64 nt, hsa
uuacuuuucugccaaaauaaaccuguucuuccuuuuuuaaaauaaaauaaguucuuaaaaaauu

SEQ ID NO: 548603 - RNA, 64 nt, hsa
acaugaugcuuggaaauuaagagacuaaagcuuuuuuuaaaaaaagguggaaaauaggaacugu

SEQ ID NO: 548604 - RNA, 64 nt, hsa
aacuuauuguggcuugaucuucuuaggacaucuuuuuuaaaaagcuguuuaguaucauuuugug

SEQ ID NO: 548605 - RNA, 64 nt, hsa
cuaaaugagucaucuaauuagauguuacuuuuaguuuuaaaaugaaaucuuaggugccuuaggg

SEQ ID NO: 548606 - RNA, 64 nt, hsa
ggugccuuagggguuuuuuuuuuuuuuaaguauuuuuuaaaaaccugcaaagauauaaauuuag

SEQ ID NO: 548607 - RNA, 64 nt, hsa
aaugcuuucucaugcauagacaaguguuuuggguuuuuaaaaaaaauauucugucauugguuac

SEQ ID NO: 548608 - RNA, 64 nt, hsa
acaucauaaauaguaaauaaugauucaaugugaauuuuaaaaugcaaauauugcuauuguuuau

SEQ ID NO: 548609 - RNA, 64 nt, hsa
ccaaauuuuucuaagacuacuaugaacaguuuucuuuuaaaauuuugagauuaagaaugccagg

SEQ ID NO: 548610 - RNA, 64 nt, hsa
uuuaagcuuaagccauaaaauagauuagauuguuuuuuaaaaauggauagcucauuaagaagug

SEQ ID NO: 548611 - RNA, 64 nt, hsa
caccuugaaagcuucaccuggccuacaacuuuuauuuuaaaaagaugaucaagaaaacuucauc

SEQ ID NO: 548612 - RNA, 64 nt, hsa
auucaagaaagauaaaccccugucucaaggaacauuuuaaaaagaacgucuguccccugugaug

SEQ ID NO: 548613 - RNA, 64 nt, hsa
uuauuuguuucaaauugcaguuuuuauaaaacauuuuuaaaacacaaauggcauguaugcuaau

SEQ ID NO: 548614 - RNA, 64 nt, hsa
cauaguuuugaacuaauguaacaugauuuuucuuuuuuaaaacagccugaaaauguacuagugu

SEQ ID NO: 548615 - RNA, 64 nt, hsa
ucaucuuauguuauuagcaagguuaagacaucuuuuuuaaaaaaauuauagcuucuaccaagag

SEQ ID NO: 548616 - RNA, 64 nt, hsa
gacuuuaaacaagaauuaaaaucaugugcuguauuuuuaaaaucuagccaaauuaaauaguaca

SEQ ID NO: 548617 - RNA, 64 nt, hsa
uauuucugaacuuggcaaaauuggaaauuaaaauuuuuaaaaauuacaaauauacaaaguuauu

SEQ ID NO: 548618 - RNA, 64 nt, hsa
cacagacgccauagcuggauuggaaacauugauguuuuaaaaauuuauuuuuuuuggaaauagu

SEQ ID NO: 548619 - RNA, 64 nt, hsa
ccaacagcuagaaggauugcaagguagauuuuuguuuuaaaauggagagaaguggacagauaag

SEQ ID NO: 548620 - RNA, 64 nt, hsa
aaugucccgauuguuaaaaaguuggcucaauuauuuuuaaaacauuuuguaagccaacaaaagu

SEQ ID NO: 548621 - RNA, 64 nt, hsa
uaucccagcaggaaaaaaaaggauaauauaacuguuuuaaaacucuuucuggggaauccaauua

SEQ ID NO: 548622 - RNA, 64 nt, hsa
guuaaggagacaauuuuggagagcaagcaaaucuuuuuaaaaaauaguaugaaugugaauacua

SEQ ID NO: 548623 - RNA, 64 nt, hsa
guuaccugagacgacugaugugucacaagcuguuuuuuaaaaucaucuuccaauucuauacuuc

SEQ ID NO: 548624 - RNA, 64 nt, hsa
uuuuuuggucagcuuuaauauauuuaugccagaauuuuaaaaccaacaaaauuuucuuguucaa

SEQ ID NO: 548625 - RNA, 64 nt, hsa
cuguuuaugcgauaacuccuuuuuguuacaauuuuuuuaaaaaaagcuauuuuuguuaauguaa

SEQ ID NO: 548626 - RNA, 64 nt, hsa
agcuaggcuaaaauuugcuaaaugccuugguuucuuuuaaaaguucauguaauauuucugauuu

SEQ ID NO: 548627 - RNA, 64 nt, hsa
ugauuuuucagaauauuugcaauaagagucuggauuuuaaaaaacacaugcauacacacaauua

SEQ ID NO: 548628 - RNA, 64 nt, hsa
cccacccuuugaagaguucaaguucuguacagguuuuuaaaacgugaaguaauguuugaacugg

SEQ ID NO: 548629 - RNA, 64 nt, hsa
aaauauuaauagaauuuuuuaaauauacucuaauuuuuaaaacauacucuuuauuaucuucauu

SEQ ID NO: 548630 - RNA, 64 nt, hsa
gaucugucauugcaaaguaacaaaaauuuuaagcuuuuaaaaauguagauuuuucauauuuuua

SEQ ID NO: 548631 - RNA, 64 nt, hsa
auuuuaagcuuuuaaaaauguagauuuuucauauuuuuaaaauuugaaucuauuugagcuuuag

SEQ ID NO: 548632 - RNA, 64 nt, hsa
ugagucuuaaucugaagucuuuuucaugcccuuguuuuaaaaaaacuacuuuuuuuggccucaa

SEQ ID NO: 548633 - RNA, 64 nt, hsa
gaaccuuuucuuaaaaugaaaauaauuacugcuauuuuaaaauuucuugaucauugaaugugag

SEQ ID NO: 548634 - RNA, 64 nt, hsa
uacuguuuacuucauuguuauauugcaguaaaaguuuuaaaacaaccauugcauguuugcuuuu

SEQ ID NO: 548635 - RNA, 64 nt, hsa
uguuuaucagcaagucgugagucaaacugcugccuuuuaaaaaacccacaaaaugcugauucag

SEQ ID NO: 548636 - RNA, 64 nt, hsa
aaaaaaauaaacagccuucuuuuuuuuuccuuuguuuuaaaacugugguuuuuuaaaaaagcaa

SEQ ID NO: 548637 - RNA, 64 nt, hsa
uucuuuuuuuuuccuuuguuuuaaaacugugguuuuuuaaaaaagcaauaauuaacucagaccu

SEQ ID NO: 548638 - RNA, 64 nt, hsa
aaaucuucuugucauguaaaaugaagcuagucuguuuuaaaauuuuuaguuuuggauuguauac

SEQ ID NO: 548639 - RNA, 64 nt, hsa
uugagaggcugggaggguugaggggaagauaaacuuuuaaaaagcucuuaucuuucauuucaau

SEQ ID NO: 548640 - RNA, 64 nt, hsa
accuccauucuuggauucccuuucuuuccuuuuauuuuaaaaaagaacaguaccccucuuuuaa

SEQ ID NO: 548641 - RNA, 64 nt, hsa
gaaugcacagaccaagaauucagugaaugucauuuuuuaaaaaacuaauuuguauugucugcuc

SEQ ID NO: 548642 - RNA, 64 nt, hsa
uuucccuucauaaaauguaauguacauuguaaucuuuuaaaagaaaaaucaggguugcacuugc

SEQ ID NO: 548643 - RNA, 64 nt, hsa
cuuuuaaaagaaaaaucaggguugcacuugcaacuuuuaaaaaaccgaguguggaaacauuggg

SEQ ID NO: 548644 - RNA, 64 nt, hsa
uuguuugaaacaaaagaaaauaaugcauuguguuuuuuaaaaagaguaucuuauacauguaucc

SEQ ID NO: 548645 - RNA, 64 nt, hsa
uugcuuggguauggaacgguagaaauuuggguguuuuuaaaaccuuguuugggguuguuccugu

SEQ ID NO: 548646 - RNA, 64 nt, hsa
guuauuuauauaaaaauaauuuaucaaaaggauauuuuaaaaaagcuagucugucuugaaacuu

SEQ ID NO: 548647 - RNA, 64 nt, hsa
auuugacagacauccuugcaguuuaagaugacacuuuuaaaauaaauucucuccuaaugaugac

SEQ ID NO: 548648 - RNA, 64 nt, hsa
auugugcccuugauuuuuaucuccaaguggcaguuuuuaaaauuggccuuuuaccuggauauaa

SEQ ID NO: 548649 - RNA, 64 nt, hsa
gcaguccagcuguucuuugcagcuggagaugaacuuuuaaaaauccccuucacacuuaauguac

SEQ ID NO: 548650 - RNA, 64 nt, hsa
gaucuuaaaugauggaaguauaggacguugcuuauuuuaaaacaagggaaggacacaaaaugga

SEQ ID NO: 548651 - RNA, 64 nt, hsa
uuuuccauuagaauacugcaaaacccauauaucuuuuuaaaaaauuuauguacucacagucuuu

SEQ ID NO: 548652 - RNA, 64 nt, hsa
cuuuucuagugcaguuauauuagaaugcauauguuuuuaaaaugcuaguauaacuagauaguau

SEQ ID NO: 548653 - RNA, 64 nt, hsa
aaaauaaccuuuccuuuuaaaugugcugcaacguuuuuaaaaaugcagcagcauaggagugaac

SEQ ID NO: 548654 - RNA, 64 nt, hsa
cacaggccaauuuguuggccaccagaaaaccgcuuuuuaaaaaaacacuuggugauucuuucaa

SEQ ID NO: 548655 - RNA, 64 nt, hsa
ccuuaaacuauugccauacuucaguaagugucuuuuuuaaaaaaaauucacuuguauaaaaaug

SEQ ID NO: 548656 - RNA, 64 nt, hsa
aggugcuggcaugcuuuacagcacagaucugauuuuuuaaaauguccuguacuaguacauaaau

SEQ ID NO: 548657 - RNA, 64 nt, hsa
agcucuauucauuuauguuagcauuaaugcacauuuuuaaaaaaagaaaaaaacauggucuugu

SEQ ID NO: 548658 - RNA, 64 nt, hsa
uucuaguaaauauaaacgguuuguuugaaaacuauuuuaaaaugucaacaauauggagaauaac

SEQ ID NO: 548659 - RNA, 64 nt, hsa
caaaaucaugaaugauacacaugaagauaacuuuuuuuaaaaaaaagcagaaauacacaaugau

SEQ ID NO: 548660 - RNA, 64 nt, hsa
guguauguucaaauuguuuauguauauaauaaaguuuuaaaaauuuguauguacuugacaauuc

SEQ ID NO: 548661 - RNA, 64 nt, hsa
ccaaagugggcaucacaauuaucuauaaaucuuguuuuaaaaauacauauuuccaccucucucu

SEQ ID NO: 548662 - RNA, 64 nt, hsa
cucaagccuuuuuauucuuugugauuaaauccuguuuuaaaaugucacaaaacaggaaccagca

SEQ ID NO: 548663 - RNA, 64 nt, hsa
caagcacuuagauggauauaaaugcagcaacuuguuuuaaaaaaaugcacaauuuacuucccaa

SEQ ID NO: 548664 - RNA, 64 nt, hsa
ggucaauauucugauuuuccucucccugcauuguuuuuaaaaagcacauuguagccuaagauca

SEQ ID NO: 548665 - RNA, 64 nt, hsa
gaauguuuugguucaagaaagaauguuuaaagcuuuuuaaaagacuucaguucuuaauguaacu

SEQ ID NO: 548666 - RNA, 64 nt, hsa
uauaaucuuuggcuaguguuaugugccuguauuuuuuuaaaaugguacaccagaaaaggacugg

SEQ ID NO: 548667 - RNA, 64 nt, hsa
auuuuugguggucauuuuuuuuuuaagacagucauuuuaaaaugguggcugaauuucccaaccc

SEQ ID NO: 548668 - RNA, 64 nt, hsa
auguaaugcucuuuuguaagaaacguuuuaugauuuuuaaaauaaauuuagugaaccuauuuuu

SEQ ID NO: 548669 - RNA, 64 nt, hsa
cauuuagcuugugguaaaugacucacaaaacugauuuuaaaaucaaguuaaugugaauuuugaa

SEQ ID NO: 548670 - RNA, 64 nt, hsa
aagucuaaauacaaagcuguucugugugagaauuuuuuaaaaggcuacuuguauaauaacccuu

SEQ ID NO: 548671 - RNA, 64 nt, hsa
acugccuuaaacguuguauuuuuauagacauguuuuuuaaaaauccuaaguuuuuaaauaacua

SEQ ID NO: 548672 - RNA, 64 nt, hsa
uuuuuauaaauuguaugcuucagaaauaauuuauuuuuaaaaagaaauuaaaaguuuuaaacuc

SEQ ID NO: 548673 - RNA, 64 nt, hsa
ugcuuggaugaaaggacagcguggauaaaaagguuuuuaaaacauggauguuaaggcuguuuug

SEQ ID NO: 548674 - RNA, 64 nt, hsa
uuaauauuuauaauggauauuuaaugauuguuauuuuuaaaaaccagcuuauaauuccucguua

SEQ ID NO: 548675 - RNA, 64 nt, hsa
uguaguauguaauauauguaacaucuuccaauucuuuuaaaauaaaauuaauauuuauaaugga

SEQ ID NO: 548676 - RNA, 64 nt, hsa
uacacccugcaaugugcacauuaaaauauggaaauuuuaaaauuaugaccaagggcuugaaaca

SEQ ID NO: 548677 - RNA, 64 nt, hsa
gacaacagacuuucugaccugagaacuggagaauuuuuaaaacaaaaucucucauuccagccca

SEQ ID NO: 548678 - RNA, 64 nt, hsa
uauaguuauacaucuucauuaauacuguguuaccuuuuaaaauaguaauuuuuuacauuuuccu

SEQ ID NO: 548679 - RNA, 64 nt, hsa
uccuuacuucgguuccucugauuucaaggccauauuuuaaaaaaucaaaaggcacugugaacua

SEQ ID NO: 548680 - RNA, 64 nt, hsa
gauuauuaggauauauucccaugaaggauucuuuuuuuaaaaaaaugugaaaugucaucuugua

SEQ ID NO: 548681 - RNA, 64 nt, hsa
ucuggaguguccauuuagacuacacuaacuagacuuuuaaaagauuuugugugguuuggugcaa

SEQ ID NO: 548682 - RNA, 64 nt, hsa
aaauauucaggucuaucauaugguuugacagauuuuuuaaaaguuauuuuugguaaggucuucu

SEQ ID NO: 548683 - RNA, 64 nt, hsa
cagccuuauacaacauuucuaaacucauuuguacuuuuaaaaaauuuaaacacagacuucuaaa

SEQ ID NO: 548684 - RNA, 64 nt, hsa
acaaaaauaacucugaguuugauauucaaguauauuuuaaaaaucaagggauuuuuuuuuuuug

SEQ ID NO: 548685 - RNA, 64 nt, hsa
ggaacuuuuuugcccaugugucuuuuaagugugauuuuaaaaaaaugagugguucaguucauuc

SEQ ID NO: 548686 - RNA, 64 nt, hsa
guggauucauuuuuauuuuugucuuuguuuaacuuuuuaaaaaauaagauuucuggaguagauu

SEQ ID NO: 548687 - RNA, 64 nt, hsa
gcaacuuaaacucaaguugcacuuacauuuugaauuuuaaaaugaugguuuuaucuguugugug

SEQ ID NO: 548688 - RNA, 64 nt, hsa
uaaaagacuuuuaaauucacuacuagaguggucauuuuaaaaauacauccauguuuuaacuuau

SEQ ID NO: 548689 - RNA, 64 nt, hsa
gaccuuuuuuuauauuauuaaauauucuacaacuuuuuaaaaaugucuauuaauauuccaucgu

SEQ ID NO: 548690 - RNA, 64 nt, hsa
uuaacaagguaacuuuuuguuuaaccuagauuuuuuuuaaaacuuuuuuuuuuuuucauauugg

SEQ ID NO: 548691 - RNA, 64 nt, hsa
uacuguauuuaauuucuauugaagcccuucuguauuuuaaaauguaauauacuuuguaccauuu

SEQ ID NO: 548692 - RNA, 64 nt, hsa
aauucuaccuuuaccagggauaucuguucuacuguuuuaaaaguuccucucuauuuuauuuuuu

SEQ ID NO: 548693 - RNA, 64 nt, hsa
uuggauuccaaacuaaacaccaagauacuuuucauuuuaaaauguauaaaguaacaauucagau

SEQ ID NO: 548694 - RNA, 64 nt, hsa
gcucugccuccugugcuuauaucauccaaaaacuuuuuaaaaagguccagaauucuauuuuaac

SEQ ID NO: 548695 - RNA, 64 nt, hsa
gugcuagaauacuguuguguuguaagaugacuaauuuuaaaagaaccugcccugaaaaguucuu

SEQ ID NO: 548696 - RNA, 64 nt, hsa
uauuuugugguuuuuuaauauaguauaaaaauccuuuuaaaaaaacaacaaucugugugccucu

SEQ ID NO: 548697 - RNA, 64 nt, hsa
ggcaaaauuugcaauaguguucuauuguauguaauuuuaaaauuuauaagauuauccacguugg

SEQ ID NO: 548698 - RNA, 64 nt, hsa
cuugguuuggagacauaaggaauauucugacccuuuuuaaaaaaggauuuucucauguuuuuau

SEQ ID NO: 548699 - RNA, 64 nt, hsa
guuuucacucaaauauuuugccucauuauucuuguuuuaaaagaaagaaaacaggccgggcaca

SEQ ID NO: 548700 - RNA, 64 nt, hsa
gaaguggccacaguaugugcuguuuuugaagcauuuuuaaaaacgaauuguaguuguuuuucuu

SEQ ID NO: 548701 - RNA, 64 nt, hsa
uauccagcccugauauuuuguguaaauaaaauguuuuuaaaaccuguuaguuaaaacacuuagg

SEQ ID NO: 548702 - RNA, 64 nt, hsa
augcaaauguccuucaccaguaaagcaagcaaauuuuuaaaaucucuguuuuugaaaucuacuc

SEQ ID NO: 548703 - RNA, 64 nt, hsa
cuguugucauauaggcuauaugcgaaauuguuaauuuuaaaauaaccucaggccacagacuugu

SEQ ID NO: 548704 - RNA, 64 nt, hsa
ugagaccugguaacccacgcucuugcauuguggauuuuaaaauguauacucuguacgguucugu

SEQ ID NO: 548705 - RNA, 64 nt, hsa
aucgggaccggcagaaauggaaguauccauacauuuuuaaaaagcaacaaguuugcacagcuag

SEQ ID NO: 548706 - RNA, 64 nt, hsa
caguuccuggaggggcucuuauuauuuucucucuuuuuaaaaaacuuccaguagaaguaaagug

SEQ ID NO: 548707 - RNA, 64 nt, hsa
cauucaauuuuaugauuuacauuuaucauguaauuuuuaaaaaaauccaucuaucuaggauaug

SEQ ID NO: 548708 - RNA, 64 nt, hsa
augaauaguguguuuauuguaacuccucauacacuuuuaaaaccaacaucuuuuuucauaaaug

SEQ ID NO: 548709 - RNA, 64 nt, hsa
guacguaguuaagucguagcuauaacuucaaauuuuuuaaaagagacaaacuguaaaaaaugug

SEQ ID NO: 548710 - RNA, 64 nt, hsa
cccuauuuugccauuuagcgaacaaccacaggaauuuuaaaaacaaaaacaucccaagauuuuu

SEQ ID NO: 548711 - RNA, 64 nt, hsa
auacugaaacaugucuuucauaggugauacaacuuuuuaaaauguauguguagauauaacuuaa

SEQ ID NO: 548712 - RNA, 64 nt, hsa
gagauguuuauuagggcaaucaaaagauuuauuauuuuaaaaaaaucaguguggacuuccauuc

SEQ ID NO: 548713 - RNA, 64 nt, hsa
ggucaauuccuaguaugcauaaauuuuuuaacccuuuuaaaagagaccuauguugaaaaccccu

SEQ ID NO: 548714 - RNA, 64 nt, hsa
uuacaaguuuuaaguugugguaguuuagugauuuuuuuaaaagaugugugaaauguucucugca

SEQ ID NO: 548715 - RNA, 64 nt, hsa
acaagacugaauguuaccuuuucuuucugacagauuuuaaaaauugauaugauaaaagcacaac

SEQ ID NO: 548716 - RNA, 64 nt, hsa
ggaaaaaaagcaauucacaaaaccauuucauauuuuuuaaaauauugugcuuaaagaugguccu

SEQ ID NO: 548717 - RNA, 64 nt, hsa
gaaagcaguacagaggaaaacaggaaccugauuuuuuuaaaauaaauuuuaaauaaaauagaau

SEQ ID NO: 548718 - RNA, 64 nt, hsa
uguacuuguacaaacucaacacuaacuuuuuuuuuuuuaaaaaaaaaaagguacuaaguaucuu

SEQ ID NO: 548719 - RNA, 64 nt, hsa
acacuggcauuuuccaaaacuguggcagcuaacuuuuuaaaaucucaaaugacaugcaguguga

SEQ ID NO: 548720 - RNA, 64 nt, hsa
acaauauguggggagagcacucgguugucuuuacuuuuaaaaguaauacuuggugcuaagaauu

SEQ ID NO: 548721 - RNA, 64 nt, hsa
ugguuggaggcuguucauaaauuguaaauauauauuuuaaaagcacuuucuauuuuuaaaagua

SEQ ID NO: 548722 - RNA, 64 nt, hsa
aauuguaaauauauauuuuaaaagcacuuucuauuuuuaaaaguaacuugaaauaauauaguau

SEQ ID NO: 548723 - RNA, 64 nt, hsa
ugauauaaugaaauguucguucauguauauacauuuuuaaaagugcuuucuuugaaacacugga

SEQ ID NO: 548724 - RNA, 64 nt, hsa
uccuucauguaagugccuauucagaguuucagaauuuuaaaaugccaaauauuuucauggucau

SEQ ID NO: 548725 - RNA, 64 nt, hsa
aggacgacccgagucccaagagugggguuuugcuuuuuaaaaggagagaggaggggugauggca

SEQ ID NO: 548726 - RNA, 64 nt, hsa
uuccauguguuuuccuccuguuguuuuagaacuuuuuuaaaaaaacagaccucguuuuagauuu

SEQ ID NO: 548727 - RNA, 64 nt, hsa
auuaaaacaacaaacgaaaccuagugaagcaucuuuuuaaaaggcugccagcuuaaugaauuua

SEQ ID NO: 548728 - RNA, 64 nt, hsa
cguuagccacugcgcccggcccgagaaaauacaguuuuaaaaagagaaagcuuuauaaccucac

SEQ ID NO: 548729 - RNA, 64 nt, hsa
uuugacaaagcucaccaacuuuaaaauauuaaguuuuuaaaaaaucaaauaugaaguauguuca

SEQ ID NO: 548730 - RNA, 64 nt, hsa
guauuuaucaguauuuuuuaaacauccuguccuuuuuuaaaaucuuugcuuagucagucauauu

SEQ ID NO: 548731 - RNA, 64 nt, hsa
uagcaccuuaaucacuguuuaguuuuguauucauuuuuaaaagcaauuauugaagccauuuuca

SEQ ID NO: 548732 - RNA, 64 nt, hsa
ucugaaggggaaauauaacaucuaugguuauauauuuuaaaaacuuagauuauaggcuguaauu

SEQ ID NO: 548733 - RNA, 64 nt, hsa
caaaacauuuuauggcuaguaauauuuauguaauuuuuaaaauguauuuuugguacugauggga

SEQ ID NO: 548734 - RNA, 64 nt, hsa
agaagacuuuggaguauauguuuuuaaaguaauuuuuuaaaauaugguaauguauuaaacuuau

SEQ ID NO: 548735 - RNA, 64 nt, hsa
uuuauaugccauucuuguuauagaagaauaugccuuuuaaaaaagcuuauuaauaacacuuucc

SEQ ID NO: 548736 - RNA, 64 nt, hsa
aaaaagcuuauuaauaacacuuucccaauuuauauuuuaaaaagcuaaagaacacuggauuaau

SEQ ID NO: 548737 - RNA, 64 nt, hsa
gggugggauggggugguuggagaaccagaacuauuuuuaaaacauuagguuucaauauaaauac

SEQ ID NO: 548738 - RNA, 64 nt, hsa
caccaauggaauuagaugagugcuaugcacuuaauuuuaaaauaaaacuaguuuucaguaaaau

SEQ ID NO: 548739 - RNA, 64 nt, hsa
uuuucuacuucaguauaguaccugaaaucgaacauuuuaaaaguugauuguauuucuguggaag

SEQ ID NO: 548740 - RNA, 64 nt, hsa
uaggauagauuccuaagggacaugcccaacagaguuuuaaaauggauguuuucaugaugacaac

SEQ ID NO: 548741 - RNA, 64 nt, hsa
uguuguuuuuucuuaaguuauauuuguuuuuacuuuuuaaaaaagaagaggaaacaaagccccc

SEQ ID NO: 548742 - RNA, 64 nt, hsa
cuugaagaauaucuaagcuuuuucugagaugggcuuuuaaaauuauaauaagggaaguuuauuu

SEQ ID NO: 548743 - RNA, 64 nt, hsa
gaauauauuuuuuucuuuaaauaggaacaaccucuuuuaaaagagaaaaauuauuucagugauu

SEQ ID NO: 548744 - RNA, 64 nt, hsa
uuaaucuuaaaagaggcauuaguucagaauacuuuuuuaaaaguuuaaauuaaauauuuaggca

SEQ ID NO: 548745 - RNA, 64 nt, hsa
cucaaaugcuggguugaaaaauguuuugaaagccuuuuaaaauauauaucuuuauaaaguaaua

SEQ ID NO: 548746 - RNA, 64 nt, hsa
aaucuauagcauuaguauacacuggcacauaauuuuuuaaaaaguuuuaagaaaagauucauuu

SEQ ID NO: 548747 - RNA, 64 nt, hsa
ccaaaagcaaugucuuucuugguugauauuugaguuuuaaaagggucaaaucuuucuaauuuuu

SEQ ID NO: 548748 - RNA, 64 nt, hsa
aauaguaaccugugaacuaugcuuuuccauaacuuuuuaaaaauauauauaucuaaaugaaugc

SEQ ID NO: 548749 - RNA, 64 nt, hsa
aagcacuuuguaccaaguuauuaaguaacauaauuuuuaaaauuuaaagaaugugucuucaacu

SEQ ID NO: 548750 - RNA, 64 nt, hsa
guuuacuaauagaggaguagagauuguugaccauuuuuaaaaaacgauagccacucuuuuucuu

SEQ ID NO: 548751 - RNA, 64 nt, hsa
augcugguauucuacuacuugugcaauauauauguuuuaaaaaacaaauuugagaauacauuua

SEQ ID NO: 548752 - RNA, 64 nt, hsa
caugguggcaaaauauuagcucuguuuugggacauuuuaaaauagaacuauccuuguucgauag

SEQ ID NO: 548753 - RNA, 64 nt, hsa
auucuuuuauaagucuauggaaauuauuuaauuauuuuaaaacguacacacuuuucuuguaaau

SEQ ID NO: 548754 - RNA, 64 nt, hsa
aaaagauacauuuuauggugguuucaguaggucauuuuaaaaaccaaugugcauuaguuuucaa

SEQ ID NO: 548755 - RNA, 64 nt, hsa
auuuuacaacacaaaaauaagccugugucaaagauuuuaaaaucauggaaaguuaaaaucuaga

SEQ ID NO: 548756 - RNA, 64 nt, hsa
cuccaaaguccugaaaauuuugguggacaaugauuuuuaaaaaacuaacuuuguauaaccuaau

SEQ ID NO: 548757 - RNA, 63 nt, hsa
aaguuaaucauugacaacgaaaaauaaaauguuauuuuaaaagacucacagugucugaccaau

SEQ ID NO: 548758 - RNA, 64 nt, hsa
accugcuauacaguuguuaaaucuuaaauaugcuuuuuaaaaauuggaauaauguauuaagguc

SEQ ID NO: 548759 - RNA, 64 nt, hsa
aacacacuagaguagcuggugacuauaaauaauauuuuaaaaugcugugucuacaccaucaaga

SEQ ID NO: 548760 - RNA, 64 nt, hsa
caugugcuauaugaaugaagaaugcauaccaguguuuuaaaagguauuuuuauguguuuuuaaa

SEQ ID NO: 548761 - RNA, 64 nt, hsa
aucauaacaucugauuaaacagaaaaagcaagauuuuuaaaacuaacuauauaaggaugguccc

SEQ ID NO: 548762 - RNA, 64 nt, hsa
caugaagcaaucaucgaagacucacugguaauauuuuuaaaaaguauacagaucaaagcaaaaa

SEQ ID NO: 548763 - RNA, 64 nt, hsa
uuuuauguuaauuaaagaaguuuuuuauuucuaauuuuaaaauaaugauucuaauucuagccca

SEQ ID NO: 548764 - RNA, 64 nt, hsa
uaugaaacugauaaauauauauguggaauauucuuuuuaaaaacaauuuuauaaacaaaucaag

SEQ ID NO: 548765 - RNA, 64 nt, hsa
gccugacagaagcacaaggaacaguuugauacacuuuuaaaagguucugaaaacaaagcuguau

SEQ ID NO: 548766 - RNA, 64 nt, hsa
guaucucgugcaugaagcugacagcuaaagaagauuuuaaaaauugaguuaaagaugacugugu

SEQ ID NO: 548767 - RNA, 64 nt, hsa
uuggaaaauuauauguauaaaaccaaagugcuauuuuuaaaagcaucauuuaaaaaaaaaugac

SEQ ID NO: 548768 - RNA, 64 nt, hsa
ugagcuuuauucuaauguaucccaaaccuaaucuuuuuaaaagauagaagauacuuuuaagaca

SEQ ID NO: 548769 - RNA, 64 nt, hsa
gcccuguccuaaaugugaagacagagguugaauuuuuuaaaaaauaucuuuaaaagacugauca

SEQ ID NO: 548770 - RNA, 64 nt, hsa
auaccgggaaugcagcuauuaauagauucccauauuuuaaaaggagggaaaggacaauuuaaua

SEQ ID NO: 548771 - RNA, 64 nt, hsa
uuuaauccauuaccuggcacuagcaacauuagaauuuuaaaauaaaauaauugggaaagaaggu

SEQ ID NO: 548772 - RNA, 64 nt, hsa
ggacuauuaugguuaacagaacugucuuaauauguuuuaaaaugugcccauauuuucagaacau

SEQ ID NO: 548773 - RNA, 64 nt, hsa
aaaggaaaccugcaaaugucuacauauaugaagcuuuuaaaaagcacaaguuaucaggcaacau

SEQ ID NO: 548774 - RNA, 64 nt, hsa
aucauguugcagaucugaugccgagauugcucuauuuuaaaaggaaaccugcaaaugucuacau

SEQ ID NO: 548775 - RNA, 64 nt, hsa
aguggggcagucauuauccagguaauccaagauauuuuaaaaucugucacguagaacuuggaug

SEQ ID NO: 548776 - RNA, 64 nt, hsa
ugaggaaaacaagcauucacaacuuguuuuugguuuuuaaaacccaguccacaaaauaaccaau

SEQ ID NO: 548777 - RNA, 64 nt, hsa
gauaguguauauuuuacuacuuuuugaauguuaauuuuaaaauagaagaugucccacuugccau

SEQ ID NO: 548778 - RNA, 64 nt, hsa
ucuuuuuuuuucagaggugggauggguggagauuuuuuaaaaaucccacgugugaaaguuuacu

SEQ ID NO: 548779 - RNA, 64 nt, hsa
uauuuuacaucuuuauuucuuggugaaacaaaaguuuuaaaaguaguuuuaacaacuuuacacu

SEQ ID NO: 548780 - RNA, 64 nt, hsa
uguaaaacaauaauggugaaggaaauaaaaaggcuuuuaaaauuuuguuuguuuuaaaucuuug

SEQ ID NO: 548781 - RNA, 64 nt, hsa
uuauagcuaaauugaaucagaagacugcuuaugguuuuaaaauugcaaugacuuaaauaaugag

SEQ ID NO: 548782 - RNA, 64 nt, hsa
gacuguuuauguugauguauggaaaagagcaugauuuuaaaaaaucaaucauaggaggaaaaga

SEQ ID NO: 548783 - RNA, 64 nt, hsa
ugccaagcagaaaacucauagucaauacaaguauuuuuaaaaaugucuaauauuuuaucaaauc

SEQ ID NO: 548784 - RNA, 64 nt, hsa
auggaaaaacauuuauucuuuuaaauaauaauuuuuuuaaaacccaagaggucaggggauuuua

SEQ ID NO: 548785 - RNA, 64 nt, hsa
gccuuaagaauugcaguggagcaaauuggucauuuuuuaaaaaaauauauuuuaaccuacaguc

SEQ ID NO: 548786 - RNA, 64 nt, hsa
auccacugcaaggcaccuagagagacugcuccuauuuuaaaagugaugcaagcaucaugauaag

SEQ ID NO: 548787 - RNA, 64 nt, hsa
uauaauguuuguauaugcaaaacugcuagcuugauuuuaaaaaaaaacaaaucuuuaaaaucug

SEQ ID NO: 548788 - RNA, 64 nt, hsa
caaacugucaggguauaaacacuauuuguuucuuuuuuaaaacaucgauaguuuugcuguaaau

SEQ ID NO: 548789 - RNA, 64 nt, hsa
uuaguuaacucugggaaagauguuaccuuuggguuuuuaaaagacaagucaucauuugaaaaua

SEQ ID NO: 548790 - RNA, 64 nt, hsa
guauuuuaauaucuugcaagggcaaagaaggcauuuuuaaaauucuaaaugcacaccuccuaag

SEQ ID NO: 548791 - RNA, 64 nt, hsa
uaaaggauauuauuguuugaauuuuuggguuauuuuuuaaaacuucauugcuguuuuugacagc

SEQ ID NO: 548792 - RNA, 64 nt, hsa
auaauaaugcuuuuuguaaacaagagcagaacaguuuuaaaaaucuaauuagaauuuccaaaua

SEQ ID NO: 548793 - RNA, 64 nt, hsa
aaguuggccaugguaaauaauuuucagaauucuuuuuuaaaauuuuaauuagauuuccuuuucc

SEQ ID NO: 548794 - RNA, 64 nt, hsa
gauuugaauuguuauccuuuauauuaagaaaauguuuuaaaauguaagaauuccauuuauucug

SEQ ID NO: 548795 - RNA, 64 nt, hsa
guuauuaugagguacuaugagugacuuacauguguuuuaaaaugucaguguguuucccagaggc

SEQ ID NO: 548796 - RNA, 64 nt, hsa
caugcuguucaaaguuuuuaauuguuaucaugguuuuuaaaagacugacaguguuuauuauuau

SEQ ID NO: 548797 - RNA, 64 nt, hsa
gcugaaauuguaucucucaguaauuuuagaugucuuuuaaaaaauugaaaaacaaaguguuaga

SEQ ID NO: 548798 - RNA, 64 nt, hsa
uccuuguagcuguuuucuuuccuuuuguuguugguuuuaaaauacauucacacacaaauacaaa

SEQ ID NO: 548799 - RNA, 64 nt, hsa
uacaaguccuuucagugaugagggaauugauuuuuuuuaaaagucuuuuucuuagaaagccaaa

SEQ ID NO: 548800 - RNA, 64 nt, hsa
aaugcucaccacuuagccuguuuuuuuaucccuuuuuuaaaaugacagaugauuuuguucagga

SEQ ID NO: 548801 - RNA, 64 nt, hsa
uucaucuguggacaauugcuuacuuuguggguucuuuuaaaaguaacacgaaaucaucauauug

SEQ ID NO: 548802 - RNA, 64 nt, hsa
auuuacaaacaacaaacuugaucuuuaaaaauguuuuuaaaacucucugagucucagugacuuc

SEQ ID NO: 548803 - RNA, 64 nt, hsa
ugcauuuguggcuagaaauuuuaaucuaaacuuuuuuuaaaaaaaaucauaauaguuaggauag

SEQ ID NO: 548804 - RNA, 64 nt, hsa
aauuguaauuaagggaaaugaauuauuaaaacaauuuuaaaauggccaaugauguauacaugua

SEQ ID NO: 548805 - RNA, 64 nt, hsa
augauacccguaaaauuaaauuaguuauauuuuauuuuaaaaugcaaaauacauugauauuuau

SEQ ID NO: 548806 - RNA, 64 nt, hsa
ugcccugaguauuaaagcuagcuuagcaaaauacuuuuaaaaacauauugguaaaugauacccg

SEQ ID NO: 548807 - RNA, 64 nt, hsa
cccuucauaggacaaaguaauauauguguuggaauuuuaaaauuguguugucauugguaaaucu

SEQ ID NO: 548808 - RNA, 64 nt, hsa
cugauguguaaaaaggucauuauauccauucuguuuuuaaaauuuaaaauauauugacuuuuug

SEQ ID NO: 548809 - RNA, 64 nt, hsa
auauuaaaagagaggguccuucaaaaaaauuauuuuuuaaaacacagagguguucugaccugca

SEQ ID NO: 548810 - RNA, 64 nt, hsa
cccucuuucauguauuaaaauaacacugagauuuuuuuaaaagcuggaagauuguacagcauaa

SEQ ID NO: 548811 - RNA, 64 nt, hsa
uuaagaaucuauauaagcuauaaaaauacucauuuuuuaaaaaaaguuuuuuucauucaaagaa

SEQ ID NO: 548812 - RNA, 64 nt, hsa
ucugaagaguaauaccaaaugccuaaaauuuuauuuuuaaaaaggaaaauuguuuaaaguauua

SEQ ID NO: 548813 - RNA, 64 nt, hsa
gcuuugaauauggcccgacacaaauucguaaacuuuuuaaaaaacauuguaagauucuuucugu

SEQ ID NO: 548814 - RNA, 64 nt, hsa
auaaacuaugcuacucucauacaggggacccguauuuuaaaaucuccagacuugcuuacaucua

SEQ ID NO: 548815 - RNA, 64 nt, hsa
uuucuguccagaaggcaaaauuaccgaaugccauuuuuaaaaguaugcuauaaacuaugcuacu

SEQ ID NO: 548816 - RNA, 64 nt, hsa
cuuuuuuuuuuucccaauccaacagcauccuuuuuuuuaaaagagagaauuagaaaauauuaaa

SEQ ID NO: 548817 - RNA, 64 nt, hsa
gguauuugguuguuuuuguuuguuuauuucuuuguuuuaaaagccauguuuuugguugggcucu

SEQ ID NO: 548818 - RNA, 64 nt, hsa
aaaauaugaaaugugugcucaacugccaguaauuuuuuaaaaagcacugucccaguggauugau

SEQ ID NO: 548819 - RNA, 64 nt, hsa
ugccacccccaaacuuuaagguagcuaaaccaauuuuuaaaagauucaauggcuuguucauccu

SEQ ID NO: 548820 - RNA, 64 nt, hsa
cccgugccagcccuucuuuugugucugaaaccgguuuuaaaaugugacucucccagagaagaag

SEQ ID NO: 548821 - RNA, 64 nt, hsa
gcucucaauuaaguguugggaacuaauuucaagauuuuaaaaaauguuaugcaggcuuaacgug

SEQ ID NO: 548822 - RNA, 64 nt, hsa
auuuugcaguguuuaagucagcaaaucuucuguuuuuuaaaaauaagccacauaucuagauuuu

SEQ ID NO: 548823 - RNA, 64 nt, hsa
auauuucauagggcccugucuuauucaacuuuacuuuuaaaaucagugauuuggaugaaggcau

SEQ ID NO: 548824 - RNA, 64 nt, hsa
uugagucuaaauuuauauguugaaaugcuaccuuuuuuaaaauaagaaacuaaauaaaauuauu

SEQ ID NO: 548825 - RNA, 64 nt, hsa
acaguauuguaucauaauuacaggaaguuuuuauuuuuaaaacuggaucugggguauauucauu

SEQ ID NO: 548826 - RNA, 64 nt, hsa
gguguuugagcucaccuccaugcaaagacuucaguuuuaaaacauuauuugccuaaaauuagca

SEQ ID NO: 548827 - RNA, 64 nt, hsa
gccaaagcucaggggaaauuuuucaaaaauugaauuuuaaaauuucuuaugauuuuaaauaccu

SEQ ID NO: 548828 - RNA, 64 nt, hsa
gcaacauagcgagacccccaucucuacaaagaaauuuuaaaagauuauccaggcaugguggugc

SEQ ID NO: 548829 - RNA, 64 nt, hsa
ccuuuaaaauauguaaugucaaaaaugacucaccuuuuaaaaauuaugcaugaaaacagguggu

SEQ ID NO: 548830 - RNA, 64 nt, hsa
aaguauucauuguaaaacauacaaaauaaacauauuuuaaaacauuugcauuuuaccaccagua

SEQ ID NO: 548831 - RNA, 64 nt, hsa
guuuaugugauugaagcaaaugugaaucguauuauuuuaaaaaguggcagagugacuuaacuga

SEQ ID NO: 548832 - RNA, 64 nt, hsa
uguaucugugagaaucucauaguuaauauaaagauuuuaaaacugcauuaugaccuagccccca

SEQ ID NO: 548833 - RNA, 64 nt, hsa
aaauuagacauuuuuuauuuugacuaucuauggcuuuuaaaaaauauuuuguggcaauguaucu

SEQ ID NO: 548834 - RNA, 64 nt, hsa
guuuuuaaaucaaccacucauaauuugaccaaaauuuuaaaaaacugguauuuuguaaaugugu

SEQ ID NO: 548835 - RNA, 64 nt, hsa
gacggucuugaagaaaauaacacuguguauauuauuuuaaaauaaaaaauagaaguuuuuauug

SEQ ID NO: 548836 - RNA, 64 nt, hsa
uuaauccucuccuuuguguucaacuuuugugugcuuuuaaaaucagcuuuauucuaagcaaauc

SEQ ID NO: 548837 - RNA, 64 nt, hsa
uaauuuuaauauacuagucaugauguguguuguauuuuaaaaauuaucugcaaccuuaauucag

SEQ ID NO: 548838 - RNA, 64 nt, hsa
uaggaaacacuaaauaguguaauauuucuuuugcuuuuaaaaaaauuccugguagcaaaucaag

SEQ ID NO: 548839 - RNA, 63 nt, hsa
auuacccuggguauuaaaaagaacuccuuucacauuuuaaaauaacaaucugagcacuucaua

SEQ ID NO: 548840 - RNA, 64 nt, hsa
uaaauauuugaaccacugaauuuuaauaacaaaauuuuaaaauuggcaugaauacggaauacug

SEQ ID NO: 548841 - RNA, 64 nt, hsa
guuuacuccuugcucuuacaacauuucuaaggauuuuuaaaaguuuacuucuugucuuguucuu

SEQ ID NO: 548842 - RNA, 64 nt, hsa
gaugcauaucauuuuucuauaaguaaucaguugcuuuuaaaaucagaaggcuauauuauucuaa

SEQ ID NO: 548843 - RNA, 64 nt, hsa
guucuccucccuuuauaaauuuuauucauaggacuuuuaaaaggcuugugcuaucuuuccagug

SEQ ID NO: 548844 - RNA, 64 nt, hsa
gccagauuuucuguaguaaaacuuuuaaauauuauuuuaaaagaaauauguauauaaauaucuc

SEQ ID NO: 548845 - RNA, 64 nt, hsa
aaaauuggucucuuuagagaccaauuugccuaaauuuuaaaaucuuccuacacacaucuagacg

SEQ ID NO: 548846 - RNA, 64 nt, hsa
gucucauguuuguauuuggucccaguuggguacauuuuaaaauccugauuuuggagacuuaaaa

SEQ ID NO: 548847 - RNA, 64 nt, hsa
guuugugauuaaauucauugugauugcacaaaaauuuuaaaaacacgugauguaaacuugcaag

SEQ ID NO: 548848 - RNA, 64 nt, hsa
agcuguuugggugguuggaauaauuuuauuuuucuuuuaaaaaagcuaacaucagaccccuuua

SEQ ID NO: 548849 - RNA, 64 nt, hsa
ucuugaaggcaauccuuccucuggccaggaaauuuuuuaaaaaauaauacuguguuguguuuau

SEQ ID NO: 548850 - RNA, 64 nt, hsa
cuuucucaaauguaggcuuuuuacaaauuuuaaauuuuaaaauauuaguuuaaauguguguuau

SEQ ID NO: 548851 - RNA, 64 nt, hsa
ggucacauguuuuuccuucagcuugaaagcuuuuuuuuaaaaggaaaagauaccaaaugccugc

SEQ ID NO: 548852 - RNA, 64 nt, hsa
aggguggugggaaaugggggaucuucaauguuuauuuuaaaauaaaauaaaauaaguucuugac

SEQ ID NO: 548853 - RNA, 64 nt, hsa
auauaaaucaucucauguggauaugaaacuucuuuuuuaaaacuuaaaaagguagaauguuauu

SEQ ID NO: 548854 - RNA, 64 nt, hsa
uuuuacucacaggaaugucacuguuggacaauuauuuuaaaaguguauaaaaccaagucucaua

SEQ ID NO: 548855 - RNA, 64 nt, hsa
gcaauuaccaaaaauccuuuuauggaaaccauuuuuuuaaaaagugaauguacacaaauccaca

SEQ ID NO: 548856 - RNA, 64 nt, hsa
aguguuucaacaagauguugcugcaggagcagcuuuuuaaaacaagauaaaacucacaggggaa

SEQ ID NO: 548857 - RNA, 64 nt, hsa
uaaaacaagauaaaacucacaggggaauguacuuuuuuaaaaaaaaaugaaaaagaaaaaaaaa

SEQ ID NO: 548858 - RNA, 64 nt, hsa
aguuguauuuugaaaugaugugucaggaaaaguuuuuuaaaaacuuguauguuuuugcaaaucc

SEQ ID NO: 548859 - RNA, 64 nt, hsa
gacaaguuguggcaaaggaaacuauacuuuucauuuuuaaaaauguaaauagaaaaguuuuuaa

SEQ ID NO: 548860 - RNA, 64 nt, hsa
cacaaagaagagauaacuuccaaaagagugcuguuuuuaaaaauaauaauuaggaaauguuuau

SEQ ID NO: 548861 - RNA, 64 nt, hsa
uaaaauauuacuaacuuaaggguuucuaugugcuuuuuaaaauauuccuucuuugauguugaca

SEQ ID NO: 548862 - RNA, 64 nt, hsa
uaggcaagcucuccuuauaaguaaggcuuucaauuuuuaaaacagacauccugcuuuaacaauu

SEQ ID NO: 548863 - RNA, 64 nt, hsa
aaugaauaaauaaaauaaaaauaaaaauguuacuuuuuaaaaaguaacuuuuuuaauaauauaa

SEQ ID NO: 548864 - RNA, 64 nt, hsa
uaauaacuggucagaaaaauuuagacggucuucauuuuaaaauuggcaucaggaaggauuacca

SEQ ID NO: 548865 - RNA, 64 nt, hsa
uuggcaaaugaauccauauugacauauuugauuuuuuuaaaaacauggaaacguacuguuuugu

SEQ ID NO: 548866 - RNA, 64 nt, hsa
uuuuugccaauguaauuaaaaaaugguaugucauuuuuaaaauuuguauuucuuucauuacaaa

SEQ ID NO: 548867 - RNA, 64 nt, hsa
agaaacuugcauucaugaagagcccauuaucaacuuuuaaaagugaauuugauuuguacccacc

SEQ ID NO: 548868 - RNA, 64 nt, hsa
uauucaugcacugaaaaaugcuguuaucuuuuguuuuuaaaaaaugcaauuaaaacuagaaaua

SEQ ID NO: 548869 - RNA, 64 nt, hsa
acuugccaaauauauguacauauauauuuauauauuuuaaaaauaaacauuuuuuaaaucguca

SEQ ID NO: 548870 - RNA, 64 nt, hsa
ugccaaaggaggaaacaggaaaaauugccguccauuuuaaaaauuuagguuuguuguuuuaaac

SEQ ID NO: 548871 - RNA, 64 nt, hsa
cuuuuuaagaugucuauuauauuuacuuauuaguuuuuaaaaauugcgcuacuugccugggaaa

SEQ ID NO: 548872 - RNA, 64 nt, hsa
ggaaacauagcagaccucguuucuacuaaaaauuuuuuaaaaaagaaaauuagggcaaggugug

SEQ ID NO: 548873 - RNA, 64 nt, hsa
caacaugaugugaaaacccaucucuacaaaaauuuuuuaaaaaauaagccagggauuguggcau

SEQ ID NO: 548874 - RNA, 64 nt, hsa
ccagauaaguuauuuauaaugggcauuacugaauuuuuaaaaugccgauuacacccaaauauug

SEQ ID NO: 548875 - RNA, 64 nt, hsa
gaaggguagaaaacuucaaggaaaauaagugaaauuuuaaaagucagcauuuucuuagaccucu

SEQ ID NO: 548876 - RNA, 64 nt, hsa
accuuugaaagaguuuaaucuuaacguuuucuaauuuuaaaauuuuaaaaucuuguuuaacaaa

SEQ ID NO: 548877 - RNA, 64 nt, hsa
aagaguuuaaucuuaacguuuucuaauuuuaaaauuuuaaaaucuuguuuaacaaaagcuugua

SEQ ID NO: 548878 - RNA, 64 nt, hsa
uagacuucugaauaagaugauagacgagaauuuuuuuuaaaaaaggaauuuaaaggaaucuugu

SEQ ID NO: 548879 - RNA, 64 nt, hsa
uaucuuccaaacccaaucuaguaggauguucucauuuuaaaaacgaggggaaaagaccagaguu

SEQ ID NO: 548880 - RNA, 64 nt, hsa
cccuaaauauaguuauauuucauacuuaguuuguuuuuaaaaaguuuucucuguagaaaauuuu

SEQ ID NO: 548881 - RNA, 64 nt, hsa
caguuuuguuugaaaguuguuuguccguaugauuuuuuaaaagucaaguuuaauuucaaaaaac

SEQ ID NO: 548882 - RNA, 64 nt, hsa
cccacagcaacugccaaugaaggaugaauccccuuuuuaaaaaguuguuguuguuguuguuuau

SEQ ID NO: 548883 - RNA, 64 nt, hsa
accauacaaucauguacucuuuaacagaaauugcuuuuaaaaaauaucuggaacuaucuuuaaa

SEQ ID NO: 548884 - RNA, 64 nt, hsa
uuuuugaaaguaaaauaauucacaagcuuugguauuuuaaaauuauuguuaaacauaucauaac

SEQ ID NO: 548885 - RNA, 64 nt, hsa
ugauacccuaaucuugcuucuggaucuguucuuuuuuuaaaaaaacuuccuucaccgcgccuau

SEQ ID NO: 548886 - RNA, 64 nt, hsa
aauauauugucauacaauguuaaauaaccuauuuuuuuaaaaaaguucaacuuaagguagaagu

SEQ ID NO: 548887 - RNA, 64 nt, hsa
auugcgaaaucaagucugucaaguacaauaacauuuuuaaaagaaaauggaucccacuguuccu

SEQ ID NO: 548888 - RNA, 64 nt, hsa
uugugcgcugggggcuugugauguuugugugcuguuuuaaaauucauuucaaauuggacucgau

SEQ ID NO: 548889 - RNA, 64 nt, hsa
auuagacuugcugaguuuaauucagauuaccuaauuuuaaaauguuucugaaaagugaacagag

SEQ ID NO: 548890 - RNA, 64 nt, hsa
uggugaguaacacacauauagugggagucguuuuuuuuaaaaaaauuuuuuaauuaaauucaag

SEQ ID NO: 548891 - RNA, 64 nt, hsa
cuuuuauuuuugcuauucugaucauuugucccccuuuuaaaaauaaacuucccaugucuuccau

SEQ ID NO: 548892 - RNA, 64 nt, hsa
ggagcauuuauuuuguuaauuaaauugcacauauuuuuaaaaguuacguguuccacagaauaaa

SEQ ID NO: 548893 - RNA, 64 nt, hsa
gucugucugauuugcugaacuuucucaguccugauuuuaaaacaguuaagagaguccuugugag

SEQ ID NO: 548894 - RNA, 64 nt, hsa
guguuguaauuuuguaaggccaacuauuuacaaguuuuaaaaauugcuaucauguauauuuaca

SEQ ID NO: 548895 - RNA, 64 nt, hsa
uuaagcaauuuauaaaucuaaaaccugaagauguuuuuaaaacaauauuaacagcuguuagguu

SEQ ID NO: 548896 - RNA, 64 nt, hsa
uaaagaacagcuguuaauauuuuuuaaaaaucuauuuuaaaaugugauuuucuauaacugaaga

SEQ ID NO: 548897 - RNA, 64 nt, hsa
auuaagcacaagauaaagaacagcuguuaauauuuuuuaaaaaucuauuuuaaaaugugauuuu

SEQ ID NO: 548898 - RNA, 64 nt, hsa
uuuuuaaaauaacuggcaaaugcuaugcuucuacuuuuaaaauuugugguaauacccagaaugg

SEQ ID NO: 548899 - RNA, 64 nt, hsa
aagaacuuugagacuaauuuguauugacucgguuuuuuaaaauaacuggcaaaugcuaugcuuc

SEQ ID NO: 548900 - RNA, 64 nt, hsa
uggcgugagccaccaugcccagccucaaauauguuuuuaaaaaauaucauuguccuccuccucu

SEQ ID NO: 548901 - RNA, 64 nt, hsa
uuuuuuguuuuuuuuuugguuuguuuguuuuuuguuuuaaaagagacaggaucuugcuuugucu

SEQ ID NO: 548902 - RNA, 64 nt, hsa
uuguuaaauuguaaauuuucaaaauuaauugauguuuuaaaaauguugagaccaaaguaguaua

SEQ ID NO: 548903 - RNA, 64 nt, hsa
aaaugcagauuuugucauaaaguuguuauagauuuuuuaaaaugcuuuuuuaauauuaaaaugu

SEQ ID NO: 548904 - RNA, 64 nt, hsa
guaaaugguagugaguuaaauuaucuuuauuauuuuuuaaaaauaagaauuuagaagugguaaa

SEQ ID NO: 548905 - RNA, 64 nt, hsa
gguugucuuuuaaguuuuuuaaauauuuguugccuuuuaaaaucccugaguguaaguuaccaug

SEQ ID NO: 548906 - RNA, 64 nt, hsa
gcagaauguaugaaauccguuuuguaguuucaaauuuuaaaaguccuuuaaaaaauaaaaggau

SEQ ID NO: 548907 - RNA, 64 nt, hsa
cgcuugaagauuugugaguuuuucaacaguuuuauuuuaaaaacuggauggcuuaugauuguaa

SEQ ID NO: 548908 - RNA, 64 nt, hsa
aagaaugaaauccuucaaguguuaaaaacucacauuuuaaaagcaaauuuugguuccaauucug

SEQ ID NO: 548909 - RNA, 64 nt, hsa
auaguucucuagcuaaggaauggacauaccuuuguuuuaaaauauuuuauacuuacaaaaaucu

SEQ ID NO: 548910 - RNA, 64 nt, hsa
ccuccuuauuagaguugaacuucaaaguaacuuguuuuaaaaaauaugaauuacuguaaaauaa

SEQ ID NO: 548911 - RNA, 64 nt, hsa
uccaggcaucaagcucauuuuauggauuucugucuuuuaaaacaaucagauugcaauagacauu

SEQ ID NO: 548912 - RNA, 64 nt, hsa
auuuuugaaucuauuuuuaaaaucauaacauugauuuuaaaaauacauuuuuguuuauuuaaaa

SEQ ID NO: 548913 - RNA, 64 nt, hsa
uucagauucagguguauggaauuuuugaaucuauuuuuaaaaucauaacauugauuuuaaaaau

SEQ ID NO: 548914 - RNA, 64 nt, hsa
uuuuaaaaaacaaaguugugaaaacaugccuccuuuuuaaaaaauaaccccuccauccaggaua

SEQ ID NO: 548915 - RNA, 64 nt, hsa
uuuaaaauauuuuuuggaagagcugcuaauuuuauuuuaaaaaacaaaguugugaaaacaugcc

SEQ ID NO: 548916 - RNA, 64 nt, hsa
aaccucaaaggguuauuugaaaucuuuuguuguauuuuaaaauauuuuuuggaagagcugcuaa

SEQ ID NO: 548917 - RNA, 64 nt, hsa
cucuuuaagcaauagauuuugcuuggguuuucuuuuuuaaaaacauaauacugugcaggcaagg

SEQ ID NO: 548918 - RNA, 64 nt, hsa
aaaaugaaguucuaaugaacuguuucucccaagguuuuaaaauugucaagaguuauucuguuug

SEQ ID NO: 548919 - RNA, 64 nt, hsa
gacuuuuuaaggguccuucuuuccagcacauuuuuuuuaaaaacucagguuagaacaaaaaugu

SEQ ID NO: 548920 - RNA, 64 nt, hsa
caaaaucuuuuuuuuauuuuuaagggaauaaaaauuuuaaaaauuaagagauauacagaugacu

SEQ ID NO: 548921 - RNA, 64 nt, hsa
acuggagaagauauguguagaauuuuuguuuuauuuuuaaaauguguaaaacaucuuuuguuuu

SEQ ID NO: 548922 - RNA, 64 nt, hsa
aauuuuaaguauuaugaaauacuaaaacuacauguuuuaaaacagagguccaguuuauucuaac

SEQ ID NO: 548923 - RNA, 64 nt, hsa
uaggugcuuccucuauaucaagugaguuugcugauuuuaaaaucuuaggaauauaaauaaagau

SEQ ID NO: 548924 - RNA, 64 nt, hsa
gguggucaaauucuggaaguaagcauuuccucuuuuuuaaaaauuugguuugagccuuaugccc

SEQ ID NO: 548925 - RNA, 64 nt, hsa
ggucuuaauugccuuuagcagagguauccaaagcuuuuaaaauuuaugcauacguucuucacaa

SEQ ID NO: 548926 - RNA, 64 nt, hsa
uuuuaaaauagaugcucauauuuuuaaaauaaaguuuuaaaaauaacugcauuauggaguuuau

SEQ ID NO: 548927 - RNA, 64 nt, hsa
uaauuaucaaaacuuuuaaaauagaugcucauauuuuuaaaauaaaguuuuaaaaauaacugca

SEQ ID NO: 548928 - RNA, 64 nt, hsa
aucacaagaaaauaauggcaauaauuaucaaaacuuuuaaaauagaugcucauauuuuuaaaau

SEQ ID NO: 548929 - RNA, 64 nt, hsa
ugcuuaaucauuuguaauucaaacaugcuauauuuuuuaaaaucaaugugaaaacauagacuua

SEQ ID NO: 548930 - RNA, 64 nt, hsa
aaaaaccuuacuauuucuaggugaugccauaccauuuuaaaaguaguaagaguuugcugcccaa

SEQ ID NO: 548931 - RNA, 64 nt, hsa
aaugcaaguucuacaaugauaauauauuaaagauuuuuaaaaguuuaucuuuucacuuaguguu

SEQ ID NO: 548932 - RNA, 64 nt, hsa
gguuguuaagucuacugucuggcuucuuuugcauuuuuaaaaauaagacgauuuaauuuuaauu

SEQ ID NO: 548933 - RNA, 63 nt, hsa
ccaaaaguaaaaacuauugagguguaccuuccauuuuaaaauuuuucuucagaucccguucag

SEQ ID NO: 548934 - RNA, 64 nt, hsa
gcuaaaggcuaauggcauuuuaaacaucuuacauuuuuaaaaauuuauauugccucugccaaac

SEQ ID NO: 548935 - RNA, 64 nt, hsa
cauguucuaaaacaagagcuauccucauuccaaauuuuaaaauauguacucuggccgguugcag

SEQ ID NO: 548936 - RNA, 64 nt, hsa
agaaaauauacauuuguugguaacuaauguuauuuuuuaaaaccuggaccuuuucuggaagggc

SEQ ID NO: 548937 - RNA, 64 nt, hsa
aggagaguuuacugaugaaacagccucugcaagauuuuaaaaguuuuguucuuuuauagacuga

SEQ ID NO: 548938 - RNA, 64 nt, hsa
cuguccucuugccuuuuacuuaaauuccucugacuuuuaaaaauggugacacucuuaucguaaa

SEQ ID NO: 548939 - RNA, 64 nt, hsa
ucugguuggaaaugccauuguuuuggggacagacuuuuaaaaugcccuugugucucccagugag

SEQ ID NO: 548940 - RNA, 64 nt, hsa
ccuauuugaacuacuuaaacaguauuaaagcccuuuuuaaaaagcaccuauuugggaucauuug

SEQ ID NO: 548941 - RNA, 64 nt, hsa
guauauguagagaaaaauacuucccauugaucauuuuuaaaaggcuucugauuggauauugugu

SEQ ID NO: 548942 - RNA, 64 nt, hsa
aacaaugcuuaggcuuuucuaagccucuugccacuuuuaaaauuauccuucaggcauaaauauu

SEQ ID NO: 548943 - RNA, 64 nt, hsa
auacugucuaaaaaagcaaaguuuuaaagugcaauuuuaaaacuguaaauuacaucugaaggcu

SEQ ID NO: 548944 - RNA, 64 nt, hsa
aauguauagaccuugauauuuuuccaauacuauuuuuuaaaaaauuguaugauuuacauaugaa

SEQ ID NO: 548945 - RNA, 64 nt, hsa
aguaacucuuucuuuccguuuuuuuuucuuuuucuuuuaaaaaaugucuucuuauuuugguuuc

SEQ ID NO: 548946 - RNA, 64 nt, hsa
ugcugacugaacauuaguugcacuaacugcugguuuuuaaaaaauguuuucuggggaaagggga

SEQ ID NO: 548947 - RNA, 64 nt, hsa
cgaagggacaucuuuggaaaacgcugguuuugguuuuuaaaaagcccaacuuuuuuuuuuuaau

SEQ ID NO: 548948 - RNA, 64 nt, hsa
cucccuuccccgugguggccccgcucccuaaauuuuuuaaaaagacaaaaacaaaacaacaaca

SEQ ID NO: 548949 - RNA, 64 nt, hsa
gcuuagagauguagcgauguaagugucgauguuuuuuuaaaaaaaaaugcaaaaaaauucuuau

SEQ ID NO: 548950 - RNA, 64 nt, hsa
agaagcaagaugaaaaaaaggaaaagcaggugcuuuuuaaaaaucagaacugagguagcuuaga

SEQ ID NO: 548951 - RNA, 64 nt, hsa
auuuuccaacuuguauuuucauauaauuuauauuuuuuaaaagcugaaaauuuagaagcaagau

SEQ ID NO: 548952 - RNA, 64 nt, hsa
gugguuuauacacuggaaauguugcguuuaugcuuuuuaaaaacacacguuaacuucagaggaa

SEQ ID NO: 548953 - RNA, 64 nt, hsa
cuuaacagagaaagagacuaauguguccaaucauuuuuaaaaaucauccaugaaaaagugucuu

SEQ ID NO: 548954 - RNA, 64 nt, hsa
agguauucugcacauucauuccaaggucauagauuuuuaaaaggaccuggauuugaagagaugg

SEQ ID NO: 548955 - RNA, 64 nt, hsa
aauggaauguucauuuuauggcaguuguuuuaaguuuuaaaauacacagaggaaaauauugugg

SEQ ID NO: 548956 - RNA, 64 nt, hsa
auuguuuaaucuuuuuaaaaaagguuuaaacuuuuuuuaaaaaaaaaaucuuuaaacuggccuu

SEQ ID NO: 548957 - RNA, 64 nt, hsa
ugaguaccuuuuugcuagccugauuguuuaaucuuuuuaaaaaagguuuaaacuuuuuuuaaaa

SEQ ID NO: 548958 - RNA, 64 nt, hsa
gugaugacuucuaaugcuuauaucucaagguauuuuuuaaaaaagcaacggucccuaauagagu

SEQ ID NO: 548959 - RNA, 64 nt, hsa
uacaauugugaguuguguuggcauuaaaacuguauuuuaaaaaaagacagaaauuuaagggaaa

SEQ ID NO: 548960 - RNA, 64 nt, hsa
aauucaggucaguuucaguauuuuucaaauauuuuuuuaaaacugaauugcaauugugccaagc

SEQ ID NO: 548961 - RNA, 64 nt, hsa
ccuuggacuuuuagcuguuaaaugguaucucauuuuuuaaaacacauuucacauuuaaagucau

SEQ ID NO: 548962 - RNA, 64 nt, hsa
ucuucagaguaaucagguaaagcuuaaacaaguguuuuaaaagaugaguuuuuccuacauucug

SEQ ID NO: 548963 - RNA, 64 nt, hsa
ugccaacguugucuuugauaauauuuaauauauuuuuuaaaaaacaauucuuguaaaauacuuu

SEQ ID NO: 548964 - RNA, 64 nt, hsa
cugcuugaugaagcaaggaagauauacaugaaaauuuuaaaaauacauaucgcugacuucaugg

SEQ ID NO: 548965 - RNA, 64 nt, hsa
uaucuaaaguuuguuagauagcugcauguggcuuuuuuaaaaaagcaacagaaaccuauccuca

SEQ ID NO: 548966 - RNA, 64 nt, hsa
auuauccauuugaucuauagcaaugugauuuuauuuuuaaaaagaaaagcaguguguuuucuuu

SEQ ID NO: 548967 - RNA, 64 nt, hsa
uaucugcgaaguaaucugcaaucucuuuuguucuuuuuaaaauuugauuuguuauaaaauugcc

SEQ ID NO: 548968 - RNA, 64 nt, hsa
acauuuagcuucaaauuguaacaauucaauugaauuuuaaaaugacaccugaaaagauacaucu

SEQ ID NO: 548969 - RNA, 64 nt, hsa
acuaacuaaggucccauaauaaaaagauaguaucuuuuaaaaugaaauguuuuugcuauagauu

SEQ ID NO: 548970 - RNA, 64 nt, hsa
uuuuaaaaugaaauguuuuugcuauagauuuguauuuuaaaacauaagaacgucauuuugggac

SEQ ID NO: 548971 - RNA, 64 nt, hsa
uuuugcaguauauuucugaaaugacagaaugcuguuuuaaaaacaaagaaauaaaauccugcuc

SEQ ID NO: 548972 - RNA, 64 nt, hsa
agguggaguaaucuguggauuuguuucuguugucuuuuaaaaugucaaauauauaauauguaau

SEQ ID NO: 548973 - RNA, 64 nt, hsa
ucuuuuaaaaugucaaauauauaauauguaauuuuuuuaaaaaccaccagauacagaaaugugc

SEQ ID NO: 548974 - RNA, 64 nt, hsa
aauugguagaugaaaaaaaccugguucaaguuuuuuuuaaaauguggugucccauuccaaggga

SEQ ID NO: 548975 - RNA, 64 nt, hsa
caaagucaauaauugggacaaaugguaaagaugauuuuaaaaucuguuguauuuaggucccuug

SEQ ID NO: 548976 - RNA, 64 nt, hsa
gaauuuccagugaccuguaauuucauuacauauauuuuaaaaucuauuuauuuuagaugguguu

SEQ ID NO: 548977 - RNA, 64 nt, hsa
aauuuucuauucaccguacuuauccaaaaaucucuuuuaaaaaguaaauuugugcaacaacguu

SEQ ID NO: 548978 - RNA, 64 nt, hsa
uguuuuuuuaaccaugaaaugacaauaaaaugauuuuuaaaaugagaauguuuuggauaaguga

SEQ ID NO: 548979 - RNA, 64 nt, hsa
acucaguuugaaacuauucauuucuacacacuauuuuuaaaaauugccuacuaggugaaacaua

SEQ ID NO: 548980 - RNA, 64 nt, hsa
gguauuuaggcuggcaauauauauauuaaccauauuuuaaaaguaccaauuuuguuuuuacaga

SEQ ID NO: 548981 - RNA, 64 nt, hsa
aauucaccugauuauuagauaacuuaaaguuuauuuuuaaaagcugacaacuuuuuaugaaucu

SEQ ID NO: 548982 - RNA, 64 nt, hsa
uuaaaucguauuauuuuuuucuuaacagaaauauuuuuaaaaaugaaaaaguacucaaaaguga

SEQ ID NO: 548983 - RNA, 64 nt, hsa
aucuguaauuuaaauguuucuaguaaccacauuuuuuuaaaaguaaaaagaaacccaugguauu

SEQ ID NO: 548984 - RNA, 64 nt, hsa
aacucaccaucuccugaagaccuuucuuaccuuuuuuuaaaaacaaaaaaugaaauuauuuugc

SEQ ID NO: 548985 - RNA, 64 nt, hsa
agaguauugaagauugaaaggguuuuucuuucuuuuuuaaaaaagaaaaacaaacuauugauug

SEQ ID NO: 548986 - RNA, 64 nt, hsa
ggcaagauuucccaguaaagauuuucugugcguauuuuaaaagucguguuaauacucaugauaa

SEQ ID NO: 548987 - RNA, 64 nt, hsa
guguucuuuugaaauguucaucaggaauaggcuuuuuuaaaaaauguuguguaucuguauauag

SEQ ID NO: 548988 - RNA, 64 nt, hsa
ugaaugcaaaaaggaaaaaaacccacaaacauguuuuuaaaauaaaauaucuuuuuuugccuug

SEQ ID NO: 548989 - RNA, 64 nt, hsa
aaguuuucgauguauuggaauuauuugggaaugcuuuuaaaacaauuuguaauuauuucuuuac

SEQ ID NO: 548990 - RNA, 64 nt, hsa
aguuauggacuuuuuugaugcauguguguauguguuuuaaaaaguaugcaggcucuaaaaaugu

SEQ ID NO: 548991 - RNA, 64 nt, hsa
cugaguaaauuuuacuuguaaucuacaauuggcuuuuuaaaaauaaccuguugauauauaauug

SEQ ID NO: 548992 - RNA, 64 nt, hsa
guugcaagagugaauguaaaaaauaguuguggcauuuuaaaaggucgccuuugaugcagaugca

SEQ ID NO: 548993 - RNA, 64 nt, hsa
uauucauauaaugacuuuuuuuuaagagucucuuuuuuaaaaaaacuuaauucucuaaaaccga

SEQ ID NO: 548994 - RNA, 64 nt, hsa
uuaauucucuaaaaccgaaaugguucaugcuucuuuuuaaaaaugauuguauaaaauguaugga

SEQ ID NO: 548995 - RNA, 64 nt, hsa
agagggugaaaaaaguuaagggaaaagacuuugcuuuuaaaaaaauguuucaaaagaaagguau

SEQ ID NO: 548996 - RNA, 64 nt, hsa
cacagucuacuggguagguauuguaaauaauaauuuuuaaaacuugcacaaaucaaaacaaaca

SEQ ID NO: 548997 - RNA, 64 nt, hsa
gacuuuaauuguaaaagccguuaauguagaaaacuuuuaaaaaaauuaauauggcagaauacga

SEQ ID NO: 548998 - RNA, 64 nt, hsa
aaacccaacucuucaugauuugccugugacuuauuuuuaaaacuuuuuuaaaaaagauuuagcu

SEQ ID NO: 548999 - RNA, 64 nt, hsa
uucaugauuugccugugacuuauuuuuaaaacuuuuuuaaaaaagauuuagcuuuaaaauaguu

SEQ ID NO: 549000 - RNA, 64 nt, hsa
aaaccugaucuuuccuaauccucacuuuuuucuuuuuuaaaaagcaguuucuccacugcuaaau

SEQ ID NO: 549001 - RNA, 64 nt, hsa
cugacuguuauaaaguauaacaacacacaucagguuuuaaaaagccuugaauggcccuugucuu

SEQ ID NO: 549002 - RNA, 64 nt, hsa
uauagcuuauaugauuuuuuugccuugguauacauuuuaaaauaugaauuuaaaaaauuuuugu

SEQ ID NO: 549003 - RNA, 64 nt, hsa
aaguugugaccauaagguuuaauuucaaaguuccuuuuaaaagagguuaaggaacuguguuacc

SEQ ID NO: 549004 - RNA, 64 nt, hsa
gguaguuuugugugacugugacuaaacuauuuuauuuuaaaaugucauucuuauuuauacauuc

SEQ ID NO: 549005 - RNA, 64 nt, hsa
ugauuuucuuuugggagucacuuuuaaucuguaauuuuaaaauacaagucugaauauuuauagu

SEQ ID NO: 549006 - RNA, 64 nt, hsa
gugugagacuuuuucauuaaauaauauugaaagauuuuaaaauucauuugaaagucugauggcu

SEQ ID NO: 549007 - RNA, 64 nt, hsa
ccaaaggcucuacuuucaaagguuaagaaugagauuuuaaaauuggauuuuugccuggacuuga

SEQ ID NO: 549008 - RNA, 64 nt, hsa
aaaacaucagauuaaauaauuacacuguucaggcuuuuaaaaaaauaccacugugagaauaaag

SEQ ID NO: 549009 - RNA, 64 nt, hsa
gaauaaagcgcuagcaagauacaucacuuacugauuuuaaaaauacagaaagauuuugaguaaa

SEQ ID NO: 549010 - RNA, 64 nt, hsa
agguauguaaguuauuaaaugguuaaucauggccuuuuaaaaauaaaauaaagugauaccuuua

SEQ ID NO: 549011 - RNA, 64 nt, hsa
gaucaucuaauuuccugcuuaccuuaacugggaauuuuaaaaaguuggccuaaaaauguuccau

SEQ ID NO: 549012 - RNA, 64 nt, hsa
guugcauuucuuaaaaaagaguaauaaaaaggauuuuuaaaaaguaauuccuuaaacauaccau

SEQ ID NO: 549013 - RNA, 64 nt, hsa
gaggcugggaugauggagaaagcucgaggugaaguuuuaaaaaaaaaguuguggaaaggaaagu

SEQ ID NO: 549014 - RNA, 64 nt, hsa
uaaauaugcacaauauuccauagcucacugaggauuuuaaaauuauaagcauaggauuuuauau

SEQ ID NO: 549015 - RNA, 64 nt, hsa
aaaaaaagccaaauuucacagucuuaauaacuuuuuuuaaaaaaaacuaaaaggcgcuucaugu

SEQ ID NO: 549016 - RNA, 64 nt, hsa
gggacuggaaaguuauguucaaaggcugaagcuauuuuaaaacauuauuuugacuacuaagugg

SEQ ID NO: 549017 - RNA, 64 nt, hsa
cgcuagcugauuuuaacuuuaggaauaaaauuaguuuuaaaagcuuuuguuuacauugucuugg

SEQ ID NO: 549018 - RNA, 64 nt, hsa
acugagaguugauauggccaaagggagagaggccuuuuaaaauauauauauauauacacauaua

SEQ ID NO: 549019 - RNA, 64 nt, hsa
guugauaauuuuacugaucuaaagcugagugauuuuuuaaaagaauuugaauuuggcuuccuca

SEQ ID NO: 549020 - RNA, 64 nt, hsa
aucgccaugcaaauuacaaucuugaaugaguguuuuuuaaaaauaaaguauuagaaaaaugugu

SEQ ID NO: 549021 - RNA, 64 nt, hsa
uacacacuuaaucuuagcggauuacuucagauguuuuuaaaaaguauauuaagaugccuuuuca

SEQ ID NO: 549022 - RNA, 64 nt, hsa
ucucaacaggcgcucacugaaguguaugaauauuuuuuaaaaagguuuuugcaguaagcuaguc

SEQ ID NO: 549023 - RNA, 64 nt, hsa
uuaauucuuuauagaaaugugaacacugaauuuauuuuaaaaaauaauaauaaaaauuuaaaaa

SEQ ID NO: 549024 - RNA, 64 nt, hsa
gagugaaccuaugacugcaguggaucucaaaaacuuuuaaaaccauagacaagccuuauagagu

SEQ ID NO: 549025 - RNA, 64 nt, hsa
agugguugacagauguucacuuugaagugugaaguuuuaaaaauacgugaauaaauugguuauu

SEQ ID NO: 549026 - RNA, 64 nt, hsa
uguugaguguuguuuccuucaauguuucugccuuuuuuaaaaaaaaaguauguguaauaugaag

SEQ ID NO: 549027 - RNA, 60 nt, hsa
ccaugaaaaagacuaugugacagcaaggccuuuuaaaacugauuuucaagguccuucuag

SEQ ID NO: 549028 - RNA, 64 nt, hsa
caauuccaguauuauguauauugcaaauuaaacauuuuaaaauauuuuuuuccaauuuauuucu

SEQ ID NO: 549029 - RNA, 64 nt, hsa
aaacaauuucguuuaaugggaucuguacaacugauuuuaaaaaaaugcuacaaaaagccccaaa

SEQ ID NO: 549030 - RNA, 64 nt, hsa
uuuuucugcccucccuauuuuuaacuagaugauguuuuaaaaauuacuuuucccucucuauaua

SEQ ID NO: 549031 - RNA, 64 nt, hsa
cgccccugagugcucauguaccauuuagcuuguguuuuaaaaaucuacuuuuucugcccucccu

SEQ ID NO: 549032 - RNA, 64 nt, hsa
uguaacauuuuucuauuguuuaaauagaaagccuuuuuaaaauuuggucaaucuucauagauga

SEQ ID NO: 549033 - RNA, 64 nt, hsa
gagcacucauuaaaggcagaagacggaaaaguguuuuuaaaauggugaauuuaagugguaagga

SEQ ID NO: 549034 - RNA, 64 nt, hsa
agcuuuuuugaaaacacaucaguagaaaccaagauuuuaaaaugaagugucaagacaaaggcaa

SEQ ID NO: 549035 - RNA, 64 nt, hsa
cacagaaaguguuuucuuuuuuuuaaaucaagacuuuuaaaacuggauuuccucccaucacugu

SEQ ID NO: 549036 - RNA, 64 nt, hsa
acagccuuaaagacaaaaauccuuguugaaguuuuuuuaaaaaaagcuaaauuacauagacuua

SEQ ID NO: 549037 - RNA, 64 nt, hsa
aacaauccuuuugauaaauuuaaaauguuacuuauuuuaaaauaaaugaagugagauggcaugg

SEQ ID NO: 549038 - RNA, 64 nt, hsa
gcauugcuuuuguuucuuaagaaaacaaacucuuuuuuaaaaauuacuuuuaaauauuaacuca

SEQ ID NO: 549039 - RNA, 64 nt, hsa
caugcagacuguuagcuuuuaccuuaaaugcuuauuuuaaaaugacaguggaaguuuuuuuuuc

SEQ ID NO: 549040 - RNA, 64 nt, hsa
acauugagaagugcaaauguucgcauccuuuuguuuuuaaaagauaugaugucagaauaaaaug

SEQ ID NO: 549041 - RNA, 64 nt, hsa
aaaagaaaacacaaauaagcagaaaacauacuuauuuuaaaaaagaaaaaaaaggauaaaaaaa

SEQ ID NO: 549042 - RNA, 64 nt, hsa
accuaguucaaaaugaaauuauuuagauaccaauuuuuaaaauacuggagagaauuuauauguc

SEQ ID NO: 549043 - RNA, 64 nt, hsa
agucuuuauuauauuugaagcaauuuuuuuucaauuuuaaaagcugaaugaagacaacuuaggu

SEQ ID NO: 549044 - RNA, 64 nt, hsa
auaaauaaggaaagaagcuguugcauuacugggauuuuaaaaguuugauuuacauuuauauucc

SEQ ID NO: 549045 - RNA, 64 nt, hsa
auauauuucaagcuuauuucaaaauuggugguuuuuuuaaaaaaagaggcaagaaaauaaaaac

SEQ ID NO: 549046 - RNA, 64 nt, hsa
agcucaaauaucuguugcacuguucaacugauauuuuuaaaauucuaauaaucuucaucucaaa

SEQ ID NO: 549047 - RNA, 64 nt, hsa
uacaaaucuuaaauauuuuuaauaaauccuuucauuuuaaaaagagaauugccaauacagaaaa

SEQ ID NO: 549048 - RNA, 64 nt, hsa
augaagaugagacaucuuaauuuguuuugacauauuuuaaaaguuaauuauuagauaaaggcuc

SEQ ID NO: 549049 - RNA, 64 nt, hsa
uaaagcauauuagaauaauuguggguugacagauuuuuaaaauagaauuuagaguauuuggggu

SEQ ID NO: 549050 - RNA, 64 nt, hsa
uaauaucauucaaaaggaaacaaaaaauguugaguuuuaaaaaucaggauugacuuuuuucucc

SEQ ID NO: 549051 - RNA, 64 nt, hsa
uuuuuggaaaauagcacuuuucacuucuguguguuuuuaaaauuaauguuauagaagacucaug

SEQ ID NO: 549052 - RNA, 64 nt, hsa
uaaagucaucacauuaaacauuguaauacuaguuuuuuaaaaguccagcuuuuaguacaggaga

SEQ ID NO: 549053 - RNA, 64 nt, hsa
cuuccaguauuuuuuaaaaaacuguccuaucucauuuuaaaagacuuucuuuugcuugauccca

SEQ ID NO: 549054 - RNA, 64 nt, hsa
uugaacauuauucacuuagauuucuuccaguauuuuuuaaaaaacuguccuaucucauuuuaaa

SEQ ID NO: 549055 - RNA, 64 nt, hsa
agggauuucauggccucuucuugaaaucaagacuuuuuaaaagucagacaugaacuugcauguc

SEQ ID NO: 549056 - RNA, 64 nt, hsa
aaaauuaaaaggguagacacaguugagaguuuuauuuuaaaaagcuaagucuuauaauuaugac

SEQ ID NO: 549057 - RNA, 64 nt, hsa
aguauugcuauaacauauauuuuuuucugaaauguuuuaaaauagaaguacaccuaauuguuau

SEQ ID NO: 549058 - RNA, 64 nt, hsa
cuucuaagacuaaauagguaguuguguucuuuauuuuuaaaauuucuuuuuagagcaaauguua

SEQ ID NO: 549059 - RNA, 64 nt, hsa
gaauacaucgagagagauaaauggcaaauugcuuuuuuaaaaguuuacauaaguuuuuuuuaac

SEQ ID NO: 549060 - RNA, 64 nt, hsa
aguaauagagucauacuuuuuuauaacagcaaccuuuuaaaaggaaagcucuuauaaagucacu

SEQ ID NO: 549061 - RNA, 64 nt, hsa
guuuguuuucaaaauacuucuuuuucauuauugguuuuaaaaaagcauuauccuuuuaucucac

SEQ ID NO: 549062 - RNA, 64 nt, hsa
aaauaaagagaaaaacucauucagaaaucauggauuuuaaaaauauuuuacugcagccaaguuu

SEQ ID NO: 549063 - RNA, 64 nt, hsa
ugacaguuccaucuuggaagguuucaaaauuaccuuuuaaaaugaucucagaagucuguagauu

SEQ ID NO: 549064 - RNA, 64 nt, hsa
uguugguccauugaaaguuacauggauugccaauuuuuaaaacacuaaaguugaauaaaaugca

SEQ ID NO: 549065 - RNA, 64 nt, hsa
auuugcuuguccuuuugaauuccuguuuuaauaauuuuaaaaugagcacaaagaacguugaagu

SEQ ID NO: 549066 - RNA, 64 nt, hsa
uaucuugaugcuccugucaaaagggaaaugaggcuuuuaaaaauaaaguaccuuaauucuuuau

SEQ ID NO: 549067 - RNA, 64 nt, hsa
ccuaaacccacccacuucucuugcccaggcugcuuuuuaaaaauauuuuuuuauuuuuuacuua

SEQ ID NO: 549068 - RNA, 64 nt, hsa
uuccaaacuaaauuacucgggaaguaaacgcuuuuuuuaaaaguauuuuuacugguuuuauacc

SEQ ID NO: 549069 - RNA, 64 nt, hsa
cguuucguuuugauaauuguugaaccaauuuuguuuuuaaaaccuuuagacucugaaaguaaua

SEQ ID NO: 549070 - RNA, 64 nt, hsa
caguccaguugugaagcuggagaagagaaauggguuuuaaaaauuaagugaggggaggccgggu

SEQ ID NO: 549071 - RNA, 64 nt, hsa
uuugcaucccaaauguuuuuaaucuuuguauauuuuuuaaaaauccuuuucuccucaucauugc

SEQ ID NO: 549072 - RNA, 64 nt, hsa
ugcccuuuuauuaaauaaauucauggcaauguuuuuuuaaaagacauuucagcuucuuuacuca

SEQ ID NO: 549073 - RNA, 64 nt, hsa
uuacuacuuaaugguuuugaagcaacuguuuaauuuuuaaaauuuuugaaaacuugcuaauaac

SEQ ID NO: 549074 - RNA, 64 nt, hsa
cagaagacacacuuguacgaauguagauuuauuuuuuuaaaaaaaaaaaagcaaagcuuucugc

SEQ ID NO: 549075 - RNA, 64 nt, hsa
guuauuuuaauauuucacgauacuaaaauuuuaauuuuaaaaaauucuggaagaaacagauuca

SEQ ID NO: 549076 - RNA, 64 nt, hsa
uccucacgaauuguuuuacugcugcauuuuuuguuuuuaaaauuaaacugcaguguuuccugga

SEQ ID NO: 549077 - RNA, 64 nt, hsa
agguucuaaacuguguuacagauacuuguaagacuuuuaaaaucagaguaaguauguucuuaca

SEQ ID NO: 549078 - RNA, 64 nt, hsa
aaauagaaauaguucuuuaaaaauauuucucuacuuuuaaaacaagauacuuaauauuuuuaau

SEQ ID NO: 549079 - RNA, 64 nt, hsa
aaacgucuggacucaaaaaaugcuuuguuccauguuuuaaaauuuuuaaguagcagucucaaag

SEQ ID NO: 549080 - RNA, 64 nt, hsa
uaaagggcuaaauuauauaagcaaacacuacuuuuuuuaaaacgucuggacucaaaaaaugcuu

SEQ ID NO: 549081 - RNA, 64 nt, hsa
cacuucuuuuuauuucuuguccccaguguguaccuuuuaaaauuauucccucucaacaaaacuu

SEQ ID NO: 549082 - RNA, 64 nt, hsa
aacuuuacucuuauucuuagcuguauauacauuuuuuuaaaaguuuguuaaaauaugcuugacu

SEQ ID NO: 549083 - RNA, 64 nt, hsa
gagccagacccucuucagggaagggaccaauuaauuuuaaaacucacuugaagcacagcugguc

SEQ ID NO: 549084 - RNA, 64 nt, hsa
augaaugucaucucuuuucaguuuccaguauccuuuuuaaaaaauggcaaaagccuagauuuac

SEQ ID NO: 549085 - RNA, 64 nt, hsa
uaugugacuuguugaacuuuuuaaaaagugcuacuuuuaaaaucccagauacucugaauuuuag

SEQ ID NO: 549086 - RNA, 64 nt, hsa
uugauguuuuaaguguuaugugacuuguugaacuuuuuaaaaagugcuacuuuuaaaaucccag

SEQ ID NO: 549087 - RNA, 64 nt, hsa
gcaaacaaagcaaccccaaaagaguugauguguguuuuaaaagaaaaaacccaaugaggaacaa

SEQ ID NO: 549088 - RNA, 64 nt, hsa
gauuuaaaauuaugcagggccccuaugugggauuuuuuaaaaagcaaacugguguguauucuca

SEQ ID NO: 549089 - RNA, 64 nt, hsa
ccaagcauguauguagagaaaggacuuugccgcuuuuuaaaacuagugucacagucucucuugg

SEQ ID NO: 549090 - RNA, 64 nt, hsa
uacaaaaagaaacauuuaaugacgguuuaaaacuuuuuaaaagaaaacucaguauuauuuuugc

SEQ ID NO: 549091 - RNA, 64 nt, hsa
cauuaaaauuuauguuugagguuaccucaacuuguuuuaaaagauuuuguuuugugaauuugua

SEQ ID NO: 549092 - RNA, 64 nt, hsa
ccauuuuaguucuauggauggaaauauuucaugcuuuuaaaaagauguuuguguuccugugguu

SEQ ID NO: 549093 - RNA, 64 nt, hsa
aaaaacuuaaaaaaaauuuaaaaaauaaaaaaaguuuuaaaaacugaucaaguuaguguguguc

SEQ ID NO: 549094 - RNA, 64 nt, hsa
gaagcacagaaaacuagaauuucauuuauuuuguuuuuaaaauauauauguugauuucuuguaa

SEQ ID NO: 549095 - RNA, 64 nt, hsa
cguuuuugugcaaaaauaaaugaauggcaauagauuuuaaaaaaucuuauuauguacuucugug

SEQ ID NO: 549096 - RNA, 64 nt, hsa
gagcucuugucaucuguggagagaaucaugcaaauuuuaaaaguucuuccaagagacuuccaug

SEQ ID NO: 549097 - RNA, 64 nt, hsa
uuaguacuugaaguugagccuuuguggugggacuuuuuaaaaaaaugccuuuuuaaagcauuaa

SEQ ID NO: 549098 - RNA, 64 nt, hsa
acccagcaguagguuuuguuaacaacaaacuggauuuuaaaaguucugccauguuaaguggcca

SEQ ID NO: 549099 - RNA, 64 nt, hsa
ccuguggguuaccugaacuccauaaucugggacuuuuuaaaaauaagaaccagcucaaguacau

SEQ ID NO: 549100 - RNA, 64 nt, hsa
uuucuuuuuaaaaauuuuccaaaacuuuucuccauuuuaaaaagcccuguuauaaacguugaac

SEQ ID NO: 549101 - RNA, 64 nt, hsa
uuggauccuguacucuaauaaaucauaaguuucuuuuuaaaaauuuuccaaaacuuuucuccau

SEQ ID NO: 549102 - RNA, 64 nt, hsa
ucauuuuuuuccauuaagaaaaaaaaaaguccccuuuuaaaacaagcagggcugggugugacgg

SEQ ID NO: 549103 - RNA, 64 nt, hsa
ccugccuuaggaaaauuuaauauauuuuaaauuauuuuaaaagaaauacaacaucuuauucuuu

SEQ ID NO: 549104 - RNA, 64 nt, hsa
aaauauaaaagauauuucucucuuuuuaaaaucuuuuuaaaagggaauuggcugcuuaaagcca

SEQ ID NO: 549105 - RNA, 64 nt, hsa
aauauguggguaaauauaaaagauauuucucucuuuuuaaaaucuuuuuaaaagggaauuggcu

SEQ ID NO: 549106 - RNA, 64 nt, hsa
ucacauucaugaaaagcacugauaaacagaauacuuuuaaaacaccuugagaaaaaaagauaau

SEQ ID NO: 549107 - RNA, 64 nt, hsa
caagagucacuaagcagaauuuagaaagagaaguuuuuaaaaagcaaacaguguaaaaaaaguc

SEQ ID NO: 549108 - RNA, 64 nt, hsa
uaagugcuuaauuuggaauagagaaaccaguauauuuuaaaaaagaaaaauauucuuuguagca

SEQ ID NO: 549109 - RNA, 64 nt, hsa
ugucagaauuacauacacaauuacaacaaacuuuuuuuaaaagacauuucauuguacugcaaaa

SEQ ID NO: 549110 - RNA, 64 nt, hsa
guauagcucuuuccuucaaauucaacuagagccuuuuuaaaaagacauuugccugcuagucaga

SEQ ID NO: 549111 - RNA, 64 nt, hsa
uaaaaagaaaauuauugcauuugaucuggauggauuuuaaaagaauauaauguucaauauuaaa

SEQ ID NO: 549112 - RNA, 64 nt, hsa
agauuuguuuguguuuaugaaacagccauuuauuuuuuaaaaaguguuuugaauugugucuuaa

SEQ ID NO: 549113 - RNA, 64 nt, hsa
cacauaauuucuguuucagcaguacaaaggcauguuuuaaaaucuauaacauaaagaauaagga

SEQ ID NO: 549114 - RNA, 64 nt, hsa
gcuggccacauuggacaucuuggucacugcagaauuuuaaaaggcaaacuucucagaacagaug

SEQ ID NO: 549115 - RNA, 64 nt, hsa
uucucuuaggcagcucugcacuucauguucaguuuuuuaaaaauagacuguaguauccuuucau

SEQ ID NO: 549116 - RNA, 64 nt, hsa
aaagagaaucugugggaaauaggcagauauagcuuuuuaaaauauaaaguacuugggauuuugc

SEQ ID NO: 549117 - RNA, 64 nt, hsa
uaccaauaauagagcuaaauacaaugacauuugcuuuuaaaagguggauauuuuauuucugcuu

SEQ ID NO: 549118 - RNA, 64 nt, hsa
uagucugacaucagaaaauaaaauugaggcugauuuuuaaaaauuucuaguagauuuuuggccu

SEQ ID NO: 549119 - RNA, 64 nt, hsa
uaaaaauuucuaguagauuuuuggccuuuccuguuuuuaaaaaucaguuucauuuucauauuuc

SEQ ID NO: 549120 - RNA, 64 nt, hsa
caagugaaaacuuaaauuguaaaacauguugaaauuuuaaaaauuaauguuaauauggaaaugc

SEQ ID NO: 549121 - RNA, 64 nt, hsa
uuuaggaaaaucacuuugucuaacucagaauuauuuuuaaaaagaaaucuggucuuguuagaaa

SEQ ID NO: 549122 - RNA, 64 nt, hsa
auguuacuauuuucuacaauuaauaguuugucuauuuuaaaauaaauuaguuguuaagagucuu

SEQ ID NO: 549123 - RNA, 64 nt, hsa
cuggggcagauauguauguuauauacaacuauuuuuuuaaaaaacuuauauccauguugggagu

SEQ ID NO: 549124 - RNA, 64 nt, hsa
uuuggagaauguauuuuuguauuuauaaaucaacuuuuaaaaacugucucauucaaaagggaau

SEQ ID NO: 549125 - RNA, 64 nt, hsa
aauucacaaauagccauugaacaaauguguggguuuuuaaaaauuauauacauauaugaguugc

SEQ ID NO: 549126 - RNA, 64 nt, hsa
ucaaccucuuacaauaagcuaaacgcaaugucauuuuuaaaaagaaggacuuagggugucguuu

SEQ ID NO: 549127 - RNA, 64 nt, hsa
aggggucuuaauugaaaugaaaauuuaauuuuguuuuuaaaauauuguuuaucuuuauuuauuu

SEQ ID NO: 549128 - RNA, 64 nt, hsa
uauaaauauguguuguaugucuuuuuugcuuuuuuuuuaaaaaaaagaauaacuuuuuuugccu

SEQ ID NO: 549129 - RNA, 64 nt, hsa
guuagugguguuuugaagaggguauuuuauuguuuuuuaaaaaaagguucuuaaacauuauuug

SEQ ID NO: 549130 - RNA, 64 nt, hsa
uuucuguauccuuccuucuaccuauuauucugauuuuuaaaaaugcaguuaauguaccauuuau

SEQ ID NO: 549131 - RNA, 64 nt, hsa
uagguuagaccacccaauaaaucuagaaaucagcuuuuaaaaauauugucugaagucuaacaaa

SEQ ID NO: 549132 - RNA, 64 nt, hsa
auggugugcuuuuggggagauacacuagcaauuuuuuuaaaaacuggaacagugugauaggaag

SEQ ID NO: 549133 - RNA, 64 nt, hsa
uaguccaguuaugaaaucaguguaauacauugauuuuuaaaacugcugcuuuuuaugcuuuaag

SEQ ID NO: 549134 - RNA, 64 nt, hsa
uuaaauacauuacacggguuguaaggacaaaggauuuuaaaaucugagcacuuaggugaaggga

SEQ ID NO: 549135 - RNA, 64 nt, hsa
cuguucaggccuuuuccuuuuuacuucuggcuuauuuuaaaaauauuuuuuaucuauuuacugu

SEQ ID NO: 549136 - RNA, 64 nt, hsa
ucuugaaauuuugccaccacagaaagaaagauguuuuuaaaagcuuggcccaaagaauaggaac

SEQ ID NO: 549137 - RNA, 64 nt, hsa
guaugaggacuccuuguuaugccuuuaagguaauuuuuaaaaaaaaucugaguagagauaguac

SEQ ID NO: 549138 - RNA, 64 nt, hsa
auuacuauguaaacaaaaaguagauaguuucacuuuuuaaaaaauccauuacuguuuugcauuu

SEQ ID NO: 549139 - RNA, 64 nt, hsa
cuuucuuuuuuuucuuuuguuucaugauuuugauuuuuaaaauuauuagcacacaacuauuuuc

SEQ ID NO: 549140 - RNA, 64 nt, hsa
gugcaaaugggugacuuagugcauugauucagauuuuuaaaauuucuugaugugguuuguaaua

SEQ ID NO: 549141 - RNA, 64 nt, hsa
aacuacccauauuccagacucugagcuguuuccuuuuuaaaaaucauauagacaauuagcuguu

SEQ ID NO: 549142 - RNA, 64 nt, hsa
caauacaccucaaggaaaagguucagauuuuuauuuuuaaaauauuuucauuuuuuucuugaau

SEQ ID NO: 549143 - RNA, 64 nt, hsa
guagguuguugauuuuguuacuucauacuggaacuuuuaaaaagauuucaucaaauaaaguuuu

SEQ ID NO: 549144 - RNA, 64 nt, hsa
ucaaaagacaguuuuaggaagucuuauuuauugauuuuaaaaguuuuacauguaggaguguggg

SEQ ID NO: 549145 - RNA, 64 nt, hsa
uuucuauaaauuacuaauuguaaaaagucuugcuuuuuaaaacaaguugguaaugcauaucaug

SEQ ID NO: 549146 - RNA, 64 nt, hsa
uuuucuuuuugauacuccagguuuauaaacuaucuuuuaaaauuuuaagccaggacuucaaaaa

SEQ ID NO: 549147 - RNA, 64 nt, hsa
ccauuuuccuauuauguuugauaauuauauguauuuuuaaaaacugugagaggaaaaauuaguc

SEQ ID NO: 549148 - RNA, 64 nt, hsa
caaacauuuacauuuguuuuuuacaauaaauuucuuuuaaaauauacuuucuauuuuucuguac

SEQ ID NO: 549149 - RNA, 64 nt, hsa
uucaguaacaaagguuuaaaguuugaagauuauuuuuuaaaaagguaaaugguuaaauuuuaca

SEQ ID NO: 549150 - RNA, 64 nt, hsa
uauuuuaucuauuggccuguuccccaaauggccauuuuaaaaugcuuggguacacuucucuuaa

SEQ ID NO: 549151 - RNA, 64 nt, hsa
cucuaguaguauauuuaauuuugacauaaguaacuuuuaaaauuugucuuaaaaauuuauacac

SEQ ID NO: 549152 - RNA, 64 nt, hsa
ucucuuuuauucauuuauuuaacauacugucuaauuuuaaaaauagguuuuuaaagcuuucauu

SEQ ID NO: 549153 - RNA, 64 nt, hsa
aagucacuaaacuuuuacacacucccaaacgucuuuuuaaaaauugcuugggaaauuauuaaau

SEQ ID NO: 549154 - RNA, 64 nt, hsa
guaacuauguucugaaaacacugcauuuaagaauuuuuaaaaauugguuuucuaaaauuaaaau

SEQ ID NO: 549155 - RNA, 64 nt, hsa
uuguugauuugaggauauaauaauguuuuaaucuuuuuaaaauauaagugguuauucucugacu

SEQ ID NO: 549156 - RNA, 64 nt, hsa
auuuuuuuucuauuaaaacuguuguuaaaauauuuuuuaaaacaaaaacauuauuugugcccuc

SEQ ID NO: 549157 - RNA, 64 nt, hsa
uaauaucagucauccagaaguacacguuucuguauuuuaaaaaauacuuugaugcauuuauuuu

SEQ ID NO: 549158 - RNA, 64 nt, hsa
ucucauucauguuuucuacuuucauuucuuaagcuuuuaaaauucauuuaauuaauauucuguu

SEQ ID NO: 549159 - RNA, 64 nt, hsa
auacugaucagaauuaaauuuguauagagcagaguuuuaaaaugaauguaaauagcacuaaacg

SEQ ID NO: 549160 - RNA, 64 nt, hsa
cuuccuaaaaauugagagguuuccuuuuauuaacuuuuaaaauaaagaaauaaguaguuucauu

SEQ ID NO: 549161 - RNA, 64 nt, hsa
uuuggacauuuaaccaagauacuaagaagguuuuuuuuaaaaaaagagauuugauuauuuuucc

SEQ ID NO: 549162 - RNA, 64 nt, hsa
ucucauuaggcaauuuaugcuuuaauggucaagcuuuuaaaaauuuguauuugauaacauccug

SEQ ID NO: 549163 - RNA, 64 nt, hsa
uuuuguugauaaaauacgaagaaauuccugcaauuuuuaaaaaacaaguuuggaauuuuuuuca

SEQ ID NO: 549164 - RNA, 64 nt, hsa
ucauaucaccgcugcauaacaacacagugcaucuuuuuaaaacaaggaaaagggaaaaaaagga

SEQ ID NO: 549165 - RNA, 64 nt, hsa
cuuccuggagauggcuacaucccuacuaauauaauuuuaaaaugagaacuuuauauauauuacu

SEQ ID NO: 549166 - RNA, 64 nt, hsa
uguuuagauaaaauugaaguacuuaauugaagcuuuuuaaaaauuguaaaguaaaugaaagcua

SEQ ID NO: 549167 - RNA, 64 nt, hsa
agaaaaggaagauguucuguagcaagggggaauauuuuaaaaauaaaccagaucaaauuaauac

SEQ ID NO: 549168 - RNA, 64 nt, hsa
aauugaagauagguuuagcaguaaagaagaaagcuuuuaaaaggauugauucagcuaagcaaag

SEQ ID NO: 549169 - RNA, 64 nt, hsa
cuucuggacuuuccuuacuuaacugacaguuaccuuuuaaaauuugcacacauuaugauuaaaa

SEQ ID NO: 549170 - RNA, 64 nt, hsa
acugcaaaagucuaaaauacccauuggugauguuuuuuaaaaaaaucuugcuuucagcuuucag

SEQ ID NO: 549171 - RNA, 64 nt, hsa
auagagucaccuguuuguuauguggauuaaauaguuuuaaaauacauauuugaagaccuuugag

SEQ ID NO: 549172 - RNA, 64 nt, hsa
ucaagcuuuuugcaucauacauuuuuugaaagauuuuuaaaaaagccuacaacuuacauaugua

SEQ ID NO: 549173 - RNA, 64 nt, hsa
auauacccaucuacucccaacauggauauaaguuuuuuaaaaaaauaguuguauauaacauaca

SEQ ID NO: 549174 - RNA, 64 nt, hsa
acacaggucuuuauucccuuuugaaugagacaguuuuuaaaaguugauuuauaaauacaaaaau

SEQ ID NO: 549175 - RNA, 64 nt, hsa
auauucaacaaaaaucuucaaagacugguuucuuuuuuaaaagaaaaaacuugaaagaacacuu

SEQ ID NO: 549176 - RNA, 64 nt, hsa
aaagcaguugaguaacagcaacauaaaccacauuuuuuaaaaaaaugagcacuuuucauucacu

SEQ ID NO: 549177 - RNA, 64 nt, hsa
gacaauuuguguuggaugguauucaaaaggaauuuuuuaaaacauuaagcaacaguguaaugau

SEQ ID NO: 549178 - RNA, 64 nt, hsa
uagucuaaaucacaaauacuuuacucaauuuaguuuuuaaaauaguaaacugaauauuuuuguu

SEQ ID NO: 549179 - RNA, 64 nt, hsa
ugaaugacauuggacuuuuaguaacaaacuuaauuuuuaaaaagguguagacaauggugguuaa

SEQ ID NO: 549180 - RNA, 64 nt, hsa
uuucaguguuuaaauuagugcuauuuuuccuuguuuuuaaaaaugaaucucguacuguaucuua

SEQ ID NO: 549181 - RNA, 64 nt, hsa
cagugguugaggaagcuaacagucuuagaucuacuuuuaaaacggauggccuucuuaagaauaa

SEQ ID NO: 549182 - RNA, 64 nt, hsa
aauccaugcauuguagagucuauaaaauguugaguuuuaaaagaugauauaaacuuugaugcug

SEQ ID NO: 549183 - RNA, 64 nt, hsa
cuauuuuggaauuacauaguuauguaaguaaaauuuuuaaaaaucauaaagggagcaccauugu

SEQ ID NO: 549184 - RNA, 64 nt, hsa
uauuaaacaauaauugaaaugaaaagcuuaccuauuuuaaaaagccaaauuuaaauaaauauag

SEQ ID NO: 549185 - RNA, 64 nt, hsa
ugcauuauuuauaauaaaauugcauucaguggcuuuuuaaaaaaauguuugauucaaaacuuua

SEQ ID NO: 549186 - RNA, 64 nt, hsa
ggcacaugugccagcugaauuuaaaauauaauacuuuuaaaaagaaaauuauuacauccuuuac

SEQ ID NO: 549187 - RNA, 64 nt, hsa
cuuuuaaaugaagcuuaaauuacucaauuuaaaauuuuaaaauccuuuaaaacaacuuuucaau

SEQ ID NO: 549188 - RNA, 64 nt, hsa
uuuaguuucauuuuggcuuuauguaauauaaaguuuuuaaaauuuuaaauaugguuuuaaccuu

SEQ ID NO: 549189 - RNA, 64 nt, hsa
cucaaaaacauuuugagcgaauaucaaaguuaacuuuuaaaaauugcgaaacuauuucagaauc

SEQ ID NO: 549190 - RNA, 64 nt, hsa
uaauauaacaugggcaaauaucugacuucuguauuuuuaaaaaguugccuucuccaguggcagu

SEQ ID NO: 549191 - RNA, 64 nt, hsa
acaugaacaucuuucacugacauuuuaaucauuauuuuaaaagcuuugcaaccuauauauuuau

SEQ ID NO: 549192 - RNA, 64 nt, hsa
auuguaacuuucauuagaaauaaguugcuuugacuuuuaaaaaugacauaguuagauuauuuaa

SEQ ID NO: 549193 - RNA, 64 nt, hsa
auugaauugguuugauuaaaaauaaagcuugcaauuuuaaaaguagcucacauuuaauuucuug

SEQ ID NO: 549194 - RNA, 64 nt, hsa
aaaaacauuuauuuuaugagugaugaauuauagauuuuaaaaucaaggccgggcgugguggcuc

SEQ ID NO: 549195 - RNA, 64 nt, hsa
uugaccugccugagaagcuucauaaaguauguuuuuuuaaaauauauuuuaauuacauuuaaaa

SEQ ID NO: 549196 - RNA, 64 nt, hsa
uaagggagaggaucuugucguagagucuaauguuuuuuaaaauuggugccagcaauucacgauu

SEQ ID NO: 549197 - RNA, 64 nt, hsa
gaguaugguucccaauuuuuaaauccauuucauuuuuuaaaaaauaagggaaauaaauguaauu

SEQ ID NO: 549198 - RNA, 64 nt, hsa
acuuauucuagggcacacaaacacuauuuuacuuuuuuaaaaucauaaaacggcagaacagauu

SEQ ID NO: 549199 - RNA, 64 nt, hsa
uuaugcuucuugaggugguaaugagaaaaaaguuuuuuaaaaaagugugccuugcuguauuucu

SEQ ID NO: 549200 - RNA, 64 nt, hsa
gaaaaaguaaauugggaggacuuaauggaaggucuuuuaaaaaguuaacuuggagcuucuguau

SEQ ID NO: 549201 - RNA, 64 nt, hsa
uauauauacaugcacacacaccgauacauuuaccuuuuaaaaaaaugauuuauaagugaacugu

SEQ ID NO: 549202 - RNA, 64 nt, hsa
aucucuagaaaagaugugguuuguuuuggcacuguuuuaaaaacucaaauauuuuaaacauuug

SEQ ID NO: 549203 - RNA, 64 nt, hsa
cggaacuggcuccauuagaccaugguucauccucuuuuaaaaccaaauuuuuuuuucuucuggc

SEQ ID NO: 549204 - RNA, 64 nt, hsa
aauuuuuuuuucuucuggccuacaaguauuuuuuuuuuaaaaaagaaaaaaagccuacauuggc

SEQ ID NO: 549205 - RNA, 64 nt, hsa
ucuuaauugauuuuacagucuguaaugcuugauguuuuaaaauaauaacauuuuuauauuuuuu

SEQ ID NO: 549206 - RNA, 64 nt, hsa
gcuugauguuuuaaaauaauaacauuuuuauauuuuuuaaaagacaaacuucauauuauccugu

SEQ ID NO: 549207 - RNA, 64 nt, hsa
cucuuuccucucuauucgcuuucuccuguuuuuuuuuuaaaaaaaaagcaugaaaaaggaagag

SEQ ID NO: 549208 - RNA, 64 nt, hsa
uccucaauaucaacuccaguuuaaaaaguguuauuuuuaaaacauuugaaaccaaguacuguuu

SEQ ID NO: 549209 - RNA, 64 nt, hsa
cugcaauagaugacacugaugguuuuacuccuuuuuuuaaaaacacaugcgcgcgcacacacac

SEQ ID NO: 549210 - RNA, 64 nt, hsa
cuuccuuucuuauuacuuuccuaauuuuucuauauuuuaaaaacuacaguuuccaugauaaaag

SEQ ID NO: 549211 - RNA, 64 nt, hsa
uguuucugugaaacaauuauuuuaaauauuuuucuuuuaaaaauaacuuuuuaucaguacagaa

SEQ ID NO: 549212 - RNA, 64 nt, hsa
auuguuuaagggaaaagaaaagaguaauaauuuuuuuuaaaacauuaaggaauuggaauucaga

SEQ ID NO: 549213 - RNA, 64 nt, hsa
aagauuuaagaaugauuaaaaauaagcuuuuacuuuuuaaaaccacuugagguuucauaaagcu

SEQ ID NO: 549214 - RNA, 64 nt, hsa
cuucugugcgaccaaugagacgacuucagcaucuuuuuaaaauaaucuaagcaucauugaagca

SEQ ID NO: 549215 - RNA, 64 nt, hsa
gaaaguaacccacauucuguucaggauacuuuuguuuuaaaaggcuaaaauguuugugugcuuu

SEQ ID NO: 549216 - RNA, 64 nt, hsa
ggugagcugagguagaaaaaaaacaagaaaaaaauuuuaaaaauagcguuaaaaugcauuuuag

SEQ ID NO: 549217 - RNA, 64 nt, hsa
uugcaguuagcuauagacaucccauuguguuaucuuuuaaaaggcccuugacauuuugcguuuu

SEQ ID NO: 549218 - RNA, 64 nt, hsa
uuuggaugguuauugauaucuuuguaguagcuuuuuuuaaaagacuaccaaaauguaugguugu

SEQ ID NO: 549219 - RNA, 64 nt, hsa
uugaaauacaguuuugaguuauuuugauguggcuuuuuaaaaaaguuaauggguagcuaauguu

SEQ ID NO: 549220 - RNA, 64 nt, hsa
caaauguaaauguuuugaggauauuuuucuuguuuuuuaaaaucaauuuuuaaccaaauauuaa

SEQ ID NO: 549221 - RNA, 64 nt, hsa
auuaaacuguaaauaacuugcccugggggccuuuuuuuaaaaaacaaaaaccacaaaaauuccc

SEQ ID NO: 549222 - RNA, 64 nt, hsa
ugauacaaucauuaauggaucauacacaauagguuuuuaaaaauuaauaacuuuuaguaauuac

SEQ ID NO: 549223 - RNA, 64 nt, hsa
gauacaaccauuaaugaaucauacacaauagguuuuuuaaaauuaauauuaauaacuuuuauua

SEQ ID NO: 549224 - RNA, 64 nt, hsa
cuuccauuugcucacuucucucuucacccaucuuuuuuaaaaacaaauaaaugaauaaagcugc

SEQ ID NO: 549225 - RNA, 64 nt, hsa
ucuguuaaagucuuaaaauggaaugagaauguuguuuuaaaagaaaauagcaaaacaacaaaaa

SEQ ID NO: 549226 - RNA, 64 nt, hsa
uggcugcacaagauauccauuacguacuuauacauuuuaaaaugaguacuaauuuucacugcua

SEQ ID NO: 549227 - RNA, 64 nt, hsa
ggacacaucaaagcuggccaaaauaaugaauuuuuuuuaaaaagcaauaccugguuuccaccuu

SEQ ID NO: 549228 - RNA, 64 nt, hsa
aagaaucugccagaaaaacuuacauguaucagauuuuuaaaaauauaaauagagaacauuuugc

SEQ ID NO: 549229 - RNA, 64 nt, hsa
aacaaaacugauaaaacaguuuuucgaaacuuacuuuuaaaagcauacgugcuaugacucucuc

SEQ ID NO: 549230 - RNA, 64 nt, hsa
uuuaaaugugggcaaaaaggcauuuucuccaagauuuuaaaacuaauucuuauuuuuaaauggu

SEQ ID NO: 549231 - RNA, 64 nt, hsa
caaaauuugucaguacauuuuacguguagaagcauuuuaaaaaucauuucuagcaagcacuuga

SEQ ID NO: 549232 - RNA, 64 nt, hsa
aggauuccaggaguaagccuguagaagagauuuauuuuaaaagagauugcucugaaauuuaucu

SEQ ID NO: 549233 - RNA, 64 nt, hsa
gagcuugcucugucuaccuugacagaaauuggaguuuuaaaauuauguguuaauauuuuuauuu

SEQ ID NO: 549234 - RNA, 64 nt, hsa
gcuacuuuuccuaguuuucaguauuacuuucauguuuuaaaaaucccuuuaauuucuugcuuga

SEQ ID NO: 549235 - RNA, 64 nt, hsa
ucacccuuuaacacaaaaaaagcaaggugauguauuuuaaaaaaggaaguggaaauaaaaaaau

SEQ ID NO: 549236 - RNA, 64 nt, hsa
aauauccaacuuaugugacuaaacgcaguaguuuuuuuaaaaggggagauagaaaauaaauggu

SEQ ID NO: 549237 - RNA, 64 nt, hsa
agacccaaaguggcacugaauuuucuugcucaccuuuuaaaaacuuguuccuuaauuuuagcca

SEQ ID NO: 549238 - RNA, 64 nt, hsa
uagguuuguguaaguacacucugugauuguacaauuuuaaaaucuccuaaugaugaugcauuuc

SEQ ID NO: 549239 - RNA, 64 nt, hsa
ugaacaaauuuugauaaaguaugaauuuguuuuauuuuaaaaagcaaacauacuaaauuuuuuu

SEQ ID NO: 549240 - RNA, 64 nt, hsa
gcuaugauacaugaagaacauuccaugaaguauguuuuaaaaccuuguuauaucugagaggcuu

SEQ ID NO: 549241 - RNA, 64 nt, hsa
uuguauaguacuagguuagaacauugcuuaauccuuuuaaaaaaaaugcauuuacguaaacacg

SEQ ID NO: 549242 - RNA, 64 nt, hsa
cuucuuuaaaaaaaaaaaagaaucugcgguauuuuuuuaaaaaaaaaguuuaccgcuguagugu

SEQ ID NO: 549243 - RNA, 57 nt, hsa
aacauggaaaaaauuuuugagcugauuuuuuaaaaauuuaaguuuuguaagagcuuu

SEQ ID NO: 549244 - RNA, 64 nt, hsa
aauuuaguuggcaauuuauaauagaacuuauagcuuuuaaaagaccuuuuaaagacauuaaaug

SEQ ID NO: 549245 - RNA, 64 nt, hsa
ugagaucugaugagaaugguuguuauaaacuuuauuuuaaaaccaaauuuagguguucuuacau

SEQ ID NO: 549246 - RNA, 64 nt, hsa
ucacuacuuaaauuauucccaagauuugaauuuauuuuaaaauuuuaauagccaccaagaaugu

SEQ ID NO: 549247 - RNA, 64 nt, hsa
aguaucacauuuauaaauaccaaagauguaacaauuuuaaaauuuucuagauuacuccaauaaa

SEQ ID NO: 549248 - RNA, 64 nt, hsa
ugaaaagcugauaccucaaucuuuacuacuguauuuuuaaaaaugaagguuguuauugcaaguu

SEQ ID NO: 549249 - RNA, 64 nt, hsa
aagugcuacauaaaacacuucuuaaacuuuuuuuuuuuaaaaacugcuccuuguggagcaggac

SEQ ID NO: 549250 - RNA, 64 nt, hsa
uaucagguaaauccugguaauuaaaaacgcauguuuuuaaaaauuagccugguaaggccgggug

SEQ ID NO: 549251 - RNA, 64 nt, hsa
uguaaaaacacaaauuuuauaaaauuguacaguuuuuuaaaaacuacucacaacuagcagaugg

SEQ ID NO: 549252 - RNA, 64 nt, hsa
augugauuuaauguauguuuaauuugauaucauguuuuaaaauauccuacuucugguagccauu

SEQ ID NO: 549253 - RNA, 64 nt, hsa
uaaggaagguguacuuaaaaaauguuuggacugcuuuuaaaaccugagcaaugucauuaaucca

SEQ ID NO: 549254 - RNA, 64 nt, hsa
uauaucugaaauuuguaauaaaaucaacuucauauuuuaaaaauuccaacuaucugcuugcauu

SEQ ID NO: 549255 - RNA, 64 nt, hsa
uugccauaguugcaaguccuuaggaucuuccuuguuuuaaaaaacuaucaaaguagguuaaauu

SEQ ID NO: 549256 - RNA, 64 nt, hsa
uuuauaaaugauuuuuuauuuaaaaauuugagauuuuuaaaauuuuucacagcacaggucuucu

SEQ ID NO: 549257 - RNA, 64 nt, hsa
gagaagugcuucaaauuauuuuguuuggauuaauuuuuaaaauguaaagcauauacuuguugcu

SEQ ID NO: 549258 - RNA, 64 nt, hsa
aauuuuaaaaaauaaaaauuuuaucucucaccaauuuuaaaauggcucaaacaucucucauuaa

SEQ ID NO: 549259 - RNA, 64 nt, hsa
uucuuuacagugaauaacuacaagcugacucuaauuuuaaaaaauaaaaauuuuaucucucacc

SEQ ID NO: 549260 - RNA, 64 nt, hsa
uuccaguaaccagguaguccugguacuccuuuaguuuuaaaauuaggaguuaagagagaagagg

SEQ ID NO: 549261 - RNA, 64 nt, hsa
gaacuuugcaaacauaaucauuguucucacccucuuuuaaaaaaaaaaaucggucuucaaagau

SEQ ID NO: 549262 - RNA, 64 nt, hsa
uuuucuguccuaugacaguucuaugcuaaauguauuuuaaaauaaaagccaaauugaagauuaa

SEQ ID NO: 549263 - RNA, 64 nt, hsa
acuuuaucuuaaguuacauauaaucaagcaaauauuuuaaaaaauguaugucagggugacaggc

SEQ ID NO: 549264 - RNA, 64 nt, hsa
uuuuuuguaacuuuacacuuuuuugguuauuuuauuuuaaaaaaaugaaaaauuaauuuaaaaa

SEQ ID NO: 549265 - RNA, 64 nt, hsa
ggugcuaaaguuccccaguucauaugugacaucuuuuuaaaaaaaauaacaacaaaaaaaaaau

SEQ ID NO: 549266 - RNA, 64 nt, hsa
cuuuucauuaggggcuuaagcuagcuccuuuggcuuuuaaaaaaaauuuuuuuucaaauuucuu

SEQ ID NO: 549267 - RNA, 64 nt, hsa
ccuuucuuucuuucuguaccuucaaguucuugauuuuuaaaauuccaacucuagagaaaaccaa

SEQ ID NO: 549268 - RNA, 64 nt, hsa
gucacuaucguaaacauucaugauagggcaaggauuuuaaaacaggauucuugcuucuguaguc

SEQ ID NO: 549269 - RNA, 64 nt, hsa
uuuuaaaaaauauauauauaaaauauuuuuuucuuuuuaaaauagacacuauaguuuuacccau

SEQ ID NO: 549270 - RNA, 64 nt, hsa
ucuaaagucccuauaguauaugauuauaaugcuauuuuaaaaaauauauauauaaaauauuuuu

SEQ ID NO: 549271 - RNA, 64 nt, hsa
cugguuaaagguaugauuauaagagagcuuauuguuuuaaaaaguuauauaaaggcaaggaaau

SEQ ID NO: 549272 - RNA, 64 nt, hsa
agauguaaccacuauaaauauguagaagaggaaguuuuaaaagaccuuaagcuggcauugugaa

SEQ ID NO: 549273 - RNA, 64 nt, hsa
cacaugcaauuagacauauucagcauauuuguuauuuuaaaagggaggguugggagguuucuua

SEQ ID NO: 549274 - RNA, 64 nt, hsa
aaccaagugauuuccagcugauguaucuaauauuuuuuaaaacgaacauuauagagguguaauu

SEQ ID NO: 549275 - RNA, 64 nt, hsa
acuuuugaaaugcaggauaugaugagugggaugauuuuaaaaaugccucuuuaauaaacuaccu

SEQ ID NO: 549276 - RNA, 64 nt, hsa
auaacaucacuauuuggcuuuuguuuugcaugauuuuuaaaagcaguacuccuagggaaauggc

SEQ ID NO: 549277 - RNA, 64 nt, hsa
cuuuuagauaauaaauaacgggcuuuauuguuuauuuuaaaagcuacaauuuguuuuagcuggu

SEQ ID NO: 549278 - RNA, 64 nt, hsa
ugaaucugagacgaauacaacuuuuaaaaauuguuuuuaaaaauagacuuuuuuuuuuagagca

SEQ ID NO: 549279 - RNA, 64 nt, hsa
ugugauaauauuuugaaucugagacgaauacaacuuuuaaaaauuguuuuuaaaaauagacuuu

SEQ ID NO: 549280 - RNA, 64 nt, hsa
uucaguauuuuaugauaaucacuucguuuuuaguuuuuaaaauuuagauuauucuauaauuuac

SEQ ID NO: 549281 - RNA, 64 nt, hsa
ugaauuuuaucagauauccaaaguaaaggaaauguuuuaaaacugcaacaagagacacagacag

SEQ ID NO: 549282 - RNA, 64 nt, hsa
auuuagaaugaccucuaacacuccuguaauugucuuuuaaaauacugauauuuuuauuuguuaa

SEQ ID NO: 549283 - RNA, 64 nt, hsa
gaaacagauuuguuaacugaacucuuaauuauguuuuuaaaauguuuguuauauuucuuuucuu

SEQ ID NO: 549284 - RNA, 64 nt, hsa
caaguuaguuaacaugaaccuucauuuguaaauuuuuuaaaauuucuuuuauaauaugcuuucc

SEQ ID NO: 549285 - RNA, 64 nt, hsa
auuccgauuuggaaccuuagaugucuauuugauuuuuuaaaaaaccuuaauguaagauaugacc

SEQ ID NO: 549286 - RNA, 64 nt, hsa
auuaaacgaguuuuugagcaaauuaggugacuuguuuuaaaaauauuuaauuccgauuuggaac

SEQ ID NO: 549287 - RNA, 64 nt, hsa
uugcacuguaacuauaauaccucuuaauuuaccuuuuuaaaagcugugggucagucuugcacuc

SEQ ID NO: 549288 - RNA, 64 nt, hsa
uacuaaaauuucugucauauguauacugaagacauuuuaaaaaccagaauauguagucuacgga

SEQ ID NO: 549289 - RNA, 57 nt, hsa
cucagguucccaauagcugaaaccgcuuuuuaaaauucaaaacaagaaacaaaacaa

SEQ ID NO: 549290 - RNA, 64 nt, hsa
aacaugaccaucgucaaagaccugcucaagaaauuuuuaaaaaagaaacaaaguuaugggguua

SEQ ID NO: 549291 - RNA, 64 nt, hsa
uauaguuucucuaaaacuuuaucugaaagagucauuuuaaaauaacuauuaaacaauguaacug

SEQ ID NO: 549292 - RNA, 64 nt, hsa
cugcuaucuuaauguucugaaauaaguuaaaacauuuuaaaauaugaauacuguaaaggaaaua

SEQ ID NO: 549293 - RNA, 64 nt, hsa
agauauauguugucugcuuuaaacaauuuuuaaauuuuaaaaaugcauuaacgucuuuuuauau

SEQ ID NO: 549294 - RNA, 64 nt, hsa
uucugagagaugaaucaauaaugaaacaugucuguuuuaaaaacuaccacaugugacuccuauu

SEQ ID NO: 549295 - RNA, 64 nt, hsa
gccuacaaugaauagguauggugguuucacagaauuuuaaaauagaguuaaagggaagugaugu

SEQ ID NO: 549296 - RNA, 64 nt, hsa
ccugaauuaaguguuaauuugauggaaacucugcuuuuaaaaucaucauuuacuggguucuaau

SEQ ID NO: 549297 - RNA, 64 nt, hsa
auauuuauauguaaguuuuucaaauuuugcuuaauuuuaaaauuuauuauuuugaucuugaauu

SEQ ID NO: 549298 - RNA, 64 nt, hsa
ucuuaguguaguuaugauguggauccuacguauuuuuuaaaaaacucuccagauaauuuugaug

SEQ ID NO: 549299 - RNA, 64 nt, hsa
aauauauuugaaugcauggguagaaaauaucauauuuuaaaacuauguauauuuaaauuuagua

SEQ ID NO: 549300 - RNA, 64 nt, hsa
gacaaaagaaaauacacacuaaaacuaaucuucauuuuaaaaggguaaaacaugacuauacaga

SEQ ID NO: 549301 - RNA, 64 nt, hsa
uuugugcaaaauauacauauaagcagaguaagccuuuuaaaaauguucuuugaaagauaaaauu

SEQ ID NO: 549302 - RNA, 64 nt, hsa
cacauaaggagacauagguuauaaacuaguuaucuuuuaaaaggcucagcaacacaacucuuga

SEQ ID NO: 549303 - RNA, 64 nt, hsa
uuuauucuaaaaaaaaaaauggaaacuuuaauuuuuuuaaaacgagaauuucauuuacagcuac

SEQ ID NO: 549304 - RNA, 64 nt, hsa
uggcccugaguucaauauauuauuaacagcaguauuuuaaaacuuaggguugaacugggcaugg

SEQ ID NO: 549305 - RNA, 64 nt, hsa
uuucauuagauugguuguaccaugucaccuuagcuuuuaaaaauacucuuuucagauucacguu

SEQ ID NO: 549306 - RNA, 64 nt, hsa
gugucauuuaguaaggauuuuaugaguucuuguuuuuuaaaauccagacuuucuuuuucuacau

SEQ ID NO: 549307 - RNA, 64 nt, hsa
uuuucuguauuuaauuauaaaaaauuaacuuaguuuuuaaaauuuauuugcaaauauacuuuac

SEQ ID NO: 549308 - RNA, 64 nt, hsa
uaaaaugcuccuagaagucuuaauuguguuuauuuuuuaaaaaaacaaauguuagacuugugug

SEQ ID NO: 549309 - RNA, 64 nt, hsa
gcagagaccaucugugaccauagccuagcuagcauuuuaaaaggggaaauuuuguucucuaggu

SEQ ID NO: 549310 - RNA, 64 nt, hsa
uaaggcacucucugucucuaauccuuaggaguuguuuuaaaagacauaaucacuuugaacuucc

SEQ ID NO: 549311 - RNA, 64 nt, hsa
acuacaggcucugucucaggagagcauaggcacauuuuaaaagguuauguacuagguuuuugug

SEQ ID NO: 549312 - RNA, 64 nt, hsa
ucuagcacuuaccugaaaacuuaguauggagcucuuuuaaaaugugauuauuuauauuuauguu

SEQ ID NO: 549313 - RNA, 64 nt, hsa
uacuuguagccuggauagcagacuguguucaacuuuuuaaaaagauguuuccuuucuaaagauu

SEQ ID NO: 549314 - RNA, 64 nt, hsa
uuucucuaaauguacacugauucugugugugugauuuuaaaaggagaauaugguucaagcaagu

SEQ ID NO: 549315 - RNA, 64 nt, hsa
gucagcugaagaccucacuggagugggucuuaauuuuuaaaaagugucucacuacauuuaagac

SEQ ID NO: 549316 - RNA, 64 nt, hsa
gugcuggagaauuccaguuguauuugaagacugauuuuaaaacuuuucugcauuugguaaaggu

SEQ ID NO: 549317 - RNA, 64 nt, hsa
aacuuaaugugcugcugcuuuuccauaaccaacauuuuaaaaauaaaugaaaaacaggaauugg

SEQ ID NO: 549318 - RNA, 64 nt, hsa
uuagucguauuccuucaccugaugaauaacaguguuuuaaaacauauuugaaagguaaguaaaa

SEQ ID NO: 549319 - RNA, 64 nt, hsa
ucugugauuggggauuugcguuauaaaaugaauauuuuaaaaagcaacagcccuaauagccucu

SEQ ID NO: 549320 - RNA, 64 nt, hsa
auccuuaucuuuguuccucuuuacauaauguuccuuuuaaaaaaaaucacugauuaugaugugc

SEQ ID NO: 549321 - RNA, 64 nt, hsa
aaguugucucacagcucacuuguauucuguugacuuuuaaaaaauuaugcuuucuguuucacug

SEQ ID NO: 549322 - RNA, 64 nt, hsa
uuugggucuuuuuauauauguucugugucuaaccuuuuaaaaccuggaacacagauauaacaau

SEQ ID NO: 549323 - RNA, 64 nt, hsa
gccccuccccaaaagaaaccaugacaaaccuagcuuuuaaaaaauauuuuaagaaagagaauga

SEQ ID NO: 549324 - RNA, 64 nt, hsa
aacccuuuguauuauaauuguugauauuuucccuuuuuaaaaaauaccauugaaaucagcauga

SEQ ID NO: 549325 - RNA, 64 nt, hsa
gauugauucaguaucuuagaguuuacaguuuguguuuuaaaaaaacugaagguuuuuuuuuuaa

SEQ ID NO: 549326 - RNA, 64 nt, hsa
gcaucucgauuucuaucucuaguuagaguuguacuuuuaaaaaaauuaacgggaaagaaaauaa

SEQ ID NO: 549327 - RNA, 64 nt, hsa
aagaaaauaacuuugugaagccaguguauucuguuuuuaaaacugugccugcagugcaauacuc

SEQ ID NO: 549328 - RNA, 64 nt, hsa
auagagcauauaacuucugauuugauaguauuuauuuuaaaaaauuauguuuucaucauucauu

SEQ ID NO: 549329 - RNA, 64 nt, hsa
ugauuugugaacugagagcagcaacaacauuauuuuuuaaaaaucuuaaauccucucaauggau

SEQ ID NO: 549330 - RNA, 64 nt, hsa
cauuaaccuggaagcuuucaugaauauucucuucuuuuaaaacauuuuaacauuauuuaaacag

SEQ ID NO: 549331 - RNA, 64 nt, hsa; identical to SEQ ID NO: 549292

SEQ ID NO: 549332 - RNA, 64 nt, hsa; identical to SEQ ID NO: 549291

SEQ ID NO: 549333 - RNA, 64 nt, hsa
uguaacugcuaucuuaauguucugaaauaaaacauuuuaaaauauaaauccuguaguuuaaaag

SEQ ID NO: 549334 - RNA, 64 nt, hsa
gcccauggguuuaaaacuguaucuuaaagagucauuuuaaaauaauauaaauauuaaaaaaugu

SEQ ID NO: 549335 - RNA, 64 nt, hsa
aacaccaccaucaucaaagagcugcucaagaaauuuuuaaaaacgaaacaaaguuaugggguua

SEQ ID NO: 549336 - RNA, 64 nt, hsa
auuacuguaaguuuuagauucuaagguucaagauuuuuaaaauuugauuuaaaugaagaaaugg

SEQ ID NO: 549337 - RNA, 64 nt, hsa
auauuguaugcuuacaaaagcuguaaaaaugaacuuuuaaaacucccaccagcuuuuaacagua

SEQ ID NO: 549338 - RNA, 64 nt, hsa
uaaugagcuaaugugauaucuauaggucacaauuuuuuaaaaccaaaauuuucaagucugggau

SEQ ID NO: 549339 - RNA, 64 nt, hsa
uguaucuguaagaucagccuuucccaagguauacuuuuaaaauuuaaagcguguacuguguugc

SEQ ID NO: 549340 - RNA, 64 nt, hsa
cccagcgccuuuuaaaaguuguuaugugguuuucuuuuaaaaagcuccuguuuuuggaaaguag

SEQ ID NO: 549341 - RNA, 64 nt, hsa
agcauugaucuagaagcagaggaaucccagcgccuuuuaaaaguuguuaugugguuuucuuuua

SEQ ID NO: 549342 - RNA, 64 nt, hsa
ggacacuuacugauuaauuuuuaacaagguagaauuuuaaaauaaaagauuuauaaauaacuuu

SEQ ID NO: 549343 - RNA, 64 nt, hsa
gacuauuagaaguaacuaaguauuguuauaaguuuuuuaaaaacaacuggaggcaucuuuguac

SEQ ID NO: 549344 - RNA, 64 nt, hsa
aaauuuauugcacacuuuaaaguguaaaaucauuuuuuaaaaucuugaauccacaaauaaaguu

SEQ ID NO: 549345 - RNA, 64 nt, hsa
aacacaauucauuuugauuauaaacuauuugacuuuuuaaaaucuucugacacaguaaauauau

SEQ ID NO: 549346 - RNA, 64 nt, hsa
aauuuguauuaaauuuauuacuauuucuuaugccuuuuaaaauacuguuuacuaugaagacaau

SEQ ID NO: 549347 - RNA, 64 nt, hsa
gaaauaauucauugguaaaguguaauaaugcguuuuuuaaaaaugcuuugagagguaauuacuu

SEQ ID NO: 549348 - RNA, 64 nt, hsa
guaauuucauagcaacuguucuaguguuuuguguuuuuaaaacagaauuaggaauuugagauau

SEQ ID NO: 549349 - RNA, 64 nt, hsa
cagaaucuauauagucuaaugcugacaacuucuauuuuaaaaaacaagacuuuacuuucuucug

SEQ ID NO: 549350 - RNA, 64 nt, hsa
gauauauauauauauauuuaucugaaacgugauauuuuaaaaacauguagguuuaacaaaccuu

SEQ ID NO: 549351 - RNA, 64 nt, hsa
cccacucagccccaaaugcccuggauuauaugauuuuuaaaacauuuuaagauacagcuacuca

SEQ ID NO: 549352 - RNA, 64 nt, hsa
acuuuuauacaaacugacauugucuacuauacauuuuuaaaagccauuuuacugguuuggcaug

SEQ ID NO: 549353 - RNA, 64 nt, hsa
ccccugggccugaaaacuuggagcaauuaauuuuuuuuaaaaaguguucuuuucacuugggaga

SEQ ID NO: 549354 - RNA, 64 nt, hsa
uauuuuuucuuuuuacacuaauaacuuuuaugccuuuuaaaauaaauuuauuuucauaaauggu

SEQ ID NO: 549355 - RNA, 64 nt, hsa
aauaaaauauauuuuguucuauugguagguuuuuuuuuaaaauuagaugaauauguuagucuuu

SEQ ID NO: 549356 - RNA, 64 nt, hsa
gcuuuauaggaggaguauaauguaugcacuacuguuuuaaaagaauuagugugaguguguuuuu

SEQ ID NO: 549357 - RNA, 64 nt, hsa
gguuaacaccagauggugccccucauugguguccuuuuaaaaaauauuuacuguaguccaauaa

SEQ ID NO: 549358 - RNA, 64 nt, hsa
aacuguuuacuaacuuugggacauccccuggaguuuuuaaaaauaaauaaauauauauauauau

SEQ ID NO: 549359 - RNA, 64 nt, hsa
agauugauauuuauacacuuuuuuauaaagcagauuuuaaaauauaguaacauccauuuuuuuc

SEQ ID NO: 549360 - RNA, 64 nt, hsa
aaaccagacaaagcauugacuuuuaaauguagacuuuuaaaauaaacuguuuucuuuuggaacu

SEQ ID NO: 549361 - RNA, 64 nt, hsa
guuguguuucggggggaaaagacauuuuagccuuuuuuaaaaguuacugauuuaauuucauguu

SEQ ID NO: 549362 - RNA, 64 nt, hsa
gauaguuuucuagcucucgggucccuuuauugcuuuuuaaaauaggguuugaaacaugccacag

SEQ ID NO: 549363 - RNA, 64 nt, hsa
uauguguuuaaaccuuuauaaaccaguauuucacuuuuaaaaagacaaggcaucucuacccauu

SEQ ID NO: 549364 - RNA, 64 nt, hsa
uguaauucuaaaagagaucuuauuuaaauuuccuuuuuaaaagccgcaugguucugugauccau

SEQ ID NO: 549365 - RNA, 64 nt, hsa
gcuuuugugucuuugacaucuaccacccuccuccuuuuaaaaaauuucuuuagaauuucucaau

SEQ ID NO: 549366 - RNA, 64 nt, hsa
uaguuccaucuagaacuccuuucuaguuuguuauuuuuaaaauguuuauacauaaaaccaccaa

SEQ ID NO: 549367 - RNA, 64 nt, hsa
augaagaaaugggugaaugagcuugucaaugugauuuuaaaaaauugacuaccuggaggaauga

SEQ ID NO: 549368 - RNA, 64 nt, hsa
gauucaaccaacugcaaauggaaaauacgauuuuuuuuaaaaaaaggaugguuacauccguauu

SEQ ID NO: 549369 - RNA, 64 nt, hsa
uagauugccucuccuggacauggcaaugaugaguuuuuaaaaaacaguguggaugaugauaugc

SEQ ID NO: 549370 - RNA, 64 nt, hsa
ggacuuuucuaggaaagacuuauguauaauugcuuuuuaaaaugcagugcuuuacuuuaaacua

SEQ ID NO: 549371 - RNA, 64 nt, hsa
cccauuuccuuuuguguuuuuauagucuauagcauuuuaaaacugcugauguuguuugcauuau

SEQ ID NO: 549372 - RNA, 64 nt, hsa
gucacaggcuggcuucuguuuuauucagggauuuuuuuaaaaagucaaucagaaaagggauacu

SEQ ID NO: 549373 - RNA, 64 nt, hsa
accuugcagauuuucuuaaggaauuuugucucacuuuuaaaaagaaggggagaagucagcuacu

SEQ ID NO: 549374 - RNA, 64 nt, hsa
gcuacucuaguucuguuguuuuguguauauaauuuuuuaaaaaaaauuugugugcuucugcuca

SEQ ID NO: 549375 - RNA, 64 nt, hsa
uaaauagccauacccaguuguacuacaaugagcuuuuuaaaaucuugaaugaauugaguauucu

SEQ ID NO: 549376 - RNA, 64 nt, hsa
uauuggaaauuauaaauggcaaccaaaaacuggcuuuuaaaaaauauuuuuggauaucauugau

SEQ ID NO: 549377 - RNA, 64 nt, hsa
aucuacaaugguuaccauaaaaaaucuggcaggauuuuaaaacucaaucagucuuuccuuugag

SEQ ID NO: 549378 - RNA, 64 nt, hsa
agaauaugaucaacgacuuguaguagacucaaguuuuuaaaaaacacuauuuuacuuaaacugu

SEQ ID NO: 549379 - RNA, 64 nt, hsa
ugcugcuggucaggacauuaaaauauugaaguguuuuuaaaaauuaaagaagaagaaaaguaaa

SEQ ID NO: 549380 - RNA, 64 nt, hsa
ugugugacagucaugugcacacaugggcgggggcuuuuaaaaaccuuucaggaagucaaugauu

SEQ ID NO: 549381 - RNA, 64 nt, hsa
guucugacgugugaaauuuaaggaaagagccauuuuuuaaaaaugccgagcagggcaaugcaag

SEQ ID NO: 549382 - RNA, 64 nt, hsa
uagaaaguagcuaauccaguguaaucuuuuaccuuuuuaaaaaccaagauagaguaucuauuag

SEQ ID NO: 549383 - RNA, 64 nt, hsa
uuugaaucagcauuugcaaaaaaauugucuugaauuuuaaaauaaacaacaaagauuuguucau

SEQ ID NO: 549384 - RNA, 64 nt, hsa
ugcaugggacaugcaugauaacucagaguugacauuuuaaaacuugccacacuuauuucaaaua

SEQ ID NO: 549385 - RNA, 64 nt, hsa
uuuccuuuuucagauaucuuggacaaaucacauauuuuaaaauuuguucuuguauuuauugguu

SEQ ID NO: 549386 - RNA, 64 nt, hsa
uucuuuucccccauuaaucaguucauuagaaauauuuuaaaaucagcuauuuugugaagccaug

SEQ ID NO: 549387 - RNA, 64 nt, hsa
uugaauuuguacuguuaacagcacauuuggaagauuuuaaaacuuuuuauugucuuauaaauag

SEQ ID NO: 549388 - RNA, 64 nt, hsa
guuuuuucgccaugugaugaagaccacugugauuuuuuaaaaaaguagauaauacuuaaaaugg

SEQ ID NO: 549389 - RNA, 64 nt, hsa
ggacagguuuucucagguuaagagaaaaacgaaauuuuaaaaacuuuaaaaaauacugauaaau

SEQ ID NO: 549390 - RNA, 64 nt, hsa
uuauguugugcucuuuauugccaaaaauaaacacuuuuaaaaagacaacuucuguuaaucaaua

SEQ ID NO: 549391 - RNA, 64 nt, hsa
ugacaucugguugacgccucaggugaaaaucugguuuuaaaauguaacuucugcacaggcuccu

SEQ ID NO: 549392 - RNA, 63 nt, hsa
auuauuuuaaaaguauauauuauugaauaaaagguuuuaaaagaaacguauggagaguuuuca

SEQ ID NO: 549393 - RNA, 64 nt, hsa
caguauguggcauggcggcaguuacauauuauuauuuuaaaaguauauauuauugaauaaaagg

SEQ ID NO: 549394 - RNA, 64 nt, hsa
uuguuauuuuguuugcacuuuuuuuugauuggcauuuuaaaaucgguauuuaaacugaagacau

SEQ ID NO: 549395 - RNA, 64 nt, hsa
agauauacuauuuuuuuccuuuuuuaauucaguuuuuuaaaaaaacaaauguauuguggcuucc

SEQ ID NO: 549396 - RNA, 64 nt, hsa
auauaaaacugcuuacauaguauacaaagcucuauuuuaaaauuuaauguuuauuuuaaauagg

SEQ ID NO: 549397 - RNA, 64 nt, hsa
auuuguguaaggagcacugcacucccauaaaagguuuuaaaauacaaaauguacaagaacacac

SEQ ID NO: 549398 - RNA, 64 nt, hsa
uuccuuaaaugaaaaguuauugaccaaauggacuuuuuaaaagacacaggacccuuaacuuugc

SEQ ID NO: 549399 - RNA, 64 nt, hsa
uccuuguuugucccauucauauaugaaaauagacuuuuaaaacuguccaacacuaaugguuuau

SEQ ID NO: 549400 - RNA, 64 nt, hsa
gaauagccuuuccucagucugagaaauuggucucuuuuaaaagacgaaucucaugaauauucac

SEQ ID NO: 549401 - RNA, 64 nt, hsa
aauucuacaaaauugcauguaacuuuauaaauauuuuuaaaagauauaguuuuguaaauauuua

SEQ ID NO: 549402 - RNA, 64 nt, hsa
aucuugcaguugggauuuugcaguuggauauuuauuuuaaaaaaaauuauaauauucagacuau

SEQ ID NO: 549403 - RNA, 64 nt, hsa
cugauauugauuuaaacuguguuucacuuacaaguuuuaaaaaaaugacaggguuuaauggagc

SEQ ID NO: 549404 - RNA, 64 nt, hsa
gauuguuaagaguucacugaagauauugacacaauuuuaaaaaaucaguaaaggaauguauaua

SEQ ID NO: 549405 - RNA, 64 nt, hsa
uguguguguguaugauguuuuguuuuuuuaaauguuuuaaaagcuuaauagguuggcaucaguu

SEQ ID NO: 549406 - RNA, 64 nt, hsa
auuuuuuucucauaaaauagucugauaagcuaauuuuuaaaaagaaaugccauuaacuguguug

SEQ ID NO: 549407 - RNA, 64 nt, hsa
agaaaaauaauauuugauuuugaaucuuaaauguuuuuaaaaauuagacuugaaugggcacaaa

SEQ ID NO: 549408 - RNA, 64 nt, hsa
auuuguuaaccuuacguuuucugucuguauauuuuuuuaaaaaucugguaguuucuggaaaaaa

SEQ ID NO: 549409 - RNA, 64 nt, hsa
auauguucuuguacugcauuuugaucaguugagcuuuuaaaauauuauuuauagacaauagaag

SEQ ID NO: 549410 - RNA, 64 nt, hsa
guuuauuucaugcacugugccuucaaaaugaaauuuuuaaaagggacuuuaaaugaaguugaau

SEQ ID NO: 549411 - RNA, 64 nt, hsa
uuaaaagggacuuuaaaugaaguugaauaguaguuuuuaaaagucaauuuguaauuuaugugaa

SEQ ID NO: 549412 - RNA, 64 nt, hsa
ccucagugggaagaaaaauaaaauuuccuucagguuuuaaaaacaugcagagagguguuuuaau

SEQ ID NO: 549413 - RNA, 64 nt, hsa
gccagcuuuucccaccaguggugcuguugagauauuuuaaaauauugccuccguuuuaucgagg

SEQ ID NO: 549414 - RNA, 64 nt, hsa
ugucucccugucuucuuuagaucggucugauugauuuuaaaaguggacccaaacuuagggaauu

SEQ ID NO: 549415 - RNA, 64 nt, hsa
uaggauauuuucccuaccuaagaauuucacugucuuuuaaaaaacaaaaaguaaaguaaugcau

SEQ ID NO: 549416 - RNA, 64 nt, hsa
aauauauauauuuuugugaauuauacuuuguuguuuuuaaaaagaaaaucaguugauuaaguua

SEQ ID NO: 549417 - RNA, 64 nt, hsa
uauauagaaaagaggagaggaaaacuauuccauguuuuaaaauuauauagcaaagauauauauu

SEQ ID NO: 549418 - RNA, 64 nt, hsa
gcaaugaucagauuguuaaucuacagauuuuauuuuuuaaaauuuggauguaaguagagacuuu

SEQ ID NO: 549419 - RNA, 64 nt, hsa
guccaaagugcuuagcgaaguaaaaaaaaaagcuuuuuaaaauuucuauuguugucuauuggua

SEQ ID NO: 549420 - RNA, 64 nt, hsa
agaacacuucagacacaggaaaaauaaacguggauuuuaaaaaaucaaucaauggugcaaaaaa

SEQ ID NO: 549421 - RNA, 64 nt, hsa
cugucuaccuuccuuauauuuuuuuccucaacaguuuuaaaaagaaaaaaaggucuauuuuuuu

SEQ ID NO: 549422 - RNA, 64 nt, hsa
agaaucuauuagauuuuagaaaaacauuuaaacuuuuuaaaauacuuauuaaaaaauuuguaua

SEQ ID NO: 549423 - RNA, 64 nt, hsa
uccaaaaugcuugggaccagaaguguuucagauuuuuuaaaauuuuggaauauuugcuuuauac

SEQ ID NO: 549424 - RNA, 64 nt, hsa
auuacugcuguggcuagagaguuugaggauugcuuuuuaaaaaagacagcaaacuuuuuuuuuu

SEQ ID NO: 549425 - RNA, 64 nt, hsa
uggcauccuucaauuucuguauaaaagcagaucuuuuuaaaaagauacuucuguaacuuaagaa

SEQ ID NO: 549426 - RNA, 64 nt, hsa
caguguauuccuaacagucuuuuguugucguuguuuuuaaaacaaagguacggaccaugugcua

SEQ ID NO: 549427 - RNA, 64 nt, hsa
uuuacgcuaagcuguauuuuuagugagcuaccccuuuuaaaaaggugaaaucuuucuuaacagg

SEQ ID NO: 549428 - RNA, 64 nt, hsa
uaucuuuuuagucuggauuucugcccugcuuagauuuuaaaaguauaagcauggauugccaauu

SEQ ID NO: 549429 - RNA, 64 nt, hsa
gauggguuuucuuguuuuguugauuauuugaggcuuuuaaaacaaguaguucaugaaagaagcu

SEQ ID NO: 549430 - RNA, 64 nt, hsa
cagagcaaaaaaauauagcguaaauacuuauuuuuuuuaaaaacuuacuuaaauuuguguguaa

SEQ ID NO: 549431 - RNA, 64 nt, hsa
guuauuagaccaggaaaacuuaauguaauauuauuuuuaaaaucaucuuaaaggauccaagucc

SEQ ID NO: 549432 - RNA, 64 nt, hsa
cagaaaagggagagcuaccaaauuguuuuuuucuuuuuaaaaggaaguuuaauguccguuguau

SEQ ID NO: 549433 - RNA, 64 nt, hsa
aaguuaguagagcuuguucuuguauugugaccuuuuuuaaaaaaaaggaacugagguucagaau

SEQ ID NO: 549434 - RNA, 64 nt, hsa
cuaggggcauuuucuuuaacuuccagaauagugauuuuaaaaguaaaaauaaaaauaaaccuua

SEQ ID NO: 549435 - RNA, 64 nt, hsa
ucugcuuuuuuccucugcucuucccuucuguaaauuuuaaaacauuuuccuccccucuggccag

SEQ ID NO: 549436 - RNA, 64 nt, hsa
ccuuaacagaaacaaaaauauauauauauauuauuuuuaaaaauuagcauugucauacaguaca

SEQ ID NO: 549437 - RNA, 64 nt, hsa
uuucauggucaagccuguaguauuaaaaugauuuuuuuaaaagauguaaacugugcuuaguuaa

SEQ ID NO: 549438 - RNA, 64 nt, hsa
ugauaguuuuauuaagcauggagaaauugccaauuuuuaaaaacugcaguuuuccaaacuuuuc

SEQ ID NO: 549439 - RNA, 64 nt, hsa
cuuuuuuaaauagaaacuuuaguuuuuuguaaauuuuuaaaaaaauauuucauugauaugcauc

SEQ ID NO: 549440 - RNA, 64 nt, hsa
aaaggcuucaguccacauuuuuuuauacguuguauuuuaaaaacguuugaaaggagucuuacac

SEQ ID NO: 549441 - RNA, 64 nt, hsa
cccugcugcauguaaugucucagaaucaacauucuuuuaaaaucuagacuauauuuugaggcaa

SEQ ID NO: 549442 - RNA, 64 nt, hsa
uuuuguguuuuugauguuuucuguuuguuuuguuuuuuaaaauagcaguuuacaaccagaauua

SEQ ID NO: 549443 - RNA, 64 nt, hsa
cacuaauaacaucaacaucugcuaucacuuaucuuuuuaaaacuaaccaaaaaaggccgggugc

SEQ ID NO: 549444 - RNA, 64 nt, hsa
uugggguuuuuuuucuaagcuucuuugucuuaaauuuuaaaauagugaauauguuugagacucc

SEQ ID NO: 549445 - RNA, 64 nt, hsa
auuggccagucaaaaaaaaaaagacuucaaucauuuuuaaaauuccuaauuuucagaaauauga

SEQ ID NO: 549446 - RNA, 64 nt, hsa
gauauuaaaauagugacaugaacuggcaaagugguuuuaaaagcuuucacgugggauaaaugau

SEQ ID NO: 549447 - RNA, 64 nt, hsa
guuauuuacaaugaaaaguuuuuaaaaauaaaauuuuuaaaaaucuaaauauggaccugcucaa

SEQ ID NO: 549448 - RNA, 64 nt, hsa
accuuuuucaugaaaguuauuuacaaugaaaaguuuuuaaaaauaaaauuuuuaaaaaucuaaa

SEQ ID NO: 549449 - RNA, 64 nt, hsa
augguagccuuugugaaauuuuccuaauugggccuuuuaaaaacauggcuggguggaacauuuc

SEQ ID NO: 549450 - RNA, 64 nt, hsa
ugugucuuuaacucuuaaauuguuugguccuauuuuuuaaaaaggaaagggcccuaaguagcuc

SEQ ID NO: 549451 - RNA, 64 nt, hsa
ugugcugcccuauauaaagguggcagaaagacauuuuuaaaaagcuuauuauuucuugcauuau

SEQ ID NO: 549452 - RNA, 64 nt, hsa
gacauuuuuaaaaagcuuauuauuucuugcauuauuuuaaaaaguucagaguugaaaugccuuu

SEQ ID NO: 549453 - RNA, 64 nt, hsa
uaaaaauauuuguuaucuucuuugccugccuguauuuuaaaaagaaauacaaaguuguaaaagu

SEQ ID NO: 549454 - RNA, 64 nt, hsa
uaaguuaaguuguaaagacuuuggaauaaguuucuuuuaaaaauaugacauagccagugaugug

SEQ ID NO: 549455 - RNA, 64 nt, hsa
cauaaaaagcuuaauuucaucccuuuuauguugguuuuaaaagguaaaugcuuaccauauuuua

SEQ ID NO: 549456 - RNA, 64 nt, hsa
aauaacucuaaugaauauucaagauauuuuagccuuuuaaaaaguugagauuuagcucauggau

SEQ ID NO: 549457 - RNA, 64 nt, hsa
augccuaauguuuucuuaaugaugacaacaaauauuuuaaaacugcauuuaucauuuuuuaggu

SEQ ID NO: 549458 - RNA, 64 nt, hsa
aacugcauuuaucauuuuuuaggucuucauuaaauuuuaaaauguaauaucuguuucccacccc

SEQ ID NO: 549459 - RNA, 64 nt, hsa
uuuuuauucuuaaacauagguguguuggcucuuuuuuuaaaagaugcgcucuaccugaaaagga

SEQ ID NO: 549460 - RNA, 64 nt, hsa
uucuuagagcuuugcacauuccuauucacugagauuuuaaaaauuucaccuuuauucgagggaa

SEQ ID NO: 549461 - RNA, 64 nt, hsa
gcuuuuucuccuaagguguggaacuuuuauuuuguuuuaaaaauaugaaucaaaauuccugugu

SEQ ID NO: 549462 - RNA, 64 nt, hsa
agugcaaggagcuccuuuguguugugaugauguguuuuaaaaguugcacuaucuuaauguugaa

SEQ ID NO: 549463 - RNA, 64 nt, hsa
agccacaagaaaucccaagagagcagaagcgaauuuuuaaaagauuuaucgugaggacugcauu

SEQ ID NO: 549464 - RNA, 64 nt, hsa
gggccuugccugcuauggaauauugagagagauuuuuuaaaaaagauuuugcauuuuguccaaa

SEQ ID NO: 549465 - RNA, 64 nt, hsa
acaagauauuuuucuuccauguauacaauaauuuuuuuaaaaagugcaauuugcguugcagcaa

SEQ ID NO: 549466 - RNA, 64 nt, hsa
augggauguccuauggaaaccuauuucaccagaguuuuaaaaauaaaaaggguauuguuuuguc

SEQ ID NO: 549467 - RNA, 64 nt, hsa
ugugacuugugguguaaaaugucuugaugauaauuuuuaaaacuuggguaacacuuccaaauau

SEQ ID NO: 549468 - RNA, 64 nt, hsa
cucuuaguaguuuuuaguacgugcuggacaccacuuuuaaaaagcaaucacugugcuagaaaag

SEQ ID NO: 549469 - RNA, 64 nt, hsa
ucauuuacauuugagaaagcuguuuuuaacauuauuuuaaaaugccaaauauguucuuucuaga

SEQ ID NO: 549470 - RNA, 64 nt, hsa
gauacuggcuuuacagaaauuucagagaacuaauuuuuaaaaucuuuagcauuuaaaacuuuuu

SEQ ID NO: 549471 - RNA, 64 nt, hsa
agucacugaacuaguagaugucaauaauuauuauuuuuaaaaauuuuuauuuguuggccgggca

SEQ ID NO: 549472 - RNA, 64 nt, hsa
acuguguugcccagccugggugucaauaauuauuuuuuaaaaaaaauuuuuaaaaagguuuuuu

SEQ ID NO: 549473 - RNA, 64 nt, hsa
gccugggugucaauaauuauuuuuuaaaaaaaauuuuuaaaaagguuuuuugagacagauucuu

SEQ ID NO: 549474 - RNA, 64 nt, hsa
accacaauaauuauugccuguaugucaauuauuauuuuaaaauauuguuguauuuacuuaaugu

SEQ ID NO: 549475 - RNA, 64 nt, hsa
auucacauuuuauuaguuugguuauguuuuguccuuuuaaaacauuuucuuuugagaugggggu

SEQ ID NO: 549476 - RNA, 64 nt, hsa
auaugagaaauacauguuuaacauucaauaauaauuuuaaaaauuugagaaauaaacucucaua

SEQ ID NO: 549477 - RNA, 64 nt, hsa
aaaaaggcagcauucaaauuauauagaaucuaguuuuuaaaaucagcacagaucuucuuaaaaa

SEQ ID NO: 549478 - RNA, 64 nt, hsa
aaaguaaucuucuacuugcuucaagauuugauuuuuuuaaaaaagccugcgaccuauucaauac

SEQ ID NO: 549479 - RNA, 64 nt, hsa
uuuggaguggaauaauuucuucauuaaaaaauguuuuuaaaaacacuauaucuugggugguuua

SEQ ID NO: 549480 - RNA, 64 nt, hsa
uuucuuauaauauguuguaguuacuagugaauucuuuuaaaagcaauaccuagaguuagaacac

SEQ ID NO: 549481 - RNA, 64 nt, hsa
uaaaacacuacuuacuucuuauucucuuaacaaauuuuaaaagguagugaucuuaaaaaaaaau

SEQ ID NO: 549482 - RNA, 64 nt, hsa
uuagaauuaauguuuucaaaugugcaacucuaguuuuuaaaacaaaauuugguucuuuacauuc

SEQ ID NO: 549483 - RNA, 64 nt, hsa
gucggugucaugucacuaaguuuaaugcugcuguuuuuaaaaaaaaaaaaaaguuuuuuuaaaa

SEQ ID NO: 549484 - RNA, 64 nt, hsa
uaaugcugcuguuuuuaaaaaaaaaaaaaaguuuuuuuaaaaagccaaucuauguacuaaauug

SEQ ID NO: 549485 - RNA, 64 nt, hsa
aucguuuuaguugcuauucauauucucauucguuuuuuaaaaacugauauauucugaauuuauu

SEQ ID NO: 549486 - RNA, 64 nt, hsa
ugugccauggcauauauguucaaauucaaaccauuuuuaaaaugugaagauggacuucaugcaa

SEQ ID NO: 549487 - RNA, 64 nt, hsa
aauugaugaauaaaaugaaggucugguguauauguuuuaaaauacucucauauagucacacuuu

SEQ ID NO: 549488 - RNA, 64 nt, hsa
caugcaaaguaagacccagcauuuuaaaagcccuuuuuaaaaacuagacuucguacugugagua

SEQ ID NO: 549489 - RNA, 64 nt, hsa
gaucuuuagauagcaugcaaaguaagacccagcauuuuaaaagcccuuuuuaaaaacuagacuu

SEQ ID NO: 549490 - RNA, 64 nt, hsa
gaugguacuaaauguuuuccauuaaagucuucuauuuuaaaauuuagagaaaaauaaaauggcu

SEQ ID NO: 549491 - RNA, 64 nt, hsa
acaggguaauucacuaagagcuuguggagcuugguuuuaaaauccuuagccuggucugacuuua

SEQ ID NO: 549492 - RNA, 64 nt, hsa
uauguauauaaauaugcaccuaggagaaugugcuuuuuaaaauaaugacuacuguuuuuauuaa

SEQ ID NO: 549493 - RNA, 64 nt, hsa
aaaucuaccccuuuugaugaccccaggcuugaguuuuuaaaaugacuacccagaagggcacaag

SEQ ID NO: 549494 - RNA, 64 nt, hsa
gggucucaaacuaaaauuuauuuuuauaaaugaauuuuaaaagaaaaaauaucuacuucuuuua

SEQ ID NO: 549495 - RNA, 64 nt, hsa
uccuagauucauuauucuuucauucugguuucacuuuuaaaauaaauggcaacuuggcacaccu

SEQ ID NO: 549496 - RNA, 64 nt, hsa
ugcaauauuaaguguuuuggaauuugaagcuaauuuuuaaaaggccugaacuauacuuugaaga

SEQ ID NO: 549497 - RNA, 64 nt, hsa
uuaaaccuuuuuauaaagaucauuuauaauacuguuuuaaaaugugaggcaauaagaauuacuu

SEQ ID NO: 549498 - RNA, 64 nt, hsa
ggcacugugauacaguuuugaguaaaaagacauuuuuuaaaagccuuccaguuuuguggauuaa

SEQ ID NO: 549499 - RNA, 64 nt, hsa
uuuuguccaccucacagaugugaacuuuacuuuguuuuaaaacugaucaguuuugccaaggggc

SEQ ID NO: 549500 - RNA, 64 nt, hsa
uuucuuuuuuccuuugucuuucuuuuuccuuuuuuuuuaaaaaaacaaaacaaacaaaacaccu

SEQ ID NO: 549501 - RNA, 64 nt, hsa
ucuaagcuuuuaaccccuuuaccacuuugcuuauuuuuaaaaaauuuauuggcaaaacugggga

SEQ ID NO: 549502 - RNA, 64 nt, hsa
cuauugugaauuccaaaucuaaaaaaagaaauauuuuuaaaauguucuuaagcaaauauauacc

SEQ ID NO: 549503 - RNA, 64 nt, hsa
uuaauuuuuaaucaguuugcuuucuccagagaaauuuuaaaauaauagaagaaauagaaauuuu

SEQ ID NO: 549504 - RNA, 64 nt, hsa
agguguuuuuuucggggagcuaauaacaaaaacauuuuaaaacuuaccuuuacugaaguuaaau

SEQ ID NO: 549505 - RNA, 64 nt, hsa
aaguugcuugcuuuugcuuuguccauuuucaucauuuuaaaaugggggauaauaacagaacuug

SEQ ID NO: 549506 - RNA, 64 nt, hsa
guaagaccccuuccuuagauuccuguuauacauuuuuuaaaauguagaguuuguuuuggagaca

SEQ ID NO: 549507 - RNA, 64 nt, hsa
auauuacuagucaugauaaaguaaauuaagcaguuuuuaaaacuuagugugaguuuguucauca

SEQ ID NO: 549508 - RNA, 64 nt, hsa
uuaacaaauguagaaaugagccaaacuauuuaaauuuuaaaacaguaaaacaaaaugaaacuua

SEQ ID NO: 549509 - RNA, 64 nt, hsa
uuuuaauuuccauaugggcuaaagaauccaaauauuuuaaaaaucugucucucuuuucuucucu

SEQ ID NO: 549510 - RNA, 64 nt, hsa
ccucuguuaccuacuuuugccagugaaauuuaaguuuuaaaauacuuucagaauguauuuuuac

SEQ ID NO: 549511 - RNA, 64 nt, hsa
cuaauaagucucugaaagccaguggcuuuaugacuuuuaaaaaaaauuacaaaccaagaauuuu

SEQ ID NO: 549512 - RNA, 64 nt, hsa
aauuaaaauggauaauuuguaaauaguuuuuagcuuuuaaaauuuaaaguguuuuugaguguga

SEQ ID NO: 549513 - RNA, 64 nt, hsa
uuuaacauggaacaaugaaaccaacaacaaacauuuuuaaaauuaaaauggauaauuuguaaau

SEQ ID NO: 549514 - RNA, 64 nt, hsa
gauuguuauucuacacauaauuaugaauucagaauuuuaaaaauugggggaaaagccauuuauu

SEQ ID NO: 549515 - RNA, 64 nt, hsa
gauaugcuagaauuacuuccacauauuuaucccuuuuuaaaaaagcuaaucuauaaauaccguu

SEQ ID NO: 549516 - RNA, 64 nt, hsa
uucuaaagaauaugcauucuugaacuacuuaacuuuuuaaaaaucacaauaaauuuuugcacuc

SEQ ID NO: 549517 - RNA, 64 nt, hsa
cguugaugacagcccucaugaguagcauccacauuuuuaaaauuucaaauugguuuuucuacua

SEQ ID NO: 549518 - RNA, 64 nt, hsa
gauaauugcuuuuauuauaauaauaggauugaaauuuuaaaauuuugaaaggacuuauuaauuu

SEQ ID NO: 549519 - RNA, 64 nt, hsa
guauguguucaguguuguuugcacagagagauuguuuuaaaaaauggcaccauauuuggccuag

SEQ ID NO: 549520 - RNA, 64 nt, hsa
uucuacacaggucuguacuucugccacuuucuccuuuuaaaaaaacaaaacuaugcauauuaug

SEQ ID NO: 549521 - RNA, 64 nt, hsa
guugaucuuccagcaacguuuauauauuuaguaauuuuaaaaauuccuauuugauacaauuaaa

SEQ ID NO: 549522 - RNA, 64 nt, hsa
acuuuguuuuuaaagugaagcuuuaaaauuacuuuuuuaaaauagucaaauucauguuuuuaag

SEQ ID NO: 549523 - RNA, 64 nt, hsa
auagaaaagaucugaccaagugcaaaaaaaugcuuuuuaaaauuuuuacaaauacuuuguuuuu

SEQ ID NO: 549524 - RNA, 64 nt, hsa
gcacuuacgcuaggagaaauuucuuuuacaaaacuuuuaaaauacaauuagugcugauaauucc

SEQ ID NO: 549525 - RNA, 64 nt, hsa
guucugucagauuaguaaggugugcuaaucuaaauuuuaaaaaaucucuuacagguuuucuugc

SEQ ID NO: 549526 - RNA, 64 nt, hsa
augugcauguuaaguauucaaaucagucuuaaauuuuuaaaaauauguaauuuuagaaaauaau

SEQ ID NO: 549527 - RNA, 64 nt, hsa
acuggaggucauggagauuuucuccuacauuuucuuuuaaaaguuuuauaguuucagaguuuac

SEQ ID NO: 549528 - RNA, 64 nt, hsa
auucaaaguacuuuuuuuugaaaauacagauuuuuuuuaaaagugaauaauguguucaacucuu

SEQ ID NO: 549529 - RNA, 64 nt, hsa
aaaaucuauacauuucugaguucugaauaaauauuuuuaaaaauuuuaauauauuuuucuuuga

SEQ ID NO: 549530 - RNA, 64 nt, hsa
auuuaugaaaguuaauccauuucugauacgugguuuuuaaaaauaugaaauggauuuauauaua

SEQ ID NO: 549531 - RNA, 64 nt, hsa
gauaaacugaauaagcauuuagcuuuuuaaaucauuuuaaaaauuaagucuaauuuugaagcuu

SEQ ID NO: 549532 - RNA, 64 nt, hsa
uaugaauucuuuacaagcuguuguaaacauuuaguuuuaaaaagaaaagcaugcugaaacaugu

SEQ ID NO: 549533 - RNA, 64 nt, hsa
caacugcucuuccuacugacucaaauaguuuauuuuuuaaaaauacuuauauaauacaugcaga

SEQ ID NO: 549534 - RNA, 64 nt, hsa
cagccucggcaacaugccaagaccccgucucuauuuuuaaaaaagaaaaagaaccgacuucuga

SEQ ID NO: 549535 - RNA, 64 nt, hsa
ucuguauguuaguaauaaagcuuaaauuauuccauuuuaaaauuaugaauaugaauaggguuuu

SEQ ID NO: 549536 - RNA, 64 nt, hsa
cugguccauaguaagugcucaguaaacuuagcuguuuuaaaaacuuuguauuugaacauugaaa

SEQ ID NO: 549537 - RNA, 64 nt, hsa
ucuccaguagugggugagguuuugccuuuguugguuuuaaaacuugauucuauaaugccaaguu

SEQ ID NO: 549538 - RNA, 64 nt, hsa
uuaguuuacagugcaauuuuaucucaggaauuauuuuuaaaaggaggaggggacauagaaaaaa

SEQ ID NO: 549539 - RNA, 64 nt, hsa
uuguagccauaugguaaauuuuuauuuguuaaauuuuuaaaaauuacuuagcucaaaaugucag

SEQ ID NO: 549540 - RNA, 64 nt, hsa
agaaaucuacucugauuuagcacugggaccuacguuuuaaaaaaaguauucuuguagaauacag

SEQ ID NO: 549541 - RNA, 64 nt, hsa
aagucuuuucaacuuaugaaacuaagucuauaccuuuuaaaaccuuauuccucacuccauccag

SEQ ID NO: 549542 - RNA, 64 nt, hsa
cauugggaugucugguuguuuuuauuucugacuuuuuuaaaauuccaggugugccgcacccacu

SEQ ID NO: 549543 - RNA, 64 nt, hsa
auaacugaaaucccccagcgaugggguaacaauuuuuuaaaacucucgauugccguuucaauug

SEQ ID NO: 549544 - RNA, 64 nt, hsa
ucccacccucggcccucuuguuuuuaaaauaaacuuuuaaaaaggaaaaaaaaaagucacucuu

SEQ ID NO: 549545 - RNA, 64 nt, hsa
gcaauucauuuucucccacccucggcccucuuguuuuuaaaauaaacuuuuaaaaaggaaaaaa

SEQ ID NO: 549546 - RNA, 64 nt, hsa
gccugguucuucucguuuuccuuuuuuuuuuuuuuuuuaaaaaaaaacuauuuaauuuuuuaau

SEQ ID NO: 549547 - RNA, 64 nt, hsa
ucuggaagccauuuguuaaaaaaaaaaaaaaaaguuuuaaaaauaccuuuuaauuuucugguaa

SEQ ID NO: 549548 - RNA, 64 nt, hsa
uauuacaagcaacccaguuuuauacuuuuaguuauuuuaaaauguaaaauuaaauuguuauuga

SEQ ID NO: 549549 - RNA, 64 nt, hsa
acuaaaacauauuuuugcagauacaggaaaaauuuuuuaaaaauuuuaaucauuaagucuguaa

SEQ ID NO: 549550 - RNA, 64 nt, hsa
ugcauaaccaguauuagcauuagaaauuagccacuuuuaaaaugagaaaacugugucacucuuc

SEQ ID NO: 549551 - RNA, 64 nt, hsa
gugacaaauuaagucuauauauuaacagaaauauuuuuaaaaaauuagagugaagaaaaaugau

SEQ ID NO: 549552 - RNA, 64 nt, hsa
uacuuaauaauauaacaguuuuauaagaagauguuuuuaaaaccuuagggcaggaaagaacuuc

SEQ ID NO: 549553 - RNA, 64 nt, hsa
auaaaauacauuaaaaugaauaacacuuuuuuguuuuuaaaauuguuauaggaaaauuuauaua

SEQ ID NO: 549554 - RNA, 64 nt, hsa
uuuuguaaaacacaagauucugaagacuuaguuauuuuaaaaaaguuaaguaucucaauuuuuc

SEQ ID NO: 549555 - RNA, 64 nt, hsa
auccaugaaauuauagccaguuuaaaaugaauuauuuuaaaaaaaauuucuggcugggcccggu

SEQ ID NO: 549556 - RNA, 64 nt, hsa
uaaagguaaaagguuugaaauuuuuaagcgcauuuuuuaaaacuuaaaauguauuuggaggaga

SEQ ID NO: 549557 - RNA, 64 nt, hsa
ccagucacuagaguucuuucaguagaaaaagaauuuuuaaaaauuaaaauguaauguugcugcc

SEQ ID NO: 549558 - RNA, 64 nt, hsa
gcuuucugugaacugaggucuuaauaucagcucauuuuaaaagucuuugcagugguauucggau

SEQ ID NO: 549559 - RNA, 64 nt, hsa
uacaggugcaugccaacacgcccggcuaauuuuuuuuuaaaaauauuuuuaguagagacagggu

SEQ ID NO: 549560 - RNA, 63 nt, hsa
gugaaacuagucaauuuguuucauuaaacaaauauuuuaaaauuauuuccuuuguaccuuguc

SEQ ID NO: 549561 - RNA, 64 nt, hsa
uacuuuuaaguggaggaaaugaaguacugugaauuuuuaaaacagaugagauaauuggugucgg

SEQ ID NO: 549562 - RNA, 64 nt, hsa
aauaccugaugcccuuauuugaagcuccauuauuuuuuaaaaagaaauuauauaaaaauacuuu

SEQ ID NO: 549563 - RNA, 64 nt, hsa
guguuaugucuaggaaacaaggcacauacuuuaauuuuaaaacacuugaugcuggcuggguggg

SEQ ID NO: 549564 - RNA, 64 nt, hsa
gcaacaugaugagaccccaucucuacaaacaauuuuuuaaaaaugagccaggugugguagugug

SEQ ID NO: 549565 - RNA, 64 nt, hsa
cuuuuauaaccccccaaaaaaucacacaaauauauuuuaaaauguaaauauuuuaucgcuucug

SEQ ID NO: 549566 - RNA, 64 nt, hsa
auauuauuuaaugcauagccucuucagaaugcaauuuuaaaauguaaaggcucuuuuauaaccc

SEQ ID NO: 549567 - RNA, 64 nt, hsa
ggggugagccaccacgcccagccccagcuuaguuuuuuaaaaaguuuauuuuagccauucuaau

SEQ ID NO: 549568 - RNA, 64 nt, hsa
uccucucucucuuucuugcuagugguuuaucaauuuuuaaaaccuuuucuuguuuauuuguuuu

SEQ ID NO: 549569 - RNA, 64 nt, hsa
uuaaaccauuuuuuaucguuuuugaaggagaucuuuuuaaaaccuacaagagacaucucucuau

SEQ ID NO: 549570 - RNA, 64 nt, hsa
gagaacuguagcgugcagauguguugccccucccuuuuaaaauuuuauuuucguuuuucuauug

SEQ ID NO: 549571 - RNA, 64 nt, hsa
agacauucgucaucaguuguucuugaacauggucuuuuaaaaacuagucagaugaauuguuuuc

SEQ ID NO: 549572 - RNA, 64 nt, hsa
agaugaauuguuuucaucugaagccugcuaucuuuuuuaaaagaugugcuauuuauucuugcac

SEQ ID NO: 549573 - RNA, 64 nt, hsa
augucuuauuuuuuuccuaaaagauaauguuuauuuuuaaaaaggaaggaaggagcaagugaag

SEQ ID NO: 549574 - RNA, 64 nt, hsa
ccguugcuuucguagccccugcuaaguguugacuuuuuaaaauauaaguuuauuguaaaaguga

SEQ ID NO: 549575 - RNA, 64 nt, hsa
uacacaagugagggcuuuuuaacuugauuaugccuuuuaaaaauacuauguauguaaaauauuu

SEQ ID NO: 549576 - RNA, 64 nt, hsa
aaagaagucacggguuguaaaaccauuuggauuuuuuuaaaacaaaaguauuaauaaucuggaa

SEQ ID NO: 549577 - RNA, 64 nt, hsa
uuacucuuaagaggagugugugugucuguguuuguuuuaaaagucacuuauuucuuacagugau

SEQ ID NO: 549578 - RNA, 64 nt, hsa
aauauauagagacuucuaaaucauaaucauccuuuuuuaaaaaaaagaauuuuaaaaaagaugg

SEQ ID NO: 549579 - RNA, 64 nt, hsa
cuaaaucauaaucauccuuuuuuaaaaaaaagaauuuuaaaaaagauggauuugacacacucac

SEQ ID NO: 549580 - RNA, 64 nt, hsa
auugcugagauguuuaguagcugauaaagaaaccuuuuaaaaaaauaauauaaaugaaugaaau

SEQ ID NO: 549581 - RNA, 64 nt, hsa
ucauuuuuuuuuuuguuucugagaaaagaacguauuuuaaaagccacauagagugacuccaaga

SEQ ID NO: 549582 - RNA, 64 nt, hsa
ucuauaucaugcuuuaaaguguaauaauaugauuuuuuaaaagaaauuuauuacuuguugcaaa

SEQ ID NO: 549583 - RNA, 64 nt, hsa
ccuaacugaagagacaguuauuuauagucauuuauuuuaaaaaaugaaaauaagugaauaauaa

SEQ ID NO: 549584 - RNA, 64 nt, hsa
ucccaauagcuuucaauuguucuuucuggaagacuuuuaaaaaaauauaaauaugcauauauau

SEQ ID NO: 549585 - RNA, 64 nt, hsa
uggccagauucuguuauuugcaauuaaagcaaguuuuuaaaaaaugcaagaggcaguuguuagu

SEQ ID NO: 549586 - RNA, 64 nt, hsa
cugaauuaguaguuaagucugauagccaaguaaguuuuaaaaaccaaagcauccaggaugcaca

SEQ ID NO: 549587 - RNA, 64 nt, hsa
ucacccuuugccuauaugguagagcaauaaugcuuuuuaaaaauaaacuucugaaaacccaagg

SEQ ID NO: 549588 - RNA, 64 nt, hsa
agagauuauuuguuuagauguaggcauuuuaauuuuuuaaaaauuccucuaccagaacuaagca

SEQ ID NO: 549589 - RNA, 64 nt, hsa
cuucuucaaaugacauggaaagcaaaacuuucuuuuuuaaaaauuuucauuuauuuaauggaaa

SEQ ID NO: 549590 - RNA, 64 nt, hsa
cccauuuucacaugucugcuuauuuauuuuauauuuuuaaaagaagacaguauucaccuaugua

SEQ ID NO: 549591 - RNA, 64 nt, hsa
uuggaauaauaauauucauauuugcuaugaauccuuuuaaaaaaaucuuuggauaaaugcugac

SEQ ID NO: 549592 - RNA, 64 nt, hsa
guaauaacgauauuucucuuuaauugauguuuuguuuuaaaaguuaaaaguaauucuuggcgug

SEQ ID NO: 549593 - RNA, 64 nt, hsa
uuacauuaagaauaucuugaauguuguguauauauuuuaaaaagcacuuugcaaaauaguuugu

SEQ ID NO: 549594 - RNA, 64 nt, hsa
gggugacagagcaagacccugucucuaaaauaaauuuuaaaaagacauauuacacuuggaccuu

SEQ ID NO: 549595 - RNA, 64 nt, hsa
ggcaacacagcaagacaccgcaucuacagaaaaauuuuaaaauuagcugggcgugguggugugu

SEQ ID NO: 549596 - RNA, 64 nt, hsa
uuuucuaggcauaaaaauaaaaguuggcuaaaaauuuuaaaaaaucaacaucuugagguugugu

SEQ ID NO: 549597 - RNA, 64 nt, hsa
uaugaaaaauuauggucuuauugcugaauaaaacuuuuaaaaaguacagaauaauugugcuugc

SEQ ID NO: 549598 - RNA, 64 nt, hsa
uaugugccuugauccaacgcuacauguauucagcuuuuaaaacuccacaaauuuuucauacucc

SEQ ID NO: 549599 - RNA, 64 nt, hsa
aacuggcugaauggcugaaugagauaaaauuuaauuuuaaaaaaugguuaugaaauaauguucc

SEQ ID NO: 549600 - RNA, 64 nt, hsa
acaaaaaaaaauugaauuaaaaauaacacagucuuuuuaaaacuaacauaggaaagccuuuccu

SEQ ID NO: 549601 - RNA, 64 nt, hsa
aaaacugcucaaagccauuuaaauuauauccucauuuuaaaaguuacauuugcaaauauuucuc

SEQ ID NO: 549602 - RNA, 64 nt, hsa
uguaagguuuaucuucuggcuuaaaaauagauauuuuuaaaaaauagauuuucuaaaacacaga

SEQ ID NO: 549603 - RNA, 64 nt, hsa
gaaauauauuauuuguuagucuguaucuggagcuuuuuaaaauuauguuauuaaucuuuuagua

SEQ ID NO: 549604 - RNA, 64 nt, hsa
guuucagugagucccagggacuaauuaagguuuauuuuaaaaagugucuaccuugguacgcagc

SEQ ID NO: 549605 - RNA, 64 nt, hsa
uguuuugauuuaggcaggguagcuugggauaccuuuuuaaaaacaccagauauuaaaaugucug

SEQ ID NO: 549606 - RNA, 64 nt, hsa
gcuccuugcuggugggcaguggguuguaaauacuuuuuaaaaaacacuaaguuccuuaucucag

SEQ ID NO: 549607 - RNA, 64 nt, hsa
cccaggguuccguuugcugaaguaaaaacacugauuuuaaaaucccaguggguaccuuuguaug

SEQ ID NO: 549608 - RNA, 64 nt, hsa
caguaguuuggauguacaauuauuauuaguggcuuuuuaaaaaaugaaacaguguuaagugaaa

SEQ ID NO: 549609 - RNA, 64 nt, hsa
cuguuuaucuuguucugggcauuggaguuucaguuuuuaaaaaauucuugaaaauguauucugu

SEQ ID NO: 549610 - RNA, 64 nt, hsa
ccuacaaaucagcguaguuacaaaggggucagucuuuuaaaauaaguauuuccuauuaaacuau

SEQ ID NO: 549611 - RNA, 64 nt, hsa
ggggcccauucauaagaaaguguuauaucuagguuuuuaaaacugaaguugaaauuaucuuugu

SEQ ID NO: 549612 - RNA, 64 nt, hsa
auaggguaaagcuuugucuaaaguccucauuuucuuuuaaaauugaauaaaauuucuguauaca

SEQ ID NO: 549613 - RNA, 64 nt, hsa
aaauaaggagaaaccccauaacuuuuuagcucucuuuuaaaaauaaaugucuccuucuguguuc

SEQ ID NO: 549614 - RNA, 64 nt, hsa
uugaguuggauuggaaaggaauauuuuaagugccuuuuaaaaauacuaauaguccggccaggcg

SEQ ID NO: 549615 - RNA, 64 nt, hsa
guuauaagaaaaaauugcacaaaaauuaugugcuuuuuaaaauauuuauccaaaauguaguuga

SEQ ID NO: 549616 - RNA, 64 nt, hsa
aaaaaaugaaaagucugcuuaacuccaauuucucuuuuaaaaaagcagacuuacagcuuucagg

SEQ ID NO: 549617 - RNA, 64 nt, hsa
auuuugaaaccaguuuaaugggauacaaccagcauuuuaaaaaaugaaauagaauacagcaugg

SEQ ID NO: 549618 - RNA, 64 nt, hsa
cagggguacauuuuugcacugaaaucuaaagauguuuuaaaaaacacuuuucacaaaaauaguc

SEQ ID NO: 549619 - RNA, 64 nt, hsa
aaguauaauuguaaauaagccauguaaaaugccuuuuuaaaauuuaauuuucuagcuggcucca

SEQ ID NO: 549620 - RNA, 64 nt, hsa
uucuagaucucugguguucucuuugguuucauuuuuuuaaaaaauuaccuucuuugggugggga

SEQ ID NO: 549621 - RNA, 64 nt, hsa
uuauauauuuaauauuaagugaaccucccgugccuuuuaaaaaauaccaacauuaugaaauuua

SEQ ID NO: 549622 - RNA, 64 nt, hsa
cagauagaguuucuaacauuuucuaguuugucaguuuuaaaauauaaaauucuuuuauguuuuu

SEQ ID NO: 549623 - RNA, 64 nt, hsa
auaaagguuuguuuugguuuguuauggcuuccuuuuuuaaaaaauuacccuguagugccaguuu

SEQ ID NO: 549624 - RNA, 64 nt, hsa
ccuuucaaggcauuaguaaauuacuugcaaauaguuuuaaaaggaaaauacgaccuuuguuaua

SEQ ID NO: 549625 - RNA, 64 nt, hsa
cuuacggccuagagaguugacaaguugcuuguaguuuuaaaaaaauaauaaaguauacccuucu

SEQ ID NO: 549626 - RNA, 64 nt, hsa
acaagaauuuaaguaaaagaaauguucauuuuuguuuuaaaauuuguuuuccaugugaaguuuu

SEQ ID NO: 549627 - RNA, 64 nt, hsa
gccgauuucaggggcgggugcauuguaguuauuauuuuaaaauagaaacuaccccaccgacuca

SEQ ID NO: 549628 - RNA, 64 nt, hsa
aaacaguuuggguuauuuggggguucuguuggcuuuuuaaaauuuucuuuuuuggauguguaaa

SEQ ID NO: 549629 - RNA, 64 nt, hsa
aaaacaaauuagguuuggguucaauuccuucaauuuuuaaaaaacuggucucugagaguuuuuu

SEQ ID NO: 549630 - RNA, 64 nt, hsa
guccacguuguuucacaucugguuagggggcagauuuuaaaauguaguuuuguaauguuacauu

SEQ ID NO: 549631 - RNA, 64 nt, hsa
aaacacagagaauggguaauucaagaggccuuucuuuuaaaauagacuuuugugacccacuaau

SEQ ID NO: 549632 - RNA, 64 nt, hsa
cugcacaaagaugucuucuguucauccugaacauuuuuaaaaaaugcagaauuuuaugugacug

SEQ ID NO: 549633 - RNA, 64 nt, hsa
ugcauggucgcuuuaccauguuagcuguguauuguuuuaaaaguuuuaacuucaaaauauguua

SEQ ID NO: 549634 - RNA, 64 nt, hsa
guuaagaagucagugggaaacacacagaaauuuguuuuaaaaucuuucaggagcuuuacugaaa

SEQ ID NO: 549635 - RNA, 64 nt, hsa
aguugguuucuguuagucuuaacagucuguuuucuuuuaaaagcauguagggcuucauugccau

SEQ ID NO: 549636 - RNA, 64 nt, hsa
augccuaaguuuugacagcaggaagaaaacaauuuuuuaaaaauucucauuacauagacgcaca

SEQ ID NO: 549637 - RNA, 64 nt, hsa
guaaauuuaauuguacauaugguugauuuauuauuuuuaaaaauacagacuaacugauguaaug

SEQ ID NO: 549638 - RNA, 64 nt, hsa
ucuauucaaauuuucuuuagugcuuaaaauuaaguuuuaaaaugaaaucagacacugcagguuu

SEQ ID NO: 549639 - RNA, 64 nt, hsa
agaccacuugcauuagaaccaucuggagcacuuguuuuaaaaugcagauucauaggcagcaucu

SEQ ID NO: 549640 - RNA, 64 nt, hsa
gaauaaaauguaccugccauccaguuuuggaucuuuuuaaaacuaaugaguaugaacuugagau

SEQ ID NO: 549641 - RNA, 64 nt, hsa
ucauugugaacagguauuucuucacagaucucauuuuuaaaauucuuaaugauuauuuuuauua

SEQ ID NO: 549642 - RNA, 64 nt, hsa
gucaaugaaaugcuagggggccagggaaacaaaauuuuaaaaauaauaaaauucaccauagcaa

SEQ ID NO: 549643 - RNA, 64 nt, hsa
agaaagcauggaaauuaaguguuucguacaaaaauuuuaaaaaguuaccaaagguuuuuauucu

SEQ ID NO: 549644 - RNA, 64 nt, hsa
ugucuuucaccuuuccauuguugcaucuugaauuuuuuaaaaugucuagaauucaggaugcuag

SEQ ID NO: 549645 - RNA, 64 nt, hsa
ucuugcuguuuucaguauuuucuuaagaaauugcuuuuaaaacaaauaauuguuuuacaaaacc

SEQ ID NO: 549646 - RNA, 64 nt, hsa
auuauuaauuuaaaaccccaaaguaaauugcaaauuuuaaaauuuauuuuugacucuuuuauca

SEQ ID NO: 549647 - RNA, 64 nt, hsa
ggauuacagcccuuaaaauuuuagcuuaaggacauuuuaaaauugcaugagauuagcaaaauua

SEQ ID NO: 549648 - RNA, 64 nt, hsa
uugagccacauauuuucagacacuuguuaccauauuuuaaaaucuggcuucacauacacagagu

SEQ ID NO: 549649 - RNA, 64 nt, hsa
ugaagaguauggaauauuuaaaugaaacauauuuuuuuaaaaccugcgcauaagauaaaagcag

SEQ ID NO: 549650 - RNA, 64 nt, hsa
gguuugggcucccucuuauuuuuacaaguuucauuuuuaaaaguaggcaacuacuuuggguuac

SEQ ID NO: 549651 - RNA, 64 nt, hsa
ugaacuuaugaaucauacucauuacuuuucagcuuuuuaaaaggccaauuuuuguccaguuuuc

SEQ ID NO: 549652 - RNA, 64 nt, hsa
gcuuuugucuggaugaaaguuuugcccaguuguguuuuaaaaacaauuccucaugaacacuaag

SEQ ID NO: 549653 - RNA, 64 nt, hsa
gugacuuuaaaaugacuuuuccaaccugcuuuguuuuuaaaaauuauauuccaguuuuaaucau

SEQ ID NO: 549654 - RNA, 64 nt, hsa
uggaggagaaaaaaugaguuacaaugucagguguuuuuaaaaauuccuuuuagagacagucuuu

SEQ ID NO: 549655 - RNA, 64 nt, hsa
aaguguucuuuaacacugacuacuaaacuuuaaguuuuaaaaaauagguuuucauuuauggcuu

SEQ ID NO: 549656 - RNA, 64 nt, hsa
uugaucuaaacauagguucugcauaucuguuagauuuuaaaaaugacugguguuuugucuucac

SEQ ID NO: 549657 - RNA, 64 nt, hsa
ggaccuaaaccuuuaugcuacauuuucgaagauuuuuuaaaaauaauauuguuaaucaguaaaa

SEQ ID NO: 549658 - RNA, 64 nt, hsa
cuaguuuguguuacgagguauucuuucaaauuuuuuuuaaaagccaacuacugucauuaagaaa

SEQ ID NO: 549659 - RNA, 64 nt, hsa
uacuuaguaauguccuuaacuuuagaaauacagcuuuuaaaauauugugguucuggaccuuaca

SEQ ID NO: 549660 - RNA, 64 nt, hsa
gcacaacugauuccaacacaaaaccccuuccccuuuuuaaaaugauuucuguucuaaugccaua

SEQ ID NO: 549661 - RNA, 64 nt, hsa
aacagaggcauugagaaaggggaaaggcggguauuuuuaaaagccaaagauugacccaguuacu

SEQ ID NO: 549662 - RNA, 64 nt, hsa
uuuggaaauagucccuguuccagauugccuugaauuuuaaaacauuuugcuuugggaaaguagg

SEQ ID NO: 549663 - RNA, 64 nt, hsa
cuucauauaaaaauucaggcccuuuuuggacaauuuuuaaaauuuguaucuuuacuagaacaug

SEQ ID NO: 549664 - RNA, 64 nt, hsa
uuguauuaaauagcauuggggaauagcuaaaccuuuuuaaaaaaauuuauuggauuuuccuccc

SEQ ID NO: 549665 - RNA, 64 nt, hsa
ccaugcuaugugcacagccccuuggauuacuuuguuuuaaaaagcaucagaguuggggguacuu

SEQ ID NO: 549666 - RNA, 64 nt, hsa
guggccuugcuucuuagacggucuucacuguguguuuuaaaacaacaacaacaacaacaacaac

SEQ ID NO: 549667 - RNA, 64 nt, hsa
auaaacuucaggcaauaauauuuucuguguaagcuuuuaaaauuauuuuuggggaucauagcuu

SEQ ID NO: 549668 - RNA, 64 nt, hsa
aaaaauuuaagauguucuaguucugcucucuuuguuuuaaaaaucacugcuucaaucuacuuca

SEQ ID NO: 549669 - RNA, 64 nt, hsa
guuuaaauucuccugacuccaguuuauaacauccuuuuaaaaaauuuaaaaacaaacagccaca

SEQ ID NO: 549670 - RNA, 64 nt, hsa
accucacuagcauuuaucacuuuuuuccuucucuuuuuaaaaauaaaaccagacucuguucuga

SEQ ID NO: 549671 - RNA, 64 nt, hsa
gcuuccucucuguuaguccccaaauccuuacuuauuuuaaaaagacuagacccucucuaaagac

SEQ ID NO: 549672 - RNA, 64 nt, hsa
gcucaugaaauugaguguuauuuuuuucuuucuuuuuuaaaaaaauauguaaagugcagucuuc

SEQ ID NO: 549673 - RNA, 64 nt, hsa
cucaugguccuggcaaccucagaaaccccugaaguuuuaaaaacuuucucgcuccccacgaccc

SEQ ID NO: 549674 - RNA, 64 nt, hsa
ggguuaauuuaaagggggggaaccucaaaaguuuuuuuaaaaaagaaacuugucugccacagua

SEQ ID NO: 549675 - RNA, 64 nt, hsa
acauaccaguguauaagauuuuuagaaguuuacuuuuuaaaaauaaaagcaaaauguaagaucu

SEQ ID NO: 549676 - RNA, 64 nt, hsa
cuucuugcaaucuccugaggauuaucugccccauuuuuaaaacgagguggaauacccaagguca

SEQ ID NO: 549677 - RNA, 64 nt, hsa
cuuuuuauguauuagaaucauauucguauugcccuuuuaaaacauugggauccuccaaaggccu

SEQ ID NO: 549678 - RNA, 64 nt, hsa
gugagacuccgucucaaaaaaaaaaaaaaaacuuuuuuaaaauguuaaaauuaauuuaaaugua

SEQ ID NO: 549679 - RNA, 64 nt, hsa
uuuaaaucauuugacuuugacaagcagaaauuacuuuuaaaaaauguauuuauggcugggcgug

SEQ ID NO: 549680 - RNA, 64 nt, hsa
ugcgaaauuagaaaaaaauuauaauaucugcuauuuuuaaaagacagcuauagucaagagcuug

SEQ ID NO: 549681 - RNA, 64 nt, hsa
aacauaaugagaccuguccucuaugaaaaaacuuuuuuaaaaauuuagcuggguguggugguac

SEQ ID NO: 549682 - RNA, 64 nt, hsa
guuuuguaaauuguauaauuuuuaaauaucugaguuuuaaaaaaagaaaaaaguacaaaaaaau

SEQ ID NO: 549683 - RNA, 64 nt, hsa
uuaaaugaaaggugcgcuaucccuuuugauucuguuuuaaaauuaucucguuaaagaucuccaa

SEQ ID NO: 549684 - RNA, 64 nt, hsa
agucuauauguuuucguaaucuucaucaagaaguuuuuaaaaggcaagcaaaaacagaagcaaa

SEQ ID NO: 549685 - RNA, 64 nt, hsa
uggaaaaaaaaauaauauuuuuauguuaaaacaauuuuaaaaucuuaaaauggccaucagacau

SEQ ID NO: 549686 - RNA, 64 nt, hsa
gccaucagacauagagagcuuugugugauucauguuuuaaaaagaaccgaagaagccacaggca

SEQ ID NO: 549687 - RNA, 64 nt, hsa
gagaaagaucuuuuuuaaauaaucuuuuugcuguuuuuaaaaaauuaaacaaggcuuuguguuc

SEQ ID NO: 549688 - RNA, 64 nt, hsa
gaauaaucaagugcuaaaacaaaaucaggugcuuuuuuaaaacagcuugauugagauauaaucc

SEQ ID NO: 549689 - RNA, 64 nt, hsa
ugauugaagauugaaaagggucagcugggaaaauuuuuaaaaagacuguuuuuaaaaaggugcu

SEQ ID NO: 549690 - RNA, 64 nt, hsa
aagggucagcugggaaaauuuuuaaaaagacuguuuuuaaaaaggugcuacaaaauaaagugcu

SEQ ID NO: 549691 - RNA, 64 nt, hsa
auuaaauuuaaagccuaagaauguauagagcuaguuuuaaaauaaugaucucagauuuuuaaaa

SEQ ID NO: 549692 - RNA, 64 nt, hsa
guauagagcuaguuuuaaaauaaugaucucagauuuuuaaaaaggauauaggaaccugcauugu

SEQ ID NO: 549693 - RNA, 64 nt, hsa
augguuucuaucauuauuuagccccaccuuuguauuuuaaaauccuucagaauacauuuaugaa

SEQ ID NO: 549694 - RNA, 64 nt, hsa
aggaccaaacuuuuucaggaaaaugcugccucguuuuuaaaacaagccuccuaagcuauguucu

SEQ ID NO: 549695 - RNA, 64 nt, hsa
cauuguuuuaaauauccuuaacuaacuuaaagaauuuuaaaauuguacugugauuuucauaacc

SEQ ID NO: 549696 - RNA, 64 nt, hsa
uaauuaaauuuuacaugugcuguacaagggguuauuuuaaaaagcauuuguucaauuucaauaa

SEQ ID NO: 549697 - RNA, 64 nt, hsa
cugucucaugauuugaaaaguacaccuugcaaaguuuuaaaaauaaaguuuuuaggcaaaugcg

SEQ ID NO: 549698 - RNA, 64 nt, hsa
uuauuauugacauuaaguaaugguaccauauauuuuuuaaaauacauauugacuugaauuguga

SEQ ID NO: 549699 - RNA, 64 nt, hsa
cguaucuauguuguguaggggaaauuuuuucauuuuuuaaaaauucuacuuugguuuuguuguu

SEQ ID NO: 549700 - RNA, 64 nt, hsa
uugcaucucucuaugaagauacgucuguccaaacuuuuaaaaggcauaacuguauuuuaugugu

SEQ ID NO: 549701 - RNA, 64 nt, hsa
uauuuuauucucacccgaaguauucacacaaucuuuuuaaaaaaaauuugaaauggcauuuugu

SEQ ID NO: 549702 - RNA, 64 nt, hsa
guuuacauaaauacuauguuuuacaguuuucauauuuuaaaauauuaauaaaguuaaaucacaa

SEQ ID NO: 549703 - RNA, 64 nt, hsa
aaugaagcugcaaacuucuuuuuacucuaaucauuuuuaaaauacuaauggaagaacuuucuag

SEQ ID NO: 549704 - RNA, 64 nt, hsa
uuguuugguuugaguuugauuuggcuuuuauauuuuuuaaaaucccuuuugcuaccccaucugg

SEQ ID NO: 549705 - RNA, 64 nt, hsa
uaccugauugauauuacauucaccuuugauuguuuuuuaaaaguuuauuuuuacagaauauauu

SEQ ID NO: 549706 - RNA, 64 nt, hsa
uuagucuuucaagaaugacggaauaagagaccuguuuuaaaaaggaacugcagcaaucuuugaa

SEQ ID NO: 549707 - RNA, 64 nt, hsa
aaaaugagugugaagggggaacaagucaaaauauuuuuaaaagaucuucaaaaguaaugccucu

SEQ ID NO: 549708 - RNA, 64 nt, hsa
cggcccacaagggugcccaccucuuguuuuccccuuuuaaaaacucagauuuuuaaaagcccuu

SEQ ID NO: 549709 - RNA, 64 nt, hsa
ccaccucuuguuuuccccuuuuaaaaacucagauuuuuaaaagcccuuuccaaagguuucaacu

SEQ ID NO: 549710 - RNA, 64 nt, hsa
ucagccccacuccacaguuaggccaagaauuagauuuuaaaacuucaucugucugucccaguua

SEQ ID NO: 549711 - RNA, 64 nt, hsa
augcuaaaacuguagaagcccaaucaccagcaguuuuuaaaaaggugauaacuuuuauuagcuc

SEQ ID NO: 549712 - RNA, 64 nt, hsa
gcagcuauuaugaaaucagcuuucauaggccuauuuuuaaaaggaaucugaaauuuaauucuau

SEQ ID NO: 549713 - RNA, 64 nt, hsa
ggacagucauuuggcuucugaauguuugaaacgauuuuaaaaaauaaguagugcuaugguuguu

SEQ ID NO: 549714 - RNA, 64 nt, hsa
uugugaacaaguaauuuuauauugugcuuuaauuuuuuaaaaaguauucuuuauucauauguau

SEQ ID NO: 549715 - RNA, 64 nt, hsa
uuuuucucugggugaggcaucugguuacugguuauuuuaaaaagaauaaagacauuccuggaau

SEQ ID NO: 549716 - RNA, 64 nt, hsa
aucuauguuacauuaaaaaagaaacgcguguacauuuuaaaagcaaugauguaaacuuuguucu

SEQ ID NO: 549717 - RNA, 64 nt, hsa
ugcucauuucaacuuggcuuuuugucuuuuaaauuuuuaaaaaaugcaguaguguguuagagac

SEQ ID NO: 549718 - RNA, 64 nt, hsa
agagccuuaaaaguuaaaaacauuuucaguuuuuuuuuaaaaaacguacucuuauuaucuggaa

SEQ ID NO: 549719 - RNA, 64 nt, hsa
ugugcuauauaaaaaaaaaaaaagacuuguuaaguuuuaaaauaacaaaaauggcuaguugaau

SEQ ID NO: 549720 - RNA, 64 nt, hsa
uuucaagcauggaucuccauauuucaaaggaaaguuuuaaaaauguuuuuaaaacuucaaauau

SEQ ID NO: 549721 - RNA, 64 nt, hsa
aucuccauauuucaaaggaaaguuuuaaaaauguuuuuaaaacuucaaauaucucaccacagug

SEQ ID NO: 549722 - RNA, 64 nt, hsa
gucuuacugaaccaacaaucaaaaaaugguucuguuuuaaaaaggauuuuguuugauuugaaau

SEQ ID NO: 549723 - RNA, 64 nt, hsa
acacuaaccgucaugugcuuuuaguaaauaugauuuuuaaaagcaguucaaguugacaacagca

SEQ ID NO: 549724 - RNA, 64 nt, hsa
gaguaaaaguuauacuuaacuugucugucuauuauuuuaaaauaugcauugaaauaauguggua

SEQ ID NO: 549725 - RNA, 64 nt, hsa
gaagcaccauuuaugcagauuuucuucagaauauuuuuaaaagguacagaauccuuaaaauauu

SEQ ID NO: 549726 - RNA, 64 nt, hsa
auucaugcuuacuguaaaguggaaguugagauuauuuuaaaacuucaagcucaguaauuuugaa

SEQ ID NO: 549727 - RNA, 64 nt, hsa
uuguacuaagugaaacuuguuaaauaaaucuuccuuuuaaaaacuggaaaaaaucuugaacuga

SEQ ID NO: 549728 - RNA, 64 nt, hsa
cauuuauaacaauuuucuuauaaaaacauguugcuuuuaaaauguggaguagcuguaaucacuu

SEQ ID NO: 549729 - RNA, 64 nt, hsa
uuaaagcaaaauauucauuuuuacuuuuucuuauuuuuaaaauuaggcugaauguacuucaugu

SEQ ID NO: 549730 - RNA, 64 nt, hsa
agaggacauaacauuuugaagaauuccuuuuguguuuuaaaaugugauauauauauauauaaaa

SEQ ID NO: 549731 - RNA, 64 nt, hsa
uugaguuuuaucccguaaguucuguuuugauuuuuuuuaaaaaacaaacccuuuuagucacuuu

SEQ ID NO: 549732 - RNA, 64 nt, hsa
aguucccauuuuucuugacaacaauaaauaccacuuuuaaaaaugacacauauuuaaacacuua

SEQ ID NO: 549733 - RNA, 64 nt, hsa
ccaacauagauauuuucuuucuccugaccauguauuuuaaaauauagucuauuucuugacuuug

SEQ ID NO: 549734 - RNA, 64 nt, hsa
uuggcaagaaaagaagaauaguuguuuaaauauuuuuuaaaaaacacuugaauaagaaucagua

SEQ ID NO: 549735 - RNA, 64 nt, hsa
cgcccggcuaaaacauugcaaauuuaaaugagaguuuuaaaaauuaaauaaugacugcccuguu

SEQ ID NO: 549736 - RNA, 64 nt, hsa
aaaguuuucuacaaggggagaaaaguguuaaaauuuuuaaaauauguuuuccaggacacuucac

SEQ ID NO: 549737 - RNA, 64 nt, hsa
uaguuggcuuuugaaucgauuauuucaugcuuuuuuuuaaaaaaaaaaaaaaacaaaauaacaa

SEQ ID NO: 549738 - RNA, 64 nt, hsa
uacaauuuuuucaucuaaaaguauuuuaagauauuuuuaaaauccaagagcuucucuauacuuu

SEQ ID NO: 549739 - RNA, 64 nt, hsa
cauuuuuagugaaauauuauuuuauagcuacuaauuuuaaaaugucuugcuugauuguauggug

SEQ ID NO: 549740 - RNA, 64 nt, hsa
acaaaaccacuggaaaguuuaugguuguauuauuuuuuaaaaaaauuccaagugauugaaaccu

SEQ ID NO: 549741 - RNA, 64 nt, hsa
uuuuguaaauuaucaagcuucaaaaagcuuuuuuuuuuaaaaaaaaacaugcauauucuaaaaa

SEQ ID NO: 549742 - RNA, 64 nt, hsa
ucauaauuaucacuaauaagcaucaguuuguuguuuuuaaaaggauauuuaagugagcauuuuc

SEQ ID NO: 549743 - RNA, 64 nt, hsa
uacauugagauauucugcagcugauagagcagcauuuuaaaaauguaacagguggaaaauuaca

SEQ ID NO: 549744 - RNA, 64 nt, hsa
acuuucuuuccuuacaacagcuugaaaaucauuauuuuaaaauccuuaaaucacugugucuaga

SEQ ID NO: 549745 - RNA, 64 nt, hsa
gcaaaagaaaaaguguucuagaguguuguugcuuuuuuaaaaaaagcgcugaaguuagaccaag

SEQ ID NO: 549746 - RNA, 64 nt, hsa
uuauaagaacauagacagcuuuuuuuuuuacuaguuuuaaaacccaucuuccaagguauaugaa

SEQ ID NO: 549747 - RNA, 64 nt, hsa
uccuuugguauucaaucaugugucuuuuagugcuuuuuaaaauuuuacccauucuuuaauucag

SEQ ID NO: 549748 - RNA, 64 nt, hsa
gcacaaaaagauaccuuaaaauuugaaacauugcuuuuaaaacuacuuagcacuucagggcaga

SEQ ID NO: 549749 - RNA, 64 nt, hsa
aaacugcacaugauuucacaaauauuaaaaagucuuuuaaaaaguauugccaaacauuaauguu

SEQ ID NO: 549750 - RNA, 64 nt, hsa
gguaccuugcacacaucaucuguaagcuguuugguuuuaaaauacuguagauaauuaaccaagg

SEQ ID NO: 549751 - RNA, 64 nt, hsa
aauugauguugaugcaauccuuacaaaugauugcuuuuaaaauuuuaagcuaggaaaagaaauc

SEQ ID NO: 549752 - RNA, 64 nt, hsa
aacguguauguuuuucaguucaaagucaugauguuuuuaaaaucuuauuaaaguuucaaaaauc

SEQ ID NO: 549753 - RNA, 64 nt, hsa
uccaaacucucuaaauaguagcuaacuuuuauuuuuuuaaaaugagucgugggguagugcuuca

SEQ ID NO: 549754 - RNA, 64 nt, hsa
gacauaauuggaaaagcagauuagcugcuacuacuuuuaaaagacuuaaggucgggaugccuuu

SEQ ID NO: 549755 - RNA, 64 nt, hsa
uauauauuuugugggcuuaauugaaacaacauuauuuuaaaaucaaaggggauauauguuugug

SEQ ID NO: 549756 - RNA, 64 nt, hsa
uccccuaauuuuccagagaagccuauuuuuauauuuuuaaaaaacugacagggcccaguuaaau

SEQ ID NO: 549757 - RNA, 64 nt, hsa
aaacuguaucaaaguuguacauauuuccaaacauuuuuaaaaugaaaaggcacucucguguucu

SEQ ID NO: 549758 - RNA, 64 nt, hsa
aaauguuuuugaaguuaaauaaacaguauuacauuuuuaaaacucuucucuauuauaacaguca

SEQ ID NO: 549759 - RNA, 64 nt, hsa
caaaugaucaaaaauauaguuauaauuuuuugaauuuuaaaaaugugauugcucuaauaaagaa

SEQ ID NO: 549760 - RNA, 64 nt, hsa
aaggucuuugugugcuagaauauuauugguaauguuuuaaaaauuccuuugauugauagagaag

SEQ ID NO: 549761 - RNA, 64 nt, hsa
uguuuguacuaaaaugcaaaagcaagagugcaauuuuuaaaaucuagaaguuagggguuuuguu

SEQ ID NO: 549762 - RNA, 64 nt, hsa
uuuaaaaaugacaacauucacaaaauuuauuacuuuuuaaaaaauaacaugccuauuaacuggu

SEQ ID NO: 549763 - RNA, 64 nt, hsa
uagauucugacaguguugugauucuguauaggauuuuuaaaaaugacaacauucacaaaauuua

SEQ ID NO: 549764 - RNA, 64 nt, hsa
aucuacacauuuauuuucaaucaauaaaugcugcuuuuaaaaccuugaugcaguugacuuuucu

SEQ ID NO: 549765 - RNA, 64 nt, hsa
gcuaagccgcuucauucaugccuacacaauuuuuuuuuaaaagggaacuuuaguuaauuaagug

SEQ ID NO: 549766 - RNA, 64 nt, hsa
guuuacauaaauacuauguuuuacaguuuucauauuuuaaaauauuaauaaaguuaaucgcaac

SEQ ID NO: 549767 - RNA, 64 nt, hsa
gucagauuaaauuuuuucagugaaauuccuauuauuuuaaaacuuuccauauuuucacuacgcu

SEQ ID NO: 549768 - RNA, 64 nt, hsa
uucuuaguucauacccuuccagaauucucucucuuuuuaaaaccuagaugagauuaaccuguuu

SEQ ID NO: 549769 - RNA, 64 nt, hsa
acauuuuuuaaaaaccacaaaugagcaaagauuuuuuuaaaaccuuaaaugucuggccgggugu

SEQ ID NO: 549770 - RNA, 64 nt, hsa
uuccacaaauaguaugugcucauuguaguacauuuuuuaaaaaccacaaaugagcaaagauuuu

SEQ ID NO: 549771 - RNA, 64 nt, hsa
uuuuaagaugugauaugguacugugguuauguuguuuuaaaaaaugauuaucuuuuagagaagu

SEQ ID NO: 549772 - RNA, 64 nt, hsa
gcugcuauuagaggggaacacaaagugaagguuuuuuuaaaaaagaggacuugcaucagcugcc

SEQ ID NO: 549773 - RNA, 64 nt, hsa
gcaaaauaauguugugaguuuuuauaaaaauaaauuuuaaaaugauauauaagacauuuuuuug

SEQ ID NO: 549774 - RNA, 64 nt, hsa
aucagaaucguuuguaaagcuuuuucuuuuuccuuuuuaaaaaguaaagcaauauauacacagg

SEQ ID NO: 549775 - RNA, 64 nt, hsa
accaucacacuuuaauuccaaucuguauauugcuuuuuaaaaguuaaguccauucuaauuaccc

SEQ ID NO: 549776 - RNA, 64 nt, hsa
gaaauauugaauuuuuauuuuugaaguuuuuguuuuuuaaaagguuggggguguucagccacug

SEQ ID NO: 549777 - RNA, 64 nt, hsa
aaucaagaaacaaacaaaagcugaacacauuucuuuuuaaaaaaaggagacuguguuugguccu

SEQ ID NO: 549778 - RNA, 59 nt, hsa
uuccuggagaugaaaguugaggcuacagguuuuaaaagccuuggccucagaggacccuu

SEQ ID NO: 549779 - RNA, 64 nt, hsa
uuccugguaauacagcucagugucauuuuccuauuuuuaaaacaugcucuacaugccuaauguu

SEQ ID NO: 549780 - RNA, 64 nt, hsa
cauugcuauuaaauguagaaggccauaccuggaauuuuaaaaauauuauuccugguaauacagc

SEQ ID NO: 549781 - RNA, 64 nt, hsa
gcuuagugauccacugaucucuaaucagaaauauuuuuaaaaaauacaauuuagaucucugaaa

SEQ ID NO: 549782 - RNA, 64 nt, hsa
ugcaagugacuauuugauuaacacauuaaaaauuuuuuaaaaauuuccccuuuaaguuaugaug

SEQ ID NO: 549783 - RNA, 64 nt, hsa
gcaaauugcuauguguguggugauggcaaaaggcuuuuaaaaguugguguuuucuuuuucuuaa

SEQ ID NO: 549784 - RNA, 64 nt, hsa
aaacucugaauuuaucuuugauaacagggauugauuuuaaaauguacauguauuaaauuacauu

SEQ ID NO: 549785 - RNA, 64 nt, hsa
cuuuagcuguguuauuauagagcagaaauucuguuuuuaaaaauuagccuaagauauacuuguu

SEQ ID NO: 549786 - RNA, 64 nt, hsa
gugccuaucuuuucacugacaauaaaguuagcuauuuuaaaaugcaguaccguguggaaaaugc

SEQ ID NO: 549787 - RNA, 64 nt, hsa
ucuuuuuuugaaauaaaaaguagcuugagcuuucuuuuaaaaucauguaucuugauuguugauu

SEQ ID NO: 549788 - RNA, 64 nt, hsa
uacugaauuucugucuugccucuccuucagugccuuuuaaaagguuuucccuuuucugaucugc

SEQ ID NO: 549789 - RNA, 64 nt, hsa
uuuaugcuauuuaauuuugugaaacuuaaucaucuuuuaaaauguauuauuugaagaguauuuu

SEQ ID NO: 549790 - RNA, 64 nt, hsa
ucaaaaauaguuugccuuaggucacgccuuaggauuuuaaaaaaauuacauugaaacaucaaac

SEQ ID NO: 549791 - RNA, 64 nt, hsa
aaggcaucucagcuuucuguggcuuaauauaacauuuuaaaauucuaaguguauaguuucauuu

SEQ ID NO: 549792 - RNA, 64 nt, hsa
uagaguagguauuaaucuuauuguuuaaucuuuuuuuuaaaaaaacuggauauuucaaucuuuu

SEQ ID NO: 549793 - RNA, 64 nt, hsa
uuauguggcuguaaugacaaaagauacaaaagcuuuuuaaaauuuagaguagguauuaaucuua

SEQ ID NO: 549794 - RNA, 64 nt, hsa
ucaauuuucuuuaguuuuaauugaaaauguuugcuuuuaaaacugauagguauuguuggaaagc

SEQ ID NO: 549795 - RNA, 64 nt, hsa
uuuuagaguaaaacuauuuuguguacaauuguguuuuuaaaauaguuaguagaucacuauggua

SEQ ID NO: 549796 - RNA, 64 nt, hsa
guccaaacacauccugcuuccuucauuggggaaguuuuaaaaaaaaguuuagauguugccuuua

SEQ ID NO: 549797 - RNA, 64 nt, hsa
cucaaauuuucuaacuuguuuuuauuuugaagacuuuuaaaauggacauuuucaauacauaaaa

SEQ ID NO: 549798 - RNA, 64 nt, hsa
guguguaaacuaguauguaugugcuuugcuuacuuuuuaaaaaaauguaguuagacugugagga

SEQ ID NO: 549799 - RNA, 64 nt, hsa
cuuagaccaucacaugccuccccucaaucacagguuuuaaaauuacugcccuauguugucuaua

SEQ ID NO: 549800 - RNA, 64 nt, hsa
cccaccucuucuacccucccccucuucuuucccauuuuaaaaaagaaaagaaggaaaaagaaaa

SEQ ID NO: 549801 - RNA, 64 nt, hsa
uguucacuccucuccccuuucucuuucucucuguuuuuaaaauaaucuaaagaaagcacauuuu

SEQ ID NO: 549802 - RNA, 64 nt, hsa
uuaaaugaagaagcacucauuaaauaaaacauaauuuuaaaaaacaauauaagaaacaaaguca

SEQ ID NO: 549803 - RNA, 64 nt, hsa
agcauaucagagaggcaaauucuuaaagaaugauuuuuaaaaucagcucuaggaagagcucaag

SEQ ID NO: 549804 - RNA, 64 nt, hsa
gucuuacugaagcaacaaucgaaaaaugguucuguuuuaaaaaggauuuuguuugauuugaaau

SEQ ID NO: 549805 - RNA, 64 nt, hsa; identical to SEQ ID NO: 549723

SEQ ID NO: 549806 - RNA, 64 nt, hsa
uggggacaacaucugaaggguauguugcaugcauuuuuaaaaaaaucaucucauaugcauugua

SEQ ID NO: 549807 - RNA, 64 nt, hsa
cuguggagaguuucuguuaggaaaagccauacauuuuuaaaaauguagcaaaaugucaagggaa

SEQ ID NO: 549808 - RNA, 64 nt, hsa
gaagauccgcagauucaugcagcauuccauauuuuuuuaaaaaaagguuacacugugcaccgac

SEQ ID NO: 549809 - RNA, 64 nt, hsa
gacugaaagaauguuaagauuuaucugcaaggauuuuuaaaaaauugaaacuugcauuuuaagu

SEQ ID NO: 549810 - RNA, 64 nt, hsa
guguuuaaaagcaaauacugacuuucaaaaaaguuuuuaaaaccugauuugaaagcuaacaauu

SEQ ID NO: 549811 - RNA, 64 nt, hsa
ugauuuaucuagaaauuuaccucaaaagcagaauuuuuaaaacugcauuuuuaaucaguggaac

SEQ ID NO: 549812 - RNA, 64 nt, hsa; identical to SEQ ID NO: 549809

SEQ ID NO: 549813 - RNA, 64 nt, hsa; identical to SEQ ID NO: 549810

SEQ ID NO: 549814 - RNA, 64 nt, hsa; identical to SEQ ID NO: 549811

SEQ ID NO: 549815 - RNA, 64 nt, hsa
uauauacagaaaccucgauauauaauuguauagauuuuaaaaguuuuauuuuuuacaucuaugg

SEQ ID NO: 549816 - RNA, 64 nt, hsa
uaagauagcaaauuuaaaucucuccucgaucagcuuuuaaaaaauguguacuauuaucugagga

SEQ ID NO: 549817 - RNA, 64 nt, hsa
cagggccuucgcucccucagcacugggguggaggcggcaggaaggggcggcccuuaccuggcag

SEQ ID NO: 549818 - RNA, 64 nt, hsa
ucaaggauuaguuuuccaggacucugcggaggaacggcaggaagaaccucagagagggcagagg

SEQ ID NO: 549819 - RNA, 64 nt, hsa
aauguggaccuuagaauacaguuuugaguagaguugaucaaaaucaauuaaaauagucucuuua

SEQ ID NO: 549820 - RNA, 64 nt, hsa
aaaauguucacaauauauuuaguuguaaaccaagugaucaaacuacauauuguaaagcccauuu

SEQ ID NO: 549821 - RNA, 64 nt, hsa
ggggagaaaaaugacaaaugacgucuucaccaagugaucaaaauuaacgucaccagugauaagu

SEQ ID NO: 549822 - RNA, 64 nt, hsa
aauuuuuuaucugcauaaauuuuacaguagaauaugaucaaaccuucauuuuuaaaccucucuu

SEQ ID NO: 549823 - RNA, 64 nt, hsa
guaugaaguaucucaaacuggaacauaaauuuagugaucaaacugccauucacaguguaaggca

SEQ ID NO: 549824 - RNA, 64 nt, hsa
cguaaauagauagcauuguaaauaaucaucacaaugaucaaaucacugaaccaugucuccgcac

SEQ ID NO: 549825 - RNA, 64 nt, hsa
gggcugcuuuguguggccauagagagcaaaacuaugaucaaauaguggguauuauggaggaggu

SEQ ID NO: 549826 - RNA, 64 nt, hsa
auuuuccuuuuuauuaugagaaauuucagcucagugaucaaagucuucaaauaguuaaaccaaa

SEQ ID NO: 549827 - RNA, 64 nt, hsa
aguuuuagaucauugguuauccugauuugcaaagugaucaaaagcauucuagccaugugcaacc

SEQ ID NO: 549828 - RNA, 64 nt, hsa
aaaagaguuagaugggaugaugcucagacucaucugaucaaaguuccgagaggcauagaaggaa

SEQ ID NO: 549829 - RNA, 64 nt, hsa
cauguccuucaugguaggugagcaccagucuccaugaucaaaaaugccccaguuuccuuugaaa

SEQ ID NO: 549830 - RNA, 64 nt, hsa
agcaaaggaguuugcugguugugucauuauuuaaugaucaaaguauagcauguaugccuuauua

SEQ ID NO: 549831 - RNA, 64 nt, hsa
aaagucuggguauucauugguuauuggccugaaaugaucaaauaacuacaaaugaucuguugaa

SEQ ID NO: 549832 - RNA, 64 nt, hsa
ggaauaagagaaacaaauuauaucaagguaaaacugaucaaaagcauaauugaaaguucugaaa

SEQ ID NO: 549833 - RNA, 65 nt, hsa
ggccaguugucugguuuccauguauucuaggccagguaggcaacacagagccaaggcgggugcug

SEQ ID NO: 549834 - RNA, 65 nt, hsa
uuaugcacacggugauuucauguuauauaugcaaaguaggcaacuguuuucuuaguuacagaagu

SEQ ID NO: 549835 - RNA, 65 nt, hsa
uaagucuuagguggguugggaagacagauaaugaaguaggcaaagagaaaaggacccaagauaga

SEQ ID NO: 549836 - RNA, 65 nt, hsa
gacaccaccaucuauagggucccaacuugguuauuguaggcaaccuucccucucuccuuggugaa

SEQ ID NO: 549837 - RNA, 65 nt, hsa
caguaaaucaugaguagucgcauguguggacaucaguaggcaaguaaccaguuuuacuaaugcau

SEQ ID NO: 549838 - RNA, 65 nt, hsa
gauugguaaucugaaaaggaccacaagcauagcugguaggcaaauuguuaggcagaauaauggua

SEQ ID NO: 549839 - RNA, 65 nt, hsa
gcaguggggccaaggaugccaccccacccucagcuguaggcaagcuugcacauaaauaacccccg

SEQ ID NO: 549840 - RNA, 65 nt, hsa
ccuugacacauccaggccaaccucccauggaauagguaggcaagccaggacuccgggaaggaggu

SEQ ID NO: 549841 - RNA, 65 nt, hsa
cacuaauauuguguuauuaaaaugauggcuuuuggguaggcaaaacuucuuuucuaaaagguaua

SEQ ID NO: 549842 - RNA, 65 nt, hsa
acaaaucuguacaacauguuacuguauugaauacaguaggcaauuguaacacaaugguaaguauc

SEQ ID NO: 549843 - RNA, 65 nt, hsa
cugguauugcaagucauuugcucuaauucucaauuguaggcaaacugauuuguaaauuugcuucu

SEQ ID NO: 549844 - RNA, 65 nt, hsa
agucaacugcacguguuuuauauuuuuaagagaucguaggcaauuagagaucgaagccuccuauc

SEQ ID NO: 549845 - RNA, 65 nt, hsa
ugcaguggagcccugagcagggcuggauaugggaaguaggcaaaugaaaugcgccaaggguucag

SEQ ID NO: 549846 - RNA, 65 nt, hsa
cagccuguggcccagagacacaaugggguccuucuguaggcaaagguggaaguccuccagggauc

SEQ ID NO: 549847 - RNA, 65 nt, hsa
ggaucccuagacuaaguugaaauguauuucuaauaguaggcaauuuuaauuuucauguaguuguu

SEQ ID NO: 549848 - RNA, 65 nt, hsa
gugugugucuguauguuucugcguugugugucuuuguaggcaagcaaacguugucuacacaaacg

SEQ ID NO: 549849 - RNA, 65 nt, hsa
gacaugguggcucagcuucuaaucccagcacuuugguaggcaaaggugggaggaucauuugagcu

SEQ ID NO: 549850 - RNA, 65 nt, hsa
gcucccugggugaaaggccacaguauuuuggguugguaggcaaauugcaacauucuggacauggc

SEQ ID NO: 549851 - RNA, 65 nt, hsa
aaaacaucugauugcuggcuccuccuccguuugcaguaggcaagcucugcugcgaugccucugcc

SEQ ID NO: 549852 - RNA, 65 nt, hsa
aauuauaucgauacaugaauuuaacuuacuuuaauguaggcaaacuaucaauuuuuuguccauuu

SEQ ID NO: 549853 - RNA, 65 nt, hsa
uagaaaucacuggaaagaggagaggaaagaaccagguaggcaaauggucugugaaacccuugggu

SEQ ID NO: 549854 - RNA, 65 nt, hsa
ccaagcagugaaaugaaccuuggguuagaguuaugguaggcaaaaagaaaaggagaauuuaggaa

SEQ ID NO: 549855 - RNA, 65 nt, hsa
ucccuaagcaguugggaagaacaaauuguaugcauguaggcaaagauuuugaagauacauuugca

SEQ ID NO: 549856 - RNA, 65 nt, hsa
uuaguagaaucagggaggacgggacuuaugcugugguaggcaacagaaaaaaacuucuauugauu

SEQ ID NO: 549857 - RNA, 65 nt, hsa
aaucuauuauaguuaccuauuuuaagguaaggucuguaggcaagauauguaaguaaagacaagcc

SEQ ID NO: 549858 - RNA, 65 nt, hsa
cuucacugcuuugaauacauacuauggauauaaauguaggcaaaaugaaagauuaugacuaauau

SEQ ID NO: 549859 - RNA, 65 nt, hsa
acagauuuaaauuuuauuugaaaaaaugaaauaaaguaggcaaaaaaauaaagauguuuauuuuu

SEQ ID NO: 549860 - RNA, 65 nt, hsa
cuugcacauaaugugcuauuucugugaguuuuaaaguaggcaagggauaauaaccaaagaagaaa

SEQ ID NO: 549861 - RNA, 65 nt, hsa
uuacauuggcacaauguauacuucagugcucacccguaggcaaaucucuuuuuaaaaaacucuuu

SEQ ID NO: 549862 - RNA, 65 nt, hsa
uuuuuuuuuuuucaugaaaaagugcucaaauuaugguaggcaacuaacgguguuuuuaagggggu

SEQ ID NO: 549863 - RNA, 65 nt, hsa
uuuguaaaaaggaaguauuucucccaaaauugggaguaggcaaacuacuaaucaguuuagcuuug

SEQ ID NO: 549864 - RNA, 65 nt, hsa
ucauuuuuaagagaguacagacauacacuuuuugaguaggcaauauguucacauaguuugaaauu

SEQ ID NO: 549865 - RNA, 65 nt, hsa
cacggguguuggugcaacucaccagcaggugugcaguaggcaagcuugaagguggcccaugcuuc

SEQ ID NO: 549866 - RNA, 65 nt, hsa
ucugaggggcuaucaauguguagauaaagcccugaguaggcaagagcagugagauccacugcuau

SEQ ID NO: 549867 - RNA, 65 nt, hsa
aggcuacagacauauacagcauguuacugaauacuguaggcaauaguaacagugguauuuguaua

SEQ ID NO: 549868 - RNA, 65 nt, hsa
agagguccugccuccccauuucucaagggaagccaguaggcaacacagccagcacggugcucucc

SEQ ID NO: 549869 - RNA, 65 nt, hsa
uuuguauaauuaaaaggaaaacagaaaaaggaaaaguaggcaaaugugaaaauaguuucaauaua

SEQ ID NO: 549870 - RNA, 65 nt, hsa
gcacuuuauaauaaagcauggaagaaauuaucuuaguaggcaauuguaacacuuuuugaaaguaa

SEQ ID NO: 549871 - RNA, 65 nt, hsa
uuucacauaauguaaaguucuacaaaauaaagcuaguaggcaagaccccucaguguauaccuuua

SEQ ID NO: 549872 - RNA, 65 nt, hsa
uaaaauuaauuguagacuccaggauacaaaccauaguaggcaauacaauuuuagaauguaauaua

SEQ ID NO: 549873 - RNA, 65 nt, hsa
uuaucagguuguuagaugauaacucaaaauuuucaguaggcaaauagguaauguggaaaucugaa

SEQ ID NO: 549874 - RNA, 65 nt, hsa
caucuauguaucuaccaucuaaucuaugcauguauguaggcaauacauguaucuaaacaauguau

SEQ ID NO: 549875 - RNA, 65 nt, hsa
caagaaguagcuuuucaauuugcuagaagcuuaauguaggcaagccacuucauuuuucagaacuu

SEQ ID NO: 549876 - RNA, 65 nt, hsa
uuuuuauuucugccuuuguguagacugaugauuaaguaggcaaacuacuucuacuuucaaagagc

SEQ ID NO: 549877 - RNA, 65 nt, hsa
gauccauuccacucuauaauaaaacaaaagauuuuguaggcaacucggaauauagcucuuuugaa

SEQ ID NO: 549878 - RNA, 65 nt, hsa
uuuugcuacugauuuuccuuaauuugugggaaggaguaggcaaagaauaugcuuacaugauuaca

SEQ ID NO: 549879 - RNA, 65 nt, hsa
uuaugaaggaggucauugaaaaagagaacagugacguaggcaaauguuucaagcacuuuagaaac

SEQ ID NO: 549880 - RNA, 65 nt, hsa
aauggcacuaggagcugauguuugccucauuuaaaguaggcaagccgagccaacugcagccauca

SEQ ID NO: 549881 - RNA, 65 nt, hsa
ggaaucugcaaugagugauuacaugcuuguaauagguaggcaauuccuugauuacaggaagcuuu

SEQ ID NO: 549882 - RNA, 65 nt, hsa
uaaucuuguggcaucagggaaauauuuguuacauaguaggcaauuuuuauccaguacuuuauaga

SEQ ID NO: 549883 - RNA, 65 nt, hsa
uuucuagugccuuucuugucuugauuguauggucaguaggcaaucuuaaauguuuuuauuuaaaa

SEQ ID NO: 549884 - RNA, 65 nt, hsa
cuccugguacauugccauuccaaggaauucugagaguaggcaaacaaauuuugccuucaugguac

SEQ ID NO: 549885 - RNA, 65 nt, hsa
ucuucaaagguccuuagguguaaauugaugccaucguaggcaaggugcaggcaggauuugaaggc

SEQ ID NO: 549886 - RNA, 65 nt, hsa
aagacauauguccacuaaguacuccaauuaccagcguaggcaaaaugagcuuccaccucugucca

SEQ ID NO: 549887 - RNA, 65 nt, hsa
caggaccauugucccaaagucuagagucuuuacagguaggcaaaauuuguuuucaaugccugugc

SEQ ID NO: 549888 - RNA, 65 nt, hsa
gacacacuacuuaacacuccuaaagacuacuuugaguaggcaacauaacuaaauuuuucuaguuu

SEQ ID NO: 549889 - RNA, 65 nt, hsa
ucugggaccgcagccugccgcuccgaacugagcccguaggcaaggugcaccugggugcccgggcc

SEQ ID NO: 549890 - RNA, 65 nt, hsa
caugacagaauguauguagagaguuggggugucugguaggcaaacugcaaggcaguugagauagu

SEQ ID NO: 549891 - RNA, 65 nt, hsa
gccugccuucuccuugaaaccuugguuaugacugcguaggcaagaaguugaaaaacaguugauuu

SEQ ID NO: 549892 - RNA, 65 nt, hsa
aucacugagguuggccagccccugccaaguguuguguaggcaaagcacuuguuaguggcuuccua

SEQ ID NO: 549893 - RNA, 65 nt, hsa
gaaaccaucuacauuccauggaauguuuuuaauaaguaggcaagaaaaaugccacuaaucaaagc

SEQ ID NO: 549894 - RNA, 65 nt, hsa
ucuuuuuuuuuuuuuaagagcugugucauccuuauguaggcaagagauguuugcuuuuguuaaaa

SEQ ID NO: 549895 - RNA, 65 nt, hsa
gcuuugagucauuuuaugaagcuaggucuuaaugcguaggcaaccucccagcucacuaugaacgc

SEQ ID NO: 549896 - RNA, 65 nt, hsa
gguuuccccauccacugaguguagcauccucagagguaggcaaguuugcuucuagggaguuagca

SEQ ID NO: 549897 - RNA, 65 nt, hsa
auucagaaccuauuuuuuaucaucuuauuuucaaaguaggcaaaagcaaaaucacuuaauuagua

SEQ ID NO: 549898 - RNA, 65 nt, hsa
ucuuaaaucaaggcugucugcuuauuuauacuagcguaggcaacacuuggauuucccuucuuagu

SEQ ID NO: 549899 - RNA, 65 nt, hsa
auugagcacuugcuguauaugcaguauugagcacuguaggcaagagggaagaaagagaaggagcc

SEQ ID NO: 549900 - RNA, 65 nt, hsa
ucaguuacacucaaagcuuucuuggaccccguuccguaggcaauaacgugcguccgccucagcgc

SEQ ID NO: 549901 - RNA, 65 nt, hsa
ugacuuguuuuauaauugcuacugauuuuuuuaauguaggcaaagcuuuguuacuuugaaauuua

SEQ ID NO: 549902 - RNA, 65 nt, hsa
guugaggcccagccacucucccuggggccugguggguaggcaaguagcucuggggccaccucaag

SEQ ID NO: 549903 - RNA, 65 nt, hsa
auugacuagaccaccagaggaggaugugugggauuguaggcaaacccaccuguggcaucacugaa

SEQ ID NO: 549904 - RNA, 65 nt, hsa
uuaaaguuccucaguaagaaaaaaaauguguuuuuguaggcaaaaagaacauuucuaaagucuca

SEQ ID NO: 549905 - RNA, 65 nt, hsa
gaagacaauguuuuuaauuacaaauccagaauucuguaggcaaaaugcuacaguucauaucuucc

SEQ ID NO: 549906 - RNA, 65 nt, hsa
uguuuaauuuagauaaguuugagggaaaauaaucaguaggcaagaggaacauuuuuccuguagua

SEQ ID NO: 549907 - RNA, 65 nt, hsa
ccugccauguuuccaugugccauuucuuaccccuuguaggcaauggcaaagaauguggucaggcu

SEQ ID NO: 549908 - RNA, 65 nt, hsa
ccccuugggauuauggcuuagaagaagggggcuggguaggcaagcacuccuuggcuguguccucu

SEQ ID NO: 549909 - RNA, 65 nt, hsa
gcagguugaacaacuccauguagauaagagcaaguguaggcaaagguuuagaaaauggacauaaa

SEQ ID NO: 549910 - RNA, 65 nt, hsa
uauuuauuuacaaguaugacuauuuuuuuuucaaaguaggcaauucuuuguauauuuuaaggcaa

SEQ ID NO: 549911 - RNA, 65 nt, hsa
aaggaguuugugguacgaccccucccccuccccaaguaggcaaggacugcacguuucuuucucuc

SEQ ID NO: 549912 - RNA, 65 nt, hsa
uacuaucaaccgggaguuugggguccuccccugaaguaggcaaggacugcacguuucuuucucuc

SEQ ID NO: 549913 - RNA, 65 nt, hsa
aauuuccccccucgugcgcaucucagaacccaucgguaggcaaaggaaaauacgcucaggugguu

SEQ ID NO: 549914 - RNA, 65 nt, hsa
cugccccugccgccugugcccuugcuggguccaggguaggcaaggcugccggcugcacccuguau

SEQ ID NO: 549915 - RNA, 65 nt, hsa
aggcuuugugggccuuugccccuuagaaaguagcuguaggcaaagauuugugauuuuccaauuac

SEQ ID NO: 549916 - RNA, 65 nt, hsa
auuuaaaauuuguugcagcaagaacuuuccuaccuguaggcaauagauugcuauguuuuuaacaa

SEQ ID NO: 549917 - RNA, 65 nt, hsa
ccccacccucacuccagccaucucggagcccuuguguaggcaacgcccggugcgggcuguguggg

SEQ ID NO: 549918 - RNA, 65 nt, hsa
cuacaucagucauuguuacauggaaaagacaggugguaggcaaguagguggaggaucucgguuug

SEQ ID NO: 549919 - RNA, 65 nt, hsa
ugcauuuccugaagauguuuaaacgugagagucugguaggcaaagcagucugagaaagaaauagg

SEQ ID NO: 549920 - RNA, 65 nt, hsa
gcucccucuuauuuuuacaaguuucauuuuuaaaaguaggcaacuacuuuggguuacaguauuuu

SEQ ID NO: 549921 - RNA, 65 nt, hsa
ucaguaaaguuuuuuaagaauguuuaucucagccaguaggcaaauacuugguguaaaacaaguug

SEQ ID NO: 549922 - RNA, 65 nt, hsa
ugcagugagcugagauaacgccacugcacuccaguguaggcaacagagugagacccugucucaaa

SEQ ID NO: 549923 - RNA, 65 nt, hsa
ggccggcgggcgcgcccgaagcgcccauccucgugguaggcaacaagcgggacaggcagcggcug

SEQ ID NO: 549924 - RNA, 65 nt, hsa
gacaaccucagucucccuuugggaccuguccaaggguaggcaaccaccuucaccuucacacagau

SEQ ID NO: 549925 - RNA, 65 nt, hsa
caccccacccacuccauccuacccagggaccccaaguaggcaacuguuauggcaguggguccagc

SEQ ID NO: 549926 - RNA, 65 nt, hsa
ugcagauaaaagagguuuaugaaguuuagggugaaguaggcaagggaaucuguuuacucccucuu

SEQ ID NO: 549927 - RNA, 65 nt, hsa
ucauaugaaaggccaaggggcuuuaucuuuuacuaguaggcaagccugggcauuucugcauuugu

SEQ ID NO: 549928 - RNA, 65 nt, hsa
aauugcaaaauauguauuuuuaaaguucaugauuuguaggcaaagauguuaagagcauuguuucc

SEQ ID NO: 549929 - RNA, 65 nt, hsa
cauauuagaaaacuuuguuaggccaaagacaaauaguaggcaagauggcacagggcaugaaauga

SEQ ID NO: 549930 - RNA, 65 nt, hsa
cuuguguuguuucaagaguuuuaguuaaauaggaaguaggcaaauguaacuacugaguaucucuu

SEQ ID NO: 549931 - RNA, 65 nt, hsa
agugaccaauauguucauauuaagcaguacagaguguaggcaagagaaagaauauguuauuguuc

SEQ ID NO: 549932 - RNA, 65 nt, hsa
uuugaaaaaggugacucaccccucauuuccagaguguaggcaauuauguccugcuuugauaaaac

SEQ ID NO: 549933 - RNA, 65 nt, hsa
cucaguuacucccuguaacuauguuaugcugugaaguaggcaauacaguuguuaaagaagaauaa

SEQ ID NO: 549934 - RNA, 64 nt, hsa; identical to SEQ ID NO: 266194

SEQ ID NO: 549935 - RNA, 64 nt, hsa; identical to SEQ ID NO: 266195

SEQ ID NO: 549936 - RNA, 64 nt, hsa; identical to SEQ ID NO: 266196

SEQ ID NO: 549937 - RNA, 64 nt, hsa; identical to SEQ ID NO: 266197

SEQ ID NO: 549938 - RNA, 64 nt, hsa; identical to SEQ ID NO: 266198

SEQ ID NO: 549939 - RNA, 64 nt, hsa; identical to SEQ ID NO: 266199

SEQ ID NO: 549940 - RNA, 64 nt, hsa; identical to SEQ ID NO: 266200

SEQ ID NO: 549941 - RNA, 64 nt, hsa; identical to SEQ ID NO: 266201

SEQ ID NO: 549942 - RNA, 64 nt, hsa; identical to SEQ ID NO: 266202

SEQ ID NO: 549943 - RNA, 64 nt, hsa; identical to SEQ ID NO: 266203

SEQ ID NO: 549944 - RNA, 64 nt, hsa; identical to SEQ ID NO: 266204

SEQ ID NO: 549945 - RNA, 64 nt, hsa; identical to SEQ ID NO: 266205

SEQ ID NO: 549946 - RNA, 64 nt, hsa; identical to SEQ ID NO: 266206

SEQ ID NO: 549947 - RNA, 64 nt, hsa; identical to SEQ ID NO: 266207

SEQ ID NO: 549948 - RNA, 64 nt, hsa; identical to SEQ ID NO: 266208

SEQ ID NO: 549949 - RNA, 64 nt, hsa; identical to SEQ ID NO: 266209

SEQ ID NO: 549950 - RNA, 64 nt, hsa; identical to SEQ ID NO: 266210

SEQ ID NO: 549951 - RNA, 64 nt, hsa; identical to SEQ ID NO: 266211

SEQ ID NO: 549952 - RNA, 64 nt, hsa; identical to SEQ ID NO: 266212

SEQ ID NO: 549953 - RNA, 64 nt, hsa; identical to SEQ ID NO: 266213

SEQ ID NO: 549954 - RNA, 64 nt, hsa; identical to SEQ ID NO: 266214

SEQ ID NO: 549955 - RNA, 64 nt, hsa; identical to SEQ ID NO: 266215

SEQ ID NO: 549956 - RNA, 64 nt, hsa; identical to SEQ ID NO: 266216

SEQ ID NO: 549957 - RNA, 64 nt, hsa; identical to SEQ ID NO: 266217

SEQ ID NO: 549958 - RNA, 64 nt, hsa; identical to SEQ ID NO: 266218

SEQ ID NO: 549959 - RNA, 64 nt, hsa; identical to SEQ ID NO: 266219

SEQ ID NO: 549960 - RNA, 64 nt, hsa; identical to SEQ ID NO: 266220

SEQ ID NO: 549961 - RNA, 64 nt, hsa; identical to SEQ ID NO: 266221

SEQ ID NO: 549962 - RNA, 64 nt, hsa; identical to SEQ ID NO: 266222

SEQ ID NO: 549963 - RNA, 64 nt, hsa; identical to SEQ ID NO: 266223

SEQ ID NO: 549964 - RNA, 64 nt, hsa; identical to SEQ ID NO: 266224

SEQ ID NO: 549965 - RNA, 64 nt, hsa; identical to SEQ ID NO: 266225

SEQ ID NO: 549966 - RNA, 64 nt, hsa; identical to SEQ ID NO: 266226

SEQ ID NO: 549967 - RNA, 64 nt, hsa; identical to SEQ ID NO: 266227

SEQ ID NO: 549968 - RNA, 64 nt, hsa; identical to SEQ ID NO: 266228

SEQ ID NO: 549969 - RNA, 64 nt, hsa; identical to SEQ ID NO: 266229

SEQ ID NO: 549970 - RNA, 64 nt, hsa; identical to SEQ ID NO: 266230

SEQ ID NO: 549971 - RNA, 64 nt, hsa; identical to SEQ ID NO: 266231

SEQ ID NO: 549972 - RNA, 64 nt, hsa; identical to SEQ ID NO: 266232

SEQ ID NO: 549973 - RNA, 64 nt, hsa; identical to SEQ ID NO: 266233

SEQ ID NO: 549974 - RNA, 64 nt, hsa; identical to SEQ ID NO: 266234

SEQ ID NO: 549975 - RNA, 64 nt, hsa; identical to SEQ ID NO: 266235

SEQ ID NO: 549976 - RNA, 64 nt, hsa; identical to SEQ ID NO: 266236

SEQ ID NO: 549977 - RNA, 64 nt, hsa; identical to SEQ ID NO: 266237

SEQ ID NO: 549978 - RNA, 64 nt, hsa; identical to SEQ ID NO: 266238

SEQ ID NO: 549979 - RNA, 64 nt, hsa; identical to SEQ ID NO: 266239

SEQ ID NO: 549980 - RNA, 64 nt, hsa; identical to SEQ ID NO: 266240

SEQ ID NO: 549981 - RNA, 64 nt, hsa; identical to SEQ ID NO: 266241

SEQ ID NO: 549982 - RNA, 64 nt, hsa; identical to SEQ ID NO: 266242

SEQ ID NO: 549983 - RNA, 64 nt, hsa; identical to SEQ ID NO: 266243

SEQ ID NO: 549984 - RNA, 64 nt, hsa; identical to SEQ ID NO: 266244

SEQ ID NO: 549985 - RNA, 64 nt, hsa; identical to SEQ ID NO: 266245

SEQ ID NO: 549986 - RNA, 64 nt, hsa; identical to SEQ ID NO: 266246

SEQ ID NO: 549987 - RNA, 64 nt, hsa; identical to SEQ ID NO: 266247

SEQ ID NO: 549988 - RNA, 64 nt, hsa; identical to SEQ ID NO: 266248

SEQ ID NO: 549989 - RNA, 64 nt, hsa; identical to SEQ ID NO: 266249

SEQ ID NO: 549990 - RNA, 64 nt, hsa; identical to SEQ ID NO: 266250

SEQ ID NO: 549991 - RNA, 64 nt, hsa; identical to SEQ ID NO: 266251

SEQ ID NO: 549992 - RNA, 64 nt, hsa; identical to SEQ ID NO: 266252

SEQ ID NO: 549993 - RNA, 64 nt, hsa
ucacauuaaauaguaugguuuccaaaauaugucugcacaacaagaccucuuuauguaauucagg

SEQ ID NO: 549994 - RNA, 64 nt, hsa
aucuugaugcaggguuucuuaaccugcagucuaugcacaacacuauauuuccauguaauguuuu

SEQ ID NO: 549995 - RNA, 64 nt, hsa
acugccagggaaggcuaaggaaauggggauuugagcacaacaggaaagccugggaggguuguug

SEQ ID NO: 549996 - RNA, 64 nt, hsa
ggggcuccacaugagagguccugcaugccccugggcacaacaaggacugauucaaucugcaugc

SEQ ID NO: 549997 - RNA, 64 nt, hsa; identical to SEQ ID NO: 247936

SEQ ID NO: 549998 - RNA, 64 nt, hsa; identical to SEQ ID NO: 247937

SEQ ID NO: 549999 - RNA, 64 nt, hsa; identical to SEQ ID NO: 247938

SEQ ID NO: 550000 - RNA, 64 nt, hsa; identical to SEQ ID NO: 247939

SEQ ID NO: 550001 - RNA, 64 nt, hsa; identical to SEQ ID NO: 247940

SEQ ID NO: 550002 - RNA, 64 nt, hsa; identical to SEQ ID NO: 247941

SEQ ID NO: 550003 - RNA, 64 nt, hsa; identical to SEQ ID NO: 247942

SEQ ID NO: 550004 - RNA, 64 nt, hsa; identical to SEQ ID NO: 247943

SEQ ID NO: 550005 - RNA, 64 nt, hsa; identical to SEQ ID NO: 247944

SEQ ID NO: 550006 - RNA, 64 nt, hsa; identical to SEQ ID NO: 247945

SEQ ID NO: 550007 - RNA, 64 nt, hsa; identical to SEQ ID NO: 247946

SEQ ID NO: 550008 - RNA, 64 nt, hsa; identical to SEQ ID NO: 247947

SEQ ID NO: 550009 - RNA, 64 nt, hsa; identical to SEQ ID NO: 247948

SEQ ID NO: 550010 - RNA, 64 nt, hsa; identical to SEQ ID NO: 247949

SEQ ID NO: 550011 - RNA, 64 nt, hsa; identical to SEQ ID NO: 247950

SEQ ID NO: 550012 - RNA, 64 nt, hsa; identical to SEQ ID NO: 247951

SEQ ID NO: 550013 - RNA, 64 nt, hsa; identical to SEQ ID NO: 247952

SEQ ID NO: 550014 - RNA, 64 nt, hsa; identical to SEQ ID NO: 247953

SEQ ID NO: 550015 - RNA, 64 nt, hsa; identical to SEQ ID NO: 247954

SEQ ID NO: 550016 - RNA, 64 nt, hsa; identical to SEQ ID NO: 247955

SEQ ID NO: 550017 - RNA, 64 nt, hsa; identical to SEQ ID NO: 247956

SEQ ID NO: 550018 - RNA, 64 nt, hsa; identical to SEQ ID NO: 247957

SEQ ID NO: 550019 - RNA, 64 nt, hsa; identical to SEQ ID NO: 247958

SEQ ID NO: 550020 - RNA, 64 nt, hsa; identical to SEQ ID NO: 247959

SEQ ID NO: 550021 - RNA, 64 nt, hsa; identical to SEQ ID NO: 247960

SEQ ID NO: 550022 - RNA, 64 nt, hsa; identical to SEQ ID NO: 247961

SEQ ID NO: 550023 - RNA, 64 nt, hsa; identical to SEQ ID NO: 247962

SEQ ID NO: 550024 - RNA, 64 nt, hsa; identical to SEQ ID NO: 247963

SEQ ID NO: 550025 - RNA, 64 nt, hsa; identical to SEQ ID NO: 247964

SEQ ID NO: 550026 - RNA, 64 nt, hsa; identical to SEQ ID NO: 247965

SEQ ID NO: 550027 - RNA, 64 nt, hsa; identical to SEQ ID NO: 247966

SEQ ID NO: 550028 - RNA, 64 nt, hsa; identical to SEQ ID NO: 247967

SEQ ID NO: 550029 - RNA, 64 nt, hsa; identical to SEQ ID NO: 247968

SEQ ID NO: 550030 - RNA, 64 nt, hsa; identical to SEQ ID NO: 247969

SEQ ID NO: 550031 - RNA, 64 nt, hsa; identical to SEQ ID NO: 247970

SEQ ID NO: 550032 - RNA, 64 nt, hsa; identical to SEQ ID NO: 247971

SEQ ID NO: 550033 - RNA, 64 nt, hsa; identical to SEQ ID NO: 247972

SEQ ID NO: 550034 - RNA, 64 nt, hsa; identical to SEQ ID NO: 247973

SEQ ID NO: 550035 - RNA, 64 nt, hsa; identical to SEQ ID NO: 247974

SEQ ID NO: 550036 - RNA, 64 nt, hsa; identical to SEQ ID NO: 247975

SEQ ID NO: 550037 - RNA, 64 nt, hsa; identical to SEQ ID NO: 247976

SEQ ID NO: 550038 - RNA, 64 nt, hsa; identical to SEQ ID NO: 247977

SEQ ID NO: 550039 - RNA, 64 nt, hsa; identical to SEQ ID NO: 247978

SEQ ID NO: 550040 - RNA, 64 nt, hsa
uaaaaauacaaaauuagccgggcaugguggugcacgccucuaaucccagcuacucgggaggcug

SEQ ID NO: 550041 - RNA, 64 nt, hsa
uuucgagaccaaccugaccuacauggagaaacuccgccucuaguaaaaauacaaaauuagccgg

SEQ ID NO: 550042 - RNA, 64 nt, hsa
gcuggacuccugaagccccgcugcugagaugggcgcucccgacacagcgcagacccaccaggag

SEQ ID NO: 550043 - RNA, 64 nt, hsa
ggaaccuacagccccagccgucaggagaaggagggcucccgaguggaaauguggaacuugaugc

SEQ ID NO: 550044 - RNA, 64 nt, hsa
acucugugcacuucagaccagcagcagcaggagggcucccgagggccuuaugagaaaaccugug

SEQ ID NO: 550045 - RNA, 64 nt, hsa
gagucacccugacacuggugccaggcugaccucagcucccgaaggcucgcacagccuccccauc

SEQ ID NO: 550046 - RNA, 64 nt, hsa
ggucucucccuuaacugcugcccuuccaagacuugcucccgagauggagugggcguggucuucc

SEQ ID NO: 550047 - RNA, 64 nt, hsa
gcagcgucugacccggaaacccuuucacuucucugcucccgagguguccucgggcucauaugug

SEQ ID NO: 550048 - RNA, 64 nt, hsa
auuccaucgugcugguagaagagucuuugcuguugcucccgaaagccgugcucuccagccuggc

SEQ ID NO: 550049 - RNA, 64 nt, hsa
uagguggauucugauucacugucaaugcuggguugcucccgagcccuagauguuccuggaaguu

SEQ ID NO: 550050 - RNA, 64 nt, hsa
gcaauacgaauuaugcaaucacaauacauuuguagcucccgaguguccuaaagggagugcacuu

SEQ ID NO: 550051 - RNA, 64 nt, hsa
gugcccaccgcccagcugcccacacccggugcaggcucccgaccagugcugcccuguuugcccu

SEQ ID NO: 550052 - RNA, 64 nt, hsa
uuggaaacaugcuccgcgccuccagagaaaaguugcucccgagguccaugccccuggaacgugu

SEQ ID NO: 550053 - RNA, 64 nt, hsa
uuuuuuguagagguggucuagccauguugccuaggcucccgaacuccugagcucaagcaauccu

SEQ ID NO: 550054 - RNA, 64 nt, hsa
cuggccugccacccuccugcgcaggccaugcauggcucccgaguacaguaguaucugcuuaggu

SEQ ID NO: 550055 - RNA, 64 nt, hsa
cacaccacagacccagacacagccaagggagagugcucccgacagguggccccagcuuccucuc

SEQ ID NO: 550056 - RNA, 64 nt, hsa
acaaccgguccacuccugccuuuucacucacacagcucccgacugcuucuugcagaggcugaga

SEQ ID NO: 550057 - RNA, 64 nt, hsa
acccggggcccccuuuccuccagggcccagucuggcucccgagcucagacacagcccccaggag

SEQ ID NO: 550058 - RNA, 64 nt, hsa
cgaguuuucaaugugaauuuguucuuacauuauggcucccgaggggaagcgauuacuuuuuuua

SEQ ID NO: 550059 - RNA, 64 nt, hsa
aucaucuuccugacccuggcaccugugucuacuugcucccgagaagaggagcgcucaugucuuu

SEQ ID NO: 550060 - RNA, 64 nt, hsa
uuucaccauuugucuuucauuuuaaagguuauuugcucccgauuauaugauucaaguguuauaa

SEQ ID NO: 550061 - RNA, 64 nt, hsa
gaauccucgaagcuuauguauccagccacagacagcucccgaugcgcugcccccugagaaaaca

SEQ ID NO: 550062 - RNA, 64 nt, hsa
gcuugcuucaugggcuaggagccgccgagcccgggcucccgagagcaaccucgugaccucagca

SEQ ID NO: 550063 - RNA, 64 nt, hsa
ucggaccagccagcugguccucugggaacagccagcucccgagcacagccgcacuccuguugac

SEQ ID NO: 550064 - RNA, 64 nt, hsa
aaucagugguguggggcacuguagagacuagccagcucccgacggaaggggucugugucuugua

SEQ ID NO: 550065 - RNA, 64 nt, hsa
gcuggcuguguauacccacuaggcugccccacgugcucccgagagaugacacuagucagaaaau

SEQ ID NO: 550066 - RNA, 64 nt, hsa
auggugcagccaaaggccccgucuagcuuggcuggcucccgaacauguccauauuugaaggcug

SEQ ID NO: 550067 - RNA, 64 nt, hsa
uggaagcccugaucccccagagagcuacaggucugcucccgacgggccucgggccugacccguc

SEQ ID NO: 550068 - RNA, 64 nt, hsa
ucccagucaccuuugcagacaaagaccaggggcagcucccgagggcacugugaaggcucccaug

SEQ ID NO: 550069 - RNA, 64 nt, hsa
agcacagagcaucucaguuggacuggaccacagugcucccgagagccugccuuuccugcccuuc

SEQ ID NO: 550070 - RNA, 64 nt, hsa
ucgagagggugucagugagcagacugcaccccaagcucccgacuccagguccccugaucuuggg

SEQ ID NO: 550071 - RNA, 64 nt, hsa
uuccaaaucacaauuucuuacaaccaagcuuugugcucccgaguaagcagggauguacuagggg

SEQ ID NO: 550072 - RNA, 64 nt, hsa
agggaggacaggcgggaggaggugugaggaggaggcucccgaggggaaggggcggugcccacac

SEQ ID NO: 550073 - RNA, 64 nt, hsa
gaacuuugggguacgccucccuaucugagcccccgcucccgaucgugggcugaaccuugccuuc

SEQ ID NO: 550074 - RNA, 64 nt, hsa
gggaccucccccaucacccagguuccuacucugggcucccgauucccauggcucccaaaccaug

SEQ ID NO: 550075 - RNA, 64 nt, hsa
ugugucugcaccagaagaggcucccacagacucugcucccgagaagccaagugaugcuggggag

SEQ ID NO: 550076 - RNA, 64 nt, hsa
agccaugcugugauaccggcggaccaggacugcagcucccgaagccugagcucauccgccgugg

SEQ ID NO: 550077 - RNA, 64 nt, hsa
ugagaggcgugaguugagauggguuuucccugaugcucccgacuccccuccccaccaccuccca

SEQ ID NO: 550078 - RNA, 64 nt, hsa
caagccugccacuccugugucccugccucccugggcucccgagauaggcaccacuguauccucc

SEQ ID NO: 550079 - RNA, 64 nt, hsa
ccgccaguguuggcggugucgccgcaaccugcaggcucccgaguggggccugccuggucucuag

SEQ ID NO: 550080 - RNA, 64 nt, hsa
cuguugaccugcccgauccagauucccaggccaggcucccgaccccauccaccuauccaccacc

SEQ ID NO: 550081 - RNA, 64 nt, hsa
gcgggugcgcucggugacacuggugguggugcacgcucccgagcucccagaguuaacacuaauc

SEQ ID NO: 550082 - RNA, 64 nt, hsa
aaugugcucgcugccccgcggcuucgagccccaagcucccgaggacuuggcgcagcggaguuug

SEQ ID NO: 550083 - RNA, 64 nt, hsa
acugagggcagagccuguaggugcagaggcccuggcucccgagguccagccacucucccugggg

SEQ ID NO: 550084 - RNA, 64 nt, hsa
cacccacucccuuccccauagauaggccccuggggcucccgaagaaugaacccaagagcaaggg

SEQ ID NO: 550085 - RNA, 64 nt, hsa
ccacucacuuaucucaguggacuccaaagcaaaagcucccgacuacuagcucuguuaguuccag

SEQ ID NO: 550086 - RNA, 64 nt, hsa
cuaugaaccucugcugggcccagccccugucccagcucccgaccugcacuuccugcuggacuca

SEQ ID NO: 550087 - RNA, 64 nt, hsa
ugguuccugggccuuauagccagguuuguguggcgcucccgacuuuugugacugacuggugucu

SEQ ID NO: 550088 - RNA, 64 nt, hsa
uuggaugaggcccguccggagggagccaucucuugcucccgaggcugggacaguccuuucugug

SEQ ID NO: 550089 - RNA, 64 nt, hsa
ucacagcugucagugcagccauuugcccagggcugcucccgagggggaugaugggaaauucagc

SEQ ID NO: 550090 - RNA, 64 nt, hsa
ggggguccugacucacacuuacugcaaaggcuuggcucccgaaugucgcauuugguggacgaga

SEQ ID NO: 550091 - RNA, 64 nt, hsa
uaaugacauggacuuggcggggggacaagacaaagcucccgaugcugcauggggcgcugccaga

SEQ ID NO: 550092 - RNA, 64 nt, hsa
agggugaacaaaccccgagggaggcccggcccuugcucccgaguuggggggaggggguguggca

SEQ ID NO: 550093 - RNA, 64 nt, hsa
ccuccugcccacgcagaccugcagcgggcaaagagcucccgaggaagcacagcuugggucaggu

SEQ ID NO: 550094 - RNA, 64 nt, hsa
uaccuugguggugggacuuggaacccaacccugagcucccgauaaagcuaaaguccaucaucug

SEQ ID NO: 550095 - RNA, 64 nt, hsa
ccuccccuucgggcccccuccuccugcaaaacccgcucccgaagcggcgcugccgucugcagcc

SEQ ID NO: 550096 - RNA, 64 nt, hsa
gcccccuccacuccacucugcuuccacaaagucggcucccgagagcucgaggcugcuucuguuu

SEQ ID NO: 550097 - RNA, 64 nt, hsa
guccgacucaguaugcagucgcaauaacaugucugcucccgagguuaacauucaagcguuucua

SEQ ID NO: 550098 - RNA, 64 nt, hsa
caggcugccaggauggcgugugugccgugacagggcucccgagucaugcacucaggcagacagc

SEQ ID NO: 550099 - RNA, 64 nt, hsa
gaaaguaaaauuguuuuuucuguccgcaacacuggcucccgagcagcuuuuguuaaagcaguag

SEQ ID NO: 550100 - RNA, 64 nt, hsa
ucugccggcugccucucccccuccgagcccguccgcucccgagcucggugacuuccacugucgc

SEQ ID NO: 550101 - RNA, 64 nt, hsa
ccacccgccaagcauaguucagggccacgcgccugcucccgaugcacggggagaagggcgacuu

SEQ ID NO: 550102 - RNA, 64 nt, hsa
cucucugccaaggcuccagcuucuucccccagcugcucccgaccaggagggggagagcagccuc

SEQ ID NO: 550103 - RNA, 64 nt, hsa
ccuccgcgggccugagcgugggcgcgccccugcggcucccgaggguccaggccccgcccccaaa

SEQ ID NO: 550104 - RNA, 64 nt, hsa
caaguacaccagccaccuccagacaccagugcgugcucccgaugcugcuauggaaggugcuacu

SEQ ID NO: 550105 - RNA, 64 nt, hsa
gccugcagugguuggagacgggaguggcccuucggcucccgagcucccucuggggacggcuggc

SEQ ID NO: 550106 - RNA, 64 nt, hsa
cacacccagcguagggggagucugagccgggagggcucccgagucucugccuucagcucccaaa

SEQ ID NO: 550107 - RNA, 64 nt, hsa
uggcugugcccgaugugcaccucccggaagugcagcucccgaaagucccagagaugaaacuccc

SEQ ID NO: 550108 - RNA, 64 nt, hsa
guggcuuuuuaacaugaaaaacacggcagcuguagcucccgagcuacucucuugccagcauuuu

SEQ ID NO: 550109 - RNA, 64 nt, hsa
uacuggcgcucacgcugccauccgaccacccucggcucccgaguccacgccugccugggccugu

SEQ ID NO: 550110 - RNA, 64 nt, hsa
gcaucugaucuauucgcuaccgggacuccuccaggcucccgagaggagucgggacccuucggcu

SEQ ID NO: 550111 - RNA, 64 nt, hsa
cuccagcugcucacagacgccagcaaagcaguaugcucccgaucaaguagauuuuuaaaaaauc

SEQ ID NO: 550112 - RNA, 64 nt, hsa
uaagcuagcacccgugguaagcgggacgagacaagcucccgaagcccgccagcuuccugcucca

SEQ ID NO: 550113 - RNA, 64 nt, hsa
uucccuggucccuacucaacaaaauaugaugauggcucccgacacaagcgccagggccagggcu

SEQ ID NO: 550114 - RNA, 64 nt, hsa
ggacccaggacggagcggggcugcccugccugaggcucccgaggagcuuugugcuuugguguuc

SEQ ID NO: 550115 - RNA, 64 nt, hsa; identical to SEQ ID NO: 344618

SEQ ID NO: 550116 - RNA, 64 nt, hsa; identical to SEQ ID NO: 344619

SEQ ID NO: 550117 - RNA, 64 nt, hsa; identical to SEQ ID NO: 344620

SEQ ID NO: 550118 - RNA, 64 nt, hsa; identical to SEQ ID NO: 344621

SEQ ID NO: 550119 - RNA, 64 nt, hsa; identical to SEQ ID NO: 344622

SEQ ID NO: 550120 - RNA, 64 nt, hsa; identical to SEQ ID NO: 344623

SEQ ID NO: 550121 - RNA, 64 nt, hsa; identical to SEQ ID NO: 247175

SEQ ID NO: 550122 - RNA, 64 nt, hsa; identical to SEQ ID NO: 247176

SEQ ID NO: 550123 - RNA, 64 nt, hsa; identical to SEQ ID NO: 247177

SEQ ID NO: 550124 - RNA, 64 nt, hsa; identical to SEQ ID NO: 247178

SEQ ID NO: 550125 - RNA, 64 nt, hsa; identical to SEQ ID NO: 247179

SEQ ID NO: 550126 - RNA, 64 nt, hsa; identical to SEQ ID NO: 247180

SEQ ID NO: 550127 - RNA, 64 nt, hsa; identical to SEQ ID NO: 247181

SEQ ID NO: 550128 - RNA, 64 nt, hsa; identical to SEQ ID NO: 247182

SEQ ID NO: 550129 - RNA, 64 nt, hsa; identical to SEQ ID NO: 247183

SEQ ID NO: 550130 - RNA, 64 nt, hsa; identical to SEQ ID NO: 247184

SEQ ID NO: 550131 - RNA, 64 nt, hsa; identical to SEQ ID NO: 247185

SEQ ID NO: 550132 - RNA, 64 nt, hsa; identical to SEQ ID NO: 247186

SEQ ID NO: 550133 - RNA, 64 nt, hsa; identical to SEQ ID NO: 247187

SEQ ID NO: 550134 - RNA, 64 nt, hsa; identical to SEQ ID NO: 247188

SEQ ID NO: 550135 - RNA, 64 nt, hsa; identical to SEQ ID NO: 247189

SEQ ID NO: 550136 - RNA, 64 nt, hsa; identical to SEQ ID NO: 247190

SEQ ID NO: 550137 - RNA, 64 nt, hsa; identical to SEQ ID NO: 247191

SEQ ID NO: 550138 - RNA, 64 nt, hsa; identical to SEQ ID NO: 247192

SEQ ID NO: 550139 - RNA, 64 nt, hsa; identical to SEQ ID NO: 247193

SEQ ID NO: 550140 - RNA, 64 nt, hsa; identical to SEQ ID NO: 247194

SEQ ID NO: 550141 - RNA, 64 nt, hsa; identical to SEQ ID NO: 247195

SEQ ID NO: 550142 - RNA, 64 nt, hsa; identical to SEQ ID NO: 247196

SEQ ID NO: 550143 - RNA, 64 nt, hsa; identical to SEQ ID NO: 247197

SEQ ID NO: 550144 - RNA, 64 nt, hsa; identical to SEQ ID NO: 247198

SEQ ID NO: 550145 - RNA, 64 nt, hsa; identical to SEQ ID NO: 247199

SEQ ID NO: 550146 - RNA, 64 nt, hsa; identical to SEQ ID NO: 247200

SEQ ID NO: 550147 - RNA, 64 nt, hsa; identical to SEQ ID NO: 247201

SEQ ID NO: 550148 - RNA, 61 nt, hsa; identical to SEQ ID NO: 247202

SEQ ID NO: 550149 - RNA, 64 nt, hsa; identical to SEQ ID NO: 247203

SEQ ID NO: 550150 - RNA, 64 nt, hsa; identical to SEQ ID NO: 247204

SEQ ID NO: 550151 - RNA, 64 nt, hsa; identical to SEQ ID NO: 247205

SEQ ID NO: 550152 - RNA, 64 nt, hsa; identical to SEQ ID NO: 247206

SEQ ID NO: 550153 - RNA, 64 nt, hsa; identical to SEQ ID NO: 247207

SEQ ID NO: 550154 - RNA, 64 nt, hsa; identical to SEQ ID NO: 247208

SEQ ID NO: 550155 - RNA, 64 nt, hsa; identical to SEQ ID NO: 247209

SEQ ID NO: 550156 - RNA, 64 nt, hsa; identical to SEQ ID NO: 247210

SEQ ID NO: 550157 - RNA, 64 nt, hsa; identical to SEQ ID NO: 247211

SEQ ID NO: 550158 - RNA, 64 nt, hsa; identical to SEQ ID NO: 247212

SEQ ID NO: 550159 - RNA, 64 nt, hsa; identical to SEQ ID NO: 247213

SEQ ID NO: 550160 - RNA, 64 nt, hsa; identical to SEQ ID NO: 247214

SEQ ID NO: 550161 - RNA, 64 nt, hsa; identical to SEQ ID NO: 247215

SEQ ID NO: 550162 - RNA, 64 nt, hsa; identical to SEQ ID NO: 247216

SEQ ID NO: 550163 - RNA, 64 nt, hsa; identical to SEQ ID NO: 247217

SEQ ID NO: 550164 - RNA, 64 nt, hsa; identical to SEQ ID NO: 247218

SEQ ID NO: 550165 - RNA, 64 nt, hsa; identical to SEQ ID NO: 247219

SEQ ID NO: 550166 - RNA, 64 nt, hsa; identical to SEQ ID NO: 247220

SEQ ID NO: 550167 - RNA, 64 nt, hsa; identical to SEQ ID NO: 247221

SEQ ID NO: 550168 - RNA, 64 nt, hsa; identical to SEQ ID NO: 247222

SEQ ID NO: 550169 - RNA, 64 nt, hsa; identical to SEQ ID NO: 247223

SEQ ID NO: 550170 - RNA, 64 nt, hsa; identical to SEQ ID NO: 247224

SEQ ID NO: 550171 - RNA, 64 nt, hsa; identical to SEQ ID NO: 247225

SEQ ID NO: 550172 - RNA, 64 nt, hsa; identical to SEQ ID NO: 247226

SEQ ID NO: 550173 - RNA, 64 nt, hsa; identical to SEQ ID NO: 247227

SEQ ID NO: 550174 - RNA, 64 nt, hsa; identical to SEQ ID NO: 247228

SEQ ID NO: 550175 - RNA, 64 nt, hsa; identical to SEQ ID NO: 247229

SEQ ID NO: 550176 - RNA, 64 nt, hsa; identical to SEQ ID NO: 247230

SEQ ID NO: 550177 - RNA, 64 nt, hsa; identical to SEQ ID NO: 247231

SEQ ID NO: 550178 - RNA, 64 nt, hsa; identical to SEQ ID NO: 247232

SEQ ID NO: 550179 - RNA, 64 nt, hsa; identical to SEQ ID NO: 247233

SEQ ID NO: 550180 - RNA, 64 nt, hsa; identical to SEQ ID NO: 247234

SEQ ID NO: 550181 - RNA, 64 nt, hsa; identical to SEQ ID NO: 247235

SEQ ID NO: 550182 - RNA, 64 nt, hsa; identical to SEQ ID NO: 247236

SEQ ID NO: 550183 - RNA, 64 nt, hsa; identical to SEQ ID NO: 247237

SEQ ID NO: 550184 - RNA, 64 nt, hsa; identical to SEQ ID NO: 247238

SEQ ID NO: 550185 - RNA, 64 nt, hsa; identical to SEQ ID NO: 247239

SEQ ID NO: 550186 - RNA, 64 nt, hsa; identical to SEQ ID NO: 247240

SEQ ID NO: 550187 - RNA, 64 nt, hsa; identical to SEQ ID NO: 247241

SEQ ID NO: 550188 - RNA, 64 nt, hsa; identical to SEQ ID NO: 247242

SEQ ID NO: 550189 - RNA, 64 nt, hsa; identical to SEQ ID NO: 247243

SEQ ID NO: 550190 - RNA, 64 nt, hsa; identical to SEQ ID NO: 247244

SEQ ID NO: 550191 - RNA, 64 nt, hsa; identical to SEQ ID NO: 247245

SEQ ID NO: 550192 - RNA, 64 nt, hsa; identical to SEQ ID NO: 247246

SEQ ID NO: 550193 - RNA, 64 nt, hsa; identical to SEQ ID NO: 247247

SEQ ID NO: 550194 - RNA, 64 nt, hsa; identical to SEQ ID NO: 247248

SEQ ID NO: 550195 - RNA, 64 nt, hsa; identical to SEQ ID NO: 247249

SEQ ID NO: 550196 - RNA, 64 nt, hsa; identical to SEQ ID NO: 247250

SEQ ID NO: 550197 - RNA, 64 nt, hsa; identical to SEQ ID NO: 247251

SEQ ID NO: 550198 - RNA, 64 nt, hsa; identical to SEQ ID NO: 247252

SEQ ID NO: 550199 - RNA, 64 nt, hsa; identical to SEQ ID NO: 409917

SEQ ID NO: 550200 - RNA, 64 nt, hsa; identical to SEQ ID NO: 409918

SEQ ID NO: 550201 - RNA, 64 nt, hsa; identical to SEQ ID NO: 409919

SEQ ID NO: 550202 - RNA, 64 nt, hsa; identical to SEQ ID NO: 409920

SEQ ID NO: 550203 - RNA, 64 nt, hsa; identical to SEQ ID NO: 409921

SEQ ID NO: 550204 - RNA, 64 nt, hsa; identical to SEQ ID NO: 409922

SEQ ID NO: 550205 - RNA, 64 nt, hsa; identical to SEQ ID NO: 409923

SEQ ID NO: 550206 - RNA, 64 nt, hsa; identical to SEQ ID NO: 409924

SEQ ID NO: 550207 - RNA, 64 nt, hsa; identical to SEQ ID NO: 409925

SEQ ID NO: 550208 - RNA, 64 nt, hsa; identical to SEQ ID NO: 409926

SEQ ID NO: 550209 - RNA, 64 nt, hsa; identical to SEQ ID NO: 409927

SEQ ID NO: 550210 - RNA, 64 nt, hsa; identical to SEQ ID NO: 409928

SEQ ID NO: 550211 - RNA, 64 nt, hsa; identical to SEQ ID NO: 409929

SEQ ID NO: 550212 - RNA, 64 nt, hsa; identical to SEQ ID NO: 409930

SEQ ID NO: 550213 - RNA, 64 nt, hsa; identical to SEQ ID NO: 409931

SEQ ID NO: 550214 - RNA, 64 nt, hsa; identical to SEQ ID NO: 409932

SEQ ID NO: 550215 - RNA, 64 nt, hsa; identical to SEQ ID NO: 409933

SEQ ID NO: 550216 - RNA, 64 nt, hsa; identical to SEQ ID NO: 409934

SEQ ID NO: 550217 - RNA, 64 nt, hsa; identical to SEQ ID NO: 409935

SEQ ID NO: 550218 - RNA, 64 nt, hsa; identical to SEQ ID NO: 409936

SEQ ID NO: 550219 - RNA, 64 nt, hsa; identical to SEQ ID NO: 409937

SEQ ID NO: 550220 - RNA, 64 nt, hsa; identical to SEQ ID NO: 409938

SEQ ID NO: 550221 - RNA, 64 nt, hsa; identical to SEQ ID NO: 409939

SEQ ID NO: 550222 - RNA, 64 nt, hsa; identical to SEQ ID NO: 409940

SEQ ID NO: 550223 - RNA, 64 nt, hsa; identical to SEQ ID NO: 409941

SEQ ID NO: 550224 - RNA, 64 nt, hsa; identical to SEQ ID NO: 409942

SEQ ID NO: 550225 - RNA, 64 nt, hsa; identical to SEQ ID NO: 409943

SEQ ID NO: 550226 - RNA, 64 nt, hsa; identical to SEQ ID NO: 409944

SEQ ID NO: 550227 - RNA, 64 nt, hsa; identical to SEQ ID NO: 409945

SEQ ID NO: 550228 - RNA, 64 nt, hsa; identical to SEQ ID NO: 409946

SEQ ID NO: 550229 - RNA, 64 nt, hsa; identical to SEQ ID NO: 409947

SEQ ID NO: 550230 - RNA, 64 nt, hsa; identical to SEQ ID NO: 409948

SEQ ID NO: 550231 - RNA, 64 nt, hsa; identical to SEQ ID NO: 409949

SEQ ID NO: 550232 - RNA, 64 nt, hsa; identical to SEQ ID NO: 409950

SEQ ID NO: 550233 - RNA, 64 nt, hsa; identical to SEQ ID NO: 409951

SEQ ID NO: 550234 - RNA, 64 nt, hsa; identical to SEQ ID NO: 409952

SEQ ID NO: 550235 - RNA, 64 nt, hsa; identical to SEQ ID NO: 409953

SEQ ID NO: 550236 - RNA, 64 nt, hsa; identical to SEQ ID NO: 409954

SEQ ID NO: 550237 - RNA, 64 nt, hsa; identical to SEQ ID NO: 409955

SEQ ID NO: 550238 - RNA, 64 nt, hsa; identical to SEQ ID NO: 409956

SEQ ID NO: 550239 - RNA, 64 nt, hsa; identical to SEQ ID NO: 409957

SEQ ID NO: 550240 - RNA, 64 nt, hsa; identical to SEQ ID NO: 409958

SEQ ID NO: 550241 - RNA, 64 nt, hsa; identical to SEQ ID NO: 409959

SEQ ID NO: 550242 - RNA, 64 nt, hsa; identical to SEQ ID NO: 409960

SEQ ID NO: 550243 - RNA, 64 nt, hsa; identical to SEQ ID NO: 409961

SEQ ID NO: 550244 - RNA, 64 nt, hsa; identical to SEQ ID NO: 409962

SEQ ID NO: 550245 - RNA, 64 nt, hsa; identical to SEQ ID NO: 409963

SEQ ID NO: 550246 - RNA, 64 nt, hsa; identical to SEQ ID NO: 409964

SEQ ID NO: 550247 - RNA, 64 nt, hsa; identical to SEQ ID NO: 409965

SEQ ID NO: 550248 - RNA, 64 nt, hsa; identical to SEQ ID NO: 409966

SEQ ID NO: 550249 - RNA, 64 nt, hsa; identical to SEQ ID NO: 409967

SEQ ID NO: 550250 - RNA, 52 nt, hsa; identical to SEQ ID NO: 409968

SEQ ID NO: 550251 - RNA, 64 nt, hsa; identical to SEQ ID NO: 409969

SEQ ID NO: 550252 - RNA, 64 nt, hsa; identical to SEQ ID NO: 409970

SEQ ID NO: 550253 - RNA, 64 nt, hsa; identical to SEQ ID NO: 409971

SEQ ID NO: 550254 - RNA, 64 nt, hsa; identical to SEQ ID NO: 409972

SEQ ID NO: 550255 - RNA, 64 nt, hsa; identical to SEQ ID NO: 409973

SEQ ID NO: 550256 - RNA, 64 nt, hsa; identical to SEQ ID NO: 43914

SEQ ID NO: 550257 - RNA, 64 nt, hsa; identical to SEQ ID NO: 43915

SEQ ID NO: 550258 - RNA, 64 nt, hsa; identical to SEQ ID NO: 43916

SEQ ID NO: 550259 - RNA, 64 nt, hsa; identical to SEQ ID NO: 43917

SEQ ID NO: 550260 - RNA, 64 nt, hsa; identical to SEQ ID NO: 43918

SEQ ID NO: 550261 - RNA, 64 nt, hsa; identical to SEQ ID NO: 43919

SEQ ID NO: 550262 - RNA, 64 nt, hsa; identical to SEQ ID NO: 43920

SEQ ID NO: 550263 - RNA, 64 nt, hsa; identical to SEQ ID NO: 43921

SEQ ID NO: 550264 - RNA, 64 nt, hsa; identical to SEQ ID NO: 43922

SEQ ID NO: 550265 - RNA, 64 nt, hsa; identical to SEQ ID NO: 43923

SEQ ID NO: 550266 - RNA, 64 nt, hsa; identical to SEQ ID NO: 43924

SEQ ID NO: 550267 - RNA, 64 nt, hsa; identical to SEQ ID NO: 43925

SEQ ID NO: 550268 - RNA, 64 nt, hsa; identical to SEQ ID NO: 43926

SEQ ID NO: 550269 - RNA, 64 nt, hsa; identical to SEQ ID NO: 43927

SEQ ID NO: 550270 - RNA, 64 nt, hsa; identical to SEQ ID NO: 43928

SEQ ID NO: 550271 - RNA, 64 nt, hsa; identical to SEQ ID NO: 43929

SEQ ID NO: 550272 - RNA, 64 nt, hsa; identical to SEQ ID NO: 43930

SEQ ID NO: 550273 - RNA, 64 nt, hsa; identical to SEQ ID NO: 43931

SEQ ID NO: 550274 - RNA, 64 nt, hsa; identical to SEQ ID NO: 43932

SEQ ID NO: 550275 - RNA, 64 nt, hsa; identical to SEQ ID NO: 43933

SEQ ID NO: 550276 - RNA, 64 nt, hsa; identical to SEQ ID NO: 43934

SEQ ID NO: 550277 - RNA, 64 nt, hsa; identical to SEQ ID NO: 43935

SEQ ID NO: 550278 - RNA, 64 nt, hsa; identical to SEQ ID NO: 43936

SEQ ID NO: 550279 - RNA, 64 nt, hsa; identical to SEQ ID NO: 43937

SEQ ID NO: 550280 - RNA, 64 nt, hsa; identical to SEQ ID NO: 43938

SEQ ID NO: 550281 - RNA, 64 nt, hsa; identical to SEQ ID NO: 43939

SEQ ID NO: 550282 - RNA, 64 nt, hsa; identical to SEQ ID NO: 43940

SEQ ID NO: 550283 - RNA, 64 nt, hsa; identical to SEQ ID NO: 43941

SEQ ID NO: 550284 - RNA, 64 nt, hsa; identical to SEQ ID NO: 43942

SEQ ID NO: 550285 - RNA, 64 nt, hsa; identical to SEQ ID NO: 43943

SEQ ID NO: 550286 - RNA, 64 nt, hsa; identical to SEQ ID NO: 43944

SEQ ID NO: 550287 - RNA, 64 nt, hsa; identical to SEQ ID NO: 43945

SEQ ID NO: 550288 - RNA, 64 nt, hsa; identical to SEQ ID NO: 43946

SEQ ID NO: 550289 - RNA, 64 nt, hsa; identical to SEQ ID NO: 43947

SEQ ID NO: 550290 - RNA, 64 nt, hsa; identical to SEQ ID NO: 43948

SEQ ID NO: 550291 - RNA, 64 nt, hsa; identical to SEQ ID NO: 111894

SEQ ID NO: 550292 - RNA, 64 nt, hsa; identical to SEQ ID NO: 111895

SEQ ID NO: 550293 - RNA, 64 nt, hsa; identical to SEQ ID NO: 111896

SEQ ID NO: 550294 - RNA, 64 nt, hsa; identical to SEQ ID NO: 111897

SEQ ID NO: 550295 - RNA, 64 nt, hsa; identical to SEQ ID NO: 111898

SEQ ID NO: 550296 - RNA, 64 nt, hsa; identical to SEQ ID NO: 111899

SEQ ID NO: 550297 - RNA, 64 nt, hsa; identical to SEQ ID NO: 111900

SEQ ID NO: 550298 - RNA, 64 nt, hsa; identical to SEQ ID NO: 111901

SEQ ID NO: 550299 - RNA, 64 nt, hsa; identical to SEQ ID NO: 111902

SEQ ID NO: 550300 - RNA, 64 nt, hsa; identical to SEQ ID NO: 111903

SEQ ID NO: 550301 - RNA, 64 nt, hsa; identical to SEQ ID NO: 111904

SEQ ID NO: 550302 - RNA, 64 nt, hsa; identical to SEQ ID NO: 111905

SEQ ID NO: 550303 - RNA, 64 nt, hsa; identical to SEQ ID NO: 111906

SEQ ID NO: 550304 - RNA, 64 nt, hsa; identical to SEQ ID NO: 111907

SEQ ID NO: 550305 - RNA, 64 nt, hsa; identical to SEQ ID NO: 111908

SEQ ID NO: 550306 - RNA, 64 nt, hsa; identical to SEQ ID NO: 111909

SEQ ID NO: 550307 - RNA, 64 nt, hsa; identical to SEQ ID NO: 111910

SEQ ID NO: 550308 - RNA, 64 nt, hsa; identical to SEQ ID NO: 111911

SEQ ID NO: 550309 - RNA, 64 nt, hsa; identical to SEQ ID NO: 111912

SEQ ID NO: 550310 - RNA, 64 nt, hsa; identical to SEQ ID NO: 111913

SEQ ID NO: 550311 - RNA, 64 nt, hsa; identical to SEQ ID NO: 111914

SEQ ID NO: 550312 - RNA, 64 nt, hsa; identical to SEQ ID NO: 111915

SEQ ID NO: 550313 - RNA, 64 nt, hsa; identical to SEQ ID NO: 111916

SEQ ID NO: 550314 - RNA, 64 nt, hsa; identical to SEQ ID NO: 111917

SEQ ID NO: 550315 - RNA, 64 nt, hsa; identical to SEQ ID NO: 111918

SEQ ID NO: 550316 - RNA, 64 nt, hsa; identical to SEQ ID NO: 111919

SEQ ID NO: 550317 - RNA, 64 nt, hsa; identical to SEQ ID NO: 111920

SEQ ID NO: 550318 - RNA, 64 nt, hsa; identical to SEQ ID NO: 111921

SEQ ID NO: 550319 - RNA, 64 nt, hsa; identical to SEQ ID NO: 111922

SEQ ID NO: 550320 - RNA, 64 nt, hsa; identical to SEQ ID NO: 111923

SEQ ID NO: 550321 - RNA, 64 nt, hsa; identical to SEQ ID NO: 111924

SEQ ID NO: 550322 - RNA, 64 nt, hsa; identical to SEQ ID NO: 111925

SEQ ID NO: 550323 - RNA, 64 nt, hsa; identical to SEQ ID NO: 111926

SEQ ID NO: 550324 - RNA, 64 nt, hsa; identical to SEQ ID NO: 111927

SEQ ID NO: 550325 - RNA, 64 nt, hsa
cacuugauaaaucauggggaacagauguguuccacccaacaaaugugauaagugaucaugcagc

SEQ ID NO: 550326 - RNA, 64 nt, hsa
ccgaguacugggaauauaggugcacgccaccacacccaacaaauuuuuguacuuuuaguacaga

SEQ ID NO: 550327 - RNA, 64 nt, hsa
ugcuccuuuggccaagaucaucagaaccucucaacccaacaaggcuggcuucagggccacuaug

SEQ ID NO: 550328 - RNA, 64 nt, hsa
uucccuuuccucugcuucucuccucaucaucauucccaacaacauccucugccacacacaacaa

SEQ ID NO: 550329 - RNA, 64 nt, hsa
cagucguucccagcagaacagcggagccuggacugacacccagugggaccaguguugccacacc

SEQ ID NO: 550330 - RNA, 64 nt, hsa
agcagagccugcucccacccuccucccagcagcagacacccacccucucacugacuaacagguc

SEQ ID NO: 550331 - RNA, 64 nt, hsa
auaauauaagcaacauuuagcuaguuguuuugaagacacccaguacuaaguaauauuguuguuc

SEQ ID NO: 550332 - RNA, 64 nt, hsa
aaucagcaaaauaauaaaaugaacgaaaaaaaaugacacccagggaguucccaaccccagugua

SEQ ID NO: 550333 - RNA, 64 nt, hsa
uccugaguccccagacagcagaguaugaacugcugacacccagauuccauuaaaaauucugcua

SEQ ID NO: 550334 - RNA, 64 nt, hsa
caauucagggcagaacuccuguaucagccucauggacacccagaauugguaucucauggcugga

SEQ ID NO: 550335 - RNA, 64 nt, hsa
aacgggugcaucccaccacucccuggaggcauuagacacccaaguggaaggugcuacaaccuga

SEQ ID NO: 550336 - RNA, 64 nt, hsa
auuguauuuuuuauuucuuucuaacuuaaaauacgacacccaguauuuucuuuaaguuucacca

SEQ ID NO: 550337 - RNA, 64 nt, hsa
auagcuucucuccauacuccuaagggacuuugcagacacccaagccacugggaccccugcuaac

SEQ ID NO: 550338 - RNA, 64 nt, hsa
ugaagucugagccaccaagggcuuggcuggguuggacacccacagguguauccagagcccagcc

SEQ ID NO: 550339 - RNA, 64 nt, hsa
ucuugcuugucacccgcuccagguuggagccacagacacccaccgccaccccggcugggucugc

SEQ ID NO: 550340 - RNA, 64 nt, hsa
uuuucauuugacccgcccccuucucgcucauaaugacacccagcuccuuugagaggaucagagc

SEQ ID NO: 550341 - RNA, 64 nt, hsa
ucagggaggcagcucauuuccaccccggccccaggacacccagccugugccccacaaggaucuc

SEQ ID NO: 550342 - RNA, 64 nt, hsa
cagauuuccauuugaaguacuucccauccacccugacacccaaagggguuuuuuuguuuuguuu

SEQ ID NO: 550343 - RNA, 63 nt, hsa
uguucugaaguuacccucugaaaaauauuuugucucucugacuugauuucuauaaaugcuuuu

SEQ ID NO: 550344 - RNA, 63 nt, hsa
uucuuuuuuaaauuauuuuuuaaaagucuuucucucucugauucagcuuaaauuuuuuuaucg

SEQ ID NO: 550345 - RNA, 63 nt, hsa
aucuuugaguagcacuguuuuggggcccucggucucucugaagacccuagcagaacugauacc

SEQ ID NO: 550346 - RNA, 63 nt, hsa
agugucugaucaugugaaacacaacacguuuuccucucugagucccagcuauggggaacaucu

SEQ ID NO: 550347 - RNA, 63 nt, hsa
agacuccgucucaaaaaaagggcaauaaaugcccucucugaauguuugaacugccaagaaaag

SEQ ID NO: 550348 - RNA, 63 nt, hsa
gggaggcuggucucccuccagcuggaauugcugcucucugagggagaggcugugguggcuguc

SEQ ID NO: 550349 - RNA, 63 nt, hsa
agccaccacuacagggcuguuucauguacuucucucucugacucugucuuguccgacucucuu

SEQ ID NO: 550350 - RNA, 63 nt, hsa
acuauuuuugguugugugauagaguuauuuaaccucucugagccucaguucccucguauguaa

SEQ ID NO: 550351 - RNA, 63 nt, hsa
gauacccaccaucuuucaagggucacaagcucacucucugacaagucagaauagggacacugc

SEQ ID NO: 550352 - RNA, 63 nt, hsa
ccgggguuuuucuuccaucugacaucugccagccucucugaauggaaguugugaauguuugca

SEQ ID NO: 550353 - RNA, 63 nt, hsa
ucuuuauuuuucaaucucugaauauuuuagucucucucugagucucauuuuuuaaaaugcucu

SEQ ID NO: 550354 - RNA, 63 nt, hsa
ccuacuauaauaugacugucugaaacuuauuuucucucugagaaauaaauguucuaaugggca

SEQ ID NO: 550355 - RNA, 63 nt, hsa
uguuggguguggguggucuccaaggccacgcugcucucugaauugauuuuuugaguuuuguuu

SEQ ID NO: 550356 - RNA, 63 nt, hsa
aacuccugucucugugagaauguauacuuuaugcucucugaaauguaugacacccagcuuuaa

SEQ ID NO: 550357 - RNA, 63 nt, hsa
cugggggucaggacagggccugauuugagccuccucucugaagaugauuuggccgagcggaag

SEQ ID NO: 550358 - RNA, 63 nt, hsa
uuggacaggaggugcugaggcuggcugcaccugcucucugaagacgccuuccucucuagguuc

SEQ ID NO: 550359 - RNA, 63 nt, hsa
accguggccucccgaaucgccuucuuccucugacucucugagugguguccucggccccccuga

SEQ ID NO: 550360 - RNA, 63 nt, hsa
cucgcuguguuuccucaggcagcauggcuccgccucucugagccucugucucugcuucugaac

SEQ ID NO: 550361 - RNA, 63 nt, hsa
cuuguugccugaaauuguuauuguuuguuauuucucucugauguuuuuuguaagacauuguau

SEQ ID NO: 550362 - RNA, 63 nt, hsa
ucagcuuaauaacaacacuuauugcaccugucucucucugagaacacggugugucucgacacg

SEQ ID NO: 550363 - RNA, 63 nt, hsa
cccugggcaggccgcuccugagcugcugucucccucucugaccuaugccuaccuucucuuucu

SEQ ID NO: 550364 - RNA, 63 nt, hsa
gccagggucccuaagaacagguuugcagcuacccucucugaccuuuuccccauaucuugugcu

SEQ ID NO: 550365 - RNA, 63 nt, hsa
cacugcacagaagacagcagcaagugugcuggccucucugacauaugcuaacccccaaauacu

SEQ ID NO: 550366 - RNA, 63 nt, hsa
agcgcgcacacgcacgcacacacacauacagagcucucugagggugauggggcugagcaggag

SEQ ID NO: 550367 - RNA, 63 nt, hsa
uuaccaaaguaggauuuugagggugggggugcucucucugagggggugggggugccgcugucu

SEQ ID NO: 550368 - RNA, 63 nt, hsa
gugccgcugucucugaggggugggggugccgcucucucugagggggugggggugccgcuuucu

SEQ ID NO: 550369 - RNA, 63 nt, hsa
ugccgcuuucucugagggggugggggugccgcucucucugagggggugggggugcugcucucu

SEQ ID NO: 550370 - RNA, 63 nt, hsa
ccucuugucuuucuucccugcuuugcugcuuugcucucugaaaccuacauuccgucaguuucc

SEQ ID NO: 550371 - RNA, 63 nt, hsa
uggccuacacagagaaccguucguguugggcuucucucugaacgccccgaaccuugcaucaag

SEQ ID NO: 550372 - RNA, 63 nt, hsa
agaaggugcacgaaggagacaccacuuggggaccucucugagcaggcucucgugaaucagcuc

SEQ ID NO: 550373 - RNA, 63 nt, hsa
cuguggagucaaggucccccucucccaggcaggcucucugagggcauucuguagucccaggcc

SEQ ID NO: 550374 - RNA, 63 nt, hsa
aauucacccuacauuccucuccucuucacuagccucucugaagguguccuggccagcccugga

SEQ ID NO: 550375 - RNA, 63 nt, hsa
caaccuggaauggagacuuuuaucuacuucucucucucugaagaugucaaaucgugguuuaga

SEQ ID NO: 550376 - RNA, 63 nt, hsa
uccccacggcccuugccacugucuccuggcccucucucugaucaugccagguuugcaccagcc

SEQ ID NO: 550377 - RNA, 63 nt, hsa
uguaguacauucuccaagaugcagcccaggagccucucugaaggaccagucugguuacgaugg

SEQ ID NO: 550378 - RNA, 63 nt, hsa
ugggucuccucccgggcucagugggccuggggccucucugacguggugccugcuggagggagg

SEQ ID NO: 550379 - RNA, 63 nt, hsa
guggguuacacugaucuuguuccacugauuacucucucugacgaguccaucaccugcaacuua

SEQ ID NO: 550380 - RNA, 64 nt, hsa; identical to SEQ ID NO: 157984

SEQ ID NO: 550381 - RNA, 64 nt, hsa; identical to SEQ ID NO: 157985

SEQ ID NO: 550382 - RNA, 64 nt, hsa; identical to SEQ ID NO: 157986

SEQ ID NO: 550383 - RNA, 64 nt, hsa; identical to SEQ ID NO: 157987

SEQ ID NO: 550384 - RNA, 64 nt, hsa; identical to SEQ ID NO: 157988

SEQ ID NO: 550385 - RNA, 64 nt, hsa; identical to SEQ ID NO: 157989

SEQ ID NO: 550386 - RNA, 64 nt, hsa; identical to SEQ ID NO: 157990

SEQ ID NO: 550387 - RNA, 64 nt, hsa; identical to SEQ ID NO: 157991

SEQ ID NO: 550388 - RNA, 64 nt, hsa; identical to SEQ ID NO: 157992

SEQ ID NO: 550389 - RNA, 64 nt, hsa; identical to SEQ ID NO: 157993

SEQ ID NO: 550390 - RNA, 64 nt, hsa; identical to SEQ ID NO: 157994

SEQ ID NO: 550391 - RNA, 64 nt, hsa; identical to SEQ ID NO: 157995

SEQ ID NO: 550392 - RNA, 64 nt, hsa; identical to SEQ ID NO: 157996

SEQ ID NO: 550393 - RNA, 64 nt, hsa; identical to SEQ ID NO: 157997

SEQ ID NO: 550394 - RNA, 64 nt, hsa; identical to SEQ ID NO: 157998

SEQ ID NO: 550395 - RNA, 64 nt, hsa; identical to SEQ ID NO: 157999

SEQ ID NO: 550396 - RNA, 64 nt, hsa; identical to SEQ ID NO: 158000

SEQ ID NO: 550397 - RNA, 64 nt, hsa; identical to SEQ ID NO: 158001

SEQ ID NO: 550398 - RNA, 64 nt, hsa; identical to SEQ ID NO: 158002

SEQ ID NO: 550399 - RNA, 64 nt, hsa; identical to SEQ ID NO: 158003

SEQ ID NO: 550400 - RNA, 64 nt, hsa; identical to SEQ ID NO: 158004

SEQ ID NO: 550401 - RNA, 64 nt, hsa; identical to SEQ ID NO: 158005

SEQ ID NO: 550402 - RNA, 64 nt, hsa; identical to SEQ ID NO: 158006

SEQ ID NO: 550403 - RNA, 64 nt, hsa; identical to SEQ ID NO: 158007

SEQ ID NO: 550404 - RNA, 64 nt, hsa; identical to SEQ ID NO: 158008

SEQ ID NO: 550405 - RNA, 64 nt, hsa; identical to SEQ ID NO: 158009

SEQ ID NO: 550406 - RNA, 64 nt, hsa; identical to SEQ ID NO: 158010

SEQ ID NO: 550407 - RNA, 64 nt, hsa; identical to SEQ ID NO: 158011

SEQ ID NO: 550408 - RNA, 64 nt, hsa; identical to SEQ ID NO: 158012

SEQ ID NO: 550409 - RNA, 64 nt, hsa; identical to SEQ ID NO: 158013

SEQ ID NO: 550410 - RNA, 64 nt, hsa; identical to SEQ ID NO: 158014

SEQ ID NO: 550411 - RNA, 64 nt, hsa; identical to SEQ ID NO: 158015

SEQ ID NO: 550412 - RNA, 64 nt, hsa; identical to SEQ ID NO: 158016

SEQ ID NO: 550413 - RNA, 64 nt, hsa; identical to SEQ ID NO: 158017

SEQ ID NO: 550414 - RNA, 64 nt, hsa; identical to SEQ ID NO: 158018

SEQ ID NO: 550415 - RNA, 64 nt, hsa; identical to SEQ ID NO: 158019

SEQ ID NO: 550416 - RNA, 64 nt, hsa; identical to SEQ ID NO: 158020

SEQ ID NO: 550417 - RNA, 64 nt, hsa; identical to SEQ ID NO: 158021

SEQ ID NO: 550418 - RNA, 64 nt, hsa; identical to SEQ ID NO: 158022

SEQ ID NO: 550419 - RNA, 64 nt, hsa; identical to SEQ ID NO: 158023

SEQ ID NO: 550420 - RNA, 64 nt, hsa; identical to SEQ ID NO: 158024

SEQ ID NO: 550421 - RNA, 64 nt, hsa; identical to SEQ ID NO: 158025

SEQ ID NO: 550422 - RNA, 64 nt, hsa; identical to SEQ ID NO: 158026

SEQ ID NO: 550423 - RNA, 64 nt, hsa; identical to SEQ ID NO: 158027

SEQ ID NO: 550424 - RNA, 64 nt, hsa; identical to SEQ ID NO: 158028

SEQ ID NO: 550425 - RNA, 64 nt, hsa; identical to SEQ ID NO: 158029

SEQ ID NO: 550426 - RNA, 64 nt, hsa; identical to SEQ ID NO: 158030

SEQ ID NO: 550427 - RNA, 64 nt, hsa; identical to SEQ ID NO: 158031

SEQ ID NO: 550428 - RNA, 64 nt, hsa; identical to SEQ ID NO: 158032

SEQ ID NO: 550429 - RNA, 64 nt, hsa; identical to SEQ ID NO: 158033

SEQ ID NO: 550430 - RNA, 64 nt, hsa; identical to SEQ ID NO: 158034

SEQ ID NO: 550431 - RNA, 64 nt, hsa; identical to SEQ ID NO: 158035

SEQ ID NO: 550432 - RNA, 64 nt, hsa; identical to SEQ ID NO: 158036

SEQ ID NO: 550433 - RNA, 64 nt, hsa; identical to SEQ ID NO: 158037

SEQ ID NO: 550434 - RNA, 64 nt, hsa; identical to SEQ ID NO: 158038

SEQ ID NO: 550435 - RNA, 64 nt, hsa; identical to SEQ ID NO: 158039

SEQ ID NO: 550436 - RNA, 64 nt, hsa; identical to SEQ ID NO: 158040

SEQ ID NO: 550437 - RNA, 64 nt, hsa; identical to SEQ ID NO: 158041

SEQ ID NO: 550438 - RNA, 64 nt, hsa; identical to SEQ ID NO: 158042

SEQ ID NO: 550439 - RNA, 64 nt, hsa; identical to SEQ ID NO: 158043

SEQ ID NO: 550440 - RNA, 64 nt, hsa; identical to SEQ ID NO: 158044

SEQ ID NO: 550441 - RNA, 64 nt, hsa; identical to SEQ ID NO: 158045

SEQ ID NO: 550442 - RNA, 64 nt, hsa; identical to SEQ ID NO: 158046

SEQ ID NO: 550443 - RNA, 64 nt, hsa; identical to SEQ ID NO: 158047

SEQ ID NO: 550444 - RNA, 64 nt, hsa; identical to SEQ ID NO: 158048

SEQ ID NO: 550445 - RNA, 64 nt, hsa; identical to SEQ ID NO: 158049

SEQ ID NO: 550446 - RNA, 64 nt, hsa; identical to SEQ ID NO: 158050

SEQ ID NO: 550447 - RNA, 64 nt, hsa; identical to SEQ ID NO: 158051

SEQ ID NO: 550448 - RNA, 64 nt, hsa; identical to SEQ ID NO: 158052

SEQ ID NO: 550449 - RNA, 64 nt, hsa; identical to SEQ ID NO: 158053

SEQ ID NO: 550450 - RNA, 64 nt, hsa; identical to SEQ ID NO: 158054

SEQ ID NO: 550451 - RNA, 64 nt, hsa; identical to SEQ ID NO: 158055

SEQ ID NO: 550452 - RNA, 64 nt, hsa; identical to SEQ ID NO: 158056

SEQ ID NO: 550453 - RNA, 64 nt, hsa; identical to SEQ ID NO: 158057

SEQ ID NO: 550454 - RNA, 64 nt, hsa; identical to SEQ ID NO: 158058

SEQ ID NO: 550455 - RNA, 64 nt, hsa; identical to SEQ ID NO: 158059

SEQ ID NO: 550456 - RNA, 64 nt, hsa; identical to SEQ ID NO: 158060

SEQ ID NO: 550457 - RNA, 64 nt, hsa; identical to SEQ ID NO: 158061

SEQ ID NO: 550458 - RNA, 64 nt, hsa; identical to SEQ ID NO: 158062

SEQ ID NO: 550459 - RNA, 64 nt, hsa; identical to SEQ ID NO: 158063

SEQ ID NO: 550460 - RNA, 64 nt, hsa; identical to SEQ ID NO: 158064

SEQ ID NO: 550461 - RNA, 64 nt, hsa; identical to SEQ ID NO: 158065

SEQ ID NO: 550462 - RNA, 64 nt, hsa; identical to SEQ ID NO: 158066

SEQ ID NO: 550463 - RNA, 64 nt, hsa; identical to SEQ ID NO: 158067

SEQ ID NO: 550464 - RNA, 64 nt, hsa; identical to SEQ ID NO: 158068

SEQ ID NO: 550465 - RNA, 64 nt, hsa; identical to SEQ ID NO: 158069

SEQ ID NO: 550466 - RNA, 64 nt, hsa; identical to SEQ ID NO: 158070

SEQ ID NO: 550467 - RNA, 64 nt, hsa; identical to SEQ ID NO: 158071

SEQ ID NO: 550468 - RNA, 64 nt, hsa; identical to SEQ ID NO: 158072

SEQ ID NO: 550469 - RNA, 64 nt, hsa; identical to SEQ ID NO: 158073

SEQ ID NO: 550470 - RNA, 64 nt, hsa; identical to SEQ ID NO: 158074

SEQ ID NO: 550471 - RNA, 64 nt, hsa; identical to SEQ ID NO: 158075

SEQ ID NO: 550472 - RNA, 64 nt, hsa; identical to SEQ ID NO: 158076

SEQ ID NO: 550473 - RNA, 64 nt, hsa; identical to SEQ ID NO: 158077

SEQ ID NO: 550474 - RNA, 64 nt, hsa; identical to SEQ ID NO: 158078

SEQ ID NO: 550475 - RNA, 64 nt, hsa; identical to SEQ ID NO: 311803

SEQ ID NO: 550476 - RNA, 64 nt, hsa; identical to SEQ ID NO: 311804

SEQ ID NO: 550477 - RNA, 64 nt, hsa; identical to SEQ ID NO: 311805

SEQ ID NO: 550478 - RNA, 64 nt, hsa; identical to SEQ ID NO: 311806

SEQ ID NO: 550479 - RNA, 64 nt, hsa; identical to SEQ ID NO: 311807

SEQ ID NO: 550480 - RNA, 64 nt, hsa; identical to SEQ ID NO: 311808

SEQ ID NO: 550481 - RNA, 64 nt, hsa; identical to SEQ ID NO: 311809

SEQ ID NO: 550482 - RNA, 64 nt, hsa; identical to SEQ ID NO: 311810

SEQ ID NO: 550483 - RNA, 64 nt, hsa; identical to SEQ ID NO: 311811

SEQ ID NO: 550484 - RNA, 64 nt, hsa; identical to SEQ ID NO: 311812

SEQ ID NO: 550485 - RNA, 64 nt, hsa; identical to SEQ ID NO: 311813

SEQ ID NO: 550486 - RNA, 64 nt, hsa; identical to SEQ ID NO: 311814

SEQ ID NO: 550487 - RNA, 64 nt, hsa; identical to SEQ ID NO: 311815

SEQ ID NO: 550488 - RNA, 64 nt, hsa; identical to SEQ ID NO: 311816

SEQ ID NO: 550489 - RNA, 64 nt, hsa; identical to SEQ ID NO: 311817

SEQ ID NO: 550490 - RNA, 64 nt, hsa; identical to SEQ ID NO: 311818

SEQ ID NO: 550491 - RNA, 64 nt, hsa; identical to SEQ ID NO: 311819

SEQ ID NO: 550492 - RNA, 64 nt, hsa; identical to SEQ ID NO: 311820

SEQ ID NO: 550493 - RNA, 64 nt, hsa; identical to SEQ ID NO: 311821

SEQ ID NO: 550494 - RNA, 64 nt, hsa; identical to SEQ ID NO: 311822

SEQ ID NO: 550495 - RNA, 64 nt, hsa; identical to SEQ ID NO: 311823

SEQ ID NO: 550496 - RNA, 64 nt, hsa; identical to SEQ ID NO: 311824

SEQ ID NO: 550497 - RNA, 64 nt, hsa; identical to SEQ ID NO: 311825

SEQ ID NO: 550498 - RNA, 64 nt, hsa; identical to SEQ ID NO: 311824

SEQ ID NO: 550499 - RNA, 64 nt, hsa; identical to SEQ ID NO: 311824

SEQ ID NO: 550500 - RNA, 64 nt, hsa; identical to SEQ ID NO: 311828

SEQ ID NO: 550501 - RNA, 64 nt, hsa; identical to SEQ ID NO: 311829

SEQ ID NO: 550502 - RNA, 64 nt, hsa; identical to SEQ ID NO: 311830

SEQ ID NO: 550503 - RNA, 64 nt, hsa; identical to SEQ ID NO: 311831

SEQ ID NO: 550504 - RNA, 64 nt, hsa; identical to SEQ ID NO: 311832

SEQ ID NO: 550505 - RNA, 64 nt, hsa; identical to SEQ ID NO: 311833

SEQ ID NO: 550506 - RNA, 64 nt, hsa; identical to SEQ ID NO: 311834

SEQ ID NO: 550507 - RNA, 64 nt, hsa; identical to SEQ ID NO: 311835

SEQ ID NO: 550508 - RNA, 64 nt, hsa; identical to SEQ ID NO: 311836

SEQ ID NO: 550509 - RNA, 64 nt, hsa; identical to SEQ ID NO: 311837

SEQ ID NO: 550510 - RNA, 64 nt, hsa; identical to SEQ ID NO: 311838

SEQ ID NO: 550511 - RNA, 64 nt, hsa; identical to SEQ ID NO: 311839

SEQ ID NO: 550512 - RNA, 64 nt, hsa; identical to SEQ ID NO: 311840

SEQ ID NO: 550513 - RNA, 64 nt, hsa; identical to SEQ ID NO: 311841

SEQ ID NO: 550514 - RNA, 64 nt, hsa; identical to SEQ ID NO: 311842

SEQ ID NO: 550515 - RNA, 64 nt, hsa; identical to SEQ ID NO: 311843

SEQ ID NO: 550516 - RNA, 64 nt, hsa; identical to SEQ ID NO: 311844

SEQ ID NO: 550517 - RNA, 64 nt, hsa; identical to SEQ ID NO: 311845

SEQ ID NO: 550518 - RNA, 64 nt, hsa; identical to SEQ ID NO: 311846

SEQ ID NO: 550519 - RNA, 64 nt, hsa; identical to SEQ ID NO: 542642

SEQ ID NO: 550520 - RNA, 64 nt, hsa; identical to SEQ ID NO: 542643

SEQ ID NO: 550521 - RNA, 64 nt, hsa; identical to SEQ ID NO: 542644

SEQ ID NO: 550522 - RNA, 64 nt, hsa; identical to SEQ ID NO: 542645

SEQ ID NO: 550523 - RNA, 64 nt, hsa; identical to SEQ ID NO: 542646

SEQ ID NO: 550524 - RNA, 64 nt, hsa; identical to SEQ ID NO: 542647

SEQ ID NO: 550525 - RNA, 64 nt, hsa; identical to SEQ ID NO: 542648

SEQ ID NO: 550526 - RNA, 64 nt, hsa; identical to SEQ ID NO: 542649

SEQ ID NO: 550527 - RNA, 64 nt, hsa
ccuggcucuccagaaccuucuaucccacagucaggccccagagagggcaggacaagccuugucc

SEQ ID NO: 550528 - RNA, 64 nt, hsa
gugcugggauuacaggugugagcuacugcgcccagccccagaaaucucagugcuguuuggagcu

SEQ ID NO: 550529 - RNA, 64 nt, hsa
cugccugcagucagcucggccuccccgaccugcagccccagacucugcucucccagcacugacu

SEQ ID NO: 550530 - RNA, 64 nt, hsa
ccacaguucuggguuaucuccucucauacaucaagccccagaggaggcggcaagaggaacagcc

SEQ ID NO: 550531 - RNA, 64 nt, hsa
gugcugggauuacaggcgugagccaccaugccccgccccagauggauuuuacauuugcucuuuu

SEQ ID NO: 550532 - RNA, 64 nt, hsa
ggacaggaagccuugcgagaagggacguaccuaugccccagaaggcaagagaggaagacuauuu

SEQ ID NO: 550533 - RNA, 64 nt, hsa
aggccccgacgaggagggguaugcaggcuggcaggccccagagcugguggagggcaucucacuc

SEQ ID NO: 550534 - RNA, 64 nt, hsa
ccauugacaacugcucguguacaggcaccccacagccccagagcauggggcacagcaggcaugc

SEQ ID NO: 550535 - RNA, 64 nt, hsa
agagccccaccgcagcccaguagggaugcagcacgccccagagggcucaugugggccccagaug

SEQ ID NO: 550536 - RNA, 64 nt, hsa
uagggaugcagcacgccccagagggcucaugugggccccagauggcaaugccaccauuguugau

SEQ ID NO: 550537 - RNA, 64 nt, hsa
ggcauggccucccugaugaucaccaccaaggguagccccagaggggagcuccgagggcagguag

SEQ ID NO: 550538 - RNA, 64 nt, hsa
augcuguucccgcugcacggcccaccggcggccagccccagagaccagaacugauccagagcug

SEQ ID NO: 550539 - RNA, 64 nt, hsa
cuccuuccaaguaugugacguaguccugaaccacgccccagacuuccgccgggucuaccugccu

SEQ ID NO: 550540 - RNA, 64 nt, hsa
gagcugaagaacaagcugcucauggcaagggcuggccccagaacccugcaagagaggccuucug

SEQ ID NO: 550541 - RNA, 64 nt, hsa
agcagaagccuccaagcacagagccuggccccaggccccagacagggugggcuuccugcccuuc

SEQ ID NO: 550542 - RNA, 64 nt, hsa
ggcagaugucuucccugggcugccaccagcccccgccccagaguggcccaccguggcacuagaa

SEQ ID NO: 550543 - RNA, 64 nt, hsa
gccggcggaugcuggauccggagccccagguuccgccccagagcgguccuggacaaggccagac

SEQ ID NO: 550544 - RNA, 64 nt, hsa
gguagcauccaucugguggccaaagagaaucguagccccagagcugcccaaguucacugggcuc

SEQ ID NO: 550545 - RNA, 64 nt, hsa
augccaggacccgccagccccgcucccaccuagugccccagacugagcucuccaggccaggugg

SEQ ID NO: 550546 - RNA, 64 nt, hsa
aguggcuaguggggugaacagcuggugccaaauagccccagacugggcccaggcaggucugcaa

SEQ ID NO: 550547 - RNA, 64 nt, hsa
aagaaguuucugggagaugcccgcagcugugcgugccccagacacaaaggcuggccugugugua

SEQ ID NO: 550548 - RNA, 64 nt, hsa
cagccugcccucccugccggagccggcucugccagccccagauugggaagucuccccgcuggag

SEQ ID NO: 550549 - RNA, 64 nt, hsa
ggcaugggggggaggggggcguguuucugggccugccccagacacugcccuuggcugccagccu

SEQ ID NO: 550550 - RNA, 64 nt, hsa
ccuuaggaguucuugcuucuugcguugauacuuugccccagaaaggccugggauucauucuggu

SEQ ID NO: 550551 - RNA, 64 nt, hsa
gccacaaaugaagagaaaagccaugcccaccccagccccagagaaaccaauaagaauccucuau

SEQ ID NO: 550552 - RNA, 64 nt, hsa
acaaauucagaacgugccucuuuccagaucgcuggccccagaacccugucccccacacccaggg

SEQ ID NO: 550553 - RNA, 64 nt, hsa
ugcaucuuuguuugcaucuccagagacaccugaggccccagagcuugaggcaaagccaggccgu

SEQ ID NO: 550554 - RNA, 64 nt, hsa
ccuucuccucaucuguggagcaagccaacucagugccccagaccccaccugaucugcaucuuug

SEQ ID NO: 550555 - RNA, 64 nt, hsa
ccuagaccacccuccaugucagguacugagcaaggccccagauccuucucucuggaggaagagg

SEQ ID NO: 550556 - RNA, 64 nt, hsa
caaacacugguuccccacugcccugugccuuccggccccagaaggaucuuccuggaugccaacg

SEQ ID NO: 550557 - RNA, 64 nt, hsa
aucaagccaaaccugcugccacagcccucccccggccccagauagcagccccagggaggaugcu

SEQ ID NO: 550558 - RNA, 64 nt, hsa
cccaaccaaggagcuggggcccaaggccaguccugccccagagacacuccaaguccgccagggg

SEQ ID NO: 550559 - RNA, 64 nt, hsa
ggcggccucugggcuugggcaccagcucaugccagccccagagggucaggguuggaggccugug

SEQ ID NO: 550560 - RNA, 64 nt, hsa
uccauggugucaugccaagacaguaucagacacagccccagaagggggcauuaugggcccugcc

SEQ ID NO: 550561 - RNA, 64 nt, hsa
acuuugggauucuugucagcgggaggcgucacuggccccagagugacuccgacucuccgcuggg

SEQ ID NO: 550562 - RNA, 64 nt, hsa
cagagcccccucccucaccuucccuccaccgccagccccagaguuagauuuuaugcuugggccu

SEQ ID NO: 550563 - RNA, 64 nt, hsa
ggugguugaaacccugcacauccucccagggccagccccagaaugggccuuucucugccugccc

SEQ ID NO: 550564 - RNA, 64 nt, hsa
aggauuuucaagacaaacuggaguaagaauuaaagccccagaggauuuaauuauccugguuugc

SEQ ID NO: 550565 - RNA, 64 nt, hsa
uugaugccucagggucucugaaaucucccgggaagccccagagcuuuccugaggcugccuggcc

SEQ ID NO: 550566 - RNA, 64 nt, hsa
uaguuccucuccauccgccaccuccccucccgcugccccagaaguuucuaucauuccauggaga

SEQ ID NO: 550567 - RNA, 64 nt, hsa
uacacacaguguuucauugcuccgcgucuucccagccccagaaaccggcuaaaggacccugcac

SEQ ID NO: 550568 - RNA, 64 nt, hsa
ccuaggcaggggcugggccagggcuccaaggcuugccccagaggccacauggccaccagcccca

SEQ ID NO: 550569 - RNA, 64 nt, hsa
acaggcccaggcaggaggucccaccccagacccugccccagacgcucccucacccucucggccc

SEQ ID NO: 550570 - RNA, 64 nt, hsa
acacacggacagacgcagacggacacagcgacaugccccagacacguuaagggacugguuggcc

SEQ ID NO: 550571 - RNA, 64 nt, hsa
uuccccgagagaaaguguuaacauugagacucuggccccagauugguaucuucuaugaagaugg

SEQ ID NO: 550572 - RNA, 64 nt, hsa
cugcuuuccaaaugugguuaaauguaauugguuagccccagacuugggcuagagcagaaggcau

SEQ ID NO: 550573 - RNA, 60 nt, hsa
aauaccauaaacccugcugaagacaggagaguacagaaugacaacauugagcccacacug

SEQ ID NO: 550574 - RNA, 64 nt, hsa
caaacuuuugugaacaugcaaucaucuuauguggguacagaaagagguaaagagucugaaucaa

SEQ ID NO: 550575 - RNA, 64 nt, hsa
ucaucuuauuaaaugugaugugacuuuuuucuuuguacagaagaguacuguauuuuugaauagc

SEQ ID NO: 550576 - RNA, 64 nt, hsa
aauacaauuacugcccuaaaaugucucuggcaauguacagaaauauuguauauacuuacauaug

SEQ ID NO: 550577 - RNA, 64 nt, hsa
gauuuccauguagauagaagaacuauagggccuaguacagaaggugcacacaaauguuggcaaa

SEQ ID NO: 550578 - RNA, 64 nt, hsa
cccuaccaagugaaaauugauguguguuaagaggguacagaauuaucaacugauuuggucaguu

SEQ ID NO: 550579 - RNA, 64 nt, hsa
cuuuuaagcagacccauaccuuuccagggucaaaguacagaauagaauacauugauacaaagua

SEQ ID NO: 550580 - RNA, 64 nt, hsa
ggucaaaguacagaauagaauacauugauacaaaguacagaaaaauacuuugauuuuuauccau

SEQ ID NO: 550581 - RNA, 64 nt, hsa
cuguuguaccuuuggggaaaauuuguauguaaauguacagaaauaaaaacguugccccauuaac

SEQ ID NO: 550582 - RNA, 64 nt, hsa
gcuauaaagccaccugucaacaaacccccauuauguacagaauaggaccuauccaguagccagg

SEQ ID NO: 550583 - RNA, 64 nt, hsa
uuacuguauaaaggugugcuguguccaccguuguguacagaauuuuucuucauuaauuuugugu

SEQ ID NO: 550584 - RNA, 64 nt, hsa
aaacguauaauauguacaucacugagacaaucauguacagaaagaauuuuugguguaaauuugu

SEQ ID NO: 550585 - RNA, 64 nt, hsa
guccucaucuaacugccaucccuguggaauuucaguacagaacacugacaaacaaggaaagcgg

SEQ ID NO: 550586 - RNA, 64 nt, hsa
caaaguuaagaaauaggaaacugaauuuuucauuguacagaaaauguaucucuuggggagggcc

SEQ ID NO: 550587 - RNA, 64 nt, hsa
caacugguaaacuaacagagugauuaagcaugguguacagaaaagcauuacgcugagucuuacc

SEQ ID NO: 550588 - RNA, 64 nt, hsa
uuuacuauucaaauugguuucauucuuaguaaaaguacagaaucuauuugaaauuauaguaaaa

SEQ ID NO: 550589 - RNA, 64 nt, hsa
uaacauguacguauuucugaaauauuaaauagcuguacagaagcagguuuuauuuaucauguua

SEQ ID NO: 550590 - RNA, 64 nt, hsa
ccccaaaccauguuaaacguggcuaacaguguagguacagaacuauaguuaguugugcauuugu

SEQ ID NO: 550591 - RNA, 64 nt, hsa
aauuuugaaaugugucauuuuuaaacaaucuuaaaaguaauacagaauugugauuuauuaauuu

SEQ ID NO: 550592 - RNA, 64 nt, hsa
cucuuagaacuuagaaguguuucuaagagaacagaaguaauaagagaaacaguuacguguggaa

SEQ ID NO: 550593 - RNA, 64 nt, hsa
ucauccuuaguacacagagaauauacuuuuccucaaguaauauaccuguuugaagcuuuaagag

SEQ ID NO: 550594 - RNA, 64 nt, hsa
uuuaucacagugaaaggcaaaauuauucacucagaaguaauauaaauuaccucuuuaaaaagua

SEQ ID NO: 550595 - RNA, 64 nt, hsa
uuuauguuauuaugugugaaguaauauauuguacaaguaauaaauguauuguugagauauauug

SEQ ID NO: 550596 - RNA, 64 nt, hsa
uuuagugaaaugauguuuuauguuauuaugugugaaguaauauauuguacaaguaauaaaugua

SEQ ID NO: 550597 - RNA, 64 nt, hsa
uucuuauuucuucauuuuaagucauugcaauggaaaguaauauuauaaaaugguaauuacaaca

SEQ ID NO: 550598 - RNA, 64 nt, hsa
ucugacaacguguuucugaaaaacagauuuucauaaguaauaauaaaaauaauaauaaaaaagu

SEQ ID NO: 550599 - RNA, 64 nt, hsa
gcaaaauuaugaauaggauauacuaauaaauacaaaguaauaacaaaagucaaagcaguguucu

SEQ ID NO: 550600 - RNA, 64 nt, hsa
uuagugauuaugauucuuaucccaaaauucuagaaaguaauaaauucuguaugaauaagcauaa

SEQ ID NO: 550601 - RNA, 64 nt, hsa
uguucuauucaacuucuaauuugaaagcuguacaaaguaauagaaguuccauuuaaauaugagu

SEQ ID NO: 550602 - RNA, 64 nt, hsa
gacauucuccuaaaaauccguaauaccauuguaaaaguaauaauuccccaauaucaucuaauca

SEQ ID NO: 550603 - RNA, 64 nt, hsa
augauaguaaaaacaccugacaacuaaacauaguaaguaauacuagacuggauucuguaccaga

SEQ ID NO: 550604 - RNA, 64 nt, hsa
acaggcaggaacgggggaccauugcauugugcccaaguaauaauaaaacuauuucagauguauu

SEQ ID NO: 550605 - RNA, 64 nt, hsa
uguggggagagcacucgguugucuuuacuuuuaaaaguaauacuuggugcuaagaauuucagga

SEQ ID NO: 550606 - RNA, 64 nt, hsa
aggagagcaacaggccccugauuauacaguuccaaaguaauaagauguuaauuguaauucagcc

SEQ ID NO: 550607 - RNA, 64 nt, hsa
auuuuagcuuuagaaagaaaugcguuauagaaacaaguaauagcaagaaaauugauguauauuu

SEQ ID NO: 550608 - RNA, 64 nt, hsa
aagcauuauugggugccuuuguuuguaaaccaaaaaguaauaaaugaaucccuauauuuccauu

SEQ ID NO: 550609 - RNA, 64 nt, hsa
agaauacggugguugagaaggaaccaguguuuacaaguaauaucagaaaguugaaggaaccagu

SEQ ID NO: 550610 - RNA, 64 nt, hsa
guaauaucagaaaguugaaggaaccaguguuuacaaguaauaccagaaaguugccaaacccuuc

SEQ ID NO: 550611 - RNA, 64 nt, hsa
aguaccaccuaaaacugaauuuuaucauauaagcaaguaauaccuauuagucauaccuaaauuu

SEQ ID NO: 550612 - RNA, 64 nt, hsa
aucaggcuuuaccgguuuuuuuaguuguuuaaauaaguaauauuuucaaaagaauaaaauaacc

SEQ ID NO: 550613 - RNA, 64 nt, hsa
ucaaaguaauagcuuuuguucaaacauuuuuaggaaguaauaauacauuucuuccuggacaguu

SEQ ID NO: 550614 - RNA, 64 nt, hsa
aaacagcaauuaccuauggagaauacaucauucaaaguaauagcuuuuguucaaacauuuuuag

SEQ ID NO: 550615 - RNA, 64 nt, hsa
gguaguauaacaugagugaaugucauuaauuuugaaguaauaacugccacaugugggaaguagg

SEQ ID NO: 550616 - RNA, 64 nt, hsa
gccuuaaauaugcuuguauagcauccacuggcagaaguaauaguugugccucagacuugggggu

SEQ ID NO: 550617 - RNA, 64 nt, hsa
uauuacaaaaaacucccacuuuuuuuguuacaaaaaguaauagaaaaugguaauaguuaacauu

SEQ ID NO: 550618 - RNA, 64 nt, hsa
gucaccauauuuucgcuagcucaagcaguaccccaaguaauaacugaaggagcuaacuacccaa

SEQ ID NO: 550619 - RNA, 64 nt, hsa
caaugugucuaccaagaacaauugaguuuucuaaaaguaauaaugaagauuaugcaauucuaac

SEQ ID NO: 550620 - RNA, 64 nt, hsa
uuuaaucuuuuuaaauuguacagcaaggugcucuaaguaauauucgauaaaauauauuuaauag

SEQ ID NO: 550621 - RNA, 64 nt, hsa; identical to SEQ ID NO: 117373

SEQ ID NO: 550622 - RNA, 64 nt, hsa; identical to SEQ ID NO: 117374

SEQ ID NO: 550623 - RNA, 64 nt, hsa; identical to SEQ ID NO: 117375

SEQ ID NO: 550624 - RNA, 64 nt, hsa; identical to SEQ ID NO: 117376

SEQ ID NO: 550625 - RNA, 64 nt, hsa; identical to SEQ ID NO: 117377

SEQ ID NO: 550626 - RNA, 64 nt, hsa; identical to SEQ ID NO: 117378

SEQ ID NO: 550627 - RNA, 64 nt, hsa; identical to SEQ ID NO: 117379

SEQ ID NO: 550628 - RNA, 64 nt, hsa; identical to SEQ ID NO: 117380

SEQ ID NO: 550629 - RNA, 64 nt, hsa; identical to SEQ ID NO: 117381

SEQ ID NO: 550630 - RNA, 64 nt, hsa; identical to SEQ ID NO: 117382

SEQ ID NO: 550631 - RNA, 64 nt, hsa; identical to SEQ ID NO: 117383

SEQ ID NO: 550632 - RNA, 64 nt, hsa; identical to SEQ ID NO: 117384

SEQ ID NO: 550633 - RNA, 64 nt, hsa; identical to SEQ ID NO: 117385

SEQ ID NO: 550634 - RNA, 64 nt, hsa; identical to SEQ ID NO: 117386

SEQ ID NO: 550635 - RNA, 64 nt, hsa; identical to SEQ ID NO: 117387

SEQ ID NO: 550636 - RNA, 64 nt, hsa; identical to SEQ ID NO: 117388

SEQ ID NO: 550637 - RNA, 64 nt, hsa; identical to SEQ ID NO: 117389

SEQ ID NO: 550638 - RNA, 64 nt, hsa; identical to SEQ ID NO: 117390

SEQ ID NO: 550639 - RNA, 64 nt, hsa; identical to SEQ ID NO: 117391

SEQ ID NO: 550640 - RNA, 64 nt, hsa; identical to SEQ ID NO: 117392

SEQ ID NO: 550641 - RNA, 64 nt, hsa; identical to SEQ ID NO: 117393

SEQ ID NO: 550642 - RNA, 64 nt, hsa; identical to SEQ ID NO: 117394

SEQ ID NO: 550643 - RNA, 64 nt, hsa; identical to SEQ ID NO: 61334

SEQ ID NO: 550644 - RNA, 64 nt, hsa; identical to SEQ ID NO: 61335

SEQ ID NO: 550645 - RNA, 64 nt, hsa; identical to SEQ ID NO: 61336

SEQ ID NO: 550646 - RNA, 64 nt, hsa; identical to SEQ ID NO: 61337

SEQ ID NO: 550647 - RNA, 64 nt, hsa; identical to SEQ ID NO: 61338

SEQ ID NO: 550648 - RNA, 64 nt, hsa; identical to SEQ ID NO: 61339

SEQ ID NO: 550649 - RNA, 64 nt, hsa; identical to SEQ ID NO: 61340

SEQ ID NO: 550650 - RNA, 64 nt, hsa; identical to SEQ ID NO: 61341

SEQ ID NO: 550651 - RNA, 64 nt, hsa; identical to SEQ ID NO: 61342

SEQ ID NO: 550652 - RNA, 64 nt, hsa; identical to SEQ ID NO: 61343

SEQ ID NO: 550653 - RNA, 64 nt, hsa; identical to SEQ ID NO: 61344

SEQ ID NO: 550654 - RNA, 64 nt, hsa; identical to SEQ ID NO: 61345

SEQ ID NO: 550655 - RNA, 64 nt, hsa; identical to SEQ ID NO: 61346

SEQ ID NO: 550656 - RNA, 64 nt, hsa; identical to SEQ ID NO: 61347

SEQ ID NO: 550657 - RNA, 64 nt, hsa; identical to SEQ ID NO: 61348

SEQ ID NO: 550658 - RNA, 64 nt, hsa; identical to SEQ ID NO: 61349

SEQ ID NO: 550659 - RNA, 64 nt, hsa; identical to SEQ ID NO: 61350

SEQ ID NO: 550660 - RNA, 64 nt, hsa; identical to SEQ ID NO: 61351

SEQ ID NO: 550661 - RNA, 53 nt, hsa; identical to SEQ ID NO: 167525

SEQ ID NO: 550662 - RNA, 64 nt, hsa; identical to SEQ ID NO: 167526

SEQ ID NO: 550663 - RNA, 64 nt, hsa; identical to SEQ ID NO: 167527

SEQ ID NO: 550664 - RNA, 64 nt, hsa; identical to SEQ ID NO: 167528

SEQ ID NO: 550665 - RNA, 64 nt, hsa; identical to SEQ ID NO: 167529

SEQ ID NO: 550666 - RNA, 64 nt, hsa; identical to SEQ ID NO: 167530

SEQ ID NO: 550667 - RNA, 64 nt, hsa; identical to SEQ ID NO: 167531

SEQ ID NO: 550668 - RNA, 64 nt, hsa; identical to SEQ ID NO: 167532

SEQ ID NO: 550669 - RNA, 64 nt, hsa; identical to SEQ ID NO: 167533

SEQ ID NO: 550670 - RNA, 64 nt, hsa; identical to SEQ ID NO: 167534

SEQ ID NO: 550671 - RNA, 64 nt, hsa; identical to SEQ ID NO: 167535

SEQ ID NO: 550672 - RNA, 64 nt, hsa; identical to SEQ ID NO: 167536

SEQ ID NO: 550673 - RNA, 64 nt, hsa; identical to SEQ ID NO: 167537

SEQ ID NO: 550674 - RNA, 64 nt, hsa; identical to SEQ ID NO: 167538

SEQ ID NO: 550675 - RNA, 64 nt, hsa; identical to SEQ ID NO: 167539

SEQ ID NO: 550676 - RNA, 64 nt, hsa; identical to SEQ ID NO: 167540

SEQ ID NO: 550677 - RNA, 64 nt, hsa; identical to SEQ ID NO: 167541

SEQ ID NO: 550678 - RNA, 64 nt, hsa; identical to SEQ ID NO: 167542

SEQ ID NO: 550679 - RNA, 64 nt, hsa; identical to SEQ ID NO: 167543

SEQ ID NO: 550680 - RNA, 64 nt, hsa; identical to SEQ ID NO: 167544

SEQ ID NO: 550681 - RNA, 64 nt, hsa; identical to SEQ ID NO: 167545

SEQ ID NO: 550682 - RNA, 64 nt, hsa; identical to SEQ ID NO: 167546

SEQ ID NO: 550683 - RNA, 64 nt, hsa; identical to SEQ ID NO: 167547

SEQ ID NO: 550684 - RNA, 64 nt, hsa; identical to SEQ ID NO: 167548

SEQ ID NO: 550685 - RNA, 64 nt, hsa; identical to SEQ ID NO: 167549

SEQ ID NO: 550686 - RNA, 64 nt, hsa; identical to SEQ ID NO: 167550

SEQ ID NO: 550687 - RNA, 64 nt, hsa; identical to SEQ ID NO: 167551

SEQ ID NO: 550688 - RNA, 64 nt, hsa; identical to SEQ ID NO: 167552

SEQ ID NO: 550689 - RNA, 64 nt, hsa; identical to SEQ ID NO: 167553

SEQ ID NO: 550690 - RNA, 64 nt, hsa; identical to SEQ ID NO: 167554

SEQ ID NO: 550691 - RNA, 64 nt, hsa; identical to SEQ ID NO: 167555

SEQ ID NO: 550692 - RNA, 64 nt, hsa; identical to SEQ ID NO: 167556

SEQ ID NO: 550693 - RNA, 64 nt, hsa; identical to SEQ ID NO: 167557

SEQ ID NO: 550694 - RNA, 64 nt, hsa; identical to SEQ ID NO: 167558

SEQ ID NO: 550695 - RNA, 64 nt, hsa; identical to SEQ ID NO: 167559

SEQ ID NO: 550696 - RNA, 64 nt, hsa; identical to SEQ ID NO: 167560

SEQ ID NO: 550697 - RNA, 64 nt, hsa; identical to SEQ ID NO: 167561

SEQ ID NO: 550698 - RNA, 64 nt, hsa; identical to SEQ ID NO: 167562

SEQ ID NO: 550699 - RNA, 64 nt, hsa; identical to SEQ ID NO: 167563

SEQ ID NO: 550700 - RNA, 64 nt, hsa; identical to SEQ ID NO: 167564

SEQ ID NO: 550701 - RNA, 64 nt, hsa; identical to SEQ ID NO: 167565

SEQ ID NO: 550702 - RNA, 64 nt, hsa; identical to SEQ ID NO: 167566

SEQ ID NO: 550703 - RNA, 64 nt, hsa; identical to SEQ ID NO: 167567

SEQ ID NO: 550704 - RNA, 64 nt, hsa; identical to SEQ ID NO: 167568

SEQ ID NO: 550705 - RNA, 64 nt, hsa; identical to SEQ ID NO: 167569

SEQ ID NO: 550706 - RNA, 64 nt, hsa; identical to SEQ ID NO: 167570

SEQ ID NO: 550707 - RNA, 64 nt, hsa; identical to SEQ ID NO: 167571

SEQ ID NO: 550708 - RNA, 64 nt, hsa; identical to SEQ ID NO: 167572

SEQ ID NO: 550709 - RNA, 64 nt, hsa; identical to SEQ ID NO: 167573

SEQ ID NO: 550710 - RNA, 64 nt, hsa; identical to SEQ ID NO: 167574

SEQ ID NO: 550711 - RNA, 64 nt, hsa; identical to SEQ ID NO: 167575

SEQ ID NO: 550712 - RNA, 64 nt, hsa; identical to SEQ ID NO: 193524

SEQ ID NO: 550713 - RNA, 64 nt, hsa; identical to SEQ ID NO: 193525

SEQ ID NO: 550714 - RNA, 64 nt, hsa; identical to SEQ ID NO: 193526

SEQ ID NO: 550715 - RNA, 64 nt, hsa; identical to SEQ ID NO: 193527

SEQ ID NO: 550716 - RNA, 64 nt, hsa; identical to SEQ ID NO: 193528

SEQ ID NO: 550717 - RNA, 64 nt, hsa; identical to SEQ ID NO: 193529

SEQ ID NO: 550718 - RNA, 64 nt, hsa; identical to SEQ ID NO: 193530

SEQ ID NO: 550719 - RNA, 64 nt, hsa; identical to SEQ ID NO: 193531

SEQ ID NO: 550720 - RNA, 64 nt, hsa; identical to SEQ ID NO: 193532

SEQ ID NO: 550721 - RNA, 64 nt, hsa; identical to SEQ ID NO: 193533

SEQ ID NO: 550722 - RNA, 64 nt, hsa; identical to SEQ ID NO: 193534

SEQ ID NO: 550723 - RNA, 64 nt, hsa; identical to SEQ ID NO: 193535

SEQ ID NO: 550724 - RNA, 64 nt, hsa; identical to SEQ ID NO: 193536

SEQ ID NO: 550725 - RNA, 64 nt, hsa; identical to SEQ ID NO: 193537

SEQ ID NO: 550726 - RNA, 64 nt, hsa; identical to SEQ ID NO: 193538

SEQ ID NO: 550727 - RNA, 64 nt, hsa; identical to SEQ ID NO: 193539

SEQ ID NO: 550728 - RNA, 64 nt, hsa; identical to SEQ ID NO: 193540

SEQ ID NO: 550729 - RNA, 64 nt, hsa; identical to SEQ ID NO: 193541

SEQ ID NO: 550730 - RNA, 64 nt, hsa; identical to SEQ ID NO: 193542

SEQ ID NO: 550731 - RNA, 64 nt, hsa; identical to SEQ ID NO: 193543

SEQ ID NO: 550732 - RNA, 64 nt, hsa; identical to SEQ ID NO: 193544

SEQ ID NO: 550733 - RNA, 64 nt, hsa; identical to SEQ ID NO: 193545

SEQ ID NO: 550734 - RNA, 64 nt, hsa; identical to SEQ ID NO: 193546

SEQ ID NO: 550735 - RNA, 64 nt, hsa; identical to SEQ ID NO: 193547

SEQ ID NO: 550736 - RNA, 64 nt, hsa; identical to SEQ ID NO: 193548

SEQ ID NO: 550737 - RNA, 64 nt, hsa; identical to SEQ ID NO: 193549

SEQ ID NO: 550738 - RNA, 64 nt, hsa; identical to SEQ ID NO: 193550

SEQ ID NO: 550739 - RNA, 64 nt, hsa; identical to SEQ ID NO: 193551

SEQ ID NO: 550740 - RNA, 64 nt, hsa; identical to SEQ ID NO: 193552

SEQ ID NO: 550741 - RNA, 64 nt, hsa; identical to SEQ ID NO: 193553

SEQ ID NO: 550742 - RNA, 64 nt, hsa; identical to SEQ ID NO: 193554

SEQ ID NO: 550743 - RNA, 64 nt, hsa; identical to SEQ ID NO: 193555

SEQ ID NO: 550744 - RNA, 64 nt, hsa; identical to SEQ ID NO: 193556

SEQ ID NO: 550745 - RNA, 64 nt, hsa; identical to SEQ ID NO: 193557

SEQ ID NO: 550746 - RNA, 64 nt, hsa; identical to SEQ ID NO: 193558

SEQ ID NO: 550747 - RNA, 64 nt, hsa; identical to SEQ ID NO: 193559

SEQ ID NO: 550748 - RNA, 64 nt, hsa; identical to SEQ ID NO: 193560

SEQ ID NO: 550749 - RNA, 64 nt, hsa; identical to SEQ ID NO: 193561

SEQ ID NO: 550750 - RNA, 64 nt, hsa; identical to SEQ ID NO: 193562

SEQ ID NO: 550751 - RNA, 64 nt, hsa; identical to SEQ ID NO: 193563

SEQ ID NO: 550752 - RNA, 64 nt, hsa; identical to SEQ ID NO: 193564

SEQ ID NO: 550753 - RNA, 64 nt, hsa; identical to SEQ ID NO: 193565

SEQ ID NO: 550754 - RNA, 64 nt, hsa; identical to SEQ ID NO: 193566

SEQ ID NO: 550755 - RNA, 64 nt, hsa; identical to SEQ ID NO: 193567

SEQ ID NO: 550756 - RNA, 64 nt, hsa; identical to SEQ ID NO: 193568

SEQ ID NO: 550757 - RNA, 64 nt, hsa; identical to SEQ ID NO: 193569

SEQ ID NO: 550758 - RNA, 64 nt, hsa; identical to SEQ ID NO: 193570

SEQ ID NO: 550759 - RNA, 64 nt, hsa; identical to SEQ ID NO: 193571

SEQ ID NO: 550760 - RNA, 64 nt, hsa; identical to SEQ ID NO: 193572

SEQ ID NO: 550761 - RNA, 64 nt, hsa; identical to SEQ ID NO: 193573

SEQ ID NO: 550762 - RNA, 64 nt, hsa; identical to SEQ ID NO: 193574

SEQ ID NO: 550763 - RNA, 64 nt, hsa; identical to SEQ ID NO: 193575

SEQ ID NO: 550764 - RNA, 64 nt, hsa; identical to SEQ ID NO: 193576

SEQ ID NO: 550765 - RNA, 64 nt, hsa; identical to SEQ ID NO: 193577

SEQ ID NO: 550766 - RNA, 64 nt, hsa; identical to SEQ ID NO: 193578

SEQ ID NO: 550767 - RNA, 64 nt, hsa; identical to SEQ ID NO: 193579

SEQ ID NO: 550768 - RNA, 64 nt, hsa; identical to SEQ ID NO: 193580

SEQ ID NO: 550769 - RNA, 64 nt, hsa; identical to SEQ ID NO: 193581

SEQ ID NO: 550770 - RNA, 64 nt, hsa; identical to SEQ ID NO: 193582

SEQ ID NO: 550771 - RNA, 64 nt, hsa; identical to SEQ ID NO: 193583

SEQ ID NO: 550772 - RNA, 64 nt, hsa; identical to SEQ ID NO: 193584

SEQ ID NO: 550773 - RNA, 64 nt, hsa; identical to SEQ ID NO: 193585

SEQ ID NO: 550774 - RNA, 64 nt, hsa; identical to SEQ ID NO: 193586

SEQ ID NO: 550775 - RNA, 64 nt, hsa; identical to SEQ ID NO: 193587

SEQ ID NO: 550776 - RNA, 64 nt, hsa; identical to SEQ ID NO: 193588

SEQ ID NO: 550777 - RNA, 64 nt, hsa; identical to SEQ ID NO: 193589

SEQ ID NO: 550778 - RNA, 64 nt, hsa; identical to SEQ ID NO: 193590

SEQ ID NO: 550779 - RNA, 64 nt, hsa; identical to SEQ ID NO: 193591

SEQ ID NO: 550780 - RNA, 64 nt, hsa; identical to SEQ ID NO: 193592

SEQ ID NO: 550781 - RNA, 64 nt, hsa; identical to SEQ ID NO: 193593

SEQ ID NO: 550782 - RNA, 64 nt, hsa; identical to SEQ ID NO: 193594

SEQ ID NO: 550783 - RNA, 64 nt, hsa; identical to SEQ ID NO: 193595

SEQ ID NO: 550784 - RNA, 64 nt, hsa; identical to SEQ ID NO: 193596

SEQ ID NO: 550785 - RNA, 64 nt, hsa; identical to SEQ ID NO: 107827

SEQ ID NO: 550786 - RNA, 64 nt, hsa; identical to SEQ ID NO: 107828

SEQ ID NO: 550787 - RNA, 64 nt, hsa; identical to SEQ ID NO: 107829

SEQ ID NO: 550788 - RNA, 64 nt, hsa; identical to SEQ ID NO: 107830

SEQ ID NO: 550789 - RNA, 64 nt, hsa; identical to SEQ ID NO: 107831

SEQ ID NO: 550790 - RNA, 64 nt, hsa; identical to SEQ ID NO: 107832

SEQ ID NO: 550791 - RNA, 64 nt, hsa; identical to SEQ ID NO: 107833

SEQ ID NO: 550792 - RNA, 64 nt, hsa; identical to SEQ ID NO: 107834

SEQ ID NO: 550793 - RNA, 64 nt, hsa; identical to SEQ ID NO: 107835

SEQ ID NO: 550794 - RNA, 64 nt, hsa; identical to SEQ ID NO: 107836

SEQ ID NO: 550795 - RNA, 64 nt, hsa; identical to SEQ ID NO: 107837

SEQ ID NO: 550796 - RNA, 64 nt, hsa; identical to SEQ ID NO: 107838

SEQ ID NO: 550797 - RNA, 64 nt, hsa; identical to SEQ ID NO: 107839

SEQ ID NO: 550798 - RNA, 64 nt, hsa; identical to SEQ ID NO: 107840

SEQ ID NO: 550799 - RNA, 64 nt, hsa; identical to SEQ ID NO: 118014

SEQ ID NO: 550800 - RNA, 64 nt, hsa; identical to SEQ ID NO: 118015

SEQ ID NO: 550801 - RNA, 64 nt, hsa; identical to SEQ ID NO: 118016

SEQ ID NO: 550802 - RNA, 64 nt, hsa; identical to SEQ ID NO: 118017

SEQ ID NO: 550803 - RNA, 64 nt, hsa; identical to SEQ ID NO: 118018

SEQ ID NO: 550804 - RNA, 64 nt, hsa; identical to SEQ ID NO: 118019

SEQ ID NO: 550805 - RNA, 64 nt, hsa; identical to SEQ ID NO: 118020

SEQ ID NO: 550806 - RNA, 64 nt, hsa; identical to SEQ ID NO: 118021

SEQ ID NO: 550807 - RNA, 64 nt, hsa; identical to SEQ ID NO: 118022

SEQ ID NO: 550808 - RNA, 64 nt, hsa; identical to SEQ ID NO: 118023

SEQ ID NO: 550809 - RNA, 64 nt, hsa; identical to SEQ ID NO: 118024

SEQ ID NO: 550810 - RNA, 64 nt, hsa; identical to SEQ ID NO: 118025

SEQ ID NO: 550811 - RNA, 64 nt, hsa; identical to SEQ ID NO: 376674

SEQ ID NO: 550812 - RNA, 64 nt, hsa; identical to SEQ ID NO: 376675

SEQ ID NO: 550813 - RNA, 64 nt, hsa; identical to SEQ ID NO: 376676

SEQ ID NO: 550814 - RNA, 64 nt, hsa; identical to SEQ ID NO: 376677

SEQ ID NO: 550815 - RNA, 64 nt, hsa; identical to SEQ ID NO: 376678

SEQ ID NO: 550816 - RNA, 64 nt, hsa; identical to SEQ ID NO: 376679

SEQ ID NO: 550817 - RNA, 64 nt, hsa; identical to SEQ ID NO: 376680

SEQ ID NO: 550818 - RNA, 64 nt, hsa; identical to SEQ ID NO: 376681

SEQ ID NO: 550819 - RNA, 64 nt, hsa; identical to SEQ ID NO: 376682

SEQ ID NO: 550820 - RNA, 64 nt, hsa; identical to SEQ ID NO: 376683

SEQ ID NO: 550821 - RNA, 64 nt, hsa; identical to SEQ ID NO: 376684

SEQ ID NO: 550822 - RNA, 64 nt, hsa; identical to SEQ ID NO: 376685

SEQ ID NO: 550823 - RNA, 64 nt, hsa; identical to SEQ ID NO: 376686

SEQ ID NO: 550824 - RNA, 64 nt, hsa; identical to SEQ ID NO: 376687

SEQ ID NO: 550825 - RNA, 64 nt, hsa; identical to SEQ ID NO: 376688

SEQ ID NO: 550826 - RNA, 64 nt, hsa; identical to SEQ ID NO: 376689

SEQ ID NO: 550827 - RNA, 64 nt, hsa; identical to SEQ ID NO: 376690

SEQ ID NO: 550828 - RNA, 64 nt, hsa; identical to SEQ ID NO: 376691

SEQ ID NO: 550829 - RNA, 64 nt, hsa; identical to SEQ ID NO: 376692

SEQ ID NO: 550830 - RNA, 64 nt, hsa; identical to SEQ ID NO: 376693

SEQ ID NO: 550831 - RNA, 64 nt, hsa; identical to SEQ ID NO: 376694

SEQ ID NO: 550832 - RNA, 64 nt, hsa; identical to SEQ ID NO: 376695

SEQ ID NO: 550833 - RNA, 64 nt, hsa; identical to SEQ ID NO: 376696

SEQ ID NO: 550834 - RNA, 64 nt, hsa; identical to SEQ ID NO: 376697

SEQ ID NO: 550835 - RNA, 64 nt, hsa; identical to SEQ ID NO: 376698

SEQ ID NO: 550836 - RNA, 64 nt, hsa; identical to SEQ ID NO: 376699

SEQ ID NO: 550837 - RNA, 64 nt, hsa; identical to SEQ ID NO: 376700

SEQ ID NO: 550838 - RNA, 64 nt, hsa; identical to SEQ ID NO: 376701

SEQ ID NO: 550839 - RNA, 64 nt, hsa; identical to SEQ ID NO: 376702

SEQ ID NO: 550840 - RNA, 64 nt, hsa; identical to SEQ ID NO: 376703

SEQ ID NO: 550841 - RNA, 64 nt, hsa; identical to SEQ ID NO: 376704

SEQ ID NO: 550842 - RNA, 64 nt, hsa; identical to SEQ ID NO: 376705

SEQ ID NO: 550843 - RNA, 64 nt, hsa; identical to SEQ ID NO: 376706

SEQ ID NO: 550844 - RNA, 64 nt, hsa; identical to SEQ ID NO: 376707

SEQ ID NO: 550845 - RNA, 64 nt, hsa; identical to SEQ ID NO: 376708

SEQ ID NO: 550846 - RNA, 64 nt, hsa; identical to SEQ ID NO: 376709

SEQ ID NO: 550847 - RNA, 64 nt, hsa; identical to SEQ ID NO: 376710

SEQ ID NO: 550848 - RNA, 64 nt, hsa; identical to SEQ ID NO: 376711

SEQ ID NO: 550849 - RNA, 64 nt, hsa; identical to SEQ ID NO: 376712

SEQ ID NO: 550850 - RNA, 64 nt, hsa; identical to SEQ ID NO: 376713

SEQ ID NO: 550851 - RNA, 64 nt, hsa; identical to SEQ ID NO: 376714

SEQ ID NO: 550852 - RNA, 64 nt, hsa; identical to SEQ ID NO: 376715

SEQ ID NO: 550853 - RNA, 64 nt, hsa; identical to SEQ ID NO: 376716

SEQ ID NO: 550854 - RNA, 64 nt, hsa; identical to SEQ ID NO: 376717

SEQ ID NO: 550855 - RNA, 64 nt, hsa; identical to SEQ ID NO: 376718

SEQ ID NO: 550856 - RNA, 64 nt, hsa; identical to SEQ ID NO: 376719

SEQ ID NO: 550857 - RNA, 64 nt, hsa; identical to SEQ ID NO: 376720

SEQ ID NO: 550858 - RNA, 64 nt, hsa; identical to SEQ ID NO: 376721

SEQ ID NO: 550859 - RNA, 64 nt, hsa; identical to SEQ ID NO: 376722

SEQ ID NO: 550860 - RNA, 64 nt, hsa; identical to SEQ ID NO: 376723

SEQ ID NO: 550861 - RNA, 64 nt, hsa; identical to SEQ ID NO: 376724

SEQ ID NO: 550862 - RNA, 64 nt, hsa; identical to SEQ ID NO: 376725

SEQ ID NO: 550863 - RNA, 64 nt, hsa; identical to SEQ ID NO: 376726

SEQ ID NO: 550864 - RNA, 64 nt, hsa; identical to SEQ ID NO: 376727

SEQ ID NO: 550865 - RNA, 64 nt, hsa; identical to SEQ ID NO: 376728

SEQ ID NO: 550866 - RNA, 64 nt, hsa; identical to SEQ ID NO: 376729

SEQ ID NO: 550867 - RNA, 64 nt, hsa; identical to SEQ ID NO: 376730

SEQ ID NO: 550868 - RNA, 64 nt, hsa; identical to SEQ ID NO: 376731

SEQ ID NO: 550869 - RNA, 62 nt, hsa; identical to SEQ ID NO: 376732

SEQ ID NO: 550870 - RNA, 64 nt, hsa; identical to SEQ ID NO: 376733

SEQ ID NO: 550871 - RNA, 64 nt, hsa; identical to SEQ ID NO: 376734

SEQ ID NO: 550872 - RNA, 55 nt, hsa; identical to SEQ ID NO: 376735

SEQ ID NO: 550873 - RNA, 64 nt, hsa; identical to SEQ ID NO: 376736

SEQ ID NO: 550874 - RNA, 64 nt, hsa; identical to SEQ ID NO: 376737

SEQ ID NO: 550875 - RNA, 64 nt, hsa; identical to SEQ ID NO: 376738

SEQ ID NO: 550876 - RNA, 64 nt, hsa; identical to SEQ ID NO: 376739

SEQ ID NO: 550877 - RNA, 64 nt, hsa; identical to SEQ ID NO: 376740

SEQ ID NO: 550878 - RNA, 64 nt, hsa; identical to SEQ ID NO: 376741

SEQ ID NO: 550879 - RNA, 64 nt, hsa; identical to SEQ ID NO: 376742

SEQ ID NO: 550880 - RNA, 64 nt, hsa; identical to SEQ ID NO: 376743

SEQ ID NO: 550881 - RNA, 64 nt, hsa; identical to SEQ ID NO: 376744

SEQ ID NO: 550882 - RNA, 64 nt, hsa; identical to SEQ ID NO: 376745

SEQ ID NO: 550883 - RNA, 64 nt, hsa; identical to SEQ ID NO: 376746

SEQ ID NO: 550884 - RNA, 64 nt, hsa; identical to SEQ ID NO: 376747

SEQ ID NO: 550885 - RNA, 64 nt, hsa; identical to SEQ ID NO: 376748

SEQ ID NO: 550886 - RNA, 64 nt, hsa; identical to SEQ ID NO: 376749

SEQ ID NO: 550887 - RNA, 64 nt, hsa; identical to SEQ ID NO: 376750

SEQ ID NO: 550888 - RNA, 64 nt, hsa; identical to SEQ ID NO: 376751

SEQ ID NO: 550889 - RNA, 64 nt, hsa; identical to SEQ ID NO: 376752

SEQ ID NO: 550890 - RNA, 64 nt, hsa; identical to SEQ ID NO: 376753

SEQ ID NO: 550891 - RNA, 64 nt, hsa; identical to SEQ ID NO: 376754

SEQ ID NO: 550892 - RNA, 64 nt, hsa; identical to SEQ ID NO: 376755

SEQ ID NO: 550893 - RNA, 64 nt, hsa; identical to SEQ ID NO: 376756

SEQ ID NO: 550894 - RNA, 64 nt, hsa; identical to SEQ ID NO: 376757

SEQ ID NO: 550895 - RNA, 64 nt, hsa; identical to SEQ ID NO: 376758

SEQ ID NO: 550896 - RNA, 64 nt, hsa; identical to SEQ ID NO: 376759

SEQ ID NO: 550897 - RNA, 64 nt, hsa; identical to SEQ ID NO: 376760

SEQ ID NO: 550898 - RNA, 64 nt, hsa; identical to SEQ ID NO: 376761

SEQ ID NO: 550899 - RNA, 64 nt, hsa; identical to SEQ ID NO: 376762

SEQ ID NO: 550900 - RNA, 64 nt, hsa; identical to SEQ ID NO: 376763

SEQ ID NO: 550901 - RNA, 64 nt, hsa; identical to SEQ ID NO: 376764

SEQ ID NO: 550902 - RNA, 64 nt, hsa; identical to SEQ ID NO: 376765

SEQ ID NO: 550903 - RNA, 64 nt, hsa; identical to SEQ ID NO: 376766

SEQ ID NO: 550904 - RNA, 64 nt, hsa; identical to SEQ ID NO: 376767

SEQ ID NO: 550905 - RNA, 64 nt, hsa; identical to SEQ ID NO: 376768

SEQ ID NO: 550906 - RNA, 64 nt, hsa; identical to SEQ ID NO: 376769

SEQ ID NO: 550907 - RNA, 64 nt, hsa; identical to SEQ ID NO: 376770

SEQ ID NO: 550908 - RNA, 64 nt, hsa; identical to SEQ ID NO: 376771

SEQ ID NO: 550909 - RNA, 64 nt, hsa; identical to SEQ ID NO: 376772

SEQ ID NO: 550910 - RNA, 64 nt, hsa; identical to SEQ ID NO: 376773

SEQ ID NO: 550911 - RNA, 64 nt, hsa; identical to SEQ ID NO: 376774

SEQ ID NO: 550912 - RNA, 64 nt, hsa; identical to SEQ ID NO: 376775

SEQ ID NO: 550913 - RNA, 64 nt, hsa; identical to SEQ ID NO: 376776

SEQ ID NO: 550914 - RNA, 64 nt, hsa; identical to SEQ ID NO: 376777

SEQ ID NO: 550915 - RNA, 64 nt, hsa; identical to SEQ ID NO: 376778

SEQ ID NO: 550916 - RNA, 64 nt, hsa; identical to SEQ ID NO: 376779

SEQ ID NO: 550917 - RNA, 64 nt, hsa; identical to SEQ ID NO: 376780

SEQ ID NO: 550918 - RNA, 64 nt, hsa; identical to SEQ ID NO: 376781

SEQ ID NO: 550919 - RNA, 64 nt, hsa; identical to SEQ ID NO: 376782

SEQ ID NO: 550920 - RNA, 64 nt, hsa; identical to SEQ ID NO: 376783

SEQ ID NO: 550921 - RNA, 64 nt, hsa; identical to SEQ ID NO: 376784

SEQ ID NO: 550922 - RNA, 64 nt, hsa; identical to SEQ ID NO: 376785

SEQ ID NO: 550923 - RNA, 64 nt, hsa; identical to SEQ ID NO: 83612

SEQ ID NO: 550924 - RNA, 64 nt, hsa; identical to SEQ ID NO: 83613

SEQ ID NO: 550925 - RNA, 64 nt, hsa; identical to SEQ ID NO: 83614

SEQ ID NO: 550926 - RNA, 64 nt, hsa; identical to SEQ ID NO: 83615

SEQ ID NO: 550927 - RNA, 64 nt, hsa; identical to SEQ ID NO: 83616

SEQ ID NO: 550928 - RNA, 64 nt, hsa; identical to SEQ ID NO: 83617

SEQ ID NO: 550929 - RNA, 64 nt, hsa; identical to SEQ ID NO: 83618

SEQ ID NO: 550930 - RNA, 64 nt, hsa; identical to SEQ ID NO: 83619

SEQ ID NO: 550931 - RNA, 64 nt, hsa; identical to SEQ ID NO: 83620

SEQ ID NO: 550932 - RNA, 64 nt, hsa; identical to SEQ ID NO: 83621

SEQ ID NO: 550933 - RNA, 64 nt, hsa; identical to SEQ ID NO: 83622

SEQ ID NO: 550934 - RNA, 64 nt, hsa; identical to SEQ ID NO: 83623

SEQ ID NO: 550935 - RNA, 64 nt, hsa; identical to SEQ ID NO: 83624

SEQ ID NO: 550936 - RNA, 64 nt, hsa; identical to SEQ ID NO: 83625

SEQ ID NO: 550937 - RNA, 64 nt, hsa; identical to SEQ ID NO: 83626

SEQ ID NO: 550938 - RNA, 64 nt, hsa; identical to SEQ ID NO: 83627

SEQ ID NO: 550939 - RNA, 64 nt, hsa; identical to SEQ ID NO: 83628

SEQ ID NO: 550940 - RNA, 64 nt, hsa; identical to SEQ ID NO: 83629

SEQ ID NO: 550941 - RNA, 64 nt, hsa; identical to SEQ ID NO: 83630

SEQ ID NO: 550942 - RNA, 64 nt, hsa; identical to SEQ ID NO: 83631

SEQ ID NO: 550943 - RNA, 64 nt, hsa; identical to SEQ ID NO: 83632

SEQ ID NO: 550944 - RNA, 60 nt, hsa; identical to SEQ ID NO: 83633

SEQ ID NO: 550945 - RNA, 64 nt, hsa; identical to SEQ ID NO: 83634

SEQ ID NO: 550946 - RNA, 64 nt, hsa; identical to SEQ ID NO: 83635

SEQ ID NO: 550947 - RNA, 64 nt, hsa; identical to SEQ ID NO: 83636

SEQ ID NO: 550948 - RNA, 64 nt, hsa; identical to SEQ ID NO: 83637

SEQ ID NO: 550949 - RNA, 64 nt, hsa; identical to SEQ ID NO: 83638

SEQ ID NO: 550950 - RNA, 64 nt, hsa; identical to SEQ ID NO: 83639

SEQ ID NO: 550951 - RNA, 64 nt, hsa; identical to SEQ ID NO: 83640

SEQ ID NO: 550952 - RNA, 64 nt, hsa; identical to SEQ ID NO: 83641

SEQ ID NO: 550953 - RNA, 64 nt, hsa; identical to SEQ ID NO: 83642

SEQ ID NO: 550954 - RNA, 64 nt, hsa; identical to SEQ ID NO: 83643

SEQ ID NO: 550955 - RNA, 64 nt, hsa; identical to SEQ ID NO: 83644

SEQ ID NO: 550956 - RNA, 64 nt, hsa; identical to SEQ ID NO: 83645

SEQ ID NO: 550957 - RNA, 64 nt, hsa; identical to SEQ ID NO: 83646

SEQ ID NO: 550958 - RNA, 64 nt, hsa; identical to SEQ ID NO: 83647

SEQ ID NO: 550959 - RNA, 64 nt, hsa; identical to SEQ ID NO: 83648

SEQ ID NO: 550960 - RNA, 64 nt, hsa; identical to SEQ ID NO: 83649

SEQ ID NO: 550961 - RNA, 64 nt, hsa; identical to SEQ ID NO: 83650

SEQ ID NO: 550962 - RNA, 54 nt, hsa; identical to SEQ ID NO: 83651

SEQ ID NO: 550963 - RNA, 64 nt, hsa; identical to SEQ ID NO: 83652

SEQ ID NO: 550964 - RNA, 64 nt, hsa; identical to SEQ ID NO: 83653

SEQ ID NO: 550965 - RNA, 64 nt, hsa; identical to SEQ ID NO: 83654

SEQ ID NO: 550966 - RNA, 64 nt, hsa; identical to SEQ ID NO: 83655

SEQ ID NO: 550967 - RNA, 64 nt, hsa; identical to SEQ ID NO: 83656

SEQ ID NO: 550968 - RNA, 64 nt, hsa; identical to SEQ ID NO: 83657

SEQ ID NO: 550969 - RNA, 59 nt, hsa; identical to SEQ ID NO: 83658

SEQ ID NO: 550970 - RNA, 64 nt, hsa; identical to SEQ ID NO: 83659

SEQ ID NO: 550971 - RNA, 64 nt, hsa; identical to SEQ ID NO: 83660

SEQ ID NO: 550972 - RNA, 64 nt, hsa; identical to SEQ ID NO: 83661

SEQ ID NO: 550973 - RNA, 64 nt, hsa; identical to SEQ ID NO: 83662

SEQ ID NO: 550974 - RNA, 64 nt, hsa; identical to SEQ ID NO: 83663

SEQ ID NO: 550975 - RNA, 64 nt, hsa; identical to SEQ ID NO: 83664

SEQ ID NO: 550976 - RNA, 64 nt, hsa; identical to SEQ ID NO: 83665

SEQ ID NO: 550977 - RNA, 64 nt, hsa; identical to SEQ ID NO: 83666

SEQ ID NO: 550978 - RNA, 64 nt, hsa; identical to SEQ ID NO: 83667

SEQ ID NO: 550979 - RNA, 64 nt, hsa; identical to SEQ ID NO: 83668

SEQ ID NO: 550980 - RNA, 64 nt, hsa
gaagaacaaccccugaacaauggaggccuuucuuucccgcuaggcucccagccuccuucccgcu

SEQ ID NO: 550981 - RNA, 64 nt, hsa
aggccuuucuuucccgcuaggcucccagccuccuucccgcuacagaaucgcucaucggcgaggc

SEQ ID NO: 550982 - RNA, 64 nt, hsa
cugaccacuacccucuuuccuagggcauaguccaucccgcuaguccaucccgcuagccccacuc

SEQ ID NO: 550983 - RNA, 64 nt, hsa
ucuuuccuagggcauaguccaucccgcuaguccaucccgcuagccccacuccagggacucagac

SEQ ID NO: 550984 - RNA, 64 nt, hsa; identical to SEQ ID NO: 307517

SEQ ID NO: 550985 - RNA, 64 nt, hsa; identical to SEQ ID NO: 307518

SEQ ID NO: 550986 - RNA, 64 nt, hsa; identical to SEQ ID NO: 307519

SEQ ID NO: 550987 - RNA, 64 nt, hsa; identical to SEQ ID NO: 307520

SEQ ID NO: 550988 - RNA, 64 nt, hsa; identical to SEQ ID NO: 307521

SEQ ID NO: 550989 - RNA, 64 nt, hsa; identical to SEQ ID NO: 307522

SEQ ID NO: 550990 - RNA, 64 nt, hsa; identical to SEQ ID NO: 307523

SEQ ID NO: 550991 - RNA, 64 nt, hsa; identical to SEQ ID NO: 247465

SEQ ID NO: 550992 - RNA, 64 nt, hsa; identical to SEQ ID NO: 247466

SEQ ID NO: 550993 - RNA, 64 nt, hsa; identical to SEQ ID NO: 247467

SEQ ID NO: 550994 - RNA, 64 nt, hsa; identical to SEQ ID NO: 247468

SEQ ID NO: 550995 - RNA, 64 nt, hsa; identical to SEQ ID NO: 247469

SEQ ID NO: 550996 - RNA, 64 nt, hsa; identical to SEQ ID NO: 247470

SEQ ID NO: 550997 - RNA, 64 nt, hsa; identical to SEQ ID NO: 247471

SEQ ID NO: 550998 - RNA, 64 nt, hsa; identical to SEQ ID NO: 247472

SEQ ID NO: 550999 - RNA, 64 nt, hsa; identical to SEQ ID NO: 247473

SEQ ID NO: 551000 - RNA, 64 nt, hsa; identical to SEQ ID NO: 247474

SEQ ID NO: 551001 - RNA, 64 nt, hsa; identical to SEQ ID NO: 247475

SEQ ID NO: 551002 - RNA, 64 nt, hsa; identical to SEQ ID NO: 247476

SEQ ID NO: 551003 - RNA, 64 nt, hsa; identical to SEQ ID NO: 247477

SEQ ID NO: 551004 - RNA, 64 nt, hsa; identical to SEQ ID NO: 247478

SEQ ID NO: 551005 - RNA, 64 nt, hsa; identical to SEQ ID NO: 247479

SEQ ID NO: 551006 - RNA, 64 nt, hsa; identical to SEQ ID NO: 247480

SEQ ID NO: 551007 - RNA, 64 nt, hsa
cuaaaccuuaacuguuccuuaaggauuuuagccaguauuuuaauagaacaugauuaaugaaagu

SEQ ID NO: 551008 - RNA, 64 nt, hsa
gaaagggaacaaaguguauaaaacugccacaauuguauuuuaauuuugagguaugauauuuuca

SEQ ID NO: 551009 - RNA, 64 nt, hsa
cauccuuuuuuuugauuauaaaauuuucuaaaauguauuuuagacuuccuguagggggcgauau

SEQ ID NO: 551010 - RNA, 64 nt, hsa
uaaauguauuccuguagggggcgauauacuaaauguauuuuagacuuccuguagggggcgauaa

SEQ ID NO: 551011 - RNA, 64 nt, hsa
auucaguggcucauuuauaccuaauaaaauaaugguauuuuaaaauaaugcuacuuucaaagua

SEQ ID NO: 551012 - RNA, 64 nt, hsa
augauaaaugaauuuaccaguuuaguaugcugugguauuuuaauaaguuuucaaagauaauugg

SEQ ID NO: 551013 - RNA, 64 nt, hsa
cagccauuauuuuauugucuagcuccaguuaucuguauuuuauguaauguaauugacaggaugg

SEQ ID NO: 551014 - RNA, 64 nt, hsa
caacacuuggcauuuuuauguuuuaagaaaaacaguauuuuauuuauaauaaaaucugaauauu

SEQ ID NO: 551015 - RNA, 64 nt, hsa
agcaugccugguuguauuaaagcagggauaugcuguauuuuauaaaauuggcaaaauuagagaa

SEQ ID NO: 551016 - RNA, 64 nt, hsa
acucuuaagauuauucuuucaccaacuauagaauguauuuuauauaucguucauuguaaaaagc

SEQ ID NO: 551017 - RNA, 64 nt, hsa
caaagggcgcugguugguagggugaggugggggaguauuuuaauuuuuggaauuugggaagcag

SEQ ID NO: 551018 - RNA, 64 nt, hsa
ucaaauuuuaugcuguguggaauacuaacuauauguauuuuaacuuaguuuuaauauuuucauu

SEQ ID NO: 551019 - RNA, 64 nt, hsa
agaaaugccagaauacaaauaugaaagcucugcuguauuuuaaauguuuauguuuuaagaauga

SEQ ID NO: 551020 - RNA, 64 nt, hsa
uuuaaauuauauaaaugcuagaaauaugguuaauguauuuuacuuugcauuuguguaguacuuu

SEQ ID NO: 551021 - RNA, 64 nt, hsa
auuugaagaaacaauuuaauuauuuaaaauucaaguauuuuauucacauuauuugcaauaucca

SEQ ID NO: 551022 - RNA, 64 nt, hsa
uguuuuaaaucaaugaccuaagaucaacaaugaaguauuuuauaaauguauuuaugcugcuaga

SEQ ID NO: 551023 - RNA, 64 nt, hsa
uggccagauaaauguguuauauuaaaccagguaaguauuuuaaacagagaacauuuuauuugca

SEQ ID NO: 551024 - RNA, 64 nt, hsa
gagcagacgacuucuguuuaacuuaaaauuagucguauuuuaauggcuugggauuuggugcaaa

SEQ ID NO: 551025 - RNA, 64 nt, hsa
gaaccacaugaaguuauagccucuaaagccugugguauuuuauauaauauuuuuauaacuuuaa

SEQ ID NO: 551026 - RNA, 64 nt, hsa
uaaaugaagcauuugaaugucauaucuuuuuaaaguauuuuauuguauacuguaucauagaagu

SEQ ID NO: 551027 - RNA, 64 nt, hsa
auaguguggaaauccccuaaauugauuagaaauuguauuuuaugaaaaauaacuuguauucauu

SEQ ID NO: 551028 - RNA, 64 nt, hsa
acaggugugagccacugugccuggccuccggugaguauuuuauauuuagucuacacuuccauac

SEQ ID NO: 551029 - RNA, 64 nt, hsa
uagagugccacuuauguuuucuuucuuguguacaguauuuuauuguauggauuuaccauccccu

SEQ ID NO: 551030 - RNA, 64 nt, hsa
cauuuucagauaaauguauucaacauguaauacaguauuuuaacauucaccucuuauuuuauau

SEQ ID NO: 551031 - RNA, 64 nt, hsa
uauuuuuugguacugaaucuucaaaauccagaguguauuuuacacuuaccgcacaucuccauuc

SEQ ID NO: 551032 - RNA, 64 nt, hsa
gaaggaaagcuguugcauaucaauuguaggucauguauuuuacuauauguugcauaguauuuug

SEQ ID NO: 551033 - RNA, 64 nt, hsa
agguuuuguucugaguuauuucuagagaaagaaaguauuuuaguauguguaaauuguacaauaa

SEQ ID NO: 551034 - RNA, 64 nt, hsa
uuuguauucacuugaaagcaaacuggcaugguucguauuuuaaaaaucuugcacaaauuguaau

SEQ ID NO: 551035 - RNA, 64 nt, hsa
uuuuaucaucaugauguuuuggaguuauuacuguguauuuuagaaaucauucuuuacaguuuug

SEQ ID NO: 551036 - RNA, 64 nt, hsa
caugaugauuuacuaaaucucuccaucugcauuaguauuuuaaggagcacugugagagaaauca

SEQ ID NO: 551037 - RNA, 64 nt, hsa
ggaugguuauuagggcccauuagaaacaggagaaguauuuuacccauucuuaaagcucuaaaaa

SEQ ID NO: 551038 - RNA, 64 nt, hsa
aaucucccacaaguauauacuuuuaaauuauggaguauuuuaagucuacaaaaagguauaaaua

SEQ ID NO: 551039 - RNA, 64 nt, hsa
gguuuaaaggauaugaaacucuacauuuaaacaaguauuuuauauuuggguacagaggaagaaa

SEQ ID NO: 551040 - RNA, 64 nt, hsa
uuuucuucaauacaacugugcuguaccuuguaaaguauuuuaucugcugcuuauuuguggaaug

SEQ ID NO: 551041 - RNA, 64 nt, hsa
uguuuugaguuuugucauuaaaacagccaccuuuguauuuuauaauuuaugacagaaugaaguc

SEQ ID NO: 551042 - RNA, 64 nt, hsa
cuaccguuggaacuagccagauggccauuauuuuguauuuuaaauacauaaauaggauugaauc

SEQ ID NO: 551043 - RNA, 64 nt, hsa
acuguggucuucuugacacauuaagauguauuuuguauuuuaagagucucaugcucuaccguug

SEQ ID NO: 551044 - RNA, 64 nt, hsa
gcaaauaauucuauaaacugaauuauuuuaaaagguauuuuaggugacaccacugcauuucuau

SEQ ID NO: 551045 - RNA, 64 nt, hsa
aggugcaugccaccacgcccagcuacuuuuuuguguauuuuaguagagaugggguuucaccaug

SEQ ID NO: 551046 - RNA, 64 nt, hsa
auuaguuuuuaaaugaguuuuguuaguuucaguuguauuuuauuuuuaguuuuauuaguugauu

SEQ ID NO: 551047 - RNA, 64 nt, hsa
uguagagagaguucguuccaaguuacuuucugagguauuuuauguaucgauuuauuaguuuuua

SEQ ID NO: 551048 - RNA, 64 nt, hsa
aaccugagguuuaccuagugacaccaaauuaucgguauuuuaacugaauuuacccauugacuaa

SEQ ID NO: 551049 - RNA, 64 nt, hsa
aacaguugucugcugucuguaauucaguuugcguguauuuuaugcucaugcaccaacccauaca

SEQ ID NO: 551050 - RNA, 64 nt, hsa
aauuuuaauaguuaaucaucucugagaguaaccuguauuuuaauuguugaaacuuaaccaaaau

SEQ ID NO: 551051 - RNA, 64 nt, hsa
gaaaguuauacauguauacuuauuaucuugcucaguauuuuaucucacuuguucuagaauuuuc

SEQ ID NO: 551052 - RNA, 64 nt, hsa
guuuucaauauucuuggggauuagacaggggaagguauuuuauuacugcauaauagauggugaa

SEQ ID NO: 551053 - RNA, 64 nt, hsa
cuugacaacuucacauugccucucuuccuugaauguauuuuaucuggucuuuucuauauagucu

SEQ ID NO: 551054 - RNA, 64 nt, hsa
guuauuuugcacaucacaaauuacacuauccuggguauuuuacaggugacauguuacuucguuc

SEQ ID NO: 551055 - RNA, 64 nt, hsa
uuauaaugugcuagcuaauugcuacucucaucuuguauuuuaacuccuaauuuacccuucaggu

SEQ ID NO: 551056 - RNA, 64 nt, hsa
gauuaaaauagcacagcucauguggcauagguggguauuuuagauguuugaguaaauuugaaag

SEQ ID NO: 551057 - RNA, 64 nt, hsa
uuuuuggcaaauuuaaaauuuguuuuuuuccauuguauuuuaaaaucuuauuccuacuauuuuu

SEQ ID NO: 551058 - RNA, 64 nt, hsa
uuguuucgcgucgcuuauuacuuucaguuuccuuguauuuuaaauauuuguauuuauuucauua

SEQ ID NO: 551059 - RNA, 64 nt, hsa
agaacuuauuuaagaauuauuucaguauuuaccuguauuuuauucuugaaguuggccaacagag

SEQ ID NO: 551060 - RNA, 64 nt, hsa
guuguacuagauguucuuaggaaauaucucagaaguauuuuauuugaagugaagaacuuauuua

SEQ ID NO: 551061 - RNA, 64 nt, hsa
uuaacguaugccaccucagagauaaaucuaagaaguauuuuacccacuggugguuugugugugu

SEQ ID NO: 551062 - RNA, 64 nt, hsa
uuuauaaagauucuuagcuaucaagggcugcauuguauuuuauauacucaguuuuauaagguga

SEQ ID NO: 551063 - RNA, 64 nt, hsa
accccugcuuuaacugaugcauugauuugauaaaguauuuuacaagccugauaauguuauaacc

SEQ ID NO: 551064 - RNA, 64 nt, hsa
gccaagccagaucuaggcaucuaggauaauuaagguauuuuaguaugcaauuuacugccauaau

SEQ ID NO: 551065 - RNA, 60 nt, hsa
uuguuucccuucauagaugauaacuugacuguauuuuagcacuguuaaagcacgaauugg

SEQ ID NO: 551066 - RNA, 64 nt, hsa
cccacuaaguugugugugaggaaauccucaucuuguauuuuaagaaucugcagauggcauccau

SEQ ID NO: 551067 - RNA, 64 nt, hsa
cccggugaauaaauguagauccugccauucauugguauuuuaaagaaccacuugaaaucggauc

SEQ ID NO: 551068 - RNA, 64 nt, hsa
cucuuuuucauacuaagcuuucgaaaucugguguguauuuuacacuuucugcacaucuccauuu

SEQ ID NO: 551069 - RNA, 64 nt, hsa
uaacacuucagaaagauucaaacucauaaacucaguauuuuaacucaaaauucauguaacaaga

SEQ ID NO: 551070 - RNA, 64 nt, hsa
guguguguguguguucauggguuuuaaaagaacaguauuuuacaaaagguguagcuuuuauaag

SEQ ID NO: 551071 - RNA, 64 nt, hsa
ucuauuauauuuuagacaaacauaucauuuucgaguauuuuaaauacugaauucauaguuguug

SEQ ID NO: 551072 - RNA, 64 nt, hsa
uccuauaagaucuugaacuugaauuuuauggguuguauuuuaauaauguaaguaaauuauuuau

SEQ ID NO: 551073 - RNA, 64 nt, hsa
ucaaggaauuccaaugaugaagauuuuaaggaaaguauuuuauauucaacagguauauucugcu

SEQ ID NO: 551074 - RNA, 64 nt, hsa
ggagacauuaacaugaaucucauuuauucucucaguauuuuaacugaagaaauuauacuguuug

SEQ ID NO: 551075 - RNA, 64 nt, hsa
uccugguaaaaauuacagggcucuauuuaaggauguauuuuaauguaaaugcuuauguuuuuua

SEQ ID NO: 551076 - RNA, 64 nt, hsa
acauuauccuuguaauguauuuuacaaggauaauguauuuuaaaaugggaguugcauaggagag

SEQ ID NO: 551077 - RNA, 64 nt, hsa
guuaaaguauuuuaaaauacauuauccuuguaauguauuuuacaaggauaauguauuuuaaaau

SEQ ID NO: 551078 - RNA, 64 nt, hsa
cuaacauacaaaucuaggaauauuaugcguuaaaguauuuuaaaauacauuauccuuguaaugu

SEQ ID NO: 551079 - RNA, 64 nt, hsa
aacacugauuguaaugugagaaaaguguauuuuuguauuuuaauaaauauuguugaauuuuuaa

SEQ ID NO: 551080 - RNA, 64 nt, hsa
cuucagaggcuaaggggaagauagaccuguacauguauuuuaagcaggaaaaccaccaaaauuc

SEQ ID NO: 551081 - RNA, 64 nt, hsa
cugacaagccucagcaaacccaaagauguuaacaguauuuuaagaaguugcugcagauuccuuu

SEQ ID NO: 551082 - RNA, 64 nt, hsa
aaugaguauauguaacaguuuaaaaaaaaaguugguauuuuauaagcacagacaauucuaaugg

SEQ ID NO: 551083 - RNA, 64 nt, hsa
ugauuaaguucacaguuuauuguuugucuguuuaguauuuuagaaauauaccagcacuacuaau

SEQ ID NO: 551084 - RNA, 64 nt, hsa
ccuuuuauguauaaaacugccaaaugcuuaccugguauuuuauuagaugcagaaacagauugga

SEQ ID NO: 551085 - RNA, 64 nt, hsa
guauugauggcaguccacucuguuuucuaaaaauguauuuuacuguggugcuuaacuucuuauu

SEQ ID NO: 551086 - RNA, 64 nt, hsa
aucuauugaaaauggauauagauacagguuuuaaguauuuuaaguauauauuacuuauuuuaau

SEQ ID NO: 551087 - RNA, 64 nt, hsa
uaauaaauuaauuuaaaaagccccccaaucugugguauuuuauuauggcagcccuagcaagcua

SEQ ID NO: 551088 - RNA, 64 nt, hsa
uucuuagauucauaauguuaggagcauuuaaucuguauuuuacaaguuaggaagcagaggauca

SEQ ID NO: 551089 - RNA, 64 nt, hsa
augugggaaacagaucuaaaucucauuuuaugcuguauuuuauaucuuaguuguguuugaaaac

SEQ ID NO: 551090 - RNA, 64 nt, hsa
accaguggcuuugauguuguuucugccccgcauuguauuuuauaggaauagugaaaacauuuag

SEQ ID NO: 551091 - RNA, 64 nt, hsa
gcugaggugauucaguucccuccuucuuacagaaguauuuuaauucaccccacacuagaaaugc

SEQ ID NO: 551092 - RNA, 64 nt, hsa
ugcagcucuguaguuucuugaggccaaacacacuguauuuuacaagucaaaauauaauuuacau

SEQ ID NO: 551093 - RNA, 64 nt, hsa
ucuacuagacuuucuuacagauuuaauuucuuuuguauuuuaagaacuuuauaaugacugaagg

SEQ ID NO: 551094 - RNA, 64 nt, hsa
aaagaugugcugccuucauaagauuuggguugauguauuuuacuauuaguucuacaagaaguag

SEQ ID NO: 551095 - RNA, 64 nt, hsa
guagaauacagcuccuuaucguucuauguaccagguauuuuauuacugaacuagcaacuagccu

SEQ ID NO: 551096 - RNA, 64 nt, hsa
gacuuaaaauuucuaguggcuuuuauuuuucuuuguauuuuaauuuuccuacaaaguccuuuuu

SEQ ID NO: 551097 - RNA, 64 nt, hsa
cuaguguuaaauuggaaaauaucaauaauuaagaguauuuuacccaaggaauccucucauggaa

SEQ ID NO: 551098 - RNA, 64 nt, hsa
uauaacugagacuagacggaaaaggaauacucguguauuuuaagauaugaaugugacucaagac

SEQ ID NO: 551099 - RNA, 64 nt, hsa
auauauuauauuuaaaguguugcauuuaagaugaguauuuuaccagaguguuuccauucauauc

SEQ ID NO: 551100 - RNA, 64 nt, hsa
gauaauagguaauaagguuaaauuuuuuuaugacguauuuuauuuacaaauaucauacacugcu

SEQ ID NO: 551101 - RNA, 64 nt, hsa
gacuucaaaacauaugugacuguggauaaucuugguauuuuauauauuuuacagacuuuagaau

SEQ ID NO: 551102 - RNA, 64 nt, hsa
gacauaauuaaugagaagaauuuggaagaaauugguauuuuaauacugucuguauuuauuacug

SEQ ID NO: 551103 - RNA, 64 nt, hsa
ucggggagaggguaagggaauagaucacucagauguauuuuagauaagcuauuuagccuuugau

SEQ ID NO: 551104 - RNA, 64 nt, hsa
uucucguaauucuggaguuucuucagauugugguguauuuuauugugcuccuauguaagaugaa

SEQ ID NO: 551105 - RNA, 64 nt, hsa
acuguguuuauuucauuuucccaauuugacaaucguauuuuaaaauugaaacugauggaacauu

SEQ ID NO: 551106 - RNA, 64 nt, hsa
auggcaaugaaaauuuuaagaagaaagauuuaaaguauuuuaauuuuaaagaguguguuauaaa

SEQ ID NO: 551107 - RNA, 64 nt, hsa
cuuuauaaagcuguucuugaaagccaaguguuuuguauuuuauagugaguugcauguuuuugaa

SEQ ID NO: 551108 - RNA, 64 nt, hsa
gguuacuacuuaaugcuuaccuaauuucauuuuaguauuuuaggugcuguuauguuuuuucaug

SEQ ID NO: 551109 - RNA, 64 nt, hsa
aaugacauacuuggagagcaaauuauggaaauguguauuuuauaugauuuuugagguccugucu

SEQ ID NO: 551110 - RNA, 64 nt, hsa
gaacccagaaauagccacuauuaacauuuccuacguauuuuauuuuacauagaucauauuguau

SEQ ID NO: 551111 - RNA, 64 nt, hsa
auuauauaauguuucccuuuuugauuauugcauuguauuuuaauuugugcagaaugauaaagaa

SEQ ID NO: 551112 - RNA, 64 nt, hsa
uuuucaccuuaaaaguuaaaugaaaugcaugaugguauuuuauuccuugaauuaugcaaugcaa

SEQ ID NO: 551113 - RNA, 64 nt, hsa
guagcagggggaaguauuuaauugcccaugauauguauuuuacuuauacuaugccagagaggaa

SEQ ID NO: 551114 - RNA, 64 nt, hsa
guucaacacacacaugcaauuuugcuuaacaaaaguauuuuauaauacaguuucauacagaauu

SEQ ID NO: 551115 - RNA, 64 nt, hsa
uuauuuucuguccuaugacaguucuaugcuaaauguauuuuaaaauaaaagccaaauugaagau

SEQ ID NO: 551116 - RNA, 64 nt, hsa
uuaagguaaauuauaaaaccuaaaauuaguaucaguauuuuagauccuauuauuuuuucaacuu

SEQ ID NO: 551117 - RNA, 64 nt, hsa
aagaauagccuauugucuuucauuuugccugaguguauuuuacuauuugggcucugaaauaaaa

SEQ ID NO: 551118 - RNA, 64 nt, hsa
aaaagagugagaacuaggugugcaagaaccaaacguauuuuauuuuauuuuuuaaaugggagca

SEQ ID NO: 551119 - RNA, 64 nt, hsa
ucacagaauuaaaugagcuuaaauagaaaauucaguauuuuaugauaaucacuucguuuuuagu

SEQ ID NO: 551120 - RNA, 64 nt, hsa
uagauaguucuuucuauauuauguuuucgcuuuuguauuuuaagcuuuacuuagauauucaaaa

SEQ ID NO: 551121 - RNA, 64 nt, hsa
uuaaugacuuuuguaugugugcucucuuuauaauguauuuuauaucacuuuaauuuguauaaau

SEQ ID NO: 551122 - RNA, 64 nt, hsa
cauuccugaugacgucuggucuuuucuuuucauuguauuuuaagcuuaccugugaauagcccaa

SEQ ID NO: 551123 - RNA, 64 nt, hsa
aaaauuauauuucauauugcaaagauguuuacaaguauuuuaauuuaaguucagugaacuuuuu

SEQ ID NO: 551124 - RNA, 64 nt, hsa
guuuuaaagagaaauugcauuaauacagauugaaguauuuuauucuuuuuugacuugaaaaauu

SEQ ID NO: 551125 - RNA, 64 nt, hsa
auuaaaaucauguuuaagauagcugcuuuuauguguauuuuauauugcaugcuuuuguaaaaac

SEQ ID NO: 551126 - RNA, 64 nt, hsa
uaaauguuacuacauuucugaauuuuugaaaaauguauuuuaucauuaaauggcauuauuuuaa

SEQ ID NO: 551127 - RNA, 64 nt, hsa
ucuaaaggcuucaguccacauuuuuuuauacguuguauuuuaaaaacguuugaaaggagucuua

SEQ ID NO: 551128 - RNA, 64 nt, hsa
ugucauuuuacuguauagcugacuguguacucagguauuuuauugguccuugaaagauuggucg

SEQ ID NO: 551129 - RNA, 64 nt, hsa
aucuauucugcauucccaagaguuuauguuuauuguauuuuauaugaucuacaacauauaaaau

SEQ ID NO: 551130 - RNA, 64 nt, hsa
guauuuuucuuugguugucccuauuaacaaaaaaguauuuuaauaaaaaauugaaaugagugag

SEQ ID NO: 551131 - RNA, 64 nt, hsa
guguuugaugcuuuuuaacgagaugauguuuuuuguauuuuaucuacuguggccugauuuuuuu

SEQ ID NO: 551132 - RNA, 64 nt, hsa
aaaaagcuaaucuauaaauaccguuuuuccaaagguauuuuacaauauuucaacagcagaccuu

SEQ ID NO: 551133 - RNA, 64 nt, hsa
cguauuuuacaguacacuaauaugcauauauguuguauuuuauuaaaauauuaaaauguuuuuu

SEQ ID NO: 551134 - RNA, 64 nt, hsa
uaaggauaguuaaaacuuauuuugcaauuaauacguauuuuacaguacacuaauaugcauauau

SEQ ID NO: 551135 - RNA, 64 nt, hsa
uacaggcacccaccaccaugcccagcuaauuuuuguauuuuaguagagacaggguuucauaaug

SEQ ID NO: 551136 - RNA, 64 nt, hsa
uacaguagaaauauguaaggcacugaugcuucagguauuuuacuaaaucagagugcugaguaua

SEQ ID NO: 551137 - RNA, 64 nt, hsa
ucucuuguagguuuauuuaugugugugugaauguguauuuuaauuauguguauuuaacucuuua

SEQ ID NO: 551138 - RNA, 64 nt, hsa
uguuccaaaaacucugaaucaucuacauuuuaagguauuuuaccucaaaaaugaaucauugugu

SEQ ID NO: 551139 - RNA, 64 nt, hsa
uuauuuucagaaaauaaaauaauaaaagcccaggguauuuuaaaugcuucuaauauaagaugug

SEQ ID NO: 551140 - RNA, 64 nt, hsa
uaaagguacuacaaauuaaaaauuaaaguauaaaguauuuuaaguuagaaauagacuuagcugg

SEQ ID NO: 551141 - RNA, 64 nt, hsa
uuuaaagguguacccauauauaucucuuucuggaguauuuuaucugucugauguugcaguauuc

SEQ ID NO: 551142 - RNA, 64 nt, hsa
gauacgucuguccaaacuuuuaaaaggcauaacuguauuuuauguguuuauucuuuauauagau

SEQ ID NO: 551143 - RNA, 64 nt, hsa
acuguauuuuauguguuuauucuuuauauagauaguauuuuauauuuuauucucacccgaagua

SEQ ID NO: 551144 - RNA, 64 nt, hsa
auaagcagaacuuuuacaauuuuuucaucuaaaaguauuuuaagauauuuuuaaaauccaagag

SEQ ID NO: 551145 - RNA, 64 nt, hsa
ugaguguucaugcuuuaaaaugauuuuuaaauuuguauuuuauauuguuuuaucuaucugucuu

SEQ ID NO: 551146 - RNA, 64 nt, hsa
agauuuccuccaacccagcuuuucugugcucuugguauuuuacuacuugauguggaccucagag

SEQ ID NO: 551147 - RNA, 63 nt, hsa
caaggcaaaguguugucugauucuauuuucuggguauuuuaggaagaguugggaguugccaag

SEQ ID NO: 551148 - RNA, 64 nt, hsa
uuuuauagaaaaccugacuucagugaauauuuuuguauuuuacaugggccaguuuauauacugc

SEQ ID NO: 551149 - RNA, 64 nt, hsa
cuuuagccuuccaacauuucuuguugauagugauguauuuuauuauuuucuuuuucuuaagaaa

SEQ ID NO: 551150 - RNA, 64 nt, hsa
auagugauagcccauaaauaauugcuggaaaauuguauuuuauaacaguagaaaacauauaguc

SEQ ID NO: 551151 - RNA, 64 nt, hsa
acuuuuuguucauuuucaaaccuaaugauuauauguauuuuauauguguguguauguguacaca

SEQ ID NO: 551152 - RNA, 64 nt, hsa
cucuauuucugggcugaugaauuaauauucauuuguauuuuaacccugcagaauuuuccuuagu

SEQ ID NO: 551153 - RNA, 64 nt, hsa; identical to SEQ ID NO: 510984

SEQ ID NO: 551154 - RNA, 64 nt, hsa; identical to SEQ ID NO: 510985

SEQ ID NO: 551155 - RNA, 64 nt, hsa; identical to SEQ ID NO: 510986

SEQ ID NO: 551156 - RNA, 53 nt, hsa; identical to SEQ ID NO: 510987

SEQ ID NO: 551157 - RNA, 64 nt, hsa; identical to SEQ ID NO: 510988

SEQ ID NO: 551158 - RNA, 64 nt, hsa; identical to SEQ ID NO: 510989

SEQ ID NO: 551159 - RNA, 64 nt, hsa; identical to SEQ ID NO: 510990

SEQ ID NO: 551160 - RNA, 64 nt, hsa; identical to SEQ ID NO: 510991

SEQ ID NO: 551161 - RNA, 64 nt, hsa; identical to SEQ ID NO: 510992

SEQ ID NO: 551162 - RNA, 64 nt, hsa; identical to SEQ ID NO: 510993

SEQ ID NO: 551163 - RNA, 64 nt, hsa; identical to SEQ ID NO: 510994

SEQ ID NO: 551164 - RNA, 64 nt, hsa; identical to SEQ ID NO: 510995

SEQ ID NO: 551165 - RNA, 64 nt, hsa; identical to SEQ ID NO: 510996

SEQ ID NO: 551166 - RNA, 64 nt, hsa; identical to SEQ ID NO: 510997

SEQ ID NO: 551167 - RNA, 64 nt, hsa; identical to SEQ ID NO: 510998

SEQ ID NO: 551168 - RNA, 64 nt, hsa; identical to SEQ ID NO: 510999

SEQ ID NO: 551169 - RNA, 64 nt, hsa; identical to SEQ ID NO: 511000

SEQ ID NO: 551170 - RNA, 64 nt, hsa; identical to SEQ ID NO: 511001

SEQ ID NO: 551171 - RNA, 64 nt, hsa; identical to SEQ ID NO: 511002

SEQ ID NO: 551172 - RNA, 64 nt, hsa; identical to SEQ ID NO: 511003

SEQ ID NO: 551173 - RNA, 64 nt, hsa; identical to SEQ ID NO: 511004

SEQ ID NO: 551174 - RNA, 64 nt, hsa; identical to SEQ ID NO: 511005

SEQ ID NO: 551175 - RNA, 64 nt, hsa; identical to SEQ ID NO: 511006

SEQ ID NO: 551176 - RNA, 64 nt, hsa; identical to SEQ ID NO: 511007

SEQ ID NO: 551177 - RNA, 64 nt, hsa; identical to SEQ ID NO: 277176

SEQ ID NO: 551178 - RNA, 64 nt, hsa; identical to SEQ ID NO: 277177

SEQ ID NO: 551179 - RNA, 64 nt, hsa; identical to SEQ ID NO: 277178

SEQ ID NO: 551180 - RNA, 64 nt, hsa; identical to SEQ ID NO: 277179

SEQ ID NO: 551181 - RNA, 64 nt, hsa; identical to SEQ ID NO: 277180

SEQ ID NO: 551182 - RNA, 64 nt, hsa; identical to SEQ ID NO: 277181

SEQ ID NO: 551183 - RNA, 64 nt, hsa; identical to SEQ ID NO: 277182

SEQ ID NO: 551184 - RNA, 64 nt, hsa; identical to SEQ ID NO: 277183

SEQ ID NO: 551185 - RNA, 64 nt, hsa; identical to SEQ ID NO: 277184

SEQ ID NO: 551186 - RNA, 64 nt, hsa; identical to SEQ ID NO: 277185

SEQ ID NO: 551187 - RNA, 52 nt, hsa; identical to SEQ ID NO: 277186

SEQ ID NO: 551188 - RNA, 64 nt, hsa; identical to SEQ ID NO: 277187

SEQ ID NO: 551189 - RNA, 64 nt, hsa; identical to SEQ ID NO: 277188

SEQ ID NO: 551190 - RNA, 64 nt, hsa; identical to SEQ ID NO: 277189

SEQ ID NO: 551191 - RNA, 64 nt, hsa; identical to SEQ ID NO: 277190

SEQ ID NO: 551192 - RNA, 64 nt, hsa; identical to SEQ ID NO: 277191

SEQ ID NO: 551193 - RNA, 64 nt, hsa; identical to SEQ ID NO: 277192

SEQ ID NO: 551194 - RNA, 64 nt, hsa; identical to SEQ ID NO: 277193

SEQ ID NO: 551195 - RNA, 64 nt, hsa; identical to SEQ ID NO: 277194

SEQ ID NO: 551196 - RNA, 64 nt, hsa; identical to SEQ ID NO: 277195

SEQ ID NO: 551197 - RNA, 64 nt, hsa; identical to SEQ ID NO: 277196

SEQ ID NO: 551198 - RNA, 64 nt, hsa; identical to SEQ ID NO: 277197

SEQ ID NO: 551199 - RNA, 64 nt, hsa; identical to SEQ ID NO: 277198

SEQ ID NO: 551200 - RNA, 64 nt, hsa; identical to SEQ ID NO: 277199

SEQ ID NO: 551201 - RNA, 64 nt, hsa; identical to SEQ ID NO: 48511

SEQ ID NO: 551202 - RNA, 64 nt, hsa; identical to SEQ ID NO: 48512

SEQ ID NO: 551203 - RNA, 64 nt, hsa; identical to SEQ ID NO: 48513

SEQ ID NO: 551204 - RNA, 64 nt, hsa; identical to SEQ ID NO: 48514

SEQ ID NO: 551205 - RNA, 64 nt, hsa; identical to SEQ ID NO: 48515

SEQ ID NO: 551206 - RNA, 64 nt, hsa; identical to SEQ ID NO: 48516

SEQ ID NO: 551207 - RNA, 64 nt, hsa; identical to SEQ ID NO: 48517

SEQ ID NO: 551208 - RNA, 64 nt, hsa; identical to SEQ ID NO: 48518

SEQ ID NO: 551209 - RNA, 64 nt, hsa; identical to SEQ ID NO: 48519

SEQ ID NO: 551210 - RNA, 64 nt, hsa; identical to SEQ ID NO: 48520

SEQ ID NO: 551211 - RNA, 64 nt, hsa; identical to SEQ ID NO: 48521

SEQ ID NO: 551212 - RNA, 64 nt, hsa; identical to SEQ ID NO: 48522

SEQ ID NO: 551213 - RNA, 64 nt, hsa; identical to SEQ ID NO: 48523

SEQ ID NO: 551214 - RNA, 64 nt, hsa; identical to SEQ ID NO: 48524

SEQ ID NO: 551215 - RNA, 64 nt, hsa; identical to SEQ ID NO: 48525

SEQ ID NO: 551216 - RNA, 64 nt, hsa; identical to SEQ ID NO: 48526

SEQ ID NO: 551217 - RNA, 64 nt, hsa; identical to SEQ ID NO: 48527

SEQ ID NO: 551218 - RNA, 64 nt, hsa; identical to SEQ ID NO: 48528

SEQ ID NO: 551219 - RNA, 63 nt, hsa; identical to SEQ ID NO: 68055

SEQ ID NO: 551220 - RNA, 64 nt, hsa; identical to SEQ ID NO: 68056

SEQ ID NO: 551221 - RNA, 64 nt, hsa; identical to SEQ ID NO: 68057

SEQ ID NO: 551222 - RNA, 64 nt, hsa; identical to SEQ ID NO: 68058

SEQ ID NO: 551223 - RNA, 64 nt, hsa; identical to SEQ ID NO: 68059

SEQ ID NO: 551224 - RNA, 64 nt, hsa; identical to SEQ ID NO: 68060

SEQ ID NO: 551225 - RNA, 64 nt, hsa; identical to SEQ ID NO: 68061

SEQ ID NO: 551226 - RNA, 64 nt, hsa; identical to SEQ ID NO: 68062

SEQ ID NO: 551227 - RNA, 64 nt, hsa; identical to SEQ ID NO: 68063

SEQ ID NO: 551228 - RNA, 64 nt, hsa; identical to SEQ ID NO: 68064

SEQ ID NO: 551229 - RNA, 64 nt, hsa; identical to SEQ ID NO: 68065

SEQ ID NO: 551230 - RNA, 64 nt, hsa; identical to SEQ ID NO: 68066

SEQ ID NO: 551231 - RNA, 64 nt, hsa; identical to SEQ ID NO: 68067

SEQ ID NO: 551232 - RNA, 64 nt, hsa; identical to SEQ ID NO: 68068

SEQ ID NO: 551233 - RNA, 64 nt, hsa; identical to SEQ ID NO: 68069

SEQ ID NO: 551234 - RNA, 64 nt, hsa; identical to SEQ ID NO: 68070

SEQ ID NO: 551235 - RNA, 64 nt, hsa; identical to SEQ ID NO: 68071

SEQ ID NO: 551236 - RNA, 64 nt, hsa; identical to SEQ ID NO: 68072

SEQ ID NO: 551237 - RNA, 64 nt, hsa; identical to SEQ ID NO: 68073

SEQ ID NO: 551238 - RNA, 64 nt, hsa; identical to SEQ ID NO: 68074

SEQ ID NO: 551239 - RNA, 64 nt, hsa; identical to SEQ ID NO: 68075

SEQ ID NO: 551240 - RNA, 64 nt, hsa; identical to SEQ ID NO: 68076

SEQ ID NO: 551241 - RNA, 64 nt, hsa; identical to SEQ ID NO: 68077

SEQ ID NO: 551242 - RNA, 64 nt, hsa; identical to SEQ ID NO: 68078

SEQ ID NO: 551243 - RNA, 64 nt, hsa; identical to SEQ ID NO: 68079

SEQ ID NO: 551244 - RNA, 64 nt, hsa; identical to SEQ ID NO: 68080

SEQ ID NO: 551245 - RNA, 64 nt, hsa; identical to SEQ ID NO: 68081

SEQ ID NO: 551246 - RNA, 64 nt, hsa; identical to SEQ ID NO: 68082

SEQ ID NO: 551247 - RNA, 64 nt, hsa; identical to SEQ ID NO: 68083

SEQ ID NO: 551248 - RNA, 64 nt, hsa; identical to SEQ ID NO: 68084

SEQ ID NO: 551249 - RNA, 64 nt, hsa; identical to SEQ ID NO: 68085

SEQ ID NO: 551250 - RNA, 64 nt, hsa; identical to SEQ ID NO: 68086

SEQ ID NO: 551251 - RNA, 64 nt, hsa; identical to SEQ ID NO: 68087

SEQ ID NO: 551252 - RNA, 64 nt, hsa; identical to SEQ ID NO: 68088

SEQ ID NO: 551253 - RNA, 64 nt, hsa; identical to SEQ ID NO: 68089

SEQ ID NO: 551254 - RNA, 64 nt, hsa; identical to SEQ ID NO: 68090

SEQ ID NO: 551255 - RNA, 64 nt, hsa; identical to SEQ ID NO: 68091

SEQ ID NO: 551256 - RNA, 64 nt, hsa; identical to SEQ ID NO: 68092

SEQ ID NO: 551257 - RNA, 64 nt, hsa; identical to SEQ ID NO: 68093

SEQ ID NO: 551258 - RNA, 64 nt, hsa; identical to SEQ ID NO: 68094

SEQ ID NO: 551259 - RNA, 64 nt, hsa; identical to SEQ ID NO: 68095

SEQ ID NO: 551260 - RNA, 64 nt, hsa; identical to SEQ ID NO: 68096

SEQ ID NO: 551261 - RNA, 64 nt, hsa; identical to SEQ ID NO: 68097

SEQ ID NO: 551262 - RNA, 64 nt, hsa; identical to SEQ ID NO: 68098

SEQ ID NO: 551263 - RNA, 64 nt, hsa; identical to SEQ ID NO: 68099

SEQ ID NO: 551264 - RNA, 64 nt, hsa; identical to SEQ ID NO: 68100

SEQ ID NO: 551265 - RNA, 64 nt, hsa; identical to SEQ ID NO: 68101

SEQ ID NO: 551266 - RNA, 64 nt, hsa; identical to SEQ ID NO: 68102

SEQ ID NO: 551267 - RNA, 64 nt, hsa; identical to SEQ ID NO: 68103

SEQ ID NO: 551268 - RNA, 64 nt, hsa; identical to SEQ ID NO: 68104

SEQ ID NO: 551269 - RNA, 64 nt, hsa; identical to SEQ ID NO: 68105

SEQ ID NO: 551270 - RNA, 64 nt, hsa; identical to SEQ ID NO: 68106

SEQ ID NO: 551271 - RNA, 64 nt, hsa; identical to SEQ ID NO: 68107

SEQ ID NO: 551272 - RNA, 64 nt, hsa; identical to SEQ ID NO: 68108

SEQ ID NO: 551273 - RNA, 64 nt, hsa; identical to SEQ ID NO: 68109

SEQ ID NO: 551274 - RNA, 64 nt, hsa; identical to SEQ ID NO: 68110

SEQ ID NO: 551275 - RNA, 64 nt, hsa; identical to SEQ ID NO: 68111

SEQ ID NO: 551276 - RNA, 64 nt, hsa; identical to SEQ ID NO: 68112

SEQ ID NO: 551277 - RNA, 64 nt, hsa; identical to SEQ ID NO: 68113

SEQ ID NO: 551278 - RNA, 64 nt, hsa; identical to SEQ ID NO: 68114

SEQ ID NO: 551279 - RNA, 64 nt, hsa; identical to SEQ ID NO: 68115

SEQ ID NO: 551280 - RNA, 64 nt, hsa; identical to SEQ ID NO: 68116

SEQ ID NO: 551281 - RNA, 64 nt, hsa; identical to SEQ ID NO: 68117

SEQ ID NO: 551282 - RNA, 64 nt, hsa; identical to SEQ ID NO: 68118

SEQ ID NO: 551283 - RNA, 64 nt, hsa; identical to SEQ ID NO: 68119

SEQ ID NO: 551284 - RNA, 64 nt, hsa; identical to SEQ ID NO: 68120

SEQ ID NO: 551285 - RNA, 64 nt, hsa; identical to SEQ ID NO: 68121

SEQ ID NO: 551286 - RNA, 64 nt, hsa; identical to SEQ ID NO: 68122

SEQ ID NO: 551287 - RNA, 64 nt, hsa; identical to SEQ ID NO: 68123

SEQ ID NO: 551288 - RNA, 64 nt, hsa; identical to SEQ ID NO: 68124

SEQ ID NO: 551289 - RNA, 64 nt, hsa; identical to SEQ ID NO: 68125

SEQ ID NO: 551290 - RNA, 64 nt, hsa; identical to SEQ ID NO: 68126

SEQ ID NO: 551291 - RNA, 64 nt, hsa; identical to SEQ ID NO: 68127

SEQ ID NO: 551292 - RNA, 64 nt, hsa; identical to SEQ ID NO: 68128

SEQ ID NO: 551293 - RNA, 64 nt, hsa; identical to SEQ ID NO: 68129

SEQ ID NO: 551294 - RNA, 64 nt, hsa; identical to SEQ ID NO: 68130

SEQ ID NO: 551295 - RNA, 64 nt, hsa; identical to SEQ ID NO: 68131

SEQ ID NO: 551296 - RNA, 64 nt, hsa; identical to SEQ ID NO: 68132

SEQ ID NO: 551297 - RNA, 64 nt, hsa; identical to SEQ ID NO: 68133

SEQ ID NO: 551298 - RNA, 64 nt, hsa; identical to SEQ ID NO: 68134

SEQ ID NO: 551299 - RNA, 64 nt, hsa; identical to SEQ ID NO: 68135

SEQ ID NO: 551300 - RNA, 64 nt, hsa; identical to SEQ ID NO: 68136

SEQ ID NO: 551301 - RNA, 64 nt, hsa; identical to SEQ ID NO: 68137

SEQ ID NO: 551302 - RNA, 64 nt, hsa; identical to SEQ ID NO: 68138

SEQ ID NO: 551303 - RNA, 64 nt, hsa; identical to SEQ ID NO: 68139

SEQ ID NO: 551304 - RNA, 64 nt, hsa; identical to SEQ ID NO: 68140

SEQ ID NO: 551305 - RNA, 64 nt, hsa; identical to SEQ ID NO: 68141

SEQ ID NO: 551306 - RNA, 64 nt, hsa; identical to SEQ ID NO: 68142

SEQ ID NO: 551307 - RNA, 64 nt, hsa; identical to SEQ ID NO: 68143

SEQ ID NO: 551308 - RNA, 64 nt, hsa; identical to SEQ ID NO: 68144

SEQ ID NO: 551309 - RNA, 64 nt, hsa; identical to SEQ ID NO: 68145

SEQ ID NO: 551310 - RNA, 64 nt, hsa; identical to SEQ ID NO: 68146

SEQ ID NO: 551311 - RNA, 64 nt, hsa; identical to SEQ ID NO: 68147

SEQ ID NO: 551312 - RNA, 64 nt, hsa; identical to SEQ ID NO: 68148

SEQ ID NO: 551313 - RNA, 64 nt, hsa; identical to SEQ ID NO: 68149

SEQ ID NO: 551314 - RNA, 64 nt, hsa; identical to SEQ ID NO: 68150

SEQ ID NO: 551315 - RNA, 62 nt, hsa; identical to SEQ ID NO: 68151

SEQ ID NO: 551316 - RNA, 64 nt, hsa; identical to SEQ ID NO: 68152

SEQ ID NO: 551317 - RNA, 64 nt, hsa; identical to SEQ ID NO: 68153

SEQ ID NO: 551318 - RNA, 64 nt, hsa; identical to SEQ ID NO: 68154

SEQ ID NO: 551319 - RNA, 64 nt, hsa; identical to SEQ ID NO: 68155

SEQ ID NO: 551320 - RNA, 64 nt, hsa; identical to SEQ ID NO: 68156

SEQ ID NO: 551321 - RNA, 64 nt, hsa; identical to SEQ ID NO: 68157

SEQ ID NO: 551322 - RNA, 64 nt, hsa; identical to SEQ ID NO: 68158

SEQ ID NO: 551323 - RNA, 64 nt, hsa; identical to SEQ ID NO: 68159

SEQ ID NO: 551324 - RNA, 64 nt, hsa; identical to SEQ ID NO: 68160

SEQ ID NO: 551325 - RNA, 64 nt, hsa; identical to SEQ ID NO: 68161

SEQ ID NO: 551326 - RNA, 64 nt, hsa; identical to SEQ ID NO: 68162

SEQ ID NO: 551327 - RNA, 64 nt, hsa; identical to SEQ ID NO: 68163

SEQ ID NO: 551328 - RNA, 64 nt, hsa; identical to SEQ ID NO: 68164

SEQ ID NO: 551329 - RNA, 64 nt, hsa; identical to SEQ ID NO: 68165

SEQ ID NO: 551330 - RNA, 64 nt, hsa; identical to SEQ ID NO: 68166

SEQ ID NO: 551331 - RNA, 64 nt, hsa; identical to SEQ ID NO: 68167

SEQ ID NO: 551332 - RNA, 64 nt, hsa; identical to SEQ ID NO: 68168

SEQ ID NO: 551333 - RNA, 64 nt, hsa; identical to SEQ ID NO: 68169

SEQ ID NO: 551334 - RNA, 64 nt, hsa; identical to SEQ ID NO: 68170

SEQ ID NO: 551335 - RNA, 64 nt, hsa; identical to SEQ ID NO: 68171

SEQ ID NO: 551336 - RNA, 64 nt, hsa; identical to SEQ ID NO: 68172

SEQ ID NO: 551337 - RNA, 64 nt, hsa; identical to SEQ ID NO: 68173

SEQ ID NO: 551338 - RNA, 64 nt, hsa; identical to SEQ ID NO: 68174

SEQ ID NO: 551339 - RNA, 64 nt, hsa; identical to SEQ ID NO: 68175

SEQ ID NO: 551340 - RNA, 64 nt, hsa; identical to SEQ ID NO: 68176

SEQ ID NO: 551341 - RNA, 64 nt, hsa; identical to SEQ ID NO: 68177

SEQ ID NO: 551342 - RNA, 64 nt, hsa; identical to SEQ ID NO: 68178

SEQ ID NO: 551343 - RNA, 64 nt, hsa; identical to SEQ ID NO: 68179

SEQ ID NO: 551344 - RNA, 64 nt, hsa; identical to SEQ ID NO: 68180

SEQ ID NO: 551345 - RNA, 64 nt, hsa; identical to SEQ ID NO: 68181

SEQ ID NO: 551346 - RNA, 64 nt, hsa; identical to SEQ ID NO: 68182

SEQ ID NO: 551347 - RNA, 64 nt, hsa; identical to SEQ ID NO: 68183

SEQ ID NO: 551348 - RNA, 64 nt, hsa; identical to SEQ ID NO: 68184

SEQ ID NO: 551349 - RNA, 64 nt, hsa; identical to SEQ ID NO: 68185

SEQ ID NO: 551350 - RNA, 64 nt, hsa; identical to SEQ ID NO: 68186

SEQ ID NO: 551351 - RNA, 64 nt, hsa; identical to SEQ ID NO: 68187

SEQ ID NO: 551352 - RNA, 64 nt, hsa; identical to SEQ ID NO: 68188

SEQ ID NO: 551353 - RNA, 64 nt, hsa; identical to SEQ ID NO: 68189

SEQ ID NO: 551354 - RNA, 64 nt, hsa; identical to SEQ ID NO: 68190

SEQ ID NO: 551355 - RNA, 64 nt, hsa; identical to SEQ ID NO: 68191

SEQ ID NO: 551356 - RNA, 64 nt, hsa; identical to SEQ ID NO: 68192

SEQ ID NO: 551357 - RNA, 64 nt, hsa; identical to SEQ ID NO: 68193

SEQ ID NO: 551358 - RNA, 64 nt, hsa; identical to SEQ ID NO: 68194

SEQ ID NO: 551359 - RNA, 64 nt, hsa; identical to SEQ ID NO: 68195

SEQ ID NO: 551360 - RNA, 64 nt, hsa; identical to SEQ ID NO: 68196

SEQ ID NO: 551361 - RNA, 64 nt, hsa; identical to SEQ ID NO: 68197

SEQ ID NO: 551362 - RNA, 64 nt, hsa; identical to SEQ ID NO: 68198

SEQ ID NO: 551363 - RNA, 64 nt, hsa; identical to SEQ ID NO: 68199

SEQ ID NO: 551364 - RNA, 64 nt, hsa; identical to SEQ ID NO: 68200

SEQ ID NO: 551365 - RNA, 64 nt, hsa; identical to SEQ ID NO: 68201

SEQ ID NO: 551366 - RNA, 64 nt, hsa; identical to SEQ ID NO: 68202

SEQ ID NO: 551367 - RNA, 64 nt, hsa; identical to SEQ ID NO: 68203

SEQ ID NO: 551368 - RNA, 64 nt, hsa; identical to SEQ ID NO: 68204

SEQ ID NO: 551369 - RNA, 64 nt, hsa; identical to SEQ ID NO: 68205

SEQ ID NO: 551370 - RNA, 64 nt, hsa; identical to SEQ ID NO: 68206

SEQ ID NO: 551371 - RNA, 64 nt, hsa; identical to SEQ ID NO: 68207

SEQ ID NO: 551372 - RNA, 64 nt, hsa; identical to SEQ ID NO: 68208

SEQ ID NO: 551373 - RNA, 64 nt, hsa; identical to SEQ ID NO: 68209

SEQ ID NO: 551374 - RNA, 64 nt, hsa; identical to SEQ ID NO: 68210

SEQ ID NO: 551375 - RNA, 64 nt, hsa; identical to SEQ ID NO: 68211

SEQ ID NO: 551376 - RNA, 64 nt, hsa; identical to SEQ ID NO: 68212

SEQ ID NO: 551377 - RNA, 64 nt, hsa; identical to SEQ ID NO: 68213

SEQ ID NO: 551378 - RNA, 64 nt, hsa; identical to SEQ ID NO: 68214

SEQ ID NO: 551379 - RNA, 64 nt, hsa; identical to SEQ ID NO: 68215

SEQ ID NO: 551380 - RNA, 64 nt, hsa; identical to SEQ ID NO: 68216

SEQ ID NO: 551381 - RNA, 64 nt, hsa; identical to SEQ ID NO: 68217

SEQ ID NO: 551382 - RNA, 64 nt, hsa; identical to SEQ ID NO: 68218

SEQ ID NO: 551383 - RNA, 64 nt, hsa; identical to SEQ ID NO: 68219

SEQ ID NO: 551384 - RNA, 64 nt, hsa; identical to SEQ ID NO: 68220

SEQ ID NO: 551385 - RNA, 64 nt, hsa; identical to SEQ ID NO: 68221

SEQ ID NO: 551386 - RNA, 64 nt, hsa; identical to SEQ ID NO: 68222

SEQ ID NO: 551387 - RNA, 64 nt, hsa; identical to SEQ ID NO: 68223

SEQ ID NO: 551388 - RNA, 64 nt, hsa; identical to SEQ ID NO: 68224

SEQ ID NO: 551389 - RNA, 64 nt, hsa; identical to SEQ ID NO: 68225

SEQ ID NO: 551390 - RNA, 64 nt, hsa; identical to SEQ ID NO: 68226

SEQ ID NO: 551391 - RNA, 64 nt, hsa; identical to SEQ ID NO: 68227

SEQ ID NO: 551392 - RNA, 64 nt, hsa; identical to SEQ ID NO: 68228

SEQ ID NO: 551393 - RNA, 64 nt, hsa; identical to SEQ ID NO: 68229

SEQ ID NO: 551394 - RNA, 64 nt, hsa; identical to SEQ ID NO: 68230

SEQ ID NO: 551395 - RNA, 64 nt, hsa; identical to SEQ ID NO: 338191

SEQ ID NO: 551396 - RNA, 64 nt, hsa; identical to SEQ ID NO: 338192

SEQ ID NO: 551397 - RNA, 64 nt, hsa; identical to SEQ ID NO: 338193

SEQ ID NO: 551398 - RNA, 64 nt, hsa; identical to SEQ ID NO: 338194

SEQ ID NO: 551399 - RNA, 64 nt, hsa; identical to SEQ ID NO: 338195

SEQ ID NO: 551400 - RNA, 64 nt, hsa; identical to SEQ ID NO: 338196

SEQ ID NO: 551401 - RNA, 64 nt, hsa; identical to SEQ ID NO: 338197

SEQ ID NO: 551402 - RNA, 64 nt, hsa; identical to SEQ ID NO: 338198

SEQ ID NO: 551403 - RNA, 64 nt, hsa; identical to SEQ ID NO: 338199

SEQ ID NO: 551404 - RNA, 64 nt, hsa; identical to SEQ ID NO: 338200

SEQ ID NO: 551405 - RNA, 64 nt, hsa; identical to SEQ ID NO: 321937

SEQ ID NO: 551406 - RNA, 64 nt, hsa; identical to SEQ ID NO: 321938

SEQ ID NO: 551407 - RNA, 64 nt, hsa; identical to SEQ ID NO: 321939

SEQ ID NO: 551408 - RNA, 64 nt, hsa; identical to SEQ ID NO: 321940

SEQ ID NO: 551409 - RNA, 64 nt, hsa
cacugaugguuauaaugacugugggacaggauuaacuucagaauaaaugaacaggagacacaga

SEQ ID NO: 551410 - RNA, 64 nt, hsa
uguaacuagcauguuacaagagugaauaaucuggacuucagagauuaagucaccaauagugauc

SEQ ID NO: 551411 - RNA, 64 nt, hsa
ccaaaaggaaaaaugaagugccccaggagaagauacuucagaagggcuguucugaaauuccuaa

SEQ ID NO: 551412 - RNA, 64 nt, hsa
gaaauuugaaagauaagauuuauucuuauuuaauacuucagaaaauuucugcagagcccugccc

SEQ ID NO: 551413 - RNA, 64 nt, hsa
gugcauuauacuaagaauuacaugccauaagaugacuucagaaauccuacuucagaaguguaau

SEQ ID NO: 551414 - RNA, 64 nt, hsa
gaauuacaugccauaagaugacuucagaaauccuacuucagaaguguaauaaauggauggggaa

SEQ ID NO: 551415 - RNA, 64 nt, hsa
ugaggaccauuguguggauccauggugauucuagacuucagauauauuuaggaaggcgcagauu

SEQ ID NO: 551416 - RNA, 64 nt, hsa
ccuuggccacaucccuauuaacagaggcagcuccacuucagacagggacaaggcuuccugcugu

SEQ ID NO: 551417 - RNA, 64 nt, hsa
agagggacagucccauguguggcagcauugucccacuucagaugccaggagugggcucauccua

SEQ ID NO: 551418 - RNA, 64 nt, hsa
ucauacauggaaccauuuuagucccauuugacucacuucagaccaucuuccacacacuaugucu

SEQ ID NO: 551419 - RNA, 64 nt, hsa
ucugaaacuauugucuucguaaaaguuagaucugacuucagacagaaaccaauaccagcuuccu

SEQ ID NO: 551420 - RNA, 64 nt, hsa
cauaaaaagcacaauugcuaggacuucaguuuuuacuucagacuaaagcuacccaaggacuuag

SEQ ID NO: 551421 - RNA, 64 nt, hsa
ugaucucgaacuccugaccucaagugaucugcccacuucagacccccaaagugcugggauucca

SEQ ID NO: 551422 - RNA, 64 nt, hsa
uccccuccuuccuauuagcuacaaaacuggauaaacuucagaauaugagccaaugaguaggaag

SEQ ID NO: 551423 - RNA, 64 nt, hsa
uaguuuuaaccauuguuaaaaugcaaucauagugacuucagaaaauuuggaaaauacagaaaau

SEQ ID NO: 551424 - RNA, 64 nt, hsa
uauauugcuuuaccaaaauacauguguaguugucacuucagauucacugaguuaagaaaguuuu

SEQ ID NO: 551425 - RNA, 64 nt, hsa
augcucaccccuuauugcacaggaaagcauuuauacuucagaaagauuguacaaauacaaggaa

SEQ ID NO: 551426 - RNA, 64 nt, hsa
gagaauucacaguagaaauaucuaagguacugacacuucagacauugcugaguauagaaucaga

SEQ ID NO: 551427 - RNA, 64 nt, hsa
uguaaauaguguacauuuuaaacauuggcucgaaacuucagagauaagucauggagaggacauu

SEQ ID NO: 551428 - RNA, 64 nt, hsa
cuuguucaaguucugaaucccagcacaugacaacacuucagaagggucccccugcugacuggag

SEQ ID NO: 551429 - RNA, 64 nt, hsa
caaaaguuagacugagaacaaacguuagaaaaucacuucagauuguguuugaaaauuauauacu

SEQ ID NO: 551430 - RNA, 64 nt, hsa
ugugagcauugagcccccauuaaaacucuuuuuuacuucagaaagaauuuuacagguuaaaggg

SEQ ID NO: 551431 - RNA, 64 nt, hsa
gucauuugaguaagucucugcaggacguggcaugacuucagaggcuucugggaacccaggcugg

SEQ ID NO: 551432 - RNA, 64 nt, hsa
gcauuuucuuggguguugagaacuuguaccauggacuucagaccgccuugcagccguaugcugc

SEQ ID NO: 551433 - RNA, 64 nt, hsa
augugcuuuuggccaugucucaaagacaggaccaacuucagauucccaaagaagccagcuacag

SEQ ID NO: 551434 - RNA, 64 nt, hsa
ucgacaaccaaauuugucaugugacuaaaccguuacuucagaugaagcuuacauuacuguuuuc

SEQ ID NO: 551435 - RNA, 64 nt, hsa
accaagcuaguuauuaauccaagacuggaauuguacuucagacauuuagagcagaauuccaaga

SEQ ID NO: 551436 - RNA, 64 nt, hsa
uuacuagcgucauggagcuaccucugcgcaucagacuucagaccuugaacaaacuuaaaaccuu

SEQ ID NO: 551437 - RNA, 64 nt, hsa
aguuagguacggucugaaguuaugucuagauaagacuucagacguccugggauugaaagaaugu

SEQ ID NO: 551438 - RNA, 64 nt, hsa
ggccuggauaugguuucuaaaaucucagcugagaacuucagaaaacagcagcaguauuuuccuu

SEQ ID NO: 551439 - RNA, 64 nt, hsa
gaacauucaacucaggaagcauuugacucguuguacuucagagaccauaaaugacaagguuuug

SEQ ID NO: 551440 - RNA, 64 nt, hsa
gaguauuacuuuuccuacaacagaaccuggugaaacuucagagagcugucuagaacucgagaau

SEQ ID NO: 551441 - RNA, 64 nt, hsa
cgucuguuuuauuaccaaguaauuuaaacuguauacuucagauuacaaauuucuuacauuguga

SEQ ID NO: 551442 - RNA, 64 nt, hsa
uuaucuaacaucaccaaauucacauugcagagaaacuucagaaauauaagaaaugugggaaaca

SEQ ID NO: 551443 - RNA, 64 nt, hsa
cuacuccaggacucucacaaagcugaugagcuguacuucagaaaaaaauaauaauuuccauguu

SEQ ID NO: 551444 - RNA, 64 nt, hsa
aaagguaauggauugcacauagacuaaggaauaaacuucagauuugugauuuuuguuucuaauc

SEQ ID NO: 551445 - RNA, 64 nt, hsa
aaagauaauggauugcacauagacaaagaaauaaacuucagauuugugauuuuuguuucuaaac

SEQ ID NO: 551446 - RNA, 64 nt, hsa
ucugcuucaggacuuaacaugcugauccagcuguacuucagaaaaauaauauuaaucauauguu

SEQ ID NO: 551447 - RNA, 62 nt, hsa
agaaucucguuaguagcauguggccuaacaaaaggaaaaaauguuuuuaaacacacacacac

SEQ ID NO: 551448 - RNA, 62 nt, hsa
ggaggagacaucuggccuuuuuagaaccugagaggaaaaaaagagucuuuuuuuccccucug

SEQ ID NO: 551449 - RNA, 62 nt, hsa
ugcacuuucugguaaaaaguuaaaaauuuuuaaggaaaaaauaauuucaaugguuaaaguuu

SEQ ID NO: 551450 - RNA, 62 nt, hsa
uuuacauuuaaagaucauuugcaccuuuuucaaggaaaaaaaguauugaguaaacaauuguu

SEQ ID NO: 551451 - RNA, 62 nt, hsa
aguggcuuucuacuuucaaaaaugaaacaaaaaggaaaaauggcaaaguacuguuuuagcug

SEQ ID NO: 551452 - RNA, 62 nt, hsa
uagaaaauguuaaaaauaccaacucacuuggaaggaaaaauaaaaaucacaaagguauauug

SEQ ID NO: 551453 - RNA, 62 nt, hsa
aauauuguauauuaaggggaucagaaguaggaaggaaaaaauaagagauagcagaggaaaaa

SEQ ID NO: 551454 - RNA, 62 nt, hsa
agaaguaggaaggaaaaaauaagagauagcagaggaaaaagaaaaacauuuccucuuauaac

SEQ ID NO: 551455 - RNA, 62 nt, hsa
caucuacgccauauacccaucaccaucccaugaggaaaaaaaaaaaaguaaaacaaagacaa

SEQ ID NO: 551456 - RNA, 62 nt, hsa
ugcacagcggcagcaaggauuaccccaagggcaggaaaaaagucuuuggaaauagauugaaa

SEQ ID NO: 551457 - RNA, 62 nt, hsa
gcuuucuucuuaaaaaaaaaaaaaaaggaaaaaggaaaaaaaaaaaaggaaaaccagaagcc

SEQ ID NO: 551458 - RNA, 62 nt, hsa
ccucuaugcuuucuucuuaaaaaaaaaaaaaaaggaaaaaggaaaaaaaaaaaaggaaaacc

SEQ ID NO: 551459 - RNA, 62 nt, hsa
uguuuuuguacuuuacuaaucuuuaaacuaucaggaaaaaaaccaaaacuuuauaccaauga

SEQ ID NO: 551460 - RNA, 62 nt, hsa
cuuccccagccacagguauguggaauacggugaggaaaaaaaaaauuaaaaaaaaaaugcaa

SEQ ID NO: 551461 - RNA, 62 nt, hsa
uaagucccuuccguaauuuuuauguucuugugaggaaaaaaguaaaacauguuuaauuuuau

SEQ ID NO: 551462 - RNA, 62 nt, hsa
uauucuaucauaacuacccaaggacuacuaaaaggaaaaauuguguuaccuuuuuuaaauuc

SEQ ID NO: 551463 - RNA, 62 nt, hsa
uucaaacaaugguuucucugcguuaauuauugaggaaaaaaaaagaugggguaagaaaacua

SEQ ID NO: 551464 - RNA, 62 nt, hsa
caaauauguaaagcaauuguaggaaauuugaaaggaaaaaaagaaaccgaagccaguauuuu

SEQ ID NO: 551465 - RNA, 62 nt, hsa
cguguuuacuuguauuaacuuacaguuaacauaggaaaaauacaaguaaggaugugagaauu

SEQ ID NO: 551466 - RNA, 62 nt, hsa
uccugcaauuccagcugccauuugcaaaaacaaggaaaaaaauccgaaacuuucuuuuguug

SEQ ID NO: 551467 - RNA, 62 nt, hsa
caaaagaugguauagccgaauauaauggaaauaggaaaaauuagucgaaaauaaagguugau

SEQ ID NO: 551468 - RNA, 62 nt, hsa
aaaauagcuuccaauaaguaacuuagaccaaaaggaaaaaugaagugccccaggagaagaua

SEQ ID NO: 551469 - RNA, 62 nt, hsa
uuagauuucacucagcauuuaguagguccaguaggaaaaacccaaaaugguacauugaguag

SEQ ID NO: 551470 - RNA, 62 nt, hsa
caugaaaagagucuuagaaguaaagaacaacaaggaaaaaaauguuuguucuauuauucccu

SEQ ID NO: 551471 - RNA, 62 nt, hsa
ucauaugcaguaaaagaaagaaagaaaaaaaaaggaaaaaaaaaaaaaaaccaauguuuugc

SEQ ID NO: 551472 - RNA, 62 nt, hsa
uaucauguacaguuuuauuuuauaacgugaggaggaaaaacagucuuuggauuaacccucua

SEQ ID NO: 551473 - RNA, 62 nt, hsa
ugcugauaaauuugcaguaauuacagcauugcaggaaaaacaaucuguuauuccagucuuaa

SEQ ID NO: 551474 - RNA, 62 nt, hsa
uucuuuauuguucccuuauguauucaagcuuaaggaaaaauugcauugcuguuuaccucuuu

SEQ ID NO: 551475 - RNA, 62 nt, hsa
aagcugaccucguugcauggaauuaaaagagaaggaaaaacacaaggaugaagucuuuccga

SEQ ID NO: 551476 - RNA, 62 nt, hsa
aaaugaauacuuaccuuagaaauauucaccuuaggaaaaaagacuuugcucugcccuuuuau

SEQ ID NO: 551477 - RNA, 62 nt, hsa
cuaguuuauaaugucuuacuaaugcagaaacaaggaaaaaagcaaaauuggccugaauauuc

SEQ ID NO: 551478 - RNA, 62 nt, hsa
uuaguugauucacaguacagaacaagguauaaaggaaaaaacccugcuagguaguguuauaa

SEQ ID NO: 551479 - RNA, 62 nt, hsa
uucauuuuaagauuuacuuggaagagcaaagaaggaaaaauuauauuuuuaaagaaagagaa

SEQ ID NO: 551480 - RNA, 62 nt, hsa
gucccccaaccccagccgcucggaggccccaaaggaaaaagcacaagaagcgugagacgcca

SEQ ID NO: 551481 - RNA, 62 nt, hsa
auucucguagcuuuuuaaaaaaaugaaaguaaaggaaaaaaaaaaaacugcaaaucuagaaa

SEQ ID NO: 551482 - RNA, 62 nt, hsa
ucguuuuucuuuuguuugcauuuucugcaaaaaggaaaaagaaaccacaaauuggggaaaaa

SEQ ID NO: 551483 - RNA, 62 nt, hsa
ggaagagaggagagggagaaaaauaaaaugaaaggaaaaaaaaaaguuugcaaauucagaca

SEQ ID NO: 551484 - RNA, 62 nt, hsa
auggagaaaacccgguacgcucaaaaagaaaaaggaaaaaaaaaaaucccaucacccacagc

SEQ ID NO: 551485 - RNA, 62 nt, hsa
uggacauuuuaauuguuuaaaaauuguacaaaaggaaaaaauuagaauaaguacuggcgaac

SEQ ID NO: 551486 - RNA, 62 nt, hsa
ucagcacugcaccagagcagacaaccuauuugaggaaaaacagugaaauccaccuuccucuu

SEQ ID NO: 551487 - RNA, 62 nt, hsa
uacaauggaaggacaagaaugucauauucucaaggaaaaaagguauaucacaugucucauuc

SEQ ID NO: 551488 - RNA, 62 nt, hsa
gcuugggcaacagagcaagauccugucucaaaaggaaaaagaaaacaggaccuagguguuug

SEQ ID NO: 551489 - RNA, 62 nt, hsa
auaaauggaaccagagguuauauacaacuacaaggaaaaaaaugcauuuaaccaugccaccu

SEQ ID NO: 551490 - RNA, 62 nt, hsa
gcugccucaugacaaguacauguuauuuaaggaggaaaaaauauuaaauuuugaauugagug

SEQ ID NO: 551491 - RNA, 62 nt, hsa
uaaaaguguggccacugagcauuugauuuuauaggaaaaaauaguauuuuugagaauaacau

SEQ ID NO: 551492 - RNA, 62 nt, hsa
uauuagaggaagaaaauuuaaagaaaagcuagaggaaaaaaaaauuuuuuuaaaaauacuua

SEQ ID NO: 551493 - RNA, 62 nt, hsa
uugucuucaagaugcaauacuuuucuuaguaaaggaaaaacagcauaaaaagauaccugguc

SEQ ID NO: 551494 - RNA, 62 nt, hsa
ugaagaaacugccgcucugagacugcacauccaggaaaaaagacuaggacuugccacacacu

SEQ ID NO: 551495 - RNA, 62 nt, hsa
ggccuauuaucuggaugucccuugccuagagcaggaaaaaagucucagaauuaccuaaaaac

SEQ ID NO: 551496 - RNA, 62 nt, hsa
uuugccucuuccuuccuauuucccuuccgcuaaggaaaaaaauuggugucacauuuguaaaa

SEQ ID NO: 551497 - RNA, 62 nt, hsa
uggucauguguauguuaaaauagaaaauuuugaggaaaaauggaaauaggguggaaaaguac

SEQ ID NO: 551498 - RNA, 62 nt, hsa
cacugcagaaaccacuccaggcaaaguagugaaggaaaaaagccugcucuccaguagccugg

SEQ ID NO: 551499 - RNA, 62 nt, hsa
ucuguaacaucagagcugucuggccuuuggaaaggaaaaauuauggacucuguuaagaaauc

SEQ ID NO: 551500 - RNA, 62 nt, hsa
aggggcacucuaccuugguuaugauucaguagaggaaaaagaccaccuuucuucaauuuaca

SEQ ID NO: 551501 - RNA, 62 nt, hsa
uguacaagaaaguuuguuugaauguguagaagaggaaaaagcaacaacagcaacaacacgaa

SEQ ID NO: 551502 - RNA, 62 nt, hsa
guaaccgugaaagagugacaaggacagccuauaggaaaaacaauaccacuuaaaacaaucuc

SEQ ID NO: 551503 - RNA, 62 nt, hsa
uucaaauuggaaguaaugauauguauugcccaaggaaaaauacaggauguugucccaucaag

SEQ ID NO: 551504 - RNA, 62 nt, hsa
uauacuaaaaauauaggcucuugggauuggagaggaaaaauuagaggugauuuucagauuuc

SEQ ID NO: 551505 - RNA, 62 nt, hsa
auuucuuuaaagcaagacacaaaagcauacacaggaaaaaaugaugcauaaaaacauggcuu

SEQ ID NO: 551506 - RNA, 62 nt, hsa
aagugcagcaggagaacucuuuucccugaaaaaggaaaaauauugaacucaaugauagcacc

SEQ ID NO: 551507 - RNA, 62 nt, hsa
ugaacuuuccucacaccuggaagaaacaaaguaggaaaaagugaacaggggaugucaaaucg

SEQ ID NO: 551508 - RNA, 62 nt, hsa
uuauuugaagauggagcacugcugauuuaugaaggaaaaaagaagaauuuucuaaagauuac

SEQ ID NO: 551509 - RNA, 62 nt, hsa
uucaggauuuaagucugagguagucaacccucaggaaaaaaaaaauggcuuaucugaaauca

SEQ ID NO: 551510 - RNA, 62 nt, hsa
gagacucugucucagaaaaaaaaaaaaagaaaaggaaaaagaaaaauauauauucuauauuu

SEQ ID NO: 551511 - RNA, 62 nt, hsa
aaauugcaaagcacagauaaauggaaauaaacaggaaaaagaaucaccuauaaccucaccau

SEQ ID NO: 551512 - RNA, 62 nt, hsa
aauuaaccuccuaaaaggaauucauauuuuaaaggaaaaaaauacaacuaaugaugcacauu

SEQ ID NO: 551513 - RNA, 62 nt, hsa
ucauaugguauugugauuuucuuuccccugcuaggaaaaaauugcacugaaaugcugacaaa

SEQ ID NO: 551514 - RNA, 62 nt, hsa
gcaggggagcaaaaggacgccaugugagcauuaggaaaaaaaauacucacucuuacuaacaa

SEQ ID NO: 551515 - RNA, 62 nt, hsa
uguaguuuguauagcuguaguacugagguuugaggaaaaauaaauguugaucagcagaccac

SEQ ID NO: 551516 - RNA, 62 nt, hsa
auuuggaaaaacccaugaagguaacuaacggaaggaaaaacuaagagaaugaaaaguauuug

SEQ ID NO: 551517 - RNA, 62 nt, hsa
aauauauaauaaugaaaugacuaaguuaugugaggaaaaaaacagaagacauugcuaaaaga

SEQ ID NO: 551518 - RNA, 62 nt, hsa
cacguacucauuacauuuucagugcuuuuacaaggaaaaaaggugauauguuuaauuuuaaa

SEQ ID NO: 551519 - RNA, 62 nt, hsa
caagcccuauucugcacuguucaguuuuauggaggaaaaauaaaucuaccauaggaauguua

SEQ ID NO: 551520 - RNA, 62 nt, hsa
aaagaaauaaaaauauuuuuauuuucuauaaaaggaaaaaaguauaacaaaauguuuuauuu

SEQ ID NO: 551521 - RNA, 62 nt, hsa
ggagaccagagaccgccuacuggagagaaaggaggaaaaaagaaauaaaaauauuuuuauuu

SEQ ID NO: 551522 - RNA, 62 nt, hsa
uagcaccguuuguucugugagcuggaaacagaaggaaaaaacauacccuuggguacccauag

SEQ ID NO: 551523 - RNA, 62 nt, hsa
agauaaugaaaagugauaucuucgcauacgaaaggaaaaaagguugagguauauaugauuuu

SEQ ID NO: 551524 - RNA, 62 nt, hsa
auccuuaagauuuaaaaaaaaaaaaaaaaaaaaggaaaaaaaagugauggaagccguaagug

SEQ ID NO: 551525 - RNA, 62 nt, hsa
ugucuauuuuuucucuucauguuguaacaaaaaggaaaaaagaaaaaaaaaucccaucccuu

SEQ ID NO: 551526 - RNA, 62 nt, hsa
ucauauguuuaauugaauugaaaauaucccuuaggaaaaaaaaaaaacacacaaaaaaccac

SEQ ID NO: 551527 - RNA, 62 nt, hsa
auaaaauugcaguauuuaaagcuuaagcuuucaggaaaaagaaaauaagaauucagugugug

SEQ ID NO: 551528 - RNA, 62 nt, hsa
aacacaggaaaugaaaaauuuuuaaaaaaagaaggaaaaauguuuuaaauacaaaaggaaaa

SEQ ID NO: 551529 - RNA, 62 nt, hsa
aaaaaaagaaggaaaaauguuuuaaauacaaaaggaaaaacagacaaaaauuuaauuuuagc

SEQ ID NO: 551530 - RNA, 62 nt, hsa
aauaccuggcaaaacuaaauaaauuaccaaaaaggaaaaaaaauccaccaaaccaugauaaa

SEQ ID NO: 551531 - RNA, 62 nt, hsa
uguuuauuuauuguggauucccaucaggaaagaggaaaaaauacacauguucuuucauauag

SEQ ID NO: 551532 - RNA, 62 nt, hsa
aggaagcauauaccggggaauguguagccuucaggaaaaaaaugccaauugacacaaagcau

SEQ ID NO: 551533 - RNA, 62 nt, hsa
uucacauuuugauuuauuagguacuagcacugaggaaaaaaaauucagcacuuggacuauca

SEQ ID NO: 551534 - RNA, 62 nt, hsa
caacacuacaagucuugaguuaagaaggaaagaggaaaaaagaaaaaacaccaauacccaga

SEQ ID NO: 551535 - RNA, 62 nt, hsa
augcuuucuuuuccagucgucuuugagaauaaaggaaaaaaaaaucuucagaugcaaugguu

SEQ ID NO: 551536 - RNA, 58 nt, hsa
uggauggauuucaacuuuaacuuacuggaggaaaaaaaauuuauggcuaaaaagggua

SEQ ID NO: 551537 - RNA, 62 nt, hsa
ugaugaggacacagcagccauauuaugccaagaggaaaaauaucaugaucauauugaaagau

SEQ ID NO: 551538 - RNA, 62 nt, hsa
acuuuuaugaaagccaaagacugcuugcuaguaggaaaaaauuucaaauaauaaccaaagcu

SEQ ID NO: 551539 - RNA, 62 nt, hsa
ugucauaaauuauuuccccgguaauuuuugaaaggaaaaauguauaacaaguacuauuuaca

SEQ ID NO: 551540 - RNA, 62 nt, hsa
uuuguucaaaaguuagaacaucuggcugcaccaggaaaaaaaaaaaaaaaaaguccuguucu

SEQ ID NO: 551541 - RNA, 62 nt, hsa
gcauauugcuuaugucuggauccauguuucugaggaaaaagacauucucaggugauguauuu

SEQ ID NO: 551542 - RNA, 62 nt, hsa
gcaaagcguaagccuugauuggauuuugguuuaggaaaaaucucauagguauaaaagacaac

SEQ ID NO: 551543 - RNA, 62 nt, hsa
agagaugaagcaucauauugacaacuuacuccaggaaaaaagguguguguauaggugugugu

SEQ ID NO: 551544 - RNA, 62 nt, hsa
cuaagguguuuaaaacaugucaaccuuauguaaggaaaaauuuccugguccaaauaaaguug

SEQ ID NO: 551545 - RNA, 62 nt, hsa
ccaucaagccauuguuuugugccauucaggagaggaaaaaaaggaauuuaugcuguacauuu

SEQ ID NO: 551546 - RNA, 62 nt, hsa
ccugggaucccucugucaaccccacgccuuuuaggaaaaagaaaagugagugaacagcaagg

SEQ ID NO: 551547 - RNA, 62 nt, hsa
cuaauuaaaaagcacucaggugauaauuauguaggaaaaacaaucuugccaaauaaugaauu

SEQ ID NO: 551548 - RNA, 62 nt, hsa
gauguaaacgaaagugccauuuuaguaaaggcaggaaaaaaauagcaauauuugaguuaugu

SEQ ID NO: 551549 - RNA, 62 nt, hsa
gaccagaaacacuucgcugcugcaagccagacaggaaaaagauuccaugucagauaaggcaa

SEQ ID NO: 551550 - RNA, 62 nt, hsa
aauaacaaaguugcuaggcaggaaaaaaaaucaggaaaaaagcuugucgcuauuugagaauc

SEQ ID NO: 551551 - RNA, 62 nt, hsa
agacagugaggauaauaacaaaguugcuaggcaggaaaaaaaaucaggaaaaaagcuugucg

SEQ ID NO: 551552 - RNA, 62 nt, hsa
caaaaaaauguaagaggaaaaaaaguaaauuaaggaaaaaauccucacucauucccauguug

SEQ ID NO: 551553 - RNA, 62 nt, hsa
aucaauggagcaugugugcaaaaaaauguaagaggaaaaaaaguaaauuaaggaaaaaaucc

SEQ ID NO: 551554 - RNA, 62 nt, hsa
uaagugcuauuggcauuccaaaauucagcuaaaggaaaaaugaucaaaaacaaaguaaggug

SEQ ID NO: 551555 - RNA, 62 nt, hsa
guuaacauugcaaugaaaaaaugaaaaaaagaaggaaaaaagaauaagaaugaaaacugcug

SEQ ID NO: 551556 - RNA, 62 nt, hsa
gaauucuuguccauuuuuguaaucaagauuuuaggaaaaacagaaguacaucuaucuuuaug

SEQ ID NO: 551557 - RNA, 62 nt, hsa
agaaccacuaaacaucuucaaaugguacuaugaggaaaaaaagaaaaacauuuuucuaaaua

SEQ ID NO: 551558 - RNA, 62 nt, hsa
ugaagauaaaauagugcuuuuuugaaauggagaggaaaaacuuggggaggaagaggccugcu

SEQ ID NO: 551559 - RNA, 62 nt, hsa
cgcucugauagguagaugugaguaaaaagaacaggaaaaaauugcuucuuuuauugguuucc

SEQ ID NO: 551560 - RNA, 62 nt, hsa
uuucagccauuuuugccacauauacauuuuuaaggaaaaaagauuuuucucuguaagaaagu

SEQ ID NO: 551561 - RNA, 62 nt, hsa
uuacagcauauuuaagucuugugaaacuguauaggaaaaaaguaucuacguuuuuaguuuuu

SEQ ID NO: 551562 - RNA, 62 nt, hsa
guauaaaauuucucaggcagaguccuggauauaggaaaaaguaauuuaugaaguaaacuuca

SEQ ID NO: 551563 - RNA, 62 nt, hsa
uuugugauaaaaauauaaagacagaagacaugaggaaaaacaaaagguuugaggaaaucagg

SEQ ID NO: 551564 - RNA, 62 nt, hsa
agaaggaaaugaaaauauuuuuaugccuacuuaggaaaaaaaggguagcacuuauucauucc

SEQ ID NO: 551565 - RNA, 62 nt, hsa
cuuauuucauuaaagaaguugggagaacaaauaggaaaaaaaaaacuuauuuuucuaguaaa

SEQ ID NO: 551566 - RNA, 62 nt, hsa
uuugaauuuauuggaguaacucaaauugccugaggaaaaauggaaaaauuauccaccagucg

SEQ ID NO: 551567 - RNA, 62 nt, hsa
uucaacuuugacuucuuuugacaaaggacuuuaggaaaaagaggaacaaagacauuauuuga

SEQ ID NO: 551568 - RNA, 62 nt, hsa
uggacaacauagggagaccccaucucuaccggaggaaaaaaaaaagagucaggccugguggu

SEQ ID NO: 551569 - RNA, 62 nt, hsa
agagugagaccuugucucaaaaaaguaacauaaggaaaaaagaagccuugcuuuagcacagg

SEQ ID NO: 551570 - RNA, 62 nt, hsa
auaacaaccuuuaaaaaagcaaaauaauaagaaggaaaaauuccaggagggaaaaugaauug

SEQ ID NO: 551571 - RNA, 62 nt, hsa
gaaugcaaaaaaucuuccaaagacaagaaaagaggaaaaaaagccguuuucaugagcugagu

SEQ ID NO: 551572 - RNA, 62 nt, hsa
aagaacuauuuuaaaguguuccagacccaaaaaggaaaaauaaaaaaaaaggaauauuugua

SEQ ID NO: 551573 - RNA, 62 nt, hsa
agucugaggcuaagaaagguucaucucacaacaggaaaaacaaaucucaacacacauuagag

SEQ ID NO: 551574 - RNA, 62 nt, hsa
aaaaaaugaaaaaaaaaggaaaaaaagaaaaaaggaaaaaaacaguuugaacacaaaggcuc

SEQ ID NO: 551575 - RNA, 62 nt, hsa
gaaaucuuaaaaaaagaaaaaaugaaaaaaaaaggaaaaaaagaaaaaaggaaaaaaacagu

SEQ ID NO: 551576 - RNA, 62 nt, hsa
gcaggagauaacauuuucuucugcaucaagugaggaaaaaugugcuuuuggccaugucucaa

SEQ ID NO: 551577 - RNA, 62 nt, hsa
ucucucuagagcgagcaagagagggagagaggaggaaaaaauacacauaauacaaacauaca

SEQ ID NO: 551578 - RNA, 62 nt, hsa
uuacguagacagaaauaauaaaaauauuaacuaggaaaaaacaguauagcaccaagccagua

SEQ ID NO: 551579 - RNA, 62 nt, hsa
guaguccuguuugccacuaaaaacauuuucaaaggaaaaauaaaaugaaaguacuuuuuacu

SEQ ID NO: 551580 - RNA, 62 nt, hsa
gauuuuuuuuuaauuuaaugaaauuguuaaugaggaaaaauuuuuaauauagucuuaucuac

SEQ ID NO: 551581 - RNA, 62 nt, hsa
aggaagaaaaacuguccuuccuucuccaaaaaaggaaaaauuauaauaauauaaaugacaaa

SEQ ID NO: 551582 - RNA, 62 nt, hsa
uucaaaauagcauuccccagguuuuuaaugggaggaaaaaaagcuuuaauguugagcaugcu

SEQ ID NO: 551583 - RNA, 62 nt, hsa
aauaagaugucagaauaacuaauaauuuuauuaggaaaaaaucauguuuuaaauuucaaaau

SEQ ID NO: 551584 - RNA, 62 nt, hsa
cuacaaaaauaaccuucaggaaaaagaaaaucaggaaaaaaauuuuuuuucaauaaucuuau

SEQ ID NO: 551585 - RNA, 62 nt, hsa
uuuuuaccaugguuucuacaaaaauaaccuucaggaaaaagaaaaucaggaaaaaaauuuuu

SEQ ID NO: 551586 - RNA, 62 nt, hsa
ccuucaauuccauauauccuuuucuucuauguaggaaaaaaauagucuaguguaguauucuu

SEQ ID NO: 551587 - RNA, 62 nt, hsa
uaggcuuucagcuuacacaaaucuauuuaauuaggaaaaaaacuauuaaggauguagcuuuu

SEQ ID NO: 551588 - RNA, 62 nt, hsa
aaggccuaugaguauggauugggggggccaaaaggaaaaagcuccaugugccucuuugucug

SEQ ID NO: 551589 - RNA, 62 nt, hsa
aguuuuauuuuauguuuagauagggcugggcaaggaaaaagaaaauaaagacaaccauauuu

SEQ ID NO: 551590 - RNA, 62 nt, hsa
uucaguuuauacagcagacugaagaauaugucaggaaaaauaauccuaaauguuugauuacc

SEQ ID NO: 551591 - RNA, 62 nt, hsa
uuuuuaagcuugaaacugcagaagaaauucacaggaaaaaucaacaagauagugaucucucu

SEQ ID NO: 551592 - RNA, 62 nt, hsa
caaaaguuggcagauuuuuuuuuuuguuuuuaaggaaaaaggcaugcuuucugacugacaug

SEQ ID NO: 551593 - RNA, 62 nt, hsa
acuggcucucaagcuauaguuuguuuucaaaaaggaaaaacaaaauaguuuuuuacuggauu

SEQ ID NO: 551594 - RNA, 62 nt, hsa
ucagcaaggcauguuacuacuuuuaucaucuaaggaaaaaagacaagggaauuccagucagg

SEQ ID NO: 551595 - RNA, 62 nt, hsa
ccaucuggaggaaaaccagaucggacuaaaaaaggaaaaagaaaaacaaaaucuccgcagug

SEQ ID NO: 551596 - RNA, 62 nt, hsa
acuggaugagcggugagacgaacaaaagggaaaggaaaaaaugggggugggggguggggggu

SEQ ID NO: 551597 - RNA, 62 nt, hsa
uaucuuuugagauuaaagugacucuuuacuguaggaaaaauauuacucuguguuuacagauu

SEQ ID NO: 551598 - RNA, 62 nt, hsa
aauaaaauuuuaagugaugcuguauuauauauaggaaaaaaugcuuaaaauccugucauuua

SEQ ID NO: 551599 - RNA, 62 nt, hsa
ucauaaaaauuaaaugcuuuaagaaauggagaaggaaaaauagcuuuuaucaauuuuuuucu

SEQ ID NO: 551600 - RNA, 62 nt, hsa
uggacaaagagagagaaagaaagaaggaaggaaggaaaaacuuguuacugaaagagacuaca

SEQ ID NO: 551601 - RNA, 62 nt, hsa
aaucugaacaauccuacagggaaaucagaauuaggaaaaaaaucuggagaacaauaugguug

SEQ ID NO: 551602 - RNA, 62 nt, hsa
ggagugauacauugugggaacccucagaagauaggaaaaaagcauggaauagauucucccuc

SEQ ID NO: 551603 - RNA, 62 nt, hsa
agaauuccacuucuaguuauuuauucaagagaaggaaaaacaaugaucacagcaauacuugu

SEQ ID NO: 551604 - RNA, 62 nt, hsa
auaaaugcaauauuauuggcagacauuguugaaggaaaaaagccagacaaacaacuacauaa

SEQ ID NO: 551605 - RNA, 62 nt, hsa
caccauuuuuaguuuuauuuccugauagcaaaaggaaaaaaaacacccaucccucaaaaagg

SEQ ID NO: 551606 - RNA, 62 nt, hsa
cuuuuaaaauguagagaaaaggugacaguuuaaggaaaaauauauauagaauaccagaaaug

SEQ ID NO: 551607 - RNA, 62 nt, hsa
uaacaugauauuggaaaauaauggaugaaaauaggaaaaaugauuguuaaugcugacugugg

SEQ ID NO: 551608 - RNA, 62 nt, hsa
cugcuuuauuuuaaaagguaguauaagaaaugaggaaaaagagguaauaucagggcuucugc

SEQ ID NO: 551609 - RNA, 62 nt, hsa
gaauggucacuaaaguauccugacaaguuccuaggaaaaaaggaauaaaguuuuuuuccuua

SEQ ID NO: 551610 - RNA, 62 nt, hsa
uauuuaauggcacugagaaacaugcaagauacaggaaaaaugaaaauguuacaagcuaagag

SEQ ID NO: 551611 - RNA, 62 nt, hsa
acuguguguugacauuugaggauggguaugcaaggaaaaaauauacuucuguuuacuuacuc

SEQ ID NO: 551612 - RNA, 62 nt, hsa
cugugguuucuugucuaaugucaguguucaguaggaaaaaguuauauguggauaacuguaug

SEQ ID NO: 551613 - RNA, 62 nt, hsa
uaaacaaacaaaaaaaaauuuuaaacaaagaaaggaaaaaaauugacaauaaaagucacucu

SEQ ID NO: 551614 - RNA, 62 nt, hsa
aagauucuuucuucugaaagccaagcaccacaaggaaaaaaaaaauuauuaauagcucaggu

SEQ ID NO: 551615 - RNA, 62 nt, hsa
ugaagccaaccagagaucuugaucucucucugaggaaaaaaccuagaaaugaugguuagaau

SEQ ID NO: 551616 - RNA, 62 nt, hsa
gcauuaaaauauguacacaaaaaguuugguaaaggaaaaaugcugucauguguuacaaaagc

SEQ ID NO: 551617 - RNA, 62 nt, hsa
aguuuucuccauaucaaaacgagggcugauggaggaaaaaggucaauaaggucaagggaaaa

SEQ ID NO: 551618 - RNA, 62 nt, hsa
cucuagcaggccuaagacaugugaggaggaaaaggaaaaaaagcaaaaagcaagggagaaaa

SEQ ID NO: 551619 - RNA, 62 nt, hsa
auucaguguugcgguagcagaugcauuaucaaaggaaaaauauuuggcuccuuuaauuccuc

SEQ ID NO: 551620 - RNA, 62 nt, hsa
gaauuuuuuucaguggagugguuuucgcuuaaaggaaaaaaaaaucuaaaacugcgaagaau

SEQ ID NO: 551621 - RNA, 62 nt, hsa
acggcagugucauuccccuuugcacuguaaugaggaaaaaaugguauaaaagguugccaaau

SEQ ID NO: 551622 - RNA, 62 nt, hsa
acugcugcugccucugaaacagaaaguuggaaaggaaaaaagaaaaaagcaauuagguagca

SEQ ID NO: 551623 - RNA, 62 nt, hsa
uacuaaaaaaaguguguauuaggaggagagagaggaaaaaaagaggaaagaaggaaaaaaaa

SEQ ID NO: 551624 - RNA, 62 nt, hsa
uaggaggagagagaggaaaaaaagaggaaagaaggaaaaaaaaaagaauuaaaaaaaaaaaa

SEQ ID NO: 551625 - RNA, 62 nt, hsa
ucacuuuguucugguauugacgcaauuauauuaggaaaaaaguugguugacuguuuuuguuu

SEQ ID NO: 551626 - RNA, 62 nt, hsa
uuuggguauacuugugguuaguuuugugccauaggaaaaaauuaucuuaaaacuuuggccau

SEQ ID NO: 551627 - RNA, 62 nt, hsa
uuuuguccccauuccccuacuccugagcuaggaggaaaaaaugugaaucuuaccagcaguuc

SEQ ID NO: 551628 - RNA, 62 nt, hsa
ugccucagugagaacggggggacggggauguuaggaaaaauacaguaaaguugcaaugaaga

SEQ ID NO: 551629 - RNA, 62 nt, hsa
aaagaguggguguguguccgcauccccucuguaggaaaaagaacuuaguagcuugcugcucc

SEQ ID NO: 551630 - RNA, 62 nt, hsa
agaacagcgugagcugguggaucaugacaaggaggaaaaauguccccccaggcauuucuagg

SEQ ID NO: 551631 - RNA, 62 nt, hsa
uaauugaaguucagagucacccguggcuccuaaggaaaaaacagcaucaugaaaggcaaaaa

SEQ ID NO: 551632 - RNA, 62 nt, hsa
uaaugcauaaugcuuucucaccaacagaaaaaaggaaaaaaauuguuuucaguuaaacacua

SEQ ID NO: 551633 - RNA, 62 nt, hsa
uaccucauuucaagaaaauaugcuuaacagagaggaaaaaaaugugguuuggccuugcugcu

SEQ ID NO: 551634 - RNA, 62 nt, hsa
agcuuguugaaauguuuugcaucugucaauuaaggaaaaaaaaaaucacucuauguugcccc

SEQ ID NO: 551635 - RNA, 62 nt, hsa
auaaacuagcucauuauuuccaucuuuggaaaaggaaaaaaaaaaaaacuucuuuaggcauu

SEQ ID NO: 551636 - RNA, 62 nt, hsa
ucaaccugaugauuuguuuguuugaaauuggcaggaaaaaugcagcuuucaaaucauugggg

SEQ ID NO: 551637 - RNA, 62 nt, hsa
caaaacaaaacaaaauaaaacaaaaaaaaggaaggaaaaaaaaagaaaaaauuuaaaaaauu

SEQ ID NO: 551638 - RNA, 62 nt, hsa
cagcggggagggacugauuuuuauaggaaaggaggaaaaauaauggaaacacaucucauuau

SEQ ID NO: 551639 - RNA, 62 nt, hsa
ucuaaacugggacuauacuaguaggagaggaaaggaaaaaacauuuggaaaauaguaacauu

SEQ ID NO: 551640 - RNA, 62 nt, hsa
uacgauuugggagugacauuucuguaaagaagaggaaaaaucauuuuucuauaauuuguaaa

SEQ ID NO: 551641 - RNA, 62 nt, hsa
uccuagggaguuggcuuuucagccagggccaaaggaaaaagcccugcugcauuuaaaaacaa

SEQ ID NO: 551642 - RNA, 62 nt, hsa
caacucuaaaaaaaaaaaaaauacaaauaaaaaggaaaaaaaauuacauuuuuuaucuuaua

SEQ ID NO: 551643 - RNA, 62 nt, hsa
gcaguauucagcuucuuaaccagucgcuauuuaggaaaaaaaacccacuaguuaggccauca

SEQ ID NO: 551644 - RNA, 62 nt, hsa
acccccccacuaugcccucauuuuuuuaaaaaaggaaaaaaaaaagaaacuggguuccaguc

SEQ ID NO: 551645 - RNA, 62 nt, hsa
aaaaaaauaaauaaaaauaaaaaaaauaaaaaaggaaaaaaaaaaaagaagaaacaagacau

SEQ ID NO: 551646 - RNA, 62 nt, hsa
gucuuucagcaacauucuuuauugucaucauaaggaaaaacuuuuaucgcaaugauagucag

SEQ ID NO: 551647 - RNA, 62 nt, hsa
gccgucuucacagacaaacuugaaagguauuaaggaaaaaauuccacauagcucugggccuu

SEQ ID NO: 551648 - RNA, 62 nt, hsa
cuccauuccaccugacccuguguguacaauccaggaaaaaaacaaaccccacucagaaacag

SEQ ID NO: 551649 - RNA, 62 nt, hsa
gauacagcggucacuauuuucucuuaacacauaggaaaaaaguucagacaucgcuacaauaa

SEQ ID NO: 551650 - RNA, 62 nt, hsa
caggaaagggaaaugaucguuucuuuuguauuaggaaaaacaagacuuagacuucccgaguu

SEQ ID NO: 551651 - RNA, 62 nt, hsa
ggguuguacacacugccauuuuuguauuuuaaaggaaaaaugacuuucauucccaacugauu

SEQ ID NO: 551652 - RNA, 62 nt, hsa
cagucaugaauacauuuuuagccauuuaccuaaggaaaaagacaguuuuucuagguaccaug

SEQ ID NO: 551653 - RNA, 62 nt, hsa
ucaacggccacuguguguggcugcucugagugaggaaaaaauuaaaaagaaaaacugguucc

SEQ ID NO: 551654 - RNA, 62 nt, hsa
aaggcucagcuggggaugguguuugacuucggaggaaaaaaguugcuauugcccguuaaagg

SEQ ID NO: 551655 - RNA, 62 nt, hsa
uccuaggcaacagagugauacgcuguuuaaaaaggaaaaaauccuucccuagagcuaguauc

SEQ ID NO: 551656 - RNA, 62 nt, hsa
ugggugacagagugagacuccaucucaacagaaggaaaaaaaaggaaaauaggagaaggugg

SEQ ID NO: 551657 - RNA, 62 nt, hsa
cuagggcccugggaggagguugagccuggggaaggaaaaagcaggaaacugaaggaagcagg

SEQ ID NO: 551658 - RNA, 62 nt, hsa
auuggauucgguaaaaagaggggguugcuagaaggaaaaacaggugugaccugauccugccc

SEQ ID NO: 551659 - RNA, 62 nt, hsa
auuuauaaauuaaacuuuagauauguauguacaggaaaaaauguaguauauaguaucguaua

SEQ ID NO: 551660 - RNA, 62 nt, hsa
aaaauguaguauauaguaucguauauauguacaggaaaaaaacguacuaucugugguuucag

SEQ ID NO: 551661 - RNA, 62 nt, hsa
gaaaacacacagaagagauuuaaaaaaaaaaaaggaaaaaaaaaaaagacauaaacuggcac

SEQ ID NO: 551662 - RNA, 62 nt, hsa
ucaaaaaagcgacaaaaaaacacaaacagaagaggaaaaaaaagcaacaaaaaaagaaaaca

SEQ ID NO: 551663 - RNA, 62 nt, hsa
agugaacagaguuuugaaaggcauugcuuuaaaggaaaaaaguauagguauguguacauaua

SEQ ID NO: 551664 - RNA, 62 nt, hsa
uacagaguuggacuauguguauauuggaaauaaggaaaaacccuucucauuguuaacuggag

SEQ ID NO: 551665 - RNA, 62 nt, hsa
uuauaaucccagucuuuuaucacucaggugcuaggaaaaaaaacauagacucaagacccaag

SEQ ID NO: 551666 - RNA, 62 nt, hsa
aacccccagaaacccacaauauguacacgcuaaggaaaaacuagcacccuucuguccacuca

SEQ ID NO: 551667 - RNA, 62 nt, hsa
ugaggaaaaaacauucagacaaauguucagugaggaaaaaaaggggaaguuggggauaggca

SEQ ID NO: 551668 - RNA, 62 nt, hsa
guucagugugagugaggaaaacauguucagugaggaaaaaacauucagacaaauguucagug

SEQ ID NO: 551669 - RNA, 62 nt, hsa
ucuucccauugcuuccuacuaaagaggacaacaggaaaaagcaccuagaauauuuggggggg

SEQ ID NO: 551670 - RNA, 62 nt, hsa
aauggcuuuguggucgucguugugcucacgaaaggaaaaauggggaggucuuuuuuuucucc

SEQ ID NO: 551671 - RNA, 62 nt, hsa
ggaaggaaaagaaaguaguuguuuuacaagggaggaaaaaagugaaucugguuacacauaug

SEQ ID NO: 551672 - RNA, 62 nt, hsa
uuagcucauauucuauacagcaucguuuaaauaggaaaaauuuaaugcuagcaaaaaauaaa

SEQ ID NO: 551673 - RNA, 62 nt, hsa
ugugggauaaccuucaguuuauguuauuagguaggaaaaauaagguugaggacagugacugc

SEQ ID NO: 551674 - RNA, 62 nt, hsa
ucccacaugaaccuccagcaaauagcaaguccaggaaaaacucuucucauucaaagaggaau

SEQ ID NO: 551675 - RNA, 62 nt, hsa
ucaacuuuuuaguuuuguuccuucaaaguugaaggaaaaaaaguuugguuuuauaaaauuca

SEQ ID NO: 551676 - RNA, 62 nt, hsa
uuuuguauaaaaauuuaaauugaauuaaaagaaggaaaaaaaaagcccaaacuuaaccucug

SEQ ID NO: 551677 - RNA, 62 nt, hsa
aaaggccagagaaagagcaguccaagcauaaaaggaaaaagaguuaugaagauacagauuua

SEQ ID NO: 551678 - RNA, 62 nt, hsa
aaguuccccuccauaauuuuuauguucuugugaggaaaaaaguaaaacauguuuaauuuuau

SEQ ID NO: 551679 - RNA, 62 nt, hsa
uauucuaucauaacuacccaaggacuacuaaaaggaaaaauuguguuacuuuuuuuaaauuc

SEQ ID NO: 551680 - RNA, 64 nt, hsa; identical to SEQ ID NO: 284691

SEQ ID NO: 551681 - RNA, 64 nt, hsa; identical to SEQ ID NO: 284692

SEQ ID NO: 551682 - RNA, 64 nt, hsa; identical to SEQ ID NO: 284693

SEQ ID NO: 551683 - RNA, 64 nt, hsa
accugagaaggacggcaaggcugagguggcuaagggggaccauggggagguggcacuagggauc

SEQ ID NO: 551684 - RNA, 64 nt, hsa
cagagggugggaggggccaugcugugugagaccaggggaccagagggaugggagagucaaggga

SEQ ID NO: 551685 - RNA, 64 nt, hsa
ugcugcacugguccuaugccagccucacccauguggggaccacggaaggcacacucccuuaccc

SEQ ID NO: 551686 - RNA, 64 nt, hsa
gcagacggcacccaggcugugaucuguccugggcggggaccaggagggagcggggucgggauca

SEQ ID NO: 551687 - RNA, 64 nt, hsa
aggccagagcagguagcaaggcauuguggaaagaggggaccaggguggcuggggaagaggccga

SEQ ID NO: 551688 - RNA, 64 nt, hsa
aaaccguuaagccucuacgauuuuuaaguaaguuggggaccaucaguuuaaaauaaaugcaaua

SEQ ID NO: 551689 - RNA, 64 nt, hsa
ccaaaaauacuauggagagcuacacugcuucaguggggaccaagcagucauuuggugacuuagg

SEQ ID NO: 551690 - RNA, 64 nt, hsa
cacccccauuggacaagcuggggaacagccauagggggaccagcuucugccaggugagaugcuu

SEQ ID NO: 551691 - RNA, 64 nt, hsa
gcaggggaguccagcugagaguggaagagguggcggggaccagcugggcagaugagaggcugag

SEQ ID NO: 551692 - RNA, 64 nt, hsa
accaugaguccuguguccaggccggacauggcugggggaccaacuacucuggcaggaucuggac

SEQ ID NO: 551693 - RNA, 64 nt, hsa; identical to SEQ ID NO: 542714

SEQ ID NO: 551694 - RNA, 64 nt, hsa; identical to SEQ ID NO: 542715

SEQ ID NO: 551695 - RNA, 64 nt, hsa; identical to SEQ ID NO: 542716

SEQ ID NO: 551696 - RNA, 64 nt, hsa; identical to SEQ ID NO: 542717

SEQ ID NO: 551697 - RNA, 64 nt, hsa; identical to SEQ ID NO: 542718

SEQ ID NO: 551698 - RNA, 64 nt, hsa; identical to SEQ ID NO: 542719

SEQ ID NO: 551699 - RNA, 64 nt, hsa; identical to SEQ ID NO: 542720

SEQ ID NO: 551700 - RNA, 64 nt, hsa; identical to SEQ ID NO: 542721

SEQ ID NO: 551701 - RNA, 64 nt, hsa; identical to SEQ ID NO: 542722

SEQ ID NO: 551702 - RNA, 64 nt, hsa; identical to SEQ ID NO: 542723

SEQ ID NO: 551703 - RNA, 64 nt, hsa
gaagggacucaggugagggucuucuggacucuaagacgguaaaggcacuaaagucacuuuaaag

SEQ ID NO: 551704 - RNA, 64 nt, hsa
cgagggcucagcaaggccaagaggagacagccgugacgguaaacuuccccucuaccagccucca

SEQ ID NO: 551705 - RNA, 64 nt, hsa
ccaucauggaagucagagaauuaaccaauuaagugacgguaacuauuuuuuguauaccuuguuc

SEQ ID NO: 551706 - RNA, 64 nt, hsa
gauauucuaguauuugcuucugguggaauuaaaugacgguaaaauuggcuaauuauuugaauga

SEQ ID NO: 551707 - RNA, 64 nt, hsa
gauccuggagcuuugcuuucuauugaaggcuuuugacgguaauaggugguaacuugguaaaagg

SEQ ID NO: 551708 - RNA, 64 nt, hsa
agaaggcauuagguugacaacuugucaugauuuugacgguaagccaccaugauuguguucucug

SEQ ID NO: 551709 - RNA, 64 nt, hsa
ggaugggcuccugcagccuggggaggagugugacgacgguaacagcgaugugggugacgacugc

SEQ ID NO: 551710 - RNA, 64 nt, hsa
cuguuuuauguguaaaaucagaugcuugcaggaggacgguaaacagcaaaggcuuuacuucuuu

SEQ ID NO: 551711 - RNA, 64 nt, hsa
caucuugcauccaaaccuguaaccuuucggcaaggacgguaacuuggcugcauuugccugucau

SEQ ID NO: 551712 - RNA, 64 nt, hsa
gaggucuuacugcaauaagaaguaaugccugggggacgguaauccuaauaggacgucccgcacu

SEQ ID NO: 551713 - RNA, 64 nt, hsa
aagaaaggaaucaaaggacuguguguaguaagcugacgguaaaguuaagauuaaauuaagacag

SEQ ID NO: 551714 - RNA, 64 nt, hsa
uuuuuaaaaaauucagaaauccaauaaaggaaaggacgguaaccuuaugauagaagguguggca

SEQ ID NO: 551715 - RNA, 64 nt, hsa; identical to SEQ ID NO: 551714

SEQ ID NO: 551716 - RNA, 64 nt, hsa
augagccaugguggagaacuuuaucacucaaguagacgguaaacauccuuaauauguucuaaau

SEQ ID NO: 551717 - RNA, 64 nt, hsa
gccugggggcugccaggugugcagggccaauccugacgguaauugagaaugagugagguuucgu

SEQ ID NO: 551718 - RNA, 64 nt, hsa
auggggccaaaguugagauagaauagagggugaugacgguaagagcaagugucccaugaaugug

SEQ ID NO: 551719 - RNA, 64 nt, hsa
cuaccuauuacagccguauucugcuguccguggagacgguaagaucuuagguuccaagauuuua

SEQ ID NO: 551720 - RNA, 64 nt, hsa
ucuauuaucacauuaaucucaaagagauucgaaugacgguaaguguucucaugaagcaggaggc

SEQ ID NO: 551721 - RNA, 64 nt, hsa
aacucuuugaguugguccuucauauaagaaucgugacgguaagagaauaaacacuuguacuggg

SEQ ID NO: 551722 - RNA, 64 nt, hsa
gaaagugucgucuccgcuucucucgguguggcgugacgguaaccccauacucuccuuuugacuc

SEQ ID NO: 551723 - RNA, 64 nt, hsa
ucgaagccuaccaggcucccggugugugcagggagacgguaaagcuggaggugccugagaccag

SEQ ID NO: 551724 - RNA, 64 nt, hsa
gaauccacacuuccugagccagaggggccguguugacgguaaugcauucucuauagagccaagu

SEQ ID NO: 551725 - RNA, 64 nt, hsa
ggaugcauccaaagcacgagucacuuaaaauaucgacgguaaacuacuauuuuguagagaaacu

SEQ ID NO: 551726 - RNA, 64 nt, hsa
ucaacaaagaaaauuuuugaguuauaggaauaaggacgguaaucugcauuuugucucuuuguau

SEQ ID NO: 551727 - RNA, 64 nt, hsa; identical to SEQ ID NO: 551725

SEQ ID NO: 551728 - RNA, 64 nt, hsa; identical to SEQ ID NO: 328547

SEQ ID NO: 551729 - RNA, 64 nt, hsa; identical to SEQ ID NO: 328548

SEQ ID NO: 551730 - RNA, 64 nt, hsa; identical to SEQ ID NO: 328549

SEQ ID NO: 551731 - RNA, 64 nt, hsa; identical to SEQ ID NO: 328550

SEQ ID NO: 551732 - RNA, 64 nt, hsa; identical to SEQ ID NO: 328551

SEQ ID NO: 551733 - RNA, 64 nt, hsa; identical to SEQ ID NO: 328552

SEQ ID NO: 551734 - RNA, 64 nt, hsa; identical to SEQ ID NO: 328553

SEQ ID NO: 551735 - RNA, 64 nt, hsa; identical to SEQ ID NO: 328554

SEQ ID NO: 551736 - RNA, 64 nt, hsa; identical to SEQ ID NO: 328555

SEQ ID NO: 551737 - RNA, 64 nt, hsa; identical to SEQ ID NO: 328556

SEQ ID NO: 551738 - RNA, 64 nt, hsa; identical to SEQ ID NO: 328557

SEQ ID NO: 551739 - RNA, 64 nt, hsa; identical to SEQ ID NO: 328558

SEQ ID NO: 551740 - RNA, 64 nt, hsa; identical to SEQ ID NO: 328559

SEQ ID NO: 551741 - RNA, 64 nt, hsa; identical to SEQ ID NO: 328560

SEQ ID NO: 551742 - RNA, 64 nt, hsa; identical to SEQ ID NO: 328561

SEQ ID NO: 551743 - RNA, 64 nt, hsa; identical to SEQ ID NO: 328562

SEQ ID NO: 551744 - RNA, 64 nt, hsa; identical to SEQ ID NO: 328563

SEQ ID NO: 551745 - RNA, 64 nt, hsa; identical to SEQ ID NO: 328564

SEQ ID NO: 551746 - RNA, 64 nt, hsa; identical to SEQ ID NO: 328565

SEQ ID NO: 551747 - RNA, 64 nt, hsa; identical to SEQ ID NO: 328566

SEQ ID NO: 551748 - RNA, 64 nt, hsa; identical to SEQ ID NO: 328567

SEQ ID NO: 551749 - RNA, 64 nt, hsa; identical to SEQ ID NO: 328568

SEQ ID NO: 551750 - RNA, 64 nt, hsa; identical to SEQ ID NO: 328569

SEQ ID NO: 551751 - RNA, 64 nt, hsa; identical to SEQ ID NO: 328570

SEQ ID NO: 551752 - RNA, 64 nt, hsa; identical to SEQ ID NO: 328571

SEQ ID NO: 551753 - RNA, 64 nt, hsa; identical to SEQ ID NO: 328572

SEQ ID NO: 551754 - RNA, 64 nt, hsa; identical to SEQ ID NO: 328573

SEQ ID NO: 551755 - RNA, 64 nt, hsa; identical to SEQ ID NO: 328574

SEQ ID NO: 551756 - RNA, 64 nt, hsa; identical to SEQ ID NO: 328575

SEQ ID NO: 551757 - RNA, 64 nt, hsa; identical to SEQ ID NO: 328576

SEQ ID NO: 551758 - RNA, 64 nt, hsa; identical to SEQ ID NO: 328577

SEQ ID NO: 551759 - RNA, 64 nt, hsa; identical to SEQ ID NO: 328578

SEQ ID NO: 551760 - RNA, 64 nt, hsa; identical to SEQ ID NO: 328579

SEQ ID NO: 551761 - RNA, 64 nt, hsa; identical to SEQ ID NO: 328580

SEQ ID NO: 551762 - RNA, 64 nt, hsa; identical to SEQ ID NO: 328581

SEQ ID NO: 551763 - RNA, 64 nt, hsa; identical to SEQ ID NO: 328582

SEQ ID NO: 551764 - RNA, 64 nt, hsa; identical to SEQ ID NO: 328583

SEQ ID NO: 551765 - RNA, 64 nt, hsa; identical to SEQ ID NO: 328584

SEQ ID NO: 551766 - RNA, 64 nt, hsa; identical to SEQ ID NO: 328585

SEQ ID NO: 551767 - RNA, 64 nt, hsa; identical to SEQ ID NO: 328586

SEQ ID NO: 551768 - RNA, 64 nt, hsa; identical to SEQ ID NO: 328587

SEQ ID NO: 551769 - RNA, 64 nt, hsa; identical to SEQ ID NO: 328588

SEQ ID NO: 551770 - RNA, 64 nt, hsa; identical to SEQ ID NO: 328589

SEQ ID NO: 551771 - RNA, 64 nt, hsa; identical to SEQ ID NO: 328590

SEQ ID NO: 551772 - RNA, 64 nt, hsa; identical to SEQ ID NO: 328591

SEQ ID NO: 551773 - RNA, 64 nt, hsa; identical to SEQ ID NO: 328592

SEQ ID NO: 551774 - RNA, 64 nt, hsa; identical to SEQ ID NO: 328593

SEQ ID NO: 551775 - RNA, 64 nt, hsa; identical to SEQ ID NO: 328594

SEQ ID NO: 551776 - RNA, 64 nt, hsa; identical to SEQ ID NO: 328595

SEQ ID NO: 551777 - RNA, 64 nt, hsa; identical to SEQ ID NO: 328596

SEQ ID NO: 551778 - RNA, 64 nt, hsa; identical to SEQ ID NO: 328597

SEQ ID NO: 551779 - RNA, 64 nt, hsa; identical to SEQ ID NO: 328598

SEQ ID NO: 551780 - RNA, 64 nt, hsa; identical to SEQ ID NO: 328599

SEQ ID NO: 551781 - RNA, 55 nt, hsa; identical to SEQ ID NO: 328600

SEQ ID NO: 551782 - RNA, 64 nt, hsa; identical to SEQ ID NO: 328601

SEQ ID NO: 551783 - RNA, 64 nt, hsa; identical to SEQ ID NO: 328602

SEQ ID NO: 551784 - RNA, 64 nt, hsa; identical to SEQ ID NO: 328603

SEQ ID NO: 551785 - RNA, 64 nt, hsa; identical to SEQ ID NO: 328604

SEQ ID NO: 551786 - RNA, 64 nt, hsa; identical to SEQ ID NO: 328605

SEQ ID NO: 551787 - RNA, 64 nt, hsa; identical to SEQ ID NO: 328606

SEQ ID NO: 551788 - RNA, 64 nt, hsa; identical to SEQ ID NO: 328607

SEQ ID NO: 551789 - RNA, 64 nt, hsa; identical to SEQ ID NO: 328608

SEQ ID NO: 551790 - RNA, 64 nt, hsa; identical to SEQ ID NO: 328609

SEQ ID NO: 551791 - RNA, 64 nt, hsa; identical to SEQ ID NO: 328610

SEQ ID NO: 551792 - RNA, 64 nt, hsa; identical to SEQ ID NO: 328611

SEQ ID NO: 551793 - RNA, 64 nt, hsa; identical to SEQ ID NO: 328612

SEQ ID NO: 551794 - RNA, 64 nt, hsa; identical to SEQ ID NO: 328613

SEQ ID NO: 551795 - RNA, 64 nt, hsa; identical to SEQ ID NO: 328614

SEQ ID NO: 551796 - RNA, 64 nt, hsa; identical to SEQ ID NO: 328615

SEQ ID NO: 551797 - RNA, 64 nt, hsa; identical to SEQ ID NO: 328616

SEQ ID NO: 551798 - RNA, 64 nt, hsa; identical to SEQ ID NO: 328617

SEQ ID NO: 551799 - RNA, 64 nt, hsa; identical to SEQ ID NO: 328618

SEQ ID NO: 551800 - RNA, 64 nt, hsa; identical to SEQ ID NO: 328619

SEQ ID NO: 551801 - RNA, 64 nt, hsa; identical to SEQ ID NO: 328620

SEQ ID NO: 551802 - RNA, 64 nt, hsa; identical to SEQ ID NO: 328621

SEQ ID NO: 551803 - RNA, 64 nt, hsa; identical to SEQ ID NO: 328622

SEQ ID NO: 551804 - RNA, 64 nt, hsa; identical to SEQ ID NO: 328623

SEQ ID NO: 551805 - RNA, 64 nt, hsa; identical to SEQ ID NO: 328624

SEQ ID NO: 551806 - RNA, 64 nt, hsa; identical to SEQ ID NO: 328625

SEQ ID NO: 551807 - RNA, 64 nt, hsa; identical to SEQ ID NO: 328626

SEQ ID NO: 551808 - RNA, 64 nt, hsa; identical to SEQ ID NO: 328627

SEQ ID NO: 551809 - RNA, 64 nt, hsa; identical to SEQ ID NO: 328628

SEQ ID NO: 551810 - RNA, 57 nt, hsa; identical to SEQ ID NO: 328629

SEQ ID NO: 551811 - RNA, 64 nt, hsa; identical to SEQ ID NO: 328630

SEQ ID NO: 551812 - RNA, 64 nt, hsa; identical to SEQ ID NO: 328631

SEQ ID NO: 551813 - RNA, 64 nt, hsa; identical to SEQ ID NO: 328632

SEQ ID NO: 551814 - RNA, 64 nt, hsa; identical to SEQ ID NO: 328633

SEQ ID NO: 551815 - RNA, 64 nt, hsa; identical to SEQ ID NO: 328633

SEQ ID NO: 551816 - RNA, 64 nt, hsa; identical to SEQ ID NO: 328632

SEQ ID NO: 551817 - RNA, 64 nt, hsa; identical to SEQ ID NO: 328636

SEQ ID NO: 551818 - RNA, 64 nt, hsa; identical to SEQ ID NO: 328637

SEQ ID NO: 551819 - RNA, 64 nt, hsa; identical to SEQ ID NO: 328638

SEQ ID NO: 551820 - RNA, 64 nt, hsa; identical to SEQ ID NO: 328639

SEQ ID NO: 551821 - RNA, 64 nt, hsa; identical to SEQ ID NO: 328640

SEQ ID NO: 551822 - RNA, 64 nt, hsa; identical to SEQ ID NO: 328641

SEQ ID NO: 551823 - RNA, 64 nt, hsa; identical to SEQ ID NO: 328642

SEQ ID NO: 551824 - RNA, 64 nt, hsa; identical to SEQ ID NO: 328643

SEQ ID NO: 551825 - RNA, 64 nt, hsa; identical to SEQ ID NO: 328644

SEQ ID NO: 551826 - RNA, 64 nt, hsa; identical to SEQ ID NO: 328645

SEQ ID NO: 551827 - RNA, 64 nt, hsa; identical to SEQ ID NO: 328646

SEQ ID NO: 551828 - RNA, 64 nt, hsa; identical to SEQ ID NO: 328647

SEQ ID NO: 551829 - RNA, 64 nt, hsa; identical to SEQ ID NO: 328648

SEQ ID NO: 551830 - RNA, 64 nt, hsa; identical to SEQ ID NO: 328649

SEQ ID NO: 551831 - RNA, 64 nt, hsa; identical to SEQ ID NO: 328650

SEQ ID NO: 551832 - RNA, 64 nt, hsa; identical to SEQ ID NO: 328651

SEQ ID NO: 551833 - RNA, 64 nt, hsa; identical to SEQ ID NO: 328652

SEQ ID NO: 551834 - RNA, 64 nt, hsa; identical to SEQ ID NO: 328653

SEQ ID NO: 551835 - RNA, 64 nt, hsa; identical to SEQ ID NO: 328654

SEQ ID NO: 551836 - RNA, 64 nt, hsa; identical to SEQ ID NO: 328655

SEQ ID NO: 551837 - RNA, 64 nt, hsa; identical to SEQ ID NO: 328656

SEQ ID NO: 551838 - RNA, 64 nt, hsa; identical to SEQ ID NO: 328657

SEQ ID NO: 551839 - RNA, 64 nt, hsa; identical to SEQ ID NO: 328658

SEQ ID NO: 551840 - RNA, 64 nt, hsa; identical to SEQ ID NO: 328659

SEQ ID NO: 551841 - RNA, 64 nt, hsa; identical to SEQ ID NO: 328660

SEQ ID NO: 551842 - RNA, 64 nt, hsa; identical to SEQ ID NO: 328661

SEQ ID NO: 551843 - RNA, 64 nt, hsa; identical to SEQ ID NO: 328662

SEQ ID NO: 551844 - RNA, 64 nt, hsa; identical to SEQ ID NO: 328663

SEQ ID NO: 551845 - RNA, 64 nt, hsa; identical to SEQ ID NO: 328664

SEQ ID NO: 551846 - RNA, 64 nt, hsa; identical to SEQ ID NO: 328665

SEQ ID NO: 551847 - RNA, 64 nt, hsa; identical to SEQ ID NO: 328664

SEQ ID NO: 551848 - RNA, 64 nt, hsa; identical to SEQ ID NO: 328665

SEQ ID NO: 551849 - RNA, 62 nt, hsa
aaagacuuuaaaaaaugguaaugaaaauggaaugcagcuacugcagcuaauaaaaaauuuua

SEQ ID NO: 551850 - RNA, 62 nt, hsa
aaaaaaugguaaugaaaauggaaugcagcuacugcagcuaauaaaaaauuuuagauagcaau

SEQ ID NO: 551851 - RNA, 62 nt, hsa
cagggcagugcugcugcagagcuagaaggcccugcagcuacagcugcuucauucccugcauu

SEQ ID NO: 551852 - RNA, 62 nt, hsa
uacacugagcgggcuacagagcuagaaggcccugcagcuacagcugcuucauucccugcauu

SEQ ID NO: 551853 - RNA, 62 nt, hsa
agcuaucaucugcagcuauaaucauagcucacugcagcuaugaucaugucucagcacuccag

SEQ ID NO: 551854 - RNA, 62 nt, hsa
gagucuaggaguucggggcugcagcuaucaucugcagcuauaaucauagcucacugcagcua

SEQ ID NO: 551855 - RNA, 62 nt, hsa
uguaggaucacuugagucuaggaguucggggcugcagcuaucaucugcagcuauaaucauag

SEQ ID NO: 551856 - RNA, 62 nt, hsa
gggaaagccagaagguugcuugugucugugacugcagcuauggccuuguuugcuuaguuuau

SEQ ID NO: 551857 - RNA, 62 nt, hsa
cuuugguugucaugagaaagagacauucuccuugcagcuaccuccaugugagugaauuccug

SEQ ID NO: 551858 - RNA, 62 nt, hsa
auuaaauucagccuaaacuuuuugacgggaacacugcagagacaaugcugugaguuuccaac

SEQ ID NO: 551859 - RNA, 62 nt, hsa
gccugaguuucauaggagguaaucaccagacaacugcagaauguagaacacugagcaggaca

SEQ ID NO: 551860 - RNA, 62 nt, hsa
gauuuuuacugagaagagauaugccuguuguuacugcagaaccugaaccguaaguaggauga

SEQ ID NO: 551861 - RNA, 62 nt, hsa
uaagcauaaaaagaaagggaaaaagcagaaacacugcagaagacacaaacaaacaaagaaga

SEQ ID NO: 551862 - RNA, 62 nt, hsa
agccugguuucauaccgaaaagacauugaaggacugcagaaauguaugggugcaccgggccg

SEQ ID NO: 551863 - RNA, 62 nt, hsa
ucucuucugucccgucaccaggcucuugcuucacugcagauacaguucacucugaaagcugg

SEQ ID NO: 551864 - RNA, 62 nt, hsa
ucuuacccacauuccccaaucaauacacacacacugcagaacccagaacagaaggccacagg

SEQ ID NO: 551865 - RNA, 62 nt, hsa
acuccucucugguaccccauccccgcaucagcacugcagagagaacacauuucggcgagggu

SEQ ID NO: 551866 - RNA, 62 nt, hsa
cuauuaugagcuaucaaaguuuacauuuuuguacugcagacgcuucauguaaauaaaaacua

SEQ ID NO: 551867 - RNA, 62 nt, hsa
ggcuucaugcauuauggaucccgacccccaccacugcagacucgcucuaggaagaacuggag

SEQ ID NO: 551868 - RNA, 62 nt, hsa
ucuacuguaaugagacaagccuuucuucugucacugcagaauuuagaaggggccgugagcag

SEQ ID NO: 551869 - RNA, 62 nt, hsa
aggcaucaagaagccagggccgugccuggagcacugcagagaugacuuuggagaaagcaaag

SEQ ID NO: 551870 - RNA, 62 nt, hsa
aucugaaagaucuaaacauggugugcuuagaaacugcagauuuuagaucuaauguauacugc

SEQ ID NO: 551871 - RNA, 62 nt, hsa
acuuaaagguaccucuguagaaauaaccuaaaacugcagaaggaucugaaagaucuaaacau

SEQ ID NO: 551872 - RNA, 62 nt, hsa
ccucucgugguccucagccccucacccccaguacugcagaucucacaguuugccuuccagaa

SEQ ID NO: 551873 - RNA, 62 nt, hsa
ggcucugcuggcucagugugggcugcaggaggacugcagacucagcugcaauucugaggggg

SEQ ID NO: 551874 - RNA, 62 nt, hsa
acgcugcuagucuuaaccccagaccagagagaacugcagaucugacugggccuaaauuaagu

SEQ ID NO: 551875 - RNA, 62 nt, hsa
ucuguauuaacagcaauguuacucucaaugaaacugcagaagccaccaugaacauggaagac

SEQ ID NO: 551876 - RNA, 62 nt, hsa
gcuacauagaagggacagggucuguguuacagacugcagaggaugugcagguacuaugcaug

SEQ ID NO: 551877 - RNA, 62 nt, hsa
cuggaaaagaugccauucuuuuuaagcuugaaacugcagaagaaauucacaggaaaaaucaa

SEQ ID NO: 551878 - RNA, 62 nt, hsa
augucguaggugauagaaaacucgccuacuccacugcagaacuugcagaaugcgugguguua

SEQ ID NO: 551879 - RNA, 62 nt, hsa
gucagagauaauugccuauacuaagaaucuauacugcagaauauaguguaucaaaaacuuuu

SEQ ID NO: 551880 - RNA, 62 nt, hsa
accgugugaagcuaggggguguuucucagcacacugcagaagggcagcucagaagaaugcag

SEQ ID NO: 551881 - RNA, 62 nt, hsa
uuuggauguauacacacauguuucuugauuuuacugcagaucaagggguguuguuagaugcu

SEQ ID NO: 551882 - RNA, 62 nt, hsa
cacauauccacccuugagaaguaugucaaaagacugcagacuauagauuuuuuuuuaauaua

SEQ ID NO: 551883 - RNA, 62 nt, hsa
cccucucugcugcuuuuguuggugcugcccacacugcagauauauuaaggauguuaggagag

SEQ ID NO: 551884 - RNA, 62 nt, hsa
uucuuaaaaccaaucaauaauagcuagcuauuacugcagacuauaaaaucuggauauagaaa

SEQ ID NO: 551885 - RNA, 62 nt, hsa
auaaacauuuaaagacaaagacauuucaaauaacugcagaaaaaauauuguaguuugaauau

SEQ ID NO: 551886 - RNA, 62 nt, hsa
cuucuucagucgcucccuggaggcaggugggcacugcagaggaucacuggaauccagaucga

SEQ ID NO: 551887 - RNA, 62 nt, hsa
aaaggacuggggaggcgugucuugaaaaagcaacugcagaaauuccuuaugaugauugugug

SEQ ID NO: 551888 - RNA, 62 nt, hsa
uuacuuuuuuccccccaaauagguauauauagacugcagaagcuucagucccauauauaaac

SEQ ID NO: 551889 - RNA, 62 nt, hsa
aguguuuuugagaauuuuuauauauauuacucacugcagagaucauguucauuuacauuccc

SEQ ID NO: 551890 - RNA, 62 nt, hsa
ccauuuuguuuuuccagaguucguggagguggacugcagagcccagagcccuucaucucucu

SEQ ID NO: 551891 - RNA, 62 nt, hsa
uuggagaguggaucagagagacuaggacaguuacugcagagcuccuaagucaccacucaacc

SEQ ID NO: 551892 - RNA, 62 nt, hsa
ucaucugaugcauuuggaccauaugcugccagacugcagaacgggggagccggggcucaggg

SEQ ID NO: 551893 - RNA, 62 nt, hsa
ggguuguguggacaccccucgcucugaugccaacugcagauaauacacaccuccugcagcgu

SEQ ID NO: 551894 - RNA, 62 nt, hsa
ucaggacuguccuggcuccgaccuuuguguacacugcagacgcugguucugaggaacuguug

SEQ ID NO: 551895 - RNA, 62 nt, hsa
ccuuucaugcugcauauuaacugguuaauuauacugcagaaaccuuuucaccuccacuaguc

SEQ ID NO: 551896 - RNA, 62 nt, hsa
agucacaccuugcaagucaucauagucuucauacugcagagaaaucuuacaaaugugaagac

SEQ ID NO: 551897 - RNA, 62 nt, hsa
aaacaacccuugcacgucaucauagaauucauacugcagagaaacuuuacaaauaggaagaa

SEQ ID NO: 551898 - RNA, 62 nt, hsa
aaauauucauguagcaaaucugagaauugaaaacugcagauaaccggccggguauggugacu

SEQ ID NO: 551899 - RNA, 62 nt, hsa
aaaaaaaaaaaacagaaagaaagaaaaagaaaacugcagauaacccuauacauuaauacugg

SEQ ID NO: 551900 - RNA, 62 nt, hsa
ggaagggucuccaggcuuuauuccucccaggcacugcagaggcaccggugaggaagggucuc

SEQ ID NO: 551901 - RNA, 62 nt, hsa
guucagggagaacagcugcguugcucccaggcacugcagaggcccgguggggaagggucucc

SEQ ID NO: 551902 - RNA, 66 nt, hsa
aucauugugcggauuaaaagaaauaauauauguaaagcacuuuaacacagcaccaggcccacggaa

SEQ ID NO: 551903 - RNA, 66 nt, hsa
ggcaaggggaucuuuggggcuaacuucgggaucccugcacuuuauguaagaauguaaaccuggagu

SEQ ID NO: 551904 - RNA, 66 nt, hsa
auuguuauagggaguaguuuuuucccuuaggacucugcacuuuauagaauguuguaaaacagacaa

SEQ ID NO: 551905 - RNA, 66 nt, hsa
ugggcugauaguuuuguuuaagguuuuggauaaggagcacuuuaaaacaaacugguguguuguuuu

SEQ ID NO: 551906 - RNA, 66 nt, hsa
uucuuauucucuagguucugagagugaaugcauugggcacuuuaaguugauauuuucucuucuccg

SEQ ID NO: 551907 - RNA, 66 nt, hsa
uaaaguguccacaacaguuagggaaaugaugcuagagcacuuuaaaaaucagcaggacaacccuga

SEQ ID NO: 551908 - RNA, 66 nt, hsa
uauaagugaguacacucuaauuaacuugcuucuguugcacuuuaguuuucuaccugcauauggacu

SEQ ID NO: 551909 - RNA, 66 nt, hsa
uauguuuuuaaauuuggaaauaugacauuuuauguagcacuuuauaaaaagugaaagcgacaaauu

SEQ ID NO: 551910 - RNA, 66 nt, hsa
aggaugcuagucuuugugaccgauugcuaaucuucugcacuuuaauuuauuuuauauaaacuuuac

SEQ ID NO: 551911 - RNA, 66 nt, hsa
ucgacaaucaagaauguuauuaauguguaauacugagcacuuuacuucuuaauaaaaacuugauau

SEQ ID NO: 551912 - RNA, 66 nt, hsa
aauguaacaaacuuacaaggacaaagaggcuuguuggcacuuuacauauacaguguauacaugugu

SEQ ID NO: 551913 - RNA, 66 nt, hsa
ugucaaacgaagacauuccaauacugcuuaauuauagcacuuuauuuuuagcugcugaacugccaa

SEQ ID NO: 551914 - RNA, 66 nt, hsa
uaaauuucucuccugauggguacuuuaauuugaaaugcacuuuaugcacaguuaugucuuauaacu

SEQ ID NO: 551915 - RNA, 66 nt, hsa
uagcaacuuugcacuauguaaaguaccuuauguauugcacuuuaaauuucucuccugauggguacu

SEQ ID NO: 551916 - RNA, 66 nt, hsa
uguauucacguguacuguuuaacugagggucucaaagcacuuuaaacuguuguguucuauuuccac

SEQ ID NO: 551917 - RNA, 66 nt, hsa
ccucugaaaaauguguagauuaaaugaguuuuuaaagcacuuuagaaaauauaagggagaaaauga

SEQ ID NO: 551918 - RNA, 66 nt, hsa
acuggaggcccauucuguauuccuaauccagucucagcacuuuauucauacaaaauaaucaaaaua

SEQ ID NO: 551919 - RNA, 66 nt, hsa
gccauuugcacuuuucaaaugccuuuggaugacccagcacuuuaaucugaaaccugcaacaagacu

SEQ ID NO: 551920 - RNA, 66 nt, hsa
caccucuggagccuauggcuuuaagcaagcacuacugcacuuuacagaauuaccccacuggauccu

SEQ ID NO: 551921 - RNA, 66 nt, hsa
cgcaggaguucuuagcuccucagcgagcaacagagagcacuuuagauggcaccuuucaccacuugg

SEQ ID NO: 551922 - RNA, 66 nt, hsa
uuauucuauuuauaucuuauuacaauaaaauuaguggcacuuuauucauaaauauucaugagccug

SEQ ID NO: 551923 - RNA, 66 nt, hsa
gagugugaagguaguacuuuuuagagugcacugagugcacuuuacaucuuuauuuaaauuuuuuuu

SEQ ID NO: 551924 - RNA, 66 nt, hsa
uggauuugaaugauugggaugauacaucauugaacugcacuuuauauaaccaaagcuuagcaguuu

SEQ ID NO: 551925 - RNA, 66 nt, hsa
gcccuucugagucugccuuuuuugcacugaacauaagcacuuuauacuaaugggucacaaaucuug

SEQ ID NO: 551926 - RNA, 66 nt, hsa
uucugaacaaaugaaacucuucuccauuuaaaagaggcacuuuacuuuagacuugccacucugaaa

SEQ ID NO: 551927 - RNA, 66 nt, hsa
ugguauacaugcggcuucauugccaauaaauuucaugcacuuuaaaguccuguggcuugugaccuc

SEQ ID NO: 551928 - RNA, 66 nt, hsa
guggugccacccucucuggcauucaugcagagcaaagcacuuuaaccauuucuuuuaaaaggucua

SEQ ID NO: 551929 - RNA, 66 nt, hsa
aaagguuuuguuucaguuuguaagauuucuuuucuggcacuuuaauggcuugagguaucauuauca

SEQ ID NO: 551930 - RNA, 66 nt, hsa
cuuggcagggcacgguagcucacaccuguaaucccagcacuuuaggaggucaaggugggcagauca

SEQ ID NO: 551931 - RNA, 66 nt, hsa
accaggcuuuuggucuuucaaaauuugugauugaaagcacuuuagugacuuggauuuuguaaaucu

SEQ ID NO: 551932 - RNA, 66 nt, hsa
ucuauuucauucuagaauggaaacgguuccuuaauggcacuuuaaccaguuaacuuggugcaaaac

SEQ ID NO: 551933 - RNA, 66 nt, hsa
gaugaacuuacgugacaaugauuguauuccucaguagcacuuuaaacgccgaagacagcccugcag

SEQ ID NO: 551934 - RNA, 66 nt, hsa
uuccagcugaaaaccugcugugagaguuuugacagagcacuuuauuuucgucaaguuucaagucug

SEQ ID NO: 551935 - RNA, 65 nt, hsa; identical to SEQ ID NO: 192258

SEQ ID NO: 551936 - RNA, 65 nt, hsa; identical to SEQ ID NO: 192259

SEQ ID NO: 551937 - RNA, 65 nt, hsa; identical to SEQ ID NO: 192260

SEQ ID NO: 551938 - RNA, 65 nt, hsa; identical to SEQ ID NO: 192261

SEQ ID NO: 551939 - RNA, 65 nt, hsa; identical to SEQ ID NO: 192262

SEQ ID NO: 551940 - RNA, 65 nt, hsa; identical to SEQ ID NO: 192263

SEQ ID NO: 551941 - RNA, 65 nt, hsa; identical to SEQ ID NO: 192264

SEQ ID NO: 551942 - RNA, 65 nt, hsa; identical to SEQ ID NO: 192265

SEQ ID NO: 551943 - RNA, 65 nt, hsa; identical to SEQ ID NO: 192266

SEQ ID NO: 551944 - RNA, 65 nt, hsa; identical to SEQ ID NO: 192267

SEQ ID NO: 551945 - RNA, 65 nt, hsa; identical to SEQ ID NO: 192268

SEQ ID NO: 551946 - RNA, 65 nt, hsa; identical to SEQ ID NO: 192269

SEQ ID NO: 551947 - RNA, 65 nt, hsa; identical to SEQ ID NO: 192270

SEQ ID NO: 551948 - RNA, 65 nt, hsa; identical to SEQ ID NO: 192271

SEQ ID NO: 551949 - RNA, 65 nt, hsa; identical to SEQ ID NO: 192272

SEQ ID NO: 551950 - RNA, 65 nt, hsa; identical to SEQ ID NO: 192273

SEQ ID NO: 551951 - RNA, 65 nt, hsa; identical to SEQ ID NO: 192274

SEQ ID NO: 551952 - RNA, 65 nt, hsa; identical to SEQ ID NO: 192275

SEQ ID NO: 551953 - RNA, 65 nt, hsa; identical to SEQ ID NO: 192276

SEQ ID NO: 551954 - RNA, 65 nt, hsa; identical to SEQ ID NO: 192277

SEQ ID NO: 551955 - RNA, 65 nt, hsa; identical to SEQ ID NO: 192278

SEQ ID NO: 551956 - RNA, 65 nt, hsa; identical to SEQ ID NO: 192279

SEQ ID NO: 551957 - RNA, 65 nt, hsa; identical to SEQ ID NO: 192280

SEQ ID NO: 551958 - RNA, 65 nt, hsa; identical to SEQ ID NO: 192281

SEQ ID NO: 551959 - RNA, 65 nt, hsa; identical to SEQ ID NO: 192282

SEQ ID NO: 551960 - RNA, 65 nt, hsa; identical to SEQ ID NO: 192283

SEQ ID NO: 551961 - RNA, 65 nt, hsa; identical to SEQ ID NO: 192284

SEQ ID NO: 551962 - RNA, 65 nt, hsa; identical to SEQ ID NO: 192285

SEQ ID NO: 551963 - RNA, 65 nt, hsa; identical to SEQ ID NO: 192286

SEQ ID NO: 551964 - RNA, 65 nt, hsa; identical to SEQ ID NO: 192287

SEQ ID NO: 551965 - RNA, 65 nt, hsa; identical to SEQ ID NO: 192288

SEQ ID NO: 551966 - RNA, 65 nt, hsa; identical to SEQ ID NO: 192289

SEQ ID NO: 551967 - RNA, 65 nt, hsa; identical to SEQ ID NO: 192290

SEQ ID NO: 551968 - RNA, 65 nt, hsa; identical to SEQ ID NO: 192291

SEQ ID NO: 551969 - RNA, 65 nt, hsa; identical to SEQ ID NO: 192292

SEQ ID NO: 551970 - RNA, 65 nt, hsa; identical to SEQ ID NO: 192293

SEQ ID NO: 551971 - RNA, 65 nt, hsa; identical to SEQ ID NO: 192294

SEQ ID NO: 551972 - RNA, 65 nt, hsa; identical to SEQ ID NO: 192295

SEQ ID NO: 551973 - RNA, 65 nt, hsa; identical to SEQ ID NO: 192296

SEQ ID NO: 551974 - RNA, 65 nt, hsa; identical to SEQ ID NO: 192297

SEQ ID NO: 551975 - RNA, 65 nt, hsa; identical to SEQ ID NO: 192298

SEQ ID NO: 551976 - RNA, 65 nt, hsa; identical to SEQ ID NO: 192299

SEQ ID NO: 551977 - RNA, 65 nt, hsa; identical to SEQ ID NO: 192300

SEQ ID NO: 551978 - RNA, 65 nt, hsa; identical to SEQ ID NO: 192301

SEQ ID NO: 551979 - RNA, 65 nt, hsa; identical to SEQ ID NO: 192302

SEQ ID NO: 551980 - RNA, 65 nt, hsa; identical to SEQ ID NO: 192303

SEQ ID NO: 551981 - RNA, 65 nt, hsa; identical to SEQ ID NO: 192304

SEQ ID NO: 551982 - RNA, 65 nt, hsa; identical to SEQ ID NO: 192305

SEQ ID NO: 551983 - RNA, 65 nt, hsa; identical to SEQ ID NO: 192306

SEQ ID NO: 551984 - RNA, 65 nt, hsa; identical to SEQ ID NO: 192307

SEQ ID NO: 551985 - RNA, 65 nt, hsa; identical to SEQ ID NO: 192308

SEQ ID NO: 551986 - RNA, 65 nt, hsa; identical to SEQ ID NO: 192309

SEQ ID NO: 551987 - RNA, 65 nt, hsa; identical to SEQ ID NO: 192310

SEQ ID NO: 551988 - RNA, 65 nt, hsa; identical to SEQ ID NO: 192311

SEQ ID NO: 551989 - RNA, 65 nt, hsa; identical to SEQ ID NO: 192312

SEQ ID NO: 551990 - RNA, 65 nt, hsa; identical to SEQ ID NO: 192313

SEQ ID NO: 551991 - RNA, 65 nt, hsa; identical to SEQ ID NO: 192314

SEQ ID NO: 551992 - RNA, 65 nt, hsa; identical to SEQ ID NO: 192315

SEQ ID NO: 551993 - RNA, 65 nt, hsa; identical to SEQ ID NO: 192316

SEQ ID NO: 551994 - RNA, 65 nt, hsa; identical to SEQ ID NO: 192317

SEQ ID NO: 551995 - RNA, 65 nt, hsa; identical to SEQ ID NO: 192318

SEQ ID NO: 551996 - RNA, 65 nt, hsa; identical to SEQ ID NO: 192319

SEQ ID NO: 551997 - RNA, 65 nt, hsa; identical to SEQ ID NO: 192320

SEQ ID NO: 551998 - RNA, 65 nt, hsa; identical to SEQ ID NO: 192321

SEQ ID NO: 551999 - RNA, 65 nt, hsa; identical to SEQ ID NO: 192322

SEQ ID NO: 552000 - RNA, 65 nt, hsa; identical to SEQ ID NO: 192323

SEQ ID NO: 552001 - RNA, 65 nt, hsa; identical to SEQ ID NO: 192324

SEQ ID NO: 552002 - RNA, 65 nt, hsa; identical to SEQ ID NO: 192325

SEQ ID NO: 552003 - RNA, 65 nt, hsa; identical to SEQ ID NO: 192326

SEQ ID NO: 552004 - RNA, 65 nt, hsa; identical to SEQ ID NO: 192327

SEQ ID NO: 552005 - RNA, 65 nt, hsa; identical to SEQ ID NO: 192328

SEQ ID NO: 552006 - RNA, 65 nt, hsa; identical to SEQ ID NO: 192329

SEQ ID NO: 552007 - RNA, 65 nt, hsa; identical to SEQ ID NO: 192330

SEQ ID NO: 552008 - RNA, 65 nt, hsa; identical to SEQ ID NO: 192331

SEQ ID NO: 552009 - RNA, 65 nt, hsa; identical to SEQ ID NO: 192332

SEQ ID NO: 552010 - RNA, 65 nt, hsa; identical to SEQ ID NO: 192333

SEQ ID NO: 552011 - RNA, 65 nt, hsa; identical to SEQ ID NO: 192334

SEQ ID NO: 552012 - RNA, 65 nt, hsa; identical to SEQ ID NO: 192335

SEQ ID NO: 552013 - RNA, 65 nt, hsa; identical to SEQ ID NO: 192336

SEQ ID NO: 552014 - RNA, 65 nt, hsa; identical to SEQ ID NO: 192337

SEQ ID NO: 552015 - RNA, 65 nt, hsa; identical to SEQ ID NO: 192338

SEQ ID NO: 552016 - RNA, 65 nt, hsa; identical to SEQ ID NO: 192339

SEQ ID NO: 552017 - RNA, 65 nt, hsa; identical to SEQ ID NO: 192340

SEQ ID NO: 552018 - RNA, 65 nt, hsa; identical to SEQ ID NO: 192341

SEQ ID NO: 552019 - RNA, 65 nt, hsa; identical to SEQ ID NO: 192342

SEQ ID NO: 552020 - RNA, 65 nt, hsa; identical to SEQ ID NO: 192343

SEQ ID NO: 552021 - RNA, 65 nt, hsa; identical to SEQ ID NO: 192344

SEQ ID NO: 552022 - RNA, 65 nt, hsa; identical to SEQ ID NO: 192345

SEQ ID NO: 552023 - RNA, 65 nt, hsa; identical to SEQ ID NO: 192346

SEQ ID NO: 552024 - RNA, 65 nt, hsa; identical to SEQ ID NO: 192347

SEQ ID NO: 552025 - RNA, 65 nt, hsa; identical to SEQ ID NO: 192348

SEQ ID NO: 552026 - RNA, 65 nt, hsa; identical to SEQ ID NO: 192349

SEQ ID NO: 552027 - RNA, 65 nt, hsa; identical to SEQ ID NO: 192350

SEQ ID NO: 552028 - RNA, 65 nt, hsa; identical to SEQ ID NO: 192351

SEQ ID NO: 552029 - RNA, 65 nt, hsa; identical to SEQ ID NO: 192352

SEQ ID NO: 552030 - RNA, 65 nt, hsa; identical to SEQ ID NO: 192353

SEQ ID NO: 552031 - RNA, 65 nt, hsa; identical to SEQ ID NO: 192354

SEQ ID NO: 552032 - RNA, 65 nt, hsa; identical to SEQ ID NO: 192355

SEQ ID NO: 552033 - RNA, 65 nt, hsa; identical to SEQ ID NO: 192356

SEQ ID NO: 552034 - RNA, 65 nt, hsa; identical to SEQ ID NO: 192357

SEQ ID NO: 552035 - RNA, 65 nt, hsa; identical to SEQ ID NO: 192358

SEQ ID NO: 552036 - RNA, 65 nt, hsa; identical to SEQ ID NO: 192359

SEQ ID NO: 552037 - RNA, 65 nt, hsa; identical to SEQ ID NO: 192360

SEQ ID NO: 552038 - RNA, 65 nt, hsa; identical to SEQ ID NO: 192361

SEQ ID NO: 552039 - RNA, 65 nt, hsa; identical to SEQ ID NO: 192362

SEQ ID NO: 552040 - RNA, 65 nt, hsa; identical to SEQ ID NO: 192363

SEQ ID NO: 552041 - RNA, 65 nt, hsa; identical to SEQ ID NO: 192364

SEQ ID NO: 552042 - RNA, 65 nt, hsa; identical to SEQ ID NO: 192365

SEQ ID NO: 552043 - RNA, 65 nt, hsa; identical to SEQ ID NO: 192366

SEQ ID NO: 552044 - RNA, 65 nt, hsa; identical to SEQ ID NO: 192367

SEQ ID NO: 552045 - RNA, 65 nt, hsa; identical to SEQ ID NO: 192368

SEQ ID NO: 552046 - RNA, 65 nt, hsa; identical to SEQ ID NO: 192369

SEQ ID NO: 552047 - RNA, 65 nt, hsa; identical to SEQ ID NO: 192370

SEQ ID NO: 552048 - RNA, 65 nt, hsa; identical to SEQ ID NO: 192371

SEQ ID NO: 552049 - RNA, 65 nt, hsa; identical to SEQ ID NO: 192372

SEQ ID NO: 552050 - RNA, 65 nt, hsa; identical to SEQ ID NO: 192373

SEQ ID NO: 552051 - RNA, 65 nt, hsa; identical to SEQ ID NO: 192374

SEQ ID NO: 552052 - RNA, 65 nt, hsa; identical to SEQ ID NO: 192375

SEQ ID NO: 552053 - RNA, 65 nt, hsa; identical to SEQ ID NO: 192376

SEQ ID NO: 552054 - RNA, 65 nt, hsa; identical to SEQ ID NO: 192377

SEQ ID NO: 552055 - RNA, 65 nt, hsa; identical to SEQ ID NO: 192378

SEQ ID NO: 552056 - RNA, 65 nt, hsa; identical to SEQ ID NO: 192379

SEQ ID NO: 552057 - RNA, 65 nt, hsa; identical to SEQ ID NO: 192380

SEQ ID NO: 552058 - RNA, 65 nt, hsa; identical to SEQ ID NO: 192381

SEQ ID NO: 552059 - RNA, 65 nt, hsa; identical to SEQ ID NO: 192382

SEQ ID NO: 552060 - RNA, 65 nt, hsa; identical to SEQ ID NO: 192383

SEQ ID NO: 552061 - RNA, 65 nt, hsa; identical to SEQ ID NO: 192384

SEQ ID NO: 552062 - RNA, 65 nt, hsa; identical to SEQ ID NO: 192385

SEQ ID NO: 552063 - RNA, 65 nt, hsa; identical to SEQ ID NO: 192386

SEQ ID NO: 552064 - RNA, 65 nt, hsa; identical to SEQ ID NO: 192387

SEQ ID NO: 552065 - RNA, 65 nt, hsa; identical to SEQ ID NO: 192388

SEQ ID NO: 552066 - RNA, 65 nt, hsa; identical to SEQ ID NO: 192389

SEQ ID NO: 552067 - RNA, 65 nt, hsa; identical to SEQ ID NO: 192390

SEQ ID NO: 552068 - RNA, 65 nt, hsa; identical to SEQ ID NO: 192391

SEQ ID NO: 552069 - RNA, 65 nt, hsa; identical to SEQ ID NO: 192392

SEQ ID NO: 552070 - RNA, 65 nt, hsa; identical to SEQ ID NO: 192393

SEQ ID NO: 552071 - RNA, 65 nt, hsa; identical to SEQ ID NO: 192394

SEQ ID NO: 552072 - RNA, 65 nt, hsa; identical to SEQ ID NO: 192395

SEQ ID NO: 552073 - RNA, 65 nt, hsa; identical to SEQ ID NO: 192396

SEQ ID NO: 552074 - RNA, 65 nt, hsa; identical to SEQ ID NO: 192397

SEQ ID NO: 552075 - RNA, 65 nt, hsa; identical to SEQ ID NO: 192398

SEQ ID NO: 552076 - RNA, 65 nt, hsa; identical to SEQ ID NO: 192399

SEQ ID NO: 552077 - RNA, 65 nt, hsa; identical to SEQ ID NO: 192400

SEQ ID NO: 552078 - RNA, 65 nt, hsa; identical to SEQ ID NO: 192401

SEQ ID NO: 552079 - RNA, 65 nt, hsa; identical to SEQ ID NO: 192402

SEQ ID NO: 552080 - RNA, 65 nt, hsa; identical to SEQ ID NO: 192403

SEQ ID NO: 552081 - RNA, 65 nt, hsa; identical to SEQ ID NO: 192404

SEQ ID NO: 552082 - RNA, 65 nt, hsa; identical to SEQ ID NO: 192405

SEQ ID NO: 552083 - RNA, 65 nt, hsa; identical to SEQ ID NO: 192406

SEQ ID NO: 552084 - RNA, 65 nt, hsa; identical to SEQ ID NO: 192407

SEQ ID NO: 552085 - RNA, 65 nt, hsa; identical to SEQ ID NO: 192408

SEQ ID NO: 552086 - RNA, 65 nt, hsa; identical to SEQ ID NO: 192409

SEQ ID NO: 552087 - RNA, 65 nt, hsa; identical to SEQ ID NO: 192410

SEQ ID NO: 552088 - RNA, 65 nt, hsa; identical to SEQ ID NO: 192411

SEQ ID NO: 552089 - RNA, 65 nt, hsa; identical to SEQ ID NO: 192412

SEQ ID NO: 552090 - RNA, 65 nt, hsa; identical to SEQ ID NO: 192413

SEQ ID NO: 552091 - RNA, 65 nt, hsa; identical to SEQ ID NO: 192414

SEQ ID NO: 552092 - RNA, 65 nt, hsa; identical to SEQ ID NO: 192415

SEQ ID NO: 552093 - RNA, 65 nt, hsa; identical to SEQ ID NO: 192416

SEQ ID NO: 552094 - RNA, 65 nt, hsa; identical to SEQ ID NO: 192417

SEQ ID NO: 552095 - RNA, 65 nt, hsa; identical to SEQ ID NO: 192418

SEQ ID NO: 552096 - RNA, 65 nt, hsa; identical to SEQ ID NO: 192419

SEQ ID NO: 552097 - RNA, 65 nt, hsa; identical to SEQ ID NO: 192420

SEQ ID NO: 552098 - RNA, 65 nt, hsa; identical to SEQ ID NO: 192421

SEQ ID NO: 552099 - RNA, 65 nt, hsa; identical to SEQ ID NO: 192422

SEQ ID NO: 552100 - RNA, 65 nt, hsa; identical to SEQ ID NO: 192423

SEQ ID NO: 552101 - RNA, 65 nt, hsa; identical to SEQ ID NO: 192424

SEQ ID NO: 552102 - RNA, 65 nt, hsa; identical to SEQ ID NO: 192425

SEQ ID NO: 552103 - RNA, 65 nt, hsa; identical to SEQ ID NO: 192426

SEQ ID NO: 552104 - RNA, 65 nt, hsa; identical to SEQ ID NO: 192427

SEQ ID NO: 552105 - RNA, 65 nt, hsa; identical to SEQ ID NO: 192428

SEQ ID NO: 552106 - RNA, 65 nt, hsa; identical to SEQ ID NO: 192429

SEQ ID NO: 552107 - RNA, 65 nt, hsa; identical to SEQ ID NO: 192430

SEQ ID NO: 552108 - RNA, 65 nt, hsa; identical to SEQ ID NO: 192431

SEQ ID NO: 552109 - RNA, 65 nt, hsa; identical to SEQ ID NO: 192432

SEQ ID NO: 552110 - RNA, 65 nt, hsa; identical to SEQ ID NO: 192433

SEQ ID NO: 552111 - RNA, 65 nt, hsa; identical to SEQ ID NO: 192434

SEQ ID NO: 552112 - RNA, 65 nt, hsa; identical to SEQ ID NO: 192435

SEQ ID NO: 552113 - RNA, 65 nt, hsa; identical to SEQ ID NO: 192436

SEQ ID NO: 552114 - RNA, 65 nt, hsa; identical to SEQ ID NO: 192437

SEQ ID NO: 552115 - RNA, 65 nt, hsa; identical to SEQ ID NO: 192438

SEQ ID NO: 552116 - RNA, 65 nt, hsa; identical to SEQ ID NO: 192439

SEQ ID NO: 552117 - RNA, 65 nt, hsa; identical to SEQ ID NO: 192440

SEQ ID NO: 552118 - RNA, 65 nt, hsa; identical to SEQ ID NO: 192441

SEQ ID NO: 552119 - RNA, 65 nt, hsa; identical to SEQ ID NO: 192442

SEQ ID NO: 552120 - RNA, 65 nt, hsa; identical to SEQ ID NO: 192443

SEQ ID NO: 552121 - RNA, 65 nt, hsa; identical to SEQ ID NO: 192444

SEQ ID NO: 552122 - RNA, 65 nt, hsa; identical to SEQ ID NO: 192445

SEQ ID NO: 552123 - RNA, 65 nt, hsa; identical to SEQ ID NO: 192446

SEQ ID NO: 552124 - RNA, 65 nt, hsa; identical to SEQ ID NO: 192447

SEQ ID NO: 552125 - RNA, 65 nt, hsa; identical to SEQ ID NO: 192448

SEQ ID NO: 552126 - RNA, 65 nt, hsa; identical to SEQ ID NO: 192449

SEQ ID NO: 552127 - RNA, 65 nt, hsa; identical to SEQ ID NO: 192450

SEQ ID NO: 552128 - RNA, 65 nt, hsa; identical to SEQ ID NO: 192451

SEQ ID NO: 552129 - RNA, 65 nt, hsa; identical to SEQ ID NO: 192452

SEQ ID NO: 552130 - RNA, 65 nt, hsa; identical to SEQ ID NO: 192453

SEQ ID NO: 552131 - RNA, 65 nt, hsa; identical to SEQ ID NO: 192454

SEQ ID NO: 552132 - RNA, 65 nt, hsa; identical to SEQ ID NO: 192455

SEQ ID NO: 552133 - RNA, 65 nt, hsa; identical to SEQ ID NO: 192456

SEQ ID NO: 552134 - RNA, 65 nt, hsa; identical to SEQ ID NO: 192457

SEQ ID NO: 552135 - RNA, 65 nt, hsa; identical to SEQ ID NO: 192458

SEQ ID NO: 552136 - RNA, 65 nt, hsa; identical to SEQ ID NO: 192459

SEQ ID NO: 552137 - RNA, 65 nt, hsa; identical to SEQ ID NO: 192460

SEQ ID NO: 552138 - RNA, 65 nt, hsa; identical to SEQ ID NO: 192461

SEQ ID NO: 552139 - RNA, 65 nt, hsa; identical to SEQ ID NO: 192462

SEQ ID NO: 552140 - RNA, 65 nt, hsa; identical to SEQ ID NO: 192463

SEQ ID NO: 552141 - RNA, 51 nt, hsa; identical to SEQ ID NO: 192464

SEQ ID NO: 552142 - RNA, 65 nt, hsa; identical to SEQ ID NO: 192465

SEQ ID NO: 552143 - RNA, 65 nt, hsa; identical to SEQ ID NO: 192466

SEQ ID NO: 552144 - RNA, 65 nt, hsa; identical to SEQ ID NO: 192467

SEQ ID NO: 552145 - RNA, 65 nt, hsa; identical to SEQ ID NO: 192468

SEQ ID NO: 552146 - RNA, 65 nt, hsa; identical to SEQ ID NO: 192469

SEQ ID NO: 552147 - RNA, 65 nt, hsa; identical to SEQ ID NO: 192470

SEQ ID NO: 552148 - RNA, 65 nt, hsa; identical to SEQ ID NO: 192471

SEQ ID NO: 552149 - RNA, 65 nt, hsa; identical to SEQ ID NO: 192472

SEQ ID NO: 552150 - RNA, 65 nt, hsa; identical to SEQ ID NO: 192473

SEQ ID NO: 552151 - RNA, 65 nt, hsa; identical to SEQ ID NO: 192474

SEQ ID NO: 552152 - RNA, 65 nt, hsa; identical to SEQ ID NO: 192475

SEQ ID NO: 552153 - RNA, 65 nt, hsa; identical to SEQ ID NO: 192476

SEQ ID NO: 552154 - RNA, 65 nt, hsa; identical to SEQ ID NO: 192477

SEQ ID NO: 552155 - RNA, 65 nt, hsa; identical to SEQ ID NO: 192478

SEQ ID NO: 552156 - RNA, 65 nt, hsa; identical to SEQ ID NO: 192479

SEQ ID NO: 552157 - RNA, 65 nt, hsa; identical to SEQ ID NO: 192480

SEQ ID NO: 552158 - RNA, 65 nt, hsa; identical to SEQ ID NO: 192481

SEQ ID NO: 552159 - RNA, 65 nt, hsa; identical to SEQ ID NO: 192482

SEQ ID NO: 552160 - RNA, 65 nt, hsa; identical to SEQ ID NO: 192483

SEQ ID NO: 552161 - RNA, 65 nt, hsa; identical to SEQ ID NO: 192484

SEQ ID NO: 552162 - RNA, 65 nt, hsa; identical to SEQ ID NO: 192485

SEQ ID NO: 552163 - RNA, 65 nt, hsa; identical to SEQ ID NO: 192486

SEQ ID NO: 552164 - RNA, 65 nt, hsa; identical to SEQ ID NO: 192487

SEQ ID NO: 552165 - RNA, 65 nt, hsa; identical to SEQ ID NO: 192488

SEQ ID NO: 552166 - RNA, 65 nt, hsa; identical to SEQ ID NO: 192489

SEQ ID NO: 552167 - RNA, 65 nt, hsa; identical to SEQ ID NO: 192490

SEQ ID NO: 552168 - RNA, 65 nt, hsa; identical to SEQ ID NO: 192491

SEQ ID NO: 552169 - RNA, 65 nt, hsa; identical to SEQ ID NO: 192492

SEQ ID NO: 552170 - RNA, 65 nt, hsa; identical to SEQ ID NO: 192493

SEQ ID NO: 552171 - RNA, 65 nt, hsa; identical to SEQ ID NO: 192494

SEQ ID NO: 552172 - RNA, 65 nt, hsa; identical to SEQ ID NO: 192495

SEQ ID NO: 552173 - RNA, 65 nt, hsa; identical to SEQ ID NO: 192496

SEQ ID NO: 552174 - RNA, 65 nt, hsa; identical to SEQ ID NO: 192497

SEQ ID NO: 552175 - RNA, 65 nt, hsa; identical to SEQ ID NO: 192498

SEQ ID NO: 552176 - RNA, 65 nt, hsa; identical to SEQ ID NO: 192499

SEQ ID NO: 552177 - RNA, 65 nt, hsa; identical to SEQ ID NO: 192500

SEQ ID NO: 552178 - RNA, 65 nt, hsa; identical to SEQ ID NO: 192501

SEQ ID NO: 552179 - RNA, 65 nt, hsa; identical to SEQ ID NO: 192502

SEQ ID NO: 552180 - RNA, 65 nt, hsa; identical to SEQ ID NO: 192503

SEQ ID NO: 552181 - RNA, 65 nt, hsa; identical to SEQ ID NO: 192504

SEQ ID NO: 552182 - RNA, 65 nt, hsa; identical to SEQ ID NO: 192505

SEQ ID NO: 552183 - RNA, 65 nt, hsa; identical to SEQ ID NO: 192506

SEQ ID NO: 552184 - RNA, 65 nt, hsa; identical to SEQ ID NO: 192507

SEQ ID NO: 552185 - RNA, 65 nt, hsa; identical to SEQ ID NO: 192508

SEQ ID NO: 552186 - RNA, 65 nt, hsa; identical to SEQ ID NO: 192509

SEQ ID NO: 552187 - RNA, 65 nt, hsa; identical to SEQ ID NO: 192510

SEQ ID NO: 552188 - RNA, 65 nt, hsa; identical to SEQ ID NO: 192511

SEQ ID NO: 552189 - RNA, 65 nt, hsa; identical to SEQ ID NO: 192512

SEQ ID NO: 552190 - RNA, 65 nt, hsa; identical to SEQ ID NO: 192513

SEQ ID NO: 552191 - RNA, 65 nt, hsa; identical to SEQ ID NO: 192514

SEQ ID NO: 552192 - RNA, 65 nt, hsa; identical to SEQ ID NO: 192515

SEQ ID NO: 552193 - RNA, 65 nt, hsa; identical to SEQ ID NO: 192516

SEQ ID NO: 552194 - RNA, 65 nt, hsa; identical to SEQ ID NO: 192517

SEQ ID NO: 552195 - RNA, 65 nt, hsa; identical to SEQ ID NO: 192518

SEQ ID NO: 552196 - RNA, 65 nt, hsa; identical to SEQ ID NO: 192519

SEQ ID NO: 552197 - RNA, 65 nt, hsa; identical to SEQ ID NO: 192520

SEQ ID NO: 552198 - RNA, 65 nt, hsa; identical to SEQ ID NO: 192521

SEQ ID NO: 552199 - RNA, 65 nt, hsa; identical to SEQ ID NO: 192522

SEQ ID NO: 552200 - RNA, 65 nt, hsa; identical to SEQ ID NO: 192523

SEQ ID NO: 552201 - RNA, 65 nt, hsa; identical to SEQ ID NO: 192524

SEQ ID NO: 552202 - RNA, 65 nt, hsa; identical to SEQ ID NO: 192525

SEQ ID NO: 552203 - RNA, 65 nt, hsa; identical to SEQ ID NO: 192526

SEQ ID NO: 552204 - RNA, 65 nt, hsa; identical to SEQ ID NO: 192527

SEQ ID NO: 552205 - RNA, 65 nt, hsa; identical to SEQ ID NO: 192528

SEQ ID NO: 552206 - RNA, 65 nt, hsa; identical to SEQ ID NO: 192529

SEQ ID NO: 552207 - RNA, 65 nt, hsa; identical to SEQ ID NO: 192530

SEQ ID NO: 552208 - RNA, 65 nt, hsa; identical to SEQ ID NO: 192531

SEQ ID NO: 552209 - RNA, 53 nt, hsa; identical to SEQ ID NO: 192532

SEQ ID NO: 552210 - RNA, 65 nt, hsa; identical to SEQ ID NO: 192533

SEQ ID NO: 552211 - RNA, 65 nt, hsa; identical to SEQ ID NO: 192534

SEQ ID NO: 552212 - RNA, 65 nt, hsa; identical to SEQ ID NO: 192535

SEQ ID NO: 552213 - RNA, 65 nt, hsa; identical to SEQ ID NO: 192536

SEQ ID NO: 552214 - RNA, 65 nt, hsa; identical to SEQ ID NO: 192537

SEQ ID NO: 552215 - RNA, 65 nt, hsa; identical to SEQ ID NO: 192538

SEQ ID NO: 552216 - RNA, 65 nt, hsa; identical to SEQ ID NO: 192539

SEQ ID NO: 552217 - RNA, 65 nt, hsa; identical to SEQ ID NO: 192540

SEQ ID NO: 552218 - RNA, 65 nt, hsa; identical to SEQ ID NO: 192541

SEQ ID NO: 552219 - RNA, 65 nt, hsa; identical to SEQ ID NO: 192542

SEQ ID NO: 552220 - RNA, 65 nt, hsa; identical to SEQ ID NO: 192543

SEQ ID NO: 552221 - RNA, 65 nt, hsa; identical to SEQ ID NO: 192544

SEQ ID NO: 552222 - RNA, 65 nt, hsa; identical to SEQ ID NO: 192545

SEQ ID NO: 552223 - RNA, 65 nt, hsa; identical to SEQ ID NO: 192546

SEQ ID NO: 552224 - RNA, 65 nt, hsa; identical to SEQ ID NO: 192547

SEQ ID NO: 552225 - RNA, 65 nt, hsa; identical to SEQ ID NO: 192548

SEQ ID NO: 552226 - RNA, 65 nt, hsa; identical to SEQ ID NO: 192549

SEQ ID NO: 552227 - RNA, 65 nt, hsa; identical to SEQ ID NO: 192550

SEQ ID NO: 552228 - RNA, 65 nt, hsa; identical to SEQ ID NO: 192551

SEQ ID NO: 552229 - RNA, 65 nt, hsa; identical to SEQ ID NO: 192552

SEQ ID NO: 552230 - RNA, 65 nt, hsa; identical to SEQ ID NO: 192553

SEQ ID NO: 552231 - RNA, 65 nt, hsa; identical to SEQ ID NO: 192554

SEQ ID NO: 552232 - RNA, 65 nt, hsa; identical to SEQ ID NO: 192555

SEQ ID NO: 552233 - RNA, 65 nt, hsa; identical to SEQ ID NO: 192556

SEQ ID NO: 552234 - RNA, 65 nt, hsa; identical to SEQ ID NO: 192557

SEQ ID NO: 552235 - RNA, 65 nt, hsa; identical to SEQ ID NO: 192558

SEQ ID NO: 552236 - RNA, 65 nt, hsa; identical to SEQ ID NO: 192559

SEQ ID NO: 552237 - RNA, 65 nt, hsa; identical to SEQ ID NO: 192560

SEQ ID NO: 552238 - RNA, 65 nt, hsa; identical to SEQ ID NO: 192561

SEQ ID NO: 552239 - RNA, 65 nt, hsa; identical to SEQ ID NO: 192562

SEQ ID NO: 552240 - RNA, 65 nt, hsa; identical to SEQ ID NO: 192563

SEQ ID NO: 552241 - RNA, 65 nt, hsa; identical to SEQ ID NO: 192564

SEQ ID NO: 552242 - RNA, 65 nt, hsa; identical to SEQ ID NO: 192565

SEQ ID NO: 552243 - RNA, 65 nt, hsa; identical to SEQ ID NO: 192566

SEQ ID NO: 552244 - RNA, 65 nt, hsa; identical to SEQ ID NO: 192567

SEQ ID NO: 552245 - RNA, 65 nt, hsa; identical to SEQ ID NO: 192568

SEQ ID NO: 552246 - RNA, 65 nt, hsa; identical to SEQ ID NO: 192569

SEQ ID NO: 552247 - RNA, 65 nt, hsa; identical to SEQ ID NO: 192570

SEQ ID NO: 552248 - RNA, 65 nt, hsa; identical to SEQ ID NO: 192571

SEQ ID NO: 552249 - RNA, 65 nt, hsa; identical to SEQ ID NO: 192572

SEQ ID NO: 552250 - RNA, 65 nt, hsa; identical to SEQ ID NO: 192573

SEQ ID NO: 552251 - RNA, 65 nt, hsa; identical to SEQ ID NO: 192574

SEQ ID NO: 552252 - RNA, 65 nt, hsa; identical to SEQ ID NO: 192575

SEQ ID NO: 552253 - RNA, 65 nt, hsa; identical to SEQ ID NO: 192296

SEQ ID NO: 552254 - RNA, 65 nt, hsa; identical to SEQ ID NO: 192577

SEQ ID NO: 552255 - RNA, 65 nt, hsa; identical to SEQ ID NO: 192578

SEQ ID NO: 552256 - RNA, 65 nt, hsa; identical to SEQ ID NO: 192579

SEQ ID NO: 552257 - RNA, 65 nt, hsa; identical to SEQ ID NO: 192580

SEQ ID NO: 552258 - RNA, 65 nt, hsa; identical to SEQ ID NO: 192581

SEQ ID NO: 552259 - RNA, 65 nt, hsa; identical to SEQ ID NO: 192582

SEQ ID NO: 552260 - RNA, 65 nt, hsa; identical to SEQ ID NO: 192583

SEQ ID NO: 552261 - RNA, 65 nt, hsa; identical to SEQ ID NO: 192584

SEQ ID NO: 552262 - RNA, 65 nt, hsa; identical to SEQ ID NO: 192585

SEQ ID NO: 552263 - RNA, 65 nt, hsa; identical to SEQ ID NO: 192586

SEQ ID NO: 552264 - RNA, 65 nt, hsa; identical to SEQ ID NO: 192587

SEQ ID NO: 552265 - RNA, 65 nt, hsa; identical to SEQ ID NO: 192588

SEQ ID NO: 552266 - RNA, 65 nt, hsa; identical to SEQ ID NO: 192589

SEQ ID NO: 552267 - RNA, 65 nt, hsa; identical to SEQ ID NO: 192590

SEQ ID NO: 552268 - RNA, 65 nt, hsa; identical to SEQ ID NO: 192591

SEQ ID NO: 552269 - RNA, 65 nt, hsa; identical to SEQ ID NO: 192592

SEQ ID NO: 552270 - RNA, 65 nt, hsa; identical to SEQ ID NO: 192593

SEQ ID NO: 552271 - RNA, 65 nt, hsa; identical to SEQ ID NO: 192594

SEQ ID NO: 552272 - RNA, 65 nt, hsa; identical to SEQ ID NO: 192595

SEQ ID NO: 552273 - RNA, 65 nt, hsa; identical to SEQ ID NO: 192596

SEQ ID NO: 552274 - RNA, 65 nt, hsa; identical to SEQ ID NO: 192597

SEQ ID NO: 552275 - RNA, 65 nt, hsa; identical to SEQ ID NO: 192598

SEQ ID NO: 552276 - RNA, 65 nt, hsa; identical to SEQ ID NO: 192599

SEQ ID NO: 552277 - RNA, 65 nt, hsa; identical to SEQ ID NO: 192600

SEQ ID NO: 552278 - RNA, 65 nt, hsa; identical to SEQ ID NO: 192601

SEQ ID NO: 552279 - RNA, 65 nt, hsa; identical to SEQ ID NO: 192602

SEQ ID NO: 552280 - RNA, 65 nt, hsa; identical to SEQ ID NO: 192603

SEQ ID NO: 552281 - RNA, 65 nt, hsa; identical to SEQ ID NO: 192604

SEQ ID NO: 552282 - RNA, 65 nt, hsa; identical to SEQ ID NO: 192605

SEQ ID NO: 552283 - RNA, 65 nt, hsa; identical to SEQ ID NO: 192606

SEQ ID NO: 552284 - RNA, 65 nt, hsa; identical to SEQ ID NO: 192607

SEQ ID NO: 552285 - RNA, 65 nt, hsa; identical to SEQ ID NO: 192608

SEQ ID NO: 552286 - RNA, 65 nt, hsa; identical to SEQ ID NO: 192609

SEQ ID NO: 552287 - RNA, 65 nt, hsa; identical to SEQ ID NO: 192610

SEQ ID NO: 552288 - RNA, 65 nt, hsa; identical to SEQ ID NO: 192611

SEQ ID NO: 552289 - RNA, 65 nt, hsa; identical to SEQ ID NO: 192612

SEQ ID NO: 552290 - RNA, 65 nt, hsa; identical to SEQ ID NO: 192613

SEQ ID NO: 552291 - RNA, 65 nt, hsa; identical to SEQ ID NO: 192614

SEQ ID NO: 552292 - RNA, 65 nt, hsa; identical to SEQ ID NO: 192615

SEQ ID NO: 552293 - RNA, 65 nt, hsa; identical to SEQ ID NO: 192616

SEQ ID NO: 552294 - RNA, 65 nt, hsa; identical to SEQ ID NO: 192617

SEQ ID NO: 552295 - RNA, 65 nt, hsa; identical to SEQ ID NO: 192618

SEQ ID NO: 552296 - RNA, 65 nt, hsa; identical to SEQ ID NO: 192619

SEQ ID NO: 552297 - RNA, 65 nt, hsa; identical to SEQ ID NO: 192620

SEQ ID NO: 552298 - RNA, 65 nt, hsa; identical to SEQ ID NO: 192621

SEQ ID NO: 552299 - RNA, 65 nt, hsa; identical to SEQ ID NO: 192622

SEQ ID NO: 552300 - RNA, 65 nt, hsa; identical to SEQ ID NO: 192623

SEQ ID NO: 552301 - RNA, 65 nt, hsa; identical to SEQ ID NO: 192624

SEQ ID NO: 552302 - RNA, 65 nt, hsa; identical to SEQ ID NO: 192625

SEQ ID NO: 552303 - RNA, 65 nt, hsa; identical to SEQ ID NO: 192626

SEQ ID NO: 552304 - RNA, 65 nt, hsa; identical to SEQ ID NO: 192627

SEQ ID NO: 552305 - RNA, 65 nt, hsa; identical to SEQ ID NO: 192628

SEQ ID NO: 552306 - RNA, 65 nt, hsa; identical to SEQ ID NO: 192629

SEQ ID NO: 552307 - RNA, 65 nt, hsa; identical to SEQ ID NO: 192630

SEQ ID NO: 552308 - RNA, 65 nt, hsa; identical to SEQ ID NO: 192631

SEQ ID NO: 552309 - RNA, 65 nt, hsa; identical to SEQ ID NO: 192632

SEQ ID NO: 552310 - RNA, 65 nt, hsa; identical to SEQ ID NO: 192633

SEQ ID NO: 552311 - RNA, 65 nt, hsa; identical to SEQ ID NO: 192634

SEQ ID NO: 552312 - RNA, 65 nt, hsa; identical to SEQ ID NO: 192635

SEQ ID NO: 552313 - RNA, 65 nt, hsa; identical to SEQ ID NO: 192636

SEQ ID NO: 552314 - RNA, 65 nt, hsa; identical to SEQ ID NO: 192637

SEQ ID NO: 552315 - RNA, 65 nt, hsa; identical to SEQ ID NO: 192638

SEQ ID NO: 552316 - RNA, 65 nt, hsa; identical to SEQ ID NO: 192639

SEQ ID NO: 552317 - RNA, 65 nt, hsa; identical to SEQ ID NO: 192640

SEQ ID NO: 552318 - RNA, 65 nt, hsa; identical to SEQ ID NO: 192641

SEQ ID NO: 552319 - RNA, 65 nt, hsa; identical to SEQ ID NO: 192642

SEQ ID NO: 552320 - RNA, 65 nt, hsa; identical to SEQ ID NO: 192643

SEQ ID NO: 552321 - RNA, 65 nt, hsa; identical to SEQ ID NO: 192644

SEQ ID NO: 552322 - RNA, 65 nt, hsa; identical to SEQ ID NO: 192645

SEQ ID NO: 552323 - RNA, 65 nt, hsa; identical to SEQ ID NO: 192646

SEQ ID NO: 552324 - RNA, 65 nt, hsa; identical to SEQ ID NO: 192647

SEQ ID NO: 552325 - RNA, 65 nt, hsa; identical to SEQ ID NO: 192648

SEQ ID NO: 552326 - RNA, 65 nt, hsa; identical to SEQ ID NO: 192649

SEQ ID NO: 552327 - RNA, 51 nt, hsa; identical to SEQ ID NO: 192650

SEQ ID NO: 552328 - RNA, 65 nt, hsa; identical to SEQ ID NO: 192651

SEQ ID NO: 552329 - RNA, 65 nt, hsa; identical to SEQ ID NO: 192652

SEQ ID NO: 552330 - RNA, 65 nt, hsa; identical to SEQ ID NO: 192653

SEQ ID NO: 552331 - RNA, 65 nt, hsa; identical to SEQ ID NO: 192654

SEQ ID NO: 552332 - RNA, 65 nt, hsa; identical to SEQ ID NO: 192655

SEQ ID NO: 552333 - RNA, 65 nt, hsa; identical to SEQ ID NO: 192656

SEQ ID NO: 552334 - RNA, 65 nt, hsa; identical to SEQ ID NO: 192657

SEQ ID NO: 552335 - RNA, 65 nt, hsa; identical to SEQ ID NO: 192658

SEQ ID NO: 552336 - RNA, 65 nt, hsa; identical to SEQ ID NO: 192659

SEQ ID NO: 552337 - RNA, 65 nt, hsa; identical to SEQ ID NO: 192660

SEQ ID NO: 552338 - RNA, 65 nt, hsa; identical to SEQ ID NO: 192661

SEQ ID NO: 552339 - RNA, 65 nt, hsa; identical to SEQ ID NO: 192662

SEQ ID NO: 552340 - RNA, 65 nt, hsa; identical to SEQ ID NO: 192663

SEQ ID NO: 552341 - RNA, 65 nt, hsa; identical to SEQ ID NO: 192664

SEQ ID NO: 552342 - RNA, 65 nt, hsa; identical to SEQ ID NO: 192665

SEQ ID NO: 552343 - RNA, 65 nt, hsa; identical to SEQ ID NO: 192666

SEQ ID NO: 552344 - RNA, 65 nt, hsa; identical to SEQ ID NO: 192667

SEQ ID NO: 552345 - RNA, 65 nt, hsa; identical to SEQ ID NO: 192668

SEQ ID NO: 552346 - RNA, 65 nt, hsa; identical to SEQ ID NO: 192669

SEQ ID NO: 552347 - RNA, 65 nt, hsa; identical to SEQ ID NO: 192670

SEQ ID NO: 552348 - RNA, 65 nt, hsa; identical to SEQ ID NO: 192671

SEQ ID NO: 552349 - RNA, 65 nt, hsa; identical to SEQ ID NO: 192672

SEQ ID NO: 552350 - RNA, 65 nt, hsa; identical to SEQ ID NO: 192673

SEQ ID NO: 552351 - RNA, 65 nt, hsa; identical to SEQ ID NO: 192674

SEQ ID NO: 552352 - RNA, 65 nt, hsa; identical to SEQ ID NO: 192675

SEQ ID NO: 552353 - RNA, 65 nt, hsa; identical to SEQ ID NO: 192676

SEQ ID NO: 552354 - RNA, 65 nt, hsa; identical to SEQ ID NO: 192677

SEQ ID NO: 552355 - RNA, 65 nt, hsa; identical to SEQ ID NO: 192678

SEQ ID NO: 552356 - RNA, 65 nt, hsa; identical to SEQ ID NO: 192679

SEQ ID NO: 552357 - RNA, 65 nt, hsa; identical to SEQ ID NO: 192680

SEQ ID NO: 552358 - RNA, 64 nt, hsa; identical to SEQ ID NO: 165556

SEQ ID NO: 552359 - RNA, 64 nt, hsa; identical to SEQ ID NO: 165557

SEQ ID NO: 552360 - RNA, 64 nt, hsa; identical to SEQ ID NO: 165558

SEQ ID NO: 552361 - RNA, 64 nt, hsa; identical to SEQ ID NO: 165559

SEQ ID NO: 552362 - RNA, 64 nt, hsa; identical to SEQ ID NO: 165560

SEQ ID NO: 552363 - RNA, 64 nt, hsa; identical to SEQ ID NO: 165561

SEQ ID NO: 552364 - RNA, 64 nt, hsa; identical to SEQ ID NO: 165562

SEQ ID NO: 552365 - RNA, 64 nt, hsa; identical to SEQ ID NO: 165563

SEQ ID NO: 552366 - RNA, 64 nt, hsa; identical to SEQ ID NO: 165564

SEQ ID NO: 552367 - RNA, 64 nt, hsa; identical to SEQ ID NO: 165565

SEQ ID NO: 552368 - RNA, 64 nt, hsa; identical to SEQ ID NO: 165566

SEQ ID NO: 552369 - RNA, 64 nt, hsa; identical to SEQ ID NO: 165567

SEQ ID NO: 552370 - RNA, 64 nt, hsa; identical to SEQ ID NO: 165568

SEQ ID NO: 552371 - RNA, 64 nt, hsa; identical to SEQ ID NO: 165569

SEQ ID NO: 552372 - RNA, 64 nt, hsa; identical to SEQ ID NO: 165570

SEQ ID NO: 552373 - RNA, 64 nt, hsa; identical to SEQ ID NO: 165571

SEQ ID NO: 552374 - RNA, 64 nt, hsa; identical to SEQ ID NO: 165572

SEQ ID NO: 552375 - RNA, 64 nt, hsa; identical to SEQ ID NO: 165573

SEQ ID NO: 552376 - RNA, 64 nt, hsa; identical to SEQ ID NO: 165574

SEQ ID NO: 552377 - RNA, 64 nt, hsa; identical to SEQ ID NO: 165575

SEQ ID NO: 552378 - RNA, 64 nt, hsa; identical to SEQ ID NO: 165576

SEQ ID NO: 552379 - RNA, 64 nt, hsa; identical to SEQ ID NO: 165577

SEQ ID NO: 552380 - RNA, 64 nt, hsa; identical to SEQ ID NO: 165578

SEQ ID NO: 552381 - RNA, 64 nt, hsa; identical to SEQ ID NO: 165579

SEQ ID NO: 552382 - RNA, 64 nt, hsa; identical to SEQ ID NO: 165580

SEQ ID NO: 552383 - RNA, 64 nt, hsa; identical to SEQ ID NO: 165581

SEQ ID NO: 552384 - RNA, 64 nt, hsa; identical to SEQ ID NO: 94944

SEQ ID NO: 552385 - RNA, 64 nt, hsa; identical to SEQ ID NO: 94945

SEQ ID NO: 552386 - RNA, 64 nt, hsa; identical to SEQ ID NO: 94946

SEQ ID NO: 552387 - RNA, 64 nt, hsa; identical to SEQ ID NO: 94947

SEQ ID NO: 552388 - RNA, 64 nt, hsa; identical to SEQ ID NO: 94948

SEQ ID NO: 552389 - RNA, 64 nt, hsa; identical to SEQ ID NO: 94949

SEQ ID NO: 552390 - RNA, 64 nt, hsa; identical to SEQ ID NO: 94950

SEQ ID NO: 552391 - RNA, 59 nt, hsa; identical to SEQ ID NO: 94951

SEQ ID NO: 552392 - RNA, 64 nt, hsa; identical to SEQ ID NO: 94952

SEQ ID NO: 552393 - RNA, 64 nt, hsa; identical to SEQ ID NO: 94953

SEQ ID NO: 552394 - RNA, 62 nt, hsa; identical to SEQ ID NO: 94954

SEQ ID NO: 552395 - RNA, 64 nt, hsa; identical to SEQ ID NO: 94955

SEQ ID NO: 552396 - RNA, 64 nt, hsa
cauuccaugacgacauacaugcuacuuuuuuuuaguucaauacagugaaggucuuuguuaugac

SEQ ID NO: 552397 - RNA, 64 nt, hsa
cuucaguccuccucuccuuuuuauuuuaggcacuguucaauacuguaugccuucuguauuuuaa

SEQ ID NO: 552398 - RNA, 64 nt, hsa
uaaauauuggcauacguuaucagcaacuuccccuguucaauaguaugggaaaaauaagaugacu

SEQ ID NO: 552399 - RNA, 64 nt, hsa
auaaauaucaucucuagcacugccauccaauuuaguucaauaaaauucaaauauaaguuuccau

SEQ ID NO: 552400 - RNA, 64 nt, hsa
guuuuagucaaguaauggcuuuugaaaaaguaaaguucaauaauaacuaaggcugugauuuuuu

SEQ ID NO: 552401 - RNA, 64 nt, hsa
uuauacaagggcugugcuaugcuaccauauucuuguucaauaauaauagguuuguuguuuuuuu

SEQ ID NO: 552402 - RNA, 64 nt, hsa
caaaacaguccaggccaaagaggaagcauuucauguucaauaagaaacccagccauuccgcaug

SEQ ID NO: 552403 - RNA, 64 nt, hsa
ccacauuaucagagagcacugugcaagccaaaugguucaauaaugaaugaaaauucugggugua

SEQ ID NO: 552404 - RNA, 64 nt, hsa; identical to SEQ ID NO: 54817

SEQ ID NO: 552405 - RNA, 64 nt, hsa; identical to SEQ ID NO: 54818

SEQ ID NO: 552406 - RNA, 64 nt, hsa; identical to SEQ ID NO: 54819

SEQ ID NO: 552407 - RNA, 64 nt, hsa; identical to SEQ ID NO: 54820

SEQ ID NO: 552408 - RNA, 64 nt, hsa; identical to SEQ ID NO: 54821

SEQ ID NO: 552409 - RNA, 64 nt, hsa; identical to SEQ ID NO: 54822

SEQ ID NO: 552410 - RNA, 64 nt, hsa; identical to SEQ ID NO: 54823

SEQ ID NO: 552411 - RNA, 64 nt, hsa; identical to SEQ ID NO: 54824

SEQ ID NO: 552412 - RNA, 64 nt, hsa; identical to SEQ ID NO: 54825

SEQ ID NO: 552413 - RNA, 64 nt, hsa; identical to SEQ ID NO: 54826

SEQ ID NO: 552414 - RNA, 64 nt, hsa; identical to SEQ ID NO: 54827

SEQ ID NO: 552415 - RNA, 64 nt, hsa; identical to SEQ ID NO: 54828

SEQ ID NO: 552416 - RNA, 64 nt, hsa; identical to SEQ ID NO: 54829

SEQ ID NO: 552417 - RNA, 64 nt, hsa; identical to SEQ ID NO: 54830

SEQ ID NO: 552418 - RNA, 64 nt, hsa; identical to SEQ ID NO: 54831

SEQ ID NO: 552419 - RNA, 64 nt, hsa; identical to SEQ ID NO: 54832

SEQ ID NO: 552420 - RNA, 64 nt, hsa; identical to SEQ ID NO: 54833

SEQ ID NO: 552421 - RNA, 64 nt, hsa; identical to SEQ ID NO: 54834

SEQ ID NO: 552422 - RNA, 64 nt, hsa; identical to SEQ ID NO: 54835

SEQ ID NO: 552423 - RNA, 64 nt, hsa; identical to SEQ ID NO: 54836

SEQ ID NO: 552424 - RNA, 64 nt, hsa; identical to SEQ ID NO: 54837

SEQ ID NO: 552425 - RNA, 64 nt, hsa; identical to SEQ ID NO: 54838

SEQ ID NO: 552426 - RNA, 64 nt, hsa; identical to SEQ ID NO: 54839

SEQ ID NO: 552427 - RNA, 64 nt, hsa; identical to SEQ ID NO: 54840

SEQ ID NO: 552428 - RNA, 64 nt, hsa; identical to SEQ ID NO: 54841

SEQ ID NO: 552429 - RNA, 64 nt, hsa; identical to SEQ ID NO: 54842

SEQ ID NO: 552430 - RNA, 64 nt, hsa; identical to SEQ ID NO: 54843

SEQ ID NO: 552431 - RNA, 64 nt, hsa; identical to SEQ ID NO: 54844

SEQ ID NO: 552432 - RNA, 64 nt, hsa; identical to SEQ ID NO: 54845

SEQ ID NO: 552433 - RNA, 64 nt, hsa; identical to SEQ ID NO: 54846

SEQ ID NO: 552434 - RNA, 64 nt, hsa; identical to SEQ ID NO: 54847

SEQ ID NO: 552435 - RNA, 64 nt, hsa; identical to SEQ ID NO: 54848

SEQ ID NO: 552436 - RNA, 64 nt, hsa; identical to SEQ ID NO: 54849

SEQ ID NO: 552437 - RNA, 64 nt, hsa; identical to SEQ ID NO: 54850

SEQ ID NO: 552438 - RNA, 64 nt, hsa; identical to SEQ ID NO: 54851

SEQ ID NO: 552439 - RNA, 64 nt, hsa; identical to SEQ ID NO: 54852

SEQ ID NO: 552440 - RNA, 64 nt, hsa; identical to SEQ ID NO: 54853

SEQ ID NO: 552441 - RNA, 64 nt, hsa; identical to SEQ ID NO: 54854

SEQ ID NO: 552442 - RNA, 64 nt, hsa; identical to SEQ ID NO: 54855

SEQ ID NO: 552443 - RNA, 64 nt, hsa; identical to SEQ ID NO: 54856

SEQ ID NO: 552444 - RNA, 64 nt, hsa; identical to SEQ ID NO: 54857

SEQ ID NO: 552445 - RNA, 64 nt, hsa; identical to SEQ ID NO: 54858

SEQ ID NO: 552446 - RNA, 64 nt, hsa; identical to SEQ ID NO: 54859

SEQ ID NO: 552447 - RNA, 64 nt, hsa; identical to SEQ ID NO: 54860

SEQ ID NO: 552448 - RNA, 64 nt, hsa; identical to SEQ ID NO: 54861

SEQ ID NO: 552449 - RNA, 64 nt, hsa; identical to SEQ ID NO: 54862

SEQ ID NO: 552450 - RNA, 64 nt, hsa; identical to SEQ ID NO: 54863

SEQ ID NO: 552451 - RNA, 64 nt, hsa; identical to SEQ ID NO: 54864

SEQ ID NO: 552452 - RNA, 64 nt, hsa; identical to SEQ ID NO: 54865

SEQ ID NO: 552453 - RNA, 64 nt, hsa; identical to SEQ ID NO: 54866

SEQ ID NO: 552454 - RNA, 64 nt, hsa; identical to SEQ ID NO: 54867

SEQ ID NO: 552455 - RNA, 64 nt, hsa; identical to SEQ ID NO: 54868

SEQ ID NO: 552456 - RNA, 64 nt, hsa; identical to SEQ ID NO: 54869

SEQ ID NO: 552457 - RNA, 64 nt, hsa; identical to SEQ ID NO: 54870

SEQ ID NO: 552458 - RNA, 64 nt, hsa; identical to SEQ ID NO: 54871

SEQ ID NO: 552459 - RNA, 64 nt, hsa; identical to SEQ ID NO: 54872

SEQ ID NO: 552460 - RNA, 64 nt, hsa; identical to SEQ ID NO: 54870

SEQ ID NO: 552461 - RNA, 64 nt, hsa; identical to SEQ ID NO: 54871

SEQ ID NO: 552462 - RNA, 64 nt, hsa; identical to SEQ ID NO: 54872

SEQ ID NO: 552463 - RNA, 64 nt, hsa; identical to SEQ ID NO: 54870

SEQ ID NO: 552464 - RNA, 64 nt, hsa; identical to SEQ ID NO: 54877

SEQ ID NO: 552465 - RNA, 64 nt, hsa; identical to SEQ ID NO: 54878

SEQ ID NO: 552466 - RNA, 64 nt, hsa; identical to SEQ ID NO: 54879

SEQ ID NO: 552467 - RNA, 64 nt, hsa; identical to SEQ ID NO: 54880

SEQ ID NO: 552468 - RNA, 64 nt, hsa; identical to SEQ ID NO: 54881

SEQ ID NO: 552469 - RNA, 64 nt, hsa; identical to SEQ ID NO: 54882

SEQ ID NO: 552470 - RNA, 64 nt, hsa; identical to SEQ ID NO: 54883

SEQ ID NO: 552471 - RNA, 64 nt, hsa; identical to SEQ ID NO: 54884

SEQ ID NO: 552472 - RNA, 64 nt, hsa; identical to SEQ ID NO: 54885

SEQ ID NO: 552473 - RNA, 64 nt, hsa; identical to SEQ ID NO: 54886

SEQ ID NO: 552474 - RNA, 64 nt, hsa; identical to SEQ ID NO: 54887

SEQ ID NO: 552475 - RNA, 64 nt, hsa; identical to SEQ ID NO: 54888

SEQ ID NO: 552476 - RNA, 64 nt, hsa; identical to SEQ ID NO: 54889

SEQ ID NO: 552477 - RNA, 64 nt, hsa; identical to SEQ ID NO: 54890

SEQ ID NO: 552478 - RNA, 64 nt, hsa; identical to SEQ ID NO: 54891

SEQ ID NO: 552479 - RNA, 64 nt, hsa; identical to SEQ ID NO: 54892

SEQ ID NO: 552480 - RNA, 64 nt, hsa; identical to SEQ ID NO: 54893

SEQ ID NO: 552481 - RNA, 64 nt, hsa; identical to SEQ ID NO: 54894

SEQ ID NO: 552482 - RNA, 64 nt, hsa; identical to SEQ ID NO: 54895

SEQ ID NO: 552483 - RNA, 64 nt, hsa; identical to SEQ ID NO: 54896

SEQ ID NO: 552484 - RNA, 64 nt, hsa; identical to SEQ ID NO: 485635

SEQ ID NO: 552485 - RNA, 64 nt, hsa; identical to SEQ ID NO: 485636

SEQ ID NO: 552486 - RNA, 64 nt, hsa; identical to SEQ ID NO: 485637

SEQ ID NO: 552487 - RNA, 64 nt, hsa; identical to SEQ ID NO: 485638

SEQ ID NO: 552488 - RNA, 64 nt, hsa; identical to SEQ ID NO: 485639

SEQ ID NO: 552489 - RNA, 64 nt, hsa; identical to SEQ ID NO: 485640

SEQ ID NO: 552490 - RNA, 64 nt, hsa; identical to SEQ ID NO: 485641

SEQ ID NO: 552491 - RNA, 64 nt, hsa; identical to SEQ ID NO: 485642

SEQ ID NO: 552492 - RNA, 64 nt, hsa; identical to SEQ ID NO: 485643

SEQ ID NO: 552493 - RNA, 64 nt, hsa; identical to SEQ ID NO: 485644

SEQ ID NO: 552494 - RNA, 64 nt, hsa; identical to SEQ ID NO: 485645

SEQ ID NO: 552495 - RNA, 64 nt, hsa; identical to SEQ ID NO: 485646

SEQ ID NO: 552496 - RNA, 64 nt, hsa; identical to SEQ ID NO: 485647

SEQ ID NO: 552497 - RNA, 64 nt, hsa; identical to SEQ ID NO: 485648

SEQ ID NO: 552498 - RNA, 64 nt, hsa; identical to SEQ ID NO: 485649

SEQ ID NO: 552499 - RNA, 64 nt, hsa; identical to SEQ ID NO: 485650

SEQ ID NO: 552500 - RNA, 64 nt, hsa; identical to SEQ ID NO: 485651

SEQ ID NO: 552501 - RNA, 64 nt, hsa; identical to SEQ ID NO: 485652

SEQ ID NO: 552502 - RNA, 64 nt, hsa; identical to SEQ ID NO: 485653

SEQ ID NO: 552503 - RNA, 64 nt, hsa; identical to SEQ ID NO: 485654

SEQ ID NO: 552504 - RNA, 64 nt, hsa; identical to SEQ ID NO: 485655

SEQ ID NO: 552505 - RNA, 64 nt, hsa; identical to SEQ ID NO: 485656

SEQ ID NO: 552506 - RNA, 64 nt, hsa; identical to SEQ ID NO: 485657

SEQ ID NO: 552507 - RNA, 64 nt, hsa; identical to SEQ ID NO: 485658

SEQ ID NO: 552508 - RNA, 64 nt, hsa; identical to SEQ ID NO: 485659

SEQ ID NO: 552509 - RNA, 64 nt, hsa; identical to SEQ ID NO: 485660

SEQ ID NO: 552510 - RNA, 64 nt, hsa; identical to SEQ ID NO: 485661

SEQ ID NO: 552511 - RNA, 64 nt, hsa; identical to SEQ ID NO: 485662

SEQ ID NO: 552512 - RNA, 64 nt, hsa; identical to SEQ ID NO: 485663

SEQ ID NO: 552513 - RNA, 64 nt, hsa; identical to SEQ ID NO: 485664

SEQ ID NO: 552514 - RNA, 64 nt, hsa; identical to SEQ ID NO: 485665

SEQ ID NO: 552515 - RNA, 64 nt, hsa; identical to SEQ ID NO: 485666

SEQ ID NO: 552516 - RNA, 64 nt, hsa; identical to SEQ ID NO: 485667

SEQ ID NO: 552517 - RNA, 64 nt, hsa
cccuaaauauguuuacauaccauuaagauaugauucauguaacaauguuaaauuaauuauaaug

SEQ ID NO: 552518 - RNA, 64 nt, hsa
caugaaauucaacuuuccaaauaaaaguucuacuucauguaauccaaaaauguuuguauucugu

SEQ ID NO: 552519 - RNA, 64 nt, hsa
cauucaaaaaaagugaauugccaagauacuggugucauguaaauucccacuuuacauaaaaacc

SEQ ID NO: 552520 - RNA, 64 nt, hsa
guuagauuuauugaaagauuucaucugucguguuucauguaaaugagaacagauuauuugcaug

SEQ ID NO: 552521 - RNA, 64 nt, hsa
uucaagcuaagcuuauugaauucuuuuaccacuuucauguaagcugguaggggauuuuugagaa

SEQ ID NO: 552522 - RNA, 64 nt, hsa
ucaaacucauaaacucaguauuuuaacucaaaauucauguaacaagauagccaaaagcauagga

SEQ ID NO: 552523 - RNA, 64 nt, hsa
ggaaagggcaaaaugugucagaugcccuaguuaaucauguaauuuaauucugguauugugagug

SEQ ID NO: 552524 - RNA, 64 nt, hsa
aaauguuuuauguuuugaguuuuggaauuuauugucauguaaauaguugagcuaagcaagcccc

SEQ ID NO: 552525 - RNA, 64 nt, hsa
gaauggacuuuucaacuacuuucucuacagcuuuucauguaaauuagucuugguucugaaacuu

SEQ ID NO: 552526 - RNA, 64 nt, hsa
ccaagcauaauuguuaagaacacguguauuaaauucauguaaguggaauaaaaguuuuaugaau

SEQ ID NO: 552527 - RNA, 64 nt, hsa
cucaguguauccuuccugugucaagccuuauaaaucauguaauuuagugccacucauguaaauc

SEQ ID NO: 552528 - RNA, 64 nt, hsa
gucaagccuuauaaaucauguaauuuagugccacucauguaaaucaguaaaaucacaaaggucu

SEQ ID NO: 552529 - RNA, 64 nt, hsa
uuuguagauuccucuggauuuuguauaugcauagucauguaagcugaaaauauggcaauacuug

SEQ ID NO: 552530 - RNA, 64 nt, hsa
cugaaucucuaaucaauguucaucauguaucgcuucauguaacuagaauuucuuuaacuuaauu

SEQ ID NO: 552531 - RNA, 64 nt, hsa
uuuaauaauacauauuauuuaccccacuguaacaucauguaaacuaaguauguuuuuaaacaau

SEQ ID NO: 552532 - RNA, 64 nt, hsa
ugugaugugacuaaaagccacuuugugacucccuucauguaauccucuuuuccuccccacuccu

SEQ ID NO: 552533 - RNA, 64 nt, hsa
cuaauuuugacaaguuuucauccuaagccucaaaucauguaauuaauaauuugccuguuuauuu

SEQ ID NO: 552534 - RNA, 64 nt, hsa
aauacguuuuaggaugucaucauuuugaugugaaucauguaaauguugauaauaugcuguuuau

SEQ ID NO: 552535 - RNA, 64 nt, hsa
gaaauuaucugccuuauacauuaacuaauucaauucauguaacacuguugagugcuuacucuuu

SEQ ID NO: 552536 - RNA, 64 nt, hsa
auuuuuucuuuguauuuauuuuaauguauuguucucauguaagaaugacugauguuguguuagu

SEQ ID NO: 552537 - RNA, 64 nt, hsa
aaauaucaaaaggaaaagggagugggaauugcuaucauguaaaauaucaaaguuaaaauacuaa

SEQ ID NO: 552538 - RNA, 64 nt, hsa
augccagaggcaccaggccagaugugccgcacagucauguaauucaaucauguuuaauauguca

SEQ ID NO: 552539 - RNA, 64 nt, hsa
uaaauuguugcaacucauuagcuagugaagauauucauguaaauauauuuuaggauuguaauua

SEQ ID NO: 552540 - RNA, 64 nt, hsa
uuuauuuugguggucaaaaaaaauaugcuuccacucauguaacuauuuuaaauguuaagaagua

SEQ ID NO: 552541 - RNA, 64 nt, hsa
cacuugauaaaaauaaauauuugguauuuuguggucauguaaaacuucuuuuuguaugaaaauu

SEQ ID NO: 552542 - RNA, 64 nt, hsa; identical to SEQ ID NO: 264315

SEQ ID NO: 552543 - RNA, 64 nt, hsa; identical to SEQ ID NO: 264316

SEQ ID NO: 552544 - RNA, 64 nt, hsa; identical to SEQ ID NO: 264317

SEQ ID NO: 552545 - RNA, 64 nt, hsa; identical to SEQ ID NO: 264318

SEQ ID NO: 552546 - RNA, 64 nt, hsa; identical to SEQ ID NO: 264319

SEQ ID NO: 552547 - RNA, 64 nt, hsa; identical to SEQ ID NO: 264320

SEQ ID NO: 552548 - RNA, 64 nt, hsa; identical to SEQ ID NO: 264321

SEQ ID NO: 552549 - RNA, 64 nt, hsa; identical to SEQ ID NO: 264322

SEQ ID NO: 552550 - RNA, 64 nt, hsa; identical to SEQ ID NO: 101929

SEQ ID NO: 552551 - RNA, 64 nt, hsa; identical to SEQ ID NO: 101930

SEQ ID NO: 552552 - RNA, 64 nt, hsa; identical to SEQ ID NO: 101931

SEQ ID NO: 552553 - RNA, 64 nt, hsa; identical to SEQ ID NO: 101932

SEQ ID NO: 552554 - RNA, 64 nt, hsa; identical to SEQ ID NO: 101933

SEQ ID NO: 552555 - RNA, 64 nt, hsa; identical to SEQ ID NO: 101934

SEQ ID NO: 552556 - RNA, 64 nt, hsa; identical to SEQ ID NO: 101935

SEQ ID NO: 552557 - RNA, 64 nt, hsa; identical to SEQ ID NO: 101936

SEQ ID NO: 552558 - RNA, 64 nt, hsa; identical to SEQ ID NO: 101937

SEQ ID NO: 552559 - RNA, 64 nt, hsa; identical to SEQ ID NO: 101938

SEQ ID NO: 552560 - RNA, 64 nt, hsa; identical to SEQ ID NO: 101939

SEQ ID NO: 552561 - RNA, 64 nt, hsa; identical to SEQ ID NO: 101940

SEQ ID NO: 552562 - RNA, 64 nt, hsa; identical to SEQ ID NO: 101941

SEQ ID NO: 552563 - RNA, 64 nt, hsa; identical to SEQ ID NO: 101942

SEQ ID NO: 552564 - RNA, 64 nt, hsa; identical to SEQ ID NO: 101943

SEQ ID NO: 552565 - RNA, 64 nt, hsa; identical to SEQ ID NO: 101944

SEQ ID NO: 552566 - RNA, 64 nt, hsa; identical to SEQ ID NO: 101945

SEQ ID NO: 552567 - RNA, 64 nt, hsa; identical to SEQ ID NO: 101946

SEQ ID NO: 552568 - RNA, 64 nt, hsa; identical to SEQ ID NO: 101947

SEQ ID NO: 552569 - RNA, 64 nt, hsa; identical to SEQ ID NO: 43717

SEQ ID NO: 552570 - RNA, 64 nt, hsa; identical to SEQ ID NO: 43718

SEQ ID NO: 552571 - RNA, 64 nt, hsa; identical to SEQ ID NO: 43719

SEQ ID NO: 552572 - RNA, 64 nt, hsa; identical to SEQ ID NO: 43720

SEQ ID NO: 552573 - RNA, 64 nt, hsa; identical to SEQ ID NO: 43721

SEQ ID NO: 552574 - RNA, 64 nt, hsa; identical to SEQ ID NO: 43722

SEQ ID NO: 552575 - RNA, 64 nt, hsa; identical to SEQ ID NO: 43723

SEQ ID NO: 552576 - RNA, 64 nt, hsa; identical to SEQ ID NO: 43724

SEQ ID NO: 552577 - RNA, 64 nt, hsa; identical to SEQ ID NO: 43725

SEQ ID NO: 552578 - RNA, 64 nt, hsa; identical to SEQ ID NO: 43726

SEQ ID NO: 552579 - RNA, 64 nt, hsa; identical to SEQ ID NO: 43727

SEQ ID NO: 552580 - RNA, 64 nt, hsa; identical to SEQ ID NO: 43728

SEQ ID NO: 552581 - RNA, 64 nt, hsa; identical to SEQ ID NO: 43729

SEQ ID NO: 552582 - RNA, 64 nt, hsa; identical to SEQ ID NO: 43730

SEQ ID NO: 552583 - RNA, 64 nt, hsa; identical to SEQ ID NO: 43731

SEQ ID NO: 552584 - RNA, 64 nt, hsa; identical to SEQ ID NO: 43732

SEQ ID NO: 552585 - RNA, 64 nt, hsa; identical to SEQ ID NO: 43733

SEQ ID NO: 552586 - RNA, 64 nt, hsa; identical to SEQ ID NO: 43734

SEQ ID NO: 552587 - RNA, 64 nt, hsa; identical to SEQ ID NO: 43735

SEQ ID NO: 552588 - RNA, 64 nt, hsa; identical to SEQ ID NO: 43736

SEQ ID NO: 552589 - RNA, 64 nt, hsa; identical to SEQ ID NO: 43737

SEQ ID NO: 552590 - RNA, 64 nt, hsa; identical to SEQ ID NO: 43738

SEQ ID NO: 552591 - RNA, 64 nt, hsa; identical to SEQ ID NO: 43739

SEQ ID NO: 552592 - RNA, 64 nt, hsa; identical to SEQ ID NO: 43740

SEQ ID NO: 552593 - RNA, 64 nt, hsa; identical to SEQ ID NO: 43741

SEQ ID NO: 552594 - RNA, 64 nt, hsa; identical to SEQ ID NO: 43742

SEQ ID NO: 552595 - RNA, 64 nt, hsa; identical to SEQ ID NO: 43743

SEQ ID NO: 552596 - RNA, 64 nt, hsa; identical to SEQ ID NO: 43744

SEQ ID NO: 552597 - RNA, 64 nt, hsa; identical to SEQ ID NO: 43745

SEQ ID NO: 552598 - RNA, 64 nt, hsa; identical to SEQ ID NO: 43746

SEQ ID NO: 552599 - RNA, 64 nt, hsa
acagacgagcggucaccagaaucgcccgaucacagacgagcagucaucggaaucacccgaucac

SEQ ID NO: 552600 - RNA, 64 nt, hsa
acagacgagcagucaucggaaucacccgaucacagacgagcagucaucggacucacccgaucac

SEQ ID NO: 552601 - RNA, 64 nt, hsa
acagacgagcggucaccagacucgcccgaucacagacgagcagucaucggaaucacccgaucac

SEQ ID NO: 552602 - RNA, 64 nt, hsa
acagacaagcagucaucggaaucacccgaucacagacgagcagucaucggacucacccgaucac

SEQ ID NO: 552603 - RNA, 64 nt, hsa
acagacgagcggucaccggaaucgcccggucacagacgagcagucaucggacucacccgaucac

SEQ ID NO: 552604 - RNA, 64 nt, hsa; identical to SEQ ID NO: 189185

SEQ ID NO: 552605 - RNA, 64 nt, hsa; identical to SEQ ID NO: 189186

SEQ ID NO: 552606 - RNA, 64 nt, hsa; identical to SEQ ID NO: 189187

SEQ ID NO: 552607 - RNA, 64 nt, hsa; identical to SEQ ID NO: 189188

SEQ ID NO: 552608 - RNA, 64 nt, hsa; identical to SEQ ID NO: 189189

SEQ ID NO: 552609 - RNA, 64 nt, hsa; identical to SEQ ID NO: 189190

SEQ ID NO: 552610 - RNA, 64 nt, hsa; identical to SEQ ID NO: 189191

SEQ ID NO: 552611 - RNA, 64 nt, hsa; identical to SEQ ID NO: 189192

SEQ ID NO: 552612 - RNA, 64 nt, hsa; identical to SEQ ID NO: 189193

SEQ ID NO: 552613 - RNA, 64 nt, hsa; identical to SEQ ID NO: 189194

SEQ ID NO: 552614 - RNA, 64 nt, hsa; identical to SEQ ID NO: 189195

SEQ ID NO: 552615 - RNA, 64 nt, hsa; identical to SEQ ID NO: 189196

SEQ ID NO: 552616 - RNA, 64 nt, hsa; identical to SEQ ID NO: 189197

SEQ ID NO: 552617 - RNA, 64 nt, hsa; identical to SEQ ID NO: 189198

SEQ ID NO: 552618 - RNA, 64 nt, hsa; identical to SEQ ID NO: 189199

SEQ ID NO: 552619 - RNA, 64 nt, hsa; identical to SEQ ID NO: 189200

SEQ ID NO: 552620 - RNA, 64 nt, hsa; identical to SEQ ID NO: 189201

SEQ ID NO: 552621 - RNA, 64 nt, hsa; identical to SEQ ID NO: 189202

SEQ ID NO: 552622 - RNA, 64 nt, hsa; identical to SEQ ID NO: 189203

SEQ ID NO: 552623 - RNA, 64 nt, hsa; identical to SEQ ID NO: 189204

SEQ ID NO: 552624 - RNA, 64 nt, hsa; identical to SEQ ID NO: 189205

SEQ ID NO: 552625 - RNA, 64 nt, hsa; identical to SEQ ID NO: 189206

SEQ ID NO: 552626 - RNA, 64 nt, hsa; identical to SEQ ID NO: 189207

SEQ ID NO: 552627 - RNA, 64 nt, hsa; identical to SEQ ID NO: 189208

SEQ ID NO: 552628 - RNA, 64 nt, hsa; identical to SEQ ID NO: 189209

SEQ ID NO: 552629 - RNA, 64 nt, hsa; identical to SEQ ID NO: 189210

SEQ ID NO: 552630 - RNA, 64 nt, hsa; identical to SEQ ID NO: 189211

SEQ ID NO: 552631 - RNA, 64 nt, hsa; identical to SEQ ID NO: 189212

SEQ ID NO: 552632 - RNA, 64 nt, hsa; identical to SEQ ID NO: 189213

SEQ ID NO: 552633 - RNA, 50 nt, hsa; identical to SEQ ID NO: 189214

SEQ ID NO: 552634 - RNA, 64 nt, hsa; identical to SEQ ID NO: 189215

SEQ ID NO: 552635 - RNA, 64 nt, hsa; identical to SEQ ID NO: 189216

SEQ ID NO: 552636 - RNA, 64 nt, hsa; identical to SEQ ID NO: 189217

SEQ ID NO: 552637 - RNA, 64 nt, hsa; identical to SEQ ID NO: 189218

SEQ ID NO: 552638 - RNA, 64 nt, hsa; identical to SEQ ID NO: 189219

SEQ ID NO: 552639 - RNA, 64 nt, hsa; identical to SEQ ID NO: 189220

SEQ ID NO: 552640 - RNA, 64 nt, hsa; identical to SEQ ID NO: 189221

SEQ ID NO: 552641 - RNA, 64 nt, hsa; identical to SEQ ID NO: 189222

SEQ ID NO: 552642 - RNA, 64 nt, hsa; identical to SEQ ID NO: 189223

SEQ ID NO: 552643 - RNA, 64 nt, hsa; identical to SEQ ID NO: 189224

SEQ ID NO: 552644 - RNA, 64 nt, hsa; identical to SEQ ID NO: 189225

SEQ ID NO: 552645 - RNA, 64 nt, hsa; identical to SEQ ID NO: 189226

SEQ ID NO: 552646 - RNA, 64 nt, hsa; identical to SEQ ID NO: 189227

SEQ ID NO: 552647 - RNA, 64 nt, hsa; identical to SEQ ID NO: 189228

SEQ ID NO: 552648 - RNA, 64 nt, hsa; identical to SEQ ID NO: 189229

SEQ ID NO: 552649 - RNA, 64 nt, hsa; identical to SEQ ID NO: 189230

SEQ ID NO: 552650 - RNA, 64 nt, hsa; identical to SEQ ID NO: 189231

SEQ ID NO: 552651 - RNA, 64 nt, hsa; identical to SEQ ID NO: 189232

SEQ ID NO: 552652 - RNA, 64 nt, hsa; identical to SEQ ID NO: 189233

SEQ ID NO: 552653 - RNA, 64 nt, hsa; identical to SEQ ID NO: 189234

SEQ ID NO: 552654 - RNA, 64 nt, hsa; identical to SEQ ID NO: 189235

SEQ ID NO: 552655 - RNA, 64 nt, hsa; identical to SEQ ID NO: 189236

SEQ ID NO: 552656 - RNA, 64 nt, hsa; identical to SEQ ID NO: 189237

SEQ ID NO: 552657 - RNA, 64 nt, hsa; identical to SEQ ID NO: 189238

SEQ ID NO: 552658 - RNA, 64 nt, hsa; identical to SEQ ID NO: 189239

SEQ ID NO: 552659 - RNA, 64 nt, hsa; identical to SEQ ID NO: 189240

SEQ ID NO: 552660 - RNA, 64 nt, hsa; identical to SEQ ID NO: 189241

SEQ ID NO: 552661 - RNA, 64 nt, hsa; identical to SEQ ID NO: 189242

SEQ ID NO: 552662 - RNA, 64 nt, hsa; identical to SEQ ID NO: 189243

SEQ ID NO: 552663 - RNA, 64 nt, hsa; identical to SEQ ID NO: 189244

SEQ ID NO: 552664 - RNA, 64 nt, hsa; identical to SEQ ID NO: 189245

SEQ ID NO: 552665 - RNA, 64 nt, hsa; identical to SEQ ID NO: 189246

SEQ ID NO: 552666 - RNA, 64 nt, hsa; identical to SEQ ID NO: 189247

SEQ ID NO: 552667 - RNA, 64 nt, hsa; identical to SEQ ID NO: 189248

SEQ ID NO: 552668 - RNA, 64 nt, hsa; identical to SEQ ID NO: 189249

SEQ ID NO: 552669 - RNA, 64 nt, hsa; identical to SEQ ID NO: 189250

SEQ ID NO: 552670 - RNA, 64 nt, hsa; identical to SEQ ID NO: 189251

SEQ ID NO: 552671 - RNA, 64 nt, hsa; identical to SEQ ID NO: 189252

SEQ ID NO: 552672 - RNA, 64 nt, hsa; identical to SEQ ID NO: 189253

SEQ ID NO: 552673 - RNA, 64 nt, hsa; identical to SEQ ID NO: 189254

SEQ ID NO: 552674 - RNA, 64 nt, hsa; identical to SEQ ID NO: 189255

SEQ ID NO: 552675 - RNA, 64 nt, hsa; identical to SEQ ID NO: 189256

SEQ ID NO: 552676 - RNA, 64 nt, hsa; identical to SEQ ID NO: 189257

SEQ ID NO: 552677 - RNA, 64 nt, hsa; identical to SEQ ID NO: 189258

SEQ ID NO: 552678 - RNA, 64 nt, hsa
caccagacuuuuucuucuaaaaucuggaugucauugacgauaauguuuauggagauaaggucua

SEQ ID NO: 552679 - RNA, 64 nt, hsa
gcuugggauauaccagaguuuaccacaaguguuuugacgauauacuccugagcuuucacucugc

SEQ ID NO: 552680 - RNA, 64 nt, hsa
augauaucuaaguaguucucagcaauaauaauaaugacgauaauacuucuuuuccacaucucau

SEQ ID NO: 552681 - RNA, 64 nt, hsa
caguguauuuaauugacauuucuuuuuuguaaugugacgauauguggacaaagaagaagaugca

SEQ ID NO: 552682 - RNA, 64 nt, hsa
ucaacagucacaaacccaauggcaauaaaggcacugacgauagcuggcgcgcgcgacgucacac

SEQ ID NO: 552683 - RNA, 64 nt, hsa
aacauaugcaaacauaacaaaaucacuuccauagugacgauacuccaaccauauggauauuagu

SEQ ID NO: 552684 - RNA, 64 nt, hsa
cuuugguaauugaauucugaagaauuuaucugcaugacgauaacuaggcauucuauccauuugu

SEQ ID NO: 552685 - RNA, 64 nt, hsa
uccauuuaggauguguauuuaaugcauuuaguaaugacgauaaaguguuuuuaguaugcuuuua

SEQ ID NO: 552686 - RNA, 64 nt, hsa
cuucuuauauagguacucuuuugucuuuacagaaugacgauacaaaugccaaugaccagaugug

SEQ ID NO: 552687 - RNA, 64 nt, hsa
ucuauuuauagcuauugguaguuccccuaaauucugacgauagaaauuuuuauuugcuguuuag

SEQ ID NO: 552688 - RNA, 53 nt, hsa
agggcucaguggaggucugagaaugacgauacccgugacucagcccuggacac

SEQ ID NO: 552689 - RNA, 64 nt, hsa
auauaaauuucgcuccagaaaggccguagcaguuugacgauagguggcaaaaccuuaagauugu

SEQ ID NO: 552690 - RNA, 64 nt, hsa
auuaaaaauuucuuguauuucuugugcauuaaucugacgauaauuucccuguauauuauguuca

SEQ ID NO: 552691 - RNA, 64 nt, hsa
uucaacuccaccagaaauuaccucgagucagcauugacgauauuggaggagcugccgugcugcu

SEQ ID NO: 552692 - RNA, 64 nt, hsa
auaaauaauggagcaugcagugagcacaucuagcugacgauaaucacaccuuuucccccgucuu

SEQ ID NO: 552693 - RNA, 64 nt, hsa
aggcugcaaaauucauuuuauaauggcuauuuugugacgauaagauguaguucauguuuuucug

SEQ ID NO: 552694 - RNA, 64 nt, hsa
ugagaaaccagcugguuuagaaaaguuuaguaugugacgauaaacuagaaauuaccuuuauauu

SEQ ID NO: 552695 - RNA, 64 nt, hsa
acguauuuggaguuuauuuagaaguaaagugugaugacgauaacacuuaagugugaauuuuuaa

SEQ ID NO: 552696 - RNA, 64 nt, hsa
acagcaaaaagcccacccaggacuuagccucaguugacgauaguaacaauggccuuaacaucua

SEQ ID NO: 552697 - RNA, 64 nt, hsa
aguugucuguugaugauggugaugaugaugaugaugacgauagugaugccacacauucucucuc

SEQ ID NO: 552698 - RNA, 64 nt, hsa
uucuugcuagguaagcacuaauaacucggcaucuugacgauagucccauuugggugguuucagc

SEQ ID NO: 552699 - RNA, 64 nt, hsa
uugucauuccauuauauauccacaccaacaugggugacgauaauucaaagucauauuuugccuc

SEQ ID NO: 552700 - RNA, 64 nt, hsa
uguuuugugaaagcuucugauuaauuuauuauauugacgauaaaacucaaaccuacccagccuu

SEQ ID NO: 552701 - RNA, 53 nt, hsa
ugaaaacaaucuuccaguaguucugacgauacuuggagccugguccacgugca

SEQ ID NO: 552702 - RNA, 64 nt, hsa
cuuguuuccucccaccuguguuguaaagauaaacugacgauauacaggcacauuauguaaacau

SEQ ID NO: 552703 - RNA, 64 nt, hsa
ggauucggaccacuuggggaucccagaaccucccugacgauauccuggaaggacugaggaaggg

SEQ ID NO: 552704 - RNA, 64 nt, hsa
acacauugggauuggaauauuaauuacacuauaaugacgauaauguauucaggaaguuaaaaug

SEQ ID NO: 552705 - RNA, 64 nt, hsa
uuggguguggagaacccuggcugcacagucccuuugacgauaguccaccggccacccaggccug

SEQ ID NO: 552706 - RNA, 64 nt, hsa
aaccugaagcuuagaggaacggaaugacugcccgugacgauaccaucaggaaauuaucccagug

SEQ ID NO: 552707 - RNA, 64 nt, hsa; identical to SEQ ID NO: 156671

SEQ ID NO: 552708 - RNA, 64 nt, hsa; identical to SEQ ID NO: 156672

SEQ ID NO: 552709 - RNA, 64 nt, hsa; identical to SEQ ID NO: 156673

SEQ ID NO: 552710 - RNA, 64 nt, hsa; identical to SEQ ID NO: 156674

SEQ ID NO: 552711 - RNA, 64 nt, hsa; identical to SEQ ID NO: 156675

SEQ ID NO: 552712 - RNA, 64 nt, hsa; identical to SEQ ID NO: 156676

SEQ ID NO: 552713 - RNA, 64 nt, hsa; identical to SEQ ID NO: 73323

SEQ ID NO: 552714 - RNA, 64 nt, hsa; identical to SEQ ID NO: 73324

SEQ ID NO: 552715 - RNA, 64 nt, hsa; identical to SEQ ID NO: 73325

SEQ ID NO: 552716 - RNA, 64 nt, hsa; identical to SEQ ID NO: 73326

SEQ ID NO: 552717 - RNA, 64 nt, hsa; identical to SEQ ID NO: 73327

SEQ ID NO: 552718 - RNA, 64 nt, hsa; identical to SEQ ID NO: 73328

SEQ ID NO: 552719 - RNA, 64 nt, hsa; identical to SEQ ID NO: 73329

SEQ ID NO: 552720 - RNA, 64 nt, hsa; identical to SEQ ID NO: 73330

SEQ ID NO: 552721 - RNA, 64 nt, hsa; identical to SEQ ID NO: 73331

SEQ ID NO: 552722 - RNA, 64 nt, hsa; identical to SEQ ID NO: 73332

SEQ ID NO: 552723 - RNA, 64 nt, hsa; identical to SEQ ID NO: 73333

SEQ ID NO: 552724 - RNA, 64 nt, hsa; identical to SEQ ID NO: 73334

SEQ ID NO: 552725 - RNA, 64 nt, hsa; identical to SEQ ID NO: 73335

SEQ ID NO: 552726 - RNA, 64 nt, hsa; identical to SEQ ID NO: 73336

SEQ ID NO: 552727 - RNA, 64 nt, hsa; identical to SEQ ID NO: 73337

SEQ ID NO: 552728 - RNA, 64 nt, hsa; identical to SEQ ID NO: 73338

SEQ ID NO: 552729 - RNA, 64 nt, hsa; identical to SEQ ID NO: 73339

SEQ ID NO: 552730 - RNA, 64 nt, hsa; identical to SEQ ID NO: 73340

SEQ ID NO: 552731 - RNA, 64 nt, hsa; identical to SEQ ID NO: 73341

SEQ ID NO: 552732 - RNA, 64 nt, hsa; identical to SEQ ID NO: 73342

SEQ ID NO: 552733 - RNA, 64 nt, hsa; identical to SEQ ID NO: 73343

SEQ ID NO: 552734 - RNA, 64 nt, hsa; identical to SEQ ID NO: 73344

SEQ ID NO: 552735 - RNA, 64 nt, hsa; identical to SEQ ID NO: 481796

SEQ ID NO: 552736 - RNA, 64 nt, hsa; identical to SEQ ID NO: 481797

SEQ ID NO: 552737 - RNA, 64 nt, hsa; identical to SEQ ID NO: 481798

SEQ ID NO: 552738 - RNA, 64 nt, hsa; identical to SEQ ID NO: 481799

SEQ ID NO: 552739 - RNA, 64 nt, hsa; identical to SEQ ID NO: 481800

SEQ ID NO: 552740 - RNA, 64 nt, hsa; identical to SEQ ID NO: 481801

SEQ ID NO: 552741 - RNA, 64 nt, hsa; identical to SEQ ID NO: 481802

SEQ ID NO: 552742 - RNA, 64 nt, hsa; identical to SEQ ID NO: 481803

SEQ ID NO: 552743 - RNA, 64 nt, hsa; identical to SEQ ID NO: 481804

SEQ ID NO: 552744 - RNA, 64 nt, hsa; identical to SEQ ID NO: 481805

SEQ ID NO: 552745 - RNA, 64 nt, hsa; identical to SEQ ID NO: 481806

SEQ ID NO: 552746 - RNA, 64 nt, hsa; identical to SEQ ID NO: 481807

SEQ ID NO: 552747 - RNA, 64 nt, hsa; identical to SEQ ID NO: 481808

SEQ ID NO: 552748 - RNA, 64 nt, hsa; identical to SEQ ID NO: 481809

SEQ ID NO: 552749 - RNA, 64 nt, hsa; identical to SEQ ID NO: 481810

SEQ ID NO: 552750 - RNA, 64 nt, hsa; identical to SEQ ID NO: 481811

SEQ ID NO: 552751 - RNA, 64 nt, hsa; identical to SEQ ID NO: 481812

SEQ ID NO: 552752 - RNA, 64 nt, hsa; identical to SEQ ID NO: 481813

SEQ ID NO: 552753 - RNA, 64 nt, hsa; identical to SEQ ID NO: 481814

SEQ ID NO: 552754 - RNA, 64 nt, hsa; identical to SEQ ID NO: 481815

SEQ ID NO: 552755 - RNA, 64 nt, hsa; identical to SEQ ID NO: 481816

SEQ ID NO: 552756 - RNA, 64 nt, hsa; identical to SEQ ID NO: 481817

SEQ ID NO: 552757 - RNA, 64 nt, hsa; identical to SEQ ID NO: 481818

SEQ ID NO: 552758 - RNA, 64 nt, hsa; identical to SEQ ID NO: 481819

SEQ ID NO: 552759 - RNA, 64 nt, hsa; identical to SEQ ID NO: 481820

SEQ ID NO: 552760 - RNA, 64 nt, hsa; identical to SEQ ID NO: 481821

SEQ ID NO: 552761 - RNA, 64 nt, hsa; identical to SEQ ID NO: 481822

SEQ ID NO: 552762 - RNA, 64 nt, hsa; identical to SEQ ID NO: 481823

SEQ ID NO: 552763 - RNA, 64 nt, hsa; identical to SEQ ID NO: 481824

SEQ ID NO: 552764 - RNA, 64 nt, hsa; identical to SEQ ID NO: 481825

SEQ ID NO: 552765 - RNA, 64 nt, hsa; identical to SEQ ID NO: 481826

SEQ ID NO: 552766 - RNA, 64 nt, hsa; identical to SEQ ID NO: 481827

SEQ ID NO: 552767 - RNA, 64 nt, hsa; identical to SEQ ID NO: 481828

SEQ ID NO: 552768 - RNA, 64 nt, hsa; identical to SEQ ID NO: 481829

SEQ ID NO: 552769 - RNA, 64 nt, hsa; identical to SEQ ID NO: 481830

SEQ ID NO: 552770 - RNA, 64 nt, hsa; identical to SEQ ID NO: 481831

SEQ ID NO: 552771 - RNA, 64 nt, hsa; identical to SEQ ID NO: 481832

SEQ ID NO: 552772 - RNA, 64 nt, hsa; identical to SEQ ID NO: 481833

SEQ ID NO: 552773 - RNA, 64 nt, hsa; identical to SEQ ID NO: 52917

SEQ ID NO: 552774 - RNA, 64 nt, hsa; identical to SEQ ID NO: 52918

SEQ ID NO: 552775 - RNA, 64 nt, hsa; identical to SEQ ID NO: 52919

SEQ ID NO: 552776 - RNA, 64 nt, hsa; identical to SEQ ID NO: 52920

SEQ ID NO: 552777 - RNA, 64 nt, hsa; identical to SEQ ID NO: 52921

SEQ ID NO: 552778 - RNA, 64 nt, hsa; identical to SEQ ID NO: 52922

SEQ ID NO: 552779 - RNA, 64 nt, hsa; identical to SEQ ID NO: 52923

SEQ ID NO: 552780 - RNA, 64 nt, hsa; identical to SEQ ID NO: 52924

SEQ ID NO: 552781 - RNA, 64 nt, hsa; identical to SEQ ID NO: 52925

SEQ ID NO: 552782 - RNA, 64 nt, hsa; identical to SEQ ID NO: 52926

SEQ ID NO: 552783 - RNA, 64 nt, hsa; identical to SEQ ID NO: 52927

SEQ ID NO: 552784 - RNA, 64 nt, hsa; identical to SEQ ID NO: 52928

SEQ ID NO: 552785 - RNA, 64 nt, hsa; identical to SEQ ID NO: 52929

SEQ ID NO: 552786 - RNA, 64 nt, hsa; identical to SEQ ID NO: 52930

SEQ ID NO: 552787 - RNA, 64 nt, hsa; identical to SEQ ID NO: 52931

SEQ ID NO: 552788 - RNA, 64 nt, hsa; identical to SEQ ID NO: 52932

SEQ ID NO: 552789 - RNA, 64 nt, hsa; identical to SEQ ID NO: 52933

SEQ ID NO: 552790 - RNA, 64 nt, hsa; identical to SEQ ID NO: 52934

SEQ ID NO: 552791 - RNA, 64 nt, hsa; identical to SEQ ID NO: 52935

SEQ ID NO: 552792 - RNA, 64 nt, hsa; identical to SEQ ID NO: 52936

SEQ ID NO: 552793 - RNA, 64 nt, hsa; identical to SEQ ID NO: 52937

SEQ ID NO: 552794 - RNA, 64 nt, hsa; identical to SEQ ID NO: 52938

SEQ ID NO: 552795 - RNA, 64 nt, hsa; identical to SEQ ID NO: 52939

SEQ ID NO: 552796 - RNA, 64 nt, hsa; identical to SEQ ID NO: 52940

SEQ ID NO: 552797 - RNA, 64 nt, hsa; identical to SEQ ID NO: 52941

SEQ ID NO: 552798 - RNA, 64 nt, hsa; identical to SEQ ID NO: 52942

SEQ ID NO: 552799 - RNA, 64 nt, hsa; identical to SEQ ID NO: 52943

SEQ ID NO: 552800 - RNA, 64 nt, hsa; identical to SEQ ID NO: 52944

SEQ ID NO: 552801 - RNA, 64 nt, hsa; identical to SEQ ID NO: 52945

SEQ ID NO: 552802 - RNA, 64 nt, hsa; identical to SEQ ID NO: 52946

SEQ ID NO: 552803 - RNA, 64 nt, hsa; identical to SEQ ID NO: 52947

SEQ ID NO: 552804 - RNA, 64 nt, hsa; identical to SEQ ID NO: 52948

SEQ ID NO: 552805 - RNA, 64 nt, hsa; identical to SEQ ID NO: 52949

SEQ ID NO: 552806 - RNA, 64 nt, hsa; identical to SEQ ID NO: 52950

SEQ ID NO: 552807 - RNA, 64 nt, hsa; identical to SEQ ID NO: 52951

SEQ ID NO: 552808 - RNA, 64 nt, hsa; identical to SEQ ID NO: 52952

SEQ ID NO: 552809 - RNA, 64 nt, hsa; identical to SEQ ID NO: 52953

SEQ ID NO: 552810 - RNA, 64 nt, hsa; identical to SEQ ID NO: 52954

SEQ ID NO: 552811 - RNA, 64 nt, hsa; identical to SEQ ID NO: 52955

SEQ ID NO: 552812 - RNA, 64 nt, hsa; identical to SEQ ID NO: 52956

SEQ ID NO: 552813 - RNA, 64 nt, hsa; identical to SEQ ID NO: 52957

SEQ ID NO: 552814 - RNA, 64 nt, hsa; identical to SEQ ID NO: 52958

SEQ ID NO: 552815 - RNA, 64 nt, hsa; identical to SEQ ID NO: 52959

SEQ ID NO: 552816 - RNA, 64 nt, hsa; identical to SEQ ID NO: 52960

SEQ ID NO: 552817 - RNA, 64 nt, hsa; identical to SEQ ID NO: 52961

SEQ ID NO: 552818 - RNA, 64 nt, hsa; identical to SEQ ID NO: 52962

SEQ ID NO: 552819 - RNA, 64 nt, hsa; identical to SEQ ID NO: 52963

SEQ ID NO: 552820 - RNA, 64 nt, hsa; identical to SEQ ID NO: 52964

SEQ ID NO: 552821 - RNA, 64 nt, hsa; identical to SEQ ID NO: 52965

SEQ ID NO: 552822 - RNA, 64 nt, hsa; identical to SEQ ID NO: 52966

SEQ ID NO: 552823 - RNA, 64 nt, hsa; identical to SEQ ID NO: 52967

SEQ ID NO: 552824 - RNA, 64 nt, hsa; identical to SEQ ID NO: 52968

SEQ ID NO: 552825 - RNA, 64 nt, hsa; identical to SEQ ID NO: 52969

SEQ ID NO: 552826 - RNA, 64 nt, hsa; identical to SEQ ID NO: 52970

SEQ ID NO: 552827 - RNA, 64 nt, hsa; identical to SEQ ID NO: 52971

SEQ ID NO: 552828 - RNA, 64 nt, hsa; identical to SEQ ID NO: 52972

SEQ ID NO: 552829 - RNA, 64 nt, hsa; identical to SEQ ID NO: 52973

SEQ ID NO: 552830 - RNA, 64 nt, hsa; identical to SEQ ID NO: 52974

SEQ ID NO: 552831 - RNA, 64 nt, hsa; identical to SEQ ID NO: 52975

SEQ ID NO: 552832 - RNA, 64 nt, hsa; identical to SEQ ID NO: 52976

SEQ ID NO: 552833 - RNA, 64 nt, hsa; identical to SEQ ID NO: 52977

SEQ ID NO: 552834 - RNA, 64 nt, hsa; identical to SEQ ID NO: 52978

SEQ ID NO: 552835 - RNA, 64 nt, hsa; identical to SEQ ID NO: 291354

SEQ ID NO: 552836 - RNA, 64 nt, hsa; identical to SEQ ID NO: 291355

SEQ ID NO: 552837 - RNA, 64 nt, hsa; identical to SEQ ID NO: 291356

SEQ ID NO: 552838 - RNA, 64 nt, hsa; identical to SEQ ID NO: 291357

SEQ ID NO: 552839 - RNA, 64 nt, hsa; identical to SEQ ID NO: 291358

SEQ ID NO: 552840 - RNA, 64 nt, hsa; identical to SEQ ID NO: 291359

SEQ ID NO: 552841 - RNA, 64 nt, hsa
ccacuugccacggaugggccacggauggagcuugccaugggaagcacugggaaguaauggggug

SEQ ID NO: 552842 - RNA, 64 nt, hsa
ccagccuccuccagcugcuggcaggggcuggcacccaugggacacccucugcccccagccgcag

SEQ ID NO: 552843 - RNA, 64 nt, hsa
cucauuuguuuaccuacuaucuaugauuguucaaccaugggagaguugaguaauugugacaugg

SEQ ID NO: 552844 - RNA, 64 nt, hsa
acucauuacugugaccuuccagcucaguccccacccaugggagccuguguugcuccucucacuc

SEQ ID NO: 552845 - RNA, 64 nt, hsa
cucagucuuuaagauauuagacaguuuuuuuaguccaugggauuguaaauauaaacauuaacuu

SEQ ID NO: 552846 - RNA, 64 nt, hsa
uuaaauguggauguaucagauuugguuuauccagccaugggagagaaaacaaaccuaaguuuac

SEQ ID NO: 552847 - RNA, 64 nt, hsa
aacaucugcuccaugacauucacaauaccagggaccaugggagacacaagaaaugugugucugc

SEQ ID NO: 552848 - RNA, 64 nt, hsa
auuaagagcuuucuagccagaaucuggaccuauaccaugggaaaauuuaggggugcugggaauc

SEQ ID NO: 552849 - RNA, 64 nt, hsa
agaaaaaaacuugaaaauaguaauaccugaguacccaugggaauaauagacacuggggagguag

SEQ ID NO: 552850 - RNA, 64 nt, hsa
auuuuuuuaaaaaagaaaaagacaauaguauuacccaugggacaaaauuuguacuauuagcaag

SEQ ID NO: 552851 - RNA, 64 nt, hsa
auuauggcugggggcgccagcccaagaauggggaccaugggacuccuccagccuggcucuuccc

SEQ ID NO: 552852 - RNA, 64 nt, hsa
agugcuaaggcuggaaauggcccccucuuaguugccaugggaaccuaguaacagacucugcugg

SEQ ID NO: 552853 - RNA, 64 nt, hsa
auggcgccagucuggcuggaggagcccugagaugccaugggaggccugagguuggccacggggg

SEQ ID NO: 552854 - RNA, 64 nt, hsa
gugcugagcgacaagaggcucagagggcaugaccccaugggacuggaugcggccugagggcuga

SEQ ID NO: 552855 - RNA, 64 nt, hsa
uuucaaucucugggccaagaucacaugcaggauaccaugggaaggagccaucuccacucuccuu

SEQ ID NO: 552856 - RNA, 64 nt, hsa
cgggggccuggcacagaccccuaggugccucgcuccaugggauugcaacaagcuaguuuaggaa

SEQ ID NO: 552857 - RNA, 64 nt, hsa; identical to SEQ ID NO: 291354

SEQ ID NO: 552858 - RNA, 64 nt, hsa; identical to SEQ ID NO: 291355

SEQ ID NO: 552859 - RNA, 64 nt, hsa; identical to SEQ ID NO: 291356

SEQ ID NO: 552860 - RNA, 64 nt, hsa; identical to SEQ ID NO: 291357

SEQ ID NO: 552861 - RNA, 64 nt, hsa; identical to SEQ ID NO: 291358

SEQ ID NO: 552862 - RNA, 64 nt, hsa; identical to SEQ ID NO: 291359

SEQ ID NO: 552863 - RNA, 64 nt, hsa; identical to SEQ ID NO: 552841

SEQ ID NO: 552864 - RNA, 64 nt, hsa; identical to SEQ ID NO: 552842

SEQ ID NO: 552865 - RNA, 64 nt, hsa; identical to SEQ ID NO: 552843

SEQ ID NO: 552866 - RNA, 64 nt, hsa; identical to SEQ ID NO: 552844

SEQ ID NO: 552867 - RNA, 64 nt, hsa; identical to SEQ ID NO: 552845

SEQ ID NO: 552868 - RNA, 64 nt, hsa; identical to SEQ ID NO: 552846

SEQ ID NO: 552869 - RNA, 64 nt, hsa; identical to SEQ ID NO: 552847

SEQ ID NO: 552870 - RNA, 64 nt, hsa; identical to SEQ ID NO: 552848

SEQ ID NO: 552871 - RNA, 64 nt, hsa; identical to SEQ ID NO: 552849

SEQ ID NO: 552872 - RNA, 64 nt, hsa; identical to SEQ ID NO: 552850

SEQ ID NO: 552873 - RNA, 64 nt, hsa; identical to SEQ ID NO: 552851

SEQ ID NO: 552874 - RNA, 64 nt, hsa; identical to SEQ ID NO: 552852

SEQ ID NO: 552875 - RNA, 64 nt, hsa; identical to SEQ ID NO: 552853

SEQ ID NO: 552876 - RNA, 64 nt, hsa; identical to SEQ ID NO: 552854

SEQ ID NO: 552877 - RNA, 64 nt, hsa; identical to SEQ ID NO: 552855

SEQ ID NO: 552878 - RNA, 64 nt, hsa; identical to SEQ ID NO: 552856

SEQ ID NO: 552879 - RNA, 64 nt, hsa; identical to SEQ ID NO: 531886

SEQ ID NO: 552880 - RNA, 64 nt, hsa; identical to SEQ ID NO: 531887

SEQ ID NO: 552881 - RNA, 64 nt, hsa; identical to SEQ ID NO: 531888

SEQ ID NO: 552882 - RNA, 64 nt, hsa; identical to SEQ ID NO: 531889

SEQ ID NO: 552883 - RNA, 64 nt, hsa; identical to SEQ ID NO: 531890

SEQ ID NO: 552884 - RNA, 64 nt, hsa; identical to SEQ ID NO: 531891

SEQ ID NO: 552885 - RNA, 64 nt, hsa; identical to SEQ ID NO: 531892

SEQ ID NO: 552886 - RNA, 64 nt, hsa; identical to SEQ ID NO: 531893

SEQ ID NO: 552887 - RNA, 64 nt, hsa; identical to SEQ ID NO: 531894

SEQ ID NO: 552888 - RNA, 64 nt, hsa; identical to SEQ ID NO: 531895

SEQ ID NO: 552889 - RNA, 64 nt, hsa; identical to SEQ ID NO: 531896

SEQ ID NO: 552890 - RNA, 64 nt, hsa; identical to SEQ ID NO: 531897

SEQ ID NO: 552891 - RNA, 64 nt, hsa; identical to SEQ ID NO: 531898

SEQ ID NO: 552892 - RNA, 64 nt, hsa; identical to SEQ ID NO: 531899

SEQ ID NO: 552893 - RNA, 64 nt, hsa; identical to SEQ ID NO: 531900

SEQ ID NO: 552894 - RNA, 64 nt, hsa; identical to SEQ ID NO: 531901

SEQ ID NO: 552895 - RNA, 64 nt, hsa; identical to SEQ ID NO: 531902

SEQ ID NO: 552896 - RNA, 64 nt, hsa; identical to SEQ ID NO: 531903

SEQ ID NO: 552897 - RNA, 64 nt, hsa; identical to SEQ ID NO: 531904

SEQ ID NO: 552898 - RNA, 64 nt, hsa; identical to SEQ ID NO: 531905

SEQ ID NO: 552899 - RNA, 64 nt, hsa; identical to SEQ ID NO: 531906

SEQ ID NO: 552900 - RNA, 64 nt, hsa; identical to SEQ ID NO: 531907

SEQ ID NO: 552901 - RNA, 64 nt, hsa; identical to SEQ ID NO: 531908

SEQ ID NO: 552902 - RNA, 64 nt, hsa; identical to SEQ ID NO: 531909

SEQ ID NO: 552903 - RNA, 64 nt, hsa; identical to SEQ ID NO: 531910

SEQ ID NO: 552904 - RNA, 64 nt, hsa; identical to SEQ ID NO: 531911

SEQ ID NO: 552905 - RNA, 64 nt, hsa; identical to SEQ ID NO: 531912

SEQ ID NO: 552906 - RNA, 64 nt, hsa; identical to SEQ ID NO: 531913

SEQ ID NO: 552907 - RNA, 64 nt, hsa; identical to SEQ ID NO: 531914

SEQ ID NO: 552908 - RNA, 64 nt, hsa; identical to SEQ ID NO: 531915

SEQ ID NO: 552909 - RNA, 64 nt, hsa; identical to SEQ ID NO: 531916

SEQ ID NO: 552910 - RNA, 64 nt, hsa; identical to SEQ ID NO: 531917

SEQ ID NO: 552911 - RNA, 64 nt, hsa; identical to SEQ ID NO: 531918

SEQ ID NO: 552912 - RNA, 64 nt, hsa; identical to SEQ ID NO: 531919

SEQ ID NO: 552913 - RNA, 64 nt, hsa; identical to SEQ ID NO: 531920

SEQ ID NO: 552914 - RNA, 64 nt, hsa; identical to SEQ ID NO: 531921

SEQ ID NO: 552915 - RNA, 64 nt, hsa; identical to SEQ ID NO: 531922

SEQ ID NO: 552916 - RNA, 64 nt, hsa; identical to SEQ ID NO: 211201

SEQ ID NO: 552917 - RNA, 64 nt, hsa; identical to SEQ ID NO: 211202

SEQ ID NO: 552918 - RNA, 64 nt, hsa; identical to SEQ ID NO: 211203

SEQ ID NO: 552919 - RNA, 64 nt, hsa; identical to SEQ ID NO: 211204

SEQ ID NO: 552920 - RNA, 64 nt, hsa; identical to SEQ ID NO: 211205

SEQ ID NO: 552921 - RNA, 64 nt, hsa; identical to SEQ ID NO: 211206

SEQ ID NO: 552922 - RNA, 64 nt, hsa; identical to SEQ ID NO: 97018

SEQ ID NO: 552923 - RNA, 64 nt, hsa; identical to SEQ ID NO: 97019

SEQ ID NO: 552924 - RNA, 64 nt, hsa; identical to SEQ ID NO: 97020

SEQ ID NO: 552925 - RNA, 64 nt, hsa; identical to SEQ ID NO: 97021

SEQ ID NO: 552926 - RNA, 64 nt, hsa; identical to SEQ ID NO: 97022

SEQ ID NO: 552927 - RNA, 64 nt, hsa; identical to SEQ ID NO: 97023

SEQ ID NO: 552928 - RNA, 64 nt, hsa; identical to SEQ ID NO: 97024

SEQ ID NO: 552929 - RNA, 64 nt, hsa; identical to SEQ ID NO: 97025

SEQ ID NO: 552930 - RNA, 64 nt, hsa; identical to SEQ ID NO: 97026

SEQ ID NO: 552931 - RNA, 64 nt, hsa; identical to SEQ ID NO: 97027

SEQ ID NO: 552932 - RNA, 64 nt, hsa; identical to SEQ ID NO: 97028

SEQ ID NO: 552933 - RNA, 64 nt, hsa; identical to SEQ ID NO: 219898

SEQ ID NO: 552934 - RNA, 64 nt, hsa; identical to SEQ ID NO: 219899

SEQ ID NO: 552935 - RNA, 64 nt, hsa; identical to SEQ ID NO: 219900

SEQ ID NO: 552936 - RNA, 64 nt, hsa; identical to SEQ ID NO: 219901

SEQ ID NO: 552937 - RNA, 64 nt, hsa; identical to SEQ ID NO: 219902

SEQ ID NO: 552938 - RNA, 64 nt, hsa; identical to SEQ ID NO: 219903

SEQ ID NO: 552939 - RNA, 64 nt, hsa
uuuuauuaacccuggcuuuggugguaagggaaacuuccagaaaugcuuguggguauauuggaua

SEQ ID NO: 552940 - RNA, 64 nt, hsa
aacugugggugacuuuauccucacaucguguuucuuccagaaauucagacgcaacagagguuag

SEQ ID NO: 552941 - RNA, 64 nt, hsa
ucuucaugacccuucaacccugauuacuacagaauuccagaauguuaggcucuccagggcuucu

SEQ ID NO: 552942 - RNA, 64 nt, hsa
ucagaucccuaugggggcccagcuggcuccacgguuccagaauguucagguggucaguguucua

SEQ ID NO: 552943 - RNA, 64 nt, hsa
cucagaaaugucucacagcccagcuggguugcaauuccagaaugcugggaguuuuacagugcca

SEQ ID NO: 552944 - RNA, 64 nt, hsa
agcaacucaaagaggcagaagaggagaaugacuuuuccagaauagaaguggagcagugaucauu

SEQ ID NO: 552945 - RNA, 64 nt, hsa
cgcaguguucagaaagcugguaaguccuagggauuuccagaaguagccugcagaagaagguaag

SEQ ID NO: 552946 - RNA, 64 nt, hsa
uuauuuuuacucucuggaaaaggagauaauacaauuccagaaagugaacucauauuucuaaggu

SEQ ID NO: 552947 - RNA, 64 nt, hsa
uaucuaacacaacgccaacagaagcacauuugucuuccagaacaccgugccuuagaaaugcuuu

SEQ ID NO: 552948 - RNA, 64 nt, hsa
aauugcuacugguuggcauuguaacucauaggaauuccagaaaauuauuaauccgugcugcuug

SEQ ID NO: 552949 - RNA, 64 nt, hsa
uucuauuucaucuuuugagucauauguauauuauuuccagaauuuuagacauuauuacaggguu

SEQ ID NO: 552950 - RNA, 64 nt, hsa
uguuuucucaguuuggagggugauggguagagcuuuccagaaccuucuccauuccagaaucucu

SEQ ID NO: 552951 - RNA, 64 nt, hsa
gggugauggguagagcuuuccagaaccuucuccauuccagaaucucugccccuguguaaucuga

SEQ ID NO: 552952 - RNA, 64 nt, hsa
uuacccaaauauaaccauuuaaagaaagaaugcauuccagaacaaauuguuuacauaaguuccu

SEQ ID NO: 552953 - RNA, 64 nt, hsa
uuuuuaaccacuugccucuuucuccagcagcugauuccagaacaaaucauuauguuuccuaacu

SEQ ID NO: 552954 - RNA, 64 nt, hsa
aaaaugaacugaaguuucacaugagcuauuuccauuccagaauaucugggauucuacuuuaagc

SEQ ID NO: 552955 - RNA, 64 nt, hsa
guuguggaaauagaagcaaaugacaaaaagccuuuuccagaagaucugaaaucauuggaccugu

SEQ ID NO: 552956 - RNA, 64 nt, hsa
ugucauauuuaguaccuucacaagguuucucuccuuccagaauuuucugauguacacaaauaac

SEQ ID NO: 552957 - RNA, 64 nt, hsa
gcacauuaggacguuucauuuguugcugaaugcuuuccagaauuauuuauuccauaggguuucu

SEQ ID NO: 552958 - RNA, 64 nt, hsa
aaacucuuaccuccacauauuauccuacagauguuuccagaaaucccuguuguaacaucaagug

SEQ ID NO: 552959 - RNA, 64 nt, hsa
cacauauuuuauauucagcauaaaggagaauaaauuccagaaaacacauauucugaaaauggag

SEQ ID NO: 552960 - RNA, 64 nt, hsa
ugauaaaacauauccaaagcacccaaaccugugauuccagaaaaguagauccuauuuuuguuua

SEQ ID NO: 552961 - RNA, 64 nt, hsa
cagcugugggcucagaaacugcuagguaaaagaauuccagaaggaggccagggcauaaguugga

SEQ ID NO: 552962 - RNA, 64 nt, hsa
gacagaaucuagcaucgggacuauuagcaauggcuuccagaaugugcuugggucccacgugacu

SEQ ID NO: 552963 - RNA, 64 nt, hsa
ccaucaugguggcuaugaagcucacggcugaagauuccagaagguccuggucucccaugcccaa

SEQ ID NO: 552964 - RNA, 64 nt, hsa
agugagccacaugcaggcugaugaaugccgacacuuccagaauguauagaaauagucccugucc

SEQ ID NO: 552965 - RNA, 64 nt, hsa
uagagcuggagugaggaguagaggucuccggcuauuccagaaagaaaagugagccacaugcagg

SEQ ID NO: 552966 - RNA, 64 nt, hsa
uccauugccgugcucuuugaaugcagacuucuauuuccagaagugacagcacaagucugaguug

SEQ ID NO: 552967 - RNA, 64 nt, hsa
aaaugcauguuuagugagcacuaauacaaucuuauuccagaagacuguuuuuaguagcuuauug

SEQ ID NO: 552968 - RNA, 64 nt, hsa
cagugguuggagaggcauaggauaaacauucccauuccagaaaggagaaacaggaaagaagaaa

SEQ ID NO: 552969 - RNA, 64 nt, hsa
gaagagucauguggggugggaaccuggggugugguuccagaaauguuuuuggcaacaggagaga

SEQ ID NO: 552970 - RNA, 64 nt, hsa
cccauuaucuggaauauugugauucuguuuauucuuccagaaugcugaacuccuuguuagcccu

SEQ ID NO: 552971 - RNA, 64 nt, hsa
aucugcuagaaaguuaggggguucuuauuuugcauuccagaaucuugacuuucugauuggugau

SEQ ID NO: 552972 - RNA, 64 nt, hsa
gucuuaacacauuuuaucuuaaauaauuuauucauuccagaaugucaaggguccacuugcuauu

SEQ ID NO: 552973 - RNA, 64 nt, hsa
aucuuaaaauaaaauagcaaaccaacauuuuuuuuuccagaaaaugguaagguacucaggaauc

SEQ ID NO: 552974 - RNA, 64 nt, hsa
ggcggggcgggggagggaucucaaaguuuuagucuuccagaauccaaauuaaagguugccccug

SEQ ID NO: 552975 - RNA, 64 nt, hsa
gaaugcccagaaagugccagaagcaucguggcauuuccagaaccauggauucugccuuuggacc

SEQ ID NO: 552976 - RNA, 64 nt, hsa
ucugaugucuuggcacaggguaagugaagguuaauuccagaagagaggaaugacuugaaggcaa

SEQ ID NO: 552977 - RNA, 64 nt, hsa
cucugaauuuugaauuguuauucuauuuuuuauuuuccagaacucauuuuuuaccuucaggggu

SEQ ID NO: 552978 - RNA, 64 nt, hsa
uaauucuuaaguacucugcauaagggggaaaagcuuccagaaagcagccaugaaccaggcuguc

SEQ ID NO: 552979 - RNA, 64 nt, hsa
caggccccucgcagcauaaggauguuuugcaacuuuccagaaucuggcccagaaauuagggcuc

SEQ ID NO: 552980 - RNA, 64 nt, hsa
ucugucugugagacacagcgcaaugcuacugcccuuccagaaacugugcuaaaaagagaaaguc

SEQ ID NO: 552981 - RNA, 64 nt, hsa
aacccggcaaccagaaggggacagauaaggaccguuccagaaaucccaacucucacacccagcc

SEQ ID NO: 552982 - RNA, 64 nt, hsa
ccaggaaugaguaucuaauagcuuuuguagaaccuuccagaauauguggggaaaaagggcuauu

SEQ ID NO: 552983 - RNA, 64 nt, hsa
uggaaaauccuaccaagaauuggcuuauuuaauuuuccagaaccaggaaugaguaucuaauagc

SEQ ID NO: 552984 - RNA, 64 nt, hsa
uggacaguugauaaaaguuccauccauagcauauuuccagaauaucccuagaugaugaauuuaa

SEQ ID NO: 552985 - RNA, 64 nt, hsa
uuauccuaaguucugaggagccauaaaaauaguuuuccagaauggauuuuuuuuuuuagauaaa

SEQ ID NO: 552986 - RNA, 64 nt, hsa
uuacaagacugaagacccagaguauacuuuuucuuuccagaaauaauuucauaccgccuaugaa

SEQ ID NO: 552987 - RNA, 64 nt, hsa
gaaucagaggaaucagacagaggaggauagcucuuuccagaauccacacuucugaccucagccu

SEQ ID NO: 552988 - RNA, 64 nt, hsa
gaugggcaagugacagaccuuccccaggcucugcuuccagaacucuaaugggaaacugggccug

SEQ ID NO: 552989 - RNA, 64 nt, hsa
gauugcagucaguuccugggugcauugucgcugauuccagaagucauucuugaccagccaugaa

SEQ ID NO: 552990 - RNA, 64 nt, hsa
gccauuugguuaagguuaccugcuuuuuauuuuauuccagaaauaagauaguuacagcauagca

SEQ ID NO: 552991 - RNA, 64 nt, hsa
guuggagcuugcacauuuaaaccagcagcauacguuccagaagagcaucucaaguuaccaaauu

SEQ ID NO: 552992 - RNA, 64 nt, hsa
acacuuacuuucaucuauguugguuucugucucguuccagaacccacagccuccacccguggcu

SEQ ID NO: 552993 - RNA, 64 nt, hsa
agaaaccucaggccgugugaagagcagcaaagcuuuccagaaggcauaaaaggaaacuugaaua

SEQ ID NO: 552994 - RNA, 64 nt, hsa
aaaugugaccaauuuagcacaaauucucucuuaguuccagaaaaaucaguaaaugcacaugccc

SEQ ID NO: 552995 - RNA, 64 nt, hsa
uuccucuuuucucuguaauuuguuacuaaacaaauuccagaauuuguuuaguagcugaguguuc

SEQ ID NO: 552996 - RNA, 64 nt, hsa
aaugauuguugacucuggucuguuucugacaccuuuccagaaaaaagucaauuguucagguaca

SEQ ID NO: 552997 - RNA, 64 nt, hsa
uuauagaacuucuggaucuaacucacaaacaagcuuccagaagagacuagagaccuuaggccag

SEQ ID NO: 552998 - RNA, 64 nt, hsa
cuccaagggccagggcaccugggagacgggaggauuccagaacagcagcacugagcucccaccc

SEQ ID NO: 552999 - RNA, 64 nt, hsa
ugauuaauuuccuucucagcaaaccuccgggagguuccagaaugaguucuuccugacagguugu

SEQ ID NO: 553000 - RNA, 64 nt, hsa
acugagcccaaguguauucucuggccugggccccuuccagaaucagugcgagcguccugcagag

SEQ ID NO: 553001 - RNA, 64 nt, hsa
uccccccacaggcccugcuuugcuugccugcuuuuuccagaaucgauuuugcaagcuucaagau

SEQ ID NO: 553002 - RNA, 64 nt, hsa
gaauaacaauauuuuuccaaauugaaaguaaauauuccagaaguugauagccugguuaaaaguu

SEQ ID NO: 553003 - RNA, 64 nt, hsa
aagaggucuucauuuagacaugugauuucuaaaauuccagaaagcaaaauugauaagauguuag

SEQ ID NO: 553004 - RNA, 64 nt, hsa
agccagcccgccuccggggcggacccugcuccacuuccagaagccaggacuaggaccugggccu

SEQ ID NO: 553005 - RNA, 64 nt, hsa
aaaaucaugugcuucuucugaucaauuuugguuguuccagaauuucuucauaccuuuuccacau

SEQ ID NO: 553006 - RNA, 64 nt, hsa
uuuugccagguuuuucugacuugauuucuguaauuuccagaaacccagacuucucauuuccaca

SEQ ID NO: 553007 - RNA, 64 nt, hsa
acacuuugauuuucuaagaggaagguacuuuaaguuccagaaugaacauguagcugcacuaugc

SEQ ID NO: 553008 - RNA, 64 nt, hsa
uuuucaaaagaaacuugccuuuuacauuauuguguuccagaacauuaagugacuguagguacug

SEQ ID NO: 553009 - RNA, 64 nt, hsa
uaaagaaucuggaugcuggacucacugacaagcuuuccagaagcaauuuuauaacagauuucau

SEQ ID NO: 553010 - RNA, 64 nt, hsa; identical to SEQ ID NO: 86802

SEQ ID NO: 553011 - RNA, 64 nt, hsa; identical to SEQ ID NO: 86803

SEQ ID NO: 553012 - RNA, 64 nt, hsa; identical to SEQ ID NO: 299042

SEQ ID NO: 553013 - RNA, 64 nt, hsa; identical to SEQ ID NO: 299043

SEQ ID NO: 553014 - RNA, 64 nt, hsa; identical to SEQ ID NO: 299044

SEQ ID NO: 553015 - RNA, 64 nt, hsa; identical to SEQ ID NO: 299045

SEQ ID NO: 553016 - RNA, 64 nt, hsa; identical to SEQ ID NO: 299046

SEQ ID NO: 553017 - RNA, 64 nt, hsa; identical to SEQ ID NO: 299047

SEQ ID NO: 553018 - RNA, 64 nt, hsa; identical to SEQ ID NO: 299048

SEQ ID NO: 553019 - RNA, 64 nt, hsa; identical to SEQ ID NO: 299049

SEQ ID NO: 553020 - RNA, 64 nt, hsa; identical to SEQ ID NO: 299050

SEQ ID NO: 553021 - RNA, 64 nt, hsa; identical to SEQ ID NO: 299051

SEQ ID NO: 553022 - RNA, 64 nt, hsa; identical to SEQ ID NO: 299052

SEQ ID NO: 553023 - RNA, 64 nt, hsa; identical to SEQ ID NO: 299053

SEQ ID NO: 553024 - RNA, 64 nt, hsa; identical to SEQ ID NO: 299054

SEQ ID NO: 553025 - RNA, 64 nt, hsa; identical to SEQ ID NO: 299055

SEQ ID NO: 553026 - RNA, 64 nt, hsa; identical to SEQ ID NO: 299056

SEQ ID NO: 553027 - RNA, 64 nt, hsa; identical to SEQ ID NO: 299057

SEQ ID NO: 553028 - RNA, 64 nt, hsa; identical to SEQ ID NO: 299058

SEQ ID NO: 553029 - RNA, 64 nt, hsa; identical to SEQ ID NO: 299059

SEQ ID NO: 553030 - RNA, 64 nt, hsa; identical to SEQ ID NO: 299060

SEQ ID NO: 553031 - RNA, 64 nt, hsa; identical to SEQ ID NO: 299061

SEQ ID NO: 553032 - RNA, 64 nt, hsa; identical to SEQ ID NO: 299062

SEQ ID NO: 553033 - RNA, 64 nt, hsa; identical to SEQ ID NO: 299063

SEQ ID NO: 553034 - RNA, 64 nt, hsa; identical to SEQ ID NO: 299064

SEQ ID NO: 553035 - RNA, 64 nt, hsa; identical to SEQ ID NO: 299065

SEQ ID NO: 553036 - RNA, 64 nt, hsa; identical to SEQ ID NO: 299066

SEQ ID NO: 553037 - RNA, 64 nt, hsa; identical to SEQ ID NO: 299067

SEQ ID NO: 553038 - RNA, 64 nt, hsa; identical to SEQ ID NO: 299068

SEQ ID NO: 553039 - RNA, 64 nt, hsa; identical to SEQ ID NO: 299069

SEQ ID NO: 553040 - RNA, 64 nt, hsa; identical to SEQ ID NO: 299070

SEQ ID NO: 553041 - RNA, 64 nt, hsa; identical to SEQ ID NO: 299071

SEQ ID NO: 553042 - RNA, 64 nt, hsa; identical to SEQ ID NO: 299072

SEQ ID NO: 553043 - RNA, 64 nt, hsa; identical to SEQ ID NO: 299073

SEQ ID NO: 553044 - RNA, 64 nt, hsa; identical to SEQ ID NO: 299074

SEQ ID NO: 553045 - RNA, 64 nt, hsa; identical to SEQ ID NO: 299075

SEQ ID NO: 553046 - RNA, 64 nt, hsa; identical to SEQ ID NO: 299076

SEQ ID NO: 553047 - RNA, 64 nt, hsa; identical to SEQ ID NO: 299077

SEQ ID NO: 553048 - RNA, 64 nt, hsa; identical to SEQ ID NO: 299078

SEQ ID NO: 553049 - RNA, 64 nt, hsa; identical to SEQ ID NO: 299079

SEQ ID NO: 553050 - RNA, 64 nt, hsa; identical to SEQ ID NO: 299080

SEQ ID NO: 553051 - RNA, 64 nt, hsa; identical to SEQ ID NO: 299081

SEQ ID NO: 553052 - RNA, 64 nt, hsa; identical to SEQ ID NO: 299082

SEQ ID NO: 553053 - RNA, 64 nt, hsa; identical to SEQ ID NO: 299083

SEQ ID NO: 553054 - RNA, 64 nt, hsa; identical to SEQ ID NO: 299084

SEQ ID NO: 553055 - RNA, 64 nt, hsa; identical to SEQ ID NO: 299085

SEQ ID NO: 553056 - RNA, 64 nt, hsa; identical to SEQ ID NO: 299086

SEQ ID NO: 553057 - RNA, 64 nt, hsa; identical to SEQ ID NO: 299087

SEQ ID NO: 553058 - RNA, 64 nt, hsa; identical to SEQ ID NO: 299088

SEQ ID NO: 553059 - RNA, 64 nt, hsa; identical to SEQ ID NO: 299089

SEQ ID NO: 553060 - RNA, 51 nt, hsa; identical to SEQ ID NO: 299090

SEQ ID NO: 553061 - RNA, 64 nt, hsa; identical to SEQ ID NO: 299091

SEQ ID NO: 553062 - RNA, 64 nt, hsa; identical to SEQ ID NO: 299092

SEQ ID NO: 553063 - RNA, 64 nt, hsa; identical to SEQ ID NO: 299093

SEQ ID NO: 553064 - RNA, 64 nt, hsa; identical to SEQ ID NO: 299094

SEQ ID NO: 553065 - RNA, 64 nt, hsa; identical to SEQ ID NO: 299095

SEQ ID NO: 553066 - RNA, 64 nt, hsa; identical to SEQ ID NO: 299096

SEQ ID NO: 553067 - RNA, 64 nt, hsa; identical to SEQ ID NO: 299097

SEQ ID NO: 553068 - RNA, 64 nt, hsa; identical to SEQ ID NO: 299098

SEQ ID NO: 553069 - RNA, 64 nt, hsa; identical to SEQ ID NO: 299099

SEQ ID NO: 553070 - RNA, 64 nt, hsa; identical to SEQ ID NO: 299100

SEQ ID NO: 553071 - RNA, 64 nt, hsa; identical to SEQ ID NO: 299101

SEQ ID NO: 553072 - RNA, 64 nt, hsa; identical to SEQ ID NO: 299102

SEQ ID NO: 553073 - RNA, 64 nt, hsa; identical to SEQ ID NO: 299103

SEQ ID NO: 553074 - RNA, 64 nt, hsa; identical to SEQ ID NO: 299104

SEQ ID NO: 553075 - RNA, 64 nt, hsa; identical to SEQ ID NO: 299105

SEQ ID NO: 553076 - RNA, 64 nt, hsa; identical to SEQ ID NO: 299106

SEQ ID NO: 553077 - RNA, 64 nt, hsa; identical to SEQ ID NO: 299107

SEQ ID NO: 553078 - RNA, 64 nt, hsa; identical to SEQ ID NO: 299108

SEQ ID NO: 553079 - RNA, 64 nt, hsa; identical to SEQ ID NO: 299109

SEQ ID NO: 553080 - RNA, 64 nt, hsa; identical to SEQ ID NO: 299110

SEQ ID NO: 553081 - RNA, 64 nt, hsa; identical to SEQ ID NO: 299111

SEQ ID NO: 553082 - RNA, 64 nt, hsa; identical to SEQ ID NO: 299112

SEQ ID NO: 553083 - RNA, 64 nt, hsa; identical to SEQ ID NO: 299113

SEQ ID NO: 553084 - RNA, 64 nt, hsa; identical to SEQ ID NO: 299114

SEQ ID NO: 553085 - RNA, 64 nt, hsa; identical to SEQ ID NO: 299115

SEQ ID NO: 553086 - RNA, 64 nt, hsa; identical to SEQ ID NO: 299116

SEQ ID NO: 553087 - RNA, 64 nt, hsa; identical to SEQ ID NO: 299117

SEQ ID NO: 553088 - RNA, 64 nt, hsa; identical to SEQ ID NO: 299118

SEQ ID NO: 553089 - RNA, 64 nt, hsa; identical to SEQ ID NO: 299119

SEQ ID NO: 553090 - RNA, 64 nt, hsa; identical to SEQ ID NO: 299120

SEQ ID NO: 553091 - RNA, 64 nt, hsa; identical to SEQ ID NO: 299121

SEQ ID NO: 553092 - RNA, 64 nt, hsa; identical to SEQ ID NO: 299122

SEQ ID NO: 553093 - RNA, 64 nt, hsa; identical to SEQ ID NO: 299123

SEQ ID NO: 553094 - RNA, 64 nt, hsa; identical to SEQ ID NO: 299124

SEQ ID NO: 553095 - RNA, 64 nt, hsa; identical to SEQ ID NO: 299125

SEQ ID NO: 553096 - RNA, 64 nt, hsa; identical to SEQ ID NO: 299126

SEQ ID NO: 553097 - RNA, 64 nt, hsa; identical to SEQ ID NO: 299127

SEQ ID NO: 553098 - RNA, 64 nt, hsa; identical to SEQ ID NO: 299128

SEQ ID NO: 553099 - RNA, 64 nt, hsa; identical to SEQ ID NO: 299129

SEQ ID NO: 553100 - RNA, 64 nt, hsa; identical to SEQ ID NO: 299130

SEQ ID NO: 553101 - RNA, 64 nt, hsa; identical to SEQ ID NO: 299131

SEQ ID NO: 553102 - RNA, 64 nt, hsa; identical to SEQ ID NO: 299132

SEQ ID NO: 553103 - RNA, 64 nt, hsa; identical to SEQ ID NO: 299133

SEQ ID NO: 553104 - RNA, 64 nt, hsa; identical to SEQ ID NO: 299134

SEQ ID NO: 553105 - RNA, 64 nt, hsa; identical to SEQ ID NO: 299135

SEQ ID NO: 553106 - RNA, 64 nt, hsa; identical to SEQ ID NO: 299136

SEQ ID NO: 553107 - RNA, 64 nt, hsa; identical to SEQ ID NO: 299137

SEQ ID NO: 553108 - RNA, 64 nt, hsa; identical to SEQ ID NO: 299138

SEQ ID NO: 553109 - RNA, 64 nt, hsa; identical to SEQ ID NO: 299139

SEQ ID NO: 553110 - RNA, 64 nt, hsa; identical to SEQ ID NO: 299140

SEQ ID NO: 553111 - RNA, 64 nt, hsa; identical to SEQ ID NO: 299141

SEQ ID NO: 553112 - RNA, 64 nt, hsa; identical to SEQ ID NO: 299142

SEQ ID NO: 553113 - RNA, 64 nt, hsa; identical to SEQ ID NO: 299143

SEQ ID NO: 553114 - RNA, 64 nt, hsa; identical to SEQ ID NO: 299144

SEQ ID NO: 553115 - RNA, 64 nt, hsa; identical to SEQ ID NO: 299145

SEQ ID NO: 553116 - RNA, 64 nt, hsa; identical to SEQ ID NO: 299146

SEQ ID NO: 553117 - RNA, 64 nt, hsa; identical to SEQ ID NO: 299147

SEQ ID NO: 553118 - RNA, 64 nt, hsa; identical to SEQ ID NO: 299148

SEQ ID NO: 553119 - RNA, 64 nt, hsa
cguacuacugccaucuuaguaaaaauuuugaaaggaugaccacucagaacaacucucuugauga

SEQ ID NO: 553120 - RNA, 64 nt, hsa
uuuugaaaggaugaccacucagaacaacucucuugaugaccauucugucuggaucuacugacau

SEQ ID NO: 553121 - RNA, 64 nt, hsa
cacgccuuuuaggaaaaagaaaagugagugaacagcaaggaagaguguuugcacaguacaguaa

SEQ ID NO: 553122 - RNA, 64 nt, hsa
aguuaccuucacaauggugcuaccccuugcccaggcaaggaaagacagcagugaugacacuguc

SEQ ID NO: 553123 - RNA, 64 nt, hsa
gaaaacuggaucaagauucuagcccacuggaguugcaaggaaugagaggcaaaaauucuaaaga

SEQ ID NO: 553124 - RNA, 64 nt, hsa
aauuaagaggggccaagaggaagacauucuuucugcaaggaaauuucuuuuaaauucugaacug

SEQ ID NO: 553125 - RNA, 64 nt, hsa
ccagguuccccucuggugucaugucaggcauuuugcaaggaaaagccacuuggggaaagaugga

SEQ ID NO: 553126 - RNA, 62 nt, hsa; identical to SEQ ID NO: 82022

SEQ ID NO: 553127 - RNA, 64 nt, hsa
gaugcaugcuuuaauauuugccuauagcccggcagcaaggaagucggggcggggggacuuuuuu

SEQ ID NO: 553128 - RNA, 64 nt, hsa
caaaugccugucauuucacaguaccacuccaaaggcaaggaaccaugauugacaacagucaagc

SEQ ID NO: 553129 - RNA, 64 nt, hsa
caggcaagcugugaucugaaaggagcaaggaacagcaaggaauuauuuuccagaaugacacccg

SEQ ID NO: 553130 - RNA, 64 nt, hsa
ggggucugaccaggcaagcugugaucugaaaggagcaaggaacagcaaggaauuauuuuccaga

SEQ ID NO: 553131 - RNA, 64 nt, hsa; identical to SEQ ID NO: 188922

SEQ ID NO: 553132 - RNA, 64 nt, hsa; identical to SEQ ID NO: 188923

SEQ ID NO: 553133 - RNA, 64 nt, hsa; identical to SEQ ID NO: 188924

SEQ ID NO: 553134 - RNA, 64 nt, hsa; identical to SEQ ID NO: 188925

SEQ ID NO: 553135 - RNA, 64 nt, hsa; identical to SEQ ID NO: 188926

SEQ ID NO: 553136 - RNA, 64 nt, hsa; identical to SEQ ID NO: 188927

SEQ ID NO: 553137 - RNA, 64 nt, hsa; identical to SEQ ID NO: 188928

SEQ ID NO: 553138 - RNA, 64 nt, hsa; identical to SEQ ID NO: 188929

SEQ ID NO: 553139 - RNA, 64 nt, hsa; identical to SEQ ID NO: 188930

SEQ ID NO: 553140 - RNA, 64 nt, hsa; identical to SEQ ID NO: 188931

SEQ ID NO: 553141 - RNA, 64 nt, hsa; identical to SEQ ID NO: 188932

SEQ ID NO: 553142 - RNA, 64 nt, hsa; identical to SEQ ID NO: 188933

SEQ ID NO: 553143 - RNA, 64 nt, hsa; identical to SEQ ID NO: 188934

SEQ ID NO: 553144 - RNA, 64 nt, hsa; identical to SEQ ID NO: 188935

SEQ ID NO: 553145 - RNA, 64 nt, hsa; identical to SEQ ID NO: 188936

SEQ ID NO: 553146 - RNA, 64 nt, hsa; identical to SEQ ID NO: 188937

SEQ ID NO: 553147 - RNA, 64 nt, hsa; identical to SEQ ID NO: 188938

SEQ ID NO: 553148 - RNA, 60 nt, hsa; identical to SEQ ID NO: 188939

SEQ ID NO: 553149 - RNA, 64 nt, hsa; identical to SEQ ID NO: 188940

SEQ ID NO: 553150 - RNA, 64 nt, hsa; identical to SEQ ID NO: 188941

SEQ ID NO: 553151 - RNA, 64 nt, hsa; identical to SEQ ID NO: 188942

SEQ ID NO: 553152 - RNA, 64 nt, hsa; identical to SEQ ID NO: 188943

SEQ ID NO: 553153 - RNA, 64 nt, hsa; identical to SEQ ID NO: 188944

SEQ ID NO: 553154 - RNA, 64 nt, hsa; identical to SEQ ID NO: 188945

SEQ ID NO: 553155 - RNA, 64 nt, hsa; identical to SEQ ID NO: 531886

SEQ ID NO: 553156 - RNA, 64 nt, hsa; identical to SEQ ID NO: 531887

SEQ ID NO: 553157 - RNA, 64 nt, hsa; identical to SEQ ID NO: 531888

SEQ ID NO: 553158 - RNA, 64 nt, hsa; identical to SEQ ID NO: 531889

SEQ ID NO: 553159 - RNA, 64 nt, hsa; identical to SEQ ID NO: 531890

SEQ ID NO: 553160 - RNA, 64 nt, hsa; identical to SEQ ID NO: 531891

SEQ ID NO: 553161 - RNA, 64 nt, hsa; identical to SEQ ID NO: 531892

SEQ ID NO: 553162 - RNA, 64 nt, hsa; identical to SEQ ID NO: 531893

SEQ ID NO: 553163 - RNA, 64 nt, hsa; identical to SEQ ID NO: 531894

SEQ ID NO: 553164 - RNA, 64 nt, hsa; identical to SEQ ID NO: 531895

SEQ ID NO: 553165 - RNA, 64 nt, hsa; identical to SEQ ID NO: 531896

SEQ ID NO: 553166 - RNA, 64 nt, hsa; identical to SEQ ID NO: 531897

SEQ ID NO: 553167 - RNA, 64 nt, hsa; identical to SEQ ID NO: 531898

SEQ ID NO: 553168 - RNA, 64 nt, hsa; identical to SEQ ID NO: 531899

SEQ ID NO: 553169 - RNA, 64 nt, hsa; identical to SEQ ID NO: 531900

SEQ ID NO: 553170 - RNA, 64 nt, hsa; identical to SEQ ID NO: 531901

SEQ ID NO: 553171 - RNA, 64 nt, hsa; identical to SEQ ID NO: 531902

SEQ ID NO: 553172 - RNA, 64 nt, hsa; identical to SEQ ID NO: 531903

SEQ ID NO: 553173 - RNA, 64 nt, hsa; identical to SEQ ID NO: 531904

SEQ ID NO: 553174 - RNA, 64 nt, hsa; identical to SEQ ID NO: 531905

SEQ ID NO: 553175 - RNA, 64 nt, hsa; identical to SEQ ID NO: 531906

SEQ ID NO: 553176 - RNA, 64 nt, hsa; identical to SEQ ID NO: 531907

SEQ ID NO: 553177 - RNA, 64 nt, hsa; identical to SEQ ID NO: 531908

SEQ ID NO: 553178 - RNA, 64 nt, hsa; identical to SEQ ID NO: 531909

SEQ ID NO: 553179 - RNA, 64 nt, hsa; identical to SEQ ID NO: 531910

SEQ ID NO: 553180 - RNA, 64 nt, hsa; identical to SEQ ID NO: 531911

SEQ ID NO: 553181 - RNA, 64 nt, hsa; identical to SEQ ID NO: 531912

SEQ ID NO: 553182 - RNA, 64 nt, hsa; identical to SEQ ID NO: 531913

SEQ ID NO: 553183 - RNA, 64 nt, hsa; identical to SEQ ID NO: 531914

SEQ ID NO: 553184 - RNA, 64 nt, hsa; identical to SEQ ID NO: 531915

SEQ ID NO: 553185 - RNA, 64 nt, hsa; identical to SEQ ID NO: 531916

SEQ ID NO: 553186 - RNA, 64 nt, hsa; identical to SEQ ID NO: 531917

SEQ ID NO: 553187 - RNA, 64 nt, hsa; identical to SEQ ID NO: 531918

SEQ ID NO: 553188 - RNA, 64 nt, hsa; identical to SEQ ID NO: 531919

SEQ ID NO: 553189 - RNA, 64 nt, hsa; identical to SEQ ID NO: 531920

SEQ ID NO: 553190 - RNA, 64 nt, hsa; identical to SEQ ID NO: 531921

SEQ ID NO: 553191 - RNA, 64 nt, hsa; identical to SEQ ID NO: 531922

SEQ ID NO: 553192 - RNA, 64 nt, hsa; identical to SEQ ID NO: 211201

SEQ ID NO: 553193 - RNA, 64 nt, hsa; identical to SEQ ID NO: 211202

SEQ ID NO: 553194 - RNA, 64 nt, hsa; identical to SEQ ID NO: 211203

SEQ ID NO: 553195 - RNA, 64 nt, hsa; identical to SEQ ID NO: 211204

SEQ ID NO: 553196 - RNA, 64 nt, hsa; identical to SEQ ID NO: 211205

SEQ ID NO: 553197 - RNA, 64 nt, hsa; identical to SEQ ID NO: 211206

SEQ ID NO: 553198 - RNA, 64 nt, hsa; identical to SEQ ID NO: 267144

SEQ ID NO: 553199 - RNA, 64 nt, hsa; identical to SEQ ID NO: 267145

SEQ ID NO: 553200 - RNA, 64 nt, hsa; identical to SEQ ID NO: 267146

SEQ ID NO: 553201 - RNA, 64 nt, hsa; identical to SEQ ID NO: 267147

SEQ ID NO: 553202 - RNA, 64 nt, hsa; identical to SEQ ID NO: 267148

SEQ ID NO: 553203 - RNA, 64 nt, hsa; identical to SEQ ID NO: 267149

SEQ ID NO: 553204 - RNA, 64 nt, hsa; identical to SEQ ID NO: 267150

SEQ ID NO: 553205 - RNA, 64 nt, hsa; identical to SEQ ID NO: 267151

SEQ ID NO: 553206 - RNA, 64 nt, hsa; identical to SEQ ID NO: 267152

SEQ ID NO: 553207 - RNA, 64 nt, hsa; identical to SEQ ID NO: 267153

SEQ ID NO: 553208 - RNA, 64 nt, hsa; identical to SEQ ID NO: 267154

SEQ ID NO: 553209 - RNA, 64 nt, hsa; identical to SEQ ID NO: 267155

SEQ ID NO: 553210 - RNA, 64 nt, hsa; identical to SEQ ID NO: 267156

SEQ ID NO: 553211 - RNA, 64 nt, hsa; identical to SEQ ID NO: 267157

SEQ ID NO: 553212 - RNA, 64 nt, hsa; identical to SEQ ID NO: 267157

SEQ ID NO: 553213 - RNA, 64 nt, hsa; identical to SEQ ID NO: 267159

SEQ ID NO: 553214 - RNA, 64 nt, hsa; identical to SEQ ID NO: 267160

SEQ ID NO: 553215 - RNA, 64 nt, hsa; identical to SEQ ID NO: 267161

SEQ ID NO: 553216 - RNA, 64 nt, hsa; identical to SEQ ID NO: 267162

SEQ ID NO: 553217 - RNA, 64 nt, hsa; identical to SEQ ID NO: 267163

SEQ ID NO: 553218 - RNA, 64 nt, hsa; identical to SEQ ID NO: 267164

SEQ ID NO: 553219 - RNA, 64 nt, hsa; identical to SEQ ID NO: 267165

SEQ ID NO: 553220 - RNA, 64 nt, hsa; identical to SEQ ID NO: 267166

SEQ ID NO: 553221 - RNA, 64 nt, hsa; identical to SEQ ID NO: 267167

SEQ ID NO: 553222 - RNA, 64 nt, hsa; identical to SEQ ID NO: 267168

SEQ ID NO: 553223 - RNA, 64 nt, hsa; identical to SEQ ID NO: 267169

SEQ ID NO: 553224 - RNA, 64 nt, hsa; identical to SEQ ID NO: 267170

SEQ ID NO: 553225 - RNA, 64 nt, hsa; identical to SEQ ID NO: 267171

SEQ ID NO: 553226 - RNA, 64 nt, hsa; identical to SEQ ID NO: 267172

SEQ ID NO: 553227 - RNA, 64 nt, hsa; identical to SEQ ID NO: 267173

SEQ ID NO: 553228 - RNA, 64 nt, hsa; identical to SEQ ID NO: 267174

SEQ ID NO: 553229 - RNA, 64 nt, hsa; identical to SEQ ID NO: 267175

SEQ ID NO: 553230 - RNA, 64 nt, hsa; identical to SEQ ID NO: 267176

SEQ ID NO: 553231 - RNA, 64 nt, hsa; identical to SEQ ID NO: 267177

SEQ ID NO: 553232 - RNA, 64 nt, hsa; identical to SEQ ID NO: 267178

SEQ ID NO: 553233 - RNA, 64 nt, hsa; identical to SEQ ID NO: 267179

SEQ ID NO: 553234 - RNA, 64 nt, hsa; identical to SEQ ID NO: 267180

SEQ ID NO: 553235 - RNA, 64 nt, hsa; identical to SEQ ID NO: 267181

SEQ ID NO: 553236 - RNA, 64 nt, hsa; identical to SEQ ID NO: 267182

SEQ ID NO: 553237 - RNA, 64 nt, hsa; identical to SEQ ID NO: 267183

SEQ ID NO: 553238 - RNA, 64 nt, hsa; identical to SEQ ID NO: 267184

SEQ ID NO: 553239 - RNA, 64 nt, hsa; identical to SEQ ID NO: 267185

SEQ ID NO: 553240 - RNA, 64 nt, hsa; identical to SEQ ID NO: 267186

SEQ ID NO: 553241 - RNA, 64 nt, hsa; identical to SEQ ID NO: 267187

SEQ ID NO: 553242 - RNA, 64 nt, hsa; identical to SEQ ID NO: 267188

SEQ ID NO: 553243 - RNA, 64 nt, hsa; identical to SEQ ID NO: 267189

SEQ ID NO: 553244 - RNA, 64 nt, hsa; identical to SEQ ID NO: 267190

SEQ ID NO: 553245 - RNA, 64 nt, hsa; identical to SEQ ID NO: 267191

SEQ ID NO: 553246 - RNA, 64 nt, hsa; identical to SEQ ID NO: 267192

SEQ ID NO: 553247 - RNA, 64 nt, hsa; identical to SEQ ID NO: 267193

SEQ ID NO: 553248 - RNA, 64 nt, hsa; identical to SEQ ID NO: 267194

SEQ ID NO: 553249 - RNA, 64 nt, hsa; identical to SEQ ID NO: 267195

SEQ ID NO: 553250 - RNA, 64 nt, hsa; identical to SEQ ID NO: 267196

SEQ ID NO: 553251 - RNA, 64 nt, hsa; identical to SEQ ID NO: 267197

SEQ ID NO: 553252 - RNA, 64 nt, hsa; identical to SEQ ID NO: 267198

SEQ ID NO: 553253 - RNA, 64 nt, hsa; identical to SEQ ID NO: 267199

SEQ ID NO: 553254 - RNA, 64 nt, hsa; identical to SEQ ID NO: 267200

SEQ ID NO: 553255 - RNA, 64 nt, hsa; identical to SEQ ID NO: 437590

SEQ ID NO: 553256 - RNA, 64 nt, hsa; identical to SEQ ID NO: 437591

SEQ ID NO: 553257 - RNA, 64 nt, hsa; identical to SEQ ID NO: 437592

SEQ ID NO: 553258 - RNA, 64 nt, hsa; identical to SEQ ID NO: 437593

SEQ ID NO: 553259 - RNA, 64 nt, hsa; identical to SEQ ID NO: 437594

SEQ ID NO: 553260 - RNA, 64 nt, hsa; identical to SEQ ID NO: 437595

SEQ ID NO: 553261 - RNA, 64 nt, hsa; identical to SEQ ID NO: 437596

SEQ ID NO: 553262 - RNA, 64 nt, hsa; identical to SEQ ID NO: 437597

SEQ ID NO: 553263 - RNA, 64 nt, hsa; identical to SEQ ID NO: 437598

SEQ ID NO: 553264 - RNA, 64 nt, hsa; identical to SEQ ID NO: 437599

SEQ ID NO: 553265 - RNA, 64 nt, hsa; identical to SEQ ID NO: 437600

SEQ ID NO: 553266 - RNA, 64 nt, hsa; identical to SEQ ID NO: 437601

SEQ ID NO: 553267 - RNA, 64 nt, hsa; identical to SEQ ID NO: 437602

SEQ ID NO: 553268 - RNA, 64 nt, hsa; identical to SEQ ID NO: 300465

SEQ ID NO: 553269 - RNA, 64 nt, hsa; identical to SEQ ID NO: 300466

SEQ ID NO: 553270 - RNA, 64 nt, hsa; identical to SEQ ID NO: 300467

SEQ ID NO: 553271 - RNA, 64 nt, hsa; identical to SEQ ID NO: 300468

SEQ ID NO: 553272 - RNA, 64 nt, hsa; identical to SEQ ID NO: 300469

SEQ ID NO: 553273 - RNA, 64 nt, hsa; identical to SEQ ID NO: 300470

SEQ ID NO: 553274 - RNA, 64 nt, hsa; identical to SEQ ID NO: 300471

SEQ ID NO: 553275 - RNA, 64 nt, hsa; identical to SEQ ID NO: 300472

SEQ ID NO: 553276 - RNA, 64 nt, hsa; identical to SEQ ID NO: 313115

SEQ ID NO: 553277 - RNA, 64 nt, hsa; identical to SEQ ID NO: 313116

SEQ ID NO: 553278 - RNA, 64 nt, hsa; identical to SEQ ID NO: 313117

SEQ ID NO: 553279 - RNA, 64 nt, hsa; identical to SEQ ID NO: 313118

SEQ ID NO: 553280 - RNA, 64 nt, hsa; identical to SEQ ID NO: 313119

SEQ ID NO: 553281 - RNA, 64 nt, hsa; identical to SEQ ID NO: 313120

SEQ ID NO: 553282 - RNA, 64 nt, hsa; identical to SEQ ID NO: 313121

SEQ ID NO: 553283 - RNA, 64 nt, hsa; identical to SEQ ID NO: 313122

SEQ ID NO: 553284 - RNA, 64 nt, hsa; identical to SEQ ID NO: 313123

SEQ ID NO: 553285 - RNA, 64 nt, hsa; identical to SEQ ID NO: 313124

SEQ ID NO: 553286 - RNA, 64 nt, hsa; identical to SEQ ID NO: 263047

SEQ ID NO: 553287 - RNA, 64 nt, hsa; identical to SEQ ID NO: 263048

SEQ ID NO: 553288 - RNA, 64 nt, hsa; identical to SEQ ID NO: 263049

SEQ ID NO: 553289 - RNA, 64 nt, hsa; identical to SEQ ID NO: 263050

SEQ ID NO: 553290 - RNA, 64 nt, hsa; identical to SEQ ID NO: 263051

SEQ ID NO: 553291 - RNA, 64 nt, hsa; identical to SEQ ID NO: 263052

SEQ ID NO: 553292 - RNA, 64 nt, hsa; identical to SEQ ID NO: 263053

SEQ ID NO: 553293 - RNA, 64 nt, hsa; identical to SEQ ID NO: 263054

SEQ ID NO: 553294 - RNA, 64 nt, hsa; identical to SEQ ID NO: 263055

SEQ ID NO: 553295 - RNA, 64 nt, hsa; identical to SEQ ID NO: 263056

SEQ ID NO: 553296 - RNA, 64 nt, hsa; identical to SEQ ID NO: 263057

SEQ ID NO: 553297 - RNA, 64 nt, hsa; identical to SEQ ID NO: 263058

SEQ ID NO: 553298 - RNA, 64 nt, hsa; identical to SEQ ID NO: 263059

SEQ ID NO: 553299 - RNA, 64 nt, hsa; identical to SEQ ID NO: 263060

SEQ ID NO: 553300 - RNA, 64 nt, hsa; identical to SEQ ID NO: 263061

SEQ ID NO: 553301 - RNA, 64 nt, hsa; identical to SEQ ID NO: 263062

SEQ ID NO: 553302 - RNA, 64 nt, hsa; identical to SEQ ID NO: 263063

SEQ ID NO: 553303 - RNA, 64 nt, hsa; identical to SEQ ID NO: 263064

SEQ ID NO: 553304 - RNA, 64 nt, hsa; identical to SEQ ID NO: 263065

SEQ ID NO: 553305 - RNA, 64 nt, hsa; identical to SEQ ID NO: 263066

SEQ ID NO: 553306 - RNA, 64 nt, hsa; identical to SEQ ID NO: 263067

SEQ ID NO: 553307 - RNA, 64 nt, hsa; identical to SEQ ID NO: 263068

SEQ ID NO: 553308 - RNA, 64 nt, hsa; identical to SEQ ID NO: 263069

SEQ ID NO: 553309 - RNA, 64 nt, hsa; identical to SEQ ID NO: 263070

SEQ ID NO: 553310 - RNA, 64 nt, hsa; identical to SEQ ID NO: 263071

SEQ ID NO: 553311 - RNA, 64 nt, hsa; identical to SEQ ID NO: 263072

SEQ ID NO: 553312 - RNA, 64 nt, hsa; identical to SEQ ID NO: 263073

SEQ ID NO: 553313 - RNA, 64 nt, hsa; identical to SEQ ID NO: 263074

SEQ ID NO: 553314 - RNA, 64 nt, hsa; identical to SEQ ID NO: 263075

SEQ ID NO: 553315 - RNA, 64 nt, hsa; identical to SEQ ID NO: 263076

SEQ ID NO: 553316 - RNA, 64 nt, hsa; identical to SEQ ID NO: 263077

SEQ ID NO: 553317 - RNA, 64 nt, hsa; identical to SEQ ID NO: 263078

SEQ ID NO: 553318 - RNA, 64 nt, hsa; identical to SEQ ID NO: 263079

SEQ ID NO: 553319 - RNA, 64 nt, hsa; identical to SEQ ID NO: 263080

SEQ ID NO: 553320 - RNA, 64 nt, hsa; identical to SEQ ID NO: 263081

SEQ ID NO: 553321 - RNA, 64 nt, hsa; identical to SEQ ID NO: 263082

SEQ ID NO: 553322 - RNA, 64 nt, hsa; identical to SEQ ID NO: 263083

SEQ ID NO: 553323 - RNA, 64 nt, hsa; identical to SEQ ID NO: 263084

SEQ ID NO: 553324 - RNA, 64 nt, hsa; identical to SEQ ID NO: 263085

SEQ ID NO: 553325 - RNA, 64 nt, hsa; identical to SEQ ID NO: 263086

SEQ ID NO: 553326 - RNA, 64 nt, hsa; identical to SEQ ID NO: 263087

SEQ ID NO: 553327 - RNA, 64 nt, hsa; identical to SEQ ID NO: 263088

SEQ ID NO: 553328 - RNA, 64 nt, hsa; identical to SEQ ID NO: 263089

SEQ ID NO: 553329 - RNA, 64 nt, hsa; identical to SEQ ID NO: 263090

SEQ ID NO: 553330 - RNA, 64 nt, hsa; identical to SEQ ID NO: 263091

SEQ ID NO: 553331 - RNA, 64 nt, hsa; identical to SEQ ID NO: 263092

SEQ ID NO: 553332 - RNA, 64 nt, hsa; identical to SEQ ID NO: 263093

SEQ ID NO: 553333 - RNA, 64 nt, hsa; identical to SEQ ID NO: 263094

SEQ ID NO: 553334 - RNA, 64 nt, hsa; identical to SEQ ID NO: 263095

SEQ ID NO: 553335 - RNA, 64 nt, hsa; identical to SEQ ID NO: 263096

SEQ ID NO: 553336 - RNA, 64 nt, hsa; identical to SEQ ID NO: 263097

SEQ ID NO: 553337 - RNA, 64 nt, hsa; identical to SEQ ID NO: 263098

SEQ ID NO: 553338 - RNA, 64 nt, hsa
aagugagaaaccagccgaccggcccugccccucuucccgggaucacuuaaugaaccacguguuu

SEQ ID NO: 553339 - RNA, 64 nt, hsa
cagggcaacucggagagggcugcgagcauuucccucccgggagaggagaucagggcgaccugca

SEQ ID NO: 553340 - RNA, 64 nt, hsa
cgggacucacuggcagccccagcaccaccaggucucccgggaagccacccucccagcucugagg

SEQ ID NO: 553341 - RNA, 64 nt, hsa
cucugccggcucuggcucuccccaauauccucgcucccgggacucacuggcagccccagcacca

SEQ ID NO: 553342 - RNA, 64 nt, hsa
gccucgccugaaucccccauaaacaccagaugauugagucuaccuucuuuccuuggcccgcucc

SEQ ID NO: 553343 - RNA, 64 nt, hsa
gccucacuugaaucccccguaaacaccagacgauugagucuaccuucuuuucuuggccaccucc

SEQ ID NO: 553344 - RNA, 64 nt, hsa
ugugguuccagaaagcucauuaguugagauucugugagucuagguugaccacagaggcaagcac

SEQ ID NO: 553345 - RNA, 64 nt, hsa
gugagucuagguugaccacagaggcaagcacuggugagucuaggacagauuuuacguggagagu

SEQ ID NO: 553346 - RNA, 64 nt, hsa
uaguggacaagggaagggggaggcccagggcuggugagucuagaaugcucuggaacccuacacc

SEQ ID NO: 553347 - RNA, 64 nt, hsa
cucaagaaaagacagaagagacagugauuugggaugagucuacucuaggauuuucaacuuuuua

SEQ ID NO: 553348 - RNA, 64 nt, hsa
uguuacagaaaagacaagaaucuguguuuuggaaugagucuauucuuggguauugaacuuuuag

SEQ ID NO: 553349 - RNA, 64 nt, hsa
uugaagaaaggacagaagaggaaaugcuuugggaugagucuauucuuggauuuugaauguuuag

SEQ ID NO: 553350 - RNA, 64 nt, hsa; identical to SEQ ID NO: 196058

SEQ ID NO: 553351 - RNA, 64 nt, hsa; identical to SEQ ID NO: 196059

SEQ ID NO: 553352 - RNA, 64 nt, hsa; identical to SEQ ID NO: 196060

SEQ ID NO: 553353 - RNA, 64 nt, hsa; identical to SEQ ID NO: 196061

SEQ ID NO: 553354 - RNA, 64 nt, hsa; identical to SEQ ID NO: 196062

SEQ ID NO: 553355 - RNA, 64 nt, hsa; identical to SEQ ID NO: 196063

SEQ ID NO: 553356 - RNA, 64 nt, hsa; identical to SEQ ID NO: 196064

SEQ ID NO: 553357 - RNA, 64 nt, hsa; identical to SEQ ID NO: 196065

SEQ ID NO: 553358 - RNA, 64 nt, hsa; identical to SEQ ID NO: 196066

SEQ ID NO: 553359 - RNA, 64 nt, hsa; identical to SEQ ID NO: 485329

SEQ ID NO: 553360 - RNA, 64 nt, hsa; identical to SEQ ID NO: 485330

SEQ ID NO: 553361 - RNA, 64 nt, hsa; identical to SEQ ID NO: 485331

SEQ ID NO: 553362 - RNA, 64 nt, hsa; identical to SEQ ID NO: 485332

SEQ ID NO: 553363 - RNA, 64 nt, hsa; identical to SEQ ID NO: 485333

SEQ ID NO: 553364 - RNA, 64 nt, hsa; identical to SEQ ID NO: 485334

SEQ ID NO: 553365 - RNA, 64 nt, hsa; identical to SEQ ID NO: 485335

SEQ ID NO: 553366 - RNA, 64 nt, hsa; identical to SEQ ID NO: 485336

SEQ ID NO: 553367 - RNA, 64 nt, hsa; identical to SEQ ID NO: 485337

SEQ ID NO: 553368 - RNA, 64 nt, hsa; identical to SEQ ID NO: 485338

SEQ ID NO: 553369 - RNA, 64 nt, hsa; identical to SEQ ID NO: 485339

SEQ ID NO: 553370 - RNA, 64 nt, hsa; identical to SEQ ID NO: 485340

SEQ ID NO: 553371 - RNA, 64 nt, hsa; identical to SEQ ID NO: 485341

SEQ ID NO: 553372 - RNA, 64 nt, hsa; identical to SEQ ID NO: 485342

SEQ ID NO: 553373 - RNA, 64 nt, hsa; identical to SEQ ID NO: 485343

SEQ ID NO: 553374 - RNA, 64 nt, hsa; identical to SEQ ID NO: 485344

SEQ ID NO: 553375 - RNA, 64 nt, hsa; identical to SEQ ID NO: 485345

SEQ ID NO: 553376 - RNA, 64 nt, hsa; identical to SEQ ID NO: 485346

SEQ ID NO: 553377 - RNA, 64 nt, hsa; identical to SEQ ID NO: 485347

SEQ ID NO: 553378 - RNA, 64 nt, hsa; identical to SEQ ID NO: 485348

SEQ ID NO: 553379 - RNA, 64 nt, hsa; identical to SEQ ID NO: 485349

SEQ ID NO: 553380 - RNA, 64 nt, hsa; identical to SEQ ID NO: 485350

SEQ ID NO: 553381 - RNA, 64 nt, hsa; identical to SEQ ID NO: 485351

SEQ ID NO: 553382 - RNA, 64 nt, hsa; identical to SEQ ID NO: 485352

SEQ ID NO: 553383 - RNA, 64 nt, hsa; identical to SEQ ID NO: 485353

SEQ ID NO: 553384 - RNA, 64 nt, hsa; identical to SEQ ID NO: 485354

SEQ ID NO: 553385 - RNA, 64 nt, hsa; identical to SEQ ID NO: 485355

SEQ ID NO: 553386 - RNA, 64 nt, hsa; identical to SEQ ID NO: 485356

SEQ ID NO: 553387 - RNA, 64 nt, hsa; identical to SEQ ID NO: 485357

SEQ ID NO: 553388 - RNA, 64 nt, hsa; identical to SEQ ID NO: 485358

SEQ ID NO: 553389 - RNA, 64 nt, hsa; identical to SEQ ID NO: 485359

SEQ ID NO: 553390 - RNA, 64 nt, hsa; identical to SEQ ID NO: 485360

SEQ ID NO: 553391 - RNA, 64 nt, hsa; identical to SEQ ID NO: 485361

SEQ ID NO: 553392 - RNA, 64 nt, hsa; identical to SEQ ID NO: 485362

SEQ ID NO: 553393 - RNA, 64 nt, hsa; identical to SEQ ID NO: 485363

SEQ ID NO: 553394 - RNA, 64 nt, hsa; identical to SEQ ID NO: 485364

SEQ ID NO: 553395 - RNA, 64 nt, hsa; identical to SEQ ID NO: 485365

SEQ ID NO: 553396 - RNA, 64 nt, hsa; identical to SEQ ID NO: 485366

SEQ ID NO: 553397 - RNA, 64 nt, hsa; identical to SEQ ID NO: 485367

SEQ ID NO: 553398 - RNA, 64 nt, hsa; identical to SEQ ID NO: 485368

SEQ ID NO: 553399 - RNA, 64 nt, hsa; identical to SEQ ID NO: 485369

SEQ ID NO: 553400 - RNA, 64 nt, hsa; identical to SEQ ID NO: 485370

SEQ ID NO: 553401 - RNA, 64 nt, hsa; identical to SEQ ID NO: 485371

SEQ ID NO: 553402 - RNA, 64 nt, hsa; identical to SEQ ID NO: 485372

SEQ ID NO: 553403 - RNA, 64 nt, hsa; identical to SEQ ID NO: 485373

SEQ ID NO: 553404 - RNA, 64 nt, hsa; identical to SEQ ID NO: 485374

SEQ ID NO: 553405 - RNA, 64 nt, hsa; identical to SEQ ID NO: 485375

SEQ ID NO: 553406 - RNA, 64 nt, hsa; identical to SEQ ID NO: 485376

SEQ ID NO: 553407 - RNA, 64 nt, hsa; identical to SEQ ID NO: 485377

SEQ ID NO: 553408 - RNA, 64 nt, hsa; identical to SEQ ID NO: 485378

SEQ ID NO: 553409 - RNA, 64 nt, hsa; identical to SEQ ID NO: 121134

SEQ ID NO: 553410 - RNA, 64 nt, hsa; identical to SEQ ID NO: 121135

SEQ ID NO: 553411 - RNA, 64 nt, hsa; identical to SEQ ID NO: 121136

SEQ ID NO: 553412 - RNA, 64 nt, hsa; identical to SEQ ID NO: 121137

SEQ ID NO: 553413 - RNA, 64 nt, hsa; identical to SEQ ID NO: 121138

SEQ ID NO: 553414 - RNA, 64 nt, hsa; identical to SEQ ID NO: 121139

SEQ ID NO: 553415 - RNA, 64 nt, hsa; identical to SEQ ID NO: 121140

SEQ ID NO: 553416 - RNA, 64 nt, hsa; identical to SEQ ID NO: 121141

SEQ ID NO: 553417 - RNA, 64 nt, hsa; identical to SEQ ID NO: 121142

SEQ ID NO: 553418 - RNA, 64 nt, hsa; identical to SEQ ID NO: 121143

SEQ ID NO: 553419 - RNA, 64 nt, hsa; identical to SEQ ID NO: 121144

SEQ ID NO: 553420 - RNA, 64 nt, hsa; identical to SEQ ID NO: 121145

SEQ ID NO: 553421 - RNA, 64 nt, hsa; identical to SEQ ID NO: 121146

SEQ ID NO: 553422 - RNA, 64 nt, hsa; identical to SEQ ID NO: 121147

SEQ ID NO: 553423 - RNA, 64 nt, hsa; identical to SEQ ID NO: 176098

SEQ ID NO: 553424 - RNA, 64 nt, hsa; identical to SEQ ID NO: 176099

SEQ ID NO: 553425 - RNA, 64 nt, hsa; identical to SEQ ID NO: 176100

SEQ ID NO: 553426 - RNA, 64 nt, hsa; identical to SEQ ID NO: 176101

SEQ ID NO: 553427 - RNA, 64 nt, hsa; identical to SEQ ID NO: 176102

SEQ ID NO: 553428 - RNA, 64 nt, hsa; identical to SEQ ID NO: 176103

SEQ ID NO: 553429 - RNA, 64 nt, hsa; identical to SEQ ID NO: 176104

SEQ ID NO: 553430 - RNA, 64 nt, hsa; identical to SEQ ID NO: 176105

SEQ ID NO: 553431 - RNA, 64 nt, hsa; identical to SEQ ID NO: 176106

SEQ ID NO: 553432 - RNA, 64 nt, hsa; identical to SEQ ID NO: 176107

SEQ ID NO: 553433 - RNA, 64 nt, hsa; identical to SEQ ID NO: 176108

SEQ ID NO: 553434 - RNA, 64 nt, hsa; identical to SEQ ID NO: 176109

SEQ ID NO: 553435 - RNA, 64 nt, hsa; identical to SEQ ID NO: 176110

SEQ ID NO: 553436 - RNA, 64 nt, hsa; identical to SEQ ID NO: 176111

SEQ ID NO: 553437 - RNA, 64 nt, hsa; identical to SEQ ID NO: 176112

SEQ ID NO: 553438 - RNA, 64 nt, hsa; identical to SEQ ID NO: 176113

SEQ ID NO: 553439 - RNA, 64 nt, hsa; identical to SEQ ID NO: 43999

SEQ ID NO: 553440 - RNA, 64 nt, hsa; identical to SEQ ID NO: 44000

SEQ ID NO: 553441 - RNA, 64 nt, hsa; identical to SEQ ID NO: 44001

SEQ ID NO: 553442 - RNA, 64 nt, hsa; identical to SEQ ID NO: 44002

SEQ ID NO: 553443 - RNA, 64 nt, hsa; identical to SEQ ID NO: 44003

SEQ ID NO: 553444 - RNA, 64 nt, hsa; identical to SEQ ID NO: 44004

SEQ ID NO: 553445 - RNA, 64 nt, hsa; identical to SEQ ID NO: 44005

SEQ ID NO: 553446 - RNA, 64 nt, hsa; identical to SEQ ID NO: 44006

SEQ ID NO: 553447 - RNA, 64 nt, hsa; identical to SEQ ID NO: 44007

SEQ ID NO: 553448 - RNA, 64 nt, hsa; identical to SEQ ID NO: 44008

SEQ ID NO: 553449 - RNA, 64 nt, hsa; identical to SEQ ID NO: 44009

SEQ ID NO: 553450 - RNA, 64 nt, hsa; identical to SEQ ID NO: 44010

SEQ ID NO: 553451 - RNA, 64 nt, hsa; identical to SEQ ID NO: 44011

SEQ ID NO: 553452 - RNA, 64 nt, hsa; identical to SEQ ID NO: 44012

SEQ ID NO: 553453 - RNA, 64 nt, hsa; identical to SEQ ID NO: 44013

SEQ ID NO: 553454 - RNA, 64 nt, hsa; identical to SEQ ID NO: 44014

SEQ ID NO: 553455 - RNA, 64 nt, hsa; identical to SEQ ID NO: 44015

SEQ ID NO: 553456 - RNA, 64 nt, hsa; identical to SEQ ID NO: 44016

SEQ ID NO: 553457 - RNA, 64 nt, hsa; identical to SEQ ID NO: 44015

SEQ ID NO: 553458 - RNA, 64 nt, hsa; identical to SEQ ID NO: 44016

SEQ ID NO: 553459 - RNA, 64 nt, hsa; identical to SEQ ID NO: 195961

SEQ ID NO: 553460 - RNA, 64 nt, hsa; identical to SEQ ID NO: 195962

SEQ ID NO: 553461 - RNA, 64 nt, hsa; identical to SEQ ID NO: 195963

SEQ ID NO: 553462 - RNA, 64 nt, hsa; identical to SEQ ID NO: 195964

SEQ ID NO: 553463 - RNA, 64 nt, hsa; identical to SEQ ID NO: 195965

SEQ ID NO: 553464 - RNA, 64 nt, hsa; identical to SEQ ID NO: 195966

SEQ ID NO: 553465 - RNA, 64 nt, hsa; identical to SEQ ID NO: 195967

SEQ ID NO: 553466 - RNA, 64 nt, hsa; identical to SEQ ID NO: 195968

SEQ ID NO: 553467 - RNA, 64 nt, hsa; identical to SEQ ID NO: 195969

SEQ ID NO: 553468 - RNA, 64 nt, hsa; identical to SEQ ID NO: 195970

SEQ ID NO: 553469 - RNA, 64 nt, hsa; identical to SEQ ID NO: 195971

SEQ ID NO: 553470 - RNA, 64 nt, hsa; identical to SEQ ID NO: 195972

SEQ ID NO: 553471 - RNA, 64 nt, hsa; identical to SEQ ID NO: 195973

SEQ ID NO: 553472 - RNA, 64 nt, hsa; identical to SEQ ID NO: 195974

SEQ ID NO: 553473 - RNA, 64 nt, hsa; identical to SEQ ID NO: 195975

SEQ ID NO: 553474 - RNA, 64 nt, hsa; identical to SEQ ID NO: 195976

SEQ ID NO: 553475 - RNA, 64 nt, hsa; identical to SEQ ID NO: 195977

SEQ ID NO: 553476 - RNA, 64 nt, hsa; identical to SEQ ID NO: 195978

SEQ ID NO: 553477 - RNA, 64 nt, hsa; identical to SEQ ID NO: 195979

SEQ ID NO: 553478 - RNA, 64 nt, hsa; identical to SEQ ID NO: 195980

SEQ ID NO: 553479 - RNA, 64 nt, hsa; identical to SEQ ID NO: 195981

SEQ ID NO: 553480 - RNA, 64 nt, hsa; identical to SEQ ID NO: 195982

SEQ ID NO: 553481 - RNA, 64 nt, hsa; identical to SEQ ID NO: 195983

SEQ ID NO: 553482 - RNA, 64 nt, hsa; identical to SEQ ID NO: 195984

SEQ ID NO: 553483 - RNA, 64 nt, hsa; identical to SEQ ID NO: 195985

SEQ ID NO: 553484 - RNA, 64 nt, hsa; identical to SEQ ID NO: 195986

SEQ ID NO: 553485 - RNA, 64 nt, hsa; identical to SEQ ID NO: 195987

SEQ ID NO: 553486 - RNA, 64 nt, hsa; identical to SEQ ID NO: 333488

SEQ ID NO: 553487 - RNA, 64 nt, hsa; identical to SEQ ID NO: 333489

SEQ ID NO: 553488 - RNA, 64 nt, hsa; identical to SEQ ID NO: 333490

SEQ ID NO: 553489 - RNA, 54 nt, hsa; identical to SEQ ID NO: 333491

SEQ ID NO: 553490 - RNA, 64 nt, hsa; identical to SEQ ID NO: 333492

SEQ ID NO: 553491 - RNA, 64 nt, hsa; identical to SEQ ID NO: 333493

SEQ ID NO: 553492 - RNA, 64 nt, hsa; identical to SEQ ID NO: 333494

SEQ ID NO: 553493 - RNA, 64 nt, hsa; identical to SEQ ID NO: 333495

SEQ ID NO: 553494 - RNA, 64 nt, hsa; identical to SEQ ID NO: 333496

SEQ ID NO: 553495 - RNA, 64 nt, hsa; identical to SEQ ID NO: 333497

SEQ ID NO: 553496 - RNA, 64 nt, hsa; identical to SEQ ID NO: 333498

SEQ ID NO: 553497 - RNA, 64 nt, hsa; identical to SEQ ID NO: 333499

SEQ ID NO: 553498 - RNA, 64 nt, hsa; identical to SEQ ID NO: 333500

SEQ ID NO: 553499 - RNA, 64 nt, hsa; identical to SEQ ID NO: 333501

SEQ ID NO: 553500 - RNA, 64 nt, hsa
uuuaacagcugagcaaaaacauugagucgcucucaaaggacacgaggcccuuggcagggaauau

SEQ ID NO: 553501 - RNA, 64 nt, hsa
aaaccaggcauccaauuuguaaaccaauuaugauaaaggacaaaauaagcuguuugccaccuca

SEQ ID NO: 553502 - RNA, 64 nt, hsa
aguuagaggggacaucacuuagaaguucuuauagaaaggacacaaguuuguuuccuggcuuuac

SEQ ID NO: 553503 - RNA, 64 nt, hsa
auuacaaagacaacuggggcagguacucuaauauaaaggacaggugguguuucuaaauaauugg

SEQ ID NO: 553504 - RNA, 64 nt, hsa
cugaaguggcaccaacagaaguuuggcuugaacuaaaggacauuuuauuuuuuuuacuuuagca

SEQ ID NO: 553505 - RNA, 64 nt, hsa
aucucuuuuucccuuguagaucaugcuaaagaggaaaggacagugugcuugguuagaguaaagg

SEQ ID NO: 553506 - RNA, 64 nt, hsa
cacuuaucagcaacccuaccacuuucaucugcugaaaggacaaaugugcuugguuuuacuauua

SEQ ID NO: 553507 - RNA, 64 nt, hsa
uuguggaggcucgaggaagcugacuucuuaggcuaaaggacaaaaaaaucucuuuaccuccuug

SEQ ID NO: 553508 - RNA, 64 nt, hsa
ccgucccagaugggucugaggaaaggaaggcuguaaaggacaugguaauggcacuccauucggg

SEQ ID NO: 553509 - RNA, 64 nt, hsa
aaaauauugcagugacuuuuuaggcaggagugccaaaggacacuaugaacuuuuugaacugaca

SEQ ID NO: 553510 - RNA, 64 nt, hsa
uucagaacuagauuagcauugcccugccugucugaaaggacaguuuaccuaauggugccagccu

SEQ ID NO: 553511 - RNA, 64 nt, hsa
uuuuucguauccugcuuuucuuauauuggaguaaaaaggacaggguauagacaugaaugaugau

SEQ ID NO: 553512 - RNA, 64 nt, hsa
aaugucccaugauuuaauauaugugguuugggggaaaggacaagaaaaaacuauaauuccacau

SEQ ID NO: 553513 - RNA, 64 nt, hsa
gcuggccccagagaugaucuugcccuuccuaacuaaaggacagaagugcaauuuagcuuaaaug

SEQ ID NO: 553514 - RNA, 64 nt, hsa
uguguguagcauuguguguccaucuguuauauguaaaggacaaggcaccagaaucaggcuuuau

SEQ ID NO: 553515 - RNA, 64 nt, hsa
uguagcuacaauuguguaauguacaauauuagagaaaggacaggcuuuuuaugaguaacacaca

SEQ ID NO: 553516 - RNA, 64 nt, hsa
guguuuuucauuuuaaacacacaagauuuaauugaaaggacaucaauaaucauaauuguguauu

SEQ ID NO: 553517 - RNA, 64 nt, hsa
cuagaaccuauaggaaacuacuuggagcaaacucaaaggacagauuagggaucgagauuggguc

SEQ ID NO: 553518 - RNA, 64 nt, hsa
cuuuaggcaaguggaaaauucaaaaugugcugugaaaggacaaucucaggcugaaaucccauaa

SEQ ID NO: 553519 - RNA, 64 nt, hsa
uugugccuuuuuauuuugccaaccguguuuauagaaaggacauuacuaaugacauuuugcagau

SEQ ID NO: 553520 - RNA, 64 nt, hsa
guuuuauuggacauuuuaccccacugagugguaaaaaggacagaggcuacagauggaguugcuu

SEQ ID NO: 553521 - RNA, 64 nt, hsa
uaagcaaguauaaauuuuuccucuuauuugcaugaaaggacaagacacuguuaugcccuguccu

SEQ ID NO: 553522 - RNA, 64 nt, hsa
gcuauuaauagauucccauauuuuaaaaggagggaaaggacaauuuaauauaaauuucuguuug

SEQ ID NO: 553523 - RNA, 64 nt, hsa
ggaucuuauugcacuugggcuguucagaauguagaaaggacauauuugaggaaguaucuauuug

SEQ ID NO: 553524 - RNA, 64 nt, hsa
uuacugguauugagaaaucagcuaccaaagugaaaaaggacaagaucaauucuuuucuagucag

SEQ ID NO: 553525 - RNA, 64 nt, hsa
agaauuuggcauuuagcucuuaguuaaaucuaguaaaggacagucuauuguuuaaagagaaggu

SEQ ID NO: 553526 - RNA, 64 nt, hsa
cacuuauaaauuucucuuuuaaauagauggagacaaaggacaaggugaaauguaucaagucaaa

SEQ ID NO: 553527 - RNA, 64 nt, hsa
gguuucagugauaagucagauguuauuacacaccaaaggacacacacaggggggaagcccuacg

SEQ ID NO: 553528 - RNA, 64 nt, hsa
gagggagauuucaagggccuuuucuagcccacccaaaggacaaauggggagcucuagaguggga

SEQ ID NO: 553529 - RNA, 64 nt, hsa
caagagaucaaagaaagguccaaacucuugaauaaaaggacauggcagagggagauuucaaggg

SEQ ID NO: 553530 - RNA, 64 nt, hsa
gaucagaagucagaaguuuggaauguggugggucaaaggacaauaugggugggcauucuggaga

SEQ ID NO: 553531 - RNA, 64 nt, hsa
uuuuucagcugaauucucauggugaaaacaggggaaaggacaaaggaaaccuuaaguuguauug

SEQ ID NO: 553532 - RNA, 64 nt, hsa
uuaaaacuuggguaacacuuccaaauaugggaggaaaggacagauguguuuacaagggaggauu

SEQ ID NO: 553533 - RNA, 64 nt, hsa
aaucuacauuuaucaauaaaauguaaauuaucugaaaggacagaauauaagauuuaaccauguu

SEQ ID NO: 553534 - RNA, 64 nt, hsa
gccuucagaucugccucacaccuucaaauucaugaaaggacacaaacacacauaagaauacacu

SEQ ID NO: 553535 - RNA, 64 nt, hsa
gccuucagaucugccaagaaccuucgaauucaugaaaggacacaaacacacguaagaaugcacu

SEQ ID NO: 553536 - RNA, 64 nt, hsa
uauguaauugcgugcaaugaaccugaaauuguguaaaggacaaaagaccaguuuauaggguugg

SEQ ID NO: 553537 - RNA, 64 nt, hsa
uccacagaauguuugcagagcugggcaguugaggaaaggacagccccugguuggugccuccaaa

SEQ ID NO: 553538 - RNA, 64 nt, hsa
gucaucagcuauucaguugguaagcuuccaggaaaaaggacaggcagaaagaguuugagaccug

SEQ ID NO: 553539 - RNA, 64 nt, hsa
gagggaaaauguuuuguaagaaaccaaucaagauaaaggacagugaaguaauccguaccuugug

SEQ ID NO: 553540 - RNA, 64 nt, hsa
gugaauuauuuauucaugggagauaauuuauuuuaaaggacagaauuaccaagcguuacaaaau

SEQ ID NO: 553541 - RNA, 64 nt, hsa
aagcacaggaaagagaaaaagaaaucuguugaagaaaggacagaagaggaaaugcuuugggaug

SEQ ID NO: 553542 - RNA, 64 nt, hsa
cucaauuuugagguccucauucccaagauugaggaggcaguaguuaaucugggaaggcaguaga

SEQ ID NO: 553543 - RNA, 64 nt, hsa
ucccaagauugaggaggcaguaguuaaucugggaaggcaguagaauggccagcauuccugccug

SEQ ID NO: 553544 - RNA, 64 nt, hsa
agaauuguugccugagcgugccaggcugcagggcaggcaguaaaaggcccccacauacccugca

SEQ ID NO: 553545 - RNA, 64 nt, hsa
aucagcuuuuuuaccauugagccaggagugcggcaggcaguaccugccugacccuucaaggccu

SEQ ID NO: 553546 - RNA, 64 nt, hsa
ggccgggucccuggugcacugaccuaucugggauaggcaguacccuggaggggggccuggggca

SEQ ID NO: 553547 - RNA, 64 nt, hsa
gguguuuuauacgcuuccucguacgcuggggccaaggcaguauacauuccucugacuuuauacu

SEQ ID NO: 553548 - RNA, 64 nt, hsa
aacuuguggggacaccaccaguugucaagcuacuaggcaguagggucugagggcucaggccucc

SEQ ID NO: 553549 - RNA, 64 nt, hsa
uuuaacuccccgcccacagguccaugggagcuugaggcaguaagggggaucccaggcacccauc

SEQ ID NO: 553550 - RNA, 64 nt, hsa
ccuagacagcucagcacagcuauugauauguuagaggcaguauccuuaauauucauucuaaaug

SEQ ID NO: 553551 - RNA, 64 nt, hsa
agugucugaugaagggcagagugacccagacugcaggcaguaacugacuucacacagucccugg

SEQ ID NO: 553552 - RNA, 64 nt, hsa; identical to SEQ ID NO: 317046

SEQ ID NO: 553553 - RNA, 64 nt, hsa; identical to SEQ ID NO: 317047

SEQ ID NO: 553554 - RNA, 64 nt, hsa; identical to SEQ ID NO: 317048

SEQ ID NO: 553555 - RNA, 64 nt, hsa; identical to SEQ ID NO: 317049

SEQ ID NO: 553556 - RNA, 64 nt, hsa; identical to SEQ ID NO: 317050

SEQ ID NO: 553557 - RNA, 64 nt, hsa; identical to SEQ ID NO: 317051

SEQ ID NO: 553558 - RNA, 64 nt, hsa; identical to SEQ ID NO: 317052

SEQ ID NO: 553559 - RNA, 64 nt, hsa; identical to SEQ ID NO: 317053

SEQ ID NO: 553560 - RNA, 64 nt, hsa; identical to SEQ ID NO: 317054

SEQ ID NO: 553561 - RNA, 64 nt, hsa; identical to SEQ ID NO: 317055

SEQ ID NO: 553562 - RNA, 64 nt, hsa; identical to SEQ ID NO: 317056

SEQ ID NO: 553563 - RNA, 64 nt, hsa; identical to SEQ ID NO: 317057

SEQ ID NO: 553564 - RNA, 64 nt, hsa; identical to SEQ ID NO: 317058

SEQ ID NO: 553565 - RNA, 64 nt, hsa; identical to SEQ ID NO: 317059

SEQ ID NO: 553566 - RNA, 64 nt, hsa; identical to SEQ ID NO: 317060

SEQ ID NO: 553567 - RNA, 64 nt, hsa; identical to SEQ ID NO: 317061

SEQ ID NO: 553568 - RNA, 64 nt, hsa; identical to SEQ ID NO: 317062

SEQ ID NO: 553569 - RNA, 64 nt, hsa; identical to SEQ ID NO: 317063

SEQ ID NO: 553570 - RNA, 64 nt, hsa; identical to SEQ ID NO: 317064

SEQ ID NO: 553571 - RNA, 55 nt, hsa; identical to SEQ ID NO: 317065

SEQ ID NO: 553572 - RNA, 64 nt, hsa; identical to SEQ ID NO: 317066

SEQ ID NO: 553573 - RNA, 63 nt, hsa; identical to SEQ ID NO: 317067

SEQ ID NO: 553574 - RNA, 64 nt, hsa; identical to SEQ ID NO: 317068

SEQ ID NO: 553575 - RNA, 64 nt, hsa; identical to SEQ ID NO: 317069

SEQ ID NO: 553576 - RNA, 64 nt, hsa; identical to SEQ ID NO: 317070

SEQ ID NO: 553577 - RNA, 64 nt, hsa; identical to SEQ ID NO: 317071

SEQ ID NO: 553578 - RNA, 64 nt, hsa; identical to SEQ ID NO: 317072

SEQ ID NO: 553579 - RNA, 64 nt, hsa; identical to SEQ ID NO: 317073

SEQ ID NO: 553580 - RNA, 64 nt, hsa; identical to SEQ ID NO: 317074

SEQ ID NO: 553581 - RNA, 64 nt, hsa; identical to SEQ ID NO: 317075

SEQ ID NO: 553582 - RNA, 64 nt, hsa; identical to SEQ ID NO: 317076

SEQ ID NO: 553583 - RNA, 64 nt, hsa; identical to SEQ ID NO: 317077

SEQ ID NO: 553584 - RNA, 64 nt, hsa; identical to SEQ ID NO: 317078

SEQ ID NO: 553585 - RNA, 64 nt, hsa; identical to SEQ ID NO: 317079

SEQ ID NO: 553586 - RNA, 64 nt, hsa; identical to SEQ ID NO: 317080

SEQ ID NO: 553587 - RNA, 64 nt, hsa; identical to SEQ ID NO: 317081

SEQ ID NO: 553588 - RNA, 64 nt, hsa; identical to SEQ ID NO: 317082

SEQ ID NO: 553589 - RNA, 64 nt, hsa; identical to SEQ ID NO: 317083

SEQ ID NO: 553590 - RNA, 64 nt, hsa; identical to SEQ ID NO: 317084

SEQ ID NO: 553591 - RNA, 64 nt, hsa; identical to SEQ ID NO: 317085

SEQ ID NO: 553592 - RNA, 64 nt, hsa; identical to SEQ ID NO: 317086

SEQ ID NO: 553593 - RNA, 64 nt, hsa; identical to SEQ ID NO: 317087

SEQ ID NO: 553594 - RNA, 64 nt, hsa; identical to SEQ ID NO: 317088

SEQ ID NO: 553595 - RNA, 64 nt, hsa; identical to SEQ ID NO: 317089

SEQ ID NO: 553596 - RNA, 64 nt, hsa; identical to SEQ ID NO: 317090

SEQ ID NO: 553597 - RNA, 64 nt, hsa; identical to SEQ ID NO: 538261

SEQ ID NO: 553598 - RNA, 64 nt, hsa; identical to SEQ ID NO: 538262

SEQ ID NO: 553599 - RNA, 64 nt, hsa; identical to SEQ ID NO: 538263

SEQ ID NO: 553600 - RNA, 64 nt, hsa; identical to SEQ ID NO: 538264

SEQ ID NO: 553601 - RNA, 64 nt, hsa; identical to SEQ ID NO: 538265

SEQ ID NO: 553602 - RNA, 64 nt, hsa; identical to SEQ ID NO: 538266

SEQ ID NO: 553603 - RNA, 64 nt, hsa; identical to SEQ ID NO: 236311

SEQ ID NO: 553604 - RNA, 64 nt, hsa; identical to SEQ ID NO: 236312

SEQ ID NO: 553605 - RNA, 64 nt, hsa; identical to SEQ ID NO: 236313

SEQ ID NO: 553606 - RNA, 64 nt, hsa; identical to SEQ ID NO: 236314

SEQ ID NO: 553607 - RNA, 64 nt, hsa; identical to SEQ ID NO: 236315

SEQ ID NO: 553608 - RNA, 64 nt, hsa; identical to SEQ ID NO: 236316

SEQ ID NO: 553609 - RNA, 64 nt, hsa; identical to SEQ ID NO: 236317

SEQ ID NO: 553610 - RNA, 64 nt, hsa; identical to SEQ ID NO: 236318

SEQ ID NO: 553611 - RNA, 64 nt, hsa; identical to SEQ ID NO: 236319

SEQ ID NO: 553612 - RNA, 64 nt, hsa; identical to SEQ ID NO: 236320

SEQ ID NO: 553613 - RNA, 64 nt, hsa; identical to SEQ ID NO: 236321

SEQ ID NO: 553614 - RNA, 64 nt, hsa; identical to SEQ ID NO: 236322

SEQ ID NO: 553615 - RNA, 64 nt, hsa; identical to SEQ ID NO: 236323

SEQ ID NO: 553616 - RNA, 64 nt, hsa; identical to SEQ ID NO: 236324

SEQ ID NO: 553617 - RNA, 64 nt, hsa; identical to SEQ ID NO: 236325

SEQ ID NO: 553618 - RNA, 64 nt, hsa; identical to SEQ ID NO: 236326

SEQ ID NO: 553619 - RNA, 64 nt, hsa; identical to SEQ ID NO: 236327

SEQ ID NO: 553620 - RNA, 64 nt, hsa; identical to SEQ ID NO: 236328

SEQ ID NO: 553621 - RNA, 64 nt, hsa; identical to SEQ ID NO: 236329

SEQ ID NO: 553622 - RNA, 64 nt, hsa; identical to SEQ ID NO: 236330

SEQ ID NO: 553623 - RNA, 64 nt, hsa; identical to SEQ ID NO: 236331

SEQ ID NO: 553624 - RNA, 64 nt, hsa; identical to SEQ ID NO: 236332

SEQ ID NO: 553625 - RNA, 64 nt, hsa; identical to SEQ ID NO: 236333

SEQ ID NO: 553626 - RNA, 64 nt, hsa; identical to SEQ ID NO: 236334

SEQ ID NO: 553627 - RNA, 64 nt, hsa; identical to SEQ ID NO: 236335

SEQ ID NO: 553628 - RNA, 64 nt, hsa; identical to SEQ ID NO: 236336

SEQ ID NO: 553629 - RNA, 64 nt, hsa; identical to SEQ ID NO: 236337

SEQ ID NO: 553630 - RNA, 64 nt, hsa; identical to SEQ ID NO: 236338

SEQ ID NO: 553631 - RNA, 64 nt, hsa; identical to SEQ ID NO: 236339

SEQ ID NO: 553632 - RNA, 64 nt, hsa; identical to SEQ ID NO: 236340

SEQ ID NO: 553633 - RNA, 64 nt, hsa; identical to SEQ ID NO: 236341

SEQ ID NO: 553634 - RNA, 64 nt, hsa; identical to SEQ ID NO: 236342

SEQ ID NO: 553635 - RNA, 64 nt, hsa; identical to SEQ ID NO: 236343

SEQ ID NO: 553636 - RNA, 64 nt, hsa; identical to SEQ ID NO: 236344

SEQ ID NO: 553637 - RNA, 64 nt, hsa; identical to SEQ ID NO: 236345

SEQ ID NO: 553638 - RNA, 64 nt, hsa; identical to SEQ ID NO: 236346

SEQ ID NO: 553639 - RNA, 64 nt, hsa; identical to SEQ ID NO: 236347

SEQ ID NO: 553640 - RNA, 64 nt, hsa; identical to SEQ ID NO: 236348

SEQ ID NO: 553641 - RNA, 64 nt, hsa; identical to SEQ ID NO: 236349

SEQ ID NO: 553642 - RNA, 64 nt, hsa; identical to SEQ ID NO: 236350

SEQ ID NO: 553643 - RNA, 64 nt, hsa; identical to SEQ ID NO: 236351

SEQ ID NO: 553644 - RNA, 64 nt, hsa; identical to SEQ ID NO: 236352

SEQ ID NO: 553645 - RNA, 64 nt, hsa; identical to SEQ ID NO: 236353

SEQ ID NO: 553646 - RNA, 53 nt, hsa; identical to SEQ ID NO: 236354

SEQ ID NO: 553647 - RNA, 64 nt, hsa; identical to SEQ ID NO: 236355

SEQ ID NO: 553648 - RNA, 64 nt, hsa; identical to SEQ ID NO: 236356

SEQ ID NO: 553649 - RNA, 64 nt, hsa; identical to SEQ ID NO: 236357

SEQ ID NO: 553650 - RNA, 64 nt, hsa; identical to SEQ ID NO: 236358

SEQ ID NO: 553651 - RNA, 64 nt, hsa; identical to SEQ ID NO: 236359

SEQ ID NO: 553652 - RNA, 64 nt, hsa; identical to SEQ ID NO: 236360

SEQ ID NO: 553653 - RNA, 64 nt, hsa; identical to SEQ ID NO: 236361

SEQ ID NO: 553654 - RNA, 64 nt, hsa; identical to SEQ ID NO: 236362

SEQ ID NO: 553655 - RNA, 64 nt, hsa; identical to SEQ ID NO: 236363

SEQ ID NO: 553656 - RNA, 64 nt, hsa; identical to SEQ ID NO: 236364

SEQ ID NO: 553657 - RNA, 50 nt, hsa; identical to SEQ ID NO: 236365

SEQ ID NO: 553658 - RNA, 64 nt, hsa; identical to SEQ ID NO: 236366

SEQ ID NO: 553659 - RNA, 64 nt, hsa; identical to SEQ ID NO: 236367

SEQ ID NO: 553660 - RNA, 64 nt, hsa; identical to SEQ ID NO: 236368

SEQ ID NO: 553661 - RNA, 64 nt, hsa; identical to SEQ ID NO: 236369

SEQ ID NO: 553662 - RNA, 64 nt, hsa; identical to SEQ ID NO: 236370

SEQ ID NO: 553663 - RNA, 64 nt, hsa; identical to SEQ ID NO: 236371

SEQ ID NO: 553664 - RNA, 64 nt, hsa; identical to SEQ ID NO: 236372

SEQ ID NO: 553665 - RNA, 64 nt, hsa; identical to SEQ ID NO: 236373

SEQ ID NO: 553666 - RNA, 64 nt, hsa; identical to SEQ ID NO: 236374

SEQ ID NO: 553667 - RNA, 64 nt, hsa; identical to SEQ ID NO: 236375

SEQ ID NO: 553668 - RNA, 64 nt, hsa; identical to SEQ ID NO: 236376

SEQ ID NO: 553669 - RNA, 64 nt, hsa; identical to SEQ ID NO: 236377

SEQ ID NO: 553670 - RNA, 64 nt, hsa; identical to SEQ ID NO: 236378

SEQ ID NO: 553671 - RNA, 64 nt, hsa; identical to SEQ ID NO: 236379

SEQ ID NO: 553672 - RNA, 64 nt, hsa; identical to SEQ ID NO: 236380

SEQ ID NO: 553673 - RNA, 64 nt, hsa; identical to SEQ ID NO: 236381

SEQ ID NO: 553674 - RNA, 64 nt, hsa; identical to SEQ ID NO: 89734

SEQ ID NO: 553675 - RNA, 64 nt, hsa; identical to SEQ ID NO: 89735

SEQ ID NO: 553676 - RNA, 64 nt, hsa; identical to SEQ ID NO: 270805

SEQ ID NO: 553677 - RNA, 64 nt, hsa; identical to SEQ ID NO: 270806

SEQ ID NO: 553678 - RNA, 64 nt, hsa; identical to SEQ ID NO: 270807

SEQ ID NO: 553679 - RNA, 64 nt, hsa; identical to SEQ ID NO: 270808

SEQ ID NO: 553680 - RNA, 64 nt, hsa; identical to SEQ ID NO: 270809

SEQ ID NO: 553681 - RNA, 64 nt, hsa; identical to SEQ ID NO: 270810

SEQ ID NO: 553682 - RNA, 64 nt, hsa; identical to SEQ ID NO: 270811

SEQ ID NO: 553683 - RNA, 64 nt, hsa; identical to SEQ ID NO: 270812

SEQ ID NO: 553684 - RNA, 64 nt, hsa; identical to SEQ ID NO: 270813

SEQ ID NO: 553685 - RNA, 64 nt, hsa; identical to SEQ ID NO: 270814

SEQ ID NO: 553686 - RNA, 64 nt, hsa; identical to SEQ ID NO: 270815

SEQ ID NO: 553687 - RNA, 64 nt, hsa; identical to SEQ ID NO: 270816

SEQ ID NO: 553688 - RNA, 64 nt, hsa; identical to SEQ ID NO: 144852

SEQ ID NO: 553689 - RNA, 64 nt, hsa; identical to SEQ ID NO: 144853

SEQ ID NO: 553690 - RNA, 64 nt, hsa; identical to SEQ ID NO: 144854

SEQ ID NO: 553691 - RNA, 64 nt, hsa; identical to SEQ ID NO: 144855

SEQ ID NO: 553692 - RNA, 64 nt, hsa; identical to SEQ ID NO: 144856

SEQ ID NO: 553693 - RNA, 64 nt, hsa; identical to SEQ ID NO: 144857

SEQ ID NO: 553694 - RNA, 64 nt, hsa; identical to SEQ ID NO: 144858

SEQ ID NO: 553695 - RNA, 64 nt, hsa; identical to SEQ ID NO: 144859

SEQ ID NO: 553696 - RNA, 64 nt, hsa; identical to SEQ ID NO: 144860

SEQ ID NO: 553697 - RNA, 64 nt, hsa; identical to SEQ ID NO: 144861

SEQ ID NO: 553698 - RNA, 64 nt, hsa; identical to SEQ ID NO: 97841

SEQ ID NO: 553699 - RNA, 64 nt, hsa; identical to SEQ ID NO: 97842

SEQ ID NO: 553700 - RNA, 64 nt, hsa; identical to SEQ ID NO: 97843

SEQ ID NO: 553701 - RNA, 64 nt, hsa; identical to SEQ ID NO: 97844

SEQ ID NO: 553702 - RNA, 64 nt, hsa; identical to SEQ ID NO: 97845

SEQ ID NO: 553703 - RNA, 64 nt, hsa; identical to SEQ ID NO: 97846

SEQ ID NO: 553704 - RNA, 64 nt, hsa; identical to SEQ ID NO: 97847

SEQ ID NO: 553705 - RNA, 64 nt, hsa; identical to SEQ ID NO: 97848

SEQ ID NO: 553706 - RNA, 64 nt, hsa; identical to SEQ ID NO: 84269

SEQ ID NO: 553707 - RNA, 64 nt, hsa; identical to SEQ ID NO: 84270

SEQ ID NO: 553708 - RNA, 64 nt, hsa; identical to SEQ ID NO: 84271

SEQ ID NO: 553709 - RNA, 64 nt, hsa; identical to SEQ ID NO: 84272

SEQ ID NO: 553710 - RNA, 64 nt, hsa; identical to SEQ ID NO: 84273

SEQ ID NO: 553711 - RNA, 64 nt, hsa; identical to SEQ ID NO: 84274

SEQ ID NO: 553712 - RNA, 64 nt, hsa; identical to SEQ ID NO: 84275

SEQ ID NO: 553713 - RNA, 64 nt, hsa; identical to SEQ ID NO: 84276

SEQ ID NO: 553714 - RNA, 64 nt, hsa; identical to SEQ ID NO: 84277

SEQ ID NO: 553715 - RNA, 64 nt, hsa; identical to SEQ ID NO: 84278

SEQ ID NO: 553716 - RNA, 64 nt, hsa; identical to SEQ ID NO: 84279

SEQ ID NO: 553717 - RNA, 64 nt, hsa; identical to SEQ ID NO: 84280

SEQ ID NO: 553718 - RNA, 64 nt, hsa; identical to SEQ ID NO: 84281

SEQ ID NO: 553719 - RNA, 64 nt, hsa; identical to SEQ ID NO: 84282

SEQ ID NO: 553720 - RNA, 64 nt, hsa; identical to SEQ ID NO: 84283

SEQ ID NO: 553721 - RNA, 64 nt, hsa; identical to SEQ ID NO: 84284

SEQ ID NO: 553722 - RNA, 64 nt, hsa; identical to SEQ ID NO: 84285

SEQ ID NO: 553723 - RNA, 64 nt, hsa; identical to SEQ ID NO: 84286

SEQ ID NO: 553724 - RNA, 64 nt, hsa; identical to SEQ ID NO: 84287

SEQ ID NO: 553725 - RNA, 64 nt, hsa; identical to SEQ ID NO: 84288

SEQ ID NO: 553726 - RNA, 62 nt, hsa
agcaaauacucauuuuaggaaaaaaaaaagcaugaucugaaaaauacuuuuggugguauguu

SEQ ID NO: 553727 - RNA, 62 nt, hsa
gcaagacuguuagcccucaaacuugacucuacugaucugaccauuucccucucaucgccaga

SEQ ID NO: 553728 - RNA, 62 nt, hsa
aagaaaaaugcugaggccucgggucaagauuuugaucugagacaugcugaugcuucaaggag

SEQ ID NO: 553729 - RNA, 62 nt, hsa
cugcucgugagcaggaaaaucagaggagccacugaucugagugguauuuagguugaaggaaa

SEQ ID NO: 553730 - RNA, 64 nt, hsa; identical to SEQ ID NO: 264274

SEQ ID NO: 553731 - RNA, 64 nt, hsa; identical to SEQ ID NO: 264275

SEQ ID NO: 553732 - RNA, 64 nt, hsa; identical to SEQ ID NO: 264276

SEQ ID NO: 553733 - RNA, 64 nt, hsa; identical to SEQ ID NO: 264277

SEQ ID NO: 553734 - RNA, 64 nt, hsa; identical to SEQ ID NO: 264278

SEQ ID NO: 553735 - RNA, 64 nt, hsa; identical to SEQ ID NO: 264279

SEQ ID NO: 553736 - RNA, 64 nt, hsa; identical to SEQ ID NO: 264280

SEQ ID NO: 553737 - RNA, 64 nt, hsa; identical to SEQ ID NO: 264281

SEQ ID NO: 553738 - RNA, 64 nt, hsa; identical to SEQ ID NO: 264282

SEQ ID NO: 553739 - RNA, 64 nt, hsa; identical to SEQ ID NO: 264283

SEQ ID NO: 553740 - RNA, 64 nt, hsa; identical to SEQ ID NO: 264284

SEQ ID NO: 553741 - RNA, 64 nt, hsa; identical to SEQ ID NO: 264285

SEQ ID NO: 553742 - RNA, 64 nt, hsa; identical to SEQ ID NO: 264286

SEQ ID NO: 553743 - RNA, 64 nt, hsa; identical to SEQ ID NO: 264287

SEQ ID NO: 553744 - RNA, 64 nt, hsa; identical to SEQ ID NO: 264288

SEQ ID NO: 553745 - RNA, 64 nt, hsa; identical to SEQ ID NO: 264289

SEQ ID NO: 553746 - RNA, 64 nt, hsa; identical to SEQ ID NO: 264290

SEQ ID NO: 553747 - RNA, 64 nt, hsa; identical to SEQ ID NO: 264291

SEQ ID NO: 553748 - RNA, 64 nt, hsa; identical to SEQ ID NO: 264292

SEQ ID NO: 553749 - RNA, 64 nt, hsa; identical to SEQ ID NO: 264293

SEQ ID NO: 553750 - RNA, 64 nt, hsa; identical to SEQ ID NO: 264294

SEQ ID NO: 553751 - RNA, 64 nt, hsa; identical to SEQ ID NO: 264295

SEQ ID NO: 553752 - RNA, 64 nt, hsa; identical to SEQ ID NO: 264296

SEQ ID NO: 553753 - RNA, 64 nt, hsa; identical to SEQ ID NO: 264297

SEQ ID NO: 553754 - RNA, 64 nt, hsa; identical to SEQ ID NO: 264298

SEQ ID NO: 553755 - RNA, 64 nt, hsa; identical to SEQ ID NO: 264299

SEQ ID NO: 553756 - RNA, 64 nt, hsa; identical to SEQ ID NO: 264300

SEQ ID NO: 553757 - RNA, 64 nt, hsa; identical to SEQ ID NO: 264301

SEQ ID NO: 553758 - RNA, 64 nt, hsa; identical to SEQ ID NO: 264274

SEQ ID NO: 553759 - RNA, 64 nt, hsa; identical to SEQ ID NO: 264275

SEQ ID NO: 553760 - RNA, 64 nt, hsa; identical to SEQ ID NO: 264276

SEQ ID NO: 553761 - RNA, 64 nt, hsa; identical to SEQ ID NO: 264277

SEQ ID NO: 553762 - RNA, 64 nt, hsa; identical to SEQ ID NO: 264278

SEQ ID NO: 553763 - RNA, 64 nt, hsa; identical to SEQ ID NO: 264279

SEQ ID NO: 553764 - RNA, 64 nt, hsa; identical to SEQ ID NO: 264280

SEQ ID NO: 553765 - RNA, 64 nt, hsa; identical to SEQ ID NO: 264281

SEQ ID NO: 553766 - RNA, 64 nt, hsa; identical to SEQ ID NO: 264282

SEQ ID NO: 553767 - RNA, 64 nt, hsa; identical to SEQ ID NO: 264283

SEQ ID NO: 553768 - RNA, 64 nt, hsa; identical to SEQ ID NO: 264284

SEQ ID NO: 553769 - RNA, 64 nt, hsa; identical to SEQ ID NO: 264285

SEQ ID NO: 553770 - RNA, 64 nt, hsa; identical to SEQ ID NO: 264286

SEQ ID NO: 553771 - RNA, 64 nt, hsa; identical to SEQ ID NO: 264287

SEQ ID NO: 553772 - RNA, 64 nt, hsa; identical to SEQ ID NO: 264288

SEQ ID NO: 553773 - RNA, 64 nt, hsa; identical to SEQ ID NO: 264289

SEQ ID NO: 553774 - RNA, 64 nt, hsa; identical to SEQ ID NO: 264290

SEQ ID NO: 553775 - RNA, 64 nt, hsa; identical to SEQ ID NO: 264291

SEQ ID NO: 553776 - RNA, 64 nt, hsa; identical to SEQ ID NO: 264292

SEQ ID NO: 553777 - RNA, 64 nt, hsa; identical to SEQ ID NO: 264293

SEQ ID NO: 553778 - RNA, 64 nt, hsa; identical to SEQ ID NO: 264294

SEQ ID NO: 553779 - RNA, 64 nt, hsa; identical to SEQ ID NO: 264295

SEQ ID NO: 553780 - RNA, 64 nt, hsa; identical to SEQ ID NO: 264296

SEQ ID NO: 553781 - RNA, 64 nt, hsa; identical to SEQ ID NO: 264297

SEQ ID NO: 553782 - RNA, 64 nt, hsa; identical to SEQ ID NO: 264298

SEQ ID NO: 553783 - RNA, 64 nt, hsa; identical to SEQ ID NO: 264299

SEQ ID NO: 553784 - RNA, 64 nt, hsa; identical to SEQ ID NO: 264300

SEQ ID NO: 553785 - RNA, 64 nt, hsa; identical to SEQ ID NO: 264301

SEQ ID NO: 553786 - RNA, 64 nt, hsa; identical to SEQ ID NO: 264274

SEQ ID NO: 553787 - RNA, 64 nt, hsa; identical to SEQ ID NO: 264275

SEQ ID NO: 553788 - RNA, 64 nt, hsa; identical to SEQ ID NO: 264276

SEQ ID NO: 553789 - RNA, 64 nt, hsa; identical to SEQ ID NO: 264277

SEQ ID NO: 553790 - RNA, 64 nt, hsa; identical to SEQ ID NO: 264278

SEQ ID NO: 553791 - RNA, 64 nt, hsa; identical to SEQ ID NO: 264279

SEQ ID NO: 553792 - RNA, 64 nt, hsa; identical to SEQ ID NO: 264280

SEQ ID NO: 553793 - RNA, 64 nt, hsa; identical to SEQ ID NO: 264281

SEQ ID NO: 553794 - RNA, 64 nt, hsa; identical to SEQ ID NO: 264282

SEQ ID NO: 553795 - RNA, 64 nt, hsa; identical to SEQ ID NO: 264283

SEQ ID NO: 553796 - RNA, 64 nt, hsa; identical to SEQ ID NO: 264284

SEQ ID NO: 553797 - RNA, 64 nt, hsa; identical to SEQ ID NO: 264285

SEQ ID NO: 553798 - RNA, 64 nt, hsa; identical to SEQ ID NO: 264286

SEQ ID NO: 553799 - RNA, 64 nt, hsa; identical to SEQ ID NO: 264287

SEQ ID NO: 553800 - RNA, 64 nt, hsa; identical to SEQ ID NO: 264288

SEQ ID NO: 553801 - RNA, 64 nt, hsa; identical to SEQ ID NO: 264289

SEQ ID NO: 553802 - RNA, 64 nt, hsa; identical to SEQ ID NO: 264290

SEQ ID NO: 553803 - RNA, 64 nt, hsa; identical to SEQ ID NO: 264291

SEQ ID NO: 553804 - RNA, 64 nt, hsa; identical to SEQ ID NO: 264292

SEQ ID NO: 553805 - RNA, 64 nt, hsa; identical to SEQ ID NO: 264293

SEQ ID NO: 553806 - RNA, 64 nt, hsa; identical to SEQ ID NO: 264294

SEQ ID NO: 553807 - RNA, 64 nt, hsa; identical to SEQ ID NO: 264295

SEQ ID NO: 553808 - RNA, 64 nt, hsa; identical to SEQ ID NO: 264296

SEQ ID NO: 553809 - RNA, 64 nt, hsa; identical to SEQ ID NO: 264297

SEQ ID NO: 553810 - RNA, 64 nt, hsa; identical to SEQ ID NO: 264298

SEQ ID NO: 553811 - RNA, 64 nt, hsa; identical to SEQ ID NO: 264299

SEQ ID NO: 553812 - RNA, 64 nt, hsa; identical to SEQ ID NO: 264300

SEQ ID NO: 553813 - RNA, 64 nt, hsa; identical to SEQ ID NO: 264301

SEQ ID NO: 553814 - RNA, 64 nt, hsa; identical to SEQ ID NO: 117299

SEQ ID NO: 553815 - RNA, 64 nt, hsa; identical to SEQ ID NO: 117300

SEQ ID NO: 553816 - RNA, 64 nt, hsa; identical to SEQ ID NO: 117301

SEQ ID NO: 553817 - RNA, 64 nt, hsa; identical to SEQ ID NO: 117302

SEQ ID NO: 553818 - RNA, 64 nt, hsa; identical to SEQ ID NO: 117303

SEQ ID NO: 553819 - RNA, 64 nt, hsa; identical to SEQ ID NO: 117304

SEQ ID NO: 553820 - RNA, 64 nt, hsa; identical to SEQ ID NO: 117305

SEQ ID NO: 553821 - RNA, 64 nt, hsa; identical to SEQ ID NO: 117306

SEQ ID NO: 553822 - RNA, 64 nt, hsa; identical to SEQ ID NO: 117307

SEQ ID NO: 553823 - RNA, 64 nt, hsa; identical to SEQ ID NO: 117308

SEQ ID NO: 553824 - RNA, 64 nt, hsa; identical to SEQ ID NO: 117309

SEQ ID NO: 553825 - RNA, 64 nt, hsa; identical to SEQ ID NO: 117310

SEQ ID NO: 553826 - RNA, 64 nt, hsa; identical to SEQ ID NO: 117311

SEQ ID NO: 553827 - RNA, 64 nt, hsa; identical to SEQ ID NO: 117312

SEQ ID NO: 553828 - RNA, 64 nt, hsa; identical to SEQ ID NO: 117313

SEQ ID NO: 553829 - RNA, 64 nt, hsa; identical to SEQ ID NO: 117314

SEQ ID NO: 553830 - RNA, 64 nt, hsa; identical to SEQ ID NO: 117315

SEQ ID NO: 553831 - RNA, 64 nt, hsa; identical to SEQ ID NO: 117316

SEQ ID NO: 553832 - RNA, 64 nt, hsa; identical to SEQ ID NO: 117317

SEQ ID NO: 553833 - RNA, 64 nt, hsa; identical to SEQ ID NO: 117318

SEQ ID NO: 553834 - RNA, 64 nt, hsa; identical to SEQ ID NO: 117319

SEQ ID NO: 553835 - RNA, 64 nt, hsa; identical to SEQ ID NO: 117320

SEQ ID NO: 553836 - RNA, 64 nt, hsa; identical to SEQ ID NO: 117321

SEQ ID NO: 553837 - RNA, 64 nt, hsa; identical to SEQ ID NO: 117322

SEQ ID NO: 553838 - RNA, 64 nt, hsa; identical to SEQ ID NO: 117323

SEQ ID NO: 553839 - RNA, 64 nt, hsa; identical to SEQ ID NO: 117324

SEQ ID NO: 553840 - RNA, 64 nt, hsa; identical to SEQ ID NO: 117325

SEQ ID NO: 553841 - RNA, 64 nt, hsa; identical to SEQ ID NO: 117326

SEQ ID NO: 553842 - RNA, 64 nt, hsa; identical to SEQ ID NO: 117327

SEQ ID NO: 553843 - RNA, 64 nt, hsa; identical to SEQ ID NO: 117328

SEQ ID NO: 553844 - RNA, 64 nt, hsa; identical to SEQ ID NO: 174092

SEQ ID NO: 553845 - RNA, 64 nt, hsa; identical to SEQ ID NO: 174093

SEQ ID NO: 553846 - RNA, 64 nt, hsa; identical to SEQ ID NO: 174095

SEQ ID NO: 553847 - RNA, 64 nt, hsa; identical to SEQ ID NO: 174096

SEQ ID NO: 553848 - RNA, 64 nt, hsa; identical to SEQ ID NO: 174127

SEQ ID NO: 553849 - RNA, 64 nt, hsa; identical to SEQ ID NO: 174128

SEQ ID NO: 553850 - RNA, 64 nt, hsa; identical to SEQ ID NO: 174147

SEQ ID NO: 553851 - RNA, 64 nt, hsa; identical to SEQ ID NO: 174148

SEQ ID NO: 553852 - RNA, 64 nt, hsa; identical to SEQ ID NO: 174171

SEQ ID NO: 553853 - RNA, 64 nt, hsa; identical to SEQ ID NO: 174172

SEQ ID NO: 553854 - RNA, 64 nt, hsa; identical to SEQ ID NO: 174194

SEQ ID NO: 553855 - RNA, 64 nt, hsa; identical to SEQ ID NO: 174195

SEQ ID NO: 553856 - RNA, 64 nt, hsa; identical to SEQ ID NO: 174204

SEQ ID NO: 553857 - RNA, 64 nt, hsa; identical to SEQ ID NO: 174205

SEQ ID NO: 553858 - RNA, 64 nt, hsa; identical to SEQ ID NO: 174212

SEQ ID NO: 553859 - RNA, 64 nt, hsa; identical to SEQ ID NO: 174213

SEQ ID NO: 553860 - RNA, 64 nt, hsa; identical to SEQ ID NO: 174220

SEQ ID NO: 553861 - RNA, 64 nt, hsa; identical to SEQ ID NO: 174221

SEQ ID NO: 553862 - RNA, 64 nt, hsa; identical to SEQ ID NO: 174227

SEQ ID NO: 553863 - RNA, 64 nt, hsa; identical to SEQ ID NO: 174228

SEQ ID NO: 553864 - RNA, 64 nt, hsa; identical to SEQ ID NO: 174230

SEQ ID NO: 553865 - RNA, 64 nt, hsa; identical to SEQ ID NO: 174231

SEQ ID NO: 553866 - RNA, 64 nt, hsa; identical to SEQ ID NO: 174233

SEQ ID NO: 553867 - RNA, 51 nt, hsa; identical to SEQ ID NO: 173793

SEQ ID NO: 553868 - RNA, 64 nt, hsa; identical to SEQ ID NO: 174312

SEQ ID NO: 553869 - RNA, 64 nt, hsa; identical to SEQ ID NO: 174313

SEQ ID NO: 553870 - RNA, 57 nt, hsa; identical to SEQ ID NO: 173883

SEQ ID NO: 553871 - RNA, 64 nt, hsa; identical to SEQ ID NO: 174325

SEQ ID NO: 553872 - RNA, 64 nt, hsa; identical to SEQ ID NO: 174358

SEQ ID NO: 553873 - RNA, 64 nt, hsa; identical to SEQ ID NO: 174359

SEQ ID NO: 553874 - RNA, 64 nt, hsa; identical to SEQ ID NO: 174369

SEQ ID NO: 553875 - RNA, 64 nt, hsa; identical to SEQ ID NO: 174370

SEQ ID NO: 553876 - RNA, 64 nt, hsa; identical to SEQ ID NO: 174388

SEQ ID NO: 553877 - RNA, 64 nt, hsa; identical to SEQ ID NO: 174389

SEQ ID NO: 553878 - RNA, 64 nt, hsa; identical to SEQ ID NO: 174405

SEQ ID NO: 553879 - RNA, 64 nt, hsa; identical to SEQ ID NO: 174406

SEQ ID NO: 553880 - RNA, 64 nt, hsa; identical to SEQ ID NO: 174416

SEQ ID NO: 553881 - RNA, 64 nt, hsa; identical to SEQ ID NO: 174417

SEQ ID NO: 553882 - RNA, 64 nt, hsa; identical to SEQ ID NO: 174427

SEQ ID NO: 553883 - RNA, 64 nt, hsa; identical to SEQ ID NO: 174428

SEQ ID NO: 553884 - RNA, 64 nt, hsa; identical to SEQ ID NO: 174434

SEQ ID NO: 553885 - RNA, 64 nt, hsa; identical to SEQ ID NO: 174435

SEQ ID NO: 553886 - RNA, 64 nt, hsa; identical to SEQ ID NO: 174516

SEQ ID NO: 553887 - RNA, 64 nt, hsa; identical to SEQ ID NO: 174517

SEQ ID NO: 553888 - RNA, 63 nt, hsa; identical to SEQ ID NO: 349836

SEQ ID NO: 553889 - RNA, 63 nt, hsa; identical to SEQ ID NO: 349837

SEQ ID NO: 553890 - RNA, 63 nt, hsa; identical to SEQ ID NO: 349838

SEQ ID NO: 553891 - RNA, 63 nt, hsa; identical to SEQ ID NO: 349839

SEQ ID NO: 553892 - RNA, 63 nt, hsa; identical to SEQ ID NO: 349840

SEQ ID NO: 553893 - RNA, 63 nt, hsa; identical to SEQ ID NO: 349841

SEQ ID NO: 553894 - RNA, 63 nt, hsa; identical to SEQ ID NO: 349842

SEQ ID NO: 553895 - RNA, 63 nt, hsa; identical to SEQ ID NO: 349843

SEQ ID NO: 553896 - RNA, 63 nt, hsa; identical to SEQ ID NO: 349844

SEQ ID NO: 553897 - RNA, 63 nt, hsa; identical to SEQ ID NO: 349845

SEQ ID NO: 553898 - RNA, 63 nt, hsa; identical to SEQ ID NO: 349846

SEQ ID NO: 553899 - RNA, 63 nt, hsa; identical to SEQ ID NO: 349847

SEQ ID NO: 553900 - RNA, 63 nt, hsa; identical to SEQ ID NO: 349848

SEQ ID NO: 553901 - RNA, 63 nt, hsa; identical to SEQ ID NO: 349849

SEQ ID NO: 553902 - RNA, 63 nt, hsa; identical to SEQ ID NO: 349850

SEQ ID NO: 553903 - RNA, 63 nt, hsa; identical to SEQ ID NO: 349851

SEQ ID NO: 553904 - RNA, 63 nt, hsa; identical to SEQ ID NO: 349852

SEQ ID NO: 553905 - RNA, 63 nt, hsa; identical to SEQ ID NO: 349853

SEQ ID NO: 553906 - RNA, 63 nt, hsa; identical to SEQ ID NO: 349854

SEQ ID NO: 553907 - RNA, 63 nt, hsa; identical to SEQ ID NO: 349855

SEQ ID NO: 553908 - RNA, 63 nt, hsa; identical to SEQ ID NO: 349856

SEQ ID NO: 553909 - RNA, 63 nt, hsa; identical to SEQ ID NO: 349857

SEQ ID NO: 553910 - RNA, 63 nt, hsa; identical to SEQ ID NO: 349858

SEQ ID NO: 553911 - RNA, 63 nt, hsa; identical to SEQ ID NO: 349859

SEQ ID NO: 553912 - RNA, 63 nt, hsa; identical to SEQ ID NO: 349860

SEQ ID NO: 553913 - RNA, 63 nt, hsa; identical to SEQ ID NO: 349861

SEQ ID NO: 553914 - RNA, 63 nt, hsa; identical to SEQ ID NO: 349862

SEQ ID NO: 553915 - RNA, 63 nt, hsa; identical to SEQ ID NO: 349863

SEQ ID NO: 553916 - RNA, 63 nt, hsa; identical to SEQ ID NO: 349864

SEQ ID NO: 553917 - RNA, 63 nt, hsa; identical to SEQ ID NO: 349865

SEQ ID NO: 553918 - RNA, 63 nt, hsa; identical to SEQ ID NO: 349866

SEQ ID NO: 553919 - RNA, 63 nt, hsa; identical to SEQ ID NO: 349867

SEQ ID NO: 553920 - RNA, 63 nt, hsa; identical to SEQ ID NO: 349868

SEQ ID NO: 553921 - RNA, 63 nt, hsa; identical to SEQ ID NO: 349869

SEQ ID NO: 553922 - RNA, 63 nt, hsa; identical to SEQ ID NO: 349870

SEQ ID NO: 553923 - RNA, 63 nt, hsa; identical to SEQ ID NO: 349871

SEQ ID NO: 553924 - RNA, 63 nt, hsa; identical to SEQ ID NO: 349872

SEQ ID NO: 553925 - RNA, 63 nt, hsa; identical to SEQ ID NO: 349873

SEQ ID NO: 553926 - RNA, 63 nt, hsa; identical to SEQ ID NO: 349874

SEQ ID NO: 553927 - RNA, 63 nt, hsa; identical to SEQ ID NO: 349875

SEQ ID NO: 553928 - RNA, 63 nt, hsa; identical to SEQ ID NO: 349876

SEQ ID NO: 553929 - RNA, 63 nt, hsa; identical to SEQ ID NO: 349877

SEQ ID NO: 553930 - RNA, 63 nt, hsa; identical to SEQ ID NO: 349878

SEQ ID NO: 553931 - RNA, 63 nt, hsa; identical to SEQ ID NO: 349879

SEQ ID NO: 553932 - RNA, 63 nt, hsa; identical to SEQ ID NO: 349880

SEQ ID NO: 553933 - RNA, 63 nt, hsa; identical to SEQ ID NO: 349881

SEQ ID NO: 553934 - RNA, 63 nt, hsa; identical to SEQ ID NO: 349882

SEQ ID NO: 553935 - RNA, 63 nt, hsa; identical to SEQ ID NO: 349883

SEQ ID NO: 553936 - RNA, 63 nt, hsa; identical to SEQ ID NO: 349884

SEQ ID NO: 553937 - RNA, 63 nt, hsa; identical to SEQ ID NO: 349885

SEQ ID NO: 553938 - RNA, 63 nt, hsa; identical to SEQ ID NO: 349886

SEQ ID NO: 553939 - RNA, 63 nt, hsa; identical to SEQ ID NO: 349887

SEQ ID NO: 553940 - RNA, 63 nt, hsa; identical to SEQ ID NO: 349888

SEQ ID NO: 553941 - RNA, 63 nt, hsa; identical to SEQ ID NO: 349889

SEQ ID NO: 553942 - RNA, 63 nt, hsa; identical to SEQ ID NO: 349890

SEQ ID NO: 553943 - RNA, 63 nt, hsa; identical to SEQ ID NO: 349891

SEQ ID NO: 553944 - RNA, 63 nt, hsa; identical to SEQ ID NO: 349892

SEQ ID NO: 553945 - RNA, 63 nt, hsa; identical to SEQ ID NO: 349893

SEQ ID NO: 553946 - RNA, 63 nt, hsa; identical to SEQ ID NO: 349894

SEQ ID NO: 553947 - RNA, 63 nt, hsa; identical to SEQ ID NO: 349895

SEQ ID NO: 553948 - RNA, 63 nt, hsa; identical to SEQ ID NO: 349896

SEQ ID NO: 553949 - RNA, 63 nt, hsa; identical to SEQ ID NO: 349897

SEQ ID NO: 553950 - RNA, 63 nt, hsa; identical to SEQ ID NO: 349898

SEQ ID NO: 553951 - RNA, 63 nt, hsa; identical to SEQ ID NO: 349899

SEQ ID NO: 553952 - RNA, 63 nt, hsa; identical to SEQ ID NO: 349900

SEQ ID NO: 553953 - RNA, 63 nt, hsa; identical to SEQ ID NO: 349901

SEQ ID NO: 553954 - RNA, 63 nt, hsa; identical to SEQ ID NO: 349902

SEQ ID NO: 553955 - RNA, 63 nt, hsa; identical to SEQ ID NO: 349903

SEQ ID NO: 553956 - RNA, 63 nt, hsa; identical to SEQ ID NO: 349904

SEQ ID NO: 553957 - RNA, 63 nt, hsa; identical to SEQ ID NO: 349905

SEQ ID NO: 553958 - RNA, 63 nt, hsa; identical to SEQ ID NO: 349906

SEQ ID NO: 553959 - RNA, 63 nt, hsa; identical to SEQ ID NO: 349907

SEQ ID NO: 553960 - RNA, 63 nt, hsa; identical to SEQ ID NO: 349908

SEQ ID NO: 553961 - RNA, 63 nt, hsa; identical to SEQ ID NO: 349909

SEQ ID NO: 553962 - RNA, 63 nt, hsa; identical to SEQ ID NO: 349910

SEQ ID NO: 553963 - RNA, 63 nt, hsa; identical to SEQ ID NO: 349911

SEQ ID NO: 553964 - RNA, 63 nt, hsa; identical to SEQ ID NO: 349912

SEQ ID NO: 553965 - RNA, 63 nt, hsa; identical to SEQ ID NO: 349913

SEQ ID NO: 553966 - RNA, 63 nt, hsa; identical to SEQ ID NO: 349914

SEQ ID NO: 553967 - RNA, 63 nt, hsa; identical to SEQ ID NO: 349915

SEQ ID NO: 553968 - RNA, 63 nt, hsa; identical to SEQ ID NO: 349916

SEQ ID NO: 553969 - RNA, 63 nt, hsa; identical to SEQ ID NO: 349917

SEQ ID NO: 553970 - RNA, 63 nt, hsa; identical to SEQ ID NO: 349918

SEQ ID NO: 553971 - RNA, 63 nt, hsa; identical to SEQ ID NO: 349919

SEQ ID NO: 553972 - RNA, 63 nt, hsa; identical to SEQ ID NO: 349920

SEQ ID NO: 553973 - RNA, 63 nt, hsa; identical to SEQ ID NO: 349921

SEQ ID NO: 553974 - RNA, 63 nt, hsa; identical to SEQ ID NO: 349922

SEQ ID NO: 553975 - RNA, 63 nt, hsa; identical to SEQ ID NO: 349923

SEQ ID NO: 553976 - RNA, 63 nt, hsa; identical to SEQ ID NO: 349924

SEQ ID NO: 553977 - RNA, 63 nt, hsa; identical to SEQ ID NO: 349925

SEQ ID NO: 553978 - RNA, 63 nt, hsa; identical to SEQ ID NO: 349926

SEQ ID NO: 553979 - RNA, 63 nt, hsa; identical to SEQ ID NO: 349927

SEQ ID NO: 553980 - RNA, 63 nt, hsa; identical to SEQ ID NO: 349928

SEQ ID NO: 553981 - RNA, 63 nt, hsa; identical to SEQ ID NO: 349929

SEQ ID NO: 553982 - RNA, 63 nt, hsa; identical to SEQ ID NO: 349930

SEQ ID NO: 553983 - RNA, 63 nt, hsa; identical to SEQ ID NO: 349931

SEQ ID NO: 553984 - RNA, 63 nt, hsa; identical to SEQ ID NO: 349932

SEQ ID NO: 553985 - RNA, 63 nt, hsa; identical to SEQ ID NO: 349933

SEQ ID NO: 553986 - RNA, 63 nt, hsa; identical to SEQ ID NO: 349934

SEQ ID NO: 553987 - RNA, 63 nt, hsa; identical to SEQ ID NO: 349935

SEQ ID NO: 553988 - RNA, 63 nt, hsa; identical to SEQ ID NO: 349936

SEQ ID NO: 553989 - RNA, 63 nt, hsa; identical to SEQ ID NO: 349937

SEQ ID NO: 553990 - RNA, 63 nt, hsa; identical to SEQ ID NO: 349938

SEQ ID NO: 553991 - RNA, 63 nt, hsa; identical to SEQ ID NO: 349939

SEQ ID NO: 553992 - RNA, 63 nt, hsa; identical to SEQ ID NO: 349940

SEQ ID NO: 553993 - RNA, 63 nt, hsa; identical to SEQ ID NO: 349941

SEQ ID NO: 553994 - RNA, 63 nt, hsa; identical to SEQ ID NO: 349942

SEQ ID NO: 553995 - RNA, 63 nt, hsa; identical to SEQ ID NO: 349943

SEQ ID NO: 553996 - RNA, 63 nt, hsa; identical to SEQ ID NO: 349944

SEQ ID NO: 553997 - RNA, 63 nt, hsa; identical to SEQ ID NO: 349945

SEQ ID NO: 553998 - RNA, 63 nt, hsa; identical to SEQ ID NO: 349946

SEQ ID NO: 553999 - RNA, 63 nt, hsa; identical to SEQ ID NO: 349947

SEQ ID NO: 554000 - RNA, 63 nt, hsa; identical to SEQ ID NO: 349948

SEQ ID NO: 554001 - RNA, 63 nt, hsa; identical to SEQ ID NO: 349949

SEQ ID NO: 554002 - RNA, 63 nt, hsa; identical to SEQ ID NO: 349950

SEQ ID NO: 554003 - RNA, 52 nt, hsa; identical to SEQ ID NO: 349951

SEQ ID NO: 554004 - RNA, 63 nt, hsa; identical to SEQ ID NO: 349952

SEQ ID NO: 554005 - RNA, 63 nt, hsa; identical to SEQ ID NO: 349953

SEQ ID NO: 554006 - RNA, 63 nt, hsa; identical to SEQ ID NO: 349954

SEQ ID NO: 554007 - RNA, 63 nt, hsa; identical to SEQ ID NO: 349955

SEQ ID NO: 554008 - RNA, 63 nt, hsa; identical to SEQ ID NO: 349956

SEQ ID NO: 554009 - RNA, 63 nt, hsa; identical to SEQ ID NO: 349957

SEQ ID NO: 554010 - RNA, 63 nt, hsa; identical to SEQ ID NO: 349958

SEQ ID NO: 554011 - RNA, 63 nt, hsa; identical to SEQ ID NO: 349958

SEQ ID NO: 554012 - RNA, 63 nt, hsa; identical to SEQ ID NO: 349960

SEQ ID NO: 554013 - RNA, 63 nt, hsa; identical to SEQ ID NO: 349961

SEQ ID NO: 554014 - RNA, 63 nt, hsa; identical to SEQ ID NO: 349962

SEQ ID NO: 554015 - RNA, 63 nt, hsa; identical to SEQ ID NO: 349963

SEQ ID NO: 554016 - RNA, 63 nt, hsa; identical to SEQ ID NO: 349964

SEQ ID NO: 554017 - RNA, 63 nt, hsa; identical to SEQ ID NO: 349965

SEQ ID NO: 554018 - RNA, 63 nt, hsa; identical to SEQ ID NO: 349966

SEQ ID NO: 554019 - RNA, 63 nt, hsa; identical to SEQ ID NO: 349967

SEQ ID NO: 554020 - RNA, 63 nt, hsa; identical to SEQ ID NO: 349968

SEQ ID NO: 554021 - RNA, 63 nt, hsa; identical to SEQ ID NO: 349969

SEQ ID NO: 554022 - RNA, 63 nt, hsa; identical to SEQ ID NO: 349970

SEQ ID NO: 554023 - RNA, 63 nt, hsa; identical to SEQ ID NO: 349971

SEQ ID NO: 554024 - RNA, 63 nt, hsa; identical to SEQ ID NO: 349972

SEQ ID NO: 554025 - RNA, 63 nt, hsa; identical to SEQ ID NO: 349973

SEQ ID NO: 554026 - RNA, 63 nt, hsa; identical to SEQ ID NO: 349974

SEQ ID NO: 554027 - RNA, 63 nt, hsa; identical to SEQ ID NO: 349975

SEQ ID NO: 554028 - RNA, 63 nt, hsa; identical to SEQ ID NO: 349976

SEQ ID NO: 554029 - RNA, 63 nt, hsa; identical to SEQ ID NO: 349977

SEQ ID NO: 554030 - RNA, 63 nt, hsa; identical to SEQ ID NO: 349978

SEQ ID NO: 554031 - RNA, 63 nt, hsa; identical to SEQ ID NO: 349979

SEQ ID NO: 554032 - RNA, 63 nt, hsa; identical to SEQ ID NO: 349980

SEQ ID NO: 554033 - RNA, 63 nt, hsa; identical to SEQ ID NO: 349981

SEQ ID NO: 554034 - RNA, 63 nt, hsa; identical to SEQ ID NO: 349982

SEQ ID NO: 554035 - RNA, 63 nt, hsa; identical to SEQ ID NO: 349983

SEQ ID NO: 554036 - RNA, 63 nt, hsa; identical to SEQ ID NO: 349984

SEQ ID NO: 554037 - RNA, 63 nt, hsa; identical to SEQ ID NO: 349985

SEQ ID NO: 554038 - RNA, 63 nt, hsa; identical to SEQ ID NO: 349986

SEQ ID NO: 554039 - RNA, 63 nt, hsa; identical to SEQ ID NO: 349987

SEQ ID NO: 554040 - RNA, 63 nt, hsa; identical to SEQ ID NO: 349988

SEQ ID NO: 554041 - RNA, 63 nt, hsa; identical to SEQ ID NO: 349989

SEQ ID NO: 554042 - RNA, 63 nt, hsa; identical to SEQ ID NO: 349990

SEQ ID NO: 554043 - RNA, 63 nt, hsa; identical to SEQ ID NO: 349991

SEQ ID NO: 554044 - RNA, 63 nt, hsa; identical to SEQ ID NO: 349992

SEQ ID NO: 554045 - RNA, 63 nt, hsa; identical to SEQ ID NO: 349993

SEQ ID NO: 554046 - RNA, 63 nt, hsa; identical to SEQ ID NO: 349994

SEQ ID NO: 554047 - RNA, 63 nt, hsa; identical to SEQ ID NO: 349995

SEQ ID NO: 554048 - RNA, 63 nt, hsa; identical to SEQ ID NO: 349996

SEQ ID NO: 554049 - RNA, 63 nt, hsa; identical to SEQ ID NO: 349997

SEQ ID NO: 554050 - RNA, 63 nt, hsa; identical to SEQ ID NO: 349998

SEQ ID NO: 554051 - RNA, 63 nt, hsa; identical to SEQ ID NO: 349999

SEQ ID NO: 554052 - RNA, 63 nt, hsa; identical to SEQ ID NO: 350000

SEQ ID NO: 554053 - RNA, 63 nt, hsa; identical to SEQ ID NO: 350001

SEQ ID NO: 554054 - RNA, 63 nt, hsa; identical to SEQ ID NO: 350002

SEQ ID NO: 554055 - RNA, 63 nt, hsa; identical to SEQ ID NO: 350003

SEQ ID NO: 554056 - RNA, 63 nt, hsa; identical to SEQ ID NO: 350004

SEQ ID NO: 554057 - RNA, 63 nt, hsa; identical to SEQ ID NO: 350005

SEQ ID NO: 554058 - RNA, 63 nt, hsa; identical to SEQ ID NO: 350006

SEQ ID NO: 554059 - RNA, 63 nt, hsa; identical to SEQ ID NO: 350007

SEQ ID NO: 554060 - RNA, 63 nt, hsa; identical to SEQ ID NO: 350008

SEQ ID NO: 554061 - RNA, 63 nt, hsa; identical to SEQ ID NO: 350009

SEQ ID NO: 554062 - RNA, 63 nt, hsa; identical to SEQ ID NO: 350010

SEQ ID NO: 554063 - RNA, 63 nt, hsa; identical to SEQ ID NO: 350011

SEQ ID NO: 554064 - RNA, 63 nt, hsa; identical to SEQ ID NO: 350012

SEQ ID NO: 554065 - RNA, 63 nt, hsa; identical to SEQ ID NO: 350013

SEQ ID NO: 554066 - RNA, 63 nt, hsa; identical to SEQ ID NO: 350014

SEQ ID NO: 554067 - RNA, 63 nt, hsa; identical to SEQ ID NO: 350015

SEQ ID NO: 554068 - RNA, 63 nt, hsa; identical to SEQ ID NO: 350016

SEQ ID NO: 554069 - RNA, 63 nt, hsa; identical to SEQ ID NO: 350017

SEQ ID NO: 554070 - RNA, 63 nt, hsa; identical to SEQ ID NO: 350018

SEQ ID NO: 554071 - RNA, 63 nt, hsa; identical to SEQ ID NO: 350019

SEQ ID NO: 554072 - RNA, 63 nt, hsa; identical to SEQ ID NO: 350020

SEQ ID NO: 554073 - RNA, 63 nt, hsa; identical to SEQ ID NO: 350021

SEQ ID NO: 554074 - RNA, 63 nt, hsa; identical to SEQ ID NO: 350022

SEQ ID NO: 554075 - RNA, 63 nt, hsa; identical to SEQ ID NO: 350023

SEQ ID NO: 554076 - RNA, 63 nt, hsa; identical to SEQ ID NO: 350024

SEQ ID NO: 554077 - RNA, 63 nt, hsa; identical to SEQ ID NO: 350025

SEQ ID NO: 554078 - RNA, 63 nt, hsa; identical to SEQ ID NO: 350026

SEQ ID NO: 554079 - RNA, 63 nt, hsa; identical to SEQ ID NO: 350027

SEQ ID NO: 554080 - RNA, 63 nt, hsa; identical to SEQ ID NO: 350028

SEQ ID NO: 554081 - RNA, 63 nt, hsa; identical to SEQ ID NO: 350029

SEQ ID NO: 554082 - RNA, 63 nt, hsa; identical to SEQ ID NO: 350030

SEQ ID NO: 554083 - RNA, 63 nt, hsa; identical to SEQ ID NO: 350031

SEQ ID NO: 554084 - RNA, 63 nt, hsa; identical to SEQ ID NO: 350032

SEQ ID NO: 554085 - RNA, 63 nt, hsa; identical to SEQ ID NO: 350033

SEQ ID NO: 554086 - RNA, 63 nt, hsa; identical to SEQ ID NO: 350034

SEQ ID NO: 554087 - RNA, 63 nt, hsa; identical to SEQ ID NO: 350035

SEQ ID NO: 554088 - RNA, 63 nt, hsa; identical to SEQ ID NO: 350036

SEQ ID NO: 554089 - RNA, 63 nt, hsa; identical to SEQ ID NO: 350037

SEQ ID NO: 554090 - RNA, 63 nt, hsa; identical to SEQ ID NO: 350038

SEQ ID NO: 554091 - RNA, 63 nt, hsa; identical to SEQ ID NO: 350039

SEQ ID NO: 554092 - RNA, 63 nt, hsa; identical to SEQ ID NO: 350040

SEQ ID NO: 554093 - RNA, 63 nt, hsa; identical to SEQ ID NO: 350041

SEQ ID NO: 554094 - RNA, 63 nt, hsa; identical to SEQ ID NO: 350042

SEQ ID NO: 554095 - RNA, 63 nt, hsa; identical to SEQ ID NO: 350043

SEQ ID NO: 554096 - RNA, 63 nt, hsa; identical to SEQ ID NO: 350044

SEQ ID NO: 554097 - RNA, 63 nt, hsa; identical to SEQ ID NO: 350045

SEQ ID NO: 554098 - RNA, 63 nt, hsa; identical to SEQ ID NO: 350046

SEQ ID NO: 554099 - RNA, 63 nt, hsa; identical to SEQ ID NO: 350047

SEQ ID NO: 554100 - RNA, 63 nt, hsa; identical to SEQ ID NO: 350048

SEQ ID NO: 554101 - RNA, 63 nt, hsa; identical to SEQ ID NO: 350049

SEQ ID NO: 554102 - RNA, 63 nt, hsa; identical to SEQ ID NO: 350050

SEQ ID NO: 554103 - RNA, 63 nt, hsa; identical to SEQ ID NO: 350051

SEQ ID NO: 554104 - RNA, 63 nt, hsa; identical to SEQ ID NO: 350052

SEQ ID NO: 554105 - RNA, 63 nt, hsa; identical to SEQ ID NO: 350053

SEQ ID NO: 554106 - RNA, 63 nt, hsa; identical to SEQ ID NO: 350054

SEQ ID NO: 554107 - RNA, 63 nt, hsa; identical to SEQ ID NO: 350055

SEQ ID NO: 554108 - RNA, 63 nt, hsa; identical to SEQ ID NO: 350056

SEQ ID NO: 554109 - RNA, 63 nt, hsa; identical to SEQ ID NO: 350057

SEQ ID NO: 554110 - RNA, 63 nt, hsa; identical to SEQ ID NO: 350058

SEQ ID NO: 554111 - RNA, 63 nt, hsa; identical to SEQ ID NO: 350059

SEQ ID NO: 554112 - RNA, 63 nt, hsa; identical to SEQ ID NO: 350060

SEQ ID NO: 554113 - RNA, 63 nt, hsa; identical to SEQ ID NO: 350061

SEQ ID NO: 554114 - RNA, 63 nt, hsa; identical to SEQ ID NO: 350062

SEQ ID NO: 554115 - RNA, 63 nt, hsa; identical to SEQ ID NO: 350063

SEQ ID NO: 554116 - RNA, 63 nt, hsa; identical to SEQ ID NO: 350064

SEQ ID NO: 554117 - RNA, 63 nt, hsa; identical to SEQ ID NO: 350065

SEQ ID NO: 554118 - RNA, 63 nt, hsa; identical to SEQ ID NO: 350066

SEQ ID NO: 554119 - RNA, 63 nt, hsa; identical to SEQ ID NO: 350067

SEQ ID NO: 554120 - RNA, 63 nt, hsa; identical to SEQ ID NO: 350068

SEQ ID NO: 554121 - RNA, 63 nt, hsa; identical to SEQ ID NO: 350069

SEQ ID NO: 554122 - RNA, 63 nt, hsa; identical to SEQ ID NO: 350070

SEQ ID NO: 554123 - RNA, 63 nt, hsa; identical to SEQ ID NO: 350071

SEQ ID NO: 554124 - RNA, 63 nt, hsa; identical to SEQ ID NO: 350072

SEQ ID NO: 554125 - RNA, 63 nt, hsa; identical to SEQ ID NO: 350073

SEQ ID NO: 554126 - RNA, 63 nt, hsa; identical to SEQ ID NO: 350074

SEQ ID NO: 554127 - RNA, 63 nt, hsa; identical to SEQ ID NO: 350075

SEQ ID NO: 554128 - RNA, 62 nt, hsa; identical to SEQ ID NO: 350076

SEQ ID NO: 554129 - RNA, 63 nt, hsa; identical to SEQ ID NO: 350077

SEQ ID NO: 554130 - RNA, 63 nt, hsa; identical to SEQ ID NO: 350078

SEQ ID NO: 554131 - RNA, 63 nt, hsa; identical to SEQ ID NO: 350079

SEQ ID NO: 554132 - RNA, 63 nt, hsa; identical to SEQ ID NO: 350080

SEQ ID NO: 554133 - RNA, 63 nt, hsa; identical to SEQ ID NO: 350081

SEQ ID NO: 554134 - RNA, 63 nt, hsa; identical to SEQ ID NO: 350082

SEQ ID NO: 554135 - RNA, 63 nt, hsa; identical to SEQ ID NO: 350083

SEQ ID NO: 554136 - RNA, 63 nt, hsa; identical to SEQ ID NO: 350084

SEQ ID NO: 554137 - RNA, 63 nt, hsa; identical to SEQ ID NO: 350085

SEQ ID NO: 554138 - RNA, 63 nt, hsa; identical to SEQ ID NO: 350086

SEQ ID NO: 554139 - RNA, 63 nt, hsa; identical to SEQ ID NO: 350087

SEQ ID NO: 554140 - RNA, 63 nt, hsa; identical to SEQ ID NO: 350088

SEQ ID NO: 554141 - RNA, 63 nt, hsa; identical to SEQ ID NO: 350089

SEQ ID NO: 554142 - RNA, 63 nt, hsa; identical to SEQ ID NO: 350090

SEQ ID NO: 554143 - RNA, 63 nt, hsa; identical to SEQ ID NO: 350091

SEQ ID NO: 554144 - RNA, 63 nt, hsa; identical to SEQ ID NO: 350092

SEQ ID NO: 554145 - RNA, 63 nt, hsa; identical to SEQ ID NO: 350093

SEQ ID NO: 554146 - RNA, 63 nt, hsa; identical to SEQ ID NO: 350094

SEQ ID NO: 554147 - RNA, 63 nt, hsa; identical to SEQ ID NO: 350095

SEQ ID NO: 554148 - RNA, 63 nt, hsa; identical to SEQ ID NO: 350096

SEQ ID NO: 554149 - RNA, 63 nt, hsa; identical to SEQ ID NO: 350097

SEQ ID NO: 554150 - RNA, 63 nt, hsa; identical to SEQ ID NO: 350098

SEQ ID NO: 554151 - RNA, 63 nt, hsa; identical to SEQ ID NO: 350099

SEQ ID NO: 554152 - RNA, 63 nt, hsa; identical to SEQ ID NO: 350100

SEQ ID NO: 554153 - RNA, 63 nt, hsa; identical to SEQ ID NO: 350101

SEQ ID NO: 554154 - RNA, 63 nt, hsa; identical to SEQ ID NO: 350102

SEQ ID NO: 554155 - RNA, 63 nt, hsa; identical to SEQ ID NO: 350103

SEQ ID NO: 554156 - RNA, 63 nt, hsa; identical to SEQ ID NO: 350104

SEQ ID NO: 554157 - RNA, 63 nt, hsa; identical to SEQ ID NO: 350105

SEQ ID NO: 554158 - RNA, 63 nt, hsa; identical to SEQ ID NO: 350106

SEQ ID NO: 554159 - RNA, 63 nt, hsa; identical to SEQ ID NO: 350107

SEQ ID NO: 554160 - RNA, 63 nt, hsa; identical to SEQ ID NO: 350108

SEQ ID NO: 554161 - RNA, 63 nt, hsa; identical to SEQ ID NO: 350109

SEQ ID NO: 554162 - RNA, 63 nt, hsa; identical to SEQ ID NO: 350110

SEQ ID NO: 554163 - RNA, 63 nt, hsa; identical to SEQ ID NO: 350111

SEQ ID NO: 554164 - RNA, 63 nt, hsa; identical to SEQ ID NO: 350112

SEQ ID NO: 554165 - RNA, 63 nt, hsa; identical to SEQ ID NO: 350113

SEQ ID NO: 554166 - RNA, 63 nt, hsa; identical to SEQ ID NO: 350114

SEQ ID NO: 554167 - RNA, 63 nt, hsa; identical to SEQ ID NO: 350115

SEQ ID NO: 554168 - RNA, 63 nt, hsa; identical to SEQ ID NO: 350116

SEQ ID NO: 554169 - RNA, 63 nt, hsa; identical to SEQ ID NO: 350117

SEQ ID NO: 554170 - RNA, 63 nt, hsa; identical to SEQ ID NO: 350118

SEQ ID NO: 554171 - RNA, 63 nt, hsa; identical to SEQ ID NO: 350119

SEQ ID NO: 554172 - RNA, 63 nt, hsa; identical to SEQ ID NO: 350120

SEQ ID NO: 554173 - RNA, 63 nt, hsa; identical to SEQ ID NO: 350121

SEQ ID NO: 554174 - RNA, 63 nt, hsa; identical to SEQ ID NO: 350122

SEQ ID NO: 554175 - RNA, 63 nt, hsa; identical to SEQ ID NO: 350123

SEQ ID NO: 554176 - RNA, 63 nt, hsa; identical to SEQ ID NO: 350124

SEQ ID NO: 554177 - RNA, 63 nt, hsa; identical to SEQ ID NO: 350125

SEQ ID NO: 554178 - RNA, 63 nt, hsa; identical to SEQ ID NO: 350126

SEQ ID NO: 554179 - RNA, 63 nt, hsa; identical to SEQ ID NO: 350127

SEQ ID NO: 554180 - RNA, 63 nt, hsa; identical to SEQ ID NO: 350128

SEQ ID NO: 554181 - RNA, 63 nt, hsa; identical to SEQ ID NO: 350129

SEQ ID NO: 554182 - RNA, 63 nt, hsa; identical to SEQ ID NO: 350130

SEQ ID NO: 554183 - RNA, 63 nt, hsa; identical to SEQ ID NO: 350131

SEQ ID NO: 554184 - RNA, 63 nt, hsa; identical to SEQ ID NO: 350132

SEQ ID NO: 554185 - RNA, 63 nt, hsa; identical to SEQ ID NO: 350133

SEQ ID NO: 554186 - RNA, 63 nt, hsa; identical to SEQ ID NO: 350134

SEQ ID NO: 554187 - RNA, 63 nt, hsa; identical to SEQ ID NO: 350135

SEQ ID NO: 554188 - RNA, 63 nt, hsa; identical to SEQ ID NO: 350136

SEQ ID NO: 554189 - RNA, 63 nt, hsa; identical to SEQ ID NO: 350137

SEQ ID NO: 554190 - RNA, 63 nt, hsa; identical to SEQ ID NO: 350138

SEQ ID NO: 554191 - RNA, 63 nt, hsa; identical to SEQ ID NO: 350139

SEQ ID NO: 554192 - RNA, 63 nt, hsa; identical to SEQ ID NO: 350140

SEQ ID NO: 554193 - RNA, 63 nt, hsa; identical to SEQ ID NO: 350141

SEQ ID NO: 554194 - RNA, 63 nt, hsa; identical to SEQ ID NO: 350142

SEQ ID NO: 554195 - RNA, 63 nt, hsa; identical to SEQ ID NO: 350143

SEQ ID NO: 554196 - RNA, 63 nt, hsa; identical to SEQ ID NO: 350144

SEQ ID NO: 554197 - RNA, 63 nt, hsa; identical to SEQ ID NO: 350145

SEQ ID NO: 554198 - RNA, 63 nt, hsa; identical to SEQ ID NO: 350146

SEQ ID NO: 554199 - RNA, 63 nt, hsa; identical to SEQ ID NO: 350147

SEQ ID NO: 554200 - RNA, 63 nt, hsa; identical to SEQ ID NO: 350148

SEQ ID NO: 554201 - RNA, 63 nt, hsa; identical to SEQ ID NO: 350149

SEQ ID NO: 554202 - RNA, 63 nt, hsa; identical to SEQ ID NO: 350150

SEQ ID NO: 554203 - RNA, 63 nt, hsa; identical to SEQ ID NO: 350151

SEQ ID NO: 554204 - RNA, 63 nt, hsa; identical to SEQ ID NO: 350152

SEQ ID NO: 554205 - RNA, 63 nt, hsa; identical to SEQ ID NO: 350153

SEQ ID NO: 554206 - RNA, 60 nt, hsa; identical to SEQ ID NO: 350154

SEQ ID NO: 554207 - RNA, 63 nt, hsa; identical to SEQ ID NO: 350155

SEQ ID NO: 554208 - RNA, 63 nt, hsa; identical to SEQ ID NO: 350156

SEQ ID NO: 554209 - RNA, 63 nt, hsa; identical to SEQ ID NO: 350157

SEQ ID NO: 554210 - RNA, 63 nt, hsa; identical to SEQ ID NO: 350158

SEQ ID NO: 554211 - RNA, 63 nt, hsa; identical to SEQ ID NO: 350159

SEQ ID NO: 554212 - RNA, 63 nt, hsa; identical to SEQ ID NO: 350160

SEQ ID NO: 554213 - RNA, 63 nt, hsa; identical to SEQ ID NO: 350161

SEQ ID NO: 554214 - RNA, 63 nt, hsa; identical to SEQ ID NO: 350162

SEQ ID NO: 554215 - RNA, 63 nt, hsa; identical to SEQ ID NO: 350163

SEQ ID NO: 554216 - RNA, 63 nt, hsa; identical to SEQ ID NO: 350164

SEQ ID NO: 554217 - RNA, 63 nt, hsa; identical to SEQ ID NO: 350165

SEQ ID NO: 554218 - RNA, 63 nt, hsa; identical to SEQ ID NO: 350166

SEQ ID NO: 554219 - RNA, 63 nt, hsa; identical to SEQ ID NO: 350167

SEQ ID NO: 554220 - RNA, 63 nt, hsa; identical to SEQ ID NO: 350168

SEQ ID NO: 554221 - RNA, 63 nt, hsa; identical to SEQ ID NO: 350169

SEQ ID NO: 554222 - RNA, 63 nt, hsa; identical to SEQ ID NO: 350170

SEQ ID NO: 554223 - RNA, 63 nt, hsa; identical to SEQ ID NO: 350171

SEQ ID NO: 554224 - RNA, 63 nt, hsa; identical to SEQ ID NO: 350172

SEQ ID NO: 554225 - RNA, 63 nt, hsa; identical to SEQ ID NO: 350173

SEQ ID NO: 554226 - RNA, 63 nt, hsa; identical to SEQ ID NO: 350174

SEQ ID NO: 554227 - RNA, 63 nt, hsa; identical to SEQ ID NO: 350175

SEQ ID NO: 554228 - RNA, 63 nt, hsa; identical to SEQ ID NO: 350176

SEQ ID NO: 554229 - RNA, 63 nt, hsa; identical to SEQ ID NO: 350177

SEQ ID NO: 554230 - RNA, 63 nt, hsa; identical to SEQ ID NO: 350178

SEQ ID NO: 554231 - RNA, 63 nt, hsa; identical to SEQ ID NO: 350179

SEQ ID NO: 554232 - RNA, 63 nt, hsa; identical to SEQ ID NO: 350180

SEQ ID NO: 554233 - RNA, 63 nt, hsa; identical to SEQ ID NO: 350181

SEQ ID NO: 554234 - RNA, 63 nt, hsa; identical to SEQ ID NO: 350182

SEQ ID NO: 554235 - RNA, 63 nt, hsa; identical to SEQ ID NO: 350183

SEQ ID NO: 554236 - RNA, 63 nt, hsa; identical to SEQ ID NO: 350184

SEQ ID NO: 554237 - RNA, 63 nt, hsa; identical to SEQ ID NO: 350184

SEQ ID NO: 554238 - RNA, 63 nt, hsa; identical to SEQ ID NO: 350186

SEQ ID NO: 554239 - RNA, 63 nt, hsa; identical to SEQ ID NO: 350187

SEQ ID NO: 554240 - RNA, 63 nt, hsa; identical to SEQ ID NO: 350188

SEQ ID NO: 554241 - RNA, 63 nt, hsa; identical to SEQ ID NO: 350189

SEQ ID NO: 554242 - RNA, 63 nt, hsa; identical to SEQ ID NO: 350190

SEQ ID NO: 554243 - RNA, 63 nt, hsa; identical to SEQ ID NO: 350191

SEQ ID NO: 554244 - RNA, 63 nt, hsa; identical to SEQ ID NO: 350192

SEQ ID NO: 554245 - RNA, 63 nt, hsa; identical to SEQ ID NO: 350193

SEQ ID NO: 554246 - RNA, 63 nt, hsa; identical to SEQ ID NO: 350194

SEQ ID NO: 554247 - RNA, 63 nt, hsa; identical to SEQ ID NO: 350195

SEQ ID NO: 554248 - RNA, 63 nt, hsa; identical to SEQ ID NO: 350196

SEQ ID NO: 554249 - RNA, 63 nt, hsa; identical to SEQ ID NO: 350197

SEQ ID NO: 554250 - RNA, 63 nt, hsa; identical to SEQ ID NO: 350198

SEQ ID NO: 554251 - RNA, 63 nt, hsa; identical to SEQ ID NO: 350199

SEQ ID NO: 554252 - RNA, 63 nt, hsa; identical to SEQ ID NO: 350200

SEQ ID NO: 554253 - RNA, 63 nt, hsa; identical to SEQ ID NO: 350201

SEQ ID NO: 554254 - RNA, 63 nt, hsa; identical to SEQ ID NO: 350202

SEQ ID NO: 554255 - RNA, 61 nt, hsa; identical to SEQ ID NO: 350203

SEQ ID NO: 554256 - RNA, 63 nt, hsa; identical to SEQ ID NO: 350204

SEQ ID NO: 554257 - RNA, 63 nt, hsa; identical to SEQ ID NO: 350205

SEQ ID NO: 554258 - RNA, 63 nt, hsa; identical to SEQ ID NO: 350206

SEQ ID NO: 554259 - RNA, 63 nt, hsa; identical to SEQ ID NO: 350207

SEQ ID NO: 554260 - RNA, 63 nt, hsa; identical to SEQ ID NO: 350208

SEQ ID NO: 554261 - RNA, 63 nt, hsa; identical to SEQ ID NO: 350209

SEQ ID NO: 554262 - RNA, 63 nt, hsa; identical to SEQ ID NO: 350210

SEQ ID NO: 554263 - RNA, 63 nt, hsa; identical to SEQ ID NO: 350211

SEQ ID NO: 554264 - RNA, 63 nt, hsa; identical to SEQ ID NO: 350212

SEQ ID NO: 554265 - RNA, 63 nt, hsa; identical to SEQ ID NO: 350213

SEQ ID NO: 554266 - RNA, 63 nt, hsa; identical to SEQ ID NO: 350214

SEQ ID NO: 554267 - RNA, 63 nt, hsa; identical to SEQ ID NO: 350215

SEQ ID NO: 554268 - RNA, 63 nt, hsa; identical to SEQ ID NO: 350216

SEQ ID NO: 554269 - RNA, 63 nt, hsa; identical to SEQ ID NO: 350217

SEQ ID NO: 554270 - RNA, 63 nt, hsa; identical to SEQ ID NO: 350218

SEQ ID NO: 554271 - RNA, 63 nt, hsa; identical to SEQ ID NO: 350219

SEQ ID NO: 554272 - RNA, 63 nt, hsa; identical to SEQ ID NO: 350220

SEQ ID NO: 554273 - RNA, 63 nt, hsa; identical to SEQ ID NO: 350221

SEQ ID NO: 554274 - RNA, 63 nt, hsa; identical to SEQ ID NO: 350222

SEQ ID NO: 554275 - RNA, 63 nt, hsa; identical to SEQ ID NO: 350223

SEQ ID NO: 554276 - RNA, 63 nt, hsa; identical to SEQ ID NO: 350224

SEQ ID NO: 554277 - RNA, 63 nt, hsa; identical to SEQ ID NO: 350225

SEQ ID NO: 554278 - RNA, 63 nt, hsa; identical to SEQ ID NO: 350226

SEQ ID NO: 554279 - RNA, 63 nt, hsa; identical to SEQ ID NO: 350227

SEQ ID NO: 554280 - RNA, 63 nt, hsa; identical to SEQ ID NO: 350228

SEQ ID NO: 554281 - RNA, 63 nt, hsa; identical to SEQ ID NO: 350229

SEQ ID NO: 554282 - RNA, 63 nt, hsa; identical to SEQ ID NO: 350230

SEQ ID NO: 554283 - RNA, 63 nt, hsa; identical to SEQ ID NO: 350231

SEQ ID NO: 554284 - RNA, 63 nt, hsa; identical to SEQ ID NO: 350232

SEQ ID NO: 554285 - RNA, 63 nt, hsa; identical to SEQ ID NO: 350233

SEQ ID NO: 554286 - RNA, 63 nt, hsa; identical to SEQ ID NO: 350234

SEQ ID NO: 554287 - RNA, 63 nt, hsa; identical to SEQ ID NO: 350234

SEQ ID NO: 554288 - RNA, 63 nt, hsa; identical to SEQ ID NO: 350236

SEQ ID NO: 554289 - RNA, 62 nt, hsa; identical to SEQ ID NO: 350237

SEQ ID NO: 554290 - RNA, 62 nt, hsa; identical to SEQ ID NO: 350238

SEQ ID NO: 554291 - RNA, 62 nt, hsa; identical to SEQ ID NO: 350239

SEQ ID NO: 554292 - RNA, 62 nt, hsa; identical to SEQ ID NO: 350240

SEQ ID NO: 554293 - RNA, 62 nt, hsa; identical to SEQ ID NO: 350241

SEQ ID NO: 554294 - RNA, 62 nt, hsa; identical to SEQ ID NO: 350242

SEQ ID NO: 554295 - RNA, 62 nt, hsa; identical to SEQ ID NO: 350243

SEQ ID NO: 554296 - RNA, 62 nt, hsa; identical to SEQ ID NO: 350244

SEQ ID NO: 554297 - RNA, 62 nt, hsa; identical to SEQ ID NO: 350245

SEQ ID NO: 554298 - RNA, 62 nt, hsa; identical to SEQ ID NO: 350246

SEQ ID NO: 554299 - RNA, 62 nt, hsa; identical to SEQ ID NO: 350247

SEQ ID NO: 554300 - RNA, 62 nt, hsa; identical to SEQ ID NO: 350248

SEQ ID NO: 554301 - RNA, 62 nt, hsa; identical to SEQ ID NO: 350249

SEQ ID NO: 554302 - RNA, 62 nt, hsa; identical to SEQ ID NO: 350250

SEQ ID NO: 554303 - RNA, 62 nt, hsa; identical to SEQ ID NO: 350251

SEQ ID NO: 554304 - RNA, 62 nt, hsa; identical to SEQ ID NO: 350252

SEQ ID NO: 554305 - RNA, 55 nt, hsa; identical to SEQ ID NO: 174536

SEQ ID NO: 554306 - RNA, 62 nt, hsa; identical to SEQ ID NO: 350254

SEQ ID NO: 554307 - RNA, 62 nt, hsa; identical to SEQ ID NO: 350255

SEQ ID NO: 554308 - RNA, 62 nt, hsa; identical to SEQ ID NO: 350256

SEQ ID NO: 554309 - RNA, 62 nt, hsa; identical to SEQ ID NO: 350257

SEQ ID NO: 554310 - RNA, 62 nt, hsa; identical to SEQ ID NO: 350258

SEQ ID NO: 554311 - RNA, 62 nt, hsa; identical to SEQ ID NO: 350259

SEQ ID NO: 554312 - RNA, 62 nt, hsa; identical to SEQ ID NO: 350260

SEQ ID NO: 554313 - RNA, 62 nt, hsa; identical to SEQ ID NO: 350261

SEQ ID NO: 554314 - RNA, 62 nt, hsa; identical to SEQ ID NO: 350262

SEQ ID NO: 554315 - RNA, 62 nt, hsa; identical to SEQ ID NO: 350263

SEQ ID NO: 554316 - RNA, 62 nt, hsa; identical to SEQ ID NO: 350264

SEQ ID NO: 554317 - RNA, 62 nt, hsa; identical to SEQ ID NO: 350265

SEQ ID NO: 554318 - RNA, 62 nt, hsa; identical to SEQ ID NO: 350266

SEQ ID NO: 554319 - RNA, 62 nt, hsa; identical to SEQ ID NO: 350267

SEQ ID NO: 554320 - RNA, 62 nt, hsa; identical to SEQ ID NO: 350268

SEQ ID NO: 554321 - RNA, 58 nt, hsa; identical to SEQ ID NO: 174552

SEQ ID NO: 554322 - RNA, 62 nt, hsa; identical to SEQ ID NO: 350270

SEQ ID NO: 554323 - RNA, 62 nt, hsa; identical to SEQ ID NO: 350271

SEQ ID NO: 554324 - RNA, 62 nt, hsa; identical to SEQ ID NO: 350272

SEQ ID NO: 554325 - RNA, 62 nt, hsa; identical to SEQ ID NO: 350273

SEQ ID NO: 554326 - RNA, 62 nt, hsa; identical to SEQ ID NO: 350274

SEQ ID NO: 554327 - RNA, 62 nt, hsa; identical to SEQ ID NO: 350275

SEQ ID NO: 554328 - RNA, 62 nt, hsa; identical to SEQ ID NO: 350276

SEQ ID NO: 554329 - RNA, 62 nt, hsa; identical to SEQ ID NO: 350277

SEQ ID NO: 554330 - RNA, 62 nt, hsa; identical to SEQ ID NO: 350278

SEQ ID NO: 554331 - RNA, 62 nt, hsa; identical to SEQ ID NO: 350279

SEQ ID NO: 554332 - RNA, 62 nt, hsa; identical to SEQ ID NO: 350280

SEQ ID NO: 554333 - RNA, 62 nt, hsa; identical to SEQ ID NO: 350281

SEQ ID NO: 554334 - RNA, 62 nt, hsa; identical to SEQ ID NO: 350282

SEQ ID NO: 554335 - RNA, 62 nt, hsa; identical to SEQ ID NO: 350283

SEQ ID NO: 554336 - RNA, 62 nt, hsa; identical to SEQ ID NO: 350284

SEQ ID NO: 554337 - RNA, 62 nt, hsa; identical to SEQ ID NO: 350285

SEQ ID NO: 554338 - RNA, 62 nt, hsa; identical to SEQ ID NO: 350286

SEQ ID NO: 554339 - RNA, 62 nt, hsa; identical to SEQ ID NO: 350287

SEQ ID NO: 554340 - RNA, 62 nt, hsa; identical to SEQ ID NO: 350288

SEQ ID NO: 554341 - RNA, 62 nt, hsa; identical to SEQ ID NO: 350289

SEQ ID NO: 554342 - RNA, 62 nt, hsa; identical to SEQ ID NO: 350290

SEQ ID NO: 554343 - RNA, 62 nt, hsa; identical to SEQ ID NO: 350291

SEQ ID NO: 554344 - RNA, 62 nt, hsa; identical to SEQ ID NO: 350292

SEQ ID NO: 554345 - RNA, 62 nt, hsa; identical to SEQ ID NO: 350293

SEQ ID NO: 554346 - RNA, 62 nt, hsa; identical to SEQ ID NO: 350294

SEQ ID NO: 554347 - RNA, 62 nt, hsa; identical to SEQ ID NO: 350295

SEQ ID NO: 554348 - RNA, 62 nt, hsa; identical to SEQ ID NO: 350296

SEQ ID NO: 554349 - RNA, 62 nt, hsa; identical to SEQ ID NO: 350297

SEQ ID NO: 554350 - RNA, 62 nt, hsa; identical to SEQ ID NO: 350298

SEQ ID NO: 554351 - RNA, 62 nt, hsa; identical to SEQ ID NO: 350299

SEQ ID NO: 554352 - RNA, 62 nt, hsa; identical to SEQ ID NO: 350300

SEQ ID NO: 554353 - RNA, 62 nt, hsa; identical to SEQ ID NO: 350301

SEQ ID NO: 554354 - RNA, 62 nt, hsa; identical to SEQ ID NO: 350302

SEQ ID NO: 554355 - RNA, 62 nt, hsa; identical to SEQ ID NO: 350303

SEQ ID NO: 554356 - RNA, 62 nt, hsa; identical to SEQ ID NO: 350304

SEQ ID NO: 554357 - RNA, 62 nt, hsa; identical to SEQ ID NO: 350305

SEQ ID NO: 554358 - RNA, 62 nt, hsa; identical to SEQ ID NO: 350306

SEQ ID NO: 554359 - RNA, 62 nt, hsa; identical to SEQ ID NO: 350307

SEQ ID NO: 554360 - RNA, 62 nt, hsa; identical to SEQ ID NO: 350308

SEQ ID NO: 554361 - RNA, 62 nt, hsa; identical to SEQ ID NO: 350309

SEQ ID NO: 554362 - RNA, 62 nt, hsa; identical to SEQ ID NO: 350310

SEQ ID NO: 554363 - RNA, 62 nt, hsa; identical to SEQ ID NO: 350311

SEQ ID NO: 554364 - RNA, 62 nt, hsa; identical to SEQ ID NO: 350312

SEQ ID NO: 554365 - RNA, 62 nt, hsa; identical to SEQ ID NO: 350313

SEQ ID NO: 554366 - RNA, 62 nt, hsa; identical to SEQ ID NO: 350314

SEQ ID NO: 554367 - RNA, 62 nt, hsa; identical to SEQ ID NO: 350315

SEQ ID NO: 554368 - RNA, 62 nt, hsa; identical to SEQ ID NO: 350316

SEQ ID NO: 554369 - RNA, 62 nt, hsa; identical to SEQ ID NO: 350317

SEQ ID NO: 554370 - RNA, 62 nt, hsa; identical to SEQ ID NO: 350318

SEQ ID NO: 554371 - RNA, 62 nt, hsa; identical to SEQ ID NO: 350319

SEQ ID NO: 554372 - RNA, 62 nt, hsa; identical to SEQ ID NO: 350320

SEQ ID NO: 554373 - RNA, 62 nt, hsa; identical to SEQ ID NO: 350321

SEQ ID NO: 554374 - RNA, 62 nt, hsa; identical to SEQ ID NO: 350322

SEQ ID NO: 554375 - RNA, 62 nt, hsa; identical to SEQ ID NO: 350323

SEQ ID NO: 554376 - RNA, 62 nt, hsa; identical to SEQ ID NO: 350324

SEQ ID NO: 554377 - RNA, 62 nt, hsa; identical to SEQ ID NO: 350325

SEQ ID NO: 554378 - RNA, 62 nt, hsa; identical to SEQ ID NO: 350326

SEQ ID NO: 554379 - RNA, 62 nt, hsa; identical to SEQ ID NO: 350327

SEQ ID NO: 554380 - RNA, 62 nt, hsa; identical to SEQ ID NO: 350328

SEQ ID NO: 554381 - RNA, 62 nt, hsa; identical to SEQ ID NO: 350329

SEQ ID NO: 554382 - RNA, 62 nt, hsa; identical to SEQ ID NO: 350330

SEQ ID NO: 554383 - RNA, 62 nt, hsa; identical to SEQ ID NO: 350331

SEQ ID NO: 554384 - RNA, 62 nt, hsa; identical to SEQ ID NO: 350332

SEQ ID NO: 554385 - RNA, 62 nt, hsa; identical to SEQ ID NO: 350333

SEQ ID NO: 554386 - RNA, 62 nt, hsa; identical to SEQ ID NO: 350334

SEQ ID NO: 554387 - RNA, 62 nt, hsa; identical to SEQ ID NO: 350335

SEQ ID NO: 554388 - RNA, 62 nt, hsa; identical to SEQ ID NO: 350336

SEQ ID NO: 554389 - RNA, 62 nt, hsa; identical to SEQ ID NO: 350337

SEQ ID NO: 554390 - RNA, 62 nt, hsa; identical to SEQ ID NO: 350338

SEQ ID NO: 554391 - RNA, 62 nt, hsa; identical to SEQ ID NO: 350339

SEQ ID NO: 554392 - RNA, 62 nt, hsa; identical to SEQ ID NO: 350340

SEQ ID NO: 554393 - RNA, 62 nt, hsa; identical to SEQ ID NO: 350341

SEQ ID NO: 554394 - RNA, 62 nt, hsa; identical to SEQ ID NO: 350342

SEQ ID NO: 554395 - RNA, 62 nt, hsa; identical to SEQ ID NO: 350343

SEQ ID NO: 554396 - RNA, 62 nt, hsa; identical to SEQ ID NO: 350344

SEQ ID NO: 554397 - RNA, 62 nt, hsa; identical to SEQ ID NO: 350345

SEQ ID NO: 554398 - RNA, 62 nt, hsa; identical to SEQ ID NO: 350346

SEQ ID NO: 554399 - RNA, 62 nt, hsa; identical to SEQ ID NO: 350347

SEQ ID NO: 554400 - RNA, 62 nt, hsa; identical to SEQ ID NO: 350348

SEQ ID NO: 554401 - RNA, 62 nt, hsa; identical to SEQ ID NO: 350349

SEQ ID NO: 554402 - RNA, 62 nt, hsa; identical to SEQ ID NO: 350350

SEQ ID NO: 554403 - RNA, 62 nt, hsa; identical to SEQ ID NO: 350351

SEQ ID NO: 554404 - RNA, 62 nt, hsa; identical to SEQ ID NO: 350352

SEQ ID NO: 554405 - RNA, 62 nt, hsa; identical to SEQ ID NO: 350353

SEQ ID NO: 554406 - RNA, 62 nt, hsa; identical to SEQ ID NO: 350354

SEQ ID NO: 554407 - RNA, 62 nt, hsa; identical to SEQ ID NO: 350355

SEQ ID NO: 554408 - RNA, 62 nt, hsa; identical to SEQ ID NO: 350356

SEQ ID NO: 554409 - RNA, 62 nt, hsa; identical to SEQ ID NO: 350357

SEQ ID NO: 554410 - RNA, 62 nt, hsa; identical to SEQ ID NO: 350358

SEQ ID NO: 554411 - RNA, 62 nt, hsa; identical to SEQ ID NO: 350359

SEQ ID NO: 554412 - RNA, 62 nt, hsa; identical to SEQ ID NO: 350360

SEQ ID NO: 554413 - RNA, 62 nt, hsa; identical to SEQ ID NO: 350361

SEQ ID NO: 554414 - RNA, 62 nt, hsa; identical to SEQ ID NO: 350362

SEQ ID NO: 554415 - RNA, 62 nt, hsa; identical to SEQ ID NO: 350363

SEQ ID NO: 554416 - RNA, 62 nt, hsa; identical to SEQ ID NO: 350364

SEQ ID NO: 554417 - RNA, 62 nt, hsa; identical to SEQ ID NO: 350365

SEQ ID NO: 554418 - RNA, 62 nt, hsa; identical to SEQ ID NO: 350366

SEQ ID NO: 554419 - RNA, 62 nt, hsa; identical to SEQ ID NO: 350367

SEQ ID NO: 554420 - RNA, 62 nt, hsa; identical to SEQ ID NO: 350368

SEQ ID NO: 554421 - RNA, 62 nt, hsa; identical to SEQ ID NO: 350369

SEQ ID NO: 554422 - RNA, 62 nt, hsa; identical to SEQ ID NO: 350370

SEQ ID NO: 554423 - RNA, 62 nt, hsa; identical to SEQ ID NO: 350371

SEQ ID NO: 554424 - RNA, 62 nt, hsa; identical to SEQ ID NO: 350372

SEQ ID NO: 554425 - RNA, 62 nt, hsa; identical to SEQ ID NO: 350373

SEQ ID NO: 554426 - RNA, 62 nt, hsa; identical to SEQ ID NO: 350374

SEQ ID NO: 554427 - RNA, 62 nt, hsa; identical to SEQ ID NO: 350375

SEQ ID NO: 554428 - RNA, 62 nt, hsa; identical to SEQ ID NO: 350376

SEQ ID NO: 554429 - RNA, 62 nt, hsa; identical to SEQ ID NO: 350377

SEQ ID NO: 554430 - RNA, 62 nt, hsa; identical to SEQ ID NO: 350378

SEQ ID NO: 554431 - RNA, 62 nt, hsa; identical to SEQ ID NO: 350379

SEQ ID NO: 554432 - RNA, 62 nt, hsa; identical to SEQ ID NO: 350380

SEQ ID NO: 554433 - RNA, 62 nt, hsa; identical to SEQ ID NO: 350381

SEQ ID NO: 554434 - RNA, 62 nt, hsa; identical to SEQ ID NO: 350382

SEQ ID NO: 554435 - RNA, 62 nt, hsa; identical to SEQ ID NO: 350383

SEQ ID NO: 554436 - RNA, 62 nt, hsa; identical to SEQ ID NO: 350384

SEQ ID NO: 554437 - RNA, 62 nt, hsa; identical to SEQ ID NO: 350385

SEQ ID NO: 554438 - RNA, 62 nt, hsa; identical to SEQ ID NO: 350386

SEQ ID NO: 554439 - RNA, 62 nt, hsa; identical to SEQ ID NO: 350387

SEQ ID NO: 554440 - RNA, 62 nt, hsa; identical to SEQ ID NO: 350388

SEQ ID NO: 554441 - RNA, 62 nt, hsa; identical to SEQ ID NO: 350389

SEQ ID NO: 554442 - RNA, 62 nt, hsa; identical to SEQ ID NO: 350390

SEQ ID NO: 554443 - RNA, 62 nt, hsa; identical to SEQ ID NO: 350391

SEQ ID NO: 554444 - RNA, 62 nt, hsa; identical to SEQ ID NO: 350392

SEQ ID NO: 554445 - RNA, 62 nt, hsa; identical to SEQ ID NO: 350393

SEQ ID NO: 554446 - RNA, 62 nt, hsa; identical to SEQ ID NO: 350394

SEQ ID NO: 554447 - RNA, 62 nt, hsa; identical to SEQ ID NO: 350395

SEQ ID NO: 554448 - RNA, 62 nt, hsa; identical to SEQ ID NO: 350396

SEQ ID NO: 554449 - RNA, 62 nt, hsa; identical to SEQ ID NO: 350397

SEQ ID NO: 554450 - RNA, 62 nt, hsa; identical to SEQ ID NO: 350398

SEQ ID NO: 554451 - RNA, 62 nt, hsa; identical to SEQ ID NO: 350399

SEQ ID NO: 554452 - RNA, 62 nt, hsa; identical to SEQ ID NO: 350400

SEQ ID NO: 554453 - RNA, 62 nt, hsa; identical to SEQ ID NO: 350401

SEQ ID NO: 554454 - RNA, 62 nt, hsa; identical to SEQ ID NO: 350402

SEQ ID NO: 554455 - RNA, 62 nt, hsa; identical to SEQ ID NO: 350403

SEQ ID NO: 554456 - RNA, 62 nt, hsa; identical to SEQ ID NO: 350404

SEQ ID NO: 554457 - RNA, 62 nt, hsa; identical to SEQ ID NO: 350405

SEQ ID NO: 554458 - RNA, 62 nt, hsa; identical to SEQ ID NO: 350406

SEQ ID NO: 554459 - RNA, 62 nt, hsa; identical to SEQ ID NO: 350407

SEQ ID NO: 554460 - RNA, 62 nt, hsa; identical to SEQ ID NO: 350408

SEQ ID NO: 554461 - RNA, 62 nt, hsa; identical to SEQ ID NO: 350409

SEQ ID NO: 554462 - RNA, 62 nt, hsa; identical to SEQ ID NO: 350410

SEQ ID NO: 554463 - RNA, 62 nt, hsa; identical to SEQ ID NO: 350411

SEQ ID NO: 554464 - RNA, 62 nt, hsa; identical to SEQ ID NO: 350412

SEQ ID NO: 554465 - RNA, 62 nt, hsa; identical to SEQ ID NO: 350413

SEQ ID NO: 554466 - RNA, 62 nt, hsa; identical to SEQ ID NO: 350414

SEQ ID NO: 554467 - RNA, 62 nt, hsa; identical to SEQ ID NO: 350415

SEQ ID NO: 554468 - RNA, 62 nt, hsa; identical to SEQ ID NO: 350416

SEQ ID NO: 554469 - RNA, 62 nt, hsa; identical to SEQ ID NO: 350417

SEQ ID NO: 554470 - RNA, 62 nt, hsa; identical to SEQ ID NO: 350418

SEQ ID NO: 554471 - RNA, 62 nt, hsa; identical to SEQ ID NO: 350419

SEQ ID NO: 554472 - RNA, 62 nt, hsa; identical to SEQ ID NO: 350420

SEQ ID NO: 554473 - RNA, 62 nt, hsa; identical to SEQ ID NO: 350421

SEQ ID NO: 554474 - RNA, 62 nt, hsa; identical to SEQ ID NO: 350422

SEQ ID NO: 554475 - RNA, 62 nt, hsa; identical to SEQ ID NO: 350423

SEQ ID NO: 554476 - RNA, 62 nt, hsa; identical to SEQ ID NO: 350424

SEQ ID NO: 554477 - RNA, 62 nt, hsa; identical to SEQ ID NO: 350425

SEQ ID NO: 554478 - RNA, 62 nt, hsa; identical to SEQ ID NO: 350426

SEQ ID NO: 554479 - RNA, 62 nt, hsa; identical to SEQ ID NO: 350427

SEQ ID NO: 554480 - RNA, 62 nt, hsa; identical to SEQ ID NO: 350428

SEQ ID NO: 554481 - RNA, 62 nt, hsa; identical to SEQ ID NO: 350429

SEQ ID NO: 554482 - RNA, 62 nt, hsa; identical to SEQ ID NO: 350430

SEQ ID NO: 554483 - RNA, 62 nt, hsa; identical to SEQ ID NO: 350431

SEQ ID NO: 554484 - RNA, 62 nt, hsa; identical to SEQ ID NO: 350432

SEQ ID NO: 554485 - RNA, 62 nt, hsa; identical to SEQ ID NO: 350433

SEQ ID NO: 554486 - RNA, 62 nt, hsa; identical to SEQ ID NO: 350434

SEQ ID NO: 554487 - RNA, 62 nt, hsa; identical to SEQ ID NO: 350435

SEQ ID NO: 554488 - RNA, 62 nt, hsa; identical to SEQ ID NO: 350436

SEQ ID NO: 554489 - RNA, 62 nt, hsa; identical to SEQ ID NO: 350437

SEQ ID NO: 554490 - RNA, 62 nt, hsa; identical to SEQ ID NO: 350438

SEQ ID NO: 554491 - RNA, 62 nt, hsa; identical to SEQ ID NO: 350439

SEQ ID NO: 554492 - RNA, 62 nt, hsa; identical to SEQ ID NO: 350440

SEQ ID NO: 554493 - RNA, 62 nt, hsa; identical to SEQ ID NO: 350441

SEQ ID NO: 554494 - RNA, 62 nt, hsa; identical to SEQ ID NO: 350442

SEQ ID NO: 554495 - RNA, 62 nt, hsa; identical to SEQ ID NO: 350443

SEQ ID NO: 554496 - RNA, 62 nt, hsa; identical to SEQ ID NO: 350444

SEQ ID NO: 554497 - RNA, 62 nt, hsa; identical to SEQ ID NO: 350445

SEQ ID NO: 554498 - RNA, 62 nt, hsa; identical to SEQ ID NO: 350446

SEQ ID NO: 554499 - RNA, 62 nt, hsa; identical to SEQ ID NO: 350447

SEQ ID NO: 554500 - RNA, 62 nt, hsa; identical to SEQ ID NO: 350448

SEQ ID NO: 554501 - RNA, 62 nt, hsa; identical to SEQ ID NO: 350449

SEQ ID NO: 554502 - RNA, 62 nt, hsa; identical to SEQ ID NO: 350450

SEQ ID NO: 554503 - RNA, 62 nt, hsa; identical to SEQ ID NO: 350451

SEQ ID NO: 554504 - RNA, 62 nt, hsa; identical to SEQ ID NO: 350452

SEQ ID NO: 554505 - RNA, 62 nt, hsa; identical to SEQ ID NO: 350453

SEQ ID NO: 554506 - RNA, 62 nt, hsa; identical to SEQ ID NO: 350454

SEQ ID NO: 554507 - RNA, 62 nt, hsa; identical to SEQ ID NO: 350455

SEQ ID NO: 554508 - RNA, 62 nt, hsa; identical to SEQ ID NO: 350456

SEQ ID NO: 554509 - RNA, 62 nt, hsa; identical to SEQ ID NO: 350457

SEQ ID NO: 554510 - RNA, 62 nt, hsa; identical to SEQ ID NO: 350458

SEQ ID NO: 554511 - RNA, 62 nt, hsa; identical to SEQ ID NO: 350459

SEQ ID NO: 554512 - RNA, 62 nt, hsa; identical to SEQ ID NO: 350460

SEQ ID NO: 554513 - RNA, 62 nt, hsa; identical to SEQ ID NO: 350461

SEQ ID NO: 554514 - RNA, 62 nt, hsa; identical to SEQ ID NO: 350462

SEQ ID NO: 554515 - RNA, 62 nt, hsa; identical to SEQ ID NO: 350463

SEQ ID NO: 554516 - RNA, 62 nt, hsa; identical to SEQ ID NO: 350464

SEQ ID NO: 554517 - RNA, 62 nt, hsa; identical to SEQ ID NO: 350465

SEQ ID NO: 554518 - RNA, 62 nt, hsa; identical to SEQ ID NO: 350466

SEQ ID NO: 554519 - RNA, 62 nt, hsa; identical to SEQ ID NO: 350467

SEQ ID NO: 554520 - RNA, 62 nt, hsa; identical to SEQ ID NO: 350468

SEQ ID NO: 554521 - RNA, 62 nt, hsa; identical to SEQ ID NO: 350469

SEQ ID NO: 554522 - RNA, 62 nt, hsa; identical to SEQ ID NO: 350470

SEQ ID NO: 554523 - RNA, 62 nt, hsa; identical to SEQ ID NO: 350471

SEQ ID NO: 554524 - RNA, 62 nt, hsa; identical to SEQ ID NO: 350472

SEQ ID NO: 554525 - RNA, 62 nt, hsa; identical to SEQ ID NO: 350473

SEQ ID NO: 554526 - RNA, 62 nt, hsa; identical to SEQ ID NO: 350474

SEQ ID NO: 554527 - RNA, 62 nt, hsa; identical to SEQ ID NO: 350475

SEQ ID NO: 554528 - RNA, 62 nt, hsa; identical to SEQ ID NO: 350476

SEQ ID NO: 554529 - RNA, 62 nt, hsa; identical to SEQ ID NO: 350477

SEQ ID NO: 554530 - RNA, 62 nt, hsa; identical to SEQ ID NO: 350478

SEQ ID NO: 554531 - RNA, 62 nt, hsa; identical to SEQ ID NO: 350479

SEQ ID NO: 554532 - RNA, 62 nt, hsa; identical to SEQ ID NO: 350480

SEQ ID NO: 554533 - RNA, 62 nt, hsa; identical to SEQ ID NO: 350481

SEQ ID NO: 554534 - RNA, 62 nt, hsa; identical to SEQ ID NO: 350482

SEQ ID NO: 554535 - RNA, 62 nt, hsa; identical to SEQ ID NO: 350483

SEQ ID NO: 554536 - RNA, 62 nt, hsa; identical to SEQ ID NO: 350484

SEQ ID NO: 554537 - RNA, 62 nt, hsa; identical to SEQ ID NO: 350485

SEQ ID NO: 554538 - RNA, 62 nt, hsa; identical to SEQ ID NO: 350486

SEQ ID NO: 554539 - RNA, 62 nt, hsa; identical to SEQ ID NO: 350487

SEQ ID NO: 554540 - RNA, 62 nt, hsa; identical to SEQ ID NO: 350488

SEQ ID NO: 554541 - RNA, 62 nt, hsa; identical to SEQ ID NO: 350489

SEQ ID NO: 554542 - RNA, 62 nt, hsa; identical to SEQ ID NO: 350490

SEQ ID NO: 554543 - RNA, 62 nt, hsa; identical to SEQ ID NO: 350491

SEQ ID NO: 554544 - RNA, 62 nt, hsa; identical to SEQ ID NO: 350492

SEQ ID NO: 554545 - RNA, 62 nt, hsa; identical to SEQ ID NO: 350493

SEQ ID NO: 554546 - RNA, 62 nt, hsa; identical to SEQ ID NO: 350494

SEQ ID NO: 554547 - RNA, 62 nt, hsa; identical to SEQ ID NO: 350495

SEQ ID NO: 554548 - RNA, 62 nt, hsa; identical to SEQ ID NO: 350496

SEQ ID NO: 554549 - RNA, 62 nt, hsa; identical to SEQ ID NO: 350497

SEQ ID NO: 554550 - RNA, 62 nt, hsa; identical to SEQ ID NO: 350498

SEQ ID NO: 554551 - RNA, 62 nt, hsa; identical to SEQ ID NO: 350499

SEQ ID NO: 554552 - RNA, 62 nt, hsa; identical to SEQ ID NO: 350500

SEQ ID NO: 554553 - RNA, 62 nt, hsa; identical to SEQ ID NO: 350501

SEQ ID NO: 554554 - RNA, 62 nt, hsa; identical to SEQ ID NO: 350502

SEQ ID NO: 554555 - RNA, 62 nt, hsa; identical to SEQ ID NO: 350503

SEQ ID NO: 554556 - RNA, 62 nt, hsa; identical to SEQ ID NO: 350504

SEQ ID NO: 554557 - RNA, 62 nt, hsa; identical to SEQ ID NO: 350505

SEQ ID NO: 554558 - RNA, 62 nt, hsa; identical to SEQ ID NO: 350506

SEQ ID NO: 554559 - RNA, 62 nt, hsa; identical to SEQ ID NO: 350507

SEQ ID NO: 554560 - RNA, 62 nt, hsa; identical to SEQ ID NO: 350508

SEQ ID NO: 554561 - RNA, 62 nt, hsa; identical to SEQ ID NO: 350509

SEQ ID NO: 554562 - RNA, 62 nt, hsa; identical to SEQ ID NO: 350510

SEQ ID NO: 554563 - RNA, 62 nt, hsa; identical to SEQ ID NO: 350511

SEQ ID NO: 554564 - RNA, 62 nt, hsa; identical to SEQ ID NO: 350512

SEQ ID NO: 554565 - RNA, 64 nt, hsa; identical to SEQ ID NO: 257286

SEQ ID NO: 554566 - RNA, 64 nt, hsa; identical to SEQ ID NO: 257287

SEQ ID NO: 554567 - RNA, 64 nt, hsa; identical to SEQ ID NO: 257288

SEQ ID NO: 554568 - RNA, 64 nt, hsa; identical to SEQ ID NO: 257289

SEQ ID NO: 554569 - RNA, 64 nt, hsa; identical to SEQ ID NO: 257290

SEQ ID NO: 554570 - RNA, 64 nt, hsa; identical to SEQ ID NO: 257291

SEQ ID NO: 554571 - RNA, 64 nt, hsa; identical to SEQ ID NO: 257292

SEQ ID NO: 554572 - RNA, 64 nt, hsa; identical to SEQ ID NO: 257293

SEQ ID NO: 554573 - RNA, 64 nt, hsa; identical to SEQ ID NO: 257294

SEQ ID NO: 554574 - RNA, 64 nt, hsa; identical to SEQ ID NO: 257295

SEQ ID NO: 554575 - RNA, 64 nt, hsa; identical to SEQ ID NO: 257296

SEQ ID NO: 554576 - RNA, 64 nt, hsa; identical to SEQ ID NO: 257297

SEQ ID NO: 554577 - RNA, 64 nt, hsa; identical to SEQ ID NO: 257298

SEQ ID NO: 554578 - RNA, 64 nt, hsa; identical to SEQ ID NO: 257299

SEQ ID NO: 554579 - RNA, 64 nt, hsa; identical to SEQ ID NO: 257300

SEQ ID NO: 554580 - RNA, 64 nt, hsa; identical to SEQ ID NO: 257301

SEQ ID NO: 554581 - RNA, 64 nt, hsa; identical to SEQ ID NO: 257302

SEQ ID NO: 554582 - RNA, 64 nt, hsa; identical to SEQ ID NO: 257303

SEQ ID NO: 554583 - RNA, 64 nt, hsa; identical to SEQ ID NO: 257304

SEQ ID NO: 554584 - RNA, 64 nt, hsa; identical to SEQ ID NO: 257305

SEQ ID NO: 554585 - RNA, 64 nt, hsa; identical to SEQ ID NO: 257306

SEQ ID NO: 554586 - RNA, 64 nt, hsa; identical to SEQ ID NO: 257307

SEQ ID NO: 554587 - RNA, 64 nt, hsa; identical to SEQ ID NO: 257308

SEQ ID NO: 554588 - RNA, 64 nt, hsa; identical to SEQ ID NO: 257309

SEQ ID NO: 554589 - RNA, 54 nt, hsa; identical to SEQ ID NO: 257310

SEQ ID NO: 554590 - RNA, 64 nt, hsa; identical to SEQ ID NO: 257311

SEQ ID NO: 554591 - RNA, 64 nt, hsa; identical to SEQ ID NO: 257312

SEQ ID NO: 554592 - RNA, 64 nt, hsa; identical to SEQ ID NO: 257313

SEQ ID NO: 554593 - RNA, 64 nt, hsa; identical to SEQ ID NO: 257314

SEQ ID NO: 554594 - RNA, 64 nt, hsa; identical to SEQ ID NO: 257315

SEQ ID NO: 554595 - RNA, 64 nt, hsa; identical to SEQ ID NO: 257316

SEQ ID NO: 554596 - RNA, 64 nt, hsa; identical to SEQ ID NO: 257317

SEQ ID NO: 554597 - RNA, 64 nt, hsa; identical to SEQ ID NO: 257318

SEQ ID NO: 554598 - RNA, 64 nt, hsa; identical to SEQ ID NO: 257319

SEQ ID NO: 554599 - RNA, 64 nt, hsa; identical to SEQ ID NO: 75992

SEQ ID NO: 554600 - RNA, 64 nt, hsa; identical to SEQ ID NO: 75993

SEQ ID NO: 554601 - RNA, 64 nt, hsa; identical to SEQ ID NO: 75994

SEQ ID NO: 554602 - RNA, 64 nt, hsa; identical to SEQ ID NO: 75995

SEQ ID NO: 554603 - RNA, 64 nt, hsa; identical to SEQ ID NO: 75996

SEQ ID NO: 554604 - RNA, 64 nt, hsa; identical to SEQ ID NO: 75997

SEQ ID NO: 554605 - RNA, 64 nt, hsa; identical to SEQ ID NO: 75998

SEQ ID NO: 554606 - RNA, 64 nt, hsa; identical to SEQ ID NO: 75999

SEQ ID NO: 554607 - RNA, 64 nt, hsa; identical to SEQ ID NO: 76000

SEQ ID NO: 554608 - RNA, 64 nt, hsa; identical to SEQ ID NO: 76001

SEQ ID NO: 554609 - RNA, 64 nt, hsa; identical to SEQ ID NO: 76002

SEQ ID NO: 554610 - RNA, 64 nt, hsa; identical to SEQ ID NO: 76003

SEQ ID NO: 554611 - RNA, 64 nt, hsa; identical to SEQ ID NO: 76004

SEQ ID NO: 554612 - RNA, 64 nt, hsa; identical to SEQ ID NO: 76005

SEQ ID NO: 554613 - RNA, 64 nt, hsa; identical to SEQ ID NO: 76006

SEQ ID NO: 554614 - RNA, 64 nt, hsa; identical to SEQ ID NO: 76007

SEQ ID NO: 554615 - RNA, 64 nt, hsa; identical to SEQ ID NO: 76008

SEQ ID NO: 554616 - RNA, 64 nt, hsa; identical to SEQ ID NO: 76009

SEQ ID NO: 554617 - RNA, 64 nt, hsa; identical to SEQ ID NO: 76010

SEQ ID NO: 554618 - RNA, 64 nt, hsa; identical to SEQ ID NO: 76011

SEQ ID NO: 554619 - RNA, 64 nt, hsa; identical to SEQ ID NO: 76012

SEQ ID NO: 554620 - RNA, 64 nt, hsa; identical to SEQ ID NO: 76013

SEQ ID NO: 554621 - RNA, 64 nt, hsa; identical to SEQ ID NO: 76014

SEQ ID NO: 554622 - RNA, 64 nt, hsa; identical to SEQ ID NO: 165778

SEQ ID NO: 554623 - RNA, 64 nt, hsa; identical to SEQ ID NO: 165779

SEQ ID NO: 554624 - RNA, 64 nt, hsa; identical to SEQ ID NO: 165780

SEQ ID NO: 554625 - RNA, 64 nt, hsa; identical to SEQ ID NO: 165781

SEQ ID NO: 554626 - RNA, 64 nt, hsa; identical to SEQ ID NO: 165782

SEQ ID NO: 554627 - RNA, 64 nt, hsa; identical to SEQ ID NO: 165783

SEQ ID NO: 554628 - RNA, 64 nt, hsa; identical to SEQ ID NO: 165784

SEQ ID NO: 554629 - RNA, 64 nt, hsa; identical to SEQ ID NO: 165785

SEQ ID NO: 554630 - RNA, 64 nt, hsa; identical to SEQ ID NO: 165786

SEQ ID NO: 554631 - RNA, 64 nt, hsa; identical to SEQ ID NO: 165787

SEQ ID NO: 554632 - RNA, 64 nt, hsa; identical to SEQ ID NO: 165788

SEQ ID NO: 554633 - RNA, 64 nt, hsa; identical to SEQ ID NO: 165789

SEQ ID NO: 554634 - RNA, 64 nt, hsa; identical to SEQ ID NO: 165790

SEQ ID NO: 554635 - RNA, 64 nt, hsa; identical to SEQ ID NO: 165791

SEQ ID NO: 554636 - RNA, 64 nt, hsa; identical to SEQ ID NO: 165792

SEQ ID NO: 554637 - RNA, 64 nt, hsa; identical to SEQ ID NO: 165793

SEQ ID NO: 554638 - RNA, 64 nt, hsa; identical to SEQ ID NO: 165794

SEQ ID NO: 554639 - RNA, 64 nt, hsa; identical to SEQ ID NO: 165795

SEQ ID NO: 554640 - RNA, 64 nt, hsa; identical to SEQ ID NO: 165796

SEQ ID NO: 554641 - RNA, 64 nt, hsa; identical to SEQ ID NO: 165797

SEQ ID NO: 554642 - RNA, 64 nt, hsa; identical to SEQ ID NO: 165798

SEQ ID NO: 554643 - RNA, 64 nt, hsa; identical to SEQ ID NO: 165799

SEQ ID NO: 554644 - RNA, 64 nt, hsa; identical to SEQ ID NO: 74062

SEQ ID NO: 554645 - RNA, 64 nt, hsa; identical to SEQ ID NO: 74063

SEQ ID NO: 554646 - RNA, 64 nt, hsa; identical to SEQ ID NO: 74064

SEQ ID NO: 554647 - RNA, 64 nt, hsa; identical to SEQ ID NO: 74065

SEQ ID NO: 554648 - RNA, 64 nt, hsa; identical to SEQ ID NO: 74066

SEQ ID NO: 554649 - RNA, 64 nt, hsa; identical to SEQ ID NO: 74067

SEQ ID NO: 554650 - RNA, 64 nt, hsa; identical to SEQ ID NO: 74068

SEQ ID NO: 554651 - RNA, 64 nt, hsa; identical to SEQ ID NO: 74069

SEQ ID NO: 554652 - RNA, 64 nt, hsa; identical to SEQ ID NO: 74070

SEQ ID NO: 554653 - RNA, 64 nt, hsa; identical to SEQ ID NO: 74071

SEQ ID NO: 554654 - RNA, 64 nt, hsa; identical to SEQ ID NO: 74072

SEQ ID NO: 554655 - RNA, 64 nt, hsa; identical to SEQ ID NO: 74073

SEQ ID NO: 554656 - RNA, 64 nt, hsa; identical to SEQ ID NO: 74074

SEQ ID NO: 554657 - RNA, 64 nt, hsa; identical to SEQ ID NO: 74075

SEQ ID NO: 554658 - RNA, 64 nt, hsa; identical to SEQ ID NO: 74076

SEQ ID NO: 554659 - RNA, 64 nt, hsa; identical to SEQ ID NO: 74077

SEQ ID NO: 554660 - RNA, 64 nt, hsa; identical to SEQ ID NO: 74078

SEQ ID NO: 554661 - RNA, 64 nt, hsa; identical to SEQ ID NO: 74079

SEQ ID NO: 554662 - RNA, 64 nt, hsa; identical to SEQ ID NO: 74080

SEQ ID NO: 554663 - RNA, 64 nt, hsa; identical to SEQ ID NO: 74081

SEQ ID NO: 554664 - RNA, 64 nt, hsa; identical to SEQ ID NO: 74082

SEQ ID NO: 554665 - RNA, 64 nt, hsa; identical to SEQ ID NO: 74083

SEQ ID NO: 554666 - RNA, 64 nt, hsa; identical to SEQ ID NO: 74084

SEQ ID NO: 554667 - RNA, 64 nt, hsa; identical to SEQ ID NO: 74085

SEQ ID NO: 554668 - RNA, 64 nt, hsa; identical to SEQ ID NO: 178768

SEQ ID NO: 554669 - RNA, 64 nt, hsa; identical to SEQ ID NO: 178769

SEQ ID NO: 554670 - RNA, 64 nt, hsa; identical to SEQ ID NO: 178770

SEQ ID NO: 554671 - RNA, 64 nt, hsa; identical to SEQ ID NO: 178771

SEQ ID NO: 554672 - RNA, 64 nt, hsa
guguguucccaaauccagcuggccccaccagcucagauuccauuuuuuuuguguguguguguga

SEQ ID NO: 554673 - RNA, 64 nt, hsa
gggauuacaggcgugugccacugcgcucggccucagauuccauauuugaacaccagcugauuga

SEQ ID NO: 554674 - RNA, 64 nt, hsa
uugcugcugaucauuuuuucuuuaaaacuuggauagauuccaaaaguuacaguaccuuuguggc

SEQ ID NO: 554675 - RNA, 64 nt, hsa
ucauccuuuaacaauuuuuaaaaauuuagcuucuagauuccauuugguaaggaaaucaauauug

SEQ ID NO: 554676 - RNA, 64 nt, hsa
agcugagggagaaagguagggcugugccuucuaaagauuccaacagagaugugagaagauaaua

SEQ ID NO: 554677 - RNA, 64 nt, hsa
cugagccacauaauaaggugucaaaaugugcuugagauuccaaaaacuugcugaaacacuugau

SEQ ID NO: 554678 - RNA, 64 nt, hsa
cacaaacaucuccacuuuugggggaaagguggguagauuccaguucccuggacuaccuucagga

SEQ ID NO: 554679 - RNA, 64 nt, hsa
ccgcugcagugagcucagccacaggggcuuuaggagauuccagccggagguccaaccuucgcag

SEQ ID NO: 554680 - RNA, 64 nt, hsa
gcacaucaccuuuaguagucaaaccaaaaaucuaagauuccaaaaagaacagcauucauugaaa

SEQ ID NO: 554681 - RNA, 64 nt, hsa
ucaagugccguuguuaugugaaacucuuccauucagauuccagagagguucucaugcucccccc

SEQ ID NO: 554682 - RNA, 64 nt, hsa
cucugcaggaaggcuccggcuuaaucuaggaaguagauuccagcugcacgaugaggaacacauu

SEQ ID NO: 554683 - RNA, 64 nt, hsa
ccaaaccaguucuuaaaugcuacaugcaacucccagauuccaaaggauucaaguucuaauuaua

SEQ ID NO: 554684 - RNA, 64 nt, hsa
cucccuggcaugugaaagucagucuuagaggaagagauuccacuugcacggcaacagagccuua

SEQ ID NO: 554685 - RNA, 64 nt, hsa
uucuuugggauugugaauagaauguagcaaaaccagauuccaguguacuagucauggaucuuuc

SEQ ID NO: 554686 - RNA, 64 nt, hsa
cacagaacaccagaaagaguguugguguguagguagauuccauauuaaugaggaacacugaacu

SEQ ID NO: 554687 - RNA, 64 nt, hsa
ugcagugucuccaggccugaguuucuucuggaacagauuccauuuuagaauggggauucacagg

SEQ ID NO: 554688 - RNA, 64 nt, hsa
guccugagcccugacacucccacaccugagccucagauuccaauagcucacucccuagagccug

SEQ ID NO: 554689 - RNA, 64 nt, hsa
agccugacgccggggccccugaccccugagccucagauuccaauaccucacuccccagagccug

SEQ ID NO: 554690 - RNA, 64 nt, hsa
ucuaagucaagucagcacgggaagggcaucugacagauuccaggccugggguuagcagccugug

SEQ ID NO: 554691 - RNA, 64 nt, hsa
ggcccacgugaccagcaaggucagaggcccagccagauuccauccuggggaagcaaaugaauuc

SEQ ID NO: 554692 - RNA, 64 nt, hsa
cucaccacugcauuccagccugggugacagaguuagauuccacccucucccaccccggcaaaaa

SEQ ID NO: 554693 - RNA, 64 nt, hsa
acaucagccaaaagaacaaaagagaugucaggacagauuccaggagugucggagcacaugugug

SEQ ID NO: 554694 - RNA, 64 nt, hsa
ucauuucacagugagaugcuuuauggauugaaggauaugguaaaauguuuauaguuuacuuuga

SEQ ID NO: 554695 - RNA, 64 nt, hsa
aaacacacguuuaucuuuuggcccaaugccauacauaugguaggcauuuaauuacugauugugu

SEQ ID NO: 554696 - RNA, 64 nt, hsa
uuugucacgucauuuuuagaaauguucuaccuguauaugguaauguccaguuuuaaaaauauug

SEQ ID NO: 554697 - RNA, 64 nt, hsa
aaaaugaacuucucccgcuacacagaaguaacaaauaugguagucaguuuuguauuuagaaaug

SEQ ID NO: 554698 - RNA, 64 nt, hsa
auaacugcaugaacuuggauuuuuuuaaucacucauaugguagaauuuuauaaacacauacaug

SEQ ID NO: 554699 - RNA, 64 nt, hsa
acauguaacuugugacuguacaauaaacauaagcauaugguaccacuuuuguguaugggguuua

SEQ ID NO: 554700 - RNA, 64 nt, hsa
auuaaccuuguuguuuaccuuucacugauuucuuauaugguauaaauuaaaguucaggcauuua

SEQ ID NO: 554701 - RNA, 64 nt, hsa
cucaaguuugcugucuuuagaaugguuugugaaaauaugguauaaagguguuuucauuuuccug

SEQ ID NO: 554702 - RNA, 64 nt, hsa
gaugauaauaugguuuuacuuuuuuagucuguuaauaugguacauuacauugauggcacgauau

SEQ ID NO: 554703 - RNA, 64 nt, hsa
gggacuauaggugugagccacuguaccaggcuauauaugguauuaaaauuuuuuaaauuuccaa

SEQ ID NO: 554704 - RNA, 64 nt, hsa
cucucuucuuugggucucaauuuuuuauuuaucuauaugguaaacucagagaucacuccuuagg

SEQ ID NO: 554705 - RNA, 64 nt, hsa
aagauauccggagccuccagucugucauuaacugauaugguaaaucaccucucuucuuuggguc

SEQ ID NO: 554706 - RNA, 64 nt, hsa; identical to SEQ ID NO: 226834

SEQ ID NO: 554707 - RNA, 64 nt, hsa; identical to SEQ ID NO: 226835

SEQ ID NO: 554708 - RNA, 64 nt, hsa; identical to SEQ ID NO: 226836

SEQ ID NO: 554709 - RNA, 64 nt, hsa; identical to SEQ ID NO: 226837

SEQ ID NO: 554710 - RNA, 64 nt, hsa; identical to SEQ ID NO: 226838

SEQ ID NO: 554711 - RNA, 64 nt, hsa; identical to SEQ ID NO: 226839

SEQ ID NO: 554712 - RNA, 64 nt, hsa; identical to SEQ ID NO: 226840

SEQ ID NO: 554713 - RNA, 64 nt, hsa; identical to SEQ ID NO: 226841

SEQ ID NO: 554714 - RNA, 64 nt, hsa; identical to SEQ ID NO: 226842

SEQ ID NO: 554715 - RNA, 64 nt, hsa; identical to SEQ ID NO: 226843

SEQ ID NO: 554716 - RNA, 64 nt, hsa; identical to SEQ ID NO: 226844

SEQ ID NO: 554717 - RNA, 64 nt, hsa; identical to SEQ ID NO: 226845

SEQ ID NO: 554718 - RNA, 64 nt, hsa; identical to SEQ ID NO: 226846

SEQ ID NO: 554719 - RNA, 64 nt, hsa; identical to SEQ ID NO: 226847

SEQ ID NO: 554720 - RNA, 64 nt, hsa; identical to SEQ ID NO: 226848

SEQ ID NO: 554721 - RNA, 64 nt, hsa; identical to SEQ ID NO: 226849

SEQ ID NO: 554722 - RNA, 64 nt, hsa; identical to SEQ ID NO: 226850

SEQ ID NO: 554723 - RNA, 64 nt, hsa; identical to SEQ ID NO: 226851

SEQ ID NO: 554724 - RNA, 64 nt, hsa; identical to SEQ ID NO: 226852

SEQ ID NO: 554725 - RNA, 64 nt, hsa; identical to SEQ ID NO: 226853

SEQ ID NO: 554726 - RNA, 64 nt, hsa; identical to SEQ ID NO: 226854

SEQ ID NO: 554727 - RNA, 64 nt, hsa; identical to SEQ ID NO: 226855

SEQ ID NO: 554728 - RNA, 64 nt, hsa; identical to SEQ ID NO: 226856

SEQ ID NO: 554729 - RNA, 64 nt, hsa; identical to SEQ ID NO: 226857

SEQ ID NO: 554730 - RNA, 64 nt, hsa; identical to SEQ ID NO: 226858

SEQ ID NO: 554731 - RNA, 64 nt, hsa; identical to SEQ ID NO: 226859

SEQ ID NO: 554732 - RNA, 64 nt, hsa; identical to SEQ ID NO: 226860

SEQ ID NO: 554733 - RNA, 64 nt, hsa; identical to SEQ ID NO: 226861

SEQ ID NO: 554734 - RNA, 64 nt, hsa; identical to SEQ ID NO: 226862

SEQ ID NO: 554735 - RNA, 64 nt, hsa; identical to SEQ ID NO: 226863

SEQ ID NO: 554736 - RNA, 64 nt, hsa; identical to SEQ ID NO: 226864

SEQ ID NO: 554737 - RNA, 64 nt, hsa; identical to SEQ ID NO: 226865

SEQ ID NO: 554738 - RNA, 64 nt, hsa; identical to SEQ ID NO: 226866

SEQ ID NO: 554739 - RNA, 64 nt, hsa; identical to SEQ ID NO: 226867

SEQ ID NO: 554740 - RNA, 64 nt, hsa; identical to SEQ ID NO: 226868

SEQ ID NO: 554741 - RNA, 64 nt, hsa; identical to SEQ ID NO: 226869

SEQ ID NO: 554742 - RNA, 64 nt, hsa; identical to SEQ ID NO: 226870

SEQ ID NO: 554743 - RNA, 64 nt, hsa; identical to SEQ ID NO: 226871

SEQ ID NO: 554744 - RNA, 64 nt, hsa; identical to SEQ ID NO: 226872

SEQ ID NO: 554745 - RNA, 64 nt, hsa; identical to SEQ ID NO: 226873

SEQ ID NO: 554746 - RNA, 64 nt, hsa; identical to SEQ ID NO: 226874

SEQ ID NO: 554747 - RNA, 64 nt, hsa; identical to SEQ ID NO: 226875

SEQ ID NO: 554748 - RNA, 64 nt, hsa; identical to SEQ ID NO: 226876

SEQ ID NO: 554749 - RNA, 64 nt, hsa; identical to SEQ ID NO: 226877

SEQ ID NO: 554750 - RNA, 64 nt, hsa; identical to SEQ ID NO: 226878

SEQ ID NO: 554751 - RNA, 64 nt, hsa; identical to SEQ ID NO: 226879

SEQ ID NO: 554752 - RNA, 64 nt, hsa; identical to SEQ ID NO: 226880

SEQ ID NO: 554753 - RNA, 64 nt, hsa; identical to SEQ ID NO: 226881

SEQ ID NO: 554754 - RNA, 64 nt, hsa; identical to SEQ ID NO: 226882

SEQ ID NO: 554755 - RNA, 64 nt, hsa; identical to SEQ ID NO: 226883

SEQ ID NO: 554756 - RNA, 64 nt, hsa; identical to SEQ ID NO: 226884

SEQ ID NO: 554757 - RNA, 64 nt, hsa; identical to SEQ ID NO: 226885

SEQ ID NO: 554758 - RNA, 64 nt, hsa; identical to SEQ ID NO: 226886

SEQ ID NO: 554759 - RNA, 64 nt, hsa; identical to SEQ ID NO: 226887

SEQ ID NO: 554760 - RNA, 64 nt, hsa; identical to SEQ ID NO: 226888

SEQ ID NO: 554761 - RNA, 64 nt, hsa; identical to SEQ ID NO: 226889

SEQ ID NO: 554762 - RNA, 64 nt, hsa; identical to SEQ ID NO: 226890

SEQ ID NO: 554763 - RNA, 63 nt, hsa
ccuucacauaauugauaaugguaccaccuucuauaauaauaauauaaaauaaaaacaucugau

SEQ ID NO: 554764 - RNA, 63 nt, hsa
ucacauaauugauaaugguaccaccuucuauaauaauaauauaaaauaaaaacaucugauguc

SEQ ID NO: 554765 - RNA, 63 nt, hsa
cugggugacagagcgagacucuggcucauaaaauaauaauaauaauaaauaaauaaaaaauaa

SEQ ID NO: 554766 - RNA, 63 nt, hsa
ggugacagagcgagacucuggcucauaaaauaauaauaauaauaaauaaauaaaaaauaaaug

SEQ ID NO: 554767 - RNA, 63 nt, hsa
gacagagcgagacucuggcucauaaaauaauaauaauaauaaauaaauaaaaaauaaauguuu

SEQ ID NO: 554768 - RNA, 63 nt, hsa
gaguucaagaccagccuggcuaacaugugaaacuaauaauaauacaaaaauuagcugggcgug

SEQ ID NO: 554769 - RNA, 63 nt, hsa
uucaagaccagccuggcuaacaugugaaacuaauaauaauacaaaaauuagcugggcguggug

SEQ ID NO: 554770 - RNA, 63 nt, hsa
auuuuguucucugcuaguuuaaaguaauucguuuaauaauagauguguuuuuagaggaaaugc

SEQ ID NO: 554771 - RNA, 63 nt, hsa
aauuuuccaguuauacagucuucuauaacuuacuaauaauauucuauauguacuuuauguaau

SEQ ID NO: 554772 - RNA, 63 nt, hsa
cuaauccaguccaauacuaauccaauccaauacuaauaauacuauugguacaauccaauacua

SEQ ID NO: 554773 - RNA, 63 nt, hsa
aauacuaauaauacuauugguacaauccaauacuaauaauacuauugguacaauccaauacua

SEQ ID NO: 554774 - RNA, 63 nt, hsa
aauacuaauaauacuauugguacaauccaauacuaauaauacuaacaguaguauugauacaau

SEQ ID NO: 554775 - RNA, 63 nt, hsa
gugauuuugugagaucagcugaaccacuuaugauaauaauaauaaaaaagacugcuuugcccu

SEQ ID NO: 554776 - RNA, 63 nt, hsa
auuuugugagaucagcugaaccacuuaugauaauaauaauaaaaaagacugcuuugcccucac

SEQ ID NO: 554777 - RNA, 63 nt, hsa
gggugacagagcaagacuccaucucaaaaaaaauaauaauaauaaauaaauaaaaaaucccaa

SEQ ID NO: 554778 - RNA, 63 nt, hsa
ugacagagcaagacuccaucucaaaaaaaauaauaauaauaaauaaauaaaaaaucccaauua

SEQ ID NO: 554779 - RNA, 63 nt, hsa
aggaguuccucuaacauuugcaaaauggaaauguaauaauaaugaaugucaugcaccgcugca

SEQ ID NO: 554780 - RNA, 63 nt, hsa
ccagauaguuauauuaaauuuauaucuuauauauaauaauaugugaugauuaauacaauauua

SEQ ID NO: 554781 - RNA, 63 nt, hsa
agagcccacauugucuguagccaucaaaaauaauaauaauaaacuggacaguuuacaaucguu

SEQ ID NO: 554782 - RNA, 63 nt, hsa
gugagagcccacauugucuguagccaucaaaaauaauaauaauaaacuggacaguuuacaauc

SEQ ID NO: 554783 - RNA, 63 nt, hsa
uucaugaaaaguauguuguuguuuugauaguaauaauaauaaauguaggcucagcucuuuccc

SEQ ID NO: 554784 - RNA, 63 nt, hsa
uucuucaugaaaaguauguuguuguuuugauaguaauaauaauaaauguaggcucagcucuuu

SEQ ID NO: 554785 - RNA, 63 nt, hsa
gauucaaagugguaacccaaauucauaaagcaauaauaauaaaaaccuauauaguauguucuc

SEQ ID NO: 554786 - RNA, 63 nt, hsa
guuaacaugauucacauuauacuuucucuuaguuaauaauacaguaggccuuuuguuuauuaa

SEQ ID NO: 554787 - RNA, 63 nt, hsa
ccuaaacugaucacaacuauuaaacuuagagaauaauaauagucuuucugaugaggcugccau

SEQ ID NO: 554788 - RNA, 63 nt, hsa
aaaaccaaaugauaucuaaguaguucucagcaauaauaauaaugacgauaauacuucuuuucc

SEQ ID NO: 554789 - RNA, 63 nt, hsa
uuuauaugaaccaugucuauuaauuuaauuauuuaauaauauuuauauuaaacuccuuauguu

SEQ ID NO: 554790 - RNA, 63 nt, hsa
uuuuuggaauacaucucuuaguaaagugaaauauaauaauauaauuguauuuaguuacuauug

SEQ ID NO: 554791 - RNA, 63 nt, hsa
ugauuuuugaagguauuuacuuuaggguucuuuuaauaauaauguccguccuaaugcuuuaaa

SEQ ID NO: 554792 - RNA, 63 nt, hsa
uugcauuauagccaguaguaaaaauaauaauaauaauaauaaaaccaugucuauagcuguaga

SEQ ID NO: 554793 - RNA, 63 nt, hsa
gaguugcauuauagccaguaguaaaaauaauaauaauaauaauaaaaccaugucuauagcugu

SEQ ID NO: 554794 - RNA, 63 nt, hsa
caggaguugcauuauagccaguaguaaaaauaauaauaauaauaauaaaaccaugucuauagc

SEQ ID NO: 554795 - RNA, 63 nt, hsa
auccaggaguugcauuauagccaguaguaaaaauaauaauaauaauaauaaaaccaugucuau

SEQ ID NO: 554796 - RNA, 63 nt, hsa
guauucauuaugaacagauacacaucaaaaucauaauaauauuuucaaaacaaggaauaauuu

SEQ ID NO: 554797 - RNA, 63 nt, hsa
uauucuauuccuuaccaguaauaagguucuuccuaauaauaauuaagagauugaaacuccaaa

SEQ ID NO: 554798 - RNA, 63 nt, hsa
ucuauuguguaauucuuggugggcucuguaguuuaauaauaagaaaaaggccauuucauuuua

SEQ ID NO: 554799 - RNA, 63 nt, hsa
cgauuccugcucgggcuguuugcuguuggcugguaauaauauauuugauuuaaaugcuguuga

SEQ ID NO: 554800 - RNA, 63 nt, hsa
acugcagcgccgauuugaggguggagauauagauaauaauaauauuaauaauaauaauggcca

SEQ ID NO: 554801 - RNA, 63 nt, hsa
gcagcgccgauuugaggguggagauauagauaauaauaauauuaauaauaauaauggccacau

SEQ ID NO: 554802 - RNA, 63 nt, hsa
auuugaggguggagauauagauaauaauaauauuaauaauaauaauggccacauggaucgaac

SEQ ID NO: 554803 - RNA, 63 nt, hsa
ugaggguggagauauagauaauaauaauauuaauaauaauaauggccacauggaucgaacacu

SEQ ID NO: 554804 - RNA, 63 nt, hsa
uucucuugauucuugguuaaauuuguuuaauaauaauaauauccuaaauuuuuuauauuuaau

SEQ ID NO: 554805 - RNA, 63 nt, hsa
uauuucucuugauucuugguuaaauuuguuuaauaauaauaauauccuaaauuuuuuauauuu

SEQ ID NO: 554806 - RNA, 63 nt, hsa
aaguauuucucuugauucuugguuaaauuuguuuaauaauaauaauauccuaaauuuuuuaua

SEQ ID NO: 554807 - RNA, 63 nt, hsa
caugcucagauauguaucuaggauaauuauaauuaauaauaaucauaguaacaauggcuaaug

SEQ ID NO: 554808 - RNA, 63 nt, hsa
uccuuuacagguuuauuucuuuguaaaaaaaaauaauaauaauuugaaucauguaauauuuaa

SEQ ID NO: 554809 - RNA, 63 nt, hsa
cacuuccucaggugcagacccuuggacuuguaauaauaauaaguauuuucauaaucacugcag

SEQ ID NO: 554810 - RNA, 63 nt, hsa
ggacacuuccucaggugcagacccuuggacuuguaauaauaauaaguauuuucauaaucacug

SEQ ID NO: 554811 - RNA, 63 nt, hsa
cuuggacuugucagcaaaaaaaaaaaauaauaauaauaauaaggccugcuguguaagcugaca

SEQ ID NO: 554812 - RNA, 63 nt, hsa
caucuuggacuugucagcaaaaaaaaaaaauaauaauaauaauaaggccugcuguguaagcug

SEQ ID NO: 554813 - RNA, 63 nt, hsa
ugccaucuuggacuugucagcaaaaaaaaaaaauaauaauaauaauaaggccugcuguguaag

SEQ ID NO: 554814 - RNA, 63 nt, hsa
gacuaauagccagaguuaaauauaaauacaaauuaauaauacauagagaacagcaauaccaga

SEQ ID NO: 554815 - RNA, 63 nt, hsa
auugucuccaccauugucacacacaggaaugccuaauaauagcaacccuugucucccucuucu

SEQ ID NO: 554816 - RNA, 63 nt, hsa
caugauagauaaauauguaucuacacagaguaauaauaauaaaacacaguaaacauucuauuu

SEQ ID NO: 554817 - RNA, 63 nt, hsa
ugacaugauagauaaauauguaucuacacagaguaauaauaauaaaacacaguaaacauucua

SEQ ID NO: 554818 - RNA, 63 nt, hsa
cagagugagacuccaucucaaaaauaauaauaauaauaauaaaguaaaaauaaaaauaaaaaa

SEQ ID NO: 554819 - RNA, 63 nt, hsa
ugacagagugagacuccaucucaaaaauaauaauaauaauaauaaaguaaaaauaaaaauaaa

SEQ ID NO: 554820 - RNA, 63 nt, hsa
gggugacagagugagacuccaucucaaaaauaauaauaauaauaauaaaguaaaaauaaaaau

SEQ ID NO: 554821 - RNA, 63 nt, hsa
ccugggugacagagugagacuccaucucaaaaauaauaauaauaauaauaaaguaaaaauaaa

SEQ ID NO: 554822 - RNA, 63 nt, hsa
auggcugcgguagccuaguaggaauggacuauauaauaauauagcaggugcucaauaacuguu

SEQ ID NO: 554823 - RNA, 63 nt, hsa
gccugggcaacagagcaagacccugucucaaaauaauaauaauauauaauuuuacaccaaaag

SEQ ID NO: 554824 - RNA, 63 nt, hsa
ugggcaacagagcaagacccugucucaaaauaauaauaauauauaauuuuacaccaaaaguuu

SEQ ID NO: 554825 - RNA, 63 nt, hsa
acaacguguuucugaaaaacagauuuucauaaguaauaauaaaaauaauaauaaaaaaguuuu

SEQ ID NO: 554826 - RNA, 63 nt, hsa
ugaaaaacagauuuucauaaguaauaauaaaaauaauaauaaaaaaguuuugguaugguaagc

SEQ ID NO: 554827 - RNA, 63 nt, hsa
aaagggugauaaaguaauagauaacuuuuaguuuaauaauaauuauuguuauuauacuacuaa

SEQ ID NO: 554828 - RNA, 63 nt, hsa
uuaguuuaauaauaauuauuguuauuauacuacuaauaauagagcacuuguaagcacuaaguu

SEQ ID NO: 554829 - RNA, 63 nt, hsa
aauguuugucagacuuauuaacuggucauauuauaauaauacugauaaugaccaacugcucau

SEQ ID NO: 554830 - RNA, 63 nt, hsa
acauuuuugcuuugcugccagaguaacccugacuaauaauacaauaacagcaauuuuuuuaaa

SEQ ID NO: 554831 - RNA, 63 nt, hsa
uaauaauaauaauaauaauaauaauaauaauaauaauaauauguuguuugcuuuccuuaacug

SEQ ID NO: 554832 - RNA, 63 nt, hsa
uaauaauaauaauaauaauaauaauaauaauaauaauaauaauauguuguuugcuuuccuuaa

SEQ ID NO: 554833 - RNA, 63 nt, hsa
ugauaauaauaauaauaauaauaauaauaauaauaauaauaauaauauguuguuugcuuuccu

SEQ ID NO: 554834 - RNA, 63 nt, hsa
ugaugauaauaauaauaauaauaauaauaauaauaauaauaauaauaauauguuguuugcuuu

SEQ ID NO: 554835 - RNA, 63 nt, hsa
uaaugaugauaauaauaauaauaauaauaauaauaauaauaauaauaauaauauguuguuugc

SEQ ID NO: 554836 - RNA, 63 nt, hsa
uaauaaugaugauaauaauaauaauaauaauaauaauaauaauaauaauaauaauauguuguu

SEQ ID NO: 554837 - RNA, 63 nt, hsa
ugauaauaaugaugauaauaauaauaauaauaauaauaauaauaauaauaauaauaauauguu

SEQ ID NO: 554838 - RNA, 63 nt, hsa
caaugauaauaaugaugauaauaauaauaauaauaauaauaauaauaauaauaauaauaauau

SEQ ID NO: 554839 - RNA, 63 nt, hsa
acacaaugauaauaaugaugauaauaauaauaauaauaauaauaauaauaauaauaauaauaa

SEQ ID NO: 554840 - RNA, 63 nt, hsa
ugcacacaaugauaauaaugaugauaauaauaauaauaauaauaauaauaauaauaauaauaa

SEQ ID NO: 554841 - RNA, 63 nt, hsa
auuugcacacaaugauaauaaugaugauaauaauaauaauaauaauaauaauaauaauaauaa

SEQ ID NO: 554842 - RNA, 63 nt, hsa
uucauuugcacacaaugauaauaaugaugauaauaauaauaauaauaauaauaauaauaauaa

SEQ ID NO: 554843 - RNA, 63 nt, hsa
uauuucauuugcacacaaugauaauaaugaugauaauaauaauaauaauaauaauaauaauaa

SEQ ID NO: 554844 - RNA, 63 nt, hsa
cucgcuagguagaacacugcuaauaauaauagcuaauaauaccuuguuccaaauacugcuuag

SEQ ID NO: 554845 - RNA, 63 nt, hsa
guauuuugaucucgcuagguagaacacugcuaauaauaauagcuaauaauaccuuguuccaaa

SEQ ID NO: 554846 - RNA, 63 nt, hsa
acaguauuuugaucucgcuagguagaacacugcuaauaauaauagcuaauaauaccuuguucc

SEQ ID NO: 554847 - RNA, 63 nt, hsa
guuauauauaugaauauucccuauguuaaauaauaauaauaacuaguguuuaugaauagaauc

SEQ ID NO: 554848 - RNA, 63 nt, hsa
ccuguuauauauaugaauauucccuauguuaaauaauaauaauaacuaguguuuaugaauaga

SEQ ID NO: 554849 - RNA, 63 nt, hsa
cauugccuaaaguagaauguguaaguaaugcuguaauaauacauaucauaguauauuauaauc

SEQ ID NO: 554850 - RNA, 63 nt, hsa
aacuuaaauauauuuuguuuaauaggaaauauauaauaauagcauuuuauguaauaaaauaug

SEQ ID NO: 554851 - RNA, 63 nt, hsa
ugugccaagaauaaaugaaaugauguuaaagcauaauaauaacauaucuuuaaaaagcuuuuc

SEQ ID NO: 554852 - RNA, 63 nt, hsa
acuauuuaguaaaaaguuuuaguuuggugcuguuaauaauaauuugcuaaaaggccuuuuaga

SEQ ID NO: 554853 - RNA, 63 nt, hsa
aaacauccuuuagaugcaaaauaauaauaauaauaauaauaaauaaauaaauaaaaauccaaa

SEQ ID NO: 554854 - RNA, 63 nt, hsa
ccaaaacauccuuuagaugcaaaauaauaauaauaauaauaauaaauaaauaaauaaaaaucc

SEQ ID NO: 554855 - RNA, 63 nt, hsa
ccuccaaaacauccuuuagaugcaaaauaauaauaauaauaauaauaaauaaauaaauaaaaa

SEQ ID NO: 554856 - RNA, 63 nt, hsa
gcuccuccaaaacauccuuuagaugcaaaauaauaauaauaauaauaauaaauaaauaaauaa

SEQ ID NO: 554857 - RNA, 63 nt, hsa
ugugcuccuccaaaacauccuuuagaugcaaaauaauaauaauaauaauaauaaauaaauaaa

SEQ ID NO: 554858 - RNA, 63 nt, hsa
ugagccccugucaagugccagucaugauaguaguaauaauaauaauaaacaucuauuggacca

SEQ ID NO: 554859 - RNA, 63 nt, hsa
gccccugucaagugccagucaugauaguaguaauaauaauaauaaacaucuauuggaccaggc

SEQ ID NO: 554860 - RNA, 63 nt, hsa
ccugucaagugccagucaugauaguaguaauaauaauaauaaacaucuauuggaccaggcucu

SEQ ID NO: 554861 - RNA, 63 nt, hsa
ccuccacauagauguuuuuauauuacaugaauuuaauaauaaacuaaacuuuuuuuugucucc

SEQ ID NO: 554862 - RNA, 63 nt, hsa
acacauauaauauauaugcuaaaguauaaagaguaauaauaaugacaauaaacaaaccccugu

SEQ ID NO: 554863 - RNA, 63 nt, hsa
aacagcgagacucugucuuaaaaauaauaacaauaauaauaauaauaaagacuuacuuaacca

SEQ ID NO: 554864 - RNA, 63 nt, hsa
agcgagacucugucuuaaaaauaauaacaauaauaauaauaauaaagacuuacuuaaccaaua

SEQ ID NO: 554865 - RNA, 63 nt, hsa
gagacucugucuuaaaaauaauaacaauaauaauaauaauaaagacuuacuuaaccaauauua

SEQ ID NO: 554866 - RNA, 63 nt, hsa
aaaugagagugugagagaaaguaccuucuauuuuaauaauaauauuauuauaaaaauaauaaa

SEQ ID NO: 554867 - RNA, 63 nt, hsa
ugagagugugagagaaaguaccuucuauuuuaauaauaauauuauuauaaaaauaauaaaucu

SEQ ID NO: 554868 - RNA, 63 nt, hsa
cuaaugacuugguaaauuauugccuugguguauuaauaauauguugcauucugaacaaauaac

SEQ ID NO: 554869 - RNA, 63 nt, hsa
ccagauaauauuuucuacagauuuugaaaaauguaauaauauuaaugcaguauugcaacaggg

SEQ ID NO: 554870 - RNA, 63 nt, hsa
uuccuaugauccuuccacacuuuauuuccuuaauaauaauaaacuuuuucagaaagaauugag

SEQ ID NO: 554871 - RNA, 63 nt, hsa
uauuuccuaugauccuuccacacuuuauuuccuuaauaauaauaaacuuuuucagaaagaauu

SEQ ID NO: 554872 - RNA, 63 nt, hsa
uauauuucauaaucaggcaaaaauacuuacaguuaauaauauagauauaauguuaaaaacaau

SEQ ID NO: 554873 - RNA, 63 nt, hsa
acuuucuaacugagcccucuauuuucuuuauuuuaauaauauuucuccccacuugagaaucac

SEQ ID NO: 554874 - RNA, 63 nt, hsa
aagauacugauagcauugagucuugaaaugauuuaauaauaugagugaggauuugcuuucucc

SEQ ID NO: 554875 - RNA, 63 nt, hsa
uuuuucuuccaaacuucauauaugucuaucagguaauaauaggcuugaaaauugauauccugu

SEQ ID NO: 554876 - RNA, 63 nt, hsa
gaguauaaaggcuacacccuuauuguaaaaaaauaauaauaauaaaaugaaagaaacaaucac

SEQ ID NO: 554877 - RNA, 63 nt, hsa
uauaaaggcuacacccuuauuguaaaaaaauaauaauaauaaaaugaaagaaacaaucaccac

SEQ ID NO: 554878 - RNA, 63 nt, hsa
gaaguucugggauucagguuguuauuaaaauaauaauaauaauuaaaaacucugaagaaacuu

SEQ ID NO: 554879 - RNA, 63 nt, hsa
cuggaaguucugggauucagguuguuauuaaaauaauaauaauaauuaaaaacucugaagaaa

SEQ ID NO: 554880 - RNA, 63 nt, hsa
uuuuaaagaaacauaaccacaaaccuuuucaaauaauaauaauaauaauaauaaaaaauguau

SEQ ID NO: 554881 - RNA, 63 nt, hsa
uaaagaaacauaaccacaaaccuuuucaaauaauaauaauaauaauaauaaaaaauguauuuu

SEQ ID NO: 554882 - RNA, 63 nt, hsa
agaaacauaaccacaaaccuuuucaaauaauaauaauaauaauaauaaaaaauguauuuuaaa

SEQ ID NO: 554883 - RNA, 63 nt, hsa
aacauaaccacaaaccuuuucaaauaauaauaauaauaauaauaaaaaauguauuuuaaagau

SEQ ID NO: 554884 - RNA, 63 nt, hsa
auaaccacaaaccuuuucaaauaauaauaauaauaauaauaaaaaauguauuuuaaagauggc

SEQ ID NO: 554885 - RNA, 63 nt, hsa
uuuaaacaaguuuuuuguagaucccuuguaaaauaauaauaauaauguugugaaucuccaugc

SEQ ID NO: 554886 - RNA, 63 nt, hsa
aaacaaguuuuuuguagaucccuuguaaaauaauaauaauaauguugugaaucuccaugccaa

SEQ ID NO: 554887 - RNA, 63 nt, hsa
uuaauaaaaauuuaugaauauuaaaauuaucauuaauaauauaaaacacuuauuugagauuaa

SEQ ID NO: 554888 - RNA, 63 nt, hsa
uauauuuguuauucuaacucuauuuuuuaaaguuaauaauauaaaguggccauguaaaauauu

SEQ ID NO: 554889 - RNA, 63 nt, hsa
auuuuuauuuuaaaauaaaauuuaccuuuaaaauaauaauaguacuauugcuaguacuaguac

SEQ ID NO: 554890 - RNA, 63 nt, hsa
acuguuaguauuaacuauuaguauuauuaacacuaauaauaguacuauuacuauuacuauuuu

SEQ ID NO: 554891 - RNA, 63 nt, hsa
aucuuaaugugaauuaaaaaccaccauuuauaauaauaauagcgccauauucuaaguugagua

SEQ ID NO: 554892 - RNA, 63 nt, hsa
ccuaucuuaaugugaauuaaaaaccaccauuuauaauaauaauagcgccauauucuaaguuga

SEQ ID NO: 554893 - RNA, 63 nt, hsa
ccuuacgcugggaaagcugguuuuuuaaaaaaauaauaauaaaauauuuaaucuuauuaagug

SEQ ID NO: 554894 - RNA, 63 nt, hsa
cugaagcacacggccauguuggagagcaaaacuuaauaauaauucuuuuuuaaaaucugcuga

SEQ ID NO: 554895 - RNA, 63 nt, hsa
ucaaaagagacuuagacucccacauaguaauaauaauaauaauggcaaacuuaacaccccacu

SEQ ID NO: 554896 - RNA, 63 nt, hsa
ugaucaaaagagacuuagacucccacauaguaauaauaauaauaauggcaaacuuaacacccc

SEQ ID NO: 554897 - RNA, 63 nt, hsa
gugugaucaaaagagacuuagacucccacauaguaauaauaauaauaauggcaaacuuaacac

SEQ ID NO: 554898 - RNA, 63 nt, hsa
gaucuggcaguuuaugcauucuucagaguaauguaauaauaccuaugugaugcuguaauuuua

SEQ ID NO: 554899 - RNA, 63 nt, hsa
cugggugacagagcgacccucugucucaaaaaauaauaauaauaauaaauaaaacaacaacaa

SEQ ID NO: 554900 - RNA, 63 nt, hsa
ggugacagagcgacccucugucucaaaaaauaauaauaauaauaaauaaaacaacaacaaaau

SEQ ID NO: 554901 - RNA, 63 nt, hsa
gacagagcgacccucugucucaaaaaauaauaauaauaauaaauaaaacaacaacaaaaugca

SEQ ID NO: 554902 - RNA, 63 nt, hsa
ccuuuacuauuuccaauguauguuuguuaaaaauaauaauaauaaaaccaaaagccuuugugg

SEQ ID NO: 554903 - RNA, 63 nt, hsa
uuacuauuuccaauguauguuuguuaaaaauaauaauaauaaaaccaaaagccuuuguggaaa

SEQ ID NO: 554904 - RNA, 63 nt, hsa
uuacaggugccaaaaaggggacaguguugauaauaauaauaaaaugaaacaaucugauugggg

SEQ ID NO: 554905 - RNA, 63 nt, hsa
auuuuacaggugccaaaaaggggacaguguugauaauaauaauaaaaugaaacaaucugauug

SEQ ID NO: 554906 - RNA, 63 nt, hsa
agaggccucaggaaagucauuccuuuuuaaaaauaauaauaaauguaaggggguacagugcag

SEQ ID NO: 554907 - RNA, 63 nt, hsa
gugaagucugggcuuuuaguguaaccaucacccuaauaauauacguuguacccauuaaguuau

SEQ ID NO: 554908 - RNA, 63 nt, hsa
gauucuuuuucuuuugugcacauaagaaauaaauaauaauaauaaauaaagaauaaaauuuug

SEQ ID NO: 554909 - RNA, 63 nt, hsa
ucuuuuucuuuugugcacauaagaaauaaauaauaauaauaaauaaagaauaaaauuuuguau

SEQ ID NO: 554910 - RNA, 63 nt, hsa
uuugccaaugauagugaccacagcaaaagcaaauaauaauaauauuaauaauaauaaagagaa

SEQ ID NO: 554911 - RNA, 63 nt, hsa
gccaaugauagugaccacagcaaaagcaaauaauaauaauauuaauaauaauaaagagaaaua

SEQ ID NO: 554912 - RNA, 63 nt, hsa
agugaccacagcaaaagcaaauaauaauaauauuaauaauaauaaagagaaauaaaauaauaa

SEQ ID NO: 554913 - RNA, 63 nt, hsa
gaccacagcaaaagcaaauaauaauaauauuaauaauaauaaagagaaauaaaauaauaaaau

SEQ ID NO: 554914 - RNA, 63 nt, hsa
ugacagagugagacuccaucucaauaaaauuaauaauaauaaaaccuuccaaaaaaagugccg

SEQ ID NO: 554915 - RNA, 63 nt, hsa
gggugacagagugagacuccaucucaauaaaauuaauaauaauaaaaccuuccaaaaaaagug

SEQ ID NO: 554916 - RNA, 63 nt, hsa
ccuuggugaugcauuacaacuuguuuucuuauguaauaauaaugaugaugaugaugauaauaa

SEQ ID NO: 554917 - RNA, 63 nt, hsa
uuucuuauguaauaauaaugaugaugaugaugauaauaauaaauauuuuugagugcuuacuau

SEQ ID NO: 554918 - RNA, 63 nt, hsa
guuuucuaaacuccaaaauggucaucuuaucaauaauaauaauauugaccauuuccuaucugc

SEQ ID NO: 554919 - RNA, 63 nt, hsa
uucuaaacuccaaaauggucaucuuaucaauaauaauaauauugaccauuuccuaucugccag

SEQ ID NO: 554920 - RNA, 63 nt, hsa
uucagaugaagaaauuugguaccaaaguaauaauaauaauauaaauauauguauuagaugaau

SEQ ID NO: 554921 - RNA, 63 nt, hsa
uccuucagaugaagaaauuugguaccaaaguaauaauaauaauauaaauauauguauuagaug

SEQ ID NO: 554922 - RNA, 63 nt, hsa
cauuccuucagaugaagaaauuugguaccaaaguaauaauaauaauauaaauauauguauuag

SEQ ID NO: 554923 - RNA, 63 nt, hsa
ggacuauaauaaccugucuccaaaaccaugccauaauaauauaagugcuuuagaaauuaaauc

SEQ ID NO: 554924 - RNA, 63 nt, hsa
caacuucuauaccuaagaauauaggauugcauuuaauaauaguguuugagguuauauaugcac

SEQ ID NO: 554925 - RNA, 63 nt, hsa
aucugauguccacaagaacaggaacuggguuaauaauaauagacaauaauuauuaugaccccu

SEQ ID NO: 554926 - RNA, 63 nt, hsa
agaaucugauguccacaagaacaggaacuggguuaauaauaauagacaauaauuauuaugacc

SEQ ID NO: 554927 - RNA, 63 nt, hsa
guuagugcucagaaaucaccauaaucacgaaaauaauaauaauaaaucuuuaacauacuaccu

SEQ ID NO: 554928 - RNA, 63 nt, hsa
agugcucagaaaucaccauaaucacgaaaauaauaauaauaaaucuuuaacauacuaccuaaa

SEQ ID NO: 554929 - RNA, 63 nt, hsa
gcucgaaagaaaaaaauguuaaaaauauaucuauaauaauaauuuuuugucauuugucuuuau

SEQ ID NO: 554930 - RNA, 63 nt, hsa
gguccaaguacuuuguauuguauacgugagucauaauaauaaaaagaagaagaaaaauaauag

SEQ ID NO: 554931 - RNA, 63 nt, hsa
cuacaugacaaugugacacuccaucucaaaaaauaauaauaauaacaauauaagaacuagcug

SEQ ID NO: 554932 - RNA, 63 nt, hsa
caugacaaugugacacuccaucucaaaaaauaauaauaauaacaauauaagaacuagcugggc

SEQ ID NO: 554933 - RNA, 63 nt, hsa
augacugcuaucauaggcauccauauuuaauauuaauaauaauaauuaauaauaauaauaaac

SEQ ID NO: 554934 - RNA, 63 nt, hsa
acugcuaucauaggcauccauauuuaauauuaauaauaauaauuaauaauaauaauaaaccca

SEQ ID NO: 554935 - RNA, 63 nt, hsa
uaggcauccauauuuaauauuaauaauaauaauuaauaauaauaauaaacccaacacccaucc

SEQ ID NO: 554936 - RNA, 63 nt, hsa
gcauccauauuuaauauuaauaauaauaauuaauaauaauaauaaacccaacacccauccccc

SEQ ID NO: 554937 - RNA, 63 nt, hsa
uccauauuuaauauuaauaauaauaauuaauaauaauaauaaacccaacacccaucccccaga

SEQ ID NO: 554938 - RNA, 63 nt, hsa
gaaagugacuuucacgguuccuucauaaaacuauaauaauauccgacacuuugauagaaaaaa

SEQ ID NO: 554939 - RNA, 63 nt, hsa
gcuguuguuuagggguaaauaacaguaaauaauuaauaauaauaauaauaauaauaaaggagc

SEQ ID NO: 554940 - RNA, 63 nt, hsa
guuguuuagggguaaauaacaguaaauaauuaauaauaauaauaauaauaauaaaggagcuga

SEQ ID NO: 554941 - RNA, 63 nt, hsa
guuuagggguaaauaacaguaaauaauuaauaauaauaauaauaauaauaaaggagcugacgu

SEQ ID NO: 554942 - RNA, 63 nt, hsa
uagggguaaauaacaguaaauaauuaauaauaauaauaauaauaauaaaggagcugacguucu

SEQ ID NO: 554943 - RNA, 63 nt, hsa
ggguaaauaacaguaaauaauuaauaauaauaauaauaauaauaaaggagcugacguucuuag

SEQ ID NO: 554944 - RNA, 63 nt, hsa
uaaauaacaguaaauaauuaauaauaauaauaauaauaauaaaggagcugacguucuuagccu

SEQ ID NO: 554945 - RNA, 63 nt, hsa
aacuuacugauauccucaucuguaaauuagcgauaauaauaguacuuaccugguaggauuaug

SEQ ID NO: 554946 - RNA, 63 nt, hsa
auuauguucucuguaguuacuggcugugauuauuaauaauauugccgcacccuaauaucuguu

SEQ ID NO: 554947 - RNA, 63 nt, hsa
auaaaagagugccuggcacauaguaggugccauuaauaauauuacuauuguuaacaccuuaag

SEQ ID NO: 554948 - RNA, 63 nt, hsa
cauauuuauaccuuucagguacugaagauuuaauaauaauaaauguaaauacugugaagugug

SEQ ID NO: 554949 - RNA, 63 nt, hsa
acccauauuuauaccuuucagguacugaagauuuaauaauaauaaauguaaauacugugaagu

SEQ ID NO: 554950 - RNA, 63 nt, hsa
uauaaauauuaauaauacaacuucaaugcuuaauaauaauaaacaaauuaauucuaaaggccc

SEQ ID NO: 554951 - RNA, 63 nt, hsa
uacuauaaauauuaauaauacaacuucaaugcuuaauaauaauaaacaaauuaauucuaaagg

SEQ ID NO: 554952 - RNA, 63 nt, hsa
uuucagcaacauauagaaauauacuauaaauauuaauaauacaacuucaaugcuuaauaauaa

SEQ ID NO: 554953 - RNA, 63 nt, hsa
cagcagcaauaguagaaguagucauaauaacaauaauaauaaaugaugauaaagauguuucug

SEQ ID NO: 554954 - RNA, 63 nt, hsa
uguuucuuaaagcucugaacaucauuaaguaguuaauaauaauuccaacaaggaauucagagu

SEQ ID NO: 554955 - RNA, 63 nt, hsa
caugcuuggcccugcauuuaauuuaagaaggauuaauaauaaugcucugaauuuuucgaaagg

SEQ ID NO: 554956 - RNA, 63 nt, hsa
gacagagcaagacucugucucaaaaaaaaaaaauaauaauaaaauaagugagcugaacucacc

SEQ ID NO: 554957 - RNA, 63 nt, hsa
accaccaaucugugaaaguaaagcaaaaaauaauaauaauaaaugccaagggggagagagaca

SEQ ID NO: 554958 - RNA, 63 nt, hsa
auuaccaccaaucugugaaaguaaagcaaaaaauaauaauaauaaaugccaagggggagagag

SEQ ID NO: 554959 - RNA, 63 nt, hsa
uugccaaccucacugacacagggucauaguguauaauaauauacuguacuauauaauauauca

SEQ ID NO: 554960 - RNA, 63 nt, hsa
gaaguaauuuugcuccuugauaaaguauuauauuaauaauaaaucugccugcaacuuuuugcc

SEQ ID NO: 554961 - RNA, 63 nt, hsa
gacagaccaguuauuagguauuagcaugugugguaauaauaauaguggaacuucacacuuaca

SEQ ID NO: 554962 - RNA, 63 nt, hsa
agaccaguuauuagguauuagcaugugugguaauaauaauaguggaacuucacacuuacauca

SEQ ID NO: 554963 - RNA, 63 nt, hsa
cagucugggcaacagagugagacccugucucaauaauaauaauaauaauaaugaugauacucu

SEQ ID NO: 554964 - RNA, 63 nt, hsa
ucugggcaacagagugagacccugucucaauaauaauaauaauaauaaugaugauacucuaag

SEQ ID NO: 554965 - RNA, 63 nt, hsa
gggcaacagagugagacccugucucaauaauaauaauaauaauaaugaugauacucuaagaaa

SEQ ID NO: 554966 - RNA, 63 nt, hsa
caacagagugagacccugucucaauaauaauaauaauaauaaugaugauacucuaagaaaaaa

SEQ ID NO: 554967 - RNA, 63 nt, hsa
caauaugucauaauagaguagccacugguugcauaauaauagagaccuaaauucucaaauagg

SEQ ID NO: 554968 - RNA, 63 nt, hsa; identical to SEQ ID NO: 389138

SEQ ID NO: 554969 - RNA, 60 nt, hsa; identical to SEQ ID NO: 389139

SEQ ID NO: 554970 - RNA, 63 nt, hsa
aucuguuuuuucauuugauccuaucgacaaucauaauaauaauaaauuauauauauaacccau

SEQ ID NO: 554971 - RNA, 63 nt, hsa
uguuuuuucauuugauccuaucgacaaucauaauaauaauaaauuauauauauaacccauaua

SEQ ID NO: 554972 - RNA, 63 nt, hsa
uguuugugagcuuuuuguucccucauucugcauuaauaauagcuaauaauaaaugcauagagc

SEQ ID NO: 554973 - RNA, 63 nt, hsa
cuuuuuguucccucauucugcauuaauaauagcuaauaauaaaugcauagagcaauuaaacug

SEQ ID NO: 554974 - RNA, 63 nt, hsa
aaauauuccuaucugcuuauaaaauggcugcuauaauaauaauaauacagauguuguuauaua

SEQ ID NO: 554975 - RNA, 63 nt, hsa
uauuccuaucugcuuauaaaauggcugcuauaauaauaauaauacagauguuguuauauaagg

SEQ ID NO: 554976 - RNA, 63 nt, hsa
uccuaucugcuuauaaaauggcugcuauaauaauaauaauacagauguuguuauauaagguau

SEQ ID NO: 554977 - RNA, 63 nt, hsa
gccugggcaacaagagcaaaacucagucucaaauaauaauaauaacaacaacuuaaugugcug

SEQ ID NO: 554978 - RNA, 63 nt, hsa
ugggcaacaagagcaaaacucagucucaaauaauaauaauaacaacaacuuaaugugcugcug

SEQ ID NO: 554979 - RNA, 63 nt, hsa
guaacaauccugugaguuuucuauuaugaagguuaauaauaaaugggcucauuuaguugccug

SEQ ID NO: 554980 - RNA, 63 nt, hsa
aaacugacuuacuuuguuccagccaaagcuugcuaauaauagaaaacuacccauauuccaaaa

SEQ ID NO: 554981 - RNA, 63 nt, hsa
uugcuuuuccucggcagcuuucaaaaaaccaaauaauaauaguuauccgucuucuacuucaug

SEQ ID NO: 554982 - RNA, 63 nt, hsa
uugggaaccuuggguucuuagguuuggauucuuuaauaauaucuaaaaagcuaaauuuuaaau

SEQ ID NO: 554983 - RNA, 63 nt, hsa
gguaauuccugcuccacaccccuauuuuccucuuaauaauacguuugggugaagacaaauuag

SEQ ID NO: 554984 - RNA, 63 nt, hsa
ugggaaugcauuauuacauccauuucuguaacauaauaauauguugcaugcaguuauauuuuc

SEQ ID NO: 554985 - RNA, 63 nt, hsa
caugcuugauuuaggagagaauaaagggcuauauaauaauaaauccagauuuccggauaagaa

SEQ ID NO: 554986 - RNA, 63 nt, hsa
gcauagcuauuuguuuuuauuguaaaacaauaauaauaauaaaaagcaaacucuauuggugug

SEQ ID NO: 554987 - RNA, 63 nt, hsa
agagcauagcuauuuguuuuuauuguaaaacaauaauaauaauaaaaagcaaacucuauuggu

SEQ ID NO: 554988 - RNA, 63 nt, hsa
gccucaguuuucucaucugccaaaugggaguaauaauaauaauccuuauaaaauuggguucau

SEQ ID NO: 554989 - RNA, 63 nt, hsa
ugagccucaguuuucucaucugccaaaugggaguaauaauaauaauccuuauaaaauuggguu

SEQ ID NO: 554990 - RNA, 63 nt, hsa
ugauggcaaaaagacaguguaauaauaacauaauaauaauaaaaauauaauacugaaaaggau

SEQ ID NO: 554991 - RNA, 63 nt, hsa
uuuugauggcaaaaagacaguguaauaauaacauaauaauaauaaaaauauaauacugaaaag

SEQ ID NO: 554992 - RNA, 63 nt, hsa
cacaggccucauuuugauggcaaaaagacaguguaauaauaacauaauaauaauaaaaauaua

SEQ ID NO: 554993 - RNA, 63 nt, hsa
ugaugaugaugaugaugaugaugauaauaauaauaauaauaacaacaacaacaacaauaauaa

SEQ ID NO: 554994 - RNA, 63 nt, hsa
cgaugaugaugaugaugaugaugaugauaauaauaauaauaauaacaacaacaacaacaauaa

SEQ ID NO: 554995 - RNA, 63 nt, hsa
cuucgaugaugaugaugaugaugaugaugauaauaauaauaauaauaacaacaacaacaacaa

SEQ ID NO: 554996 - RNA, 63 nt, hsa
auacuucgaugaugaugaugaugaugaugaugauaauaauaauaauaauaacaacaacaacaa

SEQ ID NO: 554997 - RNA, 63 nt, hsa
ucugguugcuuauuuuuagaaaaugaggacauuuaauaauaauaaaaaaaaagggauuaauag

SEQ ID NO: 554998 - RNA, 63 nt, hsa
gguugcuuauuuuuagaaaaugaggacauuuaauaauaauaaaaaaaaagggauuaauagcuu

SEQ ID NO: 554999 - RNA, 63 nt, hsa
uaauguuugaaucuaaaucauugggcaaacuucuaauaauaacaauuaauaauagguuacagg

SEQ ID NO: 555000 - RNA, 63 nt, hsa
uaaaucauugggcaaacuucuaauaauaacaauuaauaauagguuacaggaaagccagccaga

SEQ ID NO: 555001 - RNA, 63 nt, hsa
cucuguucacauuuacuggucuuaauuaacagguaauaauaauacauguacuuuuagccugaa

SEQ ID NO: 555002 - RNA, 63 nt, hsa
uguucacauuuacuggucuuaauuaacagguaauaauaauacauguacuuuuagccugaaacc

SEQ ID NO: 555003 - RNA, 63 nt, hsa
gcaaaauagaggccaaauccagggaccaggcccuaauaauagaaguuguaccaaaaugccugu

SEQ ID NO: 555004 - RNA, 63 nt, hsa
acauaggccuaauugagauaauugcuuuuauuauaauaauaggauugaaauuuuaaaauuuug

SEQ ID NO: 555005 - RNA, 63 nt, hsa
gacuaaaugcugcaggucagcagaaauuugcacuaauaauacuuaccaacccacuuuguggau

SEQ ID NO: 555006 - RNA, 63 nt, hsa
ccugggcaacagagugaaacucugucucaaaaauaauaauaauaaaaaaaagcuuccaucucc

SEQ ID NO: 555007 - RNA, 63 nt, hsa
gggcaacagagugaaacucugucucaaaaauaauaauaauaaaaaaaagcuuccaucucccag

SEQ ID NO: 555008 - RNA, 63 nt, hsa
cuucuuacuuugauaacucuucuuaguuuaaaauaauaauaauaacacaucuuuggucaucua

SEQ ID NO: 555009 - RNA, 63 nt, hsa
cuuacuuugauaacucuucuuaguuuaaaauaauaauaauaacacaucuuuggucaucuaugu

SEQ ID NO: 555010 - RNA, 63 nt, hsa
aagagagcaagacucugucucaaauaauaauaauaauaauaaagcuggagacuuggccacacc

SEQ ID NO: 555011 - RNA, 63 nt, hsa
ggcaagagagcaagacucugucucaaauaauaauaauaauaauaaagcuggagacuuggccac

SEQ ID NO: 555012 - RNA, 63 nt, hsa
cugggcaagagagcaagacucugucucaaauaauaauaauaauaauaaagcuggagacuuggc

SEQ ID NO: 555013 - RNA, 63 nt, hsa
agccugggcaagagagcaagacucugucucaaauaauaauaauaauaauaaagcuggagacuu

SEQ ID NO: 555014 - RNA, 63 nt, hsa
cgugugacucuuuccauauguauaacguggggauaauaauaauagcugcuucacaggaugaaa

SEQ ID NO: 555015 - RNA, 63 nt, hsa
gugacucuuuccauauguauaacguggggauaauaauaauagcugcuucacaggaugaaauga

SEQ ID NO: 555016 - RNA, 63 nt, hsa
aaagcauaauugaaaguucugaaaaaagaaaaauaauaauauguagaaaaauguaacuuagag

SEQ ID NO: 555017 - RNA, 63 nt, hsa
uuacagacugucugaaauugaagaagaaugaacuaauaauagcauucauaaccaaacacaaug

SEQ ID NO: 555018 - RNA, 63 nt, hsa
caucauugaaacuacuacaaugauacuaucauuuaauaauauuaauauuacuugaaauagacu

SEQ ID NO: 555019 - RNA, 63 nt, hsa
uggugaauuaucucuacuaaaaauacaaaaaaauaauaauaauagccaggcgugguggcacau

SEQ ID NO: 555020 - RNA, 63 nt, hsa
ugaauuaucucuacuaaaaauacaaaaaaauaauaauaauagccaggcgugguggcacaugcc

SEQ ID NO: 555021 - RNA, 63 nt, hsa
aauauuaaaaagguauuauaaagguauuuaaaauaauaauaauaaaguguuauuuuccuggga

SEQ ID NO: 555022 - RNA, 63 nt, hsa
auuaaaaagguauuauaaagguauuuaaaauaauaauaauaaaguguuauuuuccugggauuc

SEQ ID NO: 555023 - RNA, 63 nt, hsa
uagcauggacauuugaucaaccuuuaguuggaauaauaauauucauauuugcuaugaauccuu

SEQ ID NO: 555024 - RNA, 63 nt, hsa
uuguguguuuguguguuuuuuuaagugcuguauuaauaauacuuucugaaagaaaaggacacu

SEQ ID NO: 555025 - RNA, 63 nt, hsa
agaguugaaauguugagagaugauuaaaaauaauaauaauaaagugucuuccauuguuaaaug

SEQ ID NO: 555026 - RNA, 63 nt, hsa
ccaagaguugaaauguugagagaugauuaaaaauaauaauaauaaagugucuuccauuguuaa

SEQ ID NO: 555027 - RNA, 63 nt, hsa
uucauagccaaacuuguauauuuaaauucuuuguaauaauaauauccaaaucaucaucuugug

SEQ ID NO: 555028 - RNA, 63 nt, hsa
auagccaaacuuguauauuuaaauucuuuguaauaauaauauccaaaucaucaucuuguguca

SEQ ID NO: 555029 - RNA, 63 nt, hsa
ggccaagugcaguccugucuugauuaaauuacuuaauaauauuauuaaauaauaauaggucug

SEQ ID NO: 555030 - RNA, 63 nt, hsa
gucuugauuaaauuacuuaauaauauuauuaaauaauaauaggucugggcaguauuguuuuua

SEQ ID NO: 555031 - RNA, 63 nt, hsa
auugacccagacauauuguacucuuucuaaaaauaauaauaauaaugcuaacagaaagaagag

SEQ ID NO: 555032 - RNA, 63 nt, hsa
gacccagacauauuguacucuuucuaaaaauaauaauaauaaugcuaacagaaagaagagaac

SEQ ID NO: 555033 - RNA, 63 nt, hsa
ggaaagauaaugaugguaacacaguaauaauaauaauaauaacaaaaauaugauaaagugaaa

SEQ ID NO: 555034 - RNA, 63 nt, hsa
agaggaaagauaaugaugguaacacaguaauaauaauaauaauaacaaaaauaugauaaagug

SEQ ID NO: 555035 - RNA, 63 nt, hsa
ucuagaggaaagauaaugaugguaacacaguaauaauaauaauaauaacaaaaauaugauaaa

SEQ ID NO: 555036 - RNA, 63 nt, hsa
ugcucuagaggaaagauaaugaugguaacacaguaauaauaauaauaauaacaaaaauaugau

SEQ ID NO: 555037 - RNA, 51 nt, hsa
cucauuucagacgaaaguaggcgguacgaacccuaauggaggcaguuuuga

SEQ ID NO: 555038 - RNA, 63 nt, hsa
gaaucucacucucucgcccaggcuggagugcaacgguacgaucuuggcucagugcaaccuccg

SEQ ID NO: 555039 - RNA, 63 nt, hsa
agaaggaugggccccgugggguccccacugccccgguacgagggggcccaagacccuggcagg

SEQ ID NO: 555040 - RNA, 63 nt, hsa
aggauucagucauaaagagguaaaaaacugucacgguacgaaaucuuagugcccacggaggcc

SEQ ID NO: 555041 - RNA, 63 nt, hsa
uucuuccugcuggguuuuagccauaauagggcccgguacgauuugggagugacauuucuguaa

SEQ ID NO: 555042 - RNA, 63 nt, hsa
ugaacucacugagcagccagagccaaaugcaaucgguacgaaucuuagaaggaaggaggggga

SEQ ID NO: 555043 - RNA, 63 nt, hsa
uuguucaagaccagccucuaaugggaggugaaacgguacgauggucucaacaccuuucuucug

SEQ ID NO: 555044 - RNA, 63 nt, hsa
cuuucugcaccaggaggaggcgugcucaaguaucgguacgagaucuagccugcccugccugcc

SEQ ID NO: 555045 - RNA, 64 nt, hsa; identical to SEQ ID NO: 243529

SEQ ID NO: 555046 - RNA, 64 nt, hsa; identical to SEQ ID NO: 243530

SEQ ID NO: 555047 - RNA, 64 nt, hsa; identical to SEQ ID NO: 243531

SEQ ID NO: 555048 - RNA, 64 nt, hsa; identical to SEQ ID NO: 243532

SEQ ID NO: 555049 - RNA, 64 nt, hsa; identical to SEQ ID NO: 243533

SEQ ID NO: 555050 - RNA, 64 nt, hsa; identical to SEQ ID NO: 243534

SEQ ID NO: 555051 - RNA, 64 nt, hsa; identical to SEQ ID NO: 243535

SEQ ID NO: 555052 - RNA, 64 nt, hsa; identical to SEQ ID NO: 243536

SEQ ID NO: 555053 - RNA, 63 nt, hsa
ugacuccugcucucuggaggacggucaguccaugucucggagaaacgggugagcugagcuugg

SEQ ID NO: 555054 - RNA, 63 nt, hsa
auccauugacauuugcacuuucaaacaugacaagucucggagcugcugagaugacaggccccu

SEQ ID NO: 555055 - RNA, 63 nt, hsa
guccccagucuuugccaccauugcaccaugguugucucggagucccuucaccugaccuuuuua

SEQ ID NO: 555056 - RNA, 63 nt, hsa
cacccagggcuggccagucacugagggaacagcgucucggaacugcugguccucauuccuugc

SEQ ID NO: 555057 - RNA, 63 nt, hsa
guucuuuccucccccugcaacuuccgcugaggggucucggaugacacccuggccugaacugag

SEQ ID NO: 555058 - RNA, 63 nt, hsa
gcccccuuguccuuccucacccccuccaauauagucucggagcuacaaccgcagcagccacua

SEQ ID NO: 555059 - RNA, 63 nt, hsa
cuauauuggaacuagggucauuugaaagcuucagucucggaacaugaccuuuagucuguggac

SEQ ID NO: 555060 - RNA, 63 nt, hsa
ggagccccuuugaugauuaauucaccuuccagugucucggagggauuccccuaaccucauucc

SEQ ID NO: 555061 - RNA, 63 nt, hsa
acaugcaccuggcugaccuggcugaaagccgcugucucggagccccccacagcauuuuguucc

SEQ ID NO: 555062 - RNA, 63 nt, hsa
ccgccuucucccugggggugauucaaggauuuggucucggaccagaccccccuccacagcugc

SEQ ID NO: 555063 - RNA, 63 nt, hsa
ggaaaugagaaggcagccaccagcgaaugcuaggucucggacuaagccuaccugcucuccaag

SEQ ID NO: 555064 - RNA, 63 nt, hsa
agcuauugcuauugguuuggaguugagauaucagucucggaaacuucugaaaaaugcuaauaa

SEQ ID NO: 555065 - RNA, 63 nt, hsa
ccugauaugguaauauuauggugcauagcagaggucucggaaaaaaaauauuucuguucacuu

SEQ ID NO: 555066 - RNA, 63 nt, hsa
ggagggcacgagagcugaaccugagccuggggcgucucggagcuggauccccgucagcucauc

SEQ ID NO: 555067 - RNA, 63 nt, hsa
cacccuggaagccacugucaaugauuagaucgggucucggaagggaaguagccaucacaccau

SEQ ID NO: 555068 - RNA, 63 nt, hsa
aggcgcuuucccccgauggaggcacaggcuucugucucggauguuuggcgcacgugaguuugu

SEQ ID NO: 555069 - RNA, 63 nt, hsa
ugaagaacaucuggaguuggagccgcacaucuggucucggagcucgccugcgccgcugugccc

SEQ ID NO: 555070 - RNA, 63 nt, hsa
uuuaaaaacugagaccaagacucccaucagcuggucucggauuuacaucggaacugcucagga

SEQ ID NO: 555071 - RNA, 63 nt, hsa
gcggggcggggccggguguuccauagcaugugugucucggaugcggaaggcaguuuugcuugg

SEQ ID NO: 555072 - RNA, 63 nt, hsa
agcacgggccgcuccgcuccccugcuccugucugucucggacagaaaacacgaggcuccuugu

SEQ ID NO: 555073 - RNA, 63 nt, hsa
ucucucucucucucuguguuuccuccagcccuugucucggagacgguguuuuccucccuugcc

SEQ ID NO: 555074 - RNA, 63 nt, hsa
ugcgcucuaguaacugccuuagcaacuguagaugucucggauaaaaguccuggauuuuccauu

SEQ ID NO: 555075 - RNA, 63 nt, hsa
ugaugcuccauuggaugauaaaauuggagcagagucucggaauuggagagcugguaagccagu

SEQ ID NO: 555076 - RNA, 63 nt, hsa
gauagcucgagaaagaauuuuuuccaaggaaaugucucggauauggguacuguauuugaaagc

SEQ ID NO: 555077 - RNA, 63 nt, hsa
aaucuaaauguagagaaguugggauuaaaagcagucucggaaacacagagccaggaauauagc

SEQ ID NO: 555078 - RNA, 63 nt, hsa
gaccagaagagagaauuggagcuguacgagugugucucggaucugguguuguuaggugggcca

SEQ ID NO: 555079 - RNA, 63 nt, hsa
gcggggcugacagcucaggagugucugcacacugucucggaagccaggauuccauuuguguug

SEQ ID NO: 555080 - RNA, 63 nt, hsa
accaucagcagggggcacccaccaugcacaccugucucggaguaggcagcucuuccugggagc

SEQ ID NO: 555081 - RNA, 63 nt, hsa
ccagggacuuaccuggggcuggcaugugugacugucucggaugaagugacugacccagugcac

SEQ ID NO: 555082 - RNA, 63 nt, hsa
cgcuucugcugagacccugcccccggcccaggugucucggaggguggcugcccacggccuggg

SEQ ID NO: 555083 - RNA, 63 nt, hsa
ggaggaggugcgaaguccuggaguauuguuugggucucggaaugggcgcauaaccugcgcuga

SEQ ID NO: 555084 - RNA, 63 nt, hsa
aaggagggggggucuccugggggcagaccgagggucucggaggauagaaugagagguuuccag

SEQ ID NO: 555085 - RNA, 63 nt, hsa
gcuuuguuggaucagagcagauuuuucacccuggucucggaaucuaaaaacccucgcuguguc

SEQ ID NO: 555086 - RNA, 63 nt, hsa
auaaaaacaguaaaagcuuaugcauuuggcaaagucucggaucagggucuacgggaccgagga

SEQ ID NO: 555087 - RNA, 63 nt, hsa
ccccuccugccaggguggcgauuccgcuccacagucucggacggaucugcucagaaaggaaga

SEQ ID NO: 555088 - RNA, 63 nt, hsa
acccugguuguguguccccuugcagccgacacggucucggaucaggcucccaggagccugccc

SEQ ID NO: 555089 - RNA, 63 nt, hsa
gggcggggccacugcucugugcugacgggcuccgucucggagauucuuguccuguuuuuuuuc

SEQ ID NO: 555090 - RNA, 63 nt, hsa
cugccucccuuaggaggggacacugaugaugaggucucggagccggcauccuuccaucccugu

SEQ ID NO: 555091 - RNA, 63 nt, hsa
cguguccugagccucagugaggcugggcagauggucucggagccuccauggggcguagcagga

SEQ ID NO: 555092 - RNA, 63 nt, hsa
ggcaaaauaaacuuucuaaauuaacugagaccugucucggauuuucuggguucacauuuugga

SEQ ID NO: 555093 - RNA, 63 nt, hsa
cuuguccuuuuaagccagaguaguguaaacugcgucucggaugucugucuuuugccucgaagc

SEQ ID NO: 555094 - RNA, 63 nt, hsa
uucuuuuuccgugugggugguuaauaaucgucagucucggagggcgaggcucguaggauauuu

SEQ ID NO: 555095 - RNA, 63 nt, hsa
guggcaggacugcaccaguguauccacaguccugucucggaaucauacagacccucagcugac

SEQ ID NO: 555096 - RNA, 65 nt, hsa
gcugacuccugcucucuggaggacggucaguccaugucucggagaaacgggugagcugagcuugg

SEQ ID NO: 555097 - RNA, 65 nt, hsa
aaauccauugacauuugcacuuucaaacaugacaagucucggagcugcugagaugacaggccccu

SEQ ID NO: 555098 - RNA, 65 nt, hsa
caguccccagucuuugccaccauugcaccaugguugucucggagucccuucaccugaccuuuuua

SEQ ID NO: 555099 - RNA, 65 nt, hsa
agcacccagggcuggccagucacugagggaacagcgucucggaacugcugguccucauuccuugc

SEQ ID NO: 555100 - RNA, 65 nt, hsa
uaguucuuuccucccccugcaacuuccgcugaggggucucggaugacacccuggccugaacugag

SEQ ID NO: 555101 - RNA, 65 nt, hsa
uggcccccuuguccuuccucacccccuccaauauagucucggagcuacaaccgcagcagccacua

SEQ ID NO: 555102 - RNA, 65 nt, hsa
gucuauauuggaacuagggucauuugaaagcuucagucucggaacaugaccuuuagucuguggac

SEQ ID NO: 555103 - RNA, 65 nt, hsa
agggagccccuuugaugauuaauucaccuuccagugucucggagggauuccccuaaccucauucc

SEQ ID NO: 555104 - RNA, 65 nt, hsa
ccacaugcaccuggcugaccuggcugaaagccgcugucucggagccccccacagcauuuuguucc

SEQ ID NO: 555105 - RNA, 65 nt, hsa
ggccgccuucucccugggggugauucaaggauuuggucucggaccagaccccccuccacagcugc

SEQ ID NO: 555106 - RNA, 65 nt, hsa
ugggaaaugagaaggcagccaccagcgaaugcuaggucucggacuaagccuaccugcucuccaag

SEQ ID NO: 555107 - RNA, 65 nt, hsa
uaagcuauugcuauugguuuggaguugagauaucagucucggaaacuucugaaaaaugcuaauaa

SEQ ID NO: 555108 - RNA, 65 nt, hsa
acccugauaugguaauauuauggugcauagcagaggucucggaaaaaaaauauuucuguucacuu

SEQ ID NO: 555109 - RNA, 65 nt, hsa
ggggagggcacgagagcugaaccugagccuggggcgucucggagcuggauccccgucagcucauc

SEQ ID NO: 555110 - RNA, 65 nt, hsa
aacacccuggaagccacugucaaugauuagaucgggucucggaagggaaguagccaucacaccau

SEQ ID NO: 555111 - RNA, 65 nt, hsa
aaaggcgcuuucccccgauggaggcacaggcuucugucucggauguuuggcgcacgugaguuugu

SEQ ID NO: 555112 - RNA, 65 nt, hsa
gaugaagaacaucuggaguuggagccgcacaucuggucucggagcucgccugcgccgcugugccc

SEQ ID NO: 555113 - RNA, 65 nt, hsa
cuuuuaaaaacugagaccaagacucccaucagcuggucucggauuuacaucggaacugcucagga

SEQ ID NO: 555114 - RNA, 65 nt, hsa
gggcggggcggggccggguguuccauagcaugugugucucggaugcggaaggcaguuuugcuugg

SEQ ID NO: 555115 - RNA, 65 nt, hsa
ugagcacgggccgcuccgcuccccugcuccugucugucucggacagaaaacacgaggcuccuugu

SEQ ID NO: 555116 - RNA, 65 nt, hsa
ugucucucucucucucuguguuuccuccagcccuugucucggagacgguguuuuccucccuugcc

SEQ ID NO: 555117 - RNA, 65 nt, hsa
gcugcgcucuaguaacugccuuagcaacuguagaugucucggauaaaaguccuggauuuuccauu

SEQ ID NO: 555118 - RNA, 65 nt, hsa
ugugaugcuccauuggaugauaaaauuggagcagagucucggaauuggagagcugguaagccagu

SEQ ID NO: 555119 - RNA, 65 nt, hsa
ucgauagcucgagaaagaauuuuuuccaaggaaaugucucggauauggguacuguauuugaaagc

SEQ ID NO: 555120 - RNA, 65 nt, hsa
uuaaucuaaauguagagaaguugggauuaaaagcagucucggaaacacagagccaggaauauagc

SEQ ID NO: 555121 - RNA, 65 nt, hsa
aggaccagaagagagaauuggagcuguacgagugugucucggaucugguguuguuaggugggcca

SEQ ID NO: 555122 - RNA, 65 nt, hsa
aggcggggcugacagcucaggagugucugcacacugucucggaagccaggauuccauuuguguug

SEQ ID NO: 555123 - RNA, 65 nt, hsa
acaccaucagcagggggcacccaccaugcacaccugucucggaguaggcagcucuuccugggagc

SEQ ID NO: 555124 - RNA, 65 nt, hsa
ccccagggacuuaccuggggcuggcaugugugacugucucggaugaagugacugacccagugcac

SEQ ID NO: 555125 - RNA, 65 nt, hsa
ggcgcuucugcugagacccugcccccggcccaggugucucggaggguggcugcccacggccuggg

SEQ ID NO: 555126 - RNA, 65 nt, hsa
gaggaggaggugcgaaguccuggaguauuguuugggucucggaaugggcgcauaaccugcgcuga

SEQ ID NO: 555127 - RNA, 65 nt, hsa
uaaaggagggggggucuccugggggcagaccgagggucucggaggauagaaugagagguuuccag

SEQ ID NO: 555128 - RNA, 65 nt, hsa
gugcuuuguuggaucagagcagauuuuucacccuggucucggaaucuaaaaacccucgcuguguc

SEQ ID NO: 555129 - RNA, 65 nt, hsa
auauaaaaacaguaaaagcuuaugcauuuggcaaagucucggaucagggucuacgggaccgagga

SEQ ID NO: 555130 - RNA, 65 nt, hsa
gcccccuccugccaggguggcgauuccgcuccacagucucggacggaucugcucagaaaggaaga

SEQ ID NO: 555131 - RNA, 65 nt, hsa
guacccugguuguguguccccuugcagccgacacggucucggaucaggcucccaggagccugccc

SEQ ID NO: 555132 - RNA, 65 nt, hsa
uggggcggggccacugcucugugcugacgggcuccgucucggagauucuuguccuguuuuuuuuc

SEQ ID NO: 555133 - RNA, 65 nt, hsa
ugcugccucccuuaggaggggacacugaugaugaggucucggagccggcauccuuccaucccugu

SEQ ID NO: 555134 - RNA, 65 nt, hsa
gccguguccugagccucagugaggcugggcagauggucucggagccuccauggggcguagcagga

SEQ ID NO: 555135 - RNA, 65 nt, hsa
uuggcaaaauaaacuuucuaaauuaacugagaccugucucggauuuucuggguucacauuuugga

SEQ ID NO: 555136 - RNA, 65 nt, hsa
aucuuguccuuuuaagccagaguaguguaaacugcgucucggaugucugucuuuugccucgaagc

SEQ ID NO: 555137 - RNA, 65 nt, hsa
guuucuuuuuccgugugggugguuaauaaucgucagucucggagggcgaggcucguaggauauuu

SEQ ID NO: 555138 - RNA, 65 nt, hsa
ucguggcaggacugcaccaguguauccacaguccugucucggaaucauacagacccucagcugac

SEQ ID NO: 555139 - RNA, 64 nt, hsa; identical to SEQ ID NO: 327679

SEQ ID NO: 555140 - RNA, 64 nt, hsa; identical to SEQ ID NO: 327680

SEQ ID NO: 555141 - RNA, 64 nt, hsa; identical to SEQ ID NO: 327681

SEQ ID NO: 555142 - RNA, 64 nt, hsa; identical to SEQ ID NO: 327682

SEQ ID NO: 555143 - RNA, 64 nt, hsa; identical to SEQ ID NO: 327683

SEQ ID NO: 555144 - RNA, 64 nt, hsa; identical to SEQ ID NO: 327684

SEQ ID NO: 555145 - RNA, 64 nt, hsa; identical to SEQ ID NO: 327685

SEQ ID NO: 555146 - RNA, 64 nt, hsa; identical to SEQ ID NO: 327686

SEQ ID NO: 555147 - RNA, 64 nt, hsa; identical to SEQ ID NO: 327687

SEQ ID NO: 555148 - RNA, 64 nt, hsa; identical to SEQ ID NO: 327688

SEQ ID NO: 555149 - RNA, 64 nt, hsa; identical to SEQ ID NO: 327689

SEQ ID NO: 555150 - RNA, 64 nt, hsa; identical to SEQ ID NO: 327690

SEQ ID NO: 555151 - RNA, 64 nt, hsa; identical to SEQ ID NO: 327691

SEQ ID NO: 555152 - RNA, 64 nt, hsa; identical to SEQ ID NO: 327692

SEQ ID NO: 555153 - RNA, 64 nt, hsa; identical to SEQ ID NO: 327693

SEQ ID NO: 555154 - RNA, 64 nt, hsa; identical to SEQ ID NO: 327694

SEQ ID NO: 555155 - RNA, 64 nt, hsa; identical to SEQ ID NO: 327695

SEQ ID NO: 555156 - RNA, 64 nt, hsa; identical to SEQ ID NO: 327696

SEQ ID NO: 555157 - RNA, 64 nt, hsa; identical to SEQ ID NO: 327697

SEQ ID NO: 555158 - RNA, 64 nt, hsa; identical to SEQ ID NO: 327698

SEQ ID NO: 555159 - RNA, 64 nt, hsa; identical to SEQ ID NO: 327699

SEQ ID NO: 555160 - RNA, 64 nt, hsa; identical to SEQ ID NO: 327700

SEQ ID NO: 555161 - RNA, 64 nt, hsa; identical to SEQ ID NO: 327701

SEQ ID NO: 555162 - RNA, 64 nt, hsa; identical to SEQ ID NO: 327702

SEQ ID NO: 555163 - RNA, 64 nt, hsa; identical to SEQ ID NO: 327703

SEQ ID NO: 555164 - RNA, 64 nt, hsa; identical to SEQ ID NO: 327704

SEQ ID NO: 555165 - RNA, 64 nt, hsa; identical to SEQ ID NO: 327705

SEQ ID NO: 555166 - RNA, 64 nt, hsa; identical to SEQ ID NO: 327706

SEQ ID NO: 555167 - RNA, 64 nt, hsa; identical to SEQ ID NO: 327707

SEQ ID NO: 555168 - RNA, 64 nt, hsa; identical to SEQ ID NO: 327708

SEQ ID NO: 555169 - RNA, 64 nt, hsa; identical to SEQ ID NO: 327709

SEQ ID NO: 555170 - RNA, 63 nt, hsa; identical to SEQ ID NO: 327710

SEQ ID NO: 555171 - RNA, 64 nt, hsa; identical to SEQ ID NO: 327711

SEQ ID NO: 555172 - RNA, 64 nt, hsa; identical to SEQ ID NO: 327712

SEQ ID NO: 555173 - RNA, 64 nt, hsa; identical to SEQ ID NO: 327713

SEQ ID NO: 555174 - RNA, 64 nt, hsa; identical to SEQ ID NO: 327714

SEQ ID NO: 555175 - RNA, 64 nt, hsa; identical to SEQ ID NO: 327715

SEQ ID NO: 555176 - RNA, 64 nt, hsa; identical to SEQ ID NO: 327716

SEQ ID NO: 555177 - RNA, 64 nt, hsa; identical to SEQ ID NO: 327717

SEQ ID NO: 555178 - RNA, 64 nt, hsa; identical to SEQ ID NO: 327718

SEQ ID NO: 555179 - RNA, 64 nt, hsa; identical to SEQ ID NO: 327719

SEQ ID NO: 555180 - RNA, 64 nt, hsa; identical to SEQ ID NO: 327720

SEQ ID NO: 555181 - RNA, 64 nt, hsa; identical to SEQ ID NO: 327721

SEQ ID NO: 555182 - RNA, 64 nt, hsa; identical to SEQ ID NO: 327722

SEQ ID NO: 555183 - RNA, 64 nt, hsa; identical to SEQ ID NO: 327723

SEQ ID NO: 555184 - RNA, 64 nt, hsa; identical to SEQ ID NO: 327724

SEQ ID NO: 555185 - RNA, 64 nt, hsa; identical to SEQ ID NO: 327725

SEQ ID NO: 555186 - RNA, 51 nt, hsa; identical to SEQ ID NO: 327726

SEQ ID NO: 555187 - RNA, 64 nt, hsa; identical to SEQ ID NO: 327727

SEQ ID NO: 555188 - RNA, 64 nt, hsa; identical to SEQ ID NO: 327728

SEQ ID NO: 555189 - RNA, 64 nt, hsa; identical to SEQ ID NO: 327729

SEQ ID NO: 555190 - RNA, 64 nt, hsa; identical to SEQ ID NO: 327730

SEQ ID NO: 555191 - RNA, 64 nt, hsa; identical to SEQ ID NO: 327731

SEQ ID NO: 555192 - RNA, 64 nt, hsa; identical to SEQ ID NO: 327732

SEQ ID NO: 555193 - RNA, 64 nt, hsa; identical to SEQ ID NO: 327733

SEQ ID NO: 555194 - RNA, 64 nt, hsa; identical to SEQ ID NO: 327734

SEQ ID NO: 555195 - RNA, 64 nt, hsa; identical to SEQ ID NO: 327735

SEQ ID NO: 555196 - RNA, 64 nt, hsa; identical to SEQ ID NO: 327736

SEQ ID NO: 555197 - RNA, 64 nt, hsa; identical to SEQ ID NO: 327737

SEQ ID NO: 555198 - RNA, 64 nt, hsa; identical to SEQ ID NO: 327738

SEQ ID NO: 555199 - RNA, 64 nt, hsa; identical to SEQ ID NO: 327739

SEQ ID NO: 555200 - RNA, 64 nt, hsa; identical to SEQ ID NO: 327740

SEQ ID NO: 555201 - RNA, 64 nt, hsa; identical to SEQ ID NO: 327741

SEQ ID NO: 555202 - RNA, 64 nt, hsa; identical to SEQ ID NO: 327742

SEQ ID NO: 555203 - RNA, 64 nt, hsa; identical to SEQ ID NO: 327743

SEQ ID NO: 555204 - RNA, 64 nt, hsa; identical to SEQ ID NO: 327744

SEQ ID NO: 555205 - RNA, 64 nt, hsa; identical to SEQ ID NO: 327745

SEQ ID NO: 555206 - RNA, 64 nt, hsa; identical to SEQ ID NO: 327746

SEQ ID NO: 555207 - RNA, 64 nt, hsa; identical to SEQ ID NO: 327747

SEQ ID NO: 555208 - RNA, 64 nt, hsa; identical to SEQ ID NO: 327748

SEQ ID NO: 555209 - RNA, 64 nt, hsa; identical to SEQ ID NO: 327749

SEQ ID NO: 555210 - RNA, 64 nt, hsa; identical to SEQ ID NO: 327750

SEQ ID NO: 555211 - RNA, 64 nt, hsa; identical to SEQ ID NO: 327751

SEQ ID NO: 555212 - RNA, 64 nt, hsa; identical to SEQ ID NO: 327752

SEQ ID NO: 555213 - RNA, 64 nt, hsa; identical to SEQ ID NO: 327753

SEQ ID NO: 555214 - RNA, 64 nt, hsa; identical to SEQ ID NO: 327754

SEQ ID NO: 555215 - RNA, 64 nt, hsa; identical to SEQ ID NO: 327755

SEQ ID NO: 555216 - RNA, 64 nt, hsa; identical to SEQ ID NO: 327756

SEQ ID NO: 555217 - RNA, 64 nt, hsa; identical to SEQ ID NO: 327757

SEQ ID NO: 555218 - RNA, 64 nt, hsa; identical to SEQ ID NO: 327758

SEQ ID NO: 555219 - RNA, 64 nt, hsa; identical to SEQ ID NO: 327759

SEQ ID NO: 555220 - RNA, 64 nt, hsa; identical to SEQ ID NO: 327760

SEQ ID NO: 555221 - RNA, 64 nt, hsa; identical to SEQ ID NO: 327761

SEQ ID NO: 555222 - RNA, 64 nt, hsa; identical to SEQ ID NO: 327762

SEQ ID NO: 555223 - RNA, 64 nt, hsa; identical to SEQ ID NO: 327763

SEQ ID NO: 555224 - RNA, 64 nt, hsa; identical to SEQ ID NO: 327764

SEQ ID NO: 555225 - RNA, 64 nt, hsa; identical to SEQ ID NO: 327765

SEQ ID NO: 555226 - RNA, 64 nt, hsa; identical to SEQ ID NO: 327766

SEQ ID NO: 555227 - RNA, 64 nt, hsa; identical to SEQ ID NO: 327767

SEQ ID NO: 555228 - RNA, 64 nt, hsa; identical to SEQ ID NO: 327768

SEQ ID NO: 555229 - RNA, 64 nt, hsa; identical to SEQ ID NO: 327769

SEQ ID NO: 555230 - RNA, 64 nt, hsa; identical to SEQ ID NO: 327770

SEQ ID NO: 555231 - RNA, 64 nt, hsa; identical to SEQ ID NO: 327771

SEQ ID NO: 555232 - RNA, 64 nt, hsa; identical to SEQ ID NO: 327772

SEQ ID NO: 555233 - RNA, 64 nt, hsa; identical to SEQ ID NO: 327773

SEQ ID NO: 555234 - RNA, 64 nt, hsa; identical to SEQ ID NO: 327774

SEQ ID NO: 555235 - RNA, 64 nt, hsa; identical to SEQ ID NO: 327775

SEQ ID NO: 555236 - RNA, 64 nt, hsa; identical to SEQ ID NO: 327776

SEQ ID NO: 555237 - RNA, 64 nt, hsa; identical to SEQ ID NO: 327777

SEQ ID NO: 555238 - RNA, 64 nt, hsa; identical to SEQ ID NO: 327778

SEQ ID NO: 555239 - RNA, 64 nt, hsa; identical to SEQ ID NO: 327779

SEQ ID NO: 555240 - RNA, 64 nt, hsa; identical to SEQ ID NO: 327780

SEQ ID NO: 555241 - RNA, 64 nt, hsa; identical to SEQ ID NO: 327781

SEQ ID NO: 555242 - RNA, 64 nt, hsa; identical to SEQ ID NO: 327782

SEQ ID NO: 555243 - RNA, 64 nt, hsa; identical to SEQ ID NO: 327783

SEQ ID NO: 555244 - RNA, 64 nt, hsa; identical to SEQ ID NO: 327784

SEQ ID NO: 555245 - RNA, 64 nt, hsa; identical to SEQ ID NO: 327785

SEQ ID NO: 555246 - RNA, 64 nt, hsa; identical to SEQ ID NO: 327786

SEQ ID NO: 555247 - RNA, 64 nt, hsa; identical to SEQ ID NO: 327787

SEQ ID NO: 555248 - RNA, 64 nt, hsa; identical to SEQ ID NO: 327788

SEQ ID NO: 555249 - RNA, 64 nt, hsa; identical to SEQ ID NO: 327789

SEQ ID NO: 555250 - RNA, 64 nt, hsa; identical to SEQ ID NO: 327790

SEQ ID NO: 555251 - RNA, 64 nt, hsa; identical to SEQ ID NO: 327791

SEQ ID NO: 555252 - RNA, 64 nt, hsa; identical to SEQ ID NO: 327792

SEQ ID NO: 555253 - RNA, 64 nt, hsa; identical to SEQ ID NO: 327793

SEQ ID NO: 555254 - RNA, 64 nt, hsa; identical to SEQ ID NO: 327794

SEQ ID NO: 555255 - RNA, 64 nt, hsa; identical to SEQ ID NO: 327795

SEQ ID NO: 555256 - RNA, 64 nt, hsa; identical to SEQ ID NO: 327796

SEQ ID NO: 555257 - RNA, 64 nt, hsa; identical to SEQ ID NO: 327797

SEQ ID NO: 555258 - RNA, 64 nt, hsa; identical to SEQ ID NO: 327798

SEQ ID NO: 555259 - RNA, 64 nt, hsa; identical to SEQ ID NO: 327799

SEQ ID NO: 555260 - RNA, 64 nt, hsa; identical to SEQ ID NO: 327800

SEQ ID NO: 555261 - RNA, 64 nt, hsa; identical to SEQ ID NO: 327801

SEQ ID NO: 555262 - RNA, 64 nt, hsa; identical to SEQ ID NO: 327802

SEQ ID NO: 555263 - RNA, 64 nt, hsa; identical to SEQ ID NO: 327803

SEQ ID NO: 555264 - RNA, 64 nt, hsa; identical to SEQ ID NO: 327804

SEQ ID NO: 555265 - RNA, 64 nt, hsa; identical to SEQ ID NO: 327805

SEQ ID NO: 555266 - RNA, 64 nt, hsa; identical to SEQ ID NO: 327806

SEQ ID NO: 555267 - RNA, 64 nt, hsa; identical to SEQ ID NO: 327807

SEQ ID NO: 555268 - RNA, 64 nt, hsa; identical to SEQ ID NO: 327808

SEQ ID NO: 555269 - RNA, 64 nt, hsa; identical to SEQ ID NO: 327809

SEQ ID NO: 555270 - RNA, 64 nt, hsa; identical to SEQ ID NO: 327810

SEQ ID NO: 555271 - RNA, 64 nt, hsa; identical to SEQ ID NO: 327811

SEQ ID NO: 555272 - RNA, 64 nt, hsa; identical to SEQ ID NO: 327812

SEQ ID NO: 555273 - RNA, 64 nt, hsa; identical to SEQ ID NO: 327813

SEQ ID NO: 555274 - RNA, 64 nt, hsa; identical to SEQ ID NO: 327814

SEQ ID NO: 555275 - RNA, 64 nt, hsa; identical to SEQ ID NO: 327815

SEQ ID NO: 555276 - RNA, 64 nt, hsa; identical to SEQ ID NO: 327816

SEQ ID NO: 555277 - RNA, 64 nt, hsa; identical to SEQ ID NO: 327817

SEQ ID NO: 555278 - RNA, 64 nt, hsa; identical to SEQ ID NO: 327818

SEQ ID NO: 555279 - RNA, 64 nt, hsa; identical to SEQ ID NO: 327819

SEQ ID NO: 555280 - RNA, 64 nt, hsa; identical to SEQ ID NO: 327820

SEQ ID NO: 555281 - RNA, 64 nt, hsa; identical to SEQ ID NO: 327821

SEQ ID NO: 555282 - RNA, 64 nt, hsa; identical to SEQ ID NO: 327822

SEQ ID NO: 555283 - RNA, 64 nt, hsa; identical to SEQ ID NO: 327823

SEQ ID NO: 555284 - RNA, 64 nt, hsa; identical to SEQ ID NO: 327824

SEQ ID NO: 555285 - RNA, 64 nt, hsa; identical to SEQ ID NO: 327825

SEQ ID NO: 555286 - RNA, 64 nt, hsa; identical to SEQ ID NO: 327826

SEQ ID NO: 555287 - RNA, 64 nt, hsa; identical to SEQ ID NO: 327827

SEQ ID NO: 555288 - RNA, 64 nt, hsa; identical to SEQ ID NO: 327828

SEQ ID NO: 555289 - RNA, 64 nt, hsa; identical to SEQ ID NO: 327829

SEQ ID NO: 555290 - RNA, 64 nt, hsa; identical to SEQ ID NO: 327830

SEQ ID NO: 555291 - RNA, 64 nt, hsa
aaucacagaauugauauuuaucucaagacuaucuuaagcuaauguacuucuguuacauaauuaa

SEQ ID NO: 555292 - RNA, 64 nt, hsa
aacauuugaguuuguuuaagguauaagcagaagauaagcuaauauagcuuguuuuguugaaauu

SEQ ID NO: 555293 - RNA, 64 nt, hsa
gaauucaagguugguucaacaucuaaaaaucaaauaagcuaauauacagucaguucucauuauu

SEQ ID NO: 555294 - RNA, 64 nt, hsa
gaauucaagguuuguucaacaucuaaaaaucaaauaagcuaauaaagaaaagagguuuauacug

SEQ ID NO: 555295 - RNA, 64 nt, hsa
uggugaguuuaguugugcaugccuuuguuguauauaagcuaaauucuagugacccaugugucaa

SEQ ID NO: 555296 - RNA, 64 nt, hsa
acucauuuuauucucggcaacaucuggagaagcauaagcuaauuaagggcgaugauuauuauua

SEQ ID NO: 555297 - RNA, 64 nt, hsa
aggaaaggcaggagccaguccgugcaggcacacucagcgcuaagccaaaggccgcccaugcuga

SEQ ID NO: 555298 - RNA, 64 nt, hsa
uggcuucaguguuuugaaaaauacaucuuguacccagcgcuaauuuugaaugcccucacuauug

SEQ ID NO: 555299 - RNA, 59 nt, hsa; identical to SEQ ID NO: 97671

SEQ ID NO: 555300 - RNA, 59 nt, hsa; identical to SEQ ID NO: 97672

SEQ ID NO: 555301 - RNA, 59 nt, hsa; identical to SEQ ID NO: 97673

SEQ ID NO: 555302 - RNA, 59 nt, hsa; identical to SEQ ID NO: 97674

SEQ ID NO: 555303 - RNA, 64 nt, hsa; identical to SEQ ID NO: 69124

SEQ ID NO: 555304 - RNA, 64 nt, hsa; identical to SEQ ID NO: 69125

SEQ ID NO: 555305 - RNA, 64 nt, hsa; identical to SEQ ID NO: 69126

SEQ ID NO: 555306 - RNA, 64 nt, hsa; identical to SEQ ID NO: 69127

SEQ ID NO: 555307 - RNA, 64 nt, hsa; identical to SEQ ID NO: 69128

SEQ ID NO: 555308 - RNA, 64 nt, hsa; identical to SEQ ID NO: 69129

SEQ ID NO: 555309 - RNA, 64 nt, hsa; identical to SEQ ID NO: 257640

SEQ ID NO: 555310 - RNA, 64 nt, hsa; identical to SEQ ID NO: 257641

SEQ ID NO: 555311 - RNA, 64 nt, hsa; identical to SEQ ID NO: 257642

SEQ ID NO: 555312 - RNA, 64 nt, hsa; identical to SEQ ID NO: 257642

SEQ ID NO: 555313 - RNA, 64 nt, hsa; identical to SEQ ID NO: 257644

SEQ ID NO: 555314 - RNA, 64 nt, hsa; identical to SEQ ID NO: 257645

SEQ ID NO: 555315 - RNA, 64 nt, hsa; identical to SEQ ID NO: 257646

SEQ ID NO: 555316 - RNA, 64 nt, hsa; identical to SEQ ID NO: 257647

SEQ ID NO: 555317 - RNA, 64 nt, hsa; identical to SEQ ID NO: 216073

SEQ ID NO: 555318 - RNA, 64 nt, hsa; identical to SEQ ID NO: 216074

SEQ ID NO: 555319 - RNA, 64 nt, hsa; identical to SEQ ID NO: 216075

SEQ ID NO: 555320 - RNA, 64 nt, hsa; identical to SEQ ID NO: 216076

SEQ ID NO: 555321 - RNA, 64 nt, hsa; identical to SEQ ID NO: 216077

SEQ ID NO: 555322 - RNA, 64 nt, hsa; identical to SEQ ID NO: 216078

SEQ ID NO: 555323 - RNA, 64 nt, hsa; identical to SEQ ID NO: 216079

SEQ ID NO: 555324 - RNA, 64 nt, hsa; identical to SEQ ID NO: 216080

SEQ ID NO: 555325 - RNA, 64 nt, hsa; identical to SEQ ID NO: 216081

SEQ ID NO: 555326 - RNA, 64 nt, hsa; identical to SEQ ID NO: 216082

SEQ ID NO: 555327 - RNA, 64 nt, hsa; identical to SEQ ID NO: 216083

SEQ ID NO: 555328 - RNA, 64 nt, hsa; identical to SEQ ID NO: 216084

SEQ ID NO: 555329 - RNA, 64 nt, hsa; identical to SEQ ID NO: 216085

SEQ ID NO: 555330 - RNA, 64 nt, hsa; identical to SEQ ID NO: 216086

SEQ ID NO: 555331 - RNA, 64 nt, hsa; identical to SEQ ID NO: 216087

SEQ ID NO: 555332 - RNA, 64 nt, hsa; identical to SEQ ID NO: 216088

SEQ ID NO: 555333 - RNA, 64 nt, hsa; identical to SEQ ID NO: 216089

SEQ ID NO: 555334 - RNA, 64 nt, hsa; identical to SEQ ID NO: 216090

SEQ ID NO: 555335 - RNA, 64 nt, hsa; identical to SEQ ID NO: 216091

SEQ ID NO: 555336 - RNA, 64 nt, hsa; identical to SEQ ID NO: 216092

SEQ ID NO: 555337 - RNA, 64 nt, hsa; identical to SEQ ID NO: 216093

SEQ ID NO: 555338 - RNA, 64 nt, hsa; identical to SEQ ID NO: 216094

SEQ ID NO: 555339 - RNA, 64 nt, hsa; identical to SEQ ID NO: 216095

SEQ ID NO: 555340 - RNA, 64 nt, hsa; identical to SEQ ID NO: 216096

SEQ ID NO: 555341 - RNA, 64 nt, hsa; identical to SEQ ID NO: 216097

SEQ ID NO: 555342 - RNA, 64 nt, hsa; identical to SEQ ID NO: 216098

SEQ ID NO: 555343 - RNA, 64 nt, hsa; identical to SEQ ID NO: 216099

SEQ ID NO: 555344 - RNA, 64 nt, hsa; identical to SEQ ID NO: 216100

SEQ ID NO: 555345 - RNA, 64 nt, hsa; identical to SEQ ID NO: 216101

SEQ ID NO: 555346 - RNA, 64 nt, hsa; identical to SEQ ID NO: 216102

SEQ ID NO: 555347 - RNA, 64 nt, hsa; identical to SEQ ID NO: 216103

SEQ ID NO: 555348 - RNA, 64 nt, hsa; identical to SEQ ID NO: 216104

SEQ ID NO: 555349 - RNA, 64 nt, hsa; identical to SEQ ID NO: 216105

SEQ ID NO: 555350 - RNA, 64 nt, hsa; identical to SEQ ID NO: 216106

SEQ ID NO: 555351 - RNA, 64 nt, hsa; identical to SEQ ID NO: 216107

SEQ ID NO: 555352 - RNA, 64 nt, hsa; identical to SEQ ID NO: 216108

SEQ ID NO: 555353 - RNA, 64 nt, hsa; identical to SEQ ID NO: 216109

SEQ ID NO: 555354 - RNA, 64 nt, hsa; identical to SEQ ID NO: 216110

SEQ ID NO: 555355 - RNA, 64 nt, hsa; identical to SEQ ID NO: 216111

SEQ ID NO: 555356 - RNA, 64 nt, hsa; identical to SEQ ID NO: 216112

SEQ ID NO: 555357 - RNA, 64 nt, hsa; identical to SEQ ID NO: 216113

SEQ ID NO: 555358 - RNA, 64 nt, hsa; identical to SEQ ID NO: 216114

SEQ ID NO: 555359 - RNA, 64 nt, hsa; identical to SEQ ID NO: 216115

SEQ ID NO: 555360 - RNA, 64 nt, hsa; identical to SEQ ID NO: 216116

SEQ ID NO: 555361 - RNA, 64 nt, hsa; identical to SEQ ID NO: 216117

SEQ ID NO: 555362 - RNA, 64 nt, hsa; identical to SEQ ID NO: 216118

SEQ ID NO: 555363 - RNA, 64 nt, hsa; identical to SEQ ID NO: 216119

SEQ ID NO: 555364 - RNA, 64 nt, hsa; identical to SEQ ID NO: 216120

SEQ ID NO: 555365 - RNA, 64 nt, hsa; identical to SEQ ID NO: 216121

SEQ ID NO: 555366 - RNA, 64 nt, hsa; identical to SEQ ID NO: 216121

SEQ ID NO: 555367 - RNA, 64 nt, hsa; identical to SEQ ID NO: 216123

SEQ ID NO: 555368 - RNA, 64 nt, hsa; identical to SEQ ID NO: 216124

SEQ ID NO: 555369 - RNA, 64 nt, hsa; identical to SEQ ID NO: 216125

SEQ ID NO: 555370 - RNA, 64 nt, hsa; identical to SEQ ID NO: 216126

SEQ ID NO: 555371 - RNA, 64 nt, hsa; identical to SEQ ID NO: 216127

SEQ ID NO: 555372 - RNA, 64 nt, hsa; identical to SEQ ID NO: 216128

SEQ ID NO: 555373 - RNA, 64 nt, hsa; identical to SEQ ID NO: 216129

SEQ ID NO: 555374 - RNA, 64 nt, hsa; identical to SEQ ID NO: 216130

SEQ ID NO: 555375 - RNA, 64 nt, hsa; identical to SEQ ID NO: 216131

SEQ ID NO: 555376 - RNA, 64 nt, hsa; identical to SEQ ID NO: 216132

SEQ ID NO: 555377 - RNA, 64 nt, hsa; identical to SEQ ID NO: 216133

SEQ ID NO: 555378 - RNA, 64 nt, hsa; identical to SEQ ID NO: 216134

SEQ ID NO: 555379 - RNA, 64 nt, hsa; identical to SEQ ID NO: 216135

SEQ ID NO: 555380 - RNA, 64 nt, hsa; identical to SEQ ID NO: 216136

SEQ ID NO: 555381 - RNA, 64 nt, hsa; identical to SEQ ID NO: 216137

SEQ ID NO: 555382 - RNA, 64 nt, hsa; identical to SEQ ID NO: 216138

SEQ ID NO: 555383 - RNA, 64 nt, hsa; identical to SEQ ID NO: 216139

SEQ ID NO: 555384 - RNA, 64 nt, hsa; identical to SEQ ID NO: 216140

SEQ ID NO: 555385 - RNA, 64 nt, hsa; identical to SEQ ID NO: 216141

SEQ ID NO: 555386 - RNA, 64 nt, hsa; identical to SEQ ID NO: 216142

SEQ ID NO: 555387 - RNA, 64 nt, hsa; identical to SEQ ID NO: 216143

SEQ ID NO: 555388 - RNA, 64 nt, hsa; identical to SEQ ID NO: 474199

SEQ ID NO: 555389 - RNA, 64 nt, hsa; identical to SEQ ID NO: 474200

SEQ ID NO: 555390 - RNA, 64 nt, hsa; identical to SEQ ID NO: 474201

SEQ ID NO: 555391 - RNA, 64 nt, hsa; identical to SEQ ID NO: 474202

SEQ ID NO: 555392 - RNA, 64 nt, hsa; identical to SEQ ID NO: 474203

SEQ ID NO: 555393 - RNA, 64 nt, hsa; identical to SEQ ID NO: 474204

SEQ ID NO: 555394 - RNA, 64 nt, hsa; identical to SEQ ID NO: 474205

SEQ ID NO: 555395 - RNA, 64 nt, hsa; identical to SEQ ID NO: 474206

SEQ ID NO: 555396 - RNA, 64 nt, hsa; identical to SEQ ID NO: 474207

SEQ ID NO: 555397 - RNA, 64 nt, hsa; identical to SEQ ID NO: 474208

SEQ ID NO: 555398 - RNA, 64 nt, hsa; identical to SEQ ID NO: 164108

SEQ ID NO: 555399 - RNA, 64 nt, hsa; identical to SEQ ID NO: 164109

SEQ ID NO: 555400 - RNA, 64 nt, hsa; identical to SEQ ID NO: 164110

SEQ ID NO: 555401 - RNA, 64 nt, hsa; identical to SEQ ID NO: 164111

SEQ ID NO: 555402 - RNA, 64 nt, hsa; identical to SEQ ID NO: 164112

SEQ ID NO: 555403 - RNA, 64 nt, hsa; identical to SEQ ID NO: 164113

SEQ ID NO: 555404 - RNA, 64 nt, hsa; identical to SEQ ID NO: 164114

SEQ ID NO: 555405 - RNA, 64 nt, hsa; identical to SEQ ID NO: 164115

SEQ ID NO: 555406 - RNA, 64 nt, hsa; identical to SEQ ID NO: 164116

SEQ ID NO: 555407 - RNA, 64 nt, hsa; identical to SEQ ID NO: 164117

SEQ ID NO: 555408 - RNA, 64 nt, hsa; identical to SEQ ID NO: 164118

SEQ ID NO: 555409 - RNA, 64 nt, hsa; identical to SEQ ID NO: 164119

SEQ ID NO: 555410 - RNA, 64 nt, hsa; identical to SEQ ID NO: 164120

SEQ ID NO: 555411 - RNA, 64 nt, hsa; identical to SEQ ID NO: 164121

SEQ ID NO: 555412 - RNA, 64 nt, hsa; identical to SEQ ID NO: 164122

SEQ ID NO: 555413 - RNA, 64 nt, hsa; identical to SEQ ID NO: 164123

SEQ ID NO: 555414 - RNA, 64 nt, hsa; identical to SEQ ID NO: 164124

SEQ ID NO: 555415 - RNA, 64 nt, hsa; identical to SEQ ID NO: 164125

SEQ ID NO: 555416 - RNA, 64 nt, hsa; identical to SEQ ID NO: 164126

SEQ ID NO: 555417 - RNA, 64 nt, hsa; identical to SEQ ID NO: 164127

SEQ ID NO: 555418 - RNA, 64 nt, hsa; identical to SEQ ID NO: 164128

SEQ ID NO: 555419 - RNA, 64 nt, hsa; identical to SEQ ID NO: 164129

SEQ ID NO: 555420 - RNA, 64 nt, hsa; identical to SEQ ID NO: 164130

SEQ ID NO: 555421 - RNA, 64 nt, hsa; identical to SEQ ID NO: 247598

SEQ ID NO: 555422 - RNA, 64 nt, hsa; identical to SEQ ID NO: 247599

SEQ ID NO: 555423 - RNA, 64 nt, hsa; identical to SEQ ID NO: 247600

SEQ ID NO: 555424 - RNA, 64 nt, hsa; identical to SEQ ID NO: 247601

SEQ ID NO: 555425 - RNA, 64 nt, hsa; identical to SEQ ID NO: 247602

SEQ ID NO: 555426 - RNA, 64 nt, hsa; identical to SEQ ID NO: 247603

SEQ ID NO: 555427 - RNA, 64 nt, hsa; identical to SEQ ID NO: 247604

SEQ ID NO: 555428 - RNA, 64 nt, hsa; identical to SEQ ID NO: 247605

SEQ ID NO: 555429 - RNA, 64 nt, hsa; identical to SEQ ID NO: 247606

SEQ ID NO: 555430 - RNA, 64 nt, hsa; identical to SEQ ID NO: 247607

SEQ ID NO: 555431 - RNA, 64 nt, hsa; identical to SEQ ID NO: 247608

SEQ ID NO: 555432 - RNA, 64 nt, hsa; identical to SEQ ID NO: 247609

SEQ ID NO: 555433 - RNA, 64 nt, hsa; identical to SEQ ID NO: 247610

SEQ ID NO: 555434 - RNA, 64 nt, hsa; identical to SEQ ID NO: 247611

SEQ ID NO: 555435 - RNA, 64 nt, hsa; identical to SEQ ID NO: 247612

SEQ ID NO: 555436 - RNA, 64 nt, hsa; identical to SEQ ID NO: 247613

SEQ ID NO: 555437 - RNA, 58 nt, hsa; identical to SEQ ID NO: 244172

SEQ ID NO: 555438 - RNA, 64 nt, hsa; identical to SEQ ID NO: 244173

SEQ ID NO: 555439 - RNA, 64 nt, hsa; identical to SEQ ID NO: 244174

SEQ ID NO: 555440 - RNA, 64 nt, hsa; identical to SEQ ID NO: 244175

SEQ ID NO: 555441 - RNA, 64 nt, hsa; identical to SEQ ID NO: 244176

SEQ ID NO: 555442 - RNA, 64 nt, hsa; identical to SEQ ID NO: 244177

SEQ ID NO: 555443 - RNA, 64 nt, hsa; identical to SEQ ID NO: 244178

SEQ ID NO: 555444 - RNA, 64 nt, hsa; identical to SEQ ID NO: 244179

SEQ ID NO: 555445 - RNA, 64 nt, hsa; identical to SEQ ID NO: 244180

SEQ ID NO: 555446 - RNA, 64 nt, hsa; identical to SEQ ID NO: 244181

SEQ ID NO: 555447 - RNA, 64 nt, hsa; identical to SEQ ID NO: 244182

SEQ ID NO: 555448 - RNA, 64 nt, hsa; identical to SEQ ID NO: 244183

SEQ ID NO: 555449 - RNA, 64 nt, hsa; identical to SEQ ID NO: 244184

SEQ ID NO: 555450 - RNA, 64 nt, hsa; identical to SEQ ID NO: 244185

SEQ ID NO: 555451 - RNA, 64 nt, hsa; identical to SEQ ID NO: 244186

SEQ ID NO: 555452 - RNA, 64 nt, hsa; identical to SEQ ID NO: 244187

SEQ ID NO: 555453 - RNA, 64 nt, hsa; identical to SEQ ID NO: 244188

SEQ ID NO: 555454 - RNA, 64 nt, hsa; identical to SEQ ID NO: 244189

SEQ ID NO: 555455 - RNA, 64 nt, hsa; identical to SEQ ID NO: 244190

SEQ ID NO: 555456 - RNA, 64 nt, hsa; identical to SEQ ID NO: 244191

SEQ ID NO: 555457 - RNA, 64 nt, hsa; identical to SEQ ID NO: 244192

SEQ ID NO: 555458 - RNA, 64 nt, hsa; identical to SEQ ID NO: 244193

SEQ ID NO: 555459 - RNA, 64 nt, hsa; identical to SEQ ID NO: 244194

SEQ ID NO: 555460 - RNA, 64 nt, hsa; identical to SEQ ID NO: 244195

SEQ ID NO: 555461 - RNA, 64 nt, hsa
cuccaugguggaaguuaaagggcauuuccaaguuaaggcuaagacuugcuuuucuaacuaagag

SEQ ID NO: 555462 - RNA, 64 nt, hsa
uuacugguguccagcugaguuucucuuggguauaaaggcuaaaagggaaaaaggauauguggag

SEQ ID NO: 555463 - RNA, 64 nt, hsa
uggucucacucugucucucuaccuggucaucuucaaggcuaagaaaacaaacaagcuacauucu

SEQ ID NO: 555464 - RNA, 64 nt, hsa
agccuugggaauaguuuggcagguuuaacaucccaaggcuaaccuaacguaguugggaaaggua

SEQ ID NO: 555465 - RNA, 64 nt, hsa
gaacacaucuugaguauuuaggaaaugggcagugaaggcuaagaaccugguguguuucuuggga

SEQ ID NO: 555466 - RNA, 64 nt, hsa
aucaucuuuugaucuuuuaguuuuucccucagugaaggcuaaaugagauacacugauucuaggu

SEQ ID NO: 555467 - RNA, 64 nt, hsa
aauuauucaacuaagaaccaauaauggcuucuucaaggcuaauaucaauaguuuauaagcagua

SEQ ID NO: 555468 - RNA, 64 nt, hsa
gcuucuuuuaugagguguacuuuauacuuugaugaaggcuaagguguaccuaacagcuuuuuau

SEQ ID NO: 555469 - RNA, 64 nt, hsa
ggcauauaauccuuccacacagccccugcagggaaaggcuaaucuuacggauaauccacgugag

SEQ ID NO: 555470 - RNA, 64 nt, hsa
gugggguauuuguuucuacuccagccuggcaggcaaggcuaaaaccugagauuaucgaucuaug

SEQ ID NO: 555471 - RNA, 64 nt, hsa
uggaaucaucacaccuauccaugagcagugggaaaaggcuaauguaagcaguccccaccgggag

SEQ ID NO: 555472 - RNA, 64 nt, hsa
gucaaaaagccaaggaaaaaacagagcagaccugaaggcuaaucuuauuuuugccacuaacuua

SEQ ID NO: 555473 - RNA, 64 nt, hsa; identical to SEQ ID NO: 58764

SEQ ID NO: 555474 - RNA, 64 nt, hsa; identical to SEQ ID NO: 58765

SEQ ID NO: 555475 - RNA, 64 nt, hsa; identical to SEQ ID NO: 58766

SEQ ID NO: 555476 - RNA, 64 nt, hsa; identical to SEQ ID NO: 58767

SEQ ID NO: 555477 - RNA, 64 nt, hsa; identical to SEQ ID NO: 58768

SEQ ID NO: 555478 - RNA, 64 nt, hsa; identical to SEQ ID NO: 58769

SEQ ID NO: 555479 - RNA, 64 nt, hsa; identical to SEQ ID NO: 58770

SEQ ID NO: 555480 - RNA, 64 nt, hsa; identical to SEQ ID NO: 58771

SEQ ID NO: 555481 - RNA, 64 nt, hsa; identical to SEQ ID NO: 58772

SEQ ID NO: 555482 - RNA, 64 nt, hsa; identical to SEQ ID NO: 58773

SEQ ID NO: 555483 - RNA, 64 nt, hsa; identical to SEQ ID NO: 58774

SEQ ID NO: 555484 - RNA, 64 nt, hsa; identical to SEQ ID NO: 58775

SEQ ID NO: 555485 - RNA, 64 nt, hsa; identical to SEQ ID NO: 310971

SEQ ID NO: 555486 - RNA, 64 nt, hsa; identical to SEQ ID NO: 310972

SEQ ID NO: 555487 - RNA, 64 nt, hsa; identical to SEQ ID NO: 310973

SEQ ID NO: 555488 - RNA, 64 nt, hsa; identical to SEQ ID NO: 310974

SEQ ID NO: 555489 - RNA, 64 nt, hsa; identical to SEQ ID NO: 310975

SEQ ID NO: 555490 - RNA, 64 nt, hsa; identical to SEQ ID NO: 310976

SEQ ID NO: 555491 - RNA, 64 nt, hsa; identical to SEQ ID NO: 310977

SEQ ID NO: 555492 - RNA, 64 nt, hsa; identical to SEQ ID NO: 310978

SEQ ID NO: 555493 - RNA, 64 nt, hsa; identical to SEQ ID NO: 310979

SEQ ID NO: 555494 - RNA, 64 nt, hsa; identical to SEQ ID NO: 310980

SEQ ID NO: 555495 - RNA, 64 nt, hsa; identical to SEQ ID NO: 310981

SEQ ID NO: 555496 - RNA, 64 nt, hsa; identical to SEQ ID NO: 310982

SEQ ID NO: 555497 - RNA, 53 nt, hsa; identical to SEQ ID NO: 310983

SEQ ID NO: 555498 - RNA, 64 nt, hsa; identical to SEQ ID NO: 310984

SEQ ID NO: 555499 - RNA, 64 nt, hsa; identical to SEQ ID NO: 310985

SEQ ID NO: 555500 - RNA, 64 nt, hsa; identical to SEQ ID NO: 310986

SEQ ID NO: 555501 - RNA, 64 nt, hsa; identical to SEQ ID NO: 310987

SEQ ID NO: 555502 - RNA, 64 nt, hsa; identical to SEQ ID NO: 310988

SEQ ID NO: 555503 - RNA, 64 nt, hsa; identical to SEQ ID NO: 310989

SEQ ID NO: 555504 - RNA, 64 nt, hsa; identical to SEQ ID NO: 310990

SEQ ID NO: 555505 - RNA, 64 nt, hsa; identical to SEQ ID NO: 310991

SEQ ID NO: 555506 - RNA, 64 nt, hsa; identical to SEQ ID NO: 310992

SEQ ID NO: 555507 - RNA, 64 nt, hsa; identical to SEQ ID NO: 310993

SEQ ID NO: 555508 - RNA, 64 nt, hsa; identical to SEQ ID NO: 310994

SEQ ID NO: 555509 - RNA, 63 nt, hsa; identical to SEQ ID NO: 310995

SEQ ID NO: 555510 - RNA, 64 nt, hsa; identical to SEQ ID NO: 310996

SEQ ID NO: 555511 - RNA, 64 nt, hsa; identical to SEQ ID NO: 310997

SEQ ID NO: 555512 - RNA, 64 nt, hsa; identical to SEQ ID NO: 310998

SEQ ID NO: 555513 - RNA, 64 nt, hsa; identical to SEQ ID NO: 310999

SEQ ID NO: 555514 - RNA, 64 nt, hsa; identical to SEQ ID NO: 311000

SEQ ID NO: 555515 - RNA, 64 nt, hsa; identical to SEQ ID NO: 311001

SEQ ID NO: 555516 - RNA, 64 nt, hsa; identical to SEQ ID NO: 311002

SEQ ID NO: 555517 - RNA, 64 nt, hsa; identical to SEQ ID NO: 311003

SEQ ID NO: 555518 - RNA, 64 nt, hsa; identical to SEQ ID NO: 311004

SEQ ID NO: 555519 - RNA, 64 nt, hsa; identical to SEQ ID NO: 311005

SEQ ID NO: 555520 - RNA, 64 nt, hsa; identical to SEQ ID NO: 311006

SEQ ID NO: 555521 - RNA, 64 nt, hsa; identical to SEQ ID NO: 311007

SEQ ID NO: 555522 - RNA, 64 nt, hsa; identical to SEQ ID NO: 311008

SEQ ID NO: 555523 - RNA, 64 nt, hsa; identical to SEQ ID NO: 311009

SEQ ID NO: 555524 - RNA, 64 nt, hsa; identical to SEQ ID NO: 311010

SEQ ID NO: 555525 - RNA, 64 nt, hsa; identical to SEQ ID NO: 311011

SEQ ID NO: 555526 - RNA, 64 nt, hsa; identical to SEQ ID NO: 311012

SEQ ID NO: 555527 - RNA, 64 nt, hsa; identical to SEQ ID NO: 311013

SEQ ID NO: 555528 - RNA, 64 nt, hsa; identical to SEQ ID NO: 311014

SEQ ID NO: 555529 - RNA, 64 nt, hsa; identical to SEQ ID NO: 311015

SEQ ID NO: 555530 - RNA, 64 nt, hsa
ggacuaacuguaucacuuaauuuuuaccuuauuuuggcucuaauuugaauaagcugaguaaaac

SEQ ID NO: 555531 - RNA, 64 nt, hsa
ccuaaagauuuaucugcauauucuuuuucccauguggcucuacucauuugcaacugaauuuaau

SEQ ID NO: 555532 - RNA, 64 nt, hsa
aaacugaggcaacacuaacagcuaaugacccagauggcucuauuuggguaauuuaccuacaacu

SEQ ID NO: 555533 - RNA, 64 nt, hsa
auaguuaaugcugaauuuuuuuuuaaguuuccucuggcucuauuuauguuacuuuuugcgauaa

SEQ ID NO: 555534 - RNA, 61 nt, hsa
ggauaggagaaaguuggugaggaaggaauggagagagcaggaucccuggacucccuggucc

SEQ ID NO: 555535 - RNA, 61 nt, hsa
cagagaggaccagggugagaacuaaugcucaagagagcaagauucuguaauccucuugccc

SEQ ID NO: 555536 - RNA, 61 nt, hsa
gggaugagaaggauggcggggcuagggaagcagagagcagagcacacacuggcucaagcag

SEQ ID NO: 555537 - RNA, 61 nt, hsa
ggaaacuuuuaggugguggaaccagggaagcagagagcagagcaugcagugauggaagaag

SEQ ID NO: 555538 - RNA, 61 nt, hsa
aggcugcaggcagugucaggacagaggagguagagagcagggcauaugcugacccaugcag

SEQ ID NO: 555539 - RNA, 61 nt, hsa
aggaacaagugggcuuggggaauugaauagcagagagcaaaccaaucagucccucaggaaa

SEQ ID NO: 555540 - RNA, 61 nt, hsa
gccaggacccuggggccccucaacugcagucagagagcaagccccccaaaaaaaagaaaaa

SEQ ID NO: 555541 - RNA, 61 nt, hsa
gaaaagucacaagaugagcuugugacuaugaagagagcaaaagcuaacuuuuuuuuccuag

SEQ ID NO: 555542 - RNA, 61 nt, hsa
auuugaucccuugaacagaaagucaccaccgagagagcacccaggugggugguuucacauc

SEQ ID NO: 555543 - RNA, 61 nt, hsa
acaccuuugcccuggcucugcauugucaccuagagagcaagaggucuauagaaacaucaug

SEQ ID NO: 555544 - RNA, 61 nt, hsa
uauuaaugcagucaucccuuuucaggugggaagagagcaaaccaguugauuuuuuaauuca

SEQ ID NO: 555545 - RNA, 61 nt, hsa
uggcucaggcaucgucucccgcaaugggcagagagagcagagacagguggaccaacagaca

SEQ ID NO: 555546 - RNA, 61 nt, hsa
ggccuagccucucuguccuucccugagucacagagagcaagccaagacauccagggaaaga

SEQ ID NO: 555547 - RNA, 61 nt, hsa
uugcugcaaaacugguuggcuugcaacccagagagagcagcuucccuuggcucuggggccg

SEQ ID NO: 555548 - RNA, 61 nt, hsa
gccccgaagguccugccuucaccccauugggagagagcagggcauccuggcaucugcgauc

SEQ ID NO: 555549 - RNA, 61 nt, hsa
aaugacaucucaggggccagaggaacuguccagagagcaacucugagaucuaaggauguca

SEQ ID NO: 555550 - RNA, 61 nt, hsa
ccaacuugagggcccagagcaggaagcauucagagagcagcuuuaaacucagggacagagc

SEQ ID NO: 555551 - RNA, 61 nt, hsa
uuacuggguucuaaaugcucucugauaauucagagagcauugggucugggaagagguaaga

SEQ ID NO: 555552 - RNA, 61 nt, hsa
ucuuggagacagaugaugacuggcaaggacuagagagcaggagugccuggccaggucgguc

SEQ ID NO: 555553 - RNA, 61 nt, hsa
accugcucuguccccaaaggacgccugcaggagagagcagcacuccgcaucaccucaccaa

SEQ ID NO: 555554 - RNA, 61 nt, hsa
agacccccauuugucccagacuaaaggauccagagagcagcucccuuucucaggagcuugg

SEQ ID NO: 555555 - RNA, 61 nt, hsa
cucucugggcccaccaccugcaucugcgacuagagagcacccggcccacguuggguucuca

SEQ ID NO: 555556 - RNA, 61 nt, hsa
acugacauacuugauggaggauugauucgguagagagcaguagaaaucuuguucuaacugu

SEQ ID NO: 555557 - RNA, 61 nt, hsa
cagggcaggggaagcgaagagucagccuuggagagagcacccuggggccuccgugucgggg

SEQ ID NO: 555558 - RNA, 61 nt, hsa
cacuugccccacugugcuagggcgcgggaggagagagcacuguggucgcccucugcagcca

SEQ ID NO: 555559 - RNA, 61 nt, hsa
ucaucuaguaccuuuggaguagguuuaccagagagagcaaggaagcuucaaaacauugaua

SEQ ID NO: 555560 - RNA, 61 nt, hsa
aauucuagaaaguacuuuggccucgugcuguagagagcagauuucuaugguacccuguguu

SEQ ID NO: 555561 - RNA, 61 nt, hsa
gccugucuaccuuuagaagucuucgauucucagagagcauuugucuaauacaauaaaaacu

SEQ ID NO: 555562 - RNA, 61 nt, hsa
gagucgccgcagaugaccuagcugcggugugagagagcauggcccagacaagcagcugggu

SEQ ID NO: 555563 - RNA, 61 nt, hsa
gucauccucccuugccccaggccagguagcaagagagcagcgcccaggccugcuggcauca

SEQ ID NO: 555564 - RNA, 61 nt, hsa
gccaggcagaauggcugcacguagguuccccagagagcaggcaggggcaucugucugucug

SEQ ID NO: 555565 - RNA, 61 nt, hsa
cagcaggcucaucugugguucaccuguagacagagagcagaucaauguguacuucagacac

SEQ ID NO: 555566 - RNA, 61 nt, hsa
ggagcuauuuacaaauguccaugugggagagagagagcaugagagcacaguagcccagccu

SEQ ID NO: 555567 - RNA, 61 nt, hsa
uauucaauuuauugcaguuauagaauuggucagagagcauuuucauagugugcucauuucu

SEQ ID NO: 555568 - RNA, 61 nt, hsa
uuacuaaggccuucagugaacagaaaggagcagagagcaagauuagaucugagaagaugcu

SEQ ID NO: 555569 - RNA, 61 nt, hsa
aguaaggggcuuuguugaaagaggggguuagagagagcaagacagcacuugagugcacugg

SEQ ID NO: 555570 - RNA, 61 nt, hsa
ccuccauccagguacuggcucugagcaggacagagagcaugcagcaggugcucagcaauau

SEQ ID NO: 555571 - RNA, 61 nt, hsa
agggacugauugugcagguuuugcaaggcucagagagcaaaaguggauguugcagaaucuc

SEQ ID NO: 555572 - RNA, 61 nt, hsa
agaauagacuucaucaugugcuucagaagaaagagagcaugggcauguguuucaucgggaa

SEQ ID NO: 555573 - RNA, 61 nt, hsa
ucuguagguugguuccuguauaccuugggccagagagcaaacauagguggccugagagagc

SEQ ID NO: 555574 - RNA, 61 nt, hsa
guacagaggcuguuugggcagccuugccuccagagagcagauuccagcuucggaagccccu

SEQ ID NO: 555575 - RNA, 61 nt, hsa
gggggacaaguauucuggcggggggugggggagagagcaggcccugugguggcaggaggug

SEQ ID NO: 555576 - RNA, 61 nt, hsa
aaaaugaacguccaggacacaccuguaucccagagagcaaagugaugaggagacugagcgu

SEQ ID NO: 555577 - RNA, 61 nt, hsa
ccugcggcagaacagcacccgugacccacccagagagcaaggccaggggucuuggugcucc

SEQ ID NO: 555578 - RNA, 61 nt, hsa
ucuagucuucacgcugagagagcacuacuugagagagcaguugaaaguuucaaaaacuuug

SEQ ID NO: 555579 - RNA, 61 nt, hsa
uggguuuuaacaaauucuagucuucacgcugagagagcacuacuugagagagcaguugaaa

SEQ ID NO: 555580 - RNA, 64 nt, hsa
cacuggccccaguccauagaggggucaacuaugcuggcuggacuggcugccuuguuccuggccu

SEQ ID NO: 555581 - RNA, 64 nt, hsa
cccucagcugagcugaguaagggcuccuggggguuggcuggagauggguguggcaucuguccag

SEQ ID NO: 555582 - RNA, 64 nt, hsa
guaaugcugcuggcaucgccugcuuucucuccaguggcuggagacuucaagcugacuucauugu

SEQ ID NO: 555583 - RNA, 64 nt, hsa
uccaaggccaguuaaccaggcaagacacaagccuuggcuggaaaacugugguagagccgggcug

SEQ ID NO: 555584 - RNA, 64 nt, hsa
agugcgggccugggcccugcuccaccuccagaaguggcuggauguacccugccugaggccccga

SEQ ID NO: 555585 - RNA, 64 nt, hsa
cccaccacuccccgacacuauugccuucccagcauggcuggagugggaagaggcuugggccccg

SEQ ID NO: 555586 - RNA, 64 nt, hsa
gccagcaccgacucaccacagcccuucccagaccuggcuggaguggccggagcggcggggcuca

SEQ ID NO: 555587 - RNA, 64 nt, hsa
gugcccaagcccagcccugugcccccgcugaaccuggcuggaccgcgugugaaaggcagaacua

SEQ ID NO: 555588 - RNA, 64 nt, hsa
cggccacauggugcuggcucugaacguugguugguggcuggaaaacagcccugcuucugagggc

SEQ ID NO: 555589 - RNA, 64 nt, hsa
agcccuugccuugguuucuggaaguucuuuuccuuggcuggauuuacccagugguuagguugca

SEQ ID NO: 555590 - RNA, 64 nt, hsa
uguucagccuuaacaggcucagcaaaucagggcguggcuggacgauuuccuugcaucugagggc

SEQ ID NO: 555591 - RNA, 64 nt, hsa
uuuuaccaucaucgugaugccacuggagcuggaguggcuggauguggagcaccgcaccguggcu

SEQ ID NO: 555592 - RNA, 64 nt, hsa
gagcuggaguggcuggauguggagcaccgcaccguggcuggaguccugagcagcaccuucugga

SEQ ID NO: 555593 - RNA, 64 nt, hsa
ugcccccuggggaguuggggaaaggaacgaacccuggcuggaggggauaggagggcuuuuaauu

SEQ ID NO: 555594 - RNA, 64 nt, hsa
acucauccauuugugaggaggacuucucgcccucuggcuggaagcugauaccugaagcacuccc

SEQ ID NO: 555595 - RNA, 64 nt, hsa
aaggugccaccagucaguugugccuaugucccuuuggcuggaaaugcagaauaugaauugauua

SEQ ID NO: 555596 - RNA, 64 nt, hsa
guguggacauugaagcuugagcucucaaagcaguuggcuggaauacuuuugucagaauacggua

SEQ ID NO: 555597 - RNA, 64 nt, hsa
guacaggaaauacaguuaaugcagggccucuguguggcuggauccuccgucuccaucagaucag

SEQ ID NO: 555598 - RNA, 64 nt, hsa
ggccaucgccaagcacaaucagguggaggcugcauggcuggaaggccggauccggcaggaguuu

SEQ ID NO: 555599 - RNA, 64 nt, hsa
uggacugagaauuuggccacaaccaaauugaugcuggcuggaaccagaggccagaaagccuggc

SEQ ID NO: 555600 - RNA, 64 nt, hsa
gacuggggcggaugccagagaggcaggugggcuguggcuggacugguccggagcuggcuuccuu

SEQ ID NO: 555601 - RNA, 64 nt, hsa
gggucuuugggaaacuuugggucucacuguugccuggcuggagcacuuugguuuauagcuggaa

SEQ ID NO: 555602 - RNA, 64 nt, hsa
uguccagauguugcuggggccucacuuuuucucuuggcuggagguccaauugccagagccuccc

SEQ ID NO: 555603 - RNA, 64 nt, hsa
caagaaucgaggggcacaggagauucagagcaccuggcuggaguuuaaggccaaggcuuucucc

SEQ ID NO: 555604 - RNA, 64 nt, hsa
uuccccuggcgaucagagcucagguagcaccaucuggcuggaggggggcaccccccccauggau

SEQ ID NO: 555605 - RNA, 64 nt, hsa
aucccccugagggauucuugaugggcugagcagcuggcuggagcuaguacugacugacauucau

SEQ ID NO: 555606 - RNA, 64 nt, hsa
aggcaaacagcaccccagguacuccaggcccuccuggcuggagagggcuguggcaauagaaaau

SEQ ID NO: 555607 - RNA, 64 nt, hsa
aggccccugcagagggaugccuuaaagcugucccuggcuggaggagcacuccaccuuggggaua

SEQ ID NO: 555608 - RNA, 64 nt, hsa
agucaagccgugguccagcaaacuccucugcagauggcuggaguguugacccaggcuuguggcc

SEQ ID NO: 555609 - RNA, 64 nt, hsa
uuaaagaaaauaauuguauacgugucaacacagcuggcuggaugauugggacuuuaaaacgacc

SEQ ID NO: 555610 - RNA, 64 nt, hsa
gcugcccucccucugugugguccaagggcaagaguggcuggagccgggggacugugcuggucug

SEQ ID NO: 555611 - RNA, 64 nt, hsa
agccugagugaugcuuucccaggagcagggcagcuggcuggaccagaaaguagagggcccaugg

SEQ ID NO: 555612 - RNA, 64 nt, hsa
ccauuuggggugggcucuucaacaucucaggcuguggcuggaacaggacaggaugaucuaaaac

SEQ ID NO: 555613 - RNA, 64 nt, hsa
ggaggcccuggcucugaucccaggcuggauggaguggcuggaaggaaugguuccaaacaacacc

SEQ ID NO: 555614 - RNA, 64 nt, hsa
gauucuccuuggggcccagaggaagcugaugucauggcuggacaaagucacggaguaaagccag

SEQ ID NO: 555615 - RNA, 64 nt, hsa
cugacaggucuuaggaacagcaaggagcucaguguggcuggagcagaaaaaaauugucaguacc

SEQ ID NO: 555616 - RNA, 64 nt, hsa
cguacacacacaaacacaaaacuugcugaacaaauggcuggaugagugaaacaggaauggagca

SEQ ID NO: 555617 - RNA, 64 nt, hsa
ucauccacaugcguguugugugcucugcggugccuccuggcaaaggguccuggcucgggucaga

SEQ ID NO: 555618 - RNA, 64 nt, hsa
gucucuuuaccgauggguuccagacccaagguaguccuggcacugcccuguggacucagcccag

SEQ ID NO: 555619 - RNA, 64 nt, hsa
uaguccauuuacgauucucacugacuccccgucuuccuggcagacacaaauaaacccaguguca

SEQ ID NO: 555620 - RNA, 64 nt, hsa
ggcagagaccugggacucuguauuucuauaguucuccuggcagagccuuugagaauggggagaa

SEQ ID NO: 555621 - RNA, 64 nt, hsa
ccucuugcccuguccugcggggggccccacgaguuccuggcauucagcacugcuuagcauucuc

SEQ ID NO: 555622 - RNA, 64 nt, hsa
ugcccagcccucgucaccacagggacuccuuggguccuggcagugcaugugccagcaggcagga

SEQ ID NO: 555623 - RNA, 64 nt, hsa
caggcuucuggcuuccagaggugccgcgguggccuccuggcaucauuuguuauugccucugaaa

SEQ ID NO: 555624 - RNA, 64 nt, hsa
gcaccuucucugcuuuuaaucuuucagguuugacuccuggcacugguuuugauacuuggaauuu

SEQ ID NO: 555625 - RNA, 64 nt, hsa
uguggggcgggaaugaggaaaggggagggcaugauccuggcaaauagucuuuccuuuuccguaa

SEQ ID NO: 555626 - RNA, 64 nt, hsa
uuucauggcagaccuaagcucagacccugccuuguccuggcaagcauagguuuucccagaccac

SEQ ID NO: 555627 - RNA, 64 nt, hsa
cauuuuggacaugaguucaagggggcagguuaauuccuggcauugccaguuuucuucauucaga

SEQ ID NO: 555628 - RNA, 64 nt, hsa
ggaggcuggggaaaaccagcagggagcacuuggcuccuggcagagggagaggacaggaggagga

SEQ ID NO: 555629 - RNA, 64 nt, hsa
aguccaacauugccaugggggagggaagaguguguccuggcaggaagccaccauuggagaaggu

SEQ ID NO: 555630 - RNA, 64 nt, hsa
gaaugggaggcuggacccugaggaagggccccucuccuggcaucugucucuugcuaccuaagcc

SEQ ID NO: 555631 - RNA, 64 nt, hsa
gaaaagcagccccaggccucagacucgcuucccauccuggcauagagugggggauggcuggagg

SEQ ID NO: 555632 - RNA, 64 nt, hsa
gagucagaaaccaaagugaccuccagagcuguccuccuggcaccugaguguccuugcucuagag

SEQ ID NO: 555633 - RNA, 64 nt, hsa
gauggaacuccagggguggagggaaauuggcaguuccuggcaucucuuguguaccagcugcugu

SEQ ID NO: 555634 - RNA, 64 nt, hsa
uucucacugaagagagaaagcagaagguucuagauccuggcacagacugcaucccauguuccca

SEQ ID NO: 555635 - RNA, 64 nt, hsa
cccuggcccagaggcuccugaagaugcugggcgguccuggcacagggaggagcagcucuguaaa

SEQ ID NO: 555636 - RNA, 64 nt, hsa
aucaccagccucaaggccugaggggugcaggggcuccuggcagcuacugggugagguuuccugg

SEQ ID NO: 555637 - RNA, 64 nt, hsa
gugcaggggcuccuggcagcuacugggugagguuuccuggcacagacucacccuucuuucuggc

SEQ ID NO: 555638 - RNA, 64 nt, hsa
cuggugcuaacacaggagcuacaccuugauccucuccuggcaugaaaauaaaacaaagguuuuc

SEQ ID NO: 555639 - RNA, 64 nt, hsa
uuugggagcagaggaaaacucugcugauguucgguccuggcaaacauugaguuauuuugagcug

SEQ ID NO: 555640 - RNA, 64 nt, hsa
gccgggucccaaauguucaggccccaagucuagauccuggcagcccagucacagaguaucccac

SEQ ID NO: 555641 - RNA, 64 nt, hsa
caagugcgggggccccaguggcacagcaaguggauccuggcaacugcagcugcuggauuccaga

SEQ ID NO: 555642 - RNA, 64 nt, hsa
cugugggcgacuaagugccacucacgcagcauguuccuggcaaggagcacauaccaucaagcca

SEQ ID NO: 555643 - RNA, 64 nt, hsa
ugaagagcugucaugaaggagggagggagcacauuccuggcagagaaaacagcacgugcaaagg

SEQ ID NO: 555644 - RNA, 64 nt, hsa
aaaaguagaaaaaugucacguuuccauaucuccugcuggaaaucagaaaauauaauaaaauugc

SEQ ID NO: 555645 - RNA, 64 nt, hsa
cauugaaucaauggaucuguugaagaacucagcugcuggaaaccaugcaaaauguuuugaauug

SEQ ID NO: 555646 - RNA, 64 nt, hsa
uccaagcaugggaccaaggaggccagaaccugucgcuggaaaccagggcaaagcaguggcucag

SEQ ID NO: 555647 - RNA, 64 nt, hsa
caaggccaguuaaccaggcaagacacaagccuuggcuggaaaacugugguagagccgggcugug

SEQ ID NO: 555648 - RNA, 64 nt, hsa
uuuuucagucauauaaaagcuauggugagaugcagcuggaaaagggucuugggaaauaugaaug

SEQ ID NO: 555649 - RNA, 64 nt, hsa
gagggugacaagauagagagcuauuuaauggccggcuggaaaugcugggcugacggugcagucu

SEQ ID NO: 555650 - RNA, 64 nt, hsa
agacagagucacuugguugcugagucacuugguugcuggaaaaaucuuuggggaaagcugguau

SEQ ID NO: 555651 - RNA, 64 nt, hsa
auuaugccauuuauaaacugcucugaaaccugaagcuggaaagauaacagauggguuucugagc

SEQ ID NO: 555652 - RNA, 64 nt, hsa
ggguuccugugauuaauuuugugaugacuaaaaugcuggaaagcgagugaguugcccauuaauu

SEQ ID NO: 555653 - RNA, 64 nt, hsa
uugaauuagcauaauugggccauggaacacauaugcuggaaaucuuugaaccauuucaagucuc

SEQ ID NO: 555654 - RNA, 64 nt, hsa
ggugccaccagucaguugugccuaugucccuuuggcuggaaaugcagaauaugaauugauuagu

SEQ ID NO: 555655 - RNA, 64 nt, hsa
uuuugccucacuuaauuccagccuuuuguuuucugcuggaaaauaaguguggacauugaagcuu

SEQ ID NO: 555656 - RNA, 64 nt, hsa
ucuaccuggagccccuggggcggugcuggccaaugcuggaaacauucacuuuccugcagccucu

SEQ ID NO: 555657 - RNA, 64 nt, hsa
augugcucguacucccucggccugggauuucagagcuggaaauauagaaaauaucuagcccaaa

SEQ ID NO: 555658 - RNA, 64 nt, hsa
gugucgggaaaugugugacuuaaccguggugagggcuggaaauccaaacucaccaccaugaucu

SEQ ID NO: 555659 - RNA, 64 nt, hsa
guaucuccugacagagguacuuaacaauggcucugcuggaaauuucuauaaauaaaauguccaa

SEQ ID NO: 555660 - RNA, 64 nt, hsa
gucauagagcugcaggguggauuguuacagcuucgcuggaaaccucuggaggucaucucggcug

SEQ ID NO: 555661 - RNA, 64 nt, hsa
auaacuguugcuuaguaauuggcuuuguagagaagcuggaaaaaaaugguuuugucuucaacuc

SEQ ID NO: 555662 - RNA, 64 nt, hsa
gcugcguaauuacccuucagcucuuaguuccucugcuggaaacaucaugccaacaacuuacauc

SEQ ID NO: 555663 - RNA, 64 nt, hsa
cuucaacgaauuaugaaaucuguaccaaccaacggcuggaaaugcaaaguaaguuguuuacuuu

SEQ ID NO: 555664 - RNA, 64 nt, hsa; identical to SEQ ID NO: 164727

SEQ ID NO: 555665 - RNA, 64 nt, hsa; identical to SEQ ID NO: 164728

SEQ ID NO: 555666 - RNA, 64 nt, hsa; identical to SEQ ID NO: 164729

SEQ ID NO: 555667 - RNA, 64 nt, hsa; identical to SEQ ID NO: 164730

SEQ ID NO: 555668 - RNA, 64 nt, hsa; identical to SEQ ID NO: 164731

SEQ ID NO: 555669 - RNA, 64 nt, hsa; identical to SEQ ID NO: 164732

SEQ ID NO: 555670 - RNA, 64 nt, hsa; identical to SEQ ID NO: 164733

SEQ ID NO: 555671 - RNA, 64 nt, hsa; identical to SEQ ID NO: 164734

SEQ ID NO: 555672 - RNA, 64 nt, hsa; identical to SEQ ID NO: 164735

SEQ ID NO: 555673 - RNA, 64 nt, hsa; identical to SEQ ID NO: 164736

SEQ ID NO: 555674 - RNA, 64 nt, hsa; identical to SEQ ID NO: 164737

SEQ ID NO: 555675 - RNA, 64 nt, hsa; identical to SEQ ID NO: 164738

SEQ ID NO: 555676 - RNA, 64 nt, hsa; identical to SEQ ID NO: 164739

SEQ ID NO: 555677 - RNA, 64 nt, hsa; identical to SEQ ID NO: 164740

SEQ ID NO: 555678 - RNA, 64 nt, hsa; identical to SEQ ID NO: 164741

SEQ ID NO: 555679 - RNA, 64 nt, hsa; identical to SEQ ID NO: 164742

SEQ ID NO: 555680 - RNA, 52 nt, hsa; identical to SEQ ID NO: 164743

SEQ ID NO: 555681 - RNA, 64 nt, hsa; identical to SEQ ID NO: 164744

SEQ ID NO: 555682 - RNA, 64 nt, hsa; identical to SEQ ID NO: 164745

SEQ ID NO: 555683 - RNA, 64 nt, hsa; identical to SEQ ID NO: 164746

SEQ ID NO: 555684 - RNA, 64 nt, hsa; identical to SEQ ID NO: 164747

SEQ ID NO: 555685 - RNA, 64 nt, hsa; identical to SEQ ID NO: 164748

SEQ ID NO: 555686 - RNA, 64 nt, hsa; identical to SEQ ID NO: 164749

SEQ ID NO: 555687 - RNA, 64 nt, hsa; identical to SEQ ID NO: 164750

SEQ ID NO: 555688 - RNA, 64 nt, hsa; identical to SEQ ID NO: 164751

SEQ ID NO: 555689 - RNA, 64 nt, hsa; identical to SEQ ID NO: 164752

SEQ ID NO: 555690 - RNA, 64 nt, hsa; identical to SEQ ID NO: 164753

SEQ ID NO: 555691 - RNA, 64 nt, hsa; identical to SEQ ID NO: 164754

SEQ ID NO: 555692 - RNA, 64 nt, hsa; identical to SEQ ID NO: 164755

SEQ ID NO: 555693 - RNA, 64 nt, hsa; identical to SEQ ID NO: 164756

SEQ ID NO: 555694 - RNA, 64 nt, hsa; identical to SEQ ID NO: 164757

SEQ ID NO: 555695 - RNA, 64 nt, hsa; identical to SEQ ID NO: 164758

SEQ ID NO: 555696 - RNA, 64 nt, hsa; identical to SEQ ID NO: 164759

SEQ ID NO: 555697 - RNA, 64 nt, hsa; identical to SEQ ID NO: 164760

SEQ ID NO: 555698 - RNA, 64 nt, hsa; identical to SEQ ID NO: 164761

SEQ ID NO: 555699 - RNA, 64 nt, hsa; identical to SEQ ID NO: 164762

SEQ ID NO: 555700 - RNA, 64 nt, hsa; identical to SEQ ID NO: 164763

SEQ ID NO: 555701 - RNA, 64 nt, hsa; identical to SEQ ID NO: 164764

SEQ ID NO: 555702 - RNA, 64 nt, hsa; identical to SEQ ID NO: 164765

SEQ ID NO: 555703 - RNA, 64 nt, hsa; identical to SEQ ID NO: 164766

SEQ ID NO: 555704 - RNA, 64 nt, hsa; identical to SEQ ID NO: 164767

SEQ ID NO: 555705 - RNA, 64 nt, hsa; identical to SEQ ID NO: 164768

SEQ ID NO: 555706 - RNA, 64 nt, hsa; identical to SEQ ID NO: 164769

SEQ ID NO: 555707 - RNA, 64 nt, hsa; identical to SEQ ID NO: 164770

SEQ ID NO: 555708 - RNA, 64 nt, hsa; identical to SEQ ID NO: 164771

SEQ ID NO: 555709 - RNA, 64 nt, hsa; identical to SEQ ID NO: 164772

SEQ ID NO: 555710 - RNA, 64 nt, hsa; identical to SEQ ID NO: 164773

SEQ ID NO: 555711 - RNA, 64 nt, hsa; identical to SEQ ID NO: 164774

SEQ ID NO: 555712 - RNA, 64 nt, hsa; identical to SEQ ID NO: 164775

SEQ ID NO: 555713 - RNA, 64 nt, hsa; identical to SEQ ID NO: 164776

SEQ ID NO: 555714 - RNA, 64 nt, hsa; identical to SEQ ID NO: 164777

SEQ ID NO: 555715 - RNA, 64 nt, hsa; identical to SEQ ID NO: 164778

SEQ ID NO: 555716 - RNA, 64 nt, hsa; identical to SEQ ID NO: 164779

SEQ ID NO: 555717 - RNA, 64 nt, hsa; identical to SEQ ID NO: 506912

SEQ ID NO: 555718 - RNA, 64 nt, hsa; identical to SEQ ID NO: 506913

SEQ ID NO: 555719 - RNA, 64 nt, hsa; identical to SEQ ID NO: 506914

SEQ ID NO: 555720 - RNA, 64 nt, hsa; identical to SEQ ID NO: 506915

SEQ ID NO: 555721 - RNA, 64 nt, hsa; identical to SEQ ID NO: 506916

SEQ ID NO: 555722 - RNA, 64 nt, hsa; identical to SEQ ID NO: 506917

SEQ ID NO: 555723 - RNA, 64 nt, hsa; identical to SEQ ID NO: 506918

SEQ ID NO: 555724 - RNA, 64 nt, hsa; identical to SEQ ID NO: 506919

SEQ ID NO: 555725 - RNA, 64 nt, hsa; identical to SEQ ID NO: 506920

SEQ ID NO: 555726 - RNA, 64 nt, hsa; identical to SEQ ID NO: 506921

SEQ ID NO: 555727 - RNA, 64 nt, hsa
cugaacuaacuuggggaaacaauuucuagguugaagcugguaacacucaugucuguugagugcc

SEQ ID NO: 555728 - RNA, 64 nt, hsa
cugcuccauguccuuguguggcugcuccagcgagagcugguaacuagguagacugcugcucuaa

SEQ ID NO: 555729 - RNA, 64 nt, hsa; identical to SEQ ID NO: 133159

SEQ ID NO: 555730 - RNA, 64 nt, hsa; identical to SEQ ID NO: 133160

SEQ ID NO: 555731 - RNA, 64 nt, hsa; identical to SEQ ID NO: 133161

SEQ ID NO: 555732 - RNA, 64 nt, hsa; identical to SEQ ID NO: 133162

SEQ ID NO: 555733 - RNA, 64 nt, hsa; identical to SEQ ID NO: 133163

SEQ ID NO: 555734 - RNA, 64 nt, hsa; identical to SEQ ID NO: 133164

SEQ ID NO: 555735 - RNA, 64 nt, hsa; identical to SEQ ID NO: 133165

SEQ ID NO: 555736 - RNA, 64 nt, hsa; identical to SEQ ID NO: 133166

SEQ ID NO: 555737 - RNA, 64 nt, hsa; identical to SEQ ID NO: 133167

SEQ ID NO: 555738 - RNA, 64 nt, hsa; identical to SEQ ID NO: 133168

SEQ ID NO: 555739 - RNA, 64 nt, hsa; identical to SEQ ID NO: 133169

SEQ ID NO: 555740 - RNA, 64 nt, hsa; identical to SEQ ID NO: 133170

SEQ ID NO: 555741 - RNA, 64 nt, hsa; identical to SEQ ID NO: 133171

SEQ ID NO: 555742 - RNA, 64 nt, hsa; identical to SEQ ID NO: 133172

SEQ ID NO: 555743 - RNA, 64 nt, hsa; identical to SEQ ID NO: 133173

SEQ ID NO: 555744 - RNA, 64 nt, hsa; identical to SEQ ID NO: 133174

SEQ ID NO: 555745 - RNA, 64 nt, hsa; identical to SEQ ID NO: 133175

SEQ ID NO: 555746 - RNA, 64 nt, hsa; identical to SEQ ID NO: 133176

SEQ ID NO: 555747 - RNA, 64 nt, hsa; identical to SEQ ID NO: 133177

SEQ ID NO: 555748 - RNA, 64 nt, hsa; identical to SEQ ID NO: 133178

SEQ ID NO: 555749 - RNA, 64 nt, hsa; identical to SEQ ID NO: 133179

SEQ ID NO: 555750 - RNA, 64 nt, hsa; identical to SEQ ID NO: 133180

SEQ ID NO: 555751 - RNA, 64 nt, hsa; identical to SEQ ID NO: 133181

SEQ ID NO: 555752 - RNA, 64 nt, hsa; identical to SEQ ID NO: 133182

SEQ ID NO: 555753 - RNA, 64 nt, hsa; identical to SEQ ID NO: 133183

SEQ ID NO: 555754 - RNA, 64 nt, hsa; identical to SEQ ID NO: 133184

SEQ ID NO: 555755 - RNA, 64 nt, hsa; identical to SEQ ID NO: 133185

SEQ ID NO: 555756 - RNA, 64 nt, hsa; identical to SEQ ID NO: 133186

SEQ ID NO: 555757 - RNA, 64 nt, hsa; identical to SEQ ID NO: 133187

SEQ ID NO: 555758 - RNA, 64 nt, hsa; identical to SEQ ID NO: 133188

SEQ ID NO: 555759 - RNA, 64 nt, hsa; identical to SEQ ID NO: 133189

SEQ ID NO: 555760 - RNA, 64 nt, hsa; identical to SEQ ID NO: 133190

SEQ ID NO: 555761 - RNA, 64 nt, hsa; identical to SEQ ID NO: 133191

SEQ ID NO: 555762 - RNA, 64 nt, hsa; identical to SEQ ID NO: 133192

SEQ ID NO: 555763 - RNA, 64 nt, hsa; identical to SEQ ID NO: 133193

SEQ ID NO: 555764 - RNA, 64 nt, hsa; identical to SEQ ID NO: 133194

SEQ ID NO: 555765 - RNA, 64 nt, hsa; identical to SEQ ID NO: 133195

SEQ ID NO: 555766 - RNA, 64 nt, hsa; identical to SEQ ID NO: 133196

SEQ ID NO: 555767 - RNA, 64 nt, hsa; identical to SEQ ID NO: 133197

SEQ ID NO: 555768 - RNA, 64 nt, hsa; identical to SEQ ID NO: 133198

SEQ ID NO: 555769 - RNA, 64 nt, hsa; identical to SEQ ID NO: 133199

SEQ ID NO: 555770 - RNA, 64 nt, hsa; identical to SEQ ID NO: 133200

SEQ ID NO: 555771 - RNA, 64 nt, hsa; identical to SEQ ID NO: 133201

SEQ ID NO: 555772 - RNA, 64 nt, hsa; identical to SEQ ID NO: 133202

SEQ ID NO: 555773 - RNA, 64 nt, hsa; identical to SEQ ID NO: 133203

SEQ ID NO: 555774 - RNA, 64 nt, hsa
caccacgaacucucugccugagacuggggaaguaagcggguaucuucucagugagcauagguug

SEQ ID NO: 555775 - RNA, 64 nt, hsa
cucuccccgcuacaggcugcaggcacugcagggcagcggguauucuccuccccaccuaagucuc

SEQ ID NO: 555776 - RNA, 64 nt, hsa
agauugacaagagaaaaacaaacauaaauuuauuagcggguauauguaauauauaugugggaaa

SEQ ID NO: 555777 - RNA, 64 nt, hsa
gccucccaucugacuacagccaggguggggacucagcggguauaaagcuagugugacccugcuc

SEQ ID NO: 555778 - RNA, 64 nt, hsa
cggccccaccagguacugaaagacccgcaggcugagcggguagaacagccggguagggcagaua

SEQ ID NO: 555779 - RNA, 64 nt, hsa
uuucccugggcugagaggggaagugcauauguguagcggguacugguuccugugucuuagggca

SEQ ID NO: 555780 - RNA, 64 nt, hsa
gcugcuauuuugauggugaccggagcuggcgggcagcggguacgcgguggcaccccguugugcc

SEQ ID NO: 555781 - RNA, 64 nt, hsa
agcaagccuacuucgcauuucuuccucggccaucagcggguaacagugcugacugcugccaagg

SEQ ID NO: 555782 - RNA, 64 nt, hsa
cgggcgagccagggcccgggcgggcgagugggcgagcggguaggcccaaggcuauugucgucgc

SEQ ID NO: 555783 - RNA, 64 nt, hsa
ugggguuuguuuuguuuugauuuuuuuuuuuuaaagcggguaaaagagaaaacacugaaaauug

SEQ ID NO: 555784 - RNA, 64 nt, hsa
caaaaaacggguauucuagucaucuugggguaaaagcggguaaugaacauuccuauccccaaca

SEQ ID NO: 555785 - RNA, 64 nt, hsa
gaauggggugggugguagacccaacucaucaggcagcggguagggcacagggaagagggagggu

SEQ ID NO: 555786 - RNA, 64 nt, hsa
cucucuagcuccagcagguggcaccucgguacccagcggguagggcgauaauuuauauauuuuc

SEQ ID NO: 555787 - RNA, 64 nt, hsa
gugggggggagaagaagaauuggccaucuuaaaaagcggguaaaaaaccuggguuagggugugu

SEQ ID NO: 555788 - RNA, 64 nt, hsa
agugaacuucaguuuuacaaucuguaugccuaaaagcggguacuaccguuuauuuuacugacuu

SEQ ID NO: 555789 - RNA, 64 nt, hsa
cugccuuccucuagugcagccuggaagacauggcagcggguagcuccuggggcugagccagaag

SEQ ID NO: 555790 - RNA, 64 nt, hsa
aaaaaaugcugcagaucuagaaaugcauauauuuagcggguauuugaaagauagaagcauuauu

SEQ ID NO: 555791 - RNA, 64 nt, hsa
ggcgagucucuuccccugucugggccaaacagggagcggguaagacaauccaugcucuaagauc

SEQ ID NO: 555792 - RNA, 64 nt, hsa
aagcucaucccaagcaaggagccccagucucccgagcggguaggagaguuucuugcagaacgug

SEQ ID NO: 555793 - RNA, 64 nt, hsa
gcucacauacaggacagccagcaguaggcuguggagcggguaggagagagauggcugauacugc

SEQ ID NO: 555794 - RNA, 64 nt, hsa
gcuuuugcugaggugugacauggcccccaagcagagcggguaaagugcaauggguaagggaggg

SEQ ID NO: 555795 - RNA, 64 nt, hsa
cacccucugcagggcagccugugggagaagggacagcggguaaaaagagaaggcaagcuggcag

SEQ ID NO: 555796 - RNA, 64 nt, hsa
cgccccgcugccuuucccaggcuccccucaccccagcggguaaugagcccuuaaucgcugccuc

SEQ ID NO: 555797 - RNA, 64 nt, hsa
caagccgggcacccaacccuggaugccaccccccagcggguaccagaggaaagcuggcagcagg

SEQ ID NO: 555798 - RNA, 64 nt, hsa
gaccgcugcccacagauccagguguuggaagggcagcggguaagguucccaagccagccccaac

SEQ ID NO: 555799 - RNA, 64 nt, hsa
uuguaauuuuuaauaugcucuuucaguguaucucagcggguacuccagcuuguggcauucccau

SEQ ID NO: 555800 - RNA, 64 nt, hsa
ugguggggaaacagaggcccaggguggagaccuaagcggguauaagaccagguggccugcuccu

SEQ ID NO: 555801 - RNA, 64 nt, hsa
aauuuccuucaggcagcugaaauucaccaagaacagcggguacuuauuucucagcugugccuuc

SEQ ID NO: 555802 - RNA, 64 nt, hsa
aaggacugacucaagcugugucuuucagaccaaggaacaucagagaagcuguggggcugccugc

SEQ ID NO: 555803 - RNA, 64 nt, hsa
uuuuuuccucccaguuuccaaacaagcccucagugaacaucauugaagcgugacugccugucug

SEQ ID NO: 555804 - RNA, 64 nt, hsa
agauuuucauauaauguauuaaagacaaaguagugaacaucaaugaacaucugauagagauaaa

SEQ ID NO: 555805 - RNA, 64 nt, hsa
uauaucugugcuucauaaauauuaauguucuucagaacaucauuuuaaaggagauacuugaauu

SEQ ID NO: 555806 - RNA, 64 nt, hsa
cuuauuucccuaccuuauuaagacuaaauaaguggaacaucauagagcucuuuauuuauaacag

SEQ ID NO: 555807 - RNA, 64 nt, hsa
gcugggauuacaagcauaagcaccacaccuggcugaacaucagauauuuuaaaguguagcccag

SEQ ID NO: 555808 - RNA, 64 nt, hsa
caguaaccagguaauauuggcaaaggcaucucaggaacaucaccuuagugaggaaacaaaaugu

SEQ ID NO: 555809 - RNA, 64 nt, hsa
uugugaauuuucugagacggauguaacaaauacugaacaucaucaacccaguaauaaugauuug

SEQ ID NO: 555810 - RNA, 64 nt, hsa; identical to SEQ ID NO: 370212

SEQ ID NO: 555811 - RNA, 64 nt, hsa; identical to SEQ ID NO: 370213

SEQ ID NO: 555812 - RNA, 64 nt, hsa; identical to SEQ ID NO: 370214

SEQ ID NO: 555813 - RNA, 64 nt, hsa; identical to SEQ ID NO: 370215

SEQ ID NO: 555814 - RNA, 64 nt, hsa; identical to SEQ ID NO: 491481

SEQ ID NO: 555815 - RNA, 64 nt, hsa; identical to SEQ ID NO: 491482

SEQ ID NO: 555816 - RNA, 64 nt, hsa; identical to SEQ ID NO: 491483

SEQ ID NO: 555817 - RNA, 64 nt, hsa; identical to SEQ ID NO: 491484

SEQ ID NO: 555818 - RNA, 64 nt, hsa; identical to SEQ ID NO: 491485

SEQ ID NO: 555819 - RNA, 64 nt, hsa; identical to SEQ ID NO: 491486

SEQ ID NO: 555820 - RNA, 64 nt, hsa; identical to SEQ ID NO: 491487

SEQ ID NO: 555821 - RNA, 64 nt, hsa; identical to SEQ ID NO: 491488

SEQ ID NO: 555822 - RNA, 64 nt, hsa; identical to SEQ ID NO: 491489

SEQ ID NO: 555823 - RNA, 64 nt, hsa; identical to SEQ ID NO: 491490

SEQ ID NO: 555824 - RNA, 64 nt, hsa; identical to SEQ ID NO: 491491

SEQ ID NO: 555825 - RNA, 64 nt, hsa; identical to SEQ ID NO: 491492

SEQ ID NO: 555826 - RNA, 64 nt, hsa; identical to SEQ ID NO: 491493

SEQ ID NO: 555827 - RNA, 64 nt, hsa; identical to SEQ ID NO: 491494

SEQ ID NO: 555828 - RNA, 64 nt, hsa; identical to SEQ ID NO: 491495

SEQ ID NO: 555829 - RNA, 64 nt, hsa; identical to SEQ ID NO: 491496

SEQ ID NO: 555830 - RNA, 64 nt, hsa; identical to SEQ ID NO: 491497

SEQ ID NO: 555831 - RNA, 64 nt, hsa; identical to SEQ ID NO: 491498

SEQ ID NO: 555832 - RNA, 64 nt, hsa; identical to SEQ ID NO: 491499

SEQ ID NO: 555833 - RNA, 64 nt, hsa; identical to SEQ ID NO: 491500

SEQ ID NO: 555834 - RNA, 64 nt, hsa; identical to SEQ ID NO: 491501

SEQ ID NO: 555835 - RNA, 64 nt, hsa; identical to SEQ ID NO: 491502

SEQ ID NO: 555836 - RNA, 64 nt, hsa; identical to SEQ ID NO: 491503

SEQ ID NO: 555837 - RNA, 64 nt, hsa; identical to SEQ ID NO: 491504

SEQ ID NO: 555838 - RNA, 64 nt, hsa; identical to SEQ ID NO: 491505

SEQ ID NO: 555839 - RNA, 64 nt, hsa; identical to SEQ ID NO: 491506

SEQ ID NO: 555840 - RNA, 64 nt, hsa; identical to SEQ ID NO: 491507

SEQ ID NO: 555841 - RNA, 64 nt, hsa; identical to SEQ ID NO: 491508

SEQ ID NO: 555842 - RNA, 64 nt, hsa; identical to SEQ ID NO: 491509

SEQ ID NO: 555843 - RNA, 64 nt, hsa; identical to SEQ ID NO: 491510

SEQ ID NO: 555844 - RNA, 64 nt, hsa; identical to SEQ ID NO: 491511

SEQ ID NO: 555845 - RNA, 64 nt, hsa; identical to SEQ ID NO: 491512

SEQ ID NO: 555846 - RNA, 64 nt, hsa; identical to SEQ ID NO: 491513

SEQ ID NO: 555847 - RNA, 64 nt, hsa; identical to SEQ ID NO: 491514

SEQ ID NO: 555848 - RNA, 64 nt, hsa; identical to SEQ ID NO: 491515

SEQ ID NO: 555849 - RNA, 64 nt, hsa; identical to SEQ ID NO: 491516

SEQ ID NO: 555850 - RNA, 64 nt, hsa; identical to SEQ ID NO: 491517

SEQ ID NO: 555851 - RNA, 64 nt, hsa; identical to SEQ ID NO: 491518

SEQ ID NO: 555852 - RNA, 64 nt, hsa; identical to SEQ ID NO: 491519

SEQ ID NO: 555853 - RNA, 64 nt, hsa; identical to SEQ ID NO: 491520

SEQ ID NO: 555854 - RNA, 64 nt, hsa; identical to SEQ ID NO: 491521

SEQ ID NO: 555855 - RNA, 64 nt, hsa; identical to SEQ ID NO: 491522

SEQ ID NO: 555856 - RNA, 64 nt, hsa; identical to SEQ ID NO: 491523

SEQ ID NO: 555857 - RNA, 64 nt, hsa
agcugagguuaagccuucuuuugggauuugcauuguaauugagggcccuggaagaucucugaga

SEQ ID NO: 555858 - RNA, 64 nt, hsa
gcagagaacuacuuuggaaaacaguuuaucugcuguaauugaacauucagcuacccuauaaccc

SEQ ID NO: 555859 - RNA, 64 nt, hsa
cuugguuauguaaaaaugaaauuuuuuagacacaguaauugaacuguauuccuguuuuguauau

SEQ ID NO: 555860 - RNA, 64 nt, hsa
guggucugcagacauugaugaagaaaaucuguugguaauugauacaugggcuaaagcaucagag

SEQ ID NO: 555861 - RNA, 64 nt, hsa
ugaauuucagucugcugcuuuguaaaaaauaacuguaauugauauuucauuuuuaaaauuuaua

SEQ ID NO: 555862 - RNA, 64 nt, hsa
gccacaguuuacagugucauucuuccacgaauagguaauugauagaguuuaugggucuuagucu

SEQ ID NO: 555863 - RNA, 64 nt, hsa; identical to SEQ ID NO: 126265

SEQ ID NO: 555864 - RNA, 64 nt, hsa; identical to SEQ ID NO: 126266

SEQ ID NO: 555865 - RNA, 64 nt, hsa; identical to SEQ ID NO: 126267

SEQ ID NO: 555866 - RNA, 64 nt, hsa; identical to SEQ ID NO: 126268

SEQ ID NO: 555867 - RNA, 64 nt, hsa; identical to SEQ ID NO: 126269

SEQ ID NO: 555868 - RNA, 64 nt, hsa; identical to SEQ ID NO: 126270

SEQ ID NO: 555869 - RNA, 64 nt, hsa; identical to SEQ ID NO: 126271

SEQ ID NO: 555870 - RNA, 64 nt, hsa; identical to SEQ ID NO: 126272

SEQ ID NO: 555871 - RNA, 64 nt, hsa; identical to SEQ ID NO: 126273

SEQ ID NO: 555872 - RNA, 64 nt, hsa; identical to SEQ ID NO: 126274

SEQ ID NO: 555873 - RNA, 64 nt, hsa; identical to SEQ ID NO: 126275

SEQ ID NO: 555874 - RNA, 64 nt, hsa; identical to SEQ ID NO: 126276

SEQ ID NO: 555875 - RNA, 64 nt, hsa; identical to SEQ ID NO: 126277

SEQ ID NO: 555876 - RNA, 64 nt, hsa; identical to SEQ ID NO: 126278

SEQ ID NO: 555877 - RNA, 64 nt, hsa; identical to SEQ ID NO: 126279

SEQ ID NO: 555878 - RNA, 64 nt, hsa; identical to SEQ ID NO: 126280

SEQ ID NO: 555879 - RNA, 64 nt, hsa
uaaguaauuuuuuuuucauuucaaauaaauaccuauuuaccaccaaaagaaagaaaaagaaaag

SEQ ID NO: 555880 - RNA, 64 nt, hsa
ucucuggauaucuuucuguguuccauguaaauuuauuuaccaacaucuauugucaacauguaca

SEQ ID NO: 555881 - RNA, 64 nt, hsa
aaaauauauuugcauaauaugcauauauauguauauuuaccaagauuuuguuucuuacgcuugc

SEQ ID NO: 555882 - RNA, 64 nt, hsa
acacauacauauauacauuuugcagcuauggacaauuuaccacaggaugcauauuaaagaaagu

SEQ ID NO: 555883 - RNA, 64 nt, hsa
gugaaaguggcaagcucuucauugcacugcaguuauuuaccagaaguuuaaaucuuuguuaaaa

SEQ ID NO: 555884 - RNA, 64 nt, hsa
aaagaaguccaugugauaauuguaaaggugaugaauuuaccaucaaacaaaucauuuugaugua

SEQ ID NO: 555885 - RNA, 64 nt, hsa
uuauaaacuuuugugugugcuguggcagggaacaguuaacaaggaguuuauuuagagggguuuu

SEQ ID NO: 555886 - RNA, 64 nt, hsa
aucuacuacuauccauaaaugcaauaauaugcauguuaacaacauuaaaaacagcaaacagcaa

SEQ ID NO: 555887 - RNA, 64 nt, hsa
ucccuuuuuaauuuuuuuaacagcaauggaggaaguuaacaauuuuuaauggaaagagcauguu

SEQ ID NO: 555888 - RNA, 64 nt, hsa
cgugcuguuccuacucaguaaacaggugugaugaguuaacaagaaauaacacuguuugagaacu

SEQ ID NO: 555889 - RNA, 64 nt, hsa
uggccuguguaaaucuccauugggaagucaugccuucuaaaaagauucuuauuugggggagugg

SEQ ID NO: 555890 - RNA, 64 nt, hsa
uuaaaaaucuauuuggucaaucuaaaugcauucauucuaaaaaauuuuuugaaccagauaaaua

SEQ ID NO: 555891 - RNA, 64 nt, hsa
ucucuacucuagaugccuaaaagaguuuauauacuucuaaaagcuccuaacuuauauccaaaga

SEQ ID NO: 555892 - RNA, 64 nt, hsa
uagacaaugauucuuuuuuaauaaaaucaaauaauucuaaaagugcuagagaauuuaacuaaaa

SEQ ID NO: 555893 - RNA, 64 nt, hsa
uauaacuuacuaaagcagaacaaacagugaaacuuucuaaaauauucuaucuggaauagggaca

SEQ ID NO: 555894 - RNA, 64 nt, hsa
uguaacuguagaagggaaaagggaaaguauuugguucuaaaaaauguuagccuuccucguaaaa

SEQ ID NO: 555895 - RNA, 64 nt, hsa
ugaaaucuaaagcaaauuugcaauuucuuaagauuucuaaaauuuaccagaacaguuuagccug

SEQ ID NO: 555896 - RNA, 64 nt, hsa
gaaauaguauugauuuagaaaaaguauauugcauuucuaaaaaacaucuaccaagguuacucgu

SEQ ID NO: 555897 - RNA, 64 nt, hsa
cccucagccacuucgaaugccagccaccuucugguucuaaaacggggaguggucugaaugaaca

SEQ ID NO: 555898 - RNA, 64 nt, hsa
gggcuucccuuaggagccauauucaacuacagccuucuaaaaccugugcccucagccacuucga

SEQ ID NO: 555899 - RNA, 64 nt, hsa
cauuucuauuuagcugauugguucucacauauacuucuaaaagaaacuuuuauguuauaagagu

SEQ ID NO: 555900 - RNA, 64 nt, hsa
cauccauaaucagccaccauuuaacccuuccuuguucuaaaacaaaaaccaaagggcgcugguu

SEQ ID NO: 555901 - RNA, 64 nt, hsa
uugguuuaucuauaauguuuguucauuuaauagcuucuaaaaggccuuuuuguuauacagugcu

SEQ ID NO: 555902 - RNA, 64 nt, hsa
acaagugauggcucauagcuaguuuuuuuuuuucuucuaaaaaaugucagguuuuuaaaaucau

SEQ ID NO: 555903 - RNA, 64 nt, hsa
aacaccaaaaucuccagaaaugcauuuuauguaguucuaaaaucagcaaaauauugguauuaca

SEQ ID NO: 555904 - RNA, 64 nt, hsa
uuaaaaauuauguugacuaaauacaaaguuuguuuucuaaaauguaaauauuugccacaaugua

SEQ ID NO: 555905 - RNA, 64 nt, hsa
caaugcccagacaaacgugagcacacccaccaguuucuaaaauggaauagacaggaaaagauug

SEQ ID NO: 555906 - RNA, 64 nt, hsa
auguuuuacagacuuuauucacuaugucccauuguucuaaaaugauaacaugacuucuguuuuu

SEQ ID NO: 555907 - RNA, 64 nt, hsa
aguggagaaaguguauucuuuaaagagaauuuacuucuaaaagccacaggugcuuuuacaaagc

SEQ ID NO: 555908 - RNA, 64 nt, hsa
gcuuuuacaaagcaaacugcauugaauuuaaaacuucuaaaaauaacaggcaaauauuguagcu

SEQ ID NO: 555909 - RNA, 64 nt, hsa
aggaguggugauaaagcccacugaccuucacacauucuaaaaauugguuggcaaugccaguaua

SEQ ID NO: 555910 - RNA, 64 nt, hsa
aaugcagaguuggauaagaaauacauugcuggguuucuaaaaugcugccuuccugccucuacuc

SEQ ID NO: 555911 - RNA, 64 nt, hsa
agacaggggcguauucaugggagcaucagccaguuucuaaaacccacaggccaucagcagcuag

SEQ ID NO: 555912 - RNA, 64 nt, hsa
uguguaccagguugccuaaaucaugugcagaugguucuaaaaaaaaaaaaaaaaaaaaaaaaaa

SEQ ID NO: 555913 - RNA, 64 nt, hsa
ggaaccuuuucuugggggugggggaguuucccuuuucuaaaaaugcaaugcacuaaaacuauuu

SEQ ID NO: 555914 - RNA, 64 nt, hsa
aauguguaaaaucagucucggcugucagaauaacuucuaaaagguauuuuuauaagcaguucaa

SEQ ID NO: 555915 - RNA, 64 nt, hsa
ucacccacauugggugagacagaaaaugaaucuguucuaaaauuuguaauuugcuaacuugauu

SEQ ID NO: 555916 - RNA, 64 nt, hsa
ggaggaaacauaagaggaggccaaaaguuaaacguucuaaaaagaggcgaaaggaagcaagcag

SEQ ID NO: 555917 - RNA, 64 nt, hsa
guuucugaaaacaaugaaaccauaaaagauaauauucuaaaaacugagaaauccagugaagagg

SEQ ID NO: 555918 - RNA, 64 nt, hsa
uaucagauuuuguuagaugcuagaaauggauuuauucuaaaauuuggaacugucguacacauuc

SEQ ID NO: 555919 - RNA, 64 nt, hsa
uaguacaagauugaaaaacucaacaagaauuuaauucuaaaagcaaaaauugguuugaguuuuc

SEQ ID NO: 555920 - RNA, 64 nt, hsa
cguuccuauuguuuaauaauaaauucaaaaauauuucuaaaaccuuaaaaccaacuaugccaag

SEQ ID NO: 555921 - RNA, 64 nt, hsa
uuuucacauauuaauauuuaguaauuuuuccugcuucuaaaagugagaguaucacacccuaaau

SEQ ID NO: 555922 - RNA, 64 nt, hsa
uugucagaauauauaaaagcuuagauuguagcuguucuaaaaacguaaguacuccauuguaaua

SEQ ID NO: 555923 - RNA, 64 nt, hsa
gagccauugggccaucaagccuuuauauaucugcuucuaaaauugccccaccugcucuagaugg

SEQ ID NO: 555924 - RNA, 64 nt, hsa
aaaauacucacaaagcuguuauuggcuucuuaacuucuaaaauuuggggggucuugcauuuauu

SEQ ID NO: 555925 - RNA, 64 nt, hsa
aaccuagagguaacuaccaugugaacuugaacucuucuaaaauaguucugugucucuuagacca

SEQ ID NO: 555926 - RNA, 64 nt, hsa
uuuggaaggagugaucaaauaccgaaauugaacuuucuaaaaccuacacauagcaugcguuuaa

SEQ ID NO: 555927 - RNA, 64 nt, hsa
aaauucuauuauauaaagccccaagugcuuuaccuucuaaaacaugcuucucuauaggugcaaa

SEQ ID NO: 555928 - RNA, 64 nt, hsa
acuguguacuugagguuggcuuuggauauggauuuucuaaaaagugauguuuuauuguuuauca

SEQ ID NO: 555929 - RNA, 64 nt, hsa
ccuugaccagaaauuuuucuucuaaagaauuuaauucuaaaaguuauagacauucccaaagaua

SEQ ID NO: 555930 - RNA, 64 nt, hsa
gucuucauguaccuguauguaaaucccacuuuuauucuaaaauucuuugaauauuuuguuucuu

SEQ ID NO: 555931 - RNA, 64 nt, hsa
uguuaaaauaaauaacauuuaauuugacggaaaauucuaaaaaucaacauuugguaacuuaaau

SEQ ID NO: 555932 - RNA, 64 nt, hsa
uuuguugaaugcuauggaauauuaauauaauuaauucuaaaauaucaccuaaaauaugucaacu

SEQ ID NO: 555933 - RNA, 64 nt, hsa
cucacuuaaauuaauuuuuguaaacccaaguaaguucuaaaaaaaaguaaaaaauacauagaau

SEQ ID NO: 555934 - RNA, 64 nt, hsa
gugaucagaaagaauggcguacaaaucuuauuauuucuaaaaauaagaauaaaaagguaaaacu

SEQ ID NO: 555935 - RNA, 64 nt, hsa
gauuacauaucaaaauugauuaaaacacuuccauuucuaaaaguucaaauauacuuguuaauaa

SEQ ID NO: 555936 - RNA, 64 nt, hsa
auuuucagaaacuuagugauaacauuaugaacaauucuaaaagcccugugauuugaaaaauaua

SEQ ID NO: 555937 - RNA, 64 nt, hsa
auuucaguuccgugucuuaacaguuugugauaauuucuaaaacugucuuuucaacuuauguaau

SEQ ID NO: 555938 - RNA, 64 nt, hsa
uauuucuaaugcuacaagaaugcuguaaagugucuucuaaaaugauguagccugacaagacauu

SEQ ID NO: 555939 - RNA, 64 nt, hsa
ccuuuuuugggggagugacaggaugggguauggauucuaaaaugccuuuucccaaaauguugaa

SEQ ID NO: 555940 - RNA, 64 nt, hsa
agcccuuuuauaccuccccagacuccuucaacaauucuaaaaugauuguaguaaucugcauuau

SEQ ID NO: 555941 - RNA, 64 nt, hsa
uguuuccagaaauucuucaauuugaaaucaccuuuucuaaaaagucaauucaucuaguuaaguc

SEQ ID NO: 555942 - RNA, 64 nt, hsa
uugucagucugagucaucaaaaagagucuuaauuuucuaaaacaaguuggcuagaagaaaguaa

SEQ ID NO: 555943 - RNA, 64 nt, hsa
aaccucaucaaaagugugugaauuuuaaaacaaauucuaaaaaaacuauagugcuaaauuggua

SEQ ID NO: 555944 - RNA, 64 nt, hsa
gaaauuauuugaagugauauauuugguuaaacauuucuaaaaauaaacuaccaauacuaaauag

SEQ ID NO: 555945 - RNA, 64 nt, hsa
uagaauuuuuuuuugauaaaggaucacaaaacaauucuaaaaccuaacuguuuuuaccauugaa

SEQ ID NO: 555946 - RNA, 64 nt, hsa
guaugucuuuuguuaacauauuuguuaugccuuauucuaaaauugagucucaaacuggaaugcc

SEQ ID NO: 555947 - RNA, 64 nt, hsa
ggggauuacaauggcucaaauugguucauuugauuucuaaaaauaccaugaccuuuaaaaauuc

SEQ ID NO: 555948 - RNA, 64 nt, hsa
aacauggauucugaguuguauauauuuccuaucauucuaaaaaagugaauuugugaagcaaagu

SEQ ID NO: 555949 - RNA, 64 nt, hsa
gaguuggaaggaaacucuuacuaaaauguuaacuuucuaaaaaccuucuuuuagaucuuccuug

SEQ ID NO: 555950 - RNA, 64 nt, hsa
uuaaugcauagcaguauguuugaaaaauagaccauucuaaaaagcccaugauaccuuacuguug

SEQ ID NO: 555951 - RNA, 64 nt, hsa
uuucccaugagauaccauguucuaugccuucccauucuaaaaguguggacaacgcuugauuuga

SEQ ID NO: 555952 - RNA, 64 nt, hsa
aauacgacgaaaauucauacuuuaugcaggagauuucuaaaaauuuaauguuuauuaauaguuu

SEQ ID NO: 555953 - RNA, 64 nt, hsa
gucauugguuugauuuuuggauaccacucugcuguucuaaaaggacuauuauauuauauaauuc

SEQ ID NO: 555954 - RNA, 64 nt, hsa
aaugcaguaggcuuuuuuguauaaaauuauuuuauucuaaaacugggucccauuauuuucuuaa

SEQ ID NO: 555955 - RNA, 64 nt, hsa
ucuacugauuugggcugaauguauguaaauagguuucuaaaaagucagauguuugagcaguggc

SEQ ID NO: 555956 - RNA, 64 nt, hsa
uaccacuugcugcacucuugcacauggauucaguuucuaaaauugaguucuuccuguaaucuug

SEQ ID NO: 555957 - RNA, 64 nt, hsa
gcagcagaggaacccaaaggcaguaaaucaaauauucuaaaacccaaaguucauuauuuucauc

SEQ ID NO: 555958 - RNA, 64 nt, hsa
aauauucaucucuugcugucagacccauucuauauucuaaaagcuucugcuccuuccuucccaa

SEQ ID NO: 555959 - RNA, 64 nt, hsa
agagagauuagaacuguuagaaggaguugaaauuuucuaaaagacauaguauuuaguuuauaau

SEQ ID NO: 555960 - RNA, 64 nt, hsa
ugaaguucacaauaggucauaaggucucuuccuuuucuaaaauugaaagacaagaaauuuagug

SEQ ID NO: 555961 - RNA, 64 nt, hsa
acagauuccuucagugauauacuuguucguucauuucuaaaaugugaagcuuuaggaccaaauu

SEQ ID NO: 555962 - RNA, 64 nt, hsa
caaguucccgugauugcaguaaaaauauuuacuauucuaaaaaaaugagaauugaagacuuagc

SEQ ID NO: 555963 - RNA, 64 nt, hsa
cuuuucaugcuaccuucaaucuucaacuaaagauuucuaaaagggguaagaaaugaggcaguag

SEQ ID NO: 555964 - RNA, 64 nt, hsa
gaaguccagccuacuuacuuguaacuauuaaccuuucuaaaaguuuucaucgccuugguaaagc

SEQ ID NO: 555965 - RNA, 64 nt, hsa
uagacuaaaagccaaaauauaauuauugcugccuuucuaaaaacccaaaauguaguucucuauu

SEQ ID NO: 555966 - RNA, 64 nt, hsa
auuuuuuagucaacacauaauggaaacuucuuucuucuaaaaguugccagugccacuuuuaaga

SEQ ID NO: 555967 - RNA, 64 nt, hsa
acaaauaugugccauugugcaacaucgguggauuuucuaaaaauaauguaaaugucuucuauua

SEQ ID NO: 555968 - RNA, 64 nt, hsa
uaguguauuuuuuuuucuuuuuagaaacacacauuucuaaaaaugucauguuacauuccugcau

SEQ ID NO: 555969 - RNA, 64 nt, hsa
aucuaacucucccuaaaccauccucuuuaacugcuucuaaaauaucucuguuggccuuucuuag

SEQ ID NO: 555970 - RNA, 64 nt, hsa
gugccaccaagccuggcuaauuuugucucaugucuucuaaaaauuauuuugugaagccccuuca

SEQ ID NO: 555971 - RNA, 64 nt, hsa
acauuacauuucuuaacauuuuaaaaucuagaauuucuaaaauggaauuuaaugccaucacaau

SEQ ID NO: 555972 - RNA, 64 nt, hsa
uuuuuuuuuuuuacuauagaaguuacaaaggaaguucuaaaauuaugccucccucuguuuuuau

SEQ ID NO: 555973 - RNA, 64 nt, hsa
guuaauguaguaugguauaugcacaaaacuacuuuucuaaaaucuaaaauuucauaauucugaa

SEQ ID NO: 555974 - RNA, 64 nt, hsa
uaggcauuuuaaguaaaagucuaccuguguuuuuuucuaaaaaggcugcucacaaguucuauuu

SEQ ID NO: 555975 - RNA, 64 nt, hsa
aguucaaauuaaccacuuuugacuagguaagucuuucuaaaaaccauuuaaagcuaacuggguc

SEQ ID NO: 555976 - RNA, 64 nt, hsa
caacucuaacucggagacgucuagcuggcaauguuucuaaaacuuucacuggauuucuuuagac

SEQ ID NO: 555977 - RNA, 64 nt, hsa
ucuuauuucacuuaacucauuugauuaaacuguauucuaaaacauuugggguuuuucccccuau

SEQ ID NO: 555978 - RNA, 64 nt, hsa
guauuaccuggaaugaggcagguuuuuuucuguuuucuaaaaagaguaaccaagauaccuccag

SEQ ID NO: 555979 - RNA, 54 nt, hsa
uagaaagaaaaauaaaguagccaauucuaaaaguagcccucuuucuccuggauc

SEQ ID NO: 555980 - RNA, 64 nt, hsa
guugauuuguuugugccuuuuauuaacugccauuuucuaaaauuuuuuucaauaaaaggaagga

SEQ ID NO: 555981 - RNA, 64 nt, hsa
aggugcucaauaaaaauguguucaauggaugaauuucuaaaauauccuccaaugugugcaugga

SEQ ID NO: 555982 - RNA, 64 nt, hsa
acugugccuacauuuaaaaauacuucucucucuuuucuaaaaagcuuuaacuguagugccuccu

SEQ ID NO: 555983 - RNA, 64 nt, hsa
agaaucagcuuaggcuucuaugaauucagccuguuucuaaaagcugaaaaucucaguuuaaaaa

SEQ ID NO: 555984 - RNA, 64 nt, hsa
ugauauaaauaagucuagcucuauaauccccaaguucuaaaaguuaugguuagaugcuauucug

SEQ ID NO: 555985 - RNA, 64 nt, hsa
cuuuaaguuuuuauacuuucagaaacuuuuuguguucuaaaaguacaaugagccuuacuguauu

SEQ ID NO: 555986 - RNA, 64 nt, hsa
ccaagguuuaaacugcccaguuagcauucugacauucuaaaagccggcaaagcagcuuuuagug

SEQ ID NO: 555987 - RNA, 64 nt, hsa
auaggugcuuauuaaggagacucuuuuccuauacuucuaaaaugcaaacuguuucagauucuga

SEQ ID NO: 555988 - RNA, 64 nt, hsa
ucagauucugagcaccucauuguaaauacgauuauucuaaaaacucaaagggcgagaacaacug

SEQ ID NO: 555989 - RNA, 64 nt, hsa
aaacauuguuuguucacuuucaaagagugauaguuucuaaaacauuuagagcaauaaauauuca

SEQ ID NO: 555990 - RNA, 64 nt, hsa
uuauucucuuuucagagaaggaaaauaaaaaggauucuaaaaguuugaugcauuggaaaaauuu

SEQ ID NO: 555991 - RNA, 64 nt, hsa
gugaaacccaugacaaaaugaaugugaauauucuuucuaaaaauuuagaaaauguuaucuuuuu

SEQ ID NO: 555992 - RNA, 64 nt, hsa
uuuugccaagguaguucaguuuaggaauauguuguucuaaaauaugucuuagaauccugaaagc

SEQ ID NO: 555993 - RNA, 64 nt, hsa
ugcggggaggagaagucagauuauguacauaguuuucuaaaaagccuuucuucuaaaaacgaaa

SEQ ID NO: 555994 - RNA, 64 nt, hsa
cagauuauguacauaguuuucuaaaaagccuuucuucuaaaaacgaaaaaagaccccccaccca

SEQ ID NO: 555995 - RNA, 64 nt, hsa
aaacacugcauuuaagaauuuuuaaaaauugguuuucuaaaauuaaaauguccaaauuaggcau

SEQ ID NO: 555996 - RNA, 64 nt, hsa
ggaaccucgguacuucuuaagguuuguuuguguuuucuaaaaccagagaauaaggaacugauuu

SEQ ID NO: 555997 - RNA, 64 nt, hsa
uuuaauugacuucuaaaauguucaaauugucuaguucuaaaaguuuacuaaaugccuagugcag

SEQ ID NO: 555998 - RNA, 64 nt, hsa
aaaaaaguugguugacuguuuuuguuuaauugacuucuaaaauguucaaauugucuaguucuaa

SEQ ID NO: 555999 - RNA, 64 nt, hsa
aauccagauuugaagacucaugccauaggugacauucuaaaauaccauuaaagccacuuaaaug

SEQ ID NO: 556000 - RNA, 64 nt, hsa
ccauccccauuagaccuacgaauaaagcauccgguucuaaaauuaauuuguugcagcuuuguaa

SEQ ID NO: 556001 - RNA, 64 nt, hsa
uucugagaguugaugagguuuaagaacaugaagauucuaaaaggucaguuuuuagagauagauc

SEQ ID NO: 556002 - RNA, 64 nt, hsa
uauuacauauguguuaagucauuucuuaagaauuuucuaaaaugccaacuaucacaggauuauu

SEQ ID NO: 556003 - RNA, 64 nt, hsa
cuauuguguuuguuucauaugaauauuuuuguaauucuaaaagagaucuuauuuaaauuuccuu

SEQ ID NO: 556004 - RNA, 64 nt, hsa
uuguauauuugucuaaaaugaaagcucuuuugcguucuaaaacuacaauauaugucaucuuauu

SEQ ID NO: 556005 - RNA, 64 nt, hsa
agccaugguaaaaauagggaucugugaaggaaauuucuaaaauuggauguauuagguuuugaac

SEQ ID NO: 556006 - RNA, 64 nt, hsa
aauggacuuuuuuuauuuuaauuucucauuaaacuucuaaaauucuuauaggugaggaucauuu

SEQ ID NO: 556007 - RNA, 64 nt, hsa
uugggaguuugggguuuuauguuuuguuuuucuuuucuaaaaugaagugagauuguucacacac

SEQ ID NO: 556008 - RNA, 64 nt, hsa
uugauauuugagccauuccuaaagauuugggguuuucuaaaacuaaagaaucuaggaaccuugc

SEQ ID NO: 556009 - RNA, 64 nt, hsa
auuuuucuguuuuugaccuuagguauaugaaguuuucuaaaauauuuuauuaauuuauguugaa

SEQ ID NO: 556010 - RNA, 64 nt, hsa
gauagaauagagaauuugagaaaaaucugggucuuucuaaaaacugcuuuguaaguuacuuuuu

SEQ ID NO: 556011 - RNA, 64 nt, hsa
ucauuucuacccugcaaaauaauccagaucugcuuucuaaaaugaaucaguuucuaaagugaaa

SEQ ID NO: 556012 - RNA, 64 nt, hsa
aaaauuuuuuucugucagacauuuaccaacuauuuucuaaaacuaauuugacaaaucaugacac

SEQ ID NO: 556013 - RNA, 64 nt, hsa
uucauauucugaaaaauguucuauauucucauuuuucuaaaagaaagaaaaaaggaaacccgau

SEQ ID NO: 556014 - RNA, 64 nt, hsa
cuggcagaggcacucagguacuugguaagcaaauuucuaaaacuccaaguugcugcagcuuggc

SEQ ID NO: 556015 - RNA, 64 nt, hsa
uucugccuauggcacaaauuguaaaccuuuguuuuucuaaaauaaaguaauugaaaaccugcaa

SEQ ID NO: 556016 - RNA, 64 nt, hsa
ucucuuuuaauugcagugaaguucucuuuauaacuucuaaaauucggaauucuagauccuugcu

SEQ ID NO: 556017 - RNA, 64 nt, hsa
uuuauuuacauugucagacuauucacaaaacagauucuaaaauuuguuugcucguaugcuguuc

SEQ ID NO: 556018 - RNA, 64 nt, hsa
cagcaagaguuaagaaagggcuuuucaggaacuauucuaaaagucauaaaagggucacagucuu

SEQ ID NO: 556019 - RNA, 64 nt, hsa
aguuaacaaugugucuaccaagaacaauugaguuuucuaaaaguaauaaugaagauuaugcaau

SEQ ID NO: 556020 - RNA, 64 nt, hsa
auaguucuagacauggagguucuaaggccuaggauucuaaaaugugauguucuaaggcucugag

SEQ ID NO: 556021 - RNA, 64 nt, hsa
cuaggaccaugguuaagaguccaagaauccacauuucuaaaaucuuauaguucuaggcacugua

SEQ ID NO: 556022 - RNA, 64 nt, hsa
uccuagucagauacuaauauucuguagaagauauuucuaaaaucuuaucuuuaaaauaugaaau

SEQ ID NO: 556023 - RNA, 64 nt, hsa
aagauguuuuuaaaaccuuagggcaggaaagaacuucuaaaacauuccagaauacccgguaguu

SEQ ID NO: 556024 - RNA, 64 nt, hsa
ccaccuuuuaaauuuuggucacuguauguaucaguucuaaaauuuccauuuuguucucuauauu

SEQ ID NO: 556025 - RNA, 64 nt, hsa
gucuuuuaccaaacuuagagguuuucagccuaauuucuaaaaauacuuuuuauuagccugauuu

SEQ ID NO: 556026 - RNA, 64 nt, hsa
gagaagcugcccggaauaaacugaauuucauauguucuaaaaugacuagcaaugguuuaaaaag

SEQ ID NO: 556027 - RNA, 64 nt, hsa
gcagggaaaaaauauuuucacuuauuuuauuugcuucuaaaaugcaaagaugaauacuaaaguc

SEQ ID NO: 556028 - RNA, 64 nt, hsa
guuauaaagauaaguuaggcagcuagacccugcguucuaaaaaaggauugcuugcaauguuggu

SEQ ID NO: 556029 - RNA, 64 nt, hsa
aucuaaacauuuuuagccuuuaauccauuccauuuucuaaaacugucauaaacuauuuuuaauc

SEQ ID NO: 556030 - RNA, 64 nt, hsa
guucuucuauuucaaacguuaauuuugcuucucuuucuaaaaaaaaaaaaaaaaaagaaagaga

SEQ ID NO: 556031 - RNA, 64 nt, hsa
ugcccgggaggaaagguguugauuacauggauacuucuaaaagcuaaagccuuguugccuucuc

SEQ ID NO: 556032 - RNA, 64 nt, hsa
aagugcaauagauuuucaaguguauugugccuuguucuaaaacuuuuauuaaguaggugcacuu

SEQ ID NO: 556033 - RNA, 64 nt, hsa
aacgcagcuugucuaggaaggggaugggacuagauucuaaaauuuauuugggaccaugggaaug

SEQ ID NO: 556034 - RNA, 64 nt, hsa
uuagauauuugccugucuguuugcucaaaauugcuucuaaaacaauaaagauucuuuuauuucu

SEQ ID NO: 556035 - RNA, 64 nt, hsa
caagugcauggcacugacugaaugcuguuaauauuucuaaaaguuucuacauucagauuauaug

SEQ ID NO: 556036 - RNA, 64 nt, hsa
ccugagguugguuuuugcagaaaacagucucugcuucuaaaaacuucuaugucuagucuuccau

SEQ ID NO: 556037 - RNA, 64 nt, hsa
ugcccucuaucauuauaaaugguugccaugguguuucuaaaaauaaguguuuuaccauuaaugu

SEQ ID NO: 556038 - RNA, 64 nt, hsa; identical to SEQ ID NO: 546408

SEQ ID NO: 556039 - RNA, 64 nt, hsa; identical to SEQ ID NO: 546409

SEQ ID NO: 556040 - RNA, 64 nt, hsa; identical to SEQ ID NO: 546410

SEQ ID NO: 556041 - RNA, 64 nt, hsa; identical to SEQ ID NO: 546411

SEQ ID NO: 556042 - RNA, 64 nt, hsa; identical to SEQ ID NO: 546412

SEQ ID NO: 556043 - RNA, 64 nt, hsa; identical to SEQ ID NO: 546413

SEQ ID NO: 556044 - RNA, 64 nt, hsa; identical to SEQ ID NO: 546414

SEQ ID NO: 556045 - RNA, 64 nt, hsa; identical to SEQ ID NO: 546415

SEQ ID NO: 556046 - RNA, 64 nt, hsa; identical to SEQ ID NO: 546416

SEQ ID NO: 556047 - RNA, 64 nt, hsa; identical to SEQ ID NO: 546417

SEQ ID NO: 556048 - RNA, 64 nt, hsa; identical to SEQ ID NO: 81987

SEQ ID NO: 556049 - RNA, 64 nt, hsa; identical to SEQ ID NO: 81988

SEQ ID NO: 556050 - RNA, 64 nt, hsa; identical to SEQ ID NO: 81989

SEQ ID NO: 556051 - RNA, 64 nt, hsa; identical to SEQ ID NO: 81990

SEQ ID NO: 556052 - RNA, 64 nt, hsa; identical to SEQ ID NO: 81991

SEQ ID NO: 556053 - RNA, 64 nt, hsa; identical to SEQ ID NO: 81992

SEQ ID NO: 556054 - RNA, 64 nt, hsa; identical to SEQ ID NO: 81993

SEQ ID NO: 556055 - RNA, 64 nt, hsa; identical to SEQ ID NO: 81994

SEQ ID NO: 556056 - RNA, 64 nt, hsa; identical to SEQ ID NO: 81995

SEQ ID NO: 556057 - RNA, 64 nt, hsa; identical to SEQ ID NO: 81996

SEQ ID NO: 556058 - RNA, 64 nt, hsa; identical to SEQ ID NO: 81997

SEQ ID NO: 556059 - RNA, 64 nt, hsa; identical to SEQ ID NO: 81998

SEQ ID NO: 556060 - RNA, 64 nt, hsa; identical to SEQ ID NO: 81999

SEQ ID NO: 556061 - RNA, 64 nt, hsa; identical to SEQ ID NO: 82000

SEQ ID NO: 556062 - RNA, 64 nt, hsa; identical to SEQ ID NO: 82001

SEQ ID NO: 556063 - RNA, 64 nt, hsa; identical to SEQ ID NO: 82002

SEQ ID NO: 556064 - RNA, 64 nt, hsa; identical to SEQ ID NO: 82003

SEQ ID NO: 556065 - RNA, 64 nt, hsa; identical to SEQ ID NO: 82004

SEQ ID NO: 556066 - RNA, 64 nt, hsa; identical to SEQ ID NO: 82005

SEQ ID NO: 556067 - RNA, 64 nt, hsa; identical to SEQ ID NO: 82006

SEQ ID NO: 556068 - RNA, 64 nt, hsa; identical to SEQ ID NO: 82007

SEQ ID NO: 556069 - RNA, 64 nt, hsa; identical to SEQ ID NO: 82008

SEQ ID NO: 556070 - RNA, 58 nt, hsa; identical to SEQ ID NO: 82009

SEQ ID NO: 556071 - RNA, 64 nt, hsa; identical to SEQ ID NO: 82010

SEQ ID NO: 556072 - RNA, 64 nt, hsa; identical to SEQ ID NO: 82011

SEQ ID NO: 556073 - RNA, 64 nt, hsa; identical to SEQ ID NO: 82012

SEQ ID NO: 556074 - RNA, 64 nt, hsa; identical to SEQ ID NO: 82013

SEQ ID NO: 556075 - RNA, 64 nt, hsa; identical to SEQ ID NO: 82014

SEQ ID NO: 556076 - RNA, 64 nt, hsa; identical to SEQ ID NO: 82015

SEQ ID NO: 556077 - RNA, 64 nt, hsa; identical to SEQ ID NO: 82016

SEQ ID NO: 556078 - RNA, 64 nt, hsa
ucaugcugcuccugucacccuccacgauuccacagaccaggacauuccaugugccucauggcac

SEQ ID NO: 556079 - RNA, 64 nt, hsa
gccaccaugcccucugcccuugccucuugggacugaccaggagcugcucaugugcgugagagug

SEQ ID NO: 556080 - RNA, 64 nt, hsa
uuagcccaccaggcaugaggccaagggcuccacugaccaggaggccgaggucucuaacucuuau

SEQ ID NO: 556081 - RNA, 64 nt, hsa
uggcacgcaagccugaggacccuccccuaccaaggaccaggaaaagcagcagcugccugcucuc

SEQ ID NO: 556082 - RNA, 64 nt, hsa
gucuccggaccaucaggguagggugguggguugagaccaggaagucagggaagaucggaauuca

SEQ ID NO: 556083 - RNA, 64 nt, hsa
gacggcacccaggcugugaucuguccugggcggggaccaggagggagcggggucgggaucaccu

SEQ ID NO: 556084 - RNA, 64 nt, hsa
cuuugcuaauuuggccaccuucaccuacugacaugaccaggauuuuccuuugccauuaaggaau

SEQ ID NO: 556085 - RNA, 64 nt, hsa
uuugcccugacggaguggcccggaagcagaggcugaccaggagcaggggccucccucccgaacu

SEQ ID NO: 556086 - RNA, 64 nt, hsa
cuguauccuuucggcuucccaguugagcucccaagaccaggacccacuggggcauauaaaaaag

SEQ ID NO: 556087 - RNA, 64 nt, hsa
cuguguccuuucggcuucccaguugagcucccaagaccaggacccacuggggcauauaaaaucu

SEQ ID NO: 556088 - RNA, 64 nt, hsa
cugcuugccucucccuagcccacacgcagacuuugaccaggaguauccagccaggggcacacau

SEQ ID NO: 556089 - RNA, 64 nt, hsa
uuccagucaugaucgggugggggacaugugggcugaccaggaccucugacccuggagcuucuac

SEQ ID NO: 556090 - RNA, 64 nt, hsa
accuaaauaucaaggccaggauuuucuaccuaaagaccaggacuuuuuaucuagagaccagcau

SEQ ID NO: 556091 - RNA, 64 nt, hsa
ccccaaagacuggaauauucuacccaaaugucaggaccaggauuuucuacccagagaccaaggu

SEQ ID NO: 556092 - RNA, 64 nt, hsa
ucccaaagaccaaaauauucuacccauaugucaggaccaggauuuucuacccagagaccaaggu

SEQ ID NO: 556093 - RNA, 64 nt, hsa
ggcagacuaucaguguuugccucccaaaucccaggaccaggaugacaucaaaaaucagguagag

SEQ ID NO: 556094 - RNA, 64 nt, hsa
guuucgcuggcacucuuccagcucccuggggguugaccaggagccggucagagauggaccuggc

SEQ ID NO: 556095 - RNA, 64 nt, hsa
uaggggccgggggcuucugcccagggcuccccuggaccaggacgccagguagggcagggaaccu

SEQ ID NO: 556096 - RNA, 64 nt, hsa; identical to SEQ ID NO: 143348

SEQ ID NO: 556097 - RNA, 64 nt, hsa; identical to SEQ ID NO: 143349

SEQ ID NO: 556098 - RNA, 64 nt, hsa; identical to SEQ ID NO: 143350

SEQ ID NO: 556099 - RNA, 64 nt, hsa; identical to SEQ ID NO: 143351

SEQ ID NO: 556100 - RNA, 64 nt, hsa; identical to SEQ ID NO: 143352

SEQ ID NO: 556101 - RNA, 64 nt, hsa; identical to SEQ ID NO: 143353

SEQ ID NO: 556102 - RNA, 64 nt, hsa; identical to SEQ ID NO: 143354

SEQ ID NO: 556103 - RNA, 64 nt, hsa; identical to SEQ ID NO: 143355

SEQ ID NO: 556104 - RNA, 64 nt, hsa; identical to SEQ ID NO: 143356

SEQ ID NO: 556105 - RNA, 64 nt, hsa; identical to SEQ ID NO: 143357

SEQ ID NO: 556106 - RNA, 64 nt, hsa; identical to SEQ ID NO: 143358

SEQ ID NO: 556107 - RNA, 64 nt, hsa; identical to SEQ ID NO: 143359

SEQ ID NO: 556108 - RNA, 64 nt, hsa; identical to SEQ ID NO: 143360

SEQ ID NO: 556109 - RNA, 64 nt, hsa; identical to SEQ ID NO: 143361

SEQ ID NO: 556110 - RNA, 64 nt, hsa; identical to SEQ ID NO: 143362

SEQ ID NO: 556111 - RNA, 64 nt, hsa; identical to SEQ ID NO: 143363

SEQ ID NO: 556112 - RNA, 64 nt, hsa; identical to SEQ ID NO: 143364

SEQ ID NO: 556113 - RNA, 64 nt, hsa; identical to SEQ ID NO: 143365

SEQ ID NO: 556114 - RNA, 61 nt, hsa
acuaaacucuuaagccuccccuuccagucuuucuggacagcuauuaagcacuugcagccuu

SEQ ID NO: 556115 - RNA, 61 nt, hsa
cuguuugagcccaacacuuuaauuuauucuuucuggacacuggagucacuaacuggcgugu

SEQ ID NO: 556116 - RNA, 61 nt, hsa
agaucugagugccccacagagucacagugugucuggacagccuggacauuggacauugcua

SEQ ID NO: 556117 - RNA, 61 nt, hsa
ucuggacgcugccacaucugggcauacagugucuggacacugccacauggagccacuguca

SEQ ID NO: 556118 - RNA, 61 nt, hsa
uuauugugcuuuucaaaaauguacacggaaaucuggacagugcuccacagauugauacauu

SEQ ID NO: 556119 - RNA, 61 nt, hsa
auuccagauuguaaaaagauccccaaaugauucuggacacuagauuuuuuuguuuggggag

SEQ ID NO: 556120 - RNA, 61 nt, hsa
cacacacacacacgugugcacagauaugcugucuggacacgcacacacaugcagauaugcu

SEQ ID NO: 556121 - RNA, 61 nt, hsa
ccuggacacacacaugugcacagauaugcugucuggacaugcacacacgugcagauaugcu

SEQ ID NO: 556122 - RNA, 61 nt, hsa
guuuccgaaaauggaggcauuccuuuccaaaucuggacagcgaucguuuuuaguguuucug

SEQ ID NO: 556123 - RNA, 61 nt, hsa
uuuugagucuguucuuccaggaguaauaaauucuggacaucaucacuggacuggcuuacaa

SEQ ID NO: 556124 - RNA, 61 nt, hsa
caugccagauucugccucucuggaaagaggcucuggacagcagaagccuccaagcacagag

SEQ ID NO: 556125 - RNA, 61 nt, hsa
acugguucuugcaaaugggagcugagcagccucuggacagccagugaccuuugaccucggu

SEQ ID NO: 556126 - RNA, 61 nt, hsa
aagcuuguccaucacucuaguagggagaggcucuggacagaugaauaccuuuucuucggcu

SEQ ID NO: 556127 - RNA, 61 nt, hsa
ggaguuuugggaaugcacuuggaaacuguauucuggacaaagacuaccugagaucacuaaa

SEQ ID NO: 556128 - RNA, 61 nt, hsa
caagggacccugggugggagcauaggaggggucuggacaugugguuacuaguacagguuuu

SEQ ID NO: 556129 - RNA, 61 nt, hsa
gacagcucuucuacuacccccacagaccugcucuggacacuugcucaugcccugccaagca

SEQ ID NO: 556130 - RNA, 61 nt, hsa
uguuucugucucauagcacaugugacaaucaucuggacaacagccacaagggggcgcucgg

SEQ ID NO: 556131 - RNA, 61 nt, hsa
ccugggcuggggcuuacugggggcugaagguucuggacaugaacaagggucagguagaaga

SEQ ID NO: 556132 - RNA, 61 nt, hsa
ucaugagggagacugucaauaaggcuguggcucuggacaccuaugagaagggccagcugac

SEQ ID NO: 556133 - RNA, 61 nt, hsa
uucuuggcuguccccuagagcaccagaagugucuggacaaacuccucaauaacugccuuuu

SEQ ID NO: 556134 - RNA, 61 nt, hsa
gauguucauccuaacaugacaguauuccauuucuggacaugacgucugugguuuaagcuuu

SEQ ID NO: 556135 - RNA, 61 nt, hsa
aaaguugugcauguauguauacaguugcaagucuggacaaauguauagaauaaaccuuuua

SEQ ID NO: 556136 - RNA, 63 nt, hsa
aggaauggcgugggaugggggaaagaaaagaaagagaagaagcuggggucuccaggcagggua

SEQ ID NO: 556137 - RNA, 63 nt, hsa
gagaaaauauuaauuuucaaggggaaaaaaccugagaagaaagggagaaaagaccaugaaauu

SEQ ID NO: 556138 - RNA, 63 nt, hsa
aaagccaggaaagucaaaaaaacgaaagagaaggagaagaaaaaggaaaagggcaaauugaaa

SEQ ID NO: 556139 - RNA, 63 nt, hsa
agcagaaagguacucugaaacaugguggccugagagaagaagagcuggagaaaaugaaagaag

SEQ ID NO: 556140 - RNA, 63 nt, hsa
cuaaagugacacaaagagaaugaagcagaaguagagaagaaagacuguaugugacaauuaccu

SEQ ID NO: 556141 - RNA, 63 nt, hsa
uuauuucccaauuacaggaaauuagaucgacuggagaagaaaaaaaagaaaaaagauagaaaa

SEQ ID NO: 556142 - RNA, 63 nt, hsa
gagagagagagagagagagagagaaagauggaggagaagaacuuggauuccccuggguagaug

SEQ ID NO: 556143 - RNA, 63 nt, hsa
ccagaaggaggacuuugggccaauuucggaggagagaagaaagugcaacguggggagagggaa

SEQ ID NO: 556144 - RNA, 63 nt, hsa
uagaagguggagaugaugauauugaagagaugggagaagaagauagugaggucauugaaccuc

SEQ ID NO: 556145 - RNA, 63 nt, hsa
ucuguauuugcaaaugcagauaaaggugaugaugagaagaauacagacaacucagaggacagu

SEQ ID NO: 556146 - RNA, 63 nt, hsa
aaaucuuaaaaguguuguuaucaugacuggugagagaagaaaacauuuuguuuuuauuaaaug

SEQ ID NO: 556147 - RNA, 63 nt, hsa
uaagcaccauggccuugaugauucacuguuggggagaagaaacaagaaaaguaacugguuguc

SEQ ID NO: 556148 - RNA, 63 nt, hsa
uuucugauaucucuaaaaugcuguuaaguucuggagaagaacuucaggagaagaagaucuauc

SEQ ID NO: 556149 - RNA, 63 nt, hsa
aaaaugcuguuaaguucuggagaagaacuucaggagaagaagaucuaucagcuggcuuuuaaa

SEQ ID NO: 556150 - RNA, 63 nt, hsa
acgauccaucucccuuugugagucaaauguuaagagaagaaacuuguauuugcagcuagaggu

SEQ ID NO: 556151 - RNA, 63 nt, hsa
uaagcgggaacccuuaggauccccucuguccacgagaagaagcugaggcucugagcggaugca

SEQ ID NO: 556152 - RNA, 63 nt, hsa
aggguccucuguaugagugugcacccagcugaagagaagaaauggagagcagcaauuggagcu

SEQ ID NO: 556153 - RNA, 63 nt, hsa
aaagguuagucuucaauagacugaaauguauaagagaagaaccaagucuuacauagaaaaaaa

SEQ ID NO: 556154 - RNA, 63 nt, hsa
uggaagaguuguaauauauacuuuaagaaagaagagaagaaaacuaguaucucuaagcgguaa

SEQ ID NO: 556155 - RNA, 63 nt, hsa
cauguaaacaaagauaucuuugcuuuaagaugugagaagaaaugaauuuacuuuguuugcauu

SEQ ID NO: 556156 - RNA, 63 nt, hsa
uuugaugacaauagcugcuuaguuuccuguuaagagaagaaacuuuaucuuuuaauuaugugc

SEQ ID NO: 556157 - RNA, 63 nt, hsa
aguccuaguuccuuuguuacuccugugagcaccgagaagaacugggcgacucccagucccacc

SEQ ID NO: 556158 - RNA, 63 nt, hsa
aguaggcucucacuagaguuaccauucauauuugagaagaaaagaacauuuaauaaauguaug

SEQ ID NO: 556159 - RNA, 63 nt, hsa
ugauuuuacagugcacugacaguuuacaggaaggagaagaacagaauuucugcacacuacaca

SEQ ID NO: 556160 - RNA, 63 nt, hsa
cucaggggugugccugucuguuacacuggaggagagaagaaugagccuacgcugaagauggca

SEQ ID NO: 556161 - RNA, 63 nt, hsa
ugugaacugacaggcagccuggacauagagagggagaagaagucagagagggugacaagauag

SEQ ID NO: 556162 - RNA, 63 nt, hsa
gcaugugugagcagaagggaggaugaggaaaaagagaagaaaccccgguacugacaagcuguu

SEQ ID NO: 556163 - RNA, 63 nt, hsa
uggggagagccugugaggaccgagaggagaaaugagaagaaggaacaaaaauauuauuucuau

SEQ ID NO: 556164 - RNA, 63 nt, hsa
gagcagcugacagggugggucucccuuaccaaagagaagaaccacucucuggcgcugggguga

SEQ ID NO: 556165 - RNA, 63 nt, hsa
cagcggcuugugcucacucugucugccagguaugagaagaacacguaagaccgccaccacacu

SEQ ID NO: 556166 - RNA, 63 nt, hsa
uuugagucucagucugaugacccacacuuccaugagaagaagcagauccccuguguggucucc

SEQ ID NO: 556167 - RNA, 63 nt, hsa
aggaccuuggaagagcaagggacagugaggcaggagaagaacaagaaauggauguaagccugg

SEQ ID NO: 556168 - RNA, 63 nt, hsa
cuccugcugaagaguuuagaaugaggcagcggugagaagaagggugggagggcgugggggccc

SEQ ID NO: 556169 - RNA, 63 nt, hsa
uuuggacacaugaauuaaaucccaagggaaagugagaagaaaauuaauguauuagcaaccagu

SEQ ID NO: 556170 - RNA, 63 nt, hsa
agagaaaugcaucacuuccaaacccauguauuagagaagaagggcgugaaauuuaucaccuaa

SEQ ID NO: 556171 - RNA, 63 nt, hsa
ggauauguuuugguaaauguagacugugcacuugagaagaauguauuuugaguuguuggguac

SEQ ID NO: 556172 - RNA, 63 nt, hsa
gucugaaaccgguuuuaaaaugugacucucccagagaagaagccgcuggcuguaugaaacuug

SEQ ID NO: 556173 - RNA, 63 nt, hsa
gcuacaauugcugugcaaagaaauuccagaggggagaagaauguaaaaguuugguggugggug

SEQ ID NO: 556174 - RNA, 63 nt, hsa
auaaaaaaagaaagaaagaaaagaagaagaaaagagaagaaggagaaggagaugaaggaggag

SEQ ID NO: 556175 - RNA, 63 nt, hsa
gagaaggagaugaaggaggaggaggaggagaaggagaagaagaagaagaagaagaccacaaaa

SEQ ID NO: 556176 - RNA, 63 nt, hsa
cauggggugucccgugagugugaguguggcagugagaagaagcaucgagggcgaggggaauau

SEQ ID NO: 556177 - RNA, 63 nt, hsa
gggagcuguuuugucagugucuuggggucacaggagaagaaagcgggacuuuggugggaagga

SEQ ID NO: 556178 - RNA, 63 nt, hsa
auauguuucucaagcaaccugcaucuuuuaugagagaagaaagagugagagaagaauugccuc

SEQ ID NO: 556179 - RNA, 63 nt, hsa
aaccugcaucuuuuaugagagaagaaagagugagagaagaauugccucuggacuaucaucaau

SEQ ID NO: 556180 - RNA, 63 nt, hsa
uccuccaaaugcucuggagaggcccccacccuugagaagaacugacacagagaagaacauuuu

SEQ ID NO: 556181 - RNA, 63 nt, hsa
gagaggcccccacccuugagaagaacugacacagagaagaacauuuucucaggcucguagaga

SEQ ID NO: 556182 - RNA, 63 nt, hsa
ccagcaguugccccacccuguguaguuguugaggagaagaagccucaacuuacccaggaggag

SEQ ID NO: 556183 - RNA, 63 nt, hsa
auaggccuucgagcaaaagcaaagauccaccgagagaagaagagaaagaaaagaaaaagaaaa

SEQ ID NO: 556184 - RNA, 63 nt, hsa
aguaggaagcggacccgcuccagaaguccccacgagaagaagaagaagaggcggucccggucg

SEQ ID NO: 556185 - RNA, 63 nt, hsa
uacauggauccaggcuucugccaaaaaaaaaaagagaagaagaugacgaugaugaccagucgu

SEQ ID NO: 556186 - RNA, 63 nt, hsa
uagaucagaaaucugacuagauuggauucugaggagaagaaccuacuacaaggcaaggagccg

SEQ ID NO: 556187 - RNA, 63 nt, hsa
gaaacagucuugagccugggguugacuggguuagagaagaaccgggaugcaaggagcugccug

SEQ ID NO: 556188 - RNA, 63 nt, hsa
aggagacagaggcuuuuuugaauucacugugaagagaagaacccgaaccuuaagacgccagau

SEQ ID NO: 556189 - RNA, 63 nt, hsa
cauauccauugugguuaguuacucaguuauguugagaagaaucuggagcuaaaagcagagaug

SEQ ID NO: 556190 - RNA, 63 nt, hsa
uucauuuucaaaaacuauuuaccaaaacaaauggagaagaaacauccaaaagcacauuucauu

SEQ ID NO: 556191 - RNA, 63 nt, hsa
auuaaugaugcuuaaagagaaaagaaaaaaagagagaagaaaaaggagagaugaaaaaggagg

SEQ ID NO: 556192 - RNA, 63 nt, hsa
gaagaaaaaggagagaugaaaaaggaggaugaggagaagaauuaccuuuugacaaucuguuag

SEQ ID NO: 556193 - RNA, 63 nt, hsa
uccgacuuuauagcaggaacuuucugguaguaugagaagaaaucauugggugacuaugacuaa

SEQ ID NO: 556194 - RNA, 63 nt, hsa
gcauuggcaggaaaaagcucuagaggcuauacagagaagaaaaaaagagcaaaaaugagaccu

SEQ ID NO: 556195 - RNA, 63 nt, hsa
aaacugccuacaggccauaguuaaccugcaauagagaagaaagggaaguagggcagugcauga

SEQ ID NO: 556196 - RNA, 63 nt, hsa
ugacagaacaagacugucucaaaaaaaaaaaaagagaagaaaaacugccuacaggccauaguu

SEQ ID NO: 556197 - RNA, 63 nt, hsa
cauuuggggugguugggucaugacagcuaccaugagaagaagugucccguuuuguccaguggc

SEQ ID NO: 556198 - RNA, 63 nt, hsa
aggaggugggagguggaugguucuuauucuguggagaagaagggcgggaagaacuuccuuuca

SEQ ID NO: 556199 - RNA, 63 nt, hsa
cucugauaagaucgacaaaagaaacaacaaaaugagaagaagagguuccucgaaaggggggag

SEQ ID NO: 556200 - RNA, 63 nt, hsa
caaaaugagaagaagagguuccucgaaaggggggagaagaaauuuugagaauggaaaaauccc

SEQ ID NO: 556201 - RNA, 63 nt, hsa
ccagcuggcacuugacagggugcagucauuggugagaagaaucagaaaaagaagacccaucag

SEQ ID NO: 556202 - RNA, 63 nt, hsa
uccaaaaaaagaaaauagagcuuuauaagcagagagaagaaaauaaucaucuaagaccaucuc

SEQ ID NO: 556203 - RNA, 63 nt, hsa
cuucucuuucuaaaaaaaaaaaaaaaaaagaaagagaagaaagaagugauuccuacccccuac

SEQ ID NO: 556204 - RNA, 63 nt, hsa
uuucuuagcucaagagagaggcugagaaaugcagagaagaauaagacauaaaauagcuccgac

SEQ ID NO: 556205 - RNA, 63 nt, hsa
aaauauuuaaguaaaaacaaaaugaugcauuuugagaagaacaaagugugcacucagcggcug

SEQ ID NO: 556206 - RNA, 63 nt, hsa
uaaauguguaagucacccccaccaaaaacaaaagagaagaaaaagaauagaaagaauuaucca

SEQ ID NO: 556207 - RNA, 63 nt, hsa
cuacucauucaaagcacauuguagauauucagagagaagaacaaauggcuggcuuggcaaauc

SEQ ID NO: 556208 - RNA, 64 nt, hsa
gaaacaguuuauguauaggauagcuauaaguaaauacugaaacacauuaugccucuguaauugg

SEQ ID NO: 556209 - RNA, 64 nt, hsa
agaccaucuggccaacauggugaaacccugucucuacugaaaauaaaaaaaacuagcugggcau

SEQ ID NO: 556210 - RNA, 64 nt, hsa
uccucuuggguuucaucuugucguuuaagaaauguacugaaauaaucauuggaauauuugcauu

SEQ ID NO: 556211 - RNA, 64 nt, hsa
uuuggcuguuuguaggaucacguuguccuuacgauacugaaacuuuacagcugcuguaaauuuu

SEQ ID NO: 556212 - RNA, 64 nt, hsa
uugggagaagagaugcugccauuuaaccccuugguacugaaaaugagaaaauccccaacuaugc

SEQ ID NO: 556213 - RNA, 64 nt, hsa
ucauucugcuacuucacugucaucuucaauuuauuacugaaaaugauuccuggacaucaccagu

SEQ ID NO: 556214 - RNA, 64 nt, hsa
ccaagugauuguuauuuccauuuucuguuaugauuacugaaaccugauuuauugcuuugucacu

SEQ ID NO: 556215 - RNA, 64 nt, hsa
ucuauuacuacuuagcguguuucuaaugagaaguuacugaaaucuauuacuguccuuaauaaaa

SEQ ID NO: 556216 - RNA, 64 nt, hsa
uuaucagggagcccaaacacccagcauagccaacuacugaaaugauuuuguuaauucuguauaa

SEQ ID NO: 556217 - RNA, 64 nt, hsa
uuuggcuaaaacaggaugauugcuuuugucuguuuacugaaaaaugaguuuagaaaggcuagcc

SEQ ID NO: 556218 - RNA, 64 nt, hsa
gugcuuuucacaccaucucagagguugaggagcauacugaaaauugcccuggggggugcugggu

SEQ ID NO: 556219 - RNA, 64 nt, hsa
uuuccuucucccuuucuucuuugccuucuaaauauacugaaaugauuuagauaugugucaacaa

SEQ ID NO: 556220 - RNA, 64 nt, hsa
aauuggcaagcaguuugaguuuauacucaugacauacugaaagcaucucuuuggggucaagaaa

SEQ ID NO: 556221 - RNA, 64 nt, hsa
aggaucuccuaggucauugcuucgcagcugugauuacugaaauccuccucauaggagauaaagu

SEQ ID NO: 556222 - RNA, 64 nt, hsa
uuuggacucauuugaacaaaaaucuaggccaaaauacugaaaagccuauguguuuuuuuaauug

SEQ ID NO: 556223 - RNA, 64 nt, hsa
acuuuacguuuucaugcugcuuauuguuuuauucuacugaaaaaaaugaauuucaagauucuca

SEQ ID NO: 556224 - RNA, 64 nt, hsa
aucagauugaaaaguuuugagaaaauguuauuuuuacugaaagcaagcaguggccuauaaagaa

SEQ ID NO: 556225 - RNA, 64 nt, hsa
ucuugagaaauaguagacuguauguugaaaauuguacugaaauaaaguagaaaauuguuacgua

SEQ ID NO: 556226 - RNA, 64 nt, hsa
aauguggcacagcuuuuaacuaaucuucaaaccuuacugaaaguugagaaaauucguacuggag

SEQ ID NO: 556227 - RNA, 64 nt, hsa
aaccaauccucaaaccucacuaaacauaagauaauacugaaaacuuuacaaaccugaaugaugu

SEQ ID NO: 556228 - RNA, 64 nt, hsa
uauacuguguacacauaagacgcauauaggguuuuacugaaaucuauuuuuaacucuuauguuc

SEQ ID NO: 556229 - RNA, 64 nt, hsa
acguuagcuacugaauccugggggcgagugaaacuacugaaaauccgagugaugauguugugaa

SEQ ID NO: 556230 - RNA, 64 nt, hsa
uuuuauguauagauuuagaggggaaacgagaagguacugaaauaaugaucuuggaauauuugcu

SEQ ID NO: 556231 - RNA, 64 nt, hsa
cccaaaauacgcaauuucagauaaguuacgcaguuacugaaaucuuguaaguauuuaagugauc

SEQ ID NO: 556232 - RNA, 64 nt, hsa
uguauguuagaauaauuuuauuagaauaauuucauacugaaauuauuuucuccaaauaaaaauu

SEQ ID NO: 556233 - RNA, 64 nt, hsa
ugagcaaagaaacuugugcuuuaccaaggggaauuacugaaaaaggugauuacuccugaaguga

SEQ ID NO: 556234 - RNA, 64 nt, hsa
ccaagcucuuagcgguuauccacgaacuucgaccuacugaaaaggugguguugguauccaacua

SEQ ID NO: 556235 - RNA, 64 nt, hsa
guguguuuccugcugacuacaacccucuccuguuuacugaaaaggagucaggaaaacuacaggu

SEQ ID NO: 556236 - RNA, 64 nt, hsa
cucaguccugcaaguaaggacucauacugaagaguacugaaacaaggacuucuugucagaaaca

SEQ ID NO: 556237 - RNA, 64 nt, hsa
aagaaugaucauaaauguacuucaccagugauuuuacugaaaugcacuuauauuagucuuuaug

SEQ ID NO: 556238 - RNA, 64 nt, hsa
ucagugcauaguuagauaaaaugguaaaauguuuuacugaaagcauacuuuuuuggaaaauaga

SEQ ID NO: 556239 - RNA, 64 nt, hsa
aauaccacagcauuuguacuguuccuuuuuaauauacugaaaauauaaaaggaagggugugugu

SEQ ID NO: 556240 - RNA, 64 nt, hsa
acacacacacauucacccuaaggauccaauggaauacugaaaagaaaucacuuccuugaaaauu

SEQ ID NO: 556241 - RNA, 64 nt, hsa
aagccuggagccaaagaugacacaaggggaaggguacugaaaacaccauccauuugggaaagaa

SEQ ID NO: 556242 - RNA, 64 nt, hsa
acagcaagccugaugguuugucuuauuucauucauacugaaaauucuuugcauauuuuuuuucu

SEQ ID NO: 556243 - RNA, 64 nt, hsa
agccuagaguaucuugugccacagaaaaaugaaguacugaaauuaaaaaaaaaaaaucauagug

SEQ ID NO: 556244 - RNA, 64 nt, hsa
aaauuguacauaagauugauuuaucauugaugccuacugaaauaaaaagaggaaaggcuggaag

SEQ ID NO: 556245 - RNA, 64 nt, hsa
guaucugaacaagaaucuauauuccaagcacauuuacugaaauguaaaacacaacaggaagcaa

SEQ ID NO: 556246 - RNA, 64 nt, hsa
cauuuuuagaauguuuuuaugaguaaauuuaauguacugaaaauaaaaauuuuaaaaaaggcug

SEQ ID NO: 556247 - RNA, 64 nt, hsa
ugagucuuacgugcacaaaaagagaaggcuuugguacugaaacuggacaccuuguguacucgau

SEQ ID NO: 556248 - RNA, 64 nt, hsa
ugagaacuaaaaauagaugguucuuaauucaacuuacugaaaauuuccccaaacaauagcaaau

SEQ ID NO: 556249 - RNA, 64 nt, hsa
ccugccagaauguucucaaaugauuuaguucaaauacugaaauacuuaaugagcaauuacuuga

SEQ ID NO: 556250 - RNA, 64 nt, hsa
cugcuguauccagaagccaguuuuaucuaacggcuacugaaacacccacuguguuuugcucacu

SEQ ID NO: 556251 - RNA, 64 nt, hsa
guuuagaggcuagagggagcugaggggaggaucuuacugaaagcacccuggggagauugauugu

SEQ ID NO: 556252 - RNA, 64 nt, hsa
aaccauuauaaaaucccaacauauauacugaaaauacugaaacugcuuugaaaauuuggaauuu

SEQ ID NO: 556253 - RNA, 64 nt, hsa
cuggccaugaaccauuauaaaaucccaacauauauacugaaaauacugaaacugcuuugaaaau

SEQ ID NO: 556254 - RNA, 64 nt, hsa
augaaauguaaauccauuuuuauacugaaaauguuacugaaagucacuuuuaugagcaucugcc

SEQ ID NO: 556255 - RNA, 64 nt, hsa
gguuuuccagaaaugaaauguaaauccauuuuuauacugaaaauguuacugaaagucacuuuua

SEQ ID NO: 556256 - RNA, 64 nt, hsa
ccaggcagacagaaccuugcaaacaccuuaacuucuaaccaaagacuuuaaaacucuggcugga

SEQ ID NO: 556257 - RNA, 64 nt, hsa
ucagucuuccgcaggcuuaccugcgccaggaagucuaaccaaggaacaagaaucucacuaucag

SEQ ID NO: 556258 - RNA, 64 nt, hsa
uguacaucccauaaauaaaaaauacuuuaguuugcuaaccaacugaauauaugaggacugcaug

SEQ ID NO: 556259 - RNA, 64 nt, hsa
aaaaccugauauuucacuuauacugcauaacaagcuaaccaaacuggacauggugaauaaauca

SEQ ID NO: 556260 - RNA, 64 nt, hsa
gcaaaucuuacagccggucaagaagcaggagcaggagccggagccggagcaagucccguucugu

SEQ ID NO: 556261 - RNA, 64 nt, hsa
cuuacagccggucaagaagcaggagcaggagccggagccggagcaagucccguucuguuaguag

SEQ ID NO: 556262 - RNA, 64 nt, hsa
cucagagcaugaucacauugcagaaagauucuggaagguccauguagagggcagacauugaaga

SEQ ID NO: 556263 - RNA, 64 nt, hsa
uuuucacaucauaaaacaucuauuacauaaaauaaagguccaggcauaguggcucuugccugua

SEQ ID NO: 556264 - RNA, 64 nt, hsa
cuaaacccagaacucaaacuuaacauuagaaaauaagguccagggccggacacaguggcccaug

SEQ ID NO: 556265 - RNA, 64 nt, hsa
aagagugaaacuccaucucaaaaaaaaagaaaagaagguccagcuuuuggauucaaugaguggg

SEQ ID NO: 556266 - RNA, 64 nt, hsa; identical to SEQ ID NO: 88546

SEQ ID NO: 556267 - RNA, 64 nt, hsa; identical to SEQ ID NO: 88547

SEQ ID NO: 556268 - RNA, 51 nt, hsa; identical to SEQ ID NO: 88548

SEQ ID NO: 556269 - RNA, 64 nt, hsa; identical to SEQ ID NO: 88549

SEQ ID NO: 556270 - RNA, 64 nt, hsa; identical to SEQ ID NO: 88550

SEQ ID NO: 556271 - RNA, 64 nt, hsa; identical to SEQ ID NO: 88551

SEQ ID NO: 556272 - RNA, 64 nt, hsa; identical to SEQ ID NO: 88552

SEQ ID NO: 556273 - RNA, 64 nt, hsa; identical to SEQ ID NO: 88553

SEQ ID NO: 556274 - RNA, 64 nt, hsa; identical to SEQ ID NO: 88554

SEQ ID NO: 556275 - RNA, 64 nt, hsa; identical to SEQ ID NO: 88555

SEQ ID NO: 556276 - RNA, 64 nt, hsa; identical to SEQ ID NO: 88556

SEQ ID NO: 556277 - RNA, 64 nt, hsa; identical to SEQ ID NO: 88557

SEQ ID NO: 556278 - RNA, 64 nt, hsa; identical to SEQ ID NO: 88558

SEQ ID NO: 556279 - RNA, 64 nt, hsa; identical to SEQ ID NO: 88559

SEQ ID NO: 556280 - RNA, 64 nt, hsa; identical to SEQ ID NO: 88560

SEQ ID NO: 556281 - RNA, 64 nt, hsa; identical to SEQ ID NO: 88561

SEQ ID NO: 556282 - RNA, 64 nt, hsa; identical to SEQ ID NO: 88562

SEQ ID NO: 556283 - RNA, 64 nt, hsa; identical to SEQ ID NO: 88563

SEQ ID NO: 556284 - RNA, 64 nt, hsa; identical to SEQ ID NO: 88564

SEQ ID NO: 556285 - RNA, 64 nt, hsa; identical to SEQ ID NO: 88565

SEQ ID NO: 556286 - RNA, 64 nt, hsa; identical to SEQ ID NO: 88566

SEQ ID NO: 556287 - RNA, 64 nt, hsa; identical to SEQ ID NO: 88567

SEQ ID NO: 556288 - RNA, 64 nt, hsa; identical to SEQ ID NO: 88568

SEQ ID NO: 556289 - RNA, 64 nt, hsa; identical to SEQ ID NO: 88569

SEQ ID NO: 556290 - RNA, 64 nt, hsa; identical to SEQ ID NO: 88570

SEQ ID NO: 556291 - RNA, 64 nt, hsa; identical to SEQ ID NO: 88571

SEQ ID NO: 556292 - RNA, 64 nt, hsa; identical to SEQ ID NO: 88572

SEQ ID NO: 556293 - RNA, 64 nt, hsa; identical to SEQ ID NO: 88573

SEQ ID NO: 556294 - RNA, 64 nt, hsa; identical to SEQ ID NO: 88574

SEQ ID NO: 556295 - RNA, 64 nt, hsa; identical to SEQ ID NO: 88575

SEQ ID NO: 556296 - RNA, 64 nt, hsa; identical to SEQ ID NO: 88576

SEQ ID NO: 556297 - RNA, 64 nt, hsa; identical to SEQ ID NO: 88577

SEQ ID NO: 556298 - RNA, 64 nt, hsa; identical to SEQ ID NO: 88578

SEQ ID NO: 556299 - RNA, 64 nt, hsa; identical to SEQ ID NO: 88579

SEQ ID NO: 556300 - RNA, 64 nt, hsa; identical to SEQ ID NO: 88580

SEQ ID NO: 556301 - RNA, 64 nt, hsa; identical to SEQ ID NO: 88581

SEQ ID NO: 556302 - RNA, 64 nt, hsa; identical to SEQ ID NO: 88582

SEQ ID NO: 556303 - RNA, 64 nt, hsa; identical to SEQ ID NO: 88583

SEQ ID NO: 556304 - RNA, 64 nt, hsa; identical to SEQ ID NO: 88584

SEQ ID NO: 556305 - RNA, 64 nt, hsa; identical to SEQ ID NO: 88585

SEQ ID NO: 556306 - RNA, 64 nt, hsa; identical to SEQ ID NO: 88586

SEQ ID NO: 556307 - RNA, 64 nt, hsa; identical to SEQ ID NO: 88587

SEQ ID NO: 556308 - RNA, 64 nt, hsa; identical to SEQ ID NO: 88588

SEQ ID NO: 556309 - RNA, 64 nt, hsa; identical to SEQ ID NO: 88589

SEQ ID NO: 556310 - RNA, 64 nt, hsa; identical to SEQ ID NO: 88590

SEQ ID NO: 556311 - RNA, 64 nt, hsa; identical to SEQ ID NO: 88591

SEQ ID NO: 556312 - RNA, 64 nt, hsa; identical to SEQ ID NO: 88592

SEQ ID NO: 556313 - RNA, 64 nt, hsa; identical to SEQ ID NO: 88593

SEQ ID NO: 556314 - RNA, 64 nt, hsa; identical to SEQ ID NO: 239468

SEQ ID NO: 556315 - RNA, 64 nt, hsa; identical to SEQ ID NO: 239469

SEQ ID NO: 556316 - RNA, 64 nt, hsa; identical to SEQ ID NO: 239470

SEQ ID NO: 556317 - RNA, 64 nt, hsa; identical to SEQ ID NO: 239471

SEQ ID NO: 556318 - RNA, 64 nt, hsa; identical to SEQ ID NO: 239472

SEQ ID NO: 556319 - RNA, 64 nt, hsa; identical to SEQ ID NO: 239473

SEQ ID NO: 556320 - RNA, 64 nt, hsa; identical to SEQ ID NO: 239474

SEQ ID NO: 556321 - RNA, 64 nt, hsa; identical to SEQ ID NO: 239475

SEQ ID NO: 556322 - RNA, 64 nt, hsa; identical to SEQ ID NO: 239476

SEQ ID NO: 556323 - RNA, 64 nt, hsa; identical to SEQ ID NO: 239477

SEQ ID NO: 556324 - RNA, 64 nt, hsa; identical to SEQ ID NO: 239478

SEQ ID NO: 556325 - RNA, 64 nt, hsa; identical to SEQ ID NO: 239479

SEQ ID NO: 556326 - RNA, 64 nt, hsa; identical to SEQ ID NO: 239480

SEQ ID NO: 556327 - RNA, 64 nt, hsa; identical to SEQ ID NO: 239481

SEQ ID NO: 556328 - RNA, 64 nt, hsa; identical to SEQ ID NO: 239482

SEQ ID NO: 556329 - RNA, 64 nt, hsa; identical to SEQ ID NO: 239483

SEQ ID NO: 556330 - RNA, 64 nt, hsa; identical to SEQ ID NO: 239484

SEQ ID NO: 556331 - RNA, 64 nt, hsa; identical to SEQ ID NO: 239485

SEQ ID NO: 556332 - RNA, 64 nt, hsa; identical to SEQ ID NO: 239486

SEQ ID NO: 556333 - RNA, 64 nt, hsa; identical to SEQ ID NO: 239487

SEQ ID NO: 556334 - RNA, 64 nt, hsa; identical to SEQ ID NO: 239488

SEQ ID NO: 556335 - RNA, 64 nt, hsa; identical to SEQ ID NO: 239489

SEQ ID NO: 556336 - RNA, 64 nt, hsa; identical to SEQ ID NO: 239490

SEQ ID NO: 556337 - RNA, 64 nt, hsa; identical to SEQ ID NO: 239491

SEQ ID NO: 556338 - RNA, 64 nt, hsa; identical to SEQ ID NO: 239492

SEQ ID NO: 556339 - RNA, 64 nt, hsa; identical to SEQ ID NO: 239493

SEQ ID NO: 556340 - RNA, 64 nt, hsa; identical to SEQ ID NO: 239494

SEQ ID NO: 556341 - RNA, 64 nt, hsa; identical to SEQ ID NO: 239495

SEQ ID NO: 556342 - RNA, 64 nt, hsa; identical to SEQ ID NO: 239496

SEQ ID NO: 556343 - RNA, 64 nt, hsa; identical to SEQ ID NO: 239497

SEQ ID NO: 556344 - RNA, 64 nt, hsa; identical to SEQ ID NO: 239498

SEQ ID NO: 556345 - RNA, 64 nt, hsa; identical to SEQ ID NO: 239499

SEQ ID NO: 556346 - RNA, 64 nt, hsa; identical to SEQ ID NO: 239500

SEQ ID NO: 556347 - RNA, 64 nt, hsa; identical to SEQ ID NO: 239501

SEQ ID NO: 556348 - RNA, 64 nt, hsa; identical to SEQ ID NO: 239502

SEQ ID NO: 556349 - RNA, 64 nt, hsa; identical to SEQ ID NO: 239503

SEQ ID NO: 556350 - RNA, 64 nt, hsa; identical to SEQ ID NO: 239504

SEQ ID NO: 556351 - RNA, 64 nt, hsa; identical to SEQ ID NO: 239505

SEQ ID NO: 556352 - RNA, 64 nt, hsa; identical to SEQ ID NO: 239506

SEQ ID NO: 556353 - RNA, 64 nt, hsa; identical to SEQ ID NO: 239507

SEQ ID NO: 556354 - RNA, 64 nt, hsa; identical to SEQ ID NO: 239508

SEQ ID NO: 556355 - RNA, 64 nt, hsa; identical to SEQ ID NO: 239509

SEQ ID NO: 556356 - RNA, 64 nt, hsa; identical to SEQ ID NO: 239510

SEQ ID NO: 556357 - RNA, 64 nt, hsa; identical to SEQ ID NO: 239511

SEQ ID NO: 556358 - RNA, 64 nt, hsa; identical to SEQ ID NO: 239512

SEQ ID NO: 556359 - RNA, 64 nt, hsa; identical to SEQ ID NO: 239513

SEQ ID NO: 556360 - RNA, 64 nt, hsa; identical to SEQ ID NO: 239514

SEQ ID NO: 556361 - RNA, 64 nt, hsa
gucugcuugucuuagauguugguggugcagccccaggaccaagcuuaaggagaggagagcaucu

SEQ ID NO: 556362 - RNA, 64 nt, hsa
uguccgggggucuaggacuuuagggaucuggggaaggaccaacccaugcccugccaagccugga

SEQ ID NO: 556363 - RNA, 64 nt, hsa
gucuuuuaaucuuaaccccagcuaaaugacucugaggaccaacaguacauuucuuuuauguuuu

SEQ ID NO: 556364 - RNA, 64 nt, hsa
uggcaucagagccagaaaugcccucccuagguccaggaccaaagauaaaacaaacacgaggaac

SEQ ID NO: 556365 - RNA, 64 nt, hsa
ugguuucuucaaccaaaaaagaaagaaauugcaaaggaccaaaaaaauguuggggaaucuauac

SEQ ID NO: 556366 - RNA, 64 nt, hsa
caugugcuuggcacucaaggaucuuccaaaacagaggaccaaccagucuucugaaggucaugcc

SEQ ID NO: 556367 - RNA, 64 nt, hsa
cucuccaacgaccagaauauucuacccaaaugucaggaccaagauuuucuaccaaaauaucagg

SEQ ID NO: 556368 - RNA, 64 nt, hsa
cuggacuaucaucaauauguuguaccuaaaauccaggaccaagacuccccuagagaacagguag

SEQ ID NO: 556369 - RNA, 64 nt, hsa
ugacucucuccccuacacccacuaccuggcauccaggaccaaauaccuggacuaucaaccuugu

SEQ ID NO: 556370 - RNA, 64 nt, hsa
aaacuuuaccacuuggaggacacgggguuaguccaggaccaaagaggccaauggauuuuucaaa

SEQ ID NO: 556371 - RNA, 64 nt, hsa
cugggggaggggugcuguuuuaauuucuaaagguaggaccaacacccaggggaucagugaagga

SEQ ID NO: 556372 - RNA, 64 nt, hsa
augaccaaagacugucagauuucuuagacuccacaggaccaaaccauagaacaauuucacugca

SEQ ID NO: 556373 - RNA, 64 nt, hsa
uuuugguacauauccauaaauucuccauaaaaguaggaccaacuuacauuaccaccaauagugu

SEQ ID NO: 556374 - RNA, 64 nt, hsa
cuucucuuuuccuacuuuacauguaaugguugcgaggaccaacuuucaaaugagcuaacuuggg

SEQ ID NO: 556375 - RNA, 64 nt, hsa; identical to SEQ ID NO: 189259

SEQ ID NO: 556376 - RNA, 64 nt, hsa; identical to SEQ ID NO: 189260

SEQ ID NO: 556377 - RNA, 64 nt, hsa; identical to SEQ ID NO: 189261

SEQ ID NO: 556378 - RNA, 64 nt, hsa; identical to SEQ ID NO: 189262

SEQ ID NO: 556379 - RNA, 56 nt, hsa; identical to SEQ ID NO: 189263

SEQ ID NO: 556380 - RNA, 64 nt, hsa; identical to SEQ ID NO: 189264

SEQ ID NO: 556381 - RNA, 64 nt, hsa; identical to SEQ ID NO: 189265

SEQ ID NO: 556382 - RNA, 64 nt, hsa; identical to SEQ ID NO: 189266

SEQ ID NO: 556383 - RNA, 64 nt, hsa; identical to SEQ ID NO: 189267

SEQ ID NO: 556384 - RNA, 64 nt, hsa; identical to SEQ ID NO: 189268

SEQ ID NO: 556385 - RNA, 64 nt, hsa; identical to SEQ ID NO: 189269

SEQ ID NO: 556386 - RNA, 64 nt, hsa; identical to SEQ ID NO: 189270

SEQ ID NO: 556387 - RNA, 64 nt, hsa; identical to SEQ ID NO: 189271

SEQ ID NO: 556388 - RNA, 64 nt, hsa; identical to SEQ ID NO: 189272

SEQ ID NO: 556389 - RNA, 64 nt, hsa; identical to SEQ ID NO: 189273

SEQ ID NO: 556390 - RNA, 64 nt, hsa; identical to SEQ ID NO: 189274

SEQ ID NO: 556391 - RNA, 64 nt, hsa; identical to SEQ ID NO: 189275

SEQ ID NO: 556392 - RNA, 64 nt, hsa; identical to SEQ ID NO: 189276

SEQ ID NO: 556393 - RNA, 64 nt, hsa; identical to SEQ ID NO: 189277

SEQ ID NO: 556394 - RNA, 64 nt, hsa; identical to SEQ ID NO: 189278

SEQ ID NO: 556395 - RNA, 64 nt, hsa; identical to SEQ ID NO: 189279

SEQ ID NO: 556396 - RNA, 64 nt, hsa; identical to SEQ ID NO: 189280

SEQ ID NO: 556397 - RNA, 64 nt, hsa
cuauaugaaacauaaguuguguuauaacuuaucagccguauauggaacauaaauaguuucuacc

SEQ ID NO: 556398 - RNA, 64 nt, hsa
cccuacuggcaagguuuuuaaaaaugagguaaaugccguauaugaucaauuaccuuaauuggcc

SEQ ID NO: 556399 - RNA, 64 nt, hsa
ucacugaaauguuagguuuccuaaaggguacagugccguauaaaacaaccugccucauauauuu

SEQ ID NO: 556400 - RNA, 63 nt, hsa
ccaggauucccggcagaagaaccccaugacugcagccguauagcugagugccaccgaggccag

SEQ ID NO: 556401 - RNA, 64 nt, hsa
caaagaguuugcauuugaaaauaauaaaguaguugccguauacaacccugcaaucugguugucu

SEQ ID NO: 556402 - RNA, 61 nt, hsa
ggcucuuggaacugggauaauaaggcagucugccguauagaucauuccuucccuuuauucc

SEQ ID NO: 556403 - RNA, 64 nt, hsa
aaauuuacaucagaaguuugcaucucgcguauaugccguauaaaagaauuuuuuugucuuucaa

SEQ ID NO: 556404 - RNA, 64 nt, hsa
aaaaccuagauacugcagucagauuuuggaaacugccguauagucacuguuuuaaaaaccccgg

SEQ ID NO: 556405 - RNA, 64 nt, hsa
auuuguauucaugaacuuggcuguaaucaguuaugccguauaggaugucagacaauaccacugg

SEQ ID NO: 556406 - RNA, 64 nt, hsa
agcauuuagauaaucuugugcaaaauguguuucagccguauaguggauccacuuuuuuuuuuuu

SEQ ID NO: 556407 - RNA, 64 nt, hsa
ugauacugacuugaauuauuuucuaaaauuaagagccguauaccuaccuguaagucuuuucaca

SEQ ID NO: 556408 - RNA, 64 nt, hsa
auaaauaaguguagcaucagaagcaguaggaauggccguauacaaccauccuguuaaacauuua

SEQ ID NO: 556409 - RNA, 64 nt, hsa
augcaugcugcucacccuagacaaugacauauaagccguauauagaucaauguccacauauaua

SEQ ID NO: 556410 - RNA, 64 nt, hsa
uugggaagggaaggccaggccaaaagcuccaccggccguauagauaauguacucgcaguuuugu

SEQ ID NO: 556411 - RNA, 64 nt, hsa
auguguccaauauugugccagggauacaaauauggccguauagccucaggccuucauuucugaa

SEQ ID NO: 556412 - RNA, 64 nt, hsa
guuuuuggauaaucuaguucaugugcauuaggcugccguauauacuacuaugauauuuagcugc

SEQ ID NO: 556413 - RNA, 64 nt, hsa
gccaucacgucaagcuuuggauaacgaugaaugagccguauacaaggaauaugacauacagugc

SEQ ID NO: 556414 - RNA, 64 nt, hsa
auuucucuuacguugaauccccaaucauaauuaagccguauacacagauuaaauuaacagaagc

SEQ ID NO: 556415 - RNA, 64 nt, hsa
aggaccauguaugagacacuuuuuuacaaaaagugccguauauacauauguaacaggugagugu

SEQ ID NO: 556416 - RNA, 64 nt, hsa
ccggccuccccacuggguccuggaccuggcgcaggccguauagacucagguccugaugagggcg

SEQ ID NO: 556417 - RNA, 64 nt, hsa
ucaggagucauuagcagugaugauuuuggguccugccguauaaucuguucuucuauucccacgu

SEQ ID NO: 556418 - RNA, 64 nt, hsa
cucaccggccagagaagaccacugugagcauuuugccguauauccugcccugccauuuguucac

SEQ ID NO: 556419 - RNA, 64 nt, hsa
gaguuagcguccuguagauacacacagagacuaggccguauauuaacuagaagcagcuuuaugu

SEQ ID NO: 556420 - RNA, 64 nt, hsa
ucuccucuggucugccccuuuucaaauccuaauggccguauaucuccuuuggcaagagcugggu

SEQ ID NO: 556421 - RNA, 64 nt, hsa
cuggauauuaucucccuuuauaaacuugguguaggccguauauuuugaaaauaaacaucugguu

SEQ ID NO: 556422 - RNA, 64 nt, hsa
acugaucugugauugcucucccuuugugucuacugccguauacauauauacaacuauauauaca

SEQ ID NO: 556423 - RNA, 63 nt, hsa; identical to SEQ ID NO: 354303

SEQ ID NO: 556424 - RNA, 63 nt, hsa; identical to SEQ ID NO: 354304

SEQ ID NO: 556425 - RNA, 63 nt, hsa; identical to SEQ ID NO: 354305

SEQ ID NO: 556426 - RNA, 63 nt, hsa; identical to SEQ ID NO: 354306

SEQ ID NO: 556427 - RNA, 63 nt, hsa; identical to SEQ ID NO: 354307

SEQ ID NO: 556428 - RNA, 63 nt, hsa; identical to SEQ ID NO: 354308

SEQ ID NO: 556429 - RNA, 63 nt, hsa; identical to SEQ ID NO: 354309

SEQ ID NO: 556430 - RNA, 63 nt, hsa; identical to SEQ ID NO: 354310

SEQ ID NO: 556431 - RNA, 62 nt, hsa
gcaacaggaggcugggaaaugguggggaguggggccguaacuggguacaauagggggaaccu

SEQ ID NO: 556432 - RNA, 62 nt, hsa
caguuuggcuucacuucucugaccccagccucggccguaaagugaaagagaccggaccagcu

SEQ ID NO: 556433 - RNA, 62 nt, hsa
agcuacugaguggaacauggagcugaucaagaggccguaauggucauggcuguuucccagac

SEQ ID NO: 556434 - RNA, 62 nt, hsa
cauucagaggaggaggggauuucucucuucaaggccguaacaguggaagaacagucauaugc

SEQ ID NO: 556435 - RNA, 62 nt, hsa
cucugggggggccggaaagucucccuggagaaggccguaauaucugggccuuggaaggaagg

SEQ ID NO: 556436 - RNA, 62 nt, hsa
aaguccuuucccgaugcguggcucccagcagaggccguaaauugagcguucaguugacacau

SEQ ID NO: 556437 - RNA, 62 nt, hsa
ggaauuucguugccauuuuuucucagacaccuggccguaaaaucaguuuguuacagcauucu

SEQ ID NO: 556438 - RNA, 62 nt, hsa
uggauacgggaccuggcccugagguuauuacuggccguaaggcagaguuaauccauacagaa

SEQ ID NO: 556439 - RNA, 62 nt, hsa
gauagucaccagggccagaaagcucauggaguggccguaaugagaauauguuugaagaucaa

SEQ ID NO: 556440 - RNA, 62 nt, hsa
ccaguggggaguguucuguuccggcauauccuggccguaacgauuuuuauaguuauggacua

SEQ ID NO: 556441 - RNA, 62 nt, hsa
guauuucuuuguaucaugguuaugcuuugacuggccguaaguucucucagcuuuuguuuguc

SEQ ID NO: 556442 - RNA, 62 nt, hsa
uauagcauuguuuacucagucaaguucaccauggccguaauccuucuaagggaaacacuaaa

SEQ ID NO: 556443 - RNA, 62 nt, hsa
cggggacagccacacugcgcgcggggcccgcaggccguaauaaagaguggcucgaccucgcu

SEQ ID NO: 556444 - RNA, 62 nt, hsa
ugucugggaaccugaucaccagcuucucuggaggccguaaagauggauuucuaaacccacug

SEQ ID NO: 556445 - RNA, 62 nt, hsa
uggugcaggagggacuggacagaucugaggaaggccguaaaauggggacaggaggauucagc

SEQ ID NO: 556446 - RNA, 62 nt, hsa
ccuguuugcagaccccaugcaccagcuggaggggccguaacugcaggacugcgccuacugag

SEQ ID NO: 556447 - RNA, 62 nt, hsa
ucucuaccagauaacugaggaggggagaggugggccguaacgggcacggaucacgauguaaa

SEQ ID NO: 556448 - RNA, 62 nt, hsa
ugcaugaaugucgacacuguagccacaguuuuggccguaaaugugaauuuggcaaguaacca

SEQ ID NO: 556449 - RNA, 64 nt, hsa
cacugaaauguuagguuuccuaaaggguacagugccguauaaaacaaccugccucauauauuuc

SEQ ID NO: 556450 - RNA, 64 nt, hsa
aguaccuguguaauaaugcucaaccuucaugucuccguauaaacgaaacuuuccaugagagcuc

SEQ ID NO: 556451 - RNA, 64 nt, hsa
acugugacuagguucacagccuuuguggaacauuccguauaacggcauuguggaagcaauaacu

SEQ ID NO: 556452 - RNA, 64 nt, hsa
guuaauaucagugcagacugucuccucuacgugaccguauaauguuuuucucuucuuguagucu

SEQ ID NO: 556453 - RNA, 64 nt, hsa
aauuuacaucagaaguuugcaucucgcguauaugccguauaaaagaauuuuuuugucuuucaau

SEQ ID NO: 556454 - RNA, 64 nt, hsa
gugcugauaaaccccaaguaaauuaacccuuuuuccguauaaauccauuuuuuguuuugaagag

SEQ ID NO: 556455 - RNA, 64 nt, hsa
gcgagccugccacgcuugugacuggggaggggcuccguauaaucucaccuuugcaagcguuuau

SEQ ID NO: 556456 - RNA, 64 nt, hsa
caaaguuguuuaacuagacugcguguuguuuuucccguauaauaaaaccaaagaauaguuuggu

SEQ ID NO: 556457 - RNA, 64 nt, hsa
caggagucauuagcagugaugauuuuggguccugccguauaaucuguucuucuauucccacguu

SEQ ID NO: 556458 - RNA, 64 nt, hsa
gcuguuaccucagauuuaaucacugguugaaacuccguauaaucuguagagccuccauggcucu

SEQ ID NO: 556459 - RNA, 64 nt, hsa
guuugcaguuguuuuuguguggaaucuugucuuuccguauaaguuguaagcuccuugagagcag

SEQ ID NO: 556460 - RNA, 64 nt, hsa
guguuacauaagaauuuauuugcuaucgacauucccguauaaagagagagacauaucacgcugc

SEQ ID NO: 556461 - RNA, 64 nt, hsa
gugcaacucacauuuuucacugcucugugccuguccguauaagcucaaugaguauugauuuagg

SEQ ID NO: 556462 - RNA, 64 nt, hsa
uggauuaggcguguuggcuacaucuuucccacaaccguauaacgaccgauggucauuucuccaa

SEQ ID NO: 556463 - RNA, 64 nt, hsa
uucaaauguaagcaaaccacugaugaccacugguccguauaacacauuuuaccaacagcuccuu

SEQ ID NO: 556464 - RNA, 66 nt, hsa
uucacugaaauguuagguuuccuaaaggguacagugccguauaaaacaaccugccucauauauuuc

SEQ ID NO: 556465 - RNA, 66 nt, hsa
cgaguaccuguguaauaaugcucaaccuucaugucuccguauaaacgaaacuuuccaugagagcuc

SEQ ID NO: 556466 - RNA, 66 nt, hsa
agacugugacuagguucacagccuuuguggaacauuccguauaacggcauuguggaagcaauaacu

SEQ ID NO: 556467 - RNA, 66 nt, hsa
guguuaauaucagugcagacugucuccucuacgugaccguauaauguuuuucucuucuuguagucu

SEQ ID NO: 556468 - RNA, 66 nt, hsa
caaauuuacaucagaaguuugcaucucgcguauaugccguauaaaagaauuuuuuugucuuucaau

SEQ ID NO: 556469 - RNA, 66 nt, hsa
gugugcugauaaaccccaaguaaauuaacccuuuuuccguauaaauccauuuuuuguuuugaagag

SEQ ID NO: 556470 - RNA, 66 nt, hsa
uagcgagccugccacgcuugugacuggggaggggcuccguauaaucucaccuuugcaagcguuuau

SEQ ID NO: 556471 - RNA, 66 nt, hsa
cacaaaguuguuuaacuagacugcguguuguuuuucccguauaauaaaaccaaagaauaguuuggu

SEQ ID NO: 556472 - RNA, 66 nt, hsa
uucaggagucauuagcagugaugauuuuggguccugccguauaaucuguucuucuauucccacguu

SEQ ID NO: 556473 - RNA, 66 nt, hsa
augcuguuaccucagauuuaaucacugguugaaacuccguauaaucuguagagccuccauggcucu

SEQ ID NO: 556474 - RNA, 66 nt, hsa
ugguuugcaguuguuuuuguguggaaucuugucuuuccguauaaguuguaagcuccuugagagcag

SEQ ID NO: 556475 - RNA, 66 nt, hsa
auguguuacauaagaauuuauuugcuaucgacauucccguauaaagagagagacauaucacgcugc

SEQ ID NO: 556476 - RNA, 66 nt, hsa
cagugcaacucacauuuuucacugcucugugccuguccguauaagcucaaugaguauugauuuagg

SEQ ID NO: 556477 - RNA, 66 nt, hsa
gcuggauuaggcguguuggcuacaucuuucccacaaccguauaacgaccgauggucauuucuccaa

SEQ ID NO: 556478 - RNA, 66 nt, hsa
gauucaaauguaagcaaaccacugaugaccacugguccguauaacacauuuuaccaacagcuccuu

SEQ ID NO: 556479 - RNA, 64 nt, hsa; identical to SEQ ID NO: 503217

SEQ ID NO: 556480 - RNA, 64 nt, hsa; identical to SEQ ID NO: 503218

SEQ ID NO: 556481 - RNA, 64 nt, hsa; identical to SEQ ID NO: 503219

SEQ ID NO: 556482 - RNA, 64 nt, hsa; identical to SEQ ID NO: 503220

SEQ ID NO: 556483 - RNA, 64 nt, hsa
aaugcaaaguguuuucucagaacagcugaaacauuccgaagagggaauggauggggagaauggu

SEQ ID NO: 556484 - RNA, 64 nt, hsa
auucauuuugcaugguuuuaaaauuaaaaauaauuccgaagauacaccagcucacaaaugaaaa

SEQ ID NO: 556485 - RNA, 64 nt, hsa
auuuuccauacacauccccagccagaaguuaguguccgaagaccgaauuuuauuuuacagagcu

SEQ ID NO: 556486 - RNA, 64 nt, hsa
gcgacagauucaugccacggauaaaugaggcaaauccgaagaaaaggaaaaucgaauaaaaaau

SEQ ID NO: 556487 - RNA, 64 nt, hsa
ugugacucgcuuagcugaaaccuaaggcaacauuuccgaagaccuucugaagaucucagauaaa

SEQ ID NO: 556488 - RNA, 64 nt, hsa
aauggcccauuagauacaacagcaagcccaagauuccgaagaagacagacaacucccccuagua

SEQ ID NO: 556489 - RNA, 64 nt, hsa
cugugcccaagggacucugauuauccaagcaucuuccgaagaguguuguggucaccuuaaagag

SEQ ID NO: 556490 - RNA, 64 nt, hsa
guuuaagcccuuggacugagggugggaucgcagcuccgaagacggagaggagggaaauggggcc

SEQ ID NO: 556491 - RNA, 64 nt, hsa
agccugugaugucuuaugaaccuuaugagaaaacuccgaagaggugugagcaggauucuucuga

SEQ ID NO: 556492 - RNA, 64 nt, hsa
aaauuucccauaggaagacuucaccuccuacaacuccgaagaaaacccuuacuguccaagaccg

SEQ ID NO: 556493 - RNA, 64 nt, hsa
aacaaacaauaugcacuucuuuucugaagaugcuuccgaagauuugaaaauaggauccaaaaca

SEQ ID NO: 556494 - RNA, 64 nt, hsa
gcugugagcaaaguggccgccggggaacgggugguccgaagaccuucauaccuagaccuguucc

SEQ ID NO: 556495 - RNA, 64 nt, hsa
gaacauguugcgauugaauucuaaccucuuugacuccgaagaugaaugaaguguauaacugucu

SEQ ID NO: 556496 - RNA, 64 nt, hsa
ggaauacauguuugggauuuuuauuuuuuacguguccgaagauaagcuccaggucuuaucguau

SEQ ID NO: 556497 - RNA, 64 nt, hsa
cccuugcuucagaggccugauggcgucggacuauuccgaagaaguggccaccuccgaaaaauuc

SEQ ID NO: 556498 - RNA, 55 nt, hsa
cuagcuacagccaaucuuaaaacauuccgaagaauuccauaguggaccacuugga

SEQ ID NO: 556499 - RNA, 64 nt, hsa
cacuugagacuaugguugacuaaugcucuauaaauccgaagagaguucggacuauaaguauuua

SEQ ID NO: 556500 - RNA, 64 nt, hsa
ccaugugcagcuuucuuuuuuguuagaugccacauccgaagacucaucgcaguguguuauauga

SEQ ID NO: 556501 - RNA, 64 nt, hsa
uuuggaguuuucuguuggaaccgccggcguuggcuccgaagacuuagcgacgccacuggcggca

SEQ ID NO: 556502 - RNA, 64 nt, hsa
gaccuccauuuugauacuuguagaccagaucuaauccgaagauuaaucuuuagguaacagaugg

SEQ ID NO: 556503 - RNA, 64 nt, hsa
gacaaaacuggagaugcaucgggaaagaagaaacuccgaagaaaagaauuuuaguguuaaugac

SEQ ID NO: 556504 - RNA, 64 nt, hsa
cccgucuuccagagaaccugugggcugacugcccuccgaagagaguucuggaugucuggcucaa

SEQ ID NO: 556505 - RNA, 64 nt, hsa
acuguuggacucuaccucacuggucuggaaguccuccgaagacauuauuuuuccaaaggaauuu

SEQ ID NO: 556506 - RNA, 58 nt, hsa
auuuuucaggaagcuacuaaagugcuguuccgaagaauaggcugaaacaaaaauauaa

SEQ ID NO: 556507 - RNA, 64 nt, hsa
aagaccagccuggacagcuuagugagaucccgucuccgaagaaaagauauguauucuaauuggc

SEQ ID NO: 556508 - RNA, 64 nt, hsa
cccagcaccucagccugcacagugucccccagguuccgaagaagaugcuccagcaacacagccu

SEQ ID NO: 556509 - RNA, 64 nt, hsa
aguugauuuuguuuuuagcuuacugcugccuuuguccgaagaaacuguuccuccauuauuugaa

SEQ ID NO: 556510 - RNA, 64 nt, hsa
uuaaaagacuucuuaaucuucuagaagaaaaaucuccgaagagcucucucuagaaguccaaaau

SEQ ID NO: 556511 - RNA, 64 nt, hsa
uuaggaagaaacaaggacaaauuuagaccuugaauccgaagagauaaagcuuacuugacuuuca

SEQ ID NO: 556512 - RNA, 64 nt, hsa
cauccuagggaacaaggaaccagcaguaagugguuccgaagacaggcagggacaguggcucaaa

SEQ ID NO: 556513 - RNA, 64 nt, hsa
aaggauucuuuacugugccagcacggggauuggauccgaagaaacuggcuacugggguuuggcc

SEQ ID NO: 556514 - RNA, 64 nt, hsa
ugcuuucaagagcauuucguaggaucuguccccauccgaagaggcuuugugaacugccugcuga

SEQ ID NO: 556515 - RNA, 64 nt, hsa
cccuccugcaguuggacugaauucuucccuuucauccgaagaaacccacuugcuguuuccagcc

SEQ ID NO: 556516 - RNA, 64 nt, hsa
ggaggacaggcuguaugucagauuuaccuuuuauuccgaagaacucggagcauuuauuuuguua

SEQ ID NO: 556517 - RNA, 64 nt, hsa
gaggggcacagugaagaagggagcccaccaccucuccgaagaggaaagccacguagagugguug

SEQ ID NO: 556518 - RNA, 64 nt, hsa
aagacgcucuccaaagggcaggaaguacagcacuuccgaagaguuuaguuggcccuuugcuggu

SEQ ID NO: 556519 - RNA, 64 nt, hsa
ccagcugcugccgcuggaggauccggaaagaguuuccgaagagugaagggcaguacaguggcuu

SEQ ID NO: 556520 - RNA, 64 nt, hsa
gccacacgagagcuccaggcucugggcuggucacuccgaagaagaggauuugugacgucacuua

SEQ ID NO: 556521 - RNA, 64 nt, hsa
cuacguaauggagggaagaauuucccagccaucuuccgaagaauacaagaucccguccuccagg

SEQ ID NO: 556522 - RNA, 64 nt, hsa
uggccuccuggcagaagccgagugugcuggggucuccgaagagggucccuccuuuuugggggaa

SEQ ID NO: 556523 - RNA, 64 nt, hsa
gcuccuaagggggcaggcgugugaguggacgccauccgaagacagcacuugaccucggguggaa

SEQ ID NO: 556524 - RNA, 64 nt, hsa
acagcucuuccagggcagcggcuccacuuucucauccgaagaugguggccacagacugaccccc

SEQ ID NO: 556525 - RNA, 64 nt, hsa
aaaugaggugcaccccaggaaggccccguagaccuccgaagacuccacaagaaacuaauggauc

SEQ ID NO: 556526 - RNA, 64 nt, hsa
gaugcaggcauuaccagcagggagcagacuuaccuccgaagauggagacaggugacugagagcu

SEQ ID NO: 556527 - RNA, 64 nt, hsa
cugcaacgaagacacuccuucuguccccaccugcuccgaagacaaaccaaccuccguuucuuuu

SEQ ID NO: 556528 - RNA, 64 nt, hsa
gucccuagccugcaacauuuaugucgcaugucaauccgaagagugaugcccacccaagaaguuc

SEQ ID NO: 556529 - RNA, 64 nt, hsa
aaaacuaaaggaacucccuccccaccugcaggacuccgaagacagugcgacuucuggcugcaga

SEQ ID NO: 556530 - RNA, 64 nt, hsa
ucccccgacccauagccauguuuuaaagucaccuuccgaagagaagugaaagguucaaggacac

SEQ ID NO: 556531 - RNA, 64 nt, hsa
guuucugggcagaagcuuaucuuuuuugagaguguccgaagaugaaggcauggcgaugcccguc

SEQ ID NO: 556532 - RNA, 64 nt, hsa
acgggcggcucgcccgccucuggaucagcuggccuccgaagagccguggacuguccuacccgag

SEQ ID NO: 556533 - RNA, 64 nt, hsa
cgagccuguacucugccugacgaggaacgcuggcuccgaagaggcccuguguagaaggcuguca

SEQ ID NO: 556534 - RNA, 64 nt, hsa
ccacuacuuaagaucggaaguuaagagagcucccuccgaagagaaaauuuuuauacuaaaaucu

SEQ ID NO: 556535 - RNA, 64 nt, hsa
gacagcugacagggucuauggccaucgggucgucuccgaagauuuggcaggggcagaaaacucu

SEQ ID NO: 556536 - RNA, 64 nt, hsa
cccccugagccauugugggggucgaucaugaauguccgaagaguggccuuuucccguagcccug

SEQ ID NO: 556537 - RNA, 64 nt, hsa
gagugaguuuguguguaugaauuuguaccuguuuuccgaagaaaaaagcaauacugaacaaaac

SEQ ID NO: 556538 - RNA, 64 nt, hsa
ugggauuguuuuguggggggagggaagggaguguuccgaagaugcuguaguaacugccucagug

SEQ ID NO: 556539 - RNA, 64 nt, hsa
ugagcuucagugaggugccaccagcacccgugccuccgaagaccgcucgggcauuccgccugcg

SEQ ID NO: 556540 - RNA, 64 nt, hsa
acuucacuaaagugucauccaccaguguguugaauccgaagaaugacaauuuucuaccacuggu

SEQ ID NO: 556541 - RNA, 64 nt, hsa
guggcugugaugaccuugggccagaaggucaaacuccgaagacugaaacucugccugcagcagg

SEQ ID NO: 556542 - RNA, 64 nt, hsa
cuccacuacagacccagccccagguucaauguccuccgaagaaugaagucuuucccuggugaug

SEQ ID NO: 556543 - RNA, 64 nt, hsa
cacaccaacacugagacgccuucccaugaaaaauuccgaagaugcucaagagggagguuuccuc

SEQ ID NO: 556544 - RNA, 64 nt, hsa
agacuuuuccuauacccagaaaucccuuugcauuuccgaagaucagauauuuugcuuaaagguc

SEQ ID NO: 556545 - RNA, 64 nt, hsa
agaauagacagaauuggaaaauacugcagacauuuccgaagaguuuauaaagcacagugaauuc

SEQ ID NO: 556546 - RNA, 64 nt, hsa; identical to SEQ ID NO: 147946

SEQ ID NO: 556547 - RNA, 64 nt, hsa; identical to SEQ ID NO: 147947

SEQ ID NO: 556548 - RNA, 64 nt, hsa; identical to SEQ ID NO: 196485

SEQ ID NO: 556549 - RNA, 64 nt, hsa; identical to SEQ ID NO: 196486

SEQ ID NO: 556550 - RNA, 64 nt, hsa; identical to SEQ ID NO: 196487

SEQ ID NO: 556551 - RNA, 64 nt, hsa; identical to SEQ ID NO: 196488

SEQ ID NO: 556552 - RNA, 64 nt, hsa; identical to SEQ ID NO: 196489

SEQ ID NO: 556553 - RNA, 64 nt, hsa; identical to SEQ ID NO: 196490

SEQ ID NO: 556554 - RNA, 64 nt, hsa; identical to SEQ ID NO: 196491

SEQ ID NO: 556555 - RNA, 64 nt, hsa; identical to SEQ ID NO: 196492

SEQ ID NO: 556556 - RNA, 64 nt, hsa; identical to SEQ ID NO: 196493

SEQ ID NO: 556557 - RNA, 64 nt, hsa; identical to SEQ ID NO: 196494

SEQ ID NO: 556558 - RNA, 64 nt, hsa; identical to SEQ ID NO: 196495

SEQ ID NO: 556559 - RNA, 64 nt, hsa; identical to SEQ ID NO: 196496

SEQ ID NO: 556560 - RNA, 64 nt, hsa; identical to SEQ ID NO: 196497

SEQ ID NO: 556561 - RNA, 64 nt, hsa; identical to SEQ ID NO: 196498

SEQ ID NO: 556562 - RNA, 64 nt, hsa; identical to SEQ ID NO: 196499

SEQ ID NO: 556563 - RNA, 64 nt, hsa; identical to SEQ ID NO: 196500

SEQ ID NO: 556564 - RNA, 64 nt, hsa; identical to SEQ ID NO: 196501

SEQ ID NO: 556565 - RNA, 64 nt, hsa; identical to SEQ ID NO: 196502

SEQ ID NO: 556566 - RNA, 64 nt, hsa; identical to SEQ ID NO: 196503

SEQ ID NO: 556567 - RNA, 64 nt, hsa; identical to SEQ ID NO: 196504

SEQ ID NO: 556568 - RNA, 64 nt, hsa; identical to SEQ ID NO: 196505

SEQ ID NO: 556569 - RNA, 64 nt, hsa; identical to SEQ ID NO: 196506

SEQ ID NO: 556570 - RNA, 64 nt, hsa; identical to SEQ ID NO: 196507

SEQ ID NO: 556571 - RNA, 64 nt, hsa; identical to SEQ ID NO: 196508

SEQ ID NO: 556572 - RNA, 64 nt, hsa; identical to SEQ ID NO: 196509

SEQ ID NO: 556573 - RNA, 64 nt, hsa; identical to SEQ ID NO: 196510

SEQ ID NO: 556574 - RNA, 64 nt, hsa; identical to SEQ ID NO: 196511

SEQ ID NO: 556575 - RNA, 64 nt, hsa; identical to SEQ ID NO: 196512

SEQ ID NO: 556576 - RNA, 64 nt, hsa; identical to SEQ ID NO: 196513

SEQ ID NO: 556577 - RNA, 64 nt, hsa; identical to SEQ ID NO: 196514

SEQ ID NO: 556578 - RNA, 64 nt, hsa; identical to SEQ ID NO: 196515

SEQ ID NO: 556579 - RNA, 64 nt, hsa; identical to SEQ ID NO: 196516

SEQ ID NO: 556580 - RNA, 64 nt, hsa; identical to SEQ ID NO: 196517

SEQ ID NO: 556581 - RNA, 64 nt, hsa; identical to SEQ ID NO: 196518

SEQ ID NO: 556582 - RNA, 64 nt, hsa; identical to SEQ ID NO: 196519

SEQ ID NO: 556583 - RNA, 64 nt, hsa; identical to SEQ ID NO: 196520

SEQ ID NO: 556584 - RNA, 64 nt, hsa; identical to SEQ ID NO: 196521

SEQ ID NO: 556585 - RNA, 64 nt, hsa; identical to SEQ ID NO: 196522

SEQ ID NO: 556586 - RNA, 64 nt, hsa; identical to SEQ ID NO: 196523

SEQ ID NO: 556587 - RNA, 64 nt, hsa; identical to SEQ ID NO: 196524

SEQ ID NO: 556588 - RNA, 64 nt, hsa; identical to SEQ ID NO: 196525

SEQ ID NO: 556589 - RNA, 64 nt, hsa; identical to SEQ ID NO: 196526

SEQ ID NO: 556590 - RNA, 64 nt, hsa; identical to SEQ ID NO: 196527

SEQ ID NO: 556591 - RNA, 64 nt, hsa; identical to SEQ ID NO: 196528

SEQ ID NO: 556592 - RNA, 64 nt, hsa; identical to SEQ ID NO: 196529

SEQ ID NO: 556593 - RNA, 64 nt, hsa; identical to SEQ ID NO: 196530

SEQ ID NO: 556594 - RNA, 64 nt, hsa; identical to SEQ ID NO: 196531

SEQ ID NO: 556595 - RNA, 64 nt, hsa; identical to SEQ ID NO: 196532

SEQ ID NO: 556596 - RNA, 64 nt, hsa; identical to SEQ ID NO: 196533

SEQ ID NO: 556597 - RNA, 64 nt, hsa; identical to SEQ ID NO: 196534

SEQ ID NO: 556598 - RNA, 64 nt, hsa; identical to SEQ ID NO: 196535

SEQ ID NO: 556599 - RNA, 64 nt, hsa; identical to SEQ ID NO: 196536

SEQ ID NO: 556600 - RNA, 64 nt, hsa; identical to SEQ ID NO: 196537

SEQ ID NO: 556601 - RNA, 64 nt, hsa; identical to SEQ ID NO: 196538

SEQ ID NO: 556602 - RNA, 64 nt, hsa; identical to SEQ ID NO: 196539

SEQ ID NO: 556603 - RNA, 64 nt, hsa; identical to SEQ ID NO: 196540

SEQ ID NO: 556604 - RNA, 64 nt, hsa; identical to SEQ ID NO: 196541

SEQ ID NO: 556605 - RNA, 64 nt, hsa; identical to SEQ ID NO: 196542

SEQ ID NO: 556606 - RNA, 64 nt, hsa; identical to SEQ ID NO: 196543

SEQ ID NO: 556607 - RNA, 64 nt, hsa; identical to SEQ ID NO: 196544

SEQ ID NO: 556608 - RNA, 64 nt, hsa; identical to SEQ ID NO: 196545

SEQ ID NO: 556609 - RNA, 64 nt, hsa; identical to SEQ ID NO: 196546

SEQ ID NO: 556610 - RNA, 64 nt, hsa; identical to SEQ ID NO: 196547

SEQ ID NO: 556611 - RNA, 64 nt, hsa; identical to SEQ ID NO: 196548

SEQ ID NO: 556612 - RNA, 64 nt, hsa; identical to SEQ ID NO: 196549

SEQ ID NO: 556613 - RNA, 64 nt, hsa; identical to SEQ ID NO: 196550

SEQ ID NO: 556614 - RNA, 64 nt, hsa; identical to SEQ ID NO: 196551

SEQ ID NO: 556615 - RNA, 64 nt, hsa; identical to SEQ ID NO: 196551

SEQ ID NO: 556616 - RNA, 64 nt, hsa; identical to SEQ ID NO: 196553

SEQ ID NO: 556617 - RNA, 64 nt, hsa; identical to SEQ ID NO: 196554

SEQ ID NO: 556618 - RNA, 64 nt, hsa; identical to SEQ ID NO: 196555

SEQ ID NO: 556619 - RNA, 64 nt, hsa; identical to SEQ ID NO: 196556

SEQ ID NO: 556620 - RNA, 64 nt, hsa; identical to SEQ ID NO: 196557

SEQ ID NO: 556621 - RNA, 64 nt, hsa; identical to SEQ ID NO: 196558

SEQ ID NO: 556622 - RNA, 64 nt, hsa; identical to SEQ ID NO: 196559

SEQ ID NO: 556623 - RNA, 64 nt, hsa; identical to SEQ ID NO: 196560

SEQ ID NO: 556624 - RNA, 64 nt, hsa; identical to SEQ ID NO: 196561

SEQ ID NO: 556625 - RNA, 64 nt, hsa; identical to SEQ ID NO: 196562

SEQ ID NO: 556626 - RNA, 64 nt, hsa; identical to SEQ ID NO: 196563

SEQ ID NO: 556627 - RNA, 64 nt, hsa; identical to SEQ ID NO: 196564

SEQ ID NO: 556628 - RNA, 64 nt, hsa; identical to SEQ ID NO: 196565

SEQ ID NO: 556629 - RNA, 64 nt, hsa; identical to SEQ ID NO: 196566

SEQ ID NO: 556630 - RNA, 64 nt, hsa; identical to SEQ ID NO: 196567

SEQ ID NO: 556631 - RNA, 64 nt, hsa; identical to SEQ ID NO: 196568

SEQ ID NO: 556632 - RNA, 64 nt, hsa; identical to SEQ ID NO: 196569

SEQ ID NO: 556633 - RNA, 64 nt, hsa; identical to SEQ ID NO: 196570

SEQ ID NO: 556634 - RNA, 64 nt, hsa; identical to SEQ ID NO: 196571

SEQ ID NO: 556635 - RNA, 64 nt, hsa; identical to SEQ ID NO: 196572

SEQ ID NO: 556636 - RNA, 64 nt, hsa; identical to SEQ ID NO: 223465

SEQ ID NO: 556637 - RNA, 64 nt, hsa; identical to SEQ ID NO: 223466

SEQ ID NO: 556638 - RNA, 64 nt, hsa; identical to SEQ ID NO: 223467

SEQ ID NO: 556639 - RNA, 64 nt, hsa; identical to SEQ ID NO: 223468

SEQ ID NO: 556640 - RNA, 64 nt, hsa; identical to SEQ ID NO: 223469

SEQ ID NO: 556641 - RNA, 64 nt, hsa; identical to SEQ ID NO: 223470

SEQ ID NO: 556642 - RNA, 64 nt, hsa; identical to SEQ ID NO: 223471

SEQ ID NO: 556643 - RNA, 64 nt, hsa; identical to SEQ ID NO: 223472

SEQ ID NO: 556644 - RNA, 64 nt, hsa; identical to SEQ ID NO: 223473

SEQ ID NO: 556645 - RNA, 64 nt, hsa; identical to SEQ ID NO: 223474

SEQ ID NO: 556646 - RNA, 64 nt, hsa; identical to SEQ ID NO: 223475

SEQ ID NO: 556647 - RNA, 64 nt, hsa; identical to SEQ ID NO: 223476

SEQ ID NO: 556648 - RNA, 64 nt, hsa; identical to SEQ ID NO: 223477

SEQ ID NO: 556649 - RNA, 64 nt, hsa; identical to SEQ ID NO: 223478

SEQ ID NO: 556650 - RNA, 64 nt, hsa; identical to SEQ ID NO: 223479

SEQ ID NO: 556651 - RNA, 64 nt, hsa; identical to SEQ ID NO: 223480

SEQ ID NO: 556652 - RNA, 64 nt, hsa; identical to SEQ ID NO: 223481

SEQ ID NO: 556653 - RNA, 64 nt, hsa; identical to SEQ ID NO: 223482

SEQ ID NO: 556654 - RNA, 64 nt, hsa; identical to SEQ ID NO: 223483

SEQ ID NO: 556655 - RNA, 64 nt, hsa; identical to SEQ ID NO: 223484

SEQ ID NO: 556656 - RNA, 64 nt, hsa; identical to SEQ ID NO: 223485

SEQ ID NO: 556657 - RNA, 64 nt, hsa; identical to SEQ ID NO: 223486

SEQ ID NO: 556658 - RNA, 64 nt, hsa; identical to SEQ ID NO: 223487

SEQ ID NO: 556659 - RNA, 64 nt, hsa; identical to SEQ ID NO: 223488

SEQ ID NO: 556660 - RNA, 64 nt, hsa; identical to SEQ ID NO: 223489

SEQ ID NO: 556661 - RNA, 64 nt, hsa; identical to SEQ ID NO: 223490

SEQ ID NO: 556662 - RNA, 64 nt, hsa; identical to SEQ ID NO: 223491

SEQ ID NO: 556663 - RNA, 64 nt, hsa; identical to SEQ ID NO: 223492

SEQ ID NO: 556664 - RNA, 64 nt, hsa; identical to SEQ ID NO: 223493

SEQ ID NO: 556665 - RNA, 64 nt, hsa; identical to SEQ ID NO: 223494

SEQ ID NO: 556666 - RNA, 64 nt, hsa; identical to SEQ ID NO: 223495

SEQ ID NO: 556667 - RNA, 64 nt, hsa; identical to SEQ ID NO: 223496

SEQ ID NO: 556668 - RNA, 64 nt, hsa; identical to SEQ ID NO: 223497

SEQ ID NO: 556669 - RNA, 64 nt, hsa; identical to SEQ ID NO: 223498

SEQ ID NO: 556670 - RNA, 64 nt, hsa; identical to SEQ ID NO: 223499

SEQ ID NO: 556671 - RNA, 64 nt, hsa; identical to SEQ ID NO: 223500

SEQ ID NO: 556672 - RNA, 64 nt, hsa; identical to SEQ ID NO: 223501

SEQ ID NO: 556673 - RNA, 64 nt, hsa; identical to SEQ ID NO: 223502

SEQ ID NO: 556674 - RNA, 64 nt, hsa; identical to SEQ ID NO: 223503

SEQ ID NO: 556675 - RNA, 64 nt, hsa; identical to SEQ ID NO: 223504

SEQ ID NO: 556676 - RNA, 64 nt, hsa; identical to SEQ ID NO: 223505

SEQ ID NO: 556677 - RNA, 64 nt, hsa; identical to SEQ ID NO: 223506

SEQ ID NO: 556678 - RNA, 64 nt, hsa; identical to SEQ ID NO: 223507

SEQ ID NO: 556679 - RNA, 64 nt, hsa; identical to SEQ ID NO: 223508

SEQ ID NO: 556680 - RNA, 64 nt, hsa; identical to SEQ ID NO: 223509

SEQ ID NO: 556681 - RNA, 64 nt, hsa; identical to SEQ ID NO: 223510

SEQ ID NO: 556682 - RNA, 64 nt, hsa; identical to SEQ ID NO: 223511

SEQ ID NO: 556683 - RNA, 64 nt, hsa; identical to SEQ ID NO: 223512

SEQ ID NO: 556684 - RNA, 64 nt, hsa; identical to SEQ ID NO: 223513

SEQ ID NO: 556685 - RNA, 64 nt, hsa; identical to SEQ ID NO: 223514

SEQ ID NO: 556686 - RNA, 64 nt, hsa; identical to SEQ ID NO: 223515

SEQ ID NO: 556687 - RNA, 64 nt, hsa; identical to SEQ ID NO: 223516

SEQ ID NO: 556688 - RNA, 64 nt, hsa; identical to SEQ ID NO: 223517

SEQ ID NO: 556689 - RNA, 64 nt, hsa; identical to SEQ ID NO: 223518

SEQ ID NO: 556690 - RNA, 64 nt, hsa; identical to SEQ ID NO: 223519

SEQ ID NO: 556691 - RNA, 64 nt, hsa; identical to SEQ ID NO: 223520

SEQ ID NO: 556692 - RNA, 64 nt, hsa; identical to SEQ ID NO: 223521

SEQ ID NO: 556693 - RNA, 64 nt, hsa; identical to SEQ ID NO: 223522

SEQ ID NO: 556694 - RNA, 64 nt, hsa; identical to SEQ ID NO: 223523

SEQ ID NO: 556695 - RNA, 64 nt, hsa; identical to SEQ ID NO: 223524

SEQ ID NO: 556696 - RNA, 64 nt, hsa; identical to SEQ ID NO: 223525

SEQ ID NO: 556697 - RNA, 64 nt, hsa; identical to SEQ ID NO: 223526

SEQ ID NO: 556698 - RNA, 64 nt, hsa; identical to SEQ ID NO: 223527

SEQ ID NO: 556699 - RNA, 64 nt, hsa; identical to SEQ ID NO: 223528

SEQ ID NO: 556700 - RNA, 64 nt, hsa; identical to SEQ ID NO: 223529

SEQ ID NO: 556701 - RNA, 64 nt, hsa; identical to SEQ ID NO: 223530

SEQ ID NO: 556702 - RNA, 64 nt, hsa; identical to SEQ ID NO: 223531

SEQ ID NO: 556703 - RNA, 64 nt, hsa; identical to SEQ ID NO: 223532

SEQ ID NO: 556704 - RNA, 64 nt, hsa; identical to SEQ ID NO: 223533

SEQ ID NO: 556705 - RNA, 64 nt, hsa; identical to SEQ ID NO: 223534

SEQ ID NO: 556706 - RNA, 64 nt, hsa; identical to SEQ ID NO: 223535

SEQ ID NO: 556707 - RNA, 64 nt, hsa; identical to SEQ ID NO: 223536

SEQ ID NO: 556708 - RNA, 64 nt, hsa; identical to SEQ ID NO: 223537

SEQ ID NO: 556709 - RNA, 64 nt, hsa; identical to SEQ ID NO: 223538

SEQ ID NO: 556710 - RNA, 64 nt, hsa; identical to SEQ ID NO: 223539

SEQ ID NO: 556711 - RNA, 64 nt, hsa; identical to SEQ ID NO: 223540

SEQ ID NO: 556712 - RNA, 64 nt, hsa; identical to SEQ ID NO: 223541

SEQ ID NO: 556713 - RNA, 64 nt, hsa; identical to SEQ ID NO: 223542

SEQ ID NO: 556714 - RNA, 64 nt, hsa; identical to SEQ ID NO: 223543

SEQ ID NO: 556715 - RNA, 64 nt, hsa; identical to SEQ ID NO: 223544

SEQ ID NO: 556716 - RNA, 64 nt, hsa; identical to SEQ ID NO: 223545

SEQ ID NO: 556717 - RNA, 64 nt, hsa; identical to SEQ ID NO: 223546

SEQ ID NO: 556718 - RNA, 64 nt, hsa; identical to SEQ ID NO: 223547

SEQ ID NO: 556719 - RNA, 64 nt, hsa; identical to SEQ ID NO: 223548

SEQ ID NO: 556720 - RNA, 64 nt, hsa; identical to SEQ ID NO: 223549

SEQ ID NO: 556721 - RNA, 64 nt, hsa; identical to SEQ ID NO: 223550

SEQ ID NO: 556722 - RNA, 64 nt, hsa; identical to SEQ ID NO: 223551

SEQ ID NO: 556723 - RNA, 64 nt, hsa; identical to SEQ ID NO: 223552

SEQ ID NO: 556724 - RNA, 64 nt, hsa; identical to SEQ ID NO: 223553

SEQ ID NO: 556725 - RNA, 64 nt, hsa; identical to SEQ ID NO: 223554

SEQ ID NO: 556726 - RNA, 64 nt, hsa; identical to SEQ ID NO: 223555

SEQ ID NO: 556727 - RNA, 64 nt, hsa; identical to SEQ ID NO: 223556

SEQ ID NO: 556728 - RNA, 64 nt, hsa; identical to SEQ ID NO: 223557

SEQ ID NO: 556729 - RNA, 64 nt, hsa; identical to SEQ ID NO: 223558

SEQ ID NO: 556730 - RNA, 64 nt, hsa; identical to SEQ ID NO: 223559

SEQ ID NO: 556731 - RNA, 64 nt, hsa; identical to SEQ ID NO: 223560

SEQ ID NO: 556732 - RNA, 64 nt, hsa; identical to SEQ ID NO: 223561

SEQ ID NO: 556733 - RNA, 64 nt, hsa; identical to SEQ ID NO: 223562

SEQ ID NO: 556734 - RNA, 64 nt, hsa; identical to SEQ ID NO: 223563

SEQ ID NO: 556735 - RNA, 64 nt, hsa; identical to SEQ ID NO: 223564

SEQ ID NO: 556736 - RNA, 64 nt, hsa; identical to SEQ ID NO: 223565

SEQ ID NO: 556737 - RNA, 64 nt, hsa; identical to SEQ ID NO: 223566

SEQ ID NO: 556738 - RNA, 64 nt, hsa; identical to SEQ ID NO: 223567

SEQ ID NO: 556739 - RNA, 64 nt, hsa; identical to SEQ ID NO: 223568

SEQ ID NO: 556740 - RNA, 64 nt, hsa; identical to SEQ ID NO: 223569

SEQ ID NO: 556741 - RNA, 64 nt, hsa; identical to SEQ ID NO: 223570

SEQ ID NO: 556742 - RNA, 64 nt, hsa; identical to SEQ ID NO: 223571

SEQ ID NO: 556743 - RNA, 64 nt, hsa; identical to SEQ ID NO: 164305

SEQ ID NO: 556744 - RNA, 64 nt, hsa; identical to SEQ ID NO: 164306

SEQ ID NO: 556745 - RNA, 64 nt, hsa; identical to SEQ ID NO: 164307

SEQ ID NO: 556746 - RNA, 64 nt, hsa; identical to SEQ ID NO: 164308

SEQ ID NO: 556747 - RNA, 64 nt, hsa
aaacaguucucuguuaccauauuuuguauucuggaccacuuacuggugaaagcaaccaugcaaa

SEQ ID NO: 556748 - RNA, 64 nt, hsa
cuaacucacuagaucagcgcacaagucaguguaaaccacuuagauaguaguuuuuucauaaaug

SEQ ID NO: 556749 - RNA, 64 nt, hsa
gcaagacccugucugucucaaaacaaaaaacaaaaccacuuauauugcuagcuacauuaagaau

SEQ ID NO: 556750 - RNA, 64 nt, hsa
caguauguaugguguggucucauuuguuuagaaaaccacuuaugacugggugcgguggcucaca

SEQ ID NO: 556751 - RNA, 64 nt, hsa
guuggaucuuuugaagggagaagacacugcagugaccacuuauucuguauugccauggucuuuc

SEQ ID NO: 556752 - RNA, 64 nt, hsa
ucauuguguaucaguuuccaugaaagaccugaauaccacuuaccucaaauuaagcauauguguu

SEQ ID NO: 556753 - RNA, 64 nt, hsa
acuaagacugugaaaauuaugugaaaccuaaaguaguugccaaaguggcucaggguuguaaaau

SEQ ID NO: 556754 - RNA, 64 nt, hsa
auaauaagcaagacacauuggggacacuggcagcaguugccagguuuuagcugccaccgcuuca

SEQ ID NO: 556755 - RNA, 64 nt, hsa
uuucuauagcgagacauagaauaguauucugaucaguugccaaagaaucuaggaaauuaguugu

SEQ ID NO: 556756 - RNA, 64 nt, hsa
gauuucaucacuaguaugugugcgugagcuggucaguugccaaaggaggaaauaagguuagaag

SEQ ID NO: 556757 - RNA, 64 nt, hsa
cuuugcuuuuguuuagcuucacagcauagcugaaaguugccaaacuggacauugugcaauaaag

SEQ ID NO: 556758 - RNA, 64 nt, hsa
caguaguauguggcauauacaccuuccuaguggcaguugccaauguuaaugauuauucuuuuua

SEQ ID NO: 556759 - RNA, 64 nt, hsa
caggaucaauacguuguauccuuugauccaaucaaguugccacucaguauuaaccaugacaccu

SEQ ID NO: 556760 - RNA, 64 nt, hsa
agguggguuagaaacuagugccuaucccucacuaaguugccagauggauuuaacagcaccucaa

SEQ ID NO: 556761 - RNA, 64 nt, hsa
aacuuaaaagucauugccauucaucauuaauaaaaguugccauuucaacuacgucccaacauuc

SEQ ID NO: 556762 - RNA, 64 nt, hsa
agcaucuuguaaauccuagggcuuccuggaaguuaguugccaaagucaugcaagcaucaccugu

SEQ ID NO: 556763 - RNA, 64 nt, hsa
aguuugucgaauugagguuuuagguaaagcauagaguugccagaguaccccgcauucccaugaa

SEQ ID NO: 556764 - RNA, 64 nt, hsa
gauggcuuggaguggggaaggcuguuucuuugaaaguugccaaauguguuauguugugucucag

SEQ ID NO: 556765 - RNA, 64 nt, hsa
gccacaaccuaugguggggucucgagguccucacaguugccagcccugcagcccccuuccccag

SEQ ID NO: 556766 - RNA, 64 nt, hsa
gggggcuccucuccccagaccaaaaugaauugcaaguugccacaaccuaugguggggucucgag

SEQ ID NO: 556767 - RNA, 64 nt, hsa; identical to SEQ ID NO: 424699

SEQ ID NO: 556768 - RNA, 64 nt, hsa; identical to SEQ ID NO: 424700

SEQ ID NO: 556769 - RNA, 64 nt, hsa; identical to SEQ ID NO: 424701

SEQ ID NO: 556770 - RNA, 64 nt, hsa; identical to SEQ ID NO: 424702

SEQ ID NO: 556771 - RNA, 64 nt, hsa; identical to SEQ ID NO: 424703

SEQ ID NO: 556772 - RNA, 64 nt, hsa; identical to SEQ ID NO: 424704

SEQ ID NO: 556773 - RNA, 64 nt, hsa; identical to SEQ ID NO: 424705

SEQ ID NO: 556774 - RNA, 64 nt, hsa; identical to SEQ ID NO: 424706

SEQ ID NO: 556775 - RNA, 64 nt, hsa; identical to SEQ ID NO: 424707

SEQ ID NO: 556776 - RNA, 64 nt, hsa; identical to SEQ ID NO: 424708

SEQ ID NO: 556777 - RNA, 64 nt, hsa; identical to SEQ ID NO: 424709

SEQ ID NO: 556778 - RNA, 64 nt, hsa; identical to SEQ ID NO: 424710

SEQ ID NO: 556779 - RNA, 64 nt, hsa; identical to SEQ ID NO: 424711

SEQ ID NO: 556780 - RNA, 64 nt, hsa; identical to SEQ ID NO: 424712

SEQ ID NO: 556781 - RNA, 64 nt, hsa; identical to SEQ ID NO: 424713

SEQ ID NO: 556782 - RNA, 64 nt, hsa; identical to SEQ ID NO: 424714

SEQ ID NO: 556783 - RNA, 64 nt, hsa; identical to SEQ ID NO: 424715

SEQ ID NO: 556784 - RNA, 64 nt, hsa; identical to SEQ ID NO: 424716

SEQ ID NO: 556785 - RNA, 64 nt, hsa; identical to SEQ ID NO: 424717

SEQ ID NO: 556786 - RNA, 64 nt, hsa; identical to SEQ ID NO: 424718

SEQ ID NO: 556787 - RNA, 64 nt, hsa; identical to SEQ ID NO: 424719

SEQ ID NO: 556788 - RNA, 64 nt, hsa; identical to SEQ ID NO: 424720

SEQ ID NO: 556789 - RNA, 64 nt, hsa; identical to SEQ ID NO: 424721

SEQ ID NO: 556790 - RNA, 64 nt, hsa; identical to SEQ ID NO: 424722

SEQ ID NO: 556791 - RNA, 51 nt, hsa; identical to SEQ ID NO: 424723

SEQ ID NO: 556792 - RNA, 64 nt, hsa; identical to SEQ ID NO: 424724

SEQ ID NO: 556793 - RNA, 64 nt, hsa; identical to SEQ ID NO: 424725

SEQ ID NO: 556794 - RNA, 64 nt, hsa; identical to SEQ ID NO: 424726

SEQ ID NO: 556795 - RNA, 64 nt, hsa; identical to SEQ ID NO: 424727

SEQ ID NO: 556796 - RNA, 64 nt, hsa; identical to SEQ ID NO: 424728

SEQ ID NO: 556797 - RNA, 64 nt, hsa; identical to SEQ ID NO: 424729

SEQ ID NO: 556798 - RNA, 64 nt, hsa; identical to SEQ ID NO: 424730

SEQ ID NO: 556799 - RNA, 64 nt, hsa; identical to SEQ ID NO: 424731

SEQ ID NO: 556800 - RNA, 64 nt, hsa; identical to SEQ ID NO: 424732

SEQ ID NO: 556801 - RNA, 64 nt, hsa; identical to SEQ ID NO: 424733

SEQ ID NO: 556802 - RNA, 64 nt, hsa; identical to SEQ ID NO: 424734

SEQ ID NO: 556803 - RNA, 64 nt, hsa; identical to SEQ ID NO: 424735

SEQ ID NO: 556804 - RNA, 64 nt, hsa; identical to SEQ ID NO: 424736

SEQ ID NO: 556805 - RNA, 64 nt, hsa; identical to SEQ ID NO: 424737

SEQ ID NO: 556806 - RNA, 64 nt, hsa; identical to SEQ ID NO: 424738

SEQ ID NO: 556807 - RNA, 63 nt, hsa; identical to SEQ ID NO: 120315

SEQ ID NO: 556808 - RNA, 63 nt, hsa; identical to SEQ ID NO: 120316

SEQ ID NO: 556809 - RNA, 63 nt, hsa; identical to SEQ ID NO: 120346

SEQ ID NO: 556810 - RNA, 63 nt, hsa; identical to SEQ ID NO: 120347

SEQ ID NO: 556811 - RNA, 63 nt, hsa; identical to SEQ ID NO: 120370

SEQ ID NO: 556812 - RNA, 63 nt, hsa; identical to SEQ ID NO: 120371

SEQ ID NO: 556813 - RNA, 63 nt, hsa; identical to SEQ ID NO: 120380

SEQ ID NO: 556814 - RNA, 63 nt, hsa; identical to SEQ ID NO: 120381

SEQ ID NO: 556815 - RNA, 63 nt, hsa; identical to SEQ ID NO: 120400

SEQ ID NO: 556816 - RNA, 63 nt, hsa; identical to SEQ ID NO: 120401

SEQ ID NO: 556817 - RNA, 63 nt, hsa; identical to SEQ ID NO: 120470

SEQ ID NO: 556818 - RNA, 63 nt, hsa; identical to SEQ ID NO: 120471

SEQ ID NO: 556819 - RNA, 63 nt, hsa; identical to SEQ ID NO: 120522

SEQ ID NO: 556820 - RNA, 63 nt, hsa; identical to SEQ ID NO: 120523

SEQ ID NO: 556821 - RNA, 64 nt, hsa; identical to SEQ ID NO: 79907

SEQ ID NO: 556822 - RNA, 64 nt, hsa; identical to SEQ ID NO: 79908

SEQ ID NO: 556823 - RNA, 64 nt, hsa; identical to SEQ ID NO: 180799

SEQ ID NO: 556824 - RNA, 64 nt, hsa; identical to SEQ ID NO: 180800

SEQ ID NO: 556825 - RNA, 64 nt, hsa; identical to SEQ ID NO: 180801

SEQ ID NO: 556826 - RNA, 64 nt, hsa; identical to SEQ ID NO: 180802

SEQ ID NO: 556827 - RNA, 64 nt, hsa; identical to SEQ ID NO: 180803

SEQ ID NO: 556828 - RNA, 64 nt, hsa; identical to SEQ ID NO: 180804

SEQ ID NO: 556829 - RNA, 64 nt, hsa; identical to SEQ ID NO: 180805

SEQ ID NO: 556830 - RNA, 64 nt, hsa; identical to SEQ ID NO: 180806

SEQ ID NO: 556831 - RNA, 64 nt, hsa; identical to SEQ ID NO: 180807

SEQ ID NO: 556832 - RNA, 64 nt, hsa; identical to SEQ ID NO: 180808

SEQ ID NO: 556833 - RNA, 64 nt, hsa; identical to SEQ ID NO: 180809

SEQ ID NO: 556834 - RNA, 64 nt, hsa; identical to SEQ ID NO: 180810

SEQ ID NO: 556835 - RNA, 64 nt, hsa; identical to SEQ ID NO: 180811

SEQ ID NO: 556836 - RNA, 64 nt, hsa; identical to SEQ ID NO: 180812

SEQ ID NO: 556837 - RNA, 64 nt, hsa; identical to SEQ ID NO: 180813

SEQ ID NO: 556838 - RNA, 64 nt, hsa
caauguguacacgacuacuuacuacccaagcccccugaacaaacacagcuuccggcccgaggcc

SEQ ID NO: 556839 - RNA, 64 nt, hsa
gaaugaaaaguacacacccauggaauucaagacccugaacaagaauaacuugaucccugaugac

SEQ ID NO: 556840 - RNA, 64 nt, hsa
ucagugccuuccucucucuaccagucuauuuccacugaacaaaaccuacgcacauaccuucaug

SEQ ID NO: 556841 - RNA, 64 nt, hsa
ucacugccuuccucucucuaccagucuauuuccacugaacaaaaccuacacacauaccuucaug

SEQ ID NO: 556842 - RNA, 64 nt, hsa
auuugcucagcuggcugagacacugaagaagucacugaacaaaaccuacacacguaccuucaug

SEQ ID NO: 556843 - RNA, 64 nt, hsa
uuuauaucuuccuaauaagguguggucuguuugucugaacaaagugcuagacuuucuggaguga

SEQ ID NO: 556844 - RNA, 64 nt, hsa
aagagugugaaaugaaaauauugccuugccauuucugaacaaaagaaaacugaauuguaaagau

SEQ ID NO: 556845 - RNA, 64 nt, hsa
aagcaauuuagacuuaaguggugcuuugugguaucugaacaauucauaacauguaaauaaugug

SEQ ID NO: 556846 - RNA, 64 nt, hsa
agcuuaaacucuaauagcuguuucccuuucuauucugaacaacugucuccauuuuucaagugug

SEQ ID NO: 556847 - RNA, 64 nt, hsa
augugacugaauguaagauuaacuuuauuuuggucugaacaaaccuuguaaaguuccauuguau

SEQ ID NO: 556848 - RNA, 64 nt, hsa
aggugaucagauaaaauauauuuugggaaauuaacugaacaaauaaaaaguuuuugauauaacu

SEQ ID NO: 556849 - RNA, 64 nt, hsa
uucauuucagucaaaucacugcagucaugaaauacugaacaauugccuuaagucuuugcuugac

SEQ ID NO: 556850 - RNA, 64 nt, hsa
acuguagaacaguuuuauuuuuauuaaaacuugacugaacaaaaggggaccaucaacauuguag

SEQ ID NO: 556851 - RNA, 64 nt, hsa
cguuuaaccugcucuuggucauuggaaauuuacacugaacaaagugcaauuaacuguagaacag

SEQ ID NO: 556852 - RNA, 64 nt, hsa
aaauacagugugugugugugcaccugugugccugcugaacaacuugacaguguaacagauaagg

SEQ ID NO: 556853 - RNA, 64 nt, hsa
caguauuauucuuguuuucugaauucugagucuccugaacaaaaggcuuacuauccauggucuu

SEQ ID NO: 556854 - RNA, 64 nt, hsa
uuucuguggcuccagugagaacaaggcuuugaaacugaacaagauaacuucuagaaaugaacug

SEQ ID NO: 556855 - RNA, 64 nt, hsa
aaggauccaggaguauuuucuucuugggugggcccugaacaaagccaaaaauuguagaaaccag

SEQ ID NO: 556856 - RNA, 64 nt, hsa
caccaugacaacccugcaggugcucacccugcugcugaacaaauuuaggguaagccuggucagg

SEQ ID NO: 556857 - RNA, 64 nt, hsa
uguuuugaggaaagggcuuugaauuccccagauacugaacaauuuguguuugugacugauggag

SEQ ID NO: 556858 - RNA, 64 nt, hsa
uuuuaaaagcaucauuuaaaaaaaaaugacaugccugaacaacuuuuccacuuuccacgugcuu

SEQ ID NO: 556859 - RNA, 64 nt, hsa
cuaaaggguaguuguuuuacaaugaagacuaaaacugaacaagauguugcaugcucuugaggcc

SEQ ID NO: 556860 - RNA, 64 nt, hsa
ugugucaaguuacucaaaguuauugcuguuggaacugaacaauaauauuucccagauagcuggc

SEQ ID NO: 556861 - RNA, 64 nt, hsa
acauaauuaaagcaguugaacuauagggaaagcacugaacaaaccacuuuggaguaaauagcua

SEQ ID NO: 556862 - RNA, 64 nt, hsa
cuuuuaaggguauuuuaaaaauuaguaaauuugaaugaacuaaagauauaucucuaccuucuca

SEQ ID NO: 556863 - RNA, 64 nt, hsa
guucauucagauuuacuaauuuugguaaaucugaaugaacuaaagauguaucuguaccuucuca

SEQ ID NO: 556864 - RNA, 64 nt, hsa
caauucagagagaguucuuuacaaagccaugaauaugaacuauggggaaucaugguucuuuuaa

SEQ ID NO: 556865 - RNA, 64 nt, hsa
gauuuuucuucugcugcuugacugcuucaucuggaugaacuacaaaaaacccaugauuaagguu

SEQ ID NO: 556866 - RNA, 64 nt, hsa
aaaauucugagugauccaggguaugaccuagggaaugaacuagcuaugaaauacucaggguuag

SEQ ID NO: 556867 - RNA, 64 nt, hsa
ucgcccuacagaaaacccagcuagacuauuggguaugaacuaaaaagagacugugccaugguga

SEQ ID NO: 556868 - RNA, 64 nt, hsa
gaccccagaaaacuacccaaaugauggccugacaaugaacuacugcaggaauccagaugccgau

SEQ ID NO: 556869 - RNA, 64 nt, hsa
gaccucagaaaaguacccaaaugcugacuugaucaugaacuacugcaggaauccagauccugug

SEQ ID NO: 556870 - RNA, 64 nt, hsa
guauauaacaucuaauauauauauuacaggccaaaugaacuaaacauugccuugcuauauucac

SEQ ID NO: 556871 - RNA, 64 nt, hsa
aagcaccauguaucaggauuuccgcauuauaaaaaugaacuaaacauugccuugcuauauucac

SEQ ID NO: 556872 - RNA, 64 nt, hsa
augcaacuugaaaggaaacaguuuaaugguggaaaugaacuaccauuuauaacuucuguuuuuu

SEQ ID NO: 556873 - RNA, 64 nt, hsa
uaugggagaaaccagagaugggaaugaggaaaauaugaacuacagcagaagccccugggcagcu

SEQ ID NO: 556874 - RNA, 64 nt, hsa
accacugcacugucugagaauuuccaaaacuuuaaugaacuaacugacagcuucaugaaacugu

SEQ ID NO: 556875 - RNA, 64 nt, hsa
caagcagagaaaauaauuaauuucaugggacuaaaugaacuaaugaggauaauauuuucauaau

SEQ ID NO: 556876 - RNA, 64 nt, hsa
cgagaggcccuggcccauucccuccagcggugcaaugaacuaucaugcuguggaccgucaaccc

SEQ ID NO: 556877 - RNA, 64 nt, hsa
cagguuggugacuuugcaaaugcacuuccuacagaugaacuauuaaaagaccugcaacauugaa

SEQ ID NO: 556878 - RNA, 64 nt, hsa
uaaauuacccagguucuguuuuaagccucagaaaaugaacuaagacaaugcccuagaugagcug

SEQ ID NO: 556879 - RNA, 64 nt, hsa
gagcaucuccccucuugucuguggaagauaucacaugaacuaccuaauuuucaagcauggaucu

SEQ ID NO: 556880 - RNA, 64 nt, hsa; identical to SEQ ID NO: 249485

SEQ ID NO: 556881 - RNA, 64 nt, hsa; identical to SEQ ID NO: 249486

SEQ ID NO: 556882 - RNA, 64 nt, hsa; identical to SEQ ID NO: 249487

SEQ ID NO: 556883 - RNA, 64 nt, hsa; identical to SEQ ID NO: 249488

SEQ ID NO: 556884 - RNA, 64 nt, hsa; identical to SEQ ID NO: 249489

SEQ ID NO: 556885 - RNA, 64 nt, hsa; identical to SEQ ID NO: 249490

SEQ ID NO: 556886 - RNA, 64 nt, hsa; identical to SEQ ID NO: 249491

SEQ ID NO: 556887 - RNA, 64 nt, hsa; identical to SEQ ID NO: 249492

SEQ ID NO: 556888 - RNA, 64 nt, hsa; identical to SEQ ID NO: 249493

SEQ ID NO: 556889 - RNA, 64 nt, hsa; identical to SEQ ID NO: 249494

SEQ ID NO: 556890 - RNA, 64 nt, hsa; identical to SEQ ID NO: 249495

SEQ ID NO: 556891 - RNA, 64 nt, hsa; identical to SEQ ID NO: 249496

SEQ ID NO: 556892 - RNA, 64 nt, hsa; identical to SEQ ID NO: 249497

SEQ ID NO: 556893 - RNA, 64 nt, hsa; identical to SEQ ID NO: 249498

SEQ ID NO: 556894 - RNA, 64 nt, hsa; identical to SEQ ID NO: 249499

SEQ ID NO: 556895 - RNA, 64 nt, hsa; identical to SEQ ID NO: 249500

SEQ ID NO: 556896 - RNA, 64 nt, hsa; identical to SEQ ID NO: 249501

SEQ ID NO: 556897 - RNA, 64 nt, hsa; identical to SEQ ID NO: 249502

SEQ ID NO: 556898 - RNA, 64 nt, hsa; identical to SEQ ID NO: 249503

SEQ ID NO: 556899 - RNA, 64 nt, hsa; identical to SEQ ID NO: 249504

SEQ ID NO: 556900 - RNA, 64 nt, hsa; identical to SEQ ID NO: 249505

SEQ ID NO: 556901 - RNA, 64 nt, hsa; identical to SEQ ID NO: 45744

SEQ ID NO: 556902 - RNA, 64 nt, hsa; identical to SEQ ID NO: 45745

SEQ ID NO: 556903 - RNA, 64 nt, hsa; identical to SEQ ID NO: 45746

SEQ ID NO: 556904 - RNA, 64 nt, hsa; identical to SEQ ID NO: 45747

SEQ ID NO: 556905 - RNA, 64 nt, hsa; identical to SEQ ID NO: 45748

SEQ ID NO: 556906 - RNA, 64 nt, hsa; identical to SEQ ID NO: 45749

SEQ ID NO: 556907 - RNA, 64 nt, hsa; identical to SEQ ID NO: 45750

SEQ ID NO: 556908 - RNA, 64 nt, hsa; identical to SEQ ID NO: 45751

SEQ ID NO: 556909 - RNA, 64 nt, hsa; identical to SEQ ID NO: 45752

SEQ ID NO: 556910 - RNA, 64 nt, hsa; identical to SEQ ID NO: 45753

SEQ ID NO: 556911 - RNA, 64 nt, hsa; identical to SEQ ID NO: 45754

SEQ ID NO: 556912 - RNA, 64 nt, hsa; identical to SEQ ID NO: 45755

SEQ ID NO: 556913 - RNA, 64 nt, hsa; identical to SEQ ID NO: 45756

SEQ ID NO: 556914 - RNA, 64 nt, hsa; identical to SEQ ID NO: 45757

SEQ ID NO: 556915 - RNA, 64 nt, hsa; identical to SEQ ID NO: 45758

SEQ ID NO: 556916 - RNA, 64 nt, hsa; identical to SEQ ID NO: 45759

SEQ ID NO: 556917 - RNA, 64 nt, hsa; identical to SEQ ID NO: 45760

SEQ ID NO: 556918 - RNA, 64 nt, hsa; identical to SEQ ID NO: 45761

SEQ ID NO: 556919 - RNA, 64 nt, hsa; identical to SEQ ID NO: 45762

SEQ ID NO: 556920 - RNA, 64 nt, hsa; identical to SEQ ID NO: 45763

SEQ ID NO: 556921 - RNA, 64 nt, hsa; identical to SEQ ID NO: 45764

SEQ ID NO: 556922 - RNA, 64 nt, hsa; identical to SEQ ID NO: 45765

SEQ ID NO: 556923 - RNA, 64 nt, hsa; identical to SEQ ID NO: 45766

SEQ ID NO: 556924 - RNA, 64 nt, hsa; identical to SEQ ID NO: 45767

SEQ ID NO: 556925 - RNA, 64 nt, hsa; identical to SEQ ID NO: 45768

SEQ ID NO: 556926 - RNA, 64 nt, hsa; identical to SEQ ID NO: 45769

SEQ ID NO: 556927 - RNA, 64 nt, hsa; identical to SEQ ID NO: 45770

SEQ ID NO: 556928 - RNA, 64 nt, hsa; identical to SEQ ID NO: 45771

SEQ ID NO: 556929 - RNA, 64 nt, hsa; identical to SEQ ID NO: 45772

SEQ ID NO: 556930 - RNA, 64 nt, hsa; identical to SEQ ID NO: 45773

SEQ ID NO: 556931 - RNA, 64 nt, hsa; identical to SEQ ID NO: 45774

SEQ ID NO: 556932 - RNA, 64 nt, hsa; identical to SEQ ID NO: 45775

SEQ ID NO: 556933 - RNA, 64 nt, hsa; identical to SEQ ID NO: 45776

SEQ ID NO: 556934 - RNA, 64 nt, hsa; identical to SEQ ID NO: 45777

SEQ ID NO: 556935 - RNA, 64 nt, hsa; identical to SEQ ID NO: 45778

SEQ ID NO: 556936 - RNA, 64 nt, hsa; identical to SEQ ID NO: 45779

SEQ ID NO: 556937 - RNA, 64 nt, hsa; identical to SEQ ID NO: 224102

SEQ ID NO: 556938 - RNA, 64 nt, hsa; identical to SEQ ID NO: 224103

SEQ ID NO: 556939 - RNA, 64 nt, hsa; identical to SEQ ID NO: 224104

SEQ ID NO: 556940 - RNA, 64 nt, hsa; identical to SEQ ID NO: 224105

SEQ ID NO: 556941 - RNA, 63 nt, hsa; identical to SEQ ID NO: 224106

SEQ ID NO: 556942 - RNA, 64 nt, hsa; identical to SEQ ID NO: 224107

SEQ ID NO: 556943 - RNA, 64 nt, hsa
agagaaggaauggcgugggaugggggaaagaaaagaaagagaagaagcuggggucuccaggcag

SEQ ID NO: 556944 - RNA, 64 nt, hsa
ugcugagcccggggcaggggaauugcaucugcaggaaagagaugcagcaugcuccucacuccug

SEQ ID NO: 556945 - RNA, 64 nt, hsa
cuaaagcaagagaucuggcaguugaaaauugugggaaagagaauuuguaugggcacuguaucua

SEQ ID NO: 556946 - RNA, 64 nt, hsa
uccuagaauuuaaaaauaaaaaagucuuccucuggaaagagaagucacacagacaaucaugugc

SEQ ID NO: 556947 - RNA, 64 nt, hsa
ucuuaugugagguggggaagggaaagguaugagggaaagagagucugagaauuaaaauauuuua

SEQ ID NO: 556948 - RNA, 64 nt, hsa
ugaagaaaucucuggagccagcuucuagagguaggaaagagaagauguucuuauucagauaaug

SEQ ID NO: 556949 - RNA, 64 nt, hsa
gagaaagagauaaaaauaaaaguaucucaugaaggaaagagauuuugccucucuuuuacuuuuc

SEQ ID NO: 556950 - RNA, 64 nt, hsa
cagaaucauuucaccaguuaagcacaugaguagagaaagagauaaaaauaaaaguaucucauga

SEQ ID NO: 556951 - RNA, 64 nt, hsa
aaguggguauguguaaaagcugggaaaguuaugggaaagagaaugcauagaccuaucuaggguc

SEQ ID NO: 556952 - RNA, 64 nt, hsa
uaucuagggucaucauagaagccuuuauaauuuagaaagagacugcguugagacaugaaggauc

SEQ ID NO: 556953 - RNA, 64 nt, hsa
acauggaaaauaaagccaggaaagucaaaaaaacgaaagagaaggagaagaaaaaggaaaaggg

SEQ ID NO: 556954 - RNA, 64 nt, hsa
ugguuacccucgggauggccauccacugucuccagaaagagaccacuuagagggucucuaugcc

SEQ ID NO: 556955 - RNA, 64 nt, hsa
cccauuuuccuguucgacugggagguucuggaaagaaagagagagagagaaaagagguaaagga

SEQ ID NO: 556956 - RNA, 64 nt, hsa
ucuaaguccaaaaacuauagagcagaagaauugagaaagagaaugagaccaugucaacaaggcu

SEQ ID NO: 556957 - RNA, 64 nt, hsa
ucaaaguccagaucuaguuccaagucugggcaccgaaagagagcaucaaaaucaccaagaaaaa

SEQ ID NO: 556958 - RNA, 64 nt, hsa
aacgggaaugcccucauucaaaaaaaagaacuuugaaagagaaucuuucugaucaccuuagaaa

SEQ ID NO: 556959 - RNA, 64 nt, hsa
aggaaaaucuuaaaagagaacacaccaaaaaagugaaagagaaauugaaagggaaaaaagacaa

SEQ ID NO: 556960 - RNA, 58 nt, hsa
uuccauagugcaaguggugacccaggaugaaagagagcagcuguacacaccugcuucc

SEQ ID NO: 556961 - RNA, 64 nt, hsa
aaaaaaaaagggaauaagcaaagggggaagaauugaaagagagagagaagaaagaauacagaga

SEQ ID NO: 556962 - RNA, 64 nt, hsa
ggcaaaugacaagcgauaggcuauugcaaccugagaaagagaacugcuccuucaucguaaauuu

SEQ ID NO: 556963 - RNA, 64 nt, hsa
gaaggcccucucacacagacgugacguccugccagaaagagaaugaaugacagaaaaaaaaaag

SEQ ID NO: 556964 - RNA, 64 nt, hsa
gagucaaggucacuguccccgcuucggccugaaggaaagagaagacauuucuauggccuugcuc

SEQ ID NO: 556965 - RNA, 64 nt, hsa
guguauuucuugguacccccaagauaucaggccagaaagagaugagucaguugcugugcucuuu

SEQ ID NO: 556966 - RNA, 64 nt, hsa
aaaugcaauaaggaaucaauucuuuucugccugagaaagagaaccagacgcaggaagaugaaag

SEQ ID NO: 556967 - RNA, 64 nt, hsa
gcaauguccuuugauuuuuuuuaauacauuaagagaaagagaaauauauauauauccaccccca

SEQ ID NO: 556968 - RNA, 64 nt, hsa
gaaccugcaguccacccucccuggaaccacaccagaaagagaccuggguugucguuuucuugcu

SEQ ID NO: 556969 - RNA, 64 nt, hsa
ucucucuggucacugcccuuaccugacccucacagaaagagagcucugagcaggugaggggguc

SEQ ID NO: 556970 - RNA, 64 nt, hsa
agcauugcucagaucacuguggccacacuuugcugaaagagaugcugggacauagaaccucuua

SEQ ID NO: 556971 - RNA, 64 nt, hsa
agacucaucagcuccauaucugcauuccacuggggaaagagagagagaaaagagcagauuuuaa

SEQ ID NO: 556972 - RNA, 64 nt, hsa
auaaugcuuaauaauaauugaagaaugggaaagagaaagagacagagacuggcauuuuccucuc

SEQ ID NO: 556973 - RNA, 64 nt, hsa
augauaauaaugcuuaauaauaauugaagaaugggaaagagaaagagacagagacuggcauuuu

SEQ ID NO: 556974 - RNA, 64 nt, hsa
auguaaaucaucuggcaucacugauagaauuucugaaagagaaagagaaguagauggucaacca

SEQ ID NO: 556975 - RNA, 64 nt, hsa
aucaucuggcaucacugauagaauuucugaaagagaaagagaaguagauggucaaccagucacu

SEQ ID NO: 556976 - RNA, 64 nt, hsa
aauaugugccugucacaacacaaauaccccucuugaaagagauuuacucaucuauccaagcacu

SEQ ID NO: 556977 - RNA, 64 nt, hsa
aagaggcucuguuuuccacugaagcuuuguuggagaaagagaauaugaaaauuacacauuuuau

SEQ ID NO: 556978 - RNA, 64 nt, hsa
acauuaaaucguagguagggcaauguaguaaaaugaaagagaauuaagaaagguuuugaauucu

SEQ ID NO: 556979 - RNA, 64 nt, hsa
agaucucuauucuauaaauguguaaugugaugaagaaagagaucuuucuuuuuuaaugaaaaca

SEQ ID NO: 556980 - RNA, 64 nt, hsa
ugcaggcuucuuaugccguugguauacagggcaggaaagagaggaauaaagggagagagcagug

SEQ ID NO: 556981 - RNA, 64 nt, hsa
gaggccagugugucaccagcccucagcagaaaccgaaagagaaagaacggaaacacggaguuug

SEQ ID NO: 556982 - RNA, 64 nt, hsa
acauauuuugguggagaagagguugggcuuuuuugaaagagacaaaaauuuauuauaacacuaa

SEQ ID NO: 556983 - RNA, 64 nt, hsa
gauaucaccagacuagaauuaauauauuuauaaagaaagagaccaaaacugucuagaauuugaa

SEQ ID NO: 556984 - RNA, 64 nt, hsa
ggaccagaagaggcacuagccauuuuaaggagaggaaagagaaaacucuggggucagggagaga

SEQ ID NO: 556985 - RNA, 64 nt, hsa
auuuccaucugucugguuaugucaaguuaauucagaaagagaagagacagugaccaacccugag

SEQ ID NO: 556986 - RNA, 64 nt, hsa
gcaugugaguugggucaagugcauuggaccuagggaaagagaaagaaagaauaaaagcuggaga

SEQ ID NO: 556987 - RNA, 64 nt, hsa
aguugugagggcccagaucacagaucccaugugagaaagagagaguuucagcgucauccuugaa

SEQ ID NO: 556988 - RNA, 64 nt, hsa
cacagagagaaggagaaagagggagggagagagagaaagagagagaaagagagagagagagaga

SEQ ID NO: 556989 - RNA, 64 nt, hsa
aggagaaagagggagggagagagagaaagagagagaaagagagagagagagagagagagagaaa

SEQ ID NO: 556990 - RNA, 64 nt, hsa
caccuaccuuuucaggauuuagaaccuaaaauuagaaagagaaucccagcugucauuguuccuu

SEQ ID NO: 556991 - RNA, 64 nt, hsa
ggggcuucccuguucccucagccccagucgagaggaaagagaaucgggccacugccagaaagag

SEQ ID NO: 556992 - RNA, 64 nt, hsa
ccagucgagaggaaagagaaucgggccacugccagaaagagagucaagcaaaccuggaagggca

SEQ ID NO: 556993 - RNA, 64 nt, hsa
ucucagaaaaaaaaaaaaaaaagagagagagagagaaagagaacaauauuugggagagaaggau

SEQ ID NO: 556994 - RNA, 64 nt, hsa
agauccugucucucaaaaaaaaaaaaaaaaaaaagaaagagagagggccgggcgugguggcuca

SEQ ID NO: 556995 - RNA, 64 nt, hsa
uaaugggagacagugguagagagguuuuucuugggaaagagacagagugcugaggggcacucuc

SEQ ID NO: 556996 - RNA, 64 nt, hsa
caggcacuguuuggagccauaagaucuguaucuagaaagagaucacccacuccuauguacuauc

SEQ ID NO: 556997 - RNA, 64 nt, hsa
cagacauuuccuagagaaagagagagagagaggagaaagagagagaaggagagagacaguagcc

SEQ ID NO: 556998 - RNA, 64 nt, hsa
agugaggccugcuucacaacagacauuuccuagagaaagagagagagagaggagaaagagagag

SEQ ID NO: 556999 - RNA, 64 nt, hsa
cuucauagcaagggaaggcuuuaagcaguuacuagaaagagauggggauuuggccccuggcucc

SEQ ID NO: 557000 - RNA, 64 nt, hsa
gucacuucaaggccuguuugaauguggcagguuagaaagagagagaaugucuuucauuugaaga

SEQ ID NO: 557001 - RNA, 64 nt, hsa
ggaacgucguaaggaagcugaacggauugcucgagaaagagaggaacucagaaggcaacaacag

SEQ ID NO: 557002 - RNA, 64 nt, hsa
gucuagauaaaaaaagagauaaagacuacagaaggaaagagaucuugccuuuugaaaagaugaa

SEQ ID NO: 557003 - RNA, 64 nt, hsa
gagugagagagagaaagagagugagagagagagagaaagagagagagagaugcuguugaaucag

SEQ ID NO: 557004 - RNA, 64 nt, hsa
aaccaguuuccagagagccagagagugagagagagaaagagagugagagagagagagaaagaga

SEQ ID NO: 557005 - RNA, 64 nt, hsa
ggaagagaggcagagagggaaagaggcagagaaggaaagagacaggcagagaaggagagaggca

SEQ ID NO: 557006 - RNA, 64 nt, hsa
ggaggagggagagagauggagaggaggggagagagaaagagagguggggagaggggagagagau

SEQ ID NO: 557007 - RNA, 64 nt, hsa
uugauauuguuauaauguauauacuguauaauaugaaagagaaucgauguaucucacuuuuuca

SEQ ID NO: 557008 - RNA, 64 nt, hsa
ccaaaacguagaacugaaagcauguauuuuggaagaaagagauacauuuuguaugcuuucuuuu

SEQ ID NO: 557009 - RNA, 64 nt, hsa
guguguguguugugugugugugugcgcuaagugagaaagagagcaggcucgggaggcccugccc

SEQ ID NO: 557010 - RNA, 64 nt, hsa
agguguaaaaaagauguuucacuaauguaacggugaaagagaaucccuguuguacuuuaucuuu

SEQ ID NO: 557011 - RNA, 64 nt, hsa
augcuuucuuuaaaauaacuagaagaacauaaaagaaagagaaucucagaaguaguuugcugcu

SEQ ID NO: 557012 - RNA, 64 nt, hsa
caucccuuucagaccuaacagccacagccacacggaaagagacuuugccucacuuuuacauuca

SEQ ID NO: 557013 - RNA, 64 nt, hsa
agauuagggggacuuaaaauuaauauaggcacaggaaagagaaaagugugcgcuccauucucag

SEQ ID NO: 557014 - RNA, 64 nt, hsa
cagccugcgggacagagugagacccugucugaaagaaagagagaaagaaagaaagaaagagaga

SEQ ID NO: 557015 - RNA, 64 nt, hsa
gacccugucugaaagaaagagagaaagaaagaaagaaagagagagaaagaaagaaagaaagaaa

SEQ ID NO: 557016 - RNA, 64 nt, hsa
aagaaagggaaagauggaaggaaggaaggaaaaagaaagagaaagagagagagagagaaagaaa

SEQ ID NO: 557017 - RNA, 64 nt, hsa
gggaaagauggaaggaaggaaggaaaaagaaagagaaagagagagagagagaaagaaaaagaaa

SEQ ID NO: 557018 - RNA, 64 nt, hsa
uccaugugcuuuucgcagccuuccuguguuggaugaaagagaauaagaauucagcugacaggag

SEQ ID NO: 557019 - RNA, 64 nt, hsa
gguggcuuuuaaaccaggagcccggaggaagggugaaagagaaagccugugaaauaggcagggc

SEQ ID NO: 557020 - RNA, 64 nt, hsa
uggccaaacucagacacguggacagggauagacagaaagagacagaagcuggggcuacguccau

SEQ ID NO: 557021 - RNA, 64 nt, hsa
cacccccuccccgggcagcagagagagagagagagaaagagagagagagagagagaaggggccc

SEQ ID NO: 557022 - RNA, 64 nt, hsa
cccagaguuggagacagaacaacagagucucagggaaagagaaccacaauagaaaaaggcagaa

SEQ ID NO: 557023 - RNA, 64 nt, hsa
agacaugauagagggacagagccaaaaggauagagaaagagacccagaaaaaggaagaggugga

SEQ ID NO: 557024 - RNA, 64 nt, hsa
ucagcaacauagaagagggaaggaaagagagaaggaaagagagagagaaagaaagucuccagac

SEQ ID NO: 557025 - RNA, 64 nt, hsa
ugcccuacccgcucagcaacauagaagagggaaggaaagagagaaggaaagagagagagaaaga

SEQ ID NO: 557026 - RNA, 64 nt, hsa
ccggcaccuuuuguuugucccauugguggcagaugugagcgacaucaggcgcuuccucagugca

SEQ ID NO: 557027 - RNA, 64 nt, hsa
ccacgugaaacugcuguuuucuaggccaaaaauggugagcgaucauuuauuucaugauucaacc

SEQ ID NO: 557028 - RNA, 64 nt, hsa
gcagccggagugagcccuucgccccugagugccuggcucgcaccucucgagcugugcccugggc

SEQ ID NO: 557029 - RNA, 64 nt, hsa
ugacacuggugccaggcugaccucagcucccgaaggcucgcacagccuccccauccuuccuucc

SEQ ID NO: 557030 - RNA, 64 nt, hsa
gccgcccgggguucuaugauauuuguagugccggggcucgcacacugcugcccccagccuguag

SEQ ID NO: 557031 - RNA, 64 nt, hsa
cgaggagcugacacguccucucuggccgccauccggcucgcacaggggccucccagcgccucag

SEQ ID NO: 557032 - RNA, 64 nt, hsa
acgcaggcaggugggguugucuggcgagcccgggggcucgcaggggggauuuuccaggccagga

SEQ ID NO: 557033 - RNA, 64 nt, hsa
uagugaaaucaaugaaacucuugagucuugcuuaggcucgcaaacaagaaguggggaggcuugg

SEQ ID NO: 557034 - RNA, 64 nt, hsa
ccgcccggccgcuagacugacuucgcgcagcgguggcucgcaccugugggaccucagggcaccg

SEQ ID NO: 557035 - RNA, 64 nt, hsa
aaaagcauuugcugcaagucucuuggauuauauaggcucgcaggcccaauacuugcacacauuc

SEQ ID NO: 557036 - RNA, 64 nt, hsa
gaagaauuaccacaacugaagacuuuaaacaucuggcucgcaagguacuccccuugcuuuuggu

SEQ ID NO: 557037 - RNA, 64 nt, hsa
ucuacaggaccacuugagugggcagccaagcccaggcucgcaguaucaauaaagcaguucucug

SEQ ID NO: 557038 - RNA, 64 nt, hsa
ggagccccuaacuagggcaagucagaaauagccaggcucgcagcagcgcagcgcugugucugcu

SEQ ID NO: 557039 - RNA, 64 nt, hsa
uaaauauauucuuuacuuuuuguaucaguaaccaggcucgcacacacagggucugcugccacgu

SEQ ID NO: 557040 - RNA, 64 nt, hsa
cgggcgcgggcgcggaggacgcacgcggggccccggcucgcaagccccagcucaccgcgccgcg

SEQ ID NO: 557041 - RNA, 64 nt, hsa
guaccgccuguuguaucugggagccucguacagaggcucgcacagcagugaucaagugucaucc

SEQ ID NO: 557042 - RNA, 64 nt, hsa
acaaagaaagauuuaaaaauuaaccaggcaugguggcucgcaccuguauucccagccacugggg

SEQ ID NO: 557043 - RNA, 64 nt, hsa
uuccaaaggucugccauacucuucagaggaguucggcucgcaggaaaaugugggcuuccuuuaa

SEQ ID NO: 557044 - RNA, 64 nt, hsa
cuaagggugcugugcccaacccugcgacuagcaaggcucgcagcaagagcacagcccucaacua

SEQ ID NO: 557045 - RNA, 64 nt, hsa
aaugccuuuacuuuauucucuggggagggccagcggcucgcaucccccucaucuccagcugcag

SEQ ID NO: 557046 - RNA, 64 nt, hsa
gcugucugugggccgccccuggccaccuuguccuggcucgcagggugcaggagcgccucguucu

SEQ ID NO: 557047 - RNA, 64 nt, hsa
gcccugccugcugggcucccgugucuucucacagggcucgcacgccugggagguggcccuuggg

SEQ ID NO: 557048 - RNA, 64 nt, hsa
gugaggaugggggaguagaugccgcuuuugcaguggcucgcacugcuguggccacugcugacca

SEQ ID NO: 557049 - RNA, 64 nt, hsa
ccagguuguaucacccccgaguuagcauaucccaggcucgcagacucaacacagcaaggguggg

SEQ ID NO: 557050 - RNA, 64 nt, hsa
cgggccuccagguggaccaaagggaugcacaggcggcucgcaugccccagggccagcuaagagu

SEQ ID NO: 557051 - RNA, 64 nt, hsa
uuugacuucugacaaaaaacaaaaagugcugcauggcucgcauggaauccacgcgcuccaggga

SEQ ID NO: 557052 - RNA, 64 nt, hsa
guugugccacauucccacucaaggcucagaacuuggcucgcauugguagcuggaggugguagaa

SEQ ID NO: 557053 - RNA, 64 nt, hsa
acaccgcgcguggcguggguguguguggcagcguggcucgcauucaguccuguguaggagagga

SEQ ID NO: 557054 - RNA, 64 nt, hsa
acagcacucaagcuucuggccgcauggacccgauggcucgcauucuguguaguguuuuacgucu

SEQ ID NO: 557055 - RNA, 64 nt, hsa
auuccuggaaagugguggcuucagaagugaucuuggcucgcaggcaccagugccaccuaccaag

SEQ ID NO: 557056 - RNA, 64 nt, hsa
gcccuucugcuggcccuguccgggcauaacagaaggcucgcacucuugucuucuggucacaccu

SEQ ID NO: 557057 - RNA, 64 nt, hsa
ugucacccaggcuggagugcaguggugcaaucuuggcucgcaaccuccgccucccagguucaag

SEQ ID NO: 557058 - RNA, 64 nt, hsa
cagcugugugcugcaugggguugggugucugccuggcucgcacuugguacccauggccaccucc

SEQ ID NO: 557059 - RNA, 64 nt, hsa
agcugggcaaaucuuacuuggcaucaacuuggauggcucgcauaugacaggaaacuggauugcc

SEQ ID NO: 557060 - RNA, 64 nt, hsa
ccaccacuuccagagccagaaagggugccaguugggcucgcacugcccacaugggaccuggccc

SEQ ID NO: 557061 - RNA, 64 nt, hsa
cccgcccgagcucaggcugccccucuccuuccccggcucgcaggagagcagagcagagaacugu

SEQ ID NO: 557062 - RNA, 64 nt, hsa
cggagccacuggggugggagggggcagggggcuuggcucgcacccccacuuucgccuccuccag

SEQ ID NO: 557063 - RNA, 64 nt, hsa
ccaggggccacagccaagcccagagucccccagcggcucgcaugucagcccagaccccaggguc

SEQ ID NO: 557064 - RNA, 64 nt, hsa
gggggcauauuugcaagcgcgcucggugcgggcaggcucgcauugcacccagggagcuggaguu

SEQ ID NO: 557065 - RNA, 64 nt, hsa
uauggcugcuuuagacaacugugacagacuauauggcucgcaaaacugcaaauauuuccuaucc

SEQ ID NO: 557066 - RNA, 64 nt, hsa
cgccagugcgcgcggagcugcugggcgccgcuugggcucgcaacgccucauggccgcgcagccu

SEQ ID NO: 557067 - RNA, 64 nt, hsa
agcuacagcucgcuccccuuggccucugugccuuggcucgcacuguuccuacugaaggccuagc

SEQ ID NO: 557068 - RNA, 64 nt, hsa
gucuggccgcuggucaagaagccaacagucauguggcucgcagaugcauccugcaucccagucc

SEQ ID NO: 557069 - RNA, 64 nt, hsa; identical to SEQ ID NO: 206768

SEQ ID NO: 557070 - RNA, 64 nt, hsa; identical to SEQ ID NO: 206769

SEQ ID NO: 557071 - RNA, 64 nt, hsa; identical to SEQ ID NO: 206770

SEQ ID NO: 557072 - RNA, 64 nt, hsa; identical to SEQ ID NO: 206771

SEQ ID NO: 557073 - RNA, 64 nt, hsa; identical to SEQ ID NO: 206772

SEQ ID NO: 557074 - RNA, 64 nt, hsa; identical to SEQ ID NO: 206773

SEQ ID NO: 557075 - RNA, 64 nt, hsa; identical to SEQ ID NO: 206774

SEQ ID NO: 557076 - RNA, 64 nt, hsa; identical to SEQ ID NO: 206775

SEQ ID NO: 557077 - RNA, 64 nt, hsa; identical to SEQ ID NO: 206776

SEQ ID NO: 557078 - RNA, 64 nt, hsa; identical to SEQ ID NO: 206777

SEQ ID NO: 557079 - RNA, 64 nt, hsa
augucagauuuugagcaguagcucuuugacaguguccuuuuauacccagucuuuucugcauuga

SEQ ID NO: 557080 - RNA, 64 nt, hsa
auaugguuuuaaauuggugcuuuauuaggugacuuccuuuuaggcgauggcaggucaugaaaua

SEQ ID NO: 557081 - RNA, 64 nt, hsa
caaaaguguuagaauuugcuuuugugccaucuauuccuuuuauggcaucuaucuugaaaguaau

SEQ ID NO: 557082 - RNA, 64 nt, hsa
gaaauuacuuaauacucaguguuuuggagaguauuccuuuuaguuuguugguuggcugguuuga

SEQ ID NO: 557083 - RNA, 64 nt, hsa
augcgauagguaacauguuuguaaccauauaguauccuuuuagauacaaaagcuuauuuucauu

SEQ ID NO: 557084 - RNA, 64 nt, hsa
gaccuuuaauacagugugcuuaucuguuacggccuccuuuuaucucucuucuccaauauuaaaa

SEQ ID NO: 557085 - RNA, 64 nt, hsa
ggcaagagcguuacuguagaccuuucucccuccuuccuuuuacuaccauuuuuuuuuaacacug

SEQ ID NO: 557086 - RNA, 64 nt, hsa
uuucaagauuuccaaagagaugaaauuuucuuaauccuuuuaaguuuucauaguaaacaguaug

SEQ ID NO: 557087 - RNA, 64 nt, hsa
uacuuacuaggaagccuggaauucauuauuuuuuuccuuuuaugugccacuguggcuacuuuaa

SEQ ID NO: 557088 - RNA, 64 nt, hsa
guuguuuaggaagagucaacagacuuuagcaaaauccuuuuauuugauucaugcauaacuccug

SEQ ID NO: 557089 - RNA, 64 nt, hsa
cauacauugccaauuuuccagggcucaaaaaguuuccuuuuauucauauuuucacaugacguaa

SEQ ID NO: 557090 - RNA, 64 nt, hsa
caccccaucaaguauaagguuacugauugauugguccuuuuauaaacauugguauauuuccauu

SEQ ID NO: 557091 - RNA, 64 nt, hsa
gaaaauugguacugugauaaauuugaauccaaaauccuuuuaacuauggguuuucaacuacaug

SEQ ID NO: 557092 - RNA, 64 nt, hsa
gauuuucaggacuuuaccuuuuguuuuguuuuuuuccuuuuagccaucuuuuguucuuguaauc

SEQ ID NO: 557093 - RNA, 64 nt, hsa
aaguaauuguaugugcuugccgcuauuuuuuucuuccuuuuaggaugauagaucauaacagaac

SEQ ID NO: 557094 - RNA, 64 nt, hsa
aucuucaaaaaauuauuuuaggcaaaguccauacuccuuuuaaaacaauauuuauguccuaugu

SEQ ID NO: 557095 - RNA, 64 nt, hsa
uggaaauuuguggcuagugugauuuuuguuuguuuccuuuuaaguacuguugaucaguugugac

SEQ ID NO: 557096 - RNA, 64 nt, hsa
aaugugucugguauuuacagcaaaauacuguguauccuuuuauggguaaaacaaaagugaacau

SEQ ID NO: 557097 - RNA, 64 nt, hsa
auauugcgcuaagugaaacuugucaaauaaauccuccuuuuaaaaacugcacucugucuugucu

SEQ ID NO: 557098 - RNA, 64 nt, hsa
ggccuugauuuaaaucuuucauuguauugugauuuccuuuuagguauauugcgcuaagugaaac

SEQ ID NO: 557099 - RNA, 64 nt, hsa
uacaggcuuaagcucuaagauagauagguguuuguccuuuuaccaucgagcuacuucccauaau

SEQ ID NO: 557100 - RNA, 64 nt, hsa
gaguucuagaguuucugauucuguuucucaguaguccuuuuagaggcuugcuauacuuggucug

SEQ ID NO: 557101 - RNA, 64 nt, hsa
ugggacccccuucaaaccuaaaaaucaaguuauuuccuuuuauaauacuuuucuuccccaugga

SEQ ID NO: 557102 - RNA, 64 nt, hsa
caaucagaauugugcuuuuucuccccuccucuauuccuuuuagggaauaauauucaauacacag

SEQ ID NO: 557103 - RNA, 64 nt, hsa
uuuaccaugauaauauauucugcacgguaagaauuccuuuuacagacauucuuuaucaagaggu

SEQ ID NO: 557104 - RNA, 64 nt, hsa
uucccagccuauaaaaaaaggaagguacacguuguccuuuuaaagguugugagguagauuggag

SEQ ID NO: 557105 - RNA, 64 nt, hsa
uaaccugucuucuucccucccauuauucucauuuuccuuuuaccuuucuccaccauccagagcc

SEQ ID NO: 557106 - RNA, 64 nt, hsa
uccaaaaccagcauuucagaaugguuccucaggauccuuuuauuugaagccuuugguauccagg

SEQ ID NO: 557107 - RNA, 64 nt, hsa
uguauccugaaaggcaacauaauucuuccuucccuccuuuuaaaauuuuguguuccuuuuugca

SEQ ID NO: 557108 - RNA, 64 nt, hsa
gaugaaaauaucagcuuuucuuauuccuuuuuauuccuuuuaaaaugguaugccaacuuaagua

SEQ ID NO: 557109 - RNA, 64 nt, hsa
ugugacaugaacucaaaauccugcauuuuuagauuccuuuuaguucuaauugaggccucacuag

SEQ ID NO: 557110 - RNA, 64 nt, hsa
uucugcuguugauucuuucagucuuccccccuucuccuuuuaucaaucauuccagaguuauuuu

SEQ ID NO: 557111 - RNA, 64 nt, hsa
aaaagucuacuguucauaaaccaugcuaacauuuuccuuuuagcuaguuuugaaaguaaggaac

SEQ ID NO: 557112 - RNA, 64 nt, hsa
auuuucuuuuucaaauccaauuuaaaauaaccuuuccuuuuaaaugugcugcaacguuuuuaaa

SEQ ID NO: 557113 - RNA, 64 nt, hsa
uucucaguguuuuagcuguuuuuuucauuagguuuccuuuuauucuguaccuugcagccaugac

SEQ ID NO: 557114 - RNA, 64 nt, hsa
ccaggagcuggaggagcaggcagugggugggagcuccuuuuagguagaauuuaacaugacuucu

SEQ ID NO: 557115 - RNA, 64 nt, hsa
augaaacuagauuuuuauugcgcucagguuauguuccuuuuaccuccuuccuuaauaaagagac

SEQ ID NO: 557116 - RNA, 64 nt, hsa
ucuuucauuacuuuuaguaaccauguuccuuguuuccuuuuauucuuccaucugaagccccacu

SEQ ID NO: 557117 - RNA, 64 nt, hsa
gguuaugcuccuccagcucuaguucagcuauaauuccuuuuauagagaaaccaaccugauacac

SEQ ID NO: 557118 - RNA, 64 nt, hsa
uuuucaugucuauaaucaagaauuccagauacauuccuuuuacugaaccuugaauugauccuaa

SEQ ID NO: 557119 - RNA, 64 nt, hsa
acgggaaggaaauccuuuuaaagauuuaaacugauccuuuuaaggaucacaugcuacaacuaga

SEQ ID NO: 557120 - RNA, 64 nt, hsa
aauggaaugcuauuaagccuuaacgggaaggaaauccuuuuaaagauuuaaacugauccuuuua

SEQ ID NO: 557121 - RNA, 64 nt, hsa
uacuaacauuuguagcacuugaugauuuacaaaguccuuuuacaucuguuuuuucauuugaucc

SEQ ID NO: 557122 - RNA, 64 nt, hsa
agaagagcaucucaaguuaccaaauuuuuuguaauccuuuuacuagaaaaaucuuuuuugaaga

SEQ ID NO: 557123 - RNA, 64 nt, hsa
gaccuguuuuagugcugcauucgacauggaaaaguccuuuuaaccugugcuugcauccuccuuu

SEQ ID NO: 557124 - RNA, 64 nt, hsa
auagcagauaaugaugacuaguucacacauaaaguccuuuuaaggagaaaaucuaaaaugaaaa

SEQ ID NO: 557125 - RNA, 64 nt, hsa
uguucaagaucaauaugucuaauaagugcugguguccuuuuaaaguauuuaaauauauauguug

SEQ ID NO: 557126 - RNA, 64 nt, hsa
uagcaaccaaaagagguuguuaauuagcacauauuccuuuuagaaaaauguuucagaaaccuca

SEQ ID NO: 557127 - RNA, 64 nt, hsa
gaauuuaucuaauuauuguuuuucaaaguuucuuuccuuuuaauguuucccugcuaugcaaaac

SEQ ID NO: 557128 - RNA, 64 nt, hsa
uuaagauggaaguaguuaaauauggguuauuuuguccuuuuacuuuuuuaaaaaauguuacaua

SEQ ID NO: 557129 - RNA, 64 nt, hsa
aaaccauucaccaauuuuaauccuuuuauuuuaauccuuuuacauaaaauaaucugaacucuuu

SEQ ID NO: 557130 - RNA, 64 nt, hsa
uugaauacuugaauaaaccauucaccaauuuuaauccuuuuauuuuaauccuuuuacauaaaau

SEQ ID NO: 557131 - RNA, 64 nt, hsa
cuuauuguuugcaagaacagaauacauccuuuuauccuuuuaugaaaaaugacaagugaaggca

SEQ ID NO: 557132 - RNA, 64 nt, hsa
uguuagcacuuauuguuugcaagaacagaauacauccuuuuauccuuuuaugaaaaaugacaag

SEQ ID NO: 557133 - RNA, 64 nt, hsa
guaagagaauccaucuuuuacuaggagaccagauuccuuuuauaccucauucaucaugcuggau

SEQ ID NO: 557134 - RNA, 64 nt, hsa
cuugacugaauuaugggcaggagaaagagcagauuccuuuuagcuaauuccccaacccauaugc

SEQ ID NO: 557135 - RNA, 64 nt, hsa
auuuuuaguugacauuguuuucuguucagcaguuuccuuuuagcuuccguauuuccugaugaga

SEQ ID NO: 557136 - RNA, 64 nt, hsa
uuugauuaauguuuucguggcacacauauuuccauccuuuuauguuuaaucuguuuaaaacaag

SEQ ID NO: 557137 - RNA, 64 nt, hsa
uuuccucaagaaugucugaagaagguaguaauauuccuuuuaaauuuuuuccaaccauugcuug

SEQ ID NO: 557138 - RNA, 64 nt, hsa
ucaacacgucgggaguauguguguuagaagcaauuccuuuuauuucuuucaccuuucauaaguu

SEQ ID NO: 557139 - RNA, 64 nt, hsa
guuguaacucucuggucuucauaugucccugugcuccuuuuaaccaaauaaagaguucuuguuu

SEQ ID NO: 557140 - RNA, 64 nt, hsa
aaaaugaguuacaaugucagguguuuuuaaaaauuccuuuuagagacagucuuuugggaaccaa

SEQ ID NO: 557141 - RNA, 64 nt, hsa
gaguuagauguauuaaaaaaacgaaacuacaaaauccuuuuaagaaaguaauaccaauuuagac

SEQ ID NO: 557142 - RNA, 64 nt, hsa
uugcuaauuuugugaaauaaagagucuagcccucuccuuuuaaugaacuuaacucucgcuggca

SEQ ID NO: 557143 - RNA, 64 nt, hsa
ggccaguuuuuacuuguuugcccugagggaaaaauccuuuuaaaaaaaauuucugguuuuuauu

SEQ ID NO: 557144 - RNA, 64 nt, hsa
auuuuguuggaugacuuggagauuuaucucuguuuccuuuuacaauuguugaaauguuccuuuu

SEQ ID NO: 557145 - RNA, 64 nt, hsa
uuaucucuguuuccuuuuacaauuguugaaauguuccuuuuaauggaugguugaauuaacuuca

SEQ ID NO: 557146 - RNA, 64 nt, hsa
auucuguuuuauaguauagaaucuacuuuauccuuccuuuuaauaguuccuuuagaccugugaa

SEQ ID NO: 557147 - RNA, 64 nt, hsa
cggcucagauagggcucaaaacaagagauuccucuccuuuuacugugucuuguauuaaguacgg

SEQ ID NO: 557148 - RNA, 64 nt, hsa; identical to SEQ ID NO: 308467

SEQ ID NO: 557149 - RNA, 64 nt, hsa; identical to SEQ ID NO: 308468

SEQ ID NO: 557150 - RNA, 64 nt, hsa; identical to SEQ ID NO: 308469

SEQ ID NO: 557151 - RNA, 64 nt, hsa; identical to SEQ ID NO: 308470

SEQ ID NO: 557152 - RNA, 64 nt, hsa; identical to SEQ ID NO: 60210

SEQ ID NO: 557153 - RNA, 64 nt, hsa; identical to SEQ ID NO: 60211

SEQ ID NO: 557154 - RNA, 64 nt, hsa; identical to SEQ ID NO: 60212

SEQ ID NO: 557155 - RNA, 64 nt, hsa; identical to SEQ ID NO: 60213

SEQ ID NO: 557156 - RNA, 64 nt, hsa; identical to SEQ ID NO: 60214

SEQ ID NO: 557157 - RNA, 64 nt, hsa; identical to SEQ ID NO: 60215

SEQ ID NO: 557158 - RNA, 64 nt, hsa; identical to SEQ ID NO: 60216

SEQ ID NO: 557159 - RNA, 64 nt, hsa; identical to SEQ ID NO: 60217

SEQ ID NO: 557160 - RNA, 64 nt, hsa; identical to SEQ ID NO: 60218

SEQ ID NO: 557161 - RNA, 64 nt, hsa; identical to SEQ ID NO: 60219

SEQ ID NO: 557162 - RNA, 64 nt, hsa; identical to SEQ ID NO: 60220

SEQ ID NO: 557163 - RNA, 64 nt, hsa; identical to SEQ ID NO: 60221

SEQ ID NO: 557164 - RNA, 64 nt, hsa; identical to SEQ ID NO: 60222

SEQ ID NO: 557165 - RNA, 64 nt, hsa; identical to SEQ ID NO: 60223

SEQ ID NO: 557166 - RNA, 64 nt, hsa; identical to SEQ ID NO: 60224

SEQ ID NO: 557167 - RNA, 64 nt, hsa; identical to SEQ ID NO: 60225

SEQ ID NO: 557168 - RNA, 64 nt, hsa; identical to SEQ ID NO: 60226

SEQ ID NO: 557169 - RNA, 64 nt, hsa; identical to SEQ ID NO: 60227

SEQ ID NO: 557170 - RNA, 64 nt, hsa; identical to SEQ ID NO: 60228

SEQ ID NO: 557171 - RNA, 64 nt, hsa; identical to SEQ ID NO: 60229

SEQ ID NO: 557172 - RNA, 64 nt, hsa; identical to SEQ ID NO: 60230

SEQ ID NO: 557173 - RNA, 64 nt, hsa; identical to SEQ ID NO: 60231

SEQ ID NO: 557174 - RNA, 64 nt, hsa; identical to SEQ ID NO: 60232

SEQ ID NO: 557175 - RNA, 64 nt, hsa; identical to SEQ ID NO: 60233

SEQ ID NO: 557176 - RNA, 64 nt, hsa; identical to SEQ ID NO: 60234

SEQ ID NO: 557177 - RNA, 64 nt, hsa; identical to SEQ ID NO: 60235

SEQ ID NO: 557178 - RNA, 64 nt, hsa; identical to SEQ ID NO: 60236

SEQ ID NO: 557179 - RNA, 64 nt, hsa; identical to SEQ ID NO: 60237

SEQ ID NO: 557180 - RNA, 64 nt, hsa; identical to SEQ ID NO: 60238

SEQ ID NO: 557181 - RNA, 64 nt, hsa; identical to SEQ ID NO: 60239

SEQ ID NO: 557182 - RNA, 64 nt, hsa; identical to SEQ ID NO: 60240

SEQ ID NO: 557183 - RNA, 64 nt, hsa; identical to SEQ ID NO: 60241

SEQ ID NO: 557184 - RNA, 64 nt, hsa; identical to SEQ ID NO: 60242

SEQ ID NO: 557185 - RNA, 64 nt, hsa; identical to SEQ ID NO: 60243

SEQ ID NO: 557186 - RNA, 64 nt, hsa; identical to SEQ ID NO: 60244

SEQ ID NO: 557187 - RNA, 64 nt, hsa; identical to SEQ ID NO: 60245

SEQ ID NO: 557188 - RNA, 64 nt, hsa; identical to SEQ ID NO: 60246

SEQ ID NO: 557189 - RNA, 64 nt, hsa; identical to SEQ ID NO: 60247

SEQ ID NO: 557190 - RNA, 64 nt, hsa; identical to SEQ ID NO: 60248

SEQ ID NO: 557191 - RNA, 64 nt, hsa; identical to SEQ ID NO: 60249

SEQ ID NO: 557192 - RNA, 64 nt, hsa; identical to SEQ ID NO: 60250

SEQ ID NO: 557193 - RNA, 64 nt, hsa; identical to SEQ ID NO: 60251

SEQ ID NO: 557194 - RNA, 64 nt, hsa; identical to SEQ ID NO: 60252

SEQ ID NO: 557195 - RNA, 64 nt, hsa; identical to SEQ ID NO: 60253

SEQ ID NO: 557196 - RNA, 64 nt, hsa; identical to SEQ ID NO: 60254

SEQ ID NO: 557197 - RNA, 64 nt, hsa; identical to SEQ ID NO: 60255

SEQ ID NO: 557198 - RNA, 64 nt, hsa; identical to SEQ ID NO: 60256

SEQ ID NO: 557199 - RNA, 64 nt, hsa; identical to SEQ ID NO: 379884

SEQ ID NO: 557200 - RNA, 64 nt, hsa; identical to SEQ ID NO: 379885

SEQ ID NO: 557201 - RNA, 64 nt, hsa; identical to SEQ ID NO: 379886

SEQ ID NO: 557202 - RNA, 64 nt, hsa; identical to SEQ ID NO: 379887

SEQ ID NO: 557203 - RNA, 64 nt, hsa; identical to SEQ ID NO: 379888

SEQ ID NO: 557204 - RNA, 64 nt, hsa; identical to SEQ ID NO: 379889

SEQ ID NO: 557205 - RNA, 64 nt, hsa; identical to SEQ ID NO: 379890

SEQ ID NO: 557206 - RNA, 64 nt, hsa; identical to SEQ ID NO: 379891

SEQ ID NO: 557207 - RNA, 64 nt, hsa; identical to SEQ ID NO: 379892

SEQ ID NO: 557208 - RNA, 64 nt, hsa; identical to SEQ ID NO: 379893

SEQ ID NO: 557209 - RNA, 64 nt, hsa; identical to SEQ ID NO: 379894

SEQ ID NO: 557210 - RNA, 64 nt, hsa; identical to SEQ ID NO: 379895

SEQ ID NO: 557211 - RNA, 64 nt, hsa; identical to SEQ ID NO: 79450

SEQ ID NO: 557212 - RNA, 64 nt, hsa; identical to SEQ ID NO: 79451

SEQ ID NO: 557213 - RNA, 64 nt, hsa; identical to SEQ ID NO: 79452

SEQ ID NO: 557214 - RNA, 64 nt, hsa; identical to SEQ ID NO: 79453

SEQ ID NO: 557215 - RNA, 64 nt, hsa; identical to SEQ ID NO: 79454

SEQ ID NO: 557216 - RNA, 64 nt, hsa; identical to SEQ ID NO: 79455

SEQ ID NO: 557217 - RNA, 64 nt, hsa; identical to SEQ ID NO: 79456

SEQ ID NO: 557218 - RNA, 64 nt, hsa; identical to SEQ ID NO: 79457

SEQ ID NO: 557219 - RNA, 64 nt, hsa; identical to SEQ ID NO: 79458

SEQ ID NO: 557220 - RNA, 64 nt, hsa; identical to SEQ ID NO: 79459

SEQ ID NO: 557221 - RNA, 64 nt, hsa
agcuucggccuccacaucguccccgucugaccccaccccggagggagggaggaccgacgcgacg

SEQ ID NO: 557222 - RNA, 64 nt, hsa
cccaucccaguccuguggggcuggccgggcagagaccccggacccaggcccaggccuaaccugc

SEQ ID NO: 557223 - RNA, 64 nt, hsa
cuugguggggaacucuaagggggacggagucaguaccccggacagggccacauuugcaugagac

SEQ ID NO: 557224 - RNA, 64 nt, hsa
cgggguuucuccuuguuggucaggcuggucucaaaccccggaccucaggugauccccccaccuu

SEQ ID NO: 557225 - RNA, 64 nt, hsa
uaguguuucuguauaauaaagugucugccggcucgcgggccaggauccucucggugggaugggc

SEQ ID NO: 557226 - RNA, 64 nt, hsa
ugggcaccacagacaggaggccccucaggcccgugcgggccacugucugcugccgccugccggg

SEQ ID NO: 557227 - RNA, 64 nt, hsa; identical to SEQ ID NO: 159617

SEQ ID NO: 557228 - RNA, 64 nt, hsa; identical to SEQ ID NO: 159618

SEQ ID NO: 557229 - RNA, 64 nt, hsa; identical to SEQ ID NO: 159619

SEQ ID NO: 557230 - RNA, 64 nt, hsa; identical to SEQ ID NO: 159620

SEQ ID NO: 557231 - RNA, 64 nt, hsa; identical to SEQ ID NO: 159621

SEQ ID NO: 557232 - RNA, 64 nt, hsa; identical to SEQ ID NO: 159622

SEQ ID NO: 557233 - RNA, 64 nt, hsa; identical to SEQ ID NO: 159623

SEQ ID NO: 557234 - RNA, 64 nt, hsa; identical to SEQ ID NO: 159624

SEQ ID NO: 557235 - RNA, 64 nt, hsa; identical to SEQ ID NO: 159625

SEQ ID NO: 557236 - RNA, 64 nt, hsa; identical to SEQ ID NO: 159626

SEQ ID NO: 557237 - RNA, 64 nt, hsa; identical to SEQ ID NO: 159627

SEQ ID NO: 557238 - RNA, 64 nt, hsa; identical to SEQ ID NO: 159628

SEQ ID NO: 557239 - RNA, 64 nt, hsa; identical to SEQ ID NO: 159629

SEQ ID NO: 557240 - RNA, 64 nt, hsa; identical to SEQ ID NO: 159630

SEQ ID NO: 557241 - RNA, 64 nt, hsa; identical to SEQ ID NO: 159631

SEQ ID NO: 557242 - RNA, 64 nt, hsa; identical to SEQ ID NO: 159632

SEQ ID NO: 557243 - RNA, 64 nt, hsa; identical to SEQ ID NO: 159633

SEQ ID NO: 557244 - RNA, 64 nt, hsa; identical to SEQ ID NO: 159634

SEQ ID NO: 557245 - RNA, 64 nt, hsa; identical to SEQ ID NO: 159635

SEQ ID NO: 557246 - RNA, 64 nt, hsa; identical to SEQ ID NO: 159636

SEQ ID NO: 557247 - RNA, 64 nt, hsa; identical to SEQ ID NO: 159637

SEQ ID NO: 557248 - RNA, 64 nt, hsa; identical to SEQ ID NO: 159638

SEQ ID NO: 557249 - RNA, 64 nt, hsa; identical to SEQ ID NO: 159639

SEQ ID NO: 557250 - RNA, 64 nt, hsa; identical to SEQ ID NO: 159640

SEQ ID NO: 557251 - RNA, 64 nt, hsa; identical to SEQ ID NO: 159641

SEQ ID NO: 557252 - RNA, 64 nt, hsa; identical to SEQ ID NO: 159642

SEQ ID NO: 557253 - RNA, 64 nt, hsa; identical to SEQ ID NO: 159643

SEQ ID NO: 557254 - RNA, 64 nt, hsa; identical to SEQ ID NO: 159644

SEQ ID NO: 557255 - RNA, 64 nt, hsa; identical to SEQ ID NO: 159645

SEQ ID NO: 557256 - RNA, 64 nt, hsa; identical to SEQ ID NO: 159646

SEQ ID NO: 557257 - RNA, 64 nt, hsa; identical to SEQ ID NO: 159647

SEQ ID NO: 557258 - RNA, 64 nt, hsa; identical to SEQ ID NO: 159648

SEQ ID NO: 557259 - RNA, 64 nt, hsa; identical to SEQ ID NO: 159649

SEQ ID NO: 557260 - RNA, 64 nt, hsa; identical to SEQ ID NO: 159650

SEQ ID NO: 557261 - RNA, 64 nt, hsa; identical to SEQ ID NO: 159651

SEQ ID NO: 557262 - RNA, 64 nt, hsa; identical to SEQ ID NO: 159652

SEQ ID NO: 557263 - RNA, 64 nt, hsa; identical to SEQ ID NO: 159653

SEQ ID NO: 557264 - RNA, 64 nt, hsa; identical to SEQ ID NO: 159654

SEQ ID NO: 557265 - RNA, 64 nt, hsa; identical to SEQ ID NO: 159655

SEQ ID NO: 557266 - RNA, 64 nt, hsa; identical to SEQ ID NO: 159656

SEQ ID NO: 557267 - RNA, 64 nt, hsa; identical to SEQ ID NO: 159657

SEQ ID NO: 557268 - RNA, 64 nt, hsa; identical to SEQ ID NO: 159658

SEQ ID NO: 557269 - RNA, 64 nt, hsa; identical to SEQ ID NO: 194820

SEQ ID NO: 557270 - RNA, 64 nt, hsa; identical to SEQ ID NO: 194821

SEQ ID NO: 557271 - RNA, 64 nt, hsa; identical to SEQ ID NO: 194822

SEQ ID NO: 557272 - RNA, 64 nt, hsa; identical to SEQ ID NO: 194823

SEQ ID NO: 557273 - RNA, 64 nt, hsa; identical to SEQ ID NO: 194824

SEQ ID NO: 557274 - RNA, 64 nt, hsa; identical to SEQ ID NO: 194825

SEQ ID NO: 557275 - RNA, 50 nt, hsa; identical to SEQ ID NO: 57621

SEQ ID NO: 557276 - RNA, 64 nt, hsa; identical to SEQ ID NO: 194827

SEQ ID NO: 557277 - RNA, 64 nt, hsa; identical to SEQ ID NO: 194828

SEQ ID NO: 557278 - RNA, 64 nt, hsa; identical to SEQ ID NO: 194829

SEQ ID NO: 557279 - RNA, 64 nt, hsa; identical to SEQ ID NO: 194830

SEQ ID NO: 557280 - RNA, 64 nt, hsa; identical to SEQ ID NO: 194831

SEQ ID NO: 557281 - RNA, 64 nt, hsa; identical to SEQ ID NO: 194832

SEQ ID NO: 557282 - RNA, 64 nt, hsa; identical to SEQ ID NO: 194833

SEQ ID NO: 557283 - RNA, 64 nt, hsa; identical to SEQ ID NO: 194834

SEQ ID NO: 557284 - RNA, 64 nt, hsa; identical to SEQ ID NO: 194835

SEQ ID NO: 557285 - RNA, 64 nt, hsa; identical to SEQ ID NO: 194836

SEQ ID NO: 557286 - RNA, 64 nt, hsa; identical to SEQ ID NO: 194837

SEQ ID NO: 557287 - RNA, 64 nt, hsa; identical to SEQ ID NO: 194838

SEQ ID NO: 557288 - RNA, 64 nt, hsa; identical to SEQ ID NO: 200782

SEQ ID NO: 557289 - RNA, 64 nt, hsa; identical to SEQ ID NO: 200783

SEQ ID NO: 557290 - RNA, 64 nt, hsa; identical to SEQ ID NO: 200784

SEQ ID NO: 557291 - RNA, 64 nt, hsa; identical to SEQ ID NO: 200785

SEQ ID NO: 557292 - RNA, 64 nt, hsa; identical to SEQ ID NO: 200786

SEQ ID NO: 557293 - RNA, 64 nt, hsa; identical to SEQ ID NO: 200787

SEQ ID NO: 557294 - RNA, 64 nt, hsa; identical to SEQ ID NO: 200788

SEQ ID NO: 557295 - RNA, 64 nt, hsa; identical to SEQ ID NO: 200789

SEQ ID NO: 557296 - RNA, 64 nt, hsa; identical to SEQ ID NO: 200790

SEQ ID NO: 557297 - RNA, 64 nt, hsa; identical to SEQ ID NO: 200791

SEQ ID NO: 557298 - RNA, 64 nt, hsa; identical to SEQ ID NO: 200792

SEQ ID NO: 557299 - RNA, 64 nt, hsa; identical to SEQ ID NO: 200793

SEQ ID NO: 557300 - RNA, 64 nt, hsa; identical to SEQ ID NO: 200794

SEQ ID NO: 557301 - RNA, 64 nt, hsa; identical to SEQ ID NO: 200795

SEQ ID NO: 557302 - RNA, 64 nt, hsa; identical to SEQ ID NO: 200796

SEQ ID NO: 557303 - RNA, 64 nt, hsa; identical to SEQ ID NO: 200797

SEQ ID NO: 557304 - RNA, 64 nt, hsa
cacccaagguuucugauucugacccagcagugguccugaagagagcugauggcaagucuuguag

SEQ ID NO: 557305 - RNA, 64 nt, hsa
gcucugggcacauuuccuguucuugaauucugcuccugaagagggugaacaaauggggcauuca

SEQ ID NO: 557306 - RNA, 64 nt, hsa
aaaaccagguuucuucuccccauaccacguugugccugaagaacaagccuucccguccuugccu

SEQ ID NO: 557307 - RNA, 64 nt, hsa
agaaucaaagccuugucacauggauccucuggugccugaagaaaugagauuuuauuaucccucu

SEQ ID NO: 557308 - RNA, 64 nt, hsa
ugacugggaccuccuuccaggagaucaugcacgcccugaagaugaccuggcacgugcacugcuu

SEQ ID NO: 557309 - RNA, 64 nt, hsa
cugcccucucagugcaagacccggaugaggagcaccugaagaaaucaagguacagggacgggca

SEQ ID NO: 557310 - RNA, 64 nt, hsa
ucuggccucccaugucagguagggugagagaggcccugaagauagaagccaggcccgaaggcca

SEQ ID NO: 557311 - RNA, 64 nt, hsa
aggacggggcugugucugccucagacugggaaucccugaagauggggccgugucucccucaaag

SEQ ID NO: 557312 - RNA, 64 nt, hsa
aggacggggcugugucucccucagacuggggcucccugaagaaagggcugcuucucccucagac

SEQ ID NO: 557313 - RNA, 64 nt, hsa
aagaaagggcugcuucucccucagacuggagcucccugaagauggggcugugucccccucagac

SEQ ID NO: 557314 - RNA, 64 nt, hsa
aauuuaugcuacaacugguaacaaugaccagaagccugaagaauuaaaaugccaacaccaaacc

SEQ ID NO: 557315 - RNA, 64 nt, hsa
gucauuuuuuaaacaacacucaacuuugugaaccccugaagauuuuuugaccguuccaagucuu

SEQ ID NO: 557316 - RNA, 64 nt, hsa
cccaggcccaagagacccugaagagccugggugcccugaagaagugacucugggagggcccggc

SEQ ID NO: 557317 - RNA, 64 nt, hsa
ggcugcagcagcagcugacccaggcccaagagacccugaagagccugggugcccugaagaagug

SEQ ID NO: 557318 - RNA, 64 nt, hsa
cagguugacaguuggaggacuucaccguaccaacccugaagagauuguauuacacauuaaggac

SEQ ID NO: 557319 - RNA, 64 nt, hsa
ccuaccauccaauguggaaggaaaacaagaacugccugaagaagaguccaagcuacagauacac

SEQ ID NO: 557320 - RNA, 64 nt, hsa
cuagucuuauuauucagauggagaacuuagaaaaccugaagaguacccaaauuggauuguauuu

SEQ ID NO: 557321 - RNA, 64 nt, hsa
gcaagcuugaugcaaaaccuccugaccuuuccuaccugaagagcccuuugacuucuaggaagaa

SEQ ID NO: 557322 - RNA, 64 nt, hsa
acuguucauucuuaucuucugcuaguuaauauagccugaagacagaggauaaauaguugucaau

SEQ ID NO: 557323 - RNA, 64 nt, hsa
agaaauccuguccucuuggugggagguuaccuuaccugaagaccaucucucccaagcacuguag

SEQ ID NO: 557324 - RNA, 64 nt, hsa
ugaacccuacagaaauaugggccugcugccauuuccugaagaccggggcaucggggugggguga

SEQ ID NO: 557325 - RNA, 64 nt, hsa
ggaaguuauuaaagaggcugcaaaguccagccacccugaagauacuccccagugcuccccuccu

SEQ ID NO: 557326 - RNA, 64 nt, hsa
gaggaccucaggaggccagcagaacccgcaggcuccugaagacuggccacgccuccugagacca

SEQ ID NO: 557327 - RNA, 64 nt, hsa
uggucccuuacaaacuaacugugccccuggggucccugaagacuggcuaguccuggcagaacag

SEQ ID NO: 557328 - RNA, 64 nt, hsa
gcugggggguggugaugauugucucagcacucacgcacugcacaagauggcagcaggauacagc

SEQ ID NO: 557329 - RNA, 64 nt, hsa
acucacgcacugcacaagauggcagcaggauacagcacugcacaagauggcagcuccucugcag

SEQ ID NO: 557330 - RNA, 64 nt, hsa
acugcacagacagcugcgaccaggacgucagccagcacugcacagacagcugcgaccagagacu

SEQ ID NO: 557331 - RNA, 64 nt, hsa
ccugugaggccgugguuagcguggacaucagccagcacugcacagacagcugcgaccaggacgu

SEQ ID NO: 557332 - RNA, 64 nt, hsa
ggcagagguugcagugagcugagaucgcaucauugcacugcagucugagugacagagugagacu

SEQ ID NO: 557333 - RNA, 64 nt, hsa
ccuugugaggaacaaacuccuggguuggcagcaugcacugcauauuuguuacugcugcccaccu

SEQ ID NO: 557334 - RNA, 64 nt, hsa
gcccagaaugcccagaagagaaccaugcauaccugcacugcauuugagagccaugagcuggagg

SEQ ID NO: 557335 - RNA, 64 nt, hsa
caaguggucccugaugugcagugucucauuaguugcacugcaguuaacuguggcuccugcaggg

SEQ ID NO: 557336 - RNA, 64 nt, hsa
augcacaggcacacacauguacgcacacacacaugcacugcacacauauccaugcacacaaaca

SEQ ID NO: 557337 - RNA, 64 nt, hsa
acccuccugacuguccuggaugugcaacugguuugcacugcacaccccacggccauguaacucu

SEQ ID NO: 557338 - RNA, 64 nt, hsa
ccaacaggcagcaccgcaccucugcccgccucccgcacugcagcuccgcccgccgggcucugcg

SEQ ID NO: 557339 - RNA, 64 nt, hsa
ugccacaaacaagugcacacuguccugguguccugcacugcauccugccuccuugcugaggggc

SEQ ID NO: 557340 - RNA, 64 nt, hsa
ccucacaccacagcacaccucaccacaccacaccgcacugcaccauaccucaccacaucucacc

SEQ ID NO: 557341 - RNA, 64 nt, hsa
acaccucaccacacaacacaccacaccccacaccgcacugcaccgcaccgcaccgcaccguacc

SEQ ID NO: 557342 - RNA, 64 nt, hsa
auugcuugggccccacauucauccugccacaucugcacugcagcggaugaccaccaggcucuca

SEQ ID NO: 557343 - RNA, 64 nt, hsa
ugugguugccucuccugcauuugccacuggauuugcacugcaucguuuggagauacaaagcgag

SEQ ID NO: 557344 - RNA, 64 nt, hsa
gcuaugcugcaaaguggguuggccaaggcccuuugcacugcaucacccuggugcccagcaacau

SEQ ID NO: 557345 - RNA, 64 nt, hsa
cagugaaagaggaaaagaacauuccaggcagacagcacugcaagagggugagcucuugguguau

SEQ ID NO: 557346 - RNA, 64 nt, hsa
acccacagaucacaccuccauccccaaagagguagcacugcagcaacaucagggggaggacgug

SEQ ID NO: 557347 - RNA, 64 nt, hsa
acuauucagagccaguaggaggccgacagucacagcacugcacuguggugcggcuucaugugau

SEQ ID NO: 557348 - RNA, 64 nt, hsa
uuuuagaaagagaaaaugagcugagaguuuacaggcacugcagaagcuguucaguauuauaugu

SEQ ID NO: 557349 - RNA, 64 nt, hsa
auuguaaauggaauauuccucauuuaaaauuuuugcacugcauuuucuacuguaaaccaaaaga

SEQ ID NO: 557350 - RNA, 64 nt, hsa
aggaggucaaggcugcagugagccaugauucacagcacugcacugcagccugggugacaaagca

SEQ ID NO: 557351 - RNA, 64 nt, hsa
gucaaggcugcagugagccaugauucacagcacugcacugcagccugggugacaaagcaagacc

SEQ ID NO: 557352 - RNA, 64 nt, hsa
accacgauggagcccguguuuguccugccaucuggcacugcacugaguguggcacaggcaccgu

SEQ ID NO: 557353 - RNA, 64 nt, hsa
cgucucaagugaacagugggagccugcccaccuggcacugcacuggaguugucucuuaccccac

SEQ ID NO: 557354 - RNA, 64 nt, hsa
guggggaagggucuccaggcuuuauuccucccaggcacugcagaggcaccggugaggaaggguc

SEQ ID NO: 557355 - RNA, 64 nt, hsa
agagguucagggagaacagcugcguugcucccaggcacugcagaggcccgguggggaagggucu

SEQ ID NO: 557356 - RNA, 64 nt, hsa
ucaacggcauuuguguuaugggguaaaaguaagggugggauauggggaauuugcucauucuuuu

SEQ ID NO: 557357 - RNA, 61 nt, hsa
agccgaguuuuuucaucugaccacagucauggugggauaagacaacaggcugacaaaccaa

SEQ ID NO: 557358 - RNA, 64 nt, hsa
uuuggugacuucacagugaagucuugcccucucugugggauaucacaucagugguuccaagauu

SEQ ID NO: 557359 - RNA, 64 nt, hsa
ucuuauacagacccucauuacuggggcccaagaugugggauacuacuguuaguauuauuuaacu

SEQ ID NO: 557360 - RNA, 64 nt, hsa; identical to SEQ ID NO: 138555

SEQ ID NO: 557361 - RNA, 64 nt, hsa; identical to SEQ ID NO: 138556

SEQ ID NO: 557362 - RNA, 64 nt, hsa; identical to SEQ ID NO: 138557

SEQ ID NO: 557363 - RNA, 64 nt, hsa; identical to SEQ ID NO: 138558

SEQ ID NO: 557364 - RNA, 64 nt, hsa; identical to SEQ ID NO: 138559

SEQ ID NO: 557365 - RNA, 64 nt, hsa; identical to SEQ ID NO: 138560

SEQ ID NO: 557366 - RNA, 64 nt, hsa; identical to SEQ ID NO: 138561

SEQ ID NO: 557367 - RNA, 64 nt, hsa; identical to SEQ ID NO: 138562

SEQ ID NO: 557368 - RNA, 64 nt, hsa; identical to SEQ ID NO: 138563

SEQ ID NO: 557369 - RNA, 64 nt, hsa; identical to SEQ ID NO: 138564

SEQ ID NO: 557370 - RNA, 64 nt, hsa; identical to SEQ ID NO: 138565

SEQ ID NO: 557371 - RNA, 64 nt, hsa; identical to SEQ ID NO: 138566

SEQ ID NO: 557372 - RNA, 64 nt, hsa; identical to SEQ ID NO: 138567

SEQ ID NO: 557373 - RNA, 64 nt, hsa; identical to SEQ ID NO: 138568

SEQ ID NO: 557374 - RNA, 64 nt, hsa; identical to SEQ ID NO: 138569

SEQ ID NO: 557375 - RNA, 64 nt, hsa; identical to SEQ ID NO: 138570

SEQ ID NO: 557376 - RNA, 64 nt, hsa; identical to SEQ ID NO: 138571

SEQ ID NO: 557377 - RNA, 64 nt, hsa; identical to SEQ ID NO: 138572

SEQ ID NO: 557378 - RNA, 55 nt, hsa; identical to SEQ ID NO: 138573

SEQ ID NO: 557379 - RNA, 64 nt, hsa; identical to SEQ ID NO: 138574

SEQ ID NO: 557380 - RNA, 64 nt, hsa; identical to SEQ ID NO: 138575

SEQ ID NO: 557381 - RNA, 64 nt, hsa; identical to SEQ ID NO: 138576

SEQ ID NO: 557382 - RNA, 64 nt, hsa; identical to SEQ ID NO: 138577

SEQ ID NO: 557383 - RNA, 64 nt, hsa; identical to SEQ ID NO: 138578

SEQ ID NO: 557384 - RNA, 64 nt, hsa; identical to SEQ ID NO: 138579

SEQ ID NO: 557385 - RNA, 64 nt, hsa; identical to SEQ ID NO: 138580

SEQ ID NO: 557386 - RNA, 64 nt, hsa; identical to SEQ ID NO: 138581

SEQ ID NO: 557387 - RNA, 64 nt, hsa; identical to SEQ ID NO: 138582

SEQ ID NO: 557388 - RNA, 64 nt, hsa; identical to SEQ ID NO: 138583

SEQ ID NO: 557389 - RNA, 64 nt, hsa; identical to SEQ ID NO: 138584

SEQ ID NO: 557390 - RNA, 64 nt, hsa; identical to SEQ ID NO: 100733

SEQ ID NO: 557391 - RNA, 64 nt, hsa; identical to SEQ ID NO: 100734

SEQ ID NO: 557392 - RNA, 64 nt, hsa; identical to SEQ ID NO: 100735

SEQ ID NO: 557393 - RNA, 64 nt, hsa; identical to SEQ ID NO: 100736

SEQ ID NO: 557394 - RNA, 64 nt, hsa; identical to SEQ ID NO: 100737

SEQ ID NO: 557395 - RNA, 64 nt, hsa; identical to SEQ ID NO: 100738

SEQ ID NO: 557396 - RNA, 64 nt, hsa; identical to SEQ ID NO: 100739

SEQ ID NO: 557397 - RNA, 64 nt, hsa; identical to SEQ ID NO: 100740

SEQ ID NO: 557398 - RNA, 64 nt, hsa; identical to SEQ ID NO: 100741

SEQ ID NO: 557399 - RNA, 64 nt, hsa; identical to SEQ ID NO: 100742

SEQ ID NO: 557400 - RNA, 64 nt, hsa; identical to SEQ ID NO: 100743

SEQ ID NO: 557401 - RNA, 64 nt, hsa; identical to SEQ ID NO: 100744

SEQ ID NO: 557402 - RNA, 64 nt, hsa; identical to SEQ ID NO: 100745

SEQ ID NO: 557403 - RNA, 64 nt, hsa; identical to SEQ ID NO: 100746

SEQ ID NO: 557404 - RNA, 64 nt, hsa; identical to SEQ ID NO: 100747

SEQ ID NO: 557405 - RNA, 64 nt, hsa; identical to SEQ ID NO: 100748

SEQ ID NO: 557406 - RNA, 64 nt, hsa; identical to SEQ ID NO: 100749

SEQ ID NO: 557407 - RNA, 64 nt, hsa; identical to SEQ ID NO: 100750

SEQ ID NO: 557408 - RNA, 64 nt, hsa; identical to SEQ ID NO: 100751

SEQ ID NO: 557409 - RNA, 64 nt, hsa; identical to SEQ ID NO: 100752

SEQ ID NO: 557410 - RNA, 64 nt, hsa; identical to SEQ ID NO: 100753

SEQ ID NO: 557411 - RNA, 64 nt, hsa; identical to SEQ ID NO: 100754

SEQ ID NO: 557412 - RNA, 64 nt, hsa; identical to SEQ ID NO: 100755

SEQ ID NO: 557413 - RNA, 64 nt, hsa; identical to SEQ ID NO: 100756

SEQ ID NO: 557414 - RNA, 64 nt, hsa; identical to SEQ ID NO: 100757

SEQ ID NO: 557415 - RNA, 64 nt, hsa; identical to SEQ ID NO: 100758

SEQ ID NO: 557416 - RNA, 64 nt, hsa; identical to SEQ ID NO: 100759

SEQ ID NO: 557417 - RNA, 64 nt, hsa; identical to SEQ ID NO: 100760

SEQ ID NO: 557418 - RNA, 64 nt, hsa; identical to SEQ ID NO: 100761

SEQ ID NO: 557419 - RNA, 64 nt, hsa; identical to SEQ ID NO: 100762

SEQ ID NO: 557420 - RNA, 64 nt, hsa; identical to SEQ ID NO: 100763

SEQ ID NO: 557421 - RNA, 64 nt, hsa; identical to SEQ ID NO: 100764

SEQ ID NO: 557422 - RNA, 64 nt, hsa; identical to SEQ ID NO: 100765

SEQ ID NO: 557423 - RNA, 64 nt, hsa; identical to SEQ ID NO: 100766

SEQ ID NO: 557424 - RNA, 64 nt, hsa; identical to SEQ ID NO: 100767

SEQ ID NO: 557425 - RNA, 64 nt, hsa; identical to SEQ ID NO: 100768

SEQ ID NO: 557426 - RNA, 64 nt, hsa; identical to SEQ ID NO: 100769

SEQ ID NO: 557427 - RNA, 64 nt, hsa; identical to SEQ ID NO: 100770

SEQ ID NO: 557428 - RNA, 64 nt, hsa; identical to SEQ ID NO: 100771

SEQ ID NO: 557429 - RNA, 64 nt, hsa; identical to SEQ ID NO: 100772

SEQ ID NO: 557430 - RNA, 64 nt, hsa; identical to SEQ ID NO: 100773

SEQ ID NO: 557431 - RNA, 64 nt, hsa; identical to SEQ ID NO: 100774

SEQ ID NO: 557432 - RNA, 64 nt, hsa; identical to SEQ ID NO: 100775

SEQ ID NO: 557433 - RNA, 64 nt, hsa; identical to SEQ ID NO: 100776

SEQ ID NO: 557434 - RNA, 64 nt, hsa; identical to SEQ ID NO: 100777

SEQ ID NO: 557435 - RNA, 64 nt, hsa; identical to SEQ ID NO: 55217

SEQ ID NO: 557436 - RNA, 64 nt, hsa; identical to SEQ ID NO: 55218

SEQ ID NO: 557437 - RNA, 64 nt, hsa; identical to SEQ ID NO: 55219

SEQ ID NO: 557438 - RNA, 64 nt, hsa; identical to SEQ ID NO: 55220

SEQ ID NO: 557439 - RNA, 64 nt, hsa
gccacauuacuuggcauaggagagaugcuuaguguaauuauaaguuaacaagccuuuggaucag

SEQ ID NO: 557440 - RNA, 64 nt, hsa
ucuccugaguccuccuuaccgaugguugugacuuuaauuauauacaucucugucccuccagaca

SEQ ID NO: 557441 - RNA, 64 nt, hsa
acucuaaauuuaaugcucuacaucuuaucagucauaauuauauauacuguggaacaguaucugu

SEQ ID NO: 557442 - RNA, 64 nt, hsa
uuaaagcauuaugugcaauuaaguuguuaugacauaauuauauugccuaauuguugggucuuuu

SEQ ID NO: 557443 - RNA, 64 nt, hsa
cuuuguacagguuauuuaauagcuuuguuaaagauaauuauaauaauuauaacauuaauaaaaa

SEQ ID NO: 557444 - RNA, 64 nt, hsa
gguuauuuaauagcuuuguuaaagauaauuauaauaauuauaacauuaauaaaaauguugcuuu

SEQ ID NO: 557445 - RNA, 64 nt, hsa
cacaugccguacucuuauauguaccauugguugauaauuauaaugauucauuuggacuugaaga

SEQ ID NO: 557446 - RNA, 64 nt, hsa
uagaaaugaguuguauggugaaucuguguagugauaauuauauaauuuauuuauuuugaaugca

SEQ ID NO: 557447 - RNA, 64 nt, hsa
gaaaaugaguaacagaguccacggcgugcaaugguaauuauaaauuggugaugcuuguuugcaa

SEQ ID NO: 557448 - RNA, 64 nt, hsa
ccauuaagauaugauucauguaacaauguuaaauuaauuauaaugggauuggguuuguuaucug

SEQ ID NO: 557449 - RNA, 64 nt, hsa
gaguuuucaaauaauuuuaguucuauaaguacuauaauuauauaaauauuaaugaauucagauu

SEQ ID NO: 557450 - RNA, 64 nt, hsa
gggguggguucucaguccccugcuagagaacccuuaauuauaggcauuguggaguaacuuugau

SEQ ID NO: 557451 - RNA, 64 nt, hsa
agauuauguguccuacccugucucauggaaaaauuaauuauaugguugaaauguaaaagaaagu

SEQ ID NO: 557452 - RNA, 64 nt, hsa
auggaccaucuucaucaucaccagugguuucuucuaauuauaaaauguuuaaacuuucugagaa

SEQ ID NO: 557453 - RNA, 64 nt, hsa
aauuuuguuauaauguacaauuuagaaguuugauuaauuauauuaucuauuuaggcauuaauau

SEQ ID NO: 557454 - RNA, 64 nt, hsa
aacuaggagaaucgggcuaauuuauuaaugaugauaauuauaauguaucuguacagcacuuuuu

SEQ ID NO: 557455 - RNA, 64 nt, hsa
uuuuaugcuucauuucauguauuuauucuuuguauaauuauagcauacauguuauguaauauaa

SEQ ID NO: 557456 - RNA, 64 nt, hsa
cgcccuaguaucuauacugauaauauauuuugauuaauuauauacauuaauucauucugugcua

SEQ ID NO: 557457 - RNA, 64 nt, hsa
ggaaggucugaaaacuugcacagggucaucuuuguaauuauauaaccccaaacuaagaugcaca

SEQ ID NO: 557458 - RNA, 64 nt, hsa
aaucugcaaauuccuucuaaauuucaugugcaaauaauuauauauaaauauauuuaaaaaugcu

SEQ ID NO: 557459 - RNA, 64 nt, hsa
aaaauauggauaucgcuuuguuuuccuuugaaaguaauuauaucuuaagaacauaguaucauga

SEQ ID NO: 557460 - RNA, 64 nt, hsa
uuuuguucagauuaaaauguuuacaacaaaauguuaauuauauucuaaauacaggguauguucu

SEQ ID NO: 557461 - RNA, 64 nt, hsa
aggacuuguuagaucuaguucacucuccauuuaauaauuauaugcuauuucuauauuuucauuc

SEQ ID NO: 557462 - RNA, 64 nt, hsa
cgcugauaagcguucauggaacgcguugaaauuguaauuauaucugaggaauucuguauagauu

SEQ ID NO: 557463 - RNA, 64 nt, hsa
cauuucaucggaacugcaguauauuuuuguugguuaauuauauuaguguuuucuauuuuguaaa

SEQ ID NO: 557464 - RNA, 64 nt, hsa
uuaaacugaauagaauuguauagcgaugaccucuuaauuauaauuugauuugacugcaaaacuu

SEQ ID NO: 557465 - RNA, 64 nt, hsa
acuaugguuuacucuaauaagauagcuauauugauaauuauauuuuuguuacugugcccuugca

SEQ ID NO: 557466 - RNA, 64 nt, hsa
agcaguauuucuuucccuugguugugagaguaacuaauuauauaaauauuaccucaaaaauaca

SEQ ID NO: 557467 - RNA, 64 nt, hsa
gcuauagguuuuaggguuuuguaaaucuucauaguaauuauaaacauuuguaaaauuuguaaaa

SEQ ID NO: 557468 - RNA, 64 nt, hsa
uccacaauuuggugagaccacuaaauuuuacauauaauuauacacacacauauguacauauaua

SEQ ID NO: 557469 - RNA, 64 nt, hsa
uugguugaauaauuaauaauucucauuguaaaaauaauuauaugccaaaaauauauuugauguu

SEQ ID NO: 557470 - RNA, 64 nt, hsa
uuuuggacaaggaguucuggugacaagcuauaccuaauuauaagcuauaaaacaauagauauga

SEQ ID NO: 557471 - RNA, 64 nt, hsa
acuuuugugauuuaauaauacuauuucuguggaauaauuauaaaaguaugaccuuuuuaaauca

SEQ ID NO: 557472 - RNA, 64 nt, hsa
uuauuauuauuucagaacuagcucagcccaucucuaauuauaaaacaugguuuuguuuuuuuuu

SEQ ID NO: 557473 - RNA, 64 nt, hsa
acugugauaacuacuuuuuauacuuuaucccauuuaauuauaaaaaccacucuugagaaguaau

SEQ ID NO: 557474 - RNA, 64 nt, hsa
aauaaaaacaguguuuuauagugaaaucuaagguuaauuauaaucuuuccuuauuucaacaaga

SEQ ID NO: 557475 - RNA, 64 nt, hsa
uaacauauucaguauuaauguauaaaaagcacucuaauuauauaauucaguuuuuguaaaggua

SEQ ID NO: 557476 - RNA, 64 nt, hsa
ggggcaccuccucugguacuuuuaaguguuuuguuaauuauauuuacuuuuuggaaugguguaa

SEQ ID NO: 557477 - RNA, 64 nt, hsa
gcuuuuaauaauuauaaaauuaauaauuucuugauaauuauaaaaaugaagugucaaaaaaucu

SEQ ID NO: 557478 - RNA, 64 nt, hsa
agaugcaaagccugaagacacugguagcuuuuaauaauuauaaaauuaauaauuucuugauaau

SEQ ID NO: 557479 - RNA, 64 nt, hsa
aauggauuaccuguagugacucauuggaaugauauaauuauacaaguaaugccaaaaaccaagu

SEQ ID NO: 557480 - RNA, 64 nt, hsa
cccuggauaaagaguuaauuuuaauccuucccuauaauuauacuucaaaauauuugacaucugc

SEQ ID NO: 557481 - RNA, 64 nt, hsa
uaaaccuuuucuuccuggauuuggcagauauguauaauuauauuaaaaugguucuagcacaaca

SEQ ID NO: 557482 - RNA, 64 nt, hsa
cucugcagggguucuucugugauuaaauagguuauaauuauaagcaaaauucagagcaacugag

SEQ ID NO: 557483 - RNA, 64 nt, hsa
ucaugaaacacuuguaagauacuuauuuugaaauuaauuauaaggcauucauauuuuuaggacu

SEQ ID NO: 557484 - RNA, 64 nt, hsa
uauuuucuuacgaaauaguucuguguuuauuuuuuaauuauagaaauuccaaagaacagcacau

SEQ ID NO: 557485 - RNA, 64 nt, hsa
uauuaccuauaugguuguuuuaauuacauuugaauaauuauauuuuuccaaccacugauuacuu

SEQ ID NO: 557486 - RNA, 64 nt, hsa
ugcugcuguuuugauuuauggaauuugaaaaagauaauuauaaugccugcaaugugucauauac

SEQ ID NO: 557487 - RNA, 64 nt, hsa
cuuucuuaaaaauauuagucagaguuaagcaaauuaauuauagcuaucuuuaagcuauaaaugu

SEQ ID NO: 557488 - RNA, 64 nt, hsa
uggguuaguauuuaaagucuuaacauuuauuuaauaauuauauuuauuaaaccauuuuucaaua

SEQ ID NO: 557489 - RNA, 64 nt, hsa
gcaagugcuaugccaagccaugucuaaauggcuuuaauuauauaguaaugcacucucaguaaug

SEQ ID NO: 557490 - RNA, 64 nt, hsa
agccuauuuauuugaaaguccuuguuuuugcuacuaauuauauaguauaccauacauuaucauu

SEQ ID NO: 557491 - RNA, 64 nt, hsa
gacugaagaacuaaaaauacauaaaugaauuaaguaauuauaaacauaaauuuccuguagcucc

SEQ ID NO: 557492 - RNA, 64 nt, hsa
uaaauguuauuuuauauaugauauuaaaagauuauaauuauauaaucuuuuucgauaauuuauu

SEQ ID NO: 557493 - RNA, 64 nt, hsa
auaauuauaauuauucuuuauaauaaaaauauuuuaauuauagcauguuuguguaauguacuca

SEQ ID NO: 557494 - RNA, 64 nt, hsa
uuuguuuaaagacacuuuaucaguguuucuugaauaauuauaauuauucuuuauaauaaaaaua

SEQ ID NO: 557495 - RNA, 64 nt, hsa
uuucuucuggauuccuuauuugauuuauuuaaccuaauuauauucuaauauugcaaauauuacc

SEQ ID NO: 557496 - RNA, 64 nt, hsa
accggcaucaucacugcuaucaucauuaacagcguaauuauacaagcauauuuaaugcugaguu

SEQ ID NO: 557497 - RNA, 60 nt, hsa
agcaacuuaauggaaacuagguaugaaaguuaauuauaugggaucuguugucaggauaca

SEQ ID NO: 557498 - RNA, 64 nt, hsa
auggaaggugccggggguaaucauggccagucaauaauuauauaaaggaguucaaauacuauag

SEQ ID NO: 557499 - RNA, 64 nt, hsa
agaggucuauauaaaguuacuuuuccccuuuacuuaauuauauuguagugugcagauaacaaaa

SEQ ID NO: 557500 - RNA, 64 nt, hsa
ugguuugaaaugugcauagauaugcaugucuauauaauuauaaaugcauguguauauauaugca

SEQ ID NO: 557501 - RNA, 64 nt, hsa; identical to SEQ ID NO: 189516

SEQ ID NO: 557502 - RNA, 64 nt, hsa; identical to SEQ ID NO: 189517

SEQ ID NO: 557503 - RNA, 62 nt, hsa
cgcgggacuguguucguacgugcauaguuucgauaucacaucgcggggcuguguucguagcu

SEQ ID NO: 557504 - RNA, 62 nt, hsa
cgcggggcuguguucguagcugcgucguuucgauaucacacccucugugugccgccuuacuu

SEQ ID NO: 557505 - RNA, 62 nt, hsa
cacaacucaaaggacugugauauaauccauuuauaucacagcucacaguuucugaaaaugua

SEQ ID NO: 557506 - RNA, 62 nt, hsa
cacagcucaaaggacugugauauaauccauuuauaucacaacucaaaggacugugauauaau

SEQ ID NO: 557507 - RNA, 62 nt, hsa
uggauagaaauagagaauagcaacguuuauggauaucacaaauaaagaauucaauucuuuac

SEQ ID NO: 557508 - RNA, 62 nt, hsa
gaugggcuucacaggaauguaguugccaguucauaucacaauagcccuuucuauaugagguu

SEQ ID NO: 557509 - RNA, 62 nt, hsa
aaggugcacaguuagcaaaagaugcagauguuauaucacagcaauucucaugcuaaaaauac

SEQ ID NO: 557510 - RNA, 62 nt, hsa
gugacaauuacacauuguagacagguagcaaaauaucacauacacccccaaaauauguacaa

SEQ ID NO: 557511 - RNA, 62 nt, hsa
aaauauucuugaauaaaucuguuauuuuaagaauaucacauuauucaaugcauauaaaacua

SEQ ID NO: 557512 - RNA, 62 nt, hsa
aacagaaauuuuagcucuuuucuuugcaagauauaucacagcugcuuugggcaguagcugaa

SEQ ID NO: 557513 - RNA, 62 nt, hsa
acagucaagaaaaacauuauugaggaaaauuaauaucacagcauaaccccacccuuuacauu

SEQ ID NO: 557514 - RNA, 62 nt, hsa
uguauaacccauaucugugcaauggaauauaaauaucacaaaguuguuuaacuagacugcgu

SEQ ID NO: 557515 - RNA, 62 nt, hsa
gaaaaauacauauuaugagaaaauugugcaugauaucacauuuuuugcaccaagauaaacug

SEQ ID NO: 557516 - RNA, 62 nt, hsa
gugguuuucaucuuucauuauguucaagugguauaucacauugauuugcuugacuauguuga

SEQ ID NO: 557517 - RNA, 62 nt, hsa
gaugugcuuuuguauuaaauuuaaauuuucacauaucacauccauucucaagguaguuauau

SEQ ID NO: 557518 - RNA, 62 nt, hsa
auccucagauuggugcagcuuuuucaguucagauaucacaccccaaguggauaaaggcaacu

SEQ ID NO: 557519 - RNA, 64 nt, hsa; identical to SEQ ID NO: 171243

SEQ ID NO: 557520 - RNA, 64 nt, hsa; identical to SEQ ID NO: 171244

SEQ ID NO: 557521 - RNA, 64 nt, hsa; identical to SEQ ID NO: 171245

SEQ ID NO: 557522 - RNA, 64 nt, hsa; identical to SEQ ID NO: 171246

SEQ ID NO: 557523 - RNA, 64 nt, hsa; identical to SEQ ID NO: 171247

SEQ ID NO: 557524 - RNA, 64 nt, hsa; identical to SEQ ID NO: 171248

SEQ ID NO: 557525 - RNA, 64 nt, hsa; identical to SEQ ID NO: 171249

SEQ ID NO: 557526 - RNA, 64 nt, hsa; identical to SEQ ID NO: 171250

SEQ ID NO: 557527 - RNA, 64 nt, hsa; identical to SEQ ID NO: 171251

SEQ ID NO: 557528 - RNA, 64 nt, hsa; identical to SEQ ID NO: 171252

SEQ ID NO: 557529 - RNA, 64 nt, hsa; identical to SEQ ID NO: 171253

SEQ ID NO: 557530 - RNA, 64 nt, hsa; identical to SEQ ID NO: 171254

SEQ ID NO: 557531 - RNA, 64 nt, hsa; identical to SEQ ID NO: 171255

SEQ ID NO: 557532 - RNA, 64 nt, hsa; identical to SEQ ID NO: 171256

SEQ ID NO: 557533 - RNA, 64 nt, hsa; identical to SEQ ID NO: 171257

SEQ ID NO: 557534 - RNA, 64 nt, hsa; identical to SEQ ID NO: 171258

SEQ ID NO: 557535 - RNA, 64 nt, hsa; identical to SEQ ID NO: 171259

SEQ ID NO: 557536 - RNA, 64 nt, hsa; identical to SEQ ID NO: 171260

SEQ ID NO: 557537 - RNA, 64 nt, hsa; identical to SEQ ID NO: 171261

SEQ ID NO: 557538 - RNA, 64 nt, hsa; identical to SEQ ID NO: 171262

SEQ ID NO: 557539 - RNA, 64 nt, hsa; identical to SEQ ID NO: 171263

SEQ ID NO: 557540 - RNA, 64 nt, hsa; identical to SEQ ID NO: 171264

SEQ ID NO: 557541 - RNA, 64 nt, hsa; identical to SEQ ID NO: 171265

SEQ ID NO: 557542 - RNA, 64 nt, hsa; identical to SEQ ID NO: 171266

SEQ ID NO: 557543 - RNA, 64 nt, hsa; identical to SEQ ID NO: 171267

SEQ ID NO: 557544 - RNA, 64 nt, hsa; identical to SEQ ID NO: 171268

SEQ ID NO: 557545 - RNA, 64 nt, hsa; identical to SEQ ID NO: 171269

SEQ ID NO: 557546 - RNA, 64 nt, hsa; identical to SEQ ID NO: 171270

SEQ ID NO: 557547 - RNA, 64 nt, hsa; identical to SEQ ID NO: 171271

SEQ ID NO: 557548 - RNA, 64 nt, hsa; identical to SEQ ID NO: 171272

SEQ ID NO: 557549 - RNA, 64 nt, hsa; identical to SEQ ID NO: 171273

SEQ ID NO: 557550 - RNA, 64 nt, hsa; identical to SEQ ID NO: 171274

SEQ ID NO: 557551 - RNA, 64 nt, hsa; identical to SEQ ID NO: 171275

SEQ ID NO: 557552 - RNA, 64 nt, hsa; identical to SEQ ID NO: 171276

SEQ ID NO: 557553 - RNA, 64 nt, hsa; identical to SEQ ID NO: 171277

SEQ ID NO: 557554 - RNA, 64 nt, hsa; identical to SEQ ID NO: 171278

SEQ ID NO: 557555 - RNA, 64 nt, hsa; identical to SEQ ID NO: 171279

SEQ ID NO: 557556 - RNA, 64 nt, hsa; identical to SEQ ID NO: 171280

SEQ ID NO: 557557 - RNA, 64 nt, hsa; identical to SEQ ID NO: 171281

SEQ ID NO: 557558 - RNA, 64 nt, hsa; identical to SEQ ID NO: 171282

SEQ ID NO: 557559 - RNA, 64 nt, hsa; identical to SEQ ID NO: 171283

SEQ ID NO: 557560 - RNA, 64 nt, hsa; identical to SEQ ID NO: 171284

SEQ ID NO: 557561 - RNA, 64 nt, hsa; identical to SEQ ID NO: 171285

SEQ ID NO: 557562 - RNA, 64 nt, hsa; identical to SEQ ID NO: 171286

SEQ ID NO: 557563 - RNA, 64 nt, hsa; identical to SEQ ID NO: 171287

SEQ ID NO: 557564 - RNA, 64 nt, hsa; identical to SEQ ID NO: 171288

SEQ ID NO: 557565 - RNA, 64 nt, hsa; identical to SEQ ID NO: 171289

SEQ ID NO: 557566 - RNA, 64 nt, hsa; identical to SEQ ID NO: 171290

SEQ ID NO: 557567 - RNA, 64 nt, hsa; identical to SEQ ID NO: 171291

SEQ ID NO: 557568 - RNA, 64 nt, hsa; identical to SEQ ID NO: 171292

SEQ ID NO: 557569 - RNA, 64 nt, hsa; identical to SEQ ID NO: 171293

SEQ ID NO: 557570 - RNA, 64 nt, hsa; identical to SEQ ID NO: 171294

SEQ ID NO: 557571 - RNA, 64 nt, hsa; identical to SEQ ID NO: 171295

SEQ ID NO: 557572 - RNA, 64 nt, hsa; identical to SEQ ID NO: 171296

SEQ ID NO: 557573 - RNA, 64 nt, hsa; identical to SEQ ID NO: 171297

SEQ ID NO: 557574 - RNA, 64 nt, hsa; identical to SEQ ID NO: 171298

SEQ ID NO: 557575 - RNA, 64 nt, hsa; identical to SEQ ID NO: 171299

SEQ ID NO: 557576 - RNA, 64 nt, hsa; identical to SEQ ID NO: 171300

SEQ ID NO: 557577 - RNA, 64 nt, hsa; identical to SEQ ID NO: 171301

SEQ ID NO: 557578 - RNA, 64 nt, hsa; identical to SEQ ID NO: 171302

SEQ ID NO: 557579 - RNA, 64 nt, hsa; identical to SEQ ID NO: 171303

SEQ ID NO: 557580 - RNA, 64 nt, hsa; identical to SEQ ID NO: 171304

SEQ ID NO: 557581 - RNA, 64 nt, hsa; identical to SEQ ID NO: 171305

SEQ ID NO: 557582 - RNA, 64 nt, hsa; identical to SEQ ID NO: 171306

SEQ ID NO: 557583 - RNA, 64 nt, hsa; identical to SEQ ID NO: 171307

SEQ ID NO: 557584 - RNA, 64 nt, hsa; identical to SEQ ID NO: 171308

SEQ ID NO: 557585 - RNA, 64 nt, hsa; identical to SEQ ID NO: 171309

SEQ ID NO: 557586 - RNA, 64 nt, hsa; identical to SEQ ID NO: 171310

SEQ ID NO: 557587 - RNA, 64 nt, hsa; identical to SEQ ID NO: 171311

SEQ ID NO: 557588 - RNA, 64 nt, hsa; identical to SEQ ID NO: 171312

SEQ ID NO: 557589 - RNA, 64 nt, hsa; identical to SEQ ID NO: 171313

SEQ ID NO: 557590 - RNA, 64 nt, hsa; identical to SEQ ID NO: 171314

SEQ ID NO: 557591 - RNA, 64 nt, hsa; identical to SEQ ID NO: 171315

SEQ ID NO: 557592 - RNA, 64 nt, hsa; identical to SEQ ID NO: 171316

SEQ ID NO: 557593 - RNA, 64 nt, hsa; identical to SEQ ID NO: 171317

SEQ ID NO: 557594 - RNA, 64 nt, hsa; identical to SEQ ID NO: 171318

SEQ ID NO: 557595 - RNA, 64 nt, hsa; identical to SEQ ID NO: 171319

SEQ ID NO: 557596 - RNA, 64 nt, hsa; identical to SEQ ID NO: 171320

SEQ ID NO: 557597 - RNA, 64 nt, hsa; identical to SEQ ID NO: 171321

SEQ ID NO: 557598 - RNA, 64 nt, hsa; identical to SEQ ID NO: 171322

SEQ ID NO: 557599 - RNA, 64 nt, hsa; identical to SEQ ID NO: 171323

SEQ ID NO: 557600 - RNA, 64 nt, hsa; identical to SEQ ID NO: 171324

SEQ ID NO: 557601 - RNA, 64 nt, hsa; identical to SEQ ID NO: 171325

SEQ ID NO: 557602 - RNA, 64 nt, hsa; identical to SEQ ID NO: 171326

SEQ ID NO: 557603 - RNA, 64 nt, hsa; identical to SEQ ID NO: 171327

SEQ ID NO: 557604 - RNA, 64 nt, hsa; identical to SEQ ID NO: 171328

SEQ ID NO: 557605 - RNA, 64 nt, hsa; identical to SEQ ID NO: 171329

SEQ ID NO: 557606 - RNA, 64 nt, hsa; identical to SEQ ID NO: 171330

SEQ ID NO: 557607 - RNA, 64 nt, hsa; identical to SEQ ID NO: 171331

SEQ ID NO: 557608 - RNA, 64 nt, hsa; identical to SEQ ID NO: 171332

SEQ ID NO: 557609 - RNA, 64 nt, hsa; identical to SEQ ID NO: 171333

SEQ ID NO: 557610 - RNA, 64 nt, hsa; identical to SEQ ID NO: 171334

SEQ ID NO: 557611 - RNA, 64 nt, hsa; identical to SEQ ID NO: 171335

SEQ ID NO: 557612 - RNA, 64 nt, hsa; identical to SEQ ID NO: 171336

SEQ ID NO: 557613 - RNA, 64 nt, hsa; identical to SEQ ID NO: 171337

SEQ ID NO: 557614 - RNA, 64 nt, hsa; identical to SEQ ID NO: 171338

SEQ ID NO: 557615 - RNA, 64 nt, hsa; identical to SEQ ID NO: 171339

SEQ ID NO: 557616 - RNA, 64 nt, hsa; identical to SEQ ID NO: 171340

SEQ ID NO: 557617 - RNA, 64 nt, hsa; identical to SEQ ID NO: 171341

SEQ ID NO: 557618 - RNA, 64 nt, hsa; identical to SEQ ID NO: 171342

SEQ ID NO: 557619 - RNA, 64 nt, hsa; identical to SEQ ID NO: 171343

SEQ ID NO: 557620 - RNA, 64 nt, hsa; identical to SEQ ID NO: 171344

SEQ ID NO: 557621 - RNA, 64 nt, hsa; identical to SEQ ID NO: 171345

SEQ ID NO: 557622 - RNA, 64 nt, hsa; identical to SEQ ID NO: 171346

SEQ ID NO: 557623 - RNA, 64 nt, hsa; identical to SEQ ID NO: 171347

SEQ ID NO: 557624 - RNA, 64 nt, hsa; identical to SEQ ID NO: 171348

SEQ ID NO: 557625 - RNA, 64 nt, hsa; identical to SEQ ID NO: 171349

SEQ ID NO: 557626 - RNA, 64 nt, hsa; identical to SEQ ID NO: 171350

SEQ ID NO: 557627 - RNA, 64 nt, hsa; identical to SEQ ID NO: 171351

SEQ ID NO: 557628 - RNA, 64 nt, hsa; identical to SEQ ID NO: 171352

SEQ ID NO: 557629 - RNA, 64 nt, hsa; identical to SEQ ID NO: 171353

SEQ ID NO: 557630 - RNA, 64 nt, hsa; identical to SEQ ID NO: 171354

SEQ ID NO: 557631 - RNA, 64 nt, hsa; identical to SEQ ID NO: 171355

SEQ ID NO: 557632 - RNA, 64 nt, hsa; identical to SEQ ID NO: 171356

SEQ ID NO: 557633 - RNA, 64 nt, hsa; identical to SEQ ID NO: 171357

SEQ ID NO: 557634 - RNA, 64 nt, hsa; identical to SEQ ID NO: 171358

SEQ ID NO: 557635 - RNA, 64 nt, hsa; identical to SEQ ID NO: 171359

SEQ ID NO: 557636 - RNA, 64 nt, hsa; identical to SEQ ID NO: 171360

SEQ ID NO: 557637 - RNA, 64 nt, hsa; identical to SEQ ID NO: 171361

SEQ ID NO: 557638 - RNA, 64 nt, hsa; identical to SEQ ID NO: 171362

SEQ ID NO: 557639 - RNA, 64 nt, hsa; identical to SEQ ID NO: 171363

SEQ ID NO: 557640 - RNA, 64 nt, hsa; identical to SEQ ID NO: 171364

SEQ ID NO: 557641 - RNA, 64 nt, hsa; identical to SEQ ID NO: 171365

SEQ ID NO: 557642 - RNA, 64 nt, hsa; identical to SEQ ID NO: 171366

SEQ ID NO: 557643 - RNA, 64 nt, hsa; identical to SEQ ID NO: 171367

SEQ ID NO: 557644 - RNA, 64 nt, hsa; identical to SEQ ID NO: 171368

SEQ ID NO: 557645 - RNA, 64 nt, hsa; identical to SEQ ID NO: 171369

SEQ ID NO: 557646 - RNA, 64 nt, hsa; identical to SEQ ID NO: 171370

SEQ ID NO: 557647 - RNA, 64 nt, hsa; identical to SEQ ID NO: 171371

SEQ ID NO: 557648 - RNA, 64 nt, hsa; identical to SEQ ID NO: 171372

SEQ ID NO: 557649 - RNA, 64 nt, hsa; identical to SEQ ID NO: 171373

SEQ ID NO: 557650 - RNA, 64 nt, hsa; identical to SEQ ID NO: 171374

SEQ ID NO: 557651 - RNA, 64 nt, hsa; identical to SEQ ID NO: 171375

SEQ ID NO: 557652 - RNA, 64 nt, hsa; identical to SEQ ID NO: 171376

SEQ ID NO: 557653 - RNA, 64 nt, hsa; identical to SEQ ID NO: 171377

SEQ ID NO: 557654 - RNA, 64 nt, hsa; identical to SEQ ID NO: 171378

SEQ ID NO: 557655 - RNA, 64 nt, hsa; identical to SEQ ID NO: 171379

SEQ ID NO: 557656 - RNA, 64 nt, hsa; identical to SEQ ID NO: 171380

SEQ ID NO: 557657 - RNA, 64 nt, hsa; identical to SEQ ID NO: 171381

SEQ ID NO: 557658 - RNA, 64 nt, hsa; identical to SEQ ID NO: 171382

SEQ ID NO: 557659 - RNA, 64 nt, hsa; identical to SEQ ID NO: 171383

SEQ ID NO: 557660 - RNA, 64 nt, hsa; identical to SEQ ID NO: 171384

SEQ ID NO: 557661 - RNA, 64 nt, hsa; identical to SEQ ID NO: 171385

SEQ ID NO: 557662 - RNA, 64 nt, hsa; identical to SEQ ID NO: 171386

SEQ ID NO: 557663 - RNA, 64 nt, hsa; identical to SEQ ID NO: 171387

SEQ ID NO: 557664 - RNA, 64 nt, hsa; identical to SEQ ID NO: 171388

SEQ ID NO: 557665 - RNA, 64 nt, hsa; identical to SEQ ID NO: 171389

SEQ ID NO: 557666 - RNA, 64 nt, hsa; identical to SEQ ID NO: 171390

SEQ ID NO: 557667 - RNA, 64 nt, hsa; identical to SEQ ID NO: 171391

SEQ ID NO: 557668 - RNA, 64 nt, hsa; identical to SEQ ID NO: 171392

SEQ ID NO: 557669 - RNA, 64 nt, hsa; identical to SEQ ID NO: 171393

SEQ ID NO: 557670 - RNA, 64 nt, hsa; identical to SEQ ID NO: 171394

SEQ ID NO: 557671 - RNA, 64 nt, hsa; identical to SEQ ID NO: 171395

SEQ ID NO: 557672 - RNA, 64 nt, hsa; identical to SEQ ID NO: 171396

SEQ ID NO: 557673 - RNA, 64 nt, hsa; identical to SEQ ID NO: 171397

SEQ ID NO: 557674 - RNA, 64 nt, hsa; identical to SEQ ID NO: 171398

SEQ ID NO: 557675 - RNA, 64 nt, hsa; identical to SEQ ID NO: 171399

SEQ ID NO: 557676 - RNA, 64 nt, hsa; identical to SEQ ID NO: 171400

SEQ ID NO: 557677 - RNA, 64 nt, hsa; identical to SEQ ID NO: 171401

SEQ ID NO: 557678 - RNA, 64 nt, hsa; identical to SEQ ID NO: 171402

SEQ ID NO: 557679 - RNA, 64 nt, hsa; identical to SEQ ID NO: 171403

SEQ ID NO: 557680 - RNA, 64 nt, hsa; identical to SEQ ID NO: 171404

SEQ ID NO: 557681 - RNA, 64 nt, hsa; identical to SEQ ID NO: 171405

SEQ ID NO: 557682 - RNA, 64 nt, hsa; identical to SEQ ID NO: 171406

SEQ ID NO: 557683 - RNA, 64 nt, hsa; identical to SEQ ID NO: 171407

SEQ ID NO: 557684 - RNA, 64 nt, hsa; identical to SEQ ID NO: 171408

SEQ ID NO: 557685 - RNA, 64 nt, hsa; identical to SEQ ID NO: 171409

SEQ ID NO: 557686 - RNA, 64 nt, hsa; identical to SEQ ID NO: 171410

SEQ ID NO: 557687 - RNA, 64 nt, hsa; identical to SEQ ID NO: 171411

SEQ ID NO: 557688 - RNA, 64 nt, hsa; identical to SEQ ID NO: 171412

SEQ ID NO: 557689 - RNA, 64 nt, hsa; identical to SEQ ID NO: 171413

SEQ ID NO: 557690 - RNA, 64 nt, hsa; identical to SEQ ID NO: 171414

SEQ ID NO: 557691 - RNA, 64 nt, hsa; identical to SEQ ID NO: 171415

SEQ ID NO: 557692 - RNA, 64 nt, hsa; identical to SEQ ID NO: 171416

SEQ ID NO: 557693 - RNA, 64 nt, hsa; identical to SEQ ID NO: 171417

SEQ ID NO: 557694 - RNA, 64 nt, hsa; identical to SEQ ID NO: 171418

SEQ ID NO: 557695 - RNA, 64 nt, hsa; identical to SEQ ID NO: 171419

SEQ ID NO: 557696 - RNA, 64 nt, hsa; identical to SEQ ID NO: 171420

SEQ ID NO: 557697 - RNA, 64 nt, hsa; identical to SEQ ID NO: 171421

SEQ ID NO: 557698 - RNA, 64 nt, hsa; identical to SEQ ID NO: 171422

SEQ ID NO: 557699 - RNA, 64 nt, hsa; identical to SEQ ID NO: 171423

SEQ ID NO: 557700 - RNA, 64 nt, hsa; identical to SEQ ID NO: 171424

SEQ ID NO: 557701 - RNA, 64 nt, hsa; identical to SEQ ID NO: 171425

SEQ ID NO: 557702 - RNA, 64 nt, hsa; identical to SEQ ID NO: 171426

SEQ ID NO: 557703 - RNA, 64 nt, hsa; identical to SEQ ID NO: 171427

SEQ ID NO: 557704 - RNA, 64 nt, hsa; identical to SEQ ID NO: 171428

SEQ ID NO: 557705 - RNA, 64 nt, hsa; identical to SEQ ID NO: 171429

SEQ ID NO: 557706 - RNA, 50 nt, hsa; identical to SEQ ID NO: 171430

SEQ ID NO: 557707 - RNA, 64 nt, hsa; identical to SEQ ID NO: 171431

SEQ ID NO: 557708 - RNA, 64 nt, hsa; identical to SEQ ID NO: 171432

SEQ ID NO: 557709 - RNA, 64 nt, hsa; identical to SEQ ID NO: 171433

SEQ ID NO: 557710 - RNA, 64 nt, hsa; identical to SEQ ID NO: 171434

SEQ ID NO: 557711 - RNA, 64 nt, hsa; identical to SEQ ID NO: 171435

SEQ ID NO: 557712 - RNA, 64 nt, hsa; identical to SEQ ID NO: 171436

SEQ ID NO: 557713 - RNA, 64 nt, hsa; identical to SEQ ID NO: 171437

SEQ ID NO: 557714 - RNA, 64 nt, hsa; identical to SEQ ID NO: 171438

SEQ ID NO: 557715 - RNA, 64 nt, hsa; identical to SEQ ID NO: 171439

SEQ ID NO: 557716 - RNA, 64 nt, hsa; identical to SEQ ID NO: 171440

SEQ ID NO: 557717 - RNA, 64 nt, hsa; identical to SEQ ID NO: 171441

SEQ ID NO: 557718 - RNA, 64 nt, hsa; identical to SEQ ID NO: 171442

SEQ ID NO: 557719 - RNA, 64 nt, hsa; identical to SEQ ID NO: 171443

SEQ ID NO: 557720 - RNA, 64 nt, hsa; identical to SEQ ID NO: 171444

SEQ ID NO: 557721 - RNA, 64 nt, hsa; identical to SEQ ID NO: 171445

SEQ ID NO: 557722 - RNA, 64 nt, hsa; identical to SEQ ID NO: 171446

SEQ ID NO: 557723 - RNA, 64 nt, hsa; identical to SEQ ID NO: 171447

SEQ ID NO: 557724 - RNA, 64 nt, hsa; identical to SEQ ID NO: 171448

SEQ ID NO: 557725 - RNA, 64 nt, hsa; identical to SEQ ID NO: 171449

SEQ ID NO: 557726 - RNA, 64 nt, hsa; identical to SEQ ID NO: 171450

SEQ ID NO: 557727 - RNA, 64 nt, hsa; identical to SEQ ID NO: 171451

SEQ ID NO: 557728 - RNA, 64 nt, hsa; identical to SEQ ID NO: 171452

SEQ ID NO: 557729 - RNA, 64 nt, hsa; identical to SEQ ID NO: 171453

SEQ ID NO: 557730 - RNA, 64 nt, hsa; identical to SEQ ID NO: 171454

SEQ ID NO: 557731 - RNA, 64 nt, hsa; identical to SEQ ID NO: 171455

SEQ ID NO: 557732 - RNA, 64 nt, hsa; identical to SEQ ID NO: 171456

SEQ ID NO: 557733 - RNA, 64 nt, hsa; identical to SEQ ID NO: 171457

SEQ ID NO: 557734 - RNA, 64 nt, hsa; identical to SEQ ID NO: 171458

SEQ ID NO: 557735 - RNA, 64 nt, hsa; identical to SEQ ID NO: 171459

SEQ ID NO: 557736 - RNA, 64 nt, hsa; identical to SEQ ID NO: 171460

SEQ ID NO: 557737 - RNA, 64 nt, hsa; identical to SEQ ID NO: 171461

SEQ ID NO: 557738 - RNA, 64 nt, hsa; identical to SEQ ID NO: 171462

SEQ ID NO: 557739 - RNA, 64 nt, hsa; identical to SEQ ID NO: 171463

SEQ ID NO: 557740 - RNA, 64 nt, hsa; identical to SEQ ID NO: 171464

SEQ ID NO: 557741 - RNA, 64 nt, hsa; identical to SEQ ID NO: 171465

SEQ ID NO: 557742 - RNA, 64 nt, hsa; identical to SEQ ID NO: 171466

SEQ ID NO: 557743 - RNA, 64 nt, hsa; identical to SEQ ID NO: 171467

SEQ ID NO: 557744 - RNA, 64 nt, hsa; identical to SEQ ID NO: 171468

SEQ ID NO: 557745 - RNA, 64 nt, hsa; identical to SEQ ID NO: 171469

SEQ ID NO: 557746 - RNA, 64 nt, hsa; identical to SEQ ID NO: 171470

SEQ ID NO: 557747 - RNA, 64 nt, hsa; identical to SEQ ID NO: 171471

SEQ ID NO: 557748 - RNA, 64 nt, hsa; identical to SEQ ID NO: 171472

SEQ ID NO: 557749 - RNA, 64 nt, hsa; identical to SEQ ID NO: 171473

SEQ ID NO: 557750 - RNA, 64 nt, hsa; identical to SEQ ID NO: 171474

SEQ ID NO: 557751 - RNA, 64 nt, hsa; identical to SEQ ID NO: 171475

SEQ ID NO: 557752 - RNA, 64 nt, hsa; identical to SEQ ID NO: 171476

SEQ ID NO: 557753 - RNA, 64 nt, hsa; identical to SEQ ID NO: 171477

SEQ ID NO: 557754 - RNA, 64 nt, hsa; identical to SEQ ID NO: 171478

SEQ ID NO: 557755 - RNA, 64 nt, hsa; identical to SEQ ID NO: 171479

SEQ ID NO: 557756 - RNA, 64 nt, hsa; identical to SEQ ID NO: 171480

SEQ ID NO: 557757 - RNA, 64 nt, hsa; identical to SEQ ID NO: 171481

SEQ ID NO: 557758 - RNA, 64 nt, hsa; identical to SEQ ID NO: 171482

SEQ ID NO: 557759 - RNA, 64 nt, hsa; identical to SEQ ID NO: 171483

SEQ ID NO: 557760 - RNA, 64 nt, hsa; identical to SEQ ID NO: 171484

SEQ ID NO: 557761 - RNA, 64 nt, hsa; identical to SEQ ID NO: 171485

SEQ ID NO: 557762 - RNA, 64 nt, hsa; identical to SEQ ID NO: 171486

SEQ ID NO: 557763 - RNA, 64 nt, hsa; identical to SEQ ID NO: 171487

SEQ ID NO: 557764 - RNA, 64 nt, hsa; identical to SEQ ID NO: 171488

SEQ ID NO: 557765 - RNA, 64 nt, hsa; identical to SEQ ID NO: 171489

SEQ ID NO: 557766 - RNA, 64 nt, hsa; identical to SEQ ID NO: 171490

SEQ ID NO: 557767 - RNA, 64 nt, hsa; identical to SEQ ID NO: 171491

SEQ ID NO: 557768 - RNA, 64 nt, hsa; identical to SEQ ID NO: 171492

SEQ ID NO: 557769 - RNA, 64 nt, hsa; identical to SEQ ID NO: 171493

SEQ ID NO: 557770 - RNA, 64 nt, hsa; identical to SEQ ID NO: 171494

SEQ ID NO: 557771 - RNA, 64 nt, hsa; identical to SEQ ID NO: 171495

SEQ ID NO: 557772 - RNA, 64 nt, hsa; identical to SEQ ID NO: 171496

SEQ ID NO: 557773 - RNA, 64 nt, hsa; identical to SEQ ID NO: 171497

SEQ ID NO: 557774 - RNA, 64 nt, hsa; identical to SEQ ID NO: 171498

SEQ ID NO: 557775 - RNA, 64 nt, hsa; identical to SEQ ID NO: 171499

SEQ ID NO: 557776 - RNA, 64 nt, hsa
cuaucuaaauauuuauuacuaaaauguuuuuccuacagucuacaugaauacaaaccucaauagc

SEQ ID NO: 557777 - RNA, 64 nt, hsa
uagugaaacacaaacaaaggaaaauauauuaauaacagucuaguguuuuuguugagucugccau

SEQ ID NO: 557778 - RNA, 64 nt, hsa
gaagccucagagauuacacaguuaggaugcugacacagucuagaauccauaaugcucccuacau

SEQ ID NO: 557779 - RNA, 64 nt, hsa
ucacuaaagucuuauuuuauguuuuagaacaguuacagucuaauugucuuggacauuuugggaa

SEQ ID NO: 557780 - RNA, 64 nt, hsa
gauuuucaaaaagccguugacaaggcucugcuauacagucuauaaaaauuguuauuaugggauu

SEQ ID NO: 557781 - RNA, 64 nt, hsa
ucagcuuuguccaaaggaaagcuuaaaacccaauacagucuaguuuccugguuccguuuuagaa

SEQ ID NO: 557782 - RNA, 64 nt, hsa
aggcacaagucggaguuacauuuaaaaaaaauuaacagucuacaacaacuguuuucacaagaga

SEQ ID NO: 557783 - RNA, 64 nt, hsa
uugguuuucuuuuuaccuaguugcuauagugucuacagucuauacucaauaccuauaaaaugca

SEQ ID NO: 557784 - RNA, 64 nt, hsa
uuuuaccaugaagagauugcacuuauccuugagaacagucuaaauauaaaugaagauauuuuac

SEQ ID NO: 557785 - RNA, 64 nt, hsa
uuuuaccaugaagagauugcacuuauccuugagaacagucuaaugauacuuuuuuuacuuucag

SEQ ID NO: 557786 - RNA, 64 nt, hsa
aaauuuuuaaaaaucauaaagggagcaccauuguacagucuagcauaaacagcaaauuuuaaag

SEQ ID NO: 557787 - RNA, 64 nt, hsa
ugugaaauaaccaguuauacguauuaaacaguuuacagucuaaaggaaacaaaaccuauauguu

SEQ ID NO: 557788 - RNA, 64 nt, hsa
ugcuuucgcagcugauaauauaaaaggaaaucccacagucuagauauagccccauuacuacaaa

SEQ ID NO: 557789 - RNA, 64 nt, hsa
guuaccaguaaaauauuacuguaauuucauauacacagucuauacaaugaaauaaugaauauuu

SEQ ID NO: 557790 - RNA, 64 nt, hsa; identical to SEQ ID NO: 557221

SEQ ID NO: 557791 - RNA, 64 nt, hsa; identical to SEQ ID NO: 557222

SEQ ID NO: 557792 - RNA, 64 nt, hsa; identical to SEQ ID NO: 557223

SEQ ID NO: 557793 - RNA, 64 nt, hsa; identical to SEQ ID NO: 557224

SEQ ID NO: 557794 - RNA, 64 nt, hsa; identical to SEQ ID NO: 557225

SEQ ID NO: 557795 - RNA, 64 nt, hsa; identical to SEQ ID NO: 557226

SEQ ID NO: 557796 - RNA, 64 nt, hsa; identical to SEQ ID NO: 224266

SEQ ID NO: 557797 - RNA, 64 nt, hsa; identical to SEQ ID NO: 224267

SEQ ID NO: 557798 - RNA, 64 nt, hsa; identical to SEQ ID NO: 224268

SEQ ID NO: 557799 - RNA, 64 nt, hsa; identical to SEQ ID NO: 224269

SEQ ID NO: 557800 - RNA, 64 nt, hsa; identical to SEQ ID NO: 224270

SEQ ID NO: 557801 - RNA, 64 nt, hsa; identical to SEQ ID NO: 224271

SEQ ID NO: 557802 - RNA, 64 nt, hsa; identical to SEQ ID NO: 224272

SEQ ID NO: 557803 - RNA, 64 nt, hsa; identical to SEQ ID NO: 224273

SEQ ID NO: 557804 - RNA, 64 nt, hsa; identical to SEQ ID NO: 224274

SEQ ID NO: 557805 - RNA, 64 nt, hsa; identical to SEQ ID NO: 224275

SEQ ID NO: 557806 - RNA, 64 nt, hsa; identical to SEQ ID NO: 224276

SEQ ID NO: 557807 - RNA, 64 nt, hsa; identical to SEQ ID NO: 224277

SEQ ID NO: 557808 - RNA, 64 nt, hsa; identical to SEQ ID NO: 224278

SEQ ID NO: 557809 - RNA, 64 nt, hsa; identical to SEQ ID NO: 224279

SEQ ID NO: 557810 - RNA, 64 nt, hsa
ucucaaugcacaugauauaauuaaacacuaauaauaccaugacugcauagcuaauauuagcugc

SEQ ID NO: 557811 - RNA, 64 nt, hsa
aaagcaacacuguuuuuauguaguucauauauauuaccaugacauuuaacaucaauaucguaua

SEQ ID NO: 557812 - RNA, 64 nt, hsa
ccaguuuucuugauuagaguuuaagcagauuuaauaccaugaccuugcuuaaccguuucuucuu

SEQ ID NO: 557813 - RNA, 64 nt, hsa
guccucauauauuuaucuacuaaaauagaguguuuaccaugaacaguguguugcuucagacuau

SEQ ID NO: 557814 - RNA, 64 nt, hsa
aacaaagcagugaaguuuaacagaguucugagaauaccaugaaagacauuaugccugccuaaac

SEQ ID NO: 557815 - RNA, 64 nt, hsa
cggucuucauuuuaaaauuggcaucaggaaggauuaccaugaacuuauuuuaaauccauauugu

SEQ ID NO: 557816 - RNA, 64 nt, hsa
auauuuuuguaacaaaauauaaaugaagauauuuuaccaugaagagauugcacuuauccuugag

SEQ ID NO: 557817 - RNA, 64 nt, hsa
cuugagaacagucuaaauauaaaugaagauauuuuaccaugaagagauugcacuuauccuugag

SEQ ID NO: 557818 - RNA, 64 nt, hsa
uguuaaugacugucugcccauguccugccugaaauaccaugauuguuuauggaaaguaucuuua

SEQ ID NO: 557819 - RNA, 64 nt, hsa
cgccaugugaagugccuucuccuauuuugccuucuaccaugaguaaaagcuuccugaggcuucc

SEQ ID NO: 557820 - RNA, 64 nt, hsa
cucuucuuggucagaauucuauucucaggguguguaccaugauuugucugcuaagaagacgggu

SEQ ID NO: 557821 - RNA, 64 nt, hsa
uuugcaguggggccggaaaauaugguggccacccuaccaugagagucagccguaggggacccca

SEQ ID NO: 557822 - RNA, 64 nt, hsa; identical to SEQ ID NO: 265087

SEQ ID NO: 557823 - RNA, 64 nt, hsa; identical to SEQ ID NO: 265088

SEQ ID NO: 557824 - RNA, 64 nt, hsa; identical to SEQ ID NO: 265089

SEQ ID NO: 557825 - RNA, 64 nt, hsa; identical to SEQ ID NO: 265090

SEQ ID NO: 557826 - RNA, 64 nt, hsa; identical to SEQ ID NO: 265091

SEQ ID NO: 557827 - RNA, 64 nt, hsa; identical to SEQ ID NO: 265092

SEQ ID NO: 557828 - RNA, 64 nt, hsa; identical to SEQ ID NO: 265093

SEQ ID NO: 557829 - RNA, 61 nt, hsa; identical to SEQ ID NO: 265094

SEQ ID NO: 557830 - RNA, 64 nt, hsa; identical to SEQ ID NO: 265095

SEQ ID NO: 557831 - RNA, 64 nt, hsa; identical to SEQ ID NO: 265096

SEQ ID NO: 557832 - RNA, 64 nt, hsa; identical to SEQ ID NO: 265097

SEQ ID NO: 557833 - RNA, 64 nt, hsa; identical to SEQ ID NO: 265098

SEQ ID NO: 557834 - RNA, 64 nt, hsa; identical to SEQ ID NO: 265099

SEQ ID NO: 557835 - RNA, 64 nt, hsa; identical to SEQ ID NO: 265100

SEQ ID NO: 557836 - RNA, 64 nt, hsa; identical to SEQ ID NO: 265101

SEQ ID NO: 557837 - RNA, 64 nt, hsa; identical to SEQ ID NO: 265102

SEQ ID NO: 557838 - RNA, 64 nt, hsa; identical to SEQ ID NO: 265103

SEQ ID NO: 557839 - RNA, 64 nt, hsa; identical to SEQ ID NO: 265104

SEQ ID NO: 557840 - RNA, 64 nt, hsa; identical to SEQ ID NO: 265105

SEQ ID NO: 557841 - RNA, 64 nt, hsa; identical to SEQ ID NO: 265106

SEQ ID NO: 557842 - RNA, 64 nt, hsa; identical to SEQ ID NO: 265107

SEQ ID NO: 557843 - RNA, 64 nt, hsa; identical to SEQ ID NO: 265108

SEQ ID NO: 557844 - RNA, 64 nt, hsa; identical to SEQ ID NO: 265109

SEQ ID NO: 557845 - RNA, 64 nt, hsa; identical to SEQ ID NO: 265110

SEQ ID NO: 557846 - RNA, 62 nt, hsa
agaguccaagcuggugaacuauuaagcuguuuaaagaucacccuuggccuggcacagugguu

SEQ ID NO: 557847 - RNA, 62 nt, hsa
cuguuaauuuaugacaugaucucggaauggaaaaagaucauuucagagugugcgaaauaaua

SEQ ID NO: 557848 - RNA, 62 nt, hsa
ccaacuaaaggauauuaaaguuaggggaaagaaaagaucauugaaagucaugauaauuucug

SEQ ID NO: 557849 - RNA, 62 nt, hsa
aaauuauaguauauguaaguagcuaaugaaguaaagaucaugaagaaagaaauugauaggug

SEQ ID NO: 557850 - RNA, 62 nt, hsa
ucaacacaagauggcaaaucaggaucaggugaaaagaucaagaaacgugugaaaacucccua

SEQ ID NO: 557851 - RNA, 62 nt, hsa
uuauauguagaaaagugggguccuuuugaauaaaagaucauucaacuaaaaauauuaaaauu

SEQ ID NO: 557852 - RNA, 62 nt, hsa
uccacuuuaaccucuucuaaaauacccaaccaaaagaucacuguuucucucaacacuauuua

SEQ ID NO: 557853 - RNA, 62 nt, hsa
ugaacauuguuauuuauauuuuuuaaaauggaaaagaucacuauguuuguugugcuaaccac

SEQ ID NO: 557854 - RNA, 62 nt, hsa
aauggaaaauaaucuaacucgaaggcgccugaaaagaucaaauucuauaucccagauaccuu

SEQ ID NO: 557855 - RNA, 62 nt, hsa
uuggauuuguagguccugugccaccaaaacccaaagaucaaagguccaucaucaaaacacca

SEQ ID NO: 557856 - RNA, 62 nt, hsa
aaaaagauaaggaaagaagagagaagagagacaaagaucacuacagaccaaaacagaagaag

SEQ ID NO: 557857 - RNA, 62 nt, hsa
cuuuugagauucuccaacuugacaaaugugccaaagaucaacagacagaaaauaucauccug

SEQ ID NO: 557858 - RNA, 62 nt, hsa
uaaugguggaacaaauguuaaacugcucaucuaaagaucauguugauauuauuccagguuuu

SEQ ID NO: 557859 - RNA, 62 nt, hsa
uucuuuuuaauugaagaugucuugagcucugcaaagaucagagcaggugagcauccacuuug

SEQ ID NO: 557860 - RNA, 62 nt, hsa
accauuaaauucacacaugaaagauuaaucugaaagaucagagaccauguuauuccugacca

SEQ ID NO: 557861 - RNA, 62 nt, hsa
aacacagucacugcuguggucauuuguaauguaaagaucaguuauauauauauauuuguaau

SEQ ID NO: 557862 - RNA, 62 nt, hsa
gacacauuauaucuccaacaagguguggguggaaagaucaaauuaaccugcuuuuuugaaag

SEQ ID NO: 557863 - RNA, 62 nt, hsa
uucuaggaacccccaaaaggagaauaguaaaaaaagaucauacuuaaaauuuguauuacaau

SEQ ID NO: 557864 - RNA, 62 nt, hsa
auuuuggaauucgugcaggaagccaugaaaggaaagaucagugaagacagcaaucacgguuc

SEQ ID NO: 557865 - RNA, 62 nt, hsa
cacuccagcgucaucggacucucucuuauuacaaagaucacugcccaggaccaucuucccga

SEQ ID NO: 557866 - RNA, 62 nt, hsa
ugaaagcgaaauacuugaaaagaggugaccauaaagaucacaccaauuuagaaugaauauua

SEQ ID NO: 557867 - RNA, 62 nt, hsa
cccuuuuccaaccuaccucacaagguuaucagaaagaucaaauuaaauaauagaugugaaaa

SEQ ID NO: 557868 - RNA, 64 nt, hsa; identical to SEQ ID NO: 54328

SEQ ID NO: 557869 - RNA, 64 nt, hsa; identical to SEQ ID NO: 54329

SEQ ID NO: 557870 - RNA, 64 nt, hsa; identical to SEQ ID NO: 54330

SEQ ID NO: 557871 - RNA, 64 nt, hsa; identical to SEQ ID NO: 54331

SEQ ID NO: 557872 - RNA, 64 nt, hsa; identical to SEQ ID NO: 54332

SEQ ID NO: 557873 - RNA, 64 nt, hsa; identical to SEQ ID NO: 54333

SEQ ID NO: 557874 - RNA, 64 nt, hsa; identical to SEQ ID NO: 54334

SEQ ID NO: 557875 - RNA, 64 nt, hsa; identical to SEQ ID NO: 54335

SEQ ID NO: 557876 - RNA, 64 nt, hsa; identical to SEQ ID NO: 54336

SEQ ID NO: 557877 - RNA, 64 nt, hsa; identical to SEQ ID NO: 54337

SEQ ID NO: 557878 - RNA, 64 nt, hsa; identical to SEQ ID NO: 54338

SEQ ID NO: 557879 - RNA, 64 nt, hsa; identical to SEQ ID NO: 54339

SEQ ID NO: 557880 - RNA, 64 nt, hsa; identical to SEQ ID NO: 54340

SEQ ID NO: 557881 - RNA, 64 nt, hsa; identical to SEQ ID NO: 54341

SEQ ID NO: 557882 - RNA, 64 nt, hsa; identical to SEQ ID NO: 54342

SEQ ID NO: 557883 - RNA, 64 nt, hsa; identical to SEQ ID NO: 54343

SEQ ID NO: 557884 - RNA, 64 nt, hsa; identical to SEQ ID NO: 54344

SEQ ID NO: 557885 - RNA, 64 nt, hsa; identical to SEQ ID NO: 54345

SEQ ID NO: 557886 - RNA, 64 nt, hsa; identical to SEQ ID NO: 54346

SEQ ID NO: 557887 - RNA, 64 nt, hsa; identical to SEQ ID NO: 54347

SEQ ID NO: 557888 - RNA, 64 nt, hsa; identical to SEQ ID NO: 54348

SEQ ID NO: 557889 - RNA, 64 nt, hsa; identical to SEQ ID NO: 54349

SEQ ID NO: 557890 - RNA, 64 nt, hsa; identical to SEQ ID NO: 54350

SEQ ID NO: 557891 - RNA, 64 nt, hsa; identical to SEQ ID NO: 54351

SEQ ID NO: 557892 - RNA, 64 nt, hsa; identical to SEQ ID NO: 54352

SEQ ID NO: 557893 - RNA, 64 nt, hsa; identical to SEQ ID NO: 54353

SEQ ID NO: 557894 - RNA, 64 nt, hsa; identical to SEQ ID NO: 54354

SEQ ID NO: 557895 - RNA, 64 nt, hsa; identical to SEQ ID NO: 54355

SEQ ID NO: 557896 - RNA, 64 nt, hsa; identical to SEQ ID NO: 54356

SEQ ID NO: 557897 - RNA, 64 nt, hsa; identical to SEQ ID NO: 54357

SEQ ID NO: 557898 - RNA, 64 nt, hsa; identical to SEQ ID NO: 54358

SEQ ID NO: 557899 - RNA, 64 nt, hsa; identical to SEQ ID NO: 54359

SEQ ID NO: 557900 - RNA, 64 nt, hsa; identical to SEQ ID NO: 54360

SEQ ID NO: 557901 - RNA, 64 nt, hsa; identical to SEQ ID NO: 54361

SEQ ID NO: 557902 - RNA, 64 nt, hsa; identical to SEQ ID NO: 54362

SEQ ID NO: 557903 - RNA, 64 nt, hsa; identical to SEQ ID NO: 54363

SEQ ID NO: 557904 - RNA, 64 nt, hsa; identical to SEQ ID NO: 54364

SEQ ID NO: 557905 - RNA, 64 nt, hsa; identical to SEQ ID NO: 54365

SEQ ID NO: 557906 - RNA, 64 nt, hsa; identical to SEQ ID NO: 54366

SEQ ID NO: 557907 - RNA, 64 nt, hsa; identical to SEQ ID NO: 54367

SEQ ID NO: 557908 - RNA, 64 nt, hsa; identical to SEQ ID NO: 54368

SEQ ID NO: 557909 - RNA, 64 nt, hsa; identical to SEQ ID NO: 54369

SEQ ID NO: 557910 - RNA, 64 nt, hsa; identical to SEQ ID NO: 54370

SEQ ID NO: 557911 - RNA, 64 nt, hsa; identical to SEQ ID NO: 54371

SEQ ID NO: 557912 - RNA, 64 nt, hsa; identical to SEQ ID NO: 54372

SEQ ID NO: 557913 - RNA, 64 nt, hsa; identical to SEQ ID NO: 54373

SEQ ID NO: 557914 - RNA, 64 nt, hsa; identical to SEQ ID NO: 54374

SEQ ID NO: 557915 - RNA, 64 nt, hsa; identical to SEQ ID NO: 54375

SEQ ID NO: 557916 - RNA, 64 nt, hsa; identical to SEQ ID NO: 54376

SEQ ID NO: 557917 - RNA, 64 nt, hsa; identical to SEQ ID NO: 54377

SEQ ID NO: 557918 - RNA, 64 nt, hsa; identical to SEQ ID NO: 54378

SEQ ID NO: 557919 - RNA, 64 nt, hsa; identical to SEQ ID NO: 54379

SEQ ID NO: 557920 - RNA, 64 nt, hsa; identical to SEQ ID NO: 54380

SEQ ID NO: 557921 - RNA, 64 nt, hsa; identical to SEQ ID NO: 54381

SEQ ID NO: 557922 - RNA, 64 nt, hsa; identical to SEQ ID NO: 54382

SEQ ID NO: 557923 - RNA, 64 nt, hsa; identical to SEQ ID NO: 54383

SEQ ID NO: 557924 - RNA, 64 nt, hsa; identical to SEQ ID NO: 54384

SEQ ID NO: 557925 - RNA, 64 nt, hsa; identical to SEQ ID NO: 54385

SEQ ID NO: 557926 - RNA, 64 nt, hsa; identical to SEQ ID NO: 54386

SEQ ID NO: 557927 - RNA, 64 nt, hsa; identical to SEQ ID NO: 54387

SEQ ID NO: 557928 - RNA, 64 nt, hsa; identical to SEQ ID NO: 54388

SEQ ID NO: 557929 - RNA, 64 nt, hsa; identical to SEQ ID NO: 54389

SEQ ID NO: 557930 - RNA, 64 nt, hsa; identical to SEQ ID NO: 54390

SEQ ID NO: 557931 - RNA, 64 nt, hsa; identical to SEQ ID NO: 54391

SEQ ID NO: 557932 - RNA, 64 nt, hsa; identical to SEQ ID NO: 54392

SEQ ID NO: 557933 - RNA, 64 nt, hsa; identical to SEQ ID NO: 54393

SEQ ID NO: 557934 - RNA, 64 nt, hsa; identical to SEQ ID NO: 54394

SEQ ID NO: 557935 - RNA, 64 nt, hsa; identical to SEQ ID NO: 54395

SEQ ID NO: 557936 - RNA, 64 nt, hsa; identical to SEQ ID NO: 54396

SEQ ID NO: 557937 - RNA, 64 nt, hsa; identical to SEQ ID NO: 54397

SEQ ID NO: 557938 - RNA, 64 nt, hsa; identical to SEQ ID NO: 54398

SEQ ID NO: 557939 - RNA, 64 nt, hsa; identical to SEQ ID NO: 54399

SEQ ID NO: 557940 - RNA, 64 nt, hsa; identical to SEQ ID NO: 54400

SEQ ID NO: 557941 - RNA, 64 nt, hsa; identical to SEQ ID NO: 54401

SEQ ID NO: 557942 - RNA, 64 nt, hsa; identical to SEQ ID NO: 54402

SEQ ID NO: 557943 - RNA, 64 nt, hsa; identical to SEQ ID NO: 54403

SEQ ID NO: 557944 - RNA, 64 nt, hsa; identical to SEQ ID NO: 54404

SEQ ID NO: 557945 - RNA, 64 nt, hsa; identical to SEQ ID NO: 54405

SEQ ID NO: 557946 - RNA, 64 nt, hsa; identical to SEQ ID NO: 54406

SEQ ID NO: 557947 - RNA, 64 nt, hsa; identical to SEQ ID NO: 54407

SEQ ID NO: 557948 - RNA, 64 nt, hsa; identical to SEQ ID NO: 54408

SEQ ID NO: 557949 - RNA, 64 nt, hsa; identical to SEQ ID NO: 54409

SEQ ID NO: 557950 - RNA, 64 nt, hsa; identical to SEQ ID NO: 54410

SEQ ID NO: 557951 - RNA, 64 nt, hsa; identical to SEQ ID NO: 54411

SEQ ID NO: 557952 - RNA, 64 nt, hsa; identical to SEQ ID NO: 54412

SEQ ID NO: 557953 - RNA, 64 nt, hsa; identical to SEQ ID NO: 54413

SEQ ID NO: 557954 - RNA, 64 nt, hsa; identical to SEQ ID NO: 54414

SEQ ID NO: 557955 - RNA, 64 nt, hsa; identical to SEQ ID NO: 54415

SEQ ID NO: 557956 - RNA, 64 nt, hsa; identical to SEQ ID NO: 54416

SEQ ID NO: 557957 - RNA, 64 nt, hsa; identical to SEQ ID NO: 54417

SEQ ID NO: 557958 - RNA, 64 nt, hsa; identical to SEQ ID NO: 54418

SEQ ID NO: 557959 - RNA, 64 nt, hsa; identical to SEQ ID NO: 54419

SEQ ID NO: 557960 - RNA, 64 nt, hsa; identical to SEQ ID NO: 54420

SEQ ID NO: 557961 - RNA, 64 nt, hsa; identical to SEQ ID NO: 54421

SEQ ID NO: 557962 - RNA, 64 nt, hsa; identical to SEQ ID NO: 54422

SEQ ID NO: 557963 - RNA, 64 nt, hsa; identical to SEQ ID NO: 54423

SEQ ID NO: 557964 - RNA, 64 nt, hsa; identical to SEQ ID NO: 54424

SEQ ID NO: 557965 - RNA, 64 nt, hsa; identical to SEQ ID NO: 54425

SEQ ID NO: 557966 - RNA, 64 nt, hsa; identical to SEQ ID NO: 54426

SEQ ID NO: 557967 - RNA, 64 nt, hsa; identical to SEQ ID NO: 54427

SEQ ID NO: 557968 - RNA, 64 nt, hsa; identical to SEQ ID NO: 54428

SEQ ID NO: 557969 - RNA, 64 nt, hsa; identical to SEQ ID NO: 54429

SEQ ID NO: 557970 - RNA, 64 nt, hsa; identical to SEQ ID NO: 54430

SEQ ID NO: 557971 - RNA, 64 nt, hsa; identical to SEQ ID NO: 54431

SEQ ID NO: 557972 - RNA, 64 nt, hsa; identical to SEQ ID NO: 54432

SEQ ID NO: 557973 - RNA, 64 nt, hsa; identical to SEQ ID NO: 54433

SEQ ID NO: 557974 - RNA, 64 nt, hsa; identical to SEQ ID NO: 54434

SEQ ID NO: 557975 - RNA, 64 nt, hsa; identical to SEQ ID NO: 54435

SEQ ID NO: 557976 - RNA, 64 nt, hsa; identical to SEQ ID NO: 54436

SEQ ID NO: 557977 - RNA, 64 nt, hsa; identical to SEQ ID NO: 54437

SEQ ID NO: 557978 - RNA, 64 nt, hsa; identical to SEQ ID NO: 54438

SEQ ID NO: 557979 - RNA, 64 nt, hsa; identical to SEQ ID NO: 54439

SEQ ID NO: 557980 - RNA, 64 nt, hsa; identical to SEQ ID NO: 54440

SEQ ID NO: 557981 - RNA, 64 nt, hsa; identical to SEQ ID NO: 54441

SEQ ID NO: 557982 - RNA, 64 nt, hsa; identical to SEQ ID NO: 54442

SEQ ID NO: 557983 - RNA, 64 nt, hsa; identical to SEQ ID NO: 54443

SEQ ID NO: 557984 - RNA, 64 nt, hsa; identical to SEQ ID NO: 54444

SEQ ID NO: 557985 - RNA, 64 nt, hsa; identical to SEQ ID NO: 54445

SEQ ID NO: 557986 - RNA, 64 nt, hsa; identical to SEQ ID NO: 54446

SEQ ID NO: 557987 - RNA, 64 nt, hsa; identical to SEQ ID NO: 54447

SEQ ID NO: 557988 - RNA, 64 nt, hsa; identical to SEQ ID NO: 54448

SEQ ID NO: 557989 - RNA, 64 nt, hsa; identical to SEQ ID NO: 54449

SEQ ID NO: 557990 - RNA, 64 nt, hsa; identical to SEQ ID NO: 54450

SEQ ID NO: 557991 - RNA, 64 nt, hsa; identical to SEQ ID NO: 54451

SEQ ID NO: 557992 - RNA, 64 nt, hsa; identical to SEQ ID NO: 54452

SEQ ID NO: 557993 - RNA, 58 nt, hsa; identical to SEQ ID NO: 54453

SEQ ID NO: 557994 - RNA, 64 nt, hsa; identical to SEQ ID NO: 54454

SEQ ID NO: 557995 - RNA, 64 nt, hsa; identical to SEQ ID NO: 54455

SEQ ID NO: 557996 - RNA, 64 nt, hsa; identical to SEQ ID NO: 54456

SEQ ID NO: 557997 - RNA, 64 nt, hsa; identical to SEQ ID NO: 54457

SEQ ID NO: 557998 - RNA, 64 nt, hsa; identical to SEQ ID NO: 54458

SEQ ID NO: 557999 - RNA, 64 nt, hsa; identical to SEQ ID NO: 54459

SEQ ID NO: 558000 - RNA, 64 nt, hsa; identical to SEQ ID NO: 54460

SEQ ID NO: 558001 - RNA, 64 nt, hsa; identical to SEQ ID NO: 54461

SEQ ID NO: 558002 - RNA, 64 nt, hsa; identical to SEQ ID NO: 54462

SEQ ID NO: 558003 - RNA, 64 nt, hsa; identical to SEQ ID NO: 54463

SEQ ID NO: 558004 - RNA, 64 nt, hsa; identical to SEQ ID NO: 54464

SEQ ID NO: 558005 - RNA, 53 nt, hsa; identical to SEQ ID NO: 54465

SEQ ID NO: 558006 - RNA, 64 nt, hsa; identical to SEQ ID NO: 54466

SEQ ID NO: 558007 - RNA, 64 nt, hsa; identical to SEQ ID NO: 54467

SEQ ID NO: 558008 - RNA, 64 nt, hsa; identical to SEQ ID NO: 54468

SEQ ID NO: 558009 - RNA, 64 nt, hsa; identical to SEQ ID NO: 54469

SEQ ID NO: 558010 - RNA, 64 nt, hsa; identical to SEQ ID NO: 54470

SEQ ID NO: 558011 - RNA, 64 nt, hsa; identical to SEQ ID NO: 54471

SEQ ID NO: 558012 - RNA, 64 nt, hsa; identical to SEQ ID NO: 54472

SEQ ID NO: 558013 - RNA, 64 nt, hsa; identical to SEQ ID NO: 54473

SEQ ID NO: 558014 - RNA, 64 nt, hsa; identical to SEQ ID NO: 54474

SEQ ID NO: 558015 - RNA, 64 nt, hsa; identical to SEQ ID NO: 54475

SEQ ID NO: 558016 - RNA, 64 nt, hsa; identical to SEQ ID NO: 54476

SEQ ID NO: 558017 - RNA, 64 nt, hsa; identical to SEQ ID NO: 54477

SEQ ID NO: 558018 - RNA, 64 nt, hsa; identical to SEQ ID NO: 54478

SEQ ID NO: 558019 - RNA, 64 nt, hsa; identical to SEQ ID NO: 54479

SEQ ID NO: 558020 - RNA, 64 nt, hsa; identical to SEQ ID NO: 54480

SEQ ID NO: 558021 - RNA, 64 nt, hsa; identical to SEQ ID NO: 54481

SEQ ID NO: 558022 - RNA, 64 nt, hsa; identical to SEQ ID NO: 54482

SEQ ID NO: 558023 - RNA, 64 nt, hsa; identical to SEQ ID NO: 54483

SEQ ID NO: 558024 - RNA, 64 nt, hsa; identical to SEQ ID NO: 54484

SEQ ID NO: 558025 - RNA, 64 nt, hsa; identical to SEQ ID NO: 54485

SEQ ID NO: 558026 - RNA, 64 nt, hsa; identical to SEQ ID NO: 54486

SEQ ID NO: 558027 - RNA, 64 nt, hsa; identical to SEQ ID NO: 54487

SEQ ID NO: 558028 - RNA, 64 nt, hsa; identical to SEQ ID NO: 54488

SEQ ID NO: 558029 - RNA, 64 nt, hsa; identical to SEQ ID NO: 54489

SEQ ID NO: 558030 - RNA, 64 nt, hsa; identical to SEQ ID NO: 54490

SEQ ID NO: 558031 - RNA, 64 nt, hsa; identical to SEQ ID NO: 54491

SEQ ID NO: 558032 - RNA, 64 nt, hsa; identical to SEQ ID NO: 54492

SEQ ID NO: 558033 - RNA, 64 nt, hsa; identical to SEQ ID NO: 54493

SEQ ID NO: 558034 - RNA, 64 nt, hsa; identical to SEQ ID NO: 54494

SEQ ID NO: 558035 - RNA, 64 nt, hsa; identical to SEQ ID NO: 54495

SEQ ID NO: 558036 - RNA, 64 nt, hsa; identical to SEQ ID NO: 54496

SEQ ID NO: 558037 - RNA, 64 nt, hsa; identical to SEQ ID NO: 54497

SEQ ID NO: 558038 - RNA, 64 nt, hsa; identical to SEQ ID NO: 54498

SEQ ID NO: 558039 - RNA, 64 nt, hsa; identical to SEQ ID NO: 54499

SEQ ID NO: 558040 - RNA, 64 nt, hsa; identical to SEQ ID NO: 54500

SEQ ID NO: 558041 - RNA, 64 nt, hsa; identical to SEQ ID NO: 54501

SEQ ID NO: 558042 - RNA, 64 nt, hsa; identical to SEQ ID NO: 54502

SEQ ID NO: 558043 - RNA, 64 nt, hsa; identical to SEQ ID NO: 54503

SEQ ID NO: 558044 - RNA, 64 nt, hsa; identical to SEQ ID NO: 54504

SEQ ID NO: 558045 - RNA, 64 nt, hsa; identical to SEQ ID NO: 54505

SEQ ID NO: 558046 - RNA, 64 nt, hsa; identical to SEQ ID NO: 54506

SEQ ID NO: 558047 - RNA, 64 nt, hsa; identical to SEQ ID NO: 54507

SEQ ID NO: 558048 - RNA, 64 nt, hsa; identical to SEQ ID NO: 54508

SEQ ID NO: 558049 - RNA, 64 nt, hsa; identical to SEQ ID NO: 54509

SEQ ID NO: 558050 - RNA, 64 nt, hsa; identical to SEQ ID NO: 54510

SEQ ID NO: 558051 - RNA, 64 nt, hsa; identical to SEQ ID NO: 54511

SEQ ID NO: 558052 - RNA, 64 nt, hsa; identical to SEQ ID NO: 54512

SEQ ID NO: 558053 - RNA, 64 nt, hsa; identical to SEQ ID NO: 54513

SEQ ID NO: 558054 - RNA, 64 nt, hsa; identical to SEQ ID NO: 54514

SEQ ID NO: 558055 - RNA, 64 nt, hsa; identical to SEQ ID NO: 54515

SEQ ID NO: 558056 - RNA, 64 nt, hsa; identical to SEQ ID NO: 54516

SEQ ID NO: 558057 - RNA, 64 nt, hsa; identical to SEQ ID NO: 54517

SEQ ID NO: 558058 - RNA, 64 nt, hsa; identical to SEQ ID NO: 54518

SEQ ID NO: 558059 - RNA, 64 nt, hsa; identical to SEQ ID NO: 54519

SEQ ID NO: 558060 - RNA, 64 nt, hsa; identical to SEQ ID NO: 54520

SEQ ID NO: 558061 - RNA, 64 nt, hsa; identical to SEQ ID NO: 54521

SEQ ID NO: 558062 - RNA, 64 nt, hsa; identical to SEQ ID NO: 54522

SEQ ID NO: 558063 - RNA, 64 nt, hsa; identical to SEQ ID NO: 54523

SEQ ID NO: 558064 - RNA, 64 nt, hsa; identical to SEQ ID NO: 54524

SEQ ID NO: 558065 - RNA, 64 nt, hsa; identical to SEQ ID NO: 54525

SEQ ID NO: 558066 - RNA, 64 nt, hsa; identical to SEQ ID NO: 54526

SEQ ID NO: 558067 - RNA, 64 nt, hsa; identical to SEQ ID NO: 54527

SEQ ID NO: 558068 - RNA, 64 nt, hsa; identical to SEQ ID NO: 54528

SEQ ID NO: 558069 - RNA, 64 nt, hsa; identical to SEQ ID NO: 54529

SEQ ID NO: 558070 - RNA, 64 nt, hsa; identical to SEQ ID NO: 54530

SEQ ID NO: 558071 - RNA, 64 nt, hsa; identical to SEQ ID NO: 54531

SEQ ID NO: 558072 - RNA, 64 nt, hsa; identical to SEQ ID NO: 54532

SEQ ID NO: 558073 - RNA, 64 nt, hsa; identical to SEQ ID NO: 54533

SEQ ID NO: 558074 - RNA, 64 nt, hsa; identical to SEQ ID NO: 54534

SEQ ID NO: 558075 - RNA, 64 nt, hsa; identical to SEQ ID NO: 54535

SEQ ID NO: 558076 - RNA, 64 nt, hsa; identical to SEQ ID NO: 54536

SEQ ID NO: 558077 - RNA, 64 nt, hsa; identical to SEQ ID NO: 54537

SEQ ID NO: 558078 - RNA, 64 nt, hsa; identical to SEQ ID NO: 54538

SEQ ID NO: 558079 - RNA, 64 nt, hsa; identical to SEQ ID NO: 54539

SEQ ID NO: 558080 - RNA, 64 nt, hsa; identical to SEQ ID NO: 54540

SEQ ID NO: 558081 - RNA, 64 nt, hsa; identical to SEQ ID NO: 54541

SEQ ID NO: 558082 - RNA, 64 nt, hsa; identical to SEQ ID NO: 54542

SEQ ID NO: 558083 - RNA, 64 nt, hsa; identical to SEQ ID NO: 54543

SEQ ID NO: 558084 - RNA, 64 nt, hsa; identical to SEQ ID NO: 54544

SEQ ID NO: 558085 - RNA, 64 nt, hsa; identical to SEQ ID NO: 54545

SEQ ID NO: 558086 - RNA, 64 nt, hsa; identical to SEQ ID NO: 54546

SEQ ID NO: 558087 - RNA, 64 nt, hsa; identical to SEQ ID NO: 54547

SEQ ID NO: 558088 - RNA, 64 nt, hsa; identical to SEQ ID NO: 54548

SEQ ID NO: 558089 - RNA, 64 nt, hsa; identical to SEQ ID NO: 54549

SEQ ID NO: 558090 - RNA, 64 nt, hsa; identical to SEQ ID NO: 54550

SEQ ID NO: 558091 - RNA, 64 nt, hsa; identical to SEQ ID NO: 54551

SEQ ID NO: 558092 - RNA, 64 nt, hsa; identical to SEQ ID NO: 54552

SEQ ID NO: 558093 - RNA, 64 nt, hsa; identical to SEQ ID NO: 54553

SEQ ID NO: 558094 - RNA, 64 nt, hsa; identical to SEQ ID NO: 54554

SEQ ID NO: 558095 - RNA, 64 nt, hsa; identical to SEQ ID NO: 54555

SEQ ID NO: 558096 - RNA, 64 nt, hsa; identical to SEQ ID NO: 54556

SEQ ID NO: 558097 - RNA, 64 nt, hsa; identical to SEQ ID NO: 54557

SEQ ID NO: 558098 - RNA, 64 nt, hsa; identical to SEQ ID NO: 54558

SEQ ID NO: 558099 - RNA, 64 nt, hsa; identical to SEQ ID NO: 54559

SEQ ID NO: 558100 - RNA, 64 nt, hsa; identical to SEQ ID NO: 54560

SEQ ID NO: 558101 - RNA, 64 nt, hsa; identical to SEQ ID NO: 54561

SEQ ID NO: 558102 - RNA, 64 nt, hsa; identical to SEQ ID NO: 54562

SEQ ID NO: 558103 - RNA, 64 nt, hsa; identical to SEQ ID NO: 54563

SEQ ID NO: 558104 - RNA, 64 nt, hsa; identical to SEQ ID NO: 54564

SEQ ID NO: 558105 - RNA, 64 nt, hsa; identical to SEQ ID NO: 54565

SEQ ID NO: 558106 - RNA, 64 nt, hsa; identical to SEQ ID NO: 54566

SEQ ID NO: 558107 - RNA, 64 nt, hsa; identical to SEQ ID NO: 54567

SEQ ID NO: 558108 - RNA, 64 nt, hsa; identical to SEQ ID NO: 54568

SEQ ID NO: 558109 - RNA, 64 nt, hsa; identical to SEQ ID NO: 54569

SEQ ID NO: 558110 - RNA, 64 nt, hsa; identical to SEQ ID NO: 54570

SEQ ID NO: 558111 - RNA, 64 nt, hsa; identical to SEQ ID NO: 54571

SEQ ID NO: 558112 - RNA, 64 nt, hsa; identical to SEQ ID NO: 54572

SEQ ID NO: 558113 - RNA, 64 nt, hsa; identical to SEQ ID NO: 54573

SEQ ID NO: 558114 - RNA, 64 nt, hsa; identical to SEQ ID NO: 54574

SEQ ID NO: 558115 - RNA, 64 nt, hsa; identical to SEQ ID NO: 54575

SEQ ID NO: 558116 - RNA, 64 nt, hsa; identical to SEQ ID NO: 54576

SEQ ID NO: 558117 - RNA, 64 nt, hsa; identical to SEQ ID NO: 54577

SEQ ID NO: 558118 - RNA, 64 nt, hsa; identical to SEQ ID NO: 54578

SEQ ID NO: 558119 - RNA, 64 nt, hsa; identical to SEQ ID NO: 54579

SEQ ID NO: 558120 - RNA, 64 nt, hsa; identical to SEQ ID NO: 54580

SEQ ID NO: 558121 - RNA, 64 nt, hsa; identical to SEQ ID NO: 54581

SEQ ID NO: 558122 - RNA, 64 nt, hsa; identical to SEQ ID NO: 54582

SEQ ID NO: 558123 - RNA, 64 nt, hsa; identical to SEQ ID NO: 54583

SEQ ID NO: 558124 - RNA, 64 nt, hsa
uuuuuuuuuuuuuuuuuuuugagauguagucuuacucugucacccaggcuagagugcaauggca

SEQ ID NO: 558125 - RNA, 64 nt, hsa
uuuuuauacuuuuuuuuuuugaaacggagucucacucugucaccaggcuggagugcagugccgc

SEQ ID NO: 558126 - RNA, 64 nt, hsa
ucaagauucuauaaaaaggaaaccaagcauaagacucugucaucauaccuguuacacguuccua

SEQ ID NO: 558127 - RNA, 64 nt, hsa
gaaauuucauuuuuuuuuuugagauggagucucucucugucacccaaguuggagugcaguggcc

SEQ ID NO: 558128 - RNA, 64 nt, hsa
guauuguuguuguuguuuuugagacagggucuugcucugucacccaagcuggaauacaguggca

SEQ ID NO: 558129 - RNA, 64 nt, hsa
cagcuucagaauuguucuuugaauccuaaggaaccucugucaacaguugagguugcuguugaaa

SEQ ID NO: 558130 - RNA, 64 nt, hsa
uuuucuuuuuuuuuuuuuucgagacagggucuugcucugucaccuaggcuagaguggaguggca

SEQ ID NO: 558131 - RNA, 64 nt, hsa
auauguuuauugcacuucccauggggauaaaucacucugucauuccuaguuauuuuaaaaaaag

SEQ ID NO: 558132 - RNA, 64 nt, hsa
guauguuaauuuuuuuuuuugagacggagucuugcucugucacccaggcuggagagcaguggcg

SEQ ID NO: 558133 - RNA, 64 nt, hsa
guuuuuuguuuuguguuuuugaaacggaguuuugcucugucacccaggcuggaaugcaauggca

SEQ ID NO: 558134 - RNA, 64 nt, hsa
ccuuccuuccuucugacagggucuugcucuauugcucugucacccaggcuggaaugcaguggcg

SEQ ID NO: 558135 - RNA, 64 nt, hsa
agauugauuuuuuuuuuuuugagacaggaucucacucugucauccaggcugaaguccaauccca

SEQ ID NO: 558136 - RNA, 64 nt, hsa
uuuuuuguuuguuauuuguuuuuuguagacagcacucugucacccaggcuggagugcaguggca

SEQ ID NO: 558137 - RNA, 64 nt, hsa
caaggcaaaacuuuuuuauugagauggagucuugcucugucacccaggccgugcaaucucggcu

SEQ ID NO: 558138 - RNA, 64 nt, hsa
uuguaacugcauauaccagugcgugugcgucuaccucugucagcaugaaaguauuccagucuuu

SEQ ID NO: 558139 - RNA, 64 nt, hsa
aaauuuuuguuguugucguugagauacaguuucacucugucacccaggcuggagugcaguggca

SEQ ID NO: 558140 - RNA, 64 nt, hsa
agcgaaucuuugaaaacacccacucggcucccaucucugucaccuagccaggagggguagcaaa

SEQ ID NO: 558141 - RNA, 64 nt, hsa
ccucgcggcacugccgguguccccagagcagggacucugucaccucgcacuucauuacauuccu

SEQ ID NO: 558142 - RNA, 64 nt, hsa
uuuuuuuuuuuuuuuuuuuugagauggagucucgcucugucacccaggcuggagugcaguggug

SEQ ID NO: 558143 - RNA, 64 nt, hsa
uuuuaauuuuuuauaucuuuaugagacgaucucacucugucaccagguuggaguacagugguac

SEQ ID NO: 558144 - RNA, 64 nt, hsa
uauucuuuguuuuuuuuuuuuagacggagucucgcucugucacgaggcuggagugcaguggccc

SEQ ID NO: 558145 - RNA, 64 nt, hsa
cucccaugcacccuuggagacuuaguuucacagacucugucauuuugauuuggucuguggucac

SEQ ID NO: 558146 - RNA, 64 nt, hsa
uuaaaggugauuguuuuuuugagacagagucuugcucugucacccagaguggagugcagugucc

SEQ ID NO: 558147 - RNA, 64 nt, hsa
uauuuauuuacuuuuuaagagagagacaggcucacucugucacccaggccagagugcaguggca

SEQ ID NO: 558148 - RNA, 64 nt, hsa
cuuugguugaaugagcugguauugauguaaaauacucugucauugauggaccacuaccugcagc

SEQ ID NO: 558149 - RNA, 64 nt, hsa
auaugaacuucaagaagcuguuaccaguuaucggcucugucaucugaaauuuuaaccacuuaau

SEQ ID NO: 558150 - RNA, 64 nt, hsa
uuuuauuuuaguuuuauuuugagacagagucucgcucugucaccuaggcuggagugcaguggcg

SEQ ID NO: 558151 - RNA, 64 nt, hsa
aggucccauuuuauuauuuuuuuuuuucgagacacucugucacccaggcuggagugcaauggug

SEQ ID NO: 558152 - RNA, 64 nt, hsa
ugcccagcucugcuucugguuuccuggacaauuucucugucagauacggcccauuguaaaccca

SEQ ID NO: 558153 - RNA, 64 nt, hsa
auucgcuauaaucagccuauuugagcugcugggucucugucacuguggacuccagucauucaag

SEQ ID NO: 558154 - RNA, 64 nt, hsa
ggaaagagaagaccagaugugcauagaagccagucucugucacauacaccgcagguggucaccg

SEQ ID NO: 558155 - RNA, 64 nt, hsa
uuucuacacacacaucuaaagacggugcggcucgcucugucauggguuccgucucucuguggag

SEQ ID NO: 558156 - RNA, 64 nt, hsa
cggugucuuguagcgggcggcagcgccagcgccccucugucaggcuggggcaaucuugguuuug

SEQ ID NO: 558157 - RNA, 64 nt, hsa
guuaguugauccaugucaugcacccuaaaaauggcucugucacugugaguggcuucaguaggau

SEQ ID NO: 558158 - RNA, 64 nt, hsa
uuuguuuugguuuuuuguuuuuugaggaguuucccucugucacacaagcuggagggcaauggcg

SEQ ID NO: 558159 - RNA, 64 nt, hsa
ccgcgcccagcugccuuuuuuuuuuugagucuugcucugucacugaggcuggagugcaguggcg

SEQ ID NO: 558160 - RNA, 64 nt, hsa
uuuuaaucuuuuauuuuuuugagacagagucucacucugucacccagacuggagugcaguggcg

SEQ ID NO: 558161 - RNA, 64 nt, hsa
cucucagaaguaugagaccauccucugcacucugcucugucaucaaaggcugcuggguggagau

SEQ ID NO: 558162 - RNA, 64 nt, hsa
uuuuuuuuuuuuuuuuuuuugagacagagucuugcucugucacccaggcuggagugcaguggug

SEQ ID NO: 558163 - RNA, 64 nt, hsa
ugcacaaaauucuuuuuuuugagauggagucucacucugucacccaggcuggagugcaguggcg

SEQ ID NO: 558164 - RNA, 64 nt, hsa
ccuguuagaaugucacgagggacuguacuguccccucugucaccagggaagccacaaugagagc

SEQ ID NO: 558165 - RNA, 64 nt, hsa
acccucagccagcccucacugcugacaggcaccccucugucaccuccugccaccugucagauac

SEQ ID NO: 558166 - RNA, 64 nt, hsa
agggaggggcugguccuuccccucggugcuggcucucugucacaaugccucaaaagacauggaa

SEQ ID NO: 558167 - RNA, 64 nt, hsa
gggcccugaggggcagggagaugccaccaugcuucucugucaccguaagaaggcugaccagcca

SEQ ID NO: 558168 - RNA, 64 nt, hsa
cagaucauggcauccaagagugcgccgagucugucucugucaugguagagaccgagccucuguc

SEQ ID NO: 558169 - RNA, 64 nt, hsa
gccgagucugucucugucaugguagagaccgagccucugucacugcaggcacucaaugcagcca

SEQ ID NO: 558170 - RNA, 64 nt, hsa
uucuguaaaggugucuucucuucucagacucuuccucugucacacgucugacuccuucacguca

SEQ ID NO: 558171 - RNA, 64 nt, hsa
ggcugggcccuggaggcaacgugcugcaggcgcacucugucagagugaacagcaccgcgagaca

SEQ ID NO: 558172 - RNA, 64 nt, hsa
uuuuucuuuuccuuuuuuuugagaccaagucucacucugucacccacgcuggagugcugugaug

SEQ ID NO: 558173 - RNA, 64 nt, hsa
uuuuuuuuuuuuuuuuuaaagagacagagucucacucugucacccaggcuggagugcaguggca

SEQ ID NO: 558174 - RNA, 64 nt, hsa
uuuuuuuuuuuuuuuuuuuugagauggagucucgcucugucaucuaggcuggagugcaguggug

SEQ ID NO: 558175 - RNA, 64 nt, hsa
uaagccaacucugacauuuggauucuaccauagacucugucauuuuguagccauuucagcuguc

SEQ ID NO: 558176 - RNA, 64 nt, hsa
cuccuccucugucucucauccuccuuucucccaucaaagcaaaauauggccucaccaccagccc

SEQ ID NO: 558177 - RNA, 64 nt, hsa
cuaaaaacaagaugacuuuuccuggcacauauuccaaagcaaagacuuuguugccugcugcuua

SEQ ID NO: 558178 - RNA, 64 nt, hsa
cagggggagugggcugaagggagaguagauggugcaaagcaagcccaucucuaaguagaaaaau

SEQ ID NO: 558179 - RNA, 64 nt, hsa
auuucuagacucucgccggcccaggcccaucuuccaaagcaagaggaaggaaugauaaugguga

SEQ ID NO: 558180 - RNA, 64 nt, hsa
gcacucugagggcuuaagucauaugugauauuuacaaagcaauuggcccauuuacagagagaca

SEQ ID NO: 558181 - RNA, 64 nt, hsa
aauccccagaaguggucccuaugaugaacucccccaaagcaacgccguuuuuggaggaacucaa

SEQ ID NO: 558182 - RNA, 64 nt, hsa
ucaacaaauauauuuauuggagaccgacuuugugcaaagcaaugcuaaucaggguucuccaugg

SEQ ID NO: 558183 - RNA, 64 nt, hsa
auuccgaggaguagagaggcagaagagaugucagcaaagcaagugaugaagcagaguggauguc

SEQ ID NO: 558184 - RNA, 64 nt, hsa
cuguuuacauuuauuuucuucagccugugcaaaacaaagcaauggaaaaggaaacuaaaaaaua

SEQ ID NO: 558185 - RNA, 64 nt, hsa
uaaaaugucagcaagaaggccugccucaucuuaacaaagcaaaaaaaaaugcuuuaauucaaau

SEQ ID NO: 558186 - RNA, 64 nt, hsa
aacaacaccugggucaacucuuuuaauuuauauacaaagcaaagaacaacauuaauggagaugc

SEQ ID NO: 558187 - RNA, 64 nt, hsa
caagaauuagaaugacuugagaacgggcaaauaacaaagcaaaccaauauaauuauauggucau

SEQ ID NO: 558188 - RNA, 64 nt, hsa
caguggccugugggugagggaagccagaaugacacaaagcaaugcaaagacaagauugccaugc

SEQ ID NO: 558189 - RNA, 64 nt, hsa
uaauagggaaucuagauuucaccaagauucaaaucaaagcaacauuuaaaggaauaagaccugu

SEQ ID NO: 558190 - RNA, 64 nt, hsa
aagcaagauaagcagaugugugauccacuaccgccaaagcaaauacuccuuaucguuagugucc

SEQ ID NO: 558191 - RNA, 64 nt, hsa
ucuguaucacucagaaacauuauguaaaaaauaucaaagcaagauaagcagaugugugauccac

SEQ ID NO: 558192 - RNA, 64 nt, hsa
ccccaguguuggagugcaaggaggcggggccauccaaagcaacgcugaaggccuuuuccagcag

SEQ ID NO: 558193 - RNA, 64 nt, hsa
ucgccgcaagaagcccauuccuauggaagucuagcaaagcaauacgacucagcccagcacucuc

SEQ ID NO: 558194 - RNA, 64 nt, hsa
aagaagccucaacuuacccaggaggagcuagaagcaaagcaagcaaagcaaaagcuggaagauc

SEQ ID NO: 558195 - RNA, 64 nt, hsa
caacuuacccaggaggagcuagaagcaaagcaagcaaagcaaaagcuggaagaucgccucgcag

SEQ ID NO: 558196 - RNA, 64 nt, hsa
uaguggugguauguaauggaacuuagccauuuuucaaagcaauugaaaugcauugcucuggauc

SEQ ID NO: 558197 - RNA, 64 nt, hsa
guuaugaagagcuaauuuacuggacaaagaauuccaaagcaaaaccagaacaguaugaauuuga

SEQ ID NO: 558198 - RNA, 64 nt, hsa
uuuguuucauuuuacuuuccugcaaaauuuucuucaaagcaacaaguccuaggagcacacaaag

SEQ ID NO: 558199 - RNA, 64 nt, hsa
aauuuucuucaaagcaacaaguccuaggagcacacaaagcaacccaaaggcuuuucccuggaaa

SEQ ID NO: 558200 - RNA, 64 nt, hsa
ggaacggucagaaacugggcucaucacaccaaggcaaagcaacgggcgagucuuccuccuuguc

SEQ ID NO: 558201 - RNA, 64 nt, hsa
gaagaaucaauauuguuaaaauggccauacuacccaaagcaauuuauagauucaaugcuauucc

SEQ ID NO: 558202 - RNA, 64 nt, hsa
aauuuauuugaaaccaaaaaagagcccaaaaagccaaagcaauccuaagcaaaaagaacaaagc

SEQ ID NO: 558203 - RNA, 64 nt, hsa
gcagcuugcugauauuuuauauaaaaaagaaaagcaaagcaaaagagaagcugauagucuugaa

SEQ ID NO: 558204 - RNA, 64 nt, hsa
gacagacagaggcugagagaggcuguuccugaaucaaagcaauagccagcuuucgacacauacc

SEQ ID NO: 558205 - RNA, 64 nt, hsa
ggauaggaagaaucaguauuguuaaaauacugcccaaagcaauuuacagagccaaugcuauuuc

SEQ ID NO: 558206 - RNA, 64 nt, hsa
auaagugcuggaaaagacuuaaugaugaacaccccaaagcaauugcaacaaaaacaaaaauuga

SEQ ID NO: 558207 - RNA, 64 nt, hsa
aauuccuaacuaucacugguuugguucuggacuaaaacuacauugacagauugaauuugccuaa

SEQ ID NO: 558208 - RNA, 64 nt, hsa
aauagcagcccucaauugugaaaaaauuuacuuuaaacuacauuagguugugaaugcagguuuu

SEQ ID NO: 558209 - RNA, 64 nt, hsa
uuuuguggaagauaaaauauuaaaacugcuuucaaaacuacaaauugacuuaaacugcuauagu

SEQ ID NO: 558210 - RNA, 64 nt, hsa
uauacagccuacuuuuaugucaccucuaccuucaaaacuacauauaauuuauuuuaggaguugg

SEQ ID NO: 558211 - RNA, 64 nt, hsa
gcuuacuacacauaggaaaauucauacuggagagaaacuacaaaugugaagaauguguuaaagc

SEQ ID NO: 558212 - RNA, 64 nt, hsa
uaaauguaaugcauuugugaaaacauuuuuuaaaaaacuacagcuuagaaaauaccagaggccu

SEQ ID NO: 558213 - RNA, 64 nt, hsa
uaccaaagccaggcaaaaacauuacaagaaaggaaaacuacagaucaauauuuccagugaacac

SEQ ID NO: 558214 - RNA, 64 nt, hsa
acagauuuuuuugaauuugugaaaguuuuuggcaaaacuacaaauaggauuauguuagcauuua

SEQ ID NO: 558215 - RNA, 64 nt, hsa
ucuguuuuccauuaauaauaggugaaauacaggaaaacuacauuuguuauuccucaguuuuuaa

SEQ ID NO: 558216 - RNA, 64 nt, hsa
uccauucuugaauguagaaauuucagauucucuaaaacuacaugucacuguuuuuauccuagaa

SEQ ID NO: 558217 - RNA, 64 nt, hsa
gcaaauguaauaaauuugaaaaaaaaguuuuccaaaacuacaacuuagacaacaccagaggguu

SEQ ID NO: 558218 - RNA, 64 nt, hsa
ucuuacuaaacauaaaaaaacuuaaacuggagagaaacuacaaagcuggaagacaucacaguaa

SEQ ID NO: 558219 - RNA, 64 nt, hsa
gcuaaaaaacuacaaauuaagcucuaaaacaaacaaacuacagaaauguaaaccuucauuugcc

SEQ ID NO: 558220 - RNA, 64 nt, hsa
gucguuaaaaauucaaaugguuuuaauagcuaaaaaacuacaaauuaagcucuaaaacaaacaa

SEQ ID NO: 558221 - RNA, 64 nt, hsa
caucugcaaauugcugcaauauuauaguaaucagaaacuacauaaggaauguuauauaggcuug

SEQ ID NO: 558222 - RNA, 64 nt, hsa
auuuguuaaaagauaugacaaaaugaaaaugcuuaaacuacagaaauuuaaaaaugccauaaca

SEQ ID NO: 558223 - RNA, 64 nt, hsa
gaauggauuuuucccggagccggaagccaggaggaaacuacaccacacuaaaacauugucuaca

SEQ ID NO: 558224 - RNA, 64 nt, hsa
cacgucuaugcaauuguacaaaaaaguuauaagaaaacuacauguaaaaucuugauagcuaaau

SEQ ID NO: 558225 - RNA, 64 nt, hsa
guagguugauucaaucaagauguauguagaccuaaaacuacaccaauaggcugauucaaucaag

SEQ ID NO: 558226 - RNA, 64 nt, hsa
gagaacugacaacacuacuuacugauagaccaaaaaacuacaccaguagguugauucaaucaag

SEQ ID NO: 558227 - RNA, 64 nt, hsa
uugaugaccaaaguccuuuuuuuccaucuuuacaaaacuacaugagaacaaacagaucgaaccg

SEQ ID NO: 558228 - RNA, 64 nt, hsa
uugaaauuaagaaggcaaaaauguaaaggagucaaaacuacaaaucaaguauuugggaagugaa

SEQ ID NO: 558229 - RNA, 64 nt, hsa; identical to SEQ ID NO: 93583

SEQ ID NO: 558230 - RNA, 64 nt, hsa; identical to SEQ ID NO: 93584

SEQ ID NO: 558231 - RNA, 64 nt, hsa; identical to SEQ ID NO: 93585

SEQ ID NO: 558232 - RNA, 64 nt, hsa; identical to SEQ ID NO: 93586

SEQ ID NO: 558233 - RNA, 64 nt, hsa; identical to SEQ ID NO: 93587

SEQ ID NO: 558234 - RNA, 64 nt, hsa; identical to SEQ ID NO: 93588

SEQ ID NO: 558235 - RNA, 64 nt, hsa; identical to SEQ ID NO: 93589

SEQ ID NO: 558236 - RNA, 64 nt, hsa; identical to SEQ ID NO: 93590

SEQ ID NO: 558237 - RNA, 64 nt, hsa; identical to SEQ ID NO: 93591

SEQ ID NO: 558238 - RNA, 64 nt, hsa; identical to SEQ ID NO: 93592

SEQ ID NO: 558239 - RNA, 64 nt, hsa; identical to SEQ ID NO: 93593

SEQ ID NO: 558240 - RNA, 64 nt, hsa; identical to SEQ ID NO: 93594

SEQ ID NO: 558241 - RNA, 64 nt, hsa; identical to SEQ ID NO: 93595

SEQ ID NO: 558242 - RNA, 64 nt, hsa; identical to SEQ ID NO: 93596

SEQ ID NO: 558243 - RNA, 64 nt, hsa; identical to SEQ ID NO: 145127

SEQ ID NO: 558244 - RNA, 64 nt, hsa; identical to SEQ ID NO: 145128

SEQ ID NO: 558245 - RNA, 64 nt, hsa; identical to SEQ ID NO: 266463

SEQ ID NO: 558246 - RNA, 64 nt, hsa; identical to SEQ ID NO: 266464

SEQ ID NO: 558247 - RNA, 64 nt, hsa; identical to SEQ ID NO: 266465

SEQ ID NO: 558248 - RNA, 64 nt, hsa; identical to SEQ ID NO: 266466

SEQ ID NO: 558249 - RNA, 64 nt, hsa; identical to SEQ ID NO: 266467

SEQ ID NO: 558250 - RNA, 64 nt, hsa; identical to SEQ ID NO: 266468

SEQ ID NO: 558251 - RNA, 64 nt, hsa; identical to SEQ ID NO: 266469

SEQ ID NO: 558252 - RNA, 64 nt, hsa; identical to SEQ ID NO: 266470

SEQ ID NO: 558253 - RNA, 64 nt, hsa; identical to SEQ ID NO: 266471

SEQ ID NO: 558254 - RNA, 64 nt, hsa; identical to SEQ ID NO: 266472

SEQ ID NO: 558255 - RNA, 64 nt, hsa; identical to SEQ ID NO: 266473

SEQ ID NO: 558256 - RNA, 64 nt, hsa; identical to SEQ ID NO: 266474

SEQ ID NO: 558257 - RNA, 64 nt, hsa; identical to SEQ ID NO: 266475

SEQ ID NO: 558258 - RNA, 64 nt, hsa; identical to SEQ ID NO: 266476

SEQ ID NO: 558259 - RNA, 64 nt, hsa; identical to SEQ ID NO: 266477

SEQ ID NO: 558260 - RNA, 64 nt, hsa; identical to SEQ ID NO: 266478

SEQ ID NO: 558261 - RNA, 64 nt, hsa; identical to SEQ ID NO: 266479

SEQ ID NO: 558262 - RNA, 64 nt, hsa; identical to SEQ ID NO: 266480

SEQ ID NO: 558263 - RNA, 64 nt, hsa; identical to SEQ ID NO: 266481

SEQ ID NO: 558264 - RNA, 64 nt, hsa; identical to SEQ ID NO: 266482

SEQ ID NO: 558265 - RNA, 64 nt, hsa; identical to SEQ ID NO: 266483

SEQ ID NO: 558266 - RNA, 64 nt, hsa; identical to SEQ ID NO: 266484

SEQ ID NO: 558267 - RNA, 64 nt, hsa; identical to SEQ ID NO: 266485

SEQ ID NO: 558268 - RNA, 64 nt, hsa; identical to SEQ ID NO: 266486

SEQ ID NO: 558269 - RNA, 64 nt, hsa; identical to SEQ ID NO: 266487

SEQ ID NO: 558270 - RNA, 64 nt, hsa; identical to SEQ ID NO: 266488

SEQ ID NO: 558271 - RNA, 64 nt, hsa; identical to SEQ ID NO: 266489

SEQ ID NO: 558272 - RNA, 64 nt, hsa; identical to SEQ ID NO: 266490

SEQ ID NO: 558273 - RNA, 64 nt, hsa; identical to SEQ ID NO: 266491

SEQ ID NO: 558274 - RNA, 64 nt, hsa; identical to SEQ ID NO: 266492

SEQ ID NO: 558275 - RNA, 64 nt, hsa; identical to SEQ ID NO: 266493

SEQ ID NO: 558276 - RNA, 64 nt, hsa; identical to SEQ ID NO: 266494

SEQ ID NO: 558277 - RNA, 64 nt, hsa; identical to SEQ ID NO: 266495

SEQ ID NO: 558278 - RNA, 64 nt, hsa; identical to SEQ ID NO: 266496

SEQ ID NO: 558279 - RNA, 64 nt, hsa; identical to SEQ ID NO: 266497

SEQ ID NO: 558280 - RNA, 64 nt, hsa; identical to SEQ ID NO: 266498

SEQ ID NO: 558281 - RNA, 64 nt, hsa; identical to SEQ ID NO: 266499

SEQ ID NO: 558282 - RNA, 64 nt, hsa; identical to SEQ ID NO: 266500

SEQ ID NO: 558283 - RNA, 64 nt, hsa; identical to SEQ ID NO: 266501

SEQ ID NO: 558284 - RNA, 64 nt, hsa; identical to SEQ ID NO: 266502

SEQ ID NO: 558285 - RNA, 64 nt, hsa; identical to SEQ ID NO: 266503

SEQ ID NO: 558286 - RNA, 64 nt, hsa; identical to SEQ ID NO: 266504

SEQ ID NO: 558287 - RNA, 64 nt, hsa; identical to SEQ ID NO: 266505

SEQ ID NO: 558288 - RNA, 64 nt, hsa; identical to SEQ ID NO: 266506

SEQ ID NO: 558289 - RNA, 64 nt, hsa; identical to SEQ ID NO: 266507

SEQ ID NO: 558290 - RNA, 64 nt, hsa; identical to SEQ ID NO: 266508

SEQ ID NO: 558291 - RNA, 64 nt, hsa; identical to SEQ ID NO: 266509

SEQ ID NO: 558292 - RNA, 64 nt, hsa; identical to SEQ ID NO: 266510

SEQ ID NO: 558293 - RNA, 64 nt, hsa; identical to SEQ ID NO: 266511

SEQ ID NO: 558294 - RNA, 64 nt, hsa; identical to SEQ ID NO: 266512

SEQ ID NO: 558295 - RNA, 64 nt, hsa; identical to SEQ ID NO: 266513

SEQ ID NO: 558296 - RNA, 64 nt, hsa; identical to SEQ ID NO: 266514

SEQ ID NO: 558297 - RNA, 64 nt, hsa; identical to SEQ ID NO: 266515

SEQ ID NO: 558298 - RNA, 64 nt, hsa; identical to SEQ ID NO: 266516

SEQ ID NO: 558299 - RNA, 64 nt, hsa; identical to SEQ ID NO: 266517

SEQ ID NO: 558300 - RNA, 64 nt, hsa; identical to SEQ ID NO: 266518

SEQ ID NO: 558301 - RNA, 64 nt, hsa; identical to SEQ ID NO: 266519

SEQ ID NO: 558302 - RNA, 64 nt, hsa; identical to SEQ ID NO: 266520

SEQ ID NO: 558303 - RNA, 64 nt, hsa; identical to SEQ ID NO: 266521

SEQ ID NO: 558304 - RNA, 64 nt, hsa; identical to SEQ ID NO: 266522

SEQ ID NO: 558305 - RNA, 64 nt, hsa; identical to SEQ ID NO: 266523

SEQ ID NO: 558306 - RNA, 64 nt, hsa; identical to SEQ ID NO: 266524

SEQ ID NO: 558307 - RNA, 64 nt, hsa; identical to SEQ ID NO: 266525

SEQ ID NO: 558308 - RNA, 64 nt, hsa; identical to SEQ ID NO: 266526

SEQ ID NO: 558309 - RNA, 64 nt, hsa; identical to SEQ ID NO: 266527

SEQ ID NO: 558310 - RNA, 64 nt, hsa; identical to SEQ ID NO: 266528

SEQ ID NO: 558311 - RNA, 64 nt, hsa; identical to SEQ ID NO: 266529

SEQ ID NO: 558312 - RNA, 64 nt, hsa; identical to SEQ ID NO: 266530

SEQ ID NO: 558313 - RNA, 64 nt, hsa; identical to SEQ ID NO: 266531

SEQ ID NO: 558314 - RNA, 64 nt, hsa; identical to SEQ ID NO: 266532

SEQ ID NO: 558315 - RNA, 64 nt, hsa; identical to SEQ ID NO: 266533

SEQ ID NO: 558316 - RNA, 64 nt, hsa; identical to SEQ ID NO: 266534

SEQ ID NO: 558317 - RNA, 64 nt, hsa; identical to SEQ ID NO: 266535

SEQ ID NO: 558318 - RNA, 64 nt, hsa; identical to SEQ ID NO: 266536

SEQ ID NO: 558319 - RNA, 64 nt, hsa; identical to SEQ ID NO: 266537

SEQ ID NO: 558320 - RNA, 64 nt, hsa; identical to SEQ ID NO: 266538

SEQ ID NO: 558321 - RNA, 64 nt, hsa; identical to SEQ ID NO: 266539

SEQ ID NO: 558322 - RNA, 64 nt, hsa; identical to SEQ ID NO: 266540

SEQ ID NO: 558323 - RNA, 64 nt, hsa; identical to SEQ ID NO: 266541

SEQ ID NO: 558324 - RNA, 64 nt, hsa; identical to SEQ ID NO: 266542

SEQ ID NO: 558325 - RNA, 64 nt, hsa; identical to SEQ ID NO: 266543

SEQ ID NO: 558326 - RNA, 64 nt, hsa; identical to SEQ ID NO: 266544

SEQ ID NO: 558327 - RNA, 64 nt, hsa; identical to SEQ ID NO: 266545

SEQ ID NO: 558328 - RNA, 64 nt, hsa; identical to SEQ ID NO: 266546

SEQ ID NO: 558329 - RNA, 64 nt, hsa; identical to SEQ ID NO: 266547

SEQ ID NO: 558330 - RNA, 64 nt, hsa; identical to SEQ ID NO: 266548

SEQ ID NO: 558331 - RNA, 64 nt, hsa; identical to SEQ ID NO: 266549

SEQ ID NO: 558332 - RNA, 64 nt, hsa; identical to SEQ ID NO: 266550

SEQ ID NO: 558333 - RNA, 64 nt, hsa; identical to SEQ ID NO: 266551

SEQ ID NO: 558334 - RNA, 64 nt, hsa; identical to SEQ ID NO: 266552

SEQ ID NO: 558335 - RNA, 64 nt, hsa; identical to SEQ ID NO: 266553

SEQ ID NO: 558336 - RNA, 64 nt, hsa; identical to SEQ ID NO: 266554

SEQ ID NO: 558337 - RNA, 64 nt, hsa; identical to SEQ ID NO: 266555

SEQ ID NO: 558338 - RNA, 64 nt, hsa; identical to SEQ ID NO: 266556

SEQ ID NO: 558339 - RNA, 64 nt, hsa; identical to SEQ ID NO: 266557

SEQ ID NO: 558340 - RNA, 64 nt, hsa; identical to SEQ ID NO: 266558

SEQ ID NO: 558341 - RNA, 64 nt, hsa; identical to SEQ ID NO: 266559

SEQ ID NO: 558342 - RNA, 64 nt, hsa; identical to SEQ ID NO: 266560

SEQ ID NO: 558343 - RNA, 55 nt, hsa; identical to SEQ ID NO: 266561

SEQ ID NO: 558344 - RNA, 64 nt, hsa; identical to SEQ ID NO: 266562

SEQ ID NO: 558345 - RNA, 64 nt, hsa; identical to SEQ ID NO: 266563

SEQ ID NO: 558346 - RNA, 64 nt, hsa; identical to SEQ ID NO: 266564

SEQ ID NO: 558347 - RNA, 64 nt, hsa; identical to SEQ ID NO: 266565

SEQ ID NO: 558348 - RNA, 64 nt, hsa; identical to SEQ ID NO: 266566

SEQ ID NO: 558349 - RNA, 64 nt, hsa; identical to SEQ ID NO: 266567

SEQ ID NO: 558350 - RNA, 64 nt, hsa; identical to SEQ ID NO: 266568

SEQ ID NO: 558351 - RNA, 64 nt, hsa; identical to SEQ ID NO: 266569

SEQ ID NO: 558352 - RNA, 64 nt, hsa; identical to SEQ ID NO: 266570

SEQ ID NO: 558353 - RNA, 64 nt, hsa; identical to SEQ ID NO: 266571

SEQ ID NO: 558354 - RNA, 64 nt, hsa; identical to SEQ ID NO: 266572

SEQ ID NO: 558355 - RNA, 64 nt, hsa; identical to SEQ ID NO: 266573

SEQ ID NO: 558356 - RNA, 64 nt, hsa; identical to SEQ ID NO: 266574

SEQ ID NO: 558357 - RNA, 64 nt, hsa; identical to SEQ ID NO: 266575

SEQ ID NO: 558358 - RNA, 60 nt, hsa; identical to SEQ ID NO: 266576

SEQ ID NO: 558359 - RNA, 64 nt, hsa; identical to SEQ ID NO: 266577

SEQ ID NO: 558360 - RNA, 64 nt, hsa; identical to SEQ ID NO: 266578

SEQ ID NO: 558361 - RNA, 64 nt, hsa; identical to SEQ ID NO: 266579

SEQ ID NO: 558362 - RNA, 64 nt, hsa; identical to SEQ ID NO: 266580

SEQ ID NO: 558363 - RNA, 64 nt, hsa; identical to SEQ ID NO: 266581

SEQ ID NO: 558364 - RNA, 64 nt, hsa; identical to SEQ ID NO: 266582

SEQ ID NO: 558365 - RNA, 64 nt, hsa; identical to SEQ ID NO: 266583

SEQ ID NO: 558366 - RNA, 64 nt, hsa; identical to SEQ ID NO: 266584

SEQ ID NO: 558367 - RNA, 64 nt, hsa; identical to SEQ ID NO: 266585

SEQ ID NO: 558368 - RNA, 64 nt, hsa; identical to SEQ ID NO: 266586

SEQ ID NO: 558369 - RNA, 64 nt, hsa; identical to SEQ ID NO: 266587

SEQ ID NO: 558370 - RNA, 64 nt, hsa; identical to SEQ ID NO: 266588

SEQ ID NO: 558371 - RNA, 64 nt, hsa; identical to SEQ ID NO: 266589

SEQ ID NO: 558372 - RNA, 64 nt, hsa; identical to SEQ ID NO: 266590

SEQ ID NO: 558373 - RNA, 54 nt, hsa; identical to SEQ ID NO: 266591

SEQ ID NO: 558374 - RNA, 64 nt, hsa; identical to SEQ ID NO: 266592

SEQ ID NO: 558375 - RNA, 64 nt, hsa; identical to SEQ ID NO: 266593

SEQ ID NO: 558376 - RNA, 64 nt, hsa; identical to SEQ ID NO: 266594

SEQ ID NO: 558377 - RNA, 64 nt, hsa; identical to SEQ ID NO: 266595

SEQ ID NO: 558378 - RNA, 64 nt, hsa; identical to SEQ ID NO: 266596

SEQ ID NO: 558379 - RNA, 64 nt, hsa; identical to SEQ ID NO: 266597

SEQ ID NO: 558380 - RNA, 64 nt, hsa; identical to SEQ ID NO: 266598

SEQ ID NO: 558381 - RNA, 64 nt, hsa; identical to SEQ ID NO: 266599

SEQ ID NO: 558382 - RNA, 64 nt, hsa; identical to SEQ ID NO: 266600

SEQ ID NO: 558383 - RNA, 64 nt, hsa; identical to SEQ ID NO: 266601

SEQ ID NO: 558384 - RNA, 64 nt, hsa; identical to SEQ ID NO: 266602

SEQ ID NO: 558385 - RNA, 64 nt, hsa; identical to SEQ ID NO: 266603

SEQ ID NO: 558386 - RNA, 64 nt, hsa; identical to SEQ ID NO: 266604

SEQ ID NO: 558387 - RNA, 64 nt, hsa; identical to SEQ ID NO: 266605

SEQ ID NO: 558388 - RNA, 64 nt, hsa; identical to SEQ ID NO: 266606

SEQ ID NO: 558389 - RNA, 64 nt, hsa; identical to SEQ ID NO: 266607

SEQ ID NO: 558390 - RNA, 64 nt, hsa; identical to SEQ ID NO: 266608

SEQ ID NO: 558391 - RNA, 64 nt, hsa; identical to SEQ ID NO: 266609

SEQ ID NO: 558392 - RNA, 64 nt, hsa; identical to SEQ ID NO: 266610

SEQ ID NO: 558393 - RNA, 64 nt, hsa; identical to SEQ ID NO: 266611

SEQ ID NO: 558394 - RNA, 64 nt, hsa; identical to SEQ ID NO: 266612

SEQ ID NO: 558395 - RNA, 64 nt, hsa; identical to SEQ ID NO: 266613

SEQ ID NO: 558396 - RNA, 64 nt, hsa; identical to SEQ ID NO: 266614

SEQ ID NO: 558397 - RNA, 64 nt, hsa; identical to SEQ ID NO: 266615

SEQ ID NO: 558398 - RNA, 64 nt, hsa; identical to SEQ ID NO: 266616

SEQ ID NO: 558399 - RNA, 64 nt, hsa; identical to SEQ ID NO: 266617

SEQ ID NO: 558400 - RNA, 64 nt, hsa; identical to SEQ ID NO: 266618

SEQ ID NO: 558401 - RNA, 64 nt, hsa; identical to SEQ ID NO: 266619

SEQ ID NO: 558402 - RNA, 64 nt, hsa; identical to SEQ ID NO: 266620

SEQ ID NO: 558403 - RNA, 64 nt, hsa; identical to SEQ ID NO: 266621

SEQ ID NO: 558404 - RNA, 64 nt, hsa; identical to SEQ ID NO: 266622

SEQ ID NO: 558405 - RNA, 64 nt, hsa; identical to SEQ ID NO: 266623

SEQ ID NO: 558406 - RNA, 64 nt, hsa; identical to SEQ ID NO: 266624

SEQ ID NO: 558407 - RNA, 64 nt, hsa; identical to SEQ ID NO: 266625

SEQ ID NO: 558408 - RNA, 64 nt, hsa; identical to SEQ ID NO: 266626

SEQ ID NO: 558409 - RNA, 64 nt, hsa; identical to SEQ ID NO: 266627

SEQ ID NO: 558410 - RNA, 64 nt, hsa; identical to SEQ ID NO: 266628

SEQ ID NO: 558411 - RNA, 64 nt, hsa; identical to SEQ ID NO: 266629

SEQ ID NO: 558412 - RNA, 64 nt, hsa; identical to SEQ ID NO: 266630

SEQ ID NO: 558413 - RNA, 64 nt, hsa; identical to SEQ ID NO: 266631

SEQ ID NO: 558414 - RNA, 64 nt, hsa; identical to SEQ ID NO: 266632

SEQ ID NO: 558415 - RNA, 64 nt, hsa
uaaauuaauagcagccucucaaguccauugaggccucauguaaaauucccauuuuucaucuuua

SEQ ID NO: 558416 - RNA, 64 nt, hsa
uuacuuaaguugaaaaagcuucaacucucaaggacucauguauaccauauguuccacuuauugc

SEQ ID NO: 558417 - RNA, 64 nt, hsa
ucauuggucuuuauauguagccacaaacacugaccucauguaggcaccuuaccaauauaugaca

SEQ ID NO: 558418 - RNA, 64 nt, hsa
guuuuguuguuucaaccauaguuagagacaaauucucauguacuuucagaaaucaauaucugca

SEQ ID NO: 558419 - RNA, 64 nt, hsa; identical to SEQ ID NO: 321937

SEQ ID NO: 558420 - RNA, 64 nt, hsa; identical to SEQ ID NO: 321938

SEQ ID NO: 558421 - RNA, 64 nt, hsa; identical to SEQ ID NO: 321939

SEQ ID NO: 558422 - RNA, 64 nt, hsa; identical to SEQ ID NO: 321940

SEQ ID NO: 558423 - RNA, 64 nt, hsa
acccuacuugcacugcuguggauuuuuuuaagagaagcaaaaacaaaaguaaacuccuuucccu

SEQ ID NO: 558424 - RNA, 64 nt, hsa
cagggucauuugugugauguguuuggccuuaccaaagcaaaagagggugcaagaaugugggagu

SEQ ID NO: 558425 - RNA, 64 nt, hsa
ccuuuauguauuuucuuaaagcacgccuuuaaauaagcaaaaacuuuaaaaggcaggaaagaga

SEQ ID NO: 558426 - RNA, 64 nt, hsa
ccuccucugucucucauccuccuuucucccaucaaagcaaaauauggccucaccaccagcccca

SEQ ID NO: 558427 - RNA, 64 nt, hsa
ugccaaagcuaguuuuagagaaugagaaagucuuaagcaaaauacucccaggucucacuccaga

SEQ ID NO: 558428 - RNA, 64 nt, hsa
auugugugagcaauuaaacaugguugacuuuuucaagcaaaaaucaguucaucuuuugauguaa

SEQ ID NO: 558429 - RNA, 64 nt, hsa
gaauuuuaucaaguccuuguauucuaaaauagccaagcaaaaugauaguaaauucuuugucuuu

SEQ ID NO: 558430 - RNA, 64 nt, hsa
ggaaauaccuggauauuugcuagaggaaaaaugaaagcaaaacuucguacacagugccuugccc

SEQ ID NO: 558431 - RNA, 64 nt, hsa
gaaauagcuuuaacuuugcuuaaacuacaaacacaagcaaaacuucacggggucauacuacaua

SEQ ID NO: 558432 - RNA, 64 nt, hsa
caaaacuucacggggucauacuacauacaagcauaagcaaaacuuaacuuggaucauuucuggu

SEQ ID NO: 558433 - RNA, 64 nt, hsa
cuuaagccagcaauuggcugggguccaggaaacaaagcaaaagcacaauaugugaaugugcuga

SEQ ID NO: 558434 - RNA, 64 nt, hsa
cauggcacuuggaauccuugaguuaauuccagugaagcaaaacuugggaagagucaggauuggc

SEQ ID NO: 558435 - RNA, 64 nt, hsa
aauggaaauuuauguuggcgauagccaagaccacaagcaaaagcacauacuggaaaugaugagu

SEQ ID NO: 558436 - RNA, 64 nt, hsa
uaaguuccaaauauguuaagggcuuuaauacaaaaagcaaaaauugucaguguuuggaugaaaa

SEQ ID NO: 558437 - RNA, 64 nt, hsa
cauggggcguacuauuuuuauugagcccaaaaacaagcaaaaccaaagaauauguagucuaagc

SEQ ID NO: 558438 - RNA, 64 nt, hsa
uuguucgccuaucaucuggccacaugaggcugucaagcaaaagaauaggaguguaguugaguag

SEQ ID NO: 558439 - RNA, 64 nt, hsa
gccuaaaaaaaaauuucuuaucauuguuucaaaaaagcaaaaucauggaaaauuuuuguugucc

SEQ ID NO: 558440 - RNA, 64 nt, hsa
cuaaaccagaacaagcaacaaacuguauuuaugcaagcaaaauugaugagaaaauuauauucaa

SEQ ID NO: 558441 - RNA, 64 nt, hsa
caagcaaaauugaugagaaaauuauauucaaauaaagcaaaaauuaaaaaaaaaaggcuauugc

SEQ ID NO: 558442 - RNA, 52 nt, hsa
caacaucaacaaauaaauaagaaagcaaaaagaucugggauauguguuggaa

SEQ ID NO: 558443 - RNA, 64 nt, hsa
uucucaucaucucuguuauacaccuguaucaugaaagcaaaaagaaguaaacaucaggagucag

SEQ ID NO: 558444 - RNA, 64 nt, hsa
caaaaguggucucaaaauauuuuuuuaagaaaaaaagcaaaaacaauguauugcugauaaucag

SEQ ID NO: 558445 - RNA, 64 nt, hsa
uacaucagacuuuuaaaaucuguaauauacaagcaagcaaaauuauuuuaaaugacuuaauugu

SEQ ID NO: 558446 - RNA, 64 nt, hsa
acuucuuacauuguggcaagaaaaaaugaggaagaagcaaaagcagaaaccccugauaaacuga

SEQ ID NO: 558447 - RNA, 64 nt, hsa
acuucuuacauggcagcaagagaaaaugaggaagaagcaaaaguggaaaccccugauaagccau

SEQ ID NO: 558448 - RNA, 64 nt, hsa
uugucacaagaaagcuuuguaaaaccagacagugaagcaaaauguugccaacugcuuaaccuag

SEQ ID NO: 558449 - RNA, 64 nt, hsa
gucagagagagagaggauggacgugggagaaagcaagcaaaagcuacccuagggaagagccggu

SEQ ID NO: 558450 - RNA, 64 nt, hsa
gcuaacuaaaaccaaaaaaaccuguccagugugcaagcaaaaaguuguuccuucucaaggcgau

SEQ ID NO: 558451 - RNA, 64 nt, hsa
uuucaguguccuuaaggguucuguaguguuaucaaagcaaaaagaaaaugcugcauaaaaauac

SEQ ID NO: 558452 - RNA, 64 nt, hsa
uuuuauuucaagggauagggcagauuaccauuagaagcaaaauuaaaaguacaagcugggcaaa

SEQ ID NO: 558453 - RNA, 64 nt, hsa
aagauugaaaaacucaacaagaauuuaauucuaaaagcaaaaauugguuugaguuuucaaguuu

SEQ ID NO: 558454 - RNA, 64 nt, hsa
aaucuuacauuuuugcaauaacaaacauuaaugaaagcaaaacauuauaaaaguaauuuuaauu

SEQ ID NO: 558455 - RNA, 64 nt, hsa
uaaagaugaucaugguucagaauaucuucagagaaagcaaaaucuuuaauauugcagggagccu

SEQ ID NO: 558456 - RNA, 64 nt, hsa
cugaaaguuuuuauccaacaauuauguucauuuuaagcaaaauuuuaagaaaguuuugaaauuc

SEQ ID NO: 558457 - RNA, 64 nt, hsa
aaauguugaguaaggugacauuuugagcgcuaauaagcaaaagagcaugcagugcuguugaaua

SEQ ID NO: 558458 - RNA, 64 nt, hsa
gaggaagaguguuuacuaaauaaaugacuggggcaagcaaaauugaggaggaaauuagaaacug

SEQ ID NO: 558459 - RNA, 64 nt, hsa
ugugaaugaucauuucaaauauauugaauaaaauaagcaaaagcuauuguuauuuacugauccu

SEQ ID NO: 558460 - RNA, 64 nt, hsa
caagcaaaaaucaggcugagaaaaagcaaaagaaaagcaaaaaaaagaagaagaaacagcagaa

SEQ ID NO: 558461 - RNA, 64 nt, hsa
gaaaaagaagccaagcaaaaaucaggcugagaaaaagcaaaagaaaagcaaaaaaaagaagaag

SEQ ID NO: 558462 - RNA, 64 nt, hsa
caugguauaaagaggaaaccaagaaaaagaagccaagcaaaaaucaggcugagaaaaagcaaaa

SEQ ID NO: 558463 - RNA, 64 nt, hsa
accuucuuacugcaugauaacaaagcagcaaggcaagcaaaagcguaagaugaagagagaggaa

SEQ ID NO: 558464 - RNA, 64 nt, hsa
auacagcugucacucauuuguaguaaaacuuaaaaagcaaaaacaaaaaacaaaaaagaccuuc

SEQ ID NO: 558465 - RNA, 64 nt, hsa
agaucguucugccacuugcacugugcuugcuccuaagcaaaagggaaaaggagcgcgcgugaua

SEQ ID NO: 558466 - RNA, 64 nt, hsa
aaaguagagcaaucguguauaagcuaauguuuaaaagcaaaacugcaaauuguagcccaguugg

SEQ ID NO: 558467 - RNA, 64 nt, hsa
uuaggcugagcucaggaauuguccaaaaaggaaaaagcaaaauaauuaauugagaguauuuuuu

SEQ ID NO: 558468 - RNA, 64 nt, hsa
cccucgccaacaaacaguugaaauuuaagggaagaagcaaaagcuaaacugucuuugacccuaa

SEQ ID NO: 558469 - RNA, 64 nt, hsa
ggaaugauauuuuaggaauaacggacuuuuaaagaagcaaaaaaaaagacugaauuuccuugcu

SEQ ID NO: 558470 - RNA, 64 nt, hsa
uuucauguuuaauuuguauuuguaaaaaaacaaaaagcaaaaaaauucccaaaacccagauaac

SEQ ID NO: 558471 - RNA, 64 nt, hsa
aaaauaaacguguaagcaaaauuuucuuuuguaaaagcaaaagccacaucucuuuucuggaucc

SEQ ID NO: 558472 - RNA, 64 nt, hsa
uaagucuuuauaaggaagaauaaaauaaacguguaagcaaaauuuucuuuuguaaaagcaaaag

SEQ ID NO: 558473 - RNA, 64 nt, hsa
ugcagcagaggacagucuggagaagguauuagcaaagcaaaaggcugagaaggaacagggaaca

SEQ ID NO: 558474 - RNA, 64 nt, hsa
acagaguauguccgaugguaucuggguaagaagaaagcaaaagcaagggaccuucaugcccuuc

SEQ ID NO: 558475 - RNA, 64 nt, hsa
cuuguaaaccacaucuuuuuugcacuuuuuuuauaagcaaaaacgugccguuuaaaccacugga

SEQ ID NO: 558476 - RNA, 64 nt, hsa
aaacaucuuuguacauuuaagucuguauuauaauaagcaaaaagauuguguguauguauguuua

SEQ ID NO: 558477 - RNA, 64 nt, hsa
gacuccagaaccauuaauaaaacaaaacaaaacaaagcaaaauauugaugaucaggcagauuug

SEQ ID NO: 558478 - RNA, 64 nt, hsa
aaaaugaaauuucugaucucaccccauauuacuaaagcaaaauuuccagggguagggacuggga

SEQ ID NO: 558479 - RNA, 64 nt, hsa
gaagacucaucgcaguguguuauaugacaggacaaagcaaaaacaaacaaaaagcaagccugug

SEQ ID NO: 558480 - RNA, 64 nt, hsa
uuguuuucuguggguugcgacccaugcaaucaaaaagcaaaauuuugauugagauuuuuuacag

SEQ ID NO: 558481 - RNA, 64 nt, hsa
augacuuggauauaugguugaagaaucaaaacaaaagcaaaaaaaaaaagcaaaaaaagaaaag

SEQ ID NO: 558482 - RNA, 64 nt, hsa
augguugaagaaucaaaacaaaagcaaaaaaaaaaagcaaaaaaagaaaagagaaaaaaagaaa

SEQ ID NO: 558483 - RNA, 64 nt, hsa
uucaugacgaagacgccaaaaacaauugcaacagaagcaaaaauucacaaaugggaucuaauua

SEQ ID NO: 558484 - RNA, 64 nt, hsa
aaaucuaaagaaauauugauaguaaggcaauccuaagcaaaaagaacaaagcuggaggcaucac

SEQ ID NO: 558485 - RNA, 64 nt, hsa
uuguaaaacucguuuguuuucaaaggucuggacuaagcaaaacaacagugucaguuuaggaaau

SEQ ID NO: 558486 - RNA, 64 nt, hsa
gaaugcucccccaacauuccuuugguuuuccuauaagcaaaaccaaauaccacuauaaauacaa

SEQ ID NO: 558487 - RNA, 64 nt, hsa
ugagugacagagagagauucaaaaaacaaaaaaaaagcaaaaauauacuuugcuauuggguaag

SEQ ID NO: 558488 - RNA, 64 nt, hsa
auuucuuguguaauaccugacaaacaggcaaccaaagcaaaaguggacaaaugggaucacauca

SEQ ID NO: 558489 - RNA, 64 nt, hsa
ucuuacauggcggcagcaagagaaaaugagaaagaagcaaaaguggaaaccccuaauaaaccua

SEQ ID NO: 558490 - RNA, 64 nt, hsa
ucguacauggugguggcaagagaaaaugaagaagaagcaaaaguggaaaccccugauaaaccca

SEQ ID NO: 558491 - RNA, 64 nt, hsa
agggucugacuucacagcuaugacaaaaccgaaaaagcaaaacugcaaaaaaguacuaagaugu

SEQ ID NO: 558492 - RNA, 64 nt, hsa
acauaggcagcugcacugcgcguuccuauuauugaagcaaaaagggugacugauaccuaaaagc

SEQ ID NO: 558493 - RNA, 64 nt, hsa
ggggccauaucauucauggccaaaaaaaaccaaaaagcaaaaaacaaaaacaagucccaugucc

SEQ ID NO: 558494 - RNA, 64 nt, hsa
gacuuagcuauuaguauauuuaaaaacuguucaaaagcaaaagagaaggaacaggaaugaaagg

SEQ ID NO: 558495 - RNA, 64 nt, hsa
ggcaguggugcagcauuccuaccuagugucauaaaagcaaaauacuuacauagcuuucuuaaaa

SEQ ID NO: 558496 - RNA, 64 nt, hsa
ugucuucauuaccauuaccucuacacugcagaagaagcaaaacuccuuuauuagaauuacugca

SEQ ID NO: 558497 - RNA, 64 nt, hsa
caagcaauugcugcaucuuaguagggugagggauaagcaaaagaggauguucaccauaacccag

SEQ ID NO: 558498 - RNA, 64 nt, hsa
aaaaaacucauggugaggcuuaacaaugucuuguaagcaaaagguagagcccuguaucaaccca

SEQ ID NO: 558499 - RNA, 64 nt, hsa
cuaagccuggaagccauccugcccuucugacccaaagcaaaacaucacauuccagucugaagug

SEQ ID NO: 558500 - RNA, 64 nt, hsa
uaggugaugggcagaucuuuucuuuaaaauaaaaaagcaaaaacucuugugguaccuagucaga

SEQ ID NO: 558501 - RNA, 64 nt, hsa
caguagucagggcagcagggcugccucucaucuaaagcaaaacuaccuuccucacagaaaacgc

SEQ ID NO: 558502 - RNA, 64 nt, hsa
uugacagugucuccuuacuuugaaguuuucaccaaagcaaaaagguccauauccaauaguaucc

SEQ ID NO: 558503 - RNA, 64 nt, hsa
auuauauaaugcuuaaaauacuuugucacuuuauaagcaaaaugcauaguacuuaauuuguuua

SEQ ID NO: 558504 - RNA, 64 nt, hsa
ucuacuuuuaaaacggauggccuucuuaagaauaaagcaaaaggugauuuucuacauaauuuuu

SEQ ID NO: 558505 - RNA, 64 nt, hsa
aaaaugucucuggacaaagagagucagagaagagaagcaaaaggacacuaauucaucuguaauu

SEQ ID NO: 558506 - RNA, 64 nt, hsa
gggguucuucugugauuaaauagguuauaauuauaagcaaaauucagagcaacugaguacugau

SEQ ID NO: 558507 - RNA, 64 nt, hsa
uucugaaaaaacacuccauguuauauucuggggaaagcaaaaacaaaaaaaaaaaacaaaaaaa

SEQ ID NO: 558508 - RNA, 64 nt, hsa
uugaagaaaacguauaaaucuuucuuaaccgugaaagcaaaagccuuuggguuuauuuugggau

SEQ ID NO: 558509 - RNA, 64 nt, hsa
accaaaaaagagcccaaaaagccaaagcaauccuaagcaaaaagaacaaagcuggaggcaucgc

SEQ ID NO: 558510 - RNA, 64 nt, hsa
uucaugacaaagaucccaaaaauaauuguaacgaaagcaaaaauugacaaaugggacaugauua

SEQ ID NO: 558511 - RNA, 64 nt, hsa
agcuugcugauauuuuauauaaaaaagaaaagcaaagcaaaagagaagcugauagucuugaaua

SEQ ID NO: 558512 - RNA, 64 nt, hsa
ccagcaggaaaaucauguaaguuauaccaccagaaagcaaaaggagcaugguuuggugguuaag

SEQ ID NO: 558513 - RNA, 64 nt, hsa
uaaaaaaucaaucaauggugcaaaaaaaaacuuaaagcaaaauaguauugcugaacucuuaggc

SEQ ID NO: 558514 - RNA, 64 nt, hsa
acucaaaugagaugggaugaaauccuaugacaguaagcaaaaacagaaccaugaaaaaugauug

SEQ ID NO: 558515 - RNA, 64 nt, hsa
cuaugcuggacucacagccaaauuaauacugaacaagcaaaagcuggaagcauuccccuugaga

SEQ ID NO: 558516 - RNA, 64 nt, hsa
agaaaagcccaaccuaaauagcaaaagcaauccuaagcaaaaagagcaauguuugagguaucac

SEQ ID NO: 558517 - RNA, 64 nt, hsa
ccaacucagaaaaagcaaaacaaaacaaacaaacaagcaaaaaaccacaauuagacugacagcu

SEQ ID NO: 558518 - RNA, 64 nt, hsa
gccugggcaacagagcgagacuccaacucagaaaaagcaaaacaaaacaaacaaacaagcaaaa

SEQ ID NO: 558519 - RNA, 64 nt, hsa
uuaaaaaaaagaacaaaauauaagaggaacaaagaagcaaaacaacaggaaaugugggaaaaua

SEQ ID NO: 558520 - RNA, 64 nt, hsa
ggagacccagacccuccgcugggagaccuuccaaaagcaaaaacaaaaaacaaaaaaaacaaaa

SEQ ID NO: 558521 - RNA, 64 nt, hsa
uuucguaaucuucaucaagaaguuuuuaaaaggcaagcaaaaacagaagcaaaucauaucaaac

SEQ ID NO: 558522 - RNA, 64 nt, hsa
auggaaagaaacguaaaaagcugugccaaaaaaaaagcaaaaugcugugauaaaccaaacaggg

SEQ ID NO: 558523 - RNA, 64 nt, hsa
ggcuccaucccuggcuuccccagccugcggccgcaagcaaaaccaagcgcgagaugcagcuagc

SEQ ID NO: 558524 - RNA, 64 nt, hsa
uuauaaaagccagcaggcuucaaacuaggggacaaagcaaaaagugaugauagugguggaguua

SEQ ID NO: 558525 - RNA, 64 nt, hsa
auuaauuccuuuccagguauuuuauaauucugggaagcaaaacccaugccucccccuagccauu

SEQ ID NO: 558526 - RNA, 64 nt, hsa
uuaaagaccaaaucauuuguuugcuuugaagaaaaagcaaaaacaagaacaaaaacaccaaauc

SEQ ID NO: 558527 - RNA, 64 nt, hsa
gccuggaacaaagaacugcaccuaagcagaccagaagcaaaaugucuucuucacggcauaagga

SEQ ID NO: 558528 - RNA, 64 nt, hsa
acucagaguccugcugccgcuccaggcuggaccagacccccauccccaccccuccuggucugua

SEQ ID NO: 558529 - RNA, 64 nt, hsa
ggaggggauaagguggcagaaggaaccugagcaggacccccaccugaaguagaacuuaagagag

SEQ ID NO: 558530 - RNA, 64 nt, hsa
gcaggaucgcugcucagaccugugaccccggcgggacccccauguccuccgcuccgcccggccc

SEQ ID NO: 558531 - RNA, 64 nt, hsa
ggaggagggggccgugccucccacccuucucagggacccccacgccuuuguuguuugaauggaa

SEQ ID NO: 558532 - RNA, 64 nt, hsa
cccacaggacgugugguggcgccuggcacucagggacccccagcugccgcagcccuggucucug

SEQ ID NO: 558533 - RNA, 64 nt, hsa
aggaugggcccaggccugggaucccccaccccaggacccccaggcccccuccccugcugcuuug

SEQ ID NO: 558534 - RNA, 64 nt, hsa
ucugcggaggggaaguguccugagugaaggaggggacccccauccugggggaugcugggaguga

SEQ ID NO: 558535 - RNA, 64 nt, hsa
augcccuaugaccccccaucuuuccuccgccccugacccccaccacccugcugcucggacuaug

SEQ ID NO: 558536 - RNA, 64 nt, hsa
cuccuggcugcuucagcagguggauccauucuucgacccccagaugugacucuaaagaaggcug

SEQ ID NO: 558537 - RNA, 64 nt, hsa
ggugccugcccccugccgggcagcuuuaaggacagacccccaggggcaguuuagccucaggcac

SEQ ID NO: 558538 - RNA, 64 nt, hsa
ugagcuggggguccgcaucccuaccucagcuuaggacccccagagccaagguggcugggaucug

SEQ ID NO: 558539 - RNA, 64 nt, hsa
gagccaccccccucagccccguucggcucagaccgacccccacuccauccccagaccugcagca

SEQ ID NO: 558540 - RNA, 64 nt, hsa
augggcaagugcaagguguacugggaggugggcggacccccaggcuccgccagccccuccaccc

SEQ ID NO: 558541 - RNA, 64 nt, hsa
auacggccccccagacccagcuguccgggccacagacccccagcagguagcauuccccagcccu

SEQ ID NO: 558542 - RNA, 54 nt, hsa
gcuguacgggugggcaguagagacgacccccagccccgggccccagcccgcggc

SEQ ID NO: 558543 - RNA, 64 nt, hsa
accaccuguccagcuucuuccuggucagggcugggacccccaggaauauuauguugccgugugu

SEQ ID NO: 558544 - RNA, 64 nt, hsa
ugcugcuuaccccuagccuugaugccugcccagggacccccagcccccucccguugcccugcag

SEQ ID NO: 558545 - RNA, 64 nt, hsa
agccaagucagcuuugccuuccacgcugucuccagacccccaccccuuccccacugccugccca

SEQ ID NO: 558546 - RNA, 64 nt, hsa
cuuuuggcccccgagcugggggccaugagcuccagacccccagcaacccuccuaucaccucccc

SEQ ID NO: 558547 - RNA, 64 nt, hsa
cagggcgcccccccacccccgcccgguccaccuagacccccacguuuggagauucaaaacuucu

SEQ ID NO: 558548 - RNA, 64 nt, hsa
ugccgccuuccuucacggcacuuacaaccggcgggacccccagggaccaccccucagggcgccc

SEQ ID NO: 558549 - RNA, 64 nt, hsa
cauuccucgguauuuauugucuguccccaccuaggacccccacccccgacccucgcgaauaaaa

SEQ ID NO: 558550 - RNA, 64 nt, hsa
ugaccucguccuccgacucgcugacaggcuacaggacccccaacaaccccaauccacguuuugg

SEQ ID NO: 558551 - RNA, 64 nt, hsa
agggcuucaggcccgaaggucucucuggcucuaggacccccagugcucacacaaucagaccaag

SEQ ID NO: 558552 - RNA, 64 nt, hsa
cccccagugcucacacaaucagaccaaggaacaagacccccaggaaggaaacagauuuaagcaa

SEQ ID NO: 558553 - RNA, 64 nt, hsa
ucccucucaggcagaugccgaggccaaguggacugacccccagauuuccuucccuuggaugcuu

SEQ ID NO: 558554 - RNA, 64 nt, hsa
agccaaagacuucauccggcaccuucuggagcgagacccccagaagagguucaccugccaacag

SEQ ID NO: 558555 - RNA, 64 nt, hsa
uauccccuuggcagcagagaaaacccacugaaagaucguagaguggcacaugcuuacagggcau

SEQ ID NO: 558556 - RNA, 64 nt, hsa
uagaccauagcugcagguuaaccaauuaguuacuaucguagaguaauauauauucagaauaaua

SEQ ID NO: 558557 - RNA, 64 nt, hsa
ggcaaaacacgcaagggcaucaggcacugguggcaucguagaagagauguggcaaagugcugua

SEQ ID NO: 558558 - RNA, 64 nt, hsa
guugugccuucccuucucuggucuccuugagaugaucguagacacagggaugauucccacccaa

SEQ ID NO: 558559 - RNA, 64 nt, hsa
acaaacaugugguuuuucugugugcuuucaaccaaucguagauguuuuugcuguuccauucugu

SEQ ID NO: 558560 - RNA, 64 nt, hsa
aacaaaugaaccaccguagcugacagagaaccguaucguagagguuuguaguuagugcuuauuu

SEQ ID NO: 558561 - RNA, 64 nt, hsa
uguaaaccagaauagcuuuaaaaagacaaaaaggaucguagaucugauuuuuaaaugguugguu

SEQ ID NO: 558562 - RNA, 64 nt, hsa
uacuugcauuuauacgaacauauaugagacuugaaucguagaaaauugaaugucaaaaaaagcu

SEQ ID NO: 558563 - RNA, 64 nt, hsa
uaaaauuuuggccagaacauuacaaaaguuuuaaaucguagacguaacucccccugaaauaaag

SEQ ID NO: 558564 - RNA, 64 nt, hsa
aacacuuagugaucauuuaaaaagcucacugcugaucguagaaaauuugcuuuaauuaauuaag

SEQ ID NO: 558565 - RNA, 64 nt, hsa
cauguccucacaggccugcucauuuucaguccuaaucguagaaucugaaauaaacaggaacaaa

SEQ ID NO: 558566 - RNA, 64 nt, hsa
cccaugagcauuugacuucccuuacucuuugaugaucguagagaaagacuugguaauuuaucua

SEQ ID NO: 558567 - RNA, 64 nt, hsa
cugggaagagcccacucagcuuaauugcucugccaucguagagccugguuggacuuggcuuccu

SEQ ID NO: 558568 - RNA, 64 nt, hsa
aaguguagcuccucuggagauggagagcucuuucaucguagaacugaaggaguuucucacauuu

SEQ ID NO: 558569 - RNA, 64 nt, hsa
cucuguaaaucugcaauuucuaccaaaaugugugaucguagaucucaaaggaucuugcuuuaac

SEQ ID NO: 558570 - RNA, 64 nt, hsa
gcagaucuguggaagaacaauccagggcugagaaaucguagagcagugaggcaggcugggagca

SEQ ID NO: 558571 - RNA, 64 nt, hsa
aaggaaguggagaguaaagacagcgccuggagcgaucguagaaacacagaaugggacuggggaa

SEQ ID NO: 558572 - RNA, 64 nt, hsa
uggucaaagucgaauuacuaucuauuuaucuuauaucguagaucugauaacccuaucuaaaaga

SEQ ID NO: 558573 - RNA, 64 nt, hsa
aauuuguauaauaaagcuuucagguguuacagaaaucguagacaagcaagugcacaugauaaac

SEQ ID NO: 558574 - RNA, 64 nt, hsa
cccagggucgugagguuucuggugaaaagguuaaaucguagaagcuaguauauuuuuuauauuu

SEQ ID NO: 558575 - RNA, 64 nt, hsa
gccacguggguggcccgaccucugaccugcugucaucguagagguagaaagcaaacaaucuggg

SEQ ID NO: 558576 - RNA, 64 nt, hsa
guucuuucucuugcagcugucggaggaaggggagaucguagauuugcugcugaugaaaauacuc

SEQ ID NO: 558577 - RNA, 64 nt, hsa
augagauuuuauuuuuugugagugagacugagggaucguagauuuuuacaaucuguaucuuuga

SEQ ID NO: 558578 - RNA, 64 nt, hsa
gaggucgacuauuuuagguuccaaauauagugagaucguagaguguuugucucucuguaccugg

SEQ ID NO: 558579 - RNA, 64 nt, hsa
ggauauuaacauaaaauuauauuaauaaguagauaucguagaaauaguguuguuaccugccaag

SEQ ID NO: 558580 - RNA, 64 nt, hsa; identical to SEQ ID NO: 80199

SEQ ID NO: 558581 - RNA, 64 nt, hsa; identical to SEQ ID NO: 80200

SEQ ID NO: 558582 - RNA, 64 nt, hsa; identical to SEQ ID NO: 80201

SEQ ID NO: 558583 - RNA, 64 nt, hsa; identical to SEQ ID NO: 80202

SEQ ID NO: 558584 - RNA, 64 nt, hsa; identical to SEQ ID NO: 80203

SEQ ID NO: 558585 - RNA, 64 nt, hsa; identical to SEQ ID NO: 80204

SEQ ID NO: 558586 - RNA, 64 nt, hsa; identical to SEQ ID NO: 80205

SEQ ID NO: 558587 - RNA, 64 nt, hsa; identical to SEQ ID NO: 80206

SEQ ID NO: 558588 - RNA, 64 nt, hsa; identical to SEQ ID NO: 80207

SEQ ID NO: 558589 - RNA, 64 nt, hsa; identical to SEQ ID NO: 80208

SEQ ID NO: 558590 - RNA, 64 nt, hsa; identical to SEQ ID NO: 80209

SEQ ID NO: 558591 - RNA, 64 nt, hsa; identical to SEQ ID NO: 80210

SEQ ID NO: 558592 - RNA, 64 nt, hsa; identical to SEQ ID NO: 80211

SEQ ID NO: 558593 - RNA, 64 nt, hsa; identical to SEQ ID NO: 80212

SEQ ID NO: 558594 - RNA, 64 nt, hsa; identical to SEQ ID NO: 80213

SEQ ID NO: 558595 - RNA, 64 nt, hsa; identical to SEQ ID NO: 80214

SEQ ID NO: 558596 - RNA, 64 nt, hsa; identical to SEQ ID NO: 80215

SEQ ID NO: 558597 - RNA, 64 nt, hsa; identical to SEQ ID NO: 80216

SEQ ID NO: 558598 - RNA, 64 nt, hsa; identical to SEQ ID NO: 80217

SEQ ID NO: 558599 - RNA, 64 nt, hsa; identical to SEQ ID NO: 80218

SEQ ID NO: 558600 - RNA, 64 nt, hsa; identical to SEQ ID NO: 80219

SEQ ID NO: 558601 - RNA, 64 nt, hsa; identical to SEQ ID NO: 80220

SEQ ID NO: 558602 - RNA, 64 nt, hsa; identical to SEQ ID NO: 80221

SEQ ID NO: 558603 - RNA, 64 nt, hsa; identical to SEQ ID NO: 80222

SEQ ID NO: 558604 - RNA, 64 nt, hsa; identical to SEQ ID NO: 80223

SEQ ID NO: 558605 - RNA, 64 nt, hsa; identical to SEQ ID NO: 80224

SEQ ID NO: 558606 - RNA, 64 nt, hsa; identical to SEQ ID NO: 80225

SEQ ID NO: 558607 - RNA, 64 nt, hsa; identical to SEQ ID NO: 80226

SEQ ID NO: 558608 - RNA, 64 nt, hsa; identical to SEQ ID NO: 80227

SEQ ID NO: 558609 - RNA, 64 nt, hsa; identical to SEQ ID NO: 80228

SEQ ID NO: 558610 - RNA, 64 nt, hsa; identical to SEQ ID NO: 80229

SEQ ID NO: 558611 - RNA, 64 nt, hsa; identical to SEQ ID NO: 80230

SEQ ID NO: 558612 - RNA, 64 nt, hsa; identical to SEQ ID NO: 80231

SEQ ID NO: 558613 - RNA, 52 nt, hsa; identical to SEQ ID NO: 80232

SEQ ID NO: 558614 - RNA, 64 nt, hsa; identical to SEQ ID NO: 80233

SEQ ID NO: 558615 - RNA, 64 nt, hsa; identical to SEQ ID NO: 80234

SEQ ID NO: 558616 - RNA, 64 nt, hsa; identical to SEQ ID NO: 80235

SEQ ID NO: 558617 - RNA, 64 nt, hsa; identical to SEQ ID NO: 80236

SEQ ID NO: 558618 - RNA, 64 nt, hsa; identical to SEQ ID NO: 80237

SEQ ID NO: 558619 - RNA, 64 nt, hsa; identical to SEQ ID NO: 80238

SEQ ID NO: 558620 - RNA, 64 nt, hsa; identical to SEQ ID NO: 80239

SEQ ID NO: 558621 - RNA, 64 nt, hsa; identical to SEQ ID NO: 80240

SEQ ID NO: 558622 - RNA, 64 nt, hsa; identical to SEQ ID NO: 80241

SEQ ID NO: 558623 - RNA, 64 nt, hsa; identical to SEQ ID NO: 80242

SEQ ID NO: 558624 - RNA, 64 nt, hsa; identical to SEQ ID NO: 80243

SEQ ID NO: 558625 - RNA, 64 nt, hsa; identical to SEQ ID NO: 80244

SEQ ID NO: 558626 - RNA, 64 nt, hsa; identical to SEQ ID NO: 80245

SEQ ID NO: 558627 - RNA, 64 nt, hsa; identical to SEQ ID NO: 80246

SEQ ID NO: 558628 - RNA, 64 nt, hsa; identical to SEQ ID NO: 80247

SEQ ID NO: 558629 - RNA, 64 nt, hsa; identical to SEQ ID NO: 80248

SEQ ID NO: 558630 - RNA, 64 nt, hsa; identical to SEQ ID NO: 80249

SEQ ID NO: 558631 - RNA, 64 nt, hsa; identical to SEQ ID NO: 80250

SEQ ID NO: 558632 - RNA, 64 nt, hsa; identical to SEQ ID NO: 80251

SEQ ID NO: 558633 - RNA, 64 nt, hsa; identical to SEQ ID NO: 80252

SEQ ID NO: 558634 - RNA, 64 nt, hsa; identical to SEQ ID NO: 80253

SEQ ID NO: 558635 - RNA, 64 nt, hsa; identical to SEQ ID NO: 80254

SEQ ID NO: 558636 - RNA, 64 nt, hsa; identical to SEQ ID NO: 80255

SEQ ID NO: 558637 - RNA, 64 nt, hsa; identical to SEQ ID NO: 80256

SEQ ID NO: 558638 - RNA, 64 nt, hsa; identical to SEQ ID NO: 80257

SEQ ID NO: 558639 - RNA, 64 nt, hsa; identical to SEQ ID NO: 80258

SEQ ID NO: 558640 - RNA, 64 nt, hsa; identical to SEQ ID NO: 80259

SEQ ID NO: 558641 - RNA, 64 nt, hsa; identical to SEQ ID NO: 80260

SEQ ID NO: 558642 - RNA, 64 nt, hsa; identical to SEQ ID NO: 80261

SEQ ID NO: 558643 - RNA, 64 nt, hsa; identical to SEQ ID NO: 80262

SEQ ID NO: 558644 - RNA, 64 nt, hsa; identical to SEQ ID NO: 80263

SEQ ID NO: 558645 - RNA, 64 nt, hsa; identical to SEQ ID NO: 80264

SEQ ID NO: 558646 - RNA, 64 nt, hsa; identical to SEQ ID NO: 80265

SEQ ID NO: 558647 - RNA, 64 nt, hsa; identical to SEQ ID NO: 80266

SEQ ID NO: 558648 - RNA, 64 nt, hsa; identical to SEQ ID NO: 80267

SEQ ID NO: 558649 - RNA, 64 nt, hsa; identical to SEQ ID NO: 80268

SEQ ID NO: 558650 - RNA, 64 nt, hsa; identical to SEQ ID NO: 80269

SEQ ID NO: 558651 - RNA, 64 nt, hsa; identical to SEQ ID NO: 80270

SEQ ID NO: 558652 - RNA, 64 nt, hsa; identical to SEQ ID NO: 80271

SEQ ID NO: 558653 - RNA, 64 nt, hsa; identical to SEQ ID NO: 80272

SEQ ID NO: 558654 - RNA, 64 nt, hsa; identical to SEQ ID NO: 80273

SEQ ID NO: 558655 - RNA, 64 nt, hsa; identical to SEQ ID NO: 80274

SEQ ID NO: 558656 - RNA, 64 nt, hsa; identical to SEQ ID NO: 80275

SEQ ID NO: 558657 - RNA, 64 nt, hsa; identical to SEQ ID NO: 80276

SEQ ID NO: 558658 - RNA, 64 nt, hsa; identical to SEQ ID NO: 80277

SEQ ID NO: 558659 - RNA, 64 nt, hsa; identical to SEQ ID NO: 80278

SEQ ID NO: 558660 - RNA, 64 nt, hsa; identical to SEQ ID NO: 80279

SEQ ID NO: 558661 - RNA, 64 nt, hsa; identical to SEQ ID NO: 80280

SEQ ID NO: 558662 - RNA, 64 nt, hsa; identical to SEQ ID NO: 80281

SEQ ID NO: 558663 - RNA, 64 nt, hsa; identical to SEQ ID NO: 80282

SEQ ID NO: 558664 - RNA, 64 nt, hsa; identical to SEQ ID NO: 80283

SEQ ID NO: 558665 - RNA, 64 nt, hsa; identical to SEQ ID NO: 80284

SEQ ID NO: 558666 - RNA, 64 nt, hsa; identical to SEQ ID NO: 80285

SEQ ID NO: 558667 - RNA, 64 nt, hsa; identical to SEQ ID NO: 80286

SEQ ID NO: 558668 - RNA, 64 nt, hsa; identical to SEQ ID NO: 80287

SEQ ID NO: 558669 - RNA, 64 nt, hsa; identical to SEQ ID NO: 80288

SEQ ID NO: 558670 - RNA, 64 nt, hsa; identical to SEQ ID NO: 80289

SEQ ID NO: 558671 - RNA, 64 nt, hsa; identical to SEQ ID NO: 80290

SEQ ID NO: 558672 - RNA, 64 nt, hsa; identical to SEQ ID NO: 80291

SEQ ID NO: 558673 - RNA, 64 nt, hsa; identical to SEQ ID NO: 80292

SEQ ID NO: 558674 - RNA, 64 nt, hsa; identical to SEQ ID NO: 80293

SEQ ID NO: 558675 - RNA, 64 nt, hsa; identical to SEQ ID NO: 80294

SEQ ID NO: 558676 - RNA, 64 nt, hsa; identical to SEQ ID NO: 80295

SEQ ID NO: 558677 - RNA, 64 nt, hsa; identical to SEQ ID NO: 80296

SEQ ID NO: 558678 - RNA, 64 nt, hsa; identical to SEQ ID NO: 80297

SEQ ID NO: 558679 - RNA, 64 nt, hsa; identical to SEQ ID NO: 80298

SEQ ID NO: 558680 - RNA, 64 nt, hsa; identical to SEQ ID NO: 80299

SEQ ID NO: 558681 - RNA, 64 nt, hsa; identical to SEQ ID NO: 80300

SEQ ID NO: 558682 - RNA, 64 nt, hsa; identical to SEQ ID NO: 80301

SEQ ID NO: 558683 - RNA, 64 nt, hsa; identical to SEQ ID NO: 80302

SEQ ID NO: 558684 - RNA, 64 nt, hsa; identical to SEQ ID NO: 80303

SEQ ID NO: 558685 - RNA, 64 nt, hsa; identical to SEQ ID NO: 80304

SEQ ID NO: 558686 - RNA, 64 nt, hsa; identical to SEQ ID NO: 80305

SEQ ID NO: 558687 - RNA, 64 nt, hsa; identical to SEQ ID NO: 80306

SEQ ID NO: 558688 - RNA, 64 nt, hsa; identical to SEQ ID NO: 80307

SEQ ID NO: 558689 - RNA, 64 nt, hsa; identical to SEQ ID NO: 80308

SEQ ID NO: 558690 - RNA, 64 nt, hsa; identical to SEQ ID NO: 80309

SEQ ID NO: 558691 - RNA, 64 nt, hsa; identical to SEQ ID NO: 80310

SEQ ID NO: 558692 - RNA, 64 nt, hsa; identical to SEQ ID NO: 80311

SEQ ID NO: 558693 - RNA, 64 nt, hsa; identical to SEQ ID NO: 80312

SEQ ID NO: 558694 - RNA, 64 nt, hsa; identical to SEQ ID NO: 80313

SEQ ID NO: 558695 - RNA, 64 nt, hsa; identical to SEQ ID NO: 80314

SEQ ID NO: 558696 - RNA, 64 nt, hsa; identical to SEQ ID NO: 80315

SEQ ID NO: 558697 - RNA, 64 nt, hsa; identical to SEQ ID NO: 80316

SEQ ID NO: 558698 - RNA, 64 nt, hsa; identical to SEQ ID NO: 80317

SEQ ID NO: 558699 - RNA, 64 nt, hsa; identical to SEQ ID NO: 80318

SEQ ID NO: 558700 - RNA, 64 nt, hsa; identical to SEQ ID NO: 80319

SEQ ID NO: 558701 - RNA, 64 nt, hsa; identical to SEQ ID NO: 80320

SEQ ID NO: 558702 - RNA, 64 nt, hsa; identical to SEQ ID NO: 80321

SEQ ID NO: 558703 - RNA, 64 nt, hsa; identical to SEQ ID NO: 80322

SEQ ID NO: 558704 - RNA, 64 nt, hsa; identical to SEQ ID NO: 80323

SEQ ID NO: 558705 - RNA, 64 nt, hsa; identical to SEQ ID NO: 80324

SEQ ID NO: 558706 - RNA, 51 nt, hsa; identical to SEQ ID NO: 80325

SEQ ID NO: 558707 - RNA, 64 nt, hsa; identical to SEQ ID NO: 80326

SEQ ID NO: 558708 - RNA, 64 nt, hsa; identical to SEQ ID NO: 80327

SEQ ID NO: 558709 - RNA, 64 nt, hsa; identical to SEQ ID NO: 80328

SEQ ID NO: 558710 - RNA, 64 nt, hsa; identical to SEQ ID NO: 80329

SEQ ID NO: 558711 - RNA, 64 nt, hsa; identical to SEQ ID NO: 80330

SEQ ID NO: 558712 - RNA, 62 nt, hsa; identical to SEQ ID NO: 80331

SEQ ID NO: 558713 - RNA, 64 nt, hsa; identical to SEQ ID NO: 80332

SEQ ID NO: 558714 - RNA, 64 nt, hsa; identical to SEQ ID NO: 80333

SEQ ID NO: 558715 - RNA, 64 nt, hsa; identical to SEQ ID NO: 80334

SEQ ID NO: 558716 - RNA, 54 nt, hsa; identical to SEQ ID NO: 80335

SEQ ID NO: 558717 - RNA, 64 nt, hsa; identical to SEQ ID NO: 80336

SEQ ID NO: 558718 - RNA, 64 nt, hsa; identical to SEQ ID NO: 80337

SEQ ID NO: 558719 - RNA, 64 nt, hsa; identical to SEQ ID NO: 80338

SEQ ID NO: 558720 - RNA, 64 nt, hsa; identical to SEQ ID NO: 80339

SEQ ID NO: 558721 - RNA, 64 nt, hsa; identical to SEQ ID NO: 80340

SEQ ID NO: 558722 - RNA, 64 nt, hsa; identical to SEQ ID NO: 80341

SEQ ID NO: 558723 - RNA, 64 nt, hsa; identical to SEQ ID NO: 80342

SEQ ID NO: 558724 - RNA, 64 nt, hsa; identical to SEQ ID NO: 80343

SEQ ID NO: 558725 - RNA, 64 nt, hsa; identical to SEQ ID NO: 80344

SEQ ID NO: 558726 - RNA, 64 nt, hsa; identical to SEQ ID NO: 80345

SEQ ID NO: 558727 - RNA, 64 nt, hsa; identical to SEQ ID NO: 80346

SEQ ID NO: 558728 - RNA, 64 nt, hsa; identical to SEQ ID NO: 80347

SEQ ID NO: 558729 - RNA, 64 nt, hsa; identical to SEQ ID NO: 80348

SEQ ID NO: 558730 - RNA, 64 nt, hsa; identical to SEQ ID NO: 80349

SEQ ID NO: 558731 - RNA, 64 nt, hsa; identical to SEQ ID NO: 80350

SEQ ID NO: 558732 - RNA, 64 nt, hsa; identical to SEQ ID NO: 80351

SEQ ID NO: 558733 - RNA, 59 nt, hsa; identical to SEQ ID NO: 80352

SEQ ID NO: 558734 - RNA, 64 nt, hsa; identical to SEQ ID NO: 80353

SEQ ID NO: 558735 - RNA, 64 nt, hsa; identical to SEQ ID NO: 80354

SEQ ID NO: 558736 - RNA, 64 nt, hsa; identical to SEQ ID NO: 80355

SEQ ID NO: 558737 - RNA, 64 nt, hsa; identical to SEQ ID NO: 80356

SEQ ID NO: 558738 - RNA, 64 nt, hsa; identical to SEQ ID NO: 80357

SEQ ID NO: 558739 - RNA, 64 nt, hsa; identical to SEQ ID NO: 80358

SEQ ID NO: 558740 - RNA, 64 nt, hsa; identical to SEQ ID NO: 80359

SEQ ID NO: 558741 - RNA, 64 nt, hsa; identical to SEQ ID NO: 80360

SEQ ID NO: 558742 - RNA, 64 nt, hsa; identical to SEQ ID NO: 80361

SEQ ID NO: 558743 - RNA, 64 nt, hsa; identical to SEQ ID NO: 80362

SEQ ID NO: 558744 - RNA, 64 nt, hsa; identical to SEQ ID NO: 80363

SEQ ID NO: 558745 - RNA, 64 nt, hsa; identical to SEQ ID NO: 80364

SEQ ID NO: 558746 - RNA, 64 nt, hsa; identical to SEQ ID NO: 80365

SEQ ID NO: 558747 - RNA, 64 nt, hsa; identical to SEQ ID NO: 80366

SEQ ID NO: 558748 - RNA, 64 nt, hsa; identical to SEQ ID NO: 80367

SEQ ID NO: 558749 - RNA, 64 nt, hsa; identical to SEQ ID NO: 80368

SEQ ID NO: 558750 - RNA, 64 nt, hsa; identical to SEQ ID NO: 80369

SEQ ID NO: 558751 - RNA, 64 nt, hsa; identical to SEQ ID NO: 80370

SEQ ID NO: 558752 - RNA, 64 nt, hsa; identical to SEQ ID NO: 80371

SEQ ID NO: 558753 - RNA, 64 nt, hsa; identical to SEQ ID NO: 80372

SEQ ID NO: 558754 - RNA, 64 nt, hsa; identical to SEQ ID NO: 80373

SEQ ID NO: 558755 - RNA, 64 nt, hsa; identical to SEQ ID NO: 80374

SEQ ID NO: 558756 - RNA, 64 nt, hsa; identical to SEQ ID NO: 80375

SEQ ID NO: 558757 - RNA, 64 nt, hsa; identical to SEQ ID NO: 80376

SEQ ID NO: 558758 - RNA, 64 nt, hsa; identical to SEQ ID NO: 80377

SEQ ID NO: 558759 - RNA, 64 nt, hsa; identical to SEQ ID NO: 80378

SEQ ID NO: 558760 - RNA, 64 nt, hsa; identical to SEQ ID NO: 80379

SEQ ID NO: 558761 - RNA, 64 nt, hsa; identical to SEQ ID NO: 80380

SEQ ID NO: 558762 - RNA, 64 nt, hsa; identical to SEQ ID NO: 80381

SEQ ID NO: 558763 - RNA, 64 nt, hsa; identical to SEQ ID NO: 80382

SEQ ID NO: 558764 - RNA, 64 nt, hsa; identical to SEQ ID NO: 80383

SEQ ID NO: 558765 - RNA, 64 nt, hsa; identical to SEQ ID NO: 80384

SEQ ID NO: 558766 - RNA, 64 nt, hsa; identical to SEQ ID NO: 80385

SEQ ID NO: 558767 - RNA, 64 nt, hsa; identical to SEQ ID NO: 80386

SEQ ID NO: 558768 - RNA, 64 nt, hsa; identical to SEQ ID NO: 80387

SEQ ID NO: 558769 - RNA, 64 nt, hsa; identical to SEQ ID NO: 80388

SEQ ID NO: 558770 - RNA, 64 nt, hsa; identical to SEQ ID NO: 80389

SEQ ID NO: 558771 - RNA, 64 nt, hsa; identical to SEQ ID NO: 80390

SEQ ID NO: 558772 - RNA, 64 nt, hsa; identical to SEQ ID NO: 80391

SEQ ID NO: 558773 - RNA, 53 nt, hsa; identical to SEQ ID NO: 80392

SEQ ID NO: 558774 - RNA, 64 nt, hsa; identical to SEQ ID NO: 80393

SEQ ID NO: 558775 - RNA, 64 nt, hsa; identical to SEQ ID NO: 80394

SEQ ID NO: 558776 - RNA, 64 nt, hsa; identical to SEQ ID NO: 80395

SEQ ID NO: 558777 - RNA, 64 nt, hsa; identical to SEQ ID NO: 80396

SEQ ID NO: 558778 - RNA, 64 nt, hsa; identical to SEQ ID NO: 80397

SEQ ID NO: 558779 - RNA, 64 nt, hsa; identical to SEQ ID NO: 80398

SEQ ID NO: 558780 - RNA, 64 nt, hsa; identical to SEQ ID NO: 80399

SEQ ID NO: 558781 - RNA, 64 nt, hsa; identical to SEQ ID NO: 80400

SEQ ID NO: 558782 - RNA, 64 nt, hsa; identical to SEQ ID NO: 80401

SEQ ID NO: 558783 - RNA, 64 nt, hsa; identical to SEQ ID NO: 80402

SEQ ID NO: 558784 - RNA, 64 nt, hsa; identical to SEQ ID NO: 80403

SEQ ID NO: 558785 - RNA, 64 nt, hsa; identical to SEQ ID NO: 80404

SEQ ID NO: 558786 - RNA, 64 nt, hsa; identical to SEQ ID NO: 80405

SEQ ID NO: 558787 - RNA, 64 nt, hsa; identical to SEQ ID NO: 80406

SEQ ID NO: 558788 - RNA, 64 nt, hsa; identical to SEQ ID NO: 80407

SEQ ID NO: 558789 - RNA, 64 nt, hsa; identical to SEQ ID NO: 80408

SEQ ID NO: 558790 - RNA, 64 nt, hsa; identical to SEQ ID NO: 80409

SEQ ID NO: 558791 - RNA, 64 nt, hsa; identical to SEQ ID NO: 80410

SEQ ID NO: 558792 - RNA, 64 nt, hsa; identical to SEQ ID NO: 80411

SEQ ID NO: 558793 - RNA, 64 nt, hsa; identical to SEQ ID NO: 80412

SEQ ID NO: 558794 - RNA, 64 nt, hsa; identical to SEQ ID NO: 80413

SEQ ID NO: 558795 - RNA, 64 nt, hsa; identical to SEQ ID NO: 80414

SEQ ID NO: 558796 - RNA, 64 nt, hsa; identical to SEQ ID NO: 80415

SEQ ID NO: 558797 - RNA, 64 nt, hsa; identical to SEQ ID NO: 80416

SEQ ID NO: 558798 - RNA, 64 nt, hsa; identical to SEQ ID NO: 80417

SEQ ID NO: 558799 - RNA, 64 nt, hsa; identical to SEQ ID NO: 80418

SEQ ID NO: 558800 - RNA, 64 nt, hsa; identical to SEQ ID NO: 44393

SEQ ID NO: 558801 - RNA, 64 nt, hsa; identical to SEQ ID NO: 44394

SEQ ID NO: 558802 - RNA, 64 nt, hsa; identical to SEQ ID NO: 44395

SEQ ID NO: 558803 - RNA, 64 nt, hsa; identical to SEQ ID NO: 44396

SEQ ID NO: 558804 - RNA, 64 nt, hsa; identical to SEQ ID NO: 44397

SEQ ID NO: 558805 - RNA, 64 nt, hsa; identical to SEQ ID NO: 44398

SEQ ID NO: 558806 - RNA, 64 nt, hsa
caccgaccuggccuucaagcaggcccgggacggcugcccggagcccucggcugccaugcuguga

SEQ ID NO: 558807 - RNA, 64 nt, hsa
guggcauguccuccgaguggcagcggacaugguaugcccggaugcccccgcgagccccagcgcc

SEQ ID NO: 558808 - RNA, 63 nt, hsa
ggaaaaaaggcagaguaacauuacuuaaaaaaaaaaggauauguuuacauuuaauuuuggcua

SEQ ID NO: 558809 - RNA, 63 nt, hsa
gaggaggaaaagugaaucacggagagagaaaggaaaggauagaaucacaggcugcgucugcac

SEQ ID NO: 558810 - RNA, 63 nt, hsa
uuugcuaaaaagaaccauauuauuuugauucucaaaggauaggccuuugaguguuagagaaag

SEQ ID NO: 558811 - RNA, 63 nt, hsa
uuguuuuccuguaaaugcagauaguuaaaaucuaaaggauagaaugcuuuccuaaaacagaac

SEQ ID NO: 558812 - RNA, 63 nt, hsa
auuacuuuuaaguguauuaugaaggcaguuuucaaaggauaugaccaguugggguaauucaaa

SEQ ID NO: 558813 - RNA, 63 nt, hsa
ugcaccaguuucuggaggcccuugucauuucaaaaaggauagucucuuuucuuacucuggcaa

SEQ ID NO: 558814 - RNA, 63 nt, hsa
uaaugagacaauuuuccuaccaaaggaagaacaaaaggauaaauauaauacaaaauauaugua

SEQ ID NO: 558815 - RNA, 63 nt, hsa
ugaccuccuugccucuugucuugaaccauagcaaaaggauacugcaucucucauuacuguagu

SEQ ID NO: 558816 - RNA, 63 nt, hsa
aguucuugcacucuuuguacagaauugguauaaaaaggauaauuccacacugaucuuguccca

SEQ ID NO: 558817 - RNA, 63 nt, hsa
ugugugaacuacaguauauaaugauaacaauuaaaaggauauucuguggaugucacguauuuu

SEQ ID NO: 558818 - RNA, 63 nt, hsa
cacuuuacuacaguuacuuuugcaaacagacagaaaggauacacuucuaaccacauuuuacuu

SEQ ID NO: 558819 - RNA, 63 nt, hsa
gaagagaguuuuaaaaaacaaaacaauguaaguaaaggauauuucugaaucuuaaaauucauc

SEQ ID NO: 558820 - RNA, 63 nt, hsa
auaaacucauaaaaauaauuuuaagaugucggaaaaggauacuuugauuaaauaaaaacacuc

SEQ ID NO: 558821 - RNA, 63 nt, hsa
aucauaaagaaaaacuaaaaaugaaccaaagugaaaggauaacuuccaggcaguaucuuucua

SEQ ID NO: 558822 - RNA, 63 nt, hsa
uaccacuuaagauaggagucuaaacuccacagaaaaggauaauaccaagagcuuguauuguua

SEQ ID NO: 558823 - RNA, 63 nt, hsa
gaaucuggaccccagagucuggaagcaggccagaaaggauaaggcaaaugacugaacaguucc

SEQ ID NO: 558824 - RNA, 63 nt, hsa
cguguacucacagagggagagaaagauguguacaaaggauauguauaaauauucuauuuaguc

SEQ ID NO: 558825 - RNA, 63 nt, hsa
aucaauuucuggauucauaauagcaagauuagcaaaggauaaaugccgaaggucacuucauuc

SEQ ID NO: 558826 - RNA, 63 nt, hsa
gguuuacaugcacugucucauuuaaucugagauaaaggauacuuaagcccaaacuauaucuaa

SEQ ID NO: 558827 - RNA, 63 nt, hsa
ugaacauuaagcagauuggcucagacacaaugaaaaggauaauccaauguacgugcuggugca

SEQ ID NO: 558828 - RNA, 63 nt, hsa
uaaaguucucuccuuccugccuccccuaaagaaaaaggauauuagauugcacacuauaauuuu

SEQ ID NO: 558829 - RNA, 63 nt, hsa
aaaugaaucuaaucaaaaugugaauaguagucaaaaggauaauuuaauaagcauuuuacguua

SEQ ID NO: 558830 - RNA, 63 nt, hsa
uuuuuuuuuuuuuuaugaugauuaagaaaauggaaaggauauggaugaauuguguaaacuuag

SEQ ID NO: 558831 - RNA, 63 nt, hsa
auugauguauguauguucauucaaagaaugggaaaaggauaugacauauauuugccaguacuu

SEQ ID NO: 558832 - RNA, 63 nt, hsa
ggugaggcccagcuaguaaucccuuuuagugggaaaggauauguucuaggagaaacaagcaau

SEQ ID NO: 558833 - RNA, 63 nt, hsa
gacacugucuuaugaagguuugcuugggaugaaaaaggauauugcagcuucagcaguguugaa

SEQ ID NO: 558834 - RNA, 63 nt, hsa
uugccucgcugauguugcaugggcagacuucaaaaaggauaguuagaaagguuuggguugaug

SEQ ID NO: 558835 - RNA, 63 nt, hsa
acacgccacugcccccgaggccagaguguaaguaaaggauaaccaggacucgcugggagagau

SEQ ID NO: 558836 - RNA, 63 nt, hsa
cuuuuuaaaaaaugauguuugaagugaaaaaaaaaaggauauucagggucaaaucauguacau

SEQ ID NO: 558837 - RNA, 63 nt, hsa
ccucccccagcuaucuauauggaauugcuuaccaaaggauagugcgauguuucaggaggcugg

SEQ ID NO: 558838 - RNA, 63 nt, hsa
aauuuuuuuauguuuuguuucugaaaauuccagaaaggauauuuaagaaaauacaauaaacua

SEQ ID NO: 558839 - RNA, 63 nt, hsa
ucccccaaagaguugaaaucuuaaaucuauuuaaaaggauauaaaagcuuuggauauguauuu

SEQ ID NO: 558840 - RNA, 63 nt, hsa
gaguuucucuuggguauaaaggcuaaaagggaaaaaggauauguggagaaucaucaagauaug

SEQ ID NO: 558841 - RNA, 63 nt, hsa
caaguaacagcuucagaauucaucaggaccaagaaaggauaaggauauuuggcucaccucguu

SEQ ID NO: 558842 - RNA, 63 nt, hsa
auaguuuauuguagugauguuuuuauaaaagcaaaaggauauucacuuucagcgcuuauacug

SEQ ID NO: 558843 - RNA, 63 nt, hsa
cucaggaucaagaaaguguuggcuaaugaagggaaaggauauuuucuuccaagcaaaggugaa

SEQ ID NO: 558844 - RNA, 63 nt, hsa
ggcccuuuuucaauaacuggaacacucuauaacaaaggauacuuauuuaaauagaugacauug

SEQ ID NO: 558845 - RNA, 63 nt, hsa
acuaucaauuuuaaggaaacuuuuuaauugugcaaaggauaaauuuuuugaccuauuuuaggg

SEQ ID NO: 558846 - RNA, 63 nt, hsa
uuccuuucuuuucauaaugaagcagaucaacuuaaaggauaauaaaauuuuuaaagaaaagau

SEQ ID NO: 558847 - RNA, 63 nt, hsa
gagagaaguaauggcaaggccuuuacuuucaggaaaggauagaaguauagauuaaugacugga

SEQ ID NO: 558848 - RNA, 63 nt, hsa
ucuaagaauccuucaggcauucuuuaaggagaaaaaggauaccuuugauuuuguguguuucau

SEQ ID NO: 558849 - RNA, 63 nt, hsa
ugccagcagugcagagccugguugucacccauuaaaggauaggucuccccggagugcacagcu

SEQ ID NO: 558850 - RNA, 63 nt, hsa
aaauugccaaagcccaaauuaacgaguauuauaaaaggauaauaaagcaucccugaagccaaa

SEQ ID NO: 558851 - RNA, 63 nt, hsa
guuuugcauaauuauaaucggcauuguacauagaaaggauauggcuaccuuuuguuaaaucug

SEQ ID NO: 558852 - RNA, 63 nt, hsa
cgggaguagcaguaguccaaaccuaguauagggaaaggauaaaaauaagucaccuucaccaag

SEQ ID NO: 558853 - RNA, 63 nt, hsa
uccucgaaacuaguguguguuuauuaaaaggagaaaggauaacaauagaauguucuaaaacca

SEQ ID NO: 558854 - RNA, 63 nt, hsa
gcccacaugaagagagggaaccuguuaguccagaaaggauacggauagauagccugucugacu

SEQ ID NO: 558855 - RNA, 63 nt, hsa
aauuguauuugagggaaaaaaccaugaccaaguaaaggauaaauucaaaaaauagccucauga

SEQ ID NO: 558856 - RNA, 63 nt, hsa
gcuaacgagggauuacuuuggccaaaaccuuucaaaggauaugcagaaagaugguagggagca

SEQ ID NO: 558857 - RNA, 63 nt, hsa
aaugacugaauuuacuacaaaggcaaacuuucaaaaggauaucucauuuuuguuucuaaauau

SEQ ID NO: 558858 - RNA, 63 nt, hsa
caaaaaaaaguuucugaagguaaaagauauacuaaaggauauacauauacugccucuucuaug

SEQ ID NO: 558859 - RNA, 63 nt, hsa
ggacuccuugugcucccagcagcucagacagggaaaggauaguccccacucacggugacacca

SEQ ID NO: 558860 - RNA, 63 nt, hsa
aaacacuagagguuuaauaagacuuaucagaugaaaggauauuuauauagccuuuuaguagca

SEQ ID NO: 558861 - RNA, 63 nt, hsa
auaaaagcaaccucucuauaaaucauauaauguaaaggauaucaagguucuccauagguucuu

SEQ ID NO: 558862 - RNA, 63 nt, hsa
uuuuuuuuuuaaacucugagcuauuuuaucaauaaaggauauuuuguaauaaguaaguggugu

SEQ ID NO: 558863 - RNA, 63 nt, hsa
gagugcgauuuauuuaaguuguauauaaaaauaaaaggauagcauuuuuauacaaauaucuuu

SEQ ID NO: 558864 - RNA, 63 nt, hsa
acaguaaggcaaaggccaagcuuucaaaagaguaaaggauacuuucacaauuucccuucauau

SEQ ID NO: 558865 - RNA, 63 nt, hsa
auuguaauucauagggcuuuuguuuauucauauaaaggauaaauauuuggguguuuugagcuu

SEQ ID NO: 558866 - RNA, 63 nt, hsa
ucuuuacuauguccuagcucuguccugcuaccuaaaggauauaaagaaauacuauugcucuag

SEQ ID NO: 558867 - RNA, 63 nt, hsa
cccauuuuaaugugcauucugaugagcacugacaaaggauaugguacuaaaaauaaaauguga

SEQ ID NO: 558868 - RNA, 63 nt, hsa
gacccaaaguuacuauagucaaccaagucuuucaaaggauaaaagaucauuuuauuaucuuua

SEQ ID NO: 558869 - RNA, 63 nt, hsa
augccugucuuuaaaguguuauuuuauuaauuaaaaggauauggcuauuauuauauauucucu

SEQ ID NO: 558870 - RNA, 63 nt, hsa
ggacuaggggagugguggggaggugaguggaccaaaggauauaggccccaggcaugcagaugg

SEQ ID NO: 558871 - RNA, 63 nt, hsa
aggauaaaggaacugagaccagaugagaaaaagaaaggauauagauuccuugaguggaauagu

SEQ ID NO: 558872 - RNA, 63 nt, hsa
aagacuuuuccugcaauagccugggaaggaauaaaaggauagaguguuuggguuuuuguguaa

SEQ ID NO: 558873 - RNA, 63 nt, hsa
uauauucacaguuuuuuaaaaaugugucaaaauaaaggauaacucuguauuacagcuuucaca

SEQ ID NO: 558874 - RNA, 63 nt, hsa
uauaaaaacuagucaagccuaaugcaacuggcuaaaggauaguaccacccucacccccaccau

SEQ ID NO: 558875 - RNA, 63 nt, hsa
cuaaaauguguuucauucuaguaagaaaaccucaaaggauauuguaggauauaaaucuuacuu

SEQ ID NO: 558876 - RNA, 63 nt, hsa
aauccuauaauauccuugaaaagaaacuauuaaaaaggauagacauuucugauguaaguaaaa

SEQ ID NO: 558877 - RNA, 63 nt, hsa
uccuuuuuuugagguuuggauguugcagcuaguaaaggauauuuuugcucuguucagcaguuc

SEQ ID NO: 558878 - RNA, 63 nt, hsa
ccucugucuacaaauauaagauuuucugggccuaaaggauagaucaaagucaaaaauagcaau

SEQ ID NO: 558879 - RNA, 63 nt, hsa
aaagauuccacagagauguuuauggugagguuuaaaggauaugaaacucuacauuuaaacaag

SEQ ID NO: 558880 - RNA, 63 nt, hsa
ccuugaguguaugaguagccaggguaagggguaaaaggauaguaagcauagaaaccacuagaa

SEQ ID NO: 558881 - RNA, 63 nt, hsa
ucuucaaaaacuugcacaaacagaaaaguuggaaaaggauaauacagacugcacuaaauguuu

SEQ ID NO: 558882 - RNA, 63 nt, hsa
cuucugauuauugaagaggucagauuaugaaugaaaggauaaaauguuuuaauaguagagcag

SEQ ID NO: 558883 - RNA, 63 nt, hsa
agaguggugacuccauugacccagcuuuucauuaaaggauaacacacugcacugagucugaug

SEQ ID NO: 558884 - RNA, 63 nt, hsa
cugcagugauaccgaacuguggcacgccaaagcaaaggauaaccauccuccaaaacgccucca

SEQ ID NO: 558885 - RNA, 63 nt, hsa
gaaucuaucuucuaggaucuaagccacuaaauaaaaggauaaaugaaugaugauaagucaguc

SEQ ID NO: 558886 - RNA, 63 nt, hsa
auacuugaaggacuuuauauaaaaggaugacucaaaggauaaaaugaacgcuauuugaggacu

SEQ ID NO: 558887 - RNA, 63 nt, hsa
aaugaguuuuauuuuguuuauuuguuuugcaauaaaggauaugaagguggcuggcuaggaagg

SEQ ID NO: 558888 - RNA, 63 nt, hsa
acuacaacuguagucagcucacaauuuuuaaauaaaggauaccacagugcaugcuguuuguuc

SEQ ID NO: 558889 - RNA, 63 nt, hsa
cagcuuggaagcguuuauuuauacaucucuguaaaaggauauuuuagaauugaguugugugaa

SEQ ID NO: 558890 - RNA, 63 nt, hsa
aaaguuugggaagcucuuuagcaauaucagcuaaaaggauaugaaaucacaggugauagcagu

SEQ ID NO: 558891 - RNA, 63 nt, hsa
uuuaaauguuuugacgauuucaauacaagauaaaaaggauagugaaucauucuuuacaugcaa

SEQ ID NO: 558892 - RNA, 63 nt, hsa
cuuaaagugcucccuugacacuuauucuauacuaaaggauaaauuuuaaaaaaucuuuauagg

SEQ ID NO: 558893 - RNA, 63 nt, hsa
gaaaaaucaaaaacuauuuuauuaugaauuucaaaaggauaaaucaaauauucaaaaggccau

SEQ ID NO: 558894 - RNA, 63 nt, hsa
cuuucgucuccagccccuucucagaaucuacccaaaggauacuguaacacuuuacaauguuca

SEQ ID NO: 558895 - RNA, 63 nt, hsa
gccauccaagugaugauggcuuuuccuggagggaaaggauaggcuguugcucuaucuaauuuu

SEQ ID NO: 558896 - RNA, 63 nt, hsa
uuuuuuguagaaguagcugucauagagugaagaaaaggauaagacuuuaaacaguugauucuu

SEQ ID NO: 558897 - RNA, 63 nt, hsa
caaucaagccagcccucuccucuucugucacguaaaggauauuuggcacacucaugcgucauu

SEQ ID NO: 558898 - RNA, 58 nt, hsa
cuaaaaaaaucauuuacuagaucacaugaaaggauaaagcaaacugaagucaugcuau

SEQ ID NO: 558899 - RNA, 63 nt, hsa
acaagauccucccagcuuucucucuacauguagaaaggauaacauuucucaugaacccacugc

SEQ ID NO: 558900 - RNA, 63 nt, hsa
uaggaacuacaacuucauaaaugaggaaccagaaaaggauagcugggaggcauuacauaguca

SEQ ID NO: 558901 - RNA, 63 nt, hsa
cuacugggauaaaccucaauuccuuuauucaggaaaggauacuuuauugcauuauuguugcag

SEQ ID NO: 558902 - RNA, 63 nt, hsa
ggcucaaaaccgaaaacaaugaagcuugguuuuaaaggauaaaguuuucuuuuuuguuuuccu

SEQ ID NO: 558903 - RNA, 63 nt, hsa
aaauaagccuaucuuuuugugcuuacauacuuaaaaggauaucauuaaguauauaaacaauca

SEQ ID NO: 558904 - RNA, 63 nt, hsa
guuuauaaguuuugagauuuuuuuuuuuucugaaaaggauaccaaagugcgauaacugaacau

SEQ ID NO: 558905 - RNA, 63 nt, hsa
cugcagcaaagggagacuagagagagauuuguuaaaggauacaaaguuacagcuugguaggag

SEQ ID NO: 558906 - RNA, 63 nt, hsa
accaaaucccugggguaaaagcuaggguaagguaaaggauagacucacauuuacaaguaguga

SEQ ID NO: 558907 - RNA, 63 nt, hsa
gggggagggagauggaugcucaguugucacaucaaaggauacagcauuauucuagcagcaucc

SEQ ID NO: 558908 - RNA, 63 nt, hsa
uuuuuaagugucaaauaucaucaugguuugaaaaaaggauaaaaaagcuauaacuaaaaaaau

SEQ ID NO: 558909 - RNA, 63 nt, hsa
gaccccgugcccuuuaaaccggcauuugcugcuaaaggauacccagaacccucacuacuguaa

SEQ ID NO: 558910 - RNA, 63 nt, hsa
agcaaagaccacacauuuuuuacuacaaaauguaaaggauaaauguaaauccugcauaacuaa

SEQ ID NO: 558911 - RNA, 63 nt, hsa
uauaacuccacuguacaucauccuuugaguaguaaaggauaaaagcauauauacuaccuauau

SEQ ID NO: 558912 - RNA, 63 nt, hsa
cgcccaccaccuccuucccccucaucacaugacaaaggauaaugugcaagaaaaguauuuuua

SEQ ID NO: 558913 - RNA, 63 nt, hsa
uaagaucaugaaacaauuccaguuacauuguaaaaaggauaucuuacgaguaauuuuauugaa

SEQ ID NO: 558914 - RNA, 63 nt, hsa
cuucaagucaagaaauaaauuucuuuacauagaaaaggauacagauuuaguaccaagaacacu

SEQ ID NO: 558915 - RNA, 63 nt, hsa
aacaaaaaacuguuuucauuugcucucuugaccaaaggauaggacuuuaguucuuuaagcauu

SEQ ID NO: 558916 - RNA, 63 nt, hsa
ucuguaccagguggugguuauggggucugaaccaaaggauagcagcucuucauuccucuucug

SEQ ID NO: 558917 - RNA, 63 nt, hsa
uuguuuuucuacuucauuuuuccuuuuagagucaaaggauauuuauuuauaggccuuuuuuuu

SEQ ID NO: 558918 - RNA, 63 nt, hsa
gacuucuuuagaagaagcuucauuuaaaacaugaaaggauaaucugacuuaagaaacuuuuug

SEQ ID NO: 558919 - RNA, 63 nt, hsa
cuuagggcugggaacccgaaccuggugacuuugaaaggauagagcuucauuccauaccaaaga

SEQ ID NO: 558920 - RNA, 63 nt, hsa
ugcuauuuacuagcagugagaagaaaccucaggaaaggauaugaaaaagcaaguggccagugu

SEQ ID NO: 558921 - RNA, 63 nt, hsa
agaauccuuauuucagucuagcagcuuaacaacaaaggauaaaucagacuauacaaaaccuaa

SEQ ID NO: 558922 - RNA, 63 nt, hsa
gcuuacauuuuauaaguuuaaggucagcugucaaaaggauaaccugugggguuagaacauauc

SEQ ID NO: 558923 - RNA, 63 nt, hsa
cuaucacauucucaauaguuccagcucaggaugaaaggauagacacaaaauuguuugaaaaac

SEQ ID NO: 558924 - RNA, 63 nt, hsa
aaguacguguguguguguguguguuaccauggaaaaggauauucacaguaguacaguucucaa

SEQ ID NO: 558925 - RNA, 63 nt, hsa
uuuugaggugucucuuuggguucuuucuguuugaaaggauauuugucgaaaaaaagagcaaaa

SEQ ID NO: 558926 - RNA, 63 nt, hsa
gcauuauuacugcauuguuugucacugggaaccaaaggauaaaagaguagcauaagcugcuga

SEQ ID NO: 558927 - RNA, 63 nt, hsa
uaccauuagucagauuugaauaacgagguuuugaaaggauaaaaccuuuucuccaaugacagg

SEQ ID NO: 558928 - RNA, 63 nt, hsa
uugcacauguuuuccccuaaaagcuuacucuagaaaggauauuuuuuggagagggaguguggg

SEQ ID NO: 558929 - RNA, 63 nt, hsa
agaucugagacaugggauucccauuugagagccaaaggauaugcccugucaugguuucuguuu

SEQ ID NO: 558930 - RNA, 63 nt, hsa
aaugaaugauguuugaaugauauauaacaaaccaaaggauauuacagaauauuagauucauua

SEQ ID NO: 558931 - RNA, 63 nt, hsa
aagguuaguauuuuuguuguaguuaggauacuaaaaggauauuaguuacccaagagauccaau

SEQ ID NO: 558932 - RNA, 63 nt, hsa
guaucucuuuucaucugaaaacuaauaccuggaaaaggauaaaaaaaaaaaggaauccgugac

SEQ ID NO: 558933 - RNA, 63 nt, hsa
cagagaaauacugacgaaguuuucugauguggcaaaggauauuucccaucuaauaccaguuuc

SEQ ID NO: 558934 - RNA, 63 nt, hsa
aguggaaagaccagauaacuuuaaauggcuacuaaaggauaauuacuuacuuuuauugcaugu

SEQ ID NO: 558935 - RNA, 63 nt, hsa
uguauacuuuuaaaaaaaagauuugcuaagaucaaaggauauucagaggugcaucuuuuucug

SEQ ID NO: 558936 - RNA, 63 nt, hsa
cauggaucaagauccaguuuaggguugggaaauaaaggauagggauaaaagaggcaccccauu

SEQ ID NO: 558937 - RNA, 63 nt, hsa
ggggguggcaaucauuuuucuuccuauacauacaaaggauauugucaaaaauggcguucuucu

SEQ ID NO: 558938 - RNA, 63 nt, hsa
aaccucugauuuauuuuguaugaaauauaugugaaaggauaugaaucugagagaugcuguaga

SEQ ID NO: 558939 - RNA, 63 nt, hsa
cacaaggaacuacauuccagauuuaaagaaaugaaaggauaccauuaguguguauaacagauu

SEQ ID NO: 558940 - RNA, 63 nt, hsa
uuggaacucugaaggauuuagacaagguuuugaaaaggauaaucauggguuagaaggaagugu

SEQ ID NO: 558941 - RNA, 63 nt, hsa
guuuugccuagagaggggcaauaaaaaugaaccaaaggauauuuccagaaaggauuaagaaag

SEQ ID NO: 558942 - RNA, 63 nt, hsa
cuaaugauacugacaacauaaauuaccuaggguaaaggauagcugcaacaaugaaacaggaaa

SEQ ID NO: 558943 - RNA, 63 nt, hsa
cuaacuuuuaaaucaguguguguacugcagggaaaaggauauaggaauacucaucuuacaggg

SEQ ID NO: 558944 - RNA, 63 nt, hsa
uacuugucucucugcuuguuauugguuaagaaaaaaggauaugaggaauucauuuuaucaaug

SEQ ID NO: 558945 - RNA, 63 nt, hsa
uauuuauucccuaguuugcagaacugucugaauaaaggauacaaggauuauuucaauguuacu

SEQ ID NO: 558946 - RNA, 63 nt, hsa
cugugucagucuucauuuuaaauauggauacaaaaaggauacgccgagccaaucaaagacaag

SEQ ID NO: 558947 - RNA, 63 nt, hsa
ggaaauuugaauuaaauacuguaucauacuuucaaaggauaaaaagacuaccccucugaaggu

SEQ ID NO: 558948 - RNA, 63 nt, hsa
acaauuuuguuugaaauucauauaucuuauuucaaaggauagcauaauaucugcauuaugcug

SEQ ID NO: 558949 - RNA, 63 nt, hsa
aguggucacagggcccaauucuagacauaaaacaaaggauauaccugacagacuacuucugga

SEQ ID NO: 558950 - RNA, 63 nt, hsa
aaauggaaaaaugaaagaaggcaggaaggaaagaaaggauauaggaagagagggaagcagaag

SEQ ID NO: 558951 - RNA, 63 nt, hsa
ggcuuggugugaacucgcuuaaaagcaauggugaaaggauaaccucgaugauguaaauccacc

SEQ ID NO: 558952 - RNA, 63 nt, hsa
caugucuggcauugcauaaacuucucuggugugaaaggauaaauaugccuuucuaaaguugua

SEQ ID NO: 558953 - RNA, 63 nt, hsa
cgguggagauacaaguucucugacuguguugggaaaggauaagugcuaccguugagaagggaa

SEQ ID NO: 558954 - RNA, 63 nt, hsa
uuaacaaauaugaccgagucuaguuuuucuuuaaaaggauaguuuaugaguaaucuuuaaaac

SEQ ID NO: 558955 - RNA, 63 nt, hsa
uggccuccccuggauauacucuauagugcaccaaaaggauaaagcaucuguacauguauuuuu

SEQ ID NO: 558956 - RNA, 63 nt, hsa
gugucacugccacucuguuuuaucccugaaauuaaaggauaacauaaggaggacuugggccuu

SEQ ID NO: 558957 - RNA, 63 nt, hsa
cccuggagauauuuuuucuuauuugaguccaccaaaggauaaugccaacuuauauaaguucuc

SEQ ID NO: 558958 - RNA, 63 nt, hsa
cuuaaaagcagauuuuuaugggaacuuuuuucgaaaggauacaugaccaccuucuuaaauagu

SEQ ID NO: 558959 - RNA, 63 nt, hsa
gugacuguuuuucaagaagaaauguguuucauaaaaggauauuuauaucucuguugcuuugac

SEQ ID NO: 558960 - RNA, 63 nt, hsa
uuuaugucucuuuuguuaacagaaaccacuuuuaaaggauaguaauuauucuuguuuauaaca

SEQ ID NO: 558961 - RNA, 63 nt, hsa
ucaaauuuguuccuuuccucaugcacaaaacauaaaggauaguggcgaguuuacaagcugugg

SEQ ID NO: 558962 - RNA, 63 nt, hsa
uggugggguucuucgggugugaucauauaucauaaaggauauuucaaaugauuaugauuaguu

SEQ ID NO: 558963 - RNA, 63 nt, hsa
cuucuuuugcaucauuugggacugccauuuaaaaaaggauagguaaacaaagaaaugacaaaa

SEQ ID NO: 558964 - RNA, 63 nt, hsa
ucuucauagcaaugucuccuaaagguguuuuguaaaggauaucaaugccuugauuagaccuaa

SEQ ID NO: 558965 - RNA, 63 nt, hsa
auguugaacuuuguauacuugaaaugauaauaaaaaggauauaauuucuuaguaaaaugaaau

SEQ ID NO: 558966 - RNA, 63 nt, hsa
acauuagacacaccaacgagacagaaaguuaaaaaaggauauccgggaauugagcucagcucu

SEQ ID NO: 558967 - RNA, 63 nt, hsa
aguuugaauaguagguaucucuguggaaggaagaaaggauauuguuuguuuuuuucccuuuua

SEQ ID NO: 558968 - RNA, 63 nt, hsa
ccugaggggcucaucgacgccugugacagggagaaaggauacuucugaacaaggagccuccaa

SEQ ID NO: 558969 - RNA, 63 nt, hsa
cacagaauuguuccaguacuauggagugcucacaaaggauacuuuuacagguuaagacaaagg

SEQ ID NO: 558970 - RNA, 63 nt, hsa
aaaagacacgguugcucuauauaugaagugaaaaaaggauaugguagcauuuuauaguacuag

SEQ ID NO: 558971 - RNA, 63 nt, hsa
uauuauguuguacaucauuaaagaucuaaauacaaaggauauacagucuugaaucuaaaauaa

SEQ ID NO: 558972 - RNA, 63 nt, hsa
uaaauauuuugauauuauuuuccuuuuuaauauaaaggauagguuugaauuguacuuaaaaug

SEQ ID NO: 558973 - RNA, 63 nt, hsa
aaccaggauccauuuagguaccacuugauauaaaaaggauauccauaaugaauauuuuauacu

SEQ ID NO: 558974 - RNA, 63 nt, hsa
cacuuuuggacaaugcuaucccagcaggaaaaaaaaggauaauauaacuguuuuaaaacucuu

SEQ ID NO: 558975 - RNA, 63 nt, hsa
aacagagcucuguugucugguuuuagucuuucuaaaggauauuuuaacuaaaacuauggagau

SEQ ID NO: 558976 - RNA, 63 nt, hsa
uuucucuguuauuuauauaaaaauaauuuaucaaaaggauauuuuaaaaaagcuagucugucu

SEQ ID NO: 558977 - RNA, 63 nt, hsa
aucaauguuacaaaauuuaaggguauguuaacuaaaggauagcauuucuaagauauuuugaau

SEQ ID NO: 558978 - RNA, 63 nt, hsa
guuaguugagaaucagagcauauguuauuggggaaaggauauguuuauugacacauaaucugu

SEQ ID NO: 558979 - RNA, 63 nt, hsa
uguacauaugugccuugugauugcugcugcuuuaaaggauaaaguacucuuugggggaugagu

SEQ ID NO: 558980 - RNA, 63 nt, hsa
uauguaugcaguaugccuuacuuaaaaagauuaaaaggauacuaauguuaaaucuucuaggaa

SEQ ID NO: 558981 - RNA, 63 nt, hsa
ucauuuauauacaggcuucccuuuuuuauuuuuaaaggauacguuucacuuaauaaacacguu

SEQ ID NO: 558982 - RNA, 63 nt, hsa
ugcauaaaucaggauaccaucucauuaauuuacaaaggauaaucuuucuuuucauugacaaca

SEQ ID NO: 558983 - RNA, 63 nt, hsa
ccaucuuauuuggcuaauguaggauaaagaauaaaaggauaauuacuuaauguuaauacacag

SEQ ID NO: 558984 - RNA, 63 nt, hsa
caagggaaguuaaauuuugagacuuuuuuccccaaaggauacugacuguaauacaauuaccaa

SEQ ID NO: 558985 - RNA, 63 nt, hsa
aaauuucauuuguaauuggaaaaaauccaauaaaaaggauauucauuuagaaaauagcuaaga

SEQ ID NO: 558986 - RNA, 63 nt, hsa
ggucucaauaccugaagcuaucguaaaauuaagaaaggauaaaguugguaaaccuuuuauauu

SEQ ID NO: 558987 - RNA, 63 nt, hsa
aaaaaaaaucaucuugcccacaggccuguggcaaaaggauaaaaaugugaacgaaguuuaaca

SEQ ID NO: 558988 - RNA, 63 nt, hsa
auacaaaaguguguauaaaauguacguuuuaaaaaaggauaagugaacacccaugaaccuacu

SEQ ID NO: 558989 - RNA, 63 nt, hsa
cuguuauaugagaaacauuuuaguaauuuaauaaaaggauaauguuuauuuaaaaaaccugac

SEQ ID NO: 558990 - RNA, 63 nt, hsa
aguaauaccauuaacuguuuuaucgauagcaaaaaaggauacuuuuugcaauguuauuagaug

SEQ ID NO: 558991 - RNA, 63 nt, hsa
cagcccacuuguagaagguccgugugcuuuaccaaaggauauggaagcuacauagaagggaca

SEQ ID NO: 558992 - RNA, 63 nt, hsa
uauuccuuuauuaacuuagggcagauauaaaauaaaggauaauauaugacaaauucucacuua

SEQ ID NO: 558993 - RNA, 63 nt, hsa
gugaugcuuuuguauuuguggcgauuuuaauaaaaaggauauggccuucccaaugcacaguuu

SEQ ID NO: 558994 - RNA, 63 nt, hsa
gauugccauuucaauaaaugacauuaaaaaucuaaaggauauuauuguuugaauuuuuggguu

SEQ ID NO: 558995 - RNA, 63 nt, hsa
ugugaccgccaggccuccucucguaccuuggacaaaggauacaccugaaccagaauaguuuuc

SEQ ID NO: 558996 - RNA, 63 nt, hsa
auuuucugguuuuugaaaauuugaguugcaauaaaaggauauuucagugugcgauuucaauuu

SEQ ID NO: 558997 - RNA, 63 nt, hsa
gaucuuaacuucacuuccauuaggugaagauugaaaggauaggauugacauacccaaaguagc

SEQ ID NO: 558998 - RNA, 63 nt, hsa
ugagggaacgguuggaguggggaucggccugcgaaaggauacugugaaaucacuaauuaacua

SEQ ID NO: 558999 - RNA, 63 nt, hsa
uauuucuagauauugauuaguguaaucgauuauaaaggauauuuaucaaauccagggauugca

SEQ ID NO: 559000 - RNA, 63 nt, hsa
acuguguagaaacuaaaucaucgcuuuaguaagaaaggauaaaaagguguggaagugaauaua

SEQ ID NO: 559001 - RNA, 63 nt, hsa
agcaaaauauuguccuuacucauucaagaauuaaaaggauaaauuuuaaaaauguuaucuguc

SEQ ID NO: 559002 - RNA, 63 nt, hsa
ucauuuguuuuuccugaccaguauuuaaaaccaaaaggauauucugaaaaauggccaacaauu

SEQ ID NO: 559003 - RNA, 63 nt, hsa
gggcaucauuuuguuuugucuuucguagcagggaaaggauaugacaauggggaggacaguucu

SEQ ID NO: 559004 - RNA, 63 nt, hsa
cugacugaaaacugaguuaacaagaugaaaucuaaaggauauucacagugacuucaauucagg

SEQ ID NO: 559005 - RNA, 63 nt, hsa
auuauaucuuaagguauguuguagaauaaauuaaaaggauaaucuaaaucaccauuuagauua

SEQ ID NO: 559006 - RNA, 63 nt, hsa
cccuaaauacacgucuguuuagcccgcaauuggaaaggauauauguggcaauauuaaccuggu

SEQ ID NO: 559007 - RNA, 63 nt, hsa
uuugcacugauggugccaaagggcccugagucaaaaggauagccaaggguggaguggaaaaag

SEQ ID NO: 559008 - RNA, 63 nt, hsa
cuagggcugaguugugucuccauuuugauaaggaaaggauaugcucagacucuugcuuguuca

SEQ ID NO: 559009 - RNA, 63 nt, hsa
uggaaggcuuucaguuuuaauauggcugaaagcaaaggauaacgaauucagaauuaguaaugu

SEQ ID NO: 559010 - RNA, 63 nt, hsa
uuauuuacaugucagagacauuuauaaaaagugaaaggauaaaaaaaaaaaaaaacaacuaau

SEQ ID NO: 559011 - RNA, 63 nt, hsa
auauaacaagugggugaaugugguuauggccgaaaaggauaugcaguaugcuuaaugguagca

SEQ ID NO: 559012 - RNA, 63 nt, hsa
guguuuguugugauuaccgaguuaauacuuacaaaaggauaaaaauaaacuccugcuucccaa

SEQ ID NO: 559013 - RNA, 63 nt, hsa
cucauauaagacaaauauuccuuugcauauuauaaaggauaaagaaggaugaugucuuuuuau

SEQ ID NO: 559014 - RNA, 63 nt, hsa
guguaugugugguuucaguucuguguacauuuuaaaggauaauggugaacauuuuaauggguu

SEQ ID NO: 559015 - RNA, 63 nt, hsa
gagcugaggccauucccuguaggaguaaagauaaaaggauaggaaaagauucaaagcucuaau

SEQ ID NO: 559016 - RNA, 63 nt, hsa
cagacagacaauugaaaauacugggcagguccaaaaggauaguuccaggccauaggaauggcu

SEQ ID NO: 559017 - RNA, 63 nt, hsa
aguuacaagcuuaagauacagaagcauuuguucaaaggauagaaagcaucuaaaaguuuaggc

SEQ ID NO: 559018 - RNA, 63 nt, hsa
uuucuguguuuugauagaagucacacaaaaaaaaaaggauaaaagaaacccuuccccccuucu

SEQ ID NO: 559019 - RNA, 63 nt, hsa
ucaaauugugcagagaaacaauaaaauuuuuaaaaaggauaaacuggcuaguuaaaaguaaau

SEQ ID NO: 559020 - RNA, 63 nt, hsa
uagaaucucccucacucuauaguugcccaguugaaaggauaaggaggagggguggcuuuuaug

SEQ ID NO: 559021 - RNA, 63 nt, hsa
cugccuugcaggauccauuuaucauucauugguaaaggauauauuccuuguucuuaccaagug

SEQ ID NO: 559022 - RNA, 63 nt, hsa
gggccacuauggaacccugcuguucccccuuccaaaggauacuaagaugccccucuggugggu

SEQ ID NO: 559023 - RNA, 63 nt, hsa
uuucauuccguuuggaugucuacauuccuuaucaaaggauauaaauacuguguaugcuuuuga

SEQ ID NO: 559024 - RNA, 63 nt, hsa
uagcaaaguuaaacauucuuauuucucauauuuaaaggauaccacaauaagcugcugugugug

SEQ ID NO: 559025 - RNA, 63 nt, hsa
caaggcugcuugauucacagauggaugugaccuaaaggauaaauaagcuauuacuuaugugcu

SEQ ID NO: 559026 - RNA, 63 nt, hsa
cuccacauccuggaaucaaucacacugacagggaaaggauaaaugcuccuuuauaagccaaca

SEQ ID NO: 559027 - RNA, 63 nt, hsa
ucccauagugcuucacacagcuccccugcuucuaaaggauaagguacuguagccuugguccug

SEQ ID NO: 559028 - RNA, 63 nt, hsa
uguaauuagugggggaaaaaauauuuuuuaaacaaaggauauaaccauauuuaguuguacagu

SEQ ID NO: 559029 - RNA, 63 nt, hsa
uggugcuauuuaaacaauuuuuuucuaacgugaaaaggauaaaacauuaaaaacucuugagaa

SEQ ID NO: 559030 - RNA, 63 nt, hsa
gguagggaauacuggagauauuuguacagaagaaaaggauauuuauauauuuucuuaaaacag

SEQ ID NO: 559031 - RNA, 63 nt, hsa
agcagaaaacauacuuauuuuaaaaaagaaaaaaaaggauaaaaaaacccaaacugaaauucu

SEQ ID NO: 559032 - RNA, 63 nt, hsa
uccacucacucaaaaucagagccacgaugacccaaaggauaagaaagaaaagagagcucaggc

SEQ ID NO: 559033 - RNA, 63 nt, hsa
ucuuauguuuuuuaaauggaguuaugaauuuuaaaaggauaaaaaugcuuuauuuauacagau

SEQ ID NO: 559034 - RNA, 63 nt, hsa
uaauucaauguguuuuuaacacaugaaaauauuaaaggauaugcaagagaaauuuuucaagca

SEQ ID NO: 559035 - RNA, 63 nt, hsa
aagaaagcuguggaaaggaccugccccacaugaaaaggauaagccaagauggcuguaaacaca

SEQ ID NO: 559036 - RNA, 63 nt, hsa
auggauuuuaaaagaauauaauguucaauauuaaaaggauaauucacauuugccaccauaaug

SEQ ID NO: 559037 - RNA, 63 nt, hsa
aacuaauugacuuuagaaagcugacauugccaaaaaggauacauaaugggccacugaaaucug

SEQ ID NO: 559038 - RNA, 63 nt, hsa
cuucugaagacaaaacugaaugcuauagcuuugaaaggauaaaaagcccugaagugcucauca

SEQ ID NO: 559039 - RNA, 63 nt, hsa
cuaccugagaccagcugugauguuuaaagacauaaaggauaaaguuuacuuuuaaaggguuuc

SEQ ID NO: 559040 - RNA, 63 nt, hsa
cuccccaucaaaaaaaaaaauggauacaugguuaaaggauagaagggcaauauuuuaucauau

SEQ ID NO: 559041 - RNA, 63 nt, hsa
caguuauacuugugaauugugaucuaacugcagaaaggauacauuauuaaaauacuuugccuu

SEQ ID NO: 559042 - RNA, 63 nt, hsa
uacauuuacacucccaaauugcaggcuuuauuuaaaggauaaaauuuaaaggauaaaaaaaca

SEQ ID NO: 559043 - RNA, 63 nt, hsa
caaauugcaggcuuuauuuaaaggauaaaauuuaaaggauaaaaaaacagucacucuguuaag

SEQ ID NO: 559044 - RNA, 63 nt, hsa
gaaacucuaaauaguugaaaggcuaaccugcucaaaggauaccaaauaaugguuuaacuggac

SEQ ID NO: 559045 - RNA, 63 nt, hsa
gacauugaaaaggaagaggcauagucaugaucaaaaggauauauugacaguuaucuauagcca

SEQ ID NO: 559046 - RNA, 63 nt, hsa
gucauaccuacauucaaggagaggggaccaugcaaaggauaaacugcaggugaagaacuugag

SEQ ID NO: 559047 - RNA, 63 nt, hsa
auguacuccuguuugccaagcucaauaauggacaaaggauacaaacacacacacaucuacuau

SEQ ID NO: 559048 - RNA, 63 nt, hsa
gugaucgucaaugugaauagcuuagaauacugcaaaggauaagcuaauugaaugccuugaaag

SEQ ID NO: 559049 - RNA, 62 nt, hsa
cgaaaaagucacgaaucugacuuuguccuucuaaaggauauauuugaagaaaaacaaauugu

SEQ ID NO: 559050 - RNA, 63 nt, hsa
cuucuuauuuguauggaaugcgcuuauuuuuugaaaggauauuaggccggaugugguggcuca

SEQ ID NO: 559051 - RNA, 63 nt, hsa
agggaggccugcgcaaagcuaguuuuauuucuuaaaggauaacagucauacauagaauacuag

SEQ ID NO: 559052 - RNA, 63 nt, hsa
gaaaugugugagaguguuacuuacugaaaacugaaaggauaugacaugcuggaacaggcaaaa

SEQ ID NO: 559053 - RNA, 63 nt, hsa
uaggagcaugaaguuugaguuuuguguuuuuccaaaggauacuuccuuggcccuuuuucuuua

SEQ ID NO: 559054 - RNA, 63 nt, hsa
ggaaucugugaacgccuagaaaaugagcagaauaaaggauauuaucuuuggaagucuuagaug

SEQ ID NO: 559055 - RNA, 63 nt, hsa
acugguuuguuugcuuaauuuccuucuguuaagaaaggauauaaaaggauguuacaaguuugc

SEQ ID NO: 559056 - RNA, 63 nt, hsa
gaggaaucaaggggccauuaccaaggggcaggaaaaggauauguaagagguggccuucauggu

SEQ ID NO: 559057 - RNA, 63 nt, hsa
ccuggagaaaaccagagauccaguacagaaaggaaaggauauuuauugauuaacagaaguugu

SEQ ID NO: 559058 - RNA, 63 nt, hsa
aauuguaacaauaaaucacagccacuugacaagaaaggauauucauuauuuucaaauggcuuu

SEQ ID NO: 559059 - RNA, 63 nt, hsa
gcccuggagccaaucuucaagaaaggaauuuccaaaggauaauauuuuucuaauaaaugcggc

SEQ ID NO: 559060 - RNA, 63 nt, hsa
uuaaacuuaauuaaagaaaaacuauuuaaagguaaaggauauuuuguugacaucgguggcucg

SEQ ID NO: 559061 - RNA, 63 nt, hsa
gcuggagucccaugaggaugugggcccuuuaauaaaggauagcaaacagggagcuuguggccu

SEQ ID NO: 559062 - RNA, 63 nt, hsa
cagggaaucaaacuaaauguccaucagugguagaaaggauaaagaaaaugugguggcagggag

SEQ ID NO: 559063 - RNA, 63 nt, hsa
uaguauuggcuucaguccgagccacaggcaauaaaaggauaucagcuguaguucucagcuaca

SEQ ID NO: 559064 - RNA, 63 nt, hsa
auuguaugggacuuuccuuuggaucccccaaucaaaggauaagcaaugcguaagccugugucc

SEQ ID NO: 559065 - RNA, 63 nt, hsa
uuuuuuggacagaguguggaaagggagccccccaaaggauagcuucuuuuucaugaugccagg

SEQ ID NO: 559066 - RNA, 63 nt, hsa
ggugucauuuccauuauuuauauuaguuuagccaaaggauaaguguccccuauggggaugguc

SEQ ID NO: 559067 - RNA, 63 nt, hsa
gguguuauuuccauuauuuauauuaguuuagccaaaggauaaguguccccuauggggaugguc

SEQ ID NO: 559068 - RNA, 63 nt, hsa
ucugucucccuauaaugcuggagcggcuacuaaaaaggauaaaauguaucacuuaaauguuac

SEQ ID NO: 559069 - RNA, 63 nt, hsa
aaggauggaacuauggguucucuucgcaaagccaaaggauaguguuuaacaagccagcuggcu

SEQ ID NO: 559070 - RNA, 63 nt, hsa
aaaacaggagaggagaaauaucucauacaagugaaaggauacuggagagagaaauuacccauu

SEQ ID NO: 559071 - RNA, 63 nt, hsa
ggucccgaaagauugcaacuuuggcugcuacagaaaggauagaaccuuuuuggggggagggug

SEQ ID NO: 559072 - RNA, 63 nt, hsa
caugaagcaaaauacuaaucuaauuguguaaagaaaggauauuuuaauaaguucuuucugcuu

SEQ ID NO: 559073 - RNA, 63 nt, hsa
uaugaacuuuaaaugauuauauggauuucuuuaaaaggauaugcccauuugauccuaaccuuu

SEQ ID NO: 559074 - RNA, 63 nt, hsa
guuuccaacucugauugucacuugcaucuucacaaaggauaaaccacggagcaacuggaaaac

SEQ ID NO: 559075 - RNA, 63 nt, hsa
gucugucagguuugguuuuuuuguacaauaugaaaaggauauuaucuaccuguucuguagcuu

SEQ ID NO: 559076 - RNA, 63 nt, hsa
caguagaaugauuucauuuagauguauaaugaaaaaggauaaugcaaaaauuauguaauagau

SEQ ID NO: 559077 - RNA, 63 nt, hsa
aaaagaaaguuacagguauugcacuggguggggaaaggauagugugucuuuaacucuuaaauu

SEQ ID NO: 559078 - RNA, 63 nt, hsa
ucuucaucugggaccuggaaauccugaaauaaaaaaggauaaugcaauaaacacaguugcagg

SEQ ID NO: 559079 - RNA, 63 nt, hsa
gaauauuacuccuauuuuuguaaacuggaauuaaaaggauaguauuuuuauccaugacaggcc

SEQ ID NO: 559080 - RNA, 63 nt, hsa
uccucuggcccucccuuuuccuccacgaggauuaaaggauacaagcugaccaggccucacagg

SEQ ID NO: 559081 - RNA, 63 nt, hsa
uuuugcauuuuuaauuauaauuuauuuauuuagaaaggauacuaauuuuuuuuauuacuccua

SEQ ID NO: 559082 - RNA, 63 nt, hsa
cuauuuuauucuuggggggaucaaaccuuaggaaaaggauaucuauauaucuauauagcuaua

SEQ ID NO: 559083 - RNA, 63 nt, hsa
ugaaaacaaccccaagcuauauauuaccagaugaaaggauaaacaaaauaugguccauccaua

SEQ ID NO: 559084 - RNA, 63 nt, hsa
cuuucccucaucauaauguagauaaaaagaaaaaaaggauaugguuaccuguaaucuuaccaa

SEQ ID NO: 559085 - RNA, 63 nt, hsa
uuccugaagaccggggcaucgggguggggugauaaaggauacaaccugcacagggggaaguua

SEQ ID NO: 559086 - RNA, 63 nt, hsa
uauaaaagcaagguuuauuauaaaagauacuacaaaggauacagaugaagaggcacauagggc

SEQ ID NO: 559087 - RNA, 63 nt, hsa
ugaaaacaaccccaagcuauauauuaccagaugaaaggauaaacaaaaugugguccauccaua

SEQ ID NO: 559088 - RNA, 63 nt, hsa
caaaaaggcaaauguacccuuugaccauaucccaaaggauagucuuuaucaguucauuauuua

SEQ ID NO: 559089 - RNA, 63 nt, hsa
gguggaagggaaauguuaccaagcaugguaguuaaaggauacuucaauuuuguaucuauuucu

SEQ ID NO: 559090 - RNA, 63 nt, hsa
uggauaaauuauguaaaacuaaagaauggauugaaaggauauguauauacucaguucccaaaa

SEQ ID NO: 559091 - RNA, 63 nt, hsa
gaaaagaacuccauuucauuggacuaaauaacaaaaggauaauguuuucauaauuuuuuauug

SEQ ID NO: 559092 - RNA, 63 nt, hsa
aaaaauacucaauguuauuggacuaaauaaucaaaaggauaaugauuucauaauuuucuauuu

SEQ ID NO: 559093 - RNA, 63 nt, hsa
aaaaaaacucaauguuauuggacuaaauaaucaaaaggauaauguuuucauaauuuuuuauug

SEQ ID NO: 559094 - RNA, 63 nt, hsa
acucuguccagacaugauagagggacagagccaaaaggauagagaaagagacccagaaaaagg

SEQ ID NO: 559095 - RNA, 63 nt, hsa
uugguuggagagcugaacaggcugggacugaggaaaggauaaaccccgauauugggaccucac

SEQ ID NO: 559096 - RNA, 63 nt, hsa
cagugagaaucugucucaaaaaaaaaaaaaaaaaaaggauaucaaagcuggaugguggcucau

SEQ ID NO: 559097 - RNA, 63 nt, hsa
cucaagaguauuaaaaggauuauaugaaguaauaaaggauaaaaugcauuggaaaaagcugug

SEQ ID NO: 559098 - RNA, 63 nt, hsa
aaguuuguauuuccucagaguucucacauauggaaaggauacacacuuuguagaaacaagaac

SEQ ID NO: 559099 - RNA, 63 nt, hsa
cacugcaucaguauacauaacaugaaggaauaaaaaggauacagaauuguauauacauacuua

SEQ ID NO: 559100 - RNA, 63 nt, hsa
caaaaaacuggguggagaaauaauuguuucuuuaaaggauaugaguuagaaucacccccuguu

SEQ ID NO: 559101 - RNA, 63 nt, hsa
uuuucuuuucucuuuuacugcuaagcagccuggaaaggauaaaugaauauuagacuaagauuu

SEQ ID NO: 559102 - RNA, 63 nt, hsa
cuccuuuugaacuugucacgaauuccaucuuguaaaggauauuaaauguugcuuuaaccugaa

SEQ ID NO: 559103 - RNA, 63 nt, hsa
ccauuacacuagagcagggcucuauuuauuuuuaaaggauauggccguguguuuugauaaaac

SEQ ID NO: 559104 - RNA, 63 nt, hsa
cugugcguugggucaguuucuguuacguaacgaaaaggauaaacaucucccacgggagaggcc

SEQ ID NO: 559105 - RNA, 63 nt, hsa
aagaaaaaaaaagccuuaguggccugguuguucaaaggauaagaauagcuuuauccugcacuc

SEQ ID NO: 559106 - RNA, 63 nt, hsa
uggcucaagauuuggccccaugcagacccucccaaaggauacugccuucucaagaucauaggc

SEQ ID NO: 559107 - RNA, 63 nt, hsa
augaagcaggcaugagccagagggaggaaguugaaaggauacuaaugauuccugagcaccucc

SEQ ID NO: 559108 - RNA, 63 nt, hsa
aacuugguaguucauaaagguuuacagugaauaaaaggauaucaucuugaguauagcaauauc

SEQ ID NO: 559109 - RNA, 63 nt, hsa
uaaucccaggcuggccauucauucagguuuuuuaaaggauauuuaacuuuuauggacuagaag

SEQ ID NO: 559110 - RNA, 63 nt, hsa
auuuuuaaagucuaaacuguuaaacaacucuuuaaaggauaauuauccaauaaaaaaaaaccu

SEQ ID NO: 559111 - RNA, 63 nt, hsa
auaaaccgccuuuuuggcagccuaccaaugccaaaaggauaaaugucuuuccaaaagugugua

SEQ ID NO: 559112 - RNA, 63 nt, hsa
gcuaguuuuaaaauaaugaucucagauuuuuaaaaaggauauaggaaccugcauugucauucu

SEQ ID NO: 559113 - RNA, 63 nt, hsa
cuaauucguuuuccuauuucuuuucauacaaauaaaggauaccuggauuuauuuagguuauua

SEQ ID NO: 559114 - RNA, 63 nt, hsa
aaaugaauuuaucauuuuaguauaguuuucgauaaaggauauagcaacaucuuuugauaauug

SEQ ID NO: 559115 - RNA, 63 nt, hsa
gauuuuagcauauguuaagaggaauugcagugaaaaggauaacauuuuuccauaguaaauugu

SEQ ID NO: 559116 - RNA, 63 nt, hsa
uuucugauauagaauugcaauuuuaacacacauaaaggauaaacuuuuagaaacuuaucuuac

SEQ ID NO: 559117 - RNA, 63 nt, hsa
guaagagagauuguaaaugauaaaccgagcuuuaaaggauaaaguguuaauaaagaaaggaag

SEQ ID NO: 559118 - RNA, 63 nt, hsa
auuuucaguuauuauauuuacaaaugggaaacaaaaggauaaugaauacuuuauaaaggauua

SEQ ID NO: 559119 - RNA, 63 nt, hsa
uuaucacuaauaagcaucaguuuguuguuuuuaaaaggauauuuaagugagcauuuucuaguu

SEQ ID NO: 559120 - RNA, 63 nt, hsa
caaacggugaauauuauagaagaaugggggaagaaaggauagaauauuaaaacugcuuugcau

SEQ ID NO: 559121 - RNA, 63 nt, hsa
uguguucuaauuaacacaguaaucuguucagccaaaggauacuaacagccauucuuuggacug

SEQ ID NO: 559122 - RNA, 63 nt, hsa
caugugugcaugugaguauguuugcaaaauaauaaaggauauuggagaccuguuuuagaagga

SEQ ID NO: 559123 - RNA, 63 nt, hsa
agagaaaagcuccuuuucucuucacuguuuuggaaaggauagccauuagcaugacugcuuugu

SEQ ID NO: 559124 - RNA, 63 nt, hsa
uugacagauuuguagacaauuacaaaagccaaaaaaggauaaaauaagcauuaggaaggcuag

SEQ ID NO: 559125 - RNA, 63 nt, hsa
cacacacacacacacgugcacacacacacauuuaaaggauauaaaaagaagagguugaaagau

SEQ ID NO: 559126 - RNA, 63 nt, hsa
accaaauaauaaauauuaagaagaaugggggaaaaaggauagaauauuaaaacugcuuugcau

SEQ ID NO: 559127 - RNA, 63 nt, hsa
ggcagacgugcuuuauagcuaaaugaacaaagcaaaggauacagagguauguucucucuuaga

SEQ ID NO: 559128 - RNA, 64 nt, hsa
aggaaaaaaggcagaguaacauuacuuaaaaaaaaaaggauauguuuacauuuaauuuuggcua

SEQ ID NO: 559129 - RNA, 64 nt, hsa
agaggaggaaaagugaaucacggagagagaaaggaaaggauagaaucacaggcugcgucugcac

SEQ ID NO: 559130 - RNA, 64 nt, hsa
cuuugcuaaaaagaaccauauuauuuugauucucaaaggauaggccuuugaguguuagagaaag

SEQ ID NO: 559131 - RNA, 64 nt, hsa
uuuguuuuccuguaaaugcagauaguuaaaaucuaaaggauagaaugcuuuccuaaaacagaac

SEQ ID NO: 559132 - RNA, 64 nt, hsa
cauuacuuuuaaguguauuaugaaggcaguuuucaaaggauaugaccaguugggguaauucaaa

SEQ ID NO: 559133 - RNA, 64 nt, hsa
uugcaccaguuucuggaggcccuugucauuucaaaaaggauagucucuuuucuuacucuggcaa

SEQ ID NO: 559134 - RNA, 64 nt, hsa
uuaaugagacaauuuuccuaccaaaggaagaacaaaaggauaaauauaauacaaaauauaugua

SEQ ID NO: 559135 - RNA, 64 nt, hsa
cugaccuccuugccucuugucuugaaccauagcaaaaggauacugcaucucucauuacuguagu

SEQ ID NO: 559136 - RNA, 64 nt, hsa
caguucuugcacucuuuguacagaauugguauaaaaaggauaauuccacacugaucuuguccca

SEQ ID NO: 559137 - RNA, 64 nt, hsa
uugugugaacuacaguauauaaugauaacaauuaaaaggauauucuguggaugucacguauuuu

SEQ ID NO: 559138 - RNA, 64 nt, hsa
ucacuuuacuacaguuacuuuugcaaacagacagaaaggauacacuucuaaccacauuuuacuu

SEQ ID NO: 559139 - RNA, 64 nt, hsa; identical to SEQ ID NO: 164644

SEQ ID NO: 559140 - RNA, 64 nt, hsa; identical to SEQ ID NO: 164645

SEQ ID NO: 559141 - RNA, 64 nt, hsa
aaucauaaagaaaaacuaaaaaugaaccaaagugaaaggauaacuuccaggcaguaucuuucua

SEQ ID NO: 559142 - RNA, 64 nt, hsa
auaccacuuaagauaggagucuaaacuccacagaaaaggauaauaccaagagcuuguauuguua

SEQ ID NO: 559143 - RNA, 64 nt, hsa
agaaucuggaccccagagucuggaagcaggccagaaaggauaaggcaaaugacugaacaguucc

SEQ ID NO: 559144 - RNA, 64 nt, hsa; identical to SEQ ID NO: 164646

SEQ ID NO: 559145 - RNA, 64 nt, hsa; identical to SEQ ID NO: 164647

SEQ ID NO: 559146 - RNA, 64 nt, hsa
ugguuuacaugcacugucucauuuaaucugagauaaaggauacuuaagcccaaacuauaucuaa

SEQ ID NO: 559147 - RNA, 64 nt, hsa; identical to SEQ ID NO: 164648

SEQ ID NO: 559148 - RNA, 64 nt, hsa; identical to SEQ ID NO: 164649

SEQ ID NO: 559149 - RNA, 64 nt, hsa
uaaaugaaucuaaucaaaaugugaauaguagucaaaaggauaauuuaauaagcauuuuacguua

SEQ ID NO: 559150 - RNA, 64 nt, hsa
uuuuuuuuuuuuuuuaugaugauuaagaaaauggaaaggauauggaugaauuguguaaacuuag

SEQ ID NO: 559151 - RNA, 64 nt, hsa; identical to SEQ ID NO: 164650

SEQ ID NO: 559152 - RNA, 64 nt, hsa; identical to SEQ ID NO: 164651

SEQ ID NO: 559153 - RNA, 64 nt, hsa
ggacacugucuuaugaagguuugcuugggaugaaaaaggauauugcagcuucagcaguguugaa

SEQ ID NO: 559154 - RNA, 64 nt, hsa
cuugccucgcugauguugcaugggcagacuucaaaaaggauaguuagaaagguuuggguugaug

SEQ ID NO: 559155 - RNA, 64 nt, hsa
cacacgccacugcccccgaggccagaguguaaguaaaggauaaccaggacucgcugggagagau

SEQ ID NO: 559156 - RNA, 64 nt, hsa
acuuuuuaaaaaaugauguuugaagugaaaaaaaaaaggauauucagggucaaaucauguacau

SEQ ID NO: 559157 - RNA, 64 nt, hsa; identical to SEQ ID NO: 164652

SEQ ID NO: 559158 - RNA, 64 nt, hsa; identical to SEQ ID NO: 164653

SEQ ID NO: 559159 - RNA, 64 nt, hsa
uucccccaaagaguugaaaucuuaaaucuauuuaaaaggauauaaaagcuuuggauauguauuu

SEQ ID NO: 559160 - RNA, 64 nt, hsa
ugaguuucucuuggguauaaaggcuaaaagggaaaaaggauauguggagaaucaucaagauaug

SEQ ID NO: 559161 - RNA, 64 nt, hsa
gcaaguaacagcuucagaauucaucaggaccaagaaaggauaaggauauuuggcucaccucguu

SEQ ID NO: 559162 - RNA, 64 nt, hsa
gauaguuuauuguagugauguuuuuauaaaagcaaaaggauauucacuuucagcgcuuauacug

SEQ ID NO: 559163 - RNA, 64 nt, hsa
ucucaggaucaagaaaguguuggcuaaugaagggaaaggauauuuucuuccaagcaaaggugaa

SEQ ID NO: 559164 - RNA, 64 nt, hsa
gggcccuuuuucaauaacuggaacacucuauaacaaaggauacuuauuuaaauagaugacauug

SEQ ID NO: 559165 - RNA, 64 nt, hsa
cacuaucaauuuuaaggaaacuuuuuaauugugcaaaggauaaauuuuuugaccuauuuuaggg

SEQ ID NO: 559166 - RNA, 64 nt, hsa
uuuccuuucuuuucauaaugaagcagaucaacuuaaaggauaauaaaauuuuuaaagaaaagau

SEQ ID NO: 559167 - RNA, 64 nt, hsa
ugagagaaguaauggcaaggccuuuacuuucaggaaaggauagaaguauagauuaaugacugga

SEQ ID NO: 559168 - RNA, 64 nt, hsa
gucuaagaauccuucaggcauucuuuaaggagaaaaaggauaccuuugauuuuguguguuucau

SEQ ID NO: 559169 - RNA, 64 nt, hsa
uugccagcagugcagagccugguugucacccauuaaaggauaggucuccccggagugcacagcu

SEQ ID NO: 559170 - RNA, 64 nt, hsa
gaaauugccaaagcccaaauuaacgaguauuauaaaaggauaauaaagcaucccugaagccaaa

SEQ ID NO: 559171 - RNA, 64 nt, hsa
aguuuugcauaauuauaaucggcauuguacauagaaaggauauggcuaccuuuuguuaaaucug

SEQ ID NO: 559172 - RNA, 64 nt, hsa
gcgggaguagcaguaguccaaaccuaguauagggaaaggauaaaaauaagucaccuucaccaag

SEQ ID NO: 559173 - RNA, 64 nt, hsa
uuccucgaaacuaguguguguuuauuaaaaggagaaaggauaacaauagaauguucuaaaacca

SEQ ID NO: 559174 - RNA, 64 nt, hsa
ggcccacaugaagagagggaaccuguuaguccagaaaggauacggauagauagccugucugacu

SEQ ID NO: 559175 - RNA, 64 nt, hsa
aaauuguauuugagggaaaaaaccaugaccaaguaaaggauaaauucaaaaaauagccucauga

SEQ ID NO: 559176 - RNA, 64 nt, hsa
ggcuaacgagggauuacuuuggccaaaaccuuucaaaggauaugcagaaagaugguagggagca

SEQ ID NO: 559177 - RNA, 64 nt, hsa
gaaugacugaauuuacuacaaaggcaaacuuucaaaaggauaucucauuuuuguuucuaaauau

SEQ ID NO: 559178 - RNA, 64 nt, hsa
ccaaaaaaaaguuucugaagguaaaagauauacuaaaggauauacauauacugccucuucuaug

SEQ ID NO: 559179 - RNA, 64 nt, hsa
aggacuccuugugcucccagcagcucagacagggaaaggauaguccccacucacggugacacca

SEQ ID NO: 559180 - RNA, 64 nt, hsa
caaacacuagagguuuaauaagacuuaucagaugaaaggauauuuauauagccuuuuaguagca

SEQ ID NO: 559181 - RNA, 64 nt, hsa
gauaaaagcaaccucucuauaaaucauauaauguaaaggauaucaagguucuccauagguucuu

SEQ ID NO: 559182 - RNA, 64 nt, hsa
uuuuuuuuuuuaaacucugagcuauuuuaucaauaaaggauauuuuguaauaaguaaguggugu

SEQ ID NO: 559183 - RNA, 64 nt, hsa
cgagugcgauuuauuuaaguuguauauaaaaauaaaaggauagcauuuuuauacaaauaucuuu

SEQ ID NO: 559184 - RNA, 64 nt, hsa
cacaguaaggcaaaggccaagcuuucaaaagaguaaaggauacuuucacaauuucccuucauau

SEQ ID NO: 559185 - RNA, 64 nt, hsa
uauuguaauucauagggcuuuuguuuauucauauaaaggauaaauauuuggguguuuugagcuu

SEQ ID NO: 559186 - RNA, 64 nt, hsa
cucuuuacuauguccuagcucuguccugcuaccuaaaggauauaaagaaauacuauugcucuag

SEQ ID NO: 559187 - RNA, 64 nt, hsa
acccauuuuaaugugcauucugaugagcacugacaaaggauaugguacuaaaaauaaaauguga

SEQ ID NO: 559188 - RNA, 64 nt, hsa
agacccaaaguuacuauagucaaccaagucuuucaaaggauaaaagaucauuuuauuaucuuua

SEQ ID NO: 559189 - RNA, 64 nt, hsa
uaugccugucuuuaaaguguuauuuuauuaauuaaaaggauauggcuauuauuauauauucucu

SEQ ID NO: 559190 - RNA, 64 nt, hsa
gggacuaggggagugguggggaggugaguggaccaaaggauauaggccccaggcaugcagaugg

SEQ ID NO: 559191 - RNA, 64 nt, hsa
gaggauaaaggaacugagaccagaugagaaaaagaaaggauauagauuccuugaguggaauagu

SEQ ID NO: 559192 - RNA, 64 nt, hsa
caagacuuuuccugcaauagccugggaaggaauaaaaggauagaguguuuggguuuuuguguaa

SEQ ID NO: 559193 - RNA, 64 nt, hsa
uuauauucacaguuuuuuaaaaaugugucaaaauaaaggauaacucuguauuacagcuuucaca

SEQ ID NO: 559194 - RNA, 64 nt, hsa
uuauaaaaacuagucaagccuaaugcaacuggcuaaaggauaguaccacccucacccccaccau

SEQ ID NO: 559195 - RNA, 64 nt, hsa
ccuaaaauguguuucauucuaguaagaaaaccucaaaggauauuguaggauauaaaucuuacuu

SEQ ID NO: 559196 - RNA, 64 nt, hsa
aaauccuauaauauccuugaaaagaaacuauuaaaaaggauagacauuucugauguaaguaaaa

SEQ ID NO: 559197 - RNA, 64 nt, hsa
uuccuuuuuuugagguuuggauguugcagcuaguaaaggauauuuuugcucuguucagcaguuc

SEQ ID NO: 559198 - RNA, 64 nt, hsa
cccucugucuacaaauauaagauuuucugggccuaaaggauagaucaaagucaaaaauagcaau

SEQ ID NO: 559199 - RNA, 64 nt, hsa
gaaagauuccacagagauguuuauggugagguuuaaaggauaugaaacucuacauuuaaacaag

SEQ ID NO: 559200 - RNA, 64 nt, hsa
uccuugaguguaugaguagccaggguaagggguaaaaggauaguaagcauagaaaccacuagaa

SEQ ID NO: 559201 - RNA, 64 nt, hsa
aucuucaaaaacuugcacaaacagaaaaguuggaaaaggauaauacagacugcacuaaauguuu

SEQ ID NO: 559202 - RNA, 64 nt, hsa
gcuucugauuauugaagaggucagauuaugaaugaaaggauaaaauguuuuaauaguagagcag

SEQ ID NO: 559203 - RNA, 64 nt, hsa
gagaguggugacuccauugacccagcuuuucauuaaaggauaacacacugcacugagucugaug

SEQ ID NO: 559204 - RNA, 64 nt, hsa
acugcagugauaccgaacuguggcacgccaaagcaaaggauaaccauccuccaaaacgccucca

SEQ ID NO: 559205 - RNA, 64 nt, hsa
ggaaucuaucuucuaggaucuaagccacuaaauaaaaggauaaaugaaugaugauaagucaguc

SEQ ID NO: 559206 - RNA, 64 nt, hsa
gauacuugaaggacuuuauauaaaaggaugacucaaaggauaaaaugaacgcuauuugaggacu

SEQ ID NO: 559207 - RNA, 64 nt, hsa
caaugaguuuuauuuuguuuauuuguuuugcaauaaaggauaugaagguggcuggcuaggaagg

SEQ ID NO: 559208 - RNA, 64 nt, hsa
cacuacaacuguagucagcucacaauuuuuaaauaaaggauaccacagugcaugcuguuuguuc

SEQ ID NO: 559209 - RNA, 64 nt, hsa
acagcuuggaagcguuuauuuauacaucucuguaaaaggauauuuuagaauugaguugugugaa

SEQ ID NO: 559210 - RNA, 64 nt, hsa
aaaaguuugggaagcucuuuagcaauaucagcuaaaaggauaugaaaucacaggugauagcagu

SEQ ID NO: 559211 - RNA, 64 nt, hsa
uuuuaaauguuuugacgauuucaauacaagauaaaaaggauagugaaucauucuuuacaugcaa

SEQ ID NO: 559212 - RNA, 64 nt, hsa
gcuuaaagugcucccuugacacuuauucuauacuaaaggauaaauuuuaaaaaaucuuuauagg

SEQ ID NO: 559213 - RNA, 64 nt, hsa
ugaaaaaucaaaaacuauuuuauuaugaauuucaaaaggauaaaucaaauauucaaaaggccau

SEQ ID NO: 559214 - RNA, 64 nt, hsa
gcuuucgucuccagccccuucucagaaucuacccaaaggauacuguaacacuuuacaauguuca

SEQ ID NO: 559215 - RNA, 64 nt, hsa
ugccauccaagugaugauggcuuuuccuggagggaaaggauaggcuguugcucuaucuaauuuu

SEQ ID NO: 559216 - RNA, 64 nt, hsa
uuuuuuuguagaaguagcugucauagagugaagaaaaggauaagacuuuaaacaguugauucuu

SEQ ID NO: 559217 - RNA, 64 nt, hsa
ucaaucaagccagcccucuccucuucugucacguaaaggauauuuggcacacucaugcgucauu

SEQ ID NO: 559218 - RNA, 58 nt, hsa; identical to SEQ ID NO: 558898

SEQ ID NO: 559219 - RNA, 64 nt, hsa
aacaagauccucccagcuuucucucuacauguagaaaggauaacauuucucaugaacccacugc

SEQ ID NO: 559220 - RNA, 64 nt, hsa
auaggaacuacaacuucauaaaugaggaaccagaaaaggauagcugggaggcauuacauaguca

SEQ ID NO: 559221 - RNA, 64 nt, hsa
ucuacugggauaaaccucaauuccuuuauucaggaaaggauacuuuauugcauuauuguugcag

SEQ ID NO: 559222 - RNA, 64 nt, hsa
uggcucaaaaccgaaaacaaugaagcuugguuuuaaaggauaaaguuuucuuuuuuguuuuccu

SEQ ID NO: 559223 - RNA, 64 nt, hsa
uaaauaagccuaucuuuuugugcuuacauacuuaaaaggauaucauuaaguauauaaacaauca

SEQ ID NO: 559224 - RNA, 64 nt, hsa
uguuuauaaguuuugagauuuuuuuuuuuucugaaaaggauaccaaagugcgauaacugaacau

SEQ ID NO: 559225 - RNA, 64 nt, hsa
gcugcagcaaagggagacuagagagagauuuguuaaaggauacaaaguuacagcuugguaggag

SEQ ID NO: 559226 - RNA, 64 nt, hsa
uaccaaaucccugggguaaaagcuaggguaagguaaaggauagacucacauuuacaaguaguga

SEQ ID NO: 559227 - RNA, 64 nt, hsa
agggggagggagauggaugcucaguugucacaucaaaggauacagcauuauucuagcagcaucc

SEQ ID NO: 559228 - RNA, 64 nt, hsa
uuuuuuaagugucaaauaucaucaugguuugaaaaaaggauaaaaaagcuauaacuaaaaaaau

SEQ ID NO: 559229 - RNA, 64 nt, hsa
agaccccgugcccuuuaaaccggcauuugcugcuaaaggauacccagaacccucacuacuguaa

SEQ ID NO: 559230 - RNA, 64 nt, hsa
aagcaaagaccacacauuuuuuacuacaaaauguaaaggauaaauguaaauccugcauaacuaa

SEQ ID NO: 559231 - RNA, 64 nt, hsa
auauaacuccacuguacaucauccuuugaguaguaaaggauaaaagcauauauacuaccuauau

SEQ ID NO: 559232 - RNA, 64 nt, hsa
ccgcccaccaccuccuucccccucaucacaugacaaaggauaaugugcaagaaaaguauuuuua

SEQ ID NO: 559233 - RNA, 64 nt, hsa
uuaagaucaugaaacaauuccaguuacauuguaaaaaggauaucuuacgaguaauuuuauugaa

SEQ ID NO: 559234 - RNA, 64 nt, hsa
ucuucaagucaagaaauaaauuucuuuacauagaaaaggauacagauuuaguaccaagaacacu

SEQ ID NO: 559235 - RNA, 64 nt, hsa
aaacaaaaaacuguuuucauuugcucucuugaccaaaggauaggacuuuaguucuuuaagcauu

SEQ ID NO: 559236 - RNA, 64 nt, hsa
gucuguaccagguggugguuauggggucugaaccaaaggauagcagcucuucauuccucuucug

SEQ ID NO: 559237 - RNA, 64 nt, hsa
auuguuuuucuacuucauuuuuccuuuuagagucaaaggauauuuauuuauaggccuuuuuuuu

SEQ ID NO: 559238 - RNA, 64 nt, hsa
ggacuucuuuagaagaagcuucauuuaaaacaugaaaggauaaucugacuuaagaaacuuuuug

SEQ ID NO: 559239 - RNA, 64 nt, hsa
acuuagggcugggaacccgaaccuggugacuuugaaaggauagagcuucauuccauaccaaaga

SEQ ID NO: 559240 - RNA, 64 nt, hsa
cugcuauuuacuagcagugagaagaaaccucaggaaaggauaugaaaaagcaaguggccagugu

SEQ ID NO: 559241 - RNA, 64 nt, hsa
aagaauccuuauuucagucuagcagcuuaacaacaaaggauaaaucagacuauacaaaaccuaa

SEQ ID NO: 559242 - RNA, 64 nt, hsa
ugcuuacauuuuauaaguuuaaggucagcugucaaaaggauaaccugugggguuagaacauauc

SEQ ID NO: 559243 - RNA, 64 nt, hsa
ucuaucacauucucaauaguuccagcucaggaugaaaggauagacacaaaauuguuugaaaaac

SEQ ID NO: 559244 - RNA, 64 nt, hsa
gaaguacguguguguguguguguguuaccauggaaaaggauauucacaguaguacaguucucaa

SEQ ID NO: 559245 - RNA, 64 nt, hsa
auuuugaggugucucuuuggguucuuucuguuugaaaggauauuugucgaaaaaaagagcaaaa

SEQ ID NO: 559246 - RNA, 64 nt, hsa
ggcauuauuacugcauuguuugucacugggaaccaaaggauaaaagaguagcauaagcugcuga

SEQ ID NO: 559247 - RNA, 64 nt, hsa
auaccauuagucagauuugaauaacgagguuuugaaaggauaaaaccuuuucuccaaugacagg

SEQ ID NO: 559248 - RNA, 64 nt, hsa
guugcacauguuuuccccuaaaagcuuacucuagaaaggauauuuuuuggagagggaguguggg

SEQ ID NO: 559249 - RNA, 64 nt, hsa
aagaucugagacaugggauucccauuugagagccaaaggauaugcccugucaugguuucuguuu

SEQ ID NO: 559250 - RNA, 64 nt, hsa
gaaugaaugauguuugaaugauauauaacaaaccaaaggauauuacagaauauuagauucauua

SEQ ID NO: 559251 - RNA, 64 nt, hsa
aaagguuaguauuuuuguuguaguuaggauacuaaaaggauauuaguuacccaagagauccaau

SEQ ID NO: 559252 - RNA, 64 nt, hsa
cguaucucuuuucaucugaaaacuaauaccuggaaaaggauaaaaaaaaaaaggaauccgugac

SEQ ID NO: 559253 - RNA, 64 nt, hsa
ccagagaaauacugacgaaguuuucugauguggcaaaggauauuucccaucuaauaccaguuuc

SEQ ID NO: 559254 - RNA, 64 nt, hsa
uaguggaaagaccagauaacuuuaaauggcuacuaaaggauaauuacuuacuuuuauugcaugu

SEQ ID NO: 559255 - RNA, 64 nt, hsa
auguauacuuuuaaaaaaaagauuugcuaagaucaaaggauauucagaggugcaucuuuuucug

SEQ ID NO: 559256 - RNA, 64 nt, hsa
ccauggaucaagauccaguuuaggguugggaaauaaaggauagggauaaaagaggcaccccauu

SEQ ID NO: 559257 - RNA, 64 nt, hsa
gggggguggcaaucauuuuucuuccuauacauacaaaggauauugucaaaaauggcguucuucu

SEQ ID NO: 559258 - RNA, 64 nt, hsa
gaaccucugauuuauuuuguaugaaauauaugugaaaggauaugaaucugagagaugcuguaga

SEQ ID NO: 559259 - RNA, 64 nt, hsa
acacaaggaacuacauuccagauuuaaagaaaugaaaggauaccauuaguguguauaacagauu

SEQ ID NO: 559260 - RNA, 64 nt, hsa
uuuggaacucugaaggauuuagacaagguuuugaaaaggauaaucauggguuagaaggaagugu

SEQ ID NO: 559261 - RNA, 64 nt, hsa
uguuuugccuagagaggggcaauaaaaaugaaccaaaggauauuuccagaaaggauuaagaaag

SEQ ID NO: 559262 - RNA, 64 nt, hsa
ucuaaugauacugacaacauaaauuaccuaggguaaaggauagcugcaacaaugaaacaggaaa

SEQ ID NO: 559263 - RNA, 64 nt, hsa
acuaacuuuuaaaucaguguguguacugcagggaaaaggauauaggaauacucaucuuacaggg

SEQ ID NO: 559264 - RNA, 64 nt, hsa
guacuugucucucugcuuguuauugguuaagaaaaaaggauaugaggaauucauuuuaucaaug

SEQ ID NO: 559265 - RNA, 64 nt, hsa
uuauuuauucccuaguuugcagaacugucugaauaaaggauacaaggauuauuucaauguuacu

SEQ ID NO: 559266 - RNA, 64 nt, hsa
ucugugucagucuucauuuuaaauauggauacaaaaaggauacgccgagccaaucaaagacaag

SEQ ID NO: 559267 - RNA, 64 nt, hsa
uggaaauuugaauuaaauacuguaucauacuuucaaaggauaaaaagacuaccccucugaaggu

SEQ ID NO: 559268 - RNA, 64 nt, hsa
gacaauuuuguuugaaauucauauaucuuauuucaaaggauagcauaauaucugcauuaugcug

SEQ ID NO: 559269 - RNA, 64 nt, hsa
caguggucacagggcccaauucuagacauaaaacaaaggauauaccugacagacuacuucugga

SEQ ID NO: 559270 - RNA, 64 nt, hsa
gaaauggaaaaaugaaagaaggcaggaaggaaagaaaggauauaggaagagagggaagcagaag

SEQ ID NO: 559271 - RNA, 64 nt, hsa
uggcuuggugugaacucgcuuaaaagcaauggugaaaggauaaccucgaugauguaaauccacc

SEQ ID NO: 559272 - RNA, 64 nt, hsa
ccaugucuggcauugcauaaacuucucuggugugaaaggauaaauaugccuuucuaaaguugua

SEQ ID NO: 559273 - RNA, 64 nt, hsa
ccgguggagauacaaguucucugacuguguugggaaaggauaagugcuaccguugagaagggaa

SEQ ID NO: 559274 - RNA, 64 nt, hsa
uuuaacaaauaugaccgagucuaguuuuucuuuaaaaggauaguuuaugaguaaucuuuaaaac

SEQ ID NO: 559275 - RNA, 64 nt, hsa
cuggccuccccuggauauacucuauagugcaccaaaaggauaaagcaucuguacauguauuuuu

SEQ ID NO: 559276 - RNA, 64 nt, hsa
ugugucacugccacucuguuuuaucccugaaauuaaaggauaacauaaggaggacuugggccuu

SEQ ID NO: 559277 - RNA, 64 nt, hsa
acccuggagauauuuuuucuuauuugaguccaccaaaggauaaugccaacuuauauaaguucuc

SEQ ID NO: 559278 - RNA, 64 nt, hsa
acuuaaaagcagauuuuuaugggaacuuuuuucgaaaggauacaugaccaccuucuuaaauagu

SEQ ID NO: 559279 - RNA, 64 nt, hsa; identical to SEQ ID NO: 164654

SEQ ID NO: 559280 - RNA, 64 nt, hsa; identical to SEQ ID NO: 164655

SEQ ID NO: 559281 - RNA, 64 nt, hsa
aucaaauuuguuccuuuccucaugcacaaaacauaaaggauaguggcgaguuuacaagcugugg

SEQ ID NO: 559282 - RNA, 64 nt, hsa
auggugggguucuucgggugugaucauauaucauaaaggauauuucaaaugauuaugauuaguu

SEQ ID NO: 559283 - RNA, 64 nt, hsa
gcuucuuuugcaucauuugggacugccauuuaaaaaaggauagguaaacaaagaaaugacaaaa

SEQ ID NO: 559284 - RNA, 64 nt, hsa
aucuucauagcaaugucuccuaaagguguuuuguaaaggauaucaaugccuugauuagaccuaa

SEQ ID NO: 559285 - RNA, 64 nt, hsa
uauguugaacuuuguauacuugaaaugauaauaaaaaggauauaauuucuuaguaaaaugaaau

SEQ ID NO: 559286 - RNA, 64 nt, hsa
aacauuagacacaccaacgagacagaaaguuaaaaaaggauauccgggaauugagcucagcucu

SEQ ID NO: 559287 - RNA, 64 nt, hsa
caguuugaauaguagguaucucuguggaaggaagaaaggauauuguuuguuuuuuucccuuuua

SEQ ID NO: 559288 - RNA, 64 nt, hsa
gccugaggggcucaucgacgccugugacagggagaaaggauacuucugaacaaggagccuccaa

SEQ ID NO: 559289 - RNA, 64 nt, hsa
acacagaauuguuccaguacuauggagugcucacaaaggauacuuuuacagguuaagacaaagg

SEQ ID NO: 559290 - RNA, 64 nt, hsa
aaaaagacacgguugcucuauauaugaagugaaaaaaggauaugguagcauuuuauaguacuag

SEQ ID NO: 559291 - RNA, 64 nt, hsa
guauuauguuguacaucauuaaagaucuaaauacaaaggauauacagucuugaaucuaaaauaa

SEQ ID NO: 559292 - RNA, 64 nt, hsa
auaaauauuuugauauuauuuuccuuuuuaauauaaaggauagguuugaauuguacuuaaaaug

SEQ ID NO: 559293 - RNA, 64 nt, hsa
aaaccaggauccauuuagguaccacuugauauaaaaaggauauccauaaugaauauuuuauacu

SEQ ID NO: 559294 - RNA, 64 nt, hsa
gcacuuuuggacaaugcuaucccagcaggaaaaaaaaggauaauauaacuguuuuaaaacucuu

SEQ ID NO: 559295 - RNA, 64 nt, hsa
uaacagagcucuguugucugguuuuagucuuucuaaaggauauuuuaacuaaaacuauggagau

SEQ ID NO: 559296 - RNA, 64 nt, hsa
cuuucucuguuauuuauauaaaaauaauuuaucaaaaggauauuuuaaaaaagcuagucugucu

SEQ ID NO: 559297 - RNA, 64 nt, hsa
aaucaauguuacaaaauuuaaggguauguuaacuaaaggauagcauuucuaagauauuuugaau

SEQ ID NO: 559298 - RNA, 64 nt, hsa
aguuaguugagaaucagagcauauguuauuggggaaaggauauguuuauugacacauaaucugu

SEQ ID NO: 559299 - RNA, 64 nt, hsa
uuguacauaugugccuugugauugcugcugcuuuaaaggauaaaguacucuuugggggaugagu

SEQ ID NO: 559300 - RNA, 64 nt, hsa; identical to SEQ ID NO: 164656

SEQ ID NO: 559301 - RNA, 64 nt, hsa; identical to SEQ ID NO: 164657

SEQ ID NO: 559302 - RNA, 64 nt, hsa
augcauaaaucaggauaccaucucauuaauuuacaaaggauaaucuuucuuuucauugacaaca

SEQ ID NO: 559303 - RNA, 64 nt, hsa
gccaucuuauuuggcuaauguaggauaaagaauaaaaggauaauuacuuaauguuaauacacag

SEQ ID NO: 559304 - RNA, 64 nt, hsa
acaagggaaguuaaauuuugagacuuuuuuccccaaaggauacugacuguaauacaauuaccaa

SEQ ID NO: 559305 - RNA, 64 nt, hsa
gaaauuucauuuguaauuggaaaaaauccaauaaaaaggauauucauuuagaaaauagcuaaga

SEQ ID NO: 559306 - RNA, 64 nt, hsa
aggucucaauaccugaagcuaucguaaaauuaagaaaggauaaaguugguaaaccuuuuauauu

SEQ ID NO: 559307 - RNA, 64 nt, hsa
gaaaaaaaaucaucuugcccacaggccuguggcaaaaggauaaaaaugugaacgaaguuuaaca

SEQ ID NO: 559308 - RNA, 64 nt, hsa
cauacaaaaguguguauaaaauguacguuuuaaaaaaggauaagugaacacccaugaaccuacu

SEQ ID NO: 559309 - RNA, 64 nt, hsa
acuguuauaugagaaacauuuuaguaauuuaauaaaaggauaauguuuauuuaaaaaaccugac

SEQ ID NO: 559310 - RNA, 64 nt, hsa
caguaauaccauuaacuguuuuaucgauagcaaaaaaggauacuuuuugcaauguuauuagaug

SEQ ID NO: 559311 - RNA, 64 nt, hsa
ucagcccacuuguagaagguccgugugcuuuaccaaaggauauggaagcuacauagaagggaca

SEQ ID NO: 559312 - RNA, 64 nt, hsa
uuauuccuuuauuaacuuagggcagauauaaaauaaaggauaauauaugacaaauucucacuua

SEQ ID NO: 559313 - RNA, 64 nt, hsa
agugaugcuuuuguauuuguggcgauuuuaauaaaaaggauauggccuucccaaugcacaguuu

SEQ ID NO: 559314 - RNA, 64 nt, hsa
ugauugccauuucaauaaaugacauuaaaaaucuaaaggauauuauuguuugaauuuuuggguu

SEQ ID NO: 559315 - RNA, 64 nt, hsa
augugaccgccaggccuccucucguaccuuggacaaaggauacaccugaaccagaauaguuuuc

SEQ ID NO: 559316 - RNA, 64 nt, hsa
gauuuucugguuuuugaaaauuugaguugcaauaaaaggauauuucagugugcgauuucaauuu

SEQ ID NO: 559317 - RNA, 64 nt, hsa
ugaucuuaacuucacuuccauuaggugaagauugaaaggauaggauugacauacccaaaguagc

SEQ ID NO: 559318 - RNA, 64 nt, hsa
cugagggaacgguuggaguggggaucggccugcgaaaggauacugugaaaucacuaauuaacua

SEQ ID NO: 559319 - RNA, 64 nt, hsa
auauuucuagauauugauuaguguaaucgauuauaaaggauauuuaucaaauccagggauugca

SEQ ID NO: 559320 - RNA, 64 nt, hsa
aacuguguagaaacuaaaucaucgcuuuaguaagaaaggauaaaaagguguggaagugaauaua

SEQ ID NO: 559321 - RNA, 64 nt, hsa
cagcaaaauauuguccuuacucauucaagaauuaaaaggauaaauuuuaaaaauguuaucuguc

SEQ ID NO: 559322 - RNA, 64 nt, hsa; identical to SEQ ID NO: 164658

SEQ ID NO: 559323 - RNA, 64 nt, hsa; identical to SEQ ID NO: 164659

SEQ ID NO: 559324 - RNA, 64 nt, hsa
ucugacugaaaacugaguuaacaagaugaaaucuaaaggauauucacagugacuucaauucagg

SEQ ID NO: 559325 - RNA, 64 nt, hsa
aauuauaucuuaagguauguuguagaauaaauuaaaaggauaaucuaaaucaccauuuagauua

SEQ ID NO: 559326 - RNA, 64 nt, hsa
acccuaaauacacgucuguuuagcccgcaauuggaaaggauauauguggcaauauuaaccuggu

SEQ ID NO: 559327 - RNA, 64 nt, hsa
uuuugcacugauggugccaaagggcccugagucaaaaggauagccaaggguggaguggaaaaag

SEQ ID NO: 559328 - RNA, 64 nt, hsa
acuagggcugaguugugucuccauuuugauaaggaaaggauaugcucagacucuugcuuguuca

SEQ ID NO: 559329 - RNA, 64 nt, hsa
auggaaggcuuucaguuuuaauauggcugaaagcaaaggauaacgaauucagaauuaguaaugu

SEQ ID NO: 559330 - RNA, 64 nt, hsa
guuauuuacaugucagagacauuuauaaaaagugaaaggauaaaaaaaaaaaaaaacaacuaau

SEQ ID NO: 559331 - RNA, 64 nt, hsa
aauauaacaagugggugaaugugguuauggccgaaaaggauaugcaguaugcuuaaugguagca

SEQ ID NO: 559332 - RNA, 64 nt, hsa
cguguuuguugugauuaccgaguuaauacuuacaaaaggauaaaaauaaacuccugcuucccaa

SEQ ID NO: 559333 - RNA, 64 nt, hsa
ucucauauaagacaaauauuccuuugcauauuauaaaggauaaagaaggaugaugucuuuuuau

SEQ ID NO: 559334 - RNA, 64 nt, hsa
uguguaugugugguuucaguucuguguacauuuuaaaggauaauggugaacauuuuaauggguu

SEQ ID NO: 559335 - RNA, 64 nt, hsa
ggagcugaggccauucccuguaggaguaaagauaaaaggauaggaaaagauucaaagcucuaau

SEQ ID NO: 559336 - RNA, 64 nt, hsa
gcagacagacaauugaaaauacugggcagguccaaaaggauaguuccaggccauaggaauggcu

SEQ ID NO: 559337 - RNA, 64 nt, hsa
aaguuacaagcuuaagauacagaagcauuuguucaaaggauagaaagcaucuaaaaguuuaggc

SEQ ID NO: 559338 - RNA, 64 nt, hsa
auuucuguguuuugauagaagucacacaaaaaaaaaaggauaaaagaaacccuuccccccuucu

SEQ ID NO: 559339 - RNA, 64 nt, hsa
uucaaauugugcagagaaacaauaaaauuuuuaaaaaggauaaacuggcuaguuaaaaguaaau

SEQ ID NO: 559340 - RNA, 64 nt, hsa
uuagaaucucccucacucuauaguugcccaguugaaaggauaaggaggagggguggcuuuuaug

SEQ ID NO: 559341 - RNA, 64 nt, hsa
ucugccuugcaggauccauuuaucauucauugguaaaggauauauuccuuguucuuaccaagug

SEQ ID NO: 559342 - RNA, 64 nt, hsa
agggccacuauggaacccugcuguucccccuuccaaaggauacuaagaugccccucuggugggu

SEQ ID NO: 559343 - RNA, 64 nt, hsa
cuuucauuccguuuggaugucuacauuccuuaucaaaggauauaaauacuguguaugcuuuuga

SEQ ID NO: 559344 - RNA, 64 nt, hsa
auagcaaaguuaaacauucuuauuucucauauuuaaaggauaccacaauaagcugcugugugug

SEQ ID NO: 559345 - RNA, 64 nt, hsa
gcaaggcugcuugauucacagauggaugugaccuaaaggauaaauaagcuauuacuuaugugcu

SEQ ID NO: 559346 - RNA, 64 nt, hsa
ccuccacauccuggaaucaaucacacugacagggaaaggauaaaugcuccuuuauaagccaaca

SEQ ID NO: 559347 - RNA, 64 nt, hsa
uucccauagugcuucacacagcuccccugcuucuaaaggauaagguacuguagccuugguccug

SEQ ID NO: 559348 - RNA, 64 nt, hsa
guguaauuagugggggaaaaaauauuuuuuaaacaaaggauauaaccauauuuaguuguacagu

SEQ ID NO: 559349 - RNA, 64 nt, hsa
auggugcuauuuaaacaauuuuuuucuaacgugaaaaggauaaaacauuaaaaacucuugagaa

SEQ ID NO: 559350 - RNA, 64 nt, hsa
ggguagggaauacuggagauauuuguacagaagaaaaggauauuuauauauuuucuuaaaacag

SEQ ID NO: 559351 - RNA, 64 nt, hsa
aagcagaaaacauacuuauuuuaaaaaagaaaaaaaaggauaaaaaaacccaaacugaaauucu

SEQ ID NO: 559352 - RNA, 64 nt, hsa
cuccacucacucaaaaucagagccacgaugacccaaaggauaagaaagaaaagagagcucaggc

SEQ ID NO: 559353 - RNA, 64 nt, hsa
aucuuauguuuuuuaaauggaguuaugaauuuuaaaaggauaaaaaugcuuuauuuauacagau

SEQ ID NO: 559354 - RNA, 64 nt, hsa
auaauucaauguguuuuuaacacaugaaaauauuaaaggauaugcaagagaaauuuuucaagca

SEQ ID NO: 559355 - RNA, 64 nt, hsa
aaagaaagcuguggaaaggaccugccccacaugaaaaggauaagccaagauggcuguaaacaca

SEQ ID NO: 559356 - RNA, 64 nt, hsa
gauggauuuuaaaagaauauaauguucaauauuaaaaggauaauucacauuugccaccauaaug

SEQ ID NO: 559357 - RNA, 64 nt, hsa
aaacuaauugacuuuagaaagcugacauugccaaaaaggauacauaaugggccacugaaaucug

SEQ ID NO: 559358 - RNA, 64 nt, hsa
ucuucugaagacaaaacugaaugcuauagcuuugaaaggauaaaaagcccugaagugcucauca

SEQ ID NO: 559359 - RNA, 64 nt, hsa
acuaccugagaccagcugugauguuuaaagacauaaaggauaaaguuuacuuuuaaaggguuuc

SEQ ID NO: 559360 - RNA, 64 nt, hsa
acuccccaucaaaaaaaaaaauggauacaugguuaaaggauagaagggcaauauuuuaucauau

SEQ ID NO: 559361 - RNA, 64 nt, hsa
ucaguuauacuugugaauugugaucuaacugcagaaaggauacauuauuaaaauacuuugccuu

SEQ ID NO: 559362 - RNA, 64 nt, hsa; identical to SEQ ID NO: 164660

SEQ ID NO: 559363 - RNA, 64 nt, hsa; identical to SEQ ID NO: 164661

SEQ ID NO: 559364 - RNA, 64 nt, hsa
agaaacucuaaauaguugaaaggcuaaccugcucaaaggauaccaaauaaugguuuaacuggac

SEQ ID NO: 559365 - RNA, 64 nt, hsa
agacauugaaaaggaagaggcauagucaugaucaaaaggauauauugacaguuaucuauagcca

SEQ ID NO: 559366 - RNA, 64 nt, hsa
agucauaccuacauucaaggagaggggaccaugcaaaggauaaacugcaggugaagaacuugag

SEQ ID NO: 559367 - RNA, 64 nt, hsa
uauguacuccuguuugccaagcucaauaauggacaaaggauacaaacacacacacaucuacuau

SEQ ID NO: 559368 - RNA, 64 nt, hsa
ugugaucgucaaugugaauagcuuagaauacugcaaaggauaagcuaauugaaugccuugaaag

SEQ ID NO: 559369 - RNA, 62 nt, hsa; identical to SEQ ID NO: 559049

SEQ ID NO: 559370 - RNA, 64 nt, hsa
ccuucuuauuuguauggaaugcgcuuauuuuuugaaaggauauuaggccggaugugguggcuca

SEQ ID NO: 559371 - RNA, 64 nt, hsa
aagggaggccugcgcaaagcuaguuuuauuucuuaaaggauaacagucauacauagaauacuag

SEQ ID NO: 559372 - RNA, 64 nt, hsa
ugaaaugugugagaguguuacuuacugaaaacugaaaggauaugacaugcuggaacaggcaaaa

SEQ ID NO: 559373 - RNA, 64 nt, hsa
cuaggagcaugaaguuugaguuuuguguuuuuccaaaggauacuuccuuggcccuuuuucuuua

SEQ ID NO: 559374 - RNA, 64 nt, hsa
gggaaucugugaacgccuagaaaaugagcagaauaaaggauauuaucuuuggaagucuuagaug

SEQ ID NO: 559375 - RNA, 64 nt, hsa
gacugguuuguuugcuuaauuuccuucuguuaagaaaggauauaaaaggauguuacaaguuugc

SEQ ID NO: 559376 - RNA, 64 nt, hsa
ugaggaaucaaggggccauuaccaaggggcaggaaaaggauauguaagagguggccuucauggu

SEQ ID NO: 559377 - RNA, 64 nt, hsa
gccuggagaaaaccagagauccaguacagaaaggaaaggauauuuauugauuaacagaaguugu

SEQ ID NO: 559378 - RNA, 64 nt, hsa
caauuguaacaauaaaucacagccacuugacaagaaaggauauucauuauuuucaaauggcuuu

SEQ ID NO: 559379 - RNA, 64 nt, hsa
cgcccuggagccaaucuucaagaaaggaauuuccaaaggauaauauuuuucuaauaaaugcggc

SEQ ID NO: 559380 - RNA, 64 nt, hsa
uuuaaacuuaauuaaagaaaaacuauuuaaagguaaaggauauuuuguugacaucgguggcucg

SEQ ID NO: 559381 - RNA, 64 nt, hsa
ggcuggagucccaugaggaugugggcccuuuaauaaaggauagcaaacagggagcuuguggccu

SEQ ID NO: 559382 - RNA, 64 nt, hsa
ucagggaaucaaacuaaauguccaucagugguagaaaggauaaagaaaaugugguggcagggag

SEQ ID NO: 559383 - RNA, 64 nt, hsa
auaguauuggcuucaguccgagccacaggcaauaaaaggauaucagcuguaguucucagcuaca

SEQ ID NO: 559384 - RNA, 64 nt, hsa
cauuguaugggacuuuccuuuggaucccccaaucaaaggauaagcaaugcguaagccugugucc

SEQ ID NO: 559385 - RNA, 64 nt, hsa
uuuuuuuggacagaguguggaaagggagccccccaaaggauagcuucuuuuucaugaugccagg

SEQ ID NO: 559386 - RNA, 64 nt, hsa
aggugucauuuccauuauuuauauuaguuuagccaaaggauaaguguccccuauggggaugguc

SEQ ID NO: 559387 - RNA, 64 nt, hsa
agguguuauuuccauuauuuauauuaguuuagccaaaggauaaguguccccuauggggaugguc

SEQ ID NO: 559388 - RNA, 64 nt, hsa
cucugucucccuauaaugcuggagcggcuacuaaaaaggauaaaauguaucacuuaaauguuac

SEQ ID NO: 559389 - RNA, 64 nt, hsa
aaaggauggaacuauggguucucuucgcaaagccaaaggauaguguuuaacaagccagcuggcu

SEQ ID NO: 559390 - RNA, 64 nt, hsa
gaaaacaggagaggagaaauaucucauacaagugaaaggauacuggagagagaaauuacccauu

SEQ ID NO: 559391 - RNA, 64 nt, hsa
uggucccgaaagauugcaacuuuggcugcuacagaaaggauagaaccuuuuuggggggagggug

SEQ ID NO: 559392 - RNA, 64 nt, hsa; identical to SEQ ID NO: 164662

SEQ ID NO: 559393 - RNA, 64 nt, hsa; identical to SEQ ID NO: 164663

SEQ ID NO: 559394 - RNA, 64 nt, hsa
cguuuccaacucugauugucacuugcaucuucacaaaggauaaaccacggagcaacuggaaaac

SEQ ID NO: 559395 - RNA, 64 nt, hsa
agucugucagguuugguuuuuuuguacaauaugaaaaggauauuaucuaccuguucuguagcuu

SEQ ID NO: 559396 - RNA, 64 nt, hsa
ucaguagaaugauuucauuuagauguauaaugaaaaaggauaaugcaaaaauuauguaauagau

SEQ ID NO: 559397 - RNA, 64 nt, hsa
caaaagaaaguuacagguauugcacuggguggggaaaggauagugugucuuuaacucuuaaauu

SEQ ID NO: 559398 - RNA, 64 nt, hsa
cucuucaucugggaccuggaaauccugaaauaaaaaaggauaaugcaauaaacacaguugcagg

SEQ ID NO: 559399 - RNA, 64 nt, hsa
ugaauauuacuccuauuuuuguaaacuggaauuaaaaggauaguauuuuuauccaugacaggcc

SEQ ID NO: 559400 - RNA, 64 nt, hsa
uuccucuggcccucccuuuuccuccacgaggauuaaaggauacaagcugaccaggccucacagg

SEQ ID NO: 559401 - RNA, 64 nt, hsa
guuuugcauuuuuaauuauaauuuauuuauuuagaaaggauacuaauuuuuuuuauuacuccua

SEQ ID NO: 559402 - RNA, 64 nt, hsa
ucuauuuuauucuuggggggaucaaaccuuaggaaaaggauaucuauauaucuauauagcuaua

SEQ ID NO: 559403 - RNA, 64 nt, hsa
augaaaacaaccccaagcuauauauuaccagaugaaaggauaaacaaaauaugguccauccaua

SEQ ID NO: 559404 - RNA, 64 nt, hsa
gcuuucccucaucauaauguagauaaaaagaaaaaaaggauaugguuaccuguaaucuuaccaa

SEQ ID NO: 559405 - RNA, 64 nt, hsa
uuuccugaagaccggggcaucgggguggggugauaaaggauacaaccugcacagggggaaguua

SEQ ID NO: 559406 - RNA, 64 nt, hsa
uuauaaaagcaagguuuauuauaaaagauacuacaaaggauacagaugaagaggcacauagggc

SEQ ID NO: 559407 - RNA, 64 nt, hsa
augaaaacaaccccaagcuauauauuaccagaugaaaggauaaacaaaaugugguccauccaua

SEQ ID NO: 559408 - RNA, 64 nt, hsa
acaaaaaggcaaauguacccuuugaccauaucccaaaggauagucuuuaucaguucauuauuua

SEQ ID NO: 559409 - RNA, 64 nt, hsa; identical to SEQ ID NO: 164664

SEQ ID NO: 559410 - RNA, 64 nt, hsa; identical to SEQ ID NO: 164665

SEQ ID NO: 559411 - RNA, 64 nt, hsa
agaaaagaacuccauuucauuggacuaaauaacaaaaggauaauguuuucauaauuuuuuauug

SEQ ID NO: 559412 - RNA, 64 nt, hsa
gaaaaauacucaauguuauuggacuaaauaaucaaaaggauaaugauuucauaauuuucuauuu

SEQ ID NO: 559413 - RNA, 64 nt, hsa
gaaaaaaacucaauguuauuggacuaaauaaucaaaaggauaauguuuucauaauuuuuuauug

SEQ ID NO: 559414 - RNA, 64 nt, hsa
uacucuguccagacaugauagagggacagagccaaaaggauagagaaagagacccagaaaaagg

SEQ ID NO: 559415 - RNA, 64 nt, hsa
cuugguuggagagcugaacaggcugggacugaggaaaggauaaaccccgauauugggaccucac

SEQ ID NO: 559416 - RNA, 64 nt, hsa
acagugagaaucugucucaaaaaaaaaaaaaaaaaaaggauaucaaagcuggaugguggcucau

SEQ ID NO: 559417 - RNA, 64 nt, hsa
ucucaagaguauuaaaaggauuauaugaaguaauaaaggauaaaaugcauuggaaaaagcugug

SEQ ID NO: 559418 - RNA, 64 nt, hsa
caaguuuguauuuccucagaguucucacauauggaaaggauacacacuuuguagaaacaagaac

SEQ ID NO: 559419 - RNA, 64 nt, hsa
acacugcaucaguauacauaacaugaaggaauaaaaaggauacagaauuguauauacauacuua

SEQ ID NO: 559420 - RNA, 64 nt, hsa
ucaaaaaacuggguggagaaauaauuguuucuuuaaaggauaugaguuagaaucacccccuguu

SEQ ID NO: 559421 - RNA, 64 nt, hsa
guuuucuuuucucuuuuacugcuaagcagccuggaaaggauaaaugaauauuagacuaagauuu

SEQ ID NO: 559422 - RNA, 64 nt, hsa
ucuccuuuugaacuugucacgaauuccaucuuguaaaggauauuaaauguugcuuuaaccugaa

SEQ ID NO: 559423 - RNA, 64 nt, hsa
cccauuacacuagagcagggcucuauuuauuuuuaaaggauauggccguguguuuugauaaaac

SEQ ID NO: 559424 - RNA, 64 nt, hsa
ucugugcguugggucaguuucuguuacguaacgaaaaggauaaacaucucccacgggagaggcc

SEQ ID NO: 559425 - RNA, 64 nt, hsa
aaagaaaaaaaaagccuuaguggccugguuguucaaaggauaagaauagcuuuauccugcacuc

SEQ ID NO: 559426 - RNA, 64 nt, hsa
guggcucaagauuuggccccaugcagacccucccaaaggauacugccuucucaagaucauaggc

SEQ ID NO: 559427 - RNA, 64 nt, hsa
caugaagcaggcaugagccagagggaggaaguugaaaggauacuaaugauuccugagcaccucc

SEQ ID NO: 559428 - RNA, 64 nt, hsa
gaacuugguaguucauaaagguuuacagugaauaaaaggauaucaucuugaguauagcaauauc

SEQ ID NO: 559429 - RNA, 64 nt, hsa
guaaucccaggcuggccauucauucagguuuuuuaaaggauauuuaacuuuuauggacuagaag

SEQ ID NO: 559430 - RNA, 64 nt, hsa
cauuuuuaaagucuaaacuguuaaacaacucuuuaaaggauaauuauccaauaaaaaaaaaccu

SEQ ID NO: 559431 - RNA, 64 nt, hsa
aauaaaccgccuuuuuggcagccuaccaaugccaaaaggauaaaugucuuuccaaaagugugua

SEQ ID NO: 559432 - RNA, 64 nt, hsa
agcuaguuuuaaaauaaugaucucagauuuuuaaaaaggauauaggaaccugcauugucauucu

SEQ ID NO: 559433 - RNA, 64 nt, hsa
ccuaauucguuuuccuauuucuuuucauacaaauaaaggauaccuggauuuauuuagguuauua

SEQ ID NO: 559434 - RNA, 64 nt, hsa
caaaugaauuuaucauuuuaguauaguuuucgauaaaggauauagcaacaucuuuugauaauug

SEQ ID NO: 559435 - RNA, 64 nt, hsa
ggauuuuagcauauguuaagaggaauugcagugaaaaggauaacauuuuuccauaguaaauugu

SEQ ID NO: 559436 - RNA, 64 nt, hsa
auuucugauauagaauugcaauuuuaacacacauaaaggauaaacuuuuagaaacuuaucuuac

SEQ ID NO: 559437 - RNA, 64 nt, hsa
aguaagagagauuguaaaugauaaaccgagcuuuaaaggauaaaguguuaauaaagaaaggaag

SEQ ID NO: 559438 - RNA, 64 nt, hsa
uauuuucaguuauuauauuuacaaaugggaaacaaaaggauaaugaauacuuuauaaaggauua

SEQ ID NO: 559439 - RNA, 64 nt, hsa
auuaucacuaauaagcaucaguuuguuguuuuuaaaaggauauuuaagugagcauuuucuaguu

SEQ ID NO: 559440 - RNA, 64 nt, hsa
ccaaacggugaauauuauagaagaaugggggaagaaaggauagaauauuaaaacugcuuugcau

SEQ ID NO: 559441 - RNA, 64 nt, hsa
cuguguucuaauuaacacaguaaucuguucagccaaaggauacuaacagccauucuuuggacug

SEQ ID NO: 559442 - RNA, 64 nt, hsa
gcaugugugcaugugaguauguuugcaaaauaauaaaggauauuggagaccuguuuuagaagga

SEQ ID NO: 559443 - RNA, 64 nt, hsa
gagagaaaagcuccuuuucucuucacuguuuuggaaaggauagccauuagcaugacugcuuugu

SEQ ID NO: 559444 - RNA, 64 nt, hsa
guugacagauuuguagacaauuacaaaagccaaaaaaggauaaaauaagcauuaggaaggcuag

SEQ ID NO: 559445 - RNA, 64 nt, hsa
acacacacacacacacgugcacacacacacauuuaaaggauauaaaaagaagagguugaaagau

SEQ ID NO: 559446 - RNA, 64 nt, hsa
caccaaauaauaaauauuaagaagaaugggggaaaaaggauagaauauuaaaacugcuuugcau

SEQ ID NO: 559447 - RNA, 64 nt, hsa
aggcagacgugcuuuauagcuaaaugaacaaagcaaaggauacagagguauguucucucuuaga

SEQ ID NO: 559448 - RNA, 64 nt, hsa; identical to SEQ ID NO: 520271

SEQ ID NO: 559449 - RNA, 64 nt, hsa; identical to SEQ ID NO: 520272

SEQ ID NO: 559450 - RNA, 64 nt, hsa; identical to SEQ ID NO: 520273

SEQ ID NO: 559451 - RNA, 64 nt, hsa; identical to SEQ ID NO: 520274

SEQ ID NO: 559452 - RNA, 64 nt, hsa; identical to SEQ ID NO: 520275

SEQ ID NO: 559453 - RNA, 64 nt, hsa; identical to SEQ ID NO: 520276

SEQ ID NO: 559454 - RNA, 64 nt, hsa; identical to SEQ ID NO: 520277

SEQ ID NO: 559455 - RNA, 64 nt, hsa; identical to SEQ ID NO: 520278

SEQ ID NO: 559456 - RNA, 64 nt, hsa; identical to SEQ ID NO: 520279

SEQ ID NO: 559457 - RNA, 64 nt, hsa; identical to SEQ ID NO: 520280

SEQ ID NO: 559458 - RNA, 64 nt, hsa; identical to SEQ ID NO: 520281

SEQ ID NO: 559459 - RNA, 64 nt, hsa; identical to SEQ ID NO: 520282

SEQ ID NO: 559460 - RNA, 64 nt, hsa; identical to SEQ ID NO: 520283

SEQ ID NO: 559461 - RNA, 64 nt, hsa; identical to SEQ ID NO: 520284

SEQ ID NO: 559462 - RNA, 64 nt, hsa; identical to SEQ ID NO: 520285

SEQ ID NO: 559463 - RNA, 64 nt, hsa; identical to SEQ ID NO: 520286

SEQ ID NO: 559464 - RNA, 63 nt, hsa
gacuuggugggaaguaagcuggagauccaggcugcuggagauccaaugccugcugccuccaga

SEQ ID NO: 559465 - RNA, 63 nt, hsa
accuccacuguaccaagacuuggugggaaguaagcuggagauccaggcugcuggagauccaau

SEQ ID NO: 559466 - RNA, 63 nt, hsa
augccugaaaucccacuacuuugggaggcugaggcuggagaauugcuugaggcuagugagcug

SEQ ID NO: 559467 - RNA, 63 nt, hsa
caguuuauacucuuaauuuaauuuucuuucugagcuggagaacuggcuuugcacuuugguuac

SEQ ID NO: 559468 - RNA, 63 nt, hsa
ucagggcugggccaugugguugauuuuucuaaagcuggagaaaggaagaauugugccuugcau

SEQ ID NO: 559469 - RNA, 63 nt, hsa
ggccaggauagccaagcccugggugagcgagaggcuggagaacacaggagcucacccagggcu

SEQ ID NO: 559470 - RNA, 63 nt, hsa
ggccacgaugaaacagauuucaacugauaaagagcuggagaacuccauguacuuuggaaucuc

SEQ ID NO: 559471 - RNA, 63 nt, hsa
gaucaagcucaucgacuuuggucuggccaggaggcuggagaaugcggggucucugaagguccu

SEQ ID NO: 559472 - RNA, 63 nt, hsa
augagcucacuggaaauucauucuaauccccaagcuggagaaacagguuaagagauccuguuu

SEQ ID NO: 559473 - RNA, 63 nt, hsa
cggagcagugucugucugacggcaggauggggagcuggagagcccccccgacccucagcguac

SEQ ID NO: 559474 - RNA, 63 nt, hsa
gccgcuccagggguggcuggagacgggugggcggcuggagaccaugcagagcgccgugaguuc

SEQ ID NO: 559475 - RNA, 63 nt, hsa
cucugccgccuccccacggccgcuccagggguggcuggagacgggugggcggcuggagaccau

SEQ ID NO: 559476 - RNA, 63 nt, hsa
guggggagaugggcauuuggagagucucauguagcuggagacguuaagagcugagcacaccac

SEQ ID NO: 559477 - RNA, 63 nt, hsa
gcauggagggcuguaaagccacggauuccccucgcuggagaggcuccugucugauagcgguag

SEQ ID NO: 559478 - RNA, 63 nt, hsa
auauuaauuauuuuccaaaaucuaaaagcuguagcuggagaagcccauggccacgaggaagca

SEQ ID NO: 559479 - RNA, 63 nt, hsa
aaugggaaaguauuuuugaaagaauucuauuuugcuggagacuauuuaaguacuaucuuuguc

SEQ ID NO: 559480 - RNA, 63 nt, hsa
aaagaaagcauuguuuuaauugagaggggcagggcuggagaaggagcaaguuguggggagcca

SEQ ID NO: 559481 - RNA, 63 nt, hsa
gcgccuguagucccagcagcuugggaggcugaggcuggagaauggugugaacccaggaggcgg

SEQ ID NO: 559482 - RNA, 63 nt, hsa
uguccugaauaaggagauccagagccagcagcggcuggagagccuguccgagacacccgggcc

SEQ ID NO: 559483 - RNA, 63 nt, hsa
uagcaacagcaauuuccgggaggucuuggagaagcuggagagcgaccccgucugccagcgccu

SEQ ID NO: 559484 - RNA, 63 nt, hsa
gugccuguagucccagcuacucgggaggcugaggcuggagaguugcucaaacccgggaggcgg

SEQ ID NO: 559485 - RNA, 63 nt, hsa
caaugugcaccaauaugccuaacuagcuagccagcuggagauaauuuaccagggaauguuuca

SEQ ID NO: 559486 - RNA, 63 nt, hsa
agccauccccacccacuuguaccagcuaagaaugcuggagacucugccaccaugcucugcgug

SEQ ID NO: 559487 - RNA, 63 nt, hsa
caggagcugugccaagcacuuuccucuuuuacagcuggagaucacuggaaaggugucucaguc

SEQ ID NO: 559488 - RNA, 63 nt, hsa
ugccugccgaggcgggacagaguguucgcucgcgcuggagaaggcucugcucagcccugagag

SEQ ID NO: 559489 - RNA, 63 nt, hsa
gugggcaagaaggagcuggcaaggaccggcgcugcuggagacugacccagcccucuggcugag

SEQ ID NO: 559490 - RNA, 63 nt, hsa
gugauugaaagccauugaggagcagguguccgggcuggagaagaguccugcuuucucuggagu

SEQ ID NO: 559491 - RNA, 63 nt, hsa
gcggggcucuuguuggccgcacguggcagugcagcuggagaggaagccuggggcacguccugu

SEQ ID NO: 559492 - RNA, 63 nt, hsa
aaagauccaggcccuccacuucuccuugaggcagcuggagagcuaucccccgccccucaagca

SEQ ID NO: 559493 - RNA, 63 nt, hsa
ucugggguauuuccccugcugaggagugacagggcuggagacugugucugcuuucugccuccu

SEQ ID NO: 559494 - RNA, 63 nt, hsa
cugggcucuccagagcugggcuuggcucuuccagcuggagaaggacugagccccaguaacccc

SEQ ID NO: 559495 - RNA, 63 nt, hsa
gaaccugauguaccugaagcagauccuguauuugcuggagaaauucguggcugugcuaggggg

SEQ ID NO: 559496 - RNA, 63 nt, hsa
ugccuggcgccgugcccuuccuuuguccugcccgcuggagacaguguuugucgugggcguggu

SEQ ID NO: 559497 - RNA, 63 nt, hsa
ugauaccuauaaguucacccccaccccacagcugcuggagagaaaucccaagaggcagcccuu

SEQ ID NO: 559498 - RNA, 63 nt, hsa
aacaggaccugugagcagcugcauuggccuggagcuggagaguaaggcuguaggaucuuugga

SEQ ID NO: 559499 - RNA, 63 nt, hsa
gcuggacccagccaccuuguaugagguggaagagcuggagacggccacugagcgcuaccugca

SEQ ID NO: 559500 - RNA, 63 nt, hsa
gagcgcuaccugcacguacgcccccagccuuuggcuggagaggaucccccugcuuaccaggcc

SEQ ID NO: 559501 - RNA, 63 nt, hsa
ugagaggcuguggcagcaggagacucugcaggagcuggagaggcugcgggagcuggagaggau

SEQ ID NO: 559502 - RNA, 63 nt, hsa
ggagacucugcaggagcuggagaggcugcgggagcuggagaggaugcuggagcugggguggga

SEQ ID NO: 559503 - RNA, 63 nt, hsa
gcuacaagcagaggcugaacaccugcggaaggagcuggagaaucugacaggacagcuuuaagc

SEQ ID NO: 559504 - RNA, 63 nt, hsa
gcuacaagcagaggcugaacaccugcggaaggagcuggagaaucuggcaggacagcuuuaagc

SEQ ID NO: 559505 - RNA, 63 nt, hsa
aaggcaggaaagucugaguugggagugacaguggcuggagagaagcagaucugugcaacgugc

SEQ ID NO: 559506 - RNA, 63 nt, hsa
aguuuuguuugauucugagacucucuugggaacgcuggagagcuugugcacagccucuggaag

SEQ ID NO: 559507 - RNA, 63 nt, hsa
aaccuggucugauuccuuccaacgugcacuucagcuggagaaagaaaccaagaagggaagcgg

SEQ ID NO: 559508 - RNA, 63 nt, hsa
cagucuuguuccagugacaguuggaaggccucugcuggagagacaccagcucucagggcagag

SEQ ID NO: 559509 - RNA, 63 nt, hsa
ggagaacugaacccggaccugcucacugcccuggcuggagaggagcacaacagaugccacguc

SEQ ID NO: 559510 - RNA, 63 nt, hsa
gaggcucaccacaagccuggcauuucagccagggcuggagaaggcagggacgccugggugaga

SEQ ID NO: 559511 - RNA, 63 nt, hsa
uacuuuacccuuaauacacauaagauaauuaaugcuggagagaaacccuacaaaugugaagaa

SEQ ID NO: 559512 - RNA, 63 nt, hsa
uccucaacccuuacuacacauuagauaauucaugcuggagagaaacccuacaaaugugaaaaa

SEQ ID NO: 559513 - RNA, 63 nt, hsa
gacucugucucaaauaauaauaauaauaauaaagcuggagacuuggccacaccugggcuaaag

SEQ ID NO: 559514 - RNA, 63 nt, hsa
ugacgaggacgaggaggaggacuaugagcaguggcuggagaucaaagguaaguugugggagcu

SEQ ID NO: 559515 - RNA, 63 nt, hsa
gugggagagggaugaugaagagagagagggccugcuggagagcauagggucuggaacaccagg

SEQ ID NO: 559516 - RNA, 63 nt, hsa
gauauaaugcgggugagaguaaugaggcuuggggcuggagaggacaagauggguaaacccuca

SEQ ID NO: 559517 - RNA, 63 nt, hsa
ugugcagagguuugugucuccagggaacccacggcuggagagaaauagggagaugcaggaagu

SEQ ID NO: 559518 - RNA, 63 nt, hsa
ucacugccaggccagcggcuuccgcugagacucgcuggagaggcggcucccguguccguccac

SEQ ID NO: 559519 - RNA, 63 nt, hsa
ugaucgccuaggagagggccucguaguggcacagcuggagauaguuucaaagucuaaaccacc

SEQ ID NO: 559520 - RNA, 63 nt, hsa
cuuaaaaugacaaaaaguguccauaaagaggcugcuggagagugcguggccauagggagccga

SEQ ID NO: 559521 - RNA, 64 nt, hsa
guccucuagauuuagauuaugagcccugaggaguuauuggcaagauuugugcaaaauaaaauau

SEQ ID NO: 559522 - RNA, 64 nt, hsa
uguacagucauuuuuaaaucucuugcuaacauuuuauuggcaguauguauuucuaccauuguaa

SEQ ID NO: 559523 - RNA, 64 nt, hsa
uauaucaauaaauaaauuuuuaaagaguaagugcuauuggcauuccaaaauucagcuaaaggaa

SEQ ID NO: 559524 - RNA, 64 nt, hsa
uauaguuaguguaauauaauucauauuuuuaugauauuggcacacugagaaauucauuuuguag

SEQ ID NO: 559525 - RNA, 64 nt, hsa
aauucagugcaggggcauagaauaaaauauuaaauauuggcagauguaugaaaagaagugugag

SEQ ID NO: 559526 - RNA, 64 nt, hsa
uguaugaaaagaagugugaguuaaaaauauugaauauuggcaggugugaaaacaagugucaaaa

SEQ ID NO: 559527 - RNA, 64 nt, hsa
gugauucuccugccucacccucaguagcugggauuauuggcaugcaccacaaaccuuagcuaag

SEQ ID NO: 559528 - RNA, 64 nt, hsa
guuaccauuuagcccauugguugccaucuuuaauuauuggcagugcaaagaucaucagauuagu

SEQ ID NO: 559529 - RNA, 64 nt, hsa; identical to SEQ ID NO: 285349

SEQ ID NO: 559530 - RNA, 64 nt, hsa; identical to SEQ ID NO: 285350

SEQ ID NO: 559531 - RNA, 64 nt, hsa; identical to SEQ ID NO: 285351

SEQ ID NO: 559532 - RNA, 64 nt, hsa; identical to SEQ ID NO: 285352

SEQ ID NO: 559533 - RNA, 63 nt, hsa; identical to SEQ ID NO: 285353

SEQ ID NO: 559534 - RNA, 64 nt, hsa; identical to SEQ ID NO: 285354

SEQ ID NO: 559535 - RNA, 64 nt, hsa; identical to SEQ ID NO: 285355

SEQ ID NO: 559536 - RNA, 64 nt, hsa; identical to SEQ ID NO: 285356

SEQ ID NO: 559537 - RNA, 64 nt, hsa; identical to SEQ ID NO: 285357

SEQ ID NO: 559538 - RNA, 64 nt, hsa; identical to SEQ ID NO: 285358

SEQ ID NO: 559539 - RNA, 64 nt, hsa; identical to SEQ ID NO: 285359

SEQ ID NO: 559540 - RNA, 64 nt, hsa; identical to SEQ ID NO: 285360

SEQ ID NO: 559541 - RNA, 64 nt, hsa; identical to SEQ ID NO: 285361

SEQ ID NO: 559542 - RNA, 64 nt, hsa; identical to SEQ ID NO: 285362

SEQ ID NO: 559543 - RNA, 64 nt, hsa; identical to SEQ ID NO: 285363

SEQ ID NO: 559544 - RNA, 64 nt, hsa; identical to SEQ ID NO: 285364

SEQ ID NO: 559545 - RNA, 64 nt, hsa; identical to SEQ ID NO: 285365

SEQ ID NO: 559546 - RNA, 64 nt, hsa; identical to SEQ ID NO: 285366

SEQ ID NO: 559547 - RNA, 64 nt, hsa; identical to SEQ ID NO: 285367

SEQ ID NO: 559548 - RNA, 64 nt, hsa; identical to SEQ ID NO: 285368

SEQ ID NO: 559549 - RNA, 64 nt, hsa; identical to SEQ ID NO: 285369

SEQ ID NO: 559550 - RNA, 64 nt, hsa; identical to SEQ ID NO: 285370

SEQ ID NO: 559551 - RNA, 64 nt, hsa; identical to SEQ ID NO: 285371

SEQ ID NO: 559552 - RNA, 64 nt, hsa; identical to SEQ ID NO: 285372

SEQ ID NO: 559553 - RNA, 64 nt, hsa; identical to SEQ ID NO: 285373

SEQ ID NO: 559554 - RNA, 64 nt, hsa; identical to SEQ ID NO: 285374

SEQ ID NO: 559555 - RNA, 64 nt, hsa; identical to SEQ ID NO: 285375

SEQ ID NO: 559556 - RNA, 64 nt, hsa; identical to SEQ ID NO: 285376

SEQ ID NO: 559557 - RNA, 64 nt, hsa; identical to SEQ ID NO: 285377

SEQ ID NO: 559558 - RNA, 64 nt, hsa; identical to SEQ ID NO: 285378

SEQ ID NO: 559559 - RNA, 64 nt, hsa; identical to SEQ ID NO: 285379

SEQ ID NO: 559560 - RNA, 64 nt, hsa; identical to SEQ ID NO: 285380

SEQ ID NO: 559561 - RNA, 64 nt, hsa; identical to SEQ ID NO: 285381

SEQ ID NO: 559562 - RNA, 64 nt, hsa; identical to SEQ ID NO: 285382

SEQ ID NO: 559563 - RNA, 64 nt, hsa; identical to SEQ ID NO: 285383

SEQ ID NO: 559564 - RNA, 64 nt, hsa; identical to SEQ ID NO: 285384

SEQ ID NO: 559565 - RNA, 64 nt, hsa; identical to SEQ ID NO: 285385

SEQ ID NO: 559566 - RNA, 64 nt, hsa; identical to SEQ ID NO: 285386

SEQ ID NO: 559567 - RNA, 64 nt, hsa; identical to SEQ ID NO: 285387

SEQ ID NO: 559568 - RNA, 64 nt, hsa; identical to SEQ ID NO: 285388

SEQ ID NO: 559569 - RNA, 64 nt, hsa; identical to SEQ ID NO: 285389

SEQ ID NO: 559570 - RNA, 64 nt, hsa; identical to SEQ ID NO: 285390

SEQ ID NO: 559571 - RNA, 64 nt, hsa; identical to SEQ ID NO: 285391

SEQ ID NO: 559572 - RNA, 64 nt, hsa; identical to SEQ ID NO: 285392

SEQ ID NO: 559573 - RNA, 64 nt, hsa; identical to SEQ ID NO: 285393

SEQ ID NO: 559574 - RNA, 64 nt, hsa; identical to SEQ ID NO: 285394

SEQ ID NO: 559575 - RNA, 64 nt, hsa; identical to SEQ ID NO: 285395

SEQ ID NO: 559576 - RNA, 64 nt, hsa; identical to SEQ ID NO: 285396

SEQ ID NO: 559577 - RNA, 64 nt, hsa; identical to SEQ ID NO: 285397

SEQ ID NO: 559578 - RNA, 64 nt, hsa; identical to SEQ ID NO: 285398

SEQ ID NO: 559579 - RNA, 64 nt, hsa; identical to SEQ ID NO: 285399

SEQ ID NO: 559580 - RNA, 64 nt, hsa; identical to SEQ ID NO: 285400

SEQ ID NO: 559581 - RNA, 64 nt, hsa; identical to SEQ ID NO: 285401

SEQ ID NO: 559582 - RNA, 64 nt, hsa; identical to SEQ ID NO: 285402

SEQ ID NO: 559583 - RNA, 64 nt, hsa; identical to SEQ ID NO: 285403

SEQ ID NO: 559584 - RNA, 64 nt, hsa; identical to SEQ ID NO: 285404

SEQ ID NO: 559585 - RNA, 64 nt, hsa; identical to SEQ ID NO: 285405

SEQ ID NO: 559586 - RNA, 64 nt, hsa; identical to SEQ ID NO: 285406

SEQ ID NO: 559587 - RNA, 64 nt, hsa; identical to SEQ ID NO: 285407

SEQ ID NO: 559588 - RNA, 64 nt, hsa; identical to SEQ ID NO: 285408

SEQ ID NO: 559589 - RNA, 64 nt, hsa; identical to SEQ ID NO: 285409

SEQ ID NO: 559590 - RNA, 64 nt, hsa; identical to SEQ ID NO: 285410

SEQ ID NO: 559591 - RNA, 64 nt, hsa; identical to SEQ ID NO: 285411

SEQ ID NO: 559592 - RNA, 64 nt, hsa; identical to SEQ ID NO: 285412

SEQ ID NO: 559593 - RNA, 64 nt, hsa; identical to SEQ ID NO: 285413

SEQ ID NO: 559594 - RNA, 64 nt, hsa; identical to SEQ ID NO: 285414

SEQ ID NO: 559595 - RNA, 64 nt, hsa; identical to SEQ ID NO: 285415

SEQ ID NO: 559596 - RNA, 64 nt, hsa; identical to SEQ ID NO: 285416

SEQ ID NO: 559597 - RNA, 64 nt, hsa; identical to SEQ ID NO: 285417

SEQ ID NO: 559598 - RNA, 64 nt, hsa; identical to SEQ ID NO: 285418

SEQ ID NO: 559599 - RNA, 64 nt, hsa; identical to SEQ ID NO: 285419

SEQ ID NO: 559600 - RNA, 64 nt, hsa; identical to SEQ ID NO: 285420

SEQ ID NO: 559601 - RNA, 64 nt, hsa; identical to SEQ ID NO: 285421

SEQ ID NO: 559602 - RNA, 64 nt, hsa; identical to SEQ ID NO: 285422

SEQ ID NO: 559603 - RNA, 64 nt, hsa; identical to SEQ ID NO: 285423

SEQ ID NO: 559604 - RNA, 64 nt, hsa; identical to SEQ ID NO: 285424

SEQ ID NO: 559605 - RNA, 64 nt, hsa; identical to SEQ ID NO: 285425

SEQ ID NO: 559606 - RNA, 64 nt, hsa; identical to SEQ ID NO: 285426

SEQ ID NO: 559607 - RNA, 64 nt, hsa; identical to SEQ ID NO: 285427

SEQ ID NO: 559608 - RNA, 64 nt, hsa; identical to SEQ ID NO: 285428

SEQ ID NO: 559609 - RNA, 64 nt, hsa; identical to SEQ ID NO: 285429

SEQ ID NO: 559610 - RNA, 64 nt, hsa; identical to SEQ ID NO: 285430

SEQ ID NO: 559611 - RNA, 64 nt, hsa; identical to SEQ ID NO: 285431

SEQ ID NO: 559612 - RNA, 64 nt, hsa; identical to SEQ ID NO: 285432

SEQ ID NO: 559613 - RNA, 64 nt, hsa; identical to SEQ ID NO: 285433

SEQ ID NO: 559614 - RNA, 64 nt, hsa; identical to SEQ ID NO: 285434

SEQ ID NO: 559615 - RNA, 64 nt, hsa; identical to SEQ ID NO: 285435

SEQ ID NO: 559616 - RNA, 64 nt, hsa; identical to SEQ ID NO: 285436

SEQ ID NO: 559617 - RNA, 64 nt, hsa; identical to SEQ ID NO: 285437

SEQ ID NO: 559618 - RNA, 64 nt, hsa; identical to SEQ ID NO: 285438

SEQ ID NO: 559619 - RNA, 64 nt, hsa; identical to SEQ ID NO: 285439

SEQ ID NO: 559620 - RNA, 64 nt, hsa; identical to SEQ ID NO: 285440

SEQ ID NO: 559621 - RNA, 64 nt, hsa; identical to SEQ ID NO: 285441

SEQ ID NO: 559622 - RNA, 64 nt, hsa; identical to SEQ ID NO: 285442

SEQ ID NO: 559623 - RNA, 55 nt, hsa; identical to SEQ ID NO: 221797

SEQ ID NO: 559624 - RNA, 64 nt, hsa; identical to SEQ ID NO: 285444

SEQ ID NO: 559625 - RNA, 64 nt, hsa; identical to SEQ ID NO: 285445

SEQ ID NO: 559626 - RNA, 64 nt, hsa; identical to SEQ ID NO: 285446

SEQ ID NO: 559627 - RNA, 64 nt, hsa; identical to SEQ ID NO: 285447

SEQ ID NO: 559628 - RNA, 64 nt, hsa; identical to SEQ ID NO: 285448

SEQ ID NO: 559629 - RNA, 64 nt, hsa; identical to SEQ ID NO: 285449

SEQ ID NO: 559630 - RNA, 64 nt, hsa; identical to SEQ ID NO: 285450

SEQ ID NO: 559631 - RNA, 64 nt, hsa; identical to SEQ ID NO: 285451

SEQ ID NO: 559632 - RNA, 64 nt, hsa; identical to SEQ ID NO: 285452

SEQ ID NO: 559633 - RNA, 64 nt, hsa; identical to SEQ ID NO: 285453

SEQ ID NO: 559634 - RNA, 64 nt, hsa; identical to SEQ ID NO: 285454

SEQ ID NO: 559635 - RNA, 64 nt, hsa; identical to SEQ ID NO: 285455

SEQ ID NO: 559636 - RNA, 64 nt, hsa; identical to SEQ ID NO: 285456

SEQ ID NO: 559637 - RNA, 64 nt, hsa; identical to SEQ ID NO: 285457

SEQ ID NO: 559638 - RNA, 64 nt, hsa; identical to SEQ ID NO: 285458

SEQ ID NO: 559639 - RNA, 64 nt, hsa; identical to SEQ ID NO: 285459

SEQ ID NO: 559640 - RNA, 64 nt, hsa; identical to SEQ ID NO: 285460

SEQ ID NO: 559641 - RNA, 52 nt, hsa; identical to SEQ ID NO: 221815

SEQ ID NO: 559642 - RNA, 64 nt, hsa; identical to SEQ ID NO: 285462

SEQ ID NO: 559643 - RNA, 64 nt, hsa; identical to SEQ ID NO: 285463

SEQ ID NO: 559644 - RNA, 64 nt, hsa; identical to SEQ ID NO: 285464

SEQ ID NO: 559645 - RNA, 64 nt, hsa; identical to SEQ ID NO: 285465

SEQ ID NO: 559646 - RNA, 64 nt, hsa; identical to SEQ ID NO: 285466

SEQ ID NO: 559647 - RNA, 64 nt, hsa; identical to SEQ ID NO: 285467

SEQ ID NO: 559648 - RNA, 64 nt, hsa; identical to SEQ ID NO: 285468

SEQ ID NO: 559649 - RNA, 64 nt, hsa; identical to SEQ ID NO: 285469

SEQ ID NO: 559650 - RNA, 64 nt, hsa; identical to SEQ ID NO: 285470

SEQ ID NO: 559651 - RNA, 64 nt, hsa; identical to SEQ ID NO: 285471

SEQ ID NO: 559652 - RNA, 64 nt, hsa; identical to SEQ ID NO: 285472

SEQ ID NO: 559653 - RNA, 64 nt, hsa; identical to SEQ ID NO: 285473

SEQ ID NO: 559654 - RNA, 64 nt, hsa; identical to SEQ ID NO: 285474

SEQ ID NO: 559655 - RNA, 64 nt, hsa; identical to SEQ ID NO: 285475

SEQ ID NO: 559656 - RNA, 64 nt, hsa; identical to SEQ ID NO: 285476

SEQ ID NO: 559657 - RNA, 64 nt, hsa; identical to SEQ ID NO: 285477

SEQ ID NO: 559658 - RNA, 64 nt, hsa; identical to SEQ ID NO: 285478

SEQ ID NO: 559659 - RNA, 64 nt, hsa; identical to SEQ ID NO: 285479

SEQ ID NO: 559660 - RNA, 64 nt, hsa; identical to SEQ ID NO: 285480

SEQ ID NO: 559661 - RNA, 64 nt, hsa; identical to SEQ ID NO: 285481

SEQ ID NO: 559662 - RNA, 64 nt, hsa; identical to SEQ ID NO: 285482

SEQ ID NO: 559663 - RNA, 64 nt, hsa; identical to SEQ ID NO: 285483

SEQ ID NO: 559664 - RNA, 64 nt, hsa; identical to SEQ ID NO: 285484

SEQ ID NO: 559665 - RNA, 64 nt, hsa; identical to SEQ ID NO: 285485

SEQ ID NO: 559666 - RNA, 64 nt, hsa; identical to SEQ ID NO: 285486

SEQ ID NO: 559667 - RNA, 64 nt, hsa; identical to SEQ ID NO: 285487

SEQ ID NO: 559668 - RNA, 64 nt, hsa; identical to SEQ ID NO: 285488

SEQ ID NO: 559669 - RNA, 64 nt, hsa; identical to SEQ ID NO: 285489

SEQ ID NO: 559670 - RNA, 64 nt, hsa; identical to SEQ ID NO: 285490

SEQ ID NO: 559671 - RNA, 64 nt, hsa; identical to SEQ ID NO: 285491

SEQ ID NO: 559672 - RNA, 64 nt, hsa; identical to SEQ ID NO: 285492

SEQ ID NO: 559673 - RNA, 64 nt, hsa; identical to SEQ ID NO: 285493

SEQ ID NO: 559674 - RNA, 64 nt, hsa; identical to SEQ ID NO: 285494

SEQ ID NO: 559675 - RNA, 64 nt, hsa; identical to SEQ ID NO: 285495

SEQ ID NO: 559676 - RNA, 64 nt, hsa; identical to SEQ ID NO: 285496

SEQ ID NO: 559677 - RNA, 64 nt, hsa; identical to SEQ ID NO: 285497

SEQ ID NO: 559678 - RNA, 64 nt, hsa; identical to SEQ ID NO: 285498

SEQ ID NO: 559679 - RNA, 64 nt, hsa; identical to SEQ ID NO: 285499

SEQ ID NO: 559680 - RNA, 64 nt, hsa; identical to SEQ ID NO: 285500

SEQ ID NO: 559681 - RNA, 64 nt, hsa; identical to SEQ ID NO: 285501

SEQ ID NO: 559682 - RNA, 64 nt, hsa; identical to SEQ ID NO: 285502

SEQ ID NO: 559683 - RNA, 64 nt, hsa; identical to SEQ ID NO: 285503

SEQ ID NO: 559684 - RNA, 64 nt, hsa; identical to SEQ ID NO: 285504

SEQ ID NO: 559685 - RNA, 64 nt, hsa; identical to SEQ ID NO: 285505

SEQ ID NO: 559686 - RNA, 64 nt, hsa; identical to SEQ ID NO: 285506

SEQ ID NO: 559687 - RNA, 64 nt, hsa; identical to SEQ ID NO: 285507

SEQ ID NO: 559688 - RNA, 64 nt, hsa; identical to SEQ ID NO: 285508

SEQ ID NO: 559689 - RNA, 64 nt, hsa; identical to SEQ ID NO: 285509

SEQ ID NO: 559690 - RNA, 64 nt, hsa; identical to SEQ ID NO: 285510

SEQ ID NO: 559691 - RNA, 64 nt, hsa; identical to SEQ ID NO: 285511

SEQ ID NO: 559692 - RNA, 64 nt, hsa; identical to SEQ ID NO: 285512

SEQ ID NO: 559693 - RNA, 64 nt, hsa; identical to SEQ ID NO: 285513

SEQ ID NO: 559694 - RNA, 64 nt, hsa; identical to SEQ ID NO: 285514

SEQ ID NO: 559695 - RNA, 64 nt, hsa; identical to SEQ ID NO: 285515

SEQ ID NO: 559696 - RNA, 64 nt, hsa; identical to SEQ ID NO: 285516

SEQ ID NO: 559697 - RNA, 64 nt, hsa; identical to SEQ ID NO: 285517

SEQ ID NO: 559698 - RNA, 64 nt, hsa; identical to SEQ ID NO: 285518

SEQ ID NO: 559699 - RNA, 64 nt, hsa; identical to SEQ ID NO: 285519

SEQ ID NO: 559700 - RNA, 64 nt, hsa; identical to SEQ ID NO: 285520

SEQ ID NO: 559701 - RNA, 64 nt, hsa; identical to SEQ ID NO: 285521

SEQ ID NO: 559702 - RNA, 64 nt, hsa; identical to SEQ ID NO: 285522

SEQ ID NO: 559703 - RNA, 64 nt, hsa; identical to SEQ ID NO: 285523

SEQ ID NO: 559704 - RNA, 64 nt, hsa; identical to SEQ ID NO: 285524

SEQ ID NO: 559705 - RNA, 64 nt, hsa; identical to SEQ ID NO: 285525

SEQ ID NO: 559706 - RNA, 64 nt, hsa; identical to SEQ ID NO: 285526

SEQ ID NO: 559707 - RNA, 64 nt, hsa; identical to SEQ ID NO: 285527

SEQ ID NO: 559708 - RNA, 64 nt, hsa; identical to SEQ ID NO: 285528

SEQ ID NO: 559709 - RNA, 64 nt, hsa; identical to SEQ ID NO: 285529

SEQ ID NO: 559710 - RNA, 64 nt, hsa; identical to SEQ ID NO: 285530

SEQ ID NO: 559711 - RNA, 64 nt, hsa; identical to SEQ ID NO: 285531

SEQ ID NO: 559712 - RNA, 64 nt, hsa; identical to SEQ ID NO: 285532

SEQ ID NO: 559713 - RNA, 64 nt, hsa; identical to SEQ ID NO: 285533

SEQ ID NO: 559714 - RNA, 64 nt, hsa; identical to SEQ ID NO: 285534

SEQ ID NO: 559715 - RNA, 64 nt, hsa; identical to SEQ ID NO: 285535

SEQ ID NO: 559716 - RNA, 64 nt, hsa
aaagguuucacguuguaugauuucguuuauaugaaauguccagaauaggcaaaucuguuugaga

SEQ ID NO: 559717 - RNA, 64 nt, hsa
uugcucauaauagccaauaaguaaaaacaacccaaauguccaagaaugaauaaauggauaaaca

SEQ ID NO: 559718 - RNA, 64 nt, hsa
cauuacucaaaagucaaacgguagcaacaacccaaauguccauccacagaugaauuaagacaug

SEQ ID NO: 559719 - RNA, 64 nt, hsa
cuaagugaaagaagccaaucacgaguuuaugugaaauguccagaauaggcaaaucuguguauca

SEQ ID NO: 559720 - RNA, 64 nt, hsa
uagaaaaucacagucagauguuuaaucaauccaaaauguccacuauuucuuaugucauucguua

SEQ ID NO: 559721 - RNA, 64 nt, hsa
cuuaaauuguauaaaauauccccuaacauguuuaaauguccauuuuuauucauuaugcuuugaa

SEQ ID NO: 559722 - RNA, 64 nt, hsa
cuuaaauuugauauaacaucuccuaacuuguuuaaauguccauuuuuauucuuuauguuugaaa

SEQ ID NO: 559723 - RNA, 64 nt, hsa
uuaugaaaauaaauuuuauuucuauccaaauuugaauguccaaaccauuuuuuaguuacuucuu

SEQ ID NO: 559724 - RNA, 64 nt, hsa
aauuugauaguguauaaggugcuuuauucccucgaauguccauuaagcauggaauuuaccaugc

SEQ ID NO: 559725 - RNA, 64 nt, hsa
agggccagauuccccucucuaguccccuuuuuuaaauguccauuuugcuugccuggaauuuuaa

SEQ ID NO: 559726 - RNA, 64 nt, hsa
gggagaaaguaacuacuuuggcucuaccccuagaaauguccaguuuugagugacuguaguaugg

SEQ ID NO: 559727 - RNA, 64 nt, hsa; identical to SEQ ID NO: 557304

SEQ ID NO: 559728 - RNA, 64 nt, hsa; identical to SEQ ID NO: 557305

SEQ ID NO: 559729 - RNA, 64 nt, hsa; identical to SEQ ID NO: 557306

SEQ ID NO: 559730 - RNA, 64 nt, hsa; identical to SEQ ID NO: 557307

SEQ ID NO: 559731 - RNA, 64 nt, hsa; identical to SEQ ID NO: 557308

SEQ ID NO: 559732 - RNA, 64 nt, hsa; identical to SEQ ID NO: 557309

SEQ ID NO: 559733 - RNA, 64 nt, hsa; identical to SEQ ID NO: 557310

SEQ ID NO: 559734 - RNA, 64 nt, hsa; identical to SEQ ID NO: 557311

SEQ ID NO: 559735 - RNA, 64 nt, hsa; identical to SEQ ID NO: 557312

SEQ ID NO: 559736 - RNA, 64 nt, hsa; identical to SEQ ID NO: 557313

SEQ ID NO: 559737 - RNA, 64 nt, hsa; identical to SEQ ID NO: 557314

SEQ ID NO: 559738 - RNA, 64 nt, hsa; identical to SEQ ID NO: 557315

SEQ ID NO: 559739 - RNA, 64 nt, hsa; identical to SEQ ID NO: 557316

SEQ ID NO: 559740 - RNA, 64 nt, hsa; identical to SEQ ID NO: 557317

SEQ ID NO: 559741 - RNA, 64 nt, hsa; identical to SEQ ID NO: 557318

SEQ ID NO: 559742 - RNA, 64 nt, hsa; identical to SEQ ID NO: 557319

SEQ ID NO: 559743 - RNA, 64 nt, hsa; identical to SEQ ID NO: 557320

SEQ ID NO: 559744 - RNA, 64 nt, hsa; identical to SEQ ID NO: 557321

SEQ ID NO: 559745 - RNA, 64 nt, hsa; identical to SEQ ID NO: 557322

SEQ ID NO: 559746 - RNA, 64 nt, hsa; identical to SEQ ID NO: 557323

SEQ ID NO: 559747 - RNA, 64 nt, hsa; identical to SEQ ID NO: 557324

SEQ ID NO: 559748 - RNA, 64 nt, hsa; identical to SEQ ID NO: 557325

SEQ ID NO: 559749 - RNA, 64 nt, hsa; identical to SEQ ID NO: 557326

SEQ ID NO: 559750 - RNA, 64 nt, hsa; identical to SEQ ID NO: 557327

SEQ ID NO: 559751 - RNA, 64 nt, hsa; identical to SEQ ID NO: 323858

SEQ ID NO: 559752 - RNA, 64 nt, hsa; identical to SEQ ID NO: 323859

SEQ ID NO: 559753 - RNA, 64 nt, hsa; identical to SEQ ID NO: 323860

SEQ ID NO: 559754 - RNA, 64 nt, hsa; identical to SEQ ID NO: 323861

SEQ ID NO: 559755 - RNA, 64 nt, hsa; identical to SEQ ID NO: 323862

SEQ ID NO: 559756 - RNA, 64 nt, hsa; identical to SEQ ID NO: 323863

SEQ ID NO: 559757 - RNA, 64 nt, hsa; identical to SEQ ID NO: 323864

SEQ ID NO: 559758 - RNA, 64 nt, hsa; identical to SEQ ID NO: 323865

SEQ ID NO: 559759 - RNA, 64 nt, hsa; identical to SEQ ID NO: 323866

SEQ ID NO: 559760 - RNA, 64 nt, hsa; identical to SEQ ID NO: 323867

SEQ ID NO: 559761 - RNA, 64 nt, hsa; identical to SEQ ID NO: 323868

SEQ ID NO: 559762 - RNA, 64 nt, hsa; identical to SEQ ID NO: 323869

SEQ ID NO: 559763 - RNA, 64 nt, hsa; identical to SEQ ID NO: 323870

SEQ ID NO: 559764 - RNA, 64 nt, hsa; identical to SEQ ID NO: 323871

SEQ ID NO: 559765 - RNA, 64 nt, hsa; identical to SEQ ID NO: 323872

SEQ ID NO: 559766 - RNA, 64 nt, hsa; identical to SEQ ID NO: 323873

SEQ ID NO: 559767 - RNA, 64 nt, hsa; identical to SEQ ID NO: 323874

SEQ ID NO: 559768 - RNA, 64 nt, hsa; identical to SEQ ID NO: 323875

SEQ ID NO: 559769 - RNA, 64 nt, hsa; identical to SEQ ID NO: 323876

SEQ ID NO: 559770 - RNA, 64 nt, hsa; identical to SEQ ID NO: 323877

SEQ ID NO: 559771 - RNA, 64 nt, hsa; identical to SEQ ID NO: 323878

SEQ ID NO: 559772 - RNA, 64 nt, hsa; identical to SEQ ID NO: 323879

SEQ ID NO: 559773 - RNA, 64 nt, hsa; identical to SEQ ID NO: 323880

SEQ ID NO: 559774 - RNA, 64 nt, hsa; identical to SEQ ID NO: 323881

SEQ ID NO: 559775 - RNA, 64 nt, hsa; identical to SEQ ID NO: 323882

SEQ ID NO: 559776 - RNA, 64 nt, hsa; identical to SEQ ID NO: 323883

SEQ ID NO: 559777 - RNA, 64 nt, hsa; identical to SEQ ID NO: 323884

SEQ ID NO: 559778 - RNA, 64 nt, hsa; identical to SEQ ID NO: 323885

SEQ ID NO: 559779 - RNA, 64 nt, hsa; identical to SEQ ID NO: 323886

SEQ ID NO: 559780 - RNA, 64 nt, hsa; identical to SEQ ID NO: 323887

SEQ ID NO: 559781 - RNA, 64 nt, hsa; identical to SEQ ID NO: 323888

SEQ ID NO: 559782 - RNA, 64 nt, hsa; identical to SEQ ID NO: 323889

SEQ ID NO: 559783 - RNA, 64 nt, hsa; identical to SEQ ID NO: 323890

SEQ ID NO: 559784 - RNA, 64 nt, hsa; identical to SEQ ID NO: 323891

SEQ ID NO: 559785 - RNA, 64 nt, hsa; identical to SEQ ID NO: 323892

SEQ ID NO: 559786 - RNA, 64 nt, hsa; identical to SEQ ID NO: 323893

SEQ ID NO: 559787 - RNA, 64 nt, hsa; identical to SEQ ID NO: 323894

SEQ ID NO: 559788 - RNA, 64 nt, hsa; identical to SEQ ID NO: 323895

SEQ ID NO: 559789 - RNA, 64 nt, hsa; identical to SEQ ID NO: 323896

SEQ ID NO: 559790 - RNA, 64 nt, hsa; identical to SEQ ID NO: 323897

SEQ ID NO: 559791 - RNA, 64 nt, hsa; identical to SEQ ID NO: 323898

SEQ ID NO: 559792 - RNA, 64 nt, hsa; identical to SEQ ID NO: 323899

SEQ ID NO: 559793 - RNA, 64 nt, hsa; identical to SEQ ID NO: 323900

SEQ ID NO: 559794 - RNA, 64 nt, hsa; identical to SEQ ID NO: 323901

SEQ ID NO: 559795 - RNA, 64 nt, hsa; identical to SEQ ID NO: 323902

SEQ ID NO: 559796 - RNA, 64 nt, hsa; identical to SEQ ID NO: 323903

SEQ ID NO: 559797 - RNA, 64 nt, hsa; identical to SEQ ID NO: 323904

SEQ ID NO: 559798 - RNA, 64 nt, hsa; identical to SEQ ID NO: 323905

SEQ ID NO: 559799 - RNA, 64 nt, hsa; identical to SEQ ID NO: 323906

SEQ ID NO: 559800 - RNA, 64 nt, hsa; identical to SEQ ID NO: 323907

SEQ ID NO: 559801 - RNA, 64 nt, hsa; identical to SEQ ID NO: 323908

SEQ ID NO: 559802 - RNA, 64 nt, hsa; identical to SEQ ID NO: 323909

SEQ ID NO: 559803 - RNA, 64 nt, hsa; identical to SEQ ID NO: 301531

SEQ ID NO: 559804 - RNA, 64 nt, hsa; identical to SEQ ID NO: 301532

SEQ ID NO: 559805 - RNA, 64 nt, hsa; identical to SEQ ID NO: 301533

SEQ ID NO: 559806 - RNA, 64 nt, hsa; identical to SEQ ID NO: 301534

SEQ ID NO: 559807 - RNA, 64 nt, hsa; identical to SEQ ID NO: 301535

SEQ ID NO: 559808 - RNA, 64 nt, hsa; identical to SEQ ID NO: 301536

SEQ ID NO: 559809 - RNA, 64 nt, hsa; identical to SEQ ID NO: 301537

SEQ ID NO: 559810 - RNA, 64 nt, hsa; identical to SEQ ID NO: 301538

SEQ ID NO: 559811 - RNA, 64 nt, hsa; identical to SEQ ID NO: 301539

SEQ ID NO: 559812 - RNA, 64 nt, hsa; identical to SEQ ID NO: 301540

SEQ ID NO: 559813 - RNA, 64 nt, hsa; identical to SEQ ID NO: 301541

SEQ ID NO: 559814 - RNA, 64 nt, hsa; identical to SEQ ID NO: 301542

SEQ ID NO: 559815 - RNA, 64 nt, hsa; identical to SEQ ID NO: 301543

SEQ ID NO: 559816 - RNA, 64 nt, hsa; identical to SEQ ID NO: 301544

SEQ ID NO: 559817 - RNA, 64 nt, hsa; identical to SEQ ID NO: 301545

SEQ ID NO: 559818 - RNA, 64 nt, hsa; identical to SEQ ID NO: 301546

SEQ ID NO: 559819 - RNA, 64 nt, hsa; identical to SEQ ID NO: 301547

SEQ ID NO: 559820 - RNA, 64 nt, hsa; identical to SEQ ID NO: 301548

SEQ ID NO: 559821 - RNA, 64 nt, hsa; identical to SEQ ID NO: 301549

SEQ ID NO: 559822 - RNA, 64 nt, hsa; identical to SEQ ID NO: 301550

SEQ ID NO: 559823 - RNA, 64 nt, hsa; identical to SEQ ID NO: 301551

SEQ ID NO: 559824 - RNA, 64 nt, hsa; identical to SEQ ID NO: 301552

SEQ ID NO: 559825 - RNA, 64 nt, hsa; identical to SEQ ID NO: 301553

SEQ ID NO: 559826 - RNA, 64 nt, hsa; identical to SEQ ID NO: 301554

SEQ ID NO: 559827 - RNA, 64 nt, hsa; identical to SEQ ID NO: 301555

SEQ ID NO: 559828 - RNA, 64 nt, hsa; identical to SEQ ID NO: 301556

SEQ ID NO: 559829 - RNA, 64 nt, hsa; identical to SEQ ID NO: 301557

SEQ ID NO: 559830 - RNA, 64 nt, hsa; identical to SEQ ID NO: 301558

SEQ ID NO: 559831 - RNA, 64 nt, hsa; identical to SEQ ID NO: 301559

SEQ ID NO: 559832 - RNA, 64 nt, hsa; identical to SEQ ID NO: 301560

SEQ ID NO: 559833 - RNA, 60 nt, hsa; identical to SEQ ID NO: 301561

SEQ ID NO: 559834 - RNA, 64 nt, hsa; identical to SEQ ID NO: 301562

SEQ ID NO: 559835 - RNA, 64 nt, hsa; identical to SEQ ID NO: 301563

SEQ ID NO: 559836 - RNA, 64 nt, hsa; identical to SEQ ID NO: 301564

SEQ ID NO: 559837 - RNA, 64 nt, hsa; identical to SEQ ID NO: 301565

SEQ ID NO: 559838 - RNA, 64 nt, hsa; identical to SEQ ID NO: 301566

SEQ ID NO: 559839 - RNA, 64 nt, hsa; identical to SEQ ID NO: 301567

SEQ ID NO: 559840 - RNA, 64 nt, hsa; identical to SEQ ID NO: 301568

SEQ ID NO: 559841 - RNA, 64 nt, hsa; identical to SEQ ID NO: 301569

SEQ ID NO: 559842 - RNA, 64 nt, hsa; identical to SEQ ID NO: 301570

SEQ ID NO: 559843 - RNA, 64 nt, hsa; identical to SEQ ID NO: 301571

SEQ ID NO: 559844 - RNA, 64 nt, hsa; identical to SEQ ID NO: 301572

SEQ ID NO: 559845 - RNA, 64 nt, hsa; identical to SEQ ID NO: 301573

SEQ ID NO: 559846 - RNA, 64 nt, hsa; identical to SEQ ID NO: 301574

SEQ ID NO: 559847 - RNA, 64 nt, hsa; identical to SEQ ID NO: 301575

SEQ ID NO: 559848 - RNA, 64 nt, hsa; identical to SEQ ID NO: 301576

SEQ ID NO: 559849 - RNA, 64 nt, hsa; identical to SEQ ID NO: 301577

SEQ ID NO: 559850 - RNA, 64 nt, hsa; identical to SEQ ID NO: 301578

SEQ ID NO: 559851 - RNA, 64 nt, hsa; identical to SEQ ID NO: 301579

SEQ ID NO: 559852 - RNA, 64 nt, hsa; identical to SEQ ID NO: 301580

SEQ ID NO: 559853 - RNA, 64 nt, hsa; identical to SEQ ID NO: 301581

SEQ ID NO: 559854 - RNA, 64 nt, hsa; identical to SEQ ID NO: 301582

SEQ ID NO: 559855 - RNA, 64 nt, hsa; identical to SEQ ID NO: 301583

SEQ ID NO: 559856 - RNA, 64 nt, hsa; identical to SEQ ID NO: 301584

SEQ ID NO: 559857 - RNA, 64 nt, hsa; identical to SEQ ID NO: 301585

SEQ ID NO: 559858 - RNA, 64 nt, hsa; identical to SEQ ID NO: 301586

SEQ ID NO: 559859 - RNA, 64 nt, hsa; identical to SEQ ID NO: 301587

SEQ ID NO: 559860 - RNA, 64 nt, hsa; identical to SEQ ID NO: 301588

SEQ ID NO: 559861 - RNA, 64 nt, hsa; identical to SEQ ID NO: 301589

SEQ ID NO: 559862 - RNA, 64 nt, hsa; identical to SEQ ID NO: 301590

SEQ ID NO: 559863 - RNA, 64 nt, hsa; identical to SEQ ID NO: 301591

SEQ ID NO: 559864 - RNA, 64 nt, hsa; identical to SEQ ID NO: 301592

SEQ ID NO: 559865 - RNA, 64 nt, hsa; identical to SEQ ID NO: 301593

SEQ ID NO: 559866 - RNA, 64 nt, hsa; identical to SEQ ID NO: 301594

SEQ ID NO: 559867 - RNA, 64 nt, hsa; identical to SEQ ID NO: 301595

SEQ ID NO: 559868 - RNA, 64 nt, hsa; identical to SEQ ID NO: 301596

SEQ ID NO: 559869 - RNA, 64 nt, hsa; identical to SEQ ID NO: 301597

SEQ ID NO: 559870 - RNA, 64 nt, hsa; identical to SEQ ID NO: 301598

SEQ ID NO: 559871 - RNA, 64 nt, hsa; identical to SEQ ID NO: 301599

SEQ ID NO: 559872 - RNA, 64 nt, hsa; identical to SEQ ID NO: 301600

SEQ ID NO: 559873 - RNA, 64 nt, hsa; identical to SEQ ID NO: 301601

SEQ ID NO: 559874 - RNA, 64 nt, hsa; identical to SEQ ID NO: 301602

SEQ ID NO: 559875 - RNA, 64 nt, hsa; identical to SEQ ID NO: 301603

SEQ ID NO: 559876 - RNA, 64 nt, hsa; identical to SEQ ID NO: 301604

SEQ ID NO: 559877 - RNA, 64 nt, hsa; identical to SEQ ID NO: 301605

SEQ ID NO: 559878 - RNA, 64 nt, hsa; identical to SEQ ID NO: 301606

SEQ ID NO: 559879 - RNA, 64 nt, hsa; identical to SEQ ID NO: 301607

SEQ ID NO: 559880 - RNA, 64 nt, hsa; identical to SEQ ID NO: 301608

SEQ ID NO: 559881 - RNA, 64 nt, hsa; identical to SEQ ID NO: 301609

SEQ ID NO: 559882 - RNA, 64 nt, hsa; identical to SEQ ID NO: 301610

SEQ ID NO: 559883 - RNA, 64 nt, hsa; identical to SEQ ID NO: 301611

SEQ ID NO: 559884 - RNA, 64 nt, hsa; identical to SEQ ID NO: 301612

SEQ ID NO: 559885 - RNA, 64 nt, hsa; identical to SEQ ID NO: 301613

SEQ ID NO: 559886 - RNA, 64 nt, hsa; identical to SEQ ID NO: 301614

SEQ ID NO: 559887 - RNA, 64 nt, hsa; identical to SEQ ID NO: 301615

SEQ ID NO: 559888 - RNA, 64 nt, hsa; identical to SEQ ID NO: 301616

SEQ ID NO: 559889 - RNA, 64 nt, hsa; identical to SEQ ID NO: 301617

SEQ ID NO: 559890 - RNA, 64 nt, hsa; identical to SEQ ID NO: 301618

SEQ ID NO: 559891 - RNA, 64 nt, hsa; identical to SEQ ID NO: 301619

SEQ ID NO: 559892 - RNA, 64 nt, hsa; identical to SEQ ID NO: 301620

SEQ ID NO: 559893 - RNA, 64 nt, hsa; identical to SEQ ID NO: 301621

SEQ ID NO: 559894 - RNA, 64 nt, hsa; identical to SEQ ID NO: 301622

SEQ ID NO: 559895 - RNA, 64 nt, hsa; identical to SEQ ID NO: 301623

SEQ ID NO: 559896 - RNA, 64 nt, hsa; identical to SEQ ID NO: 301624

SEQ ID NO: 559897 - RNA, 64 nt, hsa; identical to SEQ ID NO: 301625

SEQ ID NO: 559898 - RNA, 64 nt, hsa; identical to SEQ ID NO: 301626

SEQ ID NO: 559899 - RNA, 64 nt, hsa; identical to SEQ ID NO: 301627

SEQ ID NO: 559900 - RNA, 64 nt, hsa; identical to SEQ ID NO: 301628

SEQ ID NO: 559901 - RNA, 64 nt, hsa; identical to SEQ ID NO: 301629

SEQ ID NO: 559902 - RNA, 64 nt, hsa; identical to SEQ ID NO: 301630

SEQ ID NO: 559903 - RNA, 64 nt, hsa; identical to SEQ ID NO: 301631

SEQ ID NO: 559904 - RNA, 64 nt, hsa; identical to SEQ ID NO: 301632

SEQ ID NO: 559905 - RNA, 64 nt, hsa; identical to SEQ ID NO: 301633

SEQ ID NO: 559906 - RNA, 64 nt, hsa; identical to SEQ ID NO: 301634

SEQ ID NO: 559907 - RNA, 64 nt, hsa; identical to SEQ ID NO: 301635

SEQ ID NO: 559908 - RNA, 64 nt, hsa; identical to SEQ ID NO: 301636

SEQ ID NO: 559909 - RNA, 64 nt, hsa; identical to SEQ ID NO: 301637

SEQ ID NO: 559910 - RNA, 64 nt, hsa; identical to SEQ ID NO: 301638

SEQ ID NO: 559911 - RNA, 64 nt, hsa; identical to SEQ ID NO: 301639

SEQ ID NO: 559912 - RNA, 64 nt, hsa; identical to SEQ ID NO: 301640

SEQ ID NO: 559913 - RNA, 64 nt, hsa; identical to SEQ ID NO: 301641

SEQ ID NO: 559914 - RNA, 64 nt, hsa; identical to SEQ ID NO: 301642

SEQ ID NO: 559915 - RNA, 64 nt, hsa; identical to SEQ ID NO: 301643

SEQ ID NO: 559916 - RNA, 64 nt, hsa; identical to SEQ ID NO: 301644

SEQ ID NO: 559917 - RNA, 64 nt, hsa; identical to SEQ ID NO: 301645

SEQ ID NO: 559918 - RNA, 64 nt, hsa; identical to SEQ ID NO: 301646

SEQ ID NO: 559919 - RNA, 64 nt, hsa; identical to SEQ ID NO: 301647

SEQ ID NO: 559920 - RNA, 64 nt, hsa; identical to SEQ ID NO: 301648

SEQ ID NO: 559921 - RNA, 64 nt, hsa; identical to SEQ ID NO: 301649

SEQ ID NO: 559922 - RNA, 64 nt, hsa; identical to SEQ ID NO: 301650

SEQ ID NO: 559923 - RNA, 64 nt, hsa; identical to SEQ ID NO: 301651

SEQ ID NO: 559924 - RNA, 64 nt, hsa; identical to SEQ ID NO: 301652

SEQ ID NO: 559925 - RNA, 64 nt, hsa; identical to SEQ ID NO: 301653

SEQ ID NO: 559926 - RNA, 64 nt, hsa; identical to SEQ ID NO: 301654

SEQ ID NO: 559927 - RNA, 64 nt, hsa; identical to SEQ ID NO: 301655

SEQ ID NO: 559928 - RNA, 64 nt, hsa; identical to SEQ ID NO: 301656

SEQ ID NO: 559929 - RNA, 64 nt, hsa; identical to SEQ ID NO: 301657

SEQ ID NO: 559930 - RNA, 64 nt, hsa; identical to SEQ ID NO: 301658

SEQ ID NO: 559931 - RNA, 64 nt, hsa; identical to SEQ ID NO: 301659

SEQ ID NO: 559932 - RNA, 64 nt, hsa; identical to SEQ ID NO: 301660

SEQ ID NO: 559933 - RNA, 64 nt, hsa; identical to SEQ ID NO: 301661

SEQ ID NO: 559934 - RNA, 64 nt, hsa; identical to SEQ ID NO: 301662

SEQ ID NO: 559935 - RNA, 64 nt, hsa; identical to SEQ ID NO: 301663

SEQ ID NO: 559936 - RNA, 64 nt, hsa; identical to SEQ ID NO: 301664

SEQ ID NO: 559937 - RNA, 64 nt, hsa; identical to SEQ ID NO: 301665

SEQ ID NO: 559938 - RNA, 64 nt, hsa; identical to SEQ ID NO: 301666

SEQ ID NO: 559939 - RNA, 64 nt, hsa; identical to SEQ ID NO: 301667

SEQ ID NO: 559940 - RNA, 62 nt, hsa; identical to SEQ ID NO: 301668

SEQ ID NO: 559941 - RNA, 59 nt, hsa; identical to SEQ ID NO: 301669

SEQ ID NO: 559942 - RNA, 64 nt, hsa; identical to SEQ ID NO: 301670

SEQ ID NO: 559943 - RNA, 64 nt, hsa; identical to SEQ ID NO: 301671

SEQ ID NO: 559944 - RNA, 64 nt, hsa; identical to SEQ ID NO: 301672

SEQ ID NO: 559945 - RNA, 64 nt, hsa; identical to SEQ ID NO: 301673

SEQ ID NO: 559946 - RNA, 64 nt, hsa; identical to SEQ ID NO: 301674

SEQ ID NO: 559947 - RNA, 64 nt, hsa; identical to SEQ ID NO: 301675

SEQ ID NO: 559948 - RNA, 64 nt, hsa; identical to SEQ ID NO: 301676

SEQ ID NO: 559949 - RNA, 64 nt, hsa; identical to SEQ ID NO: 301677

SEQ ID NO: 559950 - RNA, 64 nt, hsa; identical to SEQ ID NO: 301678

SEQ ID NO: 559951 - RNA, 64 nt, hsa; identical to SEQ ID NO: 301679

SEQ ID NO: 559952 - RNA, 64 nt, hsa; identical to SEQ ID NO: 301680

SEQ ID NO: 559953 - RNA, 64 nt, hsa; identical to SEQ ID NO: 301681

SEQ ID NO: 559954 - RNA, 64 nt, hsa; identical to SEQ ID NO: 301682

SEQ ID NO: 559955 - RNA, 64 nt, hsa; identical to SEQ ID NO: 301683

SEQ ID NO: 559956 - RNA, 64 nt, hsa; identical to SEQ ID NO: 301684

SEQ ID NO: 559957 - RNA, 64 nt, hsa; identical to SEQ ID NO: 301685

SEQ ID NO: 559958 - RNA, 64 nt, hsa; identical to SEQ ID NO: 301686

SEQ ID NO: 559959 - RNA, 64 nt, hsa; identical to SEQ ID NO: 301687

SEQ ID NO: 559960 - RNA, 64 nt, hsa; identical to SEQ ID NO: 301688

SEQ ID NO: 559961 - RNA, 64 nt, hsa; identical to SEQ ID NO: 301689

SEQ ID NO: 559962 - RNA, 64 nt, hsa; identical to SEQ ID NO: 301690

SEQ ID NO: 559963 - RNA, 64 nt, hsa; identical to SEQ ID NO: 301691

SEQ ID NO: 559964 - RNA, 64 nt, hsa; identical to SEQ ID NO: 301692

SEQ ID NO: 559965 - RNA, 64 nt, hsa; identical to SEQ ID NO: 301693

SEQ ID NO: 559966 - RNA, 64 nt, hsa; identical to SEQ ID NO: 301694

SEQ ID NO: 559967 - RNA, 64 nt, hsa; identical to SEQ ID NO: 301695

SEQ ID NO: 559968 - RNA, 64 nt, hsa; identical to SEQ ID NO: 301696

SEQ ID NO: 559969 - RNA, 64 nt, hsa; identical to SEQ ID NO: 301697

SEQ ID NO: 559970 - RNA, 64 nt, hsa; identical to SEQ ID NO: 301698

SEQ ID NO: 559971 - RNA, 64 nt, hsa; identical to SEQ ID NO: 301699

SEQ ID NO: 559972 - RNA, 64 nt, hsa; identical to SEQ ID NO: 301700

SEQ ID NO: 559973 - RNA, 64 nt, hsa; identical to SEQ ID NO: 301701

SEQ ID NO: 559974 - RNA, 64 nt, hsa; identical to SEQ ID NO: 301702

SEQ ID NO: 559975 - RNA, 64 nt, hsa
uagauaaauaccuuucaagugugagcuuagacgucaacccuaaaauacuuaaccguaaugcuaa

SEQ ID NO: 559976 - RNA, 64 nt, hsa
guuuucugcaguuauuucucuuguucuggccaaacaacccuaaaaauccuuaccauuccacaaa

SEQ ID NO: 559977 - RNA, 64 nt, hsa
gugugcaaaggcaaggcuugcuuuuccugucuuucaacccuaucuugcuuuuccugucuuucaa

SEQ ID NO: 559978 - RNA, 64 nt, hsa
ugucuuucaacccuaucuugcuuuuccugucuuucaacccuaucuugcuuucauugucuucauc

SEQ ID NO: 559979 - RNA, 64 nt, hsa
cuaucuccugaagauuuaauugcuauuguuacccauucgaaaucagcuguacugugugaacgaa

SEQ ID NO: 559980 - RNA, 64 nt, hsa
auucgaugggacuuuggggaccuguguccuguagauucgaaaaugggaaucugaaugucuagag

SEQ ID NO: 559981 - RNA, 64 nt, hsa
gaaccucccagguguggaucccaacaaugaagccauucgaaaugcuaugggcucccuggccucc

SEQ ID NO: 559982 - RNA, 64 nt, hsa
uucuaugaggaauuuaguaccucuucacugugaaauucgaaauaaugauuuuuauaaaagcaaa

SEQ ID NO: 559983 - RNA, 64 nt, hsa
agguugcauuauaauaacaagagucagaacauuaauucgaaacaacuugcaguaugcauuucuu

SEQ ID NO: 559984 - RNA, 64 nt, hsa
uaaagauaaucacugugagcaacuuagaguaaaaauucgaaaacugaaaaauaaggcuagugua

SEQ ID NO: 559985 - RNA, 64 nt, hsa
uuuacaauuguguuuuagaucuacagaguuagaaauucgaaaacuauuccaggacuaauucuua

SEQ ID NO: 559986 - RNA, 64 nt, hsa
aaauaucugaaccuucuuucuguucaguccuaaaauucgaaauaaagugagacuaugguucacc

SEQ ID NO: 559987 - RNA, 64 nt, hsa
uuuaaggacguucuuuauuaugaaacuuuaucacauucgaaauguuuguuuacagugggauuuu

SEQ ID NO: 559988 - RNA, 64 nt, hsa
ccuagagcaaugaucuuuuucacgcauuugcuuuauucgaaaagaggcuuuuaaaaugugcaug

SEQ ID NO: 559989 - RNA, 64 nt, hsa
gcauuuuuuuuuuuuacacauuaacuaaagggcuauucgaaaucuugacucagggguucuuaac

SEQ ID NO: 559990 - RNA, 64 nt, hsa
gaaauccaggaauuaaaucaucccuuaauaaaauauucgaaauucauauuuuauuacauuuuuc

SEQ ID NO: 559991 - RNA, 64 nt, hsa
cuacugguuaaaggaccaccauuuaauuaacaugauucgaaagccuuccucggguucaaagcug

SEQ ID NO: 559992 - RNA, 64 nt, hsa
uccauucagugauaaaaugaucagccaugugaagauucgaaacuucgaguucuuuugaaauuca

SEQ ID NO: 559993 - RNA, 64 nt, hsa
uauccuaugauacaacucuaaguguuaucacuugauucgaaagggucagaagaccaguuuuuua

SEQ ID NO: 559994 - RNA, 64 nt, hsa
cagagucacuaugugguccucccugaaauaacgcauucgaaauccaugcagugcaguauauuuu

SEQ ID NO: 559995 - RNA, 64 nt, hsa
ccaguuaaguaguuuucugaacggccagaagaccauucgaaauucaugauacuacuauaaguug

SEQ ID NO: 559996 - RNA, 64 nt, hsa
aaaauuauuugaaaacauauaaagcacuauacagauucgaaacuccauugagucauuauccuug

SEQ ID NO: 559997 - RNA, 64 nt, hsa
ucaauagaaaugggcaaugugggaaagacucccuauucgaaaauuagugcuggaauaucuggcc

SEQ ID NO: 559998 - RNA, 64 nt, hsa
uggcuguuaguuuuuagugagugcuguaggauuaauucgaaaauaggcagaauuccauuccucc

SEQ ID NO: 559999 - RNA, 64 nt, hsa
ggcaggacuuccaucugugccauacuuguucuguauucgaaaugagcucaaauugauuuuuuaa

SEQ ID NO: 560000 - RNA, 64 nt, hsa
uuaauuucucuuuuuaauuuaagugaucuuucuaauucgaaagcuguguucuuuuugaauaccg

SEQ ID NO: 560001 - RNA, 64 nt, hsa
uaaaagaagaauucugcauagaaacauggcucauauucgaaauugcucuauagucauuagaagc

SEQ ID NO: 560002 - RNA, 64 nt, hsa
ugcugccaguuccucuuugauaaauauauaguuaauucgaaauaaaauccauugcaauucauuu

SEQ ID NO: 560003 - RNA, 64 nt, hsa
uuuuaucuguaacucucugggugacaugauaccuauucgaaacauuuuauacaaacuuuuauag

SEQ ID NO: 560004 - RNA, 64 nt, hsa
ccugggaaccccaggaauugacccugaguuuuaaauucgaaaauaaaguggggcugggacacac

SEQ ID NO: 560005 - RNA, 64 nt, hsa
cagccucuagaaugguaacaaaucagccaauuggauucgaaacaaagaagacuauguaaaacuc

SEQ ID NO: 560006 - RNA, 64 nt, hsa
uucugucuuuuaaaacaaucagauugcaauagacauucgaaaggcuucauuuucuucucuuuuu

SEQ ID NO: 560007 - RNA, 64 nt, hsa
caaguuuuacuaaauacuuuaaaauuuguccuacauucgaaaaauagaaauuguaaaucagagg

SEQ ID NO: 560008 - RNA, 64 nt, hsa
ugguucacaguuuagcauuguuauaaaccauuccauucgaaaagcacuuugaaaaauuguuccc

SEQ ID NO: 560009 - RNA, 64 nt, hsa
uguugaugaugccuucuauacauuaguucgagaaauucgaaaacauaaagaaaagaugagcaaa

SEQ ID NO: 560010 - RNA, 64 nt, hsa
cagcaacauaugagaagaaaaaaggcuuaucuagauucgaaaauuaacagcaauuauaguaaua

SEQ ID NO: 560011 - RNA, 64 nt, hsa
uguuugaaauauggaacuguaauaacuucuagguauucgaaaccugugauuucugugccauuuu

SEQ ID NO: 560012 - RNA, 64 nt, hsa
acauagcaaaauucaugugacggaugauaaauugauucgaaaagcuggucccccaggaucuaau

SEQ ID NO: 560013 - RNA, 64 nt, hsa
aaagugaaggcagagugagcaggcaaaguagaaaauucgaaaagguccucaacgaguuuguaca

SEQ ID NO: 560014 - RNA, 64 nt, hsa
gcacaucaagaguuaacucugccuucugggccaaauucgaaauaaccaguccauuuuuccuuuu

SEQ ID NO: 560015 - RNA, 64 nt, hsa
ggguacggcaaccacaugucccagaucgucuccaauucgaaaacaaccguccugcugucccugu

SEQ ID NO: 560016 - RNA, 64 nt, hsa
cugcgcuucgaauccuuguuugaacuuuuuaaaaauucgaaaacuuuggggaacgaaugcaaca

SEQ ID NO: 560017 - RNA, 63 nt, hsa
aagagaguuuguacucauagccuuggaaccuuaauucgaaauguacugaagaaaaaguaacag

SEQ ID NO: 560018 - RNA, 64 nt, hsa
uaacuaucauuauuuaccugauuuuaaucaucagauucgaaauucugugccauggcauauaugu

SEQ ID NO: 560019 - RNA, 64 nt, hsa
auaaccauguggauaaaaugccagacaucuuuuuauucgaaaauuuuacuuuucaugcuucugu

SEQ ID NO: 560020 - RNA, 64 nt, hsa
gaggccaaggagggaggaucgcuuaagcccaggaauucgaaaucagccuaggcaacauaguaag

SEQ ID NO: 560021 - RNA, 64 nt, hsa
ucucuguguaaagacagauuauuuucuaggauucauucgaaagcacaucuuuuaaauuaagcca

SEQ ID NO: 560022 - RNA, 64 nt, hsa
agaaaguaacuuaauuuuaauaccacuacuaaaaauucgaaaauuucuucuuuaaucacauuca

SEQ ID NO: 560023 - RNA, 64 nt, hsa
aaacucagguuaacuuggguccaugaccguuugcauucgaaacacaauacacugccucguucuc

SEQ ID NO: 560024 - RNA, 64 nt, hsa; identical to SEQ ID NO: 112183

SEQ ID NO: 560025 - RNA, 64 nt, hsa; identical to SEQ ID NO: 112184

SEQ ID NO: 560026 - RNA, 64 nt, hsa; identical to SEQ ID NO: 112185

SEQ ID NO: 560027 - RNA, 64 nt, hsa; identical to SEQ ID NO: 112186

SEQ ID NO: 560028 - RNA, 64 nt, hsa; identical to SEQ ID NO: 112187

SEQ ID NO: 560029 - RNA, 64 nt, hsa; identical to SEQ ID NO: 112188

SEQ ID NO: 560030 - RNA, 64 nt, hsa; identical to SEQ ID NO: 112189

SEQ ID NO: 560031 - RNA, 64 nt, hsa; identical to SEQ ID NO: 112190

SEQ ID NO: 560032 - RNA, 64 nt, hsa; identical to SEQ ID NO: 112191

SEQ ID NO: 560033 - RNA, 64 nt, hsa; identical to SEQ ID NO: 112192

SEQ ID NO: 560034 - RNA, 64 nt, hsa; identical to SEQ ID NO: 112193

SEQ ID NO: 560035 - RNA, 64 nt, hsa; identical to SEQ ID NO: 112194

SEQ ID NO: 560036 - RNA, 64 nt, hsa; identical to SEQ ID NO: 112195

SEQ ID NO: 560037 - RNA, 64 nt, hsa; identical to SEQ ID NO: 112196

SEQ ID NO: 560038 - RNA, 64 nt, hsa; identical to SEQ ID NO: 112197

SEQ ID NO: 560039 - RNA, 64 nt, hsa; identical to SEQ ID NO: 112198

SEQ ID NO: 560040 - RNA, 64 nt, hsa; identical to SEQ ID NO: 112199

SEQ ID NO: 560041 - RNA, 64 nt, hsa; identical to SEQ ID NO: 112200

SEQ ID NO: 560042 - RNA, 64 nt, hsa; identical to SEQ ID NO: 112201

SEQ ID NO: 560043 - RNA, 64 nt, hsa; identical to SEQ ID NO: 112202

SEQ ID NO: 560044 - RNA, 64 nt, hsa; identical to SEQ ID NO: 112203

SEQ ID NO: 560045 - RNA, 64 nt, hsa; identical to SEQ ID NO: 112204

SEQ ID NO: 560046 - RNA, 64 nt, hsa; identical to SEQ ID NO: 112205

SEQ ID NO: 560047 - RNA, 64 nt, hsa; identical to SEQ ID NO: 112206

SEQ ID NO: 560048 - RNA, 64 nt, hsa; identical to SEQ ID NO: 112207

SEQ ID NO: 560049 - RNA, 64 nt, hsa; identical to SEQ ID NO: 112208

SEQ ID NO: 560050 - RNA, 64 nt, hsa; identical to SEQ ID NO: 112209

SEQ ID NO: 560051 - RNA, 64 nt, hsa; identical to SEQ ID NO: 112210

SEQ ID NO: 560052 - RNA, 64 nt, hsa; identical to SEQ ID NO: 112211

SEQ ID NO: 560053 - RNA, 64 nt, hsa; identical to SEQ ID NO: 112212

SEQ ID NO: 560054 - RNA, 64 nt, hsa; identical to SEQ ID NO: 112213

SEQ ID NO: 560055 - RNA, 64 nt, hsa; identical to SEQ ID NO: 112214

SEQ ID NO: 560056 - RNA, 64 nt, hsa; identical to SEQ ID NO: 112215

SEQ ID NO: 560057 - RNA, 64 nt, hsa; identical to SEQ ID NO: 112216

SEQ ID NO: 560058 - RNA, 64 nt, hsa; identical to SEQ ID NO: 112217

SEQ ID NO: 560059 - RNA, 64 nt, hsa; identical to SEQ ID NO: 112218

SEQ ID NO: 560060 - RNA, 64 nt, hsa; identical to SEQ ID NO: 112219

SEQ ID NO: 560061 - RNA, 64 nt, hsa; identical to SEQ ID NO: 112220

SEQ ID NO: 560062 - RNA, 64 nt, hsa; identical to SEQ ID NO: 112221

SEQ ID NO: 560063 - RNA, 64 nt, hsa; identical to SEQ ID NO: 112222

SEQ ID NO: 560064 - RNA, 64 nt, hsa; identical to SEQ ID NO: 112223

SEQ ID NO: 560065 - RNA, 64 nt, hsa; identical to SEQ ID NO: 112224

SEQ ID NO: 560066 - RNA, 64 nt, hsa; identical to SEQ ID NO: 112225

SEQ ID NO: 560067 - RNA, 64 nt, hsa; identical to SEQ ID NO: 112226

SEQ ID NO: 560068 - RNA, 64 nt, hsa; identical to SEQ ID NO: 112227

SEQ ID NO: 560069 - RNA, 64 nt, hsa; identical to SEQ ID NO: 112228

SEQ ID NO: 560070 - RNA, 64 nt, hsa; identical to SEQ ID NO: 112229

SEQ ID NO: 560071 - RNA, 64 nt, hsa
gccucuucuuuguggagccucucagugugggcagcccucgcaugcuggggucgggccagcucuc

SEQ ID NO: 560072 - RNA, 64 nt, hsa
gaaaugaacucacugcauuucugugcucccuccucccucgcaccaaacuccuagcucuacaagu

SEQ ID NO: 560073 - RNA, 64 nt, hsa
gucuggagucuccccccggggagaggacacuggccccucgcacuccagaaaagccaugccagcu

SEQ ID NO: 560074 - RNA, 64 nt, hsa
guggagaaagcagugacacauucacacagcuguucccucgcauguuauuucaugaacaugaccu

SEQ ID NO: 560075 - RNA, 64 nt, hsa
ugauuuugcuuuccaagcuugguuuguggcgucucccucgcagagcccuucucguuucuuuuuu

SEQ ID NO: 560076 - RNA, 64 nt, hsa
gggaggcagcgugggcucugccaaugugggcugccccucgcacacagggcucacagggcaggcc

SEQ ID NO: 560077 - RNA, 64 nt, hsa
gaaugggaagggagaacauaucuauccucucagacccucgcagcagcagcaacucauacuuggc

SEQ ID NO: 560078 - RNA, 64 nt, hsa
aaacgacccucuguggccgaugggccaugcgggccccucgcagccaacucagccaguguuggga

SEQ ID NO: 560079 - RNA, 64 nt, hsa
ugugaauggugccacacagcgcccacagacugggcccucgcacccuugggugcucccggccgcc

SEQ ID NO: 560080 - RNA, 64 nt, hsa
cauuauguuccuccguagcaagaaaaauuuuaugcccucgcauugcuacagccaaauagcuuau

SEQ ID NO: 560081 - RNA, 64 nt, hsa
cucuccuccgcucaggcccccaaggccgcccuuucccucgcacacaggccccacccccacaguu

SEQ ID NO: 560082 - RNA, 64 nt, hsa
cuugcuggauguuccccuguuccugagccuuaaccccucgcacagccauccccccccccguccu

SEQ ID NO: 560083 - RNA, 64 nt, hsa
agcccauccguccucgcgugggaccgcaucuucucccucgcagcugcuucuugcuuuucuuucc

SEQ ID NO: 560084 - RNA, 64 nt, hsa
agaaaucaucuccuugcccuuuaagguauuuuaacccucgcauuccucugcuuuuccaagaaug

SEQ ID NO: 560085 - RNA, 64 nt, hsa
gucaggauggaaauaccuggacuuuucuuugcuucccucgcaaacuggggucuucucuaccgaa

SEQ ID NO: 560086 - RNA, 64 nt, hsa
agcacugccgcuuccaccugggccacccaccggacccucgcacgccgugccaggccugccccag

SEQ ID NO: 560087 - RNA, 64 nt, hsa
aguucggagagagcugcgaugugaacugccccuccccucgcaucccccaggccaccaacggcag

SEQ ID NO: 560088 - RNA, 64 nt, hsa
accaucacugaguggcuugugauucugggauggacccucgcagcaggugcaagagacagagccc

SEQ ID NO: 560089 - RNA, 64 nt, hsa
uacaaccugaagcgcaggaaagaaaggcccauuccccucgcacagccgagcuuuuacucccuga

SEQ ID NO: 560090 - RNA, 64 nt, hsa
cagaagaagacggucaccauccccucaggcagcacccucgcauuccggguggcccagcugguua

SEQ ID NO: 560091 - RNA, 64 nt, hsa
gucgguuuggucuguuuugccuucacccauaagccccucgcacucugguggcaggugccuuguc

SEQ ID NO: 560092 - RNA, 64 nt, hsa
gggugagagccuagauuccuccugugucaagggucccucgcauucuuuuacuguaaacaaacaa

SEQ ID NO: 560093 - RNA, 64 nt, hsa
guugcuuugcucuugagaauaguuucucgugucccccucgcaggccucauucuuugaacaucga

SEQ ID NO: 560094 - RNA, 64 nt, hsa
cucgugaaaggccugccccgucuuucugccgcagcccucgcagagggcgggugcacagcgccau

SEQ ID NO: 560095 - RNA, 64 nt, hsa
cuggccucagacugcacccaggaggggaacacugcccucgcacggccccgaagggcccccacau

SEQ ID NO: 560096 - RNA, 64 nt, hsa
gcccgggcucccggccgcccagggucgccgccgccccucgcaccgcuaggucugcgcaccaucu

SEQ ID NO: 560097 - RNA, 64 nt, hsa
cagaaagcacacggucaauccacguggaccgucucccucgcaggaacuccgcauccuugucccu

SEQ ID NO: 560098 - RNA, 64 nt, hsa
acagacagaaaaccugccauggggcugcuucccucccucgcagggcuggcggaggcuccgcauc

SEQ ID NO: 560099 - RNA, 64 nt, hsa
ccagcgcugcuccucaaggguuggggguccuucucccucgcagccaccacaugucucagggcua

SEQ ID NO: 560100 - RNA, 64 nt, hsa
ccaacucaccucccuucucuuagcccaagccugucccucgcacagccucgcacaaaccacauug

SEQ ID NO: 560101 - RNA, 64 nt, hsa
cagcuuucucgcgcccucccccaugggggugagacccucgcagaccuaagcccugccccgggau

SEQ ID NO: 560102 - RNA, 64 nt, hsa
uggagcagcaaagggccucaauuccuauaagagacccucgcagcccagaggcgcccagaggaag

SEQ ID NO: 560103 - RNA, 64 nt, hsa
gggaacuguaauggccacugaagcacgugagagacccucgcaaaaugaugugaaaggaccaguu

SEQ ID NO: 560104 - RNA, 64 nt, hsa
gugaggcuccaucggccgcccugggagcuggggccccucgcacuccugugaggcuuuugcaggu

SEQ ID NO: 560105 - RNA, 64 nt, hsa
uuccauccaguuccuuacucuccucuuuccucuucccucgcaugucucccuccaguccucugua

SEQ ID NO: 560106 - RNA, 64 nt, hsa
acugcccccuugaucuuugaaggaguccucaggccccucgcagcauaaggauguuuugcaacuu

SEQ ID NO: 560107 - RNA, 64 nt, hsa
uuccagcccuugaagguaguggacccagaucauccccucgcagcacuuguucguaaggcacagg

SEQ ID NO: 560108 - RNA, 64 nt, hsa
gagauagagaccugccucccccuugcacccgaggcccucgcagcagggagcucagcgaggcaga

SEQ ID NO: 560109 - RNA, 64 nt, hsa
accuuuuggcccuuucuuucuuuucuaggcuucucccucgcaggguguuccguaguuucuucuc

SEQ ID NO: 560110 - RNA, 64 nt, hsa
uggccuuagccaagcaguuuguuaguuacauauucccucgcaaaccuggagugcagaccacagg

SEQ ID NO: 560111 - RNA, 64 nt, hsa
uccuuuucucuccugugugcuugucaguggggaccccucgcaacccugccugucaccugggagg

SEQ ID NO: 560112 - RNA, 64 nt, hsa
uaccucaaaaguuuguuuuauuaauuguacucaacccucgcagaacaguaaaacugaagauuau

SEQ ID NO: 560113 - RNA, 64 nt, hsa
uauugaagcucgugacaagugccuucacacagaccccucgcaacuguccacgcgugccguggca

SEQ ID NO: 560114 - RNA, 64 nt, hsa
guguggaugugaguugugugaauaaucuuucugucccucgcacagaagccaguaauuagcaucu

SEQ ID NO: 560115 - RNA, 64 nt, hsa
gcccuugugucccucccagaguccuucagguaggcccucgcagaugcugcuugcucagaaacaa

SEQ ID NO: 560116 - RNA, 64 nt, hsa
gacacacugggaaccgucagagucagcuccuucccccucgcaaugcacugaaaggcccggccga

SEQ ID NO: 560117 - RNA, 64 nt, hsa
gggacuugcucuaguucucugagccgcggacaugcccucgcauugcuucccgcagagugcagag

SEQ ID NO: 560118 - RNA, 64 nt, hsa
ugccgccagaaccgggcucugcccccauacgcugcccucgcagccuggcggccuccgcuguggc

SEQ ID NO: 560119 - RNA, 64 nt, hsa
cccgcccggccccugcccccuccaacccuucuggcccucgcaccacugugacucugccaucuuc

SEQ ID NO: 560120 - RNA, 64 nt, hsa
aaaaaaaaagaagaaacaagacaugccaccuuuccccucgcacuguugcuuuuccugaugguua

SEQ ID NO: 560121 - RNA, 64 nt, hsa
cuccauggucacgaagcagcguugugcugugugucccucgcaagaagcacaggaaagagaaguu

SEQ ID NO: 560122 - RNA, 64 nt, hsa
uugucugcugccaaugucgucucgcaugccugcacccucgcaugcacgcugcccgcaugccacg

SEQ ID NO: 560123 - RNA, 64 nt, hsa
uccugugccaggacucucuuucuuccacuacccucccucgcauccgccucugagccaggagccu

SEQ ID NO: 560124 - RNA, 64 nt, hsa
gcgaugcugacacugccaaccuccaguauccucacccucgcagacgauaucucucucggccucu

SEQ ID NO: 560125 - RNA, 64 nt, hsa
uccugccgucugccaccccgccacguguauuuaacccucgcacuuucuccacuguggagauggc

SEQ ID NO: 560126 - RNA, 64 nt, hsa
gguggcuuaggaucuucggaucggccacccucgccccucgcaccccagcccagggcggcgggga

SEQ ID NO: 560127 - RNA, 64 nt, hsa
cagcaacuccccgcccagggaccccucccggccucccucgcacacugggaggaggaagccgccg

SEQ ID NO: 560128 - RNA, 64 nt, hsa
ggggggccauagcuggcacugcccaccguaaaggcccucgcacauuuucccccuuccuguacac

SEQ ID NO: 560129 - RNA, 64 nt, hsa
gucaaggcagggagaggccggcuggagccaggcccccucgcacgcagcccccaaaucauggacg

SEQ ID NO: 560130 - RNA, 64 nt, hsa
cugcccauccccccaccacccuccauccugggggcccucgcacaaaucuggggugggaggggcu

SEQ ID NO: 560131 - RNA, 64 nt, hsa
gagcccucuuuccaccuuccccuauccaugcacccccucgcaauaaaaccaacucuaaaaucac

SEQ ID NO: 560132 - RNA, 64 nt, hsa
uccaacagaagccacaggccggagccccugggagcccucgcaccgcuccccaccccacucagcg

SEQ ID NO: 560133 - RNA, 64 nt, hsa
caauaaacgcucuguggccaguguaaaagaaaaucccucgcaguuguggacauuucuguuccug

SEQ ID NO: 560134 - RNA, 64 nt, hsa
cugccguguaacacccuuccucugaucgcaccgccccucgcagagaguguaucaucuguuuuau

SEQ ID NO: 560135 - RNA, 64 nt, hsa
cucccagguucaagugauucuccugccucagccucccucgcaaguagcugggauuacaggcgcc

SEQ ID NO: 560136 - RNA, 64 nt, hsa
aguagacaaagagagcgacaguuacagcgucagccccucgcaagacacagguaggcccugacgc

SEQ ID NO: 560137 - RNA, 64 nt, hsa
uacugccagccgggagcugggcggacaggaccgucccucgcagggucccaggcccagaagaggc

SEQ ID NO: 560138 - RNA, 64 nt, hsa
gcucgccgcggacacaccguccgucuccgggacgcccucgcaccccuggacaccagaccggacu

SEQ ID NO: 560139 - RNA, 64 nt, hsa
cgaguggaccaaucggaagccuaagugacgaugacccucgcauguccuaggucccuggguggac

SEQ ID NO: 560140 - RNA, 64 nt, hsa
cacacacacacacacacugcauaucugagcgcgccccucgcacugggucucaccuugcaccuuc

SEQ ID NO: 560141 - RNA, 64 nt, hsa
ggugagaaauuugccuuguucaauaauuacuguacccucgcaugacuguuacagcuuucugugc

SEQ ID NO: 560142 - RNA, 64 nt, hsa
cuagcccuccccuccccgggauguagaacggggacccucgcaggguuggggcgggggcugauac

SEQ ID NO: 560143 - RNA, 64 nt, hsa
ccccacccgcugcucaguggcucugaccacacuccccucgcagcgucagugguacgacccuucc

SEQ ID NO: 560144 - RNA, 64 nt, hsa
uggaauguuuaaucauauuugcuaagaaauguuucugcuguaguuggauuugcccauauuuaug

SEQ ID NO: 560145 - RNA, 64 nt, hsa
caauuuccucaucuugaaaugaggauaauaauaccugcuguaccuaccucacagggcuguugug

SEQ ID NO: 560146 - RNA, 64 nt, hsa
ucugcacuccuccgagcccgguggagaaugcaggcugcuguagucucagguaaugaaggcacag

SEQ ID NO: 560147 - RNA, 64 nt, hsa
ccugucauagcugcugcugcugccaugcgcagagcugcuguaacagcucuuccuguucugcucc

SEQ ID NO: 560148 - RNA, 64 nt, hsa
acucuugcuuaaaaaggaugccucuuguuuuuugcugcuguaacuuaccagaaaguguucuaua

SEQ ID NO: 560149 - RNA, 54 nt, hsa; identical to SEQ ID NO: 234085

SEQ ID NO: 560150 - RNA, 64 nt, hsa
agaagggggacaugccacauguauuagaaggcaucugcuguaacuuccagugcaagauaauuca

SEQ ID NO: 560151 - RNA, 64 nt, hsa
ggugcuucuagcccugucucaguccguuaucacucugcuguagaagggggacaugccacaugua

SEQ ID NO: 560152 - RNA, 64 nt, hsa
uuuucuguaaaugaaaugcugacuucgccucuuccugcuguaugcucaucccugcacugagcac

SEQ ID NO: 560153 - RNA, 64 nt, hsa
ugugauaacucauaauuauuuuaauggcagagcacugcuguaucuguuuuauggucuacauagu

SEQ ID NO: 560154 - RNA, 64 nt, hsa
gacaaaggaaauuaaugaaaauguuuuuguuuuucugcuguaauucugcauuaagcucacauga

SEQ ID NO: 560155 - RNA, 64 nt, hsa
auuggugauugccaugggacuuuucccaugucuucugcuguaauuauccugugcagaacuagga

SEQ ID NO: 560156 - RNA, 64 nt, hsa
ugguuuaggcccuguuccagcaauaagaaccaaucugcuguacaaucugaggacuuggcucugu

SEQ ID NO: 560157 - RNA, 64 nt, hsa
agucacuugcaguuuugcuuuucucugcauuucucugcuguaagaugacuguugcauuguugaa

SEQ ID NO: 560158 - RNA, 64 nt, hsa
gguacaauuuugggaucuaguuccccuggaaaagcugcuguauuuuuaauuuuuaauggaaugu

SEQ ID NO: 560159 - RNA, 64 nt, hsa
ccuuaacaucugagagcaguaacacugauuuuaucugcuguaugagacuuugugcauuuuacuu

SEQ ID NO: 560160 - RNA, 64 nt, hsa
ugcauugggaccaaugaaucuggugugaaaaacccugcuguaguagugaaagagcaucaggaga

SEQ ID NO: 560161 - RNA, 64 nt, hsa
gcagcccccucugccagccuuucugcugcuuuugcugcuguaacagcaauaguggagaaaaaug

SEQ ID NO: 560162 - RNA, 64 nt, hsa
ggcuuccuuggaguggcuuugcauguccaacacucugcuguaucuuuuuuuuuuuuuuuuuuuu

SEQ ID NO: 560163 - RNA, 64 nt, hsa
guugagccccaaaucauugcucaggguccauucccugcuguagaacgaugccauaucuggcugc

SEQ ID NO: 560164 - RNA, 64 nt, hsa
uuuuuguuuuuuuuucccccaugcuuuuguuuggcugcuguaauuuuuaaguauuugaguuuga

SEQ ID NO: 560165 - RNA, 64 nt, hsa
uagagcaguccaacccagaauggcacacacugcucugcuguagcaucaugucagggcuuccugg

SEQ ID NO: 560166 - RNA, 64 nt, hsa
uauuuccuucauaauggucaugggugaaugcuuucugcuguaagugucuuuuagaguaggaauc

SEQ ID NO: 560167 - RNA, 64 nt, hsa
auucuugggaagacuuuggaggugccuauuuuuucugcuguaauuguucuggguagauggagua

SEQ ID NO: 560168 - RNA, 64 nt, hsa
agguaauaaacuggaauucuguugaugaauauagcugcuguacuguauauuaauauuuaauaga

SEQ ID NO: 560169 - RNA, 64 nt, hsa
ggguguagguagugucagugaguggcucuugugccugcuguagacauuaggccugcacuagggc

SEQ ID NO: 560170 - RNA, 64 nt, hsa
uguaaaagaccaagcaaaugcacucugcuuuuugcugcuguaagaccaccaaaaaugagucaga

SEQ ID NO: 560171 - RNA, 64 nt, hsa
gcgaggccagaacuaguuuaucugaacaccucagcugcuguaagcuucuccucucucaccccgu

SEQ ID NO: 560172 - RNA, 64 nt, hsa
acccacaggagugauuggucuauucaccaucccccugcuguaccggcagcaccaggugagugug

SEQ ID NO: 560173 - RNA, 64 nt, hsa
cugcauuggcccacagaaggcaaaaguggcggaccugcuguacuggaaggacacgaggacguca

SEQ ID NO: 560174 - RNA, 64 nt, hsa
gaacagucuccuucaacaguucggccaagcagaacugcuguaccucugaccacuuguguuagga

SEQ ID NO: 560175 - RNA, 64 nt, hsa
auggcagucugauggacugcggguuuggauaccacugcuguaauguaacccucuuuguuuagau

SEQ ID NO: 560176 - RNA, 64 nt, hsa
gaaugacucaugccucugagcuucuaaacugaagcugcuguaacuaaaggaaucugaaaagaac

SEQ ID NO: 560177 - RNA, 64 nt, hsa
uuuucuuuaaaucaguauuccaucaggcagauaacugcuguauucaugaaucuugagaguguuc

SEQ ID NO: 560178 - RNA, 64 nt, hsa; identical to SEQ ID NO: 463476

SEQ ID NO: 560179 - RNA, 64 nt, hsa; identical to SEQ ID NO: 463477

SEQ ID NO: 560180 - RNA, 64 nt, hsa; identical to SEQ ID NO: 463478

SEQ ID NO: 560181 - RNA, 64 nt, hsa; identical to SEQ ID NO: 463479

SEQ ID NO: 560182 - RNA, 64 nt, hsa; identical to SEQ ID NO: 463480

SEQ ID NO: 560183 - RNA, 64 nt, hsa; identical to SEQ ID NO: 463481

SEQ ID NO: 560184 - RNA, 64 nt, hsa; identical to SEQ ID NO: 463482

SEQ ID NO: 560185 - RNA, 64 nt, hsa; identical to SEQ ID NO: 463483

SEQ ID NO: 560186 - RNA, 64 nt, hsa; identical to SEQ ID NO: 463484

SEQ ID NO: 560187 - RNA, 64 nt, hsa; identical to SEQ ID NO: 463485

SEQ ID NO: 560188 - RNA, 64 nt, hsa; identical to SEQ ID NO: 463486

SEQ ID NO: 560189 - RNA, 64 nt, hsa; identical to SEQ ID NO: 463487

SEQ ID NO: 560190 - RNA, 64 nt, hsa; identical to SEQ ID NO: 463488

SEQ ID NO: 560191 - RNA, 64 nt, hsa; identical to SEQ ID NO: 463489

SEQ ID NO: 560192 - RNA, 64 nt, hsa; identical to SEQ ID NO: 463490

SEQ ID NO: 560193 - RNA, 64 nt, hsa; identical to SEQ ID NO: 463491

SEQ ID NO: 560194 - RNA, 64 nt, hsa; identical to SEQ ID NO: 463492

SEQ ID NO: 560195 - RNA, 64 nt, hsa; identical to SEQ ID NO: 463493

SEQ ID NO: 560196 - RNA, 64 nt, hsa; identical to SEQ ID NO: 463494

SEQ ID NO: 560197 - RNA, 64 nt, hsa; identical to SEQ ID NO: 463495

SEQ ID NO: 560198 - RNA, 64 nt, hsa; identical to SEQ ID NO: 463496

SEQ ID NO: 560199 - RNA, 64 nt, hsa; identical to SEQ ID NO: 463497

SEQ ID NO: 560200 - RNA, 64 nt, hsa; identical to SEQ ID NO: 463498

SEQ ID NO: 560201 - RNA, 64 nt, hsa; identical to SEQ ID NO: 463499

SEQ ID NO: 560202 - RNA, 64 nt, hsa; identical to SEQ ID NO: 463500

SEQ ID NO: 560203 - RNA, 64 nt, hsa; identical to SEQ ID NO: 463501

SEQ ID NO: 560204 - RNA, 64 nt, hsa; identical to SEQ ID NO: 463502

SEQ ID NO: 560205 - RNA, 64 nt, hsa; identical to SEQ ID NO: 463503

SEQ ID NO: 560206 - RNA, 64 nt, hsa; identical to SEQ ID NO: 463504

SEQ ID NO: 560207 - RNA, 64 nt, hsa; identical to SEQ ID NO: 463505

SEQ ID NO: 560208 - RNA, 64 nt, hsa; identical to SEQ ID NO: 463506

SEQ ID NO: 560209 - RNA, 64 nt, hsa; identical to SEQ ID NO: 463507

SEQ ID NO: 560210 - RNA, 64 nt, hsa; identical to SEQ ID NO: 463508

SEQ ID NO: 560211 - RNA, 64 nt, hsa; identical to SEQ ID NO: 463509

SEQ ID NO: 560212 - RNA, 64 nt, hsa; identical to SEQ ID NO: 463510

SEQ ID NO: 560213 - RNA, 64 nt, hsa; identical to SEQ ID NO: 463511

SEQ ID NO: 560214 - RNA, 56 nt, hsa; identical to SEQ ID NO: 463512

SEQ ID NO: 560215 - RNA, 64 nt, hsa; identical to SEQ ID NO: 463513

SEQ ID NO: 560216 - RNA, 64 nt, hsa; identical to SEQ ID NO: 463514

SEQ ID NO: 560217 - RNA, 64 nt, hsa; identical to SEQ ID NO: 463515

SEQ ID NO: 560218 - RNA, 64 nt, hsa; identical to SEQ ID NO: 463516

SEQ ID NO: 560219 - RNA, 64 nt, hsa; identical to SEQ ID NO: 463517

SEQ ID NO: 560220 - RNA, 64 nt, hsa; identical to SEQ ID NO: 463518

SEQ ID NO: 560221 - RNA, 64 nt, hsa; identical to SEQ ID NO: 463519

SEQ ID NO: 560222 - RNA, 64 nt, hsa; identical to SEQ ID NO: 463520

SEQ ID NO: 560223 - RNA, 64 nt, hsa; identical to SEQ ID NO: 463521

SEQ ID NO: 560224 - RNA, 64 nt, hsa; identical to SEQ ID NO: 463522

SEQ ID NO: 560225 - RNA, 64 nt, hsa; identical to SEQ ID NO: 463523

SEQ ID NO: 560226 - RNA, 64 nt, hsa; identical to SEQ ID NO: 463524

SEQ ID NO: 560227 - RNA, 64 nt, hsa; identical to SEQ ID NO: 463525

SEQ ID NO: 560228 - RNA, 64 nt, hsa; identical to SEQ ID NO: 463526

SEQ ID NO: 560229 - RNA, 64 nt, hsa; identical to SEQ ID NO: 463527

SEQ ID NO: 560230 - RNA, 64 nt, hsa; identical to SEQ ID NO: 463528

SEQ ID NO: 560231 - RNA, 64 nt, hsa; identical to SEQ ID NO: 463529

SEQ ID NO: 560232 - RNA, 64 nt, hsa; identical to SEQ ID NO: 463530

SEQ ID NO: 560233 - RNA, 64 nt, hsa; identical to SEQ ID NO: 463531

SEQ ID NO: 560234 - RNA, 64 nt, hsa; identical to SEQ ID NO: 463532

SEQ ID NO: 560235 - RNA, 64 nt, hsa; identical to SEQ ID NO: 463533

SEQ ID NO: 560236 - RNA, 64 nt, hsa; identical to SEQ ID NO: 463534

SEQ ID NO: 560237 - RNA, 64 nt, hsa; identical to SEQ ID NO: 463535

SEQ ID NO: 560238 - RNA, 64 nt, hsa; identical to SEQ ID NO: 463536

SEQ ID NO: 560239 - RNA, 64 nt, hsa; identical to SEQ ID NO: 463537

SEQ ID NO: 560240 - RNA, 64 nt, hsa; identical to SEQ ID NO: 463538

SEQ ID NO: 560241 - RNA, 64 nt, hsa; identical to SEQ ID NO: 463539

SEQ ID NO: 560242 - RNA, 64 nt, hsa; identical to SEQ ID NO: 463540

SEQ ID NO: 560243 - RNA, 64 nt, hsa; identical to SEQ ID NO: 463541

SEQ ID NO: 560244 - RNA, 64 nt, hsa; identical to SEQ ID NO: 463542

SEQ ID NO: 560245 - RNA, 64 nt, hsa; identical to SEQ ID NO: 463543

SEQ ID NO: 560246 - RNA, 64 nt, hsa; identical to SEQ ID NO: 463544

SEQ ID NO: 560247 - RNA, 64 nt, hsa; identical to SEQ ID NO: 463545

SEQ ID NO: 560248 - RNA, 64 nt, hsa; identical to SEQ ID NO: 463546

SEQ ID NO: 560249 - RNA, 64 nt, hsa; identical to SEQ ID NO: 463547

SEQ ID NO: 560250 - RNA, 64 nt, hsa; identical to SEQ ID NO: 463548

SEQ ID NO: 560251 - RNA, 64 nt, hsa; identical to SEQ ID NO: 463549

SEQ ID NO: 560252 - RNA, 64 nt, hsa; identical to SEQ ID NO: 463550

SEQ ID NO: 560253 - RNA, 64 nt, hsa; identical to SEQ ID NO: 463551

SEQ ID NO: 560254 - RNA, 64 nt, hsa; identical to SEQ ID NO: 463552

SEQ ID NO: 560255 - RNA, 64 nt, hsa; identical to SEQ ID NO: 463553

SEQ ID NO: 560256 - RNA, 64 nt, hsa; identical to SEQ ID NO: 463554

SEQ ID NO: 560257 - RNA, 64 nt, hsa; identical to SEQ ID NO: 463555

SEQ ID NO: 560258 - RNA, 64 nt, hsa; identical to SEQ ID NO: 463556

SEQ ID NO: 560259 - RNA, 64 nt, hsa; identical to SEQ ID NO: 463557

SEQ ID NO: 560260 - RNA, 64 nt, hsa; identical to SEQ ID NO: 463558

SEQ ID NO: 560261 - RNA, 64 nt, hsa; identical to SEQ ID NO: 463559

SEQ ID NO: 560262 - RNA, 64 nt, hsa; identical to SEQ ID NO: 463560

SEQ ID NO: 560263 - RNA, 64 nt, hsa; identical to SEQ ID NO: 463561

SEQ ID NO: 560264 - RNA, 64 nt, hsa; identical to SEQ ID NO: 463562

SEQ ID NO: 560265 - RNA, 64 nt, hsa; identical to SEQ ID NO: 463563

SEQ ID NO: 560266 - RNA, 64 nt, hsa; identical to SEQ ID NO: 463564

SEQ ID NO: 560267 - RNA, 64 nt, hsa; identical to SEQ ID NO: 463565

SEQ ID NO: 560268 - RNA, 64 nt, hsa; identical to SEQ ID NO: 463566

SEQ ID NO: 560269 - RNA, 64 nt, hsa; identical to SEQ ID NO: 463567

SEQ ID NO: 560270 - RNA, 64 nt, hsa; identical to SEQ ID NO: 463568

SEQ ID NO: 560271 - RNA, 64 nt, hsa; identical to SEQ ID NO: 463569

SEQ ID NO: 560272 - RNA, 64 nt, hsa; identical to SEQ ID NO: 463570

SEQ ID NO: 560273 - RNA, 64 nt, hsa; identical to SEQ ID NO: 463571

SEQ ID NO: 560274 - RNA, 64 nt, hsa; identical to SEQ ID NO: 463572

SEQ ID NO: 560275 - RNA, 64 nt, hsa; identical to SEQ ID NO: 463573

SEQ ID NO: 560276 - RNA, 64 nt, hsa; identical to SEQ ID NO: 463574

SEQ ID NO: 560277 - RNA, 64 nt, hsa; identical to SEQ ID NO: 463575

SEQ ID NO: 560278 - RNA, 64 nt, hsa; identical to SEQ ID NO: 463576

SEQ ID NO: 560279 - RNA, 64 nt, hsa; identical to SEQ ID NO: 463577

SEQ ID NO: 560280 - RNA, 64 nt, hsa; identical to SEQ ID NO: 463578

SEQ ID NO: 560281 - RNA, 64 nt, hsa; identical to SEQ ID NO: 463579

SEQ ID NO: 560282 - RNA, 64 nt, hsa; identical to SEQ ID NO: 463580

SEQ ID NO: 560283 - RNA, 64 nt, hsa; identical to SEQ ID NO: 463581

SEQ ID NO: 560284 - RNA, 64 nt, hsa; identical to SEQ ID NO: 463582

SEQ ID NO: 560285 - RNA, 64 nt, hsa; identical to SEQ ID NO: 463583

SEQ ID NO: 560286 - RNA, 64 nt, hsa; identical to SEQ ID NO: 463584

SEQ ID NO: 560287 - RNA, 64 nt, hsa; identical to SEQ ID NO: 463585

SEQ ID NO: 560288 - RNA, 64 nt, hsa; identical to SEQ ID NO: 463586

SEQ ID NO: 560289 - RNA, 64 nt, hsa; identical to SEQ ID NO: 463587

SEQ ID NO: 560290 - RNA, 64 nt, hsa; identical to SEQ ID NO: 463588

SEQ ID NO: 560291 - RNA, 64 nt, hsa; identical to SEQ ID NO: 463589

SEQ ID NO: 560292 - RNA, 64 nt, hsa; identical to SEQ ID NO: 463590

SEQ ID NO: 560293 - RNA, 64 nt, hsa; identical to SEQ ID NO: 463591

SEQ ID NO: 560294 - RNA, 64 nt, hsa; identical to SEQ ID NO: 463592

SEQ ID NO: 560295 - RNA, 64 nt, hsa; identical to SEQ ID NO: 463593

SEQ ID NO: 560296 - RNA, 54 nt, hsa; identical to SEQ ID NO: 463594

SEQ ID NO: 560297 - RNA, 64 nt, hsa; identical to SEQ ID NO: 463595

SEQ ID NO: 560298 - RNA, 64 nt, hsa; identical to SEQ ID NO: 463596

SEQ ID NO: 560299 - RNA, 64 nt, hsa; identical to SEQ ID NO: 463597

SEQ ID NO: 560300 - RNA, 64 nt, hsa; identical to SEQ ID NO: 463598

SEQ ID NO: 560301 - RNA, 64 nt, hsa; identical to SEQ ID NO: 463599

SEQ ID NO: 560302 - RNA, 64 nt, hsa; identical to SEQ ID NO: 463600

SEQ ID NO: 560303 - RNA, 64 nt, hsa; identical to SEQ ID NO: 463601

SEQ ID NO: 560304 - RNA, 64 nt, hsa; identical to SEQ ID NO: 463602

SEQ ID NO: 560305 - RNA, 64 nt, hsa; identical to SEQ ID NO: 463603

SEQ ID NO: 560306 - RNA, 64 nt, hsa; identical to SEQ ID NO: 463604

SEQ ID NO: 560307 - RNA, 64 nt, hsa; identical to SEQ ID NO: 463605

SEQ ID NO: 560308 - RNA, 64 nt, hsa; identical to SEQ ID NO: 463606

SEQ ID NO: 560309 - RNA, 64 nt, hsa; identical to SEQ ID NO: 463607

SEQ ID NO: 560310 - RNA, 64 nt, hsa; identical to SEQ ID NO: 463608

SEQ ID NO: 560311 - RNA, 64 nt, hsa; identical to SEQ ID NO: 463609

SEQ ID NO: 560312 - RNA, 64 nt, hsa; identical to SEQ ID NO: 463610

SEQ ID NO: 560313 - RNA, 64 nt, hsa
ucaucaucuccagaacucccagcggggcucccugagcucucaaggagaugcugccaucacuggg

SEQ ID NO: 560314 - RNA, 64 nt, hsa
gcaggagaugggcaaagaaaacuggggugcacucagcucucacagggguaaucaucucaagugg

SEQ ID NO: 560315 - RNA, 64 nt, hsa
gaaaugagcccuucaggauuaauccucuugcaccagcucucagagaaaugcuggguaucccugu

SEQ ID NO: 560316 - RNA, 64 nt, hsa
gagccuagggcaagaaggccagaaaugggccgugagcucucacaggcucagacuaaaucagagg

SEQ ID NO: 560317 - RNA, 64 nt, hsa
agugcagccuccauaaccaugacauucccgcccaagcucucagugccuaauccugcuuugucau

SEQ ID NO: 560318 - RNA, 64 nt, hsa
gacuuugaaugaaugcaagguuagugagauccuaagcucucaaaauagcauauucccuagagcu

SEQ ID NO: 560319 - RNA, 64 nt, hsa
ccaucugucauuuauuggggaaggucuucaguugagcucucagccuuaggaaggaagcacgugg

SEQ ID NO: 560320 - RNA, 64 nt, hsa
ggggugguggugggagcuuaccgccaccuauucaagcucucagcuacuccugaaacgggcagag

SEQ ID NO: 560321 - RNA, 64 nt, hsa
gcacugaagugcugccgccagcucucagucccacagcucucaggccccucucuggcagcagagc

SEQ ID NO: 560322 - RNA, 62 nt, hsa
ggaagagcuacaagcacugaagugcugccgccagcucucagucccacagcucucaggccccu

SEQ ID NO: 560323 - RNA, 64 nt, hsa
uaauggggaucggauguugguacuccucccagggagcucucaggacagcuguuugucgugggcu

SEQ ID NO: 560324 - RNA, 64 nt, hsa
cacuucccugggaaaccuaaguccagaccccaugagcucucagccagcucuuuuaauugacaca

SEQ ID NO: 560325 - RNA, 64 nt, hsa
ggaagaaccuaaauugcaaagaucugcuauugccagcucucaacccaagucagugaauugucaa

SEQ ID NO: 560326 - RNA, 64 nt, hsa
agcugcaagaauguugcagugaacaccauuucagagcucucagugugcaguucaggaauuaaga

SEQ ID NO: 560327 - RNA, 64 nt, hsa
uggccuuaggauaucugcuuaaaguccuacuuugagcucucaucaggguuaccaaagaaggcgu

SEQ ID NO: 560328 - RNA, 64 nt, hsa
gaaaggaaccgagaaagaaaguugaacugaaugcagcucucacuaacaacuucuugguaaaagc

SEQ ID NO: 560329 - RNA, 64 nt, hsa
gugacaguuggaaggccucugcuggagagacaccagcucucagggcagagauuggcuuggggcc

SEQ ID NO: 560330 - RNA, 64 nt, hsa
uuuuggugaagcaggagaugcaccccacagcucuagcucucaaauggcuucacaguccuuacuu

SEQ ID NO: 560331 - RNA, 64 nt, hsa
gaguuuuuaauagaagcuuccuccaucaauuggcagaaccuaaagaagauuuuaaggggcaaaa

SEQ ID NO: 560332 - RNA, 64 nt, hsa
cucacgcaaucucaguagaguacaacguagauacagaaccuaggagagucaacaucuggaggau

SEQ ID NO: 560333 - RNA, 64 nt, hsa
ccacccucuguuuaaaauuugugcuggguuauucagaaccuaaaaguauuauucaaaccaauuu

SEQ ID NO: 560334 - RNA, 64 nt, hsa
ccuuaacaucccuccugcuuuuaggagaauucacagaaccuacuguuccuuucagaugaccuuu

SEQ ID NO: 560335 - RNA, 64 nt, hsa
cuagaaccaagaagggcuagaaccuggaggggcuagaaccuagagaagcuaaaaccugagcuag

SEQ ID NO: 560336 - RNA, 64 nt, hsa
agcuagaaccuggagggcuagaaccuggagagcuagaaccuagaagggcuagaaccuggagggc

SEQ ID NO: 560337 - RNA, 64 nt, hsa
agcuagaaccuggagggcuagaaccuggagggcuagaaccuagaagggcuagaaccuggagggc

SEQ ID NO: 560338 - RNA, 64 nt, hsa; identical to SEQ ID NO: 560337

SEQ ID NO: 560339 - RNA, 64 nt, hsa
ggcuagaaccuggagggcuagaaccuggcagguuagaaccuagaagggcuagaaccuggagagc

SEQ ID NO: 560340 - RNA, 64 nt, hsa; identical to SEQ ID NO: 326592

SEQ ID NO: 560341 - RNA, 64 nt, hsa; identical to SEQ ID NO: 326593

SEQ ID NO: 560342 - RNA, 64 nt, hsa; identical to SEQ ID NO: 326594

SEQ ID NO: 560343 - RNA, 64 nt, hsa; identical to SEQ ID NO: 326595

SEQ ID NO: 560344 - RNA, 64 nt, hsa; identical to SEQ ID NO: 326596

SEQ ID NO: 560345 - RNA, 64 nt, hsa; identical to SEQ ID NO: 326597

SEQ ID NO: 560346 - RNA, 64 nt, hsa; identical to SEQ ID NO: 326598

SEQ ID NO: 560347 - RNA, 64 nt, hsa; identical to SEQ ID NO: 326599

SEQ ID NO: 560348 - RNA, 64 nt, hsa; identical to SEQ ID NO: 326600

SEQ ID NO: 560349 - RNA, 64 nt, hsa; identical to SEQ ID NO: 326601

SEQ ID NO: 560350 - RNA, 64 nt, hsa; identical to SEQ ID NO: 326602

SEQ ID NO: 560351 - RNA, 64 nt, hsa; identical to SEQ ID NO: 326603

SEQ ID NO: 560352 - RNA, 64 nt, hsa; identical to SEQ ID NO: 326604

SEQ ID NO: 560353 - RNA, 64 nt, hsa; identical to SEQ ID NO: 326605

SEQ ID NO: 560354 - RNA, 64 nt, hsa; identical to SEQ ID NO: 326606

SEQ ID NO: 560355 - RNA, 64 nt, hsa; identical to SEQ ID NO: 326607

SEQ ID NO: 560356 - RNA, 64 nt, hsa; identical to SEQ ID NO: 326608

SEQ ID NO: 560357 - RNA, 64 nt, hsa; identical to SEQ ID NO: 326609

SEQ ID NO: 560358 - RNA, 64 nt, hsa; identical to SEQ ID NO: 326610

SEQ ID NO: 560359 - RNA, 64 nt, hsa; identical to SEQ ID NO: 326611

SEQ ID NO: 560360 - RNA, 64 nt, hsa; identical to SEQ ID NO: 326612

SEQ ID NO: 560361 - RNA, 64 nt, hsa; identical to SEQ ID NO: 326613

SEQ ID NO: 560362 - RNA, 64 nt, hsa; identical to SEQ ID NO: 326614

SEQ ID NO: 560363 - RNA, 64 nt, hsa; identical to SEQ ID NO: 326615

SEQ ID NO: 560364 - RNA, 64 nt, hsa; identical to SEQ ID NO: 326616

SEQ ID NO: 560365 - RNA, 64 nt, hsa; identical to SEQ ID NO: 326617

SEQ ID NO: 560366 - RNA, 64 nt, hsa; identical to SEQ ID NO: 326618

SEQ ID NO: 560367 - RNA, 64 nt, hsa; identical to SEQ ID NO: 326619

SEQ ID NO: 560368 - RNA, 64 nt, hsa; identical to SEQ ID NO: 326620

SEQ ID NO: 560369 - RNA, 64 nt, hsa; identical to SEQ ID NO: 326621

SEQ ID NO: 560370 - RNA, 64 nt, hsa; identical to SEQ ID NO: 326622

SEQ ID NO: 560371 - RNA, 64 nt, hsa; identical to SEQ ID NO: 326623

SEQ ID NO: 560372 - RNA, 64 nt, hsa; identical to SEQ ID NO: 326624

SEQ ID NO: 560373 - RNA, 64 nt, hsa; identical to SEQ ID NO: 326625

SEQ ID NO: 560374 - RNA, 64 nt, hsa; identical to SEQ ID NO: 326626

SEQ ID NO: 560375 - RNA, 64 nt, hsa; identical to SEQ ID NO: 326627

SEQ ID NO: 560376 - RNA, 59 nt, hsa
gauaaagguaaguugacuugaacaacuuucuuuugcacugggaaaauaagcaaauguuu

SEQ ID NO: 560377 - RNA, 59 nt, hsa
guuuaguucuuaguggguuaauuuuuguacuuuugcagaagaaacuucagcaagcuaga

SEQ ID NO: 560378 - RNA, 59 nt, hsa
aacuugaauugauuguauguagcacagcacuuuugcaguaagauuggugugaaauacua

SEQ ID NO: 560379 - RNA, 59 nt, hsa
guuucagagccucugaguaggaugcucugcuuuugcauuugauugcagaugagagcuuu

SEQ ID NO: 560380 - RNA, 59 nt, hsa
aacauacacaaaugguaaauuauguggaucuuuugcauauaauauaaauguauagacau

SEQ ID NO: 560381 - RNA, 59 nt, hsa
uuaguaauacccaaguaauauuuuaauuacuuuugcagcuguuacaguugcugcggccu

SEQ ID NO: 560382 - RNA, 59 nt, hsa
ucucucuauucaccaacuucucuacacagcuuuugcauacuuacaguuucuguuccuuu

SEQ ID NO: 560383 - RNA, 59 nt, hsa
ggugccugcagaaguuggggagaaggauacuuuugcacagccuccaugaugucuuuauu

SEQ ID NO: 560384 - RNA, 59 nt, hsa
cugacacagucaauucugauuuucuuuuucuuuugcaagucuaaauguuagaaaacuuu

SEQ ID NO: 560385 - RNA, 59 nt, hsa
ucucugaucucccccuuccuaagacuucucuuuugcacaucuagugaggugaaaauuug

SEQ ID NO: 560386 - RNA, 59 nt, hsa
uaauuugaagcuauuuacaaacaccuuuacuuuugcacuuuuaauucaacaugaguauc

SEQ ID NO: 560387 - RNA, 59 nt, hsa
aaaucaaauauguaccacaguguaugugucuuuugcaagcuuccaacagggauguaucc

SEQ ID NO: 560388 - RNA, 59 nt, hsa
uuucccgggacauuuuuuucugccauuuucuuuugcaauuguaguuuuauguacuguua

SEQ ID NO: 560389 - RNA, 59 nt, hsa
gaacuuugacuauuuaaaaguuucauuuucuuuugcaauuuuaguuuuauguacuguua

SEQ ID NO: 560390 - RNA, 59 nt, hsa
gugaagaacgugcuucuuaggucauaacgcuuuugcagggucaaugguguugagccgcu

SEQ ID NO: 560391 - RNA, 59 nt, hsa
caaaugauuuuacaguuuuauuuuuucaucuuuugcaaaaaguauuuguuacauaauca

SEQ ID NO: 560392 - RNA, 59 nt, hsa
aguaauagaguuaaauuugauacuuccugcuuuugcaaauaauggaguagggaagaaga

SEQ ID NO: 560393 - RNA, 59 nt, hsa
aagccuuguuuaaaacauuucuuacuuaacuuuugcaaauuaaacccauuguagcuuac

SEQ ID NO: 560394 - RNA, 59 nt, hsa
cagucucagccugggcagcuucccccugccuuuugcacguuugcauccccagcauuucc

SEQ ID NO: 560395 - RNA, 59 nt, hsa
aaugacuuuucuuugaaucaguauuuuuccuuuugcacgcauuaugaaauguuaaacaa

SEQ ID NO: 560396 - RNA, 59 nt, hsa
ugauuauaaauugauagcugguaguguuucuuuugcaagaaugcauuucuaaggcaaaa

SEQ ID NO: 560397 - RNA, 59 nt, hsa
uucccaauauccacaaagcuucgccuuugcuuuugcacucucuuuuacauuuuuuuacu

SEQ ID NO: 560398 - RNA, 59 nt, hsa
ugcauucucuaccaaaucaagcaggagaucuuuugcacgacgugcaauuugcauccacc

SEQ ID NO: 560399 - RNA, 59 nt, hsa
uuugguuucuugucuguccacggggguggcuuuugcaaagaugaccggcauagggcaug

SEQ ID NO: 560400 - RNA, 59 nt, hsa
uaaaaucuccguucuuuccggcugcauugcuuuugcauguucacauaugauguacuuuu

SEQ ID NO: 560401 - RNA, 59 nt, hsa
cgggaaaggaaacgccccgggcaaagggucuuuugcagcuuuugcagacgggcaagaag

SEQ ID NO: 560402 - RNA, 59 nt, hsa
aaacgccccgggcaaagggucuuuugcagcuuuugcagacgggcaagaagcugcuucug

SEQ ID NO: 560403 - RNA, 59 nt, hsa
augagaucacugaacuuuucaaaauaaagcuuuugcauagaauaaugaagaucuuuguu

SEQ ID NO: 560404 - RNA, 59 nt, hsa
acugauggcaauauuaagacagacgccugcuuuugcaaauaacuuacaagacuguaaau

SEQ ID NO: 560405 - RNA, 59 nt, hsa
auuaucaguuuuauuuguaagagcuauugcuuuugcagcgguuuuauuuguaaaagcug

SEQ ID NO: 560406 - RNA, 59 nt, hsa
uuucagggaggagugagauguggauguugcuuuugcaccuacgggggcaucugagucca

SEQ ID NO: 560407 - RNA, 59 nt, hsa
uggaguuggaagugcuauuuuccuauggacuuuugcauuauuucauugugcaugcaucc

SEQ ID NO: 560408 - RNA, 59 nt, hsa
ccacacacaugguaaauuaaguauaaauucuuuugcaaaauuauaguucaugucauuga

SEQ ID NO: 560409 - RNA, 59 nt, hsa
gcagggugaggaugggggaguagaugccgcuuuugcaguggcucgcacugcuguggcca

SEQ ID NO: 560410 - RNA, 59 nt, hsa
uuggguacgaagugugcaaagucacagaccuuuugcaaagagguuucuagacagcagaa

SEQ ID NO: 560411 - RNA, 59 nt, hsa
uuugauagaaaggaacacguuuuuacauacuuuugcaaaauaaguaaauaauaaauaaa

SEQ ID NO: 560412 - RNA, 59 nt, hsa
gcuuuguaggugagaugcaacaagcccugcuuuugcauaaugcaaucaaaaauaugugu

SEQ ID NO: 560413 - RNA, 59 nt, hsa
gguuguucuucaagcaaguucugcuugcacuuuugcauuugccuaacagacuuuugcag

SEQ ID NO: 560414 - RNA, 59 nt, hsa
ugcuugcacuuuugcauuugccuaacagacuuuugcagaggcgauggcagagagcagcu

SEQ ID NO: 560415 - RNA, 59 nt, hsa
guaauuguagcuguauaaucguuauuuuucuuuugcaucuuaagucuuagaaauuaaga

SEQ ID NO: 560416 - RNA, 59 nt, hsa
guuuuuuucccccuaauuacccaaaagaucuuuugcaaacuauguuacaugaaugcuuc

SEQ ID NO: 560417 - RNA, 59 nt, hsa
accaaaugauauuugaguuuuuguuauuccuuuugcagauugggauguguuuugggggc

SEQ ID NO: 560418 - RNA, 59 nt, hsa
guaaggcaaacagcgacugccagaaagaccuuuugcaggauguggaggcguccucagga

SEQ ID NO: 560419 - RNA, 59 nt, hsa
gucuaggucuguuguugucuucucuugcucuuuugcaucuaauaauuuuuggcugaaug

SEQ ID NO: 560420 - RNA, 59 nt, hsa
agaagugccugcacaaugaggcuugcccacuuuugcagcucuuuggaauccugaaccca

SEQ ID NO: 560421 - RNA, 64 nt, hsa; identical to SEQ ID NO: 193776

SEQ ID NO: 560422 - RNA, 64 nt, hsa; identical to SEQ ID NO: 193777

SEQ ID NO: 560423 - RNA, 64 nt, hsa; identical to SEQ ID NO: 193778

SEQ ID NO: 560424 - RNA, 64 nt, hsa; identical to SEQ ID NO: 193779

SEQ ID NO: 560425 - RNA, 64 nt, hsa; identical to SEQ ID NO: 193780

SEQ ID NO: 560426 - RNA, 64 nt, hsa; identical to SEQ ID NO: 193781

SEQ ID NO: 560427 - RNA, 64 nt, hsa; identical to SEQ ID NO: 193782

SEQ ID NO: 560428 - RNA, 64 nt, hsa; identical to SEQ ID NO: 193783

SEQ ID NO: 560429 - RNA, 64 nt, hsa; identical to SEQ ID NO: 193784

SEQ ID NO: 560430 - RNA, 64 nt, hsa; identical to SEQ ID NO: 193785

SEQ ID NO: 560431 - RNA, 64 nt, hsa; identical to SEQ ID NO: 193786

SEQ ID NO: 560432 - RNA, 64 nt, hsa; identical to SEQ ID NO: 193787

SEQ ID NO: 560433 - RNA, 64 nt, hsa; identical to SEQ ID NO: 193788

SEQ ID NO: 560434 - RNA, 64 nt, hsa; identical to SEQ ID NO: 193789

SEQ ID NO: 560435 - RNA, 64 nt, hsa; identical to SEQ ID NO: 193790

SEQ ID NO: 560436 - RNA, 64 nt, hsa
acgcagucuuguaggcagcugccaccuuaugcagugcaucgaaaccuuuugcuuggggaugugc

SEQ ID NO: 560437 - RNA, 64 nt, hsa
acaggcugguaaugugcuggccaccuccagcuccugcaucgagucuguaaaccagagcugguuc

SEQ ID NO: 560438 - RNA, 64 nt, hsa
auuuagccguuuccuccagauuuucuucuuuaugugcaucgacuugaguguaaacauaacuuau

SEQ ID NO: 560439 - RNA, 64 nt, hsa
agaggucaugccugggaggaagggaucgucaugcugcaucgaauccucucuccgccguguggcc

SEQ ID NO: 560440 - RNA, 64 nt, hsa
ugccuucuccgcgucauuguuggaagaggagagaugcaucgagcagucccagcugcuuuucauu

SEQ ID NO: 560441 - RNA, 64 nt, hsa
agcaggacuaacaacugggaaauaagcaaaaaacugcaucgauccccagccugguguuguucuu

SEQ ID NO: 560442 - RNA, 64 nt, hsa
guccccaaaccugcaagggcuccccacugccuacugcaucgagucaaaacucaaaugcuuggcu

SEQ ID NO: 560443 - RNA, 64 nt, hsa
uuauagaucagcguuuagucaccuccagguuauaugcaucgagaaccugaauaaaucaugccac

SEQ ID NO: 560444 - RNA, 64 nt, hsa
guacccgcaaaacgggacauaguaugugacaaucugcaucgaucauggacuacuaaaugccuuu

SEQ ID NO: 560445 - RNA, 64 nt, hsa
uauggcuuucucacuuuuauuuuguagcauggguugcaucgacuuuuuuacuagagaauuuuac

SEQ ID NO: 560446 - RNA, 64 nt, hsa
uguauacaaauucuuccuuaagugaaaguuaugcugcaucgaauuguaacugaaaguauagauc

SEQ ID NO: 560447 - RNA, 64 nt, hsa
cccccgguguggaaaaggcuaaauaaggugacagugcaucgaugcucccccgcguggccuuugg

SEQ ID NO: 560448 - RNA, 64 nt, hsa
aaaugcauguuuagggauggcuaaaauuccaaggugcaucgacauuaacccacucauuuaguaa

SEQ ID NO: 560449 - RNA, 64 nt, hsa
uauaugaaaauguacugauuuuuuuuuaauaaacugcaucgagauccaaccgacugaauuguua

SEQ ID NO: 560450 - RNA, 64 nt, hsa
ccuauuggaauucgagacuuaauuaaugaagcuuugcaucgagaaacgaugggucugaagucca

SEQ ID NO: 560451 - RNA, 64 nt, hsa
acacacaguuacugacuuagccuaaacaaccuggugcaucgaaauguauucaccuuucuuuugu

SEQ ID NO: 560452 - RNA, 64 nt, hsa
uguauggaaugguaguacuacauuuuauuuaucaugcaucgauugguggacauuuggaucguuu

SEQ ID NO: 560453 - RNA, 64 nt, hsa
aacucuugacaguugccucaagauggagugaaauugcaucgaggguaagacuguguccacaggu

SEQ ID NO: 560454 - RNA, 64 nt, hsa
agaacuugcagaguguguauucuuggauggcugaugcaucgacuugcauucccacuuaacacuu

SEQ ID NO: 560455 - RNA, 64 nt, hsa
ucagacaacgacugaugaaaacgcccaugcgguuugcaucgacugauaguguguucuuuccggg

SEQ ID NO: 560456 - RNA, 64 nt, hsa
ucugcccaacccaagggcccgugcgcuccaacccugcaucgaacugccaacauaguacaccuuu

SEQ ID NO: 560457 - RNA, 64 nt, hsa
aaaacugcauggcagauacgugacugccacaauaugcaucgaagacaaacuuacuauaaagaug

SEQ ID NO: 560458 - RNA, 64 nt, hsa
uguagccguggaccgaauacgcacucuugaaagcugcaucgagaacccgcccaagcgccaccug

SEQ ID NO: 560459 - RNA, 64 nt, hsa
ccugggauaaacugggagaacuauggcagcuacuugcaucgacuuguaccucacuuagcccuug

SEQ ID NO: 560460 - RNA, 64 nt, hsa
aucacuguguaaaacuaagugucucuaaauguaaugcaucgauuuagugucuggaacauaauaa

SEQ ID NO: 560461 - RNA, 64 nt, hsa
agaaccaggaucucuggagaaacaguugggcuguugcaucgaguaaugucacuggacucggccu

SEQ ID NO: 560462 - RNA, 64 nt, hsa
gguccccucagcaucaagcagcccaaccaaggcgugcaucgagccuugcaccucaacaaaaggc

SEQ ID NO: 560463 - RNA, 64 nt, hsa
uaaguucuuaaugucaaccaucuuuaagguauugugcaucgacacuaaaaacugaucaguguaa

SEQ ID NO: 560464 - RNA, 64 nt, hsa
acagucccugugucucacagcgguaaucguguguugcaucgaugcguuuguggucaccacgaag

SEQ ID NO: 560465 - RNA, 64 nt, hsa
ggcugaguggaaaauggugugagccccaccgcugugcaucgaaugagggaaguggcagcagaga

SEQ ID NO: 560466 - RNA, 64 nt, hsa
gacacacugguuaaaaauuaaacauaaaagaaauugcaucgauguaaucagaaugaagaccgca

SEQ ID NO: 560467 - RNA, 64 nt, hsa
gguccccauuaugggaugcauuaggacuggccuaugcaucgaaaaucuuuuuguuuguaaacgu

SEQ ID NO: 560468 - RNA, 64 nt, hsa
gagagugguuuccguuugcagcuacacagcugugugcaucgacguucuccuggggugugugcca

SEQ ID NO: 560469 - RNA, 64 nt, hsa
gagaguaacugugcuuggaauagaaaagcccugcugcaucgagacacaaugcuggcagcugcgg

SEQ ID NO: 560470 - RNA, 64 nt, hsa
uuguuugauuuuuucuuuuauauuauaaagcaauugcaucgauaaaagcuuggacuccauuuua

SEQ ID NO: 560471 - RNA, 64 nt, hsa
ucauugcaauaaaagccagcauucacaaaaugaggaagauaaggaaaguagcauaaauauuuuc

SEQ ID NO: 560472 - RNA, 64 nt, hsa
acugguccugcagcuuauugaaucagagaaaugugaagauaagaugaacuaaacaaacauauuu

SEQ ID NO: 560473 - RNA, 64 nt, hsa
caaaaggacugguacgguagucuguggaaaccaggaagauaaaacaacagccacaaaagagaaa

SEQ ID NO: 560474 - RNA, 64 nt, hsa
ucugccaauauacguuuuuucuguugguuuaagagaagauaacugacagcuuuaccuacuuccu

SEQ ID NO: 560475 - RNA, 64 nt, hsa
uugaagaaauugauuacaguuccacuaaauuguugaagauaaauuauuuuuaaagguuaugaaa

SEQ ID NO: 560476 - RNA, 60 nt, hsa
auauuucaggaggagaaugaguauguuaaugaagauaaaaagaagugacaucucuuguac

SEQ ID NO: 560477 - RNA, 64 nt, hsa
auguucuacuugucagggcuggaacuauuguauagaagauaauaugauugugacuucuaguucu

SEQ ID NO: 560478 - RNA, 64 nt, hsa
uuuguugaucaagugacuguccccguaaaaaguagaagauaaguuuguuaaaguauuuuuuaua

SEQ ID NO: 560479 - RNA, 64 nt, hsa
cccugggucccucccacaacaugugggaauuccagaagauaaauucaaguugcaauuucagugg

SEQ ID NO: 560480 - RNA, 64 nt, hsa
uguuaauuugaggacugggcugucuuggggcucagaagauaaagaacuauuugagcagaugugu

SEQ ID NO: 560481 - RNA, 64 nt, hsa
gugaaaccguugguccauuuuugucuguuucuaugaagauaaaauaauugggggccaucuagaa

SEQ ID NO: 560482 - RNA, 64 nt, hsa
acugaaauguuugugucuucaacuuauuagaauggaagauaaugcagauauuucugugggaaau

SEQ ID NO: 560483 - RNA, 64 nt, hsa
uuaguuuaucuuguaguauucaucuuuguauucugaagauaagguuugaauuaaauugauacac

SEQ ID NO: 560484 - RNA, 64 nt, hsa
ucugaccuucucaucaagagagcuggggugcuuugaagauaaucccuaccccucucccccaaau

SEQ ID NO: 560485 - RNA, 64 nt, hsa
auaaugcaagcauacccucccuugagucucaauugaagauaaaagaauguacugagcaagcaaa

SEQ ID NO: 560486 - RNA, 64 nt, hsa
accuaaaucucuuugccuaacaacuugggauccugaagauaaauauguguuggacaagcauaga

SEQ ID NO: 560487 - RNA, 63 nt, hsa
uuuaaucaagcaggaaaaaguucucaugauuaugccaacuauaauaguaauccucacugagug

SEQ ID NO: 560488 - RNA, 63 nt, hsa
gaauucuuaccauacugccauuaaaauaaauuugccaacuaguaaugcauacuggaaaucaaa

SEQ ID NO: 560489 - RNA, 64 nt, hsa
ggagcagaggggugcggguaaacgaggaguggggcgaggaaagcgggaugggaacaaguggccu

SEQ ID NO: 560490 - RNA, 64 nt, hsa
uuuuucuggggccucaauccagucuugauaacagcgaggaaagagguauugaagaaacaggggu

SEQ ID NO: 560491 - RNA, 64 nt, hsa
gcauagagauuuguucguauuuagaaugggaucacgaggaaaagagaaggaaagugauuuuuuu

SEQ ID NO: 560492 - RNA, 64 nt, hsa
aaguaaaaguugggcacuaaucuggauuaacauucgaggaaaucaguugagcugaauuuaaguu

SEQ ID NO: 560493 - RNA, 64 nt, hsa
gaugaguacuugccuaggacugggaggaggauugcgaggaaauggagauucacugcuaaugagu

SEQ ID NO: 560494 - RNA, 64 nt, hsa
guuguacuaggcaaacacacugauguaggaagcacgaggaaaggaagacguuuugauauagugu

SEQ ID NO: 560495 - RNA, 64 nt, hsa
uuuuuggacuuaacaaaguugugaauagcacagucgaggaaaauugauaccugcaguaacccau

SEQ ID NO: 560496 - RNA, 64 nt, hsa
cugccagucagccacagagacccuccuccuuucacgaggaaaagaccuuccccugaaccccuaa

SEQ ID NO: 560497 - RNA, 64 nt, hsa
guggggucccuuuguugccaagacguuaggaaagcgaggaaagugcuuggauuaggagagucuu

SEQ ID NO: 560498 - RNA, 64 nt, hsa
ccuucuccaaaccagauccaaucaaaccucagcccgaggaaacaugcuccccaacgugcucucc

SEQ ID NO: 560499 - RNA, 64 nt, hsa
cguuccaacagcauucacugccaguucuaauaggcgaggaaaaugcccgaggcgcugucuucug

SEQ ID NO: 560500 - RNA, 64 nt, hsa
auuacauuuauguuccuauauauuacaacaucggcgaggaaaugaaagcgauucuccuugaguu

SEQ ID NO: 560501 - RNA, 64 nt, hsa
cuuguauauggagaauaaacuaauaaacuuguaucgaggaaauccauaaaguuauaaauuagcc

SEQ ID NO: 560502 - RNA, 64 nt, hsa
uaaaucugcucaagauaaaauguaacuuggaaagcgaggaaacacuaaacauguuuuuaccugc

SEQ ID NO: 560503 - RNA, 64 nt, hsa
aaaaucugcuagucgcuagcccugagaaguacugcgaggaaauguggagcaguuuucucugguu

SEQ ID NO: 560504 - RNA, 64 nt, hsa
uuuugaauaccaugaucgaugaugucccaugcuucgaggaaaaccaaacacuuuccgccucucu

SEQ ID NO: 560505 - RNA, 64 nt, hsa
ggcgcguuuggguuugauggcgaguuucuaaaggcgaggaaaugguuuguaagaggggaaagaa

SEQ ID NO: 560506 - RNA, 64 nt, hsa
uggaacauggggacgagugacggcaggaggaccacgaggaaauacccucaaaacuaacuuguuu

SEQ ID NO: 560507 - RNA, 64 nt, hsa
caugcacauggaaacccaugagcuaggauucuaccgaggaaaacaucuagugggauuagcaagg

SEQ ID NO: 560508 - RNA, 64 nt, hsa
gacucuuuuaggaucagaucugugagcacguuggcgaggaaaaacaaaacaaacaaaaaaaaga

SEQ ID NO: 560509 - RNA, 64 nt, hsa
guuaauaauuuguuuuauaauugaguaguacaagcgaggaaaaaauacggaggauaaccacuau

SEQ ID NO: 560510 - RNA, 64 nt, hsa
uuucugcucuugugaagaaaaaaaaaagcauuuucgaggaaagaauuaugcaauuucuuuuguu

SEQ ID NO: 560511 - RNA, 64 nt, hsa
uccagccauggucagacaggucacccaggagccucgaggaaagcccuggagggaaucacaugug

SEQ ID NO: 560512 - RNA, 64 nt, hsa
auaaaggcagagagaagagacagaacuaaaaauacgaggaaaggagagugaggauuuucauuaa

SEQ ID NO: 560513 - RNA, 64 nt, hsa
ggacugaggauccucuccuccagaaaagcccccucgaggaaauaaauuagugcgguucucuuug

SEQ ID NO: 560514 - RNA, 64 nt, hsa
gggcccagagcaaagggcaucagggagaaagucccgaggaaaugugaccagugguuucugcucg

SEQ ID NO: 560515 - RNA, 64 nt, hsa
uuuggccagccacuaagucccaccagcugagguccgaggaaagcggggugacucauuucccuug

SEQ ID NO: 560516 - RNA, 64 nt, hsa
ugugcuuugugaacucugcuuuaaagugaggggccgaggaaaacuuagaaacaggcagaguugg

SEQ ID NO: 560517 - RNA, 64 nt, hsa
ccgagauagguacuguuaccauccucucugcagacgaggaaaccgaggaccaggagguucagua

SEQ ID NO: 560518 - RNA, 64 nt, hsa
gcugcggggucaggggcuccagcauccgagcuggcgaggaaacaguacagggucugaguucuga

SEQ ID NO: 560519 - RNA, 64 nt, hsa
aagaccauggaagaaaagaaggaaugccaaagaucgaggaaaucuaccaagacuaguaggguag

SEQ ID NO: 560520 - RNA, 50 nt, hsa
uggccgaaauguuauuuuaacgaggaaagaccacagcaagauucuuucau

SEQ ID NO: 560521 - RNA, 64 nt, hsa
acauuugugucacuguacaguuuuguggacugagcgaggaaaaacaacaaauaauuuaaguugg

SEQ ID NO: 560522 - RNA, 64 nt, hsa
ggaccacugggugagagaggaauaaggcccagagcgaggaaaggauuuuaccaaagcaucaaua

SEQ ID NO: 560523 - RNA, 64 nt, hsa
ucuuuuauuuguugacucuagcucccuucaaagucgaggaaagaucuuuacucacuuaaugagg

SEQ ID NO: 560524 - RNA, 64 nt, hsa
agaucuccggauugucgggggacgcaggacucuucgaggaaaaccagccgaaugagaucaaaag

SEQ ID NO: 560525 - RNA, 64 nt, hsa
cuccggcggcccaggauucuaaggaugcaauccucgaggaaaauuagucgauucucagauuacc

SEQ ID NO: 560526 - RNA, 64 nt, hsa
aggauugaaaggugcauuuuccccauaaaaaaggcgaggaaaacccauggcugcuuugugucac

SEQ ID NO: 560527 - RNA, 64 nt, hsa
uaaaaucauccguaugucaguguaucuggauacacgaggaaaaggaaagagucucagaguggaa

SEQ ID NO: 560528 - RNA, 64 nt, hsa
agucugcccacauguaauuaccggcuaauucaagcgaggaaaaauguaagucauuuagaccaaa

SEQ ID NO: 560529 - RNA, 64 nt, hsa
caggggaaguagagguggccgagguuggggcacacgaggaaaucguagucggggaagacucuac

SEQ ID NO: 560530 - RNA, 64 nt, hsa
ccccuccucacucccuucccauaagcuauagacccgaggaaacucagagucggaacggagaaag

SEQ ID NO: 560531 - RNA, 64 nt, hsa
agcugcugugcccaggacguggguucagcgugggcgaggaaagccuggcgagcguggcccugua

SEQ ID NO: 560532 - RNA, 64 nt, hsa
acuccagccugggcaacacagcgagacuccgucucgaggaaaaaaaaagaaaagauacgugccu

SEQ ID NO: 560533 - RNA, 64 nt, hsa
cugaguauaugaguagugcccgcagccugagcuccgaggaaaaauuggcccuucucaaacagau

SEQ ID NO: 560534 - RNA, 64 nt, hsa
cugagcgucccaggcauagaaaccucgaagcgcccgaggaaacgagggccugcuggcugagaua

SEQ ID NO: 560535 - RNA, 64 nt, hsa
ggugaugaaacugagguucaguacucucgggacucgaggaaauuauuccugagacauggaguaa

SEQ ID NO: 560536 - RNA, 64 nt, hsa
gaauaaaaaagcuuucuaugaguuugguauggugcgaggaaaaucuuacaguuugaauuaugac

SEQ ID NO: 560537 - RNA, 64 nt, hsa
uaccuugaauagaaguuuuccugauaagaauaaacgaggaaaagguccuugccuccuggaagaa

SEQ ID NO: 560538 - RNA, 64 nt, hsa
agccagagaauagaucaguauuucacugauaccacgaggaaaagaacaaacaaaacuuaaaagu

SEQ ID NO: 560539 - RNA, 64 nt, hsa
aaucgaucuacacacauccacgcacaugcgaccccgaggaaacgaaacccacucuagaaaacgc

SEQ ID NO: 560540 - RNA, 59 nt, hsa
agaaaauguuuaccucaugauaucccagccgaggaaaaagauccacuggaaacuaggcc

SEQ ID NO: 560541 - RNA, 59 nt, hsa
cacaggaaacuucgcagugaugcaccaggcgaggaaacgagaccucuuucguuccuucu

SEQ ID NO: 560542 - RNA, 64 nt, hsa
cucauugcuuugcuuauuuagcaaaugcauacaacgaggaaaggagguggcuagugguaucagu

SEQ ID NO: 560543 - RNA, 64 nt, hsa
acuuuguggaggaggcaccaagugucucaggcagcgaggaaauuggaggccauuuuucagucaa

SEQ ID NO: 560544 - RNA, 64 nt, hsa
cacaaccuuaugagguagaauuccauuuuagagacgaggaaacugggacccucaauuaugcaga

SEQ ID NO: 560545 - RNA, 61 nt, hsa
uucaccaggucaccaaguaaugucccuggugcgaggaaacagagacaaccuuucugucuuc

SEQ ID NO: 560546 - RNA, 64 nt, hsa
ccacacaggugccaggagugcccauaugagaugacgaggaaaccccuuugcaggugaggggaca

SEQ ID NO: 560547 - RNA, 64 nt, hsa
caccagaccacagaggauggagccugggaagcagcgaggaaaucacagcccccucgccccugcc

SEQ ID NO: 560548 - RNA, 64 nt, hsa
caccugggccaucuugguuuuugcaagaaaaaagcgaggaaaucagagaaacucuuugggcugu

SEQ ID NO: 560549 - RNA, 64 nt, hsa
uuguuucauuuacuccaaaggauccugaagccugcgaggaaaggaucuugaaaauauuugugca

SEQ ID NO: 560550 - RNA, 58 nt, hsa
cugguggcggcggcguguaacaccuucccgaggaaacuccgcugccgacccugccuga

SEQ ID NO: 560551 - RNA, 64 nt, hsa
aaaugccuuuguccuuuguauaaucagcaggcuccgaggaaaaaguuucuucuuuugugggcau

SEQ ID NO: 560552 - RNA, 64 nt, hsa
ucucuccuuugggacccccggguucccagagcuccgaggaaacugauccuucauguuucaauag

SEQ ID NO: 560553 - RNA, 64 nt, hsa
cauccacaccagcuccccaugccagcuguggcuccgaggaaaaucacuccuacacgcuaucccu

SEQ ID NO: 560554 - RNA, 64 nt, hsa
acuaagaaaaaaagcacaaaguucucagagcucucgaggaaagugguuguccccguaccaccau

SEQ ID NO: 560555 - RNA, 64 nt, hsa
cuucuucgacucagauucagaaaugaucuaaacacgaggaaacauuauucauuggaaaagugca

SEQ ID NO: 560556 - RNA, 64 nt, hsa
ucugagaaacuucacucuuuucacuuaugcaucacgaggaaauaacuaaaauacauaccaagag

SEQ ID NO: 560557 - RNA, 64 nt, hsa
gcccggagaguaguccgcgccaggaagagagcaacgaggaaaggagagggacucuggcgucccg

SEQ ID NO: 560558 - RNA, 64 nt, hsa
aaaaaccaauaagcuggugacucaugaauacacacgaggaaaagcagagguuuauuuuaucugc

SEQ ID NO: 560559 - RNA, 64 nt, hsa
acucugcuuuguccgacauuugcaaagagguacacgaggaaauggaauugguauuucauuuuaa

SEQ ID NO: 560560 - RNA, 64 nt, hsa
gagaaccuguucagauacaggccaguuucuucuucgaggaaagccaagcuccucaaacaggguu

SEQ ID NO: 560561 - RNA, 64 nt, hsa
ucggcucgguacucaacacaacccaaguuucauccgaggaaauguccccgcaguggaugcagcu

SEQ ID NO: 560562 - RNA, 64 nt, hsa
ggcaauuuuuguauccaaggaaauaaugugaaugcgaggaaaugucuuuagagcacagggacag

SEQ ID NO: 560563 - RNA, 64 nt, hsa
cagcagcaaggcgcccaugccacacaccgucucucgaggaaacgcgguucagcgauucuuugac

SEQ ID NO: 560564 - RNA, 64 nt, hsa
ggcugguccaugucuauagaguaacacacuggaccgaggaaaagucagauuucauuuucuaccc

SEQ ID NO: 560565 - RNA, 64 nt, hsa
cuguuaaaaaacaugcauuagaaucucuagaacacgaggaaaaacagggucuuguacauauguu

SEQ ID NO: 560566 - RNA, 64 nt, hsa
ucuccuaagagccuucaugcacaccccugaaccacgaggaaacaguacagucgcuagucaagug

SEQ ID NO: 560567 - RNA, 64 nt, hsa
caccggacaaggguuccucccaggauacgcccgagcggaagaagcgggcucugagccacgcccu

SEQ ID NO: 560568 - RNA, 64 nt, hsa
uuaauuacccagguguaggaagccauacacugaggcggaagaucgcaagucagaguggcuggca

SEQ ID NO: 560569 - RNA, 64 nt, hsa; identical to SEQ ID NO: 95053

SEQ ID NO: 560570 - RNA, 64 nt, hsa; identical to SEQ ID NO: 95054

SEQ ID NO: 560571 - RNA, 64 nt, hsa; identical to SEQ ID NO: 95055

SEQ ID NO: 560572 - RNA, 64 nt, hsa; identical to SEQ ID NO: 95056

SEQ ID NO: 560573 - RNA, 64 nt, hsa; identical to SEQ ID NO: 95057

SEQ ID NO: 560574 - RNA, 64 nt, hsa; identical to SEQ ID NO: 95058

SEQ ID NO: 560575 - RNA, 64 nt, hsa; identical to SEQ ID NO: 95059

SEQ ID NO: 560576 - RNA, 64 nt, hsa; identical to SEQ ID NO: 95060

SEQ ID NO: 560577 - RNA, 64 nt, hsa; identical to SEQ ID NO: 95061

SEQ ID NO: 560578 - RNA, 64 nt, hsa; identical to SEQ ID NO: 95062

SEQ ID NO: 560579 - RNA, 64 nt, hsa; identical to SEQ ID NO: 95063

SEQ ID NO: 560580 - RNA, 64 nt, hsa; identical to SEQ ID NO: 95064

SEQ ID NO: 560581 - RNA, 64 nt, hsa; identical to SEQ ID NO: 95065

SEQ ID NO: 560582 - RNA, 64 nt, hsa; identical to SEQ ID NO: 95066

SEQ ID NO: 560583 - RNA, 64 nt, hsa; identical to SEQ ID NO: 95067

SEQ ID NO: 560584 - RNA, 64 nt, hsa; identical to SEQ ID NO: 95068

SEQ ID NO: 560585 - RNA, 64 nt, hsa; identical to SEQ ID NO: 95069

SEQ ID NO: 560586 - RNA, 64 nt, hsa; identical to SEQ ID NO: 95070

SEQ ID NO: 560587 - RNA, 64 nt, hsa; identical to SEQ ID NO: 95071

SEQ ID NO: 560588 - RNA, 64 nt, hsa; identical to SEQ ID NO: 95072

SEQ ID NO: 560589 - RNA, 64 nt, hsa; identical to SEQ ID NO: 95073

SEQ ID NO: 560590 - RNA, 64 nt, hsa; identical to SEQ ID NO: 95074

SEQ ID NO: 560591 - RNA, 64 nt, hsa; identical to SEQ ID NO: 95075

SEQ ID NO: 560592 - RNA, 64 nt, hsa; identical to SEQ ID NO: 95076

SEQ ID NO: 560593 - RNA, 64 nt, hsa; identical to SEQ ID NO: 95077

SEQ ID NO: 560594 - RNA, 64 nt, hsa; identical to SEQ ID NO: 95078

SEQ ID NO: 560595 - RNA, 64 nt, hsa; identical to SEQ ID NO: 95079

SEQ ID NO: 560596 - RNA, 64 nt, hsa; identical to SEQ ID NO: 173420

SEQ ID NO: 560597 - RNA, 64 nt, hsa; identical to SEQ ID NO: 173421

SEQ ID NO: 560598 - RNA, 64 nt, hsa; identical to SEQ ID NO: 173422

SEQ ID NO: 560599 - RNA, 64 nt, hsa; identical to SEQ ID NO: 173423

SEQ ID NO: 560600 - RNA, 64 nt, hsa; identical to SEQ ID NO: 173424

SEQ ID NO: 560601 - RNA, 64 nt, hsa; identical to SEQ ID NO: 173425

SEQ ID NO: 560602 - RNA, 64 nt, hsa; identical to SEQ ID NO: 173426

SEQ ID NO: 560603 - RNA, 64 nt, hsa; identical to SEQ ID NO: 173427

SEQ ID NO: 560604 - RNA, 64 nt, hsa; identical to SEQ ID NO: 173428

SEQ ID NO: 560605 - RNA, 64 nt, hsa; identical to SEQ ID NO: 173429

SEQ ID NO: 560606 - RNA, 64 nt, hsa; identical to SEQ ID NO: 121134

SEQ ID NO: 560607 - RNA, 64 nt, hsa; identical to SEQ ID NO: 121135

SEQ ID NO: 560608 - RNA, 64 nt, hsa; identical to SEQ ID NO: 121136

SEQ ID NO: 560609 - RNA, 64 nt, hsa; identical to SEQ ID NO: 121137

SEQ ID NO: 560610 - RNA, 64 nt, hsa; identical to SEQ ID NO: 121138

SEQ ID NO: 560611 - RNA, 64 nt, hsa; identical to SEQ ID NO: 121139

SEQ ID NO: 560612 - RNA, 64 nt, hsa; identical to SEQ ID NO: 121140

SEQ ID NO: 560613 - RNA, 64 nt, hsa; identical to SEQ ID NO: 121141

SEQ ID NO: 560614 - RNA, 64 nt, hsa; identical to SEQ ID NO: 121142

SEQ ID NO: 560615 - RNA, 64 nt, hsa; identical to SEQ ID NO: 121143

SEQ ID NO: 560616 - RNA, 64 nt, hsa; identical to SEQ ID NO: 121144

SEQ ID NO: 560617 - RNA, 64 nt, hsa; identical to SEQ ID NO: 121145

SEQ ID NO: 560618 - RNA, 64 nt, hsa; identical to SEQ ID NO: 121146

SEQ ID NO: 560619 - RNA, 64 nt, hsa; identical to SEQ ID NO: 121147

SEQ ID NO: 560620 - RNA, 64 nt, hsa; identical to SEQ ID NO: 221675

SEQ ID NO: 560621 - RNA, 64 nt, hsa; identical to SEQ ID NO: 221676

SEQ ID NO: 560622 - RNA, 64 nt, hsa; identical to SEQ ID NO: 221677

SEQ ID NO: 560623 - RNA, 64 nt, hsa; identical to SEQ ID NO: 221678

SEQ ID NO: 560624 - RNA, 64 nt, hsa; identical to SEQ ID NO: 221679

SEQ ID NO: 560625 - RNA, 64 nt, hsa; identical to SEQ ID NO: 221680

SEQ ID NO: 560626 - RNA, 64 nt, hsa; identical to SEQ ID NO: 221681

SEQ ID NO: 560627 - RNA, 64 nt, hsa; identical to SEQ ID NO: 221682

SEQ ID NO: 560628 - RNA, 64 nt, hsa; identical to SEQ ID NO: 221683

SEQ ID NO: 560629 - RNA, 64 nt, hsa; identical to SEQ ID NO: 221684

SEQ ID NO: 560630 - RNA, 64 nt, hsa; identical to SEQ ID NO: 221685

SEQ ID NO: 560631 - RNA, 64 nt, hsa; identical to SEQ ID NO: 221686

SEQ ID NO: 560632 - RNA, 64 nt, hsa; identical to SEQ ID NO: 221687

SEQ ID NO: 560633 - RNA, 64 nt, hsa; identical to SEQ ID NO: 221688

SEQ ID NO: 560634 - RNA, 64 nt, hsa; identical to SEQ ID NO: 221689

SEQ ID NO: 560635 - RNA, 64 nt, hsa; identical to SEQ ID NO: 221690

SEQ ID NO: 560636 - RNA, 64 nt, hsa; identical to SEQ ID NO: 221691

SEQ ID NO: 560637 - RNA, 64 nt, hsa; identical to SEQ ID NO: 221692

SEQ ID NO: 560638 - RNA, 64 nt, hsa; identical to SEQ ID NO: 221693

SEQ ID NO: 560639 - RNA, 64 nt, hsa; identical to SEQ ID NO: 221694

SEQ ID NO: 560640 - RNA, 64 nt, hsa; identical to SEQ ID NO: 221695

SEQ ID NO: 560641 - RNA, 64 nt, hsa; identical to SEQ ID NO: 221696

SEQ ID NO: 560642 - RNA, 64 nt, hsa; identical to SEQ ID NO: 221697

SEQ ID NO: 560643 - RNA, 64 nt, hsa; identical to SEQ ID NO: 221698

SEQ ID NO: 560644 - RNA, 64 nt, hsa; identical to SEQ ID NO: 221699

SEQ ID NO: 560645 - RNA, 64 nt, hsa; identical to SEQ ID NO: 221700

SEQ ID NO: 560646 - RNA, 64 nt, hsa; identical to SEQ ID NO: 221701

SEQ ID NO: 560647 - RNA, 64 nt, hsa; identical to SEQ ID NO: 221702

SEQ ID NO: 560648 - RNA, 64 nt, hsa
acauaugacaauaagccacgaggugcaguaaguacccgacuaaaguuuccguggguucugucau

SEQ ID NO: 560649 - RNA, 64 nt, hsa
cuccugggcucaagcgauccuccugccucaaccucccgacuagcuggcauuacaggcgugcagc

SEQ ID NO: 560650 - RNA, 64 nt, hsa
gcccccuggcggccaggaagagaaacagcuccuccccgacuagguggaaggcuggccaggcacc

SEQ ID NO: 560651 - RNA, 64 nt, hsa
ugagguuggagagaaagaacagaccagcgcccuucccgacuacauccgaaacuucacacagggu

SEQ ID NO: 560652 - RNA, 64 nt, hsa
uauuuuuuaagaugaaucagaauguuccucccuccccgacuaccuucucugacugucuuccagu

SEQ ID NO: 560653 - RNA, 55 nt, hsa
caagugcagacaagucaugagagaccccgacuacuccucagccacaucgcaccaa

SEQ ID NO: 560654 - RNA, 64 nt, hsa
gagaggcacagagugcacugucauugacauguuacccgacuaaggaucacucuguucauaagaa

SEQ ID NO: 560655 - RNA, 64 nt, hsa
uguuauccauccugaguuugugucugagaccuaucccgacuaucguugcugguagagccugggc

SEQ ID NO: 560656 - RNA, 64 nt, hsa
uuuuucuauuugaacuucaguucuguccuugaaucccgacuagauauuucuugcccucuggucu

SEQ ID NO: 560657 - RNA, 64 nt, hsa
acucaucucccuuccuucucagggggucccgagccccgacuagcuuugcccuaacuccuucauc

SEQ ID NO: 560658 - RNA, 64 nt, hsa
ugaguagcugggacuacaggugugcgccaccaugcccgacuaauuuuuguauuuugaguagaga

SEQ ID NO: 560659 - RNA, 64 nt, hsa
aaguagcuaggacugcaggcaccaugucacuaugcccgacuaauuuuuaauuuuuaauuuuuug

SEQ ID NO: 560660 - RNA, 64 nt, hsa
uuaucaaacuugggcaauucuguuuguguaacuccccgacuaguggaugggagagucccauugc

SEQ ID NO: 560661 - RNA, 64 nt, hsa
cucacuuaucucaguggacuccaaagcaaaagcucccgacuacuagcucuguuaguuccagccu

SEQ ID NO: 560662 - RNA, 64 nt, hsa
aagcccccacuacuaaauggccucucuccacuaccccgacuaucccugcacauaaacuccguuu

SEQ ID NO: 560663 - RNA, 64 nt, hsa
caaguagcugggauuacaggugcacagcaccucccccgacuaauuuuuauauuuuuaguagaga

SEQ ID NO: 560664 - RNA, 64 nt, hsa
ccaugauuuuaaaaauuaaaaaaaccuggcagagcccgacuagaaagggacggccucuccccuc

SEQ ID NO: 560665 - RNA, 64 nt, hsa
cagccuuaccugugacacugcacccucacggccacccgacuacuuugccuccuuggauuuccuc

SEQ ID NO: 560666 - RNA, 64 nt, hsa
cacccacuguccgccucugcccgcagagcccacgcccgacuagcaggcaugccgcgguagguaa

SEQ ID NO: 560667 - RNA, 64 nt, hsa
ugaguagcugagauuauaagcacgcaccaucauacccgacuaauuuuuguauuuauaguagaaa

SEQ ID NO: 560668 - RNA, 64 nt, hsa
gcagggcagggcuggguggggcaagaucccccagcccgacuagacccaccucaccugaaggggg

SEQ ID NO: 560669 - RNA, 64 nt, hsa
ugaguagcuggaauuacaggcaggugccaccaugcccgacuaauuuuuuuuuauuuuuaguaga

SEQ ID NO: 560670 - RNA, 64 nt, hsa; identical to SEQ ID NO: 309743

SEQ ID NO: 560671 - RNA, 64 nt, hsa; identical to SEQ ID NO: 309744

SEQ ID NO: 560672 - RNA, 64 nt, hsa; identical to SEQ ID NO: 309745

SEQ ID NO: 560673 - RNA, 64 nt, hsa; identical to SEQ ID NO: 309746

SEQ ID NO: 560674 - RNA, 64 nt, hsa; identical to SEQ ID NO: 309747

SEQ ID NO: 560675 - RNA, 64 nt, hsa; identical to SEQ ID NO: 309748

SEQ ID NO: 560676 - RNA, 64 nt, hsa; identical to SEQ ID NO: 309749

SEQ ID NO: 560677 - RNA, 56 nt, hsa; identical to SEQ ID NO: 83586

SEQ ID NO: 560678 - RNA, 64 nt, hsa; identical to SEQ ID NO: 309751

SEQ ID NO: 560679 - RNA, 64 nt, hsa; identical to SEQ ID NO: 309752

SEQ ID NO: 560680 - RNA, 64 nt, hsa; identical to SEQ ID NO: 309753

SEQ ID NO: 560681 - RNA, 64 nt, hsa; identical to SEQ ID NO: 309754

SEQ ID NO: 560682 - RNA, 64 nt, hsa; identical to SEQ ID NO: 309755

SEQ ID NO: 560683 - RNA, 64 nt, hsa; identical to SEQ ID NO: 309756

SEQ ID NO: 560684 - RNA, 64 nt, hsa; identical to SEQ ID NO: 309757

SEQ ID NO: 560685 - RNA, 64 nt, hsa; identical to SEQ ID NO: 309758

SEQ ID NO: 560686 - RNA, 64 nt, hsa; identical to SEQ ID NO: 309759

SEQ ID NO: 560687 - RNA, 64 nt, hsa; identical to SEQ ID NO: 309760

SEQ ID NO: 560688 - RNA, 64 nt, hsa; identical to SEQ ID NO: 309761

SEQ ID NO: 560689 - RNA, 64 nt, hsa; identical to SEQ ID NO: 309762

SEQ ID NO: 560690 - RNA, 64 nt, hsa; identical to SEQ ID NO: 309763

SEQ ID NO: 560691 - RNA, 64 nt, hsa; identical to SEQ ID NO: 309764

SEQ ID NO: 560692 - RNA, 64 nt, hsa; identical to SEQ ID NO: 309765

SEQ ID NO: 560693 - RNA, 64 nt, hsa; identical to SEQ ID NO: 309766

SEQ ID NO: 560694 - RNA, 64 nt, hsa; identical to SEQ ID NO: 309767

SEQ ID NO: 560695 - RNA, 64 nt, hsa; identical to SEQ ID NO: 309768

SEQ ID NO: 560696 - RNA, 64 nt, hsa; identical to SEQ ID NO: 309769

SEQ ID NO: 560697 - RNA, 64 nt, hsa; identical to SEQ ID NO: 309770

SEQ ID NO: 560698 - RNA, 64 nt, hsa; identical to SEQ ID NO: 309771

SEQ ID NO: 560699 - RNA, 64 nt, hsa; identical to SEQ ID NO: 309772

SEQ ID NO: 560700 - RNA, 64 nt, hsa; identical to SEQ ID NO: 309773

SEQ ID NO: 560701 - RNA, 64 nt, hsa; identical to SEQ ID NO: 309774

SEQ ID NO: 560702 - RNA, 64 nt, hsa; identical to SEQ ID NO: 309775

SEQ ID NO: 560703 - RNA, 64 nt, hsa; identical to SEQ ID NO: 560648

SEQ ID NO: 560704 - RNA, 64 nt, hsa; identical to SEQ ID NO: 560649

SEQ ID NO: 560705 - RNA, 64 nt, hsa; identical to SEQ ID NO: 560650

SEQ ID NO: 560706 - RNA, 64 nt, hsa; identical to SEQ ID NO: 560651

SEQ ID NO: 560707 - RNA, 64 nt, hsa; identical to SEQ ID NO: 560652

SEQ ID NO: 560708 - RNA, 55 nt, hsa; identical to SEQ ID NO: 560653

SEQ ID NO: 560709 - RNA, 64 nt, hsa; identical to SEQ ID NO: 560654

SEQ ID NO: 560710 - RNA, 64 nt, hsa; identical to SEQ ID NO: 560655

SEQ ID NO: 560711 - RNA, 64 nt, hsa; identical to SEQ ID NO: 560656

SEQ ID NO: 560712 - RNA, 64 nt, hsa; identical to SEQ ID NO: 560657

SEQ ID NO: 560713 - RNA, 64 nt, hsa; identical to SEQ ID NO: 560658

SEQ ID NO: 560714 - RNA, 64 nt, hsa; identical to SEQ ID NO: 560659

SEQ ID NO: 560715 - RNA, 64 nt, hsa; identical to SEQ ID NO: 560660

SEQ ID NO: 560716 - RNA, 64 nt, hsa; identical to SEQ ID NO: 560661

SEQ ID NO: 560717 - RNA, 64 nt, hsa; identical to SEQ ID NO: 560662

SEQ ID NO: 560718 - RNA, 64 nt, hsa; identical to SEQ ID NO: 560663

SEQ ID NO: 560719 - RNA, 64 nt, hsa; identical to SEQ ID NO: 560664

SEQ ID NO: 560720 - RNA, 64 nt, hsa; identical to SEQ ID NO: 560665

SEQ ID NO: 560721 - RNA, 64 nt, hsa; identical to SEQ ID NO: 560666

SEQ ID NO: 560722 - RNA, 64 nt, hsa; identical to SEQ ID NO: 560667

SEQ ID NO: 560723 - RNA, 64 nt, hsa; identical to SEQ ID NO: 560668

SEQ ID NO: 560724 - RNA, 64 nt, hsa; identical to SEQ ID NO: 560669

SEQ ID NO: 560725 - RNA, 64 nt, hsa; identical to SEQ ID NO: 309743

SEQ ID NO: 560726 - RNA, 64 nt, hsa; identical to SEQ ID NO: 309744

SEQ ID NO: 560727 - RNA, 64 nt, hsa; identical to SEQ ID NO: 309745

SEQ ID NO: 560728 - RNA, 64 nt, hsa; identical to SEQ ID NO: 309746

SEQ ID NO: 560729 - RNA, 64 nt, hsa; identical to SEQ ID NO: 309747

SEQ ID NO: 560730 - RNA, 64 nt, hsa; identical to SEQ ID NO: 309748

SEQ ID NO: 560731 - RNA, 64 nt, hsa; identical to SEQ ID NO: 309749

SEQ ID NO: 560732 - RNA, 56 nt, hsa; identical to SEQ ID NO: 83586

SEQ ID NO: 560733 - RNA, 64 nt, hsa; identical to SEQ ID NO: 309751

SEQ ID NO: 560734 - RNA, 64 nt, hsa; identical to SEQ ID NO: 309752

SEQ ID NO: 560735 - RNA, 64 nt, hsa; identical to SEQ ID NO: 309753

SEQ ID NO: 560736 - RNA, 64 nt, hsa; identical to SEQ ID NO: 309754

SEQ ID NO: 560737 - RNA, 64 nt, hsa; identical to SEQ ID NO: 309755

SEQ ID NO: 560738 - RNA, 64 nt, hsa; identical to SEQ ID NO: 309756

SEQ ID NO: 560739 - RNA, 64 nt, hsa; identical to SEQ ID NO: 309757

SEQ ID NO: 560740 - RNA, 64 nt, hsa; identical to SEQ ID NO: 309758

SEQ ID NO: 560741 - RNA, 64 nt, hsa; identical to SEQ ID NO: 309759

SEQ ID NO: 560742 - RNA, 64 nt, hsa; identical to SEQ ID NO: 309760

SEQ ID NO: 560743 - RNA, 64 nt, hsa; identical to SEQ ID NO: 309761

SEQ ID NO: 560744 - RNA, 64 nt, hsa; identical to SEQ ID NO: 309762

SEQ ID NO: 560745 - RNA, 64 nt, hsa; identical to SEQ ID NO: 309763

SEQ ID NO: 560746 - RNA, 64 nt, hsa; identical to SEQ ID NO: 309764

SEQ ID NO: 560747 - RNA, 64 nt, hsa; identical to SEQ ID NO: 309765

SEQ ID NO: 560748 - RNA, 64 nt, hsa; identical to SEQ ID NO: 309766

SEQ ID NO: 560749 - RNA, 64 nt, hsa; identical to SEQ ID NO: 309767

SEQ ID NO: 560750 - RNA, 64 nt, hsa; identical to SEQ ID NO: 309768

SEQ ID NO: 560751 - RNA, 64 nt, hsa; identical to SEQ ID NO: 309769

SEQ ID NO: 560752 - RNA, 64 nt, hsa; identical to SEQ ID NO: 309770

SEQ ID NO: 560753 - RNA, 64 nt, hsa; identical to SEQ ID NO: 309771

SEQ ID NO: 560754 - RNA, 64 nt, hsa; identical to SEQ ID NO: 309772

SEQ ID NO: 560755 - RNA, 64 nt, hsa; identical to SEQ ID NO: 309773

SEQ ID NO: 560756 - RNA, 64 nt, hsa; identical to SEQ ID NO: 309774

SEQ ID NO: 560757 - RNA, 64 nt, hsa; identical to SEQ ID NO: 309775

SEQ ID NO: 560758 - RNA, 64 nt, hsa; identical to SEQ ID NO: 560648

SEQ ID NO: 560759 - RNA, 64 nt, hsa; identical to SEQ ID NO: 560649

SEQ ID NO: 560760 - RNA, 64 nt, hsa; identical to SEQ ID NO: 560650

SEQ ID NO: 560761 - RNA, 64 nt, hsa; identical to SEQ ID NO: 560651

SEQ ID NO: 560762 - RNA, 64 nt, hsa; identical to SEQ ID NO: 560652

SEQ ID NO: 560763 - RNA, 55 nt, hsa; identical to SEQ ID NO: 560653

SEQ ID NO: 560764 - RNA, 64 nt, hsa; identical to SEQ ID NO: 560654

SEQ ID NO: 560765 - RNA, 64 nt, hsa; identical to SEQ ID NO: 560655

SEQ ID NO: 560766 - RNA, 64 nt, hsa; identical to SEQ ID NO: 560656

SEQ ID NO: 560767 - RNA, 64 nt, hsa; identical to SEQ ID NO: 560657

SEQ ID NO: 560768 - RNA, 64 nt, hsa; identical to SEQ ID NO: 560658

SEQ ID NO: 560769 - RNA, 64 nt, hsa; identical to SEQ ID NO: 560659

SEQ ID NO: 560770 - RNA, 64 nt, hsa; identical to SEQ ID NO: 560660

SEQ ID NO: 560771 - RNA, 64 nt, hsa; identical to SEQ ID NO: 560661

SEQ ID NO: 560772 - RNA, 64 nt, hsa; identical to SEQ ID NO: 560662

SEQ ID NO: 560773 - RNA, 64 nt, hsa; identical to SEQ ID NO: 560663

SEQ ID NO: 560774 - RNA, 64 nt, hsa; identical to SEQ ID NO: 560664

SEQ ID NO: 560775 - RNA, 64 nt, hsa; identical to SEQ ID NO: 560665

SEQ ID NO: 560776 - RNA, 64 nt, hsa; identical to SEQ ID NO: 560666

SEQ ID NO: 560777 - RNA, 64 nt, hsa; identical to SEQ ID NO: 560667

SEQ ID NO: 560778 - RNA, 64 nt, hsa; identical to SEQ ID NO: 560668

SEQ ID NO: 560779 - RNA, 64 nt, hsa; identical to SEQ ID NO: 560669

SEQ ID NO: 560780 - RNA, 64 nt, hsa; identical to SEQ ID NO: 309743

SEQ ID NO: 560781 - RNA, 64 nt, hsa; identical to SEQ ID NO: 309744

SEQ ID NO: 560782 - RNA, 64 nt, hsa; identical to SEQ ID NO: 309745

SEQ ID NO: 560783 - RNA, 64 nt, hsa; identical to SEQ ID NO: 309746

SEQ ID NO: 560784 - RNA, 64 nt, hsa; identical to SEQ ID NO: 309747

SEQ ID NO: 560785 - RNA, 64 nt, hsa; identical to SEQ ID NO: 309748

SEQ ID NO: 560786 - RNA, 64 nt, hsa; identical to SEQ ID NO: 309749

SEQ ID NO: 560787 - RNA, 56 nt, hsa; identical to SEQ ID NO: 83586

SEQ ID NO: 560788 - RNA, 64 nt, hsa; identical to SEQ ID NO: 309751

SEQ ID NO: 560789 - RNA, 64 nt, hsa; identical to SEQ ID NO: 309752

SEQ ID NO: 560790 - RNA, 64 nt, hsa; identical to SEQ ID NO: 309753

SEQ ID NO: 560791 - RNA, 64 nt, hsa; identical to SEQ ID NO: 309754

SEQ ID NO: 560792 - RNA, 64 nt, hsa; identical to SEQ ID NO: 309755

SEQ ID NO: 560793 - RNA, 64 nt, hsa; identical to SEQ ID NO: 309756

SEQ ID NO: 560794 - RNA, 64 nt, hsa; identical to SEQ ID NO: 309757

SEQ ID NO: 560795 - RNA, 64 nt, hsa; identical to SEQ ID NO: 309758

SEQ ID NO: 560796 - RNA, 64 nt, hsa; identical to SEQ ID NO: 309759

SEQ ID NO: 560797 - RNA, 64 nt, hsa; identical to SEQ ID NO: 309760

SEQ ID NO: 560798 - RNA, 64 nt, hsa; identical to SEQ ID NO: 309761

SEQ ID NO: 560799 - RNA, 64 nt, hsa; identical to SEQ ID NO: 309762

SEQ ID NO: 560800 - RNA, 64 nt, hsa; identical to SEQ ID NO: 309763

SEQ ID NO: 560801 - RNA, 64 nt, hsa; identical to SEQ ID NO: 309764

SEQ ID NO: 560802 - RNA, 64 nt, hsa; identical to SEQ ID NO: 309765

SEQ ID NO: 560803 - RNA, 64 nt, hsa; identical to SEQ ID NO: 309766

SEQ ID NO: 560804 - RNA, 64 nt, hsa; identical to SEQ ID NO: 309767

SEQ ID NO: 560805 - RNA, 64 nt, hsa; identical to SEQ ID NO: 309768

SEQ ID NO: 560806 - RNA, 64 nt, hsa; identical to SEQ ID NO: 309769

SEQ ID NO: 560807 - RNA, 64 nt, hsa; identical to SEQ ID NO: 309770

SEQ ID NO: 560808 - RNA, 64 nt, hsa; identical to SEQ ID NO: 309771

SEQ ID NO: 560809 - RNA, 64 nt, hsa; identical to SEQ ID NO: 309772

SEQ ID NO: 560810 - RNA, 64 nt, hsa; identical to SEQ ID NO: 309773

SEQ ID NO: 560811 - RNA, 64 nt, hsa; identical to SEQ ID NO: 309774

SEQ ID NO: 560812 - RNA, 64 nt, hsa; identical to SEQ ID NO: 309775

SEQ ID NO: 560813 - RNA, 64 nt, hsa; identical to SEQ ID NO: 238083

SEQ ID NO: 560814 - RNA, 64 nt, hsa; identical to SEQ ID NO: 238084

SEQ ID NO: 560815 - RNA, 64 nt, hsa; identical to SEQ ID NO: 238085

SEQ ID NO: 560816 - RNA, 64 nt, hsa; identical to SEQ ID NO: 238086

SEQ ID NO: 560817 - RNA, 64 nt, hsa; identical to SEQ ID NO: 238087

SEQ ID NO: 560818 - RNA, 64 nt, hsa; identical to SEQ ID NO: 238088

SEQ ID NO: 560819 - RNA, 64 nt, hsa; identical to SEQ ID NO: 238089

SEQ ID NO: 560820 - RNA, 64 nt, hsa; identical to SEQ ID NO: 238090

SEQ ID NO: 560821 - RNA, 64 nt, hsa
auauucaacuuucauggacugccccuggcaagguccucgauaaaggaagagguaaguuugacau

SEQ ID NO: 560822 - RNA, 64 nt, hsa
uguacagguuggcccuucaccuaguugacucagcccucgauagucuagagcccacccccuccuc

SEQ ID NO: 560823 - RNA, 64 nt, hsa
gcaguccaguuuugugaugcugcuuuuacgugucccucgauaacagucagcuagacacacucag

SEQ ID NO: 560824 - RNA, 64 nt, hsa
uguaacagucucccuuauggucagugauugaugaccucgauauggauuuagauuaucaaaugug

SEQ ID NO: 560825 - RNA, 64 nt, hsa
guuugugcaagugaaaauguugaaaagugaguaaccucgauauuaaaaucauccuugacaugaa

SEQ ID NO: 560826 - RNA, 50 nt, hsa
aaaaauucaaaucacaguagccucgauagaagcuauuuuugaugaauuuc

SEQ ID NO: 560827 - RNA, 64 nt, hsa
uuuggaaggauuccuuuuucuguagaauacuuugccucgauauauaagcauacagaugcacuuu

SEQ ID NO: 560828 - RNA, 64 nt, hsa
uagucagguugauuggacuuacgacccaaaugaaccucgauacugcauuuguaaucagguaaaa

SEQ ID NO: 560829 - RNA, 64 nt, hsa
ggcuguaucauagcgauauuuaucucuuccugcuccucgauaggccacuggcccugcacccuuu

SEQ ID NO: 560830 - RNA, 64 nt, hsa
ugcuuauauuaacaagaagacucacgcaauaacuccucgauaacucucagugaugguaucuguu

SEQ ID NO: 560831 - RNA, 64 nt, hsa
auuaaggagaauagccuccuuucuagcauaccaaccucgauacucuuauuuuauuccacaacuc

SEQ ID NO: 560832 - RNA, 64 nt, hsa
ggcuguguaaacacagucaaaauaauucuaaaucccucgauauuuuuaaagaucuguaaguaac

SEQ ID NO: 560833 - RNA, 64 nt, hsa
gaaacagaaaacgugucucagauggcuggcuuuaccucgauagcauaagagagaccuaagacau

SEQ ID NO: 560834 - RNA, 64 nt, hsa
ccucccucugcuugcccagguacuccuuccgccgccucgauacacgggacguugagcacaacgu

SEQ ID NO: 560835 - RNA, 64 nt, hsa
ucuguuaauauaaauagagaacauauuuaucauuccucgauaguuaauuauagacuuugguacc

SEQ ID NO: 560836 - RNA, 64 nt, hsa
cuuggaggccaaaccuuaaauccagagauagcagccucgauagggaccuuaaaaggauucacaa

SEQ ID NO: 560837 - RNA, 64 nt, hsa
auguggggaucgagcagccuucuucuuugggaccccucgauaucccauggaaugcucgcacguu

SEQ ID NO: 560838 - RNA, 64 nt, hsa
gguauggaauuuuucccuucagugacugagcuguccucgauaggccaugcaagggcuuccugag

SEQ ID NO: 560839 - RNA, 64 nt, hsa
ggucaccagauuguuuuguaaugcccgccccuugccucgauauugccaguuucuugugcaauaa

SEQ ID NO: 560840 - RNA, 64 nt, hsa
uggccacuugagaaguuuugccaacuccugggaaccucgauauucugacauuuggaaaaacaca

SEQ ID NO: 560841 - RNA, 64 nt, hsa
acucaccaccauuccuuggccagccuuuugccucccucgauacucaacaaagagaagcaaagcc

SEQ ID NO: 560842 - RNA, 64 nt, hsa
caguggggaccugagaaugcguguggccugcuguccucgauagaccggaaugggguuuucccac

SEQ ID NO: 560843 - RNA, 64 nt, hsa
cuggagagcagaggcuauuuggggucggaggagcccucgauaccugcgaauacaucugcuuucc

SEQ ID NO: 560844 - RNA, 64 nt, hsa
uucaauguaccuuccuucaccucgucguauauauccucgauaaguauuaaaacaguauuugagu

SEQ ID NO: 560845 - RNA, 64 nt, hsa
aguuuccccuccuaauacauauggcuguuuuccaccucgauaauauaacacgaguuugggcccg

SEQ ID NO: 560846 - RNA, 64 nt, hsa
aauccucuaaaucaguuuauggagaauuacccacccucgauaucugaucccauuccucaucucc

SEQ ID NO: 560847 - RNA, 64 nt, hsa
gcacaugugcugcccuacagcacccuguggucuuccucgauaaagggaaccacuuucuuauuuu

SEQ ID NO: 560848 - RNA, 64 nt, hsa
guauguguacacacauguauaauauauacagaaaccucgauauauaauuguauagauuuuaaaa

SEQ ID NO: 560849 - RNA, 64 nt, hsa; identical to SEQ ID NO: 84343

SEQ ID NO: 560850 - RNA, 64 nt, hsa; identical to SEQ ID NO: 84344

SEQ ID NO: 560851 - RNA, 64 nt, hsa; identical to SEQ ID NO: 84345

SEQ ID NO: 560852 - RNA, 64 nt, hsa; identical to SEQ ID NO: 84346

SEQ ID NO: 560853 - RNA, 64 nt, hsa; identical to SEQ ID NO: 84347

SEQ ID NO: 560854 - RNA, 64 nt, hsa; identical to SEQ ID NO: 84348

SEQ ID NO: 560855 - RNA, 64 nt, hsa; identical to SEQ ID NO: 84349

SEQ ID NO: 560856 - RNA, 64 nt, hsa; identical to SEQ ID NO: 84350

SEQ ID NO: 560857 - RNA, 64 nt, hsa; identical to SEQ ID NO: 84351

SEQ ID NO: 560858 - RNA, 64 nt, hsa; identical to SEQ ID NO: 84352

SEQ ID NO: 560859 - RNA, 64 nt, hsa; identical to SEQ ID NO: 84353

SEQ ID NO: 560860 - RNA, 64 nt, hsa; identical to SEQ ID NO: 84354

SEQ ID NO: 560861 - RNA, 64 nt, hsa; identical to SEQ ID NO: 84355

SEQ ID NO: 560862 - RNA, 64 nt, hsa; identical to SEQ ID NO: 84356

SEQ ID NO: 560863 - RNA, 64 nt, hsa; identical to SEQ ID NO: 84357

SEQ ID NO: 560864 - RNA, 64 nt, hsa; identical to SEQ ID NO: 84358

SEQ ID NO: 560865 - RNA, 64 nt, hsa; identical to SEQ ID NO: 84359

SEQ ID NO: 560866 - RNA, 64 nt, hsa; identical to SEQ ID NO: 84360

SEQ ID NO: 560867 - RNA, 64 nt, hsa; identical to SEQ ID NO: 84361

SEQ ID NO: 560868 - RNA, 64 nt, hsa; identical to SEQ ID NO: 84362

SEQ ID NO: 560869 - RNA, 64 nt, hsa; identical to SEQ ID NO: 84363

SEQ ID NO: 560870 - RNA, 64 nt, hsa; identical to SEQ ID NO: 84364

SEQ ID NO: 560871 - RNA, 64 nt, hsa; identical to SEQ ID NO: 84365

SEQ ID NO: 560872 - RNA, 64 nt, hsa; identical to SEQ ID NO: 84366

SEQ ID NO: 560873 - RNA, 64 nt, hsa; identical to SEQ ID NO: 84367

SEQ ID NO: 560874 - RNA, 64 nt, hsa; identical to SEQ ID NO: 84368

SEQ ID NO: 560875 - RNA, 64 nt, hsa; identical to SEQ ID NO: 84369

SEQ ID NO: 560876 - RNA, 64 nt, hsa; identical to SEQ ID NO: 84370

SEQ ID NO: 560877 - RNA, 64 nt, hsa; identical to SEQ ID NO: 84371

SEQ ID NO: 560878 - RNA, 64 nt, hsa; identical to SEQ ID NO: 84372

SEQ ID NO: 560879 - RNA, 64 nt, hsa; identical to SEQ ID NO: 84373

SEQ ID NO: 560880 - RNA, 64 nt, hsa; identical to SEQ ID NO: 84374

SEQ ID NO: 560881 - RNA, 64 nt, hsa; identical to SEQ ID NO: 84375

SEQ ID NO: 560882 - RNA, 64 nt, hsa; identical to SEQ ID NO: 84376

SEQ ID NO: 560883 - RNA, 64 nt, hsa; identical to SEQ ID NO: 437676

SEQ ID NO: 560884 - RNA, 64 nt, hsa; identical to SEQ ID NO: 437677

SEQ ID NO: 560885 - RNA, 64 nt, hsa; identical to SEQ ID NO: 437678

SEQ ID NO: 560886 - RNA, 64 nt, hsa; identical to SEQ ID NO: 437679

SEQ ID NO: 560887 - RNA, 64 nt, hsa; identical to SEQ ID NO: 437680

SEQ ID NO: 560888 - RNA, 64 nt, hsa; identical to SEQ ID NO: 437681

SEQ ID NO: 560889 - RNA, 64 nt, hsa; identical to SEQ ID NO: 437682

SEQ ID NO: 560890 - RNA, 64 nt, hsa; identical to SEQ ID NO: 437683

SEQ ID NO: 560891 - RNA, 64 nt, hsa; identical to SEQ ID NO: 437684

SEQ ID NO: 560892 - RNA, 64 nt, hsa; identical to SEQ ID NO: 437685

SEQ ID NO: 560893 - RNA, 64 nt, hsa; identical to SEQ ID NO: 437686

SEQ ID NO: 560894 - RNA, 64 nt, hsa; identical to SEQ ID NO: 437687

SEQ ID NO: 560895 - RNA, 64 nt, hsa; identical to SEQ ID NO: 437688

SEQ ID NO: 560896 - RNA, 64 nt, hsa; identical to SEQ ID NO: 437689

SEQ ID NO: 560897 - RNA, 64 nt, hsa; identical to SEQ ID NO: 437690

SEQ ID NO: 560898 - RNA, 64 nt, hsa; identical to SEQ ID NO: 437691

SEQ ID NO: 560899 - RNA, 64 nt, hsa; identical to SEQ ID NO: 437692

SEQ ID NO: 560900 - RNA, 64 nt, hsa; identical to SEQ ID NO: 437693

SEQ ID NO: 560901 - RNA, 64 nt, hsa; identical to SEQ ID NO: 437694

SEQ ID NO: 560902 - RNA, 64 nt, hsa; identical to SEQ ID NO: 437695

SEQ ID NO: 560903 - RNA, 64 nt, hsa; identical to SEQ ID NO: 437696

SEQ ID NO: 560904 - RNA, 64 nt, hsa; identical to SEQ ID NO: 437697

SEQ ID NO: 560905 - RNA, 64 nt, hsa; identical to SEQ ID NO: 437698

SEQ ID NO: 560906 - RNA, 64 nt, hsa; identical to SEQ ID NO: 437699

SEQ ID NO: 560907 - RNA, 64 nt, hsa; identical to SEQ ID NO: 437700

SEQ ID NO: 560908 - RNA, 64 nt, hsa; identical to SEQ ID NO: 437701

SEQ ID NO: 560909 - RNA, 64 nt, hsa; identical to SEQ ID NO: 437702

SEQ ID NO: 560910 - RNA, 64 nt, hsa; identical to SEQ ID NO: 437703

SEQ ID NO: 560911 - RNA, 64 nt, hsa; identical to SEQ ID NO: 437704

SEQ ID NO: 560912 - RNA, 64 nt, hsa; identical to SEQ ID NO: 437705

SEQ ID NO: 560913 - RNA, 64 nt, hsa; identical to SEQ ID NO: 437706

SEQ ID NO: 560914 - RNA, 64 nt, hsa; identical to SEQ ID NO: 437707

SEQ ID NO: 560915 - RNA, 64 nt, hsa; identical to SEQ ID NO: 437708

SEQ ID NO: 560916 - RNA, 64 nt, hsa; identical to SEQ ID NO: 437709

SEQ ID NO: 560917 - RNA, 64 nt, hsa; identical to SEQ ID NO: 437710

SEQ ID NO: 560918 - RNA, 64 nt, hsa; identical to SEQ ID NO: 437711

SEQ ID NO: 560919 - RNA, 64 nt, hsa; identical to SEQ ID NO: 437712

SEQ ID NO: 560920 - RNA, 64 nt, hsa; identical to SEQ ID NO: 437713

SEQ ID NO: 560921 - RNA, 64 nt, hsa; identical to SEQ ID NO: 437714

SEQ ID NO: 560922 - RNA, 64 nt, hsa; identical to SEQ ID NO: 437715

SEQ ID NO: 560923 - RNA, 64 nt, hsa; identical to SEQ ID NO: 437716

SEQ ID NO: 560924 - RNA, 64 nt, hsa; identical to SEQ ID NO: 437717

SEQ ID NO: 560925 - RNA, 64 nt, hsa; identical to SEQ ID NO: 437718

SEQ ID NO: 560926 - RNA, 64 nt, hsa; identical to SEQ ID NO: 209724

SEQ ID NO: 560927 - RNA, 64 nt, hsa; identical to SEQ ID NO: 209725

SEQ ID NO: 560928 - RNA, 64 nt, hsa; identical to SEQ ID NO: 209726

SEQ ID NO: 560929 - RNA, 64 nt, hsa; identical to SEQ ID NO: 209727

SEQ ID NO: 560930 - RNA, 64 nt, hsa; identical to SEQ ID NO: 209728

SEQ ID NO: 560931 - RNA, 64 nt, hsa; identical to SEQ ID NO: 209729

SEQ ID NO: 560932 - RNA, 64 nt, hsa; identical to SEQ ID NO: 209730

SEQ ID NO: 560933 - RNA, 64 nt, hsa; identical to SEQ ID NO: 209731

SEQ ID NO: 560934 - RNA, 64 nt, hsa; identical to SEQ ID NO: 209732

SEQ ID NO: 560935 - RNA, 64 nt, hsa; identical to SEQ ID NO: 209733

SEQ ID NO: 560936 - RNA, 63 nt, hsa; identical to SEQ ID NO: 209734

SEQ ID NO: 560937 - RNA, 64 nt, hsa; identical to SEQ ID NO: 209735

SEQ ID NO: 560938 - RNA, 64 nt, hsa; identical to SEQ ID NO: 209736

SEQ ID NO: 560939 - RNA, 64 nt, hsa; identical to SEQ ID NO: 209737

SEQ ID NO: 560940 - RNA, 64 nt, hsa; identical to SEQ ID NO: 209738

SEQ ID NO: 560941 - RNA, 64 nt, hsa; identical to SEQ ID NO: 209739

SEQ ID NO: 560942 - RNA, 64 nt, hsa; identical to SEQ ID NO: 209740

SEQ ID NO: 560943 - RNA, 64 nt, hsa; identical to SEQ ID NO: 209741

SEQ ID NO: 560944 - RNA, 64 nt, hsa; identical to SEQ ID NO: 209742

SEQ ID NO: 560945 - RNA, 64 nt, hsa; identical to SEQ ID NO: 209743

SEQ ID NO: 560946 - RNA, 64 nt, hsa; identical to SEQ ID NO: 209744

SEQ ID NO: 560947 - RNA, 64 nt, hsa; identical to SEQ ID NO: 209745

SEQ ID NO: 560948 - RNA, 64 nt, hsa; identical to SEQ ID NO: 209746

SEQ ID NO: 560949 - RNA, 64 nt, hsa; identical to SEQ ID NO: 209747

SEQ ID NO: 560950 - RNA, 64 nt, hsa; identical to SEQ ID NO: 209748

SEQ ID NO: 560951 - RNA, 64 nt, hsa; identical to SEQ ID NO: 209749

SEQ ID NO: 560952 - RNA, 64 nt, hsa; identical to SEQ ID NO: 209750

SEQ ID NO: 560953 - RNA, 64 nt, hsa; identical to SEQ ID NO: 209751

SEQ ID NO: 560954 - RNA, 64 nt, hsa; identical to SEQ ID NO: 209752

SEQ ID NO: 560955 - RNA, 64 nt, hsa; identical to SEQ ID NO: 209753

SEQ ID NO: 560956 - RNA, 64 nt, hsa; identical to SEQ ID NO: 209754

SEQ ID NO: 560957 - RNA, 64 nt, hsa; identical to SEQ ID NO: 209755

SEQ ID NO: 560958 - RNA, 64 nt, hsa; identical to SEQ ID NO: 209756

SEQ ID NO: 560959 - RNA, 64 nt, hsa; identical to SEQ ID NO: 209757

SEQ ID NO: 560960 - RNA, 64 nt, hsa; identical to SEQ ID NO: 209758

SEQ ID NO: 560961 - RNA, 64 nt, hsa; identical to SEQ ID NO: 209759

SEQ ID NO: 560962 - RNA, 64 nt, hsa; identical to SEQ ID NO: 209760

SEQ ID NO: 560963 - RNA, 64 nt, hsa; identical to SEQ ID NO: 209761

SEQ ID NO: 560964 - RNA, 64 nt, hsa; identical to SEQ ID NO: 209762

SEQ ID NO: 560965 - RNA, 64 nt, hsa; identical to SEQ ID NO: 209763

SEQ ID NO: 560966 - RNA, 64 nt, hsa; identical to SEQ ID NO: 209764

SEQ ID NO: 560967 - RNA, 64 nt, hsa; identical to SEQ ID NO: 209765

SEQ ID NO: 560968 - RNA, 64 nt, hsa; identical to SEQ ID NO: 209766

SEQ ID NO: 560969 - RNA, 64 nt, hsa; identical to SEQ ID NO: 209767

SEQ ID NO: 560970 - RNA, 64 nt, hsa; identical to SEQ ID NO: 209768

SEQ ID NO: 560971 - RNA, 64 nt, hsa; identical to SEQ ID NO: 209769

SEQ ID NO: 560972 - RNA, 64 nt, hsa; identical to SEQ ID NO: 209770

SEQ ID NO: 560973 - RNA, 64 nt, hsa; identical to SEQ ID NO: 209771

SEQ ID NO: 560974 - RNA, 64 nt, hsa; identical to SEQ ID NO: 209772

SEQ ID NO: 560975 - RNA, 64 nt, hsa; identical to SEQ ID NO: 209773

SEQ ID NO: 560976 - RNA, 64 nt, hsa; identical to SEQ ID NO: 209774

SEQ ID NO: 560977 - RNA, 64 nt, hsa; identical to SEQ ID NO: 209775

SEQ ID NO: 560978 - RNA, 64 nt, hsa; identical to SEQ ID NO: 209776

SEQ ID NO: 560979 - RNA, 64 nt, hsa; identical to SEQ ID NO: 209777

SEQ ID NO: 560980 - RNA, 64 nt, hsa; identical to SEQ ID NO: 209778

SEQ ID NO: 560981 - RNA, 64 nt, hsa; identical to SEQ ID NO: 209779

SEQ ID NO: 560982 - RNA, 64 nt, hsa; identical to SEQ ID NO: 209780

SEQ ID NO: 560983 - RNA, 64 nt, hsa; identical to SEQ ID NO: 209781

SEQ ID NO: 560984 - RNA, 64 nt, hsa; identical to SEQ ID NO: 209782

SEQ ID NO: 560985 - RNA, 64 nt, hsa; identical to SEQ ID NO: 209783

SEQ ID NO: 560986 - RNA, 64 nt, hsa; identical to SEQ ID NO: 209784

SEQ ID NO: 560987 - RNA, 64 nt, hsa; identical to SEQ ID NO: 209785

SEQ ID NO: 560988 - RNA, 64 nt, hsa; identical to SEQ ID NO: 209786

SEQ ID NO: 560989 - RNA, 64 nt, hsa; identical to SEQ ID NO: 209787

SEQ ID NO: 560990 - RNA, 64 nt, hsa; identical to SEQ ID NO: 209788

SEQ ID NO: 560991 - RNA, 64 nt, hsa; identical to SEQ ID NO: 209789

SEQ ID NO: 560992 - RNA, 64 nt, hsa; identical to SEQ ID NO: 209790

SEQ ID NO: 560993 - RNA, 64 nt, hsa; identical to SEQ ID NO: 209791

SEQ ID NO: 560994 - RNA, 64 nt, hsa; identical to SEQ ID NO: 209792

SEQ ID NO: 560995 - RNA, 64 nt, hsa; identical to SEQ ID NO: 209793

SEQ ID NO: 560996 - RNA, 64 nt, hsa; identical to SEQ ID NO: 209794

SEQ ID NO: 560997 - RNA, 64 nt, hsa; identical to SEQ ID NO: 209795

SEQ ID NO: 560998 - RNA, 64 nt, hsa; identical to SEQ ID NO: 209796

SEQ ID NO: 560999 - RNA, 64 nt, hsa; identical to SEQ ID NO: 209797

SEQ ID NO: 561000 - RNA, 64 nt, hsa; identical to SEQ ID NO: 209798

SEQ ID NO: 561001 - RNA, 64 nt, hsa; identical to SEQ ID NO: 209799

SEQ ID NO: 561002 - RNA, 64 nt, hsa; identical to SEQ ID NO: 209800

SEQ ID NO: 561003 - RNA, 64 nt, hsa; identical to SEQ ID NO: 209801

SEQ ID NO: 561004 - RNA, 64 nt, hsa; identical to SEQ ID NO: 209802

SEQ ID NO: 561005 - RNA, 64 nt, hsa; identical to SEQ ID NO: 209803

SEQ ID NO: 561006 - RNA, 64 nt, hsa; identical to SEQ ID NO: 209804

SEQ ID NO: 561007 - RNA, 64 nt, hsa; identical to SEQ ID NO: 209805

SEQ ID NO: 561008 - RNA, 64 nt, hsa; identical to SEQ ID NO: 209806

SEQ ID NO: 561009 - RNA, 64 nt, hsa; identical to SEQ ID NO: 209807

SEQ ID NO: 561010 - RNA, 64 nt, hsa; identical to SEQ ID NO: 209808

SEQ ID NO: 561011 - RNA, 64 nt, hsa; identical to SEQ ID NO: 209809

SEQ ID NO: 561012 - RNA, 64 nt, hsa; identical to SEQ ID NO: 209810

SEQ ID NO: 561013 - RNA, 64 nt, hsa; identical to SEQ ID NO: 209811

SEQ ID NO: 561014 - RNA, 64 nt, hsa; identical to SEQ ID NO: 209812

SEQ ID NO: 561015 - RNA, 64 nt, hsa; identical to SEQ ID NO: 209813

SEQ ID NO: 561016 - RNA, 64 nt, hsa; identical to SEQ ID NO: 209814

SEQ ID NO: 561017 - RNA, 59 nt, hsa
ugguaggggguuugaagaauccccuguccaccucccaaauccaggcccggcccccucug

SEQ ID NO: 561018 - RNA, 59 nt, hsa
ucuccugaccucgugauccacccaccucgaccucccaaagugcugagauuacaggcgug

SEQ ID NO: 561019 - RNA, 59 nt, hsa
uuuccaaaagauauuuugguaagacaacaaccucccagugauaugccaccuuucaauuu

SEQ ID NO: 561020 - RNA, 59 nt, hsa
ccccgcaaucucggcucacugcaaccucuaccucccagguucaagcuauucuacugccu

SEQ ID NO: 561021 - RNA, 59 nt, hsa
gguccuccaguacccugucuucuagccccaccucccacuuggccagaaccaauguccau

SEQ ID NO: 561022 - RNA, 59 nt, hsa
cagggucccuggccagaaggggcauggccaccucccaaccugaugaccucucuggcugg

SEQ ID NO: 561023 - RNA, 59 nt, hsa
uguggcuggcagccacuauucucaguuacaccucccagugcccuucugaaaagugccag

SEQ ID NO: 561024 - RNA, 59 nt, hsa
caugugguuggaaggauagacugcccccuaccucccaccaccaccaugaaguuugguga

SEQ ID NO: 561025 - RNA, 59 nt, hsa
ucuugagcucaagcagucuacccaccuugaccucccaaagugcugggauuacaggcuug

SEQ ID NO: 561026 - RNA, 59 nt, hsa
uucugggcucaagcaauccucccacuucaaccucccaaguagcugggacuauaggcaug

SEQ ID NO: 561027 - RNA, 59 nt, hsa
cuccuggccuaggugauccacccgccucgaccucccaaagugcugggauuacaggcaug

SEQ ID NO: 561028 - RNA, 59 nt, hsa
cauggaugagaguccugggugugaggaacaccucccaccaggcuagaggcaacugccca

SEQ ID NO: 561029 - RNA, 59 nt, hsa
gacccccucaucucagaguaaugggaagaaccucccacaucucccuggcagcagaugag

SEQ ID NO: 561030 - RNA, 59 nt, hsa
gaaggccuaugaaaagguccugaugcccaaccucccaccccuucaauguggggacgaga

SEQ ID NO: 561031 - RNA, 59 nt, hsa
uggugugaucucagcucacugcaaccuccaccucccagguucaagcaauucuucugccu

SEQ ID NO: 561032 - RNA, 59 nt, hsa
uggugacaucucggcucacugcaaccuccaccucccagguucaagugauucuccugccu

SEQ ID NO: 561033 - RNA, 59 nt, hsa
uuucucaaauguacacuuguauuauaauaaccucccaguucuaggggauauuugugcaa

SEQ ID NO: 561034 - RNA, 59 nt, hsa
uccugaacucaagugauccaccugccucgaccucccaaaguacugggauuacaggcgug

SEQ ID NO: 561035 - RNA, 59 nt, hsa
uagugcaaucucagcucacugcaaccuccaccucccagacucaagccauccucccaccu

SEQ ID NO: 561036 - RNA, 59 nt, hsa
ucccagacucaagccauccucccaccucaaccucccaaguagcugggacuacaggcaua

SEQ ID NO: 561037 - RNA, 59 nt, hsa
uagagagcugagacccuuauuuaaaacucaccucccaaucaccccaaacaaauggaaga

SEQ ID NO: 561038 - RNA, 59 nt, hsa
cuggaaucccacaacaucagcucugugccaccucccaagagggcuccucacuaucuagg

SEQ ID NO: 561039 - RNA, 59 nt, hsa
ucucuugaccucaugauccacccgccucgaccucccaaagugcugugauuacaggugug

SEQ ID NO: 561040 - RNA, 59 nt, hsa
uggugcaaucucggcucacugcaaccuccaccucccagguucaagcaauucuccugccu

SEQ ID NO: 561041 - RNA, 59 nt, hsa
guccccaaguaugaggugaacggggugaaaccucccauuggccaaaggacacggcucag

SEQ ID NO: 561042 - RNA, 59 nt, hsa
ucugugguucugagaagcccgaggucaucaccucccaguacaacaacaugcgcguggag

SEQ ID NO: 561043 - RNA, 59 nt, hsa
cuccgccccauacccgucacuacagccucaccucccaccccugucacuacggccucacc

SEQ ID NO: 561044 - RNA, 59 nt, hsa
ucaccucccaccccugucacuacggccucaccucccaccccugucacuacagccucacc

SEQ ID NO: 561045 - RNA, 59 nt, hsa
caugagaggucugcucucaugaccuaaucaccucccaaaggccccaccucccaauacca

SEQ ID NO: 561046 - RNA, 59 nt, hsa
ucaugaccuaaucaccucccaaaggccccaccucccaauaccaucacauuagggguuag

SEQ ID NO: 561047 - RNA, 59 nt, hsa
agccgaugccccccgguaugggaaccagcaccucccaccaaccaaccacacccgguggg

SEQ ID NO: 561048 - RNA, 59 nt, hsa
agccgaugccccccaguaugggaaccagcaccucccaccaaccagccacacccgguggg

SEQ ID NO: 561049 - RNA, 59 nt, hsa
agccgaugccccccggugugggaaccagcaccucccaccaaccagccacacccaguggg

SEQ ID NO: 561050 - RNA, 59 nt, hsa
ccggggggcccccgggugcagaaaacagcaccucccaccaaccagccacucccgguggg

SEQ ID NO: 561051 - RNA, 59 nt, hsa
uugucccagguuggagucccuacccucccaccucccaccugauaugcagugcuuuugac

SEQ ID NO: 561052 - RNA, 59 nt, hsa
cccuccuaccugagaggcugcacccuccaaccucccauuggcucgcuccccccccccca

SEQ ID NO: 561053 - RNA, 59 nt, hsa
ugugcccuugcucucuaacuucugagcccaccucccaggguaggcaccugggggcaugc

SEQ ID NO: 561054 - RNA, 59 nt, hsa
gguaggcaccugggggcaugcaggugcccaccucccaggguaggcaccugggggcaugc

SEQ ID NO: 561055 - RNA, 59 nt, hsa
ucuccugagcuuaguguccguggcuguccaccucccagccauacuugacuguccccaaa

SEQ ID NO: 561056 - RNA, 59 nt, hsa
cucuucauucauugcuagugcuuccccucaccucccacucuccacuucccaguuugcaa

SEQ ID NO: 561057 - RNA, 59 nt, hsa
ugugaacauuuguaaccacugcuucagucaccucccaccucuugccaccugcugcugcu

SEQ ID NO: 561058 - RNA, 59 nt, hsa
ccaugaacucuucacuccuuggggaagccaccucccaucacaccccugagcagaguuag

SEQ ID NO: 561059 - RNA, 59 nt, hsa
aagaagaagaagaagagacacaaaucucuaccucccauguuaagcuuugcaggacaggg

SEQ ID NO: 561060 - RNA, 59 nt, hsa
ucacuugaucuuggcucacuguaaccuccaccucccaggcucaagugauccucccaccc

SEQ ID NO: 561061 - RNA, 59 nt, hsa
ggaccggggccagccuaggggggccugugaccucccauggagcccagccccgcccucca

SEQ ID NO: 561062 - RNA, 59 nt, hsa
gcccuccacaccuccggcgcuccgcacccaccucccacggccccgccccugcccccgcu

SEQ ID NO: 561063 - RNA, 59 nt, hsa
gcugggccuggauggcugccucaccucucaccucccaacgucccuagcccuuacguccu

SEQ ID NO: 561064 - RNA, 59 nt, hsa
caucuuucaagggaccucuccaugaucccaccucccauucacagauaccucucuuguag

SEQ ID NO: 561065 - RNA, 59 nt, hsa
ccugguguggggucugagacggccggagaaccucccaggcagggcucuguguuuugucu

SEQ ID NO: 561066 - RNA, 59 nt, hsa
guucccgccgcaguggggcccugacgcccaccucccaggugccccucgagcaaaaaccu

SEQ ID NO: 561067 - RNA, 59 nt, hsa
agucuucaaccagauauccucggcaacccaccucccacccuccuccucuucuccuucaa

SEQ ID NO: 561068 - RNA, 59 nt, hsa
ccaccccccaaacguccuggacugcacagaccucccacuccagaccauccaggccuggu

SEQ ID NO: 561069 - RNA, 59 nt, hsa
ggugccugaaauggccgugcccgaugugcaccucccagaggugcagcugcccaaagucu

SEQ ID NO: 561070 - RNA, 59 nt, hsa
ggugcccgagauggccgugcccgaugugcaccucccagaagugcagcuuccaaaagucc

SEQ ID NO: 561071 - RNA, 59 nt, hsa
ggcuuggccaaaacaggcucaggccaaagaccucccaagcuguauguacuuccaguauc

SEQ ID NO: 561072 - RNA, 59 nt, hsa
uggagugaucucagcucacugcaaccuccaccucccagguucaagcgacucuccugccu

SEQ ID NO: 561073 - RNA, 59 nt, hsa
cccugacuaacagccucagcacauccgacaccucccagcgugggaccccaagugaagac

SEQ ID NO: 561074 - RNA, 59 nt, hsa
agccccggcccccugugcagggccguaguaccucccagcagggugaagaguccaagaag

SEQ ID NO: 561075 - RNA, 64 nt, hsa
guuccuguggugugcaaagcauuaugauaggcaccguggggaaacuggaaaugaauuugacaug

SEQ ID NO: 561076 - RNA, 64 nt, hsa
uuuuacuuacuuuuauagcauuacugugccuagucguggggaaagagauggggcuguauagauu

SEQ ID NO: 561077 - RNA, 64 nt, hsa
aaggggacucuggauaggguccccacauccagggcguggggagaccauuggcauuugggaacca

SEQ ID NO: 561078 - RNA, 64 nt, hsa
ccuuuguacucguguuguguccauugugugugugcguggggacagaggccuggaaaugcggagg

SEQ ID NO: 561079 - RNA, 64 nt, hsa
ucccccauagguggcugagcaucggaguggaguucguggggaacugcguggugcucuuugcugc

SEQ ID NO: 561080 - RNA, 64 nt, hsa
ggaaggcagccgcccucccgaagguuggcccccacguggggagguggaguuccggaauuauucu

SEQ ID NO: 561081 - RNA, 64 nt, hsa
ccgggaggaaggcgcccggcugcgucugcagaggcggggagaggaggcggcgagggucccgggg

SEQ ID NO: 561082 - RNA, 64 nt, hsa
cagcucgcaggccccgggcccggccgcgccuccgcggggagagcaccccggcuucccgcgcgcc

SEQ ID NO: 561083 - RNA, 64 nt, hsa
gcuguucccucuccugcccggacuguggccucgccggggagagcgggcgggggagcucgcgccg

SEQ ID NO: 561084 - RNA, 64 nt, hsa
ggaagggggcggggcuucccucccgggccgcaugcggggagaggcugcucccuccccuuuuucc

SEQ ID NO: 561085 - RNA, 64 nt, hsa
uaagccagugccagcauccagcaugagcagaugucggggagacugggaagucuccagcguuacu

SEQ ID NO: 561086 - RNA, 64 nt, hsa
uaagccagugccagcauccagcgugagcagacgucggggagacugggaagucuccgauguuacu

SEQ ID NO: 561087 - RNA, 64 nt, hsa
uuugcauugcuggcccagcgccuggccuggggggcggggagaggcagcagaaggggcugggcag

SEQ ID NO: 561088 - RNA, 64 nt, hsa
cugggcaggggcgguggaggacucaggaacugcccggggagaguggguauggcggcugagccag

SEQ ID NO: 561089 - RNA, 64 nt, hsa
gaagauucaggaaaaaugcacuugggaaucaaagaaaauggaacuucuuuuugaaaagacaagc

SEQ ID NO: 561090 - RNA, 64 nt, hsa
uccaagucuggcuguguccaggcgguccauguugaaaauggaggauggcugcugacuucugacu

SEQ ID NO: 561091 - RNA, 64 nt, hsa
aaaagguuguuuuaauaucuacuugguuuuucucaaaauggaaauaauuuuaaaaucaggaaag

SEQ ID NO: 561092 - RNA, 64 nt, hsa
aguuuuauaaccagucuauuaaagguguuuguuuaaaauggauauaguuuuagauuugugguaa

SEQ ID NO: 561093 - RNA, 64 nt, hsa
gcuauuacaauuugauaguuauguucagcuuuugaaaauggacguuuccgauuuacaaauguaa

SEQ ID NO: 561094 - RNA, 64 nt, hsa
agguguacuuguguuuauguacuccugacguauuaaaauggaauaauacuaaucuuguuaaaag

SEQ ID NO: 561095 - RNA, 64 nt, hsa
aauuuuuguaaugacaugacauuacaagaguauaaaaauggacauuaaaucauggccuugcauu

SEQ ID NO: 561096 - RNA, 64 nt, hsa
uauaauguauucagacuuugauuacuacuuauuuaaaauggaauguuuuaugguugugcauaug

SEQ ID NO: 561097 - RNA, 64 nt, hsa
gauaagaauuaaaaggguuuaauuuccuagaaagaaaauggaaaaauggucauuuuuaaaaaau

SEQ ID NO: 561098 - RNA, 64 nt, hsa
auauuugcccaugcuacaggaagagacuguauuaaaaauggauacacaaggucaguugacacua

SEQ ID NO: 561099 - RNA, 64 nt, hsa
ucccugaauucaggacuuccacaagaugcagaacaaaauggauaaaagguauuucacuggagaa

SEQ ID NO: 561100 - RNA, 64 nt, hsa
aaggguaagaaugaguuuuuaacugcuuuguaagaaaauggaaaaggucaauaaagauauauuu

SEQ ID NO: 561101 - RNA, 64 nt, hsa
cuacaaguagggaauguuuucugaagcagaaguuaaaauggacagcauuucuagaauuaacauu

SEQ ID NO: 561102 - RNA, 64 nt, hsa
uuaaauuauauagcugggauauuuugccacuguuaaaauggauucagaagagguccuagaaaag

SEQ ID NO: 561103 - RNA, 64 nt, hsa
augaaggaaucagauucccuauguaaagcaguuuaaaauggaauucaauguucagugcucaggu

SEQ ID NO: 561104 - RNA, 64 nt, hsa
caauaagacacucaaauaugaguacaaaugccuuaaaauggaauugaaaaacucuuuauuuucc

SEQ ID NO: 561105 - RNA, 64 nt, hsa
cugacuaucauaaaaucaaaacaagugaaauaacaaaauggacaugguggcuuuguuuagguag

SEQ ID NO: 561106 - RNA, 64 nt, hsa
auaaaauaaugcugcaaacuuaauguucuuaugcaaaauggaacgcuaaugaaacacagcuuac

SEQ ID NO: 561107 - RNA, 64 nt, hsa
uagaaaggaaaacuugaaucaauacucauugauuaaaauggaauaaagaaagagcagcugccac

SEQ ID NO: 561108 - RNA, 64 nt, hsa
ucccuucaguagugagcaguuuguauguacagagaaaauggacuuacaaaaacuugcagcagua

SEQ ID NO: 561109 - RNA, 64 nt, hsa
cuccuguuugcaggcccagaggagccaagucauuaaaauggaaguggauucuggauggccgggc

SEQ ID NO: 561110 - RNA, 64 nt, hsa
ugcugcaaacauuguacauccaaauuaaaggaaaaaaauggaaaccaucaguuguugcugugug

SEQ ID NO: 561111 - RNA, 64 nt, hsa
uucucuuccuuuacuuagccuauaaaacuaguuaaaaauggaauuucuuuuagcaauucaguuu

SEQ ID NO: 561112 - RNA, 64 nt, hsa
auguaauucaggcuugugucuaccucuuccaugaaaaauggaaagggaugaaaauaaugggagu

SEQ ID NO: 561113 - RNA, 64 nt, hsa
uguauaaacagguugcuauaagcuuggugaaaugaaaauggaacauuucaaucaaacauuuccu

SEQ ID NO: 561114 - RNA, 64 nt, hsa
auccucaaauaaucucaauuucaggagguuucacaaaauggacuccugaaguagacagaguagu

SEQ ID NO: 561115 - RNA, 64 nt, hsa
auaucucacacauuuguaauggauaacgugcauuaaaauggaguucuuauuauagaauaaccug

SEQ ID NO: 561116 - RNA, 64 nt, hsa
uccggggaucaucacaucaguccaaggauauaaaaaaauggaagauuaaaaacucaaauugugg

SEQ ID NO: 561117 - RNA, 64 nt, hsa
uuggggaaaacauuuuuuaucauuuucuauuaagaaaauggaaaacuuaaauaugguguuaaaa

SEQ ID NO: 561118 - RNA, 64 nt, hsa
uauuaagaaaauggaaaacuuaaauaugguguuaaaaauggaaauauaugugauauuugcauua

SEQ ID NO: 561119 - RNA, 64 nt, hsa
uuuaaugaacuauaccuguuaaguuccaaaggucaaaauggaggcauuugcugucuaauauuca

SEQ ID NO: 561120 - RNA, 64 nt, hsa
ucuuucuacuaauguaaauuugagauuauuuuuaaaaauggaauaaaagagguuuuggucauuu

SEQ ID NO: 561121 - RNA, 64 nt, hsa
augaccccucucuccccaguauuaucuuacuugcaaaauggagaccaaauucuauccugugagg

SEQ ID NO: 561122 - RNA, 64 nt, hsa
cuuugaaguaaaaccuuuuuucuugcuacugaaaaaaauggaguuguuuugggugguaaagugu

SEQ ID NO: 561123 - RNA, 64 nt, hsa
cagcaugacugguucugggagaaggugagagacaaaaauggaaagauccuggccugugguagug

SEQ ID NO: 561124 - RNA, 64 nt, hsa
ugaaaugaaagcuacaaauacaugugagaagaaaaaaauggauuuuuuuagcaaauaauuaacu

SEQ ID NO: 561125 - RNA, 64 nt, hsa
gauggcagugguuugaaaaacuaaaacagaaaaaaaaauggaagccaacacaucacucauuuua

SEQ ID NO: 561126 - RNA, 64 nt, hsa
uucccuuugauacagucaacaagccugacccuguaaaauggagguggaaagacaagcucaagug

SEQ ID NO: 561127 - RNA, 64 nt, hsa
ugugcucugagugccuagcggaguuccagcaaacaaaauggacucaagagagauuugauuaaug

SEQ ID NO: 561128 - RNA, 64 nt, hsa
ucuauuaauaauucccccaauuuuuuaaacuaacaaaauggaauguuaacugaauggaauuaaa

SEQ ID NO: 561129 - RNA, 64 nt, hsa
auugaaaaauuaauauuucuauaaucuauuaaaaaaaauggagaauguuuucucucaaauuucc

SEQ ID NO: 561130 - RNA, 64 nt, hsa
uuuuucuuucuuuacugcaugcauagcacuuaauaaaauggauuuuuaaaaaauccacuaguaa

SEQ ID NO: 561131 - RNA, 64 nt, hsa
aaauacucuucagauccuauguagucagugaaacaaaauggagagcguauucugauagaaggac

SEQ ID NO: 561132 - RNA, 64 nt, hsa
uauagaugcuauuguucugauggcccggcugaauaaaauggaaauucuaguuuguuagaauuau

SEQ ID NO: 561133 - RNA, 64 nt, hsa
aaagguuuuaaucauucuucuauaaaauacauuuaaaauggaaaaauacuuaauaucacuaaau

SEQ ID NO: 561134 - RNA, 64 nt, hsa
cuacgaucuugcaguuauccaaaagagccuaugaaaaauggacagcugcuuuugacaauaaugc

SEQ ID NO: 561135 - RNA, 64 nt, hsa
uagucuuccccagcuaaaaagagaaaugcaauccaaaauggaaagauggagagaucaaacgacu

SEQ ID NO: 561136 - RNA, 64 nt, hsa
acaaucuugaacauuuuacaguagaacucaucuaaaaauggauuuggggauggggaaacaugca

SEQ ID NO: 561137 - RNA, 64 nt, hsa
aauaaaggaaccuuuuauacugacaaaccagagaaaaauggaccuuuuuccaguuaaaauauug

SEQ ID NO: 561138 - RNA, 64 nt, hsa
uucuggggaaagaauaguaaccaugcaauggaaaaaaauggacaaccucuugacuagguuauca

SEQ ID NO: 561139 - RNA, 64 nt, hsa
aguuugccacuaaaaggaaccaaggcuacuuggaaaaauggaugauuccaaagcaagggcaagg

SEQ ID NO: 561140 - RNA, 64 nt, hsa
uuuauagacaguuaaauuuauagacaguuaaguaaaaauggauaauuuauagacagauaauuua

SEQ ID NO: 561141 - RNA, 64 nt, hsa
caucuucuauguagcugugauaucucaucuuucuaaaauggaacuuguuaaaaaguguucaaac

SEQ ID NO: 561142 - RNA, 64 nt, hsa
uucccagaucucaguaaacagccacucagccuugaaaauggaguguuguuguuucuaaacauau

SEQ ID NO: 561143 - RNA, 64 nt, hsa
cagcuagaaggauugcaagguagauuuuuguuuuaaaauggagagaaguggacagauaaggcca

SEQ ID NO: 561144 - RNA, 64 nt, hsa
uuagaacacacacgacuuuuuauuccuccauugcaaaauggaaucaagauacuacacaagaccu

SEQ ID NO: 561145 - RNA, 64 nt, hsa
gagcagaaccaagagaggaaacuuuggcgcuguuaaaauggaauuucucaucugccggcauuau

SEQ ID NO: 561146 - RNA, 64 nt, hsa
cuaggucaaauugggugucucaaggauuccucccaaaauggaguuuguagguggaguuccugac

SEQ ID NO: 561147 - RNA, 64 nt, hsa
aucagugguuccaagauuucaaaguggugaaaugaaaauggagcagcuaguauguuuuauuauu

SEQ ID NO: 561148 - RNA, 64 nt, hsa
cgccauguuccuuccacuaaaguagaggguucuuaaaauggaaaaaccugugggcucuucauau

SEQ ID NO: 561149 - RNA, 64 nt, hsa
auggaaaagaauuuuacaugcacuuuaaaauaguaaaauggaaagugaauuuuuaaaauauaug

SEQ ID NO: 561150 - RNA, 64 nt, hsa
uguauuucccuucuucaaauuaauuaccuaccaaaaaauggaaaagaauuuuacaugcacuuua

SEQ ID NO: 561151 - RNA, 64 nt, hsa
aaccaaaauggagucacuuaugccaaacucuaauaaaauggagucggggggccacauagaagcc

SEQ ID NO: 561152 - RNA, 64 nt, hsa
gccucaguuuccuuaugugaaaguugcuggaaccaaaauggagucacuuaugccaaacucuaau

SEQ ID NO: 561153 - RNA, 64 nt, hsa
ugaagaaucaagagggcagcccccacuuuccuacaaaauggagggagccaucccuucccugucc

SEQ ID NO: 561154 - RNA, 64 nt, hsa
aagagaaaauaaaccaagauagauccauuuggacaaaauggaagguuggagacguguauccccg

SEQ ID NO: 561155 - RNA, 64 nt, hsa
ggcaguuuuuggaauuacuugauaagaacuuuugaaaauggaaggauuaguauggccuauuuuu

SEQ ID NO: 561156 - RNA, 64 nt, hsa
cacauaaaauguuuuauuuuguuauuugguuaugaaaauggaauccuuguucuugcacaacugu

SEQ ID NO: 561157 - RNA, 64 nt, hsa
ccuugcaacuuccuucuccacuaacccaggacuaaaaauggacaggcugaccucaguguuuaca

SEQ ID NO: 561158 - RNA, 64 nt, hsa
gagaugauaauauauuauguauuugaauuccugaaaaauggaaaauguuuaagauauauguaua

SEQ ID NO: 561159 - RNA, 64 nt, hsa
uuaugugguaauaucagugauauuucgaacugugaaaauggacuuaauaauuagaccauuucua

SEQ ID NO: 561160 - RNA, 64 nt, hsa
cugagaaagcuuaagaccugcuucaaaagccugaaaaauggaaaaauaaaauuguuuucagaua

SEQ ID NO: 561161 - RNA, 64 nt, hsa
gcauuugagagaucagcuaauacuucucucaacaaaaauggaagggcagaugcuagaauccccc

SEQ ID NO: 561162 - RNA, 64 nt, hsa
aaauauauauauguacauacauauauauuuuuggaaaauggagcuaugguguaaaagcaacagg

SEQ ID NO: 561163 - RNA, 64 nt, hsa
cuuugcagaaaaagugugcugccuuagucuauagaaaauggacuuuucccaccauucacugacu

SEQ ID NO: 561164 - RNA, 64 nt, hsa
uuuuccuaaggccaaggauaauguacuaguuguuaaaauggaaauaaaagugaagugguaaaua

SEQ ID NO: 561165 - RNA, 64 nt, hsa
acuuguucaaaacagggaaagacugaugaaaaguaaaauggacuacuuuuguaacuuaccuguu

SEQ ID NO: 561166 - RNA, 64 nt, hsa
cuaaaagagaaggaagagaaaauacuacuuucucaaaauggaagcccuuaaaggugcuuugaua

SEQ ID NO: 561167 - RNA, 64 nt, hsa
gggaguguguaccccuuacuccccaucaaaaaaaaaaauggauacaugguuaaaggauagaagg

SEQ ID NO: 561168 - RNA, 64 nt, hsa
acuuggcacagcgaaaaaauggauuuaaaagacaaaaauggagguccagguagauguaauucac

SEQ ID NO: 561169 - RNA, 64 nt, hsa
agaaucagauguguaauauacuuggcacagcgaaaaaauggauuuaaaagacaaaaauggaggu

SEQ ID NO: 561170 - RNA, 64 nt, hsa
ucuuucuccuguuuguuugcuuguuaguuuguuuaaaauggaaaaagggguucucuguguucug

SEQ ID NO: 561171 - RNA, 64 nt, hsa
cuucaagggugauaggaaccauuauguugagcccaaaauggaaguaauaauaaaugccuccugg

SEQ ID NO: 561172 - RNA, 64 nt, hsa
uaugagggggaaaaaucacuaacaugaaaggcaaaaaauggacuaugauuccuguggggaaaca

SEQ ID NO: 561173 - RNA, 64 nt, hsa
auuuuucaggccagacauagcuuccuaaugaaagaaaauggaaauguaauucgacgacuccuca

SEQ ID NO: 561174 - RNA, 64 nt, hsa
cacaaaccuccaaguagcuccaaaugcaauuuuuaaaauggaaaacaaaaaucugaaagaaacg

SEQ ID NO: 561175 - RNA, 64 nt, hsa
cccaggucuuccaagcucugcuuccucaguuuccaaaauggaaccaccucaccuccgcagcacc

SEQ ID NO: 561176 - RNA, 64 nt, hsa
gcuggcuagaaauuggucuguagaaaugaccuugaaaauggaguucuggccaggugcgguggcu

SEQ ID NO: 561177 - RNA, 64 nt, hsa
ucuuaaaaaaaaaaaaaaaaaaaagaaagaaaagaaaauggaguucugagagcuaggaaacugg

SEQ ID NO: 561178 - RNA, 64 nt, hsa
agcacucuguaagauggaccaaucagcgcucuguaaaauggaccaaucagcaggacaugggcgg

SEQ ID NO: 561179 - RNA, 64 nt, hsa
ccuggagaacuuuucugucuuacaagaggauuguaaaauggaccaaucagcacucuguaagaug

SEQ ID NO: 561180 - RNA, 64 nt, hsa
aggagguacuaagugcaaugucuuagcauucugcaaaauggagaucuguuguccagcggcuuau

SEQ ID NO: 561181 - RNA, 64 nt, hsa
cuuuccaagcagucucuggugcuuuucuucucucaaaauggauccgauaaauauuugaauagag

SEQ ID NO: 561182 - RNA, 64 nt, hsa
acuucuuugcaugcguuuaagucaguuuauacacaaaauggauuuuauuuuuuaguuuaacugu

SEQ ID NO: 561183 - RNA, 64 nt, hsa
ucggagccauucauucggagaaaacguuuugaucaaaauggagacuuuuguagucguuucaaaa

SEQ ID NO: 561184 - RNA, 64 nt, hsa
gucauuuguguugugaaaauucuuccacugacccaaaauggaaccguacaaagccuauccgugu

SEQ ID NO: 561185 - RNA, 64 nt, hsa
caucugcauguuuauuuccucugcucauaauaggaaaauggauguuauggagcuucaagaaucg

SEQ ID NO: 561186 - RNA, 64 nt, hsa
aaugcuaauugauaauauaaauacccccugcuuaaaaauggacaaaaagaaacuauaauguaau

SEQ ID NO: 561187 - RNA, 64 nt, hsa
acacccaccccuuauuuuccguaaauacacacacaaaauggaucgcaucugugugacuaauggu

SEQ ID NO: 561188 - RNA, 64 nt, hsa
uuggacaacuacuguaaucauuuuuuuuuuaggaaaaauggaaggugccggggguaaucauggc

SEQ ID NO: 561189 - RNA, 64 nt, hsa
ggguaguaauuacauugugguauuaauauuuagaaaaauggaccucagcaguguauuuacugua

SEQ ID NO: 561190 - RNA, 64 nt, hsa
aggauagguucuuuggguaaauugaggaacauggaaaauggagggccaccacuuagguuccaug

SEQ ID NO: 561191 - RNA, 64 nt, hsa
ggaaucauuuuuggugaacuguuguguccuuuaaaaaauggaggaggauagguucuuuggguaa

SEQ ID NO: 561192 - RNA, 64 nt, hsa
aaagugagaaguaauuauuguaaauggauggauaaaaauggaauuacucauauacaggguggaa

SEQ ID NO: 561193 - RNA, 64 nt, hsa
ggagaauacauauaauaugguguagaaaucauugaaaauggauccuuuuugacgaucacuuaua

SEQ ID NO: 561194 - RNA, 64 nt, hsa
aauuuuauuggagaaaagcaaguuauauguucacaaaauggaaggcuuucuaccuaaauuuauu

SEQ ID NO: 561195 - RNA, 64 nt, hsa
caaguuagauuuuccuggagcuucggaagaaaugaaaauggaaacaugaugaagauauagucac

SEQ ID NO: 561196 - RNA, 64 nt, hsa
uggguagugugaccuguuuggaugugauuacuuaaaaauggaaugcucugaauaggcacucucu

SEQ ID NO: 561197 - RNA, 64 nt, hsa
uccucuaccucauacuuccucugaggauuuugacaaaauggauuaauugggugagccuuggaga

SEQ ID NO: 561198 - RNA, 64 nt, hsa
gcaaauggaaaacaggagauccuaauaugaaagaaaaauggaucccaaucugagaaaaggcaaa

SEQ ID NO: 561199 - RNA, 64 nt, hsa
uggagucaaaaggcaaaucauuuggacaaucugcaaaauggagagaauacaauaacuacuacag

SEQ ID NO: 561200 - RNA, 64 nt, hsa; identical to SEQ ID NO: 158079

SEQ ID NO: 561201 - RNA, 64 nt, hsa; identical to SEQ ID NO: 158080

SEQ ID NO: 561202 - RNA, 64 nt, hsa; identical to SEQ ID NO: 158081

SEQ ID NO: 561203 - RNA, 64 nt, hsa; identical to SEQ ID NO: 158082

SEQ ID NO: 561204 - RNA, 64 nt, hsa; identical to SEQ ID NO: 158083

SEQ ID NO: 561205 - RNA, 64 nt, hsa; identical to SEQ ID NO: 158084

SEQ ID NO: 561206 - RNA, 64 nt, hsa; identical to SEQ ID NO: 158085

SEQ ID NO: 561207 - RNA, 64 nt, hsa; identical to SEQ ID NO: 158086

SEQ ID NO: 561208 - RNA, 64 nt, hsa; identical to SEQ ID NO: 158087

SEQ ID NO: 561209 - RNA, 64 nt, hsa; identical to SEQ ID NO: 298090

SEQ ID NO: 561210 - RNA, 64 nt, hsa; identical to SEQ ID NO: 298091

SEQ ID NO: 561211 - RNA, 64 nt, hsa; identical to SEQ ID NO: 298092

SEQ ID NO: 561212 - RNA, 64 nt, hsa; identical to SEQ ID NO: 298093

SEQ ID NO: 561213 - RNA, 64 nt, hsa; identical to SEQ ID NO: 298094

SEQ ID NO: 561214 - RNA, 64 nt, hsa; identical to SEQ ID NO: 298095

SEQ ID NO: 561215 - RNA, 64 nt, hsa; identical to SEQ ID NO: 298096

SEQ ID NO: 561216 - RNA, 64 nt, hsa; identical to SEQ ID NO: 298097

SEQ ID NO: 561217 - RNA, 64 nt, hsa; identical to SEQ ID NO: 298098

SEQ ID NO: 561218 - RNA, 64 nt, hsa; identical to SEQ ID NO: 298099

SEQ ID NO: 561219 - RNA, 64 nt, hsa; identical to SEQ ID NO: 298100

SEQ ID NO: 561220 - RNA, 64 nt, hsa; identical to SEQ ID NO: 298101

SEQ ID NO: 561221 - RNA, 64 nt, hsa; identical to SEQ ID NO: 298102

SEQ ID NO: 561222 - RNA, 64 nt, hsa; identical to SEQ ID NO: 298103

SEQ ID NO: 561223 - RNA, 64 nt, hsa; identical to SEQ ID NO: 298104

SEQ ID NO: 561224 - RNA, 64 nt, hsa; identical to SEQ ID NO: 298105

SEQ ID NO: 561225 - RNA, 64 nt, hsa; identical to SEQ ID NO: 298106

SEQ ID NO: 561226 - RNA, 64 nt, hsa; identical to SEQ ID NO: 298107

SEQ ID NO: 561227 - RNA, 64 nt, hsa; identical to SEQ ID NO: 298108

SEQ ID NO: 561228 - RNA, 64 nt, hsa; identical to SEQ ID NO: 298109

SEQ ID NO: 561229 - RNA, 64 nt, hsa; identical to SEQ ID NO: 298110

SEQ ID NO: 561230 - RNA, 64 nt, hsa; identical to SEQ ID NO: 298111

SEQ ID NO: 561231 - RNA, 63 nt, hsa
cccagcugccccagcacgcgggacccauagcacaccccuuagcgcuugccuagguugcugaaa

SEQ ID NO: 561232 - RNA, 63 nt, hsa
aucugcuuauucuucagcuucaccucugcacuaaccccuuacccuuaugguacgucaggauuu

SEQ ID NO: 561233 - RNA, 63 nt, hsa
ccauauaaacuauuuucacagaucucaacuaaaaccccuuacuucacaaaugauuguguugug

SEQ ID NO: 561234 - RNA, 63 nt, hsa
ugccugugcuugaagguugcuguagagcaucugaccccuuauuaccaccuuaagcaauguaua

SEQ ID NO: 561235 - RNA, 63 nt, hsa
uuccucuaguacuaccaguauucauaaauguauaccccuuacuguaauuuguuccucuuagaa

SEQ ID NO: 561236 - RNA, 63 nt, hsa
aauguaagucuagcuaccuauccaauacuaaauaccccuuaaaguauuaaaugcacuaucugc

SEQ ID NO: 561237 - RNA, 63 nt, hsa
ucugaaacaagggucacacuacucagagggauaaccccuuacaguggucugaggaguaacuau

SEQ ID NO: 561238 - RNA, 63 nt, hsa
aauuguucccaaaugaaaacuuguuuuaaguccaccccuuaguuuccuuauuuuacaaggucu

SEQ ID NO: 561239 - RNA, 63 nt, hsa
uuugagaucgugcuggggaggaacauggccacuaccccuuaucccaucggccaugugggaggu

SEQ ID NO: 561240 - RNA, 63 nt, hsa
gugcuuuucuuuacaggauucaaaagccaaauaaccccuuauggaauucaacucaagguuuga

SEQ ID NO: 561241 - RNA, 63 nt, hsa
cauaagagaagcaaaucugagaguaaaacccuuaccccuuauucuuaagaauagugcuuguuu

SEQ ID NO: 561242 - RNA, 63 nt, hsa
aacagcagggugacuuuagaggcaugggcuccaaccccuuagcucugucugagaauuaugguu

SEQ ID NO: 561243 - RNA, 63 nt, hsa
aacuccuuguucuccccucugcugccucuccccaccccuuaaagcaguugguagaaggaaugg

SEQ ID NO: 561244 - RNA, 63 nt, hsa
cgucagcugcugagaggagcaagcgguaguaccaccccuuaguugagggagucagcacagucc

SEQ ID NO: 561245 - RNA, 63 nt, hsa
auuuccuacgucuguucacugaaauaauuaccaaccccuuagcaauaagcacuccuugcagag

SEQ ID NO: 561246 - RNA, 63 nt, hsa
cgcgcugcuacagagcuucacgcucuccgcuccaccccuuagccugggaacccaccgcaggug

SEQ ID NO: 561247 - RNA, 63 nt, hsa
ccaagcuaggaacaucagccuggugcccuguuaaccccuuaaagcugugguuuacaacuuuuc

SEQ ID NO: 561248 - RNA, 63 nt, hsa
agaugugguuucaaaguaaaggccuccucccccaccccuuaggccccguggugacauuuccca

SEQ ID NO: 561249 - RNA, 63 nt, hsa
aggcugacuuguugacugaagccuuuuucccagaccccuuauuucgaauccccaagcuucagu

SEQ ID NO: 561250 - RNA, 63 nt, hsa
agacccccgccagacagacucccaaccagacugaccccuuacuauucacacagccugccgagu

SEQ ID NO: 561251 - RNA, 63 nt, hsa
agugagaaaucuuuacaguugacaggaaccuggaccccuuaccccaacuuuaugaguaaugcu

SEQ ID NO: 561252 - RNA, 63 nt, hsa
uagauugagcuuagauugccucucuagacaacuaccccuuaguuauaauucuguguccccucu

SEQ ID NO: 561253 - RNA, 63 nt, hsa
cagcugcuuugcacaaagguccuucuuguccacaccccuuauccccaggcuggugccccggga

SEQ ID NO: 561254 - RNA, 63 nt, hsa
ggagauggagaccauccuggcuaacacggugaaaccccuuaucuaugcgccuguagucccagc

SEQ ID NO: 561255 - RNA, 63 nt, hsa
agaccuguugcugcauagaacucucccugcccuaccccuuaacuccaccuuagugccagggcc

SEQ ID NO: 561256 - RNA, 63 nt, hsa
gagagccuucagccaaaccucauugcuuuauaaaccccuuagaacucucccuacuagcuggaa

SEQ ID NO: 561257 - RNA, 63 nt, hsa
ccagucacauccauuuuguggaagauuaacccaaccccuuacacuacacugaacacuaaagaa

SEQ ID NO: 561258 - RNA, 63 nt, hsa
auacuguuauauccucaacuuggauuuaugguaaccccuuauaguucauggagaccaaaauuu

SEQ ID NO: 561259 - RNA, 63 nt, hsa
ucuacucggucauucuccccauuuccauccauuaccccuuagccauugagacuaaaggaaaua

SEQ ID NO: 561260 - RNA, 63 nt, hsa
cuacaacauaaauaauuugaguuuaggugauccaccccuuaauuguacccccgaugguauauu

SEQ ID NO: 561261 - RNA, 63 nt, hsa
caaacuacuuacuugcucuaaacaguuacuuguaccccuuaaccugucuucaaaaguugcaua

SEQ ID NO: 561262 - RNA, 63 nt, hsa
aaaaucgucucucccucccuuugaaaugaauauaccccuuaguguuuggguauauucauuuca

SEQ ID NO: 561263 - RNA, 63 nt, hsa
ccuuuugucucugggaccagacuuguuggugcuaccccuuacuccccucugcaacccccauuu

SEQ ID NO: 561264 - RNA, 63 nt, hsa
cagaaaaaccagcuuaucaucuaucaagcuccaaccccuuauacagcuccucugguggaaucc

SEQ ID NO: 561265 - RNA, 63 nt, hsa
ggcaugcauuuugcauugguccagcccuuugaaaccccuuagagagaagcauauauggccaca

SEQ ID NO: 561266 - RNA, 63 nt, hsa
aaaauguucuggaugcaucaucuccaaccaaggaccccuuauuuaucaugccuuuguucucuu

SEQ ID NO: 561267 - RNA, 63 nt, hsa
gguuuucccuuggccacuagcccaucuucaaugaccccuuaaucugcagcagcucacaggcug

SEQ ID NO: 561268 - RNA, 63 nt, hsa
uuuacacuguugggaguaaaggagcauuuuuacaccccuuaagggugcuuaauucuguugaaa

SEQ ID NO: 561269 - RNA, 63 nt, hsa
ggaaaagcugacacccagacaaucacuuaagaaaccccuuauugauguauuucauggcacugc

SEQ ID NO: 561270 - RNA, 63 nt, hsa
uuaccacauaaucuuuuaaacaauaaaacaaauaccccuuagaaagucuucugcaaacccauu

SEQ ID NO: 561271 - RNA, 63 nt, hsa
agaaggaugcccagacaucagccuccuucuuucaccccuuaccccaaagagaaagaguuugaa

SEQ ID NO: 561272 - RNA, 63 nt, hsa
ugcccacuguuucuuccuuucugugccuuugagaccccuuaagguuuucccucaugcgauuac

SEQ ID NO: 561273 - RNA, 63 nt, hsa
cagcugugagguggcuucagcggaagucugcugaccccuuauauuccccgagaguauaaagag

SEQ ID NO: 561274 - RNA, 63 nt, hsa
gccuugaaaaucacaucaaguaguuaauuaucuaccccuuaccuguguuuauaacuuccaggu

SEQ ID NO: 561275 - RNA, 50 nt, hsa; identical to SEQ ID NO: 165317

SEQ ID NO: 561276 - RNA, 63 nt, hsa
caggcacuccaagugaaccaccccucuugguucaccccuuacucacuuaucucaucacagagc

SEQ ID NO: 561277 - RNA, 63 nt, hsa
uucucaggguguucuuguccucaucuacccucuaccccuuacugugcaaccacugaggcaaag

SEQ ID NO: 561278 - RNA, 63 nt, hsa
acagugcauuuucaauaucuaacuuaacaugccaccccuuagcagugcaagcuuauuuaucuc

SEQ ID NO: 561279 - RNA, 63 nt, hsa
ccucccuucccgaccccaacaaaacguuuucaaaccccuuacaguuccuggggcaggcggaaa

SEQ ID NO: 561280 - RNA, 63 nt, hsa
uuaugucaccucagcccucaucucaaugcccaaaccccuuacacacaccuucaguuagcuuca

SEQ ID NO: 561281 - RNA, 63 nt, hsa
agcccagauguucaguucucuuggccccucucuaccccuuacugggauccgguuuucauuuuc

SEQ ID NO: 561282 - RNA, 63 nt, hsa
auauuugggauaucuauugaagaaaaaaagaaaaccccuuaaagauaauguacaugcuucaug

SEQ ID NO: 561283 - RNA, 63 nt, hsa
uagccugguuuuaugugacacugauacacacacaccccuuauaugggacuaauuuuacacuuu

SEQ ID NO: 561284 - RNA, 63 nt, hsa
cauuccaccacagugccccucagccagaucaccaccccuuacaauucccucuacuguguggaa

SEQ ID NO: 561285 - RNA, 63 nt, hsa
uagagaccuguugguugcuaggguaguccagacaccccuuagaugucuucauaauaguccuau

SEQ ID NO: 561286 - RNA, 63 nt, hsa
gcagcgugaguagcucuuuuguuuacuguuuacaccccuuauuggcaugucaacuccuguacu

SEQ ID NO: 561287 - RNA, 63 nt, hsa
auauaaaugcauuauuacacauacauuucucucaccccuuaaugcauuuuucucaaugcagaa

SEQ ID NO: 561288 - RNA, 63 nt, hsa
uaaaaaauguggcaacacuuuuaauaaaugcucaccccuuauugcacaggaaagcauuuauac

SEQ ID NO: 561289 - RNA, 63 nt, hsa
gguaucuccaggauugaagagcauugcauggacaccccuuauccaggacucugucaauuuccc

SEQ ID NO: 561290 - RNA, 63 nt, hsa
uuuuauauauuuuuucugacuccuauuuaaagaaccccuuagguuucuaaguacccauuucuu

SEQ ID NO: 561291 - RNA, 63 nt, hsa
ucccagccccuucucccaggguccagagccaggaccccuuaaucuagguaaauugacagaaau

SEQ ID NO: 561292 - RNA, 63 nt, hsa
gugaaagcagcuuuuaguuuaacuuauucacagaccccuuauaauuaccauguuuuuuuuuuu

SEQ ID NO: 561293 - RNA, 63 nt, hsa
uucuacagaauaggucagaucuuggccucccaaaccccuuauuuuuaaaauacuuugcgccuu

SEQ ID NO: 561294 - RNA, 63 nt, hsa
uggcagcccuucccuagcacacugguggaagagaccccuuaagaaccugaccccagugaauga

SEQ ID NO: 561295 - RNA, 63 nt, hsa
gccccuuccccagaccccucuccagucuccugcaccccuuagcccucccugcuuugccuggcc

SEQ ID NO: 561296 - RNA, 63 nt, hsa
ugaaacauagagggagagagggagagagccuauaccccuuacuuagcaugcacaaaguguauu

SEQ ID NO: 561297 - RNA, 63 nt, hsa
auguauccagauuuaaaccuaccaguuuguccuaccccuuaagcguuuaaaauaaaauaugca

SEQ ID NO: 561298 - RNA, 63 nt, hsa
uuuuggauugucggauuuccucccucacaugauaccccuuaucuuuuauaaugucuuaugccu

SEQ ID NO: 561299 - RNA, 63 nt, hsa
acuuggaaggggccuggucugucaacuaguccaaccccuuaaaauucauagaggagcaaacug

SEQ ID NO: 561300 - RNA, 63 nt, hsa
ggaguucgagagcagccuggccaacauggcaaaaccccuuauuuacuaaaaauacaaaaauua

SEQ ID NO: 561301 - RNA, 63 nt, hsa
gacucugcggcccuccaggacggacaccgggugaccccuuagggcacccaggcaagaucccua

SEQ ID NO: 561302 - RNA, 63 nt, hsa
uuuguugcacugaaauggaauucccaugccccuaccccuuaccccaguuuuuugaacauggaa

SEQ ID NO: 561303 - RNA, 63 nt, hsa
aaauacuaagugguuuucuugcucccacucccuaccccuuaguuaaauaggguuuauuuucca

SEQ ID NO: 561304 - RNA, 63 nt, hsa
uauugaauacuuacauucucuaauaagaaaaccaccccuuagauugaaguaaacugcaguccu

SEQ ID NO: 561305 - RNA, 63 nt, hsa
gucuggugucuucagcuccugaaaugcuaauuuaccccuuaccuaaggaguguaguuauaaua

SEQ ID NO: 561306 - RNA, 63 nt, hsa
agcaaggaucuggccuggagaggcccauccuauaccccuuauuagagccaugacagccuacag

SEQ ID NO: 561307 - RNA, 63 nt, hsa
caaccccauugucagcaccccagccaugcggccaccccuuagcacaccugcucgucccauuua

SEQ ID NO: 561308 - RNA, 63 nt, hsa
aguaucaauauuucugucauugaauuuuuucucaccccuuauuauuucucacuuacaauuucu

SEQ ID NO: 561309 - RNA, 63 nt, hsa
ucccucuacgucucucuagaaugacaucuuuaaaccccuuacacucuuuggucuuacacaucc

SEQ ID NO: 561310 - RNA, 63 nt, hsa
ucuugaacagguauuacaaaggaagaaaacuucaccccuuauccuuaacauauauaguauauu

SEQ ID NO: 561311 - RNA, 63 nt, hsa
aaacagacacaucaacgcaccccacucacagacaccccuuaccccacccccacuguacagaga

SEQ ID NO: 561312 - RNA, 63 nt, hsa
cacagugaagcaaaggacacaacuuuuuauuguaccccuuaauugucaacaggaguuaacuga

SEQ ID NO: 561313 - RNA, 63 nt, hsa
ccccuuuuuaugccccaccgauacacugggaccaccccuuaccccggacaggaugaauggauc

SEQ ID NO: 561314 - RNA, 63 nt, hsa
agcccccuucccuggcucugcagcggcugggucaccccuuacgcuggugaucaggaaagcccg

SEQ ID NO: 561315 - RNA, 63 nt, hsa
aggauuccgccgcuggaagccuucuguucagacaccccuuaugcuccaaggccugaugugagc

SEQ ID NO: 561316 - RNA, 63 nt, hsa
cugguuacggcccagggggaagaugccaagggcaccccuuaauggaaacacgagaucaguagu

SEQ ID NO: 561317 - RNA, 63 nt, hsa
gaauuuguuuugugauuaguucgccccuuccccaccccuuaccagauguuaagcagcuaugaa

SEQ ID NO: 561318 - RNA, 61 nt, hsa; identical to SEQ ID NO: 165360

SEQ ID NO: 561319 - RNA, 63 nt, hsa
acaaagcgaauaggcaguuagcacagcacagcuaccccuuaccaagcagucuauggaaacaac

SEQ ID NO: 561320 - RNA, 63 nt, hsa
ucaggcacccggggccagagacauaugggccauaccccuuaaccccgggaugcaagguagcau

SEQ ID NO: 561321 - RNA, 63 nt, hsa
uacacaauggcuuuguuuugcuuuuucagccacaccccuuaugugaacuagugccuuugggua

SEQ ID NO: 561322 - RNA, 63 nt, hsa
acggucuccagcuccccuuucugccaggaagccaccccuuagcacucccccgauuauucugcc

SEQ ID NO: 561323 - RNA, 63 nt, hsa
ccuugacugcagagcagguuccuccacugccccaccccuuagacaccaugaccccaucagguu

SEQ ID NO: 561324 - RNA, 63 nt, hsa
ucccucccucacuuucacuguggauuuggaucgaccccuuacaucuugauuucccuuaaacga

SEQ ID NO: 561325 - RNA, 56 nt, hsa; identical to SEQ ID NO: 165367

SEQ ID NO: 561326 - RNA, 63 nt, hsa
cuacuggccuugucaacauacagacuucaaaauaccccuuaugagaauccaaagaaugaugug

SEQ ID NO: 561327 - RNA, 63 nt, hsa
auacagcaacaaucauugcuacugacuuguucaaccccuuaguuacacuguaugaucaacaua

SEQ ID NO: 561328 - RNA, 63 nt, hsa
auaacugugagcucgcacaaccgaaagggccugaccccuuacuuagcucccuccuugaaacaa

SEQ ID NO: 561329 - RNA, 63 nt, hsa
aaaaaguuugugacauuguaguagggaguguguaccccuuacuccccaucaaaaaaaaaaaug

SEQ ID NO: 561330 - RNA, 63 nt, hsa
gccagcagcuuccuccuucagccaccuggccauaccccuuaaauaagccccucaccuugcugc

SEQ ID NO: 561331 - RNA, 63 nt, hsa
auaaagagauuuugauuuuugaaaugccacaaaaccccuuaaaguggucaaguaccuaaggua

SEQ ID NO: 561332 - RNA, 63 nt, hsa
ccucuccauuuuagcccaguguuuucuuugaggaccccuuaaucuugcuuucuuuagaauuuu

SEQ ID NO: 561333 - RNA, 63 nt, hsa
cucccuguuucucaugcuuucucuaacuuccucaccccuuaaccaaaaagguguguuuucuuu

SEQ ID NO: 561334 - RNA, 63 nt, hsa
uccaagaggggcccagcauuguauuucccugugaccccuuacucuccuggccagaacuugagc

SEQ ID NO: 561335 - RNA, 63 nt, hsa
cgggcccagcucaagcccccuuccuugcucuggaccccuuagguauacccuggaagagcuggg

SEQ ID NO: 561336 - RNA, 63 nt, hsa
ccccuguuuucagggaccucugccuucucccacaccccuuacacuagugaggacuccuucggc

SEQ ID NO: 561337 - RNA, 63 nt, hsa
ugugcugcuugcacaacugagcugcugguguguaccccuuagcagggugucuggggacuuacg

SEQ ID NO: 561338 - RNA, 63 nt, hsa
ccguccauccauccauccacucuuccacccucuaccccuuaccuuauucuaaaaagaacuuag

SEQ ID NO: 561339 - RNA, 63 nt, hsa
ggcaacauccaugccuucucauucucuuuccugaccccuuaggagcgccuggaagcagaacca

SEQ ID NO: 561340 - RNA, 63 nt, hsa
aggcagcugugccccuggccugcccuucccgggaccccuuauuccaacucagcuccucuuugc

SEQ ID NO: 561341 - RNA, 63 nt, hsa
cuuuugguggagaggcccggccucucacaaaagaccccuuaccacugcucugaugaagaggag

SEQ ID NO: 561342 - RNA, 63 nt, hsa
uuaccaguaaauuauguuucuguauguaaaauaaccccuuauuagagagacaguguuauaugu

SEQ ID NO: 561343 - RNA, 63 nt, hsa
gacucugccccucagcagggcuuacuaagcacuaccccuuaacagggaugacuccgcacugcc

SEQ ID NO: 561344 - RNA, 63 nt, hsa
ccagagaaccagccuaggaacacucgggaugacaccccuuaucacaccaaggacagcaaguuu

SEQ ID NO: 561345 - RNA, 63 nt, hsa
cagcucugagguggcuucagcgaaagucugcuaaccccuuacauuccccgagaguguaaagag

SEQ ID NO: 561346 - RNA, 63 nt, hsa
ucuccauuugagaggagagugcuuggggcuugaaccccuuaccccacugcugcugacugggca

SEQ ID NO: 561347 - RNA, 63 nt, hsa
uggggacaagccccucuuggucucagccacagcaccccuuauuccagcugcccugcccaaccu

SEQ ID NO: 561348 - RNA, 63 nt, hsa
ccuucuuucuaaacucaacccauuucccucccuaccccuuaucuucaggacucuucagagcua

SEQ ID NO: 561349 - RNA, 63 nt, hsa
gguccuugccucucguguacccccucaaggcugaccccuuagauggcccaggaauggcaggug

SEQ ID NO: 561350 - RNA, 63 nt, hsa
caaaccauuuuauuuuuugggccauuaccccauaccccuuauugcugccaaaaccacaugggc

SEQ ID NO: 561351 - RNA, 63 nt, hsa
cuugggccuuuucucucaaccuuggcugagccuaccccuuacuuugccaaagacuugaggacc

SEQ ID NO: 561352 - RNA, 63 nt, hsa
aagucuguuuuuuuuuuuucuuucuucuuccccaccccuuaauuuuaacuuugugguaacuga

SEQ ID NO: 561353 - RNA, 63 nt, hsa
uggaaguuaagagaguggcauccacuugugguaaccccuuacgaugaugacaucccacacacu

SEQ ID NO: 561354 - RNA, 63 nt, hsa
aacgaugggugcugugguccucugcaggcccucaccccuuaacuuccucauacagacuggcac

SEQ ID NO: 561355 - RNA, 63 nt, hsa
ccuuagggacagguggaggugugggccgaucuaaccccuuacccaucucucuacugcuggacu

SEQ ID NO: 561356 - RNA, 63 nt, hsa
cuaaucauaugugcucagacacagcucaagcacaccccuuaguuaagaaagaaccuccauaua

SEQ ID NO: 561357 - RNA, 63 nt, hsa
cuccagugccgaccgcugagccuccuggcccggaccccuuacacccugcauuccagauggggg

SEQ ID NO: 561358 - RNA, 63 nt, hsa
uauuauuuuuucuucaauauaacacuggaggaaaccccuuaugaggaugccaucugccuaaau

SEQ ID NO: 561359 - RNA, 63 nt, hsa
aggugugaccucaggugugugaguaucccucauaccccuuaucaucacugccuauucgcucuu

SEQ ID NO: 561360 - RNA, 63 nt, hsa
aggaaccaaauuuaagacucucgcaucuucccaaccccuuaagcccuggcccccugaguuucc

SEQ ID NO: 561361 - RNA, 63 nt, hsa
cuacauuaacauggaugcagaauaauuucagaaaccccuuaaauaauuccuuaacaucucuau

SEQ ID NO: 561362 - RNA, 63 nt, hsa
aacaacugaccuguuuccuccaccuccacccccaccccuuaacuuggguaccccucuggcccu

SEQ ID NO: 561363 - RNA, 63 nt, hsa
ucaagaccggaggcacagagggcaggagcacagaccccuuaaaccggcauuguauuccaaaga

SEQ ID NO: 561364 - RNA, 63 nt, hsa
cuagcacugagucaagcaaucagcaggcugggcaccccuuagccauaaguuuucaggaaauaa

SEQ ID NO: 561365 - RNA, 63 nt, hsa
auguguuugcagaccggcugggauagccuccccaccccuuaucagagccaagacaccugcugc

SEQ ID NO: 561366 - RNA, 63 nt, hsa
ucuuggauugugaugcuauugguacuugagaauaccccuuaucugaguauaaagaauccuuga

SEQ ID NO: 561367 - RNA, 63 nt, hsa
gcaggagggcccuaccugauuggugcaacccuuaccccuuagccucccugaaaauguuuuucu

SEQ ID NO: 561368 - RNA, 63 nt, hsa
guuugaggaaagcaagaaucagagaaggaacauaccccuuacaaaugaaaaauuccacucaaa

SEQ ID NO: 561369 - RNA, 63 nt, hsa
gcccuucagucugcuccaccaaggggcucuugaaccccuuauuaaggccccagaugaucccag

SEQ ID NO: 561370 - RNA, 63 nt, hsa
gggcccugcaaagcacccaaguguguuucacucaccccuuaccgcucgcccaccggccuguga

SEQ ID NO: 561371 - RNA, 63 nt, hsa
aucugauauggucauuuguuuuaaauaacacccaccccuuauuuuccguaaauacacacacaa

SEQ ID NO: 561372 - RNA, 63 nt, hsa
ggccggucuaaagugagcucuaugggcagaucuaccccuuacuuauuauuccagaucugcagu

SEQ ID NO: 561373 - RNA, 63 nt, hsa
ccucauuuccuucuuuuauuccuccccaccccaaccccuuaaaaaaaaggucagaaggacaaa

SEQ ID NO: 561374 - RNA, 63 nt, hsa
ucagggguaagggaaggaagccagccuuucagcaccccuuacccuccacaguucugugauuuc

SEQ ID NO: 561375 - RNA, 63 nt, hsa
uuuuucacucuuaugucagagcaguuggguuuuaccccuuaguuuuuaugccuguuaagcuuu

SEQ ID NO: 561376 - RNA, 63 nt, hsa
ccgcgguuugucagggggcccaccuucuagaugaccccuuaauaaagugauggccccacagaa

SEQ ID NO: 561377 - RNA, 64 nt, hsa
gaagaugcuuucagugaugcucucuauacucauaaauaagcaaauguggcaggcuuugcuuucu

SEQ ID NO: 561378 - RNA, 64 nt, hsa
ccaccuuuauguauuuucuuaaagcacgccuuuaaauaagcaaaaacuuuaaaaggcaggaaag

SEQ ID NO: 561379 - RNA, 64 nt, hsa
caaccgcaauccggagcgcggcaguauccagaacaauaagcagguccugcggaacuugauuaac

SEQ ID NO: 561380 - RNA, 64 nt, hsa
uaauuuugaaugcccucacuauugaugcauuuuuaauaagcaaucaccggagacuugguaccca

SEQ ID NO: 561381 - RNA, 64 nt, hsa
guugucuucacuuaauccauuuagcacuauuuaaaauaagcacaccaaguuauaugacuaauau

SEQ ID NO: 561382 - RNA, 64 nt, hsa
aggaaagaacuacuagcuacaaaaaauauuuuggaauaagcauuguuuugguauaagguacaua

SEQ ID NO: 561383 - RNA, 64 nt, hsa
auaagggaaguuuauuuucugcgguuuuugcaagaauaagcaaagcccauggaauuuaauuuuu

SEQ ID NO: 561384 - RNA, 64 nt, hsa
auucagguaaauuuucuuuuccaagaagcuuuugaauaagcauauuuccuccaaaggucucucu

SEQ ID NO: 561385 - RNA, 64 nt, hsa
cguauaauaaagucucugaaaaggccuuauucagaauaagcaagaaagguucugugauucacuu

SEQ ID NO: 561386 - RNA, 64 nt, hsa
gcacauccaucuccaucagagcugauagccuguuaauaagcacuggucuaacacagccaacccu

SEQ ID NO: 561387 - RNA, 64 nt, hsa; identical to SEQ ID NO: 452644

SEQ ID NO: 561388 - RNA, 64 nt, hsa; identical to SEQ ID NO: 452645

SEQ ID NO: 561389 - RNA, 64 nt, hsa; identical to SEQ ID NO: 452646

SEQ ID NO: 561390 - RNA, 64 nt, hsa; identical to SEQ ID NO: 452647

SEQ ID NO: 561391 - RNA, 64 nt, hsa; identical to SEQ ID NO: 452648

SEQ ID NO: 561392 - RNA, 64 nt, hsa; identical to SEQ ID NO: 452649

SEQ ID NO: 561393 - RNA, 64 nt, hsa; identical to SEQ ID NO: 452650

SEQ ID NO: 561394 - RNA, 64 nt, hsa; identical to SEQ ID NO: 452651

SEQ ID NO: 561395 - RNA, 64 nt, hsa; identical to SEQ ID NO: 452652

SEQ ID NO: 561396 - RNA, 64 nt, hsa; identical to SEQ ID NO: 452653

SEQ ID NO: 561397 - RNA, 64 nt, hsa; identical to SEQ ID NO: 452654

SEQ ID NO: 561398 - RNA, 62 nt, hsa; identical to SEQ ID NO: 452655

SEQ ID NO: 561399 - RNA, 64 nt, hsa; identical to SEQ ID NO: 452656

SEQ ID NO: 561400 - RNA, 64 nt, hsa; identical to SEQ ID NO: 452657

SEQ ID NO: 561401 - RNA, 64 nt, hsa; identical to SEQ ID NO: 452658

SEQ ID NO: 561402 - RNA, 64 nt, hsa; identical to SEQ ID NO: 452659

SEQ ID NO: 561403 - RNA, 64 nt, hsa; identical to SEQ ID NO: 452660

SEQ ID NO: 561404 - RNA, 64 nt, hsa; identical to SEQ ID NO: 452661

SEQ ID NO: 561405 - RNA, 64 nt, hsa; identical to SEQ ID NO: 452662

SEQ ID NO: 561406 - RNA, 64 nt, hsa; identical to SEQ ID NO: 452663

SEQ ID NO: 561407 - RNA, 64 nt, hsa; identical to SEQ ID NO: 452663

SEQ ID NO: 561408 - RNA, 64 nt, hsa; identical to SEQ ID NO: 452665

SEQ ID NO: 561409 - RNA, 64 nt, hsa; identical to SEQ ID NO: 452666

SEQ ID NO: 561410 - RNA, 64 nt, hsa; identical to SEQ ID NO: 430373

SEQ ID NO: 561411 - RNA, 64 nt, hsa; identical to SEQ ID NO: 430374

SEQ ID NO: 561412 - RNA, 64 nt, hsa; identical to SEQ ID NO: 430375

SEQ ID NO: 561413 - RNA, 64 nt, hsa; identical to SEQ ID NO: 430376

SEQ ID NO: 561414 - RNA, 64 nt, hsa; identical to SEQ ID NO: 430377

SEQ ID NO: 561415 - RNA, 64 nt, hsa; identical to SEQ ID NO: 430378

SEQ ID NO: 561416 - RNA, 64 nt, hsa; identical to SEQ ID NO: 430379

SEQ ID NO: 561417 - RNA, 64 nt, hsa; identical to SEQ ID NO: 430380

SEQ ID NO: 561418 - RNA, 64 nt, hsa; identical to SEQ ID NO: 430381

SEQ ID NO: 561419 - RNA, 64 nt, hsa; identical to SEQ ID NO: 430382

SEQ ID NO: 561420 - RNA, 64 nt, hsa; identical to SEQ ID NO: 430383

SEQ ID NO: 561421 - RNA, 64 nt, hsa; identical to SEQ ID NO: 430384

SEQ ID NO: 561422 - RNA, 64 nt, hsa; identical to SEQ ID NO: 430385

SEQ ID NO: 561423 - RNA, 64 nt, hsa; identical to SEQ ID NO: 430386

SEQ ID NO: 561424 - RNA, 64 nt, hsa; identical to SEQ ID NO: 430387

SEQ ID NO: 561425 - RNA, 64 nt, hsa; identical to SEQ ID NO: 430388

SEQ ID NO: 561426 - RNA, 64 nt, hsa; identical to SEQ ID NO: 430389

SEQ ID NO: 561427 - RNA, 64 nt, hsa; identical to SEQ ID NO: 430390

SEQ ID NO: 561428 - RNA, 64 nt, hsa; identical to SEQ ID NO: 430391

SEQ ID NO: 561429 - RNA, 64 nt, hsa; identical to SEQ ID NO: 430392

SEQ ID NO: 561430 - RNA, 64 nt, hsa; identical to SEQ ID NO: 430393

SEQ ID NO: 561431 - RNA, 64 nt, hsa; identical to SEQ ID NO: 430394

SEQ ID NO: 561432 - RNA, 64 nt, hsa; identical to SEQ ID NO: 430395

SEQ ID NO: 561433 - RNA, 64 nt, hsa; identical to SEQ ID NO: 430396

SEQ ID NO: 561434 - RNA, 64 nt, hsa; identical to SEQ ID NO: 430397

SEQ ID NO: 561435 - RNA, 64 nt, hsa; identical to SEQ ID NO: 430398

SEQ ID NO: 561436 - RNA, 64 nt, hsa; identical to SEQ ID NO: 430399

SEQ ID NO: 561437 - RNA, 64 nt, hsa; identical to SEQ ID NO: 430400

SEQ ID NO: 561438 - RNA, 64 nt, hsa; identical to SEQ ID NO: 430401

SEQ ID NO: 561439 - RNA, 64 nt, hsa; identical to SEQ ID NO: 430402

SEQ ID NO: 561440 - RNA, 64 nt, hsa; identical to SEQ ID NO: 430403

SEQ ID NO: 561441 - RNA, 64 nt, hsa; identical to SEQ ID NO: 430404

SEQ ID NO: 561442 - RNA, 62 nt, hsa; identical to SEQ ID NO: 296757

SEQ ID NO: 561443 - RNA, 64 nt, hsa; identical to SEQ ID NO: 430406

SEQ ID NO: 561444 - RNA, 64 nt, hsa; identical to SEQ ID NO: 430407

SEQ ID NO: 561445 - RNA, 64 nt, hsa; identical to SEQ ID NO: 430408

SEQ ID NO: 561446 - RNA, 64 nt, hsa; identical to SEQ ID NO: 430409

SEQ ID NO: 561447 - RNA, 64 nt, hsa; identical to SEQ ID NO: 430410

SEQ ID NO: 561448 - RNA, 64 nt, hsa; identical to SEQ ID NO: 430411

SEQ ID NO: 561449 - RNA, 64 nt, hsa; identical to SEQ ID NO: 430412

SEQ ID NO: 561450 - RNA, 64 nt, hsa; identical to SEQ ID NO: 430413

SEQ ID NO: 561451 - RNA, 64 nt, hsa; identical to SEQ ID NO: 430414

SEQ ID NO: 561452 - RNA, 64 nt, hsa; identical to SEQ ID NO: 430415

SEQ ID NO: 561453 - RNA, 64 nt, hsa; identical to SEQ ID NO: 430416

SEQ ID NO: 561454 - RNA, 64 nt, hsa; identical to SEQ ID NO: 430417

SEQ ID NO: 561455 - RNA, 64 nt, hsa; identical to SEQ ID NO: 430418

SEQ ID NO: 561456 - RNA, 64 nt, hsa; identical to SEQ ID NO: 430419

SEQ ID NO: 561457 - RNA, 64 nt, hsa; identical to SEQ ID NO: 430420

SEQ ID NO: 561458 - RNA, 64 nt, hsa; identical to SEQ ID NO: 430421

SEQ ID NO: 561459 - RNA, 64 nt, hsa; identical to SEQ ID NO: 430422

SEQ ID NO: 561460 - RNA, 64 nt, hsa; identical to SEQ ID NO: 430423

SEQ ID NO: 561461 - RNA, 64 nt, hsa; identical to SEQ ID NO: 430424

SEQ ID NO: 561462 - RNA, 64 nt, hsa; identical to SEQ ID NO: 430425

SEQ ID NO: 561463 - RNA, 64 nt, hsa; identical to SEQ ID NO: 430426

SEQ ID NO: 561464 - RNA, 64 nt, hsa; identical to SEQ ID NO: 430427

SEQ ID NO: 561465 - RNA, 64 nt, hsa; identical to SEQ ID NO: 430428

SEQ ID NO: 561466 - RNA, 64 nt, hsa; identical to SEQ ID NO: 430429

SEQ ID NO: 561467 - RNA, 64 nt, hsa; identical to SEQ ID NO: 430430

SEQ ID NO: 561468 - RNA, 64 nt, hsa; identical to SEQ ID NO: 430431

SEQ ID NO: 561469 - RNA, 64 nt, hsa; identical to SEQ ID NO: 430432

SEQ ID NO: 561470 - RNA, 64 nt, hsa; identical to SEQ ID NO: 430433

SEQ ID NO: 561471 - RNA, 64 nt, hsa; identical to SEQ ID NO: 430434

SEQ ID NO: 561472 - RNA, 64 nt, hsa; identical to SEQ ID NO: 430435

SEQ ID NO: 561473 - RNA, 64 nt, hsa; identical to SEQ ID NO: 430436

SEQ ID NO: 561474 - RNA, 64 nt, hsa; identical to SEQ ID NO: 430437

SEQ ID NO: 561475 - RNA, 64 nt, hsa; identical to SEQ ID NO: 430438

SEQ ID NO: 561476 - RNA, 64 nt, hsa; identical to SEQ ID NO: 430439

SEQ ID NO: 561477 - RNA, 64 nt, hsa; identical to SEQ ID NO: 430440

SEQ ID NO: 561478 - RNA, 64 nt, hsa; identical to SEQ ID NO: 430441

SEQ ID NO: 561479 - RNA, 64 nt, hsa; identical to SEQ ID NO: 430442

SEQ ID NO: 561480 - RNA, 64 nt, hsa; identical to SEQ ID NO: 430443

SEQ ID NO: 561481 - RNA, 64 nt, hsa; identical to SEQ ID NO: 430444

SEQ ID NO: 561482 - RNA, 64 nt, hsa; identical to SEQ ID NO: 430445

SEQ ID NO: 561483 - RNA, 64 nt, hsa; identical to SEQ ID NO: 430446

SEQ ID NO: 561484 - RNA, 64 nt, hsa; identical to SEQ ID NO: 430447

SEQ ID NO: 561485 - RNA, 64 nt, hsa; identical to SEQ ID NO: 430448

SEQ ID NO: 561486 - RNA, 64 nt, hsa; identical to SEQ ID NO: 430449

SEQ ID NO: 561487 - RNA, 64 nt, hsa; identical to SEQ ID NO: 361390

SEQ ID NO: 561488 - RNA, 64 nt, hsa; identical to SEQ ID NO: 361391

SEQ ID NO: 561489 - RNA, 64 nt, hsa; identical to SEQ ID NO: 361392

SEQ ID NO: 561490 - RNA, 64 nt, hsa; identical to SEQ ID NO: 361393

SEQ ID NO: 561491 - RNA, 64 nt, hsa; identical to SEQ ID NO: 361394

SEQ ID NO: 561492 - RNA, 64 nt, hsa; identical to SEQ ID NO: 361395

SEQ ID NO: 561493 - RNA, 64 nt, hsa; identical to SEQ ID NO: 361396

SEQ ID NO: 561494 - RNA, 64 nt, hsa; identical to SEQ ID NO: 361397

SEQ ID NO: 561495 - RNA, 64 nt, hsa; identical to SEQ ID NO: 361398

SEQ ID NO: 561496 - RNA, 64 nt, hsa; identical to SEQ ID NO: 361399

SEQ ID NO: 561497 - RNA, 64 nt, hsa; identical to SEQ ID NO: 385550

SEQ ID NO: 561498 - RNA, 64 nt, hsa; identical to SEQ ID NO: 385551

SEQ ID NO: 561499 - RNA, 64 nt, hsa; identical to SEQ ID NO: 385552

SEQ ID NO: 561500 - RNA, 64 nt, hsa; identical to SEQ ID NO: 385553

SEQ ID NO: 561501 - RNA, 64 nt, hsa; identical to SEQ ID NO: 385554

SEQ ID NO: 561502 - RNA, 64 nt, hsa; identical to SEQ ID NO: 385555

SEQ ID NO: 561503 - RNA, 64 nt, hsa; identical to SEQ ID NO: 385556

SEQ ID NO: 561504 - RNA, 64 nt, hsa; identical to SEQ ID NO: 385557

SEQ ID NO: 561505 - RNA, 64 nt, hsa; identical to SEQ ID NO: 385558

SEQ ID NO: 561506 - RNA, 64 nt, hsa; identical to SEQ ID NO: 385559

SEQ ID NO: 561507 - RNA, 64 nt, hsa; identical to SEQ ID NO: 385560

SEQ ID NO: 561508 - RNA, 64 nt, hsa; identical to SEQ ID NO: 385561

SEQ ID NO: 561509 - RNA, 64 nt, hsa; identical to SEQ ID NO: 385562

SEQ ID NO: 561510 - RNA, 64 nt, hsa; identical to SEQ ID NO: 385563

SEQ ID NO: 561511 - RNA, 64 nt, hsa; identical to SEQ ID NO: 385564

SEQ ID NO: 561512 - RNA, 64 nt, hsa; identical to SEQ ID NO: 385565

SEQ ID NO: 561513 - RNA, 64 nt, hsa; identical to SEQ ID NO: 385566

SEQ ID NO: 561514 - RNA, 64 nt, hsa; identical to SEQ ID NO: 385567

SEQ ID NO: 561515 - RNA, 64 nt, hsa; identical to SEQ ID NO: 385568

SEQ ID NO: 561516 - RNA, 64 nt, hsa; identical to SEQ ID NO: 385569

SEQ ID NO: 561517 - RNA, 64 nt, hsa; identical to SEQ ID NO: 385570

SEQ ID NO: 561518 - RNA, 64 nt, hsa; identical to SEQ ID NO: 385571

SEQ ID NO: 561519 - RNA, 64 nt, hsa; identical to SEQ ID NO: 385572

SEQ ID NO: 561520 - RNA, 64 nt, hsa; identical to SEQ ID NO: 385573

SEQ ID NO: 561521 - RNA, 64 nt, hsa; identical to SEQ ID NO: 385574

SEQ ID NO: 561522 - RNA, 64 nt, hsa; identical to SEQ ID NO: 385575

SEQ ID NO: 561523 - RNA, 64 nt, hsa; identical to SEQ ID NO: 385576

SEQ ID NO: 561524 - RNA, 64 nt, hsa; identical to SEQ ID NO: 385577

SEQ ID NO: 561525 - RNA, 64 nt, hsa; identical to SEQ ID NO: 385578

SEQ ID NO: 561526 - RNA, 64 nt, hsa; identical to SEQ ID NO: 385579

SEQ ID NO: 561527 - RNA, 64 nt, hsa; identical to SEQ ID NO: 385580

SEQ ID NO: 561528 - RNA, 64 nt, hsa; identical to SEQ ID NO: 385581

SEQ ID NO: 561529 - RNA, 64 nt, hsa; identical to SEQ ID NO: 385582

SEQ ID NO: 561530 - RNA, 64 nt, hsa; identical to SEQ ID NO: 385583

SEQ ID NO: 561531 - RNA, 64 nt, hsa; identical to SEQ ID NO: 385584

SEQ ID NO: 561532 - RNA, 64 nt, hsa; identical to SEQ ID NO: 385585

SEQ ID NO: 561533 - RNA, 64 nt, hsa; identical to SEQ ID NO: 385586

SEQ ID NO: 561534 - RNA, 64 nt, hsa; identical to SEQ ID NO: 385587

SEQ ID NO: 561535 - RNA, 64 nt, hsa; identical to SEQ ID NO: 385588

SEQ ID NO: 561536 - RNA, 64 nt, hsa; identical to SEQ ID NO: 114926

SEQ ID NO: 561537 - RNA, 64 nt, hsa; identical to SEQ ID NO: 114927

SEQ ID NO: 561538 - RNA, 64 nt, hsa; identical to SEQ ID NO: 536729

SEQ ID NO: 561539 - RNA, 64 nt, hsa; identical to SEQ ID NO: 536730

SEQ ID NO: 561540 - RNA, 64 nt, hsa; identical to SEQ ID NO: 536731

SEQ ID NO: 561541 - RNA, 64 nt, hsa; identical to SEQ ID NO: 536732

SEQ ID NO: 561542 - RNA, 64 nt, hsa; identical to SEQ ID NO: 536733

SEQ ID NO: 561543 - RNA, 64 nt, hsa; identical to SEQ ID NO: 536734

SEQ ID NO: 561544 - RNA, 64 nt, hsa; identical to SEQ ID NO: 536735

SEQ ID NO: 561545 - RNA, 64 nt, hsa; identical to SEQ ID NO: 536736

SEQ ID NO: 561546 - RNA, 64 nt, hsa; identical to SEQ ID NO: 536737

SEQ ID NO: 561547 - RNA, 64 nt, hsa; identical to SEQ ID NO: 536738

SEQ ID NO: 561548 - RNA, 64 nt, hsa; identical to SEQ ID NO: 536739

SEQ ID NO: 561549 - RNA, 64 nt, hsa; identical to SEQ ID NO: 536740

SEQ ID NO: 561550 - RNA, 64 nt, hsa; identical to SEQ ID NO: 536741

SEQ ID NO: 561551 - RNA, 64 nt, hsa; identical to SEQ ID NO: 536742

SEQ ID NO: 561552 - RNA, 64 nt, hsa; identical to SEQ ID NO: 536743

SEQ ID NO: 561553 - RNA, 64 nt, hsa; identical to SEQ ID NO: 536744

SEQ ID NO: 561554 - RNA, 64 nt, hsa; identical to SEQ ID NO: 536745

SEQ ID NO: 561555 - RNA, 64 nt, hsa; identical to SEQ ID NO: 536746

SEQ ID NO: 561556 - RNA, 64 nt, hsa; identical to SEQ ID NO: 536747

SEQ ID NO: 561557 - RNA, 64 nt, hsa; identical to SEQ ID NO: 536748

SEQ ID NO: 561558 - RNA, 64 nt, hsa; identical to SEQ ID NO: 536749

SEQ ID NO: 561559 - RNA, 64 nt, hsa; identical to SEQ ID NO: 536750

SEQ ID NO: 561560 - RNA, 64 nt, hsa; identical to SEQ ID NO: 536751

SEQ ID NO: 561561 - RNA, 64 nt, hsa; identical to SEQ ID NO: 536752

SEQ ID NO: 561562 - RNA, 64 nt, hsa; identical to SEQ ID NO: 536753

SEQ ID NO: 561563 - RNA, 64 nt, hsa; identical to SEQ ID NO: 536754

SEQ ID NO: 561564 - RNA, 64 nt, hsa; identical to SEQ ID NO: 536755

SEQ ID NO: 561565 - RNA, 64 nt, hsa; identical to SEQ ID NO: 536756

SEQ ID NO: 561566 - RNA, 64 nt, hsa; identical to SEQ ID NO: 536757

SEQ ID NO: 561567 - RNA, 57 nt, hsa; identical to SEQ ID NO: 536758

SEQ ID NO: 561568 - RNA, 64 nt, hsa; identical to SEQ ID NO: 536759

SEQ ID NO: 561569 - RNA, 64 nt, hsa; identical to SEQ ID NO: 536760

SEQ ID NO: 561570 - RNA, 64 nt, hsa; identical to SEQ ID NO: 536761

SEQ ID NO: 561571 - RNA, 64 nt, hsa; identical to SEQ ID NO: 536762

SEQ ID NO: 561572 - RNA, 64 nt, hsa
cugacuaauggugucacugcuggcaauggugauaauggauuaauuccucaaaggaagagcagaa

SEQ ID NO: 561573 - RNA, 64 nt, hsa
cugacuaauggugccacugcuggcaauggugaugauggauuaauuccuccaaggaagagcagaa

SEQ ID NO: 561574 - RNA, 64 nt, hsa
aaaagugucacauauuagaaugcugaccuuucauauggauuauugugagucaucagaguuuauu

SEQ ID NO: 561575 - RNA, 64 nt, hsa
ccucgugucaguagccuugugacacugaaccuggauggauuauagaggagcccucacggcugau

SEQ ID NO: 561576 - RNA, 64 nt, hsa
aaaugagguuuuuugcauuccaaggaaauggcauauggauuaacuguaagaaaugaaauaagua

SEQ ID NO: 561577 - RNA, 64 nt, hsa
caucagcugccucucgaauggaagaacagugguaauggauuaacauccuauuuuguuguacuaa

SEQ ID NO: 561578 - RNA, 64 nt, hsa
uguuuguugucuuauuugugguggcacucguuuaauggauuaacugagguugcucaauguucag

SEQ ID NO: 561579 - RNA, 64 nt, hsa
uuuacuuagaugccagucuacuuuauaaagacaaauggauuauagacuuaaaaauagucauuuu

SEQ ID NO: 561580 - RNA, 64 nt, hsa
agccuuugucagaaaguauucucacaauuaugagauggauuauaauaaaauacuuaaauuugug

SEQ ID NO: 561581 - RNA, 64 nt, hsa
agccgagaauggucagaaagaucaguacaaccccauggauuaggcugaaacauaugaaauugcu

SEQ ID NO: 561582 - RNA, 64 nt, hsa
aauuacauuuaucugaagaaaauaguacaacuuaauggauuagcuuuuggguuuaacugaauau

SEQ ID NO: 561583 - RNA, 64 nt, hsa
uuaaaaauaagauauuugggguauauucaagugcauggauuaguuuuccugacaaagcauguuu

SEQ ID NO: 561584 - RNA, 64 nt, hsa
caugguaucugcugcaaacaugaguagauccaugauggauuaauaaagcuugcugaaaaaaaaa

SEQ ID NO: 561585 - RNA, 64 nt, hsa
aggugauugggccaugaggucugugcccuccugaauggauuaauccauucauggauuaauggau

SEQ ID NO: 561586 - RNA, 64 nt, hsa
aggucugugcccuccugaauggauuaauccauucauggauuaauggauuauuaugaguggggga

SEQ ID NO: 561587 - RNA, 64 nt, hsa
gcccuccugaauggauuaauccauucauggauuaauggauuauuaugagugggggacuggugac

SEQ ID NO: 561588 - RNA, 64 nt, hsa
uuggggguagauuagaaaacccuuacacuuuggcuaugaacaaauaauaaaaauuauucuuuaa

SEQ ID NO: 561589 - RNA, 64 nt, hsa
aaaagauguuauucugaguuuguuuuaauacauauaugaacauauaguuuuauucaauuaaacc

SEQ ID NO: 561590 - RNA, 64 nt, hsa
acaguauaccaguaacagcacuuuaucucauuuauaugaacaccuuugaggugcuacuuaaguc

SEQ ID NO: 561591 - RNA, 64 nt, hsa
caacguuuguuccuguguguacaauuguacuuuguaugaacagcuuuaucauuuuuauaggcuu

SEQ ID NO: 561592 - RNA, 64 nt, hsa
uaaaaagaaaaaauccagaacauaagaacuauauuaugaacacaugauuugaaccuguuguggu

SEQ ID NO: 561593 - RNA, 64 nt, hsa
ucccugccaucaaauuuauuagaagagaccuauauaugaacaacuuaaaggcacugauuucuau

SEQ ID NO: 561594 - RNA, 64 nt, hsa
uuuuaaaaauguguccauuguugcauuuuauauauaugaacaaacaaaaaaugcacaguucaua

SEQ ID NO: 561595 - RNA, 64 nt, hsa
guugagacaaucaccacaguuauuacccaaauacuaugaacauauuuuuguaaaccagucauuc

SEQ ID NO: 561596 - RNA, 64 nt, hsa
ucacagcugcuuugggcaguagcugaagccgaaguaugaacaguccauuuuguuucuuaaaauu

SEQ ID NO: 561597 - RNA, 64 nt, hsa
auggcauuaaaacauuuuugaggcaguugucuaauaugaacaauaaucuaaacaauauauuccu

SEQ ID NO: 561598 - RNA, 64 nt, hsa
acccuuauaauaaaagaucaaaagauauaucuccuaugaacagauuggagauaggagaugaaaa

SEQ ID NO: 561599 - RNA, 64 nt, hsa
aacuaaugaaugacauuuagauacuucauaaaauuaugaacagauauggaggccagagcucauu

SEQ ID NO: 561600 - RNA, 64 nt, hsa
uagcaacuguuugauuucuuucuggauacagcuguaugaacacuuuucuauuuuauacugaaau

SEQ ID NO: 561601 - RNA, 64 nt, hsa
gccuuaucuguagggaccuaaauuuuuuaagugcuaugaacacugaucaaguaguuguggagag

SEQ ID NO: 561602 - RNA, 64 nt, hsa
uguaagaaaauguuacggcaucacacuuauauuuuaugaacauuguacuguugcuuuaauauga

SEQ ID NO: 561603 - RNA, 64 nt, hsa
cugaacugacaaugaagggaaauuguuuauguguuaugaacauccaagucuuucuucuuuuuua

SEQ ID NO: 561604 - RNA, 64 nt, hsa
cuauaauguuccccagaaaccauuuauuaauugguaugaacaugagacuagaaaaguuuuccug

SEQ ID NO: 561605 - RNA, 64 nt, hsa
gaaauauacaucuuguguauaaaaauugauaccuuaugaacacauuaaugaagacuuuauuuuc

SEQ ID NO: 561606 - RNA, 64 nt, hsa; identical to SEQ ID NO: 486887

SEQ ID NO: 561607 - RNA, 64 nt, hsa; identical to SEQ ID NO: 486888

SEQ ID NO: 561608 - RNA, 64 nt, hsa; identical to SEQ ID NO: 486889

SEQ ID NO: 561609 - RNA, 64 nt, hsa; identical to SEQ ID NO: 486890

SEQ ID NO: 561610 - RNA, 64 nt, hsa; identical to SEQ ID NO: 486891

SEQ ID NO: 561611 - RNA, 64 nt, hsa; identical to SEQ ID NO: 486892

SEQ ID NO: 561612 - RNA, 64 nt, hsa; identical to SEQ ID NO: 486893

SEQ ID NO: 561613 - RNA, 64 nt, hsa; identical to SEQ ID NO: 486894

SEQ ID NO: 561614 - RNA, 64 nt, hsa; identical to SEQ ID NO: 486895

SEQ ID NO: 561615 - RNA, 64 nt, hsa; identical to SEQ ID NO: 486896

SEQ ID NO: 561616 - RNA, 64 nt, hsa; identical to SEQ ID NO: 486897

SEQ ID NO: 561617 - RNA, 64 nt, hsa; identical to SEQ ID NO: 486898

SEQ ID NO: 561618 - RNA, 64 nt, hsa; identical to SEQ ID NO: 486899

SEQ ID NO: 561619 - RNA, 64 nt, hsa; identical to SEQ ID NO: 486900

SEQ ID NO: 561620 - RNA, 64 nt, hsa; identical to SEQ ID NO: 486901

SEQ ID NO: 561621 - RNA, 64 nt, hsa; identical to SEQ ID NO: 486902

SEQ ID NO: 561622 - RNA, 64 nt, hsa; identical to SEQ ID NO: 486903

SEQ ID NO: 561623 - RNA, 64 nt, hsa; identical to SEQ ID NO: 74808

SEQ ID NO: 561624 - RNA, 64 nt, hsa; identical to SEQ ID NO: 74809

SEQ ID NO: 561625 - RNA, 64 nt, hsa; identical to SEQ ID NO: 74810

SEQ ID NO: 561626 - RNA, 64 nt, hsa; identical to SEQ ID NO: 74811

SEQ ID NO: 561627 - RNA, 64 nt, hsa; identical to SEQ ID NO: 74812

SEQ ID NO: 561628 - RNA, 64 nt, hsa; identical to SEQ ID NO: 74813

SEQ ID NO: 561629 - RNA, 64 nt, hsa; identical to SEQ ID NO: 74814

SEQ ID NO: 561630 - RNA, 64 nt, hsa; identical to SEQ ID NO: 74815

SEQ ID NO: 561631 - RNA, 64 nt, hsa; identical to SEQ ID NO: 74816

SEQ ID NO: 561632 - RNA, 64 nt, hsa; identical to SEQ ID NO: 74817

SEQ ID NO: 561633 - RNA, 64 nt, hsa; identical to SEQ ID NO: 74818

SEQ ID NO: 561634 - RNA, 64 nt, hsa; identical to SEQ ID NO: 74819

SEQ ID NO: 561635 - RNA, 64 nt, hsa; identical to SEQ ID NO: 74820

SEQ ID NO: 561636 - RNA, 64 nt, hsa; identical to SEQ ID NO: 74821

SEQ ID NO: 561637 - RNA, 64 nt, hsa; identical to SEQ ID NO: 74822

SEQ ID NO: 561638 - RNA, 64 nt, hsa; identical to SEQ ID NO: 74823

SEQ ID NO: 561639 - RNA, 64 nt, hsa; identical to SEQ ID NO: 74824

SEQ ID NO: 561640 - RNA, 64 nt, hsa; identical to SEQ ID NO: 74825

SEQ ID NO: 561641 - RNA, 64 nt, hsa; identical to SEQ ID NO: 74826

SEQ ID NO: 561642 - RNA, 64 nt, hsa; identical to SEQ ID NO: 74827

SEQ ID NO: 561643 - RNA, 64 nt, hsa; identical to SEQ ID NO: 74828

SEQ ID NO: 561644 - RNA, 64 nt, hsa; identical to SEQ ID NO: 74829

SEQ ID NO: 561645 - RNA, 64 nt, hsa; identical to SEQ ID NO: 74830

SEQ ID NO: 561646 - RNA, 64 nt, hsa; identical to SEQ ID NO: 74831

SEQ ID NO: 561647 - RNA, 64 nt, hsa; identical to SEQ ID NO: 74832

SEQ ID NO: 561648 - RNA, 64 nt, hsa; identical to SEQ ID NO: 74833

SEQ ID NO: 561649 - RNA, 64 nt, hsa; identical to SEQ ID NO: 74834

SEQ ID NO: 561650 - RNA, 64 nt, hsa; identical to SEQ ID NO: 74835

SEQ ID NO: 561651 - RNA, 64 nt, hsa; identical to SEQ ID NO: 74836

SEQ ID NO: 561652 - RNA, 64 nt, hsa
caacgucagccagaacaucgcggccgagacccgggcugaggacccgccgugguuugaaggugcg

SEQ ID NO: 561653 - RNA, 64 nt, hsa
cauacgggucaguagggauaagaauugucucugggcugaggaauucuucuguucucugguuuca

SEQ ID NO: 561654 - RNA, 64 nt, hsa
cuucacugucccuauuccuagaccuggggcuugagcugaggaugggacgaugugcccagggagg

SEQ ID NO: 561655 - RNA, 64 nt, hsa
caggguccccucagucaaggcagugggaugggcggcugaggaacggggcaggcaaggucacugc

SEQ ID NO: 561656 - RNA, 64 nt, hsa
gcgucugcagggugacgccugagacagcaccacugcugaggagucugaggacuguccucccaca

SEQ ID NO: 561657 - RNA, 64 nt, hsa
ugcugggguccagggcuguuggaggaccccgagggcugaggagcagccaggacccgccugcucc

SEQ ID NO: 561658 - RNA, 64 nt, hsa
aggugccgacacugagcugugacccagaggggacgcugaggaagugggcgugaguggacguguc

SEQ ID NO: 561659 - RNA, 64 nt, hsa
ccacagggcuguuuugccuccccacggaaggcgggcugaggagacaaccagaucaggagagcaa

SEQ ID NO: 561660 - RNA, 64 nt, hsa
guggcacacacuuguagccccagcuacuagggaggcugaggagggaggaucucuugugccuagg

SEQ ID NO: 561661 - RNA, 61 nt, hsa
ggaucuucaaggggagaugacgcagugaagggcugaggauggacgcacugucacaccucug

SEQ ID NO: 561662 - RNA, 64 nt, hsa
aucuccccucguccugcgucccggacccaucuacgcugaggacggagaccgcggcaucaaccag

SEQ ID NO: 561663 - RNA, 64 nt, hsa
gaacuccaccgucauccccgagacgcaacugcaggcugaggaccgcgacaaggacgacauucug

SEQ ID NO: 561664 - RNA, 64 nt, hsa
uuaacuauugugauugcugcugaaucagcuacaugcugaggaaacggccaaacaaguguuaaag

SEQ ID NO: 561665 - RNA, 64 nt, hsa
gcugccccugccuaccuccugccuguccccagaggcugaggagaggggguacugugcccaccac

SEQ ID NO: 561666 - RNA, 64 nt, hsa
gaaacucagaucagccacccaggaggaagagcgggcugaggaaacccagagggaccaagcgcug

SEQ ID NO: 561667 - RNA, 64 nt, hsa
gccaggaaaagccaugaguugcaaccaaaacgcggcugaggauggaacucagaaugaaacugca

SEQ ID NO: 561668 - RNA, 64 nt, hsa
cccaucuguugacaaugucuuguggagcauuuuugcugaggaaaaggucacuuguaaacagagg

SEQ ID NO: 561669 - RNA, 64 nt, hsa
ucuuuguuucuuuuuaauuaaaauacaagaagcagcugaggaaagggagacaagguauuuuauu

SEQ ID NO: 561670 - RNA, 64 nt, hsa
agcuggcugcgcuucuccggguauuuaguacugugcugaggagcauuggggaacgcuucagccc

SEQ ID NO: 561671 - RNA, 64 nt, hsa
ucuuggucaguuucuagaagacauggaagcauaugcugaggaccucagccauguggccucuggg

SEQ ID NO: 561672 - RNA, 64 nt, hsa
acugggggccagagcuaggguggggggcgagggugcugaggagcagcccccaggggccgagcgu

SEQ ID NO: 561673 - RNA, 64 nt, hsa
ccgggcagguggucacugagggccaugacgcggggcugaggaugccuccgcugggcaucucccu

SEQ ID NO: 561674 - RNA, 64 nt, hsa
ugucccagcuuuaagauaucuagcagaaacuauagcugaggacuaaggaauucugcagcuugca

SEQ ID NO: 561675 - RNA, 63 nt, hsa
uuccagacuuugaugacuagcacccaccccauagcugaggaggagucacaguggaacuguccc

SEQ ID NO: 561676 - RNA, 64 nt, hsa
ucacugcgucaaagggcuggugcugucccugcuggcugaggagccgcugcugggagacagcgca

SEQ ID NO: 561677 - RNA, 64 nt, hsa
gaguucgaggugcaguuuggcaaccuguguccuggcugaggaaugcacucacagcaccccuuuc

SEQ ID NO: 561678 - RNA, 64 nt, hsa
aaggccggguaaugagccauuuccauggugcccagcugaggaccaggugucucugagaauccaa

SEQ ID NO: 561679 - RNA, 64 nt, hsa
ugccugucuuuacuuuaaucuccuaauccugucagcugaggaggauguaugucaccucaggacc

SEQ ID NO: 561680 - RNA, 64 nt, hsa; identical to SEQ ID NO: 546336

SEQ ID NO: 561681 - RNA, 64 nt, hsa; identical to SEQ ID NO: 546337

SEQ ID NO: 561682 - RNA, 64 nt, hsa; identical to SEQ ID NO: 546338

SEQ ID NO: 561683 - RNA, 64 nt, hsa; identical to SEQ ID NO: 546339

SEQ ID NO: 561684 - RNA, 64 nt, hsa; identical to SEQ ID NO: 325145

SEQ ID NO: 561685 - RNA, 64 nt, hsa; identical to SEQ ID NO: 325146

SEQ ID NO: 561686 - RNA, 64 nt, hsa; identical to SEQ ID NO: 325147

SEQ ID NO: 561687 - RNA, 64 nt, hsa; identical to SEQ ID NO: 325148

SEQ ID NO: 561688 - RNA, 64 nt, hsa; identical to SEQ ID NO: 325149

SEQ ID NO: 561689 - RNA, 64 nt, hsa; identical to SEQ ID NO: 325150

SEQ ID NO: 561690 - RNA, 64 nt, hsa; identical to SEQ ID NO: 325151

SEQ ID NO: 561691 - RNA, 64 nt, hsa; identical to SEQ ID NO: 325152

SEQ ID NO: 561692 - RNA, 64 nt, hsa; identical to SEQ ID NO: 325153

SEQ ID NO: 561693 - RNA, 64 nt, hsa; identical to SEQ ID NO: 325154

SEQ ID NO: 561694 - RNA, 64 nt, hsa; identical to SEQ ID NO: 325155

SEQ ID NO: 561695 - RNA, 64 nt, hsa; identical to SEQ ID NO: 325156

SEQ ID NO: 561696 - RNA, 64 nt, hsa; identical to SEQ ID NO: 325157

SEQ ID NO: 561697 - RNA, 64 nt, hsa; identical to SEQ ID NO: 325158

SEQ ID NO: 561698 - RNA, 64 nt, hsa; identical to SEQ ID NO: 325159

SEQ ID NO: 561699 - RNA, 64 nt, hsa; identical to SEQ ID NO: 325160

SEQ ID NO: 561700 - RNA, 64 nt, hsa; identical to SEQ ID NO: 325161

SEQ ID NO: 561701 - RNA, 64 nt, hsa; identical to SEQ ID NO: 325162

SEQ ID NO: 561702 - RNA, 64 nt, hsa; identical to SEQ ID NO: 52979

SEQ ID NO: 561703 - RNA, 64 nt, hsa; identical to SEQ ID NO: 52980

SEQ ID NO: 561704 - RNA, 64 nt, hsa; identical to SEQ ID NO: 52981

SEQ ID NO: 561705 - RNA, 64 nt, hsa; identical to SEQ ID NO: 52982

SEQ ID NO: 561706 - RNA, 64 nt, hsa; identical to SEQ ID NO: 52983

SEQ ID NO: 561707 - RNA, 64 nt, hsa; identical to SEQ ID NO: 52984

SEQ ID NO: 561708 - RNA, 64 nt, hsa; identical to SEQ ID NO: 52985

SEQ ID NO: 561709 - RNA, 64 nt, hsa; identical to SEQ ID NO: 52986

SEQ ID NO: 561710 - RNA, 64 nt, hsa; identical to SEQ ID NO: 52987

SEQ ID NO: 561711 - RNA, 64 nt, hsa; identical to SEQ ID NO: 52988

SEQ ID NO: 561712 - RNA, 64 nt, hsa; identical to SEQ ID NO: 52989

SEQ ID NO: 561713 - RNA, 64 nt, hsa; identical to SEQ ID NO: 52990

SEQ ID NO: 561714 - RNA, 64 nt, hsa; identical to SEQ ID NO: 52991

SEQ ID NO: 561715 - RNA, 64 nt, hsa; identical to SEQ ID NO: 52992

SEQ ID NO: 561716 - RNA, 64 nt, hsa; identical to SEQ ID NO: 52993

SEQ ID NO: 561717 - RNA, 64 nt, hsa; identical to SEQ ID NO: 52994

SEQ ID NO: 561718 - RNA, 64 nt, hsa; identical to SEQ ID NO: 52995

SEQ ID NO: 561719 - RNA, 64 nt, hsa; identical to SEQ ID NO: 52996

SEQ ID NO: 561720 - RNA, 64 nt, hsa; identical to SEQ ID NO: 52997

SEQ ID NO: 561721 - RNA, 64 nt, hsa; identical to SEQ ID NO: 52998

SEQ ID NO: 561722 - RNA, 64 nt, hsa; identical to SEQ ID NO: 52999

SEQ ID NO: 561723 - RNA, 64 nt, hsa; identical to SEQ ID NO: 53000

SEQ ID NO: 561724 - RNA, 64 nt, hsa; identical to SEQ ID NO: 53001

SEQ ID NO: 561725 - RNA, 64 nt, hsa; identical to SEQ ID NO: 53002

SEQ ID NO: 561726 - RNA, 64 nt, hsa; identical to SEQ ID NO: 53003

SEQ ID NO: 561727 - RNA, 64 nt, hsa; identical to SEQ ID NO: 53004

SEQ ID NO: 561728 - RNA, 59 nt, hsa; identical to SEQ ID NO: 53005

SEQ ID NO: 561729 - RNA, 64 nt, hsa; identical to SEQ ID NO: 53006

SEQ ID NO: 561730 - RNA, 64 nt, hsa; identical to SEQ ID NO: 53007

SEQ ID NO: 561731 - RNA, 64 nt, hsa; identical to SEQ ID NO: 53008

SEQ ID NO: 561732 - RNA, 64 nt, hsa; identical to SEQ ID NO: 53009

SEQ ID NO: 561733 - RNA, 64 nt, hsa; identical to SEQ ID NO: 53010

SEQ ID NO: 561734 - RNA, 64 nt, hsa; identical to SEQ ID NO: 53011

SEQ ID NO: 561735 - RNA, 64 nt, hsa; identical to SEQ ID NO: 53012

SEQ ID NO: 561736 - RNA, 64 nt, hsa; identical to SEQ ID NO: 53013

SEQ ID NO: 561737 - RNA, 64 nt, hsa; identical to SEQ ID NO: 53014

SEQ ID NO: 561738 - RNA, 64 nt, hsa; identical to SEQ ID NO: 53015

SEQ ID NO: 561739 - RNA, 64 nt, hsa; identical to SEQ ID NO: 53016

SEQ ID NO: 561740 - RNA, 64 nt, hsa; identical to SEQ ID NO: 53017

SEQ ID NO: 561741 - RNA, 64 nt, hsa
gugauccacuugccucggccucccaaagugcugagauuacaagugugagccaccacgcccagcc

SEQ ID NO: 561742 - RNA, 64 nt, hsa
gcgauucuucugccucagccucccaaguagcuaggauuacaagugccugccacuaugccuggcu

SEQ ID NO: 561743 - RNA, 64 nt, hsa
uaauuggcuccaauucauaauauguucaccaggagauuacaauuuuuugcucuucuugucuuug

SEQ ID NO: 561744 - RNA, 64 nt, hsa
gcugaauugaacauuuugaaguuuauagcuuccagauuacaaaggccaaggguaauagaaaugc

SEQ ID NO: 561745 - RNA, 64 nt, hsa; identical to SEQ ID NO: 294359

SEQ ID NO: 561746 - RNA, 64 nt, hsa; identical to SEQ ID NO: 294360

SEQ ID NO: 561747 - RNA, 64 nt, hsa; identical to SEQ ID NO: 294361

SEQ ID NO: 561748 - RNA, 64 nt, hsa; identical to SEQ ID NO: 294362

SEQ ID NO: 561749 - RNA, 64 nt, hsa; identical to SEQ ID NO: 294363

SEQ ID NO: 561750 - RNA, 64 nt, hsa; identical to SEQ ID NO: 294364

SEQ ID NO: 561751 - RNA, 64 nt, hsa; identical to SEQ ID NO: 294365

SEQ ID NO: 561752 - RNA, 64 nt, hsa; identical to SEQ ID NO: 294366

SEQ ID NO: 561753 - RNA, 64 nt, hsa; identical to SEQ ID NO: 294367

SEQ ID NO: 561754 - RNA, 64 nt, hsa; identical to SEQ ID NO: 294368

SEQ ID NO: 561755 - RNA, 64 nt, hsa; identical to SEQ ID NO: 294369

SEQ ID NO: 561756 - RNA, 64 nt, hsa; identical to SEQ ID NO: 294370

SEQ ID NO: 561757 - RNA, 64 nt, hsa; identical to SEQ ID NO: 294371

SEQ ID NO: 561758 - RNA, 64 nt, hsa; identical to SEQ ID NO: 294372

SEQ ID NO: 561759 - RNA, 64 nt, hsa; identical to SEQ ID NO: 294373

SEQ ID NO: 561760 - RNA, 64 nt, hsa; identical to SEQ ID NO: 294374

SEQ ID NO: 561761 - RNA, 64 nt, hsa; identical to SEQ ID NO: 294375

SEQ ID NO: 561762 - RNA, 64 nt, hsa; identical to SEQ ID NO: 294376

SEQ ID NO: 561763 - RNA, 64 nt, hsa; identical to SEQ ID NO: 294377

SEQ ID NO: 561764 - RNA, 64 nt, hsa; identical to SEQ ID NO: 294378

SEQ ID NO: 561765 - RNA, 64 nt, hsa; identical to SEQ ID NO: 294379

SEQ ID NO: 561766 - RNA, 64 nt, hsa; identical to SEQ ID NO: 294380

SEQ ID NO: 561767 - RNA, 64 nt, hsa; identical to SEQ ID NO: 294381

SEQ ID NO: 561768 - RNA, 64 nt, hsa; identical to SEQ ID NO: 294382

SEQ ID NO: 561769 - RNA, 64 nt, hsa; identical to SEQ ID NO: 294383

SEQ ID NO: 561770 - RNA, 64 nt, hsa; identical to SEQ ID NO: 294384

SEQ ID NO: 561771 - RNA, 64 nt, hsa; identical to SEQ ID NO: 294385

SEQ ID NO: 561772 - RNA, 64 nt, hsa; identical to SEQ ID NO: 294386

SEQ ID NO: 561773 - RNA, 64 nt, hsa; identical to SEQ ID NO: 294372

SEQ ID NO: 561774 - RNA, 64 nt, hsa; identical to SEQ ID NO: 294388

SEQ ID NO: 561775 - RNA, 64 nt, hsa; identical to SEQ ID NO: 294389

SEQ ID NO: 561776 - RNA, 64 nt, hsa; identical to SEQ ID NO: 294390

SEQ ID NO: 561777 - RNA, 64 nt, hsa; identical to SEQ ID NO: 294391

SEQ ID NO: 561778 - RNA, 64 nt, hsa; identical to SEQ ID NO: 294392

SEQ ID NO: 561779 - RNA, 64 nt, hsa; identical to SEQ ID NO: 284290

SEQ ID NO: 561780 - RNA, 64 nt, hsa; identical to SEQ ID NO: 284291

SEQ ID NO: 561781 - RNA, 64 nt, hsa; identical to SEQ ID NO: 284292

SEQ ID NO: 561782 - RNA, 64 nt, hsa; identical to SEQ ID NO: 284293

SEQ ID NO: 561783 - RNA, 64 nt, hsa; identical to SEQ ID NO: 284294

SEQ ID NO: 561784 - RNA, 64 nt, hsa; identical to SEQ ID NO: 284295

SEQ ID NO: 561785 - RNA, 64 nt, hsa; identical to SEQ ID NO: 284296

SEQ ID NO: 561786 - RNA, 64 nt, hsa; identical to SEQ ID NO: 284297

SEQ ID NO: 561787 - RNA, 64 nt, hsa; identical to SEQ ID NO: 284298

SEQ ID NO: 561788 - RNA, 64 nt, hsa; identical to SEQ ID NO: 284299

SEQ ID NO: 561789 - RNA, 64 nt, hsa; identical to SEQ ID NO: 284300

SEQ ID NO: 561790 - RNA, 64 nt, hsa; identical to SEQ ID NO: 284301

SEQ ID NO: 561791 - RNA, 64 nt, hsa; identical to SEQ ID NO: 284302

SEQ ID NO: 561792 - RNA, 64 nt, hsa; identical to SEQ ID NO: 284303

SEQ ID NO: 561793 - RNA, 64 nt, hsa; identical to SEQ ID NO: 284304

SEQ ID NO: 561794 - RNA, 64 nt, hsa; identical to SEQ ID NO: 284305

SEQ ID NO: 561795 - RNA, 64 nt, hsa; identical to SEQ ID NO: 284306

SEQ ID NO: 561796 - RNA, 64 nt, hsa; identical to SEQ ID NO: 284307

SEQ ID NO: 561797 - RNA, 64 nt, hsa; identical to SEQ ID NO: 284308

SEQ ID NO: 561798 - RNA, 64 nt, hsa; identical to SEQ ID NO: 284309

SEQ ID NO: 561799 - RNA, 64 nt, hsa; identical to SEQ ID NO: 284310

SEQ ID NO: 561800 - RNA, 64 nt, hsa; identical to SEQ ID NO: 284311

SEQ ID NO: 561801 - RNA, 64 nt, hsa; identical to SEQ ID NO: 284312

SEQ ID NO: 561802 - RNA, 64 nt, hsa; identical to SEQ ID NO: 284313

SEQ ID NO: 561803 - RNA, 64 nt, hsa; identical to SEQ ID NO: 284314

SEQ ID NO: 561804 - RNA, 64 nt, hsa; identical to SEQ ID NO: 284315

SEQ ID NO: 561805 - RNA, 64 nt, hsa; identical to SEQ ID NO: 284316

SEQ ID NO: 561806 - RNA, 64 nt, hsa; identical to SEQ ID NO: 284317

SEQ ID NO: 561807 - RNA, 64 nt, hsa; identical to SEQ ID NO: 284318

SEQ ID NO: 561808 - RNA, 64 nt, hsa; identical to SEQ ID NO: 284319

SEQ ID NO: 561809 - RNA, 64 nt, hsa; identical to SEQ ID NO: 284320

SEQ ID NO: 561810 - RNA, 64 nt, hsa; identical to SEQ ID NO: 284321

SEQ ID NO: 561811 - RNA, 64 nt, hsa; identical to SEQ ID NO: 284322

SEQ ID NO: 561812 - RNA, 64 nt, hsa; identical to SEQ ID NO: 284323

SEQ ID NO: 561813 - RNA, 64 nt, hsa; identical to SEQ ID NO: 284324

SEQ ID NO: 561814 - RNA, 64 nt, hsa; identical to SEQ ID NO: 284325

SEQ ID NO: 561815 - RNA, 64 nt, hsa; identical to SEQ ID NO: 284326

SEQ ID NO: 561816 - RNA, 64 nt, hsa; identical to SEQ ID NO: 284327

SEQ ID NO: 561817 - RNA, 64 nt, hsa; identical to SEQ ID NO: 284328

SEQ ID NO: 561818 - RNA, 64 nt, hsa; identical to SEQ ID NO: 284329

SEQ ID NO: 561819 - RNA, 64 nt, hsa; identical to SEQ ID NO: 284330

SEQ ID NO: 561820 - RNA, 64 nt, hsa; identical to SEQ ID NO: 284331

SEQ ID NO: 561821 - RNA, 64 nt, hsa; identical to SEQ ID NO: 284332

SEQ ID NO: 561822 - RNA, 64 nt, hsa; identical to SEQ ID NO: 284333

SEQ ID NO: 561823 - RNA, 50 nt, hsa; identical to SEQ ID NO: 284334

SEQ ID NO: 561824 - RNA, 64 nt, hsa; identical to SEQ ID NO: 284335

SEQ ID NO: 561825 - RNA, 64 nt, hsa; identical to SEQ ID NO: 284336

SEQ ID NO: 561826 - RNA, 64 nt, hsa; identical to SEQ ID NO: 284337

SEQ ID NO: 561827 - RNA, 64 nt, hsa; identical to SEQ ID NO: 284338

SEQ ID NO: 561828 - RNA, 64 nt, hsa; identical to SEQ ID NO: 284339

SEQ ID NO: 561829 - RNA, 64 nt, hsa; identical to SEQ ID NO: 284340

SEQ ID NO: 561830 - RNA, 64 nt, hsa; identical to SEQ ID NO: 284341

SEQ ID NO: 561831 - RNA, 64 nt, hsa; identical to SEQ ID NO: 284342

SEQ ID NO: 561832 - RNA, 64 nt, hsa; identical to SEQ ID NO: 284343

SEQ ID NO: 561833 - RNA, 64 nt, hsa; identical to SEQ ID NO: 284344

SEQ ID NO: 561834 - RNA, 64 nt, hsa; identical to SEQ ID NO: 284345

SEQ ID NO: 561835 - RNA, 64 nt, hsa; identical to SEQ ID NO: 284346

SEQ ID NO: 561836 - RNA, 64 nt, hsa; identical to SEQ ID NO: 284347

SEQ ID NO: 561837 - RNA, 64 nt, hsa; identical to SEQ ID NO: 284348

SEQ ID NO: 561838 - RNA, 64 nt, hsa; identical to SEQ ID NO: 284349

SEQ ID NO: 561839 - RNA, 64 nt, hsa; identical to SEQ ID NO: 284350

SEQ ID NO: 561840 - RNA, 64 nt, hsa; identical to SEQ ID NO: 284351

SEQ ID NO: 561841 - RNA, 64 nt, hsa; identical to SEQ ID NO: 284352

SEQ ID NO: 561842 - RNA, 64 nt, hsa; identical to SEQ ID NO: 284353

SEQ ID NO: 561843 - RNA, 64 nt, hsa
ugaaauaacugcaacuagagaaaacuguauaaaaacauuaaauugucaguauuuuuguaagguu

SEQ ID NO: 561844 - RNA, 64 nt, hsa
uuuauauauaaauauuauauaaauaauguauaaaacauuaaaaguuaacuauguaagauauuau

SEQ ID NO: 561845 - RNA, 64 nt, hsa
cuaggcagcuggaaaaguauuugaaacuaaauugacauuaaaauuaagauuuguuuucaagugg

SEQ ID NO: 561846 - RNA, 64 nt, hsa
agucggaacaauugccuguugauauauuaauaagacauuaaagucaaauuuuaauguuggccuc

SEQ ID NO: 561847 - RNA, 64 nt, hsa
auagcauguccuaaugcuugcugcugauuuaaacacauuaaagguacuuugcaggaaauccuug

SEQ ID NO: 561848 - RNA, 64 nt, hsa
uccccucuccuccacauuuguuuugccaauuugcacauuaaaugacucuucccucaaaugugua

SEQ ID NO: 561849 - RNA, 64 nt, hsa
uuauuuugagaguuucuucuucauaaaucuacagacauuaaacaauuguuguguucuuuuuacc

SEQ ID NO: 561850 - RNA, 64 nt, hsa
cauuuaggaaagauuucuuagguuuugaaagaauacauuaaaauaaaaaacuugccccuacuag

SEQ ID NO: 561851 - RNA, 64 nt, hsa
uuggagcacagguuugauauuuaugcuucuaaauacauuaaaacauuucugaauugcaguugaa

SEQ ID NO: 561852 - RNA, 64 nt, hsa
auguaaaaacuuuauuugaaaucuccuaagugagacauuaaacauuuuagugcuaguuuaagcc

SEQ ID NO: 561853 - RNA, 64 nt, hsa
augcaaagucuacuacuuccaaauguuauuccaaacauuaaauuuuaacagucuaucaaucaau

SEQ ID NO: 561854 - RNA, 64 nt, hsa
cuacgauguguuucauuaacuguuggagauuaucacauuaaauugagcagauuuggaucuuuua

SEQ ID NO: 561855 - RNA, 64 nt, hsa
cugucccaaacaguauaugccuuuuaucagggacacauuaaauauaaauguuuaaccaaagaaa

SEQ ID NO: 561856 - RNA, 64 nt, hsa
ucuuuggcucagagaggauaauuugccuaaugauacauuaaaguuaguggcaaaacuuaauuug

SEQ ID NO: 561857 - RNA, 64 nt, hsa
uugcaguucugaguuucagauaaaacauuauaaaacauuaaauucaauacauacugcuccuuug

SEQ ID NO: 561858 - RNA, 64 nt, hsa
caggcagguguguaauaaauuauuuuugaauugaacauuaaaauucugcuucuuaaagucagca

SEQ ID NO: 561859 - RNA, 64 nt, hsa
uuucuuuugaaaagaacuauguuaauuuuuuugcacauuaaaaugcccuagcaguaucuaauua

SEQ ID NO: 561860 - RNA, 64 nt, hsa
cuaucuacagugugauguauggacucaaucaaaaacauuaaacgcaaacugauuaggauuugau

SEQ ID NO: 561861 - RNA, 64 nt, hsa
acugccuaugggcugugauguauauagaaguuguacauuaaacauacccucauuuuuuucuuuu

SEQ ID NO: 561862 - RNA, 64 nt, hsa
aucuuuauauguuccacauguuaagaauaaauguacauuaaaucuuguuaagcacugugauggg

SEQ ID NO: 561863 - RNA, 64 nt, hsa
auagaaauaaugucauuugaaugaaaaucuuaucacauuaaauucacugugaaggcagcauacu

SEQ ID NO: 561864 - RNA, 64 nt, hsa
guuggaauuugauuucaugcauaacuguauuaaaacauuaaauagaaauaaugucauuugaaug

SEQ ID NO: 561865 - RNA, 64 nt, hsa
caacagaaaaaaaagcuaagaaaacugagaacuaacauuaaaaaaauuaaauuuagaauaagaa

SEQ ID NO: 561866 - RNA, 64 nt, hsa
auacuuaguauguaaaugucacgagaucauuuuuacauuaaacgugaaaaaaaaucaacuuugc

SEQ ID NO: 561867 - RNA, 64 nt, hsa
gcaaagugcagcagaguauuuauuuugaagagaaacauuaaaaguacaaagagguuuguaguac

SEQ ID NO: 561868 - RNA, 64 nt, hsa
cauuauuuaugaccuuuucuguggaagaguaagaacauuaaaaugaaagaugcaugaugaaaau

SEQ ID NO: 561869 - RNA, 64 nt, hsa
ugauaucugugucuguauugacuugucuuguguuacauuaaacaguaggcagaacugaggucuc

SEQ ID NO: 561870 - RNA, 64 nt, hsa
cuguccaugucuaauaaguaaaaacugauagaauacauuaaaaagucacugguuuaucauagaa

SEQ ID NO: 561871 - RNA, 64 nt, hsa
ugugugguaaacauucauauggccauuaauuuuaacauuaaaucguagguagggcaauguagua

SEQ ID NO: 561872 - RNA, 64 nt, hsa
uuucuaauuuauuagagauuauggaucaguucugacauuaaaaucauaguuaauugauggaugg

SEQ ID NO: 561873 - RNA, 64 nt, hsa
gaaaagaugcuugaugcccagccccguuuuaaggacauuaaaagcuaucaggccaagaccccag

SEQ ID NO: 561874 - RNA, 64 nt, hsa
ucaaccugcucacuguucuaucuccaaaugagacacauuaaaggguagccuacaaauguuuuca

SEQ ID NO: 561875 - RNA, 64 nt, hsa
agacuuuuaauaaaaagaaauuguagaaauaaacacauuaaaauuugcccagcugucgucuaag

SEQ ID NO: 561876 - RNA, 64 nt, hsa
uaauagcaauguauguguuauaauacaacuuaguacauuaaagcuacgaaaacucauccuggcu

SEQ ID NO: 561877 - RNA, 64 nt, hsa
aagcgagcccaagucauguaauugaaacuucuguacauuaaaagaacugauucaugaagacguu

SEQ ID NO: 561878 - RNA, 64 nt, hsa
uaaguuucuguuaugauugccauuucaauaaaugacauuaaaaaucuaaaggauauuauuguuu

SEQ ID NO: 561879 - RNA, 64 nt, hsa
guaaaauguauaagucaucucacuuuuugucaagacauuaaaccaucuuagaucggagugugaa

SEQ ID NO: 561880 - RNA, 64 nt, hsa
uaauagcaagaaaauugauguauauuuuaaugauacauuaaaauucccuuuuaaucauaauagu

SEQ ID NO: 561881 - RNA, 64 nt, hsa
uuaaacaauuuuuuucuaacgugaaaaggauaaaacauuaaaaacucuugagaacuauaaagug

SEQ ID NO: 561882 - RNA, 64 nt, hsa
acuugaguccauauggguuggacaguccccacacacauuaaauucuguaaaugaaagccaccuu

SEQ ID NO: 561883 - RNA, 64 nt, hsa
cuaugugcaauuauacucuaaauuccacuacacuacauuaaaguaaauggacauuccagaauau

SEQ ID NO: 561884 - RNA, 57 nt, hsa
cugaagcuacuacugauuaaagucaucacauuaaacauuguaauacuaguuuuuuaa

SEQ ID NO: 561885 - RNA, 64 nt, hsa
gauagaauucauaacacauuaaagagaaaauuucacauuaaaggaagguuuaaaaaucuauuuu

SEQ ID NO: 561886 - RNA, 64 nt, hsa
auccuaaaugguuauauuugauagaauucauaacacauuaaagagaaaauuucacauuaaagga

SEQ ID NO: 561887 - RNA, 64 nt, hsa
auguuucuuagaaacuuuaaaccuuuaacuucaaacauuaaaauacaagucuuuuaaguacaug

SEQ ID NO: 561888 - RNA, 64 nt, hsa
aaauguacauaauguuuauauacacuuaugccuuacauuaaaguccaauaugagaaauacaugu

SEQ ID NO: 561889 - RNA, 64 nt, hsa
caaaguguucauacuaaaauauauuuuugcagauacauuaaauaugaaagauauucaauccaaa

SEQ ID NO: 561890 - RNA, 64 nt, hsa
cauuauuuaugaccuuuucuaugaaaagauaaggacauuaaaauguaagaugcgugaggaaaau

SEQ ID NO: 561891 - RNA, 64 nt, hsa
auagagaaacuugaguaauuuuuacauuucuaagacauuaaaucccauuuaaauucugugugaa

SEQ ID NO: 561892 - RNA, 64 nt, hsa
cuaagacauuaaaucccauuuaaauucugugugaacauuaaagacagcacacuugcaaaaguau

SEQ ID NO: 561893 - RNA, 64 nt, hsa
uuuauuuuuauuuuuugugguuauauucccaacaacauuaaaaaauacucgaggcauaaaugua

SEQ ID NO: 561894 - RNA, 64 nt, hsa
aauguuuuguauuucuugacuuauuuuauuagaaacauuaaagaucacuugguaguuagccaca

SEQ ID NO: 561895 - RNA, 64 nt, hsa
gaugcuugcacacaugcacccccucacucucacacuugcacacauacacacacacacacacgaa

SEQ ID NO: 561896 - RNA, 64 nt, hsa
agcguuggucuucucuugucaggaaugaaggaugcuugcacacaugcacccccucacucucaca

SEQ ID NO: 561897 - RNA, 64 nt, hsa
uauccaauccacuggucugugaguuuuugaaaugcuugcacagcauggucucaguuguauagau

SEQ ID NO: 561898 - RNA, 64 nt, hsa
gagcaaaaagcugcagccggugcuugcacaccgccuugcacauagcagaggcuccgggcucacu

SEQ ID NO: 561899 - RNA, 64 nt, hsa
agagaaagaagagagcaaaaagcugcagccggugcuugcacaccgccuugcacauagcagaggc

SEQ ID NO: 561900 - RNA, 64 nt, hsa
cagcaaagagccgcagccggugcuugcacaccgccuugcacauagcagaggcuccgggcugacu

SEQ ID NO: 561901 - RNA, 64 nt, hsa
agaaagaagagacagcaaagagccgcagccggugcuugcacaccgccuugcacauagcagaggc

SEQ ID NO: 561902 - RNA, 64 nt, hsa
ucagaacuauuuuugugguuuucaguaaaguguucuugcacauccuucaauagauuuauucuua

SEQ ID NO: 561903 - RNA, 64 nt, hsa
gggauuacaggcgugagccaccacgcccggcccacuugcacauuuucaaaguaguccgcaaagc

SEQ ID NO: 561904 - RNA, 64 nt, hsa
aauaucuuguguuugcuuuuugucacuuauuucacuugcacauuuuuuguuuguuuguuuguuu

SEQ ID NO: 561905 - RNA, 64 nt, hsa
caagacaggacccugggaccacagagggcaggaacuugcacaaaaucacacagccaagccaguc

SEQ ID NO: 561906 - RNA, 64 nt, hsa
cuaugugggugggaccacagacucacauccugaccuugcacaaacagccccucuggacacagcc

SEQ ID NO: 561907 - RNA, 64 nt, hsa
ucgaaggacuugcacagacagacgaugcuacuuucuugcacacgcgcugccuugcgggaggggg

SEQ ID NO: 561908 - RNA, 64 nt, hsa
acacuugcccguauuacuuaccuaacucgaaggacuugcacagacagacgaugcuacuuucuug

SEQ ID NO: 561909 - RNA, 64 nt, hsa
cugagaguuccagauucccagcuuccagaugauccuugcacagacaaccuaccuucuuuccaga

SEQ ID NO: 561910 - RNA, 64 nt, hsa
agaguccugguuuccucagccucacccugcauagcuugcacaacauccucagaaccauucacug

SEQ ID NO: 561911 - RNA, 64 nt, hsa
uggaacacuuuaacagaaggaaaugccgaagcagcuugcacaguugcuuuacagacuuccaaga

SEQ ID NO: 561912 - RNA, 64 nt, hsa
gcuaaauggagaaauguuucaauuucuuugaauacuugcacauuucaauaauuccuuucccgag

SEQ ID NO: 561913 - RNA, 64 nt, hsa; identical to SEQ ID NO: 561843

SEQ ID NO: 561914 - RNA, 64 nt, hsa; identical to SEQ ID NO: 561844

SEQ ID NO: 561915 - RNA, 64 nt, hsa; identical to SEQ ID NO: 561845

SEQ ID NO: 561916 - RNA, 64 nt, hsa; identical to SEQ ID NO: 561846

SEQ ID NO: 561917 - RNA, 64 nt, hsa; identical to SEQ ID NO: 561847

SEQ ID NO: 561918 - RNA, 64 nt, hsa; identical to SEQ ID NO: 561848

SEQ ID NO: 561919 - RNA, 64 nt, hsa; identical to SEQ ID NO: 561849

SEQ ID NO: 561920 - RNA, 64 nt, hsa; identical to SEQ ID NO: 561850

SEQ ID NO: 561921 - RNA, 64 nt, hsa; identical to SEQ ID NO: 561851

SEQ ID NO: 561922 - RNA, 64 nt, hsa; identical to SEQ ID NO: 561852

SEQ ID NO: 561923 - RNA, 64 nt, hsa; identical to SEQ ID NO: 561853

SEQ ID NO: 561924 - RNA, 64 nt, hsa; identical to SEQ ID NO: 561854

SEQ ID NO: 561925 - RNA, 64 nt, hsa; identical to SEQ ID NO: 561855

SEQ ID NO: 561926 - RNA, 64 nt, hsa; identical to SEQ ID NO: 561856

SEQ ID NO: 561927 - RNA, 64 nt, hsa; identical to SEQ ID NO: 561857

SEQ ID NO: 561928 - RNA, 64 nt, hsa; identical to SEQ ID NO: 561858

SEQ ID NO: 561929 - RNA, 64 nt, hsa; identical to SEQ ID NO: 561859

SEQ ID NO: 561930 - RNA, 64 nt, hsa; identical to SEQ ID NO: 561860

SEQ ID NO: 561931 - RNA, 64 nt, hsa; identical to SEQ ID NO: 561861

SEQ ID NO: 561932 - RNA, 64 nt, hsa; identical to SEQ ID NO: 561862

SEQ ID NO: 561933 - RNA, 64 nt, hsa; identical to SEQ ID NO: 561863

SEQ ID NO: 561934 - RNA, 64 nt, hsa; identical to SEQ ID NO: 561864

SEQ ID NO: 561935 - RNA, 64 nt, hsa; identical to SEQ ID NO: 561865

SEQ ID NO: 561936 - RNA, 64 nt, hsa; identical to SEQ ID NO: 561866

SEQ ID NO: 561937 - RNA, 64 nt, hsa; identical to SEQ ID NO: 561867

SEQ ID NO: 561938 - RNA, 64 nt, hsa; identical to SEQ ID NO: 561868

SEQ ID NO: 561939 - RNA, 64 nt, hsa; identical to SEQ ID NO: 561869

SEQ ID NO: 561940 - RNA, 64 nt, hsa; identical to SEQ ID NO: 561870

SEQ ID NO: 561941 - RNA, 64 nt, hsa; identical to SEQ ID NO: 561871

SEQ ID NO: 561942 - RNA, 64 nt, hsa; identical to SEQ ID NO: 561872

SEQ ID NO: 561943 - RNA, 64 nt, hsa; identical to SEQ ID NO: 561873

SEQ ID NO: 561944 - RNA, 64 nt, hsa; identical to SEQ ID NO: 561874

SEQ ID NO: 561945 - RNA, 64 nt, hsa; identical to SEQ ID NO: 561875

SEQ ID NO: 561946 - RNA, 64 nt, hsa; identical to SEQ ID NO: 561876

SEQ ID NO: 561947 - RNA, 64 nt, hsa; identical to SEQ ID NO: 561877

SEQ ID NO: 561948 - RNA, 64 nt, hsa; identical to SEQ ID NO: 561878

SEQ ID NO: 561949 - RNA, 64 nt, hsa; identical to SEQ ID NO: 561879

SEQ ID NO: 561950 - RNA, 64 nt, hsa; identical to SEQ ID NO: 561880

SEQ ID NO: 561951 - RNA, 64 nt, hsa; identical to SEQ ID NO: 561881

SEQ ID NO: 561952 - RNA, 64 nt, hsa; identical to SEQ ID NO: 561882

SEQ ID NO: 561953 - RNA, 64 nt, hsa; identical to SEQ ID NO: 561883

SEQ ID NO: 561954 - RNA, 57 nt, hsa; identical to SEQ ID NO: 561884

SEQ ID NO: 561955 - RNA, 64 nt, hsa; identical to SEQ ID NO: 561885

SEQ ID NO: 561956 - RNA, 64 nt, hsa; identical to SEQ ID NO: 561886

SEQ ID NO: 561957 - RNA, 64 nt, hsa; identical to SEQ ID NO: 561887

SEQ ID NO: 561958 - RNA, 64 nt, hsa; identical to SEQ ID NO: 561888

SEQ ID NO: 561959 - RNA, 64 nt, hsa; identical to SEQ ID NO: 561889

SEQ ID NO: 561960 - RNA, 64 nt, hsa; identical to SEQ ID NO: 561890

SEQ ID NO: 561961 - RNA, 64 nt, hsa; identical to SEQ ID NO: 561891

SEQ ID NO: 561962 - RNA, 64 nt, hsa; identical to SEQ ID NO: 561892

SEQ ID NO: 561963 - RNA, 64 nt, hsa; identical to SEQ ID NO: 561893

SEQ ID NO: 561964 - RNA, 64 nt, hsa; identical to SEQ ID NO: 561894

SEQ ID NO: 561965 - RNA, 64 nt, hsa; identical to SEQ ID NO: 561895

SEQ ID NO: 561966 - RNA, 64 nt, hsa; identical to SEQ ID NO: 561896

SEQ ID NO: 561967 - RNA, 64 nt, hsa; identical to SEQ ID NO: 561897

SEQ ID NO: 561968 - RNA, 64 nt, hsa; identical to SEQ ID NO: 561898

SEQ ID NO: 561969 - RNA, 64 nt, hsa; identical to SEQ ID NO: 561899

SEQ ID NO: 561970 - RNA, 64 nt, hsa; identical to SEQ ID NO: 561900

SEQ ID NO: 561971 - RNA, 64 nt, hsa; identical to SEQ ID NO: 561901

SEQ ID NO: 561972 - RNA, 64 nt, hsa; identical to SEQ ID NO: 561902

SEQ ID NO: 561973 - RNA, 64 nt, hsa; identical to SEQ ID NO: 561903

SEQ ID NO: 561974 - RNA, 64 nt, hsa; identical to SEQ ID NO: 561904

SEQ ID NO: 561975 - RNA, 64 nt, hsa; identical to SEQ ID NO: 561905

SEQ ID NO: 561976 - RNA, 64 nt, hsa; identical to SEQ ID NO: 561906

SEQ ID NO: 561977 - RNA, 64 nt, hsa; identical to SEQ ID NO: 561907

SEQ ID NO: 561978 - RNA, 64 nt, hsa; identical to SEQ ID NO: 561908

SEQ ID NO: 561979 - RNA, 64 nt, hsa; identical to SEQ ID NO: 561909

SEQ ID NO: 561980 - RNA, 64 nt, hsa; identical to SEQ ID NO: 561910

SEQ ID NO: 561981 - RNA, 64 nt, hsa; identical to SEQ ID NO: 561911

SEQ ID NO: 561982 - RNA, 64 nt, hsa; identical to SEQ ID NO: 561912

SEQ ID NO: 561983 - RNA, 64 nt, hsa; identical to SEQ ID NO: 389582

SEQ ID NO: 561984 - RNA, 64 nt, hsa; identical to SEQ ID NO: 389583

SEQ ID NO: 561985 - RNA, 64 nt, hsa; identical to SEQ ID NO: 389584

SEQ ID NO: 561986 - RNA, 64 nt, hsa; identical to SEQ ID NO: 389585

SEQ ID NO: 561987 - RNA, 64 nt, hsa; identical to SEQ ID NO: 389586

SEQ ID NO: 561988 - RNA, 64 nt, hsa; identical to SEQ ID NO: 389587

SEQ ID NO: 561989 - RNA, 64 nt, hsa
aggaaaagcaaaggcuuuucuuuucaguuuguguuauuuggaagacagaaaaacaucuugucua

SEQ ID NO: 561990 - RNA, 64 nt, hsa
aaugggacuguagguuguuuuucuacaucuucauuauuuggaccuaaaaccaguuuuuaauaag

SEQ ID NO: 561991 - RNA, 64 nt, hsa
cccagccuagaaagcacaggaacaauacgucauauauuuggaacaguuauugucugugccauga

SEQ ID NO: 561992 - RNA, 64 nt, hsa
acuucuugcuggaaugaacagugugcucagggacuauuuggaacuggauguuuuugaauuauuu

SEQ ID NO: 561993 - RNA, 64 nt, hsa
auguuguagcuugggugaauuacacuuccuaguuuauuuggauuuaaguugacaaauaaaaauu

SEQ ID NO: 561994 - RNA, 64 nt, hsa
cguugguauaacauugcuucuugaaaaaugaaaguauuuggacauacagacagaagcaauauua

SEQ ID NO: 561995 - RNA, 64 nt, hsa
guuacaugguagaacugcccaugccacaaauauuuauuuggaaaaguagucauuaaaugaaccc

SEQ ID NO: 561996 - RNA, 64 nt, hsa
caaccaugcccccuucguuggcaucacagggccuuauuuggaagagcgggcaaagaggauggaa

SEQ ID NO: 561997 - RNA, 64 nt, hsa
accaguggaaugucagauaauuuucaccaguuuuuauuuggagccguuuuauuguguagaccau

SEQ ID NO: 561998 - RNA, 64 nt, hsa
uuggagccguuuuauuguguagaccauauuuacauauuuggauaaguacacaaagcgucaaugc

SEQ ID NO: 561999 - RNA, 64 nt, hsa
gcauaugcuuuuugcuaaauauguauguacagaguauuuggaaguuaagaauugauuagacuag

SEQ ID NO: 562000 - RNA, 64 nt, hsa
ugaauuuuuugccaaacuuaguaacucuguuaaauauuuggaggauuuaaagaacaucccaguu

SEQ ID NO: 562001 - RNA, 64 nt, hsa
guuuuaggauugcuaucaauuuucagcauugugcuauuuggaaauaaguguuuugcuuuugucu

SEQ ID NO: 562002 - RNA, 64 nt, hsa
uaaaaugguuuuuacuccugugauuauguuggaauauuuggaauuuuaaaggaguaaagacugu

SEQ ID NO: 562003 - RNA, 64 nt, hsa
uuuggcaaccucuguauuuggguuacagucaaccuauuuggauacuuggcaaaagauucuugcu

SEQ ID NO: 562004 - RNA, 64 nt, hsa
auauuuuauaugccuuuugagcuguguaacuuaauauuuggauacuugacaauuuguuuuauua

SEQ ID NO: 562005 - RNA, 64 nt, hsa
ugaggacagaugaugcagcuguuguguggcgagcuauuuggaaagacgucuguguuuuugaagg

SEQ ID NO: 562006 - RNA, 64 nt, hsa
cuuagcuguuaucccuacucuugaaauuguaguguauuuggauuauuuguguauuguacgaugu

SEQ ID NO: 562007 - RNA, 64 nt, hsa
acaauaaaguuuacuaaaaaacaguauuaggguuuauuuggaguuaacucccuuaguaauugcu

SEQ ID NO: 562008 - RNA, 64 nt, hsa
caggaagugggaaaacucuauccacuggagauaguauuuggaaugaauggaagaauauggguua

SEQ ID NO: 562009 - RNA, 64 nt, hsa
guaaugagcugagaaaagacagagcauaucuguguauuuggaaaaauaauuguaacguaauugc

SEQ ID NO: 562010 - RNA, 64 nt, hsa
uguaacguaauugcagugcauuuagacaggcaucuauuuggaccuguuucuaucucuaaaugaa

SEQ ID NO: 562011 - RNA, 64 nt, hsa
uuuaucuauauugaaaaucauuuacauuggccuauauuuggaagagagauagucuuuuguuuuu

SEQ ID NO: 562012 - RNA, 64 nt, hsa
uuucuuacuauaaauuuuaaacaaauugguuaguuauuuggauauuuuauuaaacuaguaacac

SEQ ID NO: 562013 - RNA, 64 nt, hsa
ccaaagggcccccuaacccucuuguggcuccaguuauuuggaaacuaugaucugcauccuuagg

SEQ ID NO: 562014 - RNA, 64 nt, hsa
uaagcgccagugguaguugggaggaauaaaccauuauuuggaugcaggugguuuuugauugcaa

SEQ ID NO: 562015 - RNA, 64 nt, hsa
cagaaaguuguaaaguuugugcuggagaaagguuuauuuggacuuugauuacauaaauauuaaa

SEQ ID NO: 562016 - RNA, 64 nt, hsa
uuuucucuaauuaggugacuguucauaauggguauauuuggaauuuagaagaaauaauuuugua

SEQ ID NO: 562017 - RNA, 64 nt, hsa
aagaaaagcccuuauuuggaaagugugaaauuuguauuuggaaaagcugccuggagagaagaac

SEQ ID NO: 562018 - RNA, 64 nt, hsa
uacccauaaucaguaaccuaucaagaaaagcccuuauuuggaaagugugaaauuuguauuugga

SEQ ID NO: 562019 - RNA, 64 nt, hsa
aaggcguaagauaaggauggaaggcuguccaaguuauuuggaaggccucggcagcuugggauua

SEQ ID NO: 562020 - RNA, 64 nt, hsa
auugacucuuccaauauaggucucagaaauccaauauuuggaguacaauuucuuuuaauccaga

SEQ ID NO: 562021 - RNA, 64 nt, hsa
ucauguugcuuuagguuuaauaaauagccuuaacuauuuggaggggaaaaaaugggucaacuuu

SEQ ID NO: 562022 - RNA, 64 nt, hsa
gcguuugcauguacaacuuucuauuuuuagccuauauuuggaaagaaagcacuuaacauuuuag

SEQ ID NO: 562023 - RNA, 64 nt, hsa
gaaacuuguucauaauuuauuguuacuauagaacuauuuggauuuucucauuuuuaguucugau

SEQ ID NO: 562024 - RNA, 64 nt, hsa
aguuaguuuuauaaugauuuuuaaaaaacauaucuauuuggaauaagauacagcaacaaucauu

SEQ ID NO: 562025 - RNA, 64 nt, hsa
ugcaguuuucuuuccaguacuuauuagaacucaguauuuggaaauaauuucagcuuaauugacc

SEQ ID NO: 562026 - RNA, 64 nt, hsa
uguuuucuucccucaaauauuuuacuauuuguuuuauuuggaguuaaaauaagaguaucaucca

SEQ ID NO: 562027 - RNA, 64 nt, hsa
uaaaaaugaauugaaccauuucaacuauuuucuauauuuggagaaaguuugugcccuguguuuu

SEQ ID NO: 562028 - RNA, 64 nt, hsa
uaaauggaaauuaauuuauuguagacuacaucucuauuuggaaugaugagguaaauguauaccu

SEQ ID NO: 562029 - RNA, 64 nt, hsa
caccuuuaauguuuuauugauuucacuggcacuguauuuggaccuguccuuguauauguagaga

SEQ ID NO: 562030 - RNA, 64 nt, hsa
guauucauggaucgaagcaaccauggaucaaaaguauuuggagcauccauggauugcagugauc

SEQ ID NO: 562031 - RNA, 64 nt, hsa
gcauccauggauugcagugaucauuaaucaaaaauauuuggaaaacaaaaaggguaguugcauc

SEQ ID NO: 562032 - RNA, 64 nt, hsa
aaagagcccuacacuagauuucuaccaucacuaauauuuggaaguauuucauuacuaacaaucu

SEQ ID NO: 562033 - RNA, 64 nt, hsa
auugcauauugucagagcagcaugagaaauaugauauuuggauagggauuucagcaacuaaaca

SEQ ID NO: 562034 - RNA, 64 nt, hsa
gaagauaaaaguacauaaugaaaauccauggccuuauuuggaauauauaucacuuuccaaauuu

SEQ ID NO: 562035 - RNA, 64 nt, hsa
uuuagguuccuuaauuuggcuguugguaccuguguauuuggaauauuuuaggggauucgaauuu

SEQ ID NO: 562036 - RNA, 64 nt, hsa; identical to SEQ ID NO: 95478

SEQ ID NO: 562037 - RNA, 64 nt, hsa; identical to SEQ ID NO: 95479

SEQ ID NO: 562038 - RNA, 64 nt, hsa; identical to SEQ ID NO: 95480

SEQ ID NO: 562039 - RNA, 64 nt, hsa; identical to SEQ ID NO: 95481

SEQ ID NO: 562040 - RNA, 64 nt, hsa; identical to SEQ ID NO: 95482

SEQ ID NO: 562041 - RNA, 64 nt, hsa; identical to SEQ ID NO: 95483

SEQ ID NO: 562042 - RNA, 64 nt, hsa; identical to SEQ ID NO: 95484

SEQ ID NO: 562043 - RNA, 64 nt, hsa; identical to SEQ ID NO: 95485

SEQ ID NO: 562044 - RNA, 64 nt, hsa; identical to SEQ ID NO: 95486

SEQ ID NO: 562045 - RNA, 64 nt, hsa; identical to SEQ ID NO: 95487

SEQ ID NO: 562046 - RNA, 64 nt, hsa; identical to SEQ ID NO: 95488

SEQ ID NO: 562047 - RNA, 64 nt, hsa; identical to SEQ ID NO: 95489

SEQ ID NO: 562048 - RNA, 64 nt, hsa; identical to SEQ ID NO: 95490

SEQ ID NO: 562049 - RNA, 64 nt, hsa; identical to SEQ ID NO: 95491

SEQ ID NO: 562050 - RNA, 64 nt, hsa; identical to SEQ ID NO: 95492

SEQ ID NO: 562051 - RNA, 64 nt, hsa; identical to SEQ ID NO: 95493

SEQ ID NO: 562052 - RNA, 64 nt, hsa; identical to SEQ ID NO: 95494

SEQ ID NO: 562053 - RNA, 64 nt, hsa; identical to SEQ ID NO: 95495

SEQ ID NO: 562054 - RNA, 64 nt, hsa; identical to SEQ ID NO: 95496

SEQ ID NO: 562055 - RNA, 64 nt, hsa; identical to SEQ ID NO: 95497

SEQ ID NO: 562056 - RNA, 64 nt, hsa; identical to SEQ ID NO: 95498

SEQ ID NO: 562057 - RNA, 64 nt, hsa; identical to SEQ ID NO: 95499

SEQ ID NO: 562058 - RNA, 64 nt, hsa; identical to SEQ ID NO: 95500

SEQ ID NO: 562059 - RNA, 64 nt, hsa; identical to SEQ ID NO: 95501

SEQ ID NO: 562060 - RNA, 64 nt, hsa; identical to SEQ ID NO: 95502

SEQ ID NO: 562061 - RNA, 64 nt, hsa; identical to SEQ ID NO: 95503

SEQ ID NO: 562062 - RNA, 64 nt, hsa; identical to SEQ ID NO: 95504

SEQ ID NO: 562063 - RNA, 64 nt, hsa; identical to SEQ ID NO: 95505

SEQ ID NO: 562064 - RNA, 64 nt, hsa; identical to SEQ ID NO: 95506

SEQ ID NO: 562065 - RNA, 64 nt, hsa; identical to SEQ ID NO: 95507

SEQ ID NO: 562066 - RNA, 64 nt, hsa; identical to SEQ ID NO: 95508

SEQ ID NO: 562067 - RNA, 64 nt, hsa; identical to SEQ ID NO: 95509

SEQ ID NO: 562068 - RNA, 64 nt, hsa; identical to SEQ ID NO: 95510

SEQ ID NO: 562069 - RNA, 64 nt, hsa; identical to SEQ ID NO: 95511

SEQ ID NO: 562070 - RNA, 64 nt, hsa; identical to SEQ ID NO: 95512

SEQ ID NO: 562071 - RNA, 64 nt, hsa; identical to SEQ ID NO: 95513

SEQ ID NO: 562072 - RNA, 64 nt, hsa; identical to SEQ ID NO: 95514

SEQ ID NO: 562073 - RNA, 64 nt, hsa; identical to SEQ ID NO: 95515

SEQ ID NO: 562074 - RNA, 64 nt, hsa; identical to SEQ ID NO: 95516

SEQ ID NO: 562075 - RNA, 64 nt, hsa; identical to SEQ ID NO: 95517

SEQ ID NO: 562076 - RNA, 64 nt, hsa; identical to SEQ ID NO: 95518

SEQ ID NO: 562077 - RNA, 64 nt, hsa; identical to SEQ ID NO: 95519

SEQ ID NO: 562078 - RNA, 64 nt, hsa; identical to SEQ ID NO: 95520

SEQ ID NO: 562079 - RNA, 64 nt, hsa; identical to SEQ ID NO: 95521

SEQ ID NO: 562080 - RNA, 64 nt, hsa; identical to SEQ ID NO: 95522

SEQ ID NO: 562081 - RNA, 64 nt, hsa; identical to SEQ ID NO: 95523

SEQ ID NO: 562082 - RNA, 64 nt, hsa; identical to SEQ ID NO: 95524

SEQ ID NO: 562083 - RNA, 64 nt, hsa; identical to SEQ ID NO: 95525

SEQ ID NO: 562084 - RNA, 64 nt, hsa; identical to SEQ ID NO: 150365

SEQ ID NO: 562085 - RNA, 64 nt, hsa; identical to SEQ ID NO: 150366

SEQ ID NO: 562086 - RNA, 64 nt, hsa; identical to SEQ ID NO: 150367

SEQ ID NO: 562087 - RNA, 64 nt, hsa; identical to SEQ ID NO: 150368

SEQ ID NO: 562088 - RNA, 64 nt, hsa; identical to SEQ ID NO: 150369

SEQ ID NO: 562089 - RNA, 64 nt, hsa; identical to SEQ ID NO: 150370

SEQ ID NO: 562090 - RNA, 64 nt, hsa; identical to SEQ ID NO: 150371

SEQ ID NO: 562091 - RNA, 64 nt, hsa; identical to SEQ ID NO: 150372

SEQ ID NO: 562092 - RNA, 64 nt, hsa; identical to SEQ ID NO: 150373

SEQ ID NO: 562093 - RNA, 64 nt, hsa; identical to SEQ ID NO: 150374

SEQ ID NO: 562094 - RNA, 64 nt, hsa; identical to SEQ ID NO: 150375

SEQ ID NO: 562095 - RNA, 64 nt, hsa; identical to SEQ ID NO: 150376

SEQ ID NO: 562096 - RNA, 64 nt, hsa; identical to SEQ ID NO: 150377

SEQ ID NO: 562097 - RNA, 64 nt, hsa; identical to SEQ ID NO: 150378

SEQ ID NO: 562098 - RNA, 64 nt, hsa; identical to SEQ ID NO: 80175

SEQ ID NO: 562099 - RNA, 64 nt, hsa; identical to SEQ ID NO: 80176

SEQ ID NO: 562100 - RNA, 64 nt, hsa; identical to SEQ ID NO: 80177

SEQ ID NO: 562101 - RNA, 64 nt, hsa; identical to SEQ ID NO: 80178

SEQ ID NO: 562102 - RNA, 64 nt, hsa; identical to SEQ ID NO: 80179

SEQ ID NO: 562103 - RNA, 64 nt, hsa; identical to SEQ ID NO: 80180

SEQ ID NO: 562104 - RNA, 64 nt, hsa; identical to SEQ ID NO: 80181

SEQ ID NO: 562105 - RNA, 50 nt, hsa; identical to SEQ ID NO: 80182

SEQ ID NO: 562106 - RNA, 64 nt, hsa; identical to SEQ ID NO: 188510

SEQ ID NO: 562107 - RNA, 64 nt, hsa; identical to SEQ ID NO: 188511

SEQ ID NO: 562108 - RNA, 64 nt, hsa; identical to SEQ ID NO: 188512

SEQ ID NO: 562109 - RNA, 64 nt, hsa; identical to SEQ ID NO: 188513

SEQ ID NO: 562110 - RNA, 64 nt, hsa; identical to SEQ ID NO: 188514

SEQ ID NO: 562111 - RNA, 64 nt, hsa; identical to SEQ ID NO: 188515

SEQ ID NO: 562112 - RNA, 64 nt, hsa; identical to SEQ ID NO: 188516

SEQ ID NO: 562113 - RNA, 64 nt, hsa; identical to SEQ ID NO: 188517

SEQ ID NO: 562114 - RNA, 64 nt, hsa; identical to SEQ ID NO: 188518

SEQ ID NO: 562115 - RNA, 64 nt, hsa; identical to SEQ ID NO: 188519

SEQ ID NO: 562116 - RNA, 64 nt, hsa; identical to SEQ ID NO: 188520

SEQ ID NO: 562117 - RNA, 64 nt, hsa; identical to SEQ ID NO: 188521

SEQ ID NO: 562118 - RNA, 64 nt, hsa; identical to SEQ ID NO: 188522

SEQ ID NO: 562119 - RNA, 64 nt, hsa; identical to SEQ ID NO: 188523

SEQ ID NO: 562120 - RNA, 64 nt, hsa; identical to SEQ ID NO: 188524

SEQ ID NO: 562121 - RNA, 64 nt, hsa; identical to SEQ ID NO: 188525

SEQ ID NO: 562122 - RNA, 64 nt, hsa; identical to SEQ ID NO: 188526

SEQ ID NO: 562123 - RNA, 64 nt, hsa; identical to SEQ ID NO: 188527

SEQ ID NO: 562124 - RNA, 64 nt, hsa; identical to SEQ ID NO: 188528

SEQ ID NO: 562125 - RNA, 64 nt, hsa; identical to SEQ ID NO: 188529

SEQ ID NO: 562126 - RNA, 64 nt, hsa; identical to SEQ ID NO: 188530

SEQ ID NO: 562127 - RNA, 64 nt, hsa; identical to SEQ ID NO: 188531

SEQ ID NO: 562128 - RNA, 64 nt, hsa; identical to SEQ ID NO: 188532

SEQ ID NO: 562129 - RNA, 64 nt, hsa; identical to SEQ ID NO: 188533

SEQ ID NO: 562130 - RNA, 64 nt, hsa; identical to SEQ ID NO: 188534

SEQ ID NO: 562131 - RNA, 64 nt, hsa
caaguaaaaauucucaucuggucuccccugcuguuaguaacagucaccaaaauguucuaagcaa

SEQ ID NO: 562132 - RNA, 64 nt, hsa
uaguaaaauaaguaaauuucuuuuggaauauuuuuaguaacaaauagccacuauaauucuguag

SEQ ID NO: 562133 - RNA, 64 nt, hsa
aaggcauagcuaaaggcuaaacauauggcuuuaguaguaacaaaaggguucauagaaacuucau

SEQ ID NO: 562134 - RNA, 64 nt, hsa
ucuauagagauaaauagaaauuuucaauaagauguaguaacacugugauuuaucuuucaagagu

SEQ ID NO: 562135 - RNA, 64 nt, hsa
guauuuauuaaacuacagcauuguacaauuagcuuaguaacacuauggaauaagcuaaaacaua

SEQ ID NO: 562136 - RNA, 64 nt, hsa
gaaaugaaaaucugccguggaauuaacuaauaaguaguaacaauaaacuucauauuuagaaugc

SEQ ID NO: 562137 - RNA, 64 nt, hsa; identical to SEQ ID NO: 111876

SEQ ID NO: 562138 - RNA, 64 nt, hsa; identical to SEQ ID NO: 111877

SEQ ID NO: 562139 - RNA, 64 nt, hsa; identical to SEQ ID NO: 111878

SEQ ID NO: 562140 - RNA, 64 nt, hsa; identical to SEQ ID NO: 111879

SEQ ID NO: 562141 - RNA, 64 nt, hsa; identical to SEQ ID NO: 111880

SEQ ID NO: 562142 - RNA, 64 nt, hsa; identical to SEQ ID NO: 111881

SEQ ID NO: 562143 - RNA, 64 nt, hsa
agguugcuuucuuaguuucagcaaugggcuggcuugucuagacaugguuuuaagaauagcugac

SEQ ID NO: 562144 - RNA, 64 nt, hsa
guucguccucccccacucccuccuaucguugguuugucuagaacacucagcugcuucuuugguc

SEQ ID NO: 562145 - RNA, 64 nt, hsa
ucguaauuuauuuccccccagccauugcucacucugucuagacuuccugccacuuccaauucuu

SEQ ID NO: 562146 - RNA, 64 nt, hsa
aaucugcaacacuccugcuguuggcuggagcaugugucuagagguggggguggcuggguuuauc

SEQ ID NO: 562147 - RNA, 62 nt, hsa
gcuaagucaggaacaucggaugccagggagggaggagaaagccgaagcgaaaggggucaggg

SEQ ID NO: 562148 - RNA, 62 nt, hsa
ggaauuuuagugacaccuuaugccauuucaagaggagaaaugcaggcuggcagagcaauuuc

SEQ ID NO: 562149 - RNA, 62 nt, hsa
cuaacggaaacugcuuuuugacauuaaaagacaggagaaauuauauuuaacuaaguaaaagu

SEQ ID NO: 562150 - RNA, 62 nt, hsa
ucauucauuucauuucccccguagcagauggaaggagaaaccucugagaaaaugaaaacauc

SEQ ID NO: 562151 - RNA, 62 nt, hsa
auagguagaugguaaagagaaugaggagaaaaaggagaaaagggaaaagcagaaaggaaaaa

SEQ ID NO: 562152 - RNA, 62 nt, hsa
gagggucacauagguagaugguaaagagaaugaggagaaaaaggagaaaagggaaaagcaga

SEQ ID NO: 562153 - RNA, 62 nt, hsa
caggguuggugugaugccaaggcaaaguggugaggagaaaacaggaaacgggcuuucucuga

SEQ ID NO: 562154 - RNA, 62 nt, hsa
cgcucccaccauugccccuccucagcugugcaaggagaaagcaugcuuaggaaguuuucagg

SEQ ID NO: 562155 - RNA, 62 nt, hsa
uaucaaucucgguuuuuuuguggugcaguggaaggagaaauaggucuaguuucugccucuga

SEQ ID NO: 562156 - RNA, 62 nt, hsa
guuuugaaagauaggcaaaaaaaaaaaaguauaggagaaacugaagaauguacacuuuuuua

SEQ ID NO: 562157 - RNA, 62 nt, hsa
uaacauucacuguuagagaguguaggcgcugcaggagaaagagaaagugcccacgaaaauua

SEQ ID NO: 562158 - RNA, 62 nt, hsa
aauuccuaaggaggaauucuuaggaauuccuaaggagaaacagagugaggccuuuuuaaccu

SEQ ID NO: 562159 - RNA, 52 nt, hsa; identical to SEQ ID NO: 21695

SEQ ID NO: 562160 - RNA, 62 nt, hsa
gugcccugcuggauaucugggucuggaacaggaggagaaagggugucugcugccuggugagg

SEQ ID NO: 562161 - RNA, 62 nt, hsa
augcuguuuuuauugggcaugucaucuaagagaggagaaauagcuggguuuugggucuaauu

SEQ ID NO: 562162 - RNA, 62 nt, hsa
aacuuaucucaaauggagauuuuggugggaggaggagaaaacaauuguuuuuaaaucacaca

SEQ ID NO: 562163 - RNA, 62 nt, hsa
uguugaucgguagggcagccauauguguaggaaggagaaaacagaauuugguggauaccuag

SEQ ID NO: 562164 - RNA, 62 nt, hsa
uuuuauaauccuuaaugugaggcuaagguauaaggagaaaggagauugguaaggaaguguga

SEQ ID NO: 562165 - RNA, 62 nt, hsa
auaaacauaauucaaauauuuaaauauuuaagaggagaaaaguaacuagaaaaccaaugaaa

SEQ ID NO: 562166 - RNA, 62 nt, hsa
acaguauuucuauuuaaggcagcuauaaauauaggagaaaaauguuuuuggagagcugugaa

SEQ ID NO: 562167 - RNA, 62 nt, hsa
ggcuccucugugacaaaacacaaguuggaccaaggagaaagcccuuuggagaaacuggaccc

SEQ ID NO: 562168 - RNA, 62 nt, hsa
auugguauuuauuuuaaauauuaguuauucuaaggagaaaaaaaugcuucugcaagauuuuc

SEQ ID NO: 562169 - RNA, 62 nt, hsa
cucucagaaaagagaaaaaagaaugucaguuuaggagaaaagcuuccuuuuuacuugugugg

SEQ ID NO: 562170 - RNA, 62 nt, hsa
gacaguaauuccagcucggucccuccaggcaaaggagaaacgggacuuacuucacaggacag

SEQ ID NO: 562171 - RNA, 62 nt, hsa
guuucuggacguuugugcaguauugaaaagacaggagaaaagaaaacagaaaccugguuaua

SEQ ID NO: 562172 - RNA, 62 nt, hsa
guucauaaggaggugagaaguaauuuuuuuaaaggagaaaaauuuuuuggcuuuagauuuaa

SEQ ID NO: 562173 - RNA, 62 nt, hsa
ccuagacuucagagagaaugagcagagagcaaaggagaaaucuggcuguccuuccauuuuca

SEQ ID NO: 562174 - RNA, 62 nt, hsa
cugaauaucaacucugaaagagcaaaccuaacaggagaaaggacaaccaggaugaggauguc

SEQ ID NO: 562175 - RNA, 62 nt, hsa
gcacagcagcucccucaaggaggagaagagugaggagaaaggaaacucaagucucaccauuc

SEQ ID NO: 562176 - RNA, 62 nt, hsa
ugcuauguuuacucguucuuggguuccaauaaaggagaaacagggcacaggagucggaagga

SEQ ID NO: 562177 - RNA, 62 nt, hsa
uuauggacugggcaaagcccacuauaaacuauaggagaaagaaguucugauaaaccucuuag

SEQ ID NO: 562178 - RNA, 62 nt, hsa
auguuugugaaauaaaacugauuuuaacuggaaggagaaacagguuaauggacuuuguguuu

SEQ ID NO: 562179 - RNA, 62 nt, hsa
aaaguauaagccuaacuuugucgcuaguccuaaggagaaaccuuuaaccacaaaguuuuuau

SEQ ID NO: 562180 - RNA, 62 nt, hsa
cuugagacuuuccuuugugugguaggacuuggaggagaaauccccuggacuuucacuaaccc

SEQ ID NO: 562181 - RNA, 62 nt, hsa
cccuuugcuguagcuacacuucagauuaaaguaggagaaagaaugugcugaguguuuuccuc

SEQ ID NO: 562182 - RNA, 62 nt, hsa
ggggcaucuuuguguaaaagaugcauggagucaggagaaaaccaccuucauaaacugcucug

SEQ ID NO: 562183 - RNA, 62 nt, hsa
agguuugaacagugggagauaccagaggugggaggagaaaaaguuauuuauuaccguucccu

SEQ ID NO: 562184 - RNA, 62 nt, hsa
uaauauauguuuaacuggagucccagaaggagaggagaaaaugaagaggcaugaagaaguau

SEQ ID NO: 562185 - RNA, 62 nt, hsa
ugcaaagaagcaauaaaauaugacuuauaaccaggagaaaaaucaguagaaacccagaaaag

SEQ ID NO: 562186 - RNA, 62 nt, hsa
ggugaguuuucuaaaaguauuuccccauggaaaggagaaagugguuugggacagaaagaaau

SEQ ID NO: 562187 - RNA, 62 nt, hsa
acaaagcagagauggaaauaaugcgccucuugaggagaaaagcaauaaugaauaaaaggacu

SEQ ID NO: 562188 - RNA, 62 nt, hsa
uggucucugcccuucggagcuuauauuccaguaggagaaaaagcaaaaauaaaauaauuaua

SEQ ID NO: 562189 - RNA, 62 nt, hsa
gguuauuggugacuuacuggacuggcaccgccaggagaaaauucuccugcuaacuuuuuuuc

SEQ ID NO: 562190 - RNA, 62 nt, hsa
uuccuaguauuuaacagaacccaagugaacagaggagaaaugagauugccagaaagugauua

SEQ ID NO: 562191 - RNA, 62 nt, hsa
augaugacuaguucacacauaaaguccuuuuaaggagaaaaucuaaaaugaaaaguggauaa

SEQ ID NO: 562192 - RNA, 62 nt, hsa
aagcuggacuguggguuccaaauuacucauagaggagaaaaccagagaaagaugaagaggag

SEQ ID NO: 562193 - RNA, 62 nt, hsa
ucaggguaggugggcacaggcuuggacuagagaggagaaagauugguguaaucugcuuuccu

SEQ ID NO: 562194 - RNA, 62 nt, hsa
aaccauaggaaagugacauguaggagggcuauaggagaaacugaugauuuuacauuuucuag

SEQ ID NO: 562195 - RNA, 62 nt, hsa
ucagagcuuucuauccaucugagagccaacacaggagaaaaaccauaggaaagugacaugua

SEQ ID NO: 562196 - RNA, 62 nt, hsa
uuaguuuuccugaaaucaccaggucaggcacaaggagaaaagguuccuggauacugacuaac

SEQ ID NO: 562197 - RNA, 62 nt, hsa
auacugacuaacuuggguggguggaucuagccaggagaaagacaguaacauguguucuguac

SEQ ID NO: 562198 - RNA, 62 nt, hsa
gggagaagacaaaauugguguuuagauucuggaggagaaaaaaugaguuacaaugucaggug

SEQ ID NO: 562199 - RNA, 62 nt, hsa
ucuaaauuaccauuuacuuccagauagagcagaggagaaacaccucacugcaguuucaacau

SEQ ID NO: 562200 - RNA, 62 nt, hsa
auguaagaaggcagggcaggggggcuuuuuacaggagaaaaaaaaaugacuuauaagagaaa

SEQ ID NO: 562201 - RNA, 62 nt, hsa
aucuuuauaauuucuuugucucacagaagacuaggagaaagaucuuuuuuaaauaaucuuuu

SEQ ID NO: 562202 - RNA, 62 nt, hsa
uuagaacucuucaacuucgguaaugaggaagaaggagaaagagcugggggaagggcagaaga

SEQ ID NO: 562203 - RNA, 62 nt, hsa
gcagaagacugguuuaggaggaaaaggaaauaaggagaaaagagaaugggagagugagagaa

SEQ ID NO: 562204 - RNA, 62 nt, hsa
cagagggccucagggagcugcaaaacucauccaggagaaaaaggcaggagcagcaagugacc

SEQ ID NO: 562205 - RNA, 62 nt, hsa
aagagaguggagauacggaagggggagaggagaggagaaauguggacagagggcuugaagac

SEQ ID NO: 562206 - RNA, 62 nt, hsa
aauuaugcuagagcaauuagacacccauggcgaggagaaaaaagaaccucuacuuaaaccuc

SEQ ID NO: 562207 - RNA, 62 nt, hsa
acauaaaacuagauaacuuugaaaaaagccacaggagaaaaaucuucaggaucuugggcuag

SEQ ID NO: 562208 - RNA, 62 nt, hsa
aagcugugcucagaggaggugagaggagaggaaggagaaaacugcaucauaacuuuacagaa

SEQ ID NO: 562209 - RNA, 62 nt, hsa
uuuuuccuuucaaaucagacgaugagacuagaaggagaaauacuuucugucuuauuaaaauu

SEQ ID NO: 562210 - RNA, 62 nt, hsa
uugaggacagugacugccauuuguauauaaaaaggagaaaaaugguaaguacauaauuguga

SEQ ID NO: 562211 - RNA, 62 nt, hsa
gguaggauguuuccuagaccauuuggggucugaggagaaacaggcuggggccucgagaagga

SEQ ID NO: 562212 - RNA, 64 nt, hsa; identical to SEQ ID NO: 94103

SEQ ID NO: 562213 - RNA, 64 nt, hsa; identical to SEQ ID NO: 94104

SEQ ID NO: 562214 - RNA, 64 nt, hsa
uuuauuuaaaaaaaaacauaacuuuguaaauauuacccuguaauauuauauauacuuaauaaaa

SEQ ID NO: 562215 - RNA, 64 nt, hsa
gguaauuugccacgcuuuuugacugcucaccaauacccuguaaaaauacguaauucuuccuguu

SEQ ID NO: 562216 - RNA, 64 nt, hsa
auauacuugagugguguguguuaucagauaaagcacccuguaucacagacuggcaacaagaaga

SEQ ID NO: 562217 - RNA, 64 nt, hsa
uuaacuaucccugccugugacuuucaagcuacucacccuguaauggaucuuaaagcauucccca

SEQ ID NO: 562218 - RNA, 64 nt, hsa
cauucaaagcuaccagaagcaucaugguccccagacccuguaccugccuguaacucuaagcagu

SEQ ID NO: 562219 - RNA, 64 nt, hsa
uucuggcauauuuuaggggaugcguugcugguucacccuguaucagacucuggagcccauggug

SEQ ID NO: 562220 - RNA, 64 nt, hsa
aauaacaauaaggaguaagccaccuuuuauaggcacccuguaguuuuauaguucuuaaucuaaa

SEQ ID NO: 562221 - RNA, 64 nt, hsa
cuuggggaaauggcaagucuuuaggauaggcaagacccuguaugaauaguaccaaagcauuacc

SEQ ID NO: 562222 - RNA, 64 nt, hsa; identical to SEQ ID NO: 77046

SEQ ID NO: 562223 - RNA, 64 nt, hsa; identical to SEQ ID NO: 77047

SEQ ID NO: 562224 - RNA, 64 nt, hsa; identical to SEQ ID NO: 77048

SEQ ID NO: 562225 - RNA, 64 nt, hsa; identical to SEQ ID NO: 77049

SEQ ID NO: 562226 - RNA, 64 nt, hsa; identical to SEQ ID NO: 161764

SEQ ID NO: 562227 - RNA, 64 nt, hsa; identical to SEQ ID NO: 161765

SEQ ID NO: 562228 - RNA, 64 nt, hsa
auagaccuggggcugcaguuggggacuucaugucagugcaaaugccauuaguuccauuuguacc

SEQ ID NO: 562229 - RNA, 64 nt, hsa
aauuuaaggaacaaguaacuaaaaauguuaagccagugcaaaauaaucugcuuaccuacucaca

SEQ ID NO: 562230 - RNA, 64 nt, hsa
uacacuugguugccucuuggcuauauaacuucugagugcaaaucauugaacacuuuaacgaagu

SEQ ID NO: 562231 - RNA, 64 nt, hsa
uuacuucccugaagcaagagacuauauggccuucagugcaaagacuucagaccaauucuuugua

SEQ ID NO: 562232 - RNA, 64 nt, hsa
gucagaagacaauggcgcugcauguuuuucuuugagugcaaauguacauugcuaagauuuuuuu

SEQ ID NO: 562233 - RNA, 64 nt, hsa
aucgauaaucauugcauagugacugaaaagccuaagugcaaaaaaaaaaaaaaaagauguucuu

SEQ ID NO: 562234 - RNA, 64 nt, hsa
ugaguugggauuuuugcacucagugaaaagcugaagugcaaaagagcuaucaaagacaagagga

SEQ ID NO: 562235 - RNA, 64 nt, hsa
uggcucuccagauuuacuuuuggggccuguucuaagugcaaacccagcaaguuucacuuguccu

SEQ ID NO: 562236 - RNA, 64 nt, hsa
uaaaaacaaucccaugcuagaguugccauuaagcagugcaaaauuaaucggcuguaugguagau

SEQ ID NO: 562237 - RNA, 64 nt, hsa
cuaaugugugugaugauaguguccuguguuucuuagugcaaaucuguagaguaaaaauguccau

SEQ ID NO: 562238 - RNA, 64 nt, hsa
gcuuaccagcuccuaccaguccagugugcuuauaagugcaaaagaaaguaaaggcaaccccaga

SEQ ID NO: 562239 - RNA, 64 nt, hsa
uugucuuuccugcccccuaucuguuugcugugauagugcaaagaagcacaggaaaauguuuaau

SEQ ID NO: 562240 - RNA, 64 nt, hsa
agacagaguugccucagguucccaggggcccgggaguccaaauacuggaauggaggguuggagg

SEQ ID NO: 562241 - RNA, 64 nt, hsa
agucacaggccagagcugccuugguauguuguuaaguccaaaacuucuucucugggcuaccuau

SEQ ID NO: 562242 - RNA, 64 nt, hsa
aucccaauauuuugucuuggugggcuuacucauaaguccaaacauuuuauucucaacaggugua

SEQ ID NO: 562243 - RNA, 64 nt, hsa
ucuaaaggaagaagcacuaaauggcagggugaucaguccaaagcauuuaugaggggagcuuaca

SEQ ID NO: 562244 - RNA, 64 nt, hsa
cuggaaacccaggaaagcugauggugcaagguccaguccaaagguaucuguuggaggauucucu

SEQ ID NO: 562245 - RNA, 64 nt, hsa
ggauuggcuuguguuguuauuauuaagucuaacaaguccaaaagcuggagugugaggcaggagg

SEQ ID NO: 562246 - RNA, 64 nt, hsa
cuuaacucauuucagcauuaacccaaaaguccgcaguccaaaguuucaucugagacaaggcaag

SEQ ID NO: 562247 - RNA, 64 nt, hsa
uuggccaacacaaaaggguaacagggcccaugcaaguccaaaauucagcagggcagucaaauuu

SEQ ID NO: 562248 - RNA, 64 nt, hsa
gaaauauuaguguuacggaagugccuaauaucccaguccaaauuuuuuuuuuuuuuuuuuuuuu

SEQ ID NO: 562249 - RNA, 64 nt, hsa
gggauuacaggugugagccaccacgccuggccccaguccaaaauauuuaaagauuguuuccuua

SEQ ID NO: 562250 - RNA, 64 nt, hsa
auugacuggccauccaauuaccauuuuuucuuucaguccaaaauaguuagacccuugcauacag

SEQ ID NO: 562251 - RNA, 64 nt, hsa
ggggcaacuaaauguaucuuuauuagugacuucuaguccaaauauaagaaacugucauguuuug

SEQ ID NO: 562252 - RNA, 64 nt, hsa
auguuuguaacuuaugaacacacgugaaguguugaguccaaaagacaaaggggcaucggcaugu

SEQ ID NO: 562253 - RNA, 64 nt, hsa
aagcgugcuuucauuuucaaguagcauaugcaagaguccaaacaggcuacccaauguuacuacu

SEQ ID NO: 562254 - RNA, 64 nt, hsa; identical to SEQ ID NO: 481345

SEQ ID NO: 562255 - RNA, 64 nt, hsa; identical to SEQ ID NO: 481346

SEQ ID NO: 562256 - RNA, 64 nt, hsa; identical to SEQ ID NO: 481347

SEQ ID NO: 562257 - RNA, 64 nt, hsa; identical to SEQ ID NO: 481348

SEQ ID NO: 562258 - RNA, 64 nt, hsa; identical to SEQ ID NO: 481349

SEQ ID NO: 562259 - RNA, 64 nt, hsa; identical to SEQ ID NO: 481350

SEQ ID NO: 562260 - RNA, 64 nt, hsa; identical to SEQ ID NO: 481351

SEQ ID NO: 562261 - RNA, 63 nt, hsa; identical to SEQ ID NO: 481352

SEQ ID NO: 562262 - RNA, 64 nt, hsa; identical to SEQ ID NO: 481353

SEQ ID NO: 562263 - RNA, 64 nt, hsa; identical to SEQ ID NO: 481354

SEQ ID NO: 562264 - RNA, 64 nt, hsa; identical to SEQ ID NO: 481355

SEQ ID NO: 562265 - RNA, 64 nt, hsa; identical to SEQ ID NO: 481356

SEQ ID NO: 562266 - RNA, 64 nt, hsa; identical to SEQ ID NO: 481357

SEQ ID NO: 562267 - RNA, 64 nt, hsa; identical to SEQ ID NO: 481358

SEQ ID NO: 562268 - RNA, 64 nt, hsa; identical to SEQ ID NO: 481359

SEQ ID NO: 562269 - RNA, 64 nt, hsa; identical to SEQ ID NO: 481360

SEQ ID NO: 562270 - RNA, 64 nt, hsa; identical to SEQ ID NO: 481361

SEQ ID NO: 562271 - RNA, 64 nt, hsa; identical to SEQ ID NO: 481362

SEQ ID NO: 562272 - RNA, 64 nt, hsa; identical to SEQ ID NO: 481363

SEQ ID NO: 562273 - RNA, 64 nt, hsa; identical to SEQ ID NO: 481364

SEQ ID NO: 562274 - RNA, 64 nt, hsa; identical to SEQ ID NO: 481365

SEQ ID NO: 562275 - RNA, 64 nt, hsa; identical to SEQ ID NO: 481366

SEQ ID NO: 562276 - RNA, 64 nt, hsa; identical to SEQ ID NO: 481367

SEQ ID NO: 562277 - RNA, 64 nt, hsa; identical to SEQ ID NO: 481368

SEQ ID NO: 562278 - RNA, 64 nt, hsa; identical to SEQ ID NO: 481369

SEQ ID NO: 562279 - RNA, 64 nt, hsa; identical to SEQ ID NO: 481370

SEQ ID NO: 562280 - RNA, 64 nt, hsa; identical to SEQ ID NO: 481371

SEQ ID NO: 562281 - RNA, 64 nt, hsa; identical to SEQ ID NO: 481372

SEQ ID NO: 562282 - RNA, 64 nt, hsa; identical to SEQ ID NO: 481373

SEQ ID NO: 562283 - RNA, 64 nt, hsa; identical to SEQ ID NO: 481374

SEQ ID NO: 562284 - RNA, 64 nt, hsa; identical to SEQ ID NO: 481375

SEQ ID NO: 562285 - RNA, 64 nt, hsa; identical to SEQ ID NO: 481376

SEQ ID NO: 562286 - RNA, 64 nt, hsa; identical to SEQ ID NO: 481377

SEQ ID NO: 562287 - RNA, 64 nt, hsa; identical to SEQ ID NO: 481378

SEQ ID NO: 562288 - RNA, 64 nt, hsa; identical to SEQ ID NO: 481379

SEQ ID NO: 562289 - RNA, 64 nt, hsa; identical to SEQ ID NO: 481380

SEQ ID NO: 562290 - RNA, 64 nt, hsa; identical to SEQ ID NO: 481381

SEQ ID NO: 562291 - RNA, 64 nt, hsa; identical to SEQ ID NO: 481382

SEQ ID NO: 562292 - RNA, 64 nt, hsa; identical to SEQ ID NO: 481383

SEQ ID NO: 562293 - RNA, 64 nt, hsa; identical to SEQ ID NO: 481384

SEQ ID NO: 562294 - RNA, 64 nt, hsa; identical to SEQ ID NO: 481385

SEQ ID NO: 562295 - RNA, 64 nt, hsa; identical to SEQ ID NO: 481386

SEQ ID NO: 562296 - RNA, 64 nt, hsa; identical to SEQ ID NO: 481387

SEQ ID NO: 562297 - RNA, 64 nt, hsa; identical to SEQ ID NO: 481388

SEQ ID NO: 562298 - RNA, 64 nt, hsa; identical to SEQ ID NO: 481389

SEQ ID NO: 562299 - RNA, 64 nt, hsa; identical to SEQ ID NO: 481390

SEQ ID NO: 562300 - RNA, 64 nt, hsa; identical to SEQ ID NO: 481391

SEQ ID NO: 562301 - RNA, 64 nt, hsa; identical to SEQ ID NO: 481392

SEQ ID NO: 562302 - RNA, 64 nt, hsa; identical to SEQ ID NO: 481393

SEQ ID NO: 562303 - RNA, 64 nt, hsa; identical to SEQ ID NO: 481394

SEQ ID NO: 562304 - RNA, 64 nt, hsa; identical to SEQ ID NO: 481395

SEQ ID NO: 562305 - RNA, 64 nt, hsa
ucagcuccccuuuaaaaaucuaagguaucuccaagcaacacaucuccauucuaguugucuugaa

SEQ ID NO: 562306 - RNA, 64 nt, hsa
agggcuuuggccaagcccuugucuucacaaauucgcaacacaacaaucagauggcaccagggac

SEQ ID NO: 562307 - RNA, 64 nt, hsa
guggcugcuuuuggcuggauucccugcacccagugcaacacacccuuuccccuucacucucccu

SEQ ID NO: 562308 - RNA, 64 nt, hsa
cuucucuggcucacccaagcucucccuuacagaggcaacacagaauuauaaggaaucagaaauc

SEQ ID NO: 562309 - RNA, 64 nt, hsa
aaauguaagagaucugguuuugaauguaaaaguugcaacacacaaacggaagucuuaaaaacuu

SEQ ID NO: 562310 - RNA, 64 nt, hsa
ucauuuuuccccccaccuuaggauggugaauguugcaacacaaugacagguuuaagucagucaa

SEQ ID NO: 562311 - RNA, 64 nt, hsa
uacccaaaagagaaaaaaaauuaagacaagccuggcaacacaccuggugaagaguaguuuacua

SEQ ID NO: 562312 - RNA, 64 nt, hsa
agagcuuagccuggagcaccuuuccuucaagccagcaacacagagcacuagguucaauucccug

SEQ ID NO: 562313 - RNA, 64 nt, hsa; identical to SEQ ID NO: 312115

SEQ ID NO: 562314 - RNA, 64 nt, hsa; identical to SEQ ID NO: 312116

SEQ ID NO: 562315 - RNA, 64 nt, hsa; identical to SEQ ID NO: 312117

SEQ ID NO: 562316 - RNA, 64 nt, hsa; identical to SEQ ID NO: 312118

SEQ ID NO: 562317 - RNA, 64 nt, hsa
cuucccacugugguaaccccccauguggcacccagggacugaaggacacagugcguggagacgg

SEQ ID NO: 562318 - RNA, 64 nt, hsa
ggaugauucuucaaagcccccuccuccaugagaggggacugaaaugcugcagcugaggcugguc

SEQ ID NO: 562319 - RNA, 64 nt, hsa
cauagacaagaaaacagauauggguuaagaguuggggacugaggagucaagagcaacggccacg

SEQ ID NO: 562320 - RNA, 64 nt, hsa
cugcugacugccagcaaagguuuguaauuaagaagggacugaaccacugcccuaaguuucuuua

SEQ ID NO: 562321 - RNA, 64 nt, hsa
gaaugaagaauuauuuccucauuuggaaguaggagggacugaagaaauucuccccaggcacugu

SEQ ID NO: 562322 - RNA, 64 nt, hsa
aggagggacugaagaaauucuccccaggcacugugggacugagaguccuauuccccuaguaaua

SEQ ID NO: 562323 - RNA, 64 nt, hsa
gguauuugcuuuguaacuccccccagguacgauagggacugaauauggacccugcugaaagcag

SEQ ID NO: 562324 - RNA, 64 nt, hsa
ccugcgauguuuacguccacaccgagcccagugugggacugacauuucucaauggaagugaaau

SEQ ID NO: 562325 - RNA, 64 nt, hsa
uggacccuguaaagggucagggugaaucagaugggggacugagcaaguagcuaugacugcagau

SEQ ID NO: 562326 - RNA, 64 nt, hsa
agcaaguagcuaugacugcagaucauguaaggaagggacugacaagaagcucccagaugcuggg

SEQ ID NO: 562327 - RNA, 64 nt, hsa; identical to SEQ ID NO: 235033

SEQ ID NO: 562328 - RNA, 64 nt, hsa; identical to SEQ ID NO: 235034

SEQ ID NO: 562329 - RNA, 64 nt, hsa; identical to SEQ ID NO: 235035

SEQ ID NO: 562330 - RNA, 64 nt, hsa; identical to SEQ ID NO: 235036

SEQ ID NO: 562331 - RNA, 64 nt, hsa; identical to SEQ ID NO: 235037

SEQ ID NO: 562332 - RNA, 64 nt, hsa; identical to SEQ ID NO: 235038

SEQ ID NO: 562333 - RNA, 64 nt, hsa; identical to SEQ ID NO: 235039

SEQ ID NO: 562334 - RNA, 64 nt, hsa; identical to SEQ ID NO: 235040

SEQ ID NO: 562335 - RNA, 64 nt, hsa; identical to SEQ ID NO: 235041

SEQ ID NO: 562336 - RNA, 64 nt, hsa; identical to SEQ ID NO: 235042

SEQ ID NO: 562337 - RNA, 62 nt, hsa
cucagaaguaugcgauguaauuaaagaaauuauuggauaaccucuacaaauaaagauagggg

SEQ ID NO: 562338 - RNA, 64 nt, hsa
ugugagacuaaaagcuuuucuuauugacuuaaauuuggauaacagcaaggugugaggggggugg

SEQ ID NO: 562339 - RNA, 64 nt, hsa
acuucguucgcagagcuuuucagauuguggaauguuggauaaggaauuauagaccucuaguagc

SEQ ID NO: 562340 - RNA, 64 nt, hsa
uguaacuuauauuaauaguaauuuguaaaguugguuggauaagcuauccguguugcagguucau

SEQ ID NO: 562341 - RNA, 64 nt, hsa
ugacuggcucccucaguccuauucuguagccuuuuuggauaaaauuggguuuuaacauaccucg

SEQ ID NO: 562342 - RNA, 64 nt, hsa
agcacuugaaaacaugacaagggcccguaguuguuuggauaagagaacuccagcauagagccuu

SEQ ID NO: 562343 - RNA, 64 nt, hsa
cacugcacuccagccugggcaacagagcgagacuccgucucaaaaaaaaaaaaaaaaaaaguaa

SEQ ID NO: 562344 - RNA, 64 nt, hsa
cacugcacuccagccugggugacagagcgagacuccgucucaaaaaacaaaaagcccguggcaa

SEQ ID NO: 562345 - RNA, 64 nt, hsa
ggccugcguggccuccugagcagcagcugaccgcccgucucaugcuggacgggaccccugggcg

SEQ ID NO: 562346 - RNA, 64 nt, hsa
ggccuacguggcugccugagcagcagcugaccgcccgucucacuguuggccagggcuuuguggc

SEQ ID NO: 562347 - RNA, 64 nt, hsa
cggucacugauucacacccagucccugccacagaccgucucagacacgcacagugggccugcug

SEQ ID NO: 562348 - RNA, 64 nt, hsa
ugcugcaugauucacacccagucccugccacagaccgucucagacacgcacagugggccugcug

SEQ ID NO: 562349 - RNA, 64 nt, hsa; identical to SEQ ID NO: 562348

SEQ ID NO: 562350 - RNA, 64 nt, hsa
aggaggggaggaacacugcacucuuaagcuuccgccgucucaaccccucacaggagcuuacugg

SEQ ID NO: 562351 - RNA, 64 nt, hsa
cacugcacuccagccugggcgacagagcgagacuccgucucaaaaaaaaaaaaaaaaaaaaaaa

SEQ ID NO: 562352 - RNA, 64 nt, hsa; identical to SEQ ID NO: 264286

SEQ ID NO: 562353 - RNA, 64 nt, hsa; identical to SEQ ID NO: 264287

SEQ ID NO: 562354 - RNA, 64 nt, hsa; identical to SEQ ID NO: 264288

SEQ ID NO: 562355 - RNA, 64 nt, hsa; identical to SEQ ID NO: 264289

SEQ ID NO: 562356 - RNA, 64 nt, hsa; identical to SEQ ID NO: 264290

SEQ ID NO: 562357 - RNA, 64 nt, hsa; identical to SEQ ID NO: 264291

SEQ ID NO: 562358 - RNA, 64 nt, hsa; identical to SEQ ID NO: 264292

SEQ ID NO: 562359 - RNA, 64 nt, hsa; identical to SEQ ID NO: 264293

SEQ ID NO: 562360 - RNA, 64 nt, hsa; identical to SEQ ID NO: 264294

SEQ ID NO: 562361 - RNA, 64 nt, hsa; identical to SEQ ID NO: 264295

SEQ ID NO: 562362 - RNA, 64 nt, hsa; identical to SEQ ID NO: 264296

SEQ ID NO: 562363 - RNA, 64 nt, hsa; identical to SEQ ID NO: 264297

SEQ ID NO: 562364 - RNA, 64 nt, hsa; identical to SEQ ID NO: 264298

SEQ ID NO: 562365 - RNA, 64 nt, hsa; identical to SEQ ID NO: 264299

SEQ ID NO: 562366 - RNA, 64 nt, hsa; identical to SEQ ID NO: 264300

SEQ ID NO: 562367 - RNA, 64 nt, hsa; identical to SEQ ID NO: 264301

SEQ ID NO: 562368 - RNA, 64 nt, hsa; identical to SEQ ID NO: 249371

SEQ ID NO: 562369 - RNA, 64 nt, hsa; identical to SEQ ID NO: 249372

SEQ ID NO: 562370 - RNA, 64 nt, hsa; identical to SEQ ID NO: 249373

SEQ ID NO: 562371 - RNA, 64 nt, hsa; identical to SEQ ID NO: 249374

SEQ ID NO: 562372 - RNA, 64 nt, hsa; identical to SEQ ID NO: 249375

SEQ ID NO: 562373 - RNA, 64 nt, hsa; identical to SEQ ID NO: 249376

SEQ ID NO: 562374 - RNA, 64 nt, hsa; identical to SEQ ID NO: 249377

SEQ ID NO: 562375 - RNA, 64 nt, hsa; identical to SEQ ID NO: 249378

SEQ ID NO: 562376 - RNA, 64 nt, hsa; identical to SEQ ID NO: 249379

SEQ ID NO: 562377 - RNA, 64 nt, hsa; identical to SEQ ID NO: 249380

SEQ ID NO: 562378 - RNA, 64 nt, hsa; identical to SEQ ID NO: 249381

SEQ ID NO: 562379 - RNA, 64 nt, hsa; identical to SEQ ID NO: 249382

SEQ ID NO: 562380 - RNA, 64 nt, hsa; identical to SEQ ID NO: 249383

SEQ ID NO: 562381 - RNA, 64 nt, hsa; identical to SEQ ID NO: 249384

SEQ ID NO: 562382 - RNA, 64 nt, hsa; identical to SEQ ID NO: 249385

SEQ ID NO: 562383 - RNA, 64 nt, hsa; identical to SEQ ID NO: 249386

SEQ ID NO: 562384 - RNA, 64 nt, hsa; identical to SEQ ID NO: 249387

SEQ ID NO: 562385 - RNA, 64 nt, hsa; identical to SEQ ID NO: 249388

SEQ ID NO: 562386 - RNA, 64 nt, hsa; identical to SEQ ID NO: 249389

SEQ ID NO: 562387 - RNA, 64 nt, hsa; identical to SEQ ID NO: 249390

SEQ ID NO: 562388 - RNA, 63 nt, hsa; identical to SEQ ID NO: 249391

SEQ ID NO: 562389 - RNA, 64 nt, hsa; identical to SEQ ID NO: 249392

SEQ ID NO: 562390 - RNA, 64 nt, hsa; identical to SEQ ID NO: 249393

SEQ ID NO: 562391 - RNA, 64 nt, hsa; identical to SEQ ID NO: 249394

SEQ ID NO: 562392 - RNA, 64 nt, hsa; identical to SEQ ID NO: 249395

SEQ ID NO: 562393 - RNA, 64 nt, hsa; identical to SEQ ID NO: 249396

SEQ ID NO: 562394 - RNA, 64 nt, hsa; identical to SEQ ID NO: 249397

SEQ ID NO: 562395 - RNA, 64 nt, hsa; identical to SEQ ID NO: 249398

SEQ ID NO: 562396 - RNA, 64 nt, hsa; identical to SEQ ID NO: 249399

SEQ ID NO: 562397 - RNA, 64 nt, hsa; identical to SEQ ID NO: 249400

SEQ ID NO: 562398 - RNA, 64 nt, hsa; identical to SEQ ID NO: 249401

SEQ ID NO: 562399 - RNA, 64 nt, hsa; identical to SEQ ID NO: 249402

SEQ ID NO: 562400 - RNA, 64 nt, hsa; identical to SEQ ID NO: 249403

SEQ ID NO: 562401 - RNA, 64 nt, hsa; identical to SEQ ID NO: 249404

SEQ ID NO: 562402 - RNA, 64 nt, hsa; identical to SEQ ID NO: 249405

SEQ ID NO: 562403 - RNA, 64 nt, hsa; identical to SEQ ID NO: 249406

SEQ ID NO: 562404 - RNA, 64 nt, hsa; identical to SEQ ID NO: 249407

SEQ ID NO: 562405 - RNA, 64 nt, hsa; identical to SEQ ID NO: 249408

SEQ ID NO: 562406 - RNA, 64 nt, hsa; identical to SEQ ID NO: 249409

SEQ ID NO: 562407 - RNA, 64 nt, hsa; identical to SEQ ID NO: 249410

SEQ ID NO: 562408 - RNA, 64 nt, hsa; identical to SEQ ID NO: 249411

SEQ ID NO: 562409 - RNA, 64 nt, hsa; identical to SEQ ID NO: 249412

SEQ ID NO: 562410 - RNA, 64 nt, hsa; identical to SEQ ID NO: 249413

SEQ ID NO: 562411 - RNA, 64 nt, hsa; identical to SEQ ID NO: 249414

SEQ ID NO: 562412 - RNA, 64 nt, hsa; identical to SEQ ID NO: 249415

SEQ ID NO: 562413 - RNA, 64 nt, hsa; identical to SEQ ID NO: 249416

SEQ ID NO: 562414 - RNA, 64 nt, hsa; identical to SEQ ID NO: 249417

SEQ ID NO: 562415 - RNA, 64 nt, hsa; identical to SEQ ID NO: 249418

SEQ ID NO: 562416 - RNA, 64 nt, hsa; identical to SEQ ID NO: 249419

SEQ ID NO: 562417 - RNA, 64 nt, hsa; identical to SEQ ID NO: 249420

SEQ ID NO: 562418 - RNA, 64 nt, hsa; identical to SEQ ID NO: 249421

SEQ ID NO: 562419 - RNA, 64 nt, hsa; identical to SEQ ID NO: 249422

SEQ ID NO: 562420 - RNA, 64 nt, hsa; identical to SEQ ID NO: 249423

SEQ ID NO: 562421 - RNA, 59 nt, hsa; identical to SEQ ID NO: 249424

SEQ ID NO: 562422 - RNA, 64 nt, hsa
gaaugaaguaguuuguuucauagcuugucucauugaauaguauuauugaagauacuaaaugaug

SEQ ID NO: 562423 - RNA, 64 nt, hsa
acaaugucuugauaauucuaccuuuuuagagcaagaauaguaucugcuaauguaagggacaucu

SEQ ID NO: 562424 - RNA, 64 nt, hsa
aaugaugucgucucugaagugggaauauuuuacagaauaguaaaaugcuuccaggaacuacaag

SEQ ID NO: 562425 - RNA, 64 nt, hsa
gaguucaaagucuuccauuuuacuugagaaaaaugaauaguaaaugucucuaaacaggcagcau

SEQ ID NO: 562426 - RNA, 64 nt, hsa
auugacaaagaaauuguuacauauauaauuuccagaauaguaacucaggaguucaaagucuucc

SEQ ID NO: 562427 - RNA, 64 nt, hsa
auguuuguucuuuuuucagcaaaauacuucaaaugaauaguauuaacuuacaaaaagucacaaa

SEQ ID NO: 562428 - RNA, 64 nt, hsa
uguauguauugauuucuaggaacccccaaaaggagaauaguaaaaaaagaucauacuuaaaauu

SEQ ID NO: 562429 - RNA, 64 nt, hsa
agauuagcaaauguuaauuccuagcucaaacugugaauaguaaggauugaaaaguaaaguaugu

SEQ ID NO: 562430 - RNA, 64 nt, hsa
uuaaagcugaaauaaccagcuccauucuuuucaugaauaguaaguugauauauuuauuuaucag

SEQ ID NO: 562431 - RNA, 64 nt, hsa; identical to SEQ ID NO: 60102

SEQ ID NO: 562432 - RNA, 64 nt, hsa; identical to SEQ ID NO: 60103

SEQ ID NO: 562433 - RNA, 64 nt, hsa; identical to SEQ ID NO: 60104

SEQ ID NO: 562434 - RNA, 64 nt, hsa; identical to SEQ ID NO: 60105

SEQ ID NO: 562435 - RNA, 64 nt, hsa; identical to SEQ ID NO: 60106

SEQ ID NO: 562436 - RNA, 64 nt, hsa; identical to SEQ ID NO: 60107

SEQ ID NO: 562437 - RNA, 64 nt, hsa; identical to SEQ ID NO: 60108

SEQ ID NO: 562438 - RNA, 64 nt, hsa; identical to SEQ ID NO: 60109

SEQ ID NO: 562439 - RNA, 64 nt, hsa; identical to SEQ ID NO: 60110

SEQ ID NO: 562440 - RNA, 64 nt, hsa; identical to SEQ ID NO: 60111

SEQ ID NO: 562441 - RNA, 64 nt, hsa; identical to SEQ ID NO: 60112

SEQ ID NO: 562442 - RNA, 64 nt, hsa; identical to SEQ ID NO: 60113

SEQ ID NO: 562443 - RNA, 64 nt, hsa; identical to SEQ ID NO: 60114

SEQ ID NO: 562444 - RNA, 64 nt, hsa; identical to SEQ ID NO: 60115

SEQ ID NO: 562445 - RNA, 64 nt, hsa; identical to SEQ ID NO: 60116

SEQ ID NO: 562446 - RNA, 64 nt, hsa; identical to SEQ ID NO: 60117

SEQ ID NO: 562447 - RNA, 64 nt, hsa; identical to SEQ ID NO: 60118

SEQ ID NO: 562448 - RNA, 64 nt, hsa; identical to SEQ ID NO: 60119

SEQ ID NO: 562449 - RNA, 64 nt, hsa; identical to SEQ ID NO: 60120

SEQ ID NO: 562450 - RNA, 64 nt, hsa; identical to SEQ ID NO: 60121

SEQ ID NO: 562451 - RNA, 64 nt, hsa; identical to SEQ ID NO: 60122

SEQ ID NO: 562452 - RNA, 64 nt, hsa; identical to SEQ ID NO: 60123

SEQ ID NO: 562453 - RNA, 64 nt, hsa; identical to SEQ ID NO: 60124

SEQ ID NO: 562454 - RNA, 64 nt, hsa; identical to SEQ ID NO: 60125

SEQ ID NO: 562455 - RNA, 64 nt, hsa; identical to SEQ ID NO: 60126

SEQ ID NO: 562456 - RNA, 64 nt, hsa; identical to SEQ ID NO: 60127

SEQ ID NO: 562457 - RNA, 64 nt, hsa; identical to SEQ ID NO: 60128

SEQ ID NO: 562458 - RNA, 64 nt, hsa; identical to SEQ ID NO: 60129

SEQ ID NO: 562459 - RNA, 64 nt, hsa; identical to SEQ ID NO: 60130

SEQ ID NO: 562460 - RNA, 64 nt, hsa; identical to SEQ ID NO: 60131

SEQ ID NO: 562461 - RNA, 64 nt, hsa; identical to SEQ ID NO: 60132

SEQ ID NO: 562462 - RNA, 64 nt, hsa; identical to SEQ ID NO: 60133

SEQ ID NO: 562463 - RNA, 64 nt, hsa; identical to SEQ ID NO: 60134

SEQ ID NO: 562464 - RNA, 64 nt, hsa; identical to SEQ ID NO: 60135

SEQ ID NO: 562465 - RNA, 64 nt, hsa; identical to SEQ ID NO: 60136

SEQ ID NO: 562466 - RNA, 64 nt, hsa; identical to SEQ ID NO: 60137

SEQ ID NO: 562467 - RNA, 64 nt, hsa; identical to SEQ ID NO: 60138

SEQ ID NO: 562468 - RNA, 64 nt, hsa; identical to SEQ ID NO: 60139

SEQ ID NO: 562469 - RNA, 64 nt, hsa; identical to SEQ ID NO: 60140

SEQ ID NO: 562470 - RNA, 64 nt, hsa; identical to SEQ ID NO: 60141

SEQ ID NO: 562471 - RNA, 64 nt, hsa; identical to SEQ ID NO: 60142

SEQ ID NO: 562472 - RNA, 64 nt, hsa; identical to SEQ ID NO: 60143

SEQ ID NO: 562473 - RNA, 64 nt, hsa; identical to SEQ ID NO: 60144

SEQ ID NO: 562474 - RNA, 64 nt, hsa; identical to SEQ ID NO: 60145

SEQ ID NO: 562475 - RNA, 64 nt, hsa; identical to SEQ ID NO: 60146

SEQ ID NO: 562476 - RNA, 64 nt, hsa; identical to SEQ ID NO: 60147

SEQ ID NO: 562477 - RNA, 64 nt, hsa; identical to SEQ ID NO: 60148

SEQ ID NO: 562478 - RNA, 64 nt, hsa; identical to SEQ ID NO: 60149

SEQ ID NO: 562479 - RNA, 64 nt, hsa; identical to SEQ ID NO: 60150

SEQ ID NO: 562480 - RNA, 64 nt, hsa; identical to SEQ ID NO: 60151

SEQ ID NO: 562481 - RNA, 64 nt, hsa; identical to SEQ ID NO: 60152

SEQ ID NO: 562482 - RNA, 64 nt, hsa; identical to SEQ ID NO: 60153

SEQ ID NO: 562483 - RNA, 64 nt, hsa; identical to SEQ ID NO: 60154

SEQ ID NO: 562484 - RNA, 64 nt, hsa; identical to SEQ ID NO: 60155

SEQ ID NO: 562485 - RNA, 64 nt, hsa; identical to SEQ ID NO: 60156

SEQ ID NO: 562486 - RNA, 64 nt, hsa; identical to SEQ ID NO: 60157

SEQ ID NO: 562487 - RNA, 64 nt, hsa; identical to SEQ ID NO: 60158

SEQ ID NO: 562488 - RNA, 64 nt, hsa; identical to SEQ ID NO: 60159

SEQ ID NO: 562489 - RNA, 64 nt, hsa; identical to SEQ ID NO: 60160

SEQ ID NO: 562490 - RNA, 64 nt, hsa; identical to SEQ ID NO: 60161

SEQ ID NO: 562491 - RNA, 64 nt, hsa; identical to SEQ ID NO: 60162

SEQ ID NO: 562492 - RNA, 64 nt, hsa; identical to SEQ ID NO: 60163

SEQ ID NO: 562493 - RNA, 64 nt, hsa; identical to SEQ ID NO: 60164

SEQ ID NO: 562494 - RNA, 64 nt, hsa; identical to SEQ ID NO: 60165

SEQ ID NO: 562495 - RNA, 64 nt, hsa; identical to SEQ ID NO: 60166

SEQ ID NO: 562496 - RNA, 64 nt, hsa; identical to SEQ ID NO: 60167

SEQ ID NO: 562497 - RNA, 64 nt, hsa; identical to SEQ ID NO: 60168

SEQ ID NO: 562498 - RNA, 64 nt, hsa; identical to SEQ ID NO: 60169

SEQ ID NO: 562499 - RNA, 64 nt, hsa; identical to SEQ ID NO: 60170

SEQ ID NO: 562500 - RNA, 64 nt, hsa; identical to SEQ ID NO: 60171

SEQ ID NO: 562501 - RNA, 64 nt, hsa; identical to SEQ ID NO: 383060

SEQ ID NO: 562502 - RNA, 64 nt, hsa; identical to SEQ ID NO: 383061

SEQ ID NO: 562503 - RNA, 64 nt, hsa; identical to SEQ ID NO: 383062

SEQ ID NO: 562504 - RNA, 64 nt, hsa; identical to SEQ ID NO: 383063

SEQ ID NO: 562505 - RNA, 64 nt, hsa; identical to SEQ ID NO: 383064

SEQ ID NO: 562506 - RNA, 64 nt, hsa; identical to SEQ ID NO: 383065

SEQ ID NO: 562507 - RNA, 64 nt, hsa; identical to SEQ ID NO: 383066

SEQ ID NO: 562508 - RNA, 64 nt, hsa; identical to SEQ ID NO: 383067

SEQ ID NO: 562509 - RNA, 64 nt, hsa; identical to SEQ ID NO: 383068

SEQ ID NO: 562510 - RNA, 64 nt, hsa; identical to SEQ ID NO: 383069

SEQ ID NO: 562511 - RNA, 64 nt, hsa; identical to SEQ ID NO: 383070

SEQ ID NO: 562512 - RNA, 64 nt, hsa; identical to SEQ ID NO: 383071

SEQ ID NO: 562513 - RNA, 64 nt, hsa; identical to SEQ ID NO: 383072

SEQ ID NO: 562514 - RNA, 64 nt, hsa; identical to SEQ ID NO: 383073

SEQ ID NO: 562515 - RNA, 64 nt, hsa; identical to SEQ ID NO: 383074

SEQ ID NO: 562516 - RNA, 64 nt, hsa; identical to SEQ ID NO: 383075

SEQ ID NO: 562517 - RNA, 64 nt, hsa; identical to SEQ ID NO: 383076

SEQ ID NO: 562518 - RNA, 64 nt, hsa; identical to SEQ ID NO: 383077

SEQ ID NO: 562519 - RNA, 64 nt, hsa; identical to SEQ ID NO: 383078

SEQ ID NO: 562520 - RNA, 51 nt, hsa; identical to SEQ ID NO: 111105

SEQ ID NO: 562521 - RNA, 64 nt, hsa; identical to SEQ ID NO: 383080

SEQ ID NO: 562522 - RNA, 64 nt, hsa; identical to SEQ ID NO: 383081

SEQ ID NO: 562523 - RNA, 64 nt, hsa; identical to SEQ ID NO: 383082

SEQ ID NO: 562524 - RNA, 64 nt, hsa; identical to SEQ ID NO: 383083

SEQ ID NO: 562525 - RNA, 64 nt, hsa; identical to SEQ ID NO: 383084

SEQ ID NO: 562526 - RNA, 64 nt, hsa; identical to SEQ ID NO: 383085

SEQ ID NO: 562527 - RNA, 64 nt, hsa; identical to SEQ ID NO: 383086

SEQ ID NO: 562528 - RNA, 64 nt, hsa; identical to SEQ ID NO: 383087

SEQ ID NO: 562529 - RNA, 64 nt, hsa; identical to SEQ ID NO: 383088

SEQ ID NO: 562530 - RNA, 64 nt, hsa; identical to SEQ ID NO: 383089

SEQ ID NO: 562531 - RNA, 64 nt, hsa; identical to SEQ ID NO: 383090

SEQ ID NO: 562532 - RNA, 64 nt, hsa; identical to SEQ ID NO: 383091

SEQ ID NO: 562533 - RNA, 64 nt, hsa; identical to SEQ ID NO: 383092

SEQ ID NO: 562534 - RNA, 64 nt, hsa; identical to SEQ ID NO: 383093

SEQ ID NO: 562535 - RNA, 64 nt, hsa; identical to SEQ ID NO: 383094

SEQ ID NO: 562536 - RNA, 64 nt, hsa; identical to SEQ ID NO: 383095

SEQ ID NO: 562537 - RNA, 64 nt, hsa; identical to SEQ ID NO: 247680

SEQ ID NO: 562538 - RNA, 64 nt, hsa; identical to SEQ ID NO: 247681

SEQ ID NO: 562539 - RNA, 64 nt, hsa; identical to SEQ ID NO: 247682

SEQ ID NO: 562540 - RNA, 64 nt, hsa; identical to SEQ ID NO: 247683

SEQ ID NO: 562541 - RNA, 64 nt, hsa; identical to SEQ ID NO: 247684

SEQ ID NO: 562542 - RNA, 64 nt, hsa; identical to SEQ ID NO: 247685

SEQ ID NO: 562543 - RNA, 64 nt, hsa; identical to SEQ ID NO: 247686

SEQ ID NO: 562544 - RNA, 64 nt, hsa; identical to SEQ ID NO: 247687

SEQ ID NO: 562545 - RNA, 64 nt, hsa; identical to SEQ ID NO: 247688

SEQ ID NO: 562546 - RNA, 64 nt, hsa; identical to SEQ ID NO: 247689

SEQ ID NO: 562547 - RNA, 64 nt, hsa; identical to SEQ ID NO: 247690

SEQ ID NO: 562548 - RNA, 64 nt, hsa; identical to SEQ ID NO: 247691

SEQ ID NO: 562549 - RNA, 64 nt, hsa; identical to SEQ ID NO: 247692

SEQ ID NO: 562550 - RNA, 64 nt, hsa; identical to SEQ ID NO: 247693

SEQ ID NO: 562551 - RNA, 64 nt, hsa; identical to SEQ ID NO: 247694

SEQ ID NO: 562552 - RNA, 64 nt, hsa; identical to SEQ ID NO: 247695

SEQ ID NO: 562553 - RNA, 64 nt, hsa; identical to SEQ ID NO: 247696

SEQ ID NO: 562554 - RNA, 64 nt, hsa; identical to SEQ ID NO: 247697

SEQ ID NO: 562555 - RNA, 62 nt, hsa
auucauguggccuuacgggauggugggucugggaccccaauucauucuuaucugccaaagaa

SEQ ID NO: 562556 - RNA, 62 nt, hsa
ugggucagggacuccaggccaaguccaacagagaccccaaacccaccacacaccagcagcca

SEQ ID NO: 562557 - RNA, 62 nt, hsa
gucugaaaggccaacccgaggcuggcagaucugaccccaaggagguccugcugcaaaccccc

SEQ ID NO: 562558 - RNA, 62 nt, hsa
uaagugggccuuuaaaaaccccagcugccagagaccccaacacuaagcccuaaaucugcuga

SEQ ID NO: 562559 - RNA, 62 nt, hsa
ccaacugggcgcccguccccagccccacgcacgaccccaagcccgcggaggcaccgaugccc

SEQ ID NO: 562560 - RNA, 62 nt, hsa
caaccagccacucccgguggggacacagcacagaccccaaagccaggaaccucucagccgau

SEQ ID NO: 562561 - RNA, 62 nt, hsa
cccugugcccucaaguccuacagccccuagaagaccccaaugccguaacuccuaggaccccc

SEQ ID NO: 562562 - RNA, 62 nt, hsa
uauuuuuuaaguaacgacuucccccuuugggggaccccaaaauuuggaggccccauucuagg

SEQ ID NO: 562563 - RNA, 62 nt, hsa
acaguaugugagugucuggagacagcauagcugaccccaaucccccagggcugaggaccccu

SEQ ID NO: 562564 - RNA, 62 nt, hsa
agcaccugcuggcugcuggaagcauaccccaagaccccaagccuugacuccagcugcgccca

SEQ ID NO: 562565 - RNA, 64 nt, hsa
gugaacccaggauaugaauuuuugcaucuucccauugucgaauuagucuccagccucuaaauaa

SEQ ID NO: 562566 - RNA, 64 nt, hsa
aagccucggguucuuucaagcuacauguacuaaauugucgaaggucucccaggagcucuguacu

SEQ ID NO: 562567 - RNA, 64 nt, hsa
cugucaacguaacgauuucaugaacguuauuauauugucgaauuccuacugacaacauuauaac

SEQ ID NO: 562568 - RNA, 64 nt, hsa
ccagacauggacccuaaaucaacagacaauggcauugucgaagagcaaccuguuaaugaaucau

SEQ ID NO: 562569 - RNA, 64 nt, hsa
ugugucuguuugauguggugugauugugcuggccuugucgaaaaagaugugaugcuucucagaa

SEQ ID NO: 562570 - RNA, 64 nt, hsa
ugaccaaaugccgccaaccccgagggccaguuucuugucgaauugguacgggcucucuggggcu

SEQ ID NO: 562571 - RNA, 64 nt, hsa
augaccaaguacauaauggauuuaguaauaaauauugucgaauugcuaaaaagucuucaaucau

SEQ ID NO: 562572 - RNA, 64 nt, hsa
acuuuaauuuucagcucgaagacgcgacguccauuugucgaaagaacaggagagccgccuaccc

SEQ ID NO: 562573 - RNA, 64 nt, hsa
ugucucuuuggguucuuucuguuugaaaggauauuugucgaaaaaaagagcaaaaccguuuuaa

SEQ ID NO: 562574 - RNA, 64 nt, hsa
gaugugacccuccaggguuugggucgcuuugcguuugucgaagccuccucugaauggcuuugug

SEQ ID NO: 562575 - RNA, 64 nt, hsa
ggaaaaagugaggguuggggauaaggguugcggguugucgaaggguggauuuucuccuucagca

SEQ ID NO: 562576 - RNA, 64 nt, hsa
aaauuaucuuguaaguagcuugucaucaauccccuugucgaaaacuagaaaaaaaggaguugac

SEQ ID NO: 562577 - RNA, 64 nt, hsa
uuacgucagaugccucuaaggaaaauacacuagguugucgaaauaauaauuccacagccucuuc

SEQ ID NO: 562578 - RNA, 64 nt, hsa
guggaaccgaugcaaguuucagcaaagggcagucuugucgaaucgcugcagcagcuuucuuuca

SEQ ID NO: 562579 - RNA, 64 nt, hsa
uugaaauaaagauacuaugcaagaaaauguacaguugucgaaguggagaaaaugaggauauauu

SEQ ID NO: 562580 - RNA, 64 nt, hsa
guagaaucuccuuucugcgucgucauauuugaacuugucgaaccagaucuucucauguacuagg

SEQ ID NO: 562581 - RNA, 64 nt, hsa
cggaccaaacagugcucaugcuucaggaccuuguuugucgaagauguugguuucccuuucucug

SEQ ID NO: 562582 - RNA, 64 nt, hsa
auauugaaugcaggaggcggggguaguuuauaccuugucgaaucauaccagauuauuaaaugug

SEQ ID NO: 562583 - RNA, 64 nt, hsa
caaagguaucugaauaauuuuucaugugcaucuuuugucgaauguuuugguucaagaaagaaug

SEQ ID NO: 562584 - RNA, 64 nt, hsa
aaacggucaggccacgugacuaaaaacuguccuguugucgaagcuucuccccugggccgccggg

SEQ ID NO: 562585 - RNA, 64 nt, hsa
augccuggcagcuagagcaaauggcucguguucuuugucgaaggccuguggugagauuguuuug

SEQ ID NO: 562586 - RNA, 64 nt, hsa
cgcccacccgccuuuuauaaaccucuaauuuauuuugucgaauuuuuauuauuuguuuucccgc

SEQ ID NO: 562587 - RNA, 64 nt, hsa
ugcuuauaacuggagaucuuuuggcuuuucuauguugucgaauguaaugucugagacuagcuaa

SEQ ID NO: 562588 - RNA, 64 nt, hsa
uuuuaaauguucuuaguuuuaaaauuucaacugauugucgaaaggguaauaugaaagauuuuaa

SEQ ID NO: 562589 - RNA, 64 nt, hsa
aaaaguaauuuaguuacauucuuaaacaaugacauugucgaaagaaaguucuuauaagcuguuu

SEQ ID NO: 562590 - RNA, 64 nt, hsa
aaaagaagaaaagcaaucucgcaguacauguuacuugucgaaaaaauuccggacaagacuaccc

SEQ ID NO: 562591 - RNA, 64 nt, hsa
gacaaguagauucuucgacugaggaaucuaccaguugucgaagaugauccguuagugauguucu

SEQ ID NO: 562592 - RNA, 64 nt, hsa
cucacaggacacagccauccagcggcaucuuuccuugucgaaugauacuguaaugaccuuccaa

SEQ ID NO: 562593 - RNA, 64 nt, hsa
aggcggcgcccacccgcugcccgaggugcucuguuugucgaaacacaguaauauuuguauuugg

SEQ ID NO: 562594 - RNA, 64 nt, hsa
gagggcccuuaaaggaaggcagcaggaaucagucuugucgaacaggggggcgugguucucgucg

SEQ ID NO: 562595 - RNA, 64 nt, hsa
acgugcagcagaugcaaaggguucuagcugcaguuugucgaauugagguuuuagguaaagcaua

SEQ ID NO: 562596 - RNA, 64 nt, hsa
caucuucugguuuaaacuuguuugcugugaacaauugucgaaaagagucuuccaauuaaugcuu

SEQ ID NO: 562597 - RNA, 64 nt, hsa
gcaguuuugugccuuuauguauuugccuuguucuuugucgaaugugugaaauuccguacugugg

SEQ ID NO: 562598 - RNA, 64 nt, hsa
ccaguuugauuuauuuuaauuguugauacuuaaguugucgaacaguagacauuacuuguuuuau

SEQ ID NO: 562599 - RNA, 64 nt, hsa; identical to SEQ ID NO: 494526

SEQ ID NO: 562600 - RNA, 64 nt, hsa; identical to SEQ ID NO: 494527

SEQ ID NO: 562601 - RNA, 64 nt, hsa; identical to SEQ ID NO: 494528

SEQ ID NO: 562602 - RNA, 64 nt, hsa; identical to SEQ ID NO: 494529

SEQ ID NO: 562603 - RNA, 64 nt, hsa; identical to SEQ ID NO: 494530

SEQ ID NO: 562604 - RNA, 64 nt, hsa; identical to SEQ ID NO: 494531

SEQ ID NO: 562605 - RNA, 64 nt, hsa; identical to SEQ ID NO: 494532

SEQ ID NO: 562606 - RNA, 64 nt, hsa; identical to SEQ ID NO: 494533

SEQ ID NO: 562607 - RNA, 64 nt, hsa; identical to SEQ ID NO: 494534

SEQ ID NO: 562608 - RNA, 64 nt, hsa; identical to SEQ ID NO: 494535

SEQ ID NO: 562609 - RNA, 64 nt, hsa; identical to SEQ ID NO: 494536

SEQ ID NO: 562610 - RNA, 64 nt, hsa; identical to SEQ ID NO: 494537

SEQ ID NO: 562611 - RNA, 64 nt, hsa; identical to SEQ ID NO: 494538

SEQ ID NO: 562612 - RNA, 64 nt, hsa; identical to SEQ ID NO: 494539

SEQ ID NO: 562613 - RNA, 64 nt, hsa; identical to SEQ ID NO: 494540

SEQ ID NO: 562614 - RNA, 64 nt, hsa; identical to SEQ ID NO: 494541

SEQ ID NO: 562615 - RNA, 64 nt, hsa; identical to SEQ ID NO: 209092

SEQ ID NO: 562616 - RNA, 64 nt, hsa; identical to SEQ ID NO: 209093

SEQ ID NO: 562617 - RNA, 64 nt, hsa; identical to SEQ ID NO: 209094

SEQ ID NO: 562618 - RNA, 64 nt, hsa; identical to SEQ ID NO: 209095

SEQ ID NO: 562619 - RNA, 64 nt, hsa; identical to SEQ ID NO: 209096

SEQ ID NO: 562620 - RNA, 64 nt, hsa; identical to SEQ ID NO: 209097

SEQ ID NO: 562621 - RNA, 64 nt, hsa; identical to SEQ ID NO: 209098

SEQ ID NO: 562622 - RNA, 64 nt, hsa; identical to SEQ ID NO: 209099

SEQ ID NO: 562623 - RNA, 64 nt, hsa; identical to SEQ ID NO: 209100

SEQ ID NO: 562624 - RNA, 64 nt, hsa; identical to SEQ ID NO: 209101

SEQ ID NO: 562625 - RNA, 64 nt, hsa; identical to SEQ ID NO: 209102

SEQ ID NO: 562626 - RNA, 64 nt, hsa; identical to SEQ ID NO: 209103

SEQ ID NO: 562627 - RNA, 64 nt, hsa; identical to SEQ ID NO: 209104

SEQ ID NO: 562628 - RNA, 64 nt, hsa; identical to SEQ ID NO: 209105

SEQ ID NO: 562629 - RNA, 64 nt, hsa; identical to SEQ ID NO: 209106

SEQ ID NO: 562630 - RNA, 64 nt, hsa; identical to SEQ ID NO: 209107

SEQ ID NO: 562631 - RNA, 64 nt, hsa; identical to SEQ ID NO: 209108

SEQ ID NO: 562632 - RNA, 64 nt, hsa; identical to SEQ ID NO: 209109

SEQ ID NO: 562633 - RNA, 64 nt, hsa; identical to SEQ ID NO: 209110

SEQ ID NO: 562634 - RNA, 64 nt, hsa; identical to SEQ ID NO: 209111

SEQ ID NO: 562635 - RNA, 64 nt, hsa; identical to SEQ ID NO: 209112

SEQ ID NO: 562636 - RNA, 64 nt, hsa; identical to SEQ ID NO: 209113

SEQ ID NO: 562637 - RNA, 59 nt, hsa; identical to SEQ ID NO: 209114

SEQ ID NO: 562638 - RNA, 64 nt, hsa; identical to SEQ ID NO: 209115

SEQ ID NO: 562639 - RNA, 64 nt, hsa; identical to SEQ ID NO: 209116

SEQ ID NO: 562640 - RNA, 64 nt, hsa; identical to SEQ ID NO: 209117

SEQ ID NO: 562641 - RNA, 64 nt, hsa; identical to SEQ ID NO: 209118

SEQ ID NO: 562642 - RNA, 64 nt, hsa; identical to SEQ ID NO: 209119

SEQ ID NO: 562643 - RNA, 64 nt, hsa; identical to SEQ ID NO: 209120

SEQ ID NO: 562644 - RNA, 64 nt, hsa; identical to SEQ ID NO: 209121

SEQ ID NO: 562645 - RNA, 64 nt, hsa; identical to SEQ ID NO: 209122

SEQ ID NO: 562646 - RNA, 64 nt, hsa; identical to SEQ ID NO: 209123

SEQ ID NO: 562647 - RNA, 64 nt, hsa; identical to SEQ ID NO: 209124

SEQ ID NO: 562648 - RNA, 64 nt, hsa; identical to SEQ ID NO: 209125

SEQ ID NO: 562649 - RNA, 64 nt, hsa; identical to SEQ ID NO: 209126

SEQ ID NO: 562650 - RNA, 64 nt, hsa; identical to SEQ ID NO: 209127

SEQ ID NO: 562651 - RNA, 64 nt, hsa; identical to SEQ ID NO: 209128

SEQ ID NO: 562652 - RNA, 64 nt, hsa; identical to SEQ ID NO: 209129

SEQ ID NO: 562653 - RNA, 64 nt, hsa; identical to SEQ ID NO: 209130

SEQ ID NO: 562654 - RNA, 64 nt, hsa; identical to SEQ ID NO: 209131

SEQ ID NO: 562655 - RNA, 64 nt, hsa; identical to SEQ ID NO: 209132

SEQ ID NO: 562656 - RNA, 64 nt, hsa; identical to SEQ ID NO: 209133

SEQ ID NO: 562657 - RNA, 64 nt, hsa; identical to SEQ ID NO: 209134

SEQ ID NO: 562658 - RNA, 64 nt, hsa; identical to SEQ ID NO: 209135

SEQ ID NO: 562659 - RNA, 64 nt, hsa; identical to SEQ ID NO: 209136

SEQ ID NO: 562660 - RNA, 64 nt, hsa; identical to SEQ ID NO: 209137

SEQ ID NO: 562661 - RNA, 64 nt, hsa; identical to SEQ ID NO: 209138

SEQ ID NO: 562662 - RNA, 64 nt, hsa; identical to SEQ ID NO: 209139

SEQ ID NO: 562663 - RNA, 64 nt, hsa; identical to SEQ ID NO: 209140

SEQ ID NO: 562664 - RNA, 64 nt, hsa; identical to SEQ ID NO: 209141

SEQ ID NO: 562665 - RNA, 64 nt, hsa; identical to SEQ ID NO: 209142

SEQ ID NO: 562666 - RNA, 64 nt, hsa; identical to SEQ ID NO: 209143

SEQ ID NO: 562667 - RNA, 64 nt, hsa; identical to SEQ ID NO: 209144

SEQ ID NO: 562668 - RNA, 64 nt, hsa; identical to SEQ ID NO: 209145

SEQ ID NO: 562669 - RNA, 64 nt, hsa
acacuaaaccuaggucuggucaccaauaggguuuggagagcaaagggccacaacucaucagcug

SEQ ID NO: 562670 - RNA, 64 nt, hsa
acuccccucuaccaaucccuggcacaggguuccuggagagcaggugcuguacauuuuacagcuu

SEQ ID NO: 562671 - RNA, 64 nt, hsa
gaggcuguggcggacacucucgggguugucugcaggagagcaagccaggaggacaugggccugg

SEQ ID NO: 562672 - RNA, 64 nt, hsa
cagguggcaacaaugccccgagugguggcagccaggagagcagcgcagaacagcccagaaaagg

SEQ ID NO: 562673 - RNA, 64 nt, hsa
guguguuggucuauaugacagggaggagaguaaaggagagcaggagcaauuggcugccugcaaa

SEQ ID NO: 562674 - RNA, 64 nt, hsa
ggaucuuggucuguuuuucuugugggagccuaguggagagcagacguggcuuuuuaugugucuu

SEQ ID NO: 562675 - RNA, 64 nt, hsa
ccuagagcagacccuuuagaaaucagcccaagggggagagcaagagaaaacacucuagggagua

SEQ ID NO: 562676 - RNA, 64 nt, hsa
aagggcccaucgauucccuacuaaugagaggcagggagagcaugggcaauggagacccaccaau

SEQ ID NO: 562677 - RNA, 64 nt, hsa
ggcccucaggcuuuucucagacaugcgggagccaggagagcacccuucuccacucagcuccaaa

SEQ ID NO: 562678 - RNA, 64 nt, hsa
ucagccuaaccucuccuggccaaucccccccgccggagagcaggacacuagggaggacccccag

SEQ ID NO: 562679 - RNA, 64 nt, hsa
uuuguacuuucucugugggugccaguuaaauauuggagagcaaggaauguggacuuguauggcu

SEQ ID NO: 562680 - RNA, 64 nt, hsa
aauuaauguugacuguuuuagauuguaagcuccuggagagcaguauugcuguaguaggaauguu

SEQ ID NO: 562681 - RNA, 64 nt, hsa
gagacucacgucccccagggcaagugcuuguggaggagagcaagucucaagagcgcaguauuug

SEQ ID NO: 562682 - RNA, 64 nt, hsa
cagugccgggcugggcucugcggugcgguccacgggagagcaggccuccagcuggaaaggccag

SEQ ID NO: 562683 - RNA, 64 nt, hsa
gcagugugaguagaaggaagucaacaauauguggggagagcacucgguugucuuuacuuuuaaa

SEQ ID NO: 562684 - RNA, 64 nt, hsa
uguaauauuuuggacugcuguuuuccauuaaugaggagagcaacaggccccugauuauacaguu

SEQ ID NO: 562685 - RNA, 64 nt, hsa
aauccuacccccucuucaaagcagagugggacuuggagagcaaaggcccaugcccccuucgcuc

SEQ ID NO: 562686 - RNA, 64 nt, hsa
cccaucagcucccaacgagccuccucaggggguaggagagcacugccucuaugcccugcagagc

SEQ ID NO: 562687 - RNA, 64 nt, hsa
cagccugauguguuuacaugguacuguauguaugggagagcagacugcacccuccagcaacaac

SEQ ID NO: 562688 - RNA, 64 nt, hsa
cacugacucuuccacccuuuuuuuuucugggaaaggagagcaagaggucccgaguccccuccua

SEQ ID NO: 562689 - RNA, 64 nt, hsa
uuucuuuuuuuucuuucguuccuuuuuugaaacaggagagcaaagcaguuagaguucagaggcc

SEQ ID NO: 562690 - RNA, 64 nt, hsa
cucaggcuaugccauggcagcugcagaggcccagggagagcagcaggaagauagccuggagaag

SEQ ID NO: 562691 - RNA, 64 nt, hsa
gugaggggccccgccagcccgauggggaugaggaggagagcacagcccucagcaucaacgagga

SEQ ID NO: 562692 - RNA, 64 nt, hsa
ugcauugggaggagaaggcagggugagggaucugggagagcaggacguugagauauccugaccc

SEQ ID NO: 562693 - RNA, 64 nt, hsa
gagaggagugaccgggacuggagccagggucuggggagagcaacagcaccaggcuuuuccuggu

SEQ ID NO: 562694 - RNA, 64 nt, hsa
gcccaugcgagagcugccugauggccucuugucaggagagcaguggcacgggggcgugaggaag

SEQ ID NO: 562695 - RNA, 64 nt, hsa
cuuugaccagcaaccaaguaaaaucaguaauugaggagagcagggcacaaaggggcugcaguuu

SEQ ID NO: 562696 - RNA, 64 nt, hsa
uucccccauccaagcauccuucgauuagggaaguggagagcacaucccuguaaggcccauaaga

SEQ ID NO: 562697 - RNA, 64 nt, hsa
ggaagggggaaacugaccaagaaagaaauucuaaggagagcaugagagaaggcuggcauuggca

SEQ ID NO: 562698 - RNA, 64 nt, hsa
aggagagcaugagagaaggcuggcauuggcaggaggagagcaccaggacgaggaugggaagcga

SEQ ID NO: 562699 - RNA, 64 nt, hsa
caagguggguggcucuggcacgagucccccagggggagagcauggcuaccagggagcugcagcg

SEQ ID NO: 562700 - RNA, 64 nt, hsa
guugggggagggcacaggguggguuugagugaagggagagcacgguccuaaguccccagcaggu

SEQ ID NO: 562701 - RNA, 64 nt, hsa; identical to SEQ ID NO: 110917

SEQ ID NO: 562702 - RNA, 64 nt, hsa; identical to SEQ ID NO: 110918

SEQ ID NO: 562703 - RNA, 64 nt, hsa; identical to SEQ ID NO: 110919

SEQ ID NO: 562704 - RNA, 64 nt, hsa; identical to SEQ ID NO: 110920

SEQ ID NO: 562705 - RNA, 64 nt, hsa; identical to SEQ ID NO: 110921

SEQ ID NO: 562706 - RNA, 64 nt, hsa; identical to SEQ ID NO: 110922

SEQ ID NO: 562707 - RNA, 64 nt, hsa; identical to SEQ ID NO: 110923

SEQ ID NO: 562708 - RNA, 64 nt, hsa; identical to SEQ ID NO: 110924

SEQ ID NO: 562709 - RNA, 64 nt, hsa; identical to SEQ ID NO: 110925

SEQ ID NO: 562710 - RNA, 64 nt, hsa; identical to SEQ ID NO: 110926

SEQ ID NO: 562711 - RNA, 64 nt, hsa; identical to SEQ ID NO: 110927

SEQ ID NO: 562712 - RNA, 64 nt, hsa; identical to SEQ ID NO: 110928

SEQ ID NO: 562713 - RNA, 61 nt, hsa; identical to SEQ ID NO: 110929

SEQ ID NO: 562714 - RNA, 64 nt, hsa; identical to SEQ ID NO: 110930

SEQ ID NO: 562715 - RNA, 64 nt, hsa; identical to SEQ ID NO: 110931

SEQ ID NO: 562716 - RNA, 64 nt, hsa; identical to SEQ ID NO: 110932

SEQ ID NO: 562717 - RNA, 64 nt, hsa; identical to SEQ ID NO: 110933

SEQ ID NO: 562718 - RNA, 64 nt, hsa; identical to SEQ ID NO: 110934

SEQ ID NO: 562719 - RNA, 64 nt, hsa; identical to SEQ ID NO: 110935

SEQ ID NO: 562720 - RNA, 64 nt, hsa; identical to SEQ ID NO: 110936

SEQ ID NO: 562721 - RNA, 64 nt, hsa; identical to SEQ ID NO: 110937

SEQ ID NO: 562722 - RNA, 64 nt, hsa; identical to SEQ ID NO: 110938

SEQ ID NO: 562723 - RNA, 64 nt, hsa; identical to SEQ ID NO: 110939

SEQ ID NO: 562724 - RNA, 64 nt, hsa; identical to SEQ ID NO: 110940

SEQ ID NO: 562725 - RNA, 64 nt, hsa; identical to SEQ ID NO: 110941

SEQ ID NO: 562726 - RNA, 64 nt, hsa; identical to SEQ ID NO: 110942

SEQ ID NO: 562727 - RNA, 64 nt, hsa; identical to SEQ ID NO: 110943

SEQ ID NO: 562728 - RNA, 64 nt, hsa; identical to SEQ ID NO: 110944

SEQ ID NO: 562729 - RNA, 64 nt, hsa; identical to SEQ ID NO: 110945

SEQ ID NO: 562730 - RNA, 64 nt, hsa; identical to SEQ ID NO: 110946

SEQ ID NO: 562731 - RNA, 64 nt, hsa; identical to SEQ ID NO: 110947

SEQ ID NO: 562732 - RNA, 64 nt, hsa; identical to SEQ ID NO: 110948

SEQ ID NO: 562733 - RNA, 64 nt, hsa; identical to SEQ ID NO: 110949

SEQ ID NO: 562734 - RNA, 64 nt, hsa; identical to SEQ ID NO: 110950

SEQ ID NO: 562735 - RNA, 64 nt, hsa; identical to SEQ ID NO: 110951

SEQ ID NO: 562736 - RNA, 64 nt, hsa; identical to SEQ ID NO: 110952

SEQ ID NO: 562737 - RNA, 64 nt, hsa; identical to SEQ ID NO: 110953

SEQ ID NO: 562738 - RNA, 64 nt, hsa; identical to SEQ ID NO: 110954

SEQ ID NO: 562739 - RNA, 64 nt, hsa; identical to SEQ ID NO: 110955

SEQ ID NO: 562740 - RNA, 64 nt, hsa; identical to SEQ ID NO: 110956

SEQ ID NO: 562741 - RNA, 64 nt, hsa; identical to SEQ ID NO: 110957

SEQ ID NO: 562742 - RNA, 64 nt, hsa; identical to SEQ ID NO: 110958

SEQ ID NO: 562743 - RNA, 64 nt, hsa; identical to SEQ ID NO: 110959

SEQ ID NO: 562744 - RNA, 64 nt, hsa; identical to SEQ ID NO: 110960

SEQ ID NO: 562745 - RNA, 64 nt, hsa; identical to SEQ ID NO: 110961

SEQ ID NO: 562746 - RNA, 64 nt, hsa; identical to SEQ ID NO: 110962

SEQ ID NO: 562747 - RNA, 64 nt, hsa; identical to SEQ ID NO: 110963

SEQ ID NO: 562748 - RNA, 64 nt, hsa; identical to SEQ ID NO: 110964

SEQ ID NO: 562749 - RNA, 64 nt, hsa; identical to SEQ ID NO: 110965

SEQ ID NO: 562750 - RNA, 64 nt, hsa; identical to SEQ ID NO: 110966

SEQ ID NO: 562751 - RNA, 64 nt, hsa; identical to SEQ ID NO: 110967

SEQ ID NO: 562752 - RNA, 64 nt, hsa; identical to SEQ ID NO: 110968

SEQ ID NO: 562753 - RNA, 64 nt, hsa; identical to SEQ ID NO: 110969

SEQ ID NO: 562754 - RNA, 64 nt, hsa; identical to SEQ ID NO: 110970

SEQ ID NO: 562755 - RNA, 64 nt, hsa; identical to SEQ ID NO: 110971

SEQ ID NO: 562756 - RNA, 64 nt, hsa; identical to SEQ ID NO: 110972

SEQ ID NO: 562757 - RNA, 64 nt, hsa; identical to SEQ ID NO: 110973

SEQ ID NO: 562758 - RNA, 64 nt, hsa; identical to SEQ ID NO: 110974

SEQ ID NO: 562759 - RNA, 64 nt, hsa; identical to SEQ ID NO: 110975

SEQ ID NO: 562760 - RNA, 64 nt, hsa; identical to SEQ ID NO: 110976

SEQ ID NO: 562761 - RNA, 64 nt, hsa; identical to SEQ ID NO: 110977

SEQ ID NO: 562762 - RNA, 64 nt, hsa; identical to SEQ ID NO: 110978

SEQ ID NO: 562763 - RNA, 64 nt, hsa; identical to SEQ ID NO: 110979

SEQ ID NO: 562764 - RNA, 64 nt, hsa; identical to SEQ ID NO: 110980

SEQ ID NO: 562765 - RNA, 64 nt, hsa
guuugguaaacaaacucaaaauggauucuuaggagcauuuuaguguuuauuaaauaacugacca

SEQ ID NO: 562766 - RNA, 64 nt, hsa
guggcuagauuuaugcuaaaaugauucucaguuagcauuuuaguaacacuucaaagguuuuuuu

SEQ ID NO: 562767 - RNA, 64 nt, hsa
aaauauuucugaauaaggcuucaccauacuguaagcauuuuagguagauugccuuaaagguuau

SEQ ID NO: 562768 - RNA, 64 nt, hsa
uuuaacuaaaagcugguucccaaaugcauagcuggcauuuuaauuuaaauucaaaucuacauag

SEQ ID NO: 562769 - RNA, 64 nt, hsa
uggcaauuucuuugacuuucuuuuaagggcagaagcauuuuaguuaauuguagauaaagaauag

SEQ ID NO: 562770 - RNA, 64 nt, hsa
uuauugaagcccagacauucuugcagcuuggacugcauuuuaagcccugcaggcuucugccaua

SEQ ID NO: 562771 - RNA, 64 nt, hsa
auaugauaugcugaacaccaaaaucuccagaaaugcauuuuauguaguucuaaaaucagcaaaa

SEQ ID NO: 562772 - RNA, 64 nt, hsa
gaaaaaaauauuuuuaaaauuucagccaaauaaugcauuuuauuuauaaaaauacagacagaaa

SEQ ID NO: 562773 - RNA, 64 nt, hsa
uuaaaaaacacuucauuauguuuaggggggaacugcauuuuaggguuccauugucuugguggug

SEQ ID NO: 562774 - RNA, 64 nt, hsa
uuugaaugcaugaucuguauggggcaauacuauugcauuuuacgcaaacuuugagccuuucucu

SEQ ID NO: 562775 - RNA, 64 nt, hsa
uaacuggaacauuuagaaagaaggaaaugaaugugcauuuuauuaauuccuuaggggcacaagg

SEQ ID NO: 562776 - RNA, 64 nt, hsa
aagaagcaaugaugugcugcuucugauuuuucuugcauuuuaaauucucagccaaccuacagcc

SEQ ID NO: 562777 - RNA, 64 nt, hsa
agaaaaugcauuuuaaacacaacucuucucaguagcauuuuaugaccuuuggauauguuuguaa

SEQ ID NO: 562778 - RNA, 64 nt, hsa
uguauauauuacagcuuaucuguaagaagaaaaugcauuuuaaacacaacucuucucaguagca

SEQ ID NO: 562779 - RNA, 64 nt, hsa
ucaagaugcuuuguuucuuucauaugaaaaaaaugcauuuuauaaauucagaaagucauagauu

SEQ ID NO: 562780 - RNA, 64 nt, hsa
ucagaaagucauagauuucugaaggcgucaacgugcauuuuauuuauggacugguaaguaacug

SEQ ID NO: 562781 - RNA, 64 nt, hsa
uacuaauuguauuuaaaauuucuacuucccuuaggcauuuuauaaaaauuuaaaaauuauuuuu

SEQ ID NO: 562782 - RNA, 64 nt, hsa
uaucauuacacagcuaagauuuuuauuuaacuuagcauuuuagcaaguuuucuuaugaaaauac

SEQ ID NO: 562783 - RNA, 64 nt, hsa
cagagcuuauauucuaguggaggaaguuagacaagcauuuuaaguaauaaauguauagagagug

SEQ ID NO: 562784 - RNA, 64 nt, hsa
uaugaccaaccagauuaaacucuacccacauccugcauuuuaaggucuaaguuuaacuggucaa

SEQ ID NO: 562785 - RNA, 64 nt, hsa
ucucccacuucugaaauguucauuuauacugguugcauuuuaagaucaugaaacaauuccaguu

SEQ ID NO: 562786 - RNA, 64 nt, hsa
gaaugcaaaauaaaacuugcagugaaugaauuuagcauuuuaugagagugcuguuggaaagacu

SEQ ID NO: 562787 - RNA, 64 nt, hsa
uacuguguauggggagguuguaguauuuauuauagcauuuuaaauaaggguaauucauuuuuua

SEQ ID NO: 562788 - RNA, 64 nt, hsa
cuuuccauaucuguaacaugaaaaugauuauucugcauuuuauucaguaguccaaauuaaagaa

SEQ ID NO: 562789 - RNA, 64 nt, hsa
ugcaaacauauaucuacagagagaaaaauuaauggcauuuuaaagguuaaaacauuuugaaaaa

SEQ ID NO: 562790 - RNA, 64 nt, hsa
cuuguggagcaauagaguucuccauuuuacagaagcauuuuaaauguaguuugaauauuuucca

SEQ ID NO: 562791 - RNA, 64 nt, hsa
uguauuuuucguauucuggaagauguuuuaagaagcauuuuaaaugucaguuacaauaugagaa

SEQ ID NO: 562792 - RNA, 64 nt, hsa
aaugaaaagccuuucucuggagcauuuuagauuugcauuuuaaaugcaugaaauguaauugauu

SEQ ID NO: 562793 - RNA, 64 nt, hsa
uauuucacauugaaaugaaaagccuuucucuggagcauuuuagauuugcauuuuaaaugcauga

SEQ ID NO: 562794 - RNA, 64 nt, hsa
ggauguguagccuucuggaaucugcacgugacuggcauuuuaaaacaacucauuaaauauugga

SEQ ID NO: 562795 - RNA, 64 nt, hsa
ugcuggugcuggagucugaagaauauuuucauuugcauuuuagugguuagggagaggauauaag

SEQ ID NO: 562796 - RNA, 64 nt, hsa
cagaagugcguaccagaaguaugacucaugcaaagcauuuuaccguacaaauauccuggugcga

SEQ ID NO: 562797 - RNA, 64 nt, hsa
caauuauuuuuagagaguaauguauaauuucauagcauuuuaaauuuaguguaucaugcgaguu

SEQ ID NO: 562798 - RNA, 64 nt, hsa
accuguuaaguauucucugaaacauggccaaaaugcauuuuaugagcuuuuuuuuuugcuauug

SEQ ID NO: 562799 - RNA, 64 nt, hsa
gugucuuuaaauauauuagguuauacauuagucagcauuuuaaagacauuucuucccaaguacg

SEQ ID NO: 562800 - RNA, 64 nt, hsa
uacuggaguuuuaguuagcggaagucaguucagggcauuuuagggcugucuugcuauacugaau

SEQ ID NO: 562801 - RNA, 64 nt, hsa
acaauacuuucaguuauguugcaaaggcucuugggcauuuuaaacaaaaugaaguauauccauu

SEQ ID NO: 562802 - RNA, 64 nt, hsa
augaaucagaaacuagguuggggcuuaggaacgugcauuuuaaacacuuuuccaaagugauucu

SEQ ID NO: 562803 - RNA, 64 nt, hsa
guagcauuuggcaacccuuuauaguuuacaaauagcauuuuacauacaccauucuacuauuccu

SEQ ID NO: 562804 - RNA, 64 nt, hsa
cuguaaauaguuguuuuaauuuagcugaauguuagcauuuuagucuuuggcauuuuagcguuug

SEQ ID NO: 562805 - RNA, 64 nt, hsa
uuaauuuagcugaauguuagcauuuuagucuuuggcauuuuagcguuugggagguagauuaaua

SEQ ID NO: 562806 - RNA, 64 nt, hsa
caguacuuuauauaguauagcuuugggccauguagcauuuuaagacucaauuuuaaaaaauuau

SEQ ID NO: 562807 - RNA, 64 nt, hsa
cauuuuugcuuuuaaccaauuaaagaagccaauggcauuuuaguuuuauauuguguuuuccacu

SEQ ID NO: 562808 - RNA, 64 nt, hsa
cuugaauuuacucagucuuauaaauuaaaaaugugcauuuuauauaaagaugcauuuuauauaa

SEQ ID NO: 562809 - RNA, 64 nt, hsa
uuauaaauuaaaaaugugcauuuuauauaaagaugcauuuuauauaaaaaugcacaccuuuaau

SEQ ID NO: 562810 - RNA, 64 nt, hsa
uuaucauuccagcuauguuggacuaggguccaaagcauuuuauaauauuuuuuuuuaaucuagg

SEQ ID NO: 562811 - RNA, 64 nt, hsa
acaacauaaaccuugguuauaugucaacuauucugcauuuuacucugugaauuuauuguuaggc

SEQ ID NO: 562812 - RNA, 64 nt, hsa
aggaaagaacaucagcugaccaaaugucaucgcugcauuuuauuucacaagaggagugugaggg

SEQ ID NO: 562813 - RNA, 64 nt, hsa
ucauacguuauugcauuugaucuucacagaaagugcauuuuaaccaguacucugggugcaauaa

SEQ ID NO: 562814 - RNA, 64 nt, hsa
cuugcaaugauagaaaacuccuuccaauuaaauggcauuuuauaauauuauguguguacuucac

SEQ ID NO: 562815 - RNA, 64 nt, hsa
agcugaauugagaucaggguuucuuuuccagggugcauuuuaauauacguaugaaaugaaauau

SEQ ID NO: 562816 - RNA, 64 nt, hsa
uguuguuguuauagccaugcauugaccauuaaaugcauuuuaauaucucggcaaaaugagauuu

SEQ ID NO: 562817 - RNA, 64 nt, hsa
acauguguauaauaagaugggugccuacugugaugcauuuuaccaggcauuuuaccuucauuau

SEQ ID NO: 562818 - RNA, 64 nt, hsa
uaagaugggugccuacugugaugcauuuuaccaggcauuuuaccuucauuauuacucaucucua

SEQ ID NO: 562819 - RNA, 64 nt, hsa
uauauauaaaauaaaauuuaggccaugggaacuggcauuuuacuugguauaggaauuuaaugag

SEQ ID NO: 562820 - RNA, 64 nt, hsa
ccacauuuaaaggacuguauuuucauacuuuuuugcauuuuaccuuucaucuaccaauccaugu

SEQ ID NO: 562821 - RNA, 64 nt, hsa
uaagcagagaccaucugugaccauagccuagcuagcauuuuaaaaggggaaauuuuguucucua

SEQ ID NO: 562822 - RNA, 64 nt, hsa
auaaccuguucauuaauaucagaaauuuacaauagcauuuuaagaccauaguaggauucuagca

SEQ ID NO: 562823 - RNA, 64 nt, hsa
auaaaaaaaaaaauuguuugaguacauuuucccugcauuuuagagauuaggacaguggucacuu

SEQ ID NO: 562824 - RNA, 64 nt, hsa
cacuuaguaaauuaaaaguuguuuaauuuacuuggcauuuuaggacauguacaugaaacaguga

SEQ ID NO: 562825 - RNA, 64 nt, hsa
uuauggugcuuuugguggaaauuuuuauuauuuagcauuuuaggagaccgcugucaacugguuu

SEQ ID NO: 562826 - RNA, 64 nt, hsa
ugguguugaaaaauaacuguuacuucuuaaagcagcauuuuaucuucuauuuugaagacuauuu

SEQ ID NO: 562827 - RNA, 64 nt, hsa
auuuggagagauacucaaaagagcuaaaacugcagcauuuuaccuuuaaaugcagugccuagag

SEQ ID NO: 562828 - RNA, 64 nt, hsa
aauaaaaagagcagggcacugcuggugggaagaggcauuuuaccuuccagugcaaauccugcuc

SEQ ID NO: 562829 - RNA, 64 nt, hsa
ucagaugcuuuagagagauuuuuuuuccaugacugcauuuuacuguacagauugcugcuucugc

SEQ ID NO: 562830 - RNA, 64 nt, hsa
ucucuugccuaaguauuccuuuccugaucacuaugcauuuuaaaguuaaacauuuuuaaguauu

SEQ ID NO: 562831 - RNA, 64 nt, hsa
ucucuucuuugaguuguuuauggccucccuuaaggcauuuuacaaacccauaagccuacaauag

SEQ ID NO: 562832 - RNA, 64 nt, hsa
ccaagaauuuugcugaaugaaacaaucaaacaaagcauuuuaagguguaaguuauaguaccugu

SEQ ID NO: 562833 - RNA, 64 nt, hsa
aaaacuccgcuucuauagaauuagcugaauaaaggcauuuuacugauagcuguucguguuagcg

SEQ ID NO: 562834 - RNA, 64 nt, hsa
aagacugugcagcucacggaauauagaagacauggcauuuuacucagaagucauaaguuuuugc

SEQ ID NO: 562835 - RNA, 64 nt, hsa
acucaaaguaagcaauggagguaacaaauauugugcauuuuaacaguaauauuugaagauuugu

SEQ ID NO: 562836 - RNA, 64 nt, hsa
uucuugccaucuuuguuuucuuaaagaaaucuaugcauuuuaaggauaaaacuaaagcauaugg

SEQ ID NO: 562837 - RNA, 64 nt, hsa
guuccucucguuuuuccuucaaucuaccuagcaugcauuuuacacacauuggaggagucguaug

SEQ ID NO: 562838 - RNA, 64 nt, hsa
uauguugcaugcauuaaaaaaaaucaucucacaugcauuuuauaguuuuggggaagaaaauauc

SEQ ID NO: 562839 - RNA, 64 nt, hsa; identical to SEQ ID NO: 130982

SEQ ID NO: 562840 - RNA, 64 nt, hsa; identical to SEQ ID NO: 130983

SEQ ID NO: 562841 - RNA, 64 nt, hsa; identical to SEQ ID NO: 130984

SEQ ID NO: 562842 - RNA, 64 nt, hsa; identical to SEQ ID NO: 130985

SEQ ID NO: 562843 - RNA, 64 nt, hsa; identical to SEQ ID NO: 130986

SEQ ID NO: 562844 - RNA, 64 nt, hsa; identical to SEQ ID NO: 130987

SEQ ID NO: 562845 - RNA, 64 nt, hsa; identical to SEQ ID NO: 130988

SEQ ID NO: 562846 - RNA, 64 nt, hsa; identical to SEQ ID NO: 130989

SEQ ID NO: 562847 - RNA, 64 nt, hsa; identical to SEQ ID NO: 130990

SEQ ID NO: 562848 - RNA, 64 nt, hsa; identical to SEQ ID NO: 130991

SEQ ID NO: 562849 - RNA, 64 nt, hsa; identical to SEQ ID NO: 130992

SEQ ID NO: 562850 - RNA, 64 nt, hsa; identical to SEQ ID NO: 130993

SEQ ID NO: 562851 - RNA, 64 nt, hsa; identical to SEQ ID NO: 130994

SEQ ID NO: 562852 - RNA, 64 nt, hsa; identical to SEQ ID NO: 130995

SEQ ID NO: 562853 - RNA, 64 nt, hsa; identical to SEQ ID NO: 130996

SEQ ID NO: 562854 - RNA, 64 nt, hsa; identical to SEQ ID NO: 130997

SEQ ID NO: 562855 - RNA, 64 nt, hsa; identical to SEQ ID NO: 130998

SEQ ID NO: 562856 - RNA, 64 nt, hsa; identical to SEQ ID NO: 130999

SEQ ID NO: 562857 - RNA, 64 nt, hsa; identical to SEQ ID NO: 131000

SEQ ID NO: 562858 - RNA, 64 nt, hsa; identical to SEQ ID NO: 131001

SEQ ID NO: 562859 - RNA, 64 nt, hsa; identical to SEQ ID NO: 131002

SEQ ID NO: 562860 - RNA, 64 nt, hsa; identical to SEQ ID NO: 131003

SEQ ID NO: 562861 - RNA, 64 nt, hsa; identical to SEQ ID NO: 131004

SEQ ID NO: 562862 - RNA, 64 nt, hsa; identical to SEQ ID NO: 131005

SEQ ID NO: 562863 - RNA, 64 nt, hsa; identical to SEQ ID NO: 131006

SEQ ID NO: 562864 - RNA, 64 nt, hsa; identical to SEQ ID NO: 131007

SEQ ID NO: 562865 - RNA, 64 nt, hsa; identical to SEQ ID NO: 131008

SEQ ID NO: 562866 - RNA, 64 nt, hsa; identical to SEQ ID NO: 131009

SEQ ID NO: 562867 - RNA, 64 nt, hsa; identical to SEQ ID NO: 162075

SEQ ID NO: 562868 - RNA, 64 nt, hsa; identical to SEQ ID NO: 162076

SEQ ID NO: 562869 - RNA, 64 nt, hsa; identical to SEQ ID NO: 162077

SEQ ID NO: 562870 - RNA, 64 nt, hsa; identical to SEQ ID NO: 162078

SEQ ID NO: 562871 - RNA, 64 nt, hsa; identical to SEQ ID NO: 162079

SEQ ID NO: 562872 - RNA, 64 nt, hsa; identical to SEQ ID NO: 162080

SEQ ID NO: 562873 - RNA, 64 nt, hsa; identical to SEQ ID NO: 162081

SEQ ID NO: 562874 - RNA, 64 nt, hsa; identical to SEQ ID NO: 162082

SEQ ID NO: 562875 - RNA, 64 nt, hsa; identical to SEQ ID NO: 162083

SEQ ID NO: 562876 - RNA, 64 nt, hsa; identical to SEQ ID NO: 162084

SEQ ID NO: 562877 - RNA, 64 nt, hsa; identical to SEQ ID NO: 162085

SEQ ID NO: 562878 - RNA, 64 nt, hsa; identical to SEQ ID NO: 162086

SEQ ID NO: 562879 - RNA, 64 nt, hsa; identical to SEQ ID NO: 162087

SEQ ID NO: 562880 - RNA, 64 nt, hsa; identical to SEQ ID NO: 162088

SEQ ID NO: 562881 - RNA, 64 nt, hsa; identical to SEQ ID NO: 162089

SEQ ID NO: 562882 - RNA, 64 nt, hsa; identical to SEQ ID NO: 162090

SEQ ID NO: 562883 - RNA, 64 nt, hsa; identical to SEQ ID NO: 162091

SEQ ID NO: 562884 - RNA, 64 nt, hsa; identical to SEQ ID NO: 162092

SEQ ID NO: 562885 - RNA, 64 nt, hsa; identical to SEQ ID NO: 162093

SEQ ID NO: 562886 - RNA, 64 nt, hsa; identical to SEQ ID NO: 162092

SEQ ID NO: 562887 - RNA, 64 nt, hsa
auuuaaagaaugguuccugaaaugaagucaguagaaauggcaugggauaagagcagagcucaca

SEQ ID NO: 562888 - RNA, 64 nt, hsa
auccacuuuuucagguaaacauuuuucauuuggcaaauggcauaauuauuugaaagugacagga

SEQ ID NO: 562889 - RNA, 64 nt, hsa
aauacuagaaacacaaggaaaugcaaguuacgcuaaauggcaguaauacuacccaacugccuuu

SEQ ID NO: 562890 - RNA, 64 nt, hsa
aaucagcauacacauuuuugacuguacacacuauaaauggcaucaaauuuggauauuuuucuua

SEQ ID NO: 562891 - RNA, 64 nt, hsa
guccuauuucauuagugaagacauaguucaccuaaaauggcauccugcucugaaucuagacuuu

SEQ ID NO: 562892 - RNA, 64 nt, hsa
aaauggcauccugcucugaaucuagacuuuuuagaaauggcauauguuuuugaugauaugucaa

SEQ ID NO: 562893 - RNA, 64 nt, hsa
gucuuucuggcuaauuaaaaaagacaacuuuauaaaauggcacuuuaagcaagccauaguuagu

SEQ ID NO: 562894 - RNA, 64 nt, hsa
ucccuagagcuuucccuguguugcuaagagcugaaaauggcaucuucgugaucaccacagugag

SEQ ID NO: 562895 - RNA, 64 nt, hsa
agccuuccuaguccuccaccuggcacaguauuugaaauggcaaaggaugugcuucauccucuaa

SEQ ID NO: 562896 - RNA, 64 nt, hsa
agauugagaauuuuauuugaaaagaaucugguuuaaauggcauugugguccgagguagcugcuc

SEQ ID NO: 562897 - RNA, 64 nt, hsa
agaugagagaggggacuaauuauuuuguuuaugaaaauggcaaguaaauuacuugaucuuuuug

SEQ ID NO: 562898 - RNA, 64 nt, hsa
cucuaagguucuuuuuuuuuauucaaacuguaugaaauggcaaagugaggcucugggguuagau

SEQ ID NO: 562899 - RNA, 64 nt, hsa
uaggaugucuugaaacccgugcauuuaauuuuagaaauggcaaauuuguaagcgugucauuuaa

SEQ ID NO: 562900 - RNA, 64 nt, hsa
cauuauaccaguguuguccaagguugcuagcaggaaauggcagagccaggaguuggaccuaggu

SEQ ID NO: 562901 - RNA, 64 nt, hsa
uagcacuuugcgcauuguguaaguuggguaacaaaaauggcaaaagaaaugcagauuucccagu

SEQ ID NO: 562902 - RNA, 64 nt, hsa
uauucccccuuggaauuugacaguuucuauggugaaauggcagaagguaacaacuauguugaaa

SEQ ID NO: 562903 - RNA, 64 nt, hsa
gauauacaguuuuuucuucuuaguucugcauuagaaauggcaucuguuuuaggucucaaaauau

SEQ ID NO: 562904 - RNA, 64 nt, hsa
auccugcuccuccucucauguuuccucuuugacuaaauggcauuaccacuaccaaccauucauu

SEQ ID NO: 562905 - RNA, 64 nt, hsa
auuuagguggaauugaugucugggcaauuaaaauaaauggcauaagagcuuaaaaaccaaaguu

SEQ ID NO: 562906 - RNA, 64 nt, hsa
uuaaaauucugacaguugccuuuuuuuucaucucaaauggcagcaugggacugaaacaugagaa

SEQ ID NO: 562907 - RNA, 64 nt, hsa
uagagguaacuuaauuugggaauuuguuguguugaaauggcauuuaauuucaaccuaaauacug

SEQ ID NO: 562908 - RNA, 64 nt, hsa
caaugaaauuuuuuaguauguucaacucucauccaaauggcauaugacccuguuuacacagccu

SEQ ID NO: 562909 - RNA, 64 nt, hsa
ccuugaagauguagcuuccaaauuugaauggauuaaauggcaccuguauaccaauuuguagaaa

SEQ ID NO: 562910 - RNA, 64 nt, hsa
ggcugcaaaaccggcaaccuguaacugcccuuuuaaauggcaugacaaggugugcaguggcccc

SEQ ID NO: 562911 - RNA, 64 nt, hsa
gcugugaaugcagaauguaaaauugguaacuaagaaauggcacaaacaccuuaagcaauauauu

SEQ ID NO: 562912 - RNA, 64 nt, hsa
aacucaaauaaaaugccccacauuuuacuacaguaaauggcaguguuuuuaugacuuuuauacu

SEQ ID NO: 562913 - RNA, 64 nt, hsa
aauguuucacuggaauugaugggaaaugguuucuaaauggcaucgaagcuggucuuuaaugagu

SEQ ID NO: 562914 - RNA, 64 nt, hsa
auauacccagauuuacagagaugacacaguauugaaauggcaggugggcucuguaaguuauuuu

SEQ ID NO: 562915 - RNA, 64 nt, hsa
caguaucaauggaaaaaugauaggcacuacaaugaaauggcaggaugccaauaugagauauuuc

SEQ ID NO: 562916 - RNA, 64 nt, hsa
cagaaaauaacauacccuguauucaaaauuacugaaauggcaaucaaagaugaucauuuuuaug

SEQ ID NO: 562917 - RNA, 64 nt, hsa
acuggggaagggaaguuucaguaacaugacacuaaaauggcagagacguuaaaaaaaguuuuuc

SEQ ID NO: 562918 - RNA, 64 nt, hsa
gguauccugggugaagccuguuugccucucuugaaaauggcaggugcucuuguuuuacccaugu

SEQ ID NO: 562919 - RNA, 64 nt, hsa
agaaaaguuauuuuucaaaggucuugcaguuaauaaauggcagagugagcauucaaguccaggu

SEQ ID NO: 562920 - RNA, 64 nt, hsa
ugugaaaauguauaaaagaugcaucuguuguuucaaauggcacuaucuucuuuucaguacuaca

SEQ ID NO: 562921 - RNA, 64 nt, hsa
cuuuuaaacacucugaccauagaaauguuuuucaaaauggcaacaauggauaaaccaaggauuu

SEQ ID NO: 562922 - RNA, 64 nt, hsa
agcaaaaucuauggccacacugagaagccuuugaaaauggcaaauacuuuucaucaccaauugc

SEQ ID NO: 562923 - RNA, 64 nt, hsa
ggcaauaaucaacugaauugcaaaauuugggggaaaauggcacuauccguguacgaaucgaaua

SEQ ID NO: 562924 - RNA, 64 nt, hsa
uuguccauuuacagcccucagcaaugugccuucuaaauggcaugacauauguagaugugcugca

SEQ ID NO: 562925 - RNA, 64 nt, hsa
ucguaucucuaauuuauggucuauauaccaauuuaaauggcauguaaaccugccuguuucuucu

SEQ ID NO: 562926 - RNA, 64 nt, hsa
ggagacauuuaagauugucagcaaacuugucccaaaauggcacaucaucauaauccauuuucuc

SEQ ID NO: 562927 - RNA, 64 nt, hsa
cauuguuuuuauucuuacacgacuacaguacuucaaauggcacauagauaggcaggauauuaca

SEQ ID NO: 562928 - RNA, 64 nt, hsa
uguuucagugucacagagacauucuuugauaaggaaauggcacaaacauaaagggaaaggcugc

SEQ ID NO: 562929 - RNA, 64 nt, hsa
ugucaauauuaaagauagcugagaagcaccuuucaaauggcacagucccucuucaagaugucua

SEQ ID NO: 562930 - RNA, 64 nt, hsa
agcauuucccuaucuugcaguucuguuaacaugaaaauggcauuuuuccauaauagcuuuaaaa

SEQ ID NO: 562931 - RNA, 64 nt, hsa
agauugucuuagucucaaugagauguagcuacaaaaauggcaccucuuagcagugaugaggcuc

SEQ ID NO: 562932 - RNA, 64 nt, hsa
aaauggcauaaauauggucgcacuaauggaagacaaauggcaaaucuugaaauagaauuggggc

SEQ ID NO: 562933 - RNA, 64 nt, hsa
gcaccuucagccacagccuuauaaaagggaagguaaauggcauaaauauggucgcacuaaugga

SEQ ID NO: 562934 - RNA, 64 nt, hsa
ucaaaugaagagaaaaagaaaaacagcauucuagaaauggcauuucuccuaauuaauuuuccac

SEQ ID NO: 562935 - RNA, 64 nt, hsa
acuggauaaccuaauuuuuuuuaaugcuuuaaaaaaauggcaaaaagacgucaggccacccuca

SEQ ID NO: 562936 - RNA, 64 nt, hsa
cuagacauggauaggagugcguuuuaggcacagcaaauggcacauacaagggccagggagcaag

SEQ ID NO: 562937 - RNA, 64 nt, hsa
ggccagggagcaagagagaggacagguccucaacaaauggcaugugacuuuguaaguguagaau

SEQ ID NO: 562938 - RNA, 64 nt, hsa
ccugcggaucgagagaggggguagagucuucuucaaauggcaguuuuacuucaaauggcagauu

SEQ ID NO: 562939 - RNA, 64 nt, hsa
ggguagagucuucuucaaauggcaguuuuacuucaaauggcagauuucacaagaguugguuauu

SEQ ID NO: 562940 - RNA, 64 nt, hsa
acacauuucuuacaaaaaagaguugaaugagguaaaauggcauuagauggcucuauauuuuuua

SEQ ID NO: 562941 - RNA, 64 nt, hsa
caguuucucuuaaucugauuaugugcacauaugaaaauggcacaucauauacauguaaaaucag

SEQ ID NO: 562942 - RNA, 64 nt, hsa
aagagcaucuucauuuuaauuaacugcuuuauaaaaauggcaacuuuagguauagauaaccuaa

SEQ ID NO: 562943 - RNA, 64 nt, hsa
auaaaagccugaauuugaaauauuuuuaucagaaaaauggcauauugcugaagugucaaaauau

SEQ ID NO: 562944 - RNA, 64 nt, hsa
guccacaucauggcaguucauuuacucuugugccaaauggcaacaccacgucuaaagcaguuuc

SEQ ID NO: 562945 - RNA, 64 nt, hsa
ucucccuagugaaaacuuggguaauauauguaagaaauggcaaauaaauaccuuaguuaaugac

SEQ ID NO: 562946 - RNA, 64 nt, hsa
ccacuuuuuauaugguuguuuaguuucaagcaauaugauguacauuacuuuugagaaacaguau

SEQ ID NO: 562947 - RNA, 64 nt, hsa
gucuuuaacagcauaauuuauauugcuuuuucaaaugauguagcugcauuaauuguguucauca

SEQ ID NO: 562948 - RNA, 64 nt, hsa
gcugauaauauuuaauaaucuggaggagagaauaaugauguaccaauaaguggagauuccuccu

SEQ ID NO: 562949 - RNA, 64 nt, hsa
auaaugauguaccaauaaguggagauuccuccuuaugauguaugcuagguuauggaagauguaa

SEQ ID NO: 562950 - RNA, 64 nt, hsa
cucuauuuuguaaauauaagaugaguauuauuuaaugauguauuugcauaaguaaugcaaauug

SEQ ID NO: 562951 - RNA, 64 nt, hsa
uaauauauuuaaauggggaauuucaucuaaaacaaugauguaguauuuuuaauauucugauugg

SEQ ID NO: 562952 - RNA, 64 nt, hsa
cuuccuguacauaaauucaagaaaggagaugaguaugauguaugugccauuuguuuggaugagu

SEQ ID NO: 562953 - RNA, 64 nt, hsa
uuugaaaguaagugacuuauguuuaacagaacuaaugauguauugaaacacuguauuaugaaaa

SEQ ID NO: 562954 - RNA, 64 nt, hsa
guauaacaccagagcuugcuguuuaaaggauuauaugauguacaucaguucuauaaaugugcuc

SEQ ID NO: 562955 - RNA, 64 nt, hsa
guuucaaucuaaaauagcagcuuuugagaaaacaaugauguaaauuccuuaugauaaaaggaug

SEQ ID NO: 562956 - RNA, 64 nt, hsa
acauuaaguagaaugugcauguuguaguccuaugaugauguaaacuugguacuacauaaugacu

SEQ ID NO: 562957 - RNA, 64 nt, hsa
aaugacuugcuccacacaugcaguaaacuacauaaugauguacugguaaacuagaaacaaagaa

SEQ ID NO: 562958 - RNA, 64 nt, hsa
uugugguugauacucaagccuuguacaagcacauaugauguagacauuuuuaaaugugaagcuu

SEQ ID NO: 562959 - RNA, 64 nt, hsa
aggcuguuaauuucccaucuaugaauagcacuuuaugauguaggcuaaacuaagcaaauaaugc

SEQ ID NO: 562960 - RNA, 64 nt, hsa
auuugguuacuuggguuuggauacccuuagugggaugauguaaauagaggcuagcuaccuaggc

SEQ ID NO: 562961 - RNA, 64 nt, hsa
auuuaaucacaucccccuucuagagugcuucaaaaugauguagucccucaacuuggcuaaagaa

SEQ ID NO: 562962 - RNA, 64 nt, hsa
auugcuuuugcauguucacauaugauguacuuuuaugauguacuuuuuuuuuuuugagauggag

SEQ ID NO: 562963 - RNA, 64 nt, hsa
ucuuuccggcugcauugcuuuugcauguucacauaugauguacuuuuaugauguacuuuuuuuu

SEQ ID NO: 562964 - RNA, 64 nt, hsa
uuccaaucuuuccucccaaggguucuggcaccuuaugauguacuuuguaaaaaaauugauugaa

SEQ ID NO: 562965 - RNA, 64 nt, hsa
gaaaugaauuauuaaaacaauuuuaaaauggccaaugauguauacauguauuuuaguaaaucca

SEQ ID NO: 562966 - RNA, 64 nt, hsa
ggcaguauccaugaaagcacaagugacuaguccuaugauguacaaagccuguaucucugugaug

SEQ ID NO: 562967 - RNA, 64 nt, hsa
ugcucaccaucagaucaaccucugauuuuacaucaugauguaaucaccacuggagcuucacugu

SEQ ID NO: 562968 - RNA, 64 nt, hsa
uuucauaaccuggagaucagacuguugcuuucgcaugauguauguagugucucaugacuggagu

SEQ ID NO: 562969 - RNA, 64 nt, hsa
uccuuguauuuuucaagagcuauuuuguaaacagaugauguauuucuccauugaaaacacaaua

SEQ ID NO: 562970 - RNA, 64 nt, hsa
gaaauuugggagguuaauaccaaguauucauuucaugauguaaagaaacugaacagugaagugg

SEQ ID NO: 562971 - RNA, 64 nt, hsa; identical to SEQ ID NO: 562970

SEQ ID NO: 562972 - RNA, 64 nt, hsa
ggauuuggaaccuuauugugauaaauauuuauauaugauguauguuugucuccccucuccaaag

SEQ ID NO: 562973 - RNA, 64 nt, hsa
auauugucuggaaagggaugguuuaaauauuaccaugauguaguugaaauauaaaauaggauuu

SEQ ID NO: 562974 - RNA, 64 nt, hsa
aucugaggggacccuguuaggagagcauagcaucaugauguauuagcuguucaucugcuacugg

SEQ ID NO: 562975 - RNA, 64 nt, hsa
gccauaucuauaccauauuuuauucgagucacugaugauguaaugauauauuuuuucauuauua

SEQ ID NO: 562976 - RNA, 64 nt, hsa
auuaaaauaaugccaaacaccaaauaugaauuuuaugauguacacuuugugcuuggcauuaaaa

SEQ ID NO: 562977 - RNA, 64 nt, hsa
aaauguaaacagaucgcacagaguaaagaagaugaugauguaauagugaauaaaccucauguuu

SEQ ID NO: 562978 - RNA, 64 nt, hsa
uguuaaauaacgcuuuuauacuguauuuuguacuaugauguaacuccccuuccuuauggcuagg

SEQ ID NO: 562979 - RNA, 64 nt, hsa
gcacuuuuauugagaaugagaagaacuuuagaugaugauguauuuaugcccuuauaucccaaaa

SEQ ID NO: 562980 - RNA, 64 nt, hsa
uuuuaugguugugaagaacgagagcaagaaaaagaugauguagauguugcccuacuaccuacca

SEQ ID NO: 562981 - RNA, 64 nt, hsa; identical to SEQ ID NO: 180837

SEQ ID NO: 562982 - RNA, 64 nt, hsa; identical to SEQ ID NO: 180838

SEQ ID NO: 562983 - RNA, 64 nt, hsa; identical to SEQ ID NO: 180839

SEQ ID NO: 562984 - RNA, 64 nt, hsa; identical to SEQ ID NO: 180840

SEQ ID NO: 562985 - RNA, 64 nt, hsa; identical to SEQ ID NO: 180841

SEQ ID NO: 562986 - RNA, 64 nt, hsa; identical to SEQ ID NO: 180842

SEQ ID NO: 562987 - RNA, 64 nt, hsa; identical to SEQ ID NO: 180843

SEQ ID NO: 562988 - RNA, 64 nt, hsa; identical to SEQ ID NO: 180844

SEQ ID NO: 562989 - RNA, 64 nt, hsa; identical to SEQ ID NO: 180845

SEQ ID NO: 562990 - RNA, 64 nt, hsa; identical to SEQ ID NO: 180846

SEQ ID NO: 562991 - RNA, 64 nt, hsa; identical to SEQ ID NO: 180847

SEQ ID NO: 562992 - RNA, 64 nt, hsa; identical to SEQ ID NO: 180848

SEQ ID NO: 562993 - RNA, 64 nt, hsa; identical to SEQ ID NO: 180849

SEQ ID NO: 562994 - RNA, 64 nt, hsa; identical to SEQ ID NO: 180850

SEQ ID NO: 562995 - RNA, 64 nt, hsa; identical to SEQ ID NO: 180851

SEQ ID NO: 562996 - RNA, 64 nt, hsa; identical to SEQ ID NO: 180852

SEQ ID NO: 562997 - RNA, 64 nt, hsa; identical to SEQ ID NO: 562946

SEQ ID NO: 562998 - RNA, 64 nt, hsa; identical to SEQ ID NO: 562947

SEQ ID NO: 562999 - RNA, 64 nt, hsa; identical to SEQ ID NO: 562948

SEQ ID NO: 563000 - RNA, 64 nt, hsa; identical to SEQ ID NO: 562949

SEQ ID NO: 563001 - RNA, 64 nt, hsa; identical to SEQ ID NO: 562950

SEQ ID NO: 563002 - RNA, 64 nt, hsa; identical to SEQ ID NO: 562951

SEQ ID NO: 563003 - RNA, 64 nt, hsa; identical to SEQ ID NO: 562952

SEQ ID NO: 563004 - RNA, 64 nt, hsa; identical to SEQ ID NO: 562953

SEQ ID NO: 563005 - RNA, 64 nt, hsa; identical to SEQ ID NO: 562954

SEQ ID NO: 563006 - RNA, 64 nt, hsa; identical to SEQ ID NO: 562955

SEQ ID NO: 563007 - RNA, 64 nt, hsa; identical to SEQ ID NO: 562956

SEQ ID NO: 563008 - RNA, 64 nt, hsa; identical to SEQ ID NO: 562957

SEQ ID NO: 563009 - RNA, 64 nt, hsa; identical to SEQ ID NO: 562958

SEQ ID NO: 563010 - RNA, 64 nt, hsa; identical to SEQ ID NO: 562959

SEQ ID NO: 563011 - RNA, 64 nt, hsa; identical to SEQ ID NO: 562960

SEQ ID NO: 563012 - RNA, 64 nt, hsa; identical to SEQ ID NO: 562961

SEQ ID NO: 563013 - RNA, 64 nt, hsa; identical to SEQ ID NO: 562962

SEQ ID NO: 563014 - RNA, 64 nt, hsa; identical to SEQ ID NO: 562963

SEQ ID NO: 563015 - RNA, 64 nt, hsa; identical to SEQ ID NO: 562964

SEQ ID NO: 563016 - RNA, 64 nt, hsa; identical to SEQ ID NO: 562965

SEQ ID NO: 563017 - RNA, 64 nt, hsa; identical to SEQ ID NO: 562966

SEQ ID NO: 563018 - RNA, 64 nt, hsa; identical to SEQ ID NO: 562967

SEQ ID NO: 563019 - RNA, 64 nt, hsa; identical to SEQ ID NO: 562968

SEQ ID NO: 563020 - RNA, 64 nt, hsa; identical to SEQ ID NO: 562969

SEQ ID NO: 563021 - RNA, 64 nt, hsa; identical to SEQ ID NO: 562970

SEQ ID NO: 563022 - RNA, 64 nt, hsa; identical to SEQ ID NO: 562970

SEQ ID NO: 563023 - RNA, 64 nt, hsa; identical to SEQ ID NO: 562972

SEQ ID NO: 563024 - RNA, 64 nt, hsa; identical to SEQ ID NO: 562973

SEQ ID NO: 563025 - RNA, 64 nt, hsa; identical to SEQ ID NO: 562974

SEQ ID NO: 563026 - RNA, 64 nt, hsa; identical to SEQ ID NO: 562975

SEQ ID NO: 563027 - RNA, 64 nt, hsa; identical to SEQ ID NO: 562976

SEQ ID NO: 563028 - RNA, 64 nt, hsa; identical to SEQ ID NO: 562977

SEQ ID NO: 563029 - RNA, 64 nt, hsa; identical to SEQ ID NO: 562978

SEQ ID NO: 563030 - RNA, 64 nt, hsa; identical to SEQ ID NO: 562979

SEQ ID NO: 563031 - RNA, 64 nt, hsa; identical to SEQ ID NO: 562980

SEQ ID NO: 563032 - RNA, 64 nt, hsa; identical to SEQ ID NO: 180837

SEQ ID NO: 563033 - RNA, 64 nt, hsa; identical to SEQ ID NO: 180838

SEQ ID NO: 563034 - RNA, 64 nt, hsa; identical to SEQ ID NO: 180839

SEQ ID NO: 563035 - RNA, 64 nt, hsa; identical to SEQ ID NO: 180840

SEQ ID NO: 563036 - RNA, 64 nt, hsa; identical to SEQ ID NO: 180841

SEQ ID NO: 563037 - RNA, 64 nt, hsa; identical to SEQ ID NO: 180842

SEQ ID NO: 563038 - RNA, 64 nt, hsa; identical to SEQ ID NO: 180843

SEQ ID NO: 563039 - RNA, 64 nt, hsa; identical to SEQ ID NO: 180844

SEQ ID NO: 563040 - RNA, 64 nt, hsa; identical to SEQ ID NO: 180845

SEQ ID NO: 563041 - RNA, 64 nt, hsa; identical to SEQ ID NO: 180846

SEQ ID NO: 563042 - RNA, 64 nt, hsa; identical to SEQ ID NO: 180847

SEQ ID NO: 563043 - RNA, 64 nt, hsa; identical to SEQ ID NO: 180848

SEQ ID NO: 563044 - RNA, 64 nt, hsa; identical to SEQ ID NO: 180849

SEQ ID NO: 563045 - RNA, 64 nt, hsa; identical to SEQ ID NO: 180850

SEQ ID NO: 563046 - RNA, 64 nt, hsa; identical to SEQ ID NO: 180851

SEQ ID NO: 563047 - RNA, 64 nt, hsa; identical to SEQ ID NO: 180852

SEQ ID NO: 563048 - RNA, 64 nt, hsa; identical to SEQ ID NO: 210217

SEQ ID NO: 563049 - RNA, 64 nt, hsa; identical to SEQ ID NO: 210218

SEQ ID NO: 563050 - RNA, 64 nt, hsa; identical to SEQ ID NO: 210219

SEQ ID NO: 563051 - RNA, 64 nt, hsa; identical to SEQ ID NO: 210220

SEQ ID NO: 563052 - RNA, 64 nt, hsa; identical to SEQ ID NO: 210221

SEQ ID NO: 563053 - RNA, 64 nt, hsa; identical to SEQ ID NO: 210222

SEQ ID NO: 563054 - RNA, 64 nt, hsa; identical to SEQ ID NO: 210223

SEQ ID NO: 563055 - RNA, 64 nt, hsa; identical to SEQ ID NO: 210224

SEQ ID NO: 563056 - RNA, 64 nt, hsa; identical to SEQ ID NO: 210225

SEQ ID NO: 563057 - RNA, 64 nt, hsa; identical to SEQ ID NO: 210226

SEQ ID NO: 563058 - RNA, 64 nt, hsa; identical to SEQ ID NO: 210227

SEQ ID NO: 563059 - RNA, 64 nt, hsa; identical to SEQ ID NO: 210228

SEQ ID NO: 563060 - RNA, 64 nt, hsa; identical to SEQ ID NO: 210229

SEQ ID NO: 563061 - RNA, 64 nt, hsa; identical to SEQ ID NO: 210230

SEQ ID NO: 563062 - RNA, 64 nt, hsa; identical to SEQ ID NO: 210231

SEQ ID NO: 563063 - RNA, 64 nt, hsa; identical to SEQ ID NO: 210232

SEQ ID NO: 563064 - RNA, 64 nt, hsa; identical to SEQ ID NO: 535894

SEQ ID NO: 563065 - RNA, 64 nt, hsa; identical to SEQ ID NO: 535895

SEQ ID NO: 563066 - RNA, 64 nt, hsa; identical to SEQ ID NO: 535896

SEQ ID NO: 563067 - RNA, 64 nt, hsa; identical to SEQ ID NO: 535897

SEQ ID NO: 563068 - RNA, 64 nt, hsa; identical to SEQ ID NO: 535898

SEQ ID NO: 563069 - RNA, 64 nt, hsa; identical to SEQ ID NO: 535899

SEQ ID NO: 563070 - RNA, 64 nt, hsa; identical to SEQ ID NO: 535900

SEQ ID NO: 563071 - RNA, 64 nt, hsa; identical to SEQ ID NO: 535901

SEQ ID NO: 563072 - RNA, 64 nt, hsa; identical to SEQ ID NO: 535902

SEQ ID NO: 563073 - RNA, 64 nt, hsa; identical to SEQ ID NO: 535903

SEQ ID NO: 563074 - RNA, 64 nt, hsa; identical to SEQ ID NO: 535904

SEQ ID NO: 563075 - RNA, 64 nt, hsa; identical to SEQ ID NO: 535905

SEQ ID NO: 563076 - RNA, 64 nt, hsa; identical to SEQ ID NO: 494417

SEQ ID NO: 563077 - RNA, 64 nt, hsa; identical to SEQ ID NO: 494418

SEQ ID NO: 563078 - RNA, 64 nt, hsa; identical to SEQ ID NO: 494419

SEQ ID NO: 563079 - RNA, 64 nt, hsa; identical to SEQ ID NO: 494420

SEQ ID NO: 563080 - RNA, 64 nt, hsa; identical to SEQ ID NO: 494421

SEQ ID NO: 563081 - RNA, 64 nt, hsa; identical to SEQ ID NO: 494422

SEQ ID NO: 563082 - RNA, 64 nt, hsa; identical to SEQ ID NO: 494423

SEQ ID NO: 563083 - RNA, 64 nt, hsa; identical to SEQ ID NO: 494424

SEQ ID NO: 563084 - RNA, 64 nt, hsa
gucggcacucaguaaauguuugguuccuuuugccccuugguaaguuuauuuuaccauccuccca

SEQ ID NO: 563085 - RNA, 64 nt, hsa
cuccguagucacaguuucagaacugaguaaggauccuugguacuugguggcaucuguugaacug

SEQ ID NO: 563086 - RNA, 64 nt, hsa
gaggccaacccaucucaccugacacugaauacugccuugguagaaagugaggaccuguaaucca

SEQ ID NO: 563087 - RNA, 64 nt, hsa
auuuuuuuucuuuauguguaguguuuucaugcuaccuugguaggaaacuuauuuacaaaccaua

SEQ ID NO: 563088 - RNA, 64 nt, hsa
gaucauuucucccuauucaaaugagaauauuuucccuugguagaauccauauacaauauggauu

SEQ ID NO: 563089 - RNA, 64 nt, hsa
caguaugugacccaaagaaagaguugucucaacuccuugguacaggguucauucaaacccccaa

SEQ ID NO: 563090 - RNA, 64 nt, hsa
ggccaggucaggcaggccagucgucuacacacccccuugguacccauucccauuucacaaacuc

SEQ ID NO: 563091 - RNA, 64 nt, hsa
agccaggggcccacacaccuggugccaggguccaccuugguauaccagcucggcagaacaguuc

SEQ ID NO: 563092 - RNA, 64 nt, hsa
aggaaugggauauggagccacauccacuuccaccccuugguaucuggacccacguguucuuccu

SEQ ID NO: 563093 - RNA, 64 nt, hsa
guaggacauuuagagguggcagugucuggaucuaccuugguaggagggagucaguacuguugga

SEQ ID NO: 563094 - RNA, 64 nt, hsa
uuuaauuacuuuccccuuuugcuugauucuucuuccuugguaucauauucaaaggaggaaagaa

SEQ ID NO: 563095 - RNA, 64 nt, hsa
uuguaacuauuaaccuuucuaaaaguuuucaucgccuugguaaagcuccagaaauggacaaugc

SEQ ID NO: 563096 - RNA, 64 nt, hsa
cugaaugucugugaauuucagaggucucugcuagccuugguaucauuuucuagcaauaacugag

SEQ ID NO: 563097 - RNA, 64 nt, hsa
cuccucacaccccagcaccccccauuuuuucaaaccuugguaucuguugggugaacaguauaau

SEQ ID NO: 563098 - RNA, 64 nt, hsa
ucagcuccaccuggagugcgaauugccagagacaccuugguagugcccaucggcaaaucgcaau

SEQ ID NO: 563099 - RNA, 64 nt, hsa
ggaguguuuucagugucuguacuacuguuguagaccuugguauuuuuuuaaacacuguuaacug

SEQ ID NO: 563100 - RNA, 64 nt, hsa
aacuauaaacacacugcauacaauuuucuucugaauaacaaaugaaugcuuauugcugcaugau

SEQ ID NO: 563101 - RNA, 64 nt, hsa
acaaccauuugcuucauuuaaaaccauuucagcuauaacaaaguacuuugcuuccuaauuuaaa

SEQ ID NO: 563102 - RNA, 64 nt, hsa
cacauacaugauaccauccaaauucuugcuuuuaauaacaaagguacaauauuuuguuuuagua

SEQ ID NO: 563103 - RNA, 64 nt, hsa
aaguguugccugccaccaaucaguaaguuagucuauaacaaauuuuacccuaacaguuuuacca

SEQ ID NO: 563104 - RNA, 64 nt, hsa
gucuguucauucugggccuaaccuuaaaggcucaauaacaaauacaacaaauguaaauauguuu

SEQ ID NO: 563105 - RNA, 64 nt, hsa
ugugauuggcuuagguaaucccaaaaacuaacaaauaacaaaggugcauaauuuauuuaucuac

SEQ ID NO: 563106 - RNA, 64 nt, hsa
agaggaucuugaagcgaucaagaauccagauucuauaacaaaucaaauugcacuuuuggaagcc

SEQ ID NO: 563107 - RNA, 64 nt, hsa
aaggcuuaaugaauuuauggcagguuuuuauauaauaacaaauaaauuaaaggaaaauuaccaa

SEQ ID NO: 563108 - RNA, 64 nt, hsa
ggauagacuuauuggaauuuacaagacauacaacauaacaaaaaguguugcuguaaauccaaaa

SEQ ID NO: 563109 - RNA, 64 nt, hsa
aagacaaaauuguaggaaaucuuacauuuuugcaauaacaaacauuaaugaaagcaaaacauua

SEQ ID NO: 563110 - RNA, 64 nt, hsa
ucugauaaugaaugccagcuuuccuugugcuuugauaacaaagacuccaaauauucuggagaac

SEQ ID NO: 563111 - RNA, 64 nt, hsa
uuuaauuugaugggaaaauaguacacacauauauauaacaaauaauauauuaaaaaacccaucc

SEQ ID NO: 563112 - RNA, 64 nt, hsa
gggagggaauaaaucaugacuuaucccauuuucaauaacaaaacgaaacuauggcacuaaccaa

SEQ ID NO: 563113 - RNA, 64 nt, hsa
acgucuaauacuaugacuguuaaaaugucagacuauaacaaauaucuaucuuuuauuuuucauu

SEQ ID NO: 563114 - RNA, 64 nt, hsa
ucaacuagagauuauaaagucucuaaagaaggcaauaacaaaauuuaucaagauauaguacuuu

SEQ ID NO: 563115 - RNA, 64 nt, hsa
gaaacaagaauuagaaugacuugagaacgggcaaauaacaaagcaaaccaauauaauuauaugg

SEQ ID NO: 563116 - RNA, 64 nt, hsa
ccauagaaacuauuaaaguaacuagaacugucaaauaacaaaacggcucauguuuuuaaaauau

SEQ ID NO: 563117 - RNA, 64 nt, hsa
auauaacaaauguuugccuuuacauuguauuaagauaacaaaacauguucagcuuuccauuugg

SEQ ID NO: 563118 - RNA, 64 nt, hsa
cauuuuaucauauuuauacuauuuauauucuuauauaacaaauguuugccuuuacauuguauua

SEQ ID NO: 563119 - RNA, 64 nt, hsa
caaauaacaugauugucuuuguagaaaauucuaaauaacaaaaaccugcugacauuaauaagca

SEQ ID NO: 563120 - RNA, 64 nt, hsa
cuguguguguacguguaugugugugugugugguuauaacaaacugguacuuuuacauuugagua

SEQ ID NO: 563121 - RNA, 64 nt, hsa
uuucuaucuguaucuggacaaugcaguagaaauuauaacaaauacaaaguucuuugugcuuuuc

SEQ ID NO: 563122 - RNA, 64 nt, hsa
auaccuaaacaggaagaaaauucuauuguuuuuuauaacaaaguggaagauuucaagaaaggac

SEQ ID NO: 563123 - RNA, 64 nt, hsa
aacuguuagaaaaauuagaaaauuuaaaauggaaauaacaaagcagaauuucuucacaaaauga

SEQ ID NO: 563124 - RNA, 64 nt, hsa
cccuguuaucuaaauuauaacauacaauuauuuuauaacaaaauauaucuaauuuuuauuggau

SEQ ID NO: 563125 - RNA, 64 nt, hsa
guguguuugcacacacgcguguguuauuguagcaauaacaaaaaguagccaucuccuuguucca

SEQ ID NO: 563126 - RNA, 64 nt, hsa
ugucucaggugucagucuuaggaauggaaguuuaauaacaaaugggccaaacucgcaggacauu

SEQ ID NO: 563127 - RNA, 64 nt, hsa; identical to SEQ ID NO: 130466

SEQ ID NO: 563128 - RNA, 64 nt, hsa; identical to SEQ ID NO: 130467

SEQ ID NO: 563129 - RNA, 64 nt, hsa; identical to SEQ ID NO: 130468

SEQ ID NO: 563130 - RNA, 64 nt, hsa; identical to SEQ ID NO: 130469

SEQ ID NO: 563131 - RNA, 64 nt, hsa; identical to SEQ ID NO: 130470

SEQ ID NO: 563132 - RNA, 64 nt, hsa; identical to SEQ ID NO: 130471

SEQ ID NO: 563133 - RNA, 64 nt, hsa; identical to SEQ ID NO: 130472

SEQ ID NO: 563134 - RNA, 64 nt, hsa; identical to SEQ ID NO: 130473

SEQ ID NO: 563135 - RNA, 64 nt, hsa; identical to SEQ ID NO: 130474

SEQ ID NO: 563136 - RNA, 64 nt, hsa; identical to SEQ ID NO: 130475

SEQ ID NO: 563137 - RNA, 64 nt, hsa; identical to SEQ ID NO: 130476

SEQ ID NO: 563138 - RNA, 64 nt, hsa; identical to SEQ ID NO: 130477

SEQ ID NO: 563139 - RNA, 64 nt, hsa; identical to SEQ ID NO: 130478

SEQ ID NO: 563140 - RNA, 64 nt, hsa; identical to SEQ ID NO: 130479

SEQ ID NO: 563141 - RNA, 64 nt, hsa; identical to SEQ ID NO: 130480

SEQ ID NO: 563142 - RNA, 64 nt, hsa; identical to SEQ ID NO: 130481

SEQ ID NO: 563143 - RNA, 64 nt, hsa; identical to SEQ ID NO: 130482

SEQ ID NO: 563144 - RNA, 64 nt, hsa; identical to SEQ ID NO: 130483

SEQ ID NO: 563145 - RNA, 64 nt, hsa; identical to SEQ ID NO: 130484

SEQ ID NO: 563146 - RNA, 64 nt, hsa; identical to SEQ ID NO: 130485

SEQ ID NO: 563147 - RNA, 64 nt, hsa; identical to SEQ ID NO: 130486

SEQ ID NO: 563148 - RNA, 64 nt, hsa; identical to SEQ ID NO: 130487

SEQ ID NO: 563149 - RNA, 64 nt, hsa; identical to SEQ ID NO: 130488

SEQ ID NO: 563150 - RNA, 64 nt, hsa; identical to SEQ ID NO: 130489

SEQ ID NO: 563151 - RNA, 64 nt, hsa; identical to SEQ ID NO: 130490

SEQ ID NO: 563152 - RNA, 64 nt, hsa; identical to SEQ ID NO: 130491

SEQ ID NO: 563153 - RNA, 64 nt, hsa; identical to SEQ ID NO: 173467

SEQ ID NO: 563154 - RNA, 64 nt, hsa; identical to SEQ ID NO: 173468

SEQ ID NO: 563155 - RNA, 64 nt, hsa; identical to SEQ ID NO: 173469

SEQ ID NO: 563156 - RNA, 64 nt, hsa; identical to SEQ ID NO: 173470

SEQ ID NO: 563157 - RNA, 64 nt, hsa; identical to SEQ ID NO: 173471

SEQ ID NO: 563158 - RNA, 64 nt, hsa; identical to SEQ ID NO: 173472

SEQ ID NO: 563159 - RNA, 64 nt, hsa; identical to SEQ ID NO: 173473

SEQ ID NO: 563160 - RNA, 64 nt, hsa; identical to SEQ ID NO: 173474

SEQ ID NO: 563161 - RNA, 64 nt, hsa; identical to SEQ ID NO: 173475

SEQ ID NO: 563162 - RNA, 64 nt, hsa; identical to SEQ ID NO: 173476

SEQ ID NO: 563163 - RNA, 64 nt, hsa; identical to SEQ ID NO: 173477

SEQ ID NO: 563164 - RNA, 64 nt, hsa; identical to SEQ ID NO: 173478

SEQ ID NO: 563165 - RNA, 64 nt, hsa; identical to SEQ ID NO: 173479

SEQ ID NO: 563166 - RNA, 64 nt, hsa; identical to SEQ ID NO: 173480

SEQ ID NO: 563167 - RNA, 64 nt, hsa; identical to SEQ ID NO: 173481

SEQ ID NO: 563168 - RNA, 64 nt, hsa; identical to SEQ ID NO: 173482

SEQ ID NO: 563169 - RNA, 64 nt, hsa; identical to SEQ ID NO: 173483

SEQ ID NO: 563170 - RNA, 64 nt, hsa; identical to SEQ ID NO: 173484

SEQ ID NO: 563171 - RNA, 64 nt, hsa; identical to SEQ ID NO: 173485

SEQ ID NO: 563172 - RNA, 64 nt, hsa; identical to SEQ ID NO: 173486

SEQ ID NO: 563173 - RNA, 64 nt, hsa; identical to SEQ ID NO: 173487

SEQ ID NO: 563174 - RNA, 64 nt, hsa; identical to SEQ ID NO: 173488

SEQ ID NO: 563175 - RNA, 64 nt, hsa; identical to SEQ ID NO: 455593

SEQ ID NO: 563176 - RNA, 64 nt, hsa; identical to SEQ ID NO: 455594

SEQ ID NO: 563177 - RNA, 64 nt, hsa; identical to SEQ ID NO: 455595

SEQ ID NO: 563178 - RNA, 64 nt, hsa; identical to SEQ ID NO: 455596

SEQ ID NO: 563179 - RNA, 65 nt, hsa; identical to SEQ ID NO: 44973

SEQ ID NO: 563180 - RNA, 65 nt, hsa; identical to SEQ ID NO: 44974

SEQ ID NO: 563181 - RNA, 65 nt, hsa; identical to SEQ ID NO: 44975

SEQ ID NO: 563182 - RNA, 65 nt, hsa; identical to SEQ ID NO: 44976

SEQ ID NO: 563183 - RNA, 65 nt, hsa; identical to SEQ ID NO: 44977

SEQ ID NO: 563184 - RNA, 65 nt, hsa; identical to SEQ ID NO: 44978

SEQ ID NO: 563185 - RNA, 65 nt, hsa; identical to SEQ ID NO: 44979

SEQ ID NO: 563186 - RNA, 65 nt, hsa; identical to SEQ ID NO: 44980

SEQ ID NO: 563187 - RNA, 65 nt, hsa; identical to SEQ ID NO: 44981

SEQ ID NO: 563188 - RNA, 65 nt, hsa; identical to SEQ ID NO: 44982

SEQ ID NO: 563189 - RNA, 65 nt, hsa; identical to SEQ ID NO: 44983

SEQ ID NO: 563190 - RNA, 65 nt, hsa; identical to SEQ ID NO: 44984

SEQ ID NO: 563191 - RNA, 65 nt, hsa; identical to SEQ ID NO: 44985

SEQ ID NO: 563192 - RNA, 65 nt, hsa; identical to SEQ ID NO: 44986

SEQ ID NO: 563193 - RNA, 65 nt, hsa; identical to SEQ ID NO: 44987

SEQ ID NO: 563194 - RNA, 65 nt, hsa; identical to SEQ ID NO: 44988

SEQ ID NO: 563195 - RNA, 65 nt, hsa; identical to SEQ ID NO: 44989

SEQ ID NO: 563196 - RNA, 65 nt, hsa; identical to SEQ ID NO: 44990

SEQ ID NO: 563197 - RNA, 65 nt, hsa; identical to SEQ ID NO: 44991

SEQ ID NO: 563198 - RNA, 65 nt, hsa; identical to SEQ ID NO: 44992

SEQ ID NO: 563199 - RNA, 65 nt, hsa; identical to SEQ ID NO: 44993

SEQ ID NO: 563200 - RNA, 65 nt, hsa; identical to SEQ ID NO: 44994

SEQ ID NO: 563201 - RNA, 65 nt, hsa; identical to SEQ ID NO: 44995

SEQ ID NO: 563202 - RNA, 65 nt, hsa; identical to SEQ ID NO: 44996

SEQ ID NO: 563203 - RNA, 65 nt, hsa; identical to SEQ ID NO: 44997

SEQ ID NO: 563204 - RNA, 65 nt, hsa; identical to SEQ ID NO: 44998

SEQ ID NO: 563205 - RNA, 65 nt, hsa; identical to SEQ ID NO: 44999

SEQ ID NO: 563206 - RNA, 65 nt, hsa; identical to SEQ ID NO: 45000

SEQ ID NO: 563207 - RNA, 65 nt, hsa; identical to SEQ ID NO: 45001

SEQ ID NO: 563208 - RNA, 65 nt, hsa; identical to SEQ ID NO: 45002

SEQ ID NO: 563209 - RNA, 65 nt, hsa; identical to SEQ ID NO: 45003

SEQ ID NO: 563210 - RNA, 65 nt, hsa; identical to SEQ ID NO: 45004

SEQ ID NO: 563211 - RNA, 65 nt, hsa; identical to SEQ ID NO: 45005

SEQ ID NO: 563212 - RNA, 65 nt, hsa; identical to SEQ ID NO: 45006

SEQ ID NO: 563213 - RNA, 65 nt, hsa; identical to SEQ ID NO: 45007

SEQ ID NO: 563214 - RNA, 65 nt, hsa; identical to SEQ ID NO: 45008

SEQ ID NO: 563215 - RNA, 65 nt, hsa; identical to SEQ ID NO: 45009

SEQ ID NO: 563216 - RNA, 65 nt, hsa; identical to SEQ ID NO: 45010

SEQ ID NO: 563217 - RNA, 65 nt, hsa; identical to SEQ ID NO: 45011

SEQ ID NO: 563218 - RNA, 65 nt, hsa; identical to SEQ ID NO: 45012

SEQ ID NO: 563219 - RNA, 65 nt, hsa; identical to SEQ ID NO: 45013

SEQ ID NO: 563220 - RNA, 65 nt, hsa; identical to SEQ ID NO: 45014

SEQ ID NO: 563221 - RNA, 65 nt, hsa; identical to SEQ ID NO: 45015

SEQ ID NO: 563222 - RNA, 65 nt, hsa; identical to SEQ ID NO: 45016

SEQ ID NO: 563223 - RNA, 65 nt, hsa; identical to SEQ ID NO: 45017

SEQ ID NO: 563224 - RNA, 65 nt, hsa; identical to SEQ ID NO: 45018

SEQ ID NO: 563225 - RNA, 65 nt, hsa; identical to SEQ ID NO: 45019

SEQ ID NO: 563226 - RNA, 65 nt, hsa; identical to SEQ ID NO: 45020

SEQ ID NO: 563227 - RNA, 65 nt, hsa; identical to SEQ ID NO: 45021

SEQ ID NO: 563228 - RNA, 65 nt, hsa; identical to SEQ ID NO: 45022

SEQ ID NO: 563229 - RNA, 65 nt, hsa; identical to SEQ ID NO: 45023

SEQ ID NO: 563230 - RNA, 65 nt, hsa; identical to SEQ ID NO: 45024

SEQ ID NO: 563231 - RNA, 64 nt, hsa; identical to SEQ ID NO: 51839

SEQ ID NO: 563232 - RNA, 64 nt, hsa; identical to SEQ ID NO: 51840

SEQ ID NO: 563233 - RNA, 64 nt, hsa; identical to SEQ ID NO: 51841

SEQ ID NO: 563234 - RNA, 64 nt, hsa; identical to SEQ ID NO: 51842

SEQ ID NO: 563235 - RNA, 64 nt, hsa; identical to SEQ ID NO: 51843

SEQ ID NO: 563236 - RNA, 64 nt, hsa; identical to SEQ ID NO: 51844

SEQ ID NO: 563237 - RNA, 64 nt, hsa; identical to SEQ ID NO: 51845

SEQ ID NO: 563238 - RNA, 64 nt, hsa; identical to SEQ ID NO: 51846

SEQ ID NO: 563239 - RNA, 64 nt, hsa; identical to SEQ ID NO: 51847

SEQ ID NO: 563240 - RNA, 64 nt, hsa; identical to SEQ ID NO: 51848

SEQ ID NO: 563241 - RNA, 64 nt, hsa; identical to SEQ ID NO: 51849

SEQ ID NO: 563242 - RNA, 64 nt, hsa; identical to SEQ ID NO: 51850

SEQ ID NO: 563243 - RNA, 64 nt, hsa; identical to SEQ ID NO: 51851

SEQ ID NO: 563244 - RNA, 64 nt, hsa; identical to SEQ ID NO: 51852

SEQ ID NO: 563245 - RNA, 64 nt, hsa; identical to SEQ ID NO: 51853

SEQ ID NO: 563246 - RNA, 64 nt, hsa; identical to SEQ ID NO: 51854

SEQ ID NO: 563247 - RNA, 64 nt, hsa; identical to SEQ ID NO: 51855

SEQ ID NO: 563248 - RNA, 64 nt, hsa; identical to SEQ ID NO: 51856

SEQ ID NO: 563249 - RNA, 64 nt, hsa; identical to SEQ ID NO: 51857

SEQ ID NO: 563250 - RNA, 64 nt, hsa; identical to SEQ ID NO: 51858

SEQ ID NO: 563251 - RNA, 64 nt, hsa; identical to SEQ ID NO: 51859

SEQ ID NO: 563252 - RNA, 64 nt, hsa; identical to SEQ ID NO: 51860

SEQ ID NO: 563253 - RNA, 64 nt, hsa; identical to SEQ ID NO: 51861

SEQ ID NO: 563254 - RNA, 64 nt, hsa; identical to SEQ ID NO: 51862

SEQ ID NO: 563255 - RNA, 64 nt, hsa; identical to SEQ ID NO: 51863

SEQ ID NO: 563256 - RNA, 64 nt, hsa; identical to SEQ ID NO: 51864

SEQ ID NO: 563257 - RNA, 64 nt, hsa; identical to SEQ ID NO: 51865

SEQ ID NO: 563258 - RNA, 64 nt, hsa; identical to SEQ ID NO: 51866

SEQ ID NO: 563259 - RNA, 64 nt, hsa; identical to SEQ ID NO: 51867

SEQ ID NO: 563260 - RNA, 64 nt, hsa; identical to SEQ ID NO: 51868

SEQ ID NO: 563261 - RNA, 64 nt, hsa; identical to SEQ ID NO: 51869

SEQ ID NO: 563262 - RNA, 64 nt, hsa; identical to SEQ ID NO: 51870

SEQ ID NO: 563263 - RNA, 64 nt, hsa; identical to SEQ ID NO: 51871

SEQ ID NO: 563264 - RNA, 64 nt, hsa; identical to SEQ ID NO: 51872

SEQ ID NO: 563265 - RNA, 64 nt, hsa; identical to SEQ ID NO: 51873

SEQ ID NO: 563266 - RNA, 64 nt, hsa; identical to SEQ ID NO: 51874

SEQ ID NO: 563267 - RNA, 64 nt, hsa; identical to SEQ ID NO: 51875

SEQ ID NO: 563268 - RNA, 64 nt, hsa; identical to SEQ ID NO: 51876

SEQ ID NO: 563269 - RNA, 64 nt, hsa; identical to SEQ ID NO: 51877

SEQ ID NO: 563270 - RNA, 64 nt, hsa; identical to SEQ ID NO: 51878

SEQ ID NO: 563271 - RNA, 64 nt, hsa; identical to SEQ ID NO: 51879

SEQ ID NO: 563272 - RNA, 64 nt, hsa; identical to SEQ ID NO: 51880

SEQ ID NO: 563273 - RNA, 64 nt, hsa; identical to SEQ ID NO: 51881

SEQ ID NO: 563274 - RNA, 64 nt, hsa; identical to SEQ ID NO: 51882

SEQ ID NO: 563275 - RNA, 64 nt, hsa; identical to SEQ ID NO: 51883

SEQ ID NO: 563276 - RNA, 64 nt, hsa; identical to SEQ ID NO: 51884

SEQ ID NO: 563277 - RNA, 64 nt, hsa; identical to SEQ ID NO: 51885

SEQ ID NO: 563278 - RNA, 64 nt, hsa; identical to SEQ ID NO: 51886

SEQ ID NO: 563279 - RNA, 64 nt, hsa; identical to SEQ ID NO: 51887

SEQ ID NO: 563280 - RNA, 64 nt, hsa; identical to SEQ ID NO: 51888

SEQ ID NO: 563281 - RNA, 64 nt, hsa; identical to SEQ ID NO: 51889

SEQ ID NO: 563282 - RNA, 64 nt, hsa; identical to SEQ ID NO: 51890

SEQ ID NO: 563283 - RNA, 63 nt, hsa; identical to SEQ ID NO: 51891

SEQ ID NO: 563284 - RNA, 64 nt, hsa; identical to SEQ ID NO: 51892

SEQ ID NO: 563285 - RNA, 64 nt, hsa; identical to SEQ ID NO: 51893

SEQ ID NO: 563286 - RNA, 64 nt, hsa; identical to SEQ ID NO: 51894

SEQ ID NO: 563287 - RNA, 64 nt, hsa; identical to SEQ ID NO: 51895

SEQ ID NO: 563288 - RNA, 64 nt, hsa; identical to SEQ ID NO: 51896

SEQ ID NO: 563289 - RNA, 64 nt, hsa; identical to SEQ ID NO: 51897

SEQ ID NO: 563290 - RNA, 64 nt, hsa; identical to SEQ ID NO: 51898

SEQ ID NO: 563291 - RNA, 64 nt, hsa; identical to SEQ ID NO: 51899

SEQ ID NO: 563292 - RNA, 64 nt, hsa; identical to SEQ ID NO: 51900

SEQ ID NO: 563293 - RNA, 64 nt, hsa; identical to SEQ ID NO: 51901

SEQ ID NO: 563294 - RNA, 64 nt, hsa; identical to SEQ ID NO: 51902

SEQ ID NO: 563295 - RNA, 64 nt, hsa; identical to SEQ ID NO: 51903

SEQ ID NO: 563296 - RNA, 64 nt, hsa; identical to SEQ ID NO: 51904

SEQ ID NO: 563297 - RNA, 64 nt, hsa; identical to SEQ ID NO: 51905

SEQ ID NO: 563298 - RNA, 64 nt, hsa; identical to SEQ ID NO: 51906

SEQ ID NO: 563299 - RNA, 64 nt, hsa; identical to SEQ ID NO: 51907

SEQ ID NO: 563300 - RNA, 64 nt, hsa; identical to SEQ ID NO: 51908

SEQ ID NO: 563301 - RNA, 64 nt, hsa; identical to SEQ ID NO: 51909

SEQ ID NO: 563302 - RNA, 64 nt, hsa; identical to SEQ ID NO: 51910

SEQ ID NO: 563303 - RNA, 64 nt, hsa; identical to SEQ ID NO: 51911

SEQ ID NO: 563304 - RNA, 64 nt, hsa; identical to SEQ ID NO: 51912

SEQ ID NO: 563305 - RNA, 64 nt, hsa; identical to SEQ ID NO: 51913

SEQ ID NO: 563306 - RNA, 64 nt, hsa; identical to SEQ ID NO: 51914

SEQ ID NO: 563307 - RNA, 64 nt, hsa; identical to SEQ ID NO: 51915

SEQ ID NO: 563308 - RNA, 64 nt, hsa; identical to SEQ ID NO: 51916

SEQ ID NO: 563309 - RNA, 64 nt, hsa; identical to SEQ ID NO: 51917

SEQ ID NO: 563310 - RNA, 64 nt, hsa
uucccacugaagauaccccaaaggaugcaagugccuacaguauuaucaggaggagaacaugaaa

SEQ ID NO: 563311 - RNA, 64 nt, hsa
uuuugagaaugccaaaaaucagguuucagaaaagcuacaguaugaaaucugaaaagcaacagaa

SEQ ID NO: 563312 - RNA, 65 nt, hsa; identical to SEQ ID NO: 192258

SEQ ID NO: 563313 - RNA, 65 nt, hsa; identical to SEQ ID NO: 192259

SEQ ID NO: 563314 - RNA, 65 nt, hsa; identical to SEQ ID NO: 192260

SEQ ID NO: 563315 - RNA, 65 nt, hsa; identical to SEQ ID NO: 192261

SEQ ID NO: 563316 - RNA, 65 nt, hsa; identical to SEQ ID NO: 192262

SEQ ID NO: 563317 - RNA, 65 nt, hsa; identical to SEQ ID NO: 192263

SEQ ID NO: 563318 - RNA, 65 nt, hsa; identical to SEQ ID NO: 192264

SEQ ID NO: 563319 - RNA, 65 nt, hsa; identical to SEQ ID NO: 192265

SEQ ID NO: 563320 - RNA, 65 nt, hsa; identical to SEQ ID NO: 192266

SEQ ID NO: 563321 - RNA, 65 nt, hsa; identical to SEQ ID NO: 192267

SEQ ID NO: 563322 - RNA, 65 nt, hsa; identical to SEQ ID NO: 192268

SEQ ID NO: 563323 - RNA, 65 nt, hsa; identical to SEQ ID NO: 192269

SEQ ID NO: 563324 - RNA, 65 nt, hsa; identical to SEQ ID NO: 192270

SEQ ID NO: 563325 - RNA, 65 nt, hsa; identical to SEQ ID NO: 192271

SEQ ID NO: 563326 - RNA, 65 nt, hsa; identical to SEQ ID NO: 192272

SEQ ID NO: 563327 - RNA, 65 nt, hsa; identical to SEQ ID NO: 192273

SEQ ID NO: 563328 - RNA, 65 nt, hsa; identical to SEQ ID NO: 192274

SEQ ID NO: 563329 - RNA, 65 nt, hsa; identical to SEQ ID NO: 192275

SEQ ID NO: 563330 - RNA, 65 nt, hsa; identical to SEQ ID NO: 192276

SEQ ID NO: 563331 - RNA, 65 nt, hsa; identical to SEQ ID NO: 192277

SEQ ID NO: 563332 - RNA, 65 nt, hsa; identical to SEQ ID NO: 192278

SEQ ID NO: 563333 - RNA, 65 nt, hsa; identical to SEQ ID NO: 192279

SEQ ID NO: 563334 - RNA, 65 nt, hsa; identical to SEQ ID NO: 192280

SEQ ID NO: 563335 - RNA, 65 nt, hsa; identical to SEQ ID NO: 192281

SEQ ID NO: 563336 - RNA, 65 nt, hsa; identical to SEQ ID NO: 192282

SEQ ID NO: 563337 - RNA, 65 nt, hsa; identical to SEQ ID NO: 192283

SEQ ID NO: 563338 - RNA, 65 nt, hsa; identical to SEQ ID NO: 192284

SEQ ID NO: 563339 - RNA, 65 nt, hsa; identical to SEQ ID NO: 192285

SEQ ID NO: 563340 - RNA, 65 nt, hsa; identical to SEQ ID NO: 192286

SEQ ID NO: 563341 - RNA, 65 nt, hsa; identical to SEQ ID NO: 192287

SEQ ID NO: 563342 - RNA, 65 nt, hsa; identical to SEQ ID NO: 192288

SEQ ID NO: 563343 - RNA, 65 nt, hsa; identical to SEQ ID NO: 192289

SEQ ID NO: 563344 - RNA, 65 nt, hsa; identical to SEQ ID NO: 192290

SEQ ID NO: 563345 - RNA, 65 nt, hsa; identical to SEQ ID NO: 192291

SEQ ID NO: 563346 - RNA, 65 nt, hsa; identical to SEQ ID NO: 192292

SEQ ID NO: 563347 - RNA, 65 nt, hsa; identical to SEQ ID NO: 192293

SEQ ID NO: 563348 - RNA, 65 nt, hsa; identical to SEQ ID NO: 192294

SEQ ID NO: 563349 - RNA, 65 nt, hsa; identical to SEQ ID NO: 192295

SEQ ID NO: 563350 - RNA, 65 nt, hsa; identical to SEQ ID NO: 192296

SEQ ID NO: 563351 - RNA, 65 nt, hsa; identical to SEQ ID NO: 192297

SEQ ID NO: 563352 - RNA, 65 nt, hsa; identical to SEQ ID NO: 192298

SEQ ID NO: 563353 - RNA, 65 nt, hsa; identical to SEQ ID NO: 192299

SEQ ID NO: 563354 - RNA, 65 nt, hsa; identical to SEQ ID NO: 192300

SEQ ID NO: 563355 - RNA, 65 nt, hsa; identical to SEQ ID NO: 192301

SEQ ID NO: 563356 - RNA, 65 nt, hsa; identical to SEQ ID NO: 192302

SEQ ID NO: 563357 - RNA, 65 nt, hsa; identical to SEQ ID NO: 192303

SEQ ID NO: 563358 - RNA, 65 nt, hsa; identical to SEQ ID NO: 192304

SEQ ID NO: 563359 - RNA, 65 nt, hsa; identical to SEQ ID NO: 192305

SEQ ID NO: 563360 - RNA, 65 nt, hsa; identical to SEQ ID NO: 192306

SEQ ID NO: 563361 - RNA, 65 nt, hsa; identical to SEQ ID NO: 192307

SEQ ID NO: 563362 - RNA, 65 nt, hsa; identical to SEQ ID NO: 192308

SEQ ID NO: 563363 - RNA, 65 nt, hsa; identical to SEQ ID NO: 192309

SEQ ID NO: 563364 - RNA, 65 nt, hsa; identical to SEQ ID NO: 192310

SEQ ID NO: 563365 - RNA, 65 nt, hsa; identical to SEQ ID NO: 192311

SEQ ID NO: 563366 - RNA, 65 nt, hsa; identical to SEQ ID NO: 192312

SEQ ID NO: 563367 - RNA, 65 nt, hsa; identical to SEQ ID NO: 192313

SEQ ID NO: 563368 - RNA, 65 nt, hsa; identical to SEQ ID NO: 192314

SEQ ID NO: 563369 - RNA, 65 nt, hsa; identical to SEQ ID NO: 192315

SEQ ID NO: 563370 - RNA, 65 nt, hsa; identical to SEQ ID NO: 192316

SEQ ID NO: 563371 - RNA, 65 nt, hsa; identical to SEQ ID NO: 192317

SEQ ID NO: 563372 - RNA, 65 nt, hsa; identical to SEQ ID NO: 192318

SEQ ID NO: 563373 - RNA, 65 nt, hsa; identical to SEQ ID NO: 192319

SEQ ID NO: 563374 - RNA, 65 nt, hsa; identical to SEQ ID NO: 192320

SEQ ID NO: 563375 - RNA, 65 nt, hsa; identical to SEQ ID NO: 192321

SEQ ID NO: 563376 - RNA, 65 nt, hsa; identical to SEQ ID NO: 192322

SEQ ID NO: 563377 - RNA, 65 nt, hsa; identical to SEQ ID NO: 192323

SEQ ID NO: 563378 - RNA, 65 nt, hsa; identical to SEQ ID NO: 192324

SEQ ID NO: 563379 - RNA, 65 nt, hsa; identical to SEQ ID NO: 192325

SEQ ID NO: 563380 - RNA, 65 nt, hsa; identical to SEQ ID NO: 192326

SEQ ID NO: 563381 - RNA, 65 nt, hsa; identical to SEQ ID NO: 192327

SEQ ID NO: 563382 - RNA, 65 nt, hsa; identical to SEQ ID NO: 192328

SEQ ID NO: 563383 - RNA, 65 nt, hsa; identical to SEQ ID NO: 192329

SEQ ID NO: 563384 - RNA, 65 nt, hsa; identical to SEQ ID NO: 192330

SEQ ID NO: 563385 - RNA, 65 nt, hsa; identical to SEQ ID NO: 192331

SEQ ID NO: 563386 - RNA, 65 nt, hsa; identical to SEQ ID NO: 192332

SEQ ID NO: 563387 - RNA, 65 nt, hsa; identical to SEQ ID NO: 192333

SEQ ID NO: 563388 - RNA, 65 nt, hsa; identical to SEQ ID NO: 192334

SEQ ID NO: 563389 - RNA, 65 nt, hsa; identical to SEQ ID NO: 192335

SEQ ID NO: 563390 - RNA, 65 nt, hsa; identical to SEQ ID NO: 192336

SEQ ID NO: 563391 - RNA, 65 nt, hsa; identical to SEQ ID NO: 192337

SEQ ID NO: 563392 - RNA, 65 nt, hsa; identical to SEQ ID NO: 192338

SEQ ID NO: 563393 - RNA, 65 nt, hsa; identical to SEQ ID NO: 192339

SEQ ID NO: 563394 - RNA, 65 nt, hsa; identical to SEQ ID NO: 192340

SEQ ID NO: 563395 - RNA, 65 nt, hsa; identical to SEQ ID NO: 192341

SEQ ID NO: 563396 - RNA, 65 nt, hsa; identical to SEQ ID NO: 192342

SEQ ID NO: 563397 - RNA, 65 nt, hsa; identical to SEQ ID NO: 192343

SEQ ID NO: 563398 - RNA, 65 nt, hsa; identical to SEQ ID NO: 192344

SEQ ID NO: 563399 - RNA, 65 nt, hsa; identical to SEQ ID NO: 192345

SEQ ID NO: 563400 - RNA, 65 nt, hsa; identical to SEQ ID NO: 192346

SEQ ID NO: 563401 - RNA, 65 nt, hsa; identical to SEQ ID NO: 192347

SEQ ID NO: 563402 - RNA, 65 nt, hsa; identical to SEQ ID NO: 192348

SEQ ID NO: 563403 - RNA, 65 nt, hsa; identical to SEQ ID NO: 192349

SEQ ID NO: 563404 - RNA, 65 nt, hsa; identical to SEQ ID NO: 192350

SEQ ID NO: 563405 - RNA, 65 nt, hsa; identical to SEQ ID NO: 192351

SEQ ID NO: 563406 - RNA, 65 nt, hsa; identical to SEQ ID NO: 192352

SEQ ID NO: 563407 - RNA, 65 nt, hsa; identical to SEQ ID NO: 192353

SEQ ID NO: 563408 - RNA, 65 nt, hsa; identical to SEQ ID NO: 192354

SEQ ID NO: 563409 - RNA, 65 nt, hsa; identical to SEQ ID NO: 192355

SEQ ID NO: 563410 - RNA, 65 nt, hsa; identical to SEQ ID NO: 192356

SEQ ID NO: 563411 - RNA, 65 nt, hsa; identical to SEQ ID NO: 192357

SEQ ID NO: 563412 - RNA, 65 nt, hsa; identical to SEQ ID NO: 192358

SEQ ID NO: 563413 - RNA, 65 nt, hsa; identical to SEQ ID NO: 192359

SEQ ID NO: 563414 - RNA, 65 nt, hsa; identical to SEQ ID NO: 192360

SEQ ID NO: 563415 - RNA, 65 nt, hsa; identical to SEQ ID NO: 192361

SEQ ID NO: 563416 - RNA, 65 nt, hsa; identical to SEQ ID NO: 192362

SEQ ID NO: 563417 - RNA, 65 nt, hsa; identical to SEQ ID NO: 192363

SEQ ID NO: 563418 - RNA, 65 nt, hsa; identical to SEQ ID NO: 192364

SEQ ID NO: 563419 - RNA, 65 nt, hsa; identical to SEQ ID NO: 192365

SEQ ID NO: 563420 - RNA, 65 nt, hsa; identical to SEQ ID NO: 192366

SEQ ID NO: 563421 - RNA, 65 nt, hsa; identical to SEQ ID NO: 192367

SEQ ID NO: 563422 - RNA, 65 nt, hsa; identical to SEQ ID NO: 192368

SEQ ID NO: 563423 - RNA, 65 nt, hsa; identical to SEQ ID NO: 192369

SEQ ID NO: 563424 - RNA, 65 nt, hsa; identical to SEQ ID NO: 192370

SEQ ID NO: 563425 - RNA, 65 nt, hsa; identical to SEQ ID NO: 192371

SEQ ID NO: 563426 - RNA, 65 nt, hsa; identical to SEQ ID NO: 192372

SEQ ID NO: 563427 - RNA, 65 nt, hsa; identical to SEQ ID NO: 192373

SEQ ID NO: 563428 - RNA, 65 nt, hsa; identical to SEQ ID NO: 192374

SEQ ID NO: 563429 - RNA, 65 nt, hsa; identical to SEQ ID NO: 192375

SEQ ID NO: 563430 - RNA, 65 nt, hsa; identical to SEQ ID NO: 192376

SEQ ID NO: 563431 - RNA, 65 nt, hsa; identical to SEQ ID NO: 192377

SEQ ID NO: 563432 - RNA, 65 nt, hsa; identical to SEQ ID NO: 192378

SEQ ID NO: 563433 - RNA, 65 nt, hsa; identical to SEQ ID NO: 192379

SEQ ID NO: 563434 - RNA, 65 nt, hsa; identical to SEQ ID NO: 192380

SEQ ID NO: 563435 - RNA, 65 nt, hsa; identical to SEQ ID NO: 192381

SEQ ID NO: 563436 - RNA, 65 nt, hsa; identical to SEQ ID NO: 192382

SEQ ID NO: 563437 - RNA, 65 nt, hsa; identical to SEQ ID NO: 192383

SEQ ID NO: 563438 - RNA, 65 nt, hsa; identical to SEQ ID NO: 192384

SEQ ID NO: 563439 - RNA, 65 nt, hsa; identical to SEQ ID NO: 192385

SEQ ID NO: 563440 - RNA, 65 nt, hsa; identical to SEQ ID NO: 192386

SEQ ID NO: 563441 - RNA, 65 nt, hsa; identical to SEQ ID NO: 192387

SEQ ID NO: 563442 - RNA, 65 nt, hsa; identical to SEQ ID NO: 192388

SEQ ID NO: 563443 - RNA, 65 nt, hsa; identical to SEQ ID NO: 192389

SEQ ID NO: 563444 - RNA, 65 nt, hsa; identical to SEQ ID NO: 192390

SEQ ID NO: 563445 - RNA, 65 nt, hsa; identical to SEQ ID NO: 192391

SEQ ID NO: 563446 - RNA, 65 nt, hsa; identical to SEQ ID NO: 192392

SEQ ID NO: 563447 - RNA, 65 nt, hsa; identical to SEQ ID NO: 192393

SEQ ID NO: 563448 - RNA, 65 nt, hsa; identical to SEQ ID NO: 192394

SEQ ID NO: 563449 - RNA, 65 nt, hsa; identical to SEQ ID NO: 192395

SEQ ID NO: 563450 - RNA, 65 nt, hsa; identical to SEQ ID NO: 192396

SEQ ID NO: 563451 - RNA, 65 nt, hsa; identical to SEQ ID NO: 192397

SEQ ID NO: 563452 - RNA, 65 nt, hsa; identical to SEQ ID NO: 192398

SEQ ID NO: 563453 - RNA, 65 nt, hsa; identical to SEQ ID NO: 192399

SEQ ID NO: 563454 - RNA, 65 nt, hsa; identical to SEQ ID NO: 192400

SEQ ID NO: 563455 - RNA, 65 nt, hsa; identical to SEQ ID NO: 192401

SEQ ID NO: 563456 - RNA, 65 nt, hsa; identical to SEQ ID NO: 192402

SEQ ID NO: 563457 - RNA, 65 nt, hsa; identical to SEQ ID NO: 192403

SEQ ID NO: 563458 - RNA, 65 nt, hsa; identical to SEQ ID NO: 192404

SEQ ID NO: 563459 - RNA, 65 nt, hsa; identical to SEQ ID NO: 192405

SEQ ID NO: 563460 - RNA, 65 nt, hsa; identical to SEQ ID NO: 192406

SEQ ID NO: 563461 - RNA, 65 nt, hsa; identical to SEQ ID NO: 192407

SEQ ID NO: 563462 - RNA, 65 nt, hsa; identical to SEQ ID NO: 192408

SEQ ID NO: 563463 - RNA, 65 nt, hsa; identical to SEQ ID NO: 192409

SEQ ID NO: 563464 - RNA, 65 nt, hsa; identical to SEQ ID NO: 192410

SEQ ID NO: 563465 - RNA, 65 nt, hsa; identical to SEQ ID NO: 192411

SEQ ID NO: 563466 - RNA, 65 nt, hsa; identical to SEQ ID NO: 192412

SEQ ID NO: 563467 - RNA, 65 nt, hsa; identical to SEQ ID NO: 192413

SEQ ID NO: 563468 - RNA, 65 nt, hsa; identical to SEQ ID NO: 192414

SEQ ID NO: 563469 - RNA, 65 nt, hsa; identical to SEQ ID NO: 192415

SEQ ID NO: 563470 - RNA, 65 nt, hsa; identical to SEQ ID NO: 192416

SEQ ID NO: 563471 - RNA, 65 nt, hsa; identical to SEQ ID NO: 192417

SEQ ID NO: 563472 - RNA, 65 nt, hsa; identical to SEQ ID NO: 192418

SEQ ID NO: 563473 - RNA, 65 nt, hsa; identical to SEQ ID NO: 192419

SEQ ID NO: 563474 - RNA, 65 nt, hsa; identical to SEQ ID NO: 192420

SEQ ID NO: 563475 - RNA, 65 nt, hsa; identical to SEQ ID NO: 192421

SEQ ID NO: 563476 - RNA, 65 nt, hsa; identical to SEQ ID NO: 192422

SEQ ID NO: 563477 - RNA, 65 nt, hsa; identical to SEQ ID NO: 192423

SEQ ID NO: 563478 - RNA, 65 nt, hsa; identical to SEQ ID NO: 192424

SEQ ID NO: 563479 - RNA, 65 nt, hsa; identical to SEQ ID NO: 192425

SEQ ID NO: 563480 - RNA, 65 nt, hsa; identical to SEQ ID NO: 192426

SEQ ID NO: 563481 - RNA, 65 nt, hsa; identical to SEQ ID NO: 192427

SEQ ID NO: 563482 - RNA, 65 nt, hsa; identical to SEQ ID NO: 192428

SEQ ID NO: 563483 - RNA, 65 nt, hsa; identical to SEQ ID NO: 192429

SEQ ID NO: 563484 - RNA, 65 nt, hsa; identical to SEQ ID NO: 192430

SEQ ID NO: 563485 - RNA, 65 nt, hsa; identical to SEQ ID NO: 192431

SEQ ID NO: 563486 - RNA, 65 nt, hsa; identical to SEQ ID NO: 192432

SEQ ID NO: 563487 - RNA, 65 nt, hsa; identical to SEQ ID NO: 192433

SEQ ID NO: 563488 - RNA, 65 nt, hsa; identical to SEQ ID NO: 192434

SEQ ID NO: 563489 - RNA, 65 nt, hsa; identical to SEQ ID NO: 192435

SEQ ID NO: 563490 - RNA, 65 nt, hsa; identical to SEQ ID NO: 192436

SEQ ID NO: 563491 - RNA, 65 nt, hsa; identical to SEQ ID NO: 192437

SEQ ID NO: 563492 - RNA, 65 nt, hsa; identical to SEQ ID NO: 192438

SEQ ID NO: 563493 - RNA, 65 nt, hsa; identical to SEQ ID NO: 192439

SEQ ID NO: 563494 - RNA, 65 nt, hsa; identical to SEQ ID NO: 192440

SEQ ID NO: 563495 - RNA, 65 nt, hsa; identical to SEQ ID NO: 192441

SEQ ID NO: 563496 - RNA, 65 nt, hsa; identical to SEQ ID NO: 192442

SEQ ID NO: 563497 - RNA, 65 nt, hsa; identical to SEQ ID NO: 192443

SEQ ID NO: 563498 - RNA, 65 nt, hsa; identical to SEQ ID NO: 192444

SEQ ID NO: 563499 - RNA, 65 nt, hsa; identical to SEQ ID NO: 192445

SEQ ID NO: 563500 - RNA, 65 nt, hsa; identical to SEQ ID NO: 192446

SEQ ID NO: 563501 - RNA, 65 nt, hsa; identical to SEQ ID NO: 192447

SEQ ID NO: 563502 - RNA, 65 nt, hsa; identical to SEQ ID NO: 192448

SEQ ID NO: 563503 - RNA, 65 nt, hsa; identical to SEQ ID NO: 192449

SEQ ID NO: 563504 - RNA, 65 nt, hsa; identical to SEQ ID NO: 192450

SEQ ID NO: 563505 - RNA, 65 nt, hsa; identical to SEQ ID NO: 192451

SEQ ID NO: 563506 - RNA, 65 nt, hsa; identical to SEQ ID NO: 192452

SEQ ID NO: 563507 - RNA, 65 nt, hsa; identical to SEQ ID NO: 192453

SEQ ID NO: 563508 - RNA, 65 nt, hsa; identical to SEQ ID NO: 192454

SEQ ID NO: 563509 - RNA, 65 nt, hsa; identical to SEQ ID NO: 192455

SEQ ID NO: 563510 - RNA, 65 nt, hsa; identical to SEQ ID NO: 192456

SEQ ID NO: 563511 - RNA, 65 nt, hsa; identical to SEQ ID NO: 192457

SEQ ID NO: 563512 - RNA, 65 nt, hsa; identical to SEQ ID NO: 192458

SEQ ID NO: 563513 - RNA, 65 nt, hsa; identical to SEQ ID NO: 192459

SEQ ID NO: 563514 - RNA, 65 nt, hsa; identical to SEQ ID NO: 192460

SEQ ID NO: 563515 - RNA, 65 nt, hsa; identical to SEQ ID NO: 192461

SEQ ID NO: 563516 - RNA, 65 nt, hsa; identical to SEQ ID NO: 192462

SEQ ID NO: 563517 - RNA, 65 nt, hsa; identical to SEQ ID NO: 192463

SEQ ID NO: 563518 - RNA, 51 nt, hsa; identical to SEQ ID NO: 192464

SEQ ID NO: 563519 - RNA, 65 nt, hsa; identical to SEQ ID NO: 192465

SEQ ID NO: 563520 - RNA, 65 nt, hsa; identical to SEQ ID NO: 192466

SEQ ID NO: 563521 - RNA, 65 nt, hsa; identical to SEQ ID NO: 192467

SEQ ID NO: 563522 - RNA, 65 nt, hsa; identical to SEQ ID NO: 192468

SEQ ID NO: 563523 - RNA, 65 nt, hsa; identical to SEQ ID NO: 192469

SEQ ID NO: 563524 - RNA, 65 nt, hsa; identical to SEQ ID NO: 192470

SEQ ID NO: 563525 - RNA, 65 nt, hsa; identical to SEQ ID NO: 192471

SEQ ID NO: 563526 - RNA, 65 nt, hsa; identical to SEQ ID NO: 192472

SEQ ID NO: 563527 - RNA, 65 nt, hsa; identical to SEQ ID NO: 192473

SEQ ID NO: 563528 - RNA, 65 nt, hsa; identical to SEQ ID NO: 192474

SEQ ID NO: 563529 - RNA, 65 nt, hsa; identical to SEQ ID NO: 192475

SEQ ID NO: 563530 - RNA, 65 nt, hsa; identical to SEQ ID NO: 192476

SEQ ID NO: 563531 - RNA, 65 nt, hsa; identical to SEQ ID NO: 192477

SEQ ID NO: 563532 - RNA, 65 nt, hsa; identical to SEQ ID NO: 192478

SEQ ID NO: 563533 - RNA, 65 nt, hsa; identical to SEQ ID NO: 192479

SEQ ID NO: 563534 - RNA, 65 nt, hsa; identical to SEQ ID NO: 192480

SEQ ID NO: 563535 - RNA, 65 nt, hsa; identical to SEQ ID NO: 192481

SEQ ID NO: 563536 - RNA, 65 nt, hsa; identical to SEQ ID NO: 192482

SEQ ID NO: 563537 - RNA, 65 nt, hsa; identical to SEQ ID NO: 192483

SEQ ID NO: 563538 - RNA, 65 nt, hsa; identical to SEQ ID NO: 192484

SEQ ID NO: 563539 - RNA, 65 nt, hsa; identical to SEQ ID NO: 192485

SEQ ID NO: 563540 - RNA, 65 nt, hsa; identical to SEQ ID NO: 192486

SEQ ID NO: 563541 - RNA, 65 nt, hsa; identical to SEQ ID NO: 192487

SEQ ID NO: 563542 - RNA, 65 nt, hsa; identical to SEQ ID NO: 192488

SEQ ID NO: 563543 - RNA, 65 nt, hsa; identical to SEQ ID NO: 192489

SEQ ID NO: 563544 - RNA, 65 nt, hsa; identical to SEQ ID NO: 192490

SEQ ID NO: 563545 - RNA, 65 nt, hsa; identical to SEQ ID NO: 192491

SEQ ID NO: 563546 - RNA, 65 nt, hsa; identical to SEQ ID NO: 192492

SEQ ID NO: 563547 - RNA, 65 nt, hsa; identical to SEQ ID NO: 192493

SEQ ID NO: 563548 - RNA, 65 nt, hsa; identical to SEQ ID NO: 192494

SEQ ID NO: 563549 - RNA, 65 nt, hsa; identical to SEQ ID NO: 192495

SEQ ID NO: 563550 - RNA, 65 nt, hsa; identical to SEQ ID NO: 192496

SEQ ID NO: 563551 - RNA, 65 nt, hsa; identical to SEQ ID NO: 192497

SEQ ID NO: 563552 - RNA, 65 nt, hsa; identical to SEQ ID NO: 192498

SEQ ID NO: 563553 - RNA, 65 nt, hsa; identical to SEQ ID NO: 192499

SEQ ID NO: 563554 - RNA, 65 nt, hsa; identical to SEQ ID NO: 192500

SEQ ID NO: 563555 - RNA, 65 nt, hsa; identical to SEQ ID NO: 192501

SEQ ID NO: 563556 - RNA, 65 nt, hsa; identical to SEQ ID NO: 192502

SEQ ID NO: 563557 - RNA, 65 nt, hsa; identical to SEQ ID NO: 192503

SEQ ID NO: 563558 - RNA, 65 nt, hsa; identical to SEQ ID NO: 192504

SEQ ID NO: 563559 - RNA, 65 nt, hsa; identical to SEQ ID NO: 192505

SEQ ID NO: 563560 - RNA, 65 nt, hsa; identical to SEQ ID NO: 192506

SEQ ID NO: 563561 - RNA, 65 nt, hsa; identical to SEQ ID NO: 192507

SEQ ID NO: 563562 - RNA, 65 nt, hsa; identical to SEQ ID NO: 192508

SEQ ID NO: 563563 - RNA, 65 nt, hsa; identical to SEQ ID NO: 192509

SEQ ID NO: 563564 - RNA, 65 nt, hsa; identical to SEQ ID NO: 192510

SEQ ID NO: 563565 - RNA, 65 nt, hsa; identical to SEQ ID NO: 192511

SEQ ID NO: 563566 - RNA, 65 nt, hsa; identical to SEQ ID NO: 192512

SEQ ID NO: 563567 - RNA, 65 nt, hsa; identical to SEQ ID NO: 192513

SEQ ID NO: 563568 - RNA, 65 nt, hsa; identical to SEQ ID NO: 192514

SEQ ID NO: 563569 - RNA, 65 nt, hsa; identical to SEQ ID NO: 192515

SEQ ID NO: 563570 - RNA, 65 nt, hsa; identical to SEQ ID NO: 192516

SEQ ID NO: 563571 - RNA, 65 nt, hsa; identical to SEQ ID NO: 192517

SEQ ID NO: 563572 - RNA, 65 nt, hsa; identical to SEQ ID NO: 192518

SEQ ID NO: 563573 - RNA, 65 nt, hsa; identical to SEQ ID NO: 192519

SEQ ID NO: 563574 - RNA, 65 nt, hsa; identical to SEQ ID NO: 192520

SEQ ID NO: 563575 - RNA, 65 nt, hsa; identical to SEQ ID NO: 192521

SEQ ID NO: 563576 - RNA, 65 nt, hsa; identical to SEQ ID NO: 192522

SEQ ID NO: 563577 - RNA, 65 nt, hsa; identical to SEQ ID NO: 192523

SEQ ID NO: 563578 - RNA, 65 nt, hsa; identical to SEQ ID NO: 192524

SEQ ID NO: 563579 - RNA, 65 nt, hsa; identical to SEQ ID NO: 192525

SEQ ID NO: 563580 - RNA, 65 nt, hsa; identical to SEQ ID NO: 192526

SEQ ID NO: 563581 - RNA, 65 nt, hsa; identical to SEQ ID NO: 192527

SEQ ID NO: 563582 - RNA, 65 nt, hsa; identical to SEQ ID NO: 192528

SEQ ID NO: 563583 - RNA, 65 nt, hsa; identical to SEQ ID NO: 192529

SEQ ID NO: 563584 - RNA, 65 nt, hsa; identical to SEQ ID NO: 192530

SEQ ID NO: 563585 - RNA, 65 nt, hsa; identical to SEQ ID NO: 192531

SEQ ID NO: 563586 - RNA, 53 nt, hsa; identical to SEQ ID NO: 192532

SEQ ID NO: 563587 - RNA, 65 nt, hsa; identical to SEQ ID NO: 192533

SEQ ID NO: 563588 - RNA, 65 nt, hsa; identical to SEQ ID NO: 192534

SEQ ID NO: 563589 - RNA, 65 nt, hsa; identical to SEQ ID NO: 192535

SEQ ID NO: 563590 - RNA, 65 nt, hsa; identical to SEQ ID NO: 192536

SEQ ID NO: 563591 - RNA, 65 nt, hsa; identical to SEQ ID NO: 192537

SEQ ID NO: 563592 - RNA, 65 nt, hsa; identical to SEQ ID NO: 192538

SEQ ID NO: 563593 - RNA, 65 nt, hsa; identical to SEQ ID NO: 192539

SEQ ID NO: 563594 - RNA, 65 nt, hsa; identical to SEQ ID NO: 192540

SEQ ID NO: 563595 - RNA, 65 nt, hsa; identical to SEQ ID NO: 192541

SEQ ID NO: 563596 - RNA, 65 nt, hsa; identical to SEQ ID NO: 192542

SEQ ID NO: 563597 - RNA, 65 nt, hsa; identical to SEQ ID NO: 192543

SEQ ID NO: 563598 - RNA, 65 nt, hsa; identical to SEQ ID NO: 192544

SEQ ID NO: 563599 - RNA, 65 nt, hsa; identical to SEQ ID NO: 192545

SEQ ID NO: 563600 - RNA, 65 nt, hsa; identical to SEQ ID NO: 192546

SEQ ID NO: 563601 - RNA, 65 nt, hsa; identical to SEQ ID NO: 192547

SEQ ID NO: 563602 - RNA, 65 nt, hsa; identical to SEQ ID NO: 192548

SEQ ID NO: 563603 - RNA, 65 nt, hsa; identical to SEQ ID NO: 192549

SEQ ID NO: 563604 - RNA, 65 nt, hsa; identical to SEQ ID NO: 192550

SEQ ID NO: 563605 - RNA, 65 nt, hsa; identical to SEQ ID NO: 192551

SEQ ID NO: 563606 - RNA, 65 nt, hsa; identical to SEQ ID NO: 192552

SEQ ID NO: 563607 - RNA, 65 nt, hsa; identical to SEQ ID NO: 192553

SEQ ID NO: 563608 - RNA, 65 nt, hsa; identical to SEQ ID NO: 192554

SEQ ID NO: 563609 - RNA, 65 nt, hsa; identical to SEQ ID NO: 192555

SEQ ID NO: 563610 - RNA, 65 nt, hsa; identical to SEQ ID NO: 192556

SEQ ID NO: 563611 - RNA, 65 nt, hsa; identical to SEQ ID NO: 192557

SEQ ID NO: 563612 - RNA, 65 nt, hsa; identical to SEQ ID NO: 192558

SEQ ID NO: 563613 - RNA, 65 nt, hsa; identical to SEQ ID NO: 192559

SEQ ID NO: 563614 - RNA, 65 nt, hsa; identical to SEQ ID NO: 192560

SEQ ID NO: 563615 - RNA, 65 nt, hsa; identical to SEQ ID NO: 192561

SEQ ID NO: 563616 - RNA, 65 nt, hsa; identical to SEQ ID NO: 192562

SEQ ID NO: 563617 - RNA, 65 nt, hsa; identical to SEQ ID NO: 192563

SEQ ID NO: 563618 - RNA, 65 nt, hsa; identical to SEQ ID NO: 192564

SEQ ID NO: 563619 - RNA, 65 nt, hsa; identical to SEQ ID NO: 192565

SEQ ID NO: 563620 - RNA, 65 nt, hsa; identical to SEQ ID NO: 192566

SEQ ID NO: 563621 - RNA, 65 nt, hsa; identical to SEQ ID NO: 192567

SEQ ID NO: 563622 - RNA, 65 nt, hsa; identical to SEQ ID NO: 192568

SEQ ID NO: 563623 - RNA, 65 nt, hsa; identical to SEQ ID NO: 192569

SEQ ID NO: 563624 - RNA, 65 nt, hsa; identical to SEQ ID NO: 192570

SEQ ID NO: 563625 - RNA, 65 nt, hsa; identical to SEQ ID NO: 192571

SEQ ID NO: 563626 - RNA, 65 nt, hsa; identical to SEQ ID NO: 192572

SEQ ID NO: 563627 - RNA, 65 nt, hsa; identical to SEQ ID NO: 192573

SEQ ID NO: 563628 - RNA, 65 nt, hsa; identical to SEQ ID NO: 192574

SEQ ID NO: 563629 - RNA, 65 nt, hsa; identical to SEQ ID NO: 192575

SEQ ID NO: 563630 - RNA, 65 nt, hsa; identical to SEQ ID NO: 192296

SEQ ID NO: 563631 - RNA, 65 nt, hsa; identical to SEQ ID NO: 192577

SEQ ID NO: 563632 - RNA, 65 nt, hsa; identical to SEQ ID NO: 192578

SEQ ID NO: 563633 - RNA, 65 nt, hsa; identical to SEQ ID NO: 192579

SEQ ID NO: 563634 - RNA, 65 nt, hsa; identical to SEQ ID NO: 192580

SEQ ID NO: 563635 - RNA, 65 nt, hsa; identical to SEQ ID NO: 192581

SEQ ID NO: 563636 - RNA, 65 nt, hsa; identical to SEQ ID NO: 192582

SEQ ID NO: 563637 - RNA, 65 nt, hsa; identical to SEQ ID NO: 192583

SEQ ID NO: 563638 - RNA, 65 nt, hsa; identical to SEQ ID NO: 192584

SEQ ID NO: 563639 - RNA, 65 nt, hsa; identical to SEQ ID NO: 192585

SEQ ID NO: 563640 - RNA, 65 nt, hsa; identical to SEQ ID NO: 192586

SEQ ID NO: 563641 - RNA, 65 nt, hsa; identical to SEQ ID NO: 192587

SEQ ID NO: 563642 - RNA, 65 nt, hsa; identical to SEQ ID NO: 192588

SEQ ID NO: 563643 - RNA, 65 nt, hsa; identical to SEQ ID NO: 192589

SEQ ID NO: 563644 - RNA, 65 nt, hsa; identical to SEQ ID NO: 192590

SEQ ID NO: 563645 - RNA, 65 nt, hsa; identical to SEQ ID NO: 192591

SEQ ID NO: 563646 - RNA, 65 nt, hsa; identical to SEQ ID NO: 192592

SEQ ID NO: 563647 - RNA, 65 nt, hsa; identical to SEQ ID NO: 192593

SEQ ID NO: 563648 - RNA, 65 nt, hsa; identical to SEQ ID NO: 192594

SEQ ID NO: 563649 - RNA, 65 nt, hsa; identical to SEQ ID NO: 192595

SEQ ID NO: 563650 - RNA, 65 nt, hsa; identical to SEQ ID NO: 192596

SEQ ID NO: 563651 - RNA, 65 nt, hsa; identical to SEQ ID NO: 192597

SEQ ID NO: 563652 - RNA, 65 nt, hsa; identical to SEQ ID NO: 192598

SEQ ID NO: 563653 - RNA, 65 nt, hsa; identical to SEQ ID NO: 192599

SEQ ID NO: 563654 - RNA, 65 nt, hsa; identical to SEQ ID NO: 192600

SEQ ID NO: 563655 - RNA, 65 nt, hsa; identical to SEQ ID NO: 192601

SEQ ID NO: 563656 - RNA, 65 nt, hsa; identical to SEQ ID NO: 192602

SEQ ID NO: 563657 - RNA, 65 nt, hsa; identical to SEQ ID NO: 192603

SEQ ID NO: 563658 - RNA, 65 nt, hsa; identical to SEQ ID NO: 192604

SEQ ID NO: 563659 - RNA, 65 nt, hsa; identical to SEQ ID NO: 192605

SEQ ID NO: 563660 - RNA, 65 nt, hsa; identical to SEQ ID NO: 192606

SEQ ID NO: 563661 - RNA, 65 nt, hsa; identical to SEQ ID NO: 192607

SEQ ID NO: 563662 - RNA, 65 nt, hsa; identical to SEQ ID NO: 192608

SEQ ID NO: 563663 - RNA, 65 nt, hsa; identical to SEQ ID NO: 192609

SEQ ID NO: 563664 - RNA, 65 nt, hsa; identical to SEQ ID NO: 192610

SEQ ID NO: 563665 - RNA, 65 nt, hsa; identical to SEQ ID NO: 192611

SEQ ID NO: 563666 - RNA, 65 nt, hsa; identical to SEQ ID NO: 192612

SEQ ID NO: 563667 - RNA, 65 nt, hsa; identical to SEQ ID NO: 192613

SEQ ID NO: 563668 - RNA, 65 nt, hsa; identical to SEQ ID NO: 192614

SEQ ID NO: 563669 - RNA, 65 nt, hsa; identical to SEQ ID NO: 192615

SEQ ID NO: 563670 - RNA, 65 nt, hsa; identical to SEQ ID NO: 192616

SEQ ID NO: 563671 - RNA, 65 nt, hsa; identical to SEQ ID NO: 192617

SEQ ID NO: 563672 - RNA, 65 nt, hsa; identical to SEQ ID NO: 192618

SEQ ID NO: 563673 - RNA, 65 nt, hsa; identical to SEQ ID NO: 192619

SEQ ID NO: 563674 - RNA, 65 nt, hsa; identical to SEQ ID NO: 192620

SEQ ID NO: 563675 - RNA, 65 nt, hsa; identical to SEQ ID NO: 192621

SEQ ID NO: 563676 - RNA, 65 nt, hsa; identical to SEQ ID NO: 192622

SEQ ID NO: 563677 - RNA, 65 nt, hsa; identical to SEQ ID NO: 192623

SEQ ID NO: 563678 - RNA, 65 nt, hsa; identical to SEQ ID NO: 192624

SEQ ID NO: 563679 - RNA, 65 nt, hsa; identical to SEQ ID NO: 192625

SEQ ID NO: 563680 - RNA, 65 nt, hsa; identical to SEQ ID NO: 192626

SEQ ID NO: 563681 - RNA, 65 nt, hsa; identical to SEQ ID NO: 192627

SEQ ID NO: 563682 - RNA, 65 nt, hsa; identical to SEQ ID NO: 192628

SEQ ID NO: 563683 - RNA, 65 nt, hsa; identical to SEQ ID NO: 192629

SEQ ID NO: 563684 - RNA, 65 nt, hsa; identical to SEQ ID NO: 192630

SEQ ID NO: 563685 - RNA, 65 nt, hsa; identical to SEQ ID NO: 192631

SEQ ID NO: 563686 - RNA, 65 nt, hsa; identical to SEQ ID NO: 192632

SEQ ID NO: 563687 - RNA, 65 nt, hsa; identical to SEQ ID NO: 192633

SEQ ID NO: 563688 - RNA, 65 nt, hsa; identical to SEQ ID NO: 192634

SEQ ID NO: 563689 - RNA, 65 nt, hsa; identical to SEQ ID NO: 192635

SEQ ID NO: 563690 - RNA, 65 nt, hsa; identical to SEQ ID NO: 192636

SEQ ID NO: 563691 - RNA, 65 nt, hsa; identical to SEQ ID NO: 192637

SEQ ID NO: 563692 - RNA, 65 nt, hsa; identical to SEQ ID NO: 192638

SEQ ID NO: 563693 - RNA, 65 nt, hsa; identical to SEQ ID NO: 192639

SEQ ID NO: 563694 - RNA, 65 nt, hsa; identical to SEQ ID NO: 192640

SEQ ID NO: 563695 - RNA, 65 nt, hsa; identical to SEQ ID NO: 192641

SEQ ID NO: 563696 - RNA, 65 nt, hsa; identical to SEQ ID NO: 192642

SEQ ID NO: 563697 - RNA, 65 nt, hsa; identical to SEQ ID NO: 192643

SEQ ID NO: 563698 - RNA, 65 nt, hsa; identical to SEQ ID NO: 192644

SEQ ID NO: 563699 - RNA, 65 nt, hsa; identical to SEQ ID NO: 192645

SEQ ID NO: 563700 - RNA, 65 nt, hsa; identical to SEQ ID NO: 192646

SEQ ID NO: 563701 - RNA, 65 nt, hsa; identical to SEQ ID NO: 192647

SEQ ID NO: 563702 - RNA, 65 nt, hsa; identical to SEQ ID NO: 192648

SEQ ID NO: 563703 - RNA, 65 nt, hsa; identical to SEQ ID NO: 192649

SEQ ID NO: 563704 - RNA, 51 nt, hsa; identical to SEQ ID NO: 192650

SEQ ID NO: 563705 - RNA, 65 nt, hsa; identical to SEQ ID NO: 192651

SEQ ID NO: 563706 - RNA, 65 nt, hsa; identical to SEQ ID NO: 192652

SEQ ID NO: 563707 - RNA, 65 nt, hsa; identical to SEQ ID NO: 192653

SEQ ID NO: 563708 - RNA, 65 nt, hsa; identical to SEQ ID NO: 192654

SEQ ID NO: 563709 - RNA, 65 nt, hsa; identical to SEQ ID NO: 192655

SEQ ID NO: 563710 - RNA, 65 nt, hsa; identical to SEQ ID NO: 192656

SEQ ID NO: 563711 - RNA, 65 nt, hsa; identical to SEQ ID NO: 192657

SEQ ID NO: 563712 - RNA, 65 nt, hsa; identical to SEQ ID NO: 192658

SEQ ID NO: 563713 - RNA, 65 nt, hsa; identical to SEQ ID NO: 192659

SEQ ID NO: 563714 - RNA, 65 nt, hsa; identical to SEQ ID NO: 192660

SEQ ID NO: 563715 - RNA, 65 nt, hsa; identical to SEQ ID NO: 192661

SEQ ID NO: 563716 - RNA, 65 nt, hsa; identical to SEQ ID NO: 192662

SEQ ID NO: 563717 - RNA, 65 nt, hsa; identical to SEQ ID NO: 192663

SEQ ID NO: 563718 - RNA, 65 nt, hsa; identical to SEQ ID NO: 192664

SEQ ID NO: 563719 - RNA, 65 nt, hsa; identical to SEQ ID NO: 192665

SEQ ID NO: 563720 - RNA, 65 nt, hsa; identical to SEQ ID NO: 192666

SEQ ID NO: 563721 - RNA, 65 nt, hsa; identical to SEQ ID NO: 192667

SEQ ID NO: 563722 - RNA, 65 nt, hsa; identical to SEQ ID NO: 192668

SEQ ID NO: 563723 - RNA, 65 nt, hsa; identical to SEQ ID NO: 192669

SEQ ID NO: 563724 - RNA, 65 nt, hsa; identical to SEQ ID NO: 192670

SEQ ID NO: 563725 - RNA, 65 nt, hsa; identical to SEQ ID NO: 192671

SEQ ID NO: 563726 - RNA, 65 nt, hsa; identical to SEQ ID NO: 192672

SEQ ID NO: 563727 - RNA, 65 nt, hsa; identical to SEQ ID NO: 192673

SEQ ID NO: 563728 - RNA, 65 nt, hsa; identical to SEQ ID NO: 192674

SEQ ID NO: 563729 - RNA, 65 nt, hsa; identical to SEQ ID NO: 192675

SEQ ID NO: 563730 - RNA, 65 nt, hsa; identical to SEQ ID NO: 192676

SEQ ID NO: 563731 - RNA, 65 nt, hsa; identical to SEQ ID NO: 192677

SEQ ID NO: 563732 - RNA, 65 nt, hsa; identical to SEQ ID NO: 192678

SEQ ID NO: 563733 - RNA, 65 nt, hsa; identical to SEQ ID NO: 192679

SEQ ID NO: 563734 - RNA, 65 nt, hsa; identical to SEQ ID NO: 192680

SEQ ID NO: 563735 - RNA, 64 nt, hsa; identical to SEQ ID NO: 138762

SEQ ID NO: 563736 - RNA, 64 nt, hsa; identical to SEQ ID NO: 138763

SEQ ID NO: 563737 - RNA, 64 nt, hsa; identical to SEQ ID NO: 138764

SEQ ID NO: 563738 - RNA, 64 nt, hsa; identical to SEQ ID NO: 138765

SEQ ID NO: 563739 - RNA, 64 nt, hsa
uaucuuggguacuugagcagacgguauauuccagaggugggaggugggaggggaagggagaaau

SEQ ID NO: 563740 - RNA, 64 nt, hsa
gguacuugagcagacgguauauuccagaggugggaggugggaggggaagggagaaauccaaaac

SEQ ID NO: 563741 - RNA, 64 nt, hsa
ccucaacaccucugcacaagcugcacccucaggcaggugggauggauuuccagccaaagccucc

SEQ ID NO: 563742 - RNA, 64 nt, hsa
agugugccugaagucccagauacuuggggggcugaggugggaggaucucuugagccugggaggu

SEQ ID NO: 563743 - RNA, 64 nt, hsa
cucacgccuguaauccuagcacuuugggaggccaaggugggaggauugcuugagcucaggaguu

SEQ ID NO: 563744 - RNA, 64 nt, hsa
cccugugugcuagugucugggaaguuucccugaaaggugggaggcggguggguggucuuuugga

SEQ ID NO: 563745 - RNA, 64 nt, hsa
caacccaaugcgaaguauuugggugagaacugagaggugggagaugauuggaggccauggccua

SEQ ID NO: 563746 - RNA, 64 nt, hsa
ugugcaucuauagucccugcuauuugagaggcugaggugggaggaucauuugagugcaggaguu

SEQ ID NO: 563747 - RNA, 64 nt, hsa
cacaccccuguagucccagcuacuugggaggcugaggugggaggauugcuugaacccaagaggu

SEQ ID NO: 563748 - RNA, 64 nt, hsa
cacaugccuguaguuccagcuacucaggaggcugaggugggagaaucuccugagccuggaaggu

SEQ ID NO: 563749 - RNA, 64 nt, hsa
acgagcauacuuguaccuuugucucugggcaaacaggugggacuguuagugacccauuugggaa

SEQ ID NO: 563750 - RNA, 64 nt, hsa
cccugcagggcagggaccccuugggaaaucgaggaggugggacgggcugggcccugugucccag

SEQ ID NO: 563751 - RNA, 64 nt, hsa
caugugccuguggucccagcuacucaggaggcugaggugggaaaaucacuugagcccaggaggu

SEQ ID NO: 563752 - RNA, 64 nt, hsa
cagagggagcccaugggcuguuugaauuugggagaggugggauucauuacaagacuuugggcuc

SEQ ID NO: 563753 - RNA, 64 nt, hsa
ggguauguugagaaacauccugaggcaaggugggaggugggauggggcaggacuuucccuucca

SEQ ID NO: 563754 - RNA, 64 nt, hsa
caugaagggguauguugagaaacauccugaggcaaggugggaggugggauggggcaggacuuuc

SEQ ID NO: 563755 - RNA, 64 nt, hsa
cucacaccuguaauccaagcacuuugggaggccaaggugggagcaucacuugauccugggaguu

SEQ ID NO: 563756 - RNA, 64 nt, hsa
uguguuccuguagucccagcuccccaggaggcugaggugggagguuggcuuuaacccaggaggc

SEQ ID NO: 563757 - RNA, 64 nt, hsa
gaguucaggagaggguucuggaccacagauguugaggugggagucauuagugaauagaugaugu

SEQ ID NO: 563758 - RNA, 64 nt, hsa
ccuaugcuuguagucacagcuacucgggaggccgaggugggagggucuucugagcccagggagg

SEQ ID NO: 563759 - RNA, 64 nt, hsa
cucacagcuauaaucucagcacuuugggaggcugaggugggagaauugccugagcccaggaguu

SEQ ID NO: 563760 - RNA, 64 nt, hsa
cacacaucuguggucccaggugcucaggaagcugaggugggaggaucacuugagcccaauucaa

SEQ ID NO: 563761 - RNA, 64 nt, hsa
guguuauggcaguggaggugggaauuuaguccccaggugggacaagggaaguuuuuucauuuug

SEQ ID NO: 563762 - RNA, 64 nt, hsa
uuuuuauuuuguuucucuaguguuauggcaguggaggugggaauuuaguccccaggugggacaa

SEQ ID NO: 563763 - RNA, 64 nt, hsa
gacuuagaacggggggaggggguaccagguggccaggugggacuguuucaaauuucccugaucc

SEQ ID NO: 563764 - RNA, 64 nt, hsa
aggcccuugguguuuuaccacagaccccagcgucaggugggaguacugcaaccugacgcgaugc

SEQ ID NO: 563765 - RNA, 64 nt, hsa
acaacccugguguuacacaacugauccgugugugaggugggaguacugcaaccugacacaaugc

SEQ ID NO: 563766 - RNA, 64 nt, hsa
aggcccuugguguuauacaacggaucccaaagucaggugggaguacugcaaccugacaggaugc

SEQ ID NO: 563767 - RNA, 64 nt, hsa
ugcacacuuguagucccagcuacucaggaggcugaggugggagaauugcuugggcccaggaauu

SEQ ID NO: 563768 - RNA, 64 nt, hsa
cucacaccuguaaucccagcacuuugggaggucgaggugggaggaucgcuugaggccaggaguu

SEQ ID NO: 563769 - RNA, 64 nt, hsa
cccaccuagugccccagacugagcucuccaggccaggugggaacggcugauguggacugucuuu

SEQ ID NO: 563770 - RNA, 64 nt, hsa
ggugcuaaagccaaccagccuuuggguccugggcaggugggagcugaaaaggaucgaggcaugg

SEQ ID NO: 563771 - RNA, 64 nt, hsa
gagagaauagagcugccacugggcaccugcgcacaggugggaggaaagggccuggccaguccug

SEQ ID NO: 563772 - RNA, 64 nt, hsa
cucaugccuguaauccuaacacuuugggaggccaaggugggaagauugccugagcucaggaguu

SEQ ID NO: 563773 - RNA, 64 nt, hsa
augcuucccaccuuaccuuuuagauucuuuugcuaggugggagauuguuauaaggucuuuaaac

SEQ ID NO: 563774 - RNA, 64 nt, hsa
aauuaagggacuggagagaggugaagaauuuugcaggugggagauuuggauuugaauguggacu

SEQ ID NO: 563775 - RNA, 64 nt, hsa
ugccccuuuuucccaccgauucgguggcuggugaaggugggagaugugaacuccaauuaaggga

SEQ ID NO: 563776 - RNA, 64 nt, hsa
cccagcagacgagacagcaaagaccaaggccuggaggugggagcgucugccccagugaggaggc

SEQ ID NO: 563777 - RNA, 64 nt, hsa
ugucuccacccccuuccauguguugaauaauaaaaggugggaaagugcugucacgaggagcucc

SEQ ID NO: 563778 - RNA, 64 nt, hsa
gggaaccuguauaaggguauugagugugagguugaggugggacauuugcugagcaaggagaacc

SEQ ID NO: 563779 - RNA, 64 nt, hsa
uaacuucucacuuggaacagacugcguaagagccaggugggauaagguaaagcaacucagcugc

SEQ ID NO: 563780 - RNA, 64 nt, hsa
guucaagugauucuccugccucagccucccaaguaggugggauuacaggcgcccgccaccacgc

SEQ ID NO: 563781 - RNA, 64 nt, hsa
aagcugcuuugaugcauggcuauaaucccagccgaggugggaggaucacuugaguccagguuca

SEQ ID NO: 563782 - RNA, 64 nt, hsa
uuagugcccgggaugggcacaguguuuugaagggaggugggagcucuugcucuccuggucacug

SEQ ID NO: 563783 - RNA, 64 nt, hsa
ggcaggaggcgggagcccggaucugugcgacugaaggugggaagaggaguacacggugcggauc

SEQ ID NO: 563784 - RNA, 64 nt, hsa
ucccuuuccucacccaguugguagaggagucaggaggugggaggccgugggcuuugguuuuaua

SEQ ID NO: 563785 - RNA, 64 nt, hsa
cucagccuuggguggcuugucucugcuucuugccaggugggagggccuguccacacccuggauc

SEQ ID NO: 563786 - RNA, 64 nt, hsa
gggagagauaauaggugugauuauuuuaauauggaggugggagugugguuggagauagaaaggc

SEQ ID NO: 563787 - RNA, 64 nt, hsa
cugaagggccuugggguaguuugcucagccuuucaggugggaaacccagauuuccucccuuugc

SEQ ID NO: 563788 - RNA, 64 nt, hsa
gguggcagaggugggaugagcuggaaagguauggaggugggagaggauggggcucuucugucug

SEQ ID NO: 563789 - RNA, 64 nt, hsa
cccucugaccccgcgaugaguguuuugguggcagaggugggaugagcuggaaagguauggaggu

SEQ ID NO: 563790 - RNA, 64 nt, hsa
ugugugccuguagucccagcuacuauggagguugaggugggaggaucgcuugagcccaugaggc

SEQ ID NO: 563791 - RNA, 64 nt, hsa
cucacucuuguaaucccaaaacuuuaggaggccaaggugggaggaucgcuugagcccaggaguu

SEQ ID NO: 563792 - RNA, 64 nt, hsa
ccagugcuccuugucaagcuccccccgucacuccaggugggagccaccccggugagggggugug

SEQ ID NO: 563793 - RNA, 64 nt, hsa
ggaagugucaugcaagugcuggacagaaggcggcaggugggacgagccccacagcccccuccuc

SEQ ID NO: 563794 - RNA, 64 nt, hsa
ccuagaucaccacuggauugcugacagauagaggaggugggacccugacuaucaccccuaaucu

SEQ ID NO: 563795 - RNA, 64 nt, hsa
gcaucuccccaccgagagaagcgggcuccuaaugaggugggaaagccacggcaggcagcgagca

SEQ ID NO: 563796 - RNA, 64 nt, hsa
cgcuuccucaagaagaggauuagcucugauuuugaggugggagacuccauggccucagaggaag

SEQ ID NO: 563797 - RNA, 64 nt, hsa
auccagggaugccaucugugggcacgcugugggcaggugggagcuugauucucagcacuugggg

SEQ ID NO: 563798 - RNA, 64 nt, hsa
ggccagaggcuuguuuugucuuuugguuuuuaugaggugggauaucccuaugcugccuaggcug

SEQ ID NO: 563799 - RNA, 64 nt, hsa
auugagcaccuacuauaugcagaaggggaggccgaggugggaggaucauuggaucucaggaguu

SEQ ID NO: 563800 - RNA, 64 nt, hsa
ugggugcuuguaguuccagcuacucaggaggcugaggugggaggaugacuugaacgcaggaggc

SEQ ID NO: 563801 - RNA, 64 nt, hsa
ggcuagaccaggucccugccgguccaccaggcggaggugggacaaagguccuaacaggagucac

SEQ ID NO: 563802 - RNA, 64 nt, hsa
cccuugcgggucccccaggaagccaggugaccccaggugggaggcuguguguggaggccauccu

SEQ ID NO: 563803 - RNA, 64 nt, hsa
gauggaaggugggagccaacacccuucugauggaaggugggagccaacacccuucugauggaag

SEQ ID NO: 563804 - RNA, 64 nt, hsa; identical to SEQ ID NO: 563803

SEQ ID NO: 563805 - RNA, 64 nt, hsa; identical to SEQ ID NO: 563803

SEQ ID NO: 563806 - RNA, 64 nt, hsa; identical to SEQ ID NO: 563803

SEQ ID NO: 563807 - RNA, 64 nt, hsa
uucagguuucccugggccagcaucuucugauggaaggugggagccaacacccuucugauggaag

SEQ ID NO: 563808 - RNA, 64 nt, hsa
auuagccggguuccaucaccugugguuccagcugaggugggaggaucacuugagccuaugaggu

SEQ ID NO: 563809 - RNA, 64 nt, hsa
ccuggcuguagagaagggcuacaucccugaacccaggugggacccguucccgcugcucacugcg

SEQ ID NO: 563810 - RNA, 64 nt, hsa
gcuccccuguaagcugggugagcuacugaagccaaggugggaggcagcugacaacaccacccac

SEQ ID NO: 563811 - RNA, 64 nt, hsa
cauggaaugaaacaggggagugagggacacaaggaggugggaagugggagggucccagccccac

SEQ ID NO: 563812 - RNA, 64 nt, hsa
cucacacauggaaucccagcacuuugggaggccgaggugggaggaucacuugagcccaggaguu

SEQ ID NO: 563813 - RNA, 64 nt, hsa
cacacaucaguagucccagcuacucugcaggcugaggugggaggauugcuugaacccaggaggu

SEQ ID NO: 563814 - RNA, 64 nt, hsa
uucccaaugucaaguuauuaggguagacuccaggaggugggauucuucaacuaaagaauaugaa

SEQ ID NO: 563815 - RNA, 64 nt, hsa
uuuagguuccccuggacuccagccaaggcuguucaggugggaccauggugcucuuuaagcguga

SEQ ID NO: 563816 - RNA, 64 nt, hsa
gguuucacugacguuuuccucaauuuuugaauuuaggugggauuugcuuucauguccuguuuca

SEQ ID NO: 563817 - RNA, 64 nt, hsa
ugggguggggcuggcauccucccaggaagguucuaggugggaccccgucuucugggggcggggg

SEQ ID NO: 563818 - RNA, 64 nt, hsa
cugauacauaccuaaguaaacauaacauuaauaccuaaguaaacauaacauuacuuggaggguu

SEQ ID NO: 563819 - RNA, 64 nt, hsa
aucugcuuuggaaauuauugccucugauacauaccuaaguaaacauaacauuaauaccuaagua

SEQ ID NO: 563820 - RNA, 64 nt, hsa
auucugauuaagcuuacuuuaccuuacauuuuuucuaaguaacaaugaauccugauuucuagug

SEQ ID NO: 563821 - RNA, 64 nt, hsa
cauuuuuucagauucuuauuucuacuaccaacaacuaaguaauugggaaauaauucuguauuuc

SEQ ID NO: 563822 - RNA, 64 nt, hsa
auauuugacuuuucauaaguaguggaagguuucacuaaguaaaacucucaguuucuugguaucu

SEQ ID NO: 563823 - RNA, 64 nt, hsa
guauuugacuuuucauaaguaguggaagguuucacuaaguaaagaucugaguuucuugguaucu

SEQ ID NO: 563824 - RNA, 64 nt, hsa
uuucugauccuggccccuaaagaauuuacuugugcuaaguaauaaaauuccuauugaucaaaac

SEQ ID NO: 563825 - RNA, 64 nt, hsa
caugacacugcaguuaaauugguuggccuaaggacuaaguaauuuuucuucugcugaaguuuua

SEQ ID NO: 563826 - RNA, 64 nt, hsa; identical to SEQ ID NO: 361526

SEQ ID NO: 563827 - RNA, 64 nt, hsa; identical to SEQ ID NO: 361527

SEQ ID NO: 563828 - RNA, 64 nt, hsa; identical to SEQ ID NO: 361528

SEQ ID NO: 563829 - RNA, 64 nt, hsa; identical to SEQ ID NO: 361529

SEQ ID NO: 563830 - RNA, 64 nt, hsa; identical to SEQ ID NO: 361530

SEQ ID NO: 563831 - RNA, 64 nt, hsa; identical to SEQ ID NO: 361531

SEQ ID NO: 563832 - RNA, 64 nt, hsa; identical to SEQ ID NO: 361532

SEQ ID NO: 563833 - RNA, 64 nt, hsa; identical to SEQ ID NO: 361533

SEQ ID NO: 563834 - RNA, 64 nt, hsa; identical to SEQ ID NO: 361534

SEQ ID NO: 563835 - RNA, 64 nt, hsa; identical to SEQ ID NO: 361535

SEQ ID NO: 563836 - RNA, 64 nt, hsa; identical to SEQ ID NO: 326578

SEQ ID NO: 563837 - RNA, 64 nt, hsa; identical to SEQ ID NO: 326579

SEQ ID NO: 563838 - RNA, 64 nt, hsa; identical to SEQ ID NO: 326580

SEQ ID NO: 563839 - RNA, 64 nt, hsa; identical to SEQ ID NO: 326581

SEQ ID NO: 563840 - RNA, 64 nt, hsa; identical to SEQ ID NO: 326582

SEQ ID NO: 563841 - RNA, 64 nt, hsa; identical to SEQ ID NO: 326583

SEQ ID NO: 563842 - RNA, 64 nt, hsa; identical to SEQ ID NO: 326584

SEQ ID NO: 563843 - RNA, 64 nt, hsa; identical to SEQ ID NO: 326585

SEQ ID NO: 563844 - RNA, 64 nt, hsa; identical to SEQ ID NO: 326586

SEQ ID NO: 563845 - RNA, 64 nt, hsa; identical to SEQ ID NO: 326587

SEQ ID NO: 563846 - RNA, 64 nt, hsa; identical to SEQ ID NO: 326588

SEQ ID NO: 563847 - RNA, 64 nt, hsa; identical to SEQ ID NO: 326589

SEQ ID NO: 563848 - RNA, 64 nt, hsa; identical to SEQ ID NO: 326590

SEQ ID NO: 563849 - RNA, 64 nt, hsa; identical to SEQ ID NO: 326591

SEQ ID NO: 563850 - RNA, 64 nt, hsa
ggagcugaaccagggagcuagcaaaaguaaagcagacuuauaaaauuauagcuaugugcagcug

SEQ ID NO: 563851 - RNA, 64 nt, hsa
aauaauucaccuauauguguuugagguugugacagacuuauaaaaucuuuuuaaaaaauaaagc

SEQ ID NO: 563852 - RNA, 64 nt, hsa; identical to SEQ ID NO: 291360

SEQ ID NO: 563853 - RNA, 64 nt, hsa; identical to SEQ ID NO: 291361

SEQ ID NO: 563854 - RNA, 64 nt, hsa; identical to SEQ ID NO: 291362

SEQ ID NO: 563855 - RNA, 64 nt, hsa; identical to SEQ ID NO: 291363

SEQ ID NO: 563856 - RNA, 64 nt, hsa; identical to SEQ ID NO: 291364

SEQ ID NO: 563857 - RNA, 64 nt, hsa; identical to SEQ ID NO: 291365

SEQ ID NO: 563858 - RNA, 64 nt, hsa; identical to SEQ ID NO: 291366

SEQ ID NO: 563859 - RNA, 64 nt, hsa; identical to SEQ ID NO: 291367

SEQ ID NO: 563860 - RNA, 64 nt, hsa; identical to SEQ ID NO: 291368

SEQ ID NO: 563861 - RNA, 64 nt, hsa; identical to SEQ ID NO: 291369

SEQ ID NO: 563862 - RNA, 64 nt, hsa; identical to SEQ ID NO: 291370

SEQ ID NO: 563863 - RNA, 64 nt, hsa; identical to SEQ ID NO: 291371

SEQ ID NO: 563864 - RNA, 64 nt, hsa; identical to SEQ ID NO: 291372

SEQ ID NO: 563865 - RNA, 64 nt, hsa; identical to SEQ ID NO: 291373

SEQ ID NO: 563866 - RNA, 64 nt, hsa; identical to SEQ ID NO: 291374

SEQ ID NO: 563867 - RNA, 64 nt, hsa; identical to SEQ ID NO: 291375

SEQ ID NO: 563868 - RNA, 64 nt, hsa; identical to SEQ ID NO: 291376

SEQ ID NO: 563869 - RNA, 64 nt, hsa; identical to SEQ ID NO: 291377

SEQ ID NO: 563870 - RNA, 64 nt, hsa; identical to SEQ ID NO: 291378

SEQ ID NO: 563871 - RNA, 64 nt, hsa; identical to SEQ ID NO: 59936

SEQ ID NO: 563872 - RNA, 64 nt, hsa; identical to SEQ ID NO: 59937

SEQ ID NO: 563873 - RNA, 64 nt, hsa; identical to SEQ ID NO: 59938

SEQ ID NO: 563874 - RNA, 64 nt, hsa; identical to SEQ ID NO: 59939

SEQ ID NO: 563875 - RNA, 64 nt, hsa; identical to SEQ ID NO: 59940

SEQ ID NO: 563876 - RNA, 64 nt, hsa; identical to SEQ ID NO: 59941

SEQ ID NO: 563877 - RNA, 64 nt, hsa; identical to SEQ ID NO: 59942

SEQ ID NO: 563878 - RNA, 64 nt, hsa; identical to SEQ ID NO: 59943

SEQ ID NO: 563879 - RNA, 64 nt, hsa; identical to SEQ ID NO: 59944

SEQ ID NO: 563880 - RNA, 64 nt, hsa; identical to SEQ ID NO: 59945

SEQ ID NO: 563881 - RNA, 64 nt, hsa; identical to SEQ ID NO: 59946

SEQ ID NO: 563882 - RNA, 64 nt, hsa; identical to SEQ ID NO: 59947

SEQ ID NO: 563883 - RNA, 64 nt, hsa; identical to SEQ ID NO: 59948

SEQ ID NO: 563884 - RNA, 64 nt, hsa; identical to SEQ ID NO: 59949

SEQ ID NO: 563885 - RNA, 64 nt, hsa; identical to SEQ ID NO: 59950

SEQ ID NO: 563886 - RNA, 64 nt, hsa; identical to SEQ ID NO: 59951

SEQ ID NO: 563887 - RNA, 64 nt, hsa; identical to SEQ ID NO: 59952

SEQ ID NO: 563888 - RNA, 64 nt, hsa; identical to SEQ ID NO: 59953

SEQ ID NO: 563889 - RNA, 64 nt, hsa; identical to SEQ ID NO: 59954

SEQ ID NO: 563890 - RNA, 64 nt, hsa; identical to SEQ ID NO: 59955

SEQ ID NO: 563891 - RNA, 64 nt, hsa
ggcuuccaagagaaaggaggcuccguuuugcaaaguggaggagggacgagggacagggguuuca

SEQ ID NO: 563892 - RNA, 64 nt, hsa
cuccauucuggccagucccugcauccucccugggguggaggauggaaggaaagcugggacaagc

SEQ ID NO: 563893 - RNA, 64 nt, hsa
ccaaauauuuuagguguaauucauauguauuugaguggaggauuuuuuuucucauuuuucuagu

SEQ ID NO: 563894 - RNA, 64 nt, hsa
aguguuaaauuuuaaccagcauuaacaugguagaguggaggagugaguguguucaaagaucaac

SEQ ID NO: 563895 - RNA, 64 nt, hsa
guaacaggaaaaccacccacagcugaccggcucgguggaggacacuccugggacaggucucuuu

SEQ ID NO: 563896 - RNA, 64 nt, hsa
uuguagucacagaguggcugcaggccuuugaaaaguggaggaaagaaaagcccuucuccuugcc

SEQ ID NO: 563897 - RNA, 64 nt, hsa
aauagaauggugguuaucaagggcugguggggcaguggaggauugaggagauauuggucaaaau

SEQ ID NO: 563898 - RNA, 64 nt, hsa
aggcugaggcaggagaauugcuugaacgcgggagguggaggauacaaugaacccgaggucgcgc

SEQ ID NO: 563899 - RNA, 64 nt, hsa
gaggacuggaugaggauguccuguuauaguugcuguggaggaaguuccucugguuaauucucau

SEQ ID NO: 563900 - RNA, 64 nt, hsa
gcaggaguuugauaagcuucgcgaguucuugagaguggaggagcaggccauucuggaugccaug

SEQ ID NO: 563901 - RNA, 64 nt, hsa
gcagaggagaacaacuaguuccaaaacagugaacguggaggaugaagaugcugcguggaggaac

SEQ ID NO: 563902 - RNA, 64 nt, hsa
ccaaaacagugaacguggaggaugaagaugcugcguggaggaacaugcaauuuuauucaauaua

SEQ ID NO: 563903 - RNA, 64 nt, hsa
accuacaauucaguuaggcuagagacagaugcugguggaggaagggcugggccaccagggauca

SEQ ID NO: 563904 - RNA, 64 nt, hsa
gugaggacucuuuccgacugcccagaaaguggggguggaggaccgaggcuacagcuccacacgc

SEQ ID NO: 563905 - RNA, 64 nt, hsa
uguggaggacagcaguggcugcugggagagggcuguggaggaaggagcuucucggagcccccuc

SEQ ID NO: 563906 - RNA, 64 nt, hsa
gaucacaggaaguggaggagccagaggugccuuuguggaggacagcaguggcugcugggagagg

SEQ ID NO: 563907 - RNA, 64 nt, hsa
ugcugcucuucccccaccauuuggaucacaggaaguggaggagccagaggugccuuuguggagg

SEQ ID NO: 563908 - RNA, 64 nt, hsa
uuugcaaguaggcuuugaggggugaaggagauugguggaggagaguaaauaaucuagaggcaag

SEQ ID NO: 563909 - RNA, 64 nt, hsa
agcucacugccuauaagaggaaauaagagagaaaguggaggagagggacaaaaggaguaauuau

SEQ ID NO: 563910 - RNA, 64 nt, hsa
gacaaggucccuacucuuguggaguuuacuucugguggaggagacagaugauaaguaaacaaau

SEQ ID NO: 563911 - RNA, 64 nt, hsa
uuuaauuuuugcuagauugauauuaaaaacucauguggaggaacucaaggaauguuuagaagac

SEQ ID NO: 563912 - RNA, 64 nt, hsa
aaauacaaaauggacuaaauaauuuuaagagauaguggaggagaggggguacagacuuccuucu

SEQ ID NO: 563913 - RNA, 64 nt, hsa
agacagaaguauugagagaaacaccaagacucuaguggaggaauuaauucaaugggagauagua

SEQ ID NO: 563914 - RNA, 64 nt, hsa
uggugcugccuuggagggcugggggaaggaguguguggaggagggaggagggugaagacugagg

SEQ ID NO: 563915 - RNA, 64 nt, hsa
uggcugggaacauugcaucccaaagagcuucucaguggaggaggcuggggaaggcaugaggggg

SEQ ID NO: 563916 - RNA, 64 nt, hsa
uuggcagaaacgugaugugucccacaaacugcugguggaggaagaagauguucgucagccaauu

SEQ ID NO: 563917 - RNA, 64 nt, hsa
gcugcccucccucccacaaacaaaugaauccagcguggaggaaggcgcgccgccccgagcugga

SEQ ID NO: 563918 - RNA, 64 nt, hsa
uuggaaugaaauuccuccuuccccccaucucugaguggaggaagcccaccaaucugcccuuugc

SEQ ID NO: 563919 - RNA, 64 nt, hsa
ugccauagggucugcagccugcuggggcuaagcgguggaggaaggcucugucacuccaggcaua

SEQ ID NO: 563920 - RNA, 64 nt, hsa
agaccagugguccuuccucucccaauguggccauguggaggacaggaugucuuccuggggguug

SEQ ID NO: 563921 - RNA, 64 nt, hsa
ccugacucuguguuguaauuucaggggagcaucaguggaggaggcagugggggcagcagcagcc

SEQ ID NO: 563922 - RNA, 64 nt, hsa
ugugucaauucaguuuccuuagaccagugccaguguggaggauuaauugaaaaccaggaccaua

SEQ ID NO: 563923 - RNA, 64 nt, hsa
auuaaaugaguaaaggaagcccaaguacuuuuaaguggaggaaaugaaguacugugaauuuuua

SEQ ID NO: 563924 - RNA, 64 nt, hsa
gucuacucugucucugcugcuagagaagccaccuguggaggacugggcugugguugggccugag

SEQ ID NO: 563925 - RNA, 64 nt, hsa
guggaggacugggcugugguugggccugaggccuguggaggaggugaguguagccagcagcggc

SEQ ID NO: 563926 - RNA, 64 nt, hsa
cuuccacagggauuuucaggaaaggcagaagcucguggaggaugggcaucugagguggcccugc

SEQ ID NO: 563927 - RNA, 64 nt, hsa
uucucccccaucuucuuaagaagcaggggggcagguggaggagagugaggggagagcugcccgg

SEQ ID NO: 563928 - RNA, 64 nt, hsa
ugaggccaucggcugucucugcauuucauuggcuguggaggagagacuccuaggauggcugcug

SEQ ID NO: 563929 - RNA, 64 nt, hsa
gagagggagaguuuucaagguuuauggcaacuuuguggaggaccuggguaacucuuacccuugg

SEQ ID NO: 563930 - RNA, 64 nt, hsa; identical to SEQ ID NO: 517844

SEQ ID NO: 563931 - RNA, 64 nt, hsa; identical to SEQ ID NO: 517845

SEQ ID NO: 563932 - RNA, 64 nt, hsa; identical to SEQ ID NO: 517846

SEQ ID NO: 563933 - RNA, 64 nt, hsa; identical to SEQ ID NO: 517847

SEQ ID NO: 563934 - RNA, 64 nt, hsa; identical to SEQ ID NO: 517848

SEQ ID NO: 563935 - RNA, 64 nt, hsa; identical to SEQ ID NO: 517849

SEQ ID NO: 563936 - RNA, 64 nt, hsa; identical to SEQ ID NO: 517850

SEQ ID NO: 563937 - RNA, 64 nt, hsa; identical to SEQ ID NO: 517851

SEQ ID NO: 563938 - RNA, 64 nt, hsa
cuuacguuaauguaauuauuaauauguuaggauuuauccucagucagccaguuuguuaugucuu

SEQ ID NO: 563939 - RNA, 64 nt, hsa
acagacuuguaaccuggcauguaccuauugacuguauccucaugcauuuuccucaagaaugucu

SEQ ID NO: 563940 - RNA, 64 nt, hsa
acacccacccacccccaagugcaugucuccaucacuuaaaaaguaaguuccauuugaaaauauc

SEQ ID NO: 563941 - RNA, 64 nt, hsa
auuuuuaauuaagaaaggguaguuugguagucuacuuaaaaauguuucugggaaauucacuaga

SEQ ID NO: 563942 - RNA, 64 nt, hsa
aaccacgaguaagauauuauuuaaauguugaaaucuuaaaaaccugccuccaagauuucagaag

SEQ ID NO: 563943 - RNA, 64 nt, hsa
ggucauguaacagguaaccacaauuuucagguuucuuaaaaacagcuguaacuaacucaggauu

SEQ ID NO: 563944 - RNA, 64 nt, hsa
uauacuucauuuuacaauacauauucccuuuuaacuuaaaaaaauuguaaaugugggagaaaaa

SEQ ID NO: 563945 - RNA, 64 nt, hsa
auuaauuuacaaugucccugauauugagcuaacucuuaaaaaaaccaaacaaaacucguaucug

SEQ ID NO: 563946 - RNA, 64 nt, hsa
ccugugauguaacuguaagccuucucgacuuagacuuaaaaaguggucacauagauuaauuuug

SEQ ID NO: 563947 - RNA, 64 nt, hsa
aauuauaaauuauuuuuggauugcugagcugaaucuuaaaaagccaaguugauauacauaguca

SEQ ID NO: 563948 - RNA, 64 nt, hsa
uaaagucaguaugaacuauaauaaauaucuguagcuuaaaaaguagguucacauguacagguaa

SEQ ID NO: 563949 - RNA, 64 nt, hsa
ucuguucauagaguuguauaauaaaacaugauugcuuaaaaacuuguauaguugucuagauuuc

SEQ ID NO: 563950 - RNA, 64 nt, hsa
gcacuccagccugggugacagagcaagacccugucuuaaaaaaagaggauucaacacauauuuu

SEQ ID NO: 563951 - RNA, 64 nt, hsa
uuaagaccccuaauagccuuuuguaacuugauggcuuaaaaauacuuaauaaaucugccauuuc

SEQ ID NO: 563952 - RNA, 64 nt, hsa
cauacuucuucauucaauacaagugugguagggacuuaaaaaacuuguaaaugcugucaacuau

SEQ ID NO: 563953 - RNA, 64 nt, hsa
guuuagaggaaaaaaaugacuaaaaauauuauaacuuaaaaaaaugacagauguugaaugccca

SEQ ID NO: 563954 - RNA, 64 nt, hsa
uuuuucuauuuggaaaagacuuuauaaauguuggcuuaaaaagagguugagcaccagaaucuca

SEQ ID NO: 563955 - RNA, 64 nt, hsa
uaggauugcuaaaauagaaaguuuggaguauuuucuuaaaaaauucauuguucuacaaguaaau

SEQ ID NO: 563956 - RNA, 64 nt, hsa
ccaaaaaucagguuaguaggcucauuuccaugugcuuaaaaauguuuuuguuguuaugcauuga

SEQ ID NO: 563957 - RNA, 64 nt, hsa
gacuucauuuguauacauuuggaaucuaaaccagcuuaaaaacaguuuccucaaugacuuagau

SEQ ID NO: 563958 - RNA, 64 nt, hsa
augagggaaucugaaauguuucauaaaaauaaagcuuaaaaauugucuuacacuggauaaaagu

SEQ ID NO: 563959 - RNA, 64 nt, hsa
guuucaaacacaacuugaaaauuaaaagugcccucuuaaaaauacaaaaaucaaaaagaggaaa

SEQ ID NO: 563960 - RNA, 64 nt, hsa
agccauauuaaaauuuugaaaauauaguuaucuucuuaaaaaccauuauaacaauucagagaga

SEQ ID NO: 563961 - RNA, 64 nt, hsa
caaaaguaaacuuauuuuauuauacagauuauuucuuaaaaacucuauuuauaccuuaacauga

SEQ ID NO: 563962 - RNA, 64 nt, hsa
agaauaaaaauaugccuuuagucauuugguuuuucuuaaaaaguugagauucuuaaucugacuu

SEQ ID NO: 563963 - RNA, 64 nt, hsa
uuccaaacuuucagcagugauauuauuuccauaacuuaaaaagugaguuugaaaaagaaaaucu

SEQ ID NO: 563964 - RNA, 64 nt, hsa
gaagcuauuauuaacuacugcaagcuaagccgagcuuaaaaaugccuuuuguuuuaaaugggcu

SEQ ID NO: 563965 - RNA, 64 nt, hsa
acacuuggaugucucgcuucacaauaaaacacagcuuaaaaauaaaauaacugaaagaaauaga

SEQ ID NO: 563966 - RNA, 64 nt, hsa
aaauuccuaaaaggaaacuguauaagcaauugcccuuaaaaauuaaaaagaauaaaagauuuuc

SEQ ID NO: 563967 - RNA, 64 nt, hsa
ucugcuuuuuaacaauuuguauacagggguuggacuuaaaaacacacauacaaacaaaacucuu

SEQ ID NO: 563968 - RNA, 64 nt, hsa
uaaugauggugcuaaaauucuuccuauaaaauuccuuaaaaauaaagaugguuuaaucacuacc

SEQ ID NO: 563969 - RNA, 64 nt, hsa
uguguaacuauaauagagacucuuuaaggagaaucuuaaaaaaaaaaaaacguuucucacuguc

SEQ ID NO: 563970 - RNA, 64 nt, hsa
cgugacacucauuuuagugcuuuguuuccgugcacuuaaaaauaauugagaagaaaaacucaau

SEQ ID NO: 563971 - RNA, 64 nt, hsa
uauuuuacugaggaugaucgaagaacuggcuuuacuuaaaaauaugcuaauucucagaaaggca

SEQ ID NO: 563972 - RNA, 64 nt, hsa
aaaaaacuguuuuugcauaggguaguacuaagaucuuaaaaagugguaacugucuugaagaaaa

SEQ ID NO: 563973 - RNA, 64 nt, hsa
ucaguucuuaucugaauuccaaaauaaaccugugcuuaaaaaagaaauaauugaccaaguaagu

SEQ ID NO: 563974 - RNA, 64 nt, hsa
aaaguaugcagguagcaaagauguaauaaauuugcuuaaaaaaagaaauuaaaguuuuauuuag

SEQ ID NO: 563975 - RNA, 64 nt, hsa
cuagaggauagagcugcaucacuuaaauucaugacuuaaaaaauaauacaguuuauauacaacu

SEQ ID NO: 563976 - RNA, 64 nt, hsa
uuacgccacccaauguauagccaaauuguacgugcuuaaaaaacagugccgagaguauguucag

SEQ ID NO: 563977 - RNA, 64 nt, hsa
cggccaucacaaccacucacugagaguugcccuucuuaaaaauguauuuuauuuuagccagugg

SEQ ID NO: 563978 - RNA, 64 nt, hsa
agaccagccugggcaacacagcgagaccccaucucuuaaaaaauaacagacuugaggaaccccu

SEQ ID NO: 563979 - RNA, 64 nt, hsa
cagggauguuuuguuuagcuugcggacucuaacacuuaaaaaaaaacccagaucagaagaucug

SEQ ID NO: 563980 - RNA, 64 nt, hsa
uuuucuguugccacugcaaccuauuacuugguagcuuaaaaacaacacauuagcuuauaguccu

SEQ ID NO: 563981 - RNA, 64 nt, hsa
aagaaaagcucccucaguuuuuuggagggaauaacuuaaaaaaauacuuaaauggcuaaguuua

SEQ ID NO: 563982 - RNA, 64 nt, hsa
ccuuuuucuucaguaaacccaacaauagucuaaccuuaaaaauugaguugauguccuuauaggu

SEQ ID NO: 563983 - RNA, 64 nt, hsa
gauccuaugagagaagagaguauggugcuggguccuuaaaaaaaaaaaugauacuugguccuua

SEQ ID NO: 563984 - RNA, 64 nt, hsa
gcuggguccuuaaaaaaaaaaaugauacuugguccuuaaaaaauaugcucuccccucccuuuuu

SEQ ID NO: 563985 - RNA, 64 nt, hsa
aaaguuguaucuugacacaggaaaugggaaaaaacuuaaaaauuaauaugguguauuuuuccaa

SEQ ID NO: 563986 - RNA, 64 nt, hsa
gucauuuggugcucugcuaaccauuuauauaaaacuuaaaaacaagagaaaagaaaaaucaauu

SEQ ID NO: 563987 - RNA, 64 nt, hsa
aucuguggauucaaccaaccaaggacggaaaaugcuuaaaaaauaauacaacaacaacaaaaaa

SEQ ID NO: 563988 - RNA, 64 nt, hsa
caagucauuuuuguauuuuucaucuuuaagaaugcuuaaaaaagcuaaucccuaaaauaguuag

SEQ ID NO: 563989 - RNA, 64 nt, hsa
acuuuccaagguuauuucugaauguaacaauuuccuuaaaaaugacuuauccaauuucuguauu

SEQ ID NO: 563990 - RNA, 64 nt, hsa
uguagcuaaacuaauuuugcaaaucaaacagacacuuaaaaaacuagcauauguaaagguauuc

SEQ ID NO: 563991 - RNA, 64 nt, hsa
uguuuucaaugacaguaagcuacaaaucaugaugcuuaaaaacuuucuaaagaugaauugugug

SEQ ID NO: 563992 - RNA, 64 nt, hsa
uguaucauauuuaucacaugaccacuuuugauuccuuaaaaagacauuacaggcuuaaauucca

SEQ ID NO: 563993 - RNA, 64 nt, hsa
uauuaacuggcacauauguacuaaaaaccccucacuuaaaaauggcagucucaauccuacuguc

SEQ ID NO: 563994 - RNA, 64 nt, hsa
gaaacguuguuacugaugaguaccacagacucaucuuaaaaaaaacucucauuauggugaucau

SEQ ID NO: 563995 - RNA, 64 nt, hsa
aaauugaaagcuugcuguacaaaggcaacagcaacuuaaaaaagaaaaucuggacaauagaugu

SEQ ID NO: 563996 - RNA, 64 nt, hsa
auugaagauucaucccauacuucuauauaccaugcuuaaaaaucacgucauucuuuaaacaaaa

SEQ ID NO: 563997 - RNA, 64 nt, hsa
auacugucugugaaauaauguaagaagcuuuucacuuaaaaaaaaugcauuacuuucacuuaac

SEQ ID NO: 563998 - RNA, 64 nt, hsa
uguucuuuuauuuuuaauuauuauuuccccgucccuuaaaaagacaaaaaaaauaaggcaaaag

SEQ ID NO: 563999 - RNA, 64 nt, hsa
aaucuauaugggauguaauuuuuuuguucagucucuuaaaaaauacuuuguuuugguacauuug

SEQ ID NO: 564000 - RNA, 64 nt, hsa
uaaaaagcuaaagcugccaaauuucuguugaacucuuaaaaacagcucauguuuguuuguccuc

SEQ ID NO: 564001 - RNA, 64 nt, hsa
auauuuaaauaacuuauuuuucuccauugcuguucuuaaaaacauuguaaguagcuguaauaua

SEQ ID NO: 564002 - RNA, 64 nt, hsa
aaaauuaauguuuucccuuaacauggcucaauaacuuaaaaacguucauuuaaauaaaauuuua

SEQ ID NO: 564003 - RNA, 64 nt, hsa
uugauuuauaccauuauuaaccugauguggucugcuuaaaaaaugaauauaucaguauuuagaa

SEQ ID NO: 564004 - RNA, 64 nt, hsa
uuucuuuuucuuaauggaagaagauauuuaauaucuuaaaaauauuccaaguuaggaagaacac

SEQ ID NO: 564005 - RNA, 64 nt, hsa
uuaucagccugggcaacacagugagacuccaucucuuaaaaaaaaaauuagcuggguauagugg

SEQ ID NO: 564006 - RNA, 64 nt, hsa
cuuccuaaguauaaaugguugucuguuuuuguaacuuaaaaaaaaaaaaaaaaguuuggccggg

SEQ ID NO: 564007 - RNA, 64 nt, hsa
ugcacuccggccugaugacagagcgagauuccgucuuaaaaaaaaaaaaaaaaaaguuuguuuu

SEQ ID NO: 564008 - RNA, 64 nt, hsa
gcagugagcuaugauugcaccacuguacuccugccuuaaaaaaaaaaaaaaaaucccaauaguc

SEQ ID NO: 564009 - RNA, 64 nt, hsa
aauaccccccaacuuuuuuagagacagccugucucuuaaaaaaaaaauuaauuugguagugaga

SEQ ID NO: 564010 - RNA, 64 nt, hsa
ggaauaauugccccuuugcagagaaaaaaaaaaacuuaaaaaaagcacaugccuacugcugccu

SEQ ID NO: 564011 - RNA, 64 nt, hsa
aaugaauugugccuaguggagaaccucuauagaucuuaaaaaaugaauuauucuuuagcagugu

SEQ ID NO: 564012 - RNA, 64 nt, hsa
aaaaagagccugggcaauuuuuuuaagacucugucuuaaaaaaaacuaaaaagaaaaaaagaag

SEQ ID NO: 564013 - RNA, 64 nt, hsa
gcacuccagccugggcaagaguuuuuuuaagacucuuaaaaaaagagccugggcaauuuuuuua

SEQ ID NO: 564014 - RNA, 64 nt, hsa
gacaucugaacauauucaguuuucaguagaagaacuuaaaaauuuguucacauuacaugaaagu

SEQ ID NO: 564015 - RNA, 64 nt, hsa
ggaaaauaguccccaucuaauauguauaggagcucuuaaaaaacugugcaaucaccccugccuu

SEQ ID NO: 564016 - RNA, 64 nt, hsa
uuuuuaaugcuuaggggaagaauauaaguaucuccuuaaaaagaacauaauucucauucacgca

SEQ ID NO: 564017 - RNA, 64 nt, hsa
uugucauugguaaauaguagucuauuuuccucugcuuaaaaaaaauuuuaaguauauccuuuaa

SEQ ID NO: 564018 - RNA, 64 nt, hsa
uuuuaaaauaaaauaaguucuuaaaaaauuuauacuuaaaaaauccugcccaaaaugugaagcu

SEQ ID NO: 564019 - RNA, 64 nt, hsa
aaccuguucuuccuuuuuuaaaauaaaauaaguucuuaaaaaauuuauacuuaaaaaauccugc

SEQ ID NO: 564020 - RNA, 64 nt, hsa
aauaaaaugcuuuuucuacuauuugucuugauuacuuaaaaaaauaaaaauauaaguaaggauc

SEQ ID NO: 564021 - RNA, 64 nt, hsa
ugaauugugaaauggauguuuaagaaaauauaggcuuaaaaaguaaaucuauaaaaugaugucu

SEQ ID NO: 564022 - RNA, 64 nt, hsa
gugcaauccaugauuuauacucagaaucgacauucuuaaaaaguuauuucaagggauggcauaa

SEQ ID NO: 564023 - RNA, 64 nt, hsa
gcaguuuggggguaaagcauuuuggaggaauaaccuuaaaaaguuaaaaagucauuguaauaac

SEQ ID NO: 564024 - RNA, 64 nt, hsa
cugucaguaucaaugcuuagagaaauauccuuuccuuaaaaagaaaauaacuuuuauauuuaga

SEQ ID NO: 564025 - RNA, 64 nt, hsa
auauugugcuuuaugugguaguguuguacccauucuuaaaaauaaaucacaucauauauaugug

SEQ ID NO: 564026 - RNA, 64 nt, hsa
aguuuaaguggcuugauuaaauggcugaucaaaacuuaaaaacacacuaggucaauguuuuuca

SEQ ID NO: 564027 - RNA, 64 nt, hsa
uuuaaaccccuuacacucuuuggucuuacacauccuuaaaaaugauuauuuauaaauugaauua

SEQ ID NO: 564028 - RNA, 64 nt, hsa
ugaggagugaacauuuggguaaaucauggcuaagcuuaaaaaaaacucauggugaggcuuaaca

SEQ ID NO: 564029 - RNA, 64 nt, hsa
caugaccagaagggaaacagucauuugcgcacaacuuaaaaagucugcauuacauuccuugaua

SEQ ID NO: 564030 - RNA, 64 nt, hsa
aaguuccuaggaaaaaaggaauaaaguuuuuuuccuuaaaaaaaaaaaaauugcucuuggcugu

SEQ ID NO: 564031 - RNA, 64 nt, hsa
gucaaaacuugcaauauaacauucuauugacuuucuuaaaaauauuuuuucuguaccuaacuug

SEQ ID NO: 564032 - RNA, 64 nt, hsa
uguugcugacaaacuuaucccaaaacuuuaguggcuuaaaaaaaccugcccccaacuguuaguc

SEQ ID NO: 564033 - RNA, 64 nt, hsa
cccacguauauuauguagucuauuugcaacuguucuuaaaaaaaugacauuaaaagaauaguuu

SEQ ID NO: 564034 - RNA, 64 nt, hsa
aauuaagaguugaccuuuuaaguuaauguauaugcuuaaaaacaguuuuaggaaaauauuuggu

SEQ ID NO: 564035 - RNA, 64 nt, hsa
cgaguucugcugaucaggaaauuuaagaauuuaucuuaaaaaugcaaggaaaaaagacugccuu

SEQ ID NO: 564036 - RNA, 64 nt, hsa
auagcuucccuuccggaaagcuugcuuugaaaaacuuaaaaagcccccguuuacauguaggcag

SEQ ID NO: 564037 - RNA, 64 nt, hsa
uuuaaaaaugugacuuucuuguuuugucucaaaacuuaaaaaaacaaacacaaaaagaugaguc

SEQ ID NO: 564038 - RNA, 64 nt, hsa
accaagguccucagacugcuuuuagcaucugcaacuuaaaaaaaugggaguuagaaaaagaaca

SEQ ID NO: 564039 - RNA, 64 nt, hsa
guuauuuagugacaaacguggcuuucaaacuaugcuuaaaaaguuccggcuggacacgguggcu

SEQ ID NO: 564040 - RNA, 64 nt, hsa
uuuuuaauuaaauaguuaaaauaauguagugcaacuuaaaaauaucuauggcuuuguuuuuguu

SEQ ID NO: 564041 - RNA, 64 nt, hsa
ccagagcuuuauuaagaagcauuucuuuucuucccuuaaaaaauagaugcuuauuuuuauugac

SEQ ID NO: 564042 - RNA, 64 nt, hsa
auauauuacuuguaagguaugaugaauaacaacacuuaaaaacucaucacaccuaaagacaugg

SEQ ID NO: 564043 - RNA, 64 nt, hsa
ucuuucagaaggcaaauaggaaacuauauauuugcuuaaaaauuggcauuuaguaaccuuaauu

SEQ ID NO: 564044 - RNA, 64 nt, hsa
aagauuuaccuuuuuaaauaaauguuguagaauacuuaaaaaaaacaaacuagaauuugccugu

SEQ ID NO: 564045 - RNA, 64 nt, hsa
aagcauguaaagguguuuaagacuuccgcugcugcuuaaaaauaacaugucauugaagucauaa

SEQ ID NO: 564046 - RNA, 64 nt, hsa
ucacauuccacaucuguuucaaacugaauuuguucuuaaaaaaauaaaauauuuuuuuccuaug

SEQ ID NO: 564047 - RNA, 64 nt, hsa
auuuguggcaauuaaguggucccaaugcucagcgcuuaaaaaaacaaauuggacagcuacuucu

SEQ ID NO: 564048 - RNA, 64 nt, hsa
guuaggcuugaauucauuuauaugucuuuugauucuuaaaaaaacaaaaaacauuccauuagaa

SEQ ID NO: 564049 - RNA, 64 nt, hsa
augaauggcagguguucauuauaaucuguauugacuuaaaaaguuucuuccucaugaugcuaau

SEQ ID NO: 564050 - RNA, 64 nt, hsa
uacaaacaguuuuguaacucuuugcuuuuuaaaucuuaaaaaaaaaaaaguugcugaaguacug

SEQ ID NO: 564051 - RNA, 64 nt, hsa
ccgaaaaugcagggguuggcuuucugacugggaacuuaaaaaucacucuucaugcuucccuggu

SEQ ID NO: 564052 - RNA, 64 nt, hsa
ucacaaauucauuugucagccucuuuuuaguucucuuaaaaaaaaaaaaaucauaugaucauuu

SEQ ID NO: 564053 - RNA, 64 nt, hsa
auauucuacaguggauagaauuaggaauugauggcuuaaaaaaaaaagucuaugaagagucugu

SEQ ID NO: 564054 - RNA, 64 nt, hsa
uuugacuguaauaguauaguaguuaaauacagcacuuaaaaauaccacagacacaguuaaagca

SEQ ID NO: 564055 - RNA, 64 nt, hsa
guuuuccauauaccuuaggucuugaucguuuguccuuaaaaaggggaucagcaugaguauagac

SEQ ID NO: 564056 - RNA, 64 nt, hsa
uggcuaaaguaaaagggaaaaguagauccgauaacuuaaaaacguagcucaucccuuaccaucc

SEQ ID NO: 564057 - RNA, 64 nt, hsa
aacacaguagcaccuaaaucuguuuucaauugggcuuaaaaauugacaugcaaucucuuaaguu

SEQ ID NO: 564058 - RNA, 64 nt, hsa
caccuaguagggcaugugcauuuaaaaacuuguccuuaaaaauagaagacagaaguauuaaaau

SEQ ID NO: 564059 - RNA, 64 nt, hsa
cuuauucucuuaacaaauuuuaaaagguagugaucuuaaaaaaaaaucacuggauaacuaggaa

SEQ ID NO: 564060 - RNA, 64 nt, hsa
aaucauacucaaucuaggacauguuccuuuacuccuuaaaaaagaaaggaaagaucucuaaauu

SEQ ID NO: 564061 - RNA, 64 nt, hsa
cagagcucauaguauuuguuuucugcuccgaacacuuaaaaaauacuaagacgugauagugaaa

SEQ ID NO: 564062 - RNA, 64 nt, hsa
agaccagccugggaaacauagcaagaccccaucucuuaaaaaaaaagaaauauauagacauaua

SEQ ID NO: 564063 - RNA, 64 nt, hsa
aaggagacuuuagcuuugcuuguaguuuuuauaccuuaaaaagacugguagcauauaaaauaaa

SEQ ID NO: 564064 - RNA, 64 nt, hsa
gaacucagaauacagacaaguagaaagauucucgcuuaaaaaaaauguauuuauuuuauggcaa

SEQ ID NO: 564065 - RNA, 64 nt, hsa
caauggaaucauauaguauguaaccuguuuugagcuuaaaaaaaaaguauacaugacuuuaaug

SEQ ID NO: 564066 - RNA, 64 nt, hsa
uauggaaugauauuucauugcacuuuuaauuuaacuuaaaaaugccuucccuugacuguugaua

SEQ ID NO: 564067 - RNA, 64 nt, hsa
aguccagccagguugacagaaugagacccugucucuuaaaaaaaaaaaaaaaaauccuggugau

SEQ ID NO: 564068 - RNA, 64 nt, hsa
ucuuaaaaaaggcucaacccaaaagaaaccauuucuuaaaaaauuuuacauagaucaguuguau

SEQ ID NO: 564069 - RNA, 64 nt, hsa
aucaaggccuguuugcaaaggggagaucccuuuucuuaaaaaaggcucaacccaaaagaaacca

SEQ ID NO: 564070 - RNA, 64 nt, hsa
auuuggggggaaagaauagauauggggaaauaaacuuaaaaaaaaaucaggaauuuaaaaaaac

SEQ ID NO: 564071 - RNA, 64 nt, hsa
ugaauucaguuucaaucaaguuuacauuauguugcuuaaaaaaauagaaauuauucuuuaucuu

SEQ ID NO: 564072 - RNA, 64 nt, hsa
aaaaugcacagaaaugcaugcaauacuuauaagacuuaaaaauuguguuuacagaugguuuauu

SEQ ID NO: 564073 - RNA, 64 nt, hsa
uggugcagggcaauguuucaaaguuuagucacagcuuaaaaacauucagugugacuuuaauauu

SEQ ID NO: 564074 - RNA, 64 nt, hsa
uuaaaaaauugacauccuuuguacuuucuuuaaucuuaaaaaguacacggcuuuuuacuuauuu

SEQ ID NO: 564075 - RNA, 64 nt, hsa
gcucugauuccaucauguuuucuuaacaugauaacuuaaaaaauugacauccuuuguacuuucu

SEQ ID NO: 564076 - RNA, 64 nt, hsa
cccuauuucaaaaaaauaaaaauuggaagaagagcuuaaaaaagauaagauuuuaaagaguccc

SEQ ID NO: 564077 - RNA, 64 nt, hsa
aucaagguuagcaaacuuuauacguagccuaacacuuaaaaaaugcacucauuaucuuaaaccu

SEQ ID NO: 564078 - RNA, 64 nt, hsa
uguguaugcaucaacacaguauauguaaaacugucuuaaaaauccauuaacuucuaccuaaauc

SEQ ID NO: 564079 - RNA, 64 nt, hsa
cuggcuuuuguuaacuugauaauucuucaucuaccuuaaaaagaaaaaaauuacacauagucau

SEQ ID NO: 564080 - RNA, 64 nt, hsa
auauugugguaauuguaaguagugcauauuuuaucuuaaaaacucaggauugauguaagcacug

SEQ ID NO: 564081 - RNA, 64 nt, hsa
uaaugaaagcccucuuuuuggugaagagagucaacuuaaaaaauaaauugccauguuccaaaau

SEQ ID NO: 564082 - RNA, 64 nt, hsa
gugagccaccacgcccggccaugaaauauuuuuacuuaaaaauugggaauaagcuuuuugguuu

SEQ ID NO: 564083 - RNA, 64 nt, hsa
gugagccaccgugcccaaccaugaaauauuuuuacuuaaaaauugggaauaagcucgcuuuuuu

SEQ ID NO: 564084 - RNA, 64 nt, hsa
uuaaaagucuauuuuauuaugagcuuucuuugcacuuaaaaauuagcaugcugcuuuuuguacu

SEQ ID NO: 564085 - RNA, 64 nt, hsa
cauugucuacauagugacaugcacacgggaaagccuuaaaaauauccuugauguacagauuuua

SEQ ID NO: 564086 - RNA, 64 nt, hsa
uaaaaaugagaacaggugugaguuuuccaaaauacuuaaaaauaauagugucaaaaauucaggg

SEQ ID NO: 564087 - RNA, 64 nt, hsa
aaagcauaccuuccccaaaugagccuaccuacuucuuaaaaaacauauaacacaaugugguagu

SEQ ID NO: 564088 - RNA, 64 nt, hsa
aauuuucaccagucuauguaucucuggagugagaucuauguacaaagugacauacaauuggaaa

SEQ ID NO: 564089 - RNA, 64 nt, hsa
ucuuuauguauagcucugauagaauuuucaccagucuauguaucucuggagugagaucuaugua

SEQ ID NO: 564090 - RNA, 64 nt, hsa
ccagcuauugguguaccuauaauuuaagaaauagucuauguaaagucacaaauuaaugaaaaaa

SEQ ID NO: 564091 - RNA, 64 nt, hsa
uuugcaauguaaaauaaaguguuucugauuauuuucuauguaaaggaacccucuccuuuccccu

SEQ ID NO: 564092 - RNA, 64 nt, hsa
aacaauguauuugucaaugcaucaauuuaccuacucuauguaugcaucuauauguguauuaugu

SEQ ID NO: 564093 - RNA, 64 nt, hsa
aauuauagacaauuugcccuaucauuuauuuacaucuauguaucuaccaucuaaucuaugcaug

SEQ ID NO: 564094 - RNA, 64 nt, hsa
uggacaaaauguauaugguacagauguaaaguuuucuauguaaaaaauucuguacaacuuucug

SEQ ID NO: 564095 - RNA, 64 nt, hsa
ucuuuugggugguggggcuugauguagauuuuacucuauguacagaauuuaacguugaauauau

SEQ ID NO: 564096 - RNA, 64 nt, hsa
guggugguuauuagggcuuuuucugaaauguguaucuauguaacaucacuuaagugugcuuaau

SEQ ID NO: 564097 - RNA, 64 nt, hsa
augauaaggcuacaauucagaaucuucugaaccaucuauguaaugaauggggauuauacauugg

SEQ ID NO: 564098 - RNA, 64 nt, hsa
guuguuugccuucuuauuguuggauuuugagaguucuauguacaaguccuuugucagucgugug

SEQ ID NO: 564099 - RNA, 64 nt, hsa
caauaauuuuuggcuauucugcuuccuuuguguuucuauguaaauuuuaucaucagugugucua

SEQ ID NO: 564100 - RNA, 64 nt, hsa
aacugagcaguuucuguguauauauagaagguagaaaugaaaagugagaaaauauuugaaaggg

SEQ ID NO: 564101 - RNA, 64 nt, hsa
aacaaaagcaaagcauuaguggcuauggucuguaaaaugaaacaaaaaaacuuuauuucacuau

SEQ ID NO: 564102 - RNA, 64 nt, hsa
aaucagaaaauauaauaaaauugcacaaaaaaaaaaaugaaaaagaugcagacuggucuuuuag

SEQ ID NO: 564103 - RNA, 64 nt, hsa
aaacacagauaccacuuuaucagggaaguuagucaaaugaaauggaaauugguaaauggacaaa

SEQ ID NO: 564104 - RNA, 64 nt, hsa
uuggaguauuuucuuuauaauuucuugaacaggcaaaugaaagcuuauuauagaaugcauguau

SEQ ID NO: 564105 - RNA, 64 nt, hsa
ucauuuucgagggucuaaaauuaucugguaaaacaaaugaaauuaagugauccaaagcugcuga

SEQ ID NO: 564106 - RNA, 64 nt, hsa
ggacuaaaagguuuuauugaaauaaagccucuuaaaaugaaaaaucauauacuuuuaacaucac

SEQ ID NO: 564107 - RNA, 64 nt, hsa
auauuuggaaauaccuggauauuugcuagaggaaaaaugaaagcaaaacuucguacacagugcc

SEQ ID NO: 564108 - RNA, 64 nt, hsa
aaaauggucaaaaaauaagucaucagcacuuaagaaaugaaagcaacuuuugaaauuuucuguu

SEQ ID NO: 564109 - RNA, 64 nt, hsa
cagaugacuugugaaccccacaguguggaugugcaaaugaaaauugaaggaaagaauaugaacu

SEQ ID NO: 564110 - RNA, 64 nt, hsa
uuuuuaacaaauaaaaggcauuuaaguaaaacuaaaaugaaaaaaguaggccuucugacauugu

SEQ ID NO: 564111 - RNA, 64 nt, hsa
ugaugauaaaauuuguaucucauuaauuuuaucaaaaugaaacuaaaaguacauauguauuaua

SEQ ID NO: 564112 - RNA, 64 nt, hsa
guaauagagaaaagauuugucaguguguuuuuuuaaaugaaauaacuagucugugcuacuuuau

SEQ ID NO: 564113 - RNA, 64 nt, hsa
guuauaaucucuuuaggagagaagauuaucaaacaaaugaaacaaguaaaggaagaaagaaggu

SEQ ID NO: 564114 - RNA, 64 nt, hsa
auugaccagcuuaagagaaaacuagauacugacaaaaugaaacucauaguagaaguuaagguaa

SEQ ID NO: 564115 - RNA, 64 nt, hsa
aaaagaaaaaucaugucaucuucuauuuguacagaaaugaaaauaaaauaugaaaauaaugaaa

SEQ ID NO: 564116 - RNA, 64 nt, hsa
cagaaaugaaaauaaaauaugaaaauaaugaaagaaaugaaaagauagcuuuuaauugugguau

SEQ ID NO: 564117 - RNA, 64 nt, hsa
uaaauucagcuuugcuaauccagaaauuguucccaaaugaaaacuuguuuuaaguccaccccuu

SEQ ID NO: 564118 - RNA, 64 nt, hsa
ggcuuucauacccaaggaucuguuuccuugcugaaaaugaaacccuaucuuucacuuuacauuc

SEQ ID NO: 564119 - RNA, 64 nt, hsa
aguuuaggagccacgugagugaaaguuuuaagaaaaaugaaauuuaugucauacuuauuuuuuu

SEQ ID NO: 564120 - RNA, 64 nt, hsa
ccagcucagcuccacacaaagcugcagaaggacgaaaugaaaagcauuuggaaguuuaggagcc

SEQ ID NO: 564121 - RNA, 64 nt, hsa
acaguuuucuuucuccaagaacuuucaagccaacaaaugaaauuuaaaagcaaauguaaaagug

SEQ ID NO: 564122 - RNA, 64 nt, hsa
cccuauuuaaaaaagagcaguacauccugggaggaaaugaaacuaaagaacaguuagaguaacu

SEQ ID NO: 564123 - RNA, 64 nt, hsa
gaaaaggaggagcaaaggagauuuugagucacagaaaugaaacccaggcaaccagccuagaaga

SEQ ID NO: 564124 - RNA, 64 nt, hsa
ggaggcugcuuccccaugacacuagugaccaguaaaaugaaaaggaggagcaaaggagauuuug

SEQ ID NO: 564125 - RNA, 64 nt, hsa
cuacuucuuaacuuguuuuuuccauguuguagacaaaugaaauuugucuaaaugcuuuugucua

SEQ ID NO: 564126 - RNA, 64 nt, hsa
ucugggacaguaauaaaagauugcugcauaauuuaaaugaaaccuauguguauauaacuuucaa

SEQ ID NO: 564127 - RNA, 64 nt, hsa
gcaguauuggcauuguucucaagccuuuuuaugaaaaugaaaucugaaaucaccaaauguaaac

SEQ ID NO: 564128 - RNA, 64 nt, hsa
ugaggcccagcaagcaccacuaaauuacuggaugaaaugaaauuguucacuugagggauuaguc

SEQ ID NO: 564129 - RNA, 64 nt, hsa
gcauuucauuauguguucuacagugucggugaauaaaugaaaccaaucucaauuuagagguaug

SEQ ID NO: 564130 - RNA, 64 nt, hsa
uggccaaggaaacuguccauuucucucagaaagcaaaugaaaugcuacagcuauacccagaccu

SEQ ID NO: 564131 - RNA, 64 nt, hsa
uuuuuuuuuaauucccacuuuggcuguguacaucaaaugaaaugagaaguguguaugcugacca

SEQ ID NO: 564132 - RNA, 64 nt, hsa
uguauuaugagaaucuuauaaucggaauggagugaaaugaaacauuuugaguacugauggcaug

SEQ ID NO: 564133 - RNA, 64 nt, hsa
aauugccaauugauuguaacuauuauuuauuuuuaaaugaaaguguaagaaugcuuucugauuc

SEQ ID NO: 564134 - RNA, 64 nt, hsa
aggcuuaggacucugugccaaaaaucucuauuuuaaaugaaaauauuuauauaaaaauacauuu

SEQ ID NO: 564135 - RNA, 64 nt, hsa
uugguuguaacaaaauuugauuugaacuaccuauaaaugaaaagucgggguuuauuacuuuaua

SEQ ID NO: 564136 - RNA, 64 nt, hsa
uuuagaauccuuugaaucuaaguauuuguuuccuaaaugaaacauuuguacaacauuugauguu

SEQ ID NO: 564137 - RNA, 64 nt, hsa
cucuauuuaaaagcuaagaaauguuuuaaaggaaaaaugaaauuaucuuccuuuagcuuauuuu

SEQ ID NO: 564138 - RNA, 64 nt, hsa
acuucacuucuuuguauauuauguauaaauuagaaaaugaaaaaugugugaauaacauuguaug

SEQ ID NO: 564139 - RNA, 64 nt, hsa
caaaaucauggugacacuuccaauuaagugcacuaaaugaaaaguuaagucacuuauuaacuuu

SEQ ID NO: 564140 - RNA, 64 nt, hsa
acccuuuccaggaauaauguuuugggaaacacugaaaugaaaucuucccaguauuauaaauugu

SEQ ID NO: 564141 - RNA, 64 nt, hsa
ugaggucaguguuuguuuuugcacaccauuuuguaaaugaaacuuaagaauugaauuggaaaga

SEQ ID NO: 564142 - RNA, 64 nt, hsa
ucuuuaugcuaauagauuuggaauuuuugaaaugaaaugaaaccuuguuuaaacauuaaaauua

SEQ ID NO: 564143 - RNA, 64 nt, hsa
uuacaucuuuaugcuaauagauuuggaauuuuugaaaugaaaugaaaccuuguuuaaacauuaa

SEQ ID NO: 564144 - RNA, 64 nt, hsa
augaauguuaucagcuauuuauccaaauuacaggaaaugaaaccugaaaagguuggguaagaau

SEQ ID NO: 564145 - RNA, 64 nt, hsa
uggagugagaagaaaguccuugguguuugcacuuaaaugaaaaccuuuucagugaugcagccag

SEQ ID NO: 564146 - RNA, 64 nt, hsa
ggauuuuguuaaucaaauuuauuguacuaugacuaaaugaaauuauuucuuacaucuaauuugu

SEQ ID NO: 564147 - RNA, 64 nt, hsa
auuuauguuccuauauauuacaacaucggcgaggaaaugaaagcgauucuccuugaguucugau

SEQ ID NO: 564148 - RNA, 64 nt, hsa
aguucuuuaaugggugaagaguuucaguuuugcaaaaugaaaaaguucuggagaucaguugugc

SEQ ID NO: 564149 - RNA, 64 nt, hsa
caugauagaaaauuuggaaagugcaaauaagcaaaaaugaaaacaauuuuaaaaauguaaaacc

SEQ ID NO: 564150 - RNA, 64 nt, hsa
guccaccuuucuaggccuugguuccuugccugaaaaaugaaagaggcgcuggcuuuccacagug

SEQ ID NO: 564151 - RNA, 64 nt, hsa
uuaaaacagaaccuuuaagagcaaccauggcacaaaaugaaaauguaguaguacaaccaguugu

SEQ ID NO: 564152 - RNA, 64 nt, hsa
aaaccuuggaagcccucuuaugagcgaauucaggaaaugaaagcuaaaacaacccauuugcuac

SEQ ID NO: 564153 - RNA, 64 nt, hsa
gcuguggaaguuaagguguugaccacugugccugaaaugaaaccacaaggcuugagaauagaaa

SEQ ID NO: 564154 - RNA, 64 nt, hsa
gagcuaguauguuguaaaaccugccaccugaauaaaaugaaaaaaaaaguguuuuuuugagaca

SEQ ID NO: 564155 - RNA, 64 nt, hsa
ggauuacaggcgugagccaccgugcccggcccuaaaaugaaauuauuaauguugguucugaaac

SEQ ID NO: 564156 - RNA, 64 nt, hsa
gaaagcagaaagaaggaaagccuagaacagaaauaaaugaaauagagaauagaaaagcaauaca

SEQ ID NO: 564157 - RNA, 64 nt, hsa
auacuaugaacaauugaaugccaacaaauuagauaaaugaaauggacaaauuccuaggaagaca

SEQ ID NO: 564158 - RNA, 64 nt, hsa
uguuucuguuggaaacacugaagcagggacucuaaaaugaaagcaucucacauugguuuucuuu

SEQ ID NO: 564159 - RNA, 64 nt, hsa
cgaaauugccugugugcacauauuuuuagaugaaaaaugaaacuaccuuacaauauuauuuuuu

SEQ ID NO: 564160 - RNA, 64 nt, hsa
uguuaauuucucuguagguuguaacuuuaaaaauaaaugaaauuauuuaaggguuaugcugcac

SEQ ID NO: 564161 - RNA, 64 nt, hsa
ggagauguccucuccacuuuaucccacgauaucuaaaugaaaaagaaagaaaacccacacacaa

SEQ ID NO: 564162 - RNA, 64 nt, hsa
uuaucaucgaagguggugaaacuauuucaggcccaaaugaaaggaaaucgccaguuggggauga

SEQ ID NO: 564163 - RNA, 64 nt, hsa
ggaacugaaaaacuccacaggguuuggagaauagaaaugaaaagccacgucauauaacucaaga

SEQ ID NO: 564164 - RNA, 64 nt, hsa
agcuccacuggguccccuuugguuguaggacaggaaaugaaacauuaggagcucugcuuggaaa

SEQ ID NO: 564165 - RNA, 64 nt, hsa
agauuuuuuuguuuggggagguuggcuugaacauaaaugaaaauauccuguuauuuucuuaggg

SEQ ID NO: 564166 - RNA, 64 nt, hsa
agauuccugguucggguguuacgcacacguacuuaaaugaaagcauguggcauguucaucguau

SEQ ID NO: 564167 - RNA, 64 nt, hsa
auuaagcauuggguggguaaauucaaccacuguaaaaugaaauuacuacaaaauuugaaauuua

SEQ ID NO: 564168 - RNA, 64 nt, hsa
cuuuccacugaaugcauaauguuuaaauagcauaaaaugaaaugcuacaaaaauugaacuaauu

SEQ ID NO: 564169 - RNA, 64 nt, hsa
ugaacuaauuuauacuuuaaaguauuucuggguuaaaugaaacaaugaaauuuuuuaguauguu

SEQ ID NO: 564170 - RNA, 64 nt, hsa
uugcacaucugcucuguuuugguuuuucuacaggaaaugaaaaucaacuuguuuuuuuaauaug

SEQ ID NO: 564171 - RNA, 64 nt, hsa
uucuagauucacaaauuuaaauaaauuacucaaaaaaugaaaauugauuuuguaaacuuuuauu

SEQ ID NO: 564172 - RNA, 52 nt, hsa
agagucagaaagcuaaauaaaaaaaugaaacuuuuuugaguaauaaaaauga

SEQ ID NO: 564173 - RNA, 64 nt, hsa
cuaaauaaaaaaaugaaacuuuuuugaguaauaaaaaugaaaagacgcuguauguaugacuuuu

SEQ ID NO: 564174 - RNA, 64 nt, hsa
agugcugcugauaugauacaaguagacaaaauuuaaaugaaauuuugucacauucuauggaaaa

SEQ ID NO: 564175 - RNA, 64 nt, hsa
auaauuuaaaaacaagacaucuccagguaggaaaaaaugaaagcuauuucaugcaaacauuauc

SEQ ID NO: 564176 - RNA, 64 nt, hsa
ugugaaaauauaugauuuuuaugucaaucaagacaaaugaaauauauauguauguguauauaua

SEQ ID NO: 564177 - RNA, 64 nt, hsa
cuuauuguaccaaaucuuugagauauuuguacauaaaugaaauauguacuuucaugcuaaaauu

SEQ ID NO: 564178 - RNA, 64 nt, hsa
augaauucuagaaacuaaaaucaagaauacagaaaaaugaaaauaacauuuuacuucugcgcuu

SEQ ID NO: 564179 - RNA, 64 nt, hsa
aacaggaaauuacaugguugagaggaaaugcauaaaaugaaagaugaaaaaucuauaguagcag

SEQ ID NO: 564180 - RNA, 64 nt, hsa
uucuuauuuuuagaaaaauaaccacagcugauguaaaugaaaagaaccuccucaguuguugcaa

SEQ ID NO: 564181 - RNA, 64 nt, hsa
gaagauuuuuguagguguaccacauaggaagagcaaaugaaauaaacucuuuaggugaacuuug

SEQ ID NO: 564182 - RNA, 64 nt, hsa
uauucuagagacggguugcaaugacaaggggggcaaaugaaaucaaugcaagauuucuuaauaa

SEQ ID NO: 564183 - RNA, 64 nt, hsa
aacucauugucuccaccagauaguauuuuucuguaaaugaaaugcugacuucgccucuuccugc

SEQ ID NO: 564184 - RNA, 64 nt, hsa
auugacuuacuaccuaacacugagcgcuguuuuuaaaugaaaagaaugagauuuauaaccacuu

SEQ ID NO: 564185 - RNA, 64 nt, hsa
aaguuuguauaaacagguugcuauaagcuuggugaaaugaaaauggaacauuucaaucaaacau

SEQ ID NO: 564186 - RNA, 64 nt, hsa
acaauagguucuaaaaauaaaauugcuaaacaagaaaugaaaacauggagcauuguuaauuuac

SEQ ID NO: 564187 - RNA, 64 nt, hsa
cccuguuugacuucacacacacucauaacuuuccaaaugaaaccccacaguauagcgcauauuu

SEQ ID NO: 564188 - RNA, 64 nt, hsa
auggacacuaaacuggagccaauagaaaagacaaaaaugaaagagacacaggguguauaucuag

SEQ ID NO: 564189 - RNA, 64 nt, hsa
agaauaguaugcucuauuuccugaauggauguggaaaugaaagcuagcgcaccugcacuuugaa

SEQ ID NO: 564190 - RNA, 64 nt, hsa
ucaggcuuuuuaaauaaaauuagagcuguaaggaaaaugaaaagccacaaaugcaagacuguuc

SEQ ID NO: 564191 - RNA, 64 nt, hsa
aagcuucaaagcugcuuuauucaauaaaaaaaagaaaugaaaaagauauaugaauaugacaaag

SEQ ID NO: 564192 - RNA, 64 nt, hsa
agcaaccauaauauggucacuacccuaauagacuaaaugaaaucuugcaauuucaaauuacucu

SEQ ID NO: 564193 - RNA, 64 nt, hsa
gucauuuuggguugccgugcucccaaaacauuuuaaaugaaaguauuggcauucaaaaagacag

SEQ ID NO: 564194 - RNA, 64 nt, hsa
augaaaguauuggcauucaaaaagacagcagacaaaaugaaagaaaaugagagcagaaaguaag

SEQ ID NO: 564195 - RNA, 64 nt, hsa
guuaauuacaacugcuauauagacauuuuguuucaaaugaaacuuuaaaagacugaaaaauuuu

SEQ ID NO: 564196 - RNA, 64 nt, hsa
ugacugaugauacaugcauacauauuuguugaauaaaugaaaauuuauuuuuagugauaagauu

SEQ ID NO: 564197 - RNA, 64 nt, hsa
agacuuuuugaagggaaaauagagcaacagggaaaaaugaaagaaaugucuugguuacugagcu

SEQ ID NO: 564198 - RNA, 64 nt, hsa
uuuuggaagcgauaaacuuuaaauauacuuauuaaaaugaaauucuauuaaguuuuucagaucu

SEQ ID NO: 564199 - RNA, 64 nt, hsa
guauaggcuacuauuuagggcaaaaggaaucuugaaaugaaagaaacagaacuaaaaggcuaac

SEQ ID NO: 564200 - RNA, 64 nt, hsa
uuugccuauuucuuguauaaguuaaggcagccauaaaugaaaauacaaaacaaacguuugcuuu

SEQ ID NO: 564201 - RNA, 64 nt, hsa
ccuaaaaguugucaacuccccacccuuggacuuuaaaugaaaauuuuauucaguccagcuauuc

SEQ ID NO: 564202 - RNA, 64 nt, hsa
guaguauuuuguuggaagagaauguuuauacaaaaaaugaaauucuuccaacagcagagaaacu

SEQ ID NO: 564203 - RNA, 64 nt, hsa
uuuucuuagaggagagagagaaauauuaaaagagaaaugaaacaauagaguauuuuggguuuuu

SEQ ID NO: 564204 - RNA, 64 nt, hsa
cuuuggguauccuguaauuuaguuguaacauagaaaaugaaaaaacaguuaaaaaaagugaagu

SEQ ID NO: 564205 - RNA, 64 nt, hsa
ucagaucauauuucacaauccuguggaucugggcaaaugaaaauguuucaggaaguuucugcag

SEQ ID NO: 564206 - RNA, 64 nt, hsa
gaaauuauacuauauuuuauagaaccaucauuggaaaugaaacugguaauaaaacuguaucagu

SEQ ID NO: 564207 - RNA, 64 nt, hsa
ugaaacagaucuauaguuuugggacaaaauuauaaaaugaaauguguagguaaccuauuuauau

SEQ ID NO: 564208 - RNA, 64 nt, hsa
uuauuaauguugggcaaaaauugauaugucaugaaaaugaaacagaucuauaguuuugggacaa

SEQ ID NO: 564209 - RNA, 64 nt, hsa
cuuauaugacaaaugaaaagaauaacaaguugucaaaugaaaagaaugacauugaaacauuugu

SEQ ID NO: 564210 - RNA, 64 nt, hsa
auuuuuaguuaugagaaaucuuugcuuauaugacaaaugaaaagaauaacaaguugucaaauga

SEQ ID NO: 564211 - RNA, 64 nt, hsa
uuaagaauugagcaguucuguugcaugauuucccaaaugaaauacugccuuggcuagaguuuga

SEQ ID NO: 564212 - RNA, 64 nt, hsa
aauacgugauuaauaugcaagugaacaaagugagaaaugaaaucgaauggagauuggccugguu

SEQ ID NO: 564213 - RNA, 64 nt, hsa
aauauuaauauuuacauauucacuaauuuaacauaaaugaaaauuaggauuaaaaauugcacca

SEQ ID NO: 564214 - RNA, 64 nt, hsa
gacuggacuuuuggguggugguagauuuuuaaacaaaugaaauuaaagcaacaauaauuuugaa

SEQ ID NO: 564215 - RNA, 64 nt, hsa
uagacaaaauauucagagccauuuuuuuuaagggaaaugaaaaagauacucuggguuuuuuaua

SEQ ID NO: 564216 - RNA, 64 nt, hsa
cuaacaaaaauaaguacucaggacuuuuuuuucaaaaugaaauauuuauguacuguuuuauggu

SEQ ID NO: 564217 - RNA, 64 nt, hsa
ccuuccccaacccuccauaaaaaaacaaaaauggaaaugaaaaaugaaacaaaaaaggacaaaa

SEQ ID NO: 564218 - RNA, 64 nt, hsa
caacccuccauaaaaaaacaaaaauggaaaugaaaaaugaaacaaaaaaggacaaaaccaaaaa

SEQ ID NO: 564219 - RNA, 64 nt, hsa
gaaaccaauuuuuauccaccaucuaguccuuauuaaaugaaaccucacggauccuuuguuccgc

SEQ ID NO: 564220 - RNA, 64 nt, hsa
caagaugcacaucgcuauuaacagccagagucauaaaugaaaugaaauugaagaauucauucaa

SEQ ID NO: 564221 - RNA, 64 nt, hsa
ugcacaucgcuauuaacagccagagucauaaaugaaaugaaauugaagaauucauucaaaugcu

SEQ ID NO: 564222 - RNA, 64 nt, hsa
guuuaauaagagcaaauauaggggaaaaucuuugaaaugaaagcuacaaauacaugugagaaga

SEQ ID NO: 564223 - RNA, 64 nt, hsa
uggggcuggcuaggccuccacuuguccaucugugaaaugaaaggaucagccuggacagcccucu

SEQ ID NO: 564224 - RNA, 64 nt, hsa
uauuuucuaauguuucugggauaugcucccuauaaaaugaaauguuuuccuggaacaaugcuaa

SEQ ID NO: 564225 - RNA, 64 nt, hsa
aaauuauuucaaucagaugaaagugauacgauugaaaugaaaucacauaguucgugcucagaaa

SEQ ID NO: 564226 - RNA, 64 nt, hsa
augugccugauuuaauguuuuuaauaaucacagcaaaugaaaggugguuuaguuauaagugaag

SEQ ID NO: 564227 - RNA, 64 nt, hsa
uuagguguguucauucacgguauggaaauacaguaaaugaaagauuccaacuaguugucagugc

SEQ ID NO: 564228 - RNA, 64 nt, hsa
ugugaacauguagauguuuuguguguauuuuuuuaaaugaaaacucaaaauaagacaaguaauu

SEQ ID NO: 564229 - RNA, 64 nt, hsa
guguuuuauguuaagcaaaacauacuuuagaaacaaaugaaaaaggcaauugaaaaucccagcu

SEQ ID NO: 564230 - RNA, 64 nt, hsa
cugggcaacauagcaacaccccccaugucuacaaaaaugaaaaaccaaaaagcaaaccaaaaga

SEQ ID NO: 564231 - RNA, 64 nt, hsa
aagagaugacaaaacuaaguucaggggccauggaaaaugaaaaaguccgcuauauugugauuug

SEQ ID NO: 564232 - RNA, 64 nt, hsa
agcucagucccuaugagguagcuguaacccuuuaaaaugaaaugucaacuuuaagguauguuuu

SEQ ID NO: 564233 - RNA, 64 nt, hsa
uuacauuaacuauuucaaaggacuacugcccuuaaaaugaaaaaaccuuucagcuauguuugua

SEQ ID NO: 564234 - RNA, 64 nt, hsa
ugacauuucuuuuuauauauaaacuauuuaauaaaaaugaaagauugaauguucaugugugggu

SEQ ID NO: 564235 - RNA, 64 nt, hsa
aauacuauagcuucacacaguuugcgcuggaauuaaaugaaauggauccaucaucaaagucuuu

SEQ ID NO: 564236 - RNA, 64 nt, hsa
cgagugauuuuccucuguuuuucacuaaauaagcaaaugaaaacucucuccauuaccuucugcu

SEQ ID NO: 564237 - RNA, 64 nt, hsa
acaguccuuuauccaccuggauuuuuagggaaaaaaaugaaaaagaauaagucacauugguucc

SEQ ID NO: 564238 - RNA, 64 nt, hsa
uuuaacauuaaaucguagguagggcaauguaguaaaaugaaagagaauuaagaaagguuuugaa

SEQ ID NO: 564239 - RNA, 64 nt, hsa
cacugguagguaagcaugaguuaaggaaagucaaaaaugaaaauauauuuugcuguguauaaau

SEQ ID NO: 564240 - RNA, 64 nt, hsa
uuauauucagucccuucuaauacuguaucaauguaaaugaaauaaauauauucaaauuggcuuu

SEQ ID NO: 564241 - RNA, 64 nt, hsa
uggucugcagucuggaagcuugucugcucuauagaaaugaaaaugcagcaugaaguugacauug

SEQ ID NO: 564242 - RNA, 64 nt, hsa
gaaaugaaaaugcagcaugaaguugacauuguggaaaugaaaguaauuggguauuagaaaucug

SEQ ID NO: 564243 - RNA, 64 nt, hsa
ugauguauuccacuguuauuacuguuaccugcacaaaugaaaaacaauacucaacaguaauucc

SEQ ID NO: 564244 - RNA, 64 nt, hsa
uguagauuuguacuuagcaaauacaaacacauccaaaugaaaaauuuuguagauaccauauccc

SEQ ID NO: 564245 - RNA, 64 nt, hsa
caugauauuuacuguuuuguugucuggguuugagaaaugaaauauuguuuccaauuauuuauaa

SEQ ID NO: 564246 - RNA, 64 nt, hsa
auacuuacuaguugauuucugcuuacccaucuucaaaugaaaauuccauuuuuguaagccauaa

SEQ ID NO: 564247 - RNA, 64 nt, hsa
aguucuugcuauaaugguauggaaaacaagaaggaaaugaaaauauuuuuaugccuacuuagga

SEQ ID NO: 564248 - RNA, 64 nt, hsa
gugugcauuaaaguuguaaacgguaacaugaaacaaaugaaaguucuugcuauaaugguaugga

SEQ ID NO: 564249 - RNA, 64 nt, hsa
ugagucaucuaauuagauguuacuuuuaguuuuaaaaugaaaucuuaggugccuuagggguuuu

SEQ ID NO: 564250 - RNA, 64 nt, hsa
uggaguacuuuguuauauaacagaagccauccugaaaugaaacuagucuaaaaaaauucauugu

SEQ ID NO: 564251 - RNA, 64 nt, hsa
cuucucuucuuacaguaguucaaauacaaaacugaaaugaaaucccauuggauuguacuucucu

SEQ ID NO: 564252 - RNA, 64 nt, hsa
cuuagccagcaaaacaaaacaaaacaaaacaaacaaaugaaaaacguuuaaaaagaagaagaag

SEQ ID NO: 564253 - RNA, 64 nt, hsa
aagaguaaacuuuuccuaaaacacuuuauauuauaaaugaaaauaaauugcuaguuuauauuuu

SEQ ID NO: 564254 - RNA, 64 nt, hsa
uuucaucuacauguaauguguuauuaauuuuauuaaaugaaaacuaaucaccuucauguggaaa

SEQ ID NO: 564255 - RNA, 64 nt, hsa
uggggugggaggggagaaagggaaccuuuucuuaaaaugaaaauaauuacugcuauuuuaaaau

SEQ ID NO: 564256 - RNA, 64 nt, hsa
uuuacaucacguacucauaaccuauuaugaaaauaaaugaaacuggcuggguaugguggcucau

SEQ ID NO: 564257 - RNA, 64 nt, hsa
gguuaucaagcauauauuagucuuuaucagaauaaaaugaaauuucauaacuguggcuauuacu

SEQ ID NO: 564258 - RNA, 64 nt, hsa
gcauauuuacucuuacuuuacuucgugccaaaucaaaugaaacaagccgucuuacaagucguua

SEQ ID NO: 564259 - RNA, 64 nt, hsa
uggcaggaauuguccuuaugaaacaagaaaaagaaaaugaaaaguauuauuaagcuucuguguu

SEQ ID NO: 564260 - RNA, 64 nt, hsa
acuuuaaaucuguccuguaaaaguuuuauaaaucaaaugaaaggugacauugccagaaacuuac

SEQ ID NO: 564261 - RNA, 64 nt, hsa
uuuugagaccucuuaagaaaaaauaaaaaguaaaaaaugaaaggaaucuuuuuuagaaauagag

SEQ ID NO: 564262 - RNA, 64 nt, hsa
ugcuguauuaaugacaauuauucaugaaaauaaaaaaugaaauauuuuguauacuacuaccuuc

SEQ ID NO: 564263 - RNA, 64 nt, hsa
gguuaguuaaaugauaaacaugaaagcucuguccaaaugaaaaagguauuucuaacaacaacca

SEQ ID NO: 564264 - RNA, 64 nt, hsa
ggcuuuaaaauaaaucccuuguaaguuguccugcaaaugaaauuacugucuggaaaacugcaau

SEQ ID NO: 564265 - RNA, 64 nt, hsa
guacagcauuuucaacauauuggcaacauauuuuaaaugaaaacacuaaaacaauucuuaguau

SEQ ID NO: 564266 - RNA, 64 nt, hsa
cauuaacauaaaauaucaaacacacaaagucauaaaaugaaaauuuacaguuuuaccuguucau

SEQ ID NO: 564267 - RNA, 64 nt, hsa
cguguuucugcuagaauuaaaaaguuaaauuuaaaaaugaaaaugaaagacagcuucccaggag

SEQ ID NO: 564268 - RNA, 64 nt, hsa
ucugcuagaauuaaaaaguuaaauuuaaaaaugaaaaugaaagacagcuucccaggaguuuugu

SEQ ID NO: 564269 - RNA, 64 nt, hsa
uuugugugcaacugcuucauugcuauuaauaguuaaaugaaaucugcauauucuggaucauaga

SEQ ID NO: 564270 - RNA, 64 nt, hsa
agcccccuacugagaaguuaauuaauucaguccaaaaugaaauuauagggcaguuuggugcaau

SEQ ID NO: 564271 - RNA, 64 nt, hsa
gaagaggauggaaaaacugaauacaagauaccaaaaaugaaaaaaagugucccauuuuuaauaa

SEQ ID NO: 564272 - RNA, 64 nt, hsa
cuuuaauuauggucaaauauaauuuggucaccaaaaaugaaauaauaguuuaaaacaaguagcu

SEQ ID NO: 564273 - RNA, 64 nt, hsa
caugggcucaauuauuauguuugucaggauaaucaaaugaaaauacuaguucagugaucagcau

SEQ ID NO: 564274 - RNA, 64 nt, hsa
uauuaaauauuugacuuuuuuuuucuuauuaagaaaaugaaaucccuuacaccagauaucaguu

SEQ ID NO: 564275 - RNA, 64 nt, hsa
uuucuaaacuguugaauaugcugcaccauugcugaaaugaaagaugacucugggggagcagagc

SEQ ID NO: 564276 - RNA, 64 nt, hsa
augucuuacugaaacauuuugccagacuuucuccaaaugaaaccugaaucaauuuuucuaaauc

SEQ ID NO: 564277 - RNA, 64 nt, hsa
ggaccuguguuuccaugucaaauguuuucaaauaaaaugaaauaugaguuucaauacuuuuuau

SEQ ID NO: 564278 - RNA, 64 nt, hsa
uagguuauagauaaacaauuagguauaauagcaaaaaugaaaauuggaagaaugcaaaauggau

SEQ ID NO: 564279 - RNA, 64 nt, hsa
auuuuuugcaaaguuagacaauggcacaaagucaaaaugaaaucaauguuuaguucacaaguag

SEQ ID NO: 564280 - RNA, 64 nt, hsa
gaggggguucuuccucaccuuguaaccagugcagaaaugaaauagcuuagcggcaagaagccgu

SEQ ID NO: 564281 - RNA, 64 nt, hsa
aucuaggugcuucaauucacuuucuugagaggacaaaugaaaagcuguggagaaaauguccuca

SEQ ID NO: 564282 - RNA, 64 nt, hsa
ucuguugucucuucauauucuucuuccuuuuccuaaaugaaauuauauuauuucaacuacuaaa

SEQ ID NO: 564283 - RNA, 64 nt, hsa
uauaaaauagguguugccuauugcugugcuuauaaaaugaaaaaggaaauugaggacacuuuug

SEQ ID NO: 564284 - RNA, 64 nt, hsa
uaacugcucaacaggaaaugaaccuagaaacagaaaaugaaaagguugauugaaauaaaacuug

SEQ ID NO: 564285 - RNA, 64 nt, hsa
uggaaguuuugucuugggcaguaugggcugggccaaaugaaaugauuuuuauaauucuaaacag

SEQ ID NO: 564286 - RNA, 64 nt, hsa
augaaaugauuuuuauaauucuaaacagguuaccaaaugaaaugucauggcuuuacuuugguca

SEQ ID NO: 564287 - RNA, 64 nt, hsa
uccagcauaugguagauacuuguaguguuugaauaaaugaaaccagcauuagagcuuuauauac

SEQ ID NO: 564288 - RNA, 64 nt, hsa
uguuauuacuugaauauagaauauauaguuuacaaaaugaaaauuacaauguucucaccaaaua

SEQ ID NO: 564289 - RNA, 64 nt, hsa
aagagggauucaugugucugucucaguugguuccaaaugaaaccagggagcaggggaguuagga

SEQ ID NO: 564290 - RNA, 64 nt, hsa
gacaaaccgagugcaaugaaugaugcuuuucugaaaaugaaauauaacaagugggugaaugugg

SEQ ID NO: 564291 - RNA, 64 nt, hsa
uuauauucuuauaauuuuaaaugagggcacagugaaaugaaaauuuuauacucuauguuucugu

SEQ ID NO: 564292 - RNA, 64 nt, hsa
uauacagagauaaagcuaaacguaauuauuauuuaaaugaaagcuauuuuuuuaaaugaauuga

SEQ ID NO: 564293 - RNA, 64 nt, hsa
caggcacuuucaagaacuuugggauguaaaaaugaaaugaaaccuuuacccaugaccaacagua

SEQ ID NO: 564294 - RNA, 64 nt, hsa
guccacaggcacuuucaagaacuuugggauguaaaaaugaaaugaaaccuuuacccaugaccaa

SEQ ID NO: 564295 - RNA, 64 nt, hsa
ggaucugguucaacauagcacaaacccuuaggaaaaaugaaauuaacaucacugauguguaauc

SEQ ID NO: 564296 - RNA, 64 nt, hsa
cuugcuguauucucaguuucuaauaaaaagaaccaaaugaaauaugaccugucguguguuuuuu

SEQ ID NO: 564297 - RNA, 64 nt, hsa
cauaaaacacaggaaaggggaauucugugauggcaaaugaaaaaaauguuaacauuugguagac

SEQ ID NO: 564298 - RNA, 64 nt, hsa
cguauuauuuuuuucuuaacagaaauauuuuuaaaaaugaaaaaguacucaaaagugagaagag

SEQ ID NO: 564299 - RNA, 64 nt, hsa
accagaacaugggucauaggguuuuuauucagcaaaaugaaaacguaucuucagaacuuaacau

SEQ ID NO: 564300 - RNA, 64 nt, hsa
gaaauauauauuuuaaacagcuacuguaaguaugaaaugaaagaaaaacaaucauuggacggaa

SEQ ID NO: 564301 - RNA, 64 nt, hsa
uauuuuuauaaccccauugagaagacuaaguaagaaaugaaauguccuaucaauuuuauuuugu

SEQ ID NO: 564302 - RNA, 64 nt, hsa
caucuuccuauuuaaugaauugugauuuaaaacaaaaugaaaauaagccagguauucuaaaaga

SEQ ID NO: 564303 - RNA, 64 nt, hsa
gcguacuuuguuuauccauuggccaaccugaaggaaaugaaacucaccuaucuuucuaucacag

SEQ ID NO: 564304 - RNA, 64 nt, hsa
augcaaucuugaauauuuucucuuuugccucguaaaaugaaaaugcauucacaguuucuguaaa

SEQ ID NO: 564305 - RNA, 64 nt, hsa
gaggccuuuuuaacaugcagacauacccauauuuaaaugaaauggggagauauuuacauuccgu

SEQ ID NO: 564306 - RNA, 64 nt, hsa
gucgccaaacuuggguauucauggaauuucuaguaaaugaaauaccuauacuuugauacugaag

SEQ ID NO: 564307 - RNA, 64 nt, hsa
ggcuggagauuuuuuccaauauuguuuucuuugaaaaugaaaggggaucaucuauuuuaguuuu

SEQ ID NO: 564308 - RNA, 64 nt, hsa
uuucuuuuccagggugcauuuuaauauacguaugaaaugaaauauuugguuaggauuuuuaaau

SEQ ID NO: 564309 - RNA, 64 nt, hsa
uucaagggagcauuauagggcagaaaacaaauuaaaaugaaauguuguuguuauagccaugcau

SEQ ID NO: 564310 - RNA, 64 nt, hsa
uaguucuguaacugcauuuuucaccuuaaaaguuaaaugaaaugcaugaugguauuuuauuccu

SEQ ID NO: 564311 - RNA, 64 nt, hsa
cacagacauuuauuuuuuaaauugauaggguagaaaaugaaauguacuucuguuuauucuuaau

SEQ ID NO: 564312 - RNA, 64 nt, hsa
cuccccuaauucagugugccagcuuacaauguggaaaugaaagcuaauuuauacacagcaggca

SEQ ID NO: 564313 - RNA, 64 nt, hsa
cuuucgaucguguauuuauguagguuuaucagugaaaugaaaggcuuguuuccgucuagucuaa

SEQ ID NO: 564314 - RNA, 64 nt, hsa
cuuuuagauucugaauggugauuuaaaauuuucaaaaugaaauuccauauaugugcaaacagau

SEQ ID NO: 564315 - RNA, 64 nt, hsa
aagaauuacuuuaaucaacuaacaagcaauaauaaaaugaaacuuaaaauauuucaguuuucug

SEQ ID NO: 564316 - RNA, 53 nt, hsa
uccauuacagucaaggcuaagucaaaugaaacugaauuuuaaacuuuuugcau

SEQ ID NO: 564317 - RNA, 64 nt, hsa
ucugcuuuaguuucacauugcaguuagccccagaaaaugaaauccgugaagucacauuccacau

SEQ ID NO: 564318 - RNA, 64 nt, hsa
auuuauaauagguauauagaacacaagggauauaaaaugaaagauuuuuacuaauauauauuuu

SEQ ID NO: 564319 - RNA, 64 nt, hsa
ucaaauugaaucuuuuacuuaccucuugcaaaaaaaaugaaaaaugaaaaaacaaauucaaaac

SEQ ID NO: 564320 - RNA, 64 nt, hsa
gaaucuuuuacuuaccucuugcaaaaaaaaugaaaaaugaaaaaacaaauucaaaaccuauuca

SEQ ID NO: 564321 - RNA, 64 nt, hsa
guuucauuccuucagagcuccauuaauguaaucaaaaugaaauauagauuaguuuaaaugugaa

SEQ ID NO: 564322 - RNA, 64 nt, hsa
ucugccaugacauacacuuaaccaaaacuauucaaaaugaaaaccggauuucaaauaaccagac

SEQ ID NO: 564323 - RNA, 64 nt, hsa
acaaaagugauuuuuuuacucuaaccuccauuugaaaugaaauuggcccuagcuuuagagggaa

SEQ ID NO: 564324 - RNA, 64 nt, hsa
gcgucaucugguugaacucuggaaaaaaaaaaaaaaaugaaaaaaagaaaaaaaaaagagcuau

SEQ ID NO: 564325 - RNA, 64 nt, hsa
auucauaaaauuuuaguuuaaugugcucuuuguaaaaugaaauuguaaagaaaauaccaguguu

SEQ ID NO: 564326 - RNA, 64 nt, hsa
ggcaaacaaccuggucaaccuuuugaaguagaagaaaugaaaauuacuugacaagauuaaaagu

SEQ ID NO: 564327 - RNA, 64 nt, hsa
uaaaauggaaauaacaaagcagaauuucuucacaaaaugaaaaugaggcugcaacaacaguaag

SEQ ID NO: 564328 - RNA, 64 nt, hsa
acugccaauuaacuaucaccauaaaaguaauaaaaaaugaaauuauuuagaacggggcaggcaa

SEQ ID NO: 564329 - RNA, 64 nt, hsa
aucuugguaaauugagacucaaagugaaauacaaaaaugaaaauauuuauaauaggacucgacu

SEQ ID NO: 564330 - RNA, 64 nt, hsa
auuuuaaugaguaaauagaauuaaccuuuuuuacaaaugaaaugauaggcaucuauguaaagug

SEQ ID NO: 564331 - RNA, 64 nt, hsa
uuccaggggccuuuggucugcccuaccuuaacccaaaugaaaguaaaucccuuuccccuuagcc

SEQ ID NO: 564332 - RNA, 64 nt, hsa
cuaaagagaaaucuggaagugugagaucuguaagaaaugaaagaaaugacucuuggagucaaga

SEQ ID NO: 564333 - RNA, 64 nt, hsa
aggauaauuuccacuguguggaaugugaauaguuaaaugaaaaguuaugguuauuuaauguaau

SEQ ID NO: 564334 - RNA, 64 nt, hsa
uucacacauaaaguccuuuuaaggagaaaaucuaaaaugaaaaguggauaaacagaacauuuau

SEQ ID NO: 564335 - RNA, 64 nt, hsa
gguacaaaaucuugcauaagcugaacuaaaauaaaaaugaaaaggagagauuaaagguauuccu

SEQ ID NO: 564336 - RNA, 64 nt, hsa
aaucaagaaaauaugccauuuauagagauaagauaaaugaaauaauacuucagccaccagguuu

SEQ ID NO: 564337 - RNA, 64 nt, hsa
auauaguagaacauacuuuuuuuuucuuuaagccaaaugaaaagagguaacuuugcuuuuuucc

SEQ ID NO: 564338 - RNA, 64 nt, hsa
uuuucuaugcauaguuaugcauuuauauucucaaaaaugaaaucauaauguacauugcuuugua

SEQ ID NO: 564339 - RNA, 64 nt, hsa
gaaaaugacuuauuuccagaagauaccgcucuaaaaaugaaauuguuaggugaaaguguuuuug

SEQ ID NO: 564340 - RNA, 64 nt, hsa
uucaagucugggauaaucuuuccuaaaugggaucaaaugaaauaauauguguaaaagagucaaa

SEQ ID NO: 564341 - RNA, 64 nt, hsa
ggaaucuaaauagucagugaggaaggcuuugauaaaaugaaauugccagaaagauauaaaacug

SEQ ID NO: 564342 - RNA, 64 nt, hsa
cacagauaaacugaggcucagauaaguccaaaugaaaugaaaucaacucccaagcccuaaagag

SEQ ID NO: 564343 - RNA, 64 nt, hsa
augaacacagauaaacugaggcucagauaaguccaaaugaaaugaaaucaacucccaagcccua

SEQ ID NO: 564344 - RNA, 64 nt, hsa
uugucaaagagagaaggucggguacuucaagaagaaaugaaagaagggacagacauguucauca

SEQ ID NO: 564345 - RNA, 64 nt, hsa
agggacaggaggaaaaugaaaccuguucugguggaaaugaaaaccaagagcuacaagauggcug

SEQ ID NO: 564346 - RNA, 64 nt, hsa
gagcaagugaucuggcaaaagagggacaggaggaaaaugaaaccuguucugguggaaaugaaaa

SEQ ID NO: 564347 - RNA, 64 nt, hsa
acacacacccacccacacacacacacacagaagaaaaugaaagcugacacaccucgaagccuuc

SEQ ID NO: 564348 - RNA, 64 nt, hsa
guucagcuguuauuaaacugucauuucucccgcuaaaugaaaaccguguuguuauaaagcuuaa

SEQ ID NO: 564349 - RNA, 64 nt, hsa
gaguagaguugcaacuggaaaacacagacaccagaaaugaaaguguuggguguugauaggaauc

SEQ ID NO: 564350 - RNA, 64 nt, hsa
aagaaaauuauuuuugaaauuaaaacaggaccccaaaugaaauccaaguggucuucuguagagg

SEQ ID NO: 564351 - RNA, 64 nt, hsa
agaagcaucacuucuuggauaacuagcacuggaaaaaugaaaucaucuguguaagugaagggac

SEQ ID NO: 564352 - RNA, 64 nt, hsa
gcccuaguugaauuaagaaacucuaaagguuauaaaaugaaaacaaaaaauaaaauauuuguuu

SEQ ID NO: 564353 - RNA, 64 nt, hsa
aaauaacuugggggaaacggggggagggaaaaugaaaugaaaacccuguugcugcgucacugug

SEQ ID NO: 564354 - RNA, 64 nt, hsa
gcacuaaauaacuugggggaaacggggggagggaaaaugaaaugaaaacccuguugcugcguca

SEQ ID NO: 564355 - RNA, 64 nt, hsa
aaauucuuaauauuuucauaaaauuuguauuuuuaaaugaaaauucuaaauguuguauuuuauc

SEQ ID NO: 564356 - RNA, 64 nt, hsa
auguaggacuuaugauccaauucaccaaaagauuaaaugaaaccacccuguguuuuaaaauaua

SEQ ID NO: 564357 - RNA, 64 nt, hsa
uucccguuaacaaauuacggccucugcuugcuggaaaugaaauauaguuuaagaccaaacauuu

SEQ ID NO: 564358 - RNA, 64 nt, hsa
uccugaauaaaacaacauccaacccaggucauugaaaugaaauuggccagucaaaaaaaaaaag

SEQ ID NO: 564359 - RNA, 64 nt, hsa
aaauacauauaugcagugcuuguuguccaaauagaaaugaaaauaaguggaagagagaggaaga

SEQ ID NO: 564360 - RNA, 64 nt, hsa
gcaaccuuuuuuccuugaauuaacagcaauaaaaaaaugaaaaacagcuuaagaauugugccuc

SEQ ID NO: 564361 - RNA, 64 nt, hsa
agugguaauccucuucuaaaauagcaauaacugaaaaugaaaguguuaauuuuaccuuguuuga

SEQ ID NO: 564362 - RNA, 64 nt, hsa
gaucugaggaggcuuugguaaaacaguuucaucuaaaugaaagugguaauccucuucuaaaaua

SEQ ID NO: 564363 - RNA, 64 nt, hsa
gcauguaugcccgaauuuguaauucuuuucucucaaaugaaaauuuaauuuuagggauucauuu

SEQ ID NO: 564364 - RNA, 64 nt, hsa
guguguauauuauuauuaaucaaugcaauauuuaaaaugaaaugagaacaaagaggaaaauggu

SEQ ID NO: 564365 - RNA, 64 nt, hsa
uuuacauauuuuugucuuguugaucauuaccuguaaaugaaagaccuuaauaggaaaaaaagag

SEQ ID NO: 564366 - RNA, 64 nt, hsa
uuaguguuugacacuccauauuucuuuuuuuuggaaaugaaacaaauaugcaguccaaaauuca

SEQ ID NO: 564367 - RNA, 64 nt, hsa
agaggucauacaggugagagacaccaaguauauuaaaugaaagaaggccucuuaaauucaaccc

SEQ ID NO: 564368 - RNA, 64 nt, hsa
uuaaaacaauguugaaugaaaaaaaucaaaauacaaaugaaacauuguguaauaauauuuaugu

SEQ ID NO: 564369 - RNA, 64 nt, hsa
augaaaaccuaggaaaguagcaaauaugugagcaaaaugaaacaaauacuuguuguaaaaauga

SEQ ID NO: 564370 - RNA, 64 nt, hsa
agugaucccagauuagauuuuugagauccaaaaaaaaugaaaaccuaggaaaguagcaaauaug

SEQ ID NO: 564371 - RNA, 64 nt, hsa
ucguccacaggggaucugucaguuuggguccuccaaaugaaaaaugucaagacagaauuggaca

SEQ ID NO: 564372 - RNA, 64 nt, hsa
gguuuuccauauaauauuauuuaaaaugcugagaaaaugaaaaaaucuaaauggugaaauauau

SEQ ID NO: 564373 - RNA, 64 nt, hsa
uaaaaauaaauaaaacagcagcagcaaacaaauaaaaugaaauaaaagaaacaaaugaaauaaa

SEQ ID NO: 564374 - RNA, 64 nt, hsa
cagcagcaaacaaauaaaaugaaauaaaagaaacaaaugaaauaaauauuguguugugcagcau

SEQ ID NO: 564375 - RNA, 64 nt, hsa
ucaaauauauuucucuuucagggucaugaucaaaaaaugaaaagucugcuuaacuccaauuucu

SEQ ID NO: 564376 - RNA, 64 nt, hsa
aaccaguuuaaugggauacaaccagcauuuuaaaaaaugaaauagaauacagcauggaaaauau

SEQ ID NO: 564377 - RNA, 64 nt, hsa
acuguuauuuaaagauguuuuacauaauucaauaaaaugaaaugacuuaaaauugcuauauuug

SEQ ID NO: 564378 - RNA, 64 nt, hsa
uguuuuacucuuauaaaaaggaaaacugaguaggaaaugaaauacuagauuagacuagaaaaua

SEQ ID NO: 564379 - RNA, 64 nt, hsa
uuucuucucuaaaacauuaguuuaauuuucuucaaaaugaaaauacugcuuuguaauuacaaaa

SEQ ID NO: 564380 - RNA, 64 nt, hsa
uuaaaaugauugacauaaacucuuugugccuugaaaaugaaacaaauuauaaaaauguuuaaau

SEQ ID NO: 564381 - RNA, 64 nt, hsa
aaauuuaaaauguuuacggcgcuuaauugccuggaaaugaaaugaaaucaaauuuaucaguuuu

SEQ ID NO: 564382 - RNA, 64 nt, hsa
uaaaauguuuacggcgcuuaauugccuggaaaugaaaugaaaucaaauuuaucaguuuuuuucc

SEQ ID NO: 564383 - RNA, 64 nt, hsa
ucaaauuuucuuuagugcuuaaaauuaaguuuuaaaaugaaaucagacacugcagguuuguaua

SEQ ID NO: 564384 - RNA, 64 nt, hsa
uaaaaugaaaucagacacugcagguuuguauauaaaaugaaaagcuauacuacuuuuuacaaaa

SEQ ID NO: 564385 - RNA, 64 nt, hsa
ugauaauauaaucucuauuuuuuuaggaaaacaaaaaugaaaaacuacuccauuugaggauugu

SEQ ID NO: 564386 - RNA, 64 nt, hsa
aggcuguaauauguguacauuguguuuaagagaaaaaugaaacccacaugccgccauuuuccug

SEQ ID NO: 564387 - RNA, 64 nt, hsa
gugucuuuuuuggauaugagcuauuuauuuugugaaaugaaaauuguucacccaaaugauucuc

SEQ ID NO: 564388 - RNA, 64 nt, hsa
gacuaaugugaaaaaaacauugcugaaaaccuaaaaaugaaaguuugugaguguuuauugguuu

SEQ ID NO: 564389 - RNA, 64 nt, hsa
uuuuuuuuuuaagggagcucaaggucacaagaagaaaugaaaggaacaaucagcagcccuguuc

SEQ ID NO: 564390 - RNA, 64 nt, hsa
auucaucuacuuagacuuuuuaaaugccugccauaaaugaaauugaaaugguagaauggcugac

SEQ ID NO: 564391 - RNA, 64 nt, hsa
caaauaauauucaugaagaguuguuuauaaugucaaaugaaaccuacaggaaucucugauuaca

SEQ ID NO: 564392 - RNA, 64 nt, hsa
aaagaccauuuaaucuugaaggaacacaaagaucaaaugaaaaguaaaacacucuaaauaaauu

SEQ ID NO: 564393 - RNA, 64 nt, hsa
aaauguaguuaguuugauacuccuuagaauaaaaaaaugaaacaguaacaacuuuuauguaaaa

SEQ ID NO: 564394 - RNA, 64 nt, hsa
accaaauuuaaaaaaugauggauuaugcucugugaaaugaaaaguucaaucauugccuaaaaaa

SEQ ID NO: 564395 - RNA, 64 nt, hsa
aucuuguuucaaaauaaguauuucugauuuuguaaaaugaaauauaaaauaugucucagaucuu

SEQ ID NO: 564396 - RNA, 64 nt, hsa
acuaugggauguauauauaucauugcuguuagagaaaugaaauaaaauggggcugggcucagug

SEQ ID NO: 564397 - RNA, 64 nt, hsa
cucagcaacaacacuuaugcauccaaacacucacaaaugaaaccugaaagaaucuuuucugagc

SEQ ID NO: 564398 - RNA, 64 nt, hsa
cuuaaggucgggaugccuuuuuuuccauguaaggaaaugaaaagaccaaaaucuucaggcaaaa

SEQ ID NO: 564399 - RNA, 64 nt, hsa
cugaaaugccuuaauugugaacugauaugcaggaaaaugaaauaugcaagcacauuggugaccu

SEQ ID NO: 564400 - RNA, 64 nt, hsa
aacauucuacuuuaaaaauuauuaauaaaaccauaaaugaaacacuugagcacacuuuaaaaag

SEQ ID NO: 564401 - RNA, 64 nt, hsa
ucaccaucugaaaauucacaaaacuucuugcuucaaaugaaaaaaucccaacuauugagcaugu

SEQ ID NO: 564402 - RNA, 64 nt, hsa
ugaaauaagcugcuaaucagauuuuaccuuggagaaaugaaaauuauuucuuggggaugccuuu

SEQ ID NO: 564403 - RNA, 64 nt, hsa
uuuccuaagaucauuuuuauccuaggugauuuuuaaaugaaaauguguaaucuaaaauauacca

SEQ ID NO: 564404 - RNA, 64 nt, hsa
auuauuaaagcaaaaauaaauaaaaguaaaaugcaaaugaaaacaagggagggaaaguuguauu

SEQ ID NO: 564405 - RNA, 64 nt, hsa
gcuaaaggcuuuucuacucugagaucucaaugcgaaaugaaaacucaggcaguuuaguccauag

SEQ ID NO: 564406 - RNA, 64 nt, hsa
uacugcauagaaaucaaauguaaguuuagcuucuaaaugaaauaauauauaggagggauaucag

SEQ ID NO: 564407 - RNA, 64 nt, hsa
guuagcaaguuagauuuuccuggagcuucggaagaaaugaaaauggaaacaugaugaagauaua

SEQ ID NO: 564408 - RNA, 64 nt, hsa
agcgaauuggggaggggaguauuuuaaucaucuuaaaugaaacagaucagaagcuggaugagag

SEQ ID NO: 564409 - RNA, 64 nt, hsa
uuuaaaguucuuauuuaaaaaaacacacacacacaaaugaaauuuuuaaucuuugaaaauuauu

SEQ ID NO: 564410 - RNA, 64 nt, hsa
uguaucucacauuaaacaaaacaccuuuuuuucaaaaugaaauaccaauguaaagaucuaauuu

SEQ ID NO: 564411 - RNA, 64 nt, hsa
aggggugagaauaaguauaaacauaaagcaacuaaaaugaaacauaaaaccuuuuauuuucuuc

SEQ ID NO: 564412 - RNA, 64 nt, hsa; identical to SEQ ID NO: 564400

SEQ ID NO: 564413 - RNA, 64 nt, hsa
cugaaaugccuuaauugugaacugauacgcaggaaaaugaaauauguaagcacauuggugaccu

SEQ ID NO: 564414 - RNA, 64 nt, hsa; identical to SEQ ID NO: 415214

SEQ ID NO: 564415 - RNA, 64 nt, hsa; identical to SEQ ID NO: 415215

SEQ ID NO: 564416 - RNA, 64 nt, hsa; identical to SEQ ID NO: 415216

SEQ ID NO: 564417 - RNA, 64 nt, hsa; identical to SEQ ID NO: 415217

SEQ ID NO: 564418 - RNA, 64 nt, hsa; identical to SEQ ID NO: 415218

SEQ ID NO: 564419 - RNA, 64 nt, hsa; identical to SEQ ID NO: 415219

SEQ ID NO: 564420 - RNA, 64 nt, hsa; identical to SEQ ID NO: 415220

SEQ ID NO: 564421 - RNA, 64 nt, hsa; identical to SEQ ID NO: 415221

SEQ ID NO: 564422 - RNA, 55 nt, hsa; identical to SEQ ID NO: 415222

SEQ ID NO: 564423 - RNA, 64 nt, hsa; identical to SEQ ID NO: 415223

SEQ ID NO: 564424 - RNA, 64 nt, hsa; identical to SEQ ID NO: 415224

SEQ ID NO: 564425 - RNA, 64 nt, hsa; identical to SEQ ID NO: 415225

SEQ ID NO: 564426 - RNA, 64 nt, hsa; identical to SEQ ID NO: 415226

SEQ ID NO: 564427 - RNA, 64 nt, hsa; identical to SEQ ID NO: 415227

SEQ ID NO: 564428 - RNA, 64 nt, hsa; identical to SEQ ID NO: 415228

SEQ ID NO: 564429 - RNA, 50 nt, hsa; identical to SEQ ID NO: 415229

SEQ ID NO: 564430 - RNA, 64 nt, hsa; identical to SEQ ID NO: 415230

SEQ ID NO: 564431 - RNA, 64 nt, hsa; identical to SEQ ID NO: 415231

SEQ ID NO: 564432 - RNA, 64 nt, hsa; identical to SEQ ID NO: 415232

SEQ ID NO: 564433 - RNA, 64 nt, hsa; identical to SEQ ID NO: 415233

SEQ ID NO: 564434 - RNA, 64 nt, hsa; identical to SEQ ID NO: 415234

SEQ ID NO: 564435 - RNA, 64 nt, hsa; identical to SEQ ID NO: 415235

SEQ ID NO: 564436 - RNA, 64 nt, hsa; identical to SEQ ID NO: 415236

SEQ ID NO: 564437 - RNA, 64 nt, hsa; identical to SEQ ID NO: 415237

SEQ ID NO: 564438 - RNA, 64 nt, hsa; identical to SEQ ID NO: 415238

SEQ ID NO: 564439 - RNA, 64 nt, hsa; identical to SEQ ID NO: 415239

SEQ ID NO: 564440 - RNA, 64 nt, hsa; identical to SEQ ID NO: 415240

SEQ ID NO: 564441 - RNA, 64 nt, hsa; identical to SEQ ID NO: 415241

SEQ ID NO: 564442 - RNA, 64 nt, hsa; identical to SEQ ID NO: 415242

SEQ ID NO: 564443 - RNA, 64 nt, hsa; identical to SEQ ID NO: 415243

SEQ ID NO: 564444 - RNA, 64 nt, hsa; identical to SEQ ID NO: 415244

SEQ ID NO: 564445 - RNA, 64 nt, hsa; identical to SEQ ID NO: 415245

SEQ ID NO: 564446 - RNA, 64 nt, hsa; identical to SEQ ID NO: 415246

SEQ ID NO: 564447 - RNA, 64 nt, hsa; identical to SEQ ID NO: 415247

SEQ ID NO: 564448 - RNA, 64 nt, hsa; identical to SEQ ID NO: 415248

SEQ ID NO: 564449 - RNA, 64 nt, hsa; identical to SEQ ID NO: 415249

SEQ ID NO: 564450 - RNA, 64 nt, hsa; identical to SEQ ID NO: 415250

SEQ ID NO: 564451 - RNA, 64 nt, hsa; identical to SEQ ID NO: 415251

SEQ ID NO: 564452 - RNA, 64 nt, hsa; identical to SEQ ID NO: 415252

SEQ ID NO: 564453 - RNA, 64 nt, hsa; identical to SEQ ID NO: 415253

SEQ ID NO: 564454 - RNA, 64 nt, hsa; identical to SEQ ID NO: 415254

SEQ ID NO: 564455 - RNA, 64 nt, hsa; identical to SEQ ID NO: 415255

SEQ ID NO: 564456 - RNA, 64 nt, hsa; identical to SEQ ID NO: 415256

SEQ ID NO: 564457 - RNA, 64 nt, hsa; identical to SEQ ID NO: 293538

SEQ ID NO: 564458 - RNA, 64 nt, hsa; identical to SEQ ID NO: 293539

SEQ ID NO: 564459 - RNA, 64 nt, hsa; identical to SEQ ID NO: 293540

SEQ ID NO: 564460 - RNA, 64 nt, hsa; identical to SEQ ID NO: 293541

SEQ ID NO: 564461 - RNA, 64 nt, hsa; identical to SEQ ID NO: 293542

SEQ ID NO: 564462 - RNA, 64 nt, hsa; identical to SEQ ID NO: 293543

SEQ ID NO: 564463 - RNA, 64 nt, hsa; identical to SEQ ID NO: 293544

SEQ ID NO: 564464 - RNA, 64 nt, hsa; identical to SEQ ID NO: 293545

SEQ ID NO: 564465 - RNA, 64 nt, hsa; identical to SEQ ID NO: 293546

SEQ ID NO: 564466 - RNA, 64 nt, hsa; identical to SEQ ID NO: 293547

SEQ ID NO: 564467 - RNA, 64 nt, hsa; identical to SEQ ID NO: 293548

SEQ ID NO: 564468 - RNA, 64 nt, hsa; identical to SEQ ID NO: 293549

SEQ ID NO: 564469 - RNA, 64 nt, hsa; identical to SEQ ID NO: 293550

SEQ ID NO: 564470 - RNA, 64 nt, hsa; identical to SEQ ID NO: 293551

SEQ ID NO: 564471 - RNA, 64 nt, hsa; identical to SEQ ID NO: 293552

SEQ ID NO: 564472 - RNA, 64 nt, hsa; identical to SEQ ID NO: 293553

SEQ ID NO: 564473 - RNA, 64 nt, hsa; identical to SEQ ID NO: 293554

SEQ ID NO: 564474 - RNA, 64 nt, hsa; identical to SEQ ID NO: 293555

SEQ ID NO: 564475 - RNA, 64 nt, hsa; identical to SEQ ID NO: 293556

SEQ ID NO: 564476 - RNA, 64 nt, hsa; identical to SEQ ID NO: 293557

SEQ ID NO: 564477 - RNA, 64 nt, hsa; identical to SEQ ID NO: 293558

SEQ ID NO: 564478 - RNA, 64 nt, hsa; identical to SEQ ID NO: 293559

SEQ ID NO: 564479 - RNA, 64 nt, hsa; identical to SEQ ID NO: 293560

SEQ ID NO: 564480 - RNA, 64 nt, hsa; identical to SEQ ID NO: 293561

SEQ ID NO: 564481 - RNA, 64 nt, hsa; identical to SEQ ID NO: 293562

SEQ ID NO: 564482 - RNA, 64 nt, hsa; identical to SEQ ID NO: 293563

SEQ ID NO: 564483 - RNA, 64 nt, hsa; identical to SEQ ID NO: 293564

SEQ ID NO: 564484 - RNA, 64 nt, hsa; identical to SEQ ID NO: 293565

SEQ ID NO: 564485 - RNA, 64 nt, hsa; identical to SEQ ID NO: 293566

SEQ ID NO: 564486 - RNA, 64 nt, hsa; identical to SEQ ID NO: 293567

SEQ ID NO: 564487 - RNA, 64 nt, hsa; identical to SEQ ID NO: 293568

SEQ ID NO: 564488 - RNA, 64 nt, hsa; identical to SEQ ID NO: 293569

SEQ ID NO: 564489 - RNA, 64 nt, hsa; identical to SEQ ID NO: 293570

SEQ ID NO: 564490 - RNA, 64 nt, hsa; identical to SEQ ID NO: 293571

SEQ ID NO: 564491 - RNA, 64 nt, hsa; identical to SEQ ID NO: 103727

SEQ ID NO: 564492 - RNA, 64 nt, hsa; identical to SEQ ID NO: 103728

SEQ ID NO: 564493 - RNA, 64 nt, hsa; identical to SEQ ID NO: 103729

SEQ ID NO: 564494 - RNA, 64 nt, hsa; identical to SEQ ID NO: 103730

SEQ ID NO: 564495 - RNA, 64 nt, hsa; identical to SEQ ID NO: 24953

SEQ ID NO: 564496 - RNA, 64 nt, hsa; identical to SEQ ID NO: 24954

SEQ ID NO: 564497 - RNA, 64 nt, hsa; identical to SEQ ID NO: 24955

SEQ ID NO: 564498 - RNA, 64 nt, hsa; identical to SEQ ID NO: 24956

SEQ ID NO: 564499 - RNA, 64 nt, hsa; identical to SEQ ID NO: 24957

SEQ ID NO: 564500 - RNA, 64 nt, hsa; identical to SEQ ID NO: 24958

SEQ ID NO: 564501 - RNA, 64 nt, hsa; identical to SEQ ID NO: 24959

SEQ ID NO: 564502 - RNA, 64 nt, hsa; identical to SEQ ID NO: 24960

SEQ ID NO: 564503 - RNA, 64 nt, hsa; identical to SEQ ID NO: 24961

SEQ ID NO: 564504 - RNA, 64 nt, hsa; identical to SEQ ID NO: 24962

SEQ ID NO: 564505 - RNA, 64 nt, hsa; identical to SEQ ID NO: 24963

SEQ ID NO: 564506 - RNA, 64 nt, hsa; identical to SEQ ID NO: 24964

SEQ ID NO: 564507 - RNA, 64 nt, hsa
ggagaucacccauuuacuguagguaguauucucuuccuacuauauuucauaucuaccuacuaca

SEQ ID NO: 564508 - RNA, 64 nt, hsa
auauuucauaucuaccuacuacauuucauaucauuccuacuacauuucauaucuaccuacauuu

SEQ ID NO: 564509 - RNA, 64 nt, hsa; identical to SEQ ID NO: 299681

SEQ ID NO: 564510 - RNA, 64 nt, hsa; identical to SEQ ID NO: 299682

SEQ ID NO: 564511 - RNA, 64 nt, hsa; identical to SEQ ID NO: 299683

SEQ ID NO: 564512 - RNA, 64 nt, hsa; identical to SEQ ID NO: 299684

SEQ ID NO: 564513 - RNA, 64 nt, hsa; identical to SEQ ID NO: 299685

SEQ ID NO: 564514 - RNA, 64 nt, hsa; identical to SEQ ID NO: 299686

SEQ ID NO: 564515 - RNA, 64 nt, hsa; identical to SEQ ID NO: 299687

SEQ ID NO: 564516 - RNA, 64 nt, hsa; identical to SEQ ID NO: 299688

SEQ ID NO: 564517 - RNA, 64 nt, hsa; identical to SEQ ID NO: 299689

SEQ ID NO: 564518 - RNA, 64 nt, hsa; identical to SEQ ID NO: 299690

SEQ ID NO: 564519 - RNA, 64 nt, hsa; identical to SEQ ID NO: 299691

SEQ ID NO: 564520 - RNA, 64 nt, hsa; identical to SEQ ID NO: 299692

SEQ ID NO: 564521 - RNA, 53 nt, hsa; identical to SEQ ID NO: 299693

SEQ ID NO: 564522 - RNA, 64 nt, hsa; identical to SEQ ID NO: 299694

SEQ ID NO: 564523 - RNA, 64 nt, hsa; identical to SEQ ID NO: 299695

SEQ ID NO: 564524 - RNA, 64 nt, hsa; identical to SEQ ID NO: 299696

SEQ ID NO: 564525 - RNA, 64 nt, hsa; identical to SEQ ID NO: 299697

SEQ ID NO: 564526 - RNA, 64 nt, hsa; identical to SEQ ID NO: 299698

SEQ ID NO: 564527 - RNA, 64 nt, hsa; identical to SEQ ID NO: 299699

SEQ ID NO: 564528 - RNA, 64 nt, hsa; identical to SEQ ID NO: 299700

SEQ ID NO: 564529 - RNA, 64 nt, hsa; identical to SEQ ID NO: 299701

SEQ ID NO: 564530 - RNA, 64 nt, hsa; identical to SEQ ID NO: 299702

SEQ ID NO: 564531 - RNA, 64 nt, hsa; identical to SEQ ID NO: 299703

SEQ ID NO: 564532 - RNA, 64 nt, hsa; identical to SEQ ID NO: 299704

SEQ ID NO: 564533 - RNA, 64 nt, hsa; identical to SEQ ID NO: 299705

SEQ ID NO: 564534 - RNA, 64 nt, hsa; identical to SEQ ID NO: 299706

SEQ ID NO: 564535 - RNA, 64 nt, hsa; identical to SEQ ID NO: 299707

SEQ ID NO: 564536 - RNA, 64 nt, hsa; identical to SEQ ID NO: 299708

SEQ ID NO: 564537 - RNA, 64 nt, hsa; identical to SEQ ID NO: 299709

SEQ ID NO: 564538 - RNA, 64 nt, hsa; identical to SEQ ID NO: 299710

SEQ ID NO: 564539 - RNA, 64 nt, hsa; identical to SEQ ID NO: 299711

SEQ ID NO: 564540 - RNA, 64 nt, hsa
gcaagaccaaaaugacaaugaugaugauaaugaugaugacgacgacaacgaugaugcuuguaac

SEQ ID NO: 564541 - RNA, 64 nt, hsa
agagaagccaaacaaagacuuggagagcugcagugaugacgacaaccagggguccaagucccca

SEQ ID NO: 564542 - RNA, 64 nt, hsa
gcauggcggcggggugcaggggaaaguuaaaggugaugacgaucaucacaccugugucguuacc

SEQ ID NO: 564543 - RNA, 64 nt, hsa
gaacugcucuuuaauuauuagugauguuugcggggaugacgaugccaaguacaccugcaaggcu

SEQ ID NO: 564544 - RNA, 64 nt, hsa
ucagaggucgcacacagugacucuccucucucaggaugacgaggaccugugccuucaacaagca

SEQ ID NO: 564545 - RNA, 64 nt, hsa
uaaaaaaggucuccugcagaucugucugggcugugaugacgaauauuaugaaaugugccuuuuc

SEQ ID NO: 564546 - RNA, 64 nt, hsa
uaaaaaaaaacaaaaaaaaaaaaaaaaaaaacaagaugacgacgacaaccacaaaaaaaauuga

SEQ ID NO: 564547 - RNA, 64 nt, hsa
auaucuggcagaaugugugaaugccauaucuguagaugacgaugaaugugaaggguuaauguag

SEQ ID NO: 564548 - RNA, 64 nt, hsa
caacaaagguccaguuaggaaacgacgcugagaggaugacgacaacgugcaacagcagaaagau

SEQ ID NO: 564549 - RNA, 64 nt, hsa
cucugcacagcuccaaccaacaggacuguagggugaugacgaucacuuucccagugaugagaag

SEQ ID NO: 564550 - RNA, 64 nt, hsa
uuucaucuguuuuguuccuugagucagugcuguugaugacgaguugucuugaauaaaucaugug

SEQ ID NO: 564551 - RNA, 64 nt, hsa
ccagaaucacgcccuccugggccauguugucuuugaugacgaugaugccguuggggcggaggcu

SEQ ID NO: 564552 - RNA, 64 nt, hsa
auugagaugucacuuuacaugggaguuauccauugaugacgaugaaaugccugauuuagaaaac

SEQ ID NO: 564553 - RNA, 64 nt, hsa
aauaagaaguccacacaagcaagccaaauuuuuagaugacgaaguccauaaauaacuagagaau

SEQ ID NO: 564554 - RNA, 64 nt, hsa
ucuggcguccacaccccagguguugcugacacuggaugacgaccuggauacugugcagcgggac

SEQ ID NO: 564555 - RNA, 64 nt, hsa
ugaugaugaugaugaugaagaugaugaugaugaugaugacgaggaagcugaagaaaaagcgcca

SEQ ID NO: 564556 - RNA, 64 nt, hsa
ugaggucagaggucaggagcagggcuggggucaggaugacgaggccugggguccugguguuggg

SEQ ID NO: 564557 - RNA, 64 nt, hsa
auccaggcuucugccaaaaaaaaaaagagaagaagaugacgaugaugaccagucguacuaucuu

SEQ ID NO: 564558 - RNA, 64 nt, hsa
uaacguauuuggaguuuauuuagaaguaaagugugaugacgauaacacuuaagugugaauuuuu

SEQ ID NO: 564559 - RNA, 64 nt, hsa
ccgcuuguuuugggugcacaggagccccacugcugaugacgaacuaucucuaacuggucuugac

SEQ ID NO: 564560 - RNA, 64 nt, hsa
guaguugucuguugaugauggugaugaugaugaugaugacgauagugaugccacacauucucuc

SEQ ID NO: 564561 - RNA, 64 nt, hsa
ugcugaugauucccaagauugagaugaugacggugaugacgacugggugaacagccaucacuuc

SEQ ID NO: 564562 - RNA, 64 nt, hsa
ggaggagcggugagaacauggaaccggacuccaagaugacgaucuaaagacccgggagcgagaa

SEQ ID NO: 564563 - RNA, 64 nt, hsa
gcccacgcuguuccgguuggcgagugacaccacugaugacgaugaugcacucgguaaguuuucu

SEQ ID NO: 564564 - RNA, 64 nt, hsa
acuagcagauuuguaugguuccaaagacacuuuugaugacgauucuuaacaauaacgauacaaa

SEQ ID NO: 564565 - RNA, 64 nt, hsa
gugguccacacaggugccaggagugcccauaugagaugacgaggaaaccccuuugcaggugagg

SEQ ID NO: 564566 - RNA, 64 nt, hsa
agaugcuuaugaugaccuggaccaagaagacccagaugacgaccuggauauuugacuggccaga

SEQ ID NO: 564567 - RNA, 64 nt, hsa
aacugccuucguuugguccagggccaucgugggugaugacgauugcucucuugcacucaaggac

SEQ ID NO: 564568 - RNA, 64 nt, hsa
uaaauuaaaauuuuaugacaguaucgaggcuugugaugacgaauccugcucuaaaauacacaag

SEQ ID NO: 564569 - RNA, 64 nt, hsa
gccgggcacagcguggcuacagagggucucccucgaugacgacgacgacgacgccaccacccca

SEQ ID NO: 564570 - RNA, 64 nt, hsa
uaucugaugagaacucacacuagcuuguuuacaagaugacgacaguccaagggcagccuugggc

SEQ ID NO: 564571 - RNA, 64 nt, hsa
cuccuuccgggacaagccuggccacccucgcugugaugacgagcuggcugauuggcccugggcc

SEQ ID NO: 564572 - RNA, 64 nt, hsa
ccgggcacccccccccaggcuccuggugccagaugaugacgaccuggguggaaaccuacccugu

SEQ ID NO: 564573 - RNA, 64 nt, hsa
uuccccuucagggccacaacaggcuguagaaggggaugacgaggacaucagagguuagacuuac

SEQ ID NO: 564574 - RNA, 64 nt, hsa
auugggggugggggagauggcuuccccacuaugggaugacgaggcgagagggaagcccuugcug

SEQ ID NO: 564575 - RNA, 64 nt, hsa
ggugauuuaugaagagaucagcgacccugaggaagaugacgaguaacuccguaagagaaccuuc

SEQ ID NO: 564576 - RNA, 64 nt, hsa
uguucauguuuuguccagcggaucaggauguuaggaugacgagcaagaguccaggucacugugc

SEQ ID NO: 564577 - RNA, 64 nt, hsa; identical to SEQ ID NO: 430373

SEQ ID NO: 564578 - RNA, 64 nt, hsa; identical to SEQ ID NO: 430374

SEQ ID NO: 564579 - RNA, 64 nt, hsa; identical to SEQ ID NO: 430375

SEQ ID NO: 564580 - RNA, 64 nt, hsa; identical to SEQ ID NO: 430376

SEQ ID NO: 564581 - RNA, 64 nt, hsa; identical to SEQ ID NO: 430377

SEQ ID NO: 564582 - RNA, 64 nt, hsa; identical to SEQ ID NO: 430378

SEQ ID NO: 564583 - RNA, 64 nt, hsa; identical to SEQ ID NO: 430379

SEQ ID NO: 564584 - RNA, 64 nt, hsa; identical to SEQ ID NO: 430380

SEQ ID NO: 564585 - RNA, 64 nt, hsa; identical to SEQ ID NO: 430381

SEQ ID NO: 564586 - RNA, 64 nt, hsa; identical to SEQ ID NO: 430382

SEQ ID NO: 564587 - RNA, 64 nt, hsa; identical to SEQ ID NO: 430383

SEQ ID NO: 564588 - RNA, 64 nt, hsa; identical to SEQ ID NO: 430384

SEQ ID NO: 564589 - RNA, 64 nt, hsa; identical to SEQ ID NO: 430385

SEQ ID NO: 564590 - RNA, 64 nt, hsa; identical to SEQ ID NO: 430386

SEQ ID NO: 564591 - RNA, 64 nt, hsa; identical to SEQ ID NO: 430387

SEQ ID NO: 564592 - RNA, 64 nt, hsa; identical to SEQ ID NO: 430388

SEQ ID NO: 564593 - RNA, 64 nt, hsa; identical to SEQ ID NO: 430389

SEQ ID NO: 564594 - RNA, 64 nt, hsa; identical to SEQ ID NO: 430390

SEQ ID NO: 564595 - RNA, 64 nt, hsa; identical to SEQ ID NO: 430391

SEQ ID NO: 564596 - RNA, 64 nt, hsa; identical to SEQ ID NO: 430392

SEQ ID NO: 564597 - RNA, 64 nt, hsa; identical to SEQ ID NO: 430393

SEQ ID NO: 564598 - RNA, 64 nt, hsa; identical to SEQ ID NO: 430394

SEQ ID NO: 564599 - RNA, 64 nt, hsa; identical to SEQ ID NO: 430395

SEQ ID NO: 564600 - RNA, 64 nt, hsa; identical to SEQ ID NO: 430396

SEQ ID NO: 564601 - RNA, 64 nt, hsa; identical to SEQ ID NO: 430397

SEQ ID NO: 564602 - RNA, 64 nt, hsa; identical to SEQ ID NO: 430398

SEQ ID NO: 564603 - RNA, 64 nt, hsa; identical to SEQ ID NO: 430399

SEQ ID NO: 564604 - RNA, 64 nt, hsa; identical to SEQ ID NO: 430400

SEQ ID NO: 564605 - RNA, 64 nt, hsa; identical to SEQ ID NO: 430401

SEQ ID NO: 564606 - RNA, 64 nt, hsa; identical to SEQ ID NO: 430402

SEQ ID NO: 564607 - RNA, 64 nt, hsa; identical to SEQ ID NO: 430403

SEQ ID NO: 564608 - RNA, 64 nt, hsa; identical to SEQ ID NO: 430404

SEQ ID NO: 564609 - RNA, 62 nt, hsa; identical to SEQ ID NO: 296757

SEQ ID NO: 564610 - RNA, 64 nt, hsa; identical to SEQ ID NO: 430406

SEQ ID NO: 564611 - RNA, 64 nt, hsa; identical to SEQ ID NO: 430407

SEQ ID NO: 564612 - RNA, 64 nt, hsa; identical to SEQ ID NO: 430408

SEQ ID NO: 564613 - RNA, 64 nt, hsa; identical to SEQ ID NO: 430409

SEQ ID NO: 564614 - RNA, 64 nt, hsa; identical to SEQ ID NO: 430410

SEQ ID NO: 564615 - RNA, 64 nt, hsa; identical to SEQ ID NO: 430411

SEQ ID NO: 564616 - RNA, 64 nt, hsa; identical to SEQ ID NO: 430412

SEQ ID NO: 564617 - RNA, 64 nt, hsa; identical to SEQ ID NO: 430413

SEQ ID NO: 564618 - RNA, 64 nt, hsa; identical to SEQ ID NO: 430414

SEQ ID NO: 564619 - RNA, 64 nt, hsa; identical to SEQ ID NO: 430415

SEQ ID NO: 564620 - RNA, 64 nt, hsa; identical to SEQ ID NO: 430416

SEQ ID NO: 564621 - RNA, 64 nt, hsa; identical to SEQ ID NO: 430417

SEQ ID NO: 564622 - RNA, 64 nt, hsa; identical to SEQ ID NO: 430418

SEQ ID NO: 564623 - RNA, 64 nt, hsa; identical to SEQ ID NO: 430419

SEQ ID NO: 564624 - RNA, 64 nt, hsa; identical to SEQ ID NO: 430420

SEQ ID NO: 564625 - RNA, 64 nt, hsa; identical to SEQ ID NO: 430421

SEQ ID NO: 564626 - RNA, 64 nt, hsa; identical to SEQ ID NO: 430422

SEQ ID NO: 564627 - RNA, 64 nt, hsa; identical to SEQ ID NO: 430423

SEQ ID NO: 564628 - RNA, 64 nt, hsa; identical to SEQ ID NO: 430424

SEQ ID NO: 564629 - RNA, 64 nt, hsa; identical to SEQ ID NO: 430425

SEQ ID NO: 564630 - RNA, 64 nt, hsa; identical to SEQ ID NO: 430426

SEQ ID NO: 564631 - RNA, 64 nt, hsa; identical to SEQ ID NO: 430427

SEQ ID NO: 564632 - RNA, 64 nt, hsa; identical to SEQ ID NO: 430428

SEQ ID NO: 564633 - RNA, 64 nt, hsa; identical to SEQ ID NO: 430429

SEQ ID NO: 564634 - RNA, 64 nt, hsa; identical to SEQ ID NO: 430430

SEQ ID NO: 564635 - RNA, 64 nt, hsa; identical to SEQ ID NO: 430431

SEQ ID NO: 564636 - RNA, 64 nt, hsa; identical to SEQ ID NO: 430432

SEQ ID NO: 564637 - RNA, 64 nt, hsa; identical to SEQ ID NO: 430433

SEQ ID NO: 564638 - RNA, 64 nt, hsa; identical to SEQ ID NO: 430434

SEQ ID NO: 564639 - RNA, 64 nt, hsa; identical to SEQ ID NO: 430435

SEQ ID NO: 564640 - RNA, 64 nt, hsa; identical to SEQ ID NO: 430436

SEQ ID NO: 564641 - RNA, 64 nt, hsa; identical to SEQ ID NO: 430437

SEQ ID NO: 564642 - RNA, 64 nt, hsa; identical to SEQ ID NO: 430438

SEQ ID NO: 564643 - RNA, 64 nt, hsa; identical to SEQ ID NO: 430439

SEQ ID NO: 564644 - RNA, 64 nt, hsa; identical to SEQ ID NO: 430440

SEQ ID NO: 564645 - RNA, 64 nt, hsa; identical to SEQ ID NO: 430441

SEQ ID NO: 564646 - RNA, 64 nt, hsa; identical to SEQ ID NO: 430442

SEQ ID NO: 564647 - RNA, 64 nt, hsa; identical to SEQ ID NO: 430443

SEQ ID NO: 564648 - RNA, 64 nt, hsa; identical to SEQ ID NO: 430444

SEQ ID NO: 564649 - RNA, 64 nt, hsa; identical to SEQ ID NO: 430445

SEQ ID NO: 564650 - RNA, 64 nt, hsa; identical to SEQ ID NO: 430446

SEQ ID NO: 564651 - RNA, 64 nt, hsa; identical to SEQ ID NO: 430447

SEQ ID NO: 564652 - RNA, 64 nt, hsa; identical to SEQ ID NO: 430448

SEQ ID NO: 564653 - RNA, 64 nt, hsa; identical to SEQ ID NO: 430449

SEQ ID NO: 564654 - RNA, 64 nt, hsa; identical to SEQ ID NO: 165419

SEQ ID NO: 564655 - RNA, 64 nt, hsa; identical to SEQ ID NO: 165420

SEQ ID NO: 564656 - RNA, 64 nt, hsa; identical to SEQ ID NO: 165421

SEQ ID NO: 564657 - RNA, 64 nt, hsa; identical to SEQ ID NO: 165422

SEQ ID NO: 564658 - RNA, 64 nt, hsa; identical to SEQ ID NO: 165423

SEQ ID NO: 564659 - RNA, 64 nt, hsa; identical to SEQ ID NO: 165424

SEQ ID NO: 564660 - RNA, 64 nt, hsa; identical to SEQ ID NO: 165425

SEQ ID NO: 564661 - RNA, 64 nt, hsa; identical to SEQ ID NO: 165426

SEQ ID NO: 564662 - RNA, 64 nt, hsa; identical to SEQ ID NO: 165427

SEQ ID NO: 564663 - RNA, 64 nt, hsa; identical to SEQ ID NO: 165428

SEQ ID NO: 564664 - RNA, 64 nt, hsa; identical to SEQ ID NO: 165429

SEQ ID NO: 564665 - RNA, 64 nt, hsa; identical to SEQ ID NO: 165430

SEQ ID NO: 564666 - RNA, 64 nt, hsa; identical to SEQ ID NO: 165431

SEQ ID NO: 564667 - RNA, 64 nt, hsa; identical to SEQ ID NO: 165432

SEQ ID NO: 564668 - RNA, 64 nt, hsa; identical to SEQ ID NO: 165433

SEQ ID NO: 564669 - RNA, 64 nt, hsa; identical to SEQ ID NO: 165434

SEQ ID NO: 564670 - RNA, 64 nt, hsa; identical to SEQ ID NO: 165435

SEQ ID NO: 564671 - RNA, 64 nt, hsa; identical to SEQ ID NO: 165436

SEQ ID NO: 564672 - RNA, 64 nt, hsa; identical to SEQ ID NO: 165437

SEQ ID NO: 564673 - RNA, 64 nt, hsa; identical to SEQ ID NO: 165438

SEQ ID NO: 564674 - RNA, 64 nt, hsa; identical to SEQ ID NO: 165439

SEQ ID NO: 564675 - RNA, 64 nt, hsa; identical to SEQ ID NO: 165440

SEQ ID NO: 564676 - RNA, 64 nt, hsa; identical to SEQ ID NO: 165441

SEQ ID NO: 564677 - RNA, 64 nt, hsa; identical to SEQ ID NO: 165442

SEQ ID NO: 564678 - RNA, 64 nt, hsa; identical to SEQ ID NO: 165443

SEQ ID NO: 564679 - RNA, 64 nt, hsa; identical to SEQ ID NO: 165444

SEQ ID NO: 564680 - RNA, 64 nt, hsa; identical to SEQ ID NO: 165445

SEQ ID NO: 564681 - RNA, 64 nt, hsa; identical to SEQ ID NO: 165446

SEQ ID NO: 564682 - RNA, 64 nt, hsa; identical to SEQ ID NO: 165447

SEQ ID NO: 564683 - RNA, 64 nt, hsa; identical to SEQ ID NO: 165448

SEQ ID NO: 564684 - RNA, 64 nt, hsa; identical to SEQ ID NO: 165449

SEQ ID NO: 564685 - RNA, 64 nt, hsa; identical to SEQ ID NO: 165450

SEQ ID NO: 564686 - RNA, 64 nt, hsa; identical to SEQ ID NO: 165451

SEQ ID NO: 564687 - RNA, 64 nt, hsa; identical to SEQ ID NO: 165452

SEQ ID NO: 564688 - RNA, 64 nt, hsa; identical to SEQ ID NO: 165453

SEQ ID NO: 564689 - RNA, 64 nt, hsa; identical to SEQ ID NO: 165454

SEQ ID NO: 564690 - RNA, 64 nt, hsa; identical to SEQ ID NO: 165455

SEQ ID NO: 564691 - RNA, 64 nt, hsa; identical to SEQ ID NO: 165456

SEQ ID NO: 564692 - RNA, 64 nt, hsa; identical to SEQ ID NO: 165457

SEQ ID NO: 564693 - RNA, 64 nt, hsa; identical to SEQ ID NO: 165458

SEQ ID NO: 564694 - RNA, 64 nt, hsa; identical to SEQ ID NO: 165459

SEQ ID NO: 564695 - RNA, 64 nt, hsa; identical to SEQ ID NO: 165460

SEQ ID NO: 564696 - RNA, 64 nt, hsa; identical to SEQ ID NO: 165461

SEQ ID NO: 564697 - RNA, 64 nt, hsa; identical to SEQ ID NO: 165462

SEQ ID NO: 564698 - RNA, 64 nt, hsa; identical to SEQ ID NO: 165463

SEQ ID NO: 564699 - RNA, 64 nt, hsa; identical to SEQ ID NO: 165464

SEQ ID NO: 564700 - RNA, 63 nt, hsa; identical to SEQ ID NO: 165465

SEQ ID NO: 564701 - RNA, 64 nt, hsa; identical to SEQ ID NO: 165466

SEQ ID NO: 564702 - RNA, 64 nt, hsa; identical to SEQ ID NO: 165467

SEQ ID NO: 564703 - RNA, 64 nt, hsa; identical to SEQ ID NO: 165468

SEQ ID NO: 564704 - RNA, 64 nt, hsa; identical to SEQ ID NO: 165469

SEQ ID NO: 564705 - RNA, 64 nt, hsa; identical to SEQ ID NO: 165470

SEQ ID NO: 564706 - RNA, 64 nt, hsa; identical to SEQ ID NO: 165471

SEQ ID NO: 564707 - RNA, 64 nt, hsa; identical to SEQ ID NO: 165472

SEQ ID NO: 564708 - RNA, 64 nt, hsa; identical to SEQ ID NO: 165473

SEQ ID NO: 564709 - RNA, 64 nt, hsa; identical to SEQ ID NO: 165474

SEQ ID NO: 564710 - RNA, 64 nt, hsa; identical to SEQ ID NO: 165475

SEQ ID NO: 564711 - RNA, 64 nt, hsa; identical to SEQ ID NO: 165476

SEQ ID NO: 564712 - RNA, 64 nt, hsa; identical to SEQ ID NO: 165477

SEQ ID NO: 564713 - RNA, 64 nt, hsa; identical to SEQ ID NO: 165478

SEQ ID NO: 564714 - RNA, 64 nt, hsa; identical to SEQ ID NO: 165479

SEQ ID NO: 564715 - RNA, 64 nt, hsa; identical to SEQ ID NO: 165480

SEQ ID NO: 564716 - RNA, 64 nt, hsa; identical to SEQ ID NO: 165481

SEQ ID NO: 564717 - RNA, 64 nt, hsa; identical to SEQ ID NO: 165482

SEQ ID NO: 564718 - RNA, 64 nt, hsa; identical to SEQ ID NO: 165483

SEQ ID NO: 564719 - RNA, 64 nt, hsa; identical to SEQ ID NO: 165484

SEQ ID NO: 564720 - RNA, 64 nt, hsa; identical to SEQ ID NO: 165485

SEQ ID NO: 564721 - RNA, 64 nt, hsa
gucuucaugagucuccugggcccaaagccaucuucugauggaaggaagagaguagggccaguga

SEQ ID NO: 564722 - RNA, 64 nt, hsa
gcugagcggcagaaacuugucucauaaauuggcacugauggagcaucagcuguggcccacagag

SEQ ID NO: 564723 - RNA, 64 nt, hsa
acuggauuuucagaccugcugaggaccguaaggccugauggaacacagaacugaacugagguuc

SEQ ID NO: 564724 - RNA, 64 nt, hsa
acaugcccauuacuaacggcaaaagggggauucccugauggaaccauaauacccuuggaaauac

SEQ ID NO: 564725 - RNA, 64 nt, hsa
gcaugggccaugugagaagaucgccaggaucuuccugauggaagcugacuugggcguggaaguc

SEQ ID NO: 564726 - RNA, 64 nt, hsa
aauuccccagauacugaacaauuuguguuugugacugauggagaauuucaggaaugaaugagaa

SEQ ID NO: 564727 - RNA, 64 nt, hsa
aggugacuggaucuguguuccuccuuaacaucaucugauggaauggcaaugaaaagcguggauu

SEQ ID NO: 564728 - RNA, 64 nt, hsa
ccccagcgcgccccuggcccugguucugucccagcugauggauggcuucuccaugcuggagaag

SEQ ID NO: 564729 - RNA, 64 nt, hsa
uuccccagcaguuuagugccugcugaaaagaucccugauggacaauacuucuugguggacucca

SEQ ID NO: 564730 - RNA, 64 nt, hsa
cugggucauuugggaguggcucugcuaguagagacugauggagagagccagguggaaugccaua

SEQ ID NO: 564731 - RNA, 64 nt, hsa
caucaccaugaugugguagcuugugacuuuucuccugauggagcauuacuggcuacugcaucuu

SEQ ID NO: 564732 - RNA, 64 nt, hsa
aguauauaucugggauccacauaauggagacauucugauggaauuuggguggguacagcaugaa

SEQ ID NO: 564733 - RNA, 64 nt, hsa
acccuucugauggaaggugggagccaacacccuucugauggaaggcgggauucccgcuucugaa

SEQ ID NO: 564734 - RNA, 64 nt, hsa
acccuucugauggaaggugggagccaacacccuucugauggaaggugggagccaacacccuucu

SEQ ID NO: 564735 - RNA, 64 nt, hsa; identical to SEQ ID NO: 564734

SEQ ID NO: 564736 - RNA, 64 nt, hsa; identical to SEQ ID NO: 564734

SEQ ID NO: 564737 - RNA, 64 nt, hsa
caucuucugauggaaggugggagccaacacccuucugauggaaggugggagccaacacccuucu

SEQ ID NO: 564738 - RNA, 64 nt, hsa
agaagccuuucagguuucccugggccagcaucuucugauggaaggugggagccaacacccuucu

SEQ ID NO: 564739 - RNA, 64 nt, hsa
ggaaacgugugugucaguuggaccaugugggacccugauggaccugaaagaccaggaucggucc

SEQ ID NO: 564740 - RNA, 64 nt, hsa
gcugucggcugaugaggaggcggccgccccagugcugauggagaugccacuuucgugugacugc

SEQ ID NO: 564741 - RNA, 64 nt, hsa
cccccucauuagcagggcuuaucugggggagcugcugauggaguccucgcugcucaugcccaca

SEQ ID NO: 564742 - RNA, 64 nt, hsa
gguguuuagacacagauaggaguccaggguaugacugauggaggccccggcccacgugaccagc

SEQ ID NO: 564743 - RNA, 64 nt, hsa; identical to SEQ ID NO: 98311

SEQ ID NO: 564744 - RNA, 64 nt, hsa; identical to SEQ ID NO: 98312

SEQ ID NO: 564745 - RNA, 64 nt, hsa; identical to SEQ ID NO: 98313

SEQ ID NO: 564746 - RNA, 64 nt, hsa; identical to SEQ ID NO: 98314

SEQ ID NO: 564747 - RNA, 64 nt, hsa; identical to SEQ ID NO: 98315

SEQ ID NO: 564748 - RNA, 64 nt, hsa; identical to SEQ ID NO: 98316

SEQ ID NO: 564749 - RNA, 64 nt, hsa; identical to SEQ ID NO: 98317

SEQ ID NO: 564750 - RNA, 64 nt, hsa; identical to SEQ ID NO: 98318

SEQ ID NO: 564751 - RNA, 64 nt, hsa; identical to SEQ ID NO: 98319

SEQ ID NO: 564752 - RNA, 64 nt, hsa; identical to SEQ ID NO: 98320

SEQ ID NO: 564753 - RNA, 64 nt, hsa; identical to SEQ ID NO: 98321

SEQ ID NO: 564754 - RNA, 64 nt, hsa; identical to SEQ ID NO: 98322

SEQ ID NO: 564755 - RNA, 64 nt, hsa; identical to SEQ ID NO: 98323

SEQ ID NO: 564756 - RNA, 64 nt, hsa; identical to SEQ ID NO: 98324

SEQ ID NO: 564757 - RNA, 64 nt, hsa; identical to SEQ ID NO: 98325

SEQ ID NO: 564758 - RNA, 64 nt, hsa; identical to SEQ ID NO: 98326

SEQ ID NO: 564759 - RNA, 64 nt, hsa; identical to SEQ ID NO: 98327

SEQ ID NO: 564760 - RNA, 64 nt, hsa; identical to SEQ ID NO: 98328

SEQ ID NO: 564761 - RNA, 64 nt, hsa; identical to SEQ ID NO: 98329

SEQ ID NO: 564762 - RNA, 64 nt, hsa; identical to SEQ ID NO: 98330

SEQ ID NO: 564763 - RNA, 64 nt, hsa; identical to SEQ ID NO: 98331

SEQ ID NO: 564764 - RNA, 64 nt, hsa; identical to SEQ ID NO: 98332

SEQ ID NO: 564765 - RNA, 64 nt, hsa; identical to SEQ ID NO: 98333

SEQ ID NO: 564766 - RNA, 64 nt, hsa; identical to SEQ ID NO: 98334

SEQ ID NO: 564767 - RNA, 64 nt, hsa; identical to SEQ ID NO: 98335

SEQ ID NO: 564768 - RNA, 64 nt, hsa; identical to SEQ ID NO: 98336

SEQ ID NO: 564769 - RNA, 64 nt, hsa; identical to SEQ ID NO: 98337

SEQ ID NO: 564770 - RNA, 64 nt, hsa; identical to SEQ ID NO: 98338

SEQ ID NO: 564771 - RNA, 64 nt, hsa; identical to SEQ ID NO: 98339

SEQ ID NO: 564772 - RNA, 64 nt, hsa; identical to SEQ ID NO: 98340

SEQ ID NO: 564773 - RNA, 64 nt, hsa; identical to SEQ ID NO: 98341

SEQ ID NO: 564774 - RNA, 64 nt, hsa; identical to SEQ ID NO: 98342

SEQ ID NO: 564775 - RNA, 64 nt, hsa; identical to SEQ ID NO: 98343

SEQ ID NO: 564776 - RNA, 64 nt, hsa; identical to SEQ ID NO: 98344

SEQ ID NO: 564777 - RNA, 64 nt, hsa; identical to SEQ ID NO: 98345

SEQ ID NO: 564778 - RNA, 64 nt, hsa; identical to SEQ ID NO: 98346

SEQ ID NO: 564779 - RNA, 64 nt, hsa; identical to SEQ ID NO: 98347

SEQ ID NO: 564780 - RNA, 64 nt, hsa; identical to SEQ ID NO: 98348

SEQ ID NO: 564781 - RNA, 64 nt, hsa; identical to SEQ ID NO: 98349

SEQ ID NO: 564782 - RNA, 64 nt, hsa; identical to SEQ ID NO: 98350

SEQ ID NO: 564783 - RNA, 64 nt, hsa; identical to SEQ ID NO: 98351

SEQ ID NO: 564784 - RNA, 64 nt, hsa; identical to SEQ ID NO: 98352

SEQ ID NO: 564785 - RNA, 64 nt, hsa; identical to SEQ ID NO: 98353

SEQ ID NO: 564786 - RNA, 64 nt, hsa; identical to SEQ ID NO: 98354

SEQ ID NO: 564787 - RNA, 64 nt, hsa; identical to SEQ ID NO: 98355

SEQ ID NO: 564788 - RNA, 64 nt, hsa; identical to SEQ ID NO: 98356

SEQ ID NO: 564789 - RNA, 64 nt, hsa; identical to SEQ ID NO: 98357

SEQ ID NO: 564790 - RNA, 64 nt, hsa; identical to SEQ ID NO: 98358

SEQ ID NO: 564791 - RNA, 64 nt, hsa; identical to SEQ ID NO: 98359

SEQ ID NO: 564792 - RNA, 64 nt, hsa; identical to SEQ ID NO: 98360

SEQ ID NO: 564793 - RNA, 64 nt, hsa; identical to SEQ ID NO: 98361

SEQ ID NO: 564794 - RNA, 64 nt, hsa; identical to SEQ ID NO: 98362

SEQ ID NO: 564795 - RNA, 64 nt, hsa; identical to SEQ ID NO: 98363

SEQ ID NO: 564796 - RNA, 64 nt, hsa; identical to SEQ ID NO: 98364

SEQ ID NO: 564797 - RNA, 64 nt, hsa; identical to SEQ ID NO: 98365

SEQ ID NO: 564798 - RNA, 64 nt, hsa; identical to SEQ ID NO: 98366

SEQ ID NO: 564799 - RNA, 64 nt, hsa; identical to SEQ ID NO: 98367

SEQ ID NO: 564800 - RNA, 64 nt, hsa; identical to SEQ ID NO: 98368

SEQ ID NO: 564801 - RNA, 64 nt, hsa; identical to SEQ ID NO: 98369

SEQ ID NO: 564802 - RNA, 64 nt, hsa; identical to SEQ ID NO: 98370

SEQ ID NO: 564803 - RNA, 64 nt, hsa; identical to SEQ ID NO: 98371

SEQ ID NO: 564804 - RNA, 64 nt, hsa; identical to SEQ ID NO: 98372

SEQ ID NO: 564805 - RNA, 64 nt, hsa; identical to SEQ ID NO: 98373

SEQ ID NO: 564806 - RNA, 64 nt, hsa; identical to SEQ ID NO: 98374

SEQ ID NO: 564807 - RNA, 64 nt, hsa; identical to SEQ ID NO: 98375

SEQ ID NO: 564808 - RNA, 64 nt, hsa; identical to SEQ ID NO: 98376

SEQ ID NO: 564809 - RNA, 64 nt, hsa; identical to SEQ ID NO: 98377

SEQ ID NO: 564810 - RNA, 64 nt, hsa; identical to SEQ ID NO: 98378

SEQ ID NO: 564811 - RNA, 64 nt, hsa; identical to SEQ ID NO: 98379

SEQ ID NO: 564812 - RNA, 64 nt, hsa; identical to SEQ ID NO: 98380

SEQ ID NO: 564813 - RNA, 64 nt, hsa; identical to SEQ ID NO: 98381

SEQ ID NO: 564814 - RNA, 64 nt, hsa; identical to SEQ ID NO: 98382

SEQ ID NO: 564815 - RNA, 64 nt, hsa; identical to SEQ ID NO: 98383

SEQ ID NO: 564816 - RNA, 64 nt, hsa; identical to SEQ ID NO: 98384

SEQ ID NO: 564817 - RNA, 64 nt, hsa; identical to SEQ ID NO: 98385

SEQ ID NO: 564818 - RNA, 64 nt, hsa; identical to SEQ ID NO: 98386

SEQ ID NO: 564819 - RNA, 64 nt, hsa; identical to SEQ ID NO: 98387

SEQ ID NO: 564820 - RNA, 64 nt, hsa; identical to SEQ ID NO: 98388

SEQ ID NO: 564821 - RNA, 64 nt, hsa; identical to SEQ ID NO: 98389

SEQ ID NO: 564822 - RNA, 64 nt, hsa; identical to SEQ ID NO: 98390

SEQ ID NO: 564823 - RNA, 64 nt, hsa; identical to SEQ ID NO: 98391

SEQ ID NO: 564824 - RNA, 64 nt, hsa; identical to SEQ ID NO: 98392

SEQ ID NO: 564825 - RNA, 64 nt, hsa; identical to SEQ ID NO: 98393

SEQ ID NO: 564826 - RNA, 64 nt, hsa; identical to SEQ ID NO: 98394

SEQ ID NO: 564827 - RNA, 64 nt, hsa; identical to SEQ ID NO: 98395

SEQ ID NO: 564828 - RNA, 64 nt, hsa; identical to SEQ ID NO: 98396

SEQ ID NO: 564829 - RNA, 64 nt, hsa; identical to SEQ ID NO: 98397

SEQ ID NO: 564830 - RNA, 64 nt, hsa; identical to SEQ ID NO: 98398

SEQ ID NO: 564831 - RNA, 64 nt, hsa; identical to SEQ ID NO: 98399

SEQ ID NO: 564832 - RNA, 64 nt, hsa; identical to SEQ ID NO: 98400

SEQ ID NO: 564833 - RNA, 64 nt, hsa; identical to SEQ ID NO: 98401

SEQ ID NO: 564834 - RNA, 64 nt, hsa; identical to SEQ ID NO: 98402

SEQ ID NO: 564835 - RNA, 64 nt, hsa; identical to SEQ ID NO: 98403

SEQ ID NO: 564836 - RNA, 64 nt, hsa; identical to SEQ ID NO: 98404

SEQ ID NO: 564837 - RNA, 64 nt, hsa; identical to SEQ ID NO: 98405

SEQ ID NO: 564838 - RNA, 64 nt, hsa; identical to SEQ ID NO: 98406

SEQ ID NO: 564839 - RNA, 64 nt, hsa; identical to SEQ ID NO: 98407

SEQ ID NO: 564840 - RNA, 64 nt, hsa; identical to SEQ ID NO: 98408

SEQ ID NO: 564841 - RNA, 64 nt, hsa; identical to SEQ ID NO: 98409

SEQ ID NO: 564842 - RNA, 64 nt, hsa; identical to SEQ ID NO: 98410

SEQ ID NO: 564843 - RNA, 64 nt, hsa; identical to SEQ ID NO: 98411

SEQ ID NO: 564844 - RNA, 64 nt, hsa; identical to SEQ ID NO: 98412

SEQ ID NO: 564845 - RNA, 64 nt, hsa; identical to SEQ ID NO: 98413

SEQ ID NO: 564846 - RNA, 64 nt, hsa; identical to SEQ ID NO: 98414

SEQ ID NO: 564847 - RNA, 64 nt, hsa; identical to SEQ ID NO: 98415

SEQ ID NO: 564848 - RNA, 64 nt, hsa; identical to SEQ ID NO: 98416

SEQ ID NO: 564849 - RNA, 64 nt, hsa; identical to SEQ ID NO: 98417

SEQ ID NO: 564850 - RNA, 64 nt, hsa; identical to SEQ ID NO: 98418

SEQ ID NO: 564851 - RNA, 64 nt, hsa; identical to SEQ ID NO: 98419

SEQ ID NO: 564852 - RNA, 64 nt, hsa; identical to SEQ ID NO: 98420

SEQ ID NO: 564853 - RNA, 64 nt, hsa; identical to SEQ ID NO: 98421

SEQ ID NO: 564854 - RNA, 64 nt, hsa; identical to SEQ ID NO: 98422

SEQ ID NO: 564855 - RNA, 64 nt, hsa; identical to SEQ ID NO: 98423

SEQ ID NO: 564856 - RNA, 64 nt, hsa; identical to SEQ ID NO: 98424

SEQ ID NO: 564857 - RNA, 64 nt, hsa; identical to SEQ ID NO: 98425

SEQ ID NO: 564858 - RNA, 64 nt, hsa; identical to SEQ ID NO: 98426

SEQ ID NO: 564859 - RNA, 64 nt, hsa; identical to SEQ ID NO: 98427

SEQ ID NO: 564860 - RNA, 64 nt, hsa; identical to SEQ ID NO: 98428

SEQ ID NO: 564861 - RNA, 64 nt, hsa; identical to SEQ ID NO: 98429

SEQ ID NO: 564862 - RNA, 64 nt, hsa; identical to SEQ ID NO: 98430

SEQ ID NO: 564863 - RNA, 64 nt, hsa; identical to SEQ ID NO: 98431

SEQ ID NO: 564864 - RNA, 64 nt, hsa; identical to SEQ ID NO: 98432

SEQ ID NO: 564865 - RNA, 64 nt, hsa; identical to SEQ ID NO: 98433

SEQ ID NO: 564866 - RNA, 64 nt, hsa; identical to SEQ ID NO: 98434

SEQ ID NO: 564867 - RNA, 64 nt, hsa; identical to SEQ ID NO: 98435

SEQ ID NO: 564868 - RNA, 64 nt, hsa; identical to SEQ ID NO: 98436

SEQ ID NO: 564869 - RNA, 64 nt, hsa; identical to SEQ ID NO: 98437

SEQ ID NO: 564870 - RNA, 64 nt, hsa; identical to SEQ ID NO: 98438

SEQ ID NO: 564871 - RNA, 64 nt, hsa; identical to SEQ ID NO: 98439

SEQ ID NO: 564872 - RNA, 64 nt, hsa; identical to SEQ ID NO: 98440

SEQ ID NO: 564873 - RNA, 64 nt, hsa; identical to SEQ ID NO: 98441

SEQ ID NO: 564874 - RNA, 64 nt, hsa; identical to SEQ ID NO: 98442

SEQ ID NO: 564875 - RNA, 64 nt, hsa; identical to SEQ ID NO: 98443

SEQ ID NO: 564876 - RNA, 64 nt, hsa; identical to SEQ ID NO: 98444

SEQ ID NO: 564877 - RNA, 64 nt, hsa; identical to SEQ ID NO: 98445

SEQ ID NO: 564878 - RNA, 64 nt, hsa; identical to SEQ ID NO: 98446

SEQ ID NO: 564879 - RNA, 64 nt, hsa; identical to SEQ ID NO: 98447

SEQ ID NO: 564880 - RNA, 64 nt, hsa; identical to SEQ ID NO: 98448

SEQ ID NO: 564881 - RNA, 64 nt, hsa; identical to SEQ ID NO: 98449

SEQ ID NO: 564882 - RNA, 64 nt, hsa; identical to SEQ ID NO: 98450

SEQ ID NO: 564883 - RNA, 64 nt, hsa; identical to SEQ ID NO: 98451

SEQ ID NO: 564884 - RNA, 64 nt, hsa; identical to SEQ ID NO: 98452

SEQ ID NO: 564885 - RNA, 64 nt, hsa; identical to SEQ ID NO: 98453

SEQ ID NO: 564886 - RNA, 64 nt, hsa; identical to SEQ ID NO: 98454

SEQ ID NO: 564887 - RNA, 64 nt, hsa; identical to SEQ ID NO: 98455

SEQ ID NO: 564888 - RNA, 64 nt, hsa; identical to SEQ ID NO: 98456

SEQ ID NO: 564889 - RNA, 64 nt, hsa; identical to SEQ ID NO: 98457

SEQ ID NO: 564890 - RNA, 64 nt, hsa; identical to SEQ ID NO: 98458

SEQ ID NO: 564891 - RNA, 64 nt, hsa; identical to SEQ ID NO: 98459

SEQ ID NO: 564892 - RNA, 64 nt, hsa; identical to SEQ ID NO: 98460

SEQ ID NO: 564893 - RNA, 64 nt, hsa; identical to SEQ ID NO: 98461

SEQ ID NO: 564894 - RNA, 64 nt, hsa; identical to SEQ ID NO: 98462

SEQ ID NO: 564895 - RNA, 64 nt, hsa; identical to SEQ ID NO: 98463

SEQ ID NO: 564896 - RNA, 64 nt, hsa; identical to SEQ ID NO: 98464

SEQ ID NO: 564897 - RNA, 64 nt, hsa; identical to SEQ ID NO: 98465

SEQ ID NO: 564898 - RNA, 64 nt, hsa; identical to SEQ ID NO: 98466

SEQ ID NO: 564899 - RNA, 64 nt, hsa; identical to SEQ ID NO: 98467

SEQ ID NO: 564900 - RNA, 64 nt, hsa; identical to SEQ ID NO: 98468

SEQ ID NO: 564901 - RNA, 64 nt, hsa; identical to SEQ ID NO: 98469

SEQ ID NO: 564902 - RNA, 64 nt, hsa; identical to SEQ ID NO: 98470

SEQ ID NO: 564903 - RNA, 64 nt, hsa; identical to SEQ ID NO: 98471

SEQ ID NO: 564904 - RNA, 64 nt, hsa; identical to SEQ ID NO: 98472

SEQ ID NO: 564905 - RNA, 64 nt, hsa; identical to SEQ ID NO: 98473

SEQ ID NO: 564906 - RNA, 64 nt, hsa; identical to SEQ ID NO: 98474

SEQ ID NO: 564907 - RNA, 64 nt, hsa; identical to SEQ ID NO: 98475

SEQ ID NO: 564908 - RNA, 64 nt, hsa; identical to SEQ ID NO: 98476

SEQ ID NO: 564909 - RNA, 64 nt, hsa; identical to SEQ ID NO: 98477

SEQ ID NO: 564910 - RNA, 64 nt, hsa; identical to SEQ ID NO: 98478

SEQ ID NO: 564911 - RNA, 64 nt, hsa; identical to SEQ ID NO: 98479

SEQ ID NO: 564912 - RNA, 64 nt, hsa; identical to SEQ ID NO: 98480

SEQ ID NO: 564913 - RNA, 64 nt, hsa; identical to SEQ ID NO: 98481

SEQ ID NO: 564914 - RNA, 64 nt, hsa; identical to SEQ ID NO: 98482

SEQ ID NO: 564915 - RNA, 64 nt, hsa; identical to SEQ ID NO: 98483

SEQ ID NO: 564916 - RNA, 64 nt, hsa; identical to SEQ ID NO: 98484

SEQ ID NO: 564917 - RNA, 64 nt, hsa; identical to SEQ ID NO: 98485

SEQ ID NO: 564918 - RNA, 64 nt, hsa; identical to SEQ ID NO: 98486

SEQ ID NO: 564919 - RNA, 64 nt, hsa; identical to SEQ ID NO: 98487

SEQ ID NO: 564920 - RNA, 64 nt, hsa; identical to SEQ ID NO: 98488

SEQ ID NO: 564921 - RNA, 64 nt, hsa; identical to SEQ ID NO: 98489

SEQ ID NO: 564922 - RNA, 64 nt, hsa; identical to SEQ ID NO: 98490

SEQ ID NO: 564923 - RNA, 64 nt, hsa; identical to SEQ ID NO: 98491

SEQ ID NO: 564924 - RNA, 64 nt, hsa; identical to SEQ ID NO: 98492

SEQ ID NO: 564925 - RNA, 64 nt, hsa; identical to SEQ ID NO: 98493

SEQ ID NO: 564926 - RNA, 64 nt, hsa; identical to SEQ ID NO: 98494

SEQ ID NO: 564927 - RNA, 64 nt, hsa; identical to SEQ ID NO: 98495

SEQ ID NO: 564928 - RNA, 64 nt, hsa; identical to SEQ ID NO: 98496

SEQ ID NO: 564929 - RNA, 64 nt, hsa; identical to SEQ ID NO: 98497

SEQ ID NO: 564930 - RNA, 64 nt, hsa; identical to SEQ ID NO: 98498

SEQ ID NO: 564931 - RNA, 64 nt, hsa; identical to SEQ ID NO: 98499

SEQ ID NO: 564932 - RNA, 64 nt, hsa; identical to SEQ ID NO: 98500

SEQ ID NO: 564933 - RNA, 64 nt, hsa; identical to SEQ ID NO: 98501

SEQ ID NO: 564934 - RNA, 64 nt, hsa; identical to SEQ ID NO: 98502

SEQ ID NO: 564935 - RNA, 64 nt, hsa; identical to SEQ ID NO: 98503

SEQ ID NO: 564936 - RNA, 64 nt, hsa; identical to SEQ ID NO: 98504

SEQ ID NO: 564937 - RNA, 64 nt, hsa
aaaucuucagcccgguaugaaaacuuaaagguauauauucaauuuuuuaccauuuuauggaaaa

SEQ ID NO: 564938 - RNA, 64 nt, hsa
uuugaaaaccaccaaaaaucaagggaacuuuuauauauucaauuccuuuucugguguaauguua

SEQ ID NO: 564939 - RNA, 64 nt, hsa
agugguaagauaauuguaaaaugaaauggacagaauauucaauuuuccaucuaugaaaauuuca

SEQ ID NO: 564940 - RNA, 64 nt, hsa
uucuuaugguuaaagggaaauagagccuugcauuauauucaacacagccauuugugugugcaca

SEQ ID NO: 564941 - RNA, 64 nt, hsa
uguuuucaugauuuuaggaauuacugcuuuguugauauucaaagugugaaacuaaaacuuuaug

SEQ ID NO: 564942 - RNA, 64 nt, hsa
aaguaaaaguuaacuuuuugguuuugauguacacauauucaaaaaguacaucuucccccccccc

SEQ ID NO: 564943 - RNA, 64 nt, hsa
caaagauaauuuucuuuacuauuauguucaaauaauauucaauaugcauauuaucuuuaaaaag

SEQ ID NO: 564944 - RNA, 64 nt, hsa
ugcauaagagcuaauguuauuuugcaaaugccauauauucaaaaaagcucaaagauaauuuucu

SEQ ID NO: 564945 - RNA, 64 nt, hsa
uguuauucagaauaaagagagaagacuacgcugcauauucaagaguuguaccuuaacauuggug

SEQ ID NO: 564946 - RNA, 64 nt, hsa
cuuuaaaauuugugcucuuuuucauauuuuauucauauucaauuuaugguuuguaacugcuuuu

SEQ ID NO: 564947 - RNA, 64 nt, hsa
aagaugauaaucuuaccuugcaguuauugacuuuauauucaauuauuuacaucaaauaaugaaa

SEQ ID NO: 564948 - RNA, 64 nt, hsa
uaacugaaauguacaaaugucaaauuuuggaaguauauucaauaccaaugcuguaugagugggc

SEQ ID NO: 564949 - RNA, 64 nt, hsa
ccuuuugaauguugaagauaggaaagaaagccauauauucaaauauguaauuuuccucauuuag

SEQ ID NO: 564950 - RNA, 64 nt, hsa
uguuucuuucuuaauaguauccuaguuccagcauauauucaacaugaauuuuaucauucuccuc

SEQ ID NO: 564951 - RNA, 64 nt, hsa
uagaugggauuuacuauaggugaagauagcccucauauucaaggacagaagcucuggcaggagu

SEQ ID NO: 564952 - RNA, 64 nt, hsa
gauugcuuuucugaaggcaguauagggaacaugaauauucaagaugaaauacaaaaauuauguu

SEQ ID NO: 564953 - RNA, 64 nt, hsa
caaguugggaguggagaucauugccuagaagucaauauucaauaaaucuuguacauaacuauuu

SEQ ID NO: 564954 - RNA, 64 nt, hsa
uuguauccauagaauaggcagcauuauuucaaacauauucaaguugggaguggagaucauugcc

SEQ ID NO: 564955 - RNA, 64 nt, hsa
gaggauuuguaugcucccuguagccagaggugaaauauucaacgcuuuuauuuuuucucccguc

SEQ ID NO: 564956 - RNA, 64 nt, hsa
aacacugauacugcauaaaucuaauauaugauccauauucaaaauucuccaguuguccccaaaa

SEQ ID NO: 564957 - RNA, 64 nt, hsa
gcagcugaggauacaaaugugcugguagggagcgauauucaagauauauugugaagugugaaaa

SEQ ID NO: 564958 - RNA, 64 nt, hsa
aaauugaaagcuuuaaaaauugugaauuauuugaauauucaaagcaauggagaaacaaguuaua

SEQ ID NO: 564959 - RNA, 64 nt, hsa
uaagguuuaaguaauuugguuuaauaaucagaaaauauucaauacaguguuggauauucuguca

SEQ ID NO: 564960 - RNA, 64 nt, hsa
agggagagaagggggcuguagaguuugaaaaagcauauucaauauuaaaauaguuuuauauuug

SEQ ID NO: 564961 - RNA, 64 nt, hsa
aacuugaauuugauuuaaaauagggcugggaaaaauauucaauaacuguaagcccccuuuugga

SEQ ID NO: 564962 - RNA, 64 nt, hsa
aguaaaauuagaaucagaaauacuucuuuaaaaaauauucaaaauguguuuguuucccauggga

SEQ ID NO: 564963 - RNA, 64 nt, hsa
aaucaaaacauacaauggcaaguaguaugcaugcauauucaagagacucuuccauuuuugcaag

SEQ ID NO: 564964 - RNA, 64 nt, hsa
gaguauuuuauuaacaccugauuuguauuccauuauauucaaaaugcaucuuugguauugugcc

SEQ ID NO: 564965 - RNA, 64 nt, hsa
aagcagaaacuuaagaaaaaauuguuuauguguuauauucaauuagcuuaaauaaguugcuuug

SEQ ID NO: 564966 - RNA, 64 nt, hsa
uaauaauguuaaagacacuuaagaagaugaaauaauauucaaauuucauuuuuuccuuuuucca

SEQ ID NO: 564967 - RNA, 64 nt, hsa
gcauaaaaauaguuuccuagguaaggggugugagauauucaaagaauacauguggcuaacaagu

SEQ ID NO: 564968 - RNA, 64 nt, hsa
aauaaugcaacuucgaguaugcuuuaauauuucaauauucaaguuacaaauguauaaggcaguu

SEQ ID NO: 564969 - RNA, 64 nt, hsa
uuuuuauaaaugaauuuuucauagaauuuacaguauauucaaaggaagaaagauaaaauuauug

SEQ ID NO: 564970 - RNA, 64 nt, hsa
auuguuuaguuguuuucuccccugauuaauggugauauucaaguaugauacaaaaagaauugua

SEQ ID NO: 564971 - RNA, 64 nt, hsa
ugcaaaacagaaguaaauaagaguucgggacccaggguaaaaugguagcuucauccaauauauc

SEQ ID NO: 564972 - RNA, 64 nt, hsa
gcugguagcuccagaauuuugugaccacuauuguggguaaaaugucucugcaucacuuguuaau

SEQ ID NO: 564973 - RNA, 64 nt, hsa
agacuugguaauacagagauggacaaucguacugggguaaaaaaacccugcugaagagaggaca

SEQ ID NO: 564974 - RNA, 64 nt, hsa
gugcuuugcaucuccaggcaguucucucacauuuggguaaaauguuuagcaggcuguaaacuua

SEQ ID NO: 564975 - RNA, 64 nt, hsa
guaaaauguuuagcaggcuguaaacuuaagaaaaggguaaaauaaaauuuucuggagaggaacu

SEQ ID NO: 564976 - RNA, 64 nt, hsa
ugguuguacaacuuuagcaucggggcugcuggaaggguaaaagcuaaauggaguuucuccugcu

SEQ ID NO: 564977 - RNA, 64 nt, hsa
uguauuuaggaagugucaggauguucaaaggaaaggguaaaaaguguucauggggaaaaagcuc

SEQ ID NO: 564978 - RNA, 64 nt, hsa
acucaggauauaguuggccuaauaaucggggcauggguaaaacuuaugaaaauuuccucaugcu

SEQ ID NO: 564979 - RNA, 64 nt, hsa
caggguccauuucucuuggauguaaaggaguccuggguaaaauguggcuguaaccuaaaccaac

SEQ ID NO: 564980 - RNA, 64 nt, hsa
uucaccauacugguuucuucucuuugguugguguggguaaaagaaaacaaaacauuuccuauaa

SEQ ID NO: 564981 - RNA, 64 nt, hsa
uggguuuagggcuagcccugccuccaucucccuuggguaaaaugaagggugugggguaaaagau

SEQ ID NO: 564982 - RNA, 64 nt, hsa
gccuccaucucccuuggguaaaaugaagggugugggguaaaagaugcauaaggccuuuucuagc

SEQ ID NO: 564983 - RNA, 64 nt, hsa
gugaaggaaauuugagucuguauugcugcuacaaggguaaaaccaggaccaauggguaaaagua

SEQ ID NO: 564984 - RNA, 64 nt, hsa
guauugcugcuacaaggguaaaaccaggaccaauggguaaaaguaacaggcgggcagauuuugg

SEQ ID NO: 564985 - RNA, 64 nt, hsa
ucaggcaagcaaaagauuguccccuucugcauauggguaaaacugagacguccccgugagcccg

SEQ ID NO: 564986 - RNA, 64 nt, hsa
gucaaaagauaaauuggggccuuguaaaaggccaggguaaaaugucucaggcaagcaaaagauu

SEQ ID NO: 564987 - RNA, 64 nt, hsa
cucuauacuggaguucccuucuuccucuugcuguaggcucaaucccauaccgacaucuacaacu

SEQ ID NO: 564988 - RNA, 64 nt, hsa
ccucaaagcccaaagccaagggaaggauaaaucaaggcucaaggcuuccccagcaaagauuagg

SEQ ID NO: 564989 - RNA, 64 nt, hsa
cucacuauguuuccucaucuggucuuaaacuucuaggcucaagcaucuaccugccucagccucc

SEQ ID NO: 564990 - RNA, 64 nt, hsa
gcacaaucacagcucacugcagccuugaccuccuaggcucaagcuauccuccaaccucagccug

SEQ ID NO: 564991 - RNA, 64 nt, hsa; identical to SEQ ID NO: 274983

SEQ ID NO: 564992 - RNA, 64 nt, hsa; identical to SEQ ID NO: 274984

SEQ ID NO: 564993 - RNA, 64 nt, hsa; identical to SEQ ID NO: 274985

SEQ ID NO: 564994 - RNA, 64 nt, hsa; identical to SEQ ID NO: 274986

SEQ ID NO: 564995 - RNA, 64 nt, hsa; identical to SEQ ID NO: 274987

SEQ ID NO: 564996 - RNA, 64 nt, hsa; identical to SEQ ID NO: 274988

SEQ ID NO: 564997 - RNA, 64 nt, hsa; identical to SEQ ID NO: 274989

SEQ ID NO: 564998 - RNA, 64 nt, hsa; identical to SEQ ID NO: 274990

SEQ ID NO: 564999 - RNA, 64 nt, hsa; identical to SEQ ID NO: 274991

SEQ ID NO: 565000 - RNA, 64 nt, hsa; identical to SEQ ID NO: 274992

SEQ ID NO: 565001 - RNA, 64 nt, hsa; identical to SEQ ID NO: 274993

SEQ ID NO: 565002 - RNA, 64 nt, hsa; identical to SEQ ID NO: 274994

SEQ ID NO: 565003 - RNA, 64 nt, hsa; identical to SEQ ID NO: 274995

SEQ ID NO: 565004 - RNA, 64 nt, hsa; identical to SEQ ID NO: 274996

SEQ ID NO: 565005 - RNA, 64 nt, hsa
cugcuccaaggcggagggugggagcaggugugccagggcucagggcucagacuugggagggccu

SEQ ID NO: 565006 - RNA, 64 nt, hsa
aaggcggagggugggagcaggugugccagggcucagggcucagacuugggagggccuaggcaga

SEQ ID NO: 565007 - RNA, 64 nt, hsa
cgugcuggugcacucugcuaguuguuaucucuguagggcucaggaagcuggaaggaggaaggga

SEQ ID NO: 565008 - RNA, 64 nt, hsa
uccucacuguaaugugaggaagcaccucugugucagggcucaccugggcauccaaagcggccac

SEQ ID NO: 565009 - RNA, 64 nt, hsa
ugggcucugccaaugugggcugccccucgcacacagggcucacagggcaggccuugcugggguc

SEQ ID NO: 565010 - RNA, 64 nt, hsa
aaccagggccucccuguucacggugacacaggucagggcucagagugacccucagcugucaccu

SEQ ID NO: 565011 - RNA, 64 nt, hsa
cucgacccagggacaugcagggcucacaggagacagggcucaggcugccggagcuccaaccaaa

SEQ ID NO: 565012 - RNA, 64 nt, hsa
ccccugcauccccagccucgacccagggacaugcagggcucacaggagacagggcucaggcugc

SEQ ID NO: 565013 - RNA, 64 nt, hsa
caggugucccauaucugguuauguuaaccuagaaagggcucacucuaccucuaggcauguuuca

SEQ ID NO: 565014 - RNA, 64 nt, hsa
ucuuccauugagaaaagcauaugaauccuaggaaagggcucagccugugauaggcauucaauaa

SEQ ID NO: 565015 - RNA, 64 nt, hsa
gcacccccacuuucaacugaaucaagugaggaagagggcucagagccugacucugagggguucc

SEQ ID NO: 565016 - RNA, 64 nt, hsa
cuacaaguccaaccaguggaccuggaauuggccaagggcucaggagagggcuguguugcucucu

SEQ ID NO: 565017 - RNA, 64 nt, hsa
aaucucaggaccccgcccagggagcugccagcccagggcucagcuucccaugggccccccgccc

SEQ ID NO: 565018 - RNA, 64 nt, hsa
cagagagggaccccagcacaucgugggcacgggcagggcucagccgcucccaccuccccacaga

SEQ ID NO: 565019 - RNA, 64 nt, hsa
gggucuguuguuugaccguccugagaccgagggaagggcucagcugaaggaccccgucugcagg

SEQ ID NO: 565020 - RNA, 64 nt, hsa
cacagcccgugugacugcuagagggcaggggugcagggcucagggggcccgggcugguccuuug

SEQ ID NO: 565021 - RNA, 64 nt, hsa
caguucccuccaggcuucuagaagcaucugggccagggcucauggcuggauaauuucccuaggc

SEQ ID NO: 565022 - RNA, 64 nt, hsa
gagcuucaagaccuugucugacccagcguccuggagggcucaggcgacccucauggggaagguc

SEQ ID NO: 565023 - RNA, 64 nt, hsa
ccugggagggguagccauuagggucuuucaaaacucuuuggaucuaagcauuugucucuccuua

SEQ ID NO: 565024 - RNA, 64 nt, hsa
cugucuuucccaugcaaagcugauaacacaguugucuuuggacuuguagaccucuuggauucca

SEQ ID NO: 565025 - RNA, 64 nt, hsa
acauguugauguuauaagcacaauagauggggcaucuuuggauugauguucacagcuuuauacu

SEQ ID NO: 565026 - RNA, 64 nt, hsa
uucaguuuacugaaugauuaccaccuguaauuccucuuuggauuguguagacucaacaugagac

SEQ ID NO: 565027 - RNA, 64 nt, hsa
uuuugagaaugccaaaccacauuuuuaucacacuucuuuggaaaucaaugccuuugcauagaaa

SEQ ID NO: 565028 - RNA, 64 nt, hsa
gguacagaauuuugaguaauggugaaaauuguugucuuuggaaagcacaaaagaaaccuggaaa

SEQ ID NO: 565029 - RNA, 64 nt, hsa
ccucuaccccacauuggccaguggacucauccauucuuuggaacaaaucccccccacuccaaag

SEQ ID NO: 565030 - RNA, 64 nt, hsa
ucuuccuugucuccccucuccccacuuauucuccucuuuggaaucuucaacuucugaagugaau

SEQ ID NO: 565031 - RNA, 64 nt, hsa
gauuggaccucauuacauaagggggcuguggacgucuuuggaauuuguuaggggaaggcuaugu

SEQ ID NO: 565032 - RNA, 64 nt, hsa
ugcaaaaccaaaaauaaauagccauaauuugccaucuuuggagagauuauggagauaaucuccu

SEQ ID NO: 565033 - RNA, 64 nt, hsa
cugcauguugccugccacuuacucaccacuggggucuuuggaagauaaucuuccucuuuggaaa

SEQ ID NO: 565034 - RNA, 64 nt, hsa
acucaccacuggggucuuuggaagauaaucuuccucuuuggaaaugaauggaaaagcaaaaggc

SEQ ID NO: 565035 - RNA, 64 nt, hsa
ccuccuuggaucaguuuucuuuccagucuaaucaucuuuggaacuaaaacuuguucuaacucgu

SEQ ID NO: 565036 - RNA, 64 nt, hsa
uuuaucugcagauauugccuguagucuaaagaucucuuuggaagacaaagcauuggcuauauau

SEQ ID NO: 565037 - RNA, 64 nt, hsa
guuagguaaaaugccugcuuuguguacaagauacucuuuggaucucucguagagaugguuuguu

SEQ ID NO: 565038 - RNA, 64 nt, hsa
auacucugguggccugguccuguuggggugggggucuuuggagagaagggcauagucuuugagc

SEQ ID NO: 565039 - RNA, 64 nt, hsa
aucauagaggaccacggcgcuuaucagcauuguuucuuuggagucuguguaauggaauguauuu

SEQ ID NO: 565040 - RNA, 64 nt, hsa
aaauucccagaaguuacagaugccuuaaagacuuucuuuggaagaucauugccuguacuauucc

SEQ ID NO: 565041 - RNA, 64 nt, hsa
accaaccuaaaaaauuacagagaagagaaaauuaucuuuggauugugcugcccuauauaaaggu

SEQ ID NO: 565042 - RNA, 64 nt, hsa
aaaaagaaauacaaaguuguaaaaguaauggauuucuuuggaugcugaaugcagugauguuauc

SEQ ID NO: 565043 - RNA, 64 nt, hsa
uuugcaauauuguaguucauauauuaccguuaugucuuuggaaaucggguucagaacacuuuuu

SEQ ID NO: 565044 - RNA, 64 nt, hsa
aagaaauuguuuuuaacagaagcaaaauggcuuuucuuuggacaguuuucaccaucucuuguaa

SEQ ID NO: 565045 - RNA, 64 nt, hsa
gugugccggacucuggggcuccgagaaaccugguucuuuggacugcaguacacaaucaaggaca

SEQ ID NO: 565046 - RNA, 64 nt, hsa
ccaugaucuauuuaugaggagaaggaaagccgauucuuuggaaguucagcagaugaaagcccag

SEQ ID NO: 565047 - RNA, 64 nt, hsa
caagaaaggagagucuugcagugauuaaggucucucuuuggacucuccccucuuauguaccucu

SEQ ID NO: 565048 - RNA, 64 nt, hsa
gagauggcccucugguagacacaggauagauaacucuuuggauagcaugucuuuuuuucuguua

SEQ ID NO: 565049 - RNA, 64 nt, hsa; identical to SEQ ID NO: 198474

SEQ ID NO: 565050 - RNA, 64 nt, hsa; identical to SEQ ID NO: 198475

SEQ ID NO: 565051 - RNA, 64 nt, hsa; identical to SEQ ID NO: 198476

SEQ ID NO: 565052 - RNA, 64 nt, hsa; identical to SEQ ID NO: 198477

SEQ ID NO: 565053 - RNA, 64 nt, hsa; identical to SEQ ID NO: 198478

SEQ ID NO: 565054 - RNA, 64 nt, hsa; identical to SEQ ID NO: 198479

SEQ ID NO: 565055 - RNA, 64 nt, hsa; identical to SEQ ID NO: 198480

SEQ ID NO: 565056 - RNA, 64 nt, hsa; identical to SEQ ID NO: 198481

SEQ ID NO: 565057 - RNA, 64 nt, hsa; identical to SEQ ID NO: 198482

SEQ ID NO: 565058 - RNA, 64 nt, hsa; identical to SEQ ID NO: 198483

SEQ ID NO: 565059 - RNA, 64 nt, hsa; identical to SEQ ID NO: 198484

SEQ ID NO: 565060 - RNA, 64 nt, hsa; identical to SEQ ID NO: 198485

SEQ ID NO: 565061 - RNA, 64 nt, hsa; identical to SEQ ID NO: 198486

SEQ ID NO: 565062 - RNA, 64 nt, hsa; identical to SEQ ID NO: 198487

SEQ ID NO: 565063 - RNA, 64 nt, hsa; identical to SEQ ID NO: 198488

SEQ ID NO: 565064 - RNA, 64 nt, hsa; identical to SEQ ID NO: 198489

SEQ ID NO: 565065 - RNA, 64 nt, hsa; identical to SEQ ID NO: 198490

SEQ ID NO: 565066 - RNA, 64 nt, hsa; identical to SEQ ID NO: 198491

SEQ ID NO: 565067 - RNA, 64 nt, hsa; identical to SEQ ID NO: 198492

SEQ ID NO: 565068 - RNA, 64 nt, hsa; identical to SEQ ID NO: 483170

SEQ ID NO: 565069 - RNA, 64 nt, hsa; identical to SEQ ID NO: 483171

SEQ ID NO: 565070 - RNA, 64 nt, hsa; identical to SEQ ID NO: 483172

SEQ ID NO: 565071 - RNA, 64 nt, hsa; identical to SEQ ID NO: 483173

SEQ ID NO: 565072 - RNA, 64 nt, hsa; identical to SEQ ID NO: 483174

SEQ ID NO: 565073 - RNA, 64 nt, hsa; identical to SEQ ID NO: 483175

SEQ ID NO: 565074 - RNA, 64 nt, hsa; identical to SEQ ID NO: 483176

SEQ ID NO: 565075 - RNA, 64 nt, hsa; identical to SEQ ID NO: 483177

SEQ ID NO: 565076 - RNA, 64 nt, hsa; identical to SEQ ID NO: 483178

SEQ ID NO: 565077 - RNA, 64 nt, hsa; identical to SEQ ID NO: 483179

SEQ ID NO: 565078 - RNA, 64 nt, hsa; identical to SEQ ID NO: 483180

SEQ ID NO: 565079 - RNA, 64 nt, hsa; identical to SEQ ID NO: 483181

SEQ ID NO: 565080 - RNA, 64 nt, hsa; identical to SEQ ID NO: 483182

SEQ ID NO: 565081 - RNA, 64 nt, hsa; identical to SEQ ID NO: 483183

SEQ ID NO: 565082 - RNA, 64 nt, hsa; identical to SEQ ID NO: 483184

SEQ ID NO: 565083 - RNA, 64 nt, hsa; identical to SEQ ID NO: 483185

SEQ ID NO: 565084 - RNA, 64 nt, hsa; identical to SEQ ID NO: 483186

SEQ ID NO: 565085 - RNA, 64 nt, hsa; identical to SEQ ID NO: 483187

SEQ ID NO: 565086 - RNA, 64 nt, hsa; identical to SEQ ID NO: 483188

SEQ ID NO: 565087 - RNA, 64 nt, hsa; identical to SEQ ID NO: 483189

SEQ ID NO: 565088 - RNA, 64 nt, hsa; identical to SEQ ID NO: 483190

SEQ ID NO: 565089 - RNA, 64 nt, hsa; identical to SEQ ID NO: 483191

SEQ ID NO: 565090 - RNA, 64 nt, hsa; identical to SEQ ID NO: 483192

SEQ ID NO: 565091 - RNA, 64 nt, hsa; identical to SEQ ID NO: 483193

SEQ ID NO: 565092 - RNA, 64 nt, hsa; identical to SEQ ID NO: 483194

SEQ ID NO: 565093 - RNA, 64 nt, hsa; identical to SEQ ID NO: 483195

SEQ ID NO: 565094 - RNA, 64 nt, hsa; identical to SEQ ID NO: 483196

SEQ ID NO: 565095 - RNA, 64 nt, hsa; identical to SEQ ID NO: 483197

SEQ ID NO: 565096 - RNA, 64 nt, hsa; identical to SEQ ID NO: 483198

SEQ ID NO: 565097 - RNA, 64 nt, hsa; identical to SEQ ID NO: 483199

SEQ ID NO: 565098 - RNA, 64 nt, hsa; identical to SEQ ID NO: 483200

SEQ ID NO: 565099 - RNA, 64 nt, hsa; identical to SEQ ID NO: 483201

SEQ ID NO: 565100 - RNA, 64 nt, hsa; identical to SEQ ID NO: 483202

SEQ ID NO: 565101 - RNA, 64 nt, hsa; identical to SEQ ID NO: 123011

SEQ ID NO: 565102 - RNA, 64 nt, hsa; identical to SEQ ID NO: 123012

SEQ ID NO: 565103 - RNA, 64 nt, hsa; identical to SEQ ID NO: 123013

SEQ ID NO: 565104 - RNA, 64 nt, hsa; identical to SEQ ID NO: 123014

SEQ ID NO: 565105 - RNA, 64 nt, hsa; identical to SEQ ID NO: 123015

SEQ ID NO: 565106 - RNA, 64 nt, hsa; identical to SEQ ID NO: 123016

SEQ ID NO: 565107 - RNA, 64 nt, hsa; identical to SEQ ID NO: 123017

SEQ ID NO: 565108 - RNA, 64 nt, hsa; identical to SEQ ID NO: 123018

SEQ ID NO: 565109 - RNA, 64 nt, hsa; identical to SEQ ID NO: 123019

SEQ ID NO: 565110 - RNA, 64 nt, hsa; identical to SEQ ID NO: 123020

SEQ ID NO: 565111 - RNA, 64 nt, hsa; identical to SEQ ID NO: 123021

SEQ ID NO: 565112 - RNA, 64 nt, hsa; identical to SEQ ID NO: 123022

SEQ ID NO: 565113 - RNA, 64 nt, hsa; identical to SEQ ID NO: 123023

SEQ ID NO: 565114 - RNA, 64 nt, hsa; identical to SEQ ID NO: 123024

SEQ ID NO: 565115 - RNA, 64 nt, hsa; identical to SEQ ID NO: 123025

SEQ ID NO: 565116 - RNA, 64 nt, hsa; identical to SEQ ID NO: 123026

SEQ ID NO: 565117 - RNA, 64 nt, hsa; identical to SEQ ID NO: 123027

SEQ ID NO: 565118 - RNA, 64 nt, hsa; identical to SEQ ID NO: 123028

SEQ ID NO: 565119 - RNA, 64 nt, hsa; identical to SEQ ID NO: 123029

SEQ ID NO: 565120 - RNA, 64 nt, hsa; identical to SEQ ID NO: 123030

SEQ ID NO: 565121 - RNA, 64 nt, hsa; identical to SEQ ID NO: 123031

SEQ ID NO: 565122 - RNA, 64 nt, hsa; identical to SEQ ID NO: 123032

SEQ ID NO: 565123 - RNA, 64 nt, hsa; identical to SEQ ID NO: 123033

SEQ ID NO: 565124 - RNA, 64 nt, hsa; identical to SEQ ID NO: 123034

SEQ ID NO: 565125 - RNA, 64 nt, hsa; identical to SEQ ID NO: 123035

SEQ ID NO: 565126 - RNA, 64 nt, hsa; identical to SEQ ID NO: 123036

SEQ ID NO: 565127 - RNA, 64 nt, hsa; identical to SEQ ID NO: 123037

SEQ ID NO: 565128 - RNA, 64 nt, hsa; identical to SEQ ID NO: 123038

SEQ ID NO: 565129 - RNA, 64 nt, hsa; identical to SEQ ID NO: 123039

SEQ ID NO: 565130 - RNA, 64 nt, hsa; identical to SEQ ID NO: 123040

SEQ ID NO: 565131 - RNA, 64 nt, hsa; identical to SEQ ID NO: 123041

SEQ ID NO: 565132 - RNA, 64 nt, hsa; identical to SEQ ID NO: 123042

SEQ ID NO: 565133 - RNA, 64 nt, hsa; identical to SEQ ID NO: 123043

SEQ ID NO: 565134 - RNA, 64 nt, hsa; identical to SEQ ID NO: 123044

SEQ ID NO: 565135 - RNA, 64 nt, hsa; identical to SEQ ID NO: 123045

SEQ ID NO: 565136 - RNA, 64 nt, hsa; identical to SEQ ID NO: 123046

SEQ ID NO: 565137 - RNA, 64 nt, hsa; identical to SEQ ID NO: 123047

SEQ ID NO: 565138 - RNA, 64 nt, hsa; identical to SEQ ID NO: 123048

SEQ ID NO: 565139 - RNA, 64 nt, hsa; identical to SEQ ID NO: 123049

SEQ ID NO: 565140 - RNA, 64 nt, hsa; identical to SEQ ID NO: 123050

SEQ ID NO: 565141 - RNA, 64 nt, hsa; identical to SEQ ID NO: 123051

SEQ ID NO: 565142 - RNA, 64 nt, hsa; identical to SEQ ID NO: 123052

SEQ ID NO: 565143 - RNA, 64 nt, hsa; identical to SEQ ID NO: 123053

SEQ ID NO: 565144 - RNA, 64 nt, hsa; identical to SEQ ID NO: 123054

SEQ ID NO: 565145 - RNA, 64 nt, hsa; identical to SEQ ID NO: 123055

SEQ ID NO: 565146 - RNA, 64 nt, hsa; identical to SEQ ID NO: 123056

SEQ ID NO: 565147 - RNA, 64 nt, hsa; identical to SEQ ID NO: 123057

SEQ ID NO: 565148 - RNA, 64 nt, hsa; identical to SEQ ID NO: 123058

SEQ ID NO: 565149 - RNA, 64 nt, hsa; identical to SEQ ID NO: 123059

SEQ ID NO: 565150 - RNA, 64 nt, hsa; identical to SEQ ID NO: 123060

SEQ ID NO: 565151 - RNA, 64 nt, hsa; identical to SEQ ID NO: 123061

SEQ ID NO: 565152 - RNA, 64 nt, hsa; identical to SEQ ID NO: 123062

SEQ ID NO: 565153 - RNA, 64 nt, hsa; identical to SEQ ID NO: 123063

SEQ ID NO: 565154 - RNA, 64 nt, hsa; identical to SEQ ID NO: 123064

SEQ ID NO: 565155 - RNA, 64 nt, hsa; identical to SEQ ID NO: 123065

SEQ ID NO: 565156 - RNA, 64 nt, hsa; identical to SEQ ID NO: 123066

SEQ ID NO: 565157 - RNA, 64 nt, hsa; identical to SEQ ID NO: 123067

SEQ ID NO: 565158 - RNA, 64 nt, hsa; identical to SEQ ID NO: 123068

SEQ ID NO: 565159 - RNA, 64 nt, hsa; identical to SEQ ID NO: 123069

SEQ ID NO: 565160 - RNA, 64 nt, hsa; identical to SEQ ID NO: 123070

SEQ ID NO: 565161 - RNA, 64 nt, hsa; identical to SEQ ID NO: 123071

SEQ ID NO: 565162 - RNA, 64 nt, hsa; identical to SEQ ID NO: 123072

SEQ ID NO: 565163 - RNA, 64 nt, hsa; identical to SEQ ID NO: 123073

SEQ ID NO: 565164 - RNA, 64 nt, hsa; identical to SEQ ID NO: 123074

SEQ ID NO: 565165 - RNA, 64 nt, hsa
agucagagcugugagcggggggcgccguccaggccgagcgcagacuguuuaggacucagcagac

SEQ ID NO: 565166 - RNA, 64 nt, hsa
agagagagaauaugugugugugugugugcgucugcgagcgcacacacaugcacaagugcgaagg

SEQ ID NO: 565167 - RNA, 64 nt, hsa
cccacagcccguguucccgaaguugcuaagugcccgagcgcagcgcguuaaguagagaagucuu

SEQ ID NO: 565168 - RNA, 64 nt, hsa
acagcuuucuugcgucucauuugucgccgagccccgagcgcacggugaugcucgggucugcccc

SEQ ID NO: 565169 - RNA, 64 nt, hsa
ccgagcugcuggcccagggccacaccaagccacccgagcgcagugccacaggcgccaagagcaa

SEQ ID NO: 565170 - RNA, 64 nt, hsa
augaguguuccagagggagaagcaucgcugaccccgagcgcagguuuugcuagcagauugcccu

SEQ ID NO: 565171 - RNA, 64 nt, hsa
cuggaguccccaugggggcgguagcugaaguuggcgagcgcagcgguggaugcagagcuggcug

SEQ ID NO: 565172 - RNA, 64 nt, hsa
cuggcaagcaucaacaggagucuucuucccaacacgagcgcauccauguccugagaaaaagucu

SEQ ID NO: 565173 - RNA, 64 nt, hsa
cguagccaccaaccgcuaaaaugcacgccaucaucgagcgcacggccagcuucgugugcaggca

SEQ ID NO: 565174 - RNA, 64 nt, hsa
ggugggcacugcagaggaucacuggaauccagaucgagcgcaguucaugcacaaggccccguug

SEQ ID NO: 565175 - RNA, 64 nt, hsa
cuacuuagcaguguuggucucuggggcuggaagccgagcgcaugcugggagcgguacugucaga

SEQ ID NO: 565176 - RNA, 64 nt, hsa
gucuuccccacuggcaguggcagcagccccaccccgagcgcacacugugauggaggagacugag

SEQ ID NO: 565177 - RNA, 64 nt, hsa
ugccacacgcccgcggugaucccagccagggccccgagcgcagaggcggagcugugcucagcac

SEQ ID NO: 565178 - RNA, 64 nt, hsa
uguagauaagcaugagaguguggagcagagucggcgagcgcaagccgagcccaucaaccuggac

SEQ ID NO: 565179 - RNA, 64 nt, hsa
cuguaguccugguagcuguugugcuuggaaauaacgagcgcauccuugccucagcuaccugcuc

SEQ ID NO: 565180 - RNA, 64 nt, hsa
acucgacaagcuggacccccugcucccgggggggcgagcgcaugacccccccgcccucgcgcug

SEQ ID NO: 565181 - RNA, 64 nt, hsa
gugaagcgugcucauuucaugcuggguaugacgccgagcgcacaccacuggcgugagacagcgc

SEQ ID NO: 565182 - RNA, 64 nt, hsa; identical to SEQ ID NO: 165937

SEQ ID NO: 565183 - RNA, 64 nt, hsa; identical to SEQ ID NO: 165938

SEQ ID NO: 565184 - RNA, 64 nt, hsa; identical to SEQ ID NO: 165939

SEQ ID NO: 565185 - RNA, 64 nt, hsa; identical to SEQ ID NO: 165940

SEQ ID NO: 565186 - RNA, 64 nt, hsa; identical to SEQ ID NO: 165941

SEQ ID NO: 565187 - RNA, 64 nt, hsa; identical to SEQ ID NO: 165942

SEQ ID NO: 565188 - RNA, 64 nt, hsa; identical to SEQ ID NO: 165943

SEQ ID NO: 565189 - RNA, 64 nt, hsa; identical to SEQ ID NO: 165944

SEQ ID NO: 565190 - RNA, 64 nt, hsa; identical to SEQ ID NO: 165945

SEQ ID NO: 565191 - RNA, 64 nt, hsa; identical to SEQ ID NO: 165946

SEQ ID NO: 565192 - RNA, 64 nt, hsa; identical to SEQ ID NO: 165947

SEQ ID NO: 565193 - RNA, 64 nt, hsa; identical to SEQ ID NO: 165948

SEQ ID NO: 565194 - RNA, 64 nt, hsa; identical to SEQ ID NO: 165949

SEQ ID NO: 565195 - RNA, 64 nt, hsa; identical to SEQ ID NO: 165950

SEQ ID NO: 565196 - RNA, 64 nt, hsa; identical to SEQ ID NO: 165951

SEQ ID NO: 565197 - RNA, 64 nt, hsa; identical to SEQ ID NO: 165952

SEQ ID NO: 565198 - RNA, 64 nt, hsa; identical to SEQ ID NO: 165953

SEQ ID NO: 565199 - RNA, 64 nt, hsa; identical to SEQ ID NO: 165954

SEQ ID NO: 565200 - RNA, 64 nt, hsa; identical to SEQ ID NO: 165955

SEQ ID NO: 565201 - RNA, 64 nt, hsa; identical to SEQ ID NO: 165956

SEQ ID NO: 565202 - RNA, 64 nt, hsa; identical to SEQ ID NO: 165957

SEQ ID NO: 565203 - RNA, 64 nt, hsa; identical to SEQ ID NO: 165958

SEQ ID NO: 565204 - RNA, 64 nt, hsa; identical to SEQ ID NO: 165959

SEQ ID NO: 565205 - RNA, 64 nt, hsa; identical to SEQ ID NO: 165960

SEQ ID NO: 565206 - RNA, 64 nt, hsa; identical to SEQ ID NO: 165961

SEQ ID NO: 565207 - RNA, 64 nt, hsa; identical to SEQ ID NO: 165962

SEQ ID NO: 565208 - RNA, 64 nt, hsa; identical to SEQ ID NO: 165963

SEQ ID NO: 565209 - RNA, 64 nt, hsa; identical to SEQ ID NO: 165964

SEQ ID NO: 565210 - RNA, 64 nt, hsa
caccucagaguucgccuuuucauuucaagcauaaggcaauaaauaccugcagcaacgugggaga

SEQ ID NO: 565211 - RNA, 64 nt, hsa
cuuuuugucuguuaguuauuucuccaggggaaaaggcaauaauuuucuaagacccgugugaaug

SEQ ID NO: 565212 - RNA, 64 nt, hsa
gagaauccugcaaugggcaauaauccuuaauauaggcaauaaauguuugucaacauauucucuu

SEQ ID NO: 565213 - RNA, 64 nt, hsa
cugcggccacugcaugugagagaauccugcaaugggcaauaauccuuaauauaggcaauaaaug

SEQ ID NO: 565214 - RNA, 64 nt, hsa
cguacuauaguauucuuaauacagugcucacugcauuuaauaaauauuuaauaaaugaugaaug

SEQ ID NO: 565215 - RNA, 64 nt, hsa
auucuuaauacagugcucacugcauuuaauaaauauuuaauaaaugaugaaugauagaaguuuc

SEQ ID NO: 565216 - RNA, 64 nt, hsa
agcugaucacaagcacaaaucuuucccacuagccauuuaauaaguuaaaaaaagauacaaaaac

SEQ ID NO: 565217 - RNA, 64 nt, hsa
cacuuaaucuauaugcuuuacacuagcuuucugcauuuaauagguuagaauguaaauuaaagug

SEQ ID NO: 565218 - RNA, 64 nt, hsa
agauauaaaauugguuuaucuauaauguuuguucauuuaauagcuucuaaaaggccuuuuuguu

SEQ ID NO: 565219 - RNA, 64 nt, hsa
caaguuguccuuucucuuaaaauacccuuuacugauuuaauacagaauaacaaucuuauuuucc

SEQ ID NO: 565220 - RNA, 64 nt, hsa
cauuaugagguauacaacuaguauuuaagauaccauuuaauaugccccguaaaugucuucagug

SEQ ID NO: 565221 - RNA, 64 nt, hsa
uauuaacauugcaaaacuggaccauauuucccuuauuuaauaagcaaaauauguuuuuggaaua

SEQ ID NO: 565222 - RNA, 64 nt, hsa
ucagugaugaguugggcuuaaugcaaagauccuaauuuaauaaagaaaccuguaaauuacuguu

SEQ ID NO: 565223 - RNA, 64 nt, hsa
aggaggcaaacuauuuuagcacucagauuaucugauuuaauacauauuauugaauaucagucuc

SEQ ID NO: 565224 - RNA, 64 nt, hsa
uaauguaaaauuuaaauggggaaagauauuuaauauuuaauacuaagcuuuaaaaagaaaccug

SEQ ID NO: 565225 - RNA, 64 nt, hsa
ggcagaguaauguaaaauuuaaauggggaaagauauuuaauauuuaauacuaagcuuuaaaaag

SEQ ID NO: 565226 - RNA, 64 nt, hsa
auucacccuugauuuaauuauuucucuggcaaugauuuaauagacuucucggagucuguuaagu

SEQ ID NO: 565227 - RNA, 64 nt, hsa
ugcaaaggaaauuugaaagauaagauuuauucuuauuuaauacuucagaaaauuucugcagagc

SEQ ID NO: 565228 - RNA, 64 nt, hsa
acuuagcuuaugaguagcuuauacaauuaugaagauuuaauauuacagauaaaauguaaacugu

SEQ ID NO: 565229 - RNA, 64 nt, hsa
auguaucaaauguaacuuacugcgacuaaacuuaauuuaauauuuacucuauaaccaaaugaaa

SEQ ID NO: 565230 - RNA, 64 nt, hsa
aaaagacuugcagcuaaucuaaaaaacuggugauauuuaauaugcauguauguaucuaaacacc

SEQ ID NO: 565231 - RNA, 64 nt, hsa
uguagcuuucuauauauguaguagguuggcuuuaauuuaauauacuugauucagaaacaaaaca

SEQ ID NO: 565232 - RNA, 64 nt, hsa
auguguauauuugguguuccuauuuaaugagauuauuuaauaaggguguacaguaauagaggcu

SEQ ID NO: 565233 - RNA, 64 nt, hsa
uguggcuguagauagaagaagaguccuauggcuuauuuaauaacuguaaauguguauauuuggu

SEQ ID NO: 565234 - RNA, 64 nt, hsa
cauuacuucuagccuuucaauuacuccauguuuuauuuaauauccauugaagucuaugaauucu

SEQ ID NO: 565235 - RNA, 64 nt, hsa
acaucuauagugacaauaaagcgggaaguauaagauuuaauaggagggguuaagguucaugaga

SEQ ID NO: 565236 - RNA, 64 nt, hsa
aaacauuuuuaucauuuaaaaaucuauuuuuaugauuuaauaucucauaugugacaguuuuuuu

SEQ ID NO: 565237 - RNA, 64 nt, hsa
gagaauagguaguggguugcugguaguuaauuggauuuaauauuuguauuaaggauuaacugga

SEQ ID NO: 565238 - RNA, 64 nt, hsa
aaugacaauucuauuuuugcuuugcuguuuugucauuuaauaugcuuuugucuaauuuuuaauu

SEQ ID NO: 565239 - RNA, 64 nt, hsa
uuuaauacuuucauauauuuuacaacaguauacuauuuaauauuaaugacaauucuauuuuugc

SEQ ID NO: 565240 - RNA, 64 nt, hsa
uguuaugaauguuuaccaucagcauuauuuuaucauuuaauaugugcucacugauuguuaacug

SEQ ID NO: 565241 - RNA, 64 nt, hsa
uguugcauuguauauuccaaagaugguucagaaaauuuaauauuggucccugguggaaauucaa

SEQ ID NO: 565242 - RNA, 64 nt, hsa
ugggaacauaugccaauuauggaauaggcuauguauuuaauauuaaucucugccauuaggauau

SEQ ID NO: 565243 - RNA, 64 nt, hsa
gcaaaaauagcuuuuuacuucaucaguugcuaagauuuaauacuuuggauucaucaaaguguga

SEQ ID NO: 565244 - RNA, 64 nt, hsa
ggagggagguggagggaggaaggugggaauuauuauuuaauacaucauuaaugcuuauuaaucu

SEQ ID NO: 565245 - RNA, 64 nt, hsa
gcaaccuuauucaauagguuuucccauauuucagauuuaauaacugaaggccagagagauuaau

SEQ ID NO: 565246 - RNA, 64 nt, hsa
aguuuaaauuucaaauguuuuaaaauuuguaggcauuuaauaaauuaucuuuuuuuggaggggu

SEQ ID NO: 565247 - RNA, 64 nt, hsa
ucaaaggaaaauguuuauauacauccacauguuuauuuaauauguuucucuuaacaccugaaac

SEQ ID NO: 565248 - RNA, 64 nt, hsa
aauaauguaaauaaagaacucaccaucucuguucauuuaauacuaugcaaugguuaugcuuuca

SEQ ID NO: 565249 - RNA, 64 nt, hsa
ugggucucagcguuuuucauaaaagaacuuuuguauuuaauacaaaguuugcuuugagacuuuu

SEQ ID NO: 565250 - RNA, 64 nt, hsa
ugcuugcacagcauggucucaguuguauagauuaauuuaauaacuuuuugaaauugcagagcuu

SEQ ID NO: 565251 - RNA, 64 nt, hsa
uauguuugaaaaauccgugaguauuccaaaauauauuuaauaauggaauaucugcauuaauaua

SEQ ID NO: 565252 - RNA, 64 nt, hsa
aaaacagaccauuuaaaaacucagacaagauuauauuuaauauauuaauuacuaaaaaggcaua

SEQ ID NO: 565253 - RNA, 64 nt, hsa
uuucaggcaaucucaacuuacuucuuuaaucaacauuuaauaucaauggaucugugauuaaaug

SEQ ID NO: 565254 - RNA, 64 nt, hsa
auuaaaugucugaauauguaaugccucgugaaguauuuaauaauggccuuuauuuguauuugga

SEQ ID NO: 565255 - RNA, 64 nt, hsa
cagacuauuugcuaauguauaaugugcagaaaauauuuaauaucaaaagaaaauugauauuuuu

SEQ ID NO: 565256 - RNA, 64 nt, hsa
aucaauuagaucuaaacaguuauuucuguuuccuauuuaauacagcugaagucaaaauauguaa

SEQ ID NO: 565257 - RNA, 64 nt, hsa
guuuucauguagcagcaaugcagauuuggugaauauuuaauauauauuuuaguauguauuucac

SEQ ID NO: 565258 - RNA, 64 nt, hsa
auagaaaauggaagaugguguuguuaauaaaggcauuuaauagauaaaaacaucuccaaaaagg

SEQ ID NO: 565259 - RNA, 64 nt, hsa
gaaaauuaauaaugguacuuaugauuaaaaacgcauuuaauacuaacugcaguaguucuuucaa

SEQ ID NO: 565260 - RNA, 64 nt, hsa
uguguggauggggaaaauguuuuaaaauccaguuauuuaauaugaguuugagagagaaaauugu

SEQ ID NO: 565261 - RNA, 64 nt, hsa
gaaagucacauuuugaaaggcuauuuugaaauugauuuaauagcuauuauaguuuaugaauauc

SEQ ID NO: 565262 - RNA, 64 nt, hsa
auuugaccaguguuaagaauuuucuaauuuaauaauuuaauagugaucucaauaccacacccuc

SEQ ID NO: 565263 - RNA, 64 nt, hsa
cucgucuaauuugaccaguguuaagaauuuucuaauuuaauaauuuaauagugaucucaauacc

SEQ ID NO: 565264 - RNA, 64 nt, hsa
aaucucuaaaucuaagaacuaagcuuugaguauuauuuaauaauuucuaauaacacucauuccu

SEQ ID NO: 565265 - RNA, 64 nt, hsa
aauuuguguuauuuuuugaaccacagaugaguaaauuuaauaaugaaccaauuacacucuugag

SEQ ID NO: 565266 - RNA, 64 nt, hsa
caaaugccauugggagguuuugaaaaaccaguuaauuuaauagcucaaaauugucccugauuuu

SEQ ID NO: 565267 - RNA, 64 nt, hsa
auaagcaucaaauuuacaacauugguuucccaauauuuaauauaaauauaccauauaauauauu

SEQ ID NO: 565268 - RNA, 64 nt, hsa
auuucuauuacuaaaguucauaucacaaaaugauauuuaauaauaaccuugggguaaaucauga

SEQ ID NO: 565269 - RNA, 64 nt, hsa
cuguagcaauaaaaugaccaagugcaaugacuugauuuaauaaaaucauauuuuaaaaguugcu

SEQ ID NO: 565270 - RNA, 64 nt, hsa
uguacucacauacuauagaaagauauuaguaugcauuuaauaaaacauauucacuugaauauau

SEQ ID NO: 565271 - RNA, 64 nt, hsa
gaaauaaucauguucugguauuauaucuaucuauauuuaauaaauauauacauuuuaauuuauu

SEQ ID NO: 565272 - RNA, 64 nt, hsa
ggagauuuugcuaauacauuuggcuccacuguaaauuuaauagauaaagugccuauaaaggaaa

SEQ ID NO: 565273 - RNA, 64 nt, hsa
aggcagaaucaguagcuggagagagaguucucacauuuaauauccugccuuuuaccuucaguaa

SEQ ID NO: 565274 - RNA, 64 nt, hsa
acacuaauuuauauaggagugaaguuuuauaaauauuuaauauuuauuuuggauucaaauugua

SEQ ID NO: 565275 - RNA, 64 nt, hsa
guauuaagacaggacauauuguuggugagauaauauuuaauagguauaaaaugguaaaauaccu

SEQ ID NO: 565276 - RNA, 64 nt, hsa
ugaugaaaacauaaugccuuaguaaaauagcucuauuuaauaaagaagauugaguacucugaca

SEQ ID NO: 565277 - RNA, 64 nt, hsa
caguuugaucucucuaaaauuguaguuugguuugauuuaauauaauucuuaguagaaauuuuga

SEQ ID NO: 565278 - RNA, 64 nt, hsa
guguguagaguuaagaagcuguuguacauuuaugauuuaauaaaauaauucuaaaggaaauugu

SEQ ID NO: 565279 - RNA, 64 nt, hsa
gaugcagagagccauuuugugaauggauuggauuauuuaauaacauuaccuuacuguggaggaa

SEQ ID NO: 565280 - RNA, 64 nt, hsa
uuucaacuauagguaauaacucuuagagaaauuaauuuaauauuagaauuucuauuaugaauca

SEQ ID NO: 565281 - RNA, 64 nt, hsa
uuuuaaauaaauuauaagcuuuaagguacgaaguauuuaauagaucuaaucaaauauguugauu

SEQ ID NO: 565282 - RNA, 64 nt, hsa
aaaguaaaauugaacuuauuaaaagcuaucuaugauuuaauagauuuaauaaaauuccuucacg

SEQ ID NO: 565283 - RNA, 64 nt, hsa
uugaacuuauuaaaagcuaucuaugauuuaauagauuuaauaaaauuccuucacgaccugguac

SEQ ID NO: 565284 - RNA, 64 nt, hsa
accaguuaucuguuaaucaaaauugcauuuuacaauuuaauaaugugauauuuccuaugucuac

SEQ ID NO: 565285 - RNA, 64 nt, hsa
ucacaguuucagcacucaaccucaucauacgcugauuuaauauuguuuuacauuaaaauagucc

SEQ ID NO: 565286 - RNA, 64 nt, hsa
uuuuauaaugcauuuuacucccaguauuauguucauuuaauaaauuauuuuuucacuacaacag

SEQ ID NO: 565287 - RNA, 64 nt, hsa
cacugcugcuuuuaauuguauuuuauccaauuacauuuaauacacuaaaaaaaaucuuguugga

SEQ ID NO: 565288 - RNA, 64 nt, hsa
uggcuacauuugacacuuuagaaaaaauaaacauauuuaauaauuuuuguuucuccuuaggaau

SEQ ID NO: 565289 - RNA, 64 nt, hsa
aauuucuuguuggaaauguaaaucuaguguccauauuuaauacucucacagcuuuguguuuauu

SEQ ID NO: 565290 - RNA, 64 nt, hsa
cauccuuugagcuaaacuaaauuaaaauuacaguauuuaauaauucuuugggcauuuuuaagag

SEQ ID NO: 565291 - RNA, 64 nt, hsa
auuugaauuuaaaaauauugagcucuugauuacaauuuaauacauuguaaaaaguauuaaaucc

SEQ ID NO: 565292 - RNA, 64 nt, hsa
ccaagaagaucuggaaaguuaaauaaauuuauaaauuuaauaacauucauuuggcuucauuuuu

SEQ ID NO: 565293 - RNA, 64 nt, hsa
ucuguaccagguaugcauuaaaauauauuuguuaauuuaauauuuaaaccugagagauagguau

SEQ ID NO: 565294 - RNA, 64 nt, hsa
gcccgaguuucuugauuuuauuuaauacaaucggauuuaauaauuuuguggccaguaaaauuau

SEQ ID NO: 565295 - RNA, 64 nt, hsa
gaaaugguucauugggcccgaguuucuugauuuuauuuaauacaaucggauuuaauaauuuugu

SEQ ID NO: 565296 - RNA, 64 nt, hsa
ccccuuaccccaguuuuuugaacauggaaagaaaauuuaauaacuuuuuaaagugacauaauuu

SEQ ID NO: 565297 - RNA, 64 nt, hsa
auaauuuacaugcaauauguuuaucaacucaagaauuuaauauaguugguacacaacuaguuuu

SEQ ID NO: 565298 - RNA, 64 nt, hsa
uguauuaaaauguacaaaauguuuuguuaauaaaauuuaauaauguuuauaacuccgugccauu

SEQ ID NO: 565299 - RNA, 64 nt, hsa
guuuuuuuacauuucugcuuugaaugcagaugcaauuuaauauaauagauuuuuuaaugaauua

SEQ ID NO: 565300 - RNA, 64 nt, hsa
ccuguguacagcaaacugaggaagaaagaucauuauuuaauacugggcccugaaaugacaccca

SEQ ID NO: 565301 - RNA, 64 nt, hsa
cuaauuaaucugcauaugaagcauuuucugauauauuuaauaagagguauagaagcucuucaag

SEQ ID NO: 565302 - RNA, 64 nt, hsa
gaacuuuaauaauccagaugcaaucauuggaaguauuuaauaugcaauugguagcaccuuagcu

SEQ ID NO: 565303 - RNA, 64 nt, hsa
uauaguaguuaauaucuaaguaaaauaugaugaaauuuaauagagaauucacuccucccaaaag

SEQ ID NO: 565304 - RNA, 64 nt, hsa
caucucaaaagaugccaacguugucuuugauaauauuuaauauauuuuuuaaaaaacaauucuu

SEQ ID NO: 565305 - RNA, 64 nt, hsa
augaauagacagaacccuauccaguggaaggagaauuuaauaaagauagugcugaaagaauucc

SEQ ID NO: 565306 - RNA, 64 nt, hsa
aacauugcauaaacacuuuucaagucugauccauauuuaauaaugcuuuaaaauaaaaauaaaa

SEQ ID NO: 565307 - RNA, 64 nt, hsa
cauugaaaaguuggccuuguaaaauacaacucucauuuaauauucaugcuuuugugccuuuaag

SEQ ID NO: 565308 - RNA, 64 nt, hsa
uaaaaguuuacauaaguuuuuuuuaaccccuagaauuuaauauuuguagaugcagguaaauaua

SEQ ID NO: 565309 - RNA, 64 nt, hsa
ucuuauuuuguuuuuguuguaauguuugaauacuauuuaauauccgguuuuaauauugcuggau

SEQ ID NO: 565310 - RNA, 64 nt, hsa
cuguguaacaguaacucuuuuuugcuuuucaguaauuuaauauguucacuuaacaaaauacgaa

SEQ ID NO: 565311 - RNA, 64 nt, hsa
guugaugaauauagcugcuguacuguauauuaauauuuaauagaucaacaaauggucauugaaa

SEQ ID NO: 565312 - RNA, 64 nt, hsa
ugacuggagaccccagugugggggaggucuuaccauuuaauauagaaaugauaucaauaacuaa

SEQ ID NO: 565313 - RNA, 64 nt, hsa
cagggcuuggggacccaaugcaaagaugaugacuauuuaauaaaauggaaaauuuaauaaaucc

SEQ ID NO: 565314 - RNA, 64 nt, hsa
augcaaagaugaugacuauuuaauaaaauggaaaauuuaauaaauccucauuuuauuaacuaag

SEQ ID NO: 565315 - RNA, 64 nt, hsa
uuuaggguuaaaaaccugacuuauagaagaguuuauuuaauauaggucaaaauuuucuguguuu

SEQ ID NO: 565316 - RNA, 64 nt, hsa
cauacuagaauuuuuauuucuacguuuuuaguaaauuuaauauucugggggaaaaaaggccuug

SEQ ID NO: 565317 - RNA, 64 nt, hsa
ggcuuggggcaagugaaguuugugacuaugcuugauuuaauaagcugagagucucuuguuuguc

SEQ ID NO: 565318 - RNA, 64 nt, hsa
ucuuuuagaauugaggccccaacuuugauggcacauuuaauacccaauuucuuccauaauagau

SEQ ID NO: 565319 - RNA, 64 nt, hsa
aucaagaguguauuguuuacuguuuuacaguauuauuuaauauccaacuggucuccaaucucca

SEQ ID NO: 565320 - RNA, 64 nt, hsa
uuugagcuuguaagaugagaacugcuuuuuacacauuuaauaaaaaaaggucucugaauuaucu

SEQ ID NO: 565321 - RNA, 64 nt, hsa
uucaucauuccuuccgaaaccccugauauuuaauauuuaauauuuaaaaacccaaauuaucaaa

SEQ ID NO: 565322 - RNA, 64 nt, hsa
gacggaauucaucauuccuuccgaaaccccugauauuuaauauuuaauauuuaaaaacccaaau

SEQ ID NO: 565323 - RNA, 64 nt, hsa
gugucgcucagguggccacucaugccugcauuccauuuaauagagucaauuggaauuuuuagag

SEQ ID NO: 565324 - RNA, 64 nt, hsa
uaaguuacucagcucuauccucaugggccuauauauuuaauaccuccaaagauauuuucaggau

SEQ ID NO: 565325 - RNA, 64 nt, hsa
auaaugucuucuauauguaguaucuaaaagcauaauuuaauagcauugucuuaaaauacgugau

SEQ ID NO: 565326 - RNA, 64 nt, hsa
uguuaauuacuaaaauuuucuuucuaaaaguauaauuuaauagaauuaucuuaaaauacaugau

SEQ ID NO: 565327 - RNA, 64 nt, hsa
aaauauuuucauuuaauaaagauugucagguuauauuuaauaagaaagaaaguaucauguaaac

SEQ ID NO: 565328 - RNA, 64 nt, hsa
cuuuuguuguuguugaugauacaaaaauauuuucauuuaauaaagauugucagguuauauuuaa

SEQ ID NO: 565329 - RNA, 64 nt, hsa
aaugcacaaaggaacacaguauaacauuuguauaauuuaauaagaucuugcaaagaacaguacu

SEQ ID NO: 565330 - RNA, 64 nt, hsa
agugcuauugaaaucacuggggaaugaauggcuuauuuaauaaauggaagguucauaggagaaa

SEQ ID NO: 565331 - RNA, 64 nt, hsa
aaaaaccaauuguguccugaaaauuguuucaagaauuuaauauuuuuaugaaaauuauuuuauu

SEQ ID NO: 565332 - RNA, 64 nt, hsa
cuugcaucauugaaacuacuacaaugauacuaucauuuaauaauauuaauauuacuugaaauag

SEQ ID NO: 565333 - RNA, 64 nt, hsa
gccaaucuuucuagaugucucugaagguaagaucauuuaauaucuuugauaugcuuacgaguaa

SEQ ID NO: 565334 - RNA, 64 nt, hsa
uaaauaucaauaacagugcuacuuaguuaucaguauuuaauaucugaggugaguuggggguauc

SEQ ID NO: 565335 - RNA, 64 nt, hsa
aaaaagguuuugguuaugaaagugaauguuauauauuuaauauuaagugaaccucccgugccuu

SEQ ID NO: 565336 - RNA, 64 nt, hsa
gcccauagcggaugccuccucaggaauauucucgauuuaauaagcuaaaaaaaaaaaguucugu

SEQ ID NO: 565337 - RNA, 64 nt, hsa
gggaguuguuauaaacacaccccaaggaagcaauauuuaauaaaacuaggucaaaaacaaaaca

SEQ ID NO: 565338 - RNA, 64 nt, hsa
aggaaauaaaucaguguccguuugccaguaauaaauuuaauauucuguuuuauacuauaaaguu

SEQ ID NO: 565339 - RNA, 64 nt, hsa
ugaauaaucaaaaauauuuuauuaggcccccaaaauuuaauagauaucuauuucuguuacauuu

SEQ ID NO: 565340 - RNA, 64 nt, hsa
uuuuagcaauuuagagcaauucuauauuugaguuauuuaauacacuucuaauucuaguuuauac

SEQ ID NO: 565341 - RNA, 64 nt, hsa
agcagacugauacuaaauuuaaaauguaguuucaauuuaauaaucacauuagguuuaauuuuuu

SEQ ID NO: 565342 - RNA, 64 nt, hsa
aaauggcuaaggucaaguaaagcacaacauuaugauuuaauaugcuuuuguugaaaccacagcu

SEQ ID NO: 565343 - RNA, 64 nt, hsa
gcaaagaaaccacagcacauacuucuuuucuuucauuuaauaaagcuuuuaauuaugguacgcu

SEQ ID NO: 565344 - RNA, 64 nt, hsa
gaaugauauaacuccugugcaaugaaggugauaacaguaaaagaaggcaggggaaacuuacguu

SEQ ID NO: 565345 - RNA, 64 nt, hsa
uauuacaagucuugacccaucccugucguaacuccaguaaaaguuacuguuacuagaaaauuuu

SEQ ID NO: 565346 - RNA, 64 nt, hsa
cuguaguaauugaccuaaaaacuuauguuagcuucaguaaaaguacuuuuauuguaaauaaaca

SEQ ID NO: 565347 - RNA, 64 nt, hsa
agugcccuugagaagggauuuuuuuuuaaauauacaguaaaauauuucgugggaaccuaacacu

SEQ ID NO: 565348 - RNA, 64 nt, hsa
ccaaauuguaccacuccuugaagaacuacaggcacaguaaaaaaaauauggcguauuaugugaa

SEQ ID NO: 565349 - RNA, 64 nt, hsa
cacaauauuuguguaucuaaauauagaaaagguacaguaaaaauauggucuacuaaggaaacac

SEQ ID NO: 565350 - RNA, 64 nt, hsa
ucuguggccccaaauccagugaaagaaauucucccaguaaaaguugcuuccuaacucuguuuuu

SEQ ID NO: 565351 - RNA, 64 nt, hsa
guaauuuuugccaauuagagaaaccaaccggugucaguaaaauucugugagaaaugccaucccu

SEQ ID NO: 565352 - RNA, 64 nt, hsa
uuggaaagucacuaaugugccucaguuaauacaucaguaaaauguuguguuucuuuuccagugu

SEQ ID NO: 565353 - RNA, 64 nt, hsa
augagcuguuuuaaauacugguguauuuucagaacaguaaaauuacugaauaucagaaaaaaug

SEQ ID NO: 565354 - RNA, 64 nt, hsa
aaaguaaggauuucuuuaaauagcauuuuugcaccaguaaaaauagauaacuuagaacucaguc

SEQ ID NO: 565355 - RNA, 64 nt, hsa
aaacagucacauuagguaugucaucaucuuuagucaguaaaaaccuuguaaugaggaguaguaa

SEQ ID NO: 565356 - RNA, 64 nt, hsa
uugaaauuuaggucugucaucuuaauauaucaugcaguaaaaggaagaaucuuuuuaaagugac

SEQ ID NO: 565357 - RNA, 64 nt, hsa
uuaauuuaggcgucuagaaaaucucaguucccaccaguaaaauuauccugaguagcuaaugcac

SEQ ID NO: 565358 - RNA, 64 nt, hsa
aaauuacaaaaugaguguuuuuagauucaagugacaguaaaaggauuuguucccuucagugacu

SEQ ID NO: 565359 - RNA, 64 nt, hsa
ccaguuuacugcuuagaaauagcaagaggcacugcaguaaaacuuguuucucauuguaaagcuu

SEQ ID NO: 565360 - RNA, 64 nt, hsa
augguuaauuucauuucuugcuuugccaccuaagcaguaaaacaugauauugaccacuuggaga

SEQ ID NO: 565361 - RNA, 64 nt, hsa
aagauggauuaaagacuuaauguaaaacccaaaacaguaaaaauccuggaagacaacccaggca

SEQ ID NO: 565362 - RNA, 64 nt, hsa
uauuucuuuacagaauggauuuguuaaacuagcacaguaaaaguaaagacuauucuguuucuag

SEQ ID NO: 565363 - RNA, 64 nt, hsa
auacuuuucuauuaaagaucuguacauauuuuuacaguaaaaugcuuuauggaacuaguuuuag

SEQ ID NO: 565364 - RNA, 64 nt, hsa
uuuuuuaaaaaugaaaaaguuuauaauuuacauucaguaaaaucacccuuuuuagugucuaguc

SEQ ID NO: 565365 - RNA, 64 nt, hsa
gauuuugaggaguaucuuauuugcuuucuaucaucaguaaaaacagcauuuaacuugcuaaaua

SEQ ID NO: 565366 - RNA, 64 nt, hsa
cuauuuccuuuauauacuuguuuaucuggacugccaguaaaacaaauguguauucaacaaaaga

SEQ ID NO: 565367 - RNA, 64 nt, hsa
auauacacauauguauacauauauauauauucuacaguaaaacuguagacuguccucguccuug

SEQ ID NO: 565368 - RNA, 64 nt, hsa
cugagaucacgacacugcacuccagccugggcaacaguaaaaccuggucuccaaaaaaaaaaaa

SEQ ID NO: 565369 - RNA, 64 nt, hsa
auuuucgagugacuuuccuuuuugcauuuuuuggcaguaaaagccaaacguuguauuuguucuu

SEQ ID NO: 565370 - RNA, 64 nt, hsa
cuugcuuugcuuuccucucuaugaugugauaauacaguaaaagcuuucuuacccagcauagugg

SEQ ID NO: 565371 - RNA, 64 nt, hsa
aaaaauguuucuguuuugaaacuugaucuacaaucaguaaaaguuugauaaucaguauaucccu

SEQ ID NO: 565372 - RNA, 64 nt, hsa
auugaugugaccacacucuucuuaauuuuguucacaguaaaaacacuuuuuugaguuauuaggc

SEQ ID NO: 565373 - RNA, 64 nt, hsa
ugacaauagcugccuuccccuaucgaacaguuaucaguaaaagacauuucaaucuuacaaagca

SEQ ID NO: 565374 - RNA, 64 nt, hsa
uccuguaccacucuauucacugguacaguccagccaguaaaaaacacuuccaaaaagauacaca

SEQ ID NO: 565375 - RNA, 64 nt, hsa
gcgauauaugaacggcauaaaaacagaaauuacccaguaaaaaggaugucagaaauugacauac

SEQ ID NO: 565376 - RNA, 64 nt, hsa
uauuuuugucuauuuggaucgcauuaauuguuuccaguaaaacucuuuuaccacagggaaauac

SEQ ID NO: 565377 - RNA, 64 nt, hsa
uccgacuaauacucuuuuugucgcauuauauacccaguaaaaaagaaaagagaacauaagcaaa

SEQ ID NO: 565378 - RNA, 64 nt, hsa
gaucauuuuucuguucauauauacaugcgugucucaguaaaaauuauaaaaugggggauaauua

SEQ ID NO: 565379 - RNA, 64 nt, hsa
ggccacggggugccuggacuaauaacuauucucacaguaaaagagggggugagaauaaugagau

SEQ ID NO: 565380 - RNA, 64 nt, hsa
cuuccagaaaaccuuauuauuuuaugugagccuucaguaaaaucuuugugugaaggauuggaaa

SEQ ID NO: 565381 - RNA, 64 nt, hsa
auuugagucuuuuucuuaccuagcccccucuuaucaguaaaacaaaggacuugccaugguucac

SEQ ID NO: 565382 - RNA, 64 nt, hsa
cauguuaucuuauuaaaagaaaaagcccaaaaagcaguaaaauuuccauuucucccuguuauuu

SEQ ID NO: 565383 - RNA, 62 nt, hsa
ggaauaguauccccuuauguuuaguugaaauguccccuuaacuugauauaauguguuaugcu

SEQ ID NO: 565384 - RNA, 62 nt, hsa
ucagccuaugccagggcuucaauggaauaguauccccuuauguuuaguugaaauguccccuu

SEQ ID NO: 565385 - RNA, 62 nt, hsa
aucauuuccccccagucagcauuauuuaacacuccccuuaacugucuuugaacuuucucuuu

SEQ ID NO: 565386 - RNA, 62 nt, hsa
uuugaugcauuuauuuuuagguguuuuuuuuuuccccuuaaaaaacuugaagugauaugcag

SEQ ID NO: 565387 - RNA, 62 nt, hsa
gagauuggauuugaccccuuggcucucaaguguccccuuagaucuagaacugcuccuuggug

SEQ ID NO: 565388 - RNA, 62 nt, hsa
aucugaagacuggguuuuuuuguuguuguuguuccccuuacagacaaaaugaagacuaucau

SEQ ID NO: 565389 - RNA, 62 nt, hsa
aagucuuucguagacaccccagagcacacacauccccuuaguccaccgguuagaugucucuc

SEQ ID NO: 565390 - RNA, 62 nt, hsa
gaacacguccuaggcaggucugacgugaaaccuccccuuacccugaaccgugugacucugca

SEQ ID NO: 565391 - RNA, 62 nt, hsa
uauugacaaaaugguuuccggaaauauuuguauccccuuacacugccaccagcaaggauaaa

SEQ ID NO: 565392 - RNA, 62 nt, hsa
cagcuguuuucacuuagcauaucgugggcaucuccccuuaugauuacuaaauauuuuauuuu

SEQ ID NO: 565393 - RNA, 64 nt, hsa
cuugaagccaagaacucuucaaugccagcuacugccaccuaaaaaucaucuggcuuuauagugg

SEQ ID NO: 565394 - RNA, 64 nt, hsa
uucuauggaaccacauuuuaagagaucugcugauccaccuaagcacauucagggaagaguaaug

SEQ ID NO: 565395 - RNA, 64 nt, hsa; identical to SEQ ID NO: 138957

SEQ ID NO: 565396 - RNA, 64 nt, hsa; identical to SEQ ID NO: 138958

SEQ ID NO: 565397 - RNA, 64 nt, hsa; identical to SEQ ID NO: 138959

SEQ ID NO: 565398 - RNA, 64 nt, hsa; identical to SEQ ID NO: 138960

SEQ ID NO: 565399 - RNA, 64 nt, hsa; identical to SEQ ID NO: 138961

SEQ ID NO: 565400 - RNA, 64 nt, hsa; identical to SEQ ID NO: 138962

SEQ ID NO: 565401 - RNA, 64 nt, hsa; identical to SEQ ID NO: 138963

SEQ ID NO: 565402 - RNA, 64 nt, hsa; identical to SEQ ID NO: 138964

SEQ ID NO: 565403 - RNA, 64 nt, hsa; identical to SEQ ID NO: 138965

SEQ ID NO: 565404 - RNA, 64 nt, hsa; identical to SEQ ID NO: 138966

SEQ ID NO: 565405 - RNA, 64 nt, hsa; identical to SEQ ID NO: 138967

SEQ ID NO: 565406 - RNA, 64 nt, hsa; identical to SEQ ID NO: 138968

SEQ ID NO: 565407 - RNA, 64 nt, hsa; identical to SEQ ID NO: 138969

SEQ ID NO: 565408 - RNA, 64 nt, hsa; identical to SEQ ID NO: 138970

SEQ ID NO: 565409 - RNA, 64 nt, hsa; identical to SEQ ID NO: 138971

SEQ ID NO: 565410 - RNA, 64 nt, hsa; identical to SEQ ID NO: 138972

SEQ ID NO: 565411 - RNA, 64 nt, hsa; identical to SEQ ID NO: 138973

SEQ ID NO: 565412 - RNA, 64 nt, hsa; identical to SEQ ID NO: 138974

SEQ ID NO: 565413 - RNA, 64 nt, hsa; identical to SEQ ID NO: 138975

SEQ ID NO: 565414 - RNA, 64 nt, hsa; identical to SEQ ID NO: 138976

SEQ ID NO: 565415 - RNA, 64 nt, hsa; identical to SEQ ID NO: 138977

SEQ ID NO: 565416 - RNA, 64 nt, hsa; identical to SEQ ID NO: 138978

SEQ ID NO: 565417 - RNA, 64 nt, hsa; identical to SEQ ID NO: 138979

SEQ ID NO: 565418 - RNA, 64 nt, hsa; identical to SEQ ID NO: 138980

SEQ ID NO: 565419 - RNA, 64 nt, hsa; identical to SEQ ID NO: 138981

SEQ ID NO: 565420 - RNA, 64 nt, hsa; identical to SEQ ID NO: 138982

SEQ ID NO: 565421 - RNA, 64 nt, hsa; identical to SEQ ID NO: 138983

SEQ ID NO: 565422 - RNA, 64 nt, hsa; identical to SEQ ID NO: 138984

SEQ ID NO: 565423 - RNA, 64 nt, hsa; identical to SEQ ID NO: 138985

SEQ ID NO: 565424 - RNA, 64 nt, hsa; identical to SEQ ID NO: 138986

SEQ ID NO: 565425 - RNA, 64 nt, hsa; identical to SEQ ID NO: 138987

SEQ ID NO: 565426 - RNA, 64 nt, hsa; identical to SEQ ID NO: 138988

SEQ ID NO: 565427 - RNA, 64 nt, hsa; identical to SEQ ID NO: 138989

SEQ ID NO: 565428 - RNA, 64 nt, hsa; identical to SEQ ID NO: 138990

SEQ ID NO: 565429 - RNA, 64 nt, hsa; identical to SEQ ID NO: 138991

SEQ ID NO: 565430 - RNA, 64 nt, hsa; identical to SEQ ID NO: 276116

SEQ ID NO: 565431 - RNA, 64 nt, hsa; identical to SEQ ID NO: 276117

SEQ ID NO: 565432 - RNA, 64 nt, hsa; identical to SEQ ID NO: 276118

SEQ ID NO: 565433 - RNA, 64 nt, hsa; identical to SEQ ID NO: 276119

SEQ ID NO: 565434 - RNA, 64 nt, hsa; identical to SEQ ID NO: 276120

SEQ ID NO: 565435 - RNA, 64 nt, hsa; identical to SEQ ID NO: 276121

SEQ ID NO: 565436 - RNA, 64 nt, hsa; identical to SEQ ID NO: 276122

SEQ ID NO: 565437 - RNA, 64 nt, hsa; identical to SEQ ID NO: 276123

SEQ ID NO: 565438 - RNA, 64 nt, hsa; identical to SEQ ID NO: 276124

SEQ ID NO: 565439 - RNA, 64 nt, hsa; identical to SEQ ID NO: 276125

SEQ ID NO: 565440 - RNA, 64 nt, hsa; identical to SEQ ID NO: 276126

SEQ ID NO: 565441 - RNA, 64 nt, hsa; identical to SEQ ID NO: 276127

SEQ ID NO: 565442 - RNA, 64 nt, hsa; identical to SEQ ID NO: 276128

SEQ ID NO: 565443 - RNA, 64 nt, hsa; identical to SEQ ID NO: 276129

SEQ ID NO: 565444 - RNA, 64 nt, hsa; identical to SEQ ID NO: 276130

SEQ ID NO: 565445 - RNA, 64 nt, hsa; identical to SEQ ID NO: 276131

SEQ ID NO: 565446 - RNA, 64 nt, hsa; identical to SEQ ID NO: 276132

SEQ ID NO: 565447 - RNA, 64 nt, hsa; identical to SEQ ID NO: 276133

SEQ ID NO: 565448 - RNA, 64 nt, hsa; identical to SEQ ID NO: 276134

SEQ ID NO: 565449 - RNA, 64 nt, hsa; identical to SEQ ID NO: 276135

SEQ ID NO: 565450 - RNA, 64 nt, hsa; identical to SEQ ID NO: 276136

SEQ ID NO: 565451 - RNA, 64 nt, hsa; identical to SEQ ID NO: 276137

SEQ ID NO: 565452 - RNA, 64 nt, hsa; identical to SEQ ID NO: 276138

SEQ ID NO: 565453 - RNA, 64 nt, hsa; identical to SEQ ID NO: 276139

SEQ ID NO: 565454 - RNA, 64 nt, hsa; identical to SEQ ID NO: 276140

SEQ ID NO: 565455 - RNA, 64 nt, hsa; identical to SEQ ID NO: 276141

SEQ ID NO: 565456 - RNA, 64 nt, hsa; identical to SEQ ID NO: 276142

SEQ ID NO: 565457 - RNA, 64 nt, hsa; identical to SEQ ID NO: 276143

SEQ ID NO: 565458 - RNA, 64 nt, hsa; identical to SEQ ID NO: 276144

SEQ ID NO: 565459 - RNA, 64 nt, hsa; identical to SEQ ID NO: 276145

SEQ ID NO: 565460 - RNA, 64 nt, hsa; identical to SEQ ID NO: 276146

SEQ ID NO: 565461 - RNA, 64 nt, hsa; identical to SEQ ID NO: 276147

SEQ ID NO: 565462 - RNA, 64 nt, hsa; identical to SEQ ID NO: 276148

SEQ ID NO: 565463 - RNA, 64 nt, hsa
aauauccuuuagaaaugcucuagaagaucuguauuguguagaaugaucauguauuuauaaauau

SEQ ID NO: 565464 - RNA, 64 nt, hsa
accgcuaacuugacuggaugaacuaguuugcuuguguguagagaguguauugcuuccucagauu

SEQ ID NO: 565465 - RNA, 64 nt, hsa
ccuucaaacacaaagauugcugugaaaacgaaaauguguagacgcacucucaaaaacugcacgg

SEQ ID NO: 565466 - RNA, 64 nt, hsa
gccacaucagcaccauccgagagcuuauuaguaauguguagauucucaugucccagccagacuu

SEQ ID NO: 565467 - RNA, 64 nt, hsa; identical to SEQ ID NO: 129356

SEQ ID NO: 565468 - RNA, 64 nt, hsa; identical to SEQ ID NO: 129357

SEQ ID NO: 565469 - RNA, 64 nt, hsa; identical to SEQ ID NO: 129358

SEQ ID NO: 565470 - RNA, 64 nt, hsa; identical to SEQ ID NO: 129359

SEQ ID NO: 565471 - RNA, 64 nt, hsa; identical to SEQ ID NO: 129360

SEQ ID NO: 565472 - RNA, 64 nt, hsa; identical to SEQ ID NO: 129361

SEQ ID NO: 565473 - RNA, 64 nt, hsa; identical to SEQ ID NO: 129362

SEQ ID NO: 565474 - RNA, 64 nt, hsa; identical to SEQ ID NO: 129363

SEQ ID NO: 565475 - RNA, 64 nt, hsa; identical to SEQ ID NO: 129364

SEQ ID NO: 565476 - RNA, 64 nt, hsa; identical to SEQ ID NO: 129365

SEQ ID NO: 565477 - RNA, 64 nt, hsa; identical to SEQ ID NO: 129366

SEQ ID NO: 565478 - RNA, 64 nt, hsa; identical to SEQ ID NO: 129367

SEQ ID NO: 565479 - RNA, 64 nt, hsa; identical to SEQ ID NO: 129368

SEQ ID NO: 565480 - RNA, 64 nt, hsa; identical to SEQ ID NO: 129369

SEQ ID NO: 565481 - RNA, 64 nt, hsa; identical to SEQ ID NO: 129370

SEQ ID NO: 565482 - RNA, 64 nt, hsa; identical to SEQ ID NO: 129371

SEQ ID NO: 565483 - RNA, 64 nt, hsa; identical to SEQ ID NO: 129372

SEQ ID NO: 565484 - RNA, 55 nt, hsa; identical to SEQ ID NO: 129373

SEQ ID NO: 565485 - RNA, 64 nt, hsa; identical to SEQ ID NO: 129374

SEQ ID NO: 565486 - RNA, 64 nt, hsa; identical to SEQ ID NO: 129375

SEQ ID NO: 565487 - RNA, 64 nt, hsa; identical to SEQ ID NO: 129376

SEQ ID NO: 565488 - RNA, 64 nt, hsa; identical to SEQ ID NO: 129377

SEQ ID NO: 565489 - RNA, 64 nt, hsa; identical to SEQ ID NO: 129378

SEQ ID NO: 565490 - RNA, 64 nt, hsa; identical to SEQ ID NO: 129379

SEQ ID NO: 565491 - RNA, 64 nt, hsa; identical to SEQ ID NO: 53018

SEQ ID NO: 565492 - RNA, 64 nt, hsa; identical to SEQ ID NO: 53019

SEQ ID NO: 565493 - RNA, 64 nt, hsa; identical to SEQ ID NO: 53020

SEQ ID NO: 565494 - RNA, 64 nt, hsa; identical to SEQ ID NO: 53021

SEQ ID NO: 565495 - RNA, 64 nt, hsa; identical to SEQ ID NO: 53022

SEQ ID NO: 565496 - RNA, 64 nt, hsa; identical to SEQ ID NO: 53023

SEQ ID NO: 565497 - RNA, 64 nt, hsa; identical to SEQ ID NO: 53024

SEQ ID NO: 565498 - RNA, 64 nt, hsa; identical to SEQ ID NO: 53025

SEQ ID NO: 565499 - RNA, 64 nt, hsa; identical to SEQ ID NO: 53026

SEQ ID NO: 565500 - RNA, 64 nt, hsa; identical to SEQ ID NO: 53027

SEQ ID NO: 565501 - RNA, 64 nt, hsa; identical to SEQ ID NO: 53028

SEQ ID NO: 565502 - RNA, 64 nt, hsa; identical to SEQ ID NO: 53029

SEQ ID NO: 565503 - RNA, 64 nt, hsa; identical to SEQ ID NO: 53030

SEQ ID NO: 565504 - RNA, 64 nt, hsa; identical to SEQ ID NO: 53031

SEQ ID NO: 565505 - RNA, 64 nt, hsa; identical to SEQ ID NO: 53032

SEQ ID NO: 565506 - RNA, 64 nt, hsa; identical to SEQ ID NO: 53033

SEQ ID NO: 565507 - RNA, 64 nt, hsa; identical to SEQ ID NO: 53034

SEQ ID NO: 565508 - RNA, 64 nt, hsa; identical to SEQ ID NO: 53035

SEQ ID NO: 565509 - RNA, 64 nt, hsa; identical to SEQ ID NO: 53036

SEQ ID NO: 565510 - RNA, 64 nt, hsa; identical to SEQ ID NO: 53037

SEQ ID NO: 565511 - RNA, 64 nt, hsa; identical to SEQ ID NO: 53038

SEQ ID NO: 565512 - RNA, 64 nt, hsa; identical to SEQ ID NO: 53039

SEQ ID NO: 565513 - RNA, 64 nt, hsa; identical to SEQ ID NO: 53040

SEQ ID NO: 565514 - RNA, 64 nt, hsa; identical to SEQ ID NO: 53041

SEQ ID NO: 565515 - RNA, 64 nt, hsa; identical to SEQ ID NO: 53042

SEQ ID NO: 565516 - RNA, 64 nt, hsa; identical to SEQ ID NO: 53043

SEQ ID NO: 565517 - RNA, 64 nt, hsa; identical to SEQ ID NO: 53044

SEQ ID NO: 565518 - RNA, 64 nt, hsa; identical to SEQ ID NO: 53045

SEQ ID NO: 565519 - RNA, 64 nt, hsa; identical to SEQ ID NO: 53046

SEQ ID NO: 565520 - RNA, 64 nt, hsa; identical to SEQ ID NO: 53047

SEQ ID NO: 565521 - RNA, 64 nt, hsa; identical to SEQ ID NO: 53048

SEQ ID NO: 565522 - RNA, 64 nt, hsa; identical to SEQ ID NO: 53049

SEQ ID NO: 565523 - RNA, 64 nt, hsa; identical to SEQ ID NO: 53050

SEQ ID NO: 565524 - RNA, 64 nt, hsa; identical to SEQ ID NO: 53051

SEQ ID NO: 565525 - RNA, 64 nt, hsa; identical to SEQ ID NO: 53052

SEQ ID NO: 565526 - RNA, 64 nt, hsa; identical to SEQ ID NO: 53053

SEQ ID NO: 565527 - RNA, 64 nt, hsa; identical to SEQ ID NO: 53054

SEQ ID NO: 565528 - RNA, 64 nt, hsa; identical to SEQ ID NO: 53055

SEQ ID NO: 565529 - RNA, 64 nt, hsa; identical to SEQ ID NO: 53056

SEQ ID NO: 565530 - RNA, 64 nt, hsa; identical to SEQ ID NO: 53057

SEQ ID NO: 565531 - RNA, 64 nt, hsa; identical to SEQ ID NO: 53058

SEQ ID NO: 565532 - RNA, 64 nt, hsa; identical to SEQ ID NO: 53059

SEQ ID NO: 565533 - RNA, 64 nt, hsa
uuuauauucaccuuuugaugauuuggggaauauauauugacauacaaggaagauaaucuguuuc

SEQ ID NO: 565534 - RNA, 64 nt, hsa
aguacuuaaguuauaugauuuauauuaaaacauuuauugacaaagccuaagagcuaaggcagua

SEQ ID NO: 565535 - RNA, 64 nt, hsa
gguggaauacucuauauauugacaagaguuuauauauugacaagaguuuauauauuugucaaaa

SEQ ID NO: 565536 - RNA, 64 nt, hsa
uaggaaauguuuuggggugguggaauacucuauauauugacaagaguuuauauauugacaagag

SEQ ID NO: 565537 - RNA, 64 nt, hsa
gaagagauacuuaacaauaauugggagaauggaauauugacaauauuagauaauauuaagaaac

SEQ ID NO: 565538 - RNA, 64 nt, hsa
auggcauuuuaagaaauaagguggaacuccuagguauugacagacuugagacaucagucaaaug

SEQ ID NO: 565539 - RNA, 64 nt, hsa
aauggaccuaaauggacuauaguauauuggauguuaaauccauauaugauguauauuuuguaaa

SEQ ID NO: 565540 - RNA, 64 nt, hsa
uuuugccauguuuacauuuuguaucuuguaaaaauaaauccaacuuugugucuaaaaaguuaaa

SEQ ID NO: 565541 - RNA, 64 nt, hsa
gugagauguauguuuggcucugcuuuuaacuuuauaaauccagugaccucucucucugggacuu

SEQ ID NO: 565542 - RNA, 64 nt, hsa
aaugcaagauuucagaaaaugaaaaaucuguugauaaauccaucacuauaauaaaaccgaaggu

SEQ ID NO: 565543 - RNA, 64 nt, hsa
ucaauggauuuguuuacaaugugauauuuucuauuaaauccaguauuuucaaauaacaugucau

SEQ ID NO: 565544 - RNA, 64 nt, hsa
ggguggguggggccaaagaggaggcuucuauugauaaauccagagccucaaggggcccagccac

SEQ ID NO: 565545 - RNA, 64 nt, hsa
ucguucggauggugggaggcugccuaggaggcaguaaauccagucacagugccugggaggggcc

SEQ ID NO: 565546 - RNA, 64 nt, hsa
acagugccugggaggggcccauccuuccaaaauguaaauccagucgcggugugaccgagcuggc

SEQ ID NO: 565547 - RNA, 64 nt, hsa
uccaguuacuguggugaaaaagaagaaaugaacuuaaauccacucccuuucuagggaaaggagg

SEQ ID NO: 565548 - RNA, 64 nt, hsa
aaaaggacucuauucacuaaguagccuguguuuuuaaauccagggcugcaggcagcaacgcaag

SEQ ID NO: 565549 - RNA, 64 nt, hsa
guaugcgacaugcccugccugaacaggugcucaauaaauccaaguuuccuucucuugaguuccu

SEQ ID NO: 565550 - RNA, 64 nt, hsa
uuuguuuuauuuucuugagagaccucaaaauuauuaaauccaacagacgcugccggucggucag

SEQ ID NO: 565551 - RNA, 64 nt, hsa
auuguaccgacaucacguagacaaaaacuccagauaaauccauugauuggguauuuucauuauu

SEQ ID NO: 565552 - RNA, 64 nt, hsa
aaauaaggccauaaaggaggggcuuucaaauuccuaaauccacauauagggcugaguuccuagu

SEQ ID NO: 565553 - RNA, 64 nt, hsa
uuaaaauggccaaugauguauacauguauuuuaguaaauccagaaaagaagacuaaggggacag

SEQ ID NO: 565554 - RNA, 64 nt, hsa
ugaguacccacauggcuaaccagaucaaccaauauaaauccacaagcagcuugauuccaccaau

SEQ ID NO: 565555 - RNA, 64 nt, hsa
uccaaaauaaaaucucugcccuaaauuuuacuaauaaauccauuuuucuagugauacacaaauu

SEQ ID NO: 565556 - RNA, 64 nt, hsa
aucauuuauucaugagccaaagccauuaagaagauaaauccaguuaucagcuuccugucucuga

SEQ ID NO: 565557 - RNA, 64 nt, hsa
ucuuuuuccuaauuaauguagcuuucggaugacauaaauccaguaucucugcuuaugacauaaa

SEQ ID NO: 565558 - RNA, 64 nt, hsa
ggaugacauaaauccaguaucucugcuuaugacauaaauccaguaccucugcuuuucuuuugcu

SEQ ID NO: 565559 - RNA, 64 nt, hsa
uaaaugaguauucaguuuuauuuuuaguaaagauuaaauccaaaacuuuacuuuuaauguagca

SEQ ID NO: 565560 - RNA, 64 nt, hsa
ggcucauagguaaugaauauuucugacuuagauguaaauccaucuggaaucuuuacauccuuug

SEQ ID NO: 565561 - RNA, 64 nt, hsa; identical to SEQ ID NO: 189841

SEQ ID NO: 565562 - RNA, 64 nt, hsa; identical to SEQ ID NO: 189842

SEQ ID NO: 565563 - RNA, 64 nt, hsa; identical to SEQ ID NO: 196221

SEQ ID NO: 565564 - RNA, 64 nt, hsa; identical to SEQ ID NO: 196222

SEQ ID NO: 565565 - RNA, 64 nt, hsa; identical to SEQ ID NO: 196223

SEQ ID NO: 565566 - RNA, 64 nt, hsa; identical to SEQ ID NO: 196224

SEQ ID NO: 565567 - RNA, 64 nt, hsa; identical to SEQ ID NO: 196225

SEQ ID NO: 565568 - RNA, 64 nt, hsa; identical to SEQ ID NO: 196226

SEQ ID NO: 565569 - RNA, 64 nt, hsa; identical to SEQ ID NO: 196227

SEQ ID NO: 565570 - RNA, 64 nt, hsa; identical to SEQ ID NO: 196228

SEQ ID NO: 565571 - RNA, 64 nt, hsa; identical to SEQ ID NO: 196229

SEQ ID NO: 565572 - RNA, 64 nt, hsa; identical to SEQ ID NO: 196230

SEQ ID NO: 565573 - RNA, 64 nt, hsa; identical to SEQ ID NO: 196231

SEQ ID NO: 565574 - RNA, 64 nt, hsa; identical to SEQ ID NO: 196232

SEQ ID NO: 565575 - RNA, 64 nt, hsa; identical to SEQ ID NO: 196233

SEQ ID NO: 565576 - RNA, 64 nt, hsa; identical to SEQ ID NO: 196234

SEQ ID NO: 565577 - RNA, 64 nt, hsa; identical to SEQ ID NO: 196235

SEQ ID NO: 565578 - RNA, 64 nt, hsa; identical to SEQ ID NO: 196236

SEQ ID NO: 565579 - RNA, 64 nt, hsa; identical to SEQ ID NO: 196237

SEQ ID NO: 565580 - RNA, 64 nt, hsa; identical to SEQ ID NO: 196238

SEQ ID NO: 565581 - RNA, 64 nt, hsa; identical to SEQ ID NO: 196239

SEQ ID NO: 565582 - RNA, 64 nt, hsa; identical to SEQ ID NO: 196240

SEQ ID NO: 565583 - RNA, 64 nt, hsa; identical to SEQ ID NO: 196241

SEQ ID NO: 565584 - RNA, 64 nt, hsa; identical to SEQ ID NO: 196242

SEQ ID NO: 565585 - RNA, 64 nt, hsa; identical to SEQ ID NO: 196243

SEQ ID NO: 565586 - RNA, 64 nt, hsa; identical to SEQ ID NO: 196244

SEQ ID NO: 565587 - RNA, 64 nt, hsa; identical to SEQ ID NO: 196245

SEQ ID NO: 565588 - RNA, 64 nt, hsa; identical to SEQ ID NO: 196246

SEQ ID NO: 565589 - RNA, 64 nt, hsa; identical to SEQ ID NO: 196247

SEQ ID NO: 565590 - RNA, 64 nt, hsa; identical to SEQ ID NO: 196248

SEQ ID NO: 565591 - RNA, 64 nt, hsa; identical to SEQ ID NO: 196249

SEQ ID NO: 565592 - RNA, 64 nt, hsa; identical to SEQ ID NO: 196250

SEQ ID NO: 565593 - RNA, 64 nt, hsa; identical to SEQ ID NO: 196251

SEQ ID NO: 565594 - RNA, 64 nt, hsa; identical to SEQ ID NO: 196252

SEQ ID NO: 565595 - RNA, 64 nt, hsa; identical to SEQ ID NO: 196253

SEQ ID NO: 565596 - RNA, 64 nt, hsa; identical to SEQ ID NO: 196254

SEQ ID NO: 565597 - RNA, 64 nt, hsa; identical to SEQ ID NO: 196255

SEQ ID NO: 565598 - RNA, 64 nt, hsa; identical to SEQ ID NO: 196256

SEQ ID NO: 565599 - RNA, 64 nt, hsa; identical to SEQ ID NO: 196257

SEQ ID NO: 565600 - RNA, 64 nt, hsa; identical to SEQ ID NO: 196258

SEQ ID NO: 565601 - RNA, 64 nt, hsa; identical to SEQ ID NO: 196259

SEQ ID NO: 565602 - RNA, 64 nt, hsa; identical to SEQ ID NO: 196260

SEQ ID NO: 565603 - RNA, 64 nt, hsa; identical to SEQ ID NO: 196261

SEQ ID NO: 565604 - RNA, 64 nt, hsa; identical to SEQ ID NO: 196262

SEQ ID NO: 565605 - RNA, 64 nt, hsa; identical to SEQ ID NO: 196263

SEQ ID NO: 565606 - RNA, 64 nt, hsa; identical to SEQ ID NO: 196264

SEQ ID NO: 565607 - RNA, 64 nt, hsa; identical to SEQ ID NO: 196265

SEQ ID NO: 565608 - RNA, 64 nt, hsa; identical to SEQ ID NO: 196266

SEQ ID NO: 565609 - RNA, 64 nt, hsa; identical to SEQ ID NO: 196267

SEQ ID NO: 565610 - RNA, 64 nt, hsa; identical to SEQ ID NO: 196268

SEQ ID NO: 565611 - RNA, 64 nt, hsa; identical to SEQ ID NO: 196269

SEQ ID NO: 565612 - RNA, 64 nt, hsa; identical to SEQ ID NO: 196270

SEQ ID NO: 565613 - RNA, 64 nt, hsa; identical to SEQ ID NO: 196271

SEQ ID NO: 565614 - RNA, 64 nt, hsa; identical to SEQ ID NO: 196272

SEQ ID NO: 565615 - RNA, 64 nt, hsa; identical to SEQ ID NO: 196273

SEQ ID NO: 565616 - RNA, 64 nt, hsa; identical to SEQ ID NO: 196274

SEQ ID NO: 565617 - RNA, 64 nt, hsa; identical to SEQ ID NO: 196275

SEQ ID NO: 565618 - RNA, 64 nt, hsa; identical to SEQ ID NO: 196276

SEQ ID NO: 565619 - RNA, 64 nt, hsa; identical to SEQ ID NO: 196277

SEQ ID NO: 565620 - RNA, 64 nt, hsa; identical to SEQ ID NO: 196278

SEQ ID NO: 565621 - RNA, 64 nt, hsa; identical to SEQ ID NO: 196279

SEQ ID NO: 565622 - RNA, 64 nt, hsa; identical to SEQ ID NO: 196280

SEQ ID NO: 565623 - RNA, 64 nt, hsa; identical to SEQ ID NO: 196281

SEQ ID NO: 565624 - RNA, 64 nt, hsa; identical to SEQ ID NO: 196282

SEQ ID NO: 565625 - RNA, 64 nt, hsa; identical to SEQ ID NO: 196283

SEQ ID NO: 565626 - RNA, 64 nt, hsa; identical to SEQ ID NO: 196284

SEQ ID NO: 565627 - RNA, 64 nt, hsa; identical to SEQ ID NO: 196285

SEQ ID NO: 565628 - RNA, 64 nt, hsa; identical to SEQ ID NO: 196286

SEQ ID NO: 565629 - RNA, 64 nt, hsa; identical to SEQ ID NO: 196287

SEQ ID NO: 565630 - RNA, 64 nt, hsa; identical to SEQ ID NO: 196288

SEQ ID NO: 565631 - RNA, 64 nt, hsa; identical to SEQ ID NO: 196289

SEQ ID NO: 565632 - RNA, 64 nt, hsa; identical to SEQ ID NO: 196290

SEQ ID NO: 565633 - RNA, 64 nt, hsa; identical to SEQ ID NO: 196291

SEQ ID NO: 565634 - RNA, 64 nt, hsa; identical to SEQ ID NO: 196292

SEQ ID NO: 565635 - RNA, 64 nt, hsa; identical to SEQ ID NO: 196293

SEQ ID NO: 565636 - RNA, 64 nt, hsa; identical to SEQ ID NO: 196294

SEQ ID NO: 565637 - RNA, 64 nt, hsa; identical to SEQ ID NO: 196295

SEQ ID NO: 565638 - RNA, 64 nt, hsa; identical to SEQ ID NO: 196296

SEQ ID NO: 565639 - RNA, 64 nt, hsa; identical to SEQ ID NO: 196297

SEQ ID NO: 565640 - RNA, 64 nt, hsa; identical to SEQ ID NO: 196298

SEQ ID NO: 565641 - RNA, 64 nt, hsa; identical to SEQ ID NO: 196299

SEQ ID NO: 565642 - RNA, 64 nt, hsa; identical to SEQ ID NO: 196300

SEQ ID NO: 565643 - RNA, 64 nt, hsa; identical to SEQ ID NO: 196301

SEQ ID NO: 565644 - RNA, 64 nt, hsa; identical to SEQ ID NO: 196302

SEQ ID NO: 565645 - RNA, 64 nt, hsa; identical to SEQ ID NO: 196303

SEQ ID NO: 565646 - RNA, 64 nt, hsa; identical to SEQ ID NO: 196304

SEQ ID NO: 565647 - RNA, 64 nt, hsa; identical to SEQ ID NO: 196305

SEQ ID NO: 565648 - RNA, 64 nt, hsa; identical to SEQ ID NO: 196306

SEQ ID NO: 565649 - RNA, 64 nt, hsa; identical to SEQ ID NO: 196307

SEQ ID NO: 565650 - RNA, 64 nt, hsa; identical to SEQ ID NO: 196308

SEQ ID NO: 565651 - RNA, 64 nt, hsa; identical to SEQ ID NO: 196309

SEQ ID NO: 565652 - RNA, 64 nt, hsa; identical to SEQ ID NO: 196310

SEQ ID NO: 565653 - RNA, 64 nt, hsa; identical to SEQ ID NO: 196311

SEQ ID NO: 565654 - RNA, 64 nt, hsa; identical to SEQ ID NO: 196312

SEQ ID NO: 565655 - RNA, 64 nt, hsa; identical to SEQ ID NO: 196313

SEQ ID NO: 565656 - RNA, 64 nt, hsa; identical to SEQ ID NO: 196314

SEQ ID NO: 565657 - RNA, 64 nt, hsa; identical to SEQ ID NO: 196315

SEQ ID NO: 565658 - RNA, 64 nt, hsa; identical to SEQ ID NO: 196316

SEQ ID NO: 565659 - RNA, 64 nt, hsa; identical to SEQ ID NO: 196317

SEQ ID NO: 565660 - RNA, 64 nt, hsa; identical to SEQ ID NO: 196318

SEQ ID NO: 565661 - RNA, 64 nt, hsa; identical to SEQ ID NO: 196319

SEQ ID NO: 565662 - RNA, 64 nt, hsa; identical to SEQ ID NO: 196320

SEQ ID NO: 565663 - RNA, 64 nt, hsa; identical to SEQ ID NO: 196321

SEQ ID NO: 565664 - RNA, 64 nt, hsa; identical to SEQ ID NO: 196322

SEQ ID NO: 565665 - RNA, 64 nt, hsa
agcaauauuucucaaaccugaugauucuuggauauuuagcuauuguccuccaaagagucaucgu

SEQ ID NO: 565666 - RNA, 64 nt, hsa
agauuucccaguuaucuugcucugaagacauuucuuuagcuagucuuauuuaauuuuaaagguu

SEQ ID NO: 565667 - RNA, 64 nt, hsa
aggcauuuuaaaagcugaagaaaagugacauuauuuuagcuagugguuuuuaauuuauuuuuug

SEQ ID NO: 565668 - RNA, 64 nt, hsa
auuuaugauaucaacuuggguccaagaugauaguuuuagcuagcuuaugaacauuggguucaca

SEQ ID NO: 565669 - RNA, 64 nt, hsa
aguuuagucuacguguauaaggcucccaguaggauuuagcuaggcuacuagaaguuagacugcu

SEQ ID NO: 565670 - RNA, 64 nt, hsa
uaggccaaaagggcuagccagguggcaagaucaauuuagcuacuuuguauuuucagagucaaau

SEQ ID NO: 565671 - RNA, 64 nt, hsa
guauuaccuuuaacuugccucuuacucuuugcccuuuagcuaacuaauaaaguuugauauaggc

SEQ ID NO: 565672 - RNA, 64 nt, hsa
caggcauuuuuaagacagaugucuauucauguucuuuagcuagagccuguacuuuuugcuggca

SEQ ID NO: 565673 - RNA, 64 nt, hsa
auuuuuaauaucguaacugauuucuugaugcuaguuuagcuauauuaggaaacugcuucuaccu

SEQ ID NO: 565674 - RNA, 64 nt, hsa
acgcuuacuuuucauuaaaauauuucuugucgcuuuuagcuauugucagaauccaauaaacagc

SEQ ID NO: 565675 - RNA, 64 nt, hsa
cacugaaaggcaaauuuaguucaggagguuaguuuuuagcuagcuuuggaaguaagccuuuauu

SEQ ID NO: 565676 - RNA, 64 nt, hsa
ugcagacuaaaagguugaaggcccgaaacuaacuuuuagcuaacaauaagggcugugccccaau

SEQ ID NO: 565677 - RNA, 64 nt, hsa
cuuaggacaauuaccacugaaacacuucgagcuauuuagcuaaagcccaccaaaccaaaacaaa

SEQ ID NO: 565678 - RNA, 64 nt, hsa
uaauuugguuguucuaaauauuccuggcagagcauuuagcuaacaccuugcagcgggaaccuua

SEQ ID NO: 565679 - RNA, 61 nt, hsa
uuaccuuacauagcacuugauacguguuaaaugaacauaugaauguaauuuauauauuccu

SEQ ID NO: 565680 - RNA, 61 nt, hsa
uaccacucugaagucugcugacugugucucuugaacauacuuaggauauucugcacauuau

SEQ ID NO: 565681 - RNA, 61 nt, hsa
ugaaacuugaacaaauagauggucacauugcugaacauaauucuaaaauaaaauauuggca

SEQ ID NO: 565682 - RNA, 61 nt, hsa
gacaaucaccacaguuauuacccaaauacuaugaacauauuuuuguaaaccagucauucug

SEQ ID NO: 565683 - RNA, 61 nt, hsa
ucuuuucauucacgugcuuucugggucuguaugaacauaaguaagacacaagguacugucu

SEQ ID NO: 565684 - RNA, 61 nt, hsa
acuguuucugaacugucuucuuuugcaagacugaacauaguuugggccauuggugcaugca

SEQ ID NO: 565685 - RNA, 61 nt, hsa
uuuuaaagugaaauauuuguuaacagcccauugaacauacuuuuaaaaacacuaugguaga

SEQ ID NO: 565686 - RNA, 61 nt, hsa
caucaucaaaauuagcuaacauggguauuuuugaacauauuuuugccaggaagaugaaaau

SEQ ID NO: 565687 - RNA, 58 nt, hsa; identical to SEQ ID NO: 79438

SEQ ID NO: 565688 - RNA, 61 nt, hsa
gcagagcuuuuaaccaguccgcaaagcucacugaacauaaguuaauucauacuggagaaaa

SEQ ID NO: 565689 - RNA, 61 nt, hsa
guggagaacaugcauacuacaauuaagagagugaacauauccaucaucccucaaaguguca

SEQ ID NO: 565690 - RNA, 61 nt, hsa
uuuauugagauauaauuaacauaaaauaaacugaacauauuuaaaguguacuauuugauaa

SEQ ID NO: 565691 - RNA, 61 nt, hsa
aauaauuucuucagagauaacuucaaguuguugaacauaaagguguuagauguuagcacau

SEQ ID NO: 565692 - RNA, 61 nt, hsa
uuuaauuuauuuuuauuguuugaacaggaagugaacauagucguuuccaacaaaguuuuac

SEQ ID NO: 565693 - RNA, 61 nt, hsa
caaagacgauuuuuucaggcugugauuauggugaacauaacaaaacccaguagucaccaag

SEQ ID NO: 565694 - RNA, 61 nt, hsa
uaaacagaaguuguugcuuaugaugugugagugaacauaugccacugccuggccuuuuuuu

SEQ ID NO: 565695 - RNA, 61 nt, hsa
gucagagagaccucauccugcucuuuugugaugaacauauucaugaaauguggaagucagu

SEQ ID NO: 565696 - RNA, 61 nt, hsa
uggaaggacacagugaugaauguacuaugucugaacauagaaacucgggcuugagugagaa

SEQ ID NO: 565697 - RNA, 61 nt, hsa
gaugaaauacgaaaaauuacaguuuacuuaaugaacauaaggauaaauagaaaaacugaau

SEQ ID NO: 565698 - RNA, 61 nt, hsa
acauuuuaacaauguuaauucuugcagaccaugaacauaagcuaccuucccauuuauaugc

SEQ ID NO: 565699 - RNA, 64 nt, hsa
auaagagcagagcucacacuuuuacaguugcaguauuucaaagucccuauccaggucacuccag

SEQ ID NO: 565700 - RNA, 64 nt, hsa
gcuuugugcuaaaugugguuuuguguuuugcuguauuucaaaauuuuccuucuguuaaaggaaa

SEQ ID NO: 565701 - RNA, 64 nt, hsa
gagauggggacagacugaagacagaggucguuugauuucaaagcaagucaaccugcuuuuuucu

SEQ ID NO: 565702 - RNA, 64 nt, hsa
aaccaugucaucuuuuucuuggaugauugcaguuauuucaaaaauuugcaugcaaaauauacac

SEQ ID NO: 565703 - RNA, 64 nt, hsa
gaagccuacgugcucacaguuaucuaaugagguuauuucaaaguuugcauuacuaacagccauu

SEQ ID NO: 565704 - RNA, 64 nt, hsa
acacccuuugcccaagugccauuggcuugucugcauuucaaaaucauuaaaaccagguauggaa

SEQ ID NO: 565705 - RNA, 64 nt, hsa
agacauuucgucauuuaaguaagggaucgaagacauuucaaauugcuaucuccaucugggcuga

SEQ ID NO: 565706 - RNA, 64 nt, hsa
auacauuucaucauuuaaguaagggaucgaaaacauuucaaauugcucuaucugggcugauaga

SEQ ID NO: 565707 - RNA, 64 nt, hsa
gccuuuggcuguugauuaguacaguacaagugcgauuucaaaaagaucuugaaaguaauauauu

SEQ ID NO: 565708 - RNA, 64 nt, hsa
uguauguuguuacugaaguacuuagauuuuuaaaauuucaaauccuaaaucacuucuuguagga

SEQ ID NO: 565709 - RNA, 64 nt, hsa
ugauugaggaaacaaguucugaaauaauagcacaauuucaaagaagagacucuuugcaaaguug

SEQ ID NO: 565710 - RNA, 64 nt, hsa
uuucaaagaagagacucuuugcaaaguugauaacauuucaaacccugaaggacagugacuuauu

SEQ ID NO: 565711 - RNA, 64 nt, hsa
ucaauuugauuguccugaccuacuguauaaguaaauuucaaaugucauuacuuucucuuuguua

SEQ ID NO: 565712 - RNA, 64 nt, hsa
ugaaagaaaaacuugaaaugcuacuuaacuuacuauuucaaagggaaguauauuucuuuuuaaa

SEQ ID NO: 565713 - RNA, 64 nt, hsa
cucuagacaaaaccuucuauuuuagcuuuagugaauuucaaaaguaaugggucuuggaguauag

SEQ ID NO: 565714 - RNA, 64 nt, hsa
aagugcaauauaacaauguaaccaaaucuagauaauuucaaaguugucauuaauuuaguaagcc

SEQ ID NO: 565715 - RNA, 64 nt, hsa
acacuuuuuaaacuuguuagaaaucccuggaggcauuucaaauucaucuucuaaccuaccuaag

SEQ ID NO: 565716 - RNA, 64 nt, hsa
uucaaccuuauuaaaaauucuucagccaguuaggauuucaaaauacauuagugagaguaacagc

SEQ ID NO: 565717 - RNA, 64 nt, hsa
aggaucauguuagugagcagacaaauagucacaaauuucaaacuugucaauaaguaaugcugga

SEQ ID NO: 565718 - RNA, 64 nt, hsa
uuguuuguuuuuuaauuacugggauauagauccgauuucaaagguuuuuaugcacuggcuauuu

SEQ ID NO: 565719 - RNA, 64 nt, hsa
aaaauucacuaaucuugaauguuugugauauuaaauuucaaaugcagaauacuugacucauuua

SEQ ID NO: 565720 - RNA, 64 nt, hsa
uuucaaagcacaauaacuaguaauaccaaagacuauuucaaaauguccagauguaggggaagag

SEQ ID NO: 565721 - RNA, 64 nt, hsa
gaauguuaaguuacaaaagacuuuucaucagaaaauuucaaacaaaguaaacauggcguuuuau

SEQ ID NO: 565722 - RNA, 64 nt, hsa
uaauuagugacacuccuaauuucuacuauggauaauuucaaaguagaaucacucuaugcuuaga

SEQ ID NO: 565723 - RNA, 64 nt, hsa
cuugauuuguaaugagcucuuauaugcagaacacauuucaaaugaguuuugcuaugggcugccc

SEQ ID NO: 565724 - RNA, 64 nt, hsa
caaugaaugaaacuagaaagcagagauuuucaacauuucaaaaugauuuccucuguaaucuauu

SEQ ID NO: 565725 - RNA, 64 nt, hsa
ggcucaggaucugaccgcagucccgggaguaagcauuucaaagggggaaggcaguguggucccu

SEQ ID NO: 565726 - RNA, 64 nt, hsa
uacauaaacauuaggcagguugcuuaaccuuuuuauuucaaacucucucaacucuaaagugcua

SEQ ID NO: 565727 - RNA, 64 nt, hsa
ugugugaaauaguuuuuauugaaagucaagugacauuucaaaagaaguucuauaacaauuaugu

SEQ ID NO: 565728 - RNA, 64 nt, hsa
uaguuuuugccacaucugcaaugauuauuguuuaauuucaaaagaauccucaggcucuacaauc

SEQ ID NO: 565729 - RNA, 64 nt, hsa
uaugcaugccaaauguaaggccaugaaaaucaguauuucaaauaacuuaaaaaaugcuuuacua

SEQ ID NO: 565730 - RNA, 64 nt, hsa
cuuacaaaguauuuuucccaaagauagcuuuacuauuucaaaaauugucaaauuaaugcaugcu

SEQ ID NO: 565731 - RNA, 64 nt, hsa
uuaauaucacuuaucuacuucauugccuaaguucauuucaaagaauuuguauuuagaaaagguu

SEQ ID NO: 565732 - RNA, 64 nt, hsa
aauaacugucagaggugaucuuuauuuucuaaauauuucaaacuugaaaacagaguaaaaaagu

SEQ ID NO: 565733 - RNA, 64 nt, hsa
cacauugaagggcagagccuacaaaacauuguauauuucaaaagacaaaaagaagcagcagcag

SEQ ID NO: 565734 - RNA, 64 nt, hsa
aguuagaugguccuaaacauuuaauugucaaauaauuucaaauuuaauguccugcuuucacauu

SEQ ID NO: 565735 - RNA, 64 nt, hsa
uaaaacuggauuuuaaauuuaaaaaucaauaaaaauuucaaauguuuauuaccuuccucggugc

SEQ ID NO: 565736 - RNA, 64 nt, hsa
agaaauuuagcagucagauuagguaggugguuuuauuucaaagggaaacuuuaauccaaagaaa

SEQ ID NO: 565737 - RNA, 64 nt, hsa
uuucacguaucuuccaaguacucagcuuuuucguauuucaaauaaggucagaccuuuuauacuu

SEQ ID NO: 565738 - RNA, 64 nt, hsa
cacuaacugaauucuccaaauacucacacgugaaauuucaaaaaagaagccacaaauauguagu

SEQ ID NO: 565739 - RNA, 64 nt, hsa
uagccuggcagaacagauuacuuaaagcuauuucauuucaaagcagacugaaugugacuucauc

SEQ ID NO: 565740 - RNA, 64 nt, hsa
ucucauuuuuauuuuuauuuuuuugggagagaauauuucaaaugaacacgugcaccccaucauc

SEQ ID NO: 565741 - RNA, 64 nt, hsa
uguaaauguccaaaauguugaucuuccacugcaaauuucaaaagccuugucaauggucaagcgu

SEQ ID NO: 565742 - RNA, 64 nt, hsa
gggggcaccugaccagaaugcgcaagggcaaaccauuucaaauggcagcaguuccaugaagaca

SEQ ID NO: 565743 - RNA, 64 nt, hsa
acacauauauauacacauacacaaauauaugcauauuucaaauggauuguaugcacuugcaaag

SEQ ID NO: 565744 - RNA, 64 nt, hsa
uauguaaauuauauuuauacaucuucugaaauauauuucaaaauauguguguacguguguauau

SEQ ID NO: 565745 - RNA, 64 nt, hsa
ugguauaauuacccccauugugcucuuaauggaaauuucaaaggacgggaguauucuguugguu

SEQ ID NO: 565746 - RNA, 64 nt, hsa
agcgucacaagccagcaacucucuuugcauuaaaauuucaaaguuuaauuaauauaauuaaaag

SEQ ID NO: 565747 - RNA, 64 nt, hsa
aauacucuuuuucaagugcuaaaggauuucuaaaauuucaaacugauuaauauguuucugcugu

SEQ ID NO: 565748 - RNA, 64 nt, hsa
agcagcccucugagauggcguaucuaucggaaggauuucaaacaccaauugcuuuaccugaaca

SEQ ID NO: 565749 - RNA, 64 nt, hsa
aggaagcucaggacuuuuuucuuuaaagcuagucauuucaaaagcauauuguauuuuuuugaau

SEQ ID NO: 565750 - RNA, 64 nt, hsa
uauuguauuuuuuugaaugacuacaguauggacaauuucaaaaaccaaaacccacuuuggauug

SEQ ID NO: 565751 - RNA, 64 nt, hsa
aauuuauuauccauaauuauaggagucacucuggauuucaaaaaugucaaaaaaugagcaacag

SEQ ID NO: 565752 - RNA, 64 nt, hsa
aauuugaguaacaaacagcuuugaacugagagcaauuucaaaaggcugcugauguaguucccgg

SEQ ID NO: 565753 - RNA, 64 nt, hsa
uaauuucuguuuaaaaauauugaauauuugcuucauuucaaauacucccuuuugacaaaaaaac

SEQ ID NO: 565754 - RNA, 64 nt, hsa
uacaauguuuucacauauauaguuucauuuaaucauuucaaaguuaaucucugccaucucgcua

SEQ ID NO: 565755 - RNA, 64 nt, hsa
gcuguucgugacauucuuuaugugcaaauuugugauuucaaaaauguccugccaguuuaagggu

SEQ ID NO: 565756 - RNA, 64 nt, hsa
auaaccuuccucuuagaaaauggcagguguuguaauuucaaauuuuugugcaauuagauuaaau

SEQ ID NO: 565757 - RNA, 64 nt, hsa
aacacuagaccuuaugugguuuauuccuucaaucauuucaaacauugaaaguagggccuacaug

SEQ ID NO: 565758 - RNA, 64 nt, hsa
ugauauuuuucuuuuacauguaaacaaugaaguuauuucaaaguuaaguuuuaaacaaaauaca

SEQ ID NO: 565759 - RNA, 64 nt, hsa
uugucaaauaaagaacaucuauaaauauuuauagauuucaaaauugagaaagaaguauauaugg

SEQ ID NO: 565760 - RNA, 64 nt, hsa
uuaguucaacugauccauuccacaauguauacauauuucaaacuaucgaguuguacaugauaaa

SEQ ID NO: 565761 - RNA, 64 nt, hsa
ucaaacggcaacauuccucagaaaccaaagcuuuauuucaaaucucuuccuucccuggcugguu

SEQ ID NO: 565762 - RNA, 64 nt, hsa
uacucucaaccaccuaggcaaugaagaauauaccauuucaaauauuuacaguacuugucuucac

SEQ ID NO: 565763 - RNA, 64 nt, hsa
aaaaaagaaaaaaagaaaaaagaaaaaucucauuauuucaaaaugauagacauauaccaaaaac

SEQ ID NO: 565764 - RNA, 64 nt, hsa
gcucauauccuuuugaagguaguugcaaagagacauuucaaaacugcccuaggccauugcagca

SEQ ID NO: 565765 - RNA, 64 nt, hsa
gugcaaaaagaagcaugugguggcucucauuuaaauuucaaaauuauuaguuuuaucuuuaaca

SEQ ID NO: 565766 - RNA, 64 nt, hsa
cccaucucaagcaagaauggcguugguuucuuccauuucaaacuaaucagcauucuccagcaau

SEQ ID NO: 565767 - RNA, 64 nt, hsa
uuauuuuuuuauuuauucauuagaaauuuuccucauuucaaaauaauuuaugacucauggaaug

SEQ ID NO: 565768 - RNA, 64 nt, hsa
acagccaguaauaauaauuuaaauauaauuuauuauuucaaaagaauaugucuuaaaagggaaa

SEQ ID NO: 565769 - RNA, 64 nt, hsa
ugcaugucaggauugcacaguauguuacaauacaauuucaaagagaacccacauuugugagauu

SEQ ID NO: 565770 - RNA, 64 nt, hsa
ucuacugccaaacuucuggcaaauuuaccugugaauuucaaaauguuauaaaaucucuugauau

SEQ ID NO: 565771 - RNA, 64 nt, hsa
auguauuuucuucuaugugcaagaaaaauagggcauuucaaagagcuguuuugauuaaaauuua

SEQ ID NO: 565772 - RNA, 64 nt, hsa
uucugaaucuuuguauuugcuuuugcaaauagguauuucaaagcucuuuuccuaacugguuaag

SEQ ID NO: 565773 - RNA, 64 nt, hsa
auacccucaauuucuggccuuuggcuauuuuagcauuucaaagugacuucuaugaagcuuuuuu

SEQ ID NO: 565774 - RNA, 64 nt, hsa
ugauuauuauaaaaauaaugaauucucacuguaaauuucaaaaaaaaauuacaaaaguauguga

SEQ ID NO: 565775 - RNA, 64 nt, hsa
uuccuuuucuaaccuauuaaaauaccucacuaucauuucaaaagguuaaaugaguugaucacua

SEQ ID NO: 565776 - RNA, 64 nt, hsa
aucacuaucucugcucugugcuccucaaaauauaauuucaaauggauccgaucuaaaucuauac

SEQ ID NO: 565777 - RNA, 64 nt, hsa
augcuuguaaucaggaaaguaauuucauccaccgauuucaaaaccagauucacugagcauaaaa

SEQ ID NO: 565778 - RNA, 64 nt, hsa
uugaacagcuuugauuaacuuaaugccaccauugauuucaaagugaagaaaauguaacagaagc

SEQ ID NO: 565779 - RNA, 64 nt, hsa
agccaauucucuuaacucuguaaugcagccaauaauuucaaacccguuuugcuuuugagucaug

SEQ ID NO: 565780 - RNA, 64 nt, hsa
uuacaccccagagauuuaagaagaaaaccucuaaauuucaaaauuaugaagaauuacagaauua

SEQ ID NO: 565781 - RNA, 64 nt, hsa
cuucaguagaauuagauuuuguuuuucaaucaugauuucaaaugcaauccuaagagcuaaugug

SEQ ID NO: 565782 - RNA, 64 nt, hsa
auaaggaaggcugguuauggauauucauaagguuauuucaaaguuaauaaagacaaaguggcaa

SEQ ID NO: 565783 - RNA, 64 nt, hsa
acuuuaagggauccuuuagaaacauuuuuacuuaauuucaaaugagugggcugagcauguagac

SEQ ID NO: 565784 - RNA, 64 nt, hsa
acuucaaagauaguuauugaccuuauaaauaaauauuucaaaauuuugauucggaagacuaagu

SEQ ID NO: 565785 - RNA, 64 nt, hsa
agcacucuaaaauuuagaguauaaauugucuuauauuucaaauuagaaaaguucaaaugaaguu

SEQ ID NO: 565786 - RNA, 64 nt, hsa
uuaguaaauuugguguaauacguggggcuuccauauuucaaaguggaagcuuucuucucugaag

SEQ ID NO: 565787 - RNA, 64 nt, hsa
cuguuuucuggggucugggaaaauagaaaauaagauuucaaauauuaaauaagcuuaaaggaac

SEQ ID NO: 565788 - RNA, 64 nt, hsa
gauuguauuucucugcuuucauuucaauuucauuauuucaaauugcuugucaaaauggcccaaa

SEQ ID NO: 565789 - RNA, 64 nt, hsa
ccguaaccuaggcacucugcaaguccaguguuuaauuucaaagcagugaugaauugcucuuuug

SEQ ID NO: 565790 - RNA, 64 nt, hsa
auaaaaauacuuuguagauuaaaaauaaaucagaauuucaaauuuaaaauuguccacacacuag

SEQ ID NO: 565791 - RNA, 64 nt, hsa
uuugaaauguuaauauguuaaauacuaaacuaauauuucaaaaauguguauauaugauuucuau

SEQ ID NO: 565792 - RNA, 64 nt, hsa
uugaaauguuugauauggcaagauagguaugguaauuucaaagugaauugggaauuccucuggc

SEQ ID NO: 565793 - RNA, 64 nt, hsa
uauucuugagauacaaaaaaaaaaaguaaauacaauuucaaaaaaaaaguuccggaucuguuuu

SEQ ID NO: 565794 - RNA, 64 nt, hsa
ggugcugaacuuucucucauaggacgucgcuuggauuucaaauccacggucaccugcugcccuu

SEQ ID NO: 565795 - RNA, 64 nt, hsa
uccugcacuucgagaagaaucaaaauguuccugaauuucaaauaccucaugcaaaaugucuccu

SEQ ID NO: 565796 - RNA, 64 nt, hsa
acaauguacaauuguuucauuucagaaaauaaaaauuucaaaucaugaauaccuugugguuuug

SEQ ID NO: 565797 - RNA, 64 nt, hsa
acaaguauuacuagaguggugguucuacucuaagauuucaaaagugcauuuaaaaucauacaug

SEQ ID NO: 565798 - RNA, 64 nt, hsa
gaaggcagagcuucuauucuuuaugggaugaaauauuucaaaagaggauaaauccucuguggua

SEQ ID NO: 565799 - RNA, 64 nt, hsa
gauuuuaaaaauauuuuacugcagccaaguuuucauuucaaaauguaauuucaguuuggagcuu

SEQ ID NO: 565800 - RNA, 64 nt, hsa
agggcaugaaaaacuaacugcuagcuuuccuuucauuucaaaaguccaagaauuucuaguauau

SEQ ID NO: 565801 - RNA, 64 nt, hsa
ucaguuggugaguuuugaagaauaacuacauuuuauuucaaacuaacaaauguauacgguuuua

SEQ ID NO: 565802 - RNA, 64 nt, hsa
aacuagguuaguugcgagggauguuucugguuucauuucaaauaauuaaauuucuacugcuacu

SEQ ID NO: 565803 - RNA, 64 nt, hsa
uguaaauacuguguuugugcuguaagaguuguguauuucaaaaacugaaaucucauaaaaaguu

SEQ ID NO: 565804 - RNA, 64 nt, hsa
cccuaagaaugcuaugauuucacgugcaggucuaauuucaaagggcuagaguuaguacuacuua

SEQ ID NO: 565805 - RNA, 64 nt, hsa
aaguccagccaguuuacucauuucgauucagaauauuucaaauuuagcaauaaacaauuagcau

SEQ ID NO: 565806 - RNA, 64 nt, hsa
guuucacuuuuuaaaaaauccauuacuguuuugcauuucaaaaguuggauuaaaggguuguaac

SEQ ID NO: 565807 - RNA, 64 nt, hsa
uguggaauuuaguuauuauguguauuuauguaguauuucaaacauuucaaaaugcuuucaucua

SEQ ID NO: 565808 - RNA, 64 nt, hsa
uaguuauuauguguauuuauguaguauuucaaacauuucaaaaugcuuucaucuauguuuauca

SEQ ID NO: 565809 - RNA, 64 nt, hsa
uaucacauccucuugaaaaugaauugucuacaaaauuucaaaugcaaaguauuacagccaaaua

SEQ ID NO: 565810 - RNA, 64 nt, hsa
acuaugagucucuaaaucucucuguaagaaaaaaauuucaaaguaaagauuuuacucuugcaau

SEQ ID NO: 565811 - RNA, 64 nt, hsa
gagacauaaugacagcugauguuaaacuuuucauauuucaaauuagauucccuaggagguauaa

SEQ ID NO: 565812 - RNA, 64 nt, hsa
agauauaccgugugaagcuauugucagcuucucuauuucaaaaugcaaucagcauauaacuaua

SEQ ID NO: 565813 - RNA, 64 nt, hsa
uucaucaauuacauuacacauucauuuagcccagauuucaaauagugggggaagaaagaaacug

SEQ ID NO: 565814 - RNA, 64 nt, hsa
auccaugcauucugauagcauuucauuaauuuugauuucaaauggaagauaaauaauaucccaa

SEQ ID NO: 565815 - RNA, 64 nt, hsa
uuugacuagugagcuuaauuguccauuucuuacaauuucaaaguuacagucucagaaaugguua

SEQ ID NO: 565816 - RNA, 64 nt, hsa
aguuuaagaccacaaguuagaagaaaggucacauauuucaaacacaacuagauggggcucugaa

SEQ ID NO: 565817 - RNA, 64 nt, hsa
uuugcaaaugacuaccuauagccugugaaaauacauuucaaaaaauguuaugugcaaugaacac

SEQ ID NO: 565818 - RNA, 64 nt, hsa
ggguacaaaucucccaaagaugguuugcaccgucauuucaaauguuugcacaauauaccacuua

SEQ ID NO: 565819 - RNA, 64 nt, hsa
aagcagcugugacaaccuccaaucaguuuacuucauuucaaaacuauuuccaaucacaaggaaa

SEQ ID NO: 565820 - RNA, 64 nt, hsa
ugugugagccuaugaaaaaguguauacgucuaagauuucaaaacaaugggucccaaagccuaac

SEQ ID NO: 565821 - RNA, 64 nt, hsa
agacaugugggaaaggcuuuuauucucccacgucauuucaaagacaugaaaaaacucacacugc

SEQ ID NO: 565822 - RNA, 64 nt, hsa
agauaugugggaaaggcuuuuauucugccaagucauuucaaauaccugaaaaaucuuacacugg

SEQ ID NO: 565823 - RNA, 64 nt, hsa
ggcgcgagccaccgcgcccggccccuaaguuaauauuucaaacaaucgaagguaaaacaacaua

SEQ ID NO: 565824 - RNA, 64 nt, hsa
ccuuaauggguuguauagaacacugaagcaucugauuucaaacucuuagcucuuuuccucuauu

SEQ ID NO: 565825 - RNA, 64 nt, hsa
aaccauguggugaaggcuuaagugauuucaguuuauuucaaauacaguuuuccccugacauaug

SEQ ID NO: 565826 - RNA, 64 nt, hsa
agauaugugggaaagccuuuguuuauuucauuggauuucaaagacaugaaaggacucacacuag

SEQ ID NO: 565827 - RNA, 64 nt, hsa
gaagagaccaaagccuguaacuguccagcuucuaauuucaaaacggguccauuagggcuucguu

SEQ ID NO: 565828 - RNA, 64 nt, hsa
auucaacuuuaaaacaaauuucucgugaugauucauuucaaaauccugagugagucugacugaa

SEQ ID NO: 565829 - RNA, 64 nt, hsa
uuuacaagauuuaauaggaaaugaaacagcuugaauuucaaacuaaauuguauuuucagagcua

SEQ ID NO: 565830 - RNA, 64 nt, hsa
ucuuuauaauaauuucuuauggagaagaggcuauauuucaaaggaauugagacauacucccauc

SEQ ID NO: 565831 - RNA, 64 nt, hsa
guggcccacaaugagugaguagugauuuuuggauauuucaaaauagucuagaccagcuagugcu

SEQ ID NO: 565832 - RNA, 64 nt, hsa
gugucuagaauuguucuccuguuuguagcuggauauuucaaagaaacauugcagguauuuuaua

SEQ ID NO: 565833 - RNA, 64 nt, hsa
ccugccccaaauuucaaauuaaugaaaugaagauauuucaaacagaucuuugaaaccucagauu

SEQ ID NO: 565834 - RNA, 64 nt, hsa
auguuuagacucuuaagaucauauccugccccaaauuucaaauuaaugaaaugaagauauuuca

SEQ ID NO: 565835 - RNA, 64 nt, hsa
gucuucacauuuuugucuaagcaaggaauauaagauuucaaauaaaauuuugaaccaaaaacau

SEQ ID NO: 565836 - RNA, 64 nt, hsa
augggcaaggccauucucuacaucauugcuuaauauuucaaaaauagguauuagagcacuauca

SEQ ID NO: 565837 - RNA, 64 nt, hsa
aaaaaccaauacaacaaaacgaguggcacgauuuauuucaaacuaggccagcugggauuccagc

SEQ ID NO: 565838 - RNA, 64 nt, hsa
aucucgugguguuucgcagaaaaaaauccagaaaauuucaaaugcaguugaguauucuuuuuua

SEQ ID NO: 565839 - RNA, 64 nt, hsa
acagcauuuccccaguugcccuuuaaguucuucuauuucaaacguuaauuuugcuucucuuucu

SEQ ID NO: 565840 - RNA, 64 nt, hsa
ucaggucgauuugugguaacuguagucaucuuaaauuucaaaccauuuaccaucugaaaguuuu

SEQ ID NO: 565841 - RNA, 64 nt, hsa
auggaugcaacuuauuaaaaauguuggccuggguauuucaaaggguauauauaaaagguaaaaa

SEQ ID NO: 565842 - RNA, 64 nt, hsa
uguauaguuucauuuauuugaagugauuucaaauauuucaaauucaugaauaagaauauuccgu

SEQ ID NO: 565843 - RNA, 64 nt, hsa
aauucuaaguguauaguuucauuuauuugaagugauuucaaauauuucaaauucaugaauaaga

SEQ ID NO: 565844 - RNA, 64 nt, hsa
aacuucauccauuugcacuguucagacauauauauguauguauguaaaaauuauauauacacaa

SEQ ID NO: 565845 - RNA, 64 nt, hsa
ucauccauuugcacuguucagacauauauauguauguauguaaaaauuauauauacacaaauua

SEQ ID NO: 565846 - RNA, 64 nt, hsa
uauagaugucuguguauacauauguaugugugaguguauguauacacacacacacacacacaca

SEQ ID NO: 565847 - RNA, 64 nt, hsa
gggaaagacccuaggugcucauaacuagaguauguguauguacuuacauggguguuuugaucuc

SEQ ID NO: 565848 - RNA, 64 nt, hsa
uagcaaaguauuugcugcuuacauauaguguguauguauguauauauguaaauuguguguuaaa

SEQ ID NO: 565849 - RNA, 64 nt, hsa
uaaguagcaaaguauuugcugcuuacauauaguguguauguauguauauauguaaauugugugu

SEQ ID NO: 565850 - RNA, 64 nt, hsa
uuucucguugaguucuccccacugaauguguguauguauguacacacacacacacgugugcaca

SEQ ID NO: 565851 - RNA, 64 nt, hsa
ccuguuucucguugaguucuccccacugaauguguguauguauguacacacacacacacgugug

SEQ ID NO: 565852 - RNA, 64 nt, hsa
aggcuucgaagcacaagccaaauaugucaauauuuguauguaagaaacuaauuauguaauaggu

SEQ ID NO: 565853 - RNA, 64 nt, hsa
uccuggacuaugugguuuuaugacuaaagucacauguauguauuaaacauugaggcucuguaga

SEQ ID NO: 565854 - RNA, 64 nt, hsa
cugcgcgcuauccccucacauucucuauguacuauguauguauguauuauuauuauugcugcca

SEQ ID NO: 565855 - RNA, 64 nt, hsa
gcgcuauccccucacauucucuauguacuauguauguauguauuauuauuauugcugccaagag

SEQ ID NO: 565856 - RNA, 64 nt, hsa
uuucacaauuagacuacauuuaauguguaggaauuguauguauguauaucuucuguaaauaaca

SEQ ID NO: 565857 - RNA, 64 nt, hsa
acaauuagacuacauuuaauguguaggaauuguauguauguauaucuucuguaaauaacaucua

SEQ ID NO: 565858 - RNA, 64 nt, hsa
gcuaaucuaaaaaacuggugauauuuaauaugcauguauguaucuaaacacccacauauauuug

SEQ ID NO: 565859 - RNA, 64 nt, hsa
aggccagaagcugucugaggcaaucaugauugauuguauguaucacuuacugaagaauaccuga

SEQ ID NO: 565860 - RNA, 64 nt, hsa
ccaauguuuuuugcaucaacuuuucuauauuguauguauguauauaaauacauagauuaaggaa

SEQ ID NO: 565861 - RNA, 64 nt, hsa
caagccaauguuuuuugcaucaacuuuucuauauuguauguauguauauaaauacauagauuaa

SEQ ID NO: 565862 - RNA, 64 nt, hsa
aaaaguaagcaaacaugauugccuucuuguuuucuguauguauaacccguaaauauccauuuug

SEQ ID NO: 565863 - RNA, 64 nt, hsa
cugggaaaaaaauaugcugccuuggugcuaauauuguauguauuuaaaugaucauccgacucag

SEQ ID NO: 565864 - RNA, 64 nt, hsa
cauaucuacacauacauauauacacauauauguguguauguagauauguagacuauccuaauga

SEQ ID NO: 565865 - RNA, 64 nt, hsa
uaggugacagguuauuguccaguacuuuaauguauguauguauaauggcuguacagguagacca

SEQ ID NO: 565866 - RNA, 64 nt, hsa
uucuuaggugacagguuauuguccaguacuuuaauguauguauguauaauggcuguacagguag

SEQ ID NO: 565867 - RNA, 64 nt, hsa
aaaugaaauauauauguauguguauauauauacauguauguaugaaauauauauaugugcgugu

SEQ ID NO: 565868 - RNA, 64 nt, hsa
gcuauaauuuggcaugucauuaucuagauuuauauguauguacguauuucagguccuugaaauu

SEQ ID NO: 565869 - RNA, 64 nt, hsa
agguuuucaguaguuuacccuccggaacccaaguuguauguauguauacgugugugugugugug

SEQ ID NO: 565870 - RNA, 64 nt, hsa
uuucaguaguuuacccuccggaacccaaguuguauguauguauacgugugugugugugugugug

SEQ ID NO: 565871 - RNA, 64 nt, hsa
uucucauuuuuaucccauugagacuauuuauuuauguauguauguauuuauuuauuuauugccu

SEQ ID NO: 565872 - RNA, 64 nt, hsa
cauuuuuaucccauugagacuauuuauuuauguauguauguauuuauuuauuuauugccuggag

SEQ ID NO: 565873 - RNA, 64 nt, hsa
uagaaaaugagcauuuuuuacaacugccauuuacuguauguagaaaaaagacauaaaaccuuag

SEQ ID NO: 565874 - RNA, 64 nt, hsa
ggaaagucuaaaaugcuuacuucaaaauaagaaauguauguaauuauauacaaucguguguaaa

SEQ ID NO: 565875 - RNA, 64 nt, hsa
gagucagaaguagcuucugugugaaacuuauauuuguauguagcuuucuaggaaaauuuuacag

SEQ ID NO: 565876 - RNA, 64 nt, hsa
uaugaugggugcauugucagagggaaaauauauguguauguacacauguguauguacacacaca

SEQ ID NO: 565877 - RNA, 64 nt, hsa
ugucagagggaaaauauauguguauguacacauguguauguacacacacacacacaccugccau

SEQ ID NO: 565878 - RNA, 64 nt, hsa
guuuuaaugggguugaaaacaagcagcuacuguauguauguagcuaacugaauuuguucagugu

SEQ ID NO: 565879 - RNA, 64 nt, hsa
ugcuguuuuaaugggguugaaaacaagcagcuacuguauguauguagcuaacugaauuuguuca

SEQ ID NO: 565880 - RNA, 64 nt, hsa
agccaucauaauguugguguuuguuucccuccaauguauguauguuuaguuuuuauccaaccug

SEQ ID NO: 565881 - RNA, 64 nt, hsa
gaaagcaaguucaaaagaacucugguaauuuuccuguauguacaauuuaaagagugaauaagau

SEQ ID NO: 565882 - RNA, 64 nt, hsa
aucagugaugaauagcccccaaacagugggaguguguauguauguguguauguauguaucuaug

SEQ ID NO: 565883 - RNA, 64 nt, hsa
uagcccccaaacagugggaguguguauguauguguguauguauguaucuauguauaugcuuggg

SEQ ID NO: 565884 - RNA, 64 nt, hsa
ccccaaacagugggaguguguauguauguguguauguauguaucuauguauaugcuugggaaca

SEQ ID NO: 565885 - RNA, 64 nt, hsa
auguaaaaauagcauucuacuugaucuuacaguauguauguauguauguauggagacauaugug

SEQ ID NO: 565886 - RNA, 64 nt, hsa
aaaaauagcauucuacuugaucuuacaguauguauguauguauguauggagacauaugugugcg

SEQ ID NO: 565887 - RNA, 64 nt, hsa
auagcauucuacuugaucuuacaguauguauguauguauguauggagacauaugugugcgugug

SEQ ID NO: 565888 - RNA, 64 nt, hsa
uaccuuuuaacagacuguuuuuaaaaauuaaaaauguauguauagguuuugaaauuuuuuuaaa

SEQ ID NO: 565889 - RNA, 64 nt, hsa
auuugcaaacacauuguucuauauguaaggguacuguauguaaaacucuguauuaaaacuauuc

SEQ ID NO: 565890 - RNA, 64 nt, hsa
aaauauaaguauauggugugcguguguauguauguguauguauaugcaugcauguguauaaaga

SEQ ID NO: 565891 - RNA, 64 nt, hsa
gauagaauuuaaauauaaguauauggugugcguguguauguauguguauguauaugcaugcaug

SEQ ID NO: 565892 - RNA, 64 nt, hsa
aagauauugaaccucauucaguuucacuuccacauguauguacaaguuaggucaccaaacacgg

SEQ ID NO: 565893 - RNA, 64 nt, hsa
aaagcauuuuggaaauggggaauagcgccauauauguauguauguguaugugugugugugugug

SEQ ID NO: 565894 - RNA, 64 nt, hsa
ccucccagacuggcuacuguauguaauguauuuauguauguauuuguaaaugugauagaagucu

SEQ ID NO: 565895 - RNA, 64 nt, hsa
ccucuguggggagucugccucccagacuggcuacuguauguaauguauuuauguauguauuugu

SEQ ID NO: 565896 - RNA, 64 nt, hsa
uuguugauccacuuauaauucgugcaacacuguauguauguagagauugaguugucaauuaaaa

SEQ ID NO: 565897 - RNA, 64 nt, hsa
auaauuguugauccacuuauaauucgugcaacacuguauguauguagagauugaguugucaauu

SEQ ID NO: 565898 - RNA, 64 nt, hsa
aauguguguguguguguguguguguguguguguauguauguauaggucggggagaggauagugg

SEQ ID NO: 565899 - RNA, 64 nt, hsa
cuagaauguguguguguguguguguguguguguguguauguauguauaggucggggagaggaua

SEQ ID NO: 565900 - RNA, 64 nt, hsa
auggaaccuaaggaugugauuuguuuucauuguuuguauguacuacuuuuauggcagucauaug

SEQ ID NO: 565901 - RNA, 64 nt, hsa
uaaauuaaauuaguuauaaauaaauaaccaaaaauguauguaaacauucaaaugauuaucugaa

SEQ ID NO: 565902 - RNA, 64 nt, hsa
ccuggguucaaaucauaguucagcuuucaauaacuguauguaugauuuuggcuaaaggauuuga

SEQ ID NO: 565903 - RNA, 64 nt, hsa
aguauuauuaauaauauaugucuguauauauguauguauguaaaagaucagcugucaaagccuu

SEQ ID NO: 565904 - RNA, 64 nt, hsa
uuaaaguauuauuaauaauauaugucuguauauauguauguauguaaaagaucagcugucaaag

SEQ ID NO: 565905 - RNA, 64 nt, hsa
ccuucagcuaaaaacuuaauguucuuuauaccuuuguauguaugaccuacuuuuguaacagacc

SEQ ID NO: 565906 - RNA, 64 nt, hsa
uugaauauggaaucuuacuauuugaauagaaauguguauguauaauauacauacauacauaagc

SEQ ID NO: 565907 - RNA, 64 nt, hsa
uggguuugaaguaguuuaguuaugucuuuuucucuguauguaaguaguauaauuuguuacuuuc

SEQ ID NO: 565908 - RNA, 64 nt, hsa
gaaaaaaaugauccaaaauauggauaugauuggauguauguaacacauacauggaguauggagg

SEQ ID NO: 565909 - RNA, 64 nt, hsa
uauauacacauauauauguauauauacacauauauguauguauacacauauacacauguauaua

SEQ ID NO: 565910 - RNA, 64 nt, hsa
uguauacacauauacacauguauauauacauguguguauguauacauguauauauauauacaua

SEQ ID NO: 565911 - RNA, 64 nt, hsa
agauuuauccaucgagacuaucugguaugcguuauguauguagucuguugcugcugaaagaugu

SEQ ID NO: 565912 - RNA, 64 nt, hsa
cauuaugcaaguacgcuaucaucuucaggucuuuuguauguaaaauguuucuguuccaguugua

SEQ ID NO: 565913 - RNA, 64 nt, hsa
uuuauaaauuguuaaacauuuagacaaacauauauguauguaugaauguacauaaauauuuuua

SEQ ID NO: 565914 - RNA, 64 nt, hsa
gguuuuuaugaaugugaagcaaacaaaaaaaauuuguauguaaacugaaaauaagaaaauacau

SEQ ID NO: 565915 - RNA, 64 nt, hsa
aaaaauauuuucugaucuuggauuuuuguguguauguauguaugugauuaugguacuaauaaua

SEQ ID NO: 565916 - RNA, 64 nt, hsa
agagaaaaauauuuucugaucuuggauuuuuguguguauguauguaugugauuaugguacuaau

SEQ ID NO: 565917 - RNA, 64 nt, hsa
uccccuuccaccucucuuugccuguaggauguacuguauguagucaugcacuuuguauuaauau

SEQ ID NO: 565918 - RNA, 64 nt, hsa
aggggacagagaugggauuuguuguaugauaaacuguauguaguuuuuagucuuucuguuuuga

SEQ ID NO: 565919 - RNA, 64 nt, hsa
acuccuggaauauugucugguucuugguauuuacuguauguaagcaacaacuugaaagguggca

SEQ ID NO: 565920 - RNA, 64 nt, hsa
uauauauauacacauacauauauauauauauauauguauguauaaaauuucacagggauaugcu

SEQ ID NO: 565921 - RNA, 64 nt, hsa
gucuguacugacucuaucugccacacagaauguauguauguaauauucaguaauaaaugucauc

SEQ ID NO: 565922 - RNA, 64 nt, hsa
uuuugucuguacugacucuaucugccacacagaauguauguauguaauauucaguaauaaaugu

SEQ ID NO: 565923 - RNA, 64 nt, hsa
aaacuaacuuuuuuguuuuuaauccaggccaacauguauguaaauuaaauuuuuagauaauuga

SEQ ID NO: 565924 - RNA, 64 nt, hsa
ugugauuuuucacugacaguaaugacaaauuuaauguauguaauugucuaugcauuuuaaguua

SEQ ID NO: 565925 - RNA, 64 nt, hsa
agcauuaugcaaggggaaaaaagcacuaugucuguguauguauguauauaguguaauacguaua

SEQ ID NO: 565926 - RNA, 64 nt, hsa
uuaugcaaggggaaaaaagcacuaugucuguguauguauguauauaguguaauacguauauuuu

SEQ ID NO: 565927 - RNA, 64 nt, hsa
gguuagauugauuuuaauguauauauuagacauuuguauguaugcucugacauugugauuugua

SEQ ID NO: 565928 - RNA, 64 nt, hsa
ucaaaacacaguaguaccagccuuaccuuucugcuguauguagauagucagaucauccuacugg

SEQ ID NO: 565929 - RNA, 64 nt, hsa
caggcacccagcuuugucuguggguuaguauugguguauguaugaguaucuguauguauauaua

SEQ ID NO: 565930 - RNA, 64 nt, hsa
ucuguggguuaguauugguguauguaugaguaucuguauguauauauacacgguauuuauagag

SEQ ID NO: 565931 - RNA, 64 nt, hsa
uugaucuuuuucauaguguucaaaucuguauuuuuguauguagagggaaauaauuuucucaaca

SEQ ID NO: 565932 - RNA, 64 nt, hsa
guccccuggcuggccuggcuuuuggguucaagucuguauguauggaguggguuggggccccaaa

SEQ ID NO: 565933 - RNA, 63 nt, hsa
auuucuuccugagauuucuauaaauauaaauguauguauguauuauauuuacuccccugccac

SEQ ID NO: 565934 - RNA, 64 nt, hsa
ugcaauuucuuccugagauuucuauaaauauaaauguauguauguauuauauuuacuccccugc

SEQ ID NO: 565935 - RNA, 64 nt, hsa
ugguugguguauguauguuuuauuuuuaugucuuuguauguaguucuacauaaugcaaauugug

SEQ ID NO: 565936 - RNA, 64 nt, hsa
uugauugguugagauuaacugguguggugguugguguauguauguuuuauuuuuaugucuuugu

SEQ ID NO: 565937 - RNA, 64 nt, hsa
uugagcacauugcagcuauguaauuuuugguguauguauguaauauuuaagguuggaaaaaaaa

SEQ ID NO: 565938 - RNA, 64 nt, hsa
gcuguugagcacauugcagcuauguaauuuuugguguauguauguaauauuuaagguuggaaaa

SEQ ID NO: 565939 - RNA, 64 nt, hsa
cucaacaagaaaaaaaaaaaagaauauauauauauguauguauguauguauguaaacacacaca

SEQ ID NO: 565940 - RNA, 64 nt, hsa
acaagaaaaaaaaaaaagaauauauauauauguauguauguauguauguaaacacacacacuaa

SEQ ID NO: 565941 - RNA, 64 nt, hsa
gaaaaaaaaaaaagaauauauauauauguauguauguauguauguaaacacacacacuaauuug

SEQ ID NO: 565942 - RNA, 64 nt, hsa
aaaaaaaaagaauauauauauauguauguauguauguauguaaacacacacacuaauuugagag

SEQ ID NO: 565943 - RNA, 64 nt, hsa
acaaauaaugcauaagaaauauauauauaauauauguauguauguauagccagaugcaguggca

SEQ ID NO: 565944 - RNA, 64 nt, hsa
auaaugcauaagaaauauauauauaauauauguauguauguauagccagaugcaguggcacaug

SEQ ID NO: 565945 - RNA, 64 nt, hsa
uuuauaaagaacaacuguuucuauuauugaaaauuguauguaaaacuauuuaaaauagaauaga

SEQ ID NO: 565946 - RNA, 64 nt, hsa
agauuuuggguuuucagauuaggaauacccaaccuguauguacguauauuucuguaucuaugua

SEQ ID NO: 565947 - RNA, 64 nt, hsa
acccaaccuguauguacguauauuucuguaucuauguauguauauauaugcauaugcagacaua

SEQ ID NO: 565948 - RNA, 64 nt, hsa
ugcagacauauguauauggucuggucagcauauguguauguaugcguauguauguauguaugua

SEQ ID NO: 565949 - RNA, 64 nt, hsa
uauggucuggucagcauauguguauguaugcguauguauguauguauguaugcccucagugcag

SEQ ID NO: 565950 - RNA, 64 nt, hsa
gucuggucagcauauguguauguaugcguauguauguauguauguaugcccucagugcaguggg

SEQ ID NO: 565951 - RNA, 64 nt, hsa
ggucagcauauguguauguaugcguauguauguauguauguaugcccucagugcagugggguuu

SEQ ID NO: 565952 - RNA, 64 nt, hsa
uauguguauauauauauacauauauauacacauauguauguauaccuaacuccuaaaguggaac

SEQ ID NO: 565953 - RNA, 64 nt, hsa
cccaccugugaacuccuaccagagagaaaccuuuuguauguaaagaauuugggaaagcauuugc

SEQ ID NO: 565954 - RNA, 64 nt, hsa
cguguguauauauuccacauauguauacauuccauguauguaugcauauauguauuccauauau

SEQ ID NO: 565955 - RNA, 64 nt, hsa
guggaauauauuccacauguguauauauuccacguguauguauuccacauguauauauuccaca

SEQ ID NO: 565956 - RNA, 64 nt, hsa
ugagugcauucaccaccuuuuaaauuuuggucacuguauguaucaguucuaaaauuuccauuuu

SEQ ID NO: 565957 - RNA, 64 nt, hsa
gagaaaucugcagucauucaaauuguuguuucccuguauguagugugucauuuuucugucagau

SEQ ID NO: 565958 - RNA, 64 nt, hsa
acaauaugaaguuauuaguucuuagaaugcagaauguauguaauaaaauaagcuuggccuagca

SEQ ID NO: 565959 - RNA, 64 nt, hsa
cauaucaucuguggacugaccuuguaaaagacaguguauguagaagcaugaagucuuaaggaca

SEQ ID NO: 565960 - RNA, 64 nt, hsa
agauauauauaccuauugaaauucucucacucuguguauguauauauaccuauggaaaacuagu

SEQ ID NO: 565961 - RNA, 64 nt, hsa
ucuuaaaagucccugauuuaugauaacuauacauuguauguaaauucagggauauguauaugua

SEQ ID NO: 565962 - RNA, 64 nt, hsa
ucuaagggcuuuacaaggaucaaauaagaugguguguauguaagaaauuuguaaaaugugaaga

SEQ ID NO: 565963 - RNA, 64 nt, hsa
agcuaaagguagaaguguuugauccagugaacuguguauguaugugugggguuuuuuucuuuau

SEQ ID NO: 565964 - RNA, 64 nt, hsa
uccauuauuacuugggucuuuacuucugggaauuuguauguaacagccuagaaaauuaaaagga

SEQ ID NO: 565965 - RNA, 64 nt, hsa
gacacagcacacaaguggcuauugugauguaugauguauguaguccuacaacugcaaaacgucu

SEQ ID NO: 565966 - RNA, 64 nt, hsa
guaugcauauaaguauaugcuuuauguaugcauauguauguagauauguuuauaucuaucgucu

SEQ ID NO: 565967 - RNA, 64 nt, hsa
guuugguaauaugcagguaggcauuacaugcauauguauguagacauaugcaugcauguauaug

SEQ ID NO: 565968 - RNA, 64 nt, hsa
uugcccacuguguguguggguauguauguguguauguauguauccgcaugugugcaugugagua

SEQ ID NO: 565969 - RNA, 64 nt, hsa
ccucuugcccacuguguguguggguauguauguguguauguauguauccgcaugugugcaugug

SEQ ID NO: 565970 - RNA, 64 nt, hsa; identical to SEQ ID NO: 565964

SEQ ID NO: 565971 - RNA, 64 nt, hsa
gacacagcacacaaguggcuauugugauguaugauguauguagucccacaacugcaaaacgucu

SEQ ID NO: 565972 - RNA, 64 nt, hsa; identical to SEQ ID NO: 44500

SEQ ID NO: 565973 - RNA, 64 nt, hsa; identical to SEQ ID NO: 44501

SEQ ID NO: 565974 - RNA, 64 nt, hsa; identical to SEQ ID NO: 44502

SEQ ID NO: 565975 - RNA, 64 nt, hsa; identical to SEQ ID NO: 44503

SEQ ID NO: 565976 - RNA, 64 nt, hsa; identical to SEQ ID NO: 44504

SEQ ID NO: 565977 - RNA, 64 nt, hsa; identical to SEQ ID NO: 44505

SEQ ID NO: 565978 - RNA, 64 nt, hsa; identical to SEQ ID NO: 44506

SEQ ID NO: 565979 - RNA, 64 nt, hsa; identical to SEQ ID NO: 44507

SEQ ID NO: 565980 - RNA, 64 nt, hsa; identical to SEQ ID NO: 44508

SEQ ID NO: 565981 - RNA, 64 nt, hsa; identical to SEQ ID NO: 44509

SEQ ID NO: 565982 - RNA, 64 nt, hsa; identical to SEQ ID NO: 44510

SEQ ID NO: 565983 - RNA, 64 nt, hsa; identical to SEQ ID NO: 44511

SEQ ID NO: 565984 - RNA, 64 nt, hsa; identical to SEQ ID NO: 44512

SEQ ID NO: 565985 - RNA, 64 nt, hsa; identical to SEQ ID NO: 44513

SEQ ID NO: 565986 - RNA, 64 nt, hsa; identical to SEQ ID NO: 44514

SEQ ID NO: 565987 - RNA, 64 nt, hsa; identical to SEQ ID NO: 44515

SEQ ID NO: 565988 - RNA, 64 nt, hsa; identical to SEQ ID NO: 44516

SEQ ID NO: 565989 - RNA, 64 nt, hsa; identical to SEQ ID NO: 44517

SEQ ID NO: 565990 - RNA, 64 nt, hsa; identical to SEQ ID NO: 44518

SEQ ID NO: 565991 - RNA, 64 nt, hsa; identical to SEQ ID NO: 44519

SEQ ID NO: 565992 - RNA, 64 nt, hsa; identical to SEQ ID NO: 44520

SEQ ID NO: 565993 - RNA, 64 nt, hsa; identical to SEQ ID NO: 44521

SEQ ID NO: 565994 - RNA, 64 nt, hsa; identical to SEQ ID NO: 44522

SEQ ID NO: 565995 - RNA, 64 nt, hsa; identical to SEQ ID NO: 44523

SEQ ID NO: 565996 - RNA, 64 nt, hsa; identical to SEQ ID NO: 44524

SEQ ID NO: 565997 - RNA, 64 nt, hsa; identical to SEQ ID NO: 44525

SEQ ID NO: 565998 - RNA, 64 nt, hsa; identical to SEQ ID NO: 44526

SEQ ID NO: 565999 - RNA, 64 nt, hsa; identical to SEQ ID NO: 44527

SEQ ID NO: 566000 - RNA, 64 nt, hsa; identical to SEQ ID NO: 44528

SEQ ID NO: 566001 - RNA, 64 nt, hsa; identical to SEQ ID NO: 44529

SEQ ID NO: 566002 - RNA, 64 nt, hsa; identical to SEQ ID NO: 44530

SEQ ID NO: 566003 - RNA, 64 nt, hsa; identical to SEQ ID NO: 44531

SEQ ID NO: 566004 - RNA, 64 nt, hsa; identical to SEQ ID NO: 44532

SEQ ID NO: 566005 - RNA, 64 nt, hsa; identical to SEQ ID NO: 44533

SEQ ID NO: 566006 - RNA, 64 nt, hsa; identical to SEQ ID NO: 44534

SEQ ID NO: 566007 - RNA, 64 nt, hsa; identical to SEQ ID NO: 44535

SEQ ID NO: 566008 - RNA, 64 nt, hsa; identical to SEQ ID NO: 44536

SEQ ID NO: 566009 - RNA, 64 nt, hsa; identical to SEQ ID NO: 44537

SEQ ID NO: 566010 - RNA, 64 nt, hsa; identical to SEQ ID NO: 44538

SEQ ID NO: 566011 - RNA, 64 nt, hsa; identical to SEQ ID NO: 44539

SEQ ID NO: 566012 - RNA, 64 nt, hsa; identical to SEQ ID NO: 44540

SEQ ID NO: 566013 - RNA, 64 nt, hsa; identical to SEQ ID NO: 44541

SEQ ID NO: 566014 - RNA, 64 nt, hsa; identical to SEQ ID NO: 44542

SEQ ID NO: 566015 - RNA, 64 nt, hsa; identical to SEQ ID NO: 44543

SEQ ID NO: 566016 - RNA, 64 nt, hsa; identical to SEQ ID NO: 44544

SEQ ID NO: 566017 - RNA, 64 nt, hsa; identical to SEQ ID NO: 44545

SEQ ID NO: 566018 - RNA, 64 nt, hsa; identical to SEQ ID NO: 44546

SEQ ID NO: 566019 - RNA, 64 nt, hsa; identical to SEQ ID NO: 44547

SEQ ID NO: 566020 - RNA, 64 nt, hsa; identical to SEQ ID NO: 44548

SEQ ID NO: 566021 - RNA, 64 nt, hsa; identical to SEQ ID NO: 44549

SEQ ID NO: 566022 - RNA, 64 nt, hsa; identical to SEQ ID NO: 44550

SEQ ID NO: 566023 - RNA, 64 nt, hsa; identical to SEQ ID NO: 44551

SEQ ID NO: 566024 - RNA, 64 nt, hsa; identical to SEQ ID NO: 44552

SEQ ID NO: 566025 - RNA, 64 nt, hsa; identical to SEQ ID NO: 44553

SEQ ID NO: 566026 - RNA, 64 nt, hsa; identical to SEQ ID NO: 44554

SEQ ID NO: 566027 - RNA, 64 nt, hsa; identical to SEQ ID NO: 44555

SEQ ID NO: 566028 - RNA, 64 nt, hsa; identical to SEQ ID NO: 44556

SEQ ID NO: 566029 - RNA, 64 nt, hsa; identical to SEQ ID NO: 44557

SEQ ID NO: 566030 - RNA, 64 nt, hsa; identical to SEQ ID NO: 44558

SEQ ID NO: 566031 - RNA, 64 nt, hsa; identical to SEQ ID NO: 44559

SEQ ID NO: 566032 - RNA, 64 nt, hsa; identical to SEQ ID NO: 44560

SEQ ID NO: 566033 - RNA, 64 nt, hsa; identical to SEQ ID NO: 44561

SEQ ID NO: 566034 - RNA, 64 nt, hsa; identical to SEQ ID NO: 44562

SEQ ID NO: 566035 - RNA, 64 nt, hsa; identical to SEQ ID NO: 44563

SEQ ID NO: 566036 - RNA, 64 nt, hsa; identical to SEQ ID NO: 44564

SEQ ID NO: 566037 - RNA, 64 nt, hsa; identical to SEQ ID NO: 44565

SEQ ID NO: 566038 - RNA, 64 nt, hsa; identical to SEQ ID NO: 44566

SEQ ID NO: 566039 - RNA, 64 nt, hsa; identical to SEQ ID NO: 44567

SEQ ID NO: 566040 - RNA, 64 nt, hsa; identical to SEQ ID NO: 44568

SEQ ID NO: 566041 - RNA, 64 nt, hsa; identical to SEQ ID NO: 44569

SEQ ID NO: 566042 - RNA, 64 nt, hsa; identical to SEQ ID NO: 44570

SEQ ID NO: 566043 - RNA, 64 nt, hsa; identical to SEQ ID NO: 44571

SEQ ID NO: 566044 - RNA, 64 nt, hsa; identical to SEQ ID NO: 44572

SEQ ID NO: 566045 - RNA, 64 nt, hsa; identical to SEQ ID NO: 44573

SEQ ID NO: 566046 - RNA, 64 nt, hsa; identical to SEQ ID NO: 44574

SEQ ID NO: 566047 - RNA, 64 nt, hsa; identical to SEQ ID NO: 44575

SEQ ID NO: 566048 - RNA, 64 nt, hsa; identical to SEQ ID NO: 44576

SEQ ID NO: 566049 - RNA, 64 nt, hsa; identical to SEQ ID NO: 44577

SEQ ID NO: 566050 - RNA, 64 nt, hsa; identical to SEQ ID NO: 44578

SEQ ID NO: 566051 - RNA, 64 nt, hsa; identical to SEQ ID NO: 44579

SEQ ID NO: 566052 - RNA, 64 nt, hsa; identical to SEQ ID NO: 44580

SEQ ID NO: 566053 - RNA, 64 nt, hsa; identical to SEQ ID NO: 44581

SEQ ID NO: 566054 - RNA, 64 nt, hsa; identical to SEQ ID NO: 44582

SEQ ID NO: 566055 - RNA, 64 nt, hsa; identical to SEQ ID NO: 44583

SEQ ID NO: 566056 - RNA, 64 nt, hsa; identical to SEQ ID NO: 44584

SEQ ID NO: 566057 - RNA, 64 nt, hsa; identical to SEQ ID NO: 44585

SEQ ID NO: 566058 - RNA, 64 nt, hsa; identical to SEQ ID NO: 44586

SEQ ID NO: 566059 - RNA, 64 nt, hsa; identical to SEQ ID NO: 44587

SEQ ID NO: 566060 - RNA, 64 nt, hsa; identical to SEQ ID NO: 44588

SEQ ID NO: 566061 - RNA, 64 nt, hsa; identical to SEQ ID NO: 44589

SEQ ID NO: 566062 - RNA, 64 nt, hsa; identical to SEQ ID NO: 44590

SEQ ID NO: 566063 - RNA, 64 nt, hsa; identical to SEQ ID NO: 44591

SEQ ID NO: 566064 - RNA, 64 nt, hsa; identical to SEQ ID NO: 44592

SEQ ID NO: 566065 - RNA, 64 nt, hsa; identical to SEQ ID NO: 44593

SEQ ID NO: 566066 - RNA, 64 nt, hsa; identical to SEQ ID NO: 44594

SEQ ID NO: 566067 - RNA, 64 nt, hsa; identical to SEQ ID NO: 44595

SEQ ID NO: 566068 - RNA, 64 nt, hsa; identical to SEQ ID NO: 44596

SEQ ID NO: 566069 - RNA, 64 nt, hsa; identical to SEQ ID NO: 44597

SEQ ID NO: 566070 - RNA, 64 nt, hsa; identical to SEQ ID NO: 44598

SEQ ID NO: 566071 - RNA, 64 nt, hsa; identical to SEQ ID NO: 44599

SEQ ID NO: 566072 - RNA, 64 nt, hsa; identical to SEQ ID NO: 44600

SEQ ID NO: 566073 - RNA, 64 nt, hsa; identical to SEQ ID NO: 44601

SEQ ID NO: 566074 - RNA, 64 nt, hsa; identical to SEQ ID NO: 44602

SEQ ID NO: 566075 - RNA, 64 nt, hsa; identical to SEQ ID NO: 44603

SEQ ID NO: 566076 - RNA, 64 nt, hsa; identical to SEQ ID NO: 44604

SEQ ID NO: 566077 - RNA, 64 nt, hsa; identical to SEQ ID NO: 44605

SEQ ID NO: 566078 - RNA, 64 nt, hsa; identical to SEQ ID NO: 44606

SEQ ID NO: 566079 - RNA, 64 nt, hsa; identical to SEQ ID NO: 44607

SEQ ID NO: 566080 - RNA, 64 nt, hsa; identical to SEQ ID NO: 44608

SEQ ID NO: 566081 - RNA, 64 nt, hsa; identical to SEQ ID NO: 44609

SEQ ID NO: 566082 - RNA, 64 nt, hsa; identical to SEQ ID NO: 44610

SEQ ID NO: 566083 - RNA, 56 nt, hsa; identical to SEQ ID NO: 44611

SEQ ID NO: 566084 - RNA, 64 nt, hsa; identical to SEQ ID NO: 44612

SEQ ID NO: 566085 - RNA, 64 nt, hsa; identical to SEQ ID NO: 44613

SEQ ID NO: 566086 - RNA, 64 nt, hsa; identical to SEQ ID NO: 44614

SEQ ID NO: 566087 - RNA, 64 nt, hsa; identical to SEQ ID NO: 44615

SEQ ID NO: 566088 - RNA, 64 nt, hsa; identical to SEQ ID NO: 44616

SEQ ID NO: 566089 - RNA, 64 nt, hsa; identical to SEQ ID NO: 44617

SEQ ID NO: 566090 - RNA, 64 nt, hsa; identical to SEQ ID NO: 44618

SEQ ID NO: 566091 - RNA, 64 nt, hsa; identical to SEQ ID NO: 44619

SEQ ID NO: 566092 - RNA, 64 nt, hsa; identical to SEQ ID NO: 44620

SEQ ID NO: 566093 - RNA, 64 nt, hsa; identical to SEQ ID NO: 44621

SEQ ID NO: 566094 - RNA, 64 nt, hsa; identical to SEQ ID NO: 44622

SEQ ID NO: 566095 - RNA, 64 nt, hsa; identical to SEQ ID NO: 44623

SEQ ID NO: 566096 - RNA, 64 nt, hsa; identical to SEQ ID NO: 44624

SEQ ID NO: 566097 - RNA, 64 nt, hsa; identical to SEQ ID NO: 44625

SEQ ID NO: 566098 - RNA, 64 nt, hsa; identical to SEQ ID NO: 44626

SEQ ID NO: 566099 - RNA, 64 nt, hsa; identical to SEQ ID NO: 44627

SEQ ID NO: 566100 - RNA, 64 nt, hsa; identical to SEQ ID NO: 44628

SEQ ID NO: 566101 - RNA, 64 nt, hsa; identical to SEQ ID NO: 44629

SEQ ID NO: 566102 - RNA, 64 nt, hsa; identical to SEQ ID NO: 44630

SEQ ID NO: 566103 - RNA, 64 nt, hsa; identical to SEQ ID NO: 44631

SEQ ID NO: 566104 - RNA, 64 nt, hsa; identical to SEQ ID NO: 44632

SEQ ID NO: 566105 - RNA, 64 nt, hsa; identical to SEQ ID NO: 44633

SEQ ID NO: 566106 - RNA, 64 nt, hsa; identical to SEQ ID NO: 44634

SEQ ID NO: 566107 - RNA, 64 nt, hsa; identical to SEQ ID NO: 44635

SEQ ID NO: 566108 - RNA, 64 nt, hsa; identical to SEQ ID NO: 44636

SEQ ID NO: 566109 - RNA, 64 nt, hsa; identical to SEQ ID NO: 44637

SEQ ID NO: 566110 - RNA, 64 nt, hsa; identical to SEQ ID NO: 44638

SEQ ID NO: 566111 - RNA, 64 nt, hsa; identical to SEQ ID NO: 44639

SEQ ID NO: 566112 - RNA, 64 nt, hsa; identical to SEQ ID NO: 44640

SEQ ID NO: 566113 - RNA, 64 nt, hsa; identical to SEQ ID NO: 44641

SEQ ID NO: 566114 - RNA, 64 nt, hsa; identical to SEQ ID NO: 44642

SEQ ID NO: 566115 - RNA, 64 nt, hsa; identical to SEQ ID NO: 44643

SEQ ID NO: 566116 - RNA, 64 nt, hsa; identical to SEQ ID NO: 44644

SEQ ID NO: 566117 - RNA, 64 nt, hsa; identical to SEQ ID NO: 44645

SEQ ID NO: 566118 - RNA, 64 nt, hsa; identical to SEQ ID NO: 44646

SEQ ID NO: 566119 - RNA, 64 nt, hsa; identical to SEQ ID NO: 44647

SEQ ID NO: 566120 - RNA, 64 nt, hsa; identical to SEQ ID NO: 44648

SEQ ID NO: 566121 - RNA, 64 nt, hsa; identical to SEQ ID NO: 44649

SEQ ID NO: 566122 - RNA, 64 nt, hsa; identical to SEQ ID NO: 44650

SEQ ID NO: 566123 - RNA, 64 nt, hsa; identical to SEQ ID NO: 44651

SEQ ID NO: 566124 - RNA, 64 nt, hsa; identical to SEQ ID NO: 44652

SEQ ID NO: 566125 - RNA, 64 nt, hsa; identical to SEQ ID NO: 44653

SEQ ID NO: 566126 - RNA, 64 nt, hsa; identical to SEQ ID NO: 44654

SEQ ID NO: 566127 - RNA, 64 nt, hsa; identical to SEQ ID NO: 44655

SEQ ID NO: 566128 - RNA, 64 nt, hsa; identical to SEQ ID NO: 44656

SEQ ID NO: 566129 - RNA, 64 nt, hsa; identical to SEQ ID NO: 44657

SEQ ID NO: 566130 - RNA, 64 nt, hsa; identical to SEQ ID NO: 44658

SEQ ID NO: 566131 - RNA, 64 nt, hsa; identical to SEQ ID NO: 44659

SEQ ID NO: 566132 - RNA, 64 nt, hsa; identical to SEQ ID NO: 44660

SEQ ID NO: 566133 - RNA, 64 nt, hsa; identical to SEQ ID NO: 44661

SEQ ID NO: 566134 - RNA, 64 nt, hsa; identical to SEQ ID NO: 44662

SEQ ID NO: 566135 - RNA, 64 nt, hsa; identical to SEQ ID NO: 44663

SEQ ID NO: 566136 - RNA, 64 nt, hsa; identical to SEQ ID NO: 44664

SEQ ID NO: 566137 - RNA, 64 nt, hsa; identical to SEQ ID NO: 44665

SEQ ID NO: 566138 - RNA, 64 nt, hsa; identical to SEQ ID NO: 44666

SEQ ID NO: 566139 - RNA, 64 nt, hsa; identical to SEQ ID NO: 44667

SEQ ID NO: 566140 - RNA, 64 nt, hsa; identical to SEQ ID NO: 44668

SEQ ID NO: 566141 - RNA, 64 nt, hsa; identical to SEQ ID NO: 44669

SEQ ID NO: 566142 - RNA, 64 nt, hsa; identical to SEQ ID NO: 44670

SEQ ID NO: 566143 - RNA, 64 nt, hsa; identical to SEQ ID NO: 44671

SEQ ID NO: 566144 - RNA, 64 nt, hsa; identical to SEQ ID NO: 44672

SEQ ID NO: 566145 - RNA, 64 nt, hsa; identical to SEQ ID NO: 44673

SEQ ID NO: 566146 - RNA, 64 nt, hsa; identical to SEQ ID NO: 44674

SEQ ID NO: 566147 - RNA, 64 nt, hsa; identical to SEQ ID NO: 44675

SEQ ID NO: 566148 - RNA, 64 nt, hsa; identical to SEQ ID NO: 44676

SEQ ID NO: 566149 - RNA, 64 nt, hsa; identical to SEQ ID NO: 44677

SEQ ID NO: 566150 - RNA, 64 nt, hsa; identical to SEQ ID NO: 44678

SEQ ID NO: 566151 - RNA, 64 nt, hsa; identical to SEQ ID NO: 44679

SEQ ID NO: 566152 - RNA, 64 nt, hsa; identical to SEQ ID NO: 44680

SEQ ID NO: 566153 - RNA, 64 nt, hsa; identical to SEQ ID NO: 44681

SEQ ID NO: 566154 - RNA, 64 nt, hsa; identical to SEQ ID NO: 44682

SEQ ID NO: 566155 - RNA, 64 nt, hsa; identical to SEQ ID NO: 44683

SEQ ID NO: 566156 - RNA, 64 nt, hsa; identical to SEQ ID NO: 44684

SEQ ID NO: 566157 - RNA, 64 nt, hsa; identical to SEQ ID NO: 44685

SEQ ID NO: 566158 - RNA, 64 nt, hsa; identical to SEQ ID NO: 44686

SEQ ID NO: 566159 - RNA, 64 nt, hsa; identical to SEQ ID NO: 44687

SEQ ID NO: 566160 - RNA, 64 nt, hsa; identical to SEQ ID NO: 44688

SEQ ID NO: 566161 - RNA, 64 nt, hsa; identical to SEQ ID NO: 44689

SEQ ID NO: 566162 - RNA, 64 nt, hsa; identical to SEQ ID NO: 44690

SEQ ID NO: 566163 - RNA, 64 nt, hsa; identical to SEQ ID NO: 44691

SEQ ID NO: 566164 - RNA, 64 nt, hsa; identical to SEQ ID NO: 44692

SEQ ID NO: 566165 - RNA, 64 nt, hsa; identical to SEQ ID NO: 44693

SEQ ID NO: 566166 - RNA, 64 nt, hsa; identical to SEQ ID NO: 44694

SEQ ID NO: 566167 - RNA, 64 nt, hsa; identical to SEQ ID NO: 44695

SEQ ID NO: 566168 - RNA, 64 nt, hsa; identical to SEQ ID NO: 44696

SEQ ID NO: 566169 - RNA, 64 nt, hsa; identical to SEQ ID NO: 44697

SEQ ID NO: 566170 - RNA, 64 nt, hsa; identical to SEQ ID NO: 44698

SEQ ID NO: 566171 - RNA, 64 nt, hsa; identical to SEQ ID NO: 44699

SEQ ID NO: 566172 - RNA, 64 nt, hsa; identical to SEQ ID NO: 44700

SEQ ID NO: 566173 - RNA, 64 nt, hsa; identical to SEQ ID NO: 44701

SEQ ID NO: 566174 - RNA, 64 nt, hsa; identical to SEQ ID NO: 44702

SEQ ID NO: 566175 - RNA, 64 nt, hsa; identical to SEQ ID NO: 44703

SEQ ID NO: 566176 - RNA, 64 nt, hsa; identical to SEQ ID NO: 44704

SEQ ID NO: 566177 - RNA, 64 nt, hsa; identical to SEQ ID NO: 44705

SEQ ID NO: 566178 - RNA, 64 nt, hsa; identical to SEQ ID NO: 44706

SEQ ID NO: 566179 - RNA, 64 nt, hsa; identical to SEQ ID NO: 44707

SEQ ID NO: 566180 - RNA, 64 nt, hsa; identical to SEQ ID NO: 44708

SEQ ID NO: 566181 - RNA, 64 nt, hsa; identical to SEQ ID NO: 44709

SEQ ID NO: 566182 - RNA, 64 nt, hsa; identical to SEQ ID NO: 44710

SEQ ID NO: 566183 - RNA, 64 nt, hsa; identical to SEQ ID NO: 44711

SEQ ID NO: 566184 - RNA, 64 nt, hsa; identical to SEQ ID NO: 44712

SEQ ID NO: 566185 - RNA, 64 nt, hsa; identical to SEQ ID NO: 44713

SEQ ID NO: 566186 - RNA, 64 nt, hsa; identical to SEQ ID NO: 44714

SEQ ID NO: 566187 - RNA, 64 nt, hsa; identical to SEQ ID NO: 44715

SEQ ID NO: 566188 - RNA, 64 nt, hsa; identical to SEQ ID NO: 44716

SEQ ID NO: 566189 - RNA, 64 nt, hsa; identical to SEQ ID NO: 44717

SEQ ID NO: 566190 - RNA, 64 nt, hsa; identical to SEQ ID NO: 44718

SEQ ID NO: 566191 - RNA, 64 nt, hsa; identical to SEQ ID NO: 44719

SEQ ID NO: 566192 - RNA, 64 nt, hsa; identical to SEQ ID NO: 44720

SEQ ID NO: 566193 - RNA, 64 nt, hsa; identical to SEQ ID NO: 44721

SEQ ID NO: 566194 - RNA, 64 nt, hsa; identical to SEQ ID NO: 44722

SEQ ID NO: 566195 - RNA, 64 nt, hsa; identical to SEQ ID NO: 44723

SEQ ID NO: 566196 - RNA, 64 nt, hsa; identical to SEQ ID NO: 44724

SEQ ID NO: 566197 - RNA, 64 nt, hsa; identical to SEQ ID NO: 44725

SEQ ID NO: 566198 - RNA, 64 nt, hsa; identical to SEQ ID NO: 44726

SEQ ID NO: 566199 - RNA, 64 nt, hsa; identical to SEQ ID NO: 44727

SEQ ID NO: 566200 - RNA, 64 nt, hsa; identical to SEQ ID NO: 44728

SEQ ID NO: 566201 - RNA, 64 nt, hsa; identical to SEQ ID NO: 44729

SEQ ID NO: 566202 - RNA, 64 nt, hsa; identical to SEQ ID NO: 44730

SEQ ID NO: 566203 - RNA, 64 nt, hsa; identical to SEQ ID NO: 44731

SEQ ID NO: 566204 - RNA, 64 nt, hsa; identical to SEQ ID NO: 44732

SEQ ID NO: 566205 - RNA, 64 nt, hsa; identical to SEQ ID NO: 44733

SEQ ID NO: 566206 - RNA, 64 nt, hsa; identical to SEQ ID NO: 44734

SEQ ID NO: 566207 - RNA, 64 nt, hsa; identical to SEQ ID NO: 44735

SEQ ID NO: 566208 - RNA, 64 nt, hsa; identical to SEQ ID NO: 44736

SEQ ID NO: 566209 - RNA, 64 nt, hsa; identical to SEQ ID NO: 44737

SEQ ID NO: 566210 - RNA, 64 nt, hsa; identical to SEQ ID NO: 44738

SEQ ID NO: 566211 - RNA, 64 nt, hsa; identical to SEQ ID NO: 44739

SEQ ID NO: 566212 - RNA, 64 nt, hsa; identical to SEQ ID NO: 44740

SEQ ID NO: 566213 - RNA, 64 nt, hsa; identical to SEQ ID NO: 44741

SEQ ID NO: 566214 - RNA, 64 nt, hsa; identical to SEQ ID NO: 44742

SEQ ID NO: 566215 - RNA, 64 nt, hsa; identical to SEQ ID NO: 44743

SEQ ID NO: 566216 - RNA, 64 nt, hsa; identical to SEQ ID NO: 44744

SEQ ID NO: 566217 - RNA, 64 nt, hsa; identical to SEQ ID NO: 44745

SEQ ID NO: 566218 - RNA, 64 nt, hsa; identical to SEQ ID NO: 44746

SEQ ID NO: 566219 - RNA, 64 nt, hsa; identical to SEQ ID NO: 44747

SEQ ID NO: 566220 - RNA, 64 nt, hsa; identical to SEQ ID NO: 44748

SEQ ID NO: 566221 - RNA, 64 nt, hsa; identical to SEQ ID NO: 44749

SEQ ID NO: 566222 - RNA, 64 nt, hsa; identical to SEQ ID NO: 44750

SEQ ID NO: 566223 - RNA, 64 nt, hsa; identical to SEQ ID NO: 44751

SEQ ID NO: 566224 - RNA, 64 nt, hsa; identical to SEQ ID NO: 44752

SEQ ID NO: 566225 - RNA, 64 nt, hsa; identical to SEQ ID NO: 44753

SEQ ID NO: 566226 - RNA, 64 nt, hsa; identical to SEQ ID NO: 44754

SEQ ID NO: 566227 - RNA, 64 nt, hsa; identical to SEQ ID NO: 44755

SEQ ID NO: 566228 - RNA, 64 nt, hsa; identical to SEQ ID NO: 44756

SEQ ID NO: 566229 - RNA, 64 nt, hsa; identical to SEQ ID NO: 44757

SEQ ID NO: 566230 - RNA, 64 nt, hsa; identical to SEQ ID NO: 44758

SEQ ID NO: 566231 - RNA, 64 nt, hsa; identical to SEQ ID NO: 44759

SEQ ID NO: 566232 - RNA, 64 nt, hsa; identical to SEQ ID NO: 44760

SEQ ID NO: 566233 - RNA, 64 nt, hsa; identical to SEQ ID NO: 44761

SEQ ID NO: 566234 - RNA, 64 nt, hsa; identical to SEQ ID NO: 44762

SEQ ID NO: 566235 - RNA, 64 nt, hsa; identical to SEQ ID NO: 44763

SEQ ID NO: 566236 - RNA, 64 nt, hsa; identical to SEQ ID NO: 44764

SEQ ID NO: 566237 - RNA, 64 nt, hsa; identical to SEQ ID NO: 44765

SEQ ID NO: 566238 - RNA, 64 nt, hsa; identical to SEQ ID NO: 44766

SEQ ID NO: 566239 - RNA, 64 nt, hsa; identical to SEQ ID NO: 44767

SEQ ID NO: 566240 - RNA, 64 nt, hsa; identical to SEQ ID NO: 44768

SEQ ID NO: 566241 - RNA, 64 nt, hsa; identical to SEQ ID NO: 44769

SEQ ID NO: 566242 - RNA, 64 nt, hsa; identical to SEQ ID NO: 44770

SEQ ID NO: 566243 - RNA, 64 nt, hsa; identical to SEQ ID NO: 44771

SEQ ID NO: 566244 - RNA, 64 nt, hsa; identical to SEQ ID NO: 44772

SEQ ID NO: 566245 - RNA, 64 nt, hsa; identical to SEQ ID NO: 44773

SEQ ID NO: 566246 - RNA, 64 nt, hsa; identical to SEQ ID NO: 44774

SEQ ID NO: 566247 - RNA, 64 nt, hsa; identical to SEQ ID NO: 44775

SEQ ID NO: 566248 - RNA, 64 nt, hsa; identical to SEQ ID NO: 44776

SEQ ID NO: 566249 - RNA, 57 nt, hsa; identical to SEQ ID NO: 44777

SEQ ID NO: 566250 - RNA, 64 nt, hsa; identical to SEQ ID NO: 44778

SEQ ID NO: 566251 - RNA, 64 nt, hsa; identical to SEQ ID NO: 44779

SEQ ID NO: 566252 - RNA, 64 nt, hsa; identical to SEQ ID NO: 44780

SEQ ID NO: 566253 - RNA, 64 nt, hsa; identical to SEQ ID NO: 44781

SEQ ID NO: 566254 - RNA, 64 nt, hsa; identical to SEQ ID NO: 44782

SEQ ID NO: 566255 - RNA, 64 nt, hsa; identical to SEQ ID NO: 44783

SEQ ID NO: 566256 - RNA, 64 nt, hsa; identical to SEQ ID NO: 44784

SEQ ID NO: 566257 - RNA, 64 nt, hsa; identical to SEQ ID NO: 44785

SEQ ID NO: 566258 - RNA, 64 nt, hsa; identical to SEQ ID NO: 44786

SEQ ID NO: 566259 - RNA, 64 nt, hsa; identical to SEQ ID NO: 44773

SEQ ID NO: 566260 - RNA, 64 nt, hsa; identical to SEQ ID NO: 44788

SEQ ID NO: 566261 - RNA, 64 nt, hsa
cuagauauuaaugucaaucauuuaagauuaaugggcaugcaauuaagucuccauuuaagauuaa

SEQ ID NO: 566262 - RNA, 64 nt, hsa
ggcaugcaauuaagucuccauuuaagauuaaugggcaugcaaugaagucuccagcagacaauca

SEQ ID NO: 566263 - RNA, 64 nt, hsa
aauaugauuucauaaauguaaaaugcacagaaaugcaugcaauacuuauaagacuuaaaaauug

SEQ ID NO: 566264 - RNA, 64 nt, hsa
aauuuuucugucuauuaaaugggacaaguguaaagcaugcaaaaguuagagaucuguuauauaa

SEQ ID NO: 566265 - RNA, 64 nt, hsa; identical to SEQ ID NO: 45110

SEQ ID NO: 566266 - RNA, 64 nt, hsa; identical to SEQ ID NO: 45111

SEQ ID NO: 566267 - RNA, 64 nt, hsa; identical to SEQ ID NO: 45112

SEQ ID NO: 566268 - RNA, 64 nt, hsa; identical to SEQ ID NO: 45113

SEQ ID NO: 566269 - RNA, 59 nt, hsa; identical to SEQ ID NO: 45114

SEQ ID NO: 566270 - RNA, 64 nt, hsa; identical to SEQ ID NO: 45115

SEQ ID NO: 566271 - RNA, 64 nt, hsa; identical to SEQ ID NO: 45116

SEQ ID NO: 566272 - RNA, 64 nt, hsa; identical to SEQ ID NO: 45117

SEQ ID NO: 566273 - RNA, 64 nt, hsa; identical to SEQ ID NO: 45118

SEQ ID NO: 566274 - RNA, 64 nt, hsa; identical to SEQ ID NO: 45119

SEQ ID NO: 566275 - RNA, 64 nt, hsa; identical to SEQ ID NO: 45120

SEQ ID NO: 566276 - RNA, 64 nt, hsa; identical to SEQ ID NO: 45121

SEQ ID NO: 566277 - RNA, 64 nt, hsa; identical to SEQ ID NO: 45122

SEQ ID NO: 566278 - RNA, 64 nt, hsa; identical to SEQ ID NO: 45123

SEQ ID NO: 566279 - RNA, 64 nt, hsa; identical to SEQ ID NO: 45124

SEQ ID NO: 566280 - RNA, 64 nt, hsa; identical to SEQ ID NO: 45125

SEQ ID NO: 566281 - RNA, 64 nt, hsa; identical to SEQ ID NO: 45126

SEQ ID NO: 566282 - RNA, 64 nt, hsa; identical to SEQ ID NO: 45127

SEQ ID NO: 566283 - RNA, 64 nt, hsa; identical to SEQ ID NO: 45128

SEQ ID NO: 566284 - RNA, 64 nt, hsa; identical to SEQ ID NO: 45129

SEQ ID NO: 566285 - RNA, 64 nt, hsa; identical to SEQ ID NO: 45130

SEQ ID NO: 566286 - RNA, 64 nt, hsa; identical to SEQ ID NO: 45131

SEQ ID NO: 566287 - RNA, 64 nt, hsa; identical to SEQ ID NO: 45132

SEQ ID NO: 566288 - RNA, 64 nt, hsa; identical to SEQ ID NO: 45133

SEQ ID NO: 566289 - RNA, 64 nt, hsa; identical to SEQ ID NO: 45134

SEQ ID NO: 566290 - RNA, 64 nt, hsa; identical to SEQ ID NO: 45135

SEQ ID NO: 566291 - RNA, 64 nt, hsa; identical to SEQ ID NO: 45136

SEQ ID NO: 566292 - RNA, 64 nt, hsa; identical to SEQ ID NO: 45137

SEQ ID NO: 566293 - RNA, 64 nt, hsa; identical to SEQ ID NO: 45138

SEQ ID NO: 566294 - RNA, 64 nt, hsa; identical to SEQ ID NO: 45139

SEQ ID NO: 566295 - RNA, 64 nt, hsa; identical to SEQ ID NO: 45140

SEQ ID NO: 566296 - RNA, 64 nt, hsa; identical to SEQ ID NO: 45141

SEQ ID NO: 566297 - RNA, 64 nt, hsa; identical to SEQ ID NO: 45142

SEQ ID NO: 566298 - RNA, 64 nt, hsa; identical to SEQ ID NO: 45143

SEQ ID NO: 566299 - RNA, 64 nt, hsa; identical to SEQ ID NO: 45144

SEQ ID NO: 566300 - RNA, 64 nt, hsa; identical to SEQ ID NO: 45145

SEQ ID NO: 566301 - RNA, 64 nt, hsa; identical to SEQ ID NO: 45146

SEQ ID NO: 566302 - RNA, 64 nt, hsa; identical to SEQ ID NO: 45147

SEQ ID NO: 566303 - RNA, 64 nt, hsa; identical to SEQ ID NO: 45148

SEQ ID NO: 566304 - RNA, 64 nt, hsa; identical to SEQ ID NO: 45149

SEQ ID NO: 566305 - RNA, 64 nt, hsa; identical to SEQ ID NO: 45150

SEQ ID NO: 566306 - RNA, 64 nt, hsa; identical to SEQ ID NO: 45151

SEQ ID NO: 566307 - RNA, 64 nt, hsa; identical to SEQ ID NO: 45152

SEQ ID NO: 566308 - RNA, 64 nt, hsa; identical to SEQ ID NO: 45153

SEQ ID NO: 566309 - RNA, 64 nt, hsa; identical to SEQ ID NO: 45154

SEQ ID NO: 566310 - RNA, 64 nt, hsa; identical to SEQ ID NO: 45155

SEQ ID NO: 566311 - RNA, 64 nt, hsa; identical to SEQ ID NO: 45156

SEQ ID NO: 566312 - RNA, 64 nt, hsa; identical to SEQ ID NO: 45157

SEQ ID NO: 566313 - RNA, 64 nt, hsa; identical to SEQ ID NO: 45158

SEQ ID NO: 566314 - RNA, 64 nt, hsa; identical to SEQ ID NO: 45159

SEQ ID NO: 566315 - RNA, 64 nt, hsa; identical to SEQ ID NO: 45160

SEQ ID NO: 566316 - RNA, 64 nt, hsa; identical to SEQ ID NO: 45161

SEQ ID NO: 566317 - RNA, 64 nt, hsa; identical to SEQ ID NO: 45162

SEQ ID NO: 566318 - RNA, 64 nt, hsa; identical to SEQ ID NO: 45163

SEQ ID NO: 566319 - RNA, 64 nt, hsa; identical to SEQ ID NO: 45164

SEQ ID NO: 566320 - RNA, 64 nt, hsa; identical to SEQ ID NO: 45165

SEQ ID NO: 566321 - RNA, 64 nt, hsa; identical to SEQ ID NO: 45166

SEQ ID NO: 566322 - RNA, 64 nt, hsa; identical to SEQ ID NO: 45167

SEQ ID NO: 566323 - RNA, 64 nt, hsa; identical to SEQ ID NO: 45168

SEQ ID NO: 566324 - RNA, 64 nt, hsa; identical to SEQ ID NO: 45169

SEQ ID NO: 566325 - RNA, 64 nt, hsa; identical to SEQ ID NO: 45170

SEQ ID NO: 566326 - RNA, 64 nt, hsa; identical to SEQ ID NO: 45171

SEQ ID NO: 566327 - RNA, 64 nt, hsa; identical to SEQ ID NO: 45172

SEQ ID NO: 566328 - RNA, 64 nt, hsa; identical to SEQ ID NO: 45173

SEQ ID NO: 566329 - RNA, 64 nt, hsa; identical to SEQ ID NO: 45174

SEQ ID NO: 566330 - RNA, 64 nt, hsa; identical to SEQ ID NO: 45175

SEQ ID NO: 566331 - RNA, 64 nt, hsa; identical to SEQ ID NO: 45176

SEQ ID NO: 566332 - RNA, 64 nt, hsa; identical to SEQ ID NO: 45177

SEQ ID NO: 566333 - RNA, 64 nt, hsa; identical to SEQ ID NO: 45178

SEQ ID NO: 566334 - RNA, 64 nt, hsa; identical to SEQ ID NO: 45179

SEQ ID NO: 566335 - RNA, 64 nt, hsa; identical to SEQ ID NO: 45180

SEQ ID NO: 566336 - RNA, 64 nt, hsa; identical to SEQ ID NO: 45181

SEQ ID NO: 566337 - RNA, 64 nt, hsa; identical to SEQ ID NO: 45182

SEQ ID NO: 566338 - RNA, 64 nt, hsa; identical to SEQ ID NO: 45183

SEQ ID NO: 566339 - RNA, 64 nt, hsa; identical to SEQ ID NO: 45184

SEQ ID NO: 566340 - RNA, 64 nt, hsa; identical to SEQ ID NO: 45185

SEQ ID NO: 566341 - RNA, 64 nt, hsa; identical to SEQ ID NO: 45186

SEQ ID NO: 566342 - RNA, 64 nt, hsa; identical to SEQ ID NO: 45187

SEQ ID NO: 566343 - RNA, 64 nt, hsa; identical to SEQ ID NO: 45188

SEQ ID NO: 566344 - RNA, 64 nt, hsa; identical to SEQ ID NO: 45189

SEQ ID NO: 566345 - RNA, 64 nt, hsa; identical to SEQ ID NO: 45190

SEQ ID NO: 566346 - RNA, 64 nt, hsa; identical to SEQ ID NO: 45191

SEQ ID NO: 566347 - RNA, 64 nt, hsa; identical to SEQ ID NO: 45192

SEQ ID NO: 566348 - RNA, 64 nt, hsa; identical to SEQ ID NO: 45193

SEQ ID NO: 566349 - RNA, 64 nt, hsa; identical to SEQ ID NO: 45194

SEQ ID NO: 566350 - RNA, 64 nt, hsa; identical to SEQ ID NO: 45195

SEQ ID NO: 566351 - RNA, 64 nt, hsa; identical to SEQ ID NO: 45196

SEQ ID NO: 566352 - RNA, 64 nt, hsa
acaugccauuaauaaaacccaagaucuuuuaaaucaaaaccauucagcaaaugcuguaagaccu

SEQ ID NO: 566353 - RNA, 64 nt, hsa
ugauguaaaucuucauagugucagacauacugaccaaaaccacaaucuagacuacaaaguauau

SEQ ID NO: 566354 - RNA, 64 nt, hsa
aaugggaaacagaagccuaaguuauuuaccuuaucaaaaccacguuccuuggaaccacauuauu

SEQ ID NO: 566355 - RNA, 64 nt, hsa
aaauauuuugugacuuuaauugguaaauauguuacaaaaccaaguacuuaaucuuuuacaucau

SEQ ID NO: 566356 - RNA, 64 nt, hsa
uuuuuuuucaagaacccuuggauuuaugugaggucaaaaccaaacucuuauucucaguggaaaa

SEQ ID NO: 566357 - RNA, 64 nt, hsa
aaagguguuuugccagagagauaaaauuuuugcucaaaaccagaaaaagaauuguaauggcuac

SEQ ID NO: 566358 - RNA, 64 nt, hsa
guguuacaguacacuuguagccaaaacuggaagacaaaaccaauauauaauuuggcugcugauu

SEQ ID NO: 566359 - RNA, 64 nt, hsa
guugcgcuaccuaacaguaccaucuuggauccuucaaaaccaaagacuugccccagcacugcug

SEQ ID NO: 566360 - RNA, 64 nt, hsa
ccaguaaggcccagugaucccauuaucccaggggcaaaaccaccuguccccuuuugagcugcca

SEQ ID NO: 566361 - RNA, 64 nt, hsa
uguugaaaacaaacaaaaagaagaaaacacucaacaaaaccaaucuacauguuuuggacuaaaa

SEQ ID NO: 566362 - RNA, 64 nt, hsa
gagacauccagacuuguauauuucaguggaaauacaaaaccacuucagagaccaggguaucucc

SEQ ID NO: 566363 - RNA, 64 nt, hsa
agaagcaaccuggagaacagcuaucaaucauauucaaaaccaguacaagaacugcugccuggua

SEQ ID NO: 566364 - RNA, 64 nt, hsa
uccugaccucaggugauccaccgccuaggccucccaaaaccauuagggcucagaggaagguauc

SEQ ID NO: 566365 - RNA, 63 nt, hsa
cugauagucuagcagguaauuaaacuuauauguccaaaaccauauucuucccugucucuucaa

SEQ ID NO: 566366 - RNA, 64 nt, hsa
uccguucugggcggugguucucgagccugccauucaaaaccaaagcaaauuggagcauuucuca

SEQ ID NO: 566367 - RNA, 64 nt, hsa
uuauguuuaacauagaaaaugaaugcguuuaaaacaaaaccacuuucugcauuuaaccaguccu

SEQ ID NO: 566368 - RNA, 64 nt, hsa
aauguuucagugaaaacuuuggagacaguuuuaacaaaaccaauaaaccaacaacaaaaaaagu

SEQ ID NO: 566369 - RNA, 64 nt, hsa
aaaaaaaagaaaacagaaaaaaauucagacccugcaaaaccacauuccccauuuuaacgggcgu

SEQ ID NO: 566370 - RNA, 64 nt, hsa
aguggcuauaguuacugauuuuuuauuauguaagcaaaaccaauaaaaauuuaaguuuuuuuaa

SEQ ID NO: 566371 - RNA, 64 nt, hsa
uaaguaagaaacaauuauaauuucuuuacauacucaaaaccaagauagaaaaaggugcuaucgu

SEQ ID NO: 566372 - RNA, 64 nt, hsa
gggggauacaaccguuuugcuccauacuaaaugacaaaaccauaaaaaccuuccaaugugggga

SEQ ID NO: 566373 - RNA, 64 nt, hsa
ccugccaauccgcuguaacaacucugcuuuaaaacaaaaccaaacaaaacuuuaaaaaaaaaug

SEQ ID NO: 566374 - RNA, 64 nt, hsa
gucuccugcagugccauucugccuucucaaugagcaaaaccauuuucuaaguaugaggauauua

SEQ ID NO: 566375 - RNA, 64 nt, hsa
agucauguaauucaaucauguuuaauaugucagucaaaaccaaauucagaauuguuuuguguac

SEQ ID NO: 566376 - RNA, 64 nt, hsa
ccacugaggaaggaaauguucauuuucauuuguccaaaaccaccuuaaguuuuaaguauauuaa

SEQ ID NO: 566377 - RNA, 64 nt, hsa
uuugaaaauaaucuauuuguagcuucucuucuaucaaaaccaacacauccucuucuuucugcca

SEQ ID NO: 566378 - RNA, 64 nt, hsa
cauuuuaaaaagaaaaacagaaaaagguuaaucacaaaaccaacccucacuucacagggucugu

SEQ ID NO: 566379 - RNA, 64 nt, hsa
uccucucucugacgggguggcauuuggccuugaacaaaaccaaguccacuggggacagaggcag

SEQ ID NO: 566380 - RNA, 64 nt, hsa
acacagguggagcugacccucgucuuuguggcagcaaaaccaggaugccuggagcuguggccug

SEQ ID NO: 566381 - RNA, 64 nt, hsa
gcacuuuauuuucgucaaguuucaagucugaguucaaaaccagcccugaucccuuaugaccaac

SEQ ID NO: 566382 - RNA, 64 nt, hsa
auaggauuuuuucuuuuuuaguaaaaaccgguaucaaaaccaaaauuauaggauuuuuuucuuu

SEQ ID NO: 566383 - RNA, 64 nt, hsa
uuuuuucaacaucuaaaauuuuuguuuuagccuucaaaaccaacuuaccaaccucaguccagcu

SEQ ID NO: 566384 - RNA, 64 nt, hsa
gaaggaaaucaggcauuccuauuucuuuaaauaacaaaaccacuaauugccacucaaugcugga

SEQ ID NO: 566385 - RNA, 64 nt, hsa; identical to SEQ ID NO: 522646

SEQ ID NO: 566386 - RNA, 64 nt, hsa; identical to SEQ ID NO: 522647

SEQ ID NO: 566387 - RNA, 64 nt, hsa; identical to SEQ ID NO: 522648

SEQ ID NO: 566388 - RNA, 64 nt, hsa; identical to SEQ ID NO: 522649

SEQ ID NO: 566389 - RNA, 64 nt, hsa; identical to SEQ ID NO: 522650

SEQ ID NO: 566390 - RNA, 64 nt, hsa; identical to SEQ ID NO: 522651

SEQ ID NO: 566391 - RNA, 64 nt, hsa; identical to SEQ ID NO: 522652

SEQ ID NO: 566392 - RNA, 64 nt, hsa; identical to SEQ ID NO: 522653

SEQ ID NO: 566393 - RNA, 64 nt, hsa; identical to SEQ ID NO: 522654

SEQ ID NO: 566394 - RNA, 64 nt, hsa; identical to SEQ ID NO: 522655

SEQ ID NO: 566395 - RNA, 64 nt, hsa; identical to SEQ ID NO: 522656

SEQ ID NO: 566396 - RNA, 64 nt, hsa; identical to SEQ ID NO: 522657

SEQ ID NO: 566397 - RNA, 64 nt, hsa; identical to SEQ ID NO: 522658

SEQ ID NO: 566398 - RNA, 64 nt, hsa; identical to SEQ ID NO: 522659

SEQ ID NO: 566399 - RNA, 64 nt, hsa; identical to SEQ ID NO: 522660

SEQ ID NO: 566400 - RNA, 64 nt, hsa; identical to SEQ ID NO: 522661

SEQ ID NO: 566401 - RNA, 64 nt, hsa; identical to SEQ ID NO: 169676

SEQ ID NO: 566402 - RNA, 64 nt, hsa; identical to SEQ ID NO: 169677

SEQ ID NO: 566403 - RNA, 64 nt, hsa; identical to SEQ ID NO: 169678

SEQ ID NO: 566404 - RNA, 64 nt, hsa; identical to SEQ ID NO: 169679

SEQ ID NO: 566405 - RNA, 64 nt, hsa; identical to SEQ ID NO: 169680

SEQ ID NO: 566406 - RNA, 64 nt, hsa; identical to SEQ ID NO: 169681

SEQ ID NO: 566407 - RNA, 64 nt, hsa; identical to SEQ ID NO: 169682

SEQ ID NO: 566408 - RNA, 64 nt, hsa; identical to SEQ ID NO: 169683

SEQ ID NO: 566409 - RNA, 64 nt, hsa; identical to SEQ ID NO: 169684

SEQ ID NO: 566410 - RNA, 64 nt, hsa; identical to SEQ ID NO: 169685

SEQ ID NO: 566411 - RNA, 64 nt, hsa; identical to SEQ ID NO: 169686

SEQ ID NO: 566412 - RNA, 64 nt, hsa; identical to SEQ ID NO: 169687

SEQ ID NO: 566413 - RNA, 64 nt, hsa; identical to SEQ ID NO: 169688

SEQ ID NO: 566414 - RNA, 64 nt, hsa; identical to SEQ ID NO: 169689

SEQ ID NO: 566415 - RNA, 64 nt, hsa; identical to SEQ ID NO: 169690

SEQ ID NO: 566416 - RNA, 64 nt, hsa; identical to SEQ ID NO: 169691

SEQ ID NO: 566417 - RNA, 64 nt, hsa; identical to SEQ ID NO: 169692

SEQ ID NO: 566418 - RNA, 64 nt, hsa; identical to SEQ ID NO: 169693

SEQ ID NO: 566419 - RNA, 64 nt, hsa; identical to SEQ ID NO: 169694

SEQ ID NO: 566420 - RNA, 64 nt, hsa; identical to SEQ ID NO: 169695

SEQ ID NO: 566421 - RNA, 64 nt, hsa; identical to SEQ ID NO: 169696

SEQ ID NO: 566422 - RNA, 64 nt, hsa; identical to SEQ ID NO: 169697

SEQ ID NO: 566423 - RNA, 64 nt, hsa; identical to SEQ ID NO: 169698

SEQ ID NO: 566424 - RNA, 64 nt, hsa; identical to SEQ ID NO: 169699

SEQ ID NO: 566425 - RNA, 64 nt, hsa; identical to SEQ ID NO: 169700

SEQ ID NO: 566426 - RNA, 64 nt, hsa; identical to SEQ ID NO: 169701

SEQ ID NO: 566427 - RNA, 64 nt, hsa; identical to SEQ ID NO: 169702

SEQ ID NO: 566428 - RNA, 64 nt, hsa; identical to SEQ ID NO: 169703

SEQ ID NO: 566429 - RNA, 64 nt, hsa; identical to SEQ ID NO: 169704

SEQ ID NO: 566430 - RNA, 64 nt, hsa; identical to SEQ ID NO: 169705

SEQ ID NO: 566431 - RNA, 64 nt, hsa; identical to SEQ ID NO: 169706

SEQ ID NO: 566432 - RNA, 64 nt, hsa; identical to SEQ ID NO: 169707

SEQ ID NO: 566433 - RNA, 64 nt, hsa; identical to SEQ ID NO: 169708

SEQ ID NO: 566434 - RNA, 64 nt, hsa; identical to SEQ ID NO: 169709

SEQ ID NO: 566435 - RNA, 64 nt, hsa; identical to SEQ ID NO: 169710

SEQ ID NO: 566436 - RNA, 64 nt, hsa; identical to SEQ ID NO: 169711

SEQ ID NO: 566437 - RNA, 64 nt, hsa; identical to SEQ ID NO: 169712

SEQ ID NO: 566438 - RNA, 64 nt, hsa; identical to SEQ ID NO: 169713

SEQ ID NO: 566439 - RNA, 64 nt, hsa; identical to SEQ ID NO: 169714

SEQ ID NO: 566440 - RNA, 64 nt, hsa; identical to SEQ ID NO: 169715

SEQ ID NO: 566441 - RNA, 64 nt, hsa; identical to SEQ ID NO: 169716

SEQ ID NO: 566442 - RNA, 64 nt, hsa; identical to SEQ ID NO: 169717

SEQ ID NO: 566443 - RNA, 64 nt, hsa; identical to SEQ ID NO: 169718

SEQ ID NO: 566444 - RNA, 64 nt, hsa; identical to SEQ ID NO: 169719

SEQ ID NO: 566445 - RNA, 64 nt, hsa; identical to SEQ ID NO: 169720

SEQ ID NO: 566446 - RNA, 62 nt, hsa; identical to SEQ ID NO: 169721

SEQ ID NO: 566447 - RNA, 64 nt, hsa; identical to SEQ ID NO: 169722

SEQ ID NO: 566448 - RNA, 64 nt, hsa; identical to SEQ ID NO: 169723

SEQ ID NO: 566449 - RNA, 64 nt, hsa; identical to SEQ ID NO: 169724

SEQ ID NO: 566450 - RNA, 64 nt, hsa; identical to SEQ ID NO: 169725

SEQ ID NO: 566451 - RNA, 64 nt, hsa; identical to SEQ ID NO: 169726

SEQ ID NO: 566452 - RNA, 64 nt, hsa; identical to SEQ ID NO: 169727

SEQ ID NO: 566453 - RNA, 64 nt, hsa; identical to SEQ ID NO: 169728

SEQ ID NO: 566454 - RNA, 64 nt, hsa; identical to SEQ ID NO: 169729

SEQ ID NO: 566455 - RNA, 64 nt, hsa; identical to SEQ ID NO: 169730

SEQ ID NO: 566456 - RNA, 64 nt, hsa; identical to SEQ ID NO: 169731

SEQ ID NO: 566457 - RNA, 64 nt, hsa; identical to SEQ ID NO: 169732

SEQ ID NO: 566458 - RNA, 64 nt, hsa; identical to SEQ ID NO: 169733

SEQ ID NO: 566459 - RNA, 64 nt, hsa; identical to SEQ ID NO: 169734

SEQ ID NO: 566460 - RNA, 64 nt, hsa; identical to SEQ ID NO: 369644

SEQ ID NO: 566461 - RNA, 64 nt, hsa; identical to SEQ ID NO: 369645

SEQ ID NO: 566462 - RNA, 64 nt, hsa; identical to SEQ ID NO: 369646

SEQ ID NO: 566463 - RNA, 64 nt, hsa; identical to SEQ ID NO: 369647

SEQ ID NO: 566464 - RNA, 64 nt, hsa; identical to SEQ ID NO: 369648

SEQ ID NO: 566465 - RNA, 64 nt, hsa; identical to SEQ ID NO: 369649

SEQ ID NO: 566466 - RNA, 64 nt, hsa; identical to SEQ ID NO: 369650

SEQ ID NO: 566467 - RNA, 64 nt, hsa; identical to SEQ ID NO: 369651

SEQ ID NO: 566468 - RNA, 64 nt, hsa; identical to SEQ ID NO: 390131

SEQ ID NO: 566469 - RNA, 64 nt, hsa; identical to SEQ ID NO: 390132

SEQ ID NO: 566470 - RNA, 64 nt, hsa; identical to SEQ ID NO: 390133

SEQ ID NO: 566471 - RNA, 64 nt, hsa; identical to SEQ ID NO: 390134

SEQ ID NO: 566472 - RNA, 64 nt, hsa; identical to SEQ ID NO: 390135

SEQ ID NO: 566473 - RNA, 64 nt, hsa; identical to SEQ ID NO: 390136

SEQ ID NO: 566474 - RNA, 64 nt, hsa; identical to SEQ ID NO: 390137

SEQ ID NO: 566475 - RNA, 64 nt, hsa; identical to SEQ ID NO: 390138

SEQ ID NO: 566476 - RNA, 64 nt, hsa; identical to SEQ ID NO: 390139

SEQ ID NO: 566477 - RNA, 64 nt, hsa; identical to SEQ ID NO: 390140

SEQ ID NO: 566478 - RNA, 64 nt, hsa; identical to SEQ ID NO: 390141

SEQ ID NO: 566479 - RNA, 64 nt, hsa; identical to SEQ ID NO: 390142

SEQ ID NO: 566480 - RNA, 64 nt, hsa; identical to SEQ ID NO: 390143

SEQ ID NO: 566481 - RNA, 57 nt, hsa; identical to SEQ ID NO: 390144

SEQ ID NO: 566482 - RNA, 64 nt, hsa; identical to SEQ ID NO: 390145

SEQ ID NO: 566483 - RNA, 64 nt, hsa; identical to SEQ ID NO: 390146

SEQ ID NO: 566484 - RNA, 64 nt, hsa; identical to SEQ ID NO: 390147

SEQ ID NO: 566485 - RNA, 64 nt, hsa; identical to SEQ ID NO: 390148

SEQ ID NO: 566486 - RNA, 64 nt, hsa; identical to SEQ ID NO: 390149

SEQ ID NO: 566487 - RNA, 64 nt, hsa; identical to SEQ ID NO: 390150

SEQ ID NO: 566488 - RNA, 64 nt, hsa; identical to SEQ ID NO: 390151

SEQ ID NO: 566489 - RNA, 64 nt, hsa; identical to SEQ ID NO: 390152

SEQ ID NO: 566490 - RNA, 64 nt, hsa; identical to SEQ ID NO: 390153

SEQ ID NO: 566491 - RNA, 64 nt, hsa; identical to SEQ ID NO: 390154

SEQ ID NO: 566492 - RNA, 64 nt, hsa; identical to SEQ ID NO: 390155

SEQ ID NO: 566493 - RNA, 64 nt, hsa; identical to SEQ ID NO: 390156

SEQ ID NO: 566494 - RNA, 64 nt, hsa; identical to SEQ ID NO: 390157

SEQ ID NO: 566495 - RNA, 64 nt, hsa; identical to SEQ ID NO: 390158

SEQ ID NO: 566496 - RNA, 64 nt, hsa; identical to SEQ ID NO: 390159

SEQ ID NO: 566497 - RNA, 64 nt, hsa; identical to SEQ ID NO: 390160

SEQ ID NO: 566498 - RNA, 64 nt, hsa; identical to SEQ ID NO: 390161

SEQ ID NO: 566499 - RNA, 64 nt, hsa; identical to SEQ ID NO: 390162

SEQ ID NO: 566500 - RNA, 64 nt, hsa; identical to SEQ ID NO: 390163

SEQ ID NO: 566501 - RNA, 64 nt, hsa; identical to SEQ ID NO: 390164

SEQ ID NO: 566502 - RNA, 64 nt, hsa; identical to SEQ ID NO: 390165

SEQ ID NO: 566503 - RNA, 64 nt, hsa; identical to SEQ ID NO: 390166

SEQ ID NO: 566504 - RNA, 64 nt, hsa; identical to SEQ ID NO: 390167

SEQ ID NO: 566505 - RNA, 64 nt, hsa; identical to SEQ ID NO: 390168

SEQ ID NO: 566506 - RNA, 64 nt, hsa; identical to SEQ ID NO: 390169

SEQ ID NO: 566507 - RNA, 64 nt, hsa; identical to SEQ ID NO: 390170

SEQ ID NO: 566508 - RNA, 64 nt, hsa; identical to SEQ ID NO: 390171

SEQ ID NO: 566509 - RNA, 64 nt, hsa; identical to SEQ ID NO: 390172

SEQ ID NO: 566510 - RNA, 64 nt, hsa; identical to SEQ ID NO: 390173

SEQ ID NO: 566511 - RNA, 64 nt, hsa; identical to SEQ ID NO: 390174

SEQ ID NO: 566512 - RNA, 64 nt, hsa; identical to SEQ ID NO: 390175

SEQ ID NO: 566513 - RNA, 64 nt, hsa; identical to SEQ ID NO: 390176

SEQ ID NO: 566514 - RNA, 64 nt, hsa; identical to SEQ ID NO: 390177

SEQ ID NO: 566515 - RNA, 64 nt, hsa; identical to SEQ ID NO: 390178

SEQ ID NO: 566516 - RNA, 64 nt, hsa; identical to SEQ ID NO: 390179

SEQ ID NO: 566517 - RNA, 64 nt, hsa; identical to SEQ ID NO: 390180

SEQ ID NO: 566518 - RNA, 64 nt, hsa; identical to SEQ ID NO: 390181

SEQ ID NO: 566519 - RNA, 64 nt, hsa; identical to SEQ ID NO: 390182

SEQ ID NO: 566520 - RNA, 64 nt, hsa; identical to SEQ ID NO: 390183

SEQ ID NO: 566521 - RNA, 64 nt, hsa; identical to SEQ ID NO: 390184

SEQ ID NO: 566522 - RNA, 64 nt, hsa; identical to SEQ ID NO: 390185

SEQ ID NO: 566523 - RNA, 64 nt, hsa; identical to SEQ ID NO: 390186

SEQ ID NO: 566524 - RNA, 64 nt, hsa; identical to SEQ ID NO: 390187

SEQ ID NO: 566525 - RNA, 64 nt, hsa; identical to SEQ ID NO: 390188

SEQ ID NO: 566526 - RNA, 64 nt, hsa; identical to SEQ ID NO: 390189

SEQ ID NO: 566527 - RNA, 64 nt, hsa; identical to SEQ ID NO: 390190

SEQ ID NO: 566528 - RNA, 64 nt, hsa; identical to SEQ ID NO: 390191

SEQ ID NO: 566529 - RNA, 64 nt, hsa; identical to SEQ ID NO: 390192

SEQ ID NO: 566530 - RNA, 64 nt, hsa; identical to SEQ ID NO: 390193

SEQ ID NO: 566531 - RNA, 64 nt, hsa; identical to SEQ ID NO: 390194

SEQ ID NO: 566532 - RNA, 64 nt, hsa; identical to SEQ ID NO: 390195

SEQ ID NO: 566533 - RNA, 64 nt, hsa; identical to SEQ ID NO: 390196

SEQ ID NO: 566534 - RNA, 64 nt, hsa; identical to SEQ ID NO: 390197

SEQ ID NO: 566535 - RNA, 64 nt, hsa; identical to SEQ ID NO: 390198

SEQ ID NO: 566536 - RNA, 64 nt, hsa; identical to SEQ ID NO: 390199

SEQ ID NO: 566537 - RNA, 64 nt, hsa; identical to SEQ ID NO: 390200

SEQ ID NO: 566538 - RNA, 64 nt, hsa; identical to SEQ ID NO: 390201

SEQ ID NO: 566539 - RNA, 64 nt, hsa; identical to SEQ ID NO: 390202

SEQ ID NO: 566540 - RNA, 64 nt, hsa; identical to SEQ ID NO: 390203

SEQ ID NO: 566541 - RNA, 64 nt, hsa; identical to SEQ ID NO: 390204

SEQ ID NO: 566542 - RNA, 60 nt, hsa; identical to SEQ ID NO: 390205

SEQ ID NO: 566543 - RNA, 64 nt, hsa; identical to SEQ ID NO: 390206

SEQ ID NO: 566544 - RNA, 64 nt, hsa; identical to SEQ ID NO: 390207

SEQ ID NO: 566545 - RNA, 64 nt, hsa; identical to SEQ ID NO: 390208

SEQ ID NO: 566546 - RNA, 64 nt, hsa; identical to SEQ ID NO: 390209

SEQ ID NO: 566547 - RNA, 64 nt, hsa; identical to SEQ ID NO: 390210

SEQ ID NO: 566548 - RNA, 64 nt, hsa; identical to SEQ ID NO: 390211

SEQ ID NO: 566549 - RNA, 64 nt, hsa; identical to SEQ ID NO: 390212

SEQ ID NO: 566550 - RNA, 64 nt, hsa; identical to SEQ ID NO: 390213

SEQ ID NO: 566551 - RNA, 64 nt, hsa; identical to SEQ ID NO: 390214

SEQ ID NO: 566552 - RNA, 64 nt, hsa; identical to SEQ ID NO: 390215

SEQ ID NO: 566553 - RNA, 64 nt, hsa; identical to SEQ ID NO: 390216

SEQ ID NO: 566554 - RNA, 64 nt, hsa; identical to SEQ ID NO: 390217

SEQ ID NO: 566555 - RNA, 64 nt, hsa; identical to SEQ ID NO: 390218

SEQ ID NO: 566556 - RNA, 64 nt, hsa; identical to SEQ ID NO: 390219

SEQ ID NO: 566557 - RNA, 64 nt, hsa; identical to SEQ ID NO: 390220

SEQ ID NO: 566558 - RNA, 64 nt, hsa; identical to SEQ ID NO: 390221

SEQ ID NO: 566559 - RNA, 64 nt, hsa; identical to SEQ ID NO: 390222

SEQ ID NO: 566560 - RNA, 64 nt, hsa; identical to SEQ ID NO: 390223

SEQ ID NO: 566561 - RNA, 64 nt, hsa; identical to SEQ ID NO: 390224

SEQ ID NO: 566562 - RNA, 64 nt, hsa; identical to SEQ ID NO: 390225

SEQ ID NO: 566563 - RNA, 64 nt, hsa; identical to SEQ ID NO: 390226

SEQ ID NO: 566564 - RNA, 64 nt, hsa; identical to SEQ ID NO: 390227

SEQ ID NO: 566565 - RNA, 64 nt, hsa; identical to SEQ ID NO: 390228

SEQ ID NO: 566566 - RNA, 64 nt, hsa; identical to SEQ ID NO: 390229

SEQ ID NO: 566567 - RNA, 64 nt, hsa; identical to SEQ ID NO: 390230

SEQ ID NO: 566568 - RNA, 64 nt, hsa; identical to SEQ ID NO: 390231

SEQ ID NO: 566569 - RNA, 64 nt, hsa; identical to SEQ ID NO: 390232

SEQ ID NO: 566570 - RNA, 64 nt, hsa; identical to SEQ ID NO: 390233

SEQ ID NO: 566571 - RNA, 64 nt, hsa; identical to SEQ ID NO: 390234

SEQ ID NO: 566572 - RNA, 64 nt, hsa; identical to SEQ ID NO: 390235

SEQ ID NO: 566573 - RNA, 64 nt, hsa; identical to SEQ ID NO: 390236

SEQ ID NO: 566574 - RNA, 64 nt, hsa; identical to SEQ ID NO: 390237

SEQ ID NO: 566575 - RNA, 64 nt, hsa; identical to SEQ ID NO: 390238

SEQ ID NO: 566576 - RNA, 64 nt, hsa; identical to SEQ ID NO: 390239

SEQ ID NO: 566577 - RNA, 64 nt, hsa; identical to SEQ ID NO: 390240

SEQ ID NO: 566578 - RNA, 64 nt, hsa; identical to SEQ ID NO: 390241

SEQ ID NO: 566579 - RNA, 64 nt, hsa; identical to SEQ ID NO: 390242

SEQ ID NO: 566580 - RNA, 64 nt, hsa; identical to SEQ ID NO: 390243

SEQ ID NO: 566581 - RNA, 64 nt, hsa; identical to SEQ ID NO: 390244

SEQ ID NO: 566582 - RNA, 64 nt, hsa; identical to SEQ ID NO: 390245

SEQ ID NO: 566583 - RNA, 64 nt, hsa; identical to SEQ ID NO: 390246

SEQ ID NO: 566584 - RNA, 64 nt, hsa; identical to SEQ ID NO: 390247

SEQ ID NO: 566585 - RNA, 64 nt, hsa; identical to SEQ ID NO: 390248

SEQ ID NO: 566586 - RNA, 64 nt, hsa; identical to SEQ ID NO: 390249

SEQ ID NO: 566587 - RNA, 64 nt, hsa; identical to SEQ ID NO: 390250

SEQ ID NO: 566588 - RNA, 64 nt, hsa; identical to SEQ ID NO: 390251

SEQ ID NO: 566589 - RNA, 64 nt, hsa; identical to SEQ ID NO: 390252

SEQ ID NO: 566590 - RNA, 64 nt, hsa; identical to SEQ ID NO: 390253

SEQ ID NO: 566591 - RNA, 64 nt, hsa; identical to SEQ ID NO: 390254

SEQ ID NO: 566592 - RNA, 64 nt, hsa; identical to SEQ ID NO: 390255

SEQ ID NO: 566593 - RNA, 64 nt, hsa; identical to SEQ ID NO: 390256

SEQ ID NO: 566594 - RNA, 64 nt, hsa; identical to SEQ ID NO: 390257

SEQ ID NO: 566595 - RNA, 64 nt, hsa; identical to SEQ ID NO: 390258

SEQ ID NO: 566596 - RNA, 64 nt, hsa; identical to SEQ ID NO: 390259

SEQ ID NO: 566597 - RNA, 64 nt, hsa
ggcacagaauuugcuaccaucucucucucccccuaccuaccaaacuauccacaauuuaaauaaa

SEQ ID NO: 566598 - RNA, 64 nt, hsa
guguuaucuaucacauaacaggaccauguuuuuaaccuaccaucaagagccuguauuuugaguu

SEQ ID NO: 566599 - RNA, 64 nt, hsa
uagauuuaggagcagaaaugcaaggggcugcaugaccuaccaggacagaacuuuccccaauuac

SEQ ID NO: 566600 - RNA, 64 nt, hsa
ucggauucaacuaccuuagauaauauuucugaaaaccuaccagccagaggguagggcacaaaga

SEQ ID NO: 566601 - RNA, 64 nt, hsa
ugauugcaaugugagaccgaauguaauauggaaaaccuaccaguggggugugguugugcccuga

SEQ ID NO: 566602 - RNA, 64 nt, hsa
uacuauacuuuucauaauguugcaugcauauuucaccuaccaaagcugugcuguuaaugccgug

SEQ ID NO: 566603 - RNA, 64 nt, hsa
uuauacaugcaaaccuaccaucuguucaacuuccaccuaccaccuccugcaccccuuugaucgg

SEQ ID NO: 566604 - RNA, 64 nt, hsa
cuauguccccuggggcguuaucuuauacaugcaaaccuaccaucuguucaacuuccaccuacca

SEQ ID NO: 566605 - RNA, 64 nt, hsa
auggaaugaacuaaaauaaacaagaacaaaagaauaguauaauuauaucaguaacaagaagacu

SEQ ID NO: 566606 - RNA, 64 nt, hsa
cauugacauuaauaaaacuuagaaacaguauaauuaguauaacauuuacucugaauuugaagau

SEQ ID NO: 566607 - RNA, 64 nt, hsa
cuuaauccagauagccuggauuuaacaaaaccaauaguauaaaaauguguguguguguucugug

SEQ ID NO: 566608 - RNA, 64 nt, hsa
uaggaaucagcgauacaaccacuuuggaaguuuauaguauaauugaaauuauuagaagaauuca

SEQ ID NO: 566609 - RNA, 64 nt, hsa
auuguggaugauggcuuauuaaauguugacuuccuaguauaaaacugcaagaauaaaaguaacu

SEQ ID NO: 566610 - RNA, 64 nt, hsa
auacauagacauuucaaaauuaauagcuuuugauuaguauaauauuucuuaauuuggauaauaa

SEQ ID NO: 566611 - RNA, 64 nt, hsa
guaguuuaguuaugucuuuuucucuguauguaaguaguauaauuuguuacuuucaaauacccgu

SEQ ID NO: 566612 - RNA, 64 nt, hsa
uuaauaguuuaaaacaauauucucuuuuugaaaauaguauaaacaggccaugcauauaauguac

SEQ ID NO: 566613 - RNA, 64 nt, hsa
ugucacaagaaaaaaaugucuucugcaaauuuucuaguauaacagaaauuuuuguagaugaaaa

SEQ ID NO: 566614 - RNA, 64 nt, hsa
uggugguauggcugacccuguuucagaagcaggauaguauaaaagcaucagccuaagaauggca

SEQ ID NO: 566615 - RNA, 64 nt, hsa
cuuaacuagagucaauuagaugugcaggaguaaguaguauaagaagaaucaaguccgagaguga

SEQ ID NO: 566616 - RNA, 64 nt, hsa
aagacucuaguggaggaauuaauucaaugggagauaguauaaaauacauagaaaacacaaguaa

SEQ ID NO: 566617 - RNA, 64 nt, hsa
uagucuuccuucaaugcguguauguaaucuuuguuaguauaaaagauauuaaauauaggugcca

SEQ ID NO: 566618 - RNA, 64 nt, hsa
uugaguuauuuugucuuuuagaauacacaaaauauaguauaaagacauuucacaauuuccaaac

SEQ ID NO: 566619 - RNA, 64 nt, hsa
cucuggaaaaagacuccgagaguuauaacuacuguaguauaaauauaggaacuaaguuaaacuu

SEQ ID NO: 566620 - RNA, 64 nt, hsa
uguuggcggacagguuauggacauucaugcccaauaguauaagggaacucaagggaaaaggaaa

SEQ ID NO: 566621 - RNA, 64 nt, hsa; identical to SEQ ID NO: 166381

SEQ ID NO: 566622 - RNA, 64 nt, hsa; identical to SEQ ID NO: 166382

SEQ ID NO: 566623 - RNA, 64 nt, hsa; identical to SEQ ID NO: 166383

SEQ ID NO: 566624 - RNA, 64 nt, hsa; identical to SEQ ID NO: 166384

SEQ ID NO: 566625 - RNA, 64 nt, hsa; identical to SEQ ID NO: 166385

SEQ ID NO: 566626 - RNA, 64 nt, hsa; identical to SEQ ID NO: 166386

SEQ ID NO: 566627 - RNA, 64 nt, hsa; identical to SEQ ID NO: 166387

SEQ ID NO: 566628 - RNA, 64 nt, hsa; identical to SEQ ID NO: 166388

SEQ ID NO: 566629 - RNA, 64 nt, hsa; identical to SEQ ID NO: 166389

SEQ ID NO: 566630 - RNA, 64 nt, hsa; identical to SEQ ID NO: 166390

SEQ ID NO: 566631 - RNA, 64 nt, hsa; identical to SEQ ID NO: 166391

SEQ ID NO: 566632 - RNA, 64 nt, hsa; identical to SEQ ID NO: 166392

SEQ ID NO: 566633 - RNA, 64 nt, hsa; identical to SEQ ID NO: 166393

SEQ ID NO: 566634 - RNA, 64 nt, hsa; identical to SEQ ID NO: 166394

SEQ ID NO: 566635 - RNA, 64 nt, hsa; identical to SEQ ID NO: 166395

SEQ ID NO: 566636 - RNA, 64 nt, hsa; identical to SEQ ID NO: 166396

SEQ ID NO: 566637 - RNA, 64 nt, hsa; identical to SEQ ID NO: 166397

SEQ ID NO: 566638 - RNA, 64 nt, hsa; identical to SEQ ID NO: 110173

SEQ ID NO: 566639 - RNA, 64 nt, hsa; identical to SEQ ID NO: 110174

SEQ ID NO: 566640 - RNA, 64 nt, hsa; identical to SEQ ID NO: 110175

SEQ ID NO: 566641 - RNA, 64 nt, hsa; identical to SEQ ID NO: 110176

SEQ ID NO: 566642 - RNA, 64 nt, hsa; identical to SEQ ID NO: 110177

SEQ ID NO: 566643 - RNA, 64 nt, hsa; identical to SEQ ID NO: 110178

SEQ ID NO: 566644 - RNA, 64 nt, hsa; identical to SEQ ID NO: 110179

SEQ ID NO: 566645 - RNA, 64 nt, hsa; identical to SEQ ID NO: 110180

SEQ ID NO: 566646 - RNA, 64 nt, hsa; identical to SEQ ID NO: 110181

SEQ ID NO: 566647 - RNA, 64 nt, hsa; identical to SEQ ID NO: 110182

SEQ ID NO: 566648 - RNA, 64 nt, hsa; identical to SEQ ID NO: 110183

SEQ ID NO: 566649 - RNA, 64 nt, hsa; identical to SEQ ID NO: 110184

SEQ ID NO: 566650 - RNA, 64 nt, hsa; identical to SEQ ID NO: 110185

SEQ ID NO: 566651 - RNA, 64 nt, hsa; identical to SEQ ID NO: 110186

SEQ ID NO: 566652 - RNA, 64 nt, hsa; identical to SEQ ID NO: 110187

SEQ ID NO: 566653 - RNA, 64 nt, hsa; identical to SEQ ID NO: 110188

SEQ ID NO: 566654 - RNA, 64 nt, hsa; identical to SEQ ID NO: 110189

SEQ ID NO: 566655 - RNA, 64 nt, hsa; identical to SEQ ID NO: 110190

SEQ ID NO: 566656 - RNA, 64 nt, hsa; identical to SEQ ID NO: 110191

SEQ ID NO: 566657 - RNA, 64 nt, hsa; identical to SEQ ID NO: 110192

SEQ ID NO: 566658 - RNA, 64 nt, hsa; identical to SEQ ID NO: 110193

SEQ ID NO: 566659 - RNA, 64 nt, hsa; identical to SEQ ID NO: 110194

SEQ ID NO: 566660 - RNA, 64 nt, hsa; identical to SEQ ID NO: 110195

SEQ ID NO: 566661 - RNA, 59 nt, hsa; identical to SEQ ID NO: 110196

SEQ ID NO: 566662 - RNA, 64 nt, hsa; identical to SEQ ID NO: 110197

SEQ ID NO: 566663 - RNA, 64 nt, hsa; identical to SEQ ID NO: 110198

SEQ ID NO: 566664 - RNA, 64 nt, hsa; identical to SEQ ID NO: 110199

SEQ ID NO: 566665 - RNA, 64 nt, hsa; identical to SEQ ID NO: 110200

SEQ ID NO: 566666 - RNA, 62 nt, hsa; identical to SEQ ID NO: 110201

SEQ ID NO: 566667 - RNA, 64 nt, hsa; identical to SEQ ID NO: 110202

SEQ ID NO: 566668 - RNA, 64 nt, hsa; identical to SEQ ID NO: 110203

SEQ ID NO: 566669 - RNA, 64 nt, hsa; identical to SEQ ID NO: 110204

SEQ ID NO: 566670 - RNA, 64 nt, hsa; identical to SEQ ID NO: 110205

SEQ ID NO: 566671 - RNA, 64 nt, hsa; identical to SEQ ID NO: 110206

SEQ ID NO: 566672 - RNA, 64 nt, hsa; identical to SEQ ID NO: 110207

SEQ ID NO: 566673 - RNA, 64 nt, hsa; identical to SEQ ID NO: 110208

SEQ ID NO: 566674 - RNA, 64 nt, hsa; identical to SEQ ID NO: 110209

SEQ ID NO: 566675 - RNA, 64 nt, hsa; identical to SEQ ID NO: 110210

SEQ ID NO: 566676 - RNA, 64 nt, hsa; identical to SEQ ID NO: 110211

SEQ ID NO: 566677 - RNA, 64 nt, hsa; identical to SEQ ID NO: 110212

SEQ ID NO: 566678 - RNA, 64 nt, hsa; identical to SEQ ID NO: 110213

SEQ ID NO: 566679 - RNA, 64 nt, hsa; identical to SEQ ID NO: 110214

SEQ ID NO: 566680 - RNA, 64 nt, hsa; identical to SEQ ID NO: 110215

SEQ ID NO: 566681 - RNA, 64 nt, hsa; identical to SEQ ID NO: 110216

SEQ ID NO: 566682 - RNA, 64 nt, hsa; identical to SEQ ID NO: 110217

SEQ ID NO: 566683 - RNA, 64 nt, hsa; identical to SEQ ID NO: 110218

SEQ ID NO: 566684 - RNA, 64 nt, hsa; identical to SEQ ID NO: 110219

SEQ ID NO: 566685 - RNA, 64 nt, hsa; identical to SEQ ID NO: 110220

SEQ ID NO: 566686 - RNA, 64 nt, hsa; identical to SEQ ID NO: 110221

SEQ ID NO: 566687 - RNA, 62 nt, hsa; identical to SEQ ID NO: 110222

SEQ ID NO: 566688 - RNA, 64 nt, hsa; identical to SEQ ID NO: 110223

SEQ ID NO: 566689 - RNA, 64 nt, hsa; identical to SEQ ID NO: 110224

SEQ ID NO: 566690 - RNA, 64 nt, hsa; identical to SEQ ID NO: 110225

SEQ ID NO: 566691 - RNA, 64 nt, hsa; identical to SEQ ID NO: 110226

SEQ ID NO: 566692 - RNA, 64 nt, hsa; identical to SEQ ID NO: 110227

SEQ ID NO: 566693 - RNA, 64 nt, hsa; identical to SEQ ID NO: 110228

SEQ ID NO: 566694 - RNA, 64 nt, hsa; identical to SEQ ID NO: 110229

SEQ ID NO: 566695 - RNA, 64 nt, hsa; identical to SEQ ID NO: 110230

SEQ ID NO: 566696 - RNA, 64 nt, hsa; identical to SEQ ID NO: 110231

SEQ ID NO: 566697 - RNA, 64 nt, hsa; identical to SEQ ID NO: 110232

SEQ ID NO: 566698 - RNA, 64 nt, hsa; identical to SEQ ID NO: 110233

SEQ ID NO: 566699 - RNA, 64 nt, hsa; identical to SEQ ID NO: 110234

SEQ ID NO: 566700 - RNA, 64 nt, hsa; identical to SEQ ID NO: 110235

SEQ ID NO: 566701 - RNA, 64 nt, hsa; identical to SEQ ID NO: 110236

SEQ ID NO: 566702 - RNA, 64 nt, hsa; identical to SEQ ID NO: 110237

SEQ ID NO: 566703 - RNA, 64 nt, hsa; identical to SEQ ID NO: 110238

SEQ ID NO: 566704 - RNA, 64 nt, hsa; identical to SEQ ID NO: 110239

SEQ ID NO: 566705 - RNA, 64 nt, hsa; identical to SEQ ID NO: 110240

SEQ ID NO: 566706 - RNA, 64 nt, hsa; identical to SEQ ID NO: 110241

SEQ ID NO: 566707 - RNA, 64 nt, hsa; identical to SEQ ID NO: 110242

SEQ ID NO: 566708 - RNA, 64 nt, hsa; identical to SEQ ID NO: 110243

SEQ ID NO: 566709 - RNA, 64 nt, hsa; identical to SEQ ID NO: 110244

SEQ ID NO: 566710 - RNA, 64 nt, hsa; identical to SEQ ID NO: 110245

SEQ ID NO: 566711 - RNA, 64 nt, hsa; identical to SEQ ID NO: 110246

SEQ ID NO: 566712 - RNA, 64 nt, hsa; identical to SEQ ID NO: 110247

SEQ ID NO: 566713 - RNA, 64 nt, hsa; identical to SEQ ID NO: 110248

SEQ ID NO: 566714 - RNA, 64 nt, hsa; identical to SEQ ID NO: 286103

SEQ ID NO: 566715 - RNA, 64 nt, hsa; identical to SEQ ID NO: 286104

SEQ ID NO: 566716 - RNA, 64 nt, hsa; identical to SEQ ID NO: 286105

SEQ ID NO: 566717 - RNA, 64 nt, hsa; identical to SEQ ID NO: 286106

SEQ ID NO: 566718 - RNA, 64 nt, hsa; identical to SEQ ID NO: 286107

SEQ ID NO: 566719 - RNA, 64 nt, hsa; identical to SEQ ID NO: 286108

SEQ ID NO: 566720 - RNA, 64 nt, hsa; identical to SEQ ID NO: 286109

SEQ ID NO: 566721 - RNA, 64 nt, hsa; identical to SEQ ID NO: 286110

SEQ ID NO: 566722 - RNA, 64 nt, hsa; identical to SEQ ID NO: 286111

SEQ ID NO: 566723 - RNA, 64 nt, hsa; identical to SEQ ID NO: 286112

SEQ ID NO: 566724 - RNA, 64 nt, hsa; identical to SEQ ID NO: 286113

SEQ ID NO: 566725 - RNA, 64 nt, hsa; identical to SEQ ID NO: 286114

SEQ ID NO: 566726 - RNA, 64 nt, hsa; identical to SEQ ID NO: 286115

SEQ ID NO: 566727 - RNA, 64 nt, hsa; identical to SEQ ID NO: 286116

SEQ ID NO: 566728 - RNA, 64 nt, hsa; identical to SEQ ID NO: 286117

SEQ ID NO: 566729 - RNA, 64 nt, hsa; identical to SEQ ID NO: 286118

SEQ ID NO: 566730 - RNA, 64 nt, hsa; identical to SEQ ID NO: 286119

SEQ ID NO: 566731 - RNA, 64 nt, hsa; identical to SEQ ID NO: 286120

SEQ ID NO: 566732 - RNA, 64 nt, hsa; identical to SEQ ID NO: 286121

SEQ ID NO: 566733 - RNA, 64 nt, hsa; identical to SEQ ID NO: 286122

SEQ ID NO: 566734 - RNA, 64 nt, hsa; identical to SEQ ID NO: 286123

SEQ ID NO: 566735 - RNA, 64 nt, hsa; identical to SEQ ID NO: 286124

SEQ ID NO: 566736 - RNA, 65 nt, hsa; identical to SEQ ID NO: 420659

SEQ ID NO: 566737 - RNA, 65 nt, hsa; identical to SEQ ID NO: 420660

SEQ ID NO: 566738 - RNA, 65 nt, hsa; identical to SEQ ID NO: 420661

SEQ ID NO: 566739 - RNA, 65 nt, hsa; identical to SEQ ID NO: 420662

SEQ ID NO: 566740 - RNA, 65 nt, hsa; identical to SEQ ID NO: 420663

SEQ ID NO: 566741 - RNA, 65 nt, hsa; identical to SEQ ID NO: 420664

SEQ ID NO: 566742 - RNA, 65 nt, hsa; identical to SEQ ID NO: 420665

SEQ ID NO: 566743 - RNA, 65 nt, hsa; identical to SEQ ID NO: 420666

SEQ ID NO: 566744 - RNA, 65 nt, hsa; identical to SEQ ID NO: 420667

SEQ ID NO: 566745 - RNA, 65 nt, hsa; identical to SEQ ID NO: 420668

SEQ ID NO: 566746 - RNA, 65 nt, hsa; identical to SEQ ID NO: 420669

SEQ ID NO: 566747 - RNA, 65 nt, hsa; identical to SEQ ID NO: 420670

SEQ ID NO: 566748 - RNA, 65 nt, hsa; identical to SEQ ID NO: 420671

SEQ ID NO: 566749 - RNA, 65 nt, hsa; identical to SEQ ID NO: 420672

SEQ ID NO: 566750 - RNA, 65 nt, hsa; identical to SEQ ID NO: 420673

SEQ ID NO: 566751 - RNA, 65 nt, hsa; identical to SEQ ID NO: 420674

SEQ ID NO: 566752 - RNA, 65 nt, hsa; identical to SEQ ID NO: 420675

SEQ ID NO: 566753 - RNA, 65 nt, hsa; identical to SEQ ID NO: 420676

SEQ ID NO: 566754 - RNA, 65 nt, hsa; identical to SEQ ID NO: 420677

SEQ ID NO: 566755 - RNA, 65 nt, hsa; identical to SEQ ID NO: 420678

SEQ ID NO: 566756 - RNA, 65 nt, hsa; identical to SEQ ID NO: 420679

SEQ ID NO: 566757 - RNA, 65 nt, hsa; identical to SEQ ID NO: 420680

SEQ ID NO: 566758 - RNA, 65 nt, hsa; identical to SEQ ID NO: 420681

SEQ ID NO: 566759 - RNA, 65 nt, hsa; identical to SEQ ID NO: 420682

SEQ ID NO: 566760 - RNA, 65 nt, hsa; identical to SEQ ID NO: 420683

SEQ ID NO: 566761 - RNA, 65 nt, hsa; identical to SEQ ID NO: 420684

SEQ ID NO: 566762 - RNA, 65 nt, hsa; identical to SEQ ID NO: 420685

SEQ ID NO: 566763 - RNA, 65 nt, hsa; identical to SEQ ID NO: 420686

SEQ ID NO: 566764 - RNA, 65 nt, hsa; identical to SEQ ID NO: 420687

SEQ ID NO: 566765 - RNA, 65 nt, hsa; identical to SEQ ID NO: 420688

SEQ ID NO: 566766 - RNA, 65 nt, hsa; identical to SEQ ID NO: 420689

SEQ ID NO: 566767 - RNA, 65 nt, hsa; identical to SEQ ID NO: 420690

SEQ ID NO: 566768 - RNA, 65 nt, hsa; identical to SEQ ID NO: 420691

SEQ ID NO: 566769 - RNA, 65 nt, hsa; identical to SEQ ID NO: 420692

SEQ ID NO: 566770 - RNA, 65 nt, hsa; identical to SEQ ID NO: 420693

SEQ ID NO: 566771 - RNA, 65 nt, hsa; identical to SEQ ID NO: 420694

SEQ ID NO: 566772 - RNA, 65 nt, hsa; identical to SEQ ID NO: 420695

SEQ ID NO: 566773 - RNA, 65 nt, hsa; identical to SEQ ID NO: 420696

SEQ ID NO: 566774 - RNA, 65 nt, hsa; identical to SEQ ID NO: 420697

SEQ ID NO: 566775 - RNA, 65 nt, hsa; identical to SEQ ID NO: 420698

SEQ ID NO: 566776 - RNA, 65 nt, hsa; identical to SEQ ID NO: 420699

SEQ ID NO: 566777 - RNA, 65 nt, hsa; identical to SEQ ID NO: 420700

SEQ ID NO: 566778 - RNA, 65 nt, hsa; identical to SEQ ID NO: 420701

SEQ ID NO: 566779 - RNA, 65 nt, hsa; identical to SEQ ID NO: 420702

SEQ ID NO: 566780 - RNA, 65 nt, hsa; identical to SEQ ID NO: 420703

SEQ ID NO: 566781 - RNA, 65 nt, hsa; identical to SEQ ID NO: 420704

SEQ ID NO: 566782 - RNA, 65 nt, hsa; identical to SEQ ID NO: 420705

SEQ ID NO: 566783 - RNA, 65 nt, hsa; identical to SEQ ID NO: 420706

SEQ ID NO: 566784 - RNA, 65 nt, hsa; identical to SEQ ID NO: 420707

SEQ ID NO: 566785 - RNA, 65 nt, hsa; identical to SEQ ID NO: 420708

SEQ ID NO: 566786 - RNA, 65 nt, hsa; identical to SEQ ID NO: 420709

SEQ ID NO: 566787 - RNA, 65 nt, hsa; identical to SEQ ID NO: 420710

SEQ ID NO: 566788 - RNA, 65 nt, hsa; identical to SEQ ID NO: 420711

SEQ ID NO: 566789 - RNA, 65 nt, hsa; identical to SEQ ID NO: 420712

SEQ ID NO: 566790 - RNA, 65 nt, hsa; identical to SEQ ID NO: 420713

SEQ ID NO: 566791 - RNA, 65 nt, hsa; identical to SEQ ID NO: 420714

SEQ ID NO: 566792 - RNA, 65 nt, hsa; identical to SEQ ID NO: 420715

SEQ ID NO: 566793 - RNA, 65 nt, hsa; identical to SEQ ID NO: 420716

SEQ ID NO: 566794 - RNA, 65 nt, hsa; identical to SEQ ID NO: 420717

SEQ ID NO: 566795 - RNA, 65 nt, hsa; identical to SEQ ID NO: 420718

SEQ ID NO: 566796 - RNA, 65 nt, hsa; identical to SEQ ID NO: 420719

SEQ ID NO: 566797 - RNA, 65 nt, hsa; identical to SEQ ID NO: 420720

SEQ ID NO: 566798 - RNA, 65 nt, hsa; identical to SEQ ID NO: 420721

SEQ ID NO: 566799 - RNA, 65 nt, hsa; identical to SEQ ID NO: 420722

SEQ ID NO: 566800 - RNA, 65 nt, hsa; identical to SEQ ID NO: 420723

SEQ ID NO: 566801 - RNA, 65 nt, hsa; identical to SEQ ID NO: 420724

SEQ ID NO: 566802 - RNA, 65 nt, hsa; identical to SEQ ID NO: 420725

SEQ ID NO: 566803 - RNA, 65 nt, hsa; identical to SEQ ID NO: 420726

SEQ ID NO: 566804 - RNA, 65 nt, hsa; identical to SEQ ID NO: 420727

SEQ ID NO: 566805 - RNA, 65 nt, hsa; identical to SEQ ID NO: 420728

SEQ ID NO: 566806 - RNA, 65 nt, hsa; identical to SEQ ID NO: 420729

SEQ ID NO: 566807 - RNA, 65 nt, hsa; identical to SEQ ID NO: 420730

SEQ ID NO: 566808 - RNA, 65 nt, hsa; identical to SEQ ID NO: 420731

SEQ ID NO: 566809 - RNA, 65 nt, hsa; identical to SEQ ID NO: 420732

SEQ ID NO: 566810 - RNA, 65 nt, hsa; identical to SEQ ID NO: 420733

SEQ ID NO: 566811 - RNA, 65 nt, hsa; identical to SEQ ID NO: 420734

SEQ ID NO: 566812 - RNA, 65 nt, hsa; identical to SEQ ID NO: 420735

SEQ ID NO: 566813 - RNA, 65 nt, hsa; identical to SEQ ID NO: 420736

SEQ ID NO: 566814 - RNA, 65 nt, hsa; identical to SEQ ID NO: 420737

SEQ ID NO: 566815 - RNA, 65 nt, hsa; identical to SEQ ID NO: 420738

SEQ ID NO: 566816 - RNA, 65 nt, hsa; identical to SEQ ID NO: 420739

SEQ ID NO: 566817 - RNA, 65 nt, hsa; identical to SEQ ID NO: 420740

SEQ ID NO: 566818 - RNA, 65 nt, hsa; identical to SEQ ID NO: 420741

SEQ ID NO: 566819 - RNA, 65 nt, hsa; identical to SEQ ID NO: 420742

SEQ ID NO: 566820 - RNA, 65 nt, hsa; identical to SEQ ID NO: 420743

SEQ ID NO: 566821 - RNA, 65 nt, hsa; identical to SEQ ID NO: 420744

SEQ ID NO: 566822 - RNA, 65 nt, hsa; identical to SEQ ID NO: 420745

SEQ ID NO: 566823 - RNA, 65 nt, hsa; identical to SEQ ID NO: 420746

SEQ ID NO: 566824 - RNA, 65 nt, hsa; identical to SEQ ID NO: 420747

SEQ ID NO: 566825 - RNA, 65 nt, hsa; identical to SEQ ID NO: 420748

SEQ ID NO: 566826 - RNA, 65 nt, hsa; identical to SEQ ID NO: 420749

SEQ ID NO: 566827 - RNA, 65 nt, hsa; identical to SEQ ID NO: 420750

SEQ ID NO: 566828 - RNA, 65 nt, hsa; identical to SEQ ID NO: 420751

SEQ ID NO: 566829 - RNA, 65 nt, hsa; identical to SEQ ID NO: 420752

SEQ ID NO: 566830 - RNA, 65 nt, hsa; identical to SEQ ID NO: 420753

SEQ ID NO: 566831 - RNA, 65 nt, hsa; identical to SEQ ID NO: 420754

SEQ ID NO: 566832 - RNA, 65 nt, hsa; identical to SEQ ID NO: 420755

SEQ ID NO: 566833 - RNA, 65 nt, hsa; identical to SEQ ID NO: 420756

SEQ ID NO: 566834 - RNA, 65 nt, hsa; identical to SEQ ID NO: 420757

SEQ ID NO: 566835 - RNA, 65 nt, hsa; identical to SEQ ID NO: 420758

SEQ ID NO: 566836 - RNA, 65 nt, hsa; identical to SEQ ID NO: 420759

SEQ ID NO: 566837 - RNA, 65 nt, hsa; identical to SEQ ID NO: 420760

SEQ ID NO: 566838 - RNA, 64 nt, hsa; identical to SEQ ID NO: 61733

SEQ ID NO: 566839 - RNA, 64 nt, hsa; identical to SEQ ID NO: 61734

SEQ ID NO: 566840 - RNA, 64 nt, hsa; identical to SEQ ID NO: 61735

SEQ ID NO: 566841 - RNA, 64 nt, hsa; identical to SEQ ID NO: 61736

SEQ ID NO: 566842 - RNA, 64 nt, hsa; identical to SEQ ID NO: 61737

SEQ ID NO: 566843 - RNA, 64 nt, hsa; identical to SEQ ID NO: 61738

SEQ ID NO: 566844 - RNA, 64 nt, hsa; identical to SEQ ID NO: 61739

SEQ ID NO: 566845 - RNA, 64 nt, hsa; identical to SEQ ID NO: 61740

SEQ ID NO: 566846 - RNA, 64 nt, hsa; identical to SEQ ID NO: 61741

SEQ ID NO: 566847 - RNA, 64 nt, hsa; identical to SEQ ID NO: 61742

SEQ ID NO: 566848 - RNA, 64 nt, hsa; identical to SEQ ID NO: 61743

SEQ ID NO: 566849 - RNA, 64 nt, hsa; identical to SEQ ID NO: 61744

SEQ ID NO: 566850 - RNA, 64 nt, hsa; identical to SEQ ID NO: 61745

SEQ ID NO: 566851 - RNA, 64 nt, hsa; identical to SEQ ID NO: 61746

SEQ ID NO: 566852 - RNA, 64 nt, hsa; identical to SEQ ID NO: 61747

SEQ ID NO: 566853 - RNA, 64 nt, hsa; identical to SEQ ID NO: 61748

SEQ ID NO: 566854 - RNA, 64 nt, hsa; identical to SEQ ID NO: 61749

SEQ ID NO: 566855 - RNA, 64 nt, hsa; identical to SEQ ID NO: 61750

SEQ ID NO: 566856 - RNA, 64 nt, hsa; identical to SEQ ID NO: 61751

SEQ ID NO: 566857 - RNA, 64 nt, hsa; identical to SEQ ID NO: 61752

SEQ ID NO: 566858 - RNA, 64 nt, hsa; identical to SEQ ID NO: 61753

SEQ ID NO: 566859 - RNA, 64 nt, hsa; identical to SEQ ID NO: 61754

SEQ ID NO: 566860 - RNA, 64 nt, hsa; identical to SEQ ID NO: 61755

SEQ ID NO: 566861 - RNA, 64 nt, hsa; identical to SEQ ID NO: 61756

SEQ ID NO: 566862 - RNA, 64 nt, hsa; identical to SEQ ID NO: 61757

SEQ ID NO: 566863 - RNA, 64 nt, hsa; identical to SEQ ID NO: 61758

SEQ ID NO: 566864 - RNA, 64 nt, hsa; identical to SEQ ID NO: 61759

SEQ ID NO: 566865 - RNA, 64 nt, hsa; identical to SEQ ID NO: 61760

SEQ ID NO: 566866 - RNA, 64 nt, hsa; identical to SEQ ID NO: 61761

SEQ ID NO: 566867 - RNA, 64 nt, hsa; identical to SEQ ID NO: 61762

SEQ ID NO: 566868 - RNA, 64 nt, hsa; identical to SEQ ID NO: 61763

SEQ ID NO: 566869 - RNA, 64 nt, hsa; identical to SEQ ID NO: 61764

SEQ ID NO: 566870 - RNA, 64 nt, hsa; identical to SEQ ID NO: 61765

SEQ ID NO: 566871 - RNA, 64 nt, hsa; identical to SEQ ID NO: 61766

SEQ ID NO: 566872 - RNA, 64 nt, hsa; identical to SEQ ID NO: 61767

SEQ ID NO: 566873 - RNA, 64 nt, hsa; identical to SEQ ID NO: 61768

SEQ ID NO: 566874 - RNA, 64 nt, hsa; identical to SEQ ID NO: 61769

SEQ ID NO: 566875 - RNA, 64 nt, hsa; identical to SEQ ID NO: 61770

SEQ ID NO: 566876 - RNA, 64 nt, hsa; identical to SEQ ID NO: 61771

SEQ ID NO: 566877 - RNA, 64 nt, hsa; identical to SEQ ID NO: 61772

SEQ ID NO: 566878 - RNA, 64 nt, hsa; identical to SEQ ID NO: 61773

SEQ ID NO: 566879 - RNA, 64 nt, hsa; identical to SEQ ID NO: 61774

SEQ ID NO: 566880 - RNA, 64 nt, hsa; identical to SEQ ID NO: 61775

SEQ ID NO: 566881 - RNA, 64 nt, hsa; identical to SEQ ID NO: 61776

SEQ ID NO: 566882 - RNA, 64 nt, hsa; identical to SEQ ID NO: 61777

SEQ ID NO: 566883 - RNA, 64 nt, hsa; identical to SEQ ID NO: 61778

SEQ ID NO: 566884 - RNA, 64 nt, hsa; identical to SEQ ID NO: 61779

SEQ ID NO: 566885 - RNA, 64 nt, hsa; identical to SEQ ID NO: 61780

SEQ ID NO: 566886 - RNA, 64 nt, hsa; identical to SEQ ID NO: 61781

SEQ ID NO: 566887 - RNA, 64 nt, hsa; identical to SEQ ID NO: 61782

SEQ ID NO: 566888 - RNA, 64 nt, hsa; identical to SEQ ID NO: 61783

SEQ ID NO: 566889 - RNA, 64 nt, hsa; identical to SEQ ID NO: 61784

SEQ ID NO: 566890 - RNA, 64 nt, hsa; identical to SEQ ID NO: 61785

SEQ ID NO: 566891 - RNA, 64 nt, hsa; identical to SEQ ID NO: 61786

SEQ ID NO: 566892 - RNA, 64 nt, hsa; identical to SEQ ID NO: 61787

SEQ ID NO: 566893 - RNA, 64 nt, hsa; identical to SEQ ID NO: 61788

SEQ ID NO: 566894 - RNA, 64 nt, hsa; identical to SEQ ID NO: 61789

SEQ ID NO: 566895 - RNA, 64 nt, hsa; identical to SEQ ID NO: 61790

SEQ ID NO: 566896 - RNA, 64 nt, hsa; identical to SEQ ID NO: 61791

SEQ ID NO: 566897 - RNA, 64 nt, hsa; identical to SEQ ID NO: 61792

SEQ ID NO: 566898 - RNA, 64 nt, hsa; identical to SEQ ID NO: 61793

SEQ ID NO: 566899 - RNA, 64 nt, hsa; identical to SEQ ID NO: 61794

SEQ ID NO: 566900 - RNA, 64 nt, hsa; identical to SEQ ID NO: 61795

SEQ ID NO: 566901 - RNA, 64 nt, hsa; identical to SEQ ID NO: 61796

SEQ ID NO: 566902 - RNA, 64 nt, hsa; identical to SEQ ID NO: 61797

SEQ ID NO: 566903 - RNA, 64 nt, hsa; identical to SEQ ID NO: 61798

SEQ ID NO: 566904 - RNA, 64 nt, hsa; identical to SEQ ID NO: 61799

SEQ ID NO: 566905 - RNA, 64 nt, hsa; identical to SEQ ID NO: 61800

SEQ ID NO: 566906 - RNA, 64 nt, hsa; identical to SEQ ID NO: 61801

SEQ ID NO: 566907 - RNA, 64 nt, hsa; identical to SEQ ID NO: 61802

SEQ ID NO: 566908 - RNA, 64 nt, hsa; identical to SEQ ID NO: 61803

SEQ ID NO: 566909 - RNA, 64 nt, hsa; identical to SEQ ID NO: 61804

SEQ ID NO: 566910 - RNA, 64 nt, hsa; identical to SEQ ID NO: 61805

SEQ ID NO: 566911 - RNA, 64 nt, hsa; identical to SEQ ID NO: 61806

SEQ ID NO: 566912 - RNA, 64 nt, hsa; identical to SEQ ID NO: 61807

SEQ ID NO: 566913 - RNA, 64 nt, hsa; identical to SEQ ID NO: 61808

SEQ ID NO: 566914 - RNA, 64 nt, hsa; identical to SEQ ID NO: 61809

SEQ ID NO: 566915 - RNA, 64 nt, hsa; identical to SEQ ID NO: 61810

SEQ ID NO: 566916 - RNA, 64 nt, hsa; identical to SEQ ID NO: 61811

SEQ ID NO: 566917 - RNA, 64 nt, hsa; identical to SEQ ID NO: 61812

SEQ ID NO: 566918 - RNA, 52 nt, hsa; identical to SEQ ID NO: 61813

SEQ ID NO: 566919 - RNA, 64 nt, hsa; identical to SEQ ID NO: 61814

SEQ ID NO: 566920 - RNA, 64 nt, hsa; identical to SEQ ID NO: 61815

SEQ ID NO: 566921 - RNA, 64 nt, hsa; identical to SEQ ID NO: 61816

SEQ ID NO: 566922 - RNA, 64 nt, hsa; identical to SEQ ID NO: 61817

SEQ ID NO: 566923 - RNA, 64 nt, hsa; identical to SEQ ID NO: 61818

SEQ ID NO: 566924 - RNA, 64 nt, hsa; identical to SEQ ID NO: 61819

SEQ ID NO: 566925 - RNA, 64 nt, hsa; identical to SEQ ID NO: 61820

SEQ ID NO: 566926 - RNA, 64 nt, hsa; identical to SEQ ID NO: 61821

SEQ ID NO: 566927 - RNA, 64 nt, hsa; identical to SEQ ID NO: 61822

SEQ ID NO: 566928 - RNA, 64 nt, hsa; identical to SEQ ID NO: 61823

SEQ ID NO: 566929 - RNA, 64 nt, hsa; identical to SEQ ID NO: 61824

SEQ ID NO: 566930 - RNA, 64 nt, hsa; identical to SEQ ID NO: 61825

SEQ ID NO: 566931 - RNA, 64 nt, hsa; identical to SEQ ID NO: 61826

SEQ ID NO: 566932 - RNA, 64 nt, hsa; identical to SEQ ID NO: 61827

SEQ ID NO: 566933 - RNA, 64 nt, hsa; identical to SEQ ID NO: 61828

SEQ ID NO: 566934 - RNA, 64 nt, hsa; identical to SEQ ID NO: 61829

SEQ ID NO: 566935 - RNA, 64 nt, hsa; identical to SEQ ID NO: 61830

SEQ ID NO: 566936 - RNA, 64 nt, hsa; identical to SEQ ID NO: 61831

SEQ ID NO: 566937 - RNA, 64 nt, hsa; identical to SEQ ID NO: 61832

SEQ ID NO: 566938 - RNA, 64 nt, hsa; identical to SEQ ID NO: 61833

SEQ ID NO: 566939 - RNA, 64 nt, hsa; identical to SEQ ID NO: 61834

SEQ ID NO: 566940 - RNA, 64 nt, hsa; identical to SEQ ID NO: 61835

SEQ ID NO: 566941 - RNA, 64 nt, hsa; identical to SEQ ID NO: 61836

SEQ ID NO: 566942 - RNA, 64 nt, hsa; identical to SEQ ID NO: 61837

SEQ ID NO: 566943 - RNA, 64 nt, hsa; identical to SEQ ID NO: 61838

SEQ ID NO: 566944 - RNA, 64 nt, hsa; identical to SEQ ID NO: 61839

SEQ ID NO: 566945 - RNA, 64 nt, hsa; identical to SEQ ID NO: 61840

SEQ ID NO: 566946 - RNA, 64 nt, hsa; identical to SEQ ID NO: 61841

SEQ ID NO: 566947 - RNA, 64 nt, hsa; identical to SEQ ID NO: 61842

SEQ ID NO: 566948 - RNA, 64 nt, hsa; identical to SEQ ID NO: 61843

SEQ ID NO: 566949 - RNA, 64 nt, hsa; identical to SEQ ID NO: 61844

SEQ ID NO: 566950 - RNA, 64 nt, hsa; identical to SEQ ID NO: 61845

SEQ ID NO: 566951 - RNA, 64 nt, hsa; identical to SEQ ID NO: 61846

SEQ ID NO: 566952 - RNA, 64 nt, hsa; identical to SEQ ID NO: 61847

SEQ ID NO: 566953 - RNA, 64 nt, hsa; identical to SEQ ID NO: 61848

SEQ ID NO: 566954 - RNA, 64 nt, hsa; identical to SEQ ID NO: 61849

SEQ ID NO: 566955 - RNA, 64 nt, hsa; identical to SEQ ID NO: 61850

SEQ ID NO: 566956 - RNA, 64 nt, hsa; identical to SEQ ID NO: 61851

SEQ ID NO: 566957 - RNA, 64 nt, hsa; identical to SEQ ID NO: 61852

SEQ ID NO: 566958 - RNA, 64 nt, hsa; identical to SEQ ID NO: 61853

SEQ ID NO: 566959 - RNA, 64 nt, hsa; identical to SEQ ID NO: 61854

SEQ ID NO: 566960 - RNA, 64 nt, hsa; identical to SEQ ID NO: 61855

SEQ ID NO: 566961 - RNA, 64 nt, hsa; identical to SEQ ID NO: 61856

SEQ ID NO: 566962 - RNA, 64 nt, hsa; identical to SEQ ID NO: 61857

SEQ ID NO: 566963 - RNA, 64 nt, hsa; identical to SEQ ID NO: 61858

SEQ ID NO: 566964 - RNA, 64 nt, hsa; identical to SEQ ID NO: 61859

SEQ ID NO: 566965 - RNA, 64 nt, hsa; identical to SEQ ID NO: 61860

SEQ ID NO: 566966 - RNA, 64 nt, hsa; identical to SEQ ID NO: 61861

SEQ ID NO: 566967 - RNA, 64 nt, hsa; identical to SEQ ID NO: 61862

SEQ ID NO: 566968 - RNA, 64 nt, hsa; identical to SEQ ID NO: 61863

SEQ ID NO: 566969 - RNA, 64 nt, hsa; identical to SEQ ID NO: 61864

SEQ ID NO: 566970 - RNA, 64 nt, hsa; identical to SEQ ID NO: 61865

SEQ ID NO: 566971 - RNA, 64 nt, hsa; identical to SEQ ID NO: 61866

SEQ ID NO: 566972 - RNA, 64 nt, hsa; identical to SEQ ID NO: 61867

SEQ ID NO: 566973 - RNA, 64 nt, hsa; identical to SEQ ID NO: 61868

SEQ ID NO: 566974 - RNA, 64 nt, hsa; identical to SEQ ID NO: 61869

SEQ ID NO: 566975 - RNA, 64 nt, hsa; identical to SEQ ID NO: 61870

SEQ ID NO: 566976 - RNA, 64 nt, hsa; identical to SEQ ID NO: 61871

SEQ ID NO: 566977 - RNA, 64 nt, hsa; identical to SEQ ID NO: 61872

SEQ ID NO: 566978 - RNA, 64 nt, hsa; identical to SEQ ID NO: 61873

SEQ ID NO: 566979 - RNA, 64 nt, hsa; identical to SEQ ID NO: 61874

SEQ ID NO: 566980 - RNA, 64 nt, hsa; identical to SEQ ID NO: 61875

SEQ ID NO: 566981 - RNA, 64 nt, hsa; identical to SEQ ID NO: 61876

SEQ ID NO: 566982 - RNA, 64 nt, hsa; identical to SEQ ID NO: 61877

SEQ ID NO: 566983 - RNA, 64 nt, hsa; identical to SEQ ID NO: 61878

SEQ ID NO: 566984 - RNA, 64 nt, hsa; identical to SEQ ID NO: 61879

SEQ ID NO: 566985 - RNA, 64 nt, hsa; identical to SEQ ID NO: 61880

SEQ ID NO: 566986 - RNA, 64 nt, hsa; identical to SEQ ID NO: 61881

SEQ ID NO: 566987 - RNA, 64 nt, hsa; identical to SEQ ID NO: 61882

SEQ ID NO: 566988 - RNA, 64 nt, hsa; identical to SEQ ID NO: 61883

SEQ ID NO: 566989 - RNA, 64 nt, hsa; identical to SEQ ID NO: 61884

SEQ ID NO: 566990 - RNA, 64 nt, hsa; identical to SEQ ID NO: 61885

SEQ ID NO: 566991 - RNA, 64 nt, hsa; identical to SEQ ID NO: 61886

SEQ ID NO: 566992 - RNA, 64 nt, hsa; identical to SEQ ID NO: 61887

SEQ ID NO: 566993 - RNA, 64 nt, hsa; identical to SEQ ID NO: 61888

SEQ ID NO: 566994 - RNA, 64 nt, hsa; identical to SEQ ID NO: 61889

SEQ ID NO: 566995 - RNA, 64 nt, hsa; identical to SEQ ID NO: 61890

SEQ ID NO: 566996 - RNA, 64 nt, hsa; identical to SEQ ID NO: 61891

SEQ ID NO: 566997 - RNA, 64 nt, hsa; identical to SEQ ID NO: 61892

SEQ ID NO: 566998 - RNA, 64 nt, hsa; identical to SEQ ID NO: 61893

SEQ ID NO: 566999 - RNA, 64 nt, hsa; identical to SEQ ID NO: 61894

SEQ ID NO: 567000 - RNA, 64 nt, hsa; identical to SEQ ID NO: 61895

SEQ ID NO: 567001 - RNA, 64 nt, hsa; identical to SEQ ID NO: 61896

SEQ ID NO: 567002 - RNA, 64 nt, hsa; identical to SEQ ID NO: 61897

SEQ ID NO: 567003 - RNA, 64 nt, hsa; identical to SEQ ID NO: 61898

SEQ ID NO: 567004 - RNA, 64 nt, hsa; identical to SEQ ID NO: 61899

SEQ ID NO: 567005 - RNA, 64 nt, hsa; identical to SEQ ID NO: 61900

SEQ ID NO: 567006 - RNA, 64 nt, hsa; identical to SEQ ID NO: 61901

SEQ ID NO: 567007 - RNA, 64 nt, hsa; identical to SEQ ID NO: 61902

SEQ ID NO: 567008 - RNA, 64 nt, hsa; identical to SEQ ID NO: 61903

SEQ ID NO: 567009 - RNA, 64 nt, hsa; identical to SEQ ID NO: 61904

SEQ ID NO: 567010 - RNA, 64 nt, hsa; identical to SEQ ID NO: 61905

SEQ ID NO: 567011 - RNA, 64 nt, hsa; identical to SEQ ID NO: 61906

SEQ ID NO: 567012 - RNA, 64 nt, hsa; identical to SEQ ID NO: 61907

SEQ ID NO: 567013 - RNA, 64 nt, hsa; identical to SEQ ID NO: 61908

SEQ ID NO: 567014 - RNA, 64 nt, hsa; identical to SEQ ID NO: 61909

SEQ ID NO: 567015 - RNA, 64 nt, hsa; identical to SEQ ID NO: 61910

SEQ ID NO: 567016 - RNA, 64 nt, hsa; identical to SEQ ID NO: 61911

SEQ ID NO: 567017 - RNA, 64 nt, hsa; identical to SEQ ID NO: 61912

SEQ ID NO: 567018 - RNA, 64 nt, hsa; identical to SEQ ID NO: 61913

SEQ ID NO: 567019 - RNA, 64 nt, hsa; identical to SEQ ID NO: 61914

SEQ ID NO: 567020 - RNA, 64 nt, hsa; identical to SEQ ID NO: 61915

SEQ ID NO: 567021 - RNA, 64 nt, hsa; identical to SEQ ID NO: 61916

SEQ ID NO: 567022 - RNA, 64 nt, hsa; identical to SEQ ID NO: 61917

SEQ ID NO: 567023 - RNA, 64 nt, hsa; identical to SEQ ID NO: 61918

SEQ ID NO: 567024 - RNA, 64 nt, hsa; identical to SEQ ID NO: 61919

SEQ ID NO: 567025 - RNA, 64 nt, hsa; identical to SEQ ID NO: 61920

SEQ ID NO: 567026 - RNA, 64 nt, hsa; identical to SEQ ID NO: 61921

SEQ ID NO: 567027 - RNA, 64 nt, hsa; identical to SEQ ID NO: 61922

SEQ ID NO: 567028 - RNA, 64 nt, hsa; identical to SEQ ID NO: 61923

SEQ ID NO: 567029 - RNA, 64 nt, hsa; identical to SEQ ID NO: 61924

SEQ ID NO: 567030 - RNA, 64 nt, hsa; identical to SEQ ID NO: 61925

SEQ ID NO: 567031 - RNA, 64 nt, hsa; identical to SEQ ID NO: 61926

SEQ ID NO: 567032 - RNA, 64 nt, hsa; identical to SEQ ID NO: 61927

SEQ ID NO: 567033 - RNA, 64 nt, hsa; identical to SEQ ID NO: 61928

SEQ ID NO: 567034 - RNA, 64 nt, hsa; identical to SEQ ID NO: 61929

SEQ ID NO: 567035 - RNA, 64 nt, hsa; identical to SEQ ID NO: 61930

SEQ ID NO: 567036 - RNA, 64 nt, hsa; identical to SEQ ID NO: 61931

SEQ ID NO: 567037 - RNA, 64 nt, hsa; identical to SEQ ID NO: 61932

SEQ ID NO: 567038 - RNA, 64 nt, hsa; identical to SEQ ID NO: 61933

SEQ ID NO: 567039 - RNA, 64 nt, hsa; identical to SEQ ID NO: 61934

SEQ ID NO: 567040 - RNA, 64 nt, hsa; identical to SEQ ID NO: 61935

SEQ ID NO: 567041 - RNA, 64 nt, hsa; identical to SEQ ID NO: 61936

SEQ ID NO: 567042 - RNA, 64 nt, hsa; identical to SEQ ID NO: 61937

SEQ ID NO: 567043 - RNA, 64 nt, hsa; identical to SEQ ID NO: 61938

SEQ ID NO: 567044 - RNA, 64 nt, hsa; identical to SEQ ID NO: 61939

SEQ ID NO: 567045 - RNA, 64 nt, hsa; identical to SEQ ID NO: 61940

SEQ ID NO: 567046 - RNA, 64 nt, hsa; identical to SEQ ID NO: 61941

SEQ ID NO: 567047 - RNA, 64 nt, hsa; identical to SEQ ID NO: 61942

SEQ ID NO: 567048 - RNA, 64 nt, hsa; identical to SEQ ID NO: 61943

SEQ ID NO: 567049 - RNA, 64 nt, hsa; identical to SEQ ID NO: 61944

SEQ ID NO: 567050 - RNA, 64 nt, hsa; identical to SEQ ID NO: 61945

SEQ ID NO: 567051 - RNA, 64 nt, hsa; identical to SEQ ID NO: 61946

SEQ ID NO: 567052 - RNA, 64 nt, hsa; identical to SEQ ID NO: 61947

SEQ ID NO: 567053 - RNA, 64 nt, hsa; identical to SEQ ID NO: 61948

SEQ ID NO: 567054 - RNA, 64 nt, hsa; identical to SEQ ID NO: 61949

SEQ ID NO: 567055 - RNA, 64 nt, hsa; identical to SEQ ID NO: 61950

SEQ ID NO: 567056 - RNA, 64 nt, hsa; identical to SEQ ID NO: 61951

SEQ ID NO: 567057 - RNA, 64 nt, hsa; identical to SEQ ID NO: 61952

SEQ ID NO: 567058 - RNA, 64 nt, hsa; identical to SEQ ID NO: 61953

SEQ ID NO: 567059 - RNA, 64 nt, hsa; identical to SEQ ID NO: 61954

SEQ ID NO: 567060 - RNA, 64 nt, hsa; identical to SEQ ID NO: 61955

SEQ ID NO: 567061 - RNA, 64 nt, hsa; identical to SEQ ID NO: 61956

SEQ ID NO: 567062 - RNA, 64 nt, hsa; identical to SEQ ID NO: 61957

SEQ ID NO: 567063 - RNA, 64 nt, hsa; identical to SEQ ID NO: 61958

SEQ ID NO: 567064 - RNA, 64 nt, hsa; identical to SEQ ID NO: 61959

SEQ ID NO: 567065 - RNA, 64 nt, hsa; identical to SEQ ID NO: 61960

SEQ ID NO: 567066 - RNA, 64 nt, hsa; identical to SEQ ID NO: 61961

SEQ ID NO: 567067 - RNA, 64 nt, hsa; identical to SEQ ID NO: 61962

SEQ ID NO: 567068 - RNA, 64 nt, hsa; identical to SEQ ID NO: 61963

SEQ ID NO: 567069 - RNA, 64 nt, hsa; identical to SEQ ID NO: 61964

SEQ ID NO: 567070 - RNA, 64 nt, hsa; identical to SEQ ID NO: 61965

SEQ ID NO: 567071 - RNA, 64 nt, hsa; identical to SEQ ID NO: 61966

SEQ ID NO: 567072 - RNA, 64 nt, hsa; identical to SEQ ID NO: 61967

SEQ ID NO: 567073 - RNA, 64 nt, hsa; identical to SEQ ID NO: 61968

SEQ ID NO: 567074 - RNA, 64 nt, hsa; identical to SEQ ID NO: 61969

SEQ ID NO: 567075 - RNA, 64 nt, hsa; identical to SEQ ID NO: 61970

SEQ ID NO: 567076 - RNA, 64 nt, hsa; identical to SEQ ID NO: 61971

SEQ ID NO: 567077 - RNA, 64 nt, hsa; identical to SEQ ID NO: 61972

SEQ ID NO: 567078 - RNA, 64 nt, hsa; identical to SEQ ID NO: 61973

SEQ ID NO: 567079 - RNA, 64 nt, hsa; identical to SEQ ID NO: 61974

SEQ ID NO: 567080 - RNA, 64 nt, hsa; identical to SEQ ID NO: 61975

SEQ ID NO: 567081 - RNA, 64 nt, hsa; identical to SEQ ID NO: 61976

SEQ ID NO: 567082 - RNA, 64 nt, hsa; identical to SEQ ID NO: 61977

SEQ ID NO: 567083 - RNA, 64 nt, hsa; identical to SEQ ID NO: 61978

SEQ ID NO: 567084 - RNA, 64 nt, hsa; identical to SEQ ID NO: 61979

SEQ ID NO: 567085 - RNA, 64 nt, hsa; identical to SEQ ID NO: 61980

SEQ ID NO: 567086 - RNA, 64 nt, hsa; identical to SEQ ID NO: 61981

SEQ ID NO: 567087 - RNA, 64 nt, hsa; identical to SEQ ID NO: 61982

SEQ ID NO: 567088 - RNA, 64 nt, hsa; identical to SEQ ID NO: 61983

SEQ ID NO: 567089 - RNA, 64 nt, hsa; identical to SEQ ID NO: 61984

SEQ ID NO: 567090 - RNA, 64 nt, hsa; identical to SEQ ID NO: 61985

SEQ ID NO: 567091 - RNA, 64 nt, hsa; identical to SEQ ID NO: 61986

SEQ ID NO: 567092 - RNA, 64 nt, hsa; identical to SEQ ID NO: 61987

SEQ ID NO: 567093 - RNA, 64 nt, hsa; identical to SEQ ID NO: 61988

SEQ ID NO: 567094 - RNA, 64 nt, hsa; identical to SEQ ID NO: 61989

SEQ ID NO: 567095 - RNA, 64 nt, hsa; identical to SEQ ID NO: 61990

SEQ ID NO: 567096 - RNA, 64 nt, hsa; identical to SEQ ID NO: 61991

SEQ ID NO: 567097 - RNA, 64 nt, hsa; identical to SEQ ID NO: 61992

SEQ ID NO: 567098 - RNA, 64 nt, hsa; identical to SEQ ID NO: 61993

SEQ ID NO: 567099 - RNA, 64 nt, hsa; identical to SEQ ID NO: 61994

SEQ ID NO: 567100 - RNA, 64 nt, hsa; identical to SEQ ID NO: 61995

SEQ ID NO: 567101 - RNA, 64 nt, hsa; identical to SEQ ID NO: 61996

SEQ ID NO: 567102 - RNA, 64 nt, hsa; identical to SEQ ID NO: 61997

SEQ ID NO: 567103 - RNA, 64 nt, hsa; identical to SEQ ID NO: 61998

SEQ ID NO: 567104 - RNA, 64 nt, hsa; identical to SEQ ID NO: 61999

SEQ ID NO: 567105 - RNA, 64 nt, hsa; identical to SEQ ID NO: 62000

SEQ ID NO: 567106 - RNA, 64 nt, hsa; identical to SEQ ID NO: 62001

SEQ ID NO: 567107 - RNA, 64 nt, hsa; identical to SEQ ID NO: 62002

SEQ ID NO: 567108 - RNA, 64 nt, hsa; identical to SEQ ID NO: 62003

SEQ ID NO: 567109 - RNA, 64 nt, hsa; identical to SEQ ID NO: 62004

SEQ ID NO: 567110 - RNA, 64 nt, hsa; identical to SEQ ID NO: 62005

SEQ ID NO: 567111 - RNA, 64 nt, hsa; identical to SEQ ID NO: 62006

SEQ ID NO: 567112 - RNA, 64 nt, hsa; identical to SEQ ID NO: 62007

SEQ ID NO: 567113 - RNA, 64 nt, hsa; identical to SEQ ID NO: 62008

SEQ ID NO: 567114 - RNA, 64 nt, hsa; identical to SEQ ID NO: 62009

SEQ ID NO: 567115 - RNA, 64 nt, hsa; identical to SEQ ID NO: 62010

SEQ ID NO: 567116 - RNA, 64 nt, hsa; identical to SEQ ID NO: 62011

SEQ ID NO: 567117 - RNA, 64 nt, hsa; identical to SEQ ID NO: 62012

SEQ ID NO: 567118 - RNA, 64 nt, hsa; identical to SEQ ID NO: 62013

SEQ ID NO: 567119 - RNA, 64 nt, hsa; identical to SEQ ID NO: 62014

SEQ ID NO: 567120 - RNA, 64 nt, hsa; identical to SEQ ID NO: 62015

SEQ ID NO: 567121 - RNA, 64 nt, hsa; identical to SEQ ID NO: 62016

SEQ ID NO: 567122 - RNA, 64 nt, hsa; identical to SEQ ID NO: 62017

SEQ ID NO: 567123 - RNA, 64 nt, hsa; identical to SEQ ID NO: 62018

SEQ ID NO: 567124 - RNA, 64 nt, hsa; identical to SEQ ID NO: 62019

SEQ ID NO: 567125 - RNA, 64 nt, hsa; identical to SEQ ID NO: 62020

SEQ ID NO: 567126 - RNA, 64 nt, hsa; identical to SEQ ID NO: 62021

SEQ ID NO: 567127 - RNA, 64 nt, hsa; identical to SEQ ID NO: 62022

SEQ ID NO: 567128 - RNA, 64 nt, hsa; identical to SEQ ID NO: 62023

SEQ ID NO: 567129 - RNA, 64 nt, hsa; identical to SEQ ID NO: 62024

SEQ ID NO: 567130 - RNA, 64 nt, hsa; identical to SEQ ID NO: 62025

SEQ ID NO: 567131 - RNA, 64 nt, hsa; identical to SEQ ID NO: 62026

SEQ ID NO: 567132 - RNA, 64 nt, hsa; identical to SEQ ID NO: 62027

SEQ ID NO: 567133 - RNA, 64 nt, hsa; identical to SEQ ID NO: 62028

SEQ ID NO: 567134 - RNA, 64 nt, hsa; identical to SEQ ID NO: 62029

SEQ ID NO: 567135 - RNA, 64 nt, hsa; identical to SEQ ID NO: 62030

SEQ ID NO: 567136 - RNA, 64 nt, hsa; identical to SEQ ID NO: 62031

SEQ ID NO: 567137 - RNA, 64 nt, hsa; identical to SEQ ID NO: 62032

SEQ ID NO: 567138 - RNA, 64 nt, hsa; identical to SEQ ID NO: 62033

SEQ ID NO: 567139 - RNA, 64 nt, hsa; identical to SEQ ID NO: 62034

SEQ ID NO: 567140 - RNA, 64 nt, hsa; identical to SEQ ID NO: 62035

SEQ ID NO: 567141 - RNA, 64 nt, hsa; identical to SEQ ID NO: 62036

SEQ ID NO: 567142 - RNA, 64 nt, hsa; identical to SEQ ID NO: 62037

SEQ ID NO: 567143 - RNA, 64 nt, hsa; identical to SEQ ID NO: 62038

SEQ ID NO: 567144 - RNA, 64 nt, hsa; identical to SEQ ID NO: 62039

SEQ ID NO: 567145 - RNA, 64 nt, hsa; identical to SEQ ID NO: 62040

SEQ ID NO: 567146 - RNA, 64 nt, hsa; identical to SEQ ID NO: 62041

SEQ ID NO: 567147 - RNA, 64 nt, hsa; identical to SEQ ID NO: 62042

SEQ ID NO: 567148 - RNA, 64 nt, hsa; identical to SEQ ID NO: 62043

SEQ ID NO: 567149 - RNA, 64 nt, hsa; identical to SEQ ID NO: 62044

SEQ ID NO: 567150 - RNA, 64 nt, hsa; identical to SEQ ID NO: 62045

SEQ ID NO: 567151 - RNA, 64 nt, hsa; identical to SEQ ID NO: 62046

SEQ ID NO: 567152 - RNA, 64 nt, hsa; identical to SEQ ID NO: 62047

SEQ ID NO: 567153 - RNA, 64 nt, hsa; identical to SEQ ID NO: 62048

SEQ ID NO: 567154 - RNA, 64 nt, hsa; identical to SEQ ID NO: 62049

SEQ ID NO: 567155 - RNA, 64 nt, hsa; identical to SEQ ID NO: 62050

SEQ ID NO: 567156 - RNA, 64 nt, hsa; identical to SEQ ID NO: 62051

SEQ ID NO: 567157 - RNA, 64 nt, hsa; identical to SEQ ID NO: 62052

SEQ ID NO: 567158 - RNA, 57 nt, hsa; identical to SEQ ID NO: 62053

SEQ ID NO: 567159 - RNA, 64 nt, hsa; identical to SEQ ID NO: 62054

SEQ ID NO: 567160 - RNA, 64 nt, hsa; identical to SEQ ID NO: 62055

SEQ ID NO: 567161 - RNA, 64 nt, hsa; identical to SEQ ID NO: 62056

SEQ ID NO: 567162 - RNA, 64 nt, hsa; identical to SEQ ID NO: 62057

SEQ ID NO: 567163 - RNA, 64 nt, hsa; identical to SEQ ID NO: 62058

SEQ ID NO: 567164 - RNA, 64 nt, hsa; identical to SEQ ID NO: 62059

SEQ ID NO: 567165 - RNA, 64 nt, hsa; identical to SEQ ID NO: 62060

SEQ ID NO: 567166 - RNA, 64 nt, hsa; identical to SEQ ID NO: 62061

SEQ ID NO: 567167 - RNA, 64 nt, hsa; identical to SEQ ID NO: 62062

SEQ ID NO: 567168 - RNA, 64 nt, hsa; identical to SEQ ID NO: 62063

SEQ ID NO: 567169 - RNA, 64 nt, hsa; identical to SEQ ID NO: 62064

SEQ ID NO: 567170 - RNA, 64 nt, hsa; identical to SEQ ID NO: 62065

SEQ ID NO: 567171 - RNA, 64 nt, hsa; identical to SEQ ID NO: 62066

SEQ ID NO: 567172 - RNA, 64 nt, hsa; identical to SEQ ID NO: 62067

SEQ ID NO: 567173 - RNA, 64 nt, hsa; identical to SEQ ID NO: 62068

SEQ ID NO: 567174 - RNA, 64 nt, hsa; identical to SEQ ID NO: 62069

SEQ ID NO: 567175 - RNA, 64 nt, hsa; identical to SEQ ID NO: 62070

SEQ ID NO: 567176 - RNA, 64 nt, hsa; identical to SEQ ID NO: 62071

SEQ ID NO: 567177 - RNA, 64 nt, hsa; identical to SEQ ID NO: 62072

SEQ ID NO: 567178 - RNA, 64 nt, hsa; identical to SEQ ID NO: 62073

SEQ ID NO: 567179 - RNA, 64 nt, hsa; identical to SEQ ID NO: 62074

SEQ ID NO: 567180 - RNA, 64 nt, hsa; identical to SEQ ID NO: 62075

SEQ ID NO: 567181 - RNA, 64 nt, hsa; identical to SEQ ID NO: 62076

SEQ ID NO: 567182 - RNA, 64 nt, hsa; identical to SEQ ID NO: 62077

SEQ ID NO: 567183 - RNA, 64 nt, hsa; identical to SEQ ID NO: 62078

SEQ ID NO: 567184 - RNA, 64 nt, hsa; identical to SEQ ID NO: 62079

SEQ ID NO: 567185 - RNA, 64 nt, hsa; identical to SEQ ID NO: 62080

SEQ ID NO: 567186 - RNA, 64 nt, hsa; identical to SEQ ID NO: 62081

SEQ ID NO: 567187 - RNA, 64 nt, hsa; identical to SEQ ID NO: 62082

SEQ ID NO: 567188 - RNA, 64 nt, hsa; identical to SEQ ID NO: 62083

SEQ ID NO: 567189 - RNA, 64 nt, hsa; identical to SEQ ID NO: 62084

SEQ ID NO: 567190 - RNA, 64 nt, hsa; identical to SEQ ID NO: 62085

SEQ ID NO: 567191 - RNA, 64 nt, hsa; identical to SEQ ID NO: 62086

SEQ ID NO: 567192 - RNA, 64 nt, hsa; identical to SEQ ID NO: 62087

SEQ ID NO: 567193 - RNA, 64 nt, hsa; identical to SEQ ID NO: 62088

SEQ ID NO: 567194 - RNA, 64 nt, hsa; identical to SEQ ID NO: 62089

SEQ ID NO: 567195 - RNA, 64 nt, hsa; identical to SEQ ID NO: 62090

SEQ ID NO: 567196 - RNA, 64 nt, hsa; identical to SEQ ID NO: 62091

SEQ ID NO: 567197 - RNA, 64 nt, hsa; identical to SEQ ID NO: 62092

SEQ ID NO: 567198 - RNA, 64 nt, hsa; identical to SEQ ID NO: 62093

SEQ ID NO: 567199 - RNA, 64 nt, hsa; identical to SEQ ID NO: 62094

SEQ ID NO: 567200 - RNA, 64 nt, hsa; identical to SEQ ID NO: 62095

SEQ ID NO: 567201 - RNA, 64 nt, hsa; identical to SEQ ID NO: 62096

SEQ ID NO: 567202 - RNA, 64 nt, hsa; identical to SEQ ID NO: 62097

SEQ ID NO: 567203 - RNA, 64 nt, hsa; identical to SEQ ID NO: 62098

SEQ ID NO: 567204 - RNA, 64 nt, hsa; identical to SEQ ID NO: 62099

SEQ ID NO: 567205 - RNA, 64 nt, hsa; identical to SEQ ID NO: 62100

SEQ ID NO: 567206 - RNA, 64 nt, hsa; identical to SEQ ID NO: 62101

SEQ ID NO: 567207 - RNA, 64 nt, hsa; identical to SEQ ID NO: 62102

SEQ ID NO: 567208 - RNA, 64 nt, hsa; identical to SEQ ID NO: 62103

SEQ ID NO: 567209 - RNA, 64 nt, hsa; identical to SEQ ID NO: 62104

SEQ ID NO: 567210 - RNA, 64 nt, hsa; identical to SEQ ID NO: 62105

SEQ ID NO: 567211 - RNA, 64 nt, hsa; identical to SEQ ID NO: 62106

SEQ ID NO: 567212 - RNA, 64 nt, hsa; identical to SEQ ID NO: 62107

SEQ ID NO: 567213 - RNA, 64 nt, hsa; identical to SEQ ID NO: 62108

SEQ ID NO: 567214 - RNA, 64 nt, hsa; identical to SEQ ID NO: 62109

SEQ ID NO: 567215 - RNA, 64 nt, hsa; identical to SEQ ID NO: 62110

SEQ ID NO: 567216 - RNA, 64 nt, hsa; identical to SEQ ID NO: 62111

SEQ ID NO: 567217 - RNA, 64 nt, hsa; identical to SEQ ID NO: 62112

SEQ ID NO: 567218 - RNA, 64 nt, hsa; identical to SEQ ID NO: 62113

SEQ ID NO: 567219 - RNA, 64 nt, hsa; identical to SEQ ID NO: 62114

SEQ ID NO: 567220 - RNA, 64 nt, hsa; identical to SEQ ID NO: 62115

SEQ ID NO: 567221 - RNA, 64 nt, hsa; identical to SEQ ID NO: 62116

SEQ ID NO: 567222 - RNA, 64 nt, hsa; identical to SEQ ID NO: 62117

SEQ ID NO: 567223 - RNA, 64 nt, hsa; identical to SEQ ID NO: 62118

SEQ ID NO: 567224 - RNA, 64 nt, hsa; identical to SEQ ID NO: 62119

SEQ ID NO: 567225 - RNA, 64 nt, hsa; identical to SEQ ID NO: 62120

SEQ ID NO: 567226 - RNA, 64 nt, hsa; identical to SEQ ID NO: 62121

SEQ ID NO: 567227 - RNA, 64 nt, hsa; identical to SEQ ID NO: 62122

SEQ ID NO: 567228 - RNA, 64 nt, hsa; identical to SEQ ID NO: 62123

SEQ ID NO: 567229 - RNA, 64 nt, hsa; identical to SEQ ID NO: 62124

SEQ ID NO: 567230 - RNA, 64 nt, hsa; identical to SEQ ID NO: 62125

SEQ ID NO: 567231 - RNA, 64 nt, hsa; identical to SEQ ID NO: 62126

SEQ ID NO: 567232 - RNA, 64 nt, hsa; identical to SEQ ID NO: 62127

SEQ ID NO: 567233 - RNA, 64 nt, hsa; identical to SEQ ID NO: 62128

SEQ ID NO: 567234 - RNA, 64 nt, hsa; identical to SEQ ID NO: 62129

SEQ ID NO: 567235 - RNA, 64 nt, hsa; identical to SEQ ID NO: 62130

SEQ ID NO: 567236 - RNA, 64 nt, hsa; identical to SEQ ID NO: 62131

SEQ ID NO: 567237 - RNA, 64 nt, hsa; identical to SEQ ID NO: 62132

SEQ ID NO: 567238 - RNA, 64 nt, hsa; identical to SEQ ID NO: 62133

SEQ ID NO: 567239 - RNA, 64 nt, hsa; identical to SEQ ID NO: 62134

SEQ ID NO: 567240 - RNA, 64 nt, hsa; identical to SEQ ID NO: 62135

SEQ ID NO: 567241 - RNA, 64 nt, hsa; identical to SEQ ID NO: 62136

SEQ ID NO: 567242 - RNA, 64 nt, hsa; identical to SEQ ID NO: 62137

SEQ ID NO: 567243 - RNA, 64 nt, hsa; identical to SEQ ID NO: 62138

SEQ ID NO: 567244 - RNA, 64 nt, hsa; identical to SEQ ID NO: 62139

SEQ ID NO: 567245 - RNA, 64 nt, hsa; identical to SEQ ID NO: 62140

SEQ ID NO: 567246 - RNA, 64 nt, hsa; identical to SEQ ID NO: 62141

SEQ ID NO: 567247 - RNA, 64 nt, hsa; identical to SEQ ID NO: 62142

SEQ ID NO: 567248 - RNA, 64 nt, hsa; identical to SEQ ID NO: 62143

SEQ ID NO: 567249 - RNA, 64 nt, hsa; identical to SEQ ID NO: 62144

SEQ ID NO: 567250 - RNA, 64 nt, hsa; identical to SEQ ID NO: 62145

SEQ ID NO: 567251 - RNA, 64 nt, hsa; identical to SEQ ID NO: 62146

SEQ ID NO: 567252 - RNA, 64 nt, hsa; identical to SEQ ID NO: 62147

SEQ ID NO: 567253 - RNA, 64 nt, hsa; identical to SEQ ID NO: 62148

SEQ ID NO: 567254 - RNA, 64 nt, hsa; identical to SEQ ID NO: 62149

SEQ ID NO: 567255 - RNA, 64 nt, hsa; identical to SEQ ID NO: 62150

SEQ ID NO: 567256 - RNA, 64 nt, hsa; identical to SEQ ID NO: 62151

SEQ ID NO: 567257 - RNA, 64 nt, hsa; identical to SEQ ID NO: 62152

SEQ ID NO: 567258 - RNA, 64 nt, hsa; identical to SEQ ID NO: 62153

SEQ ID NO: 567259 - RNA, 64 nt, hsa; identical to SEQ ID NO: 62154

SEQ ID NO: 567260 - RNA, 64 nt, hsa; identical to SEQ ID NO: 62155

SEQ ID NO: 567261 - RNA, 64 nt, hsa; identical to SEQ ID NO: 62156

SEQ ID NO: 567262 - RNA, 64 nt, hsa; identical to SEQ ID NO: 62157

SEQ ID NO: 567263 - RNA, 64 nt, hsa; identical to SEQ ID NO: 62158

SEQ ID NO: 567264 - RNA, 64 nt, hsa; identical to SEQ ID NO: 62159

SEQ ID NO: 567265 - RNA, 64 nt, hsa; identical to SEQ ID NO: 62160

SEQ ID NO: 567266 - RNA, 64 nt, hsa; identical to SEQ ID NO: 62161

SEQ ID NO: 567267 - RNA, 64 nt, hsa; identical to SEQ ID NO: 62162

SEQ ID NO: 567268 - RNA, 64 nt, hsa; identical to SEQ ID NO: 62163

SEQ ID NO: 567269 - RNA, 64 nt, hsa; identical to SEQ ID NO: 62164

SEQ ID NO: 567270 - RNA, 64 nt, hsa; identical to SEQ ID NO: 62165

SEQ ID NO: 567271 - RNA, 64 nt, hsa; identical to SEQ ID NO: 62166

SEQ ID NO: 567272 - RNA, 64 nt, hsa; identical to SEQ ID NO: 62167

SEQ ID NO: 567273 - RNA, 64 nt, hsa; identical to SEQ ID NO: 62168

SEQ ID NO: 567274 - RNA, 64 nt, hsa; identical to SEQ ID NO: 62169

SEQ ID NO: 567275 - RNA, 64 nt, hsa; identical to SEQ ID NO: 62170

SEQ ID NO: 567276 - RNA, 64 nt, hsa; identical to SEQ ID NO: 62171

SEQ ID NO: 567277 - RNA, 64 nt, hsa; identical to SEQ ID NO: 62172

SEQ ID NO: 567278 - RNA, 64 nt, hsa; identical to SEQ ID NO: 62173

SEQ ID NO: 567279 - RNA, 64 nt, hsa; identical to SEQ ID NO: 62174

SEQ ID NO: 567280 - RNA, 64 nt, hsa; identical to SEQ ID NO: 62175

SEQ ID NO: 567281 - RNA, 64 nt, hsa; identical to SEQ ID NO: 62176

SEQ ID NO: 567282 - RNA, 64 nt, hsa; identical to SEQ ID NO: 62177

SEQ ID NO: 567283 - RNA, 64 nt, hsa; identical to SEQ ID NO: 62178

SEQ ID NO: 567284 - RNA, 64 nt, hsa; identical to SEQ ID NO: 62179

SEQ ID NO: 567285 - RNA, 64 nt, hsa; identical to SEQ ID NO: 62180

SEQ ID NO: 567286 - RNA, 64 nt, hsa; identical to SEQ ID NO: 62181

SEQ ID NO: 567287 - RNA, 64 nt, hsa; identical to SEQ ID NO: 62182

SEQ ID NO: 567288 - RNA, 64 nt, hsa; identical to SEQ ID NO: 62183

SEQ ID NO: 567289 - RNA, 64 nt, hsa; identical to SEQ ID NO: 62184

SEQ ID NO: 567290 - RNA, 64 nt, hsa; identical to SEQ ID NO: 62185

SEQ ID NO: 567291 - RNA, 64 nt, hsa; identical to SEQ ID NO: 62186

SEQ ID NO: 567292 - RNA, 64 nt, hsa; identical to SEQ ID NO: 62187

SEQ ID NO: 567293 - RNA, 64 nt, hsa; identical to SEQ ID NO: 62188

SEQ ID NO: 567294 - RNA, 64 nt, hsa; identical to SEQ ID NO: 62189

SEQ ID NO: 567295 - RNA, 64 nt, hsa; identical to SEQ ID NO: 62190

SEQ ID NO: 567296 - RNA, 64 nt, hsa; identical to SEQ ID NO: 62191

SEQ ID NO: 567297 - RNA, 64 nt, hsa; identical to SEQ ID NO: 62192

SEQ ID NO: 567298 - RNA, 64 nt, hsa; identical to SEQ ID NO: 62193

SEQ ID NO: 567299 - RNA, 64 nt, hsa; identical to SEQ ID NO: 62194

SEQ ID NO: 567300 - RNA, 64 nt, hsa; identical to SEQ ID NO: 62195

SEQ ID NO: 567301 - RNA, 64 nt, hsa; identical to SEQ ID NO: 62196

SEQ ID NO: 567302 - RNA, 64 nt, hsa; identical to SEQ ID NO: 62197

SEQ ID NO: 567303 - RNA, 64 nt, hsa; identical to SEQ ID NO: 62198

SEQ ID NO: 567304 - RNA, 64 nt, hsa; identical to SEQ ID NO: 62199

SEQ ID NO: 567305 - RNA, 64 nt, hsa; identical to SEQ ID NO: 62200

SEQ ID NO: 567306 - RNA, 64 nt, hsa; identical to SEQ ID NO: 62201

SEQ ID NO: 567307 - RNA, 64 nt, hsa; identical to SEQ ID NO: 62202

SEQ ID NO: 567308 - RNA, 62 nt, hsa; identical to SEQ ID NO: 62203

SEQ ID NO: 567309 - RNA, 64 nt, hsa; identical to SEQ ID NO: 62204

SEQ ID NO: 567310 - RNA, 64 nt, hsa; identical to SEQ ID NO: 62205

SEQ ID NO: 567311 - RNA, 64 nt, hsa; identical to SEQ ID NO: 62206

SEQ ID NO: 567312 - RNA, 64 nt, hsa; identical to SEQ ID NO: 62207

SEQ ID NO: 567313 - RNA, 64 nt, hsa; identical to SEQ ID NO: 62208

SEQ ID NO: 567314 - RNA, 64 nt, hsa; identical to SEQ ID NO: 62209

SEQ ID NO: 567315 - RNA, 64 nt, hsa; identical to SEQ ID NO: 62210

SEQ ID NO: 567316 - RNA, 64 nt, hsa; identical to SEQ ID NO: 62211

SEQ ID NO: 567317 - RNA, 64 nt, hsa; identical to SEQ ID NO: 62212

SEQ ID NO: 567318 - RNA, 64 nt, hsa; identical to SEQ ID NO: 62213

SEQ ID NO: 567319 - RNA, 64 nt, hsa; identical to SEQ ID NO: 62214

SEQ ID NO: 567320 - RNA, 64 nt, hsa; identical to SEQ ID NO: 62215

SEQ ID NO: 567321 - RNA, 64 nt, hsa; identical to SEQ ID NO: 62216

SEQ ID NO: 567322 - RNA, 64 nt, hsa; identical to SEQ ID NO: 62217

SEQ ID NO: 567323 - RNA, 64 nt, hsa; identical to SEQ ID NO: 62218

SEQ ID NO: 567324 - RNA, 64 nt, hsa; identical to SEQ ID NO: 62219

SEQ ID NO: 567325 - RNA, 64 nt, hsa; identical to SEQ ID NO: 62220

SEQ ID NO: 567326 - RNA, 64 nt, hsa; identical to SEQ ID NO: 62221

SEQ ID NO: 567327 - RNA, 64 nt, hsa; identical to SEQ ID NO: 62222

SEQ ID NO: 567328 - RNA, 64 nt, hsa; identical to SEQ ID NO: 62223

SEQ ID NO: 567329 - RNA, 64 nt, hsa; identical to SEQ ID NO: 62224

SEQ ID NO: 567330 - RNA, 64 nt, hsa; identical to SEQ ID NO: 62225

SEQ ID NO: 567331 - RNA, 64 nt, hsa; identical to SEQ ID NO: 62226

SEQ ID NO: 567332 - RNA, 64 nt, hsa; identical to SEQ ID NO: 62227

SEQ ID NO: 567333 - RNA, 64 nt, hsa; identical to SEQ ID NO: 62228

SEQ ID NO: 567334 - RNA, 64 nt, hsa; identical to SEQ ID NO: 62229

SEQ ID NO: 567335 - RNA, 64 nt, hsa; identical to SEQ ID NO: 62230

SEQ ID NO: 567336 - RNA, 60 nt, hsa; identical to SEQ ID NO: 62231

SEQ ID NO: 567337 - RNA, 64 nt, hsa; identical to SEQ ID NO: 62232

SEQ ID NO: 567338 - RNA, 64 nt, hsa; identical to SEQ ID NO: 62233

SEQ ID NO: 567339 - RNA, 64 nt, hsa; identical to SEQ ID NO: 62234

SEQ ID NO: 567340 - RNA, 64 nt, hsa; identical to SEQ ID NO: 62235

SEQ ID NO: 567341 - RNA, 64 nt, hsa; identical to SEQ ID NO: 62236

SEQ ID NO: 567342 - RNA, 64 nt, hsa; identical to SEQ ID NO: 62237

SEQ ID NO: 567343 - RNA, 64 nt, hsa; identical to SEQ ID NO: 62238

SEQ ID NO: 567344 - RNA, 64 nt, hsa; identical to SEQ ID NO: 62239

SEQ ID NO: 567345 - RNA, 64 nt, hsa; identical to SEQ ID NO: 62240

SEQ ID NO: 567346 - RNA, 64 nt, hsa; identical to SEQ ID NO: 62241

SEQ ID NO: 567347 - RNA, 64 nt, hsa; identical to SEQ ID NO: 62242

SEQ ID NO: 567348 - RNA, 64 nt, hsa; identical to SEQ ID NO: 62243

SEQ ID NO: 567349 - RNA, 64 nt, hsa; identical to SEQ ID NO: 62244

SEQ ID NO: 567350 - RNA, 64 nt, hsa; identical to SEQ ID NO: 62245

SEQ ID NO: 567351 - RNA, 64 nt, hsa; identical to SEQ ID NO: 62246

SEQ ID NO: 567352 - RNA, 64 nt, hsa; identical to SEQ ID NO: 62247

SEQ ID NO: 567353 - RNA, 64 nt, hsa; identical to SEQ ID NO: 62248

SEQ ID NO: 567354 - RNA, 64 nt, hsa; identical to SEQ ID NO: 62249

SEQ ID NO: 567355 - RNA, 64 nt, hsa; identical to SEQ ID NO: 62250

SEQ ID NO: 567356 - RNA, 64 nt, hsa; identical to SEQ ID NO: 62251

SEQ ID NO: 567357 - RNA, 64 nt, hsa; identical to SEQ ID NO: 62252

SEQ ID NO: 567358 - RNA, 64 nt, hsa; identical to SEQ ID NO: 62253

SEQ ID NO: 567359 - RNA, 64 nt, hsa; identical to SEQ ID NO: 62254

SEQ ID NO: 567360 - RNA, 64 nt, hsa; identical to SEQ ID NO: 62255

SEQ ID NO: 567361 - RNA, 64 nt, hsa; identical to SEQ ID NO: 62256

SEQ ID NO: 567362 - RNA, 64 nt, hsa; identical to SEQ ID NO: 62257

SEQ ID NO: 567363 - RNA, 64 nt, hsa; identical to SEQ ID NO: 62258

SEQ ID NO: 567364 - RNA, 64 nt, hsa; identical to SEQ ID NO: 62259

SEQ ID NO: 567365 - RNA, 64 nt, hsa; identical to SEQ ID NO: 62260

SEQ ID NO: 567366 - RNA, 64 nt, hsa; identical to SEQ ID NO: 62261

SEQ ID NO: 567367 - RNA, 64 nt, hsa; identical to SEQ ID NO: 62262

SEQ ID NO: 567368 - RNA, 64 nt, hsa; identical to SEQ ID NO: 62263

SEQ ID NO: 567369 - RNA, 64 nt, hsa; identical to SEQ ID NO: 62264

SEQ ID NO: 567370 - RNA, 64 nt, hsa; identical to SEQ ID NO: 62265

SEQ ID NO: 567371 - RNA, 64 nt, hsa; identical to SEQ ID NO: 62266

SEQ ID NO: 567372 - RNA, 64 nt, hsa; identical to SEQ ID NO: 62267

SEQ ID NO: 567373 - RNA, 64 nt, hsa; identical to SEQ ID NO: 62268

SEQ ID NO: 567374 - RNA, 64 nt, hsa; identical to SEQ ID NO: 62269

SEQ ID NO: 567375 - RNA, 64 nt, hsa; identical to SEQ ID NO: 62270

SEQ ID NO: 567376 - RNA, 64 nt, hsa; identical to SEQ ID NO: 62271

SEQ ID NO: 567377 - RNA, 64 nt, hsa; identical to SEQ ID NO: 62272

SEQ ID NO: 567378 - RNA, 64 nt, hsa; identical to SEQ ID NO: 62273

SEQ ID NO: 567379 - RNA, 64 nt, hsa; identical to SEQ ID NO: 62274

SEQ ID NO: 567380 - RNA, 64 nt, hsa; identical to SEQ ID NO: 62275

SEQ ID NO: 567381 - RNA, 64 nt, hsa; identical to SEQ ID NO: 62276

SEQ ID NO: 567382 - RNA, 64 nt, hsa; identical to SEQ ID NO: 62277

SEQ ID NO: 567383 - RNA, 64 nt, hsa; identical to SEQ ID NO: 62278

SEQ ID NO: 567384 - RNA, 64 nt, hsa; identical to SEQ ID NO: 62279

SEQ ID NO: 567385 - RNA, 64 nt, hsa; identical to SEQ ID NO: 62280

SEQ ID NO: 567386 - RNA, 64 nt, hsa; identical to SEQ ID NO: 62281

SEQ ID NO: 567387 - RNA, 64 nt, hsa; identical to SEQ ID NO: 62282

SEQ ID NO: 567388 - RNA, 64 nt, hsa; identical to SEQ ID NO: 62283

SEQ ID NO: 567389 - RNA, 64 nt, hsa; identical to SEQ ID NO: 62284

SEQ ID NO: 567390 - RNA, 64 nt, hsa; identical to SEQ ID NO: 62285

SEQ ID NO: 567391 - RNA, 64 nt, hsa; identical to SEQ ID NO: 62286

SEQ ID NO: 567392 - RNA, 64 nt, hsa; identical to SEQ ID NO: 62287

SEQ ID NO: 567393 - RNA, 64 nt, hsa; identical to SEQ ID NO: 62288

SEQ ID NO: 567394 - RNA, 64 nt, hsa; identical to SEQ ID NO: 62289

SEQ ID NO: 567395 - RNA, 64 nt, hsa; identical to SEQ ID NO: 62290

SEQ ID NO: 567396 - RNA, 64 nt, hsa; identical to SEQ ID NO: 62291

SEQ ID NO: 567397 - RNA, 64 nt, hsa; identical to SEQ ID NO: 62292

SEQ ID NO: 567398 - RNA, 64 nt, hsa; identical to SEQ ID NO: 62293

SEQ ID NO: 567399 - RNA, 64 nt, hsa; identical to SEQ ID NO: 62294

SEQ ID NO: 567400 - RNA, 64 nt, hsa; identical to SEQ ID NO: 62295

SEQ ID NO: 567401 - RNA, 64 nt, hsa; identical to SEQ ID NO: 62296

SEQ ID NO: 567402 - RNA, 64 nt, hsa; identical to SEQ ID NO: 62297

SEQ ID NO: 567403 - RNA, 64 nt, hsa; identical to SEQ ID NO: 62298

SEQ ID NO: 567404 - RNA, 64 nt, hsa; identical to SEQ ID NO: 62299

SEQ ID NO: 567405 - RNA, 64 nt, hsa; identical to SEQ ID NO: 62300

SEQ ID NO: 567406 - RNA, 64 nt, hsa; identical to SEQ ID NO: 62301

SEQ ID NO: 567407 - RNA, 64 nt, hsa; identical to SEQ ID NO: 62302

SEQ ID NO: 567408 - RNA, 64 nt, hsa; identical to SEQ ID NO: 62303

SEQ ID NO: 567409 - RNA, 64 nt, hsa; identical to SEQ ID NO: 62304

SEQ ID NO: 567410 - RNA, 64 nt, hsa; identical to SEQ ID NO: 62305

SEQ ID NO: 567411 - RNA, 64 nt, hsa; identical to SEQ ID NO: 62306

SEQ ID NO: 567412 - RNA, 64 nt, hsa; identical to SEQ ID NO: 62307

SEQ ID NO: 567413 - RNA, 64 nt, hsa; identical to SEQ ID NO: 62308

SEQ ID NO: 567414 - RNA, 64 nt, hsa; identical to SEQ ID NO: 62309

SEQ ID NO: 567415 - RNA, 64 nt, hsa; identical to SEQ ID NO: 62310

SEQ ID NO: 567416 - RNA, 64 nt, hsa; identical to SEQ ID NO: 62311

SEQ ID NO: 567417 - RNA, 64 nt, hsa; identical to SEQ ID NO: 62312

SEQ ID NO: 567418 - RNA, 64 nt, hsa; identical to SEQ ID NO: 62313

SEQ ID NO: 567419 - RNA, 64 nt, hsa; identical to SEQ ID NO: 62314

SEQ ID NO: 567420 - RNA, 64 nt, hsa; identical to SEQ ID NO: 62315

SEQ ID NO: 567421 - RNA, 64 nt, hsa; identical to SEQ ID NO: 62316

SEQ ID NO: 567422 - RNA, 64 nt, hsa; identical to SEQ ID NO: 62317

SEQ ID NO: 567423 - RNA, 64 nt, hsa; identical to SEQ ID NO: 62318

SEQ ID NO: 567424 - RNA, 64 nt, hsa; identical to SEQ ID NO: 62319

SEQ ID NO: 567425 - RNA, 64 nt, hsa; identical to SEQ ID NO: 62320

SEQ ID NO: 567426 - RNA, 64 nt, hsa; identical to SEQ ID NO: 62321

SEQ ID NO: 567427 - RNA, 64 nt, hsa; identical to SEQ ID NO: 62322

SEQ ID NO: 567428 - RNA, 64 nt, hsa; identical to SEQ ID NO: 62323

SEQ ID NO: 567429 - RNA, 64 nt, hsa; identical to SEQ ID NO: 62324

SEQ ID NO: 567430 - RNA, 64 nt, hsa; identical to SEQ ID NO: 62325

SEQ ID NO: 567431 - RNA, 64 nt, hsa; identical to SEQ ID NO: 62326

SEQ ID NO: 567432 - RNA, 64 nt, hsa; identical to SEQ ID NO: 62327

SEQ ID NO: 567433 - RNA, 64 nt, hsa; identical to SEQ ID NO: 62328

SEQ ID NO: 567434 - RNA, 64 nt, hsa; identical to SEQ ID NO: 62329

SEQ ID NO: 567435 - RNA, 64 nt, hsa; identical to SEQ ID NO: 62330

SEQ ID NO: 567436 - RNA, 64 nt, hsa; identical to SEQ ID NO: 62331

SEQ ID NO: 567437 - RNA, 64 nt, hsa; identical to SEQ ID NO: 62332

SEQ ID NO: 567438 - RNA, 64 nt, hsa; identical to SEQ ID NO: 62333

SEQ ID NO: 567439 - RNA, 64 nt, hsa; identical to SEQ ID NO: 62334

SEQ ID NO: 567440 - RNA, 64 nt, hsa; identical to SEQ ID NO: 62335

SEQ ID NO: 567441 - RNA, 64 nt, hsa; identical to SEQ ID NO: 62336

SEQ ID NO: 567442 - RNA, 64 nt, hsa; identical to SEQ ID NO: 62337

SEQ ID NO: 567443 - RNA, 64 nt, hsa; identical to SEQ ID NO: 62338

SEQ ID NO: 567444 - RNA, 64 nt, hsa; identical to SEQ ID NO: 62339

SEQ ID NO: 567445 - RNA, 64 nt, hsa; identical to SEQ ID NO: 62340

SEQ ID NO: 567446 - RNA, 64 nt, hsa; identical to SEQ ID NO: 62341

SEQ ID NO: 567447 - RNA, 64 nt, hsa; identical to SEQ ID NO: 62342

SEQ ID NO: 567448 - RNA, 64 nt, hsa; identical to SEQ ID NO: 62343

SEQ ID NO: 567449 - RNA, 64 nt, hsa; identical to SEQ ID NO: 62344

SEQ ID NO: 567450 - RNA, 64 nt, hsa; identical to SEQ ID NO: 62345

SEQ ID NO: 567451 - RNA, 64 nt, hsa; identical to SEQ ID NO: 62346

SEQ ID NO: 567452 - RNA, 64 nt, hsa; identical to SEQ ID NO: 62347

SEQ ID NO: 567453 - RNA, 64 nt, hsa; identical to SEQ ID NO: 62348

SEQ ID NO: 567454 - RNA, 64 nt, hsa; identical to SEQ ID NO: 62349

SEQ ID NO: 567455 - RNA, 64 nt, hsa; identical to SEQ ID NO: 62350

SEQ ID NO: 567456 - RNA, 64 nt, hsa; identical to SEQ ID NO: 62351

SEQ ID NO: 567457 - RNA, 64 nt, hsa; identical to SEQ ID NO: 62352

SEQ ID NO: 567458 - RNA, 64 nt, hsa; identical to SEQ ID NO: 62353

SEQ ID NO: 567459 - RNA, 64 nt, hsa; identical to SEQ ID NO: 62354

SEQ ID NO: 567460 - RNA, 64 nt, hsa; identical to SEQ ID NO: 62355

SEQ ID NO: 567461 - RNA, 64 nt, hsa; identical to SEQ ID NO: 62356

SEQ ID NO: 567462 - RNA, 64 nt, hsa; identical to SEQ ID NO: 62357

SEQ ID NO: 567463 - RNA, 64 nt, hsa; identical to SEQ ID NO: 62358

SEQ ID NO: 567464 - RNA, 64 nt, hsa; identical to SEQ ID NO: 62359

SEQ ID NO: 567465 - RNA, 64 nt, hsa; identical to SEQ ID NO: 62360

SEQ ID NO: 567466 - RNA, 64 nt, hsa; identical to SEQ ID NO: 62361

SEQ ID NO: 567467 - RNA, 64 nt, hsa; identical to SEQ ID NO: 62362

SEQ ID NO: 567468 - RNA, 64 nt, hsa; identical to SEQ ID NO: 62363

SEQ ID NO: 567469 - RNA, 64 nt, hsa; identical to SEQ ID NO: 62364

SEQ ID NO: 567470 - RNA, 64 nt, hsa; identical to SEQ ID NO: 62365

SEQ ID NO: 567471 - RNA, 64 nt, hsa; identical to SEQ ID NO: 62366

SEQ ID NO: 567472 - RNA, 64 nt, hsa; identical to SEQ ID NO: 62367

SEQ ID NO: 567473 - RNA, 64 nt, hsa; identical to SEQ ID NO: 62368

SEQ ID NO: 567474 - RNA, 64 nt, hsa; identical to SEQ ID NO: 62369

SEQ ID NO: 567475 - RNA, 64 nt, hsa; identical to SEQ ID NO: 62370

SEQ ID NO: 567476 - RNA, 64 nt, hsa; identical to SEQ ID NO: 62371

SEQ ID NO: 567477 - RNA, 64 nt, hsa; identical to SEQ ID NO: 62372

SEQ ID NO: 567478 - RNA, 64 nt, hsa; identical to SEQ ID NO: 62373

SEQ ID NO: 567479 - RNA, 64 nt, hsa; identical to SEQ ID NO: 62374

SEQ ID NO: 567480 - RNA, 64 nt, hsa; identical to SEQ ID NO: 62375

SEQ ID NO: 567481 - RNA, 64 nt, hsa; identical to SEQ ID NO: 62376

SEQ ID NO: 567482 - RNA, 64 nt, hsa; identical to SEQ ID NO: 62377

SEQ ID NO: 567483 - RNA, 64 nt, hsa; identical to SEQ ID NO: 62378

SEQ ID NO: 567484 - RNA, 64 nt, hsa; identical to SEQ ID NO: 62379

SEQ ID NO: 567485 - RNA, 64 nt, hsa; identical to SEQ ID NO: 62380

SEQ ID NO: 567486 - RNA, 64 nt, hsa; identical to SEQ ID NO: 62381

SEQ ID NO: 567487 - RNA, 64 nt, hsa; identical to SEQ ID NO: 62382

SEQ ID NO: 567488 - RNA, 64 nt, hsa; identical to SEQ ID NO: 62383

SEQ ID NO: 567489 - RNA, 64 nt, hsa; identical to SEQ ID NO: 62384

SEQ ID NO: 567490 - RNA, 64 nt, hsa; identical to SEQ ID NO: 62385

SEQ ID NO: 567491 - RNA, 64 nt, hsa; identical to SEQ ID NO: 62386

SEQ ID NO: 567492 - RNA, 64 nt, hsa; identical to SEQ ID NO: 62387

SEQ ID NO: 567493 - RNA, 64 nt, hsa; identical to SEQ ID NO: 62388

SEQ ID NO: 567494 - RNA, 64 nt, hsa; identical to SEQ ID NO: 62389

SEQ ID NO: 567495 - RNA, 64 nt, hsa; identical to SEQ ID NO: 62390

SEQ ID NO: 567496 - RNA, 64 nt, hsa; identical to SEQ ID NO: 62391

SEQ ID NO: 567497 - RNA, 64 nt, hsa; identical to SEQ ID NO: 62392

SEQ ID NO: 567498 - RNA, 64 nt, hsa; identical to SEQ ID NO: 62393

SEQ ID NO: 567499 - RNA, 64 nt, hsa; identical to SEQ ID NO: 62394

SEQ ID NO: 567500 - RNA, 64 nt, hsa; identical to SEQ ID NO: 62395

SEQ ID NO: 567501 - RNA, 64 nt, hsa; identical to SEQ ID NO: 62396

SEQ ID NO: 567502 - RNA, 64 nt, hsa; identical to SEQ ID NO: 62397

SEQ ID NO: 567503 - RNA, 64 nt, hsa; identical to SEQ ID NO: 62398

SEQ ID NO: 567504 - RNA, 64 nt, hsa; identical to SEQ ID NO: 62399

SEQ ID NO: 567505 - RNA, 64 nt, hsa; identical to SEQ ID NO: 62400

SEQ ID NO: 567506 - RNA, 64 nt, hsa; identical to SEQ ID NO: 62401

SEQ ID NO: 567507 - RNA, 64 nt, hsa; identical to SEQ ID NO: 62402

SEQ ID NO: 567508 - RNA, 64 nt, hsa; identical to SEQ ID NO: 62403

SEQ ID NO: 567509 - RNA, 64 nt, hsa; identical to SEQ ID NO: 62404

SEQ ID NO: 567510 - RNA, 64 nt, hsa; identical to SEQ ID NO: 62405

SEQ ID NO: 567511 - RNA, 64 nt, hsa; identical to SEQ ID NO: 62406

SEQ ID NO: 567512 - RNA, 64 nt, hsa; identical to SEQ ID NO: 62407

SEQ ID NO: 567513 - RNA, 64 nt, hsa; identical to SEQ ID NO: 62408

SEQ ID NO: 567514 - RNA, 64 nt, hsa; identical to SEQ ID NO: 62409

SEQ ID NO: 567515 - RNA, 64 nt, hsa; identical to SEQ ID NO: 62410

SEQ ID NO: 567516 - RNA, 64 nt, hsa; identical to SEQ ID NO: 62411

SEQ ID NO: 567517 - RNA, 64 nt, hsa; identical to SEQ ID NO: 62412

SEQ ID NO: 567518 - RNA, 64 nt, hsa; identical to SEQ ID NO: 62413

SEQ ID NO: 567519 - RNA, 64 nt, hsa; identical to SEQ ID NO: 62414

SEQ ID NO: 567520 - RNA, 64 nt, hsa; identical to SEQ ID NO: 62415

SEQ ID NO: 567521 - RNA, 64 nt, hsa; identical to SEQ ID NO: 62416

SEQ ID NO: 567522 - RNA, 64 nt, hsa; identical to SEQ ID NO: 62417

SEQ ID NO: 567523 - RNA, 64 nt, hsa; identical to SEQ ID NO: 62418

SEQ ID NO: 567524 - RNA, 64 nt, hsa; identical to SEQ ID NO: 62419

SEQ ID NO: 567525 - RNA, 64 nt, hsa; identical to SEQ ID NO: 62420

SEQ ID NO: 567526 - RNA, 64 nt, hsa; identical to SEQ ID NO: 62421

SEQ ID NO: 567527 - RNA, 64 nt, hsa; identical to SEQ ID NO: 62422

SEQ ID NO: 567528 - RNA, 64 nt, hsa; identical to SEQ ID NO: 62423

SEQ ID NO: 567529 - RNA, 64 nt, hsa; identical to SEQ ID NO: 62424

SEQ ID NO: 567530 - RNA, 64 nt, hsa; identical to SEQ ID NO: 62425

SEQ ID NO: 567531 - RNA, 64 nt, hsa; identical to SEQ ID NO: 62426

SEQ ID NO: 567532 - RNA, 64 nt, hsa; identical to SEQ ID NO: 62427

SEQ ID NO: 567533 - RNA, 64 nt, hsa; identical to SEQ ID NO: 62428

SEQ ID NO: 567534 - RNA, 64 nt, hsa; identical to SEQ ID NO: 62429

SEQ ID NO: 567535 - RNA, 64 nt, hsa; identical to SEQ ID NO: 62430

SEQ ID NO: 567536 - RNA, 64 nt, hsa; identical to SEQ ID NO: 62431

SEQ ID NO: 567537 - RNA, 64 nt, hsa; identical to SEQ ID NO: 62432

SEQ ID NO: 567538 - RNA, 64 nt, hsa; identical to SEQ ID NO: 62433

SEQ ID NO: 567539 - RNA, 64 nt, hsa; identical to SEQ ID NO: 62434

SEQ ID NO: 567540 - RNA, 64 nt, hsa; identical to SEQ ID NO: 62435

SEQ ID NO: 567541 - RNA, 64 nt, hsa; identical to SEQ ID NO: 62436

SEQ ID NO: 567542 - RNA, 64 nt, hsa; identical to SEQ ID NO: 62437

SEQ ID NO: 567543 - RNA, 64 nt, hsa; identical to SEQ ID NO: 62438

SEQ ID NO: 567544 - RNA, 64 nt, hsa; identical to SEQ ID NO: 62439

SEQ ID NO: 567545 - RNA, 64 nt, hsa; identical to SEQ ID NO: 62440

SEQ ID NO: 567546 - RNA, 64 nt, hsa; identical to SEQ ID NO: 62441

SEQ ID NO: 567547 - RNA, 64 nt, hsa; identical to SEQ ID NO: 62442

SEQ ID NO: 567548 - RNA, 64 nt, hsa; identical to SEQ ID NO: 62443

SEQ ID NO: 567549 - RNA, 64 nt, hsa; identical to SEQ ID NO: 62444

SEQ ID NO: 567550 - RNA, 64 nt, hsa; identical to SEQ ID NO: 62445

SEQ ID NO: 567551 - RNA, 64 nt, hsa; identical to SEQ ID NO: 62446

SEQ ID NO: 567552 - RNA, 64 nt, hsa; identical to SEQ ID NO: 62447

SEQ ID NO: 567553 - RNA, 64 nt, hsa; identical to SEQ ID NO: 62448

SEQ ID NO: 567554 - RNA, 64 nt, hsa; identical to SEQ ID NO: 62449

SEQ ID NO: 567555 - RNA, 64 nt, hsa; identical to SEQ ID NO: 62450

SEQ ID NO: 567556 - RNA, 64 nt, hsa; identical to SEQ ID NO: 62451

SEQ ID NO: 567557 - RNA, 64 nt, hsa; identical to SEQ ID NO: 62452

SEQ ID NO: 567558 - RNA, 64 nt, hsa; identical to SEQ ID NO: 62453

SEQ ID NO: 567559 - RNA, 64 nt, hsa; identical to SEQ ID NO: 62454

SEQ ID NO: 567560 - RNA, 64 nt, hsa; identical to SEQ ID NO: 62455

SEQ ID NO: 567561 - RNA, 64 nt, hsa; identical to SEQ ID NO: 62456

SEQ ID NO: 567562 - RNA, 64 nt, hsa; identical to SEQ ID NO: 62457

SEQ ID NO: 567563 - RNA, 64 nt, hsa; identical to SEQ ID NO: 62458

SEQ ID NO: 567564 - RNA, 64 nt, hsa; identical to SEQ ID NO: 62459

SEQ ID NO: 567565 - RNA, 50 nt, hsa; identical to SEQ ID NO: 62460

SEQ ID NO: 567566 - RNA, 64 nt, hsa; identical to SEQ ID NO: 62461

SEQ ID NO: 567567 - RNA, 64 nt, hsa; identical to SEQ ID NO: 62462

SEQ ID NO: 567568 - RNA, 64 nt, hsa; identical to SEQ ID NO: 62463

SEQ ID NO: 567569 - RNA, 64 nt, hsa; identical to SEQ ID NO: 62464

SEQ ID NO: 567570 - RNA, 64 nt, hsa; identical to SEQ ID NO: 62465

SEQ ID NO: 567571 - RNA, 64 nt, hsa; identical to SEQ ID NO: 62466

SEQ ID NO: 567572 - RNA, 64 nt, hsa; identical to SEQ ID NO: 62467

SEQ ID NO: 567573 - RNA, 64 nt, hsa; identical to SEQ ID NO: 62468

SEQ ID NO: 567574 - RNA, 64 nt, hsa; identical to SEQ ID NO: 62469

SEQ ID NO: 567575 - RNA, 64 nt, hsa; identical to SEQ ID NO: 62470

SEQ ID NO: 567576 - RNA, 64 nt, hsa; identical to SEQ ID NO: 62471

SEQ ID NO: 567577 - RNA, 64 nt, hsa; identical to SEQ ID NO: 62472

SEQ ID NO: 567578 - RNA, 64 nt, hsa; identical to SEQ ID NO: 62473

SEQ ID NO: 567579 - RNA, 64 nt, hsa; identical to SEQ ID NO: 62474

SEQ ID NO: 567580 - RNA, 64 nt, hsa; identical to SEQ ID NO: 62475

SEQ ID NO: 567581 - RNA, 64 nt, hsa; identical to SEQ ID NO: 62476

SEQ ID NO: 567582 - RNA, 64 nt, hsa; identical to SEQ ID NO: 62477

SEQ ID NO: 567583 - RNA, 64 nt, hsa; identical to SEQ ID NO: 62478

SEQ ID NO: 567584 - RNA, 64 nt, hsa; identical to SEQ ID NO: 62479

SEQ ID NO: 567585 - RNA, 64 nt, hsa; identical to SEQ ID NO: 62480

SEQ ID NO: 567586 - RNA, 64 nt, hsa; identical to SEQ ID NO: 62481

SEQ ID NO: 567587 - RNA, 64 nt, hsa; identical to SEQ ID NO: 62482

SEQ ID NO: 567588 - RNA, 64 nt, hsa; identical to SEQ ID NO: 62483

SEQ ID NO: 567589 - RNA, 64 nt, hsa; identical to SEQ ID NO: 62484

SEQ ID NO: 567590 - RNA, 64 nt, hsa; identical to SEQ ID NO: 62485

SEQ ID NO: 567591 - RNA, 64 nt, hsa; identical to SEQ ID NO: 62486

SEQ ID NO: 567592 - RNA, 64 nt, hsa; identical to SEQ ID NO: 62487

SEQ ID NO: 567593 - RNA, 64 nt, hsa; identical to SEQ ID NO: 62488

SEQ ID NO: 567594 - RNA, 64 nt, hsa; identical to SEQ ID NO: 62489

SEQ ID NO: 567595 - RNA, 64 nt, hsa; identical to SEQ ID NO: 62490

SEQ ID NO: 567596 - RNA, 64 nt, hsa; identical to SEQ ID NO: 62491

SEQ ID NO: 567597 - RNA, 64 nt, hsa; identical to SEQ ID NO: 62492

SEQ ID NO: 567598 - RNA, 64 nt, hsa; identical to SEQ ID NO: 62493

SEQ ID NO: 567599 - RNA, 64 nt, hsa; identical to SEQ ID NO: 62494

SEQ ID NO: 567600 - RNA, 64 nt, hsa; identical to SEQ ID NO: 62495

SEQ ID NO: 567601 - RNA, 64 nt, hsa; identical to SEQ ID NO: 62496

SEQ ID NO: 567602 - RNA, 63 nt, hsa; identical to SEQ ID NO: 62497

SEQ ID NO: 567603 - RNA, 64 nt, hsa; identical to SEQ ID NO: 62498

SEQ ID NO: 567604 - RNA, 64 nt, hsa; identical to SEQ ID NO: 62499

SEQ ID NO: 567605 - RNA, 64 nt, hsa; identical to SEQ ID NO: 62500

SEQ ID NO: 567606 - RNA, 64 nt, hsa; identical to SEQ ID NO: 62501

SEQ ID NO: 567607 - RNA, 64 nt, hsa; identical to SEQ ID NO: 62502

SEQ ID NO: 567608 - RNA, 64 nt, hsa; identical to SEQ ID NO: 62503

SEQ ID NO: 567609 - RNA, 64 nt, hsa; identical to SEQ ID NO: 62504

SEQ ID NO: 567610 - RNA, 64 nt, hsa; identical to SEQ ID NO: 62505

SEQ ID NO: 567611 - RNA, 64 nt, hsa; identical to SEQ ID NO: 62506

SEQ ID NO: 567612 - RNA, 64 nt, hsa; identical to SEQ ID NO: 62507

SEQ ID NO: 567613 - RNA, 64 nt, hsa; identical to SEQ ID NO: 62508

SEQ ID NO: 567614 - RNA, 64 nt, hsa; identical to SEQ ID NO: 62509

SEQ ID NO: 567615 - RNA, 64 nt, hsa; identical to SEQ ID NO: 62510

SEQ ID NO: 567616 - RNA, 64 nt, hsa; identical to SEQ ID NO: 62511

SEQ ID NO: 567617 - RNA, 64 nt, hsa; identical to SEQ ID NO: 62512

SEQ ID NO: 567618 - RNA, 64 nt, hsa; identical to SEQ ID NO: 62513

SEQ ID NO: 567619 - RNA, 64 nt, hsa; identical to SEQ ID NO: 62514

SEQ ID NO: 567620 - RNA, 64 nt, hsa; identical to SEQ ID NO: 62515

SEQ ID NO: 567621 - RNA, 64 nt, hsa; identical to SEQ ID NO: 62516

SEQ ID NO: 567622 - RNA, 64 nt, hsa; identical to SEQ ID NO: 62517

SEQ ID NO: 567623 - RNA, 64 nt, hsa; identical to SEQ ID NO: 62518

SEQ ID NO: 567624 - RNA, 64 nt, hsa; identical to SEQ ID NO: 62519

SEQ ID NO: 567625 - RNA, 64 nt, hsa; identical to SEQ ID NO: 62520

SEQ ID NO: 567626 - RNA, 64 nt, hsa; identical to SEQ ID NO: 62521

SEQ ID NO: 567627 - RNA, 64 nt, hsa; identical to SEQ ID NO: 62522

SEQ ID NO: 567628 - RNA, 64 nt, hsa; identical to SEQ ID NO: 62523

SEQ ID NO: 567629 - RNA, 64 nt, hsa; identical to SEQ ID NO: 62524

SEQ ID NO: 567630 - RNA, 64 nt, hsa; identical to SEQ ID NO: 62525

SEQ ID NO: 567631 - RNA, 64 nt, hsa; identical to SEQ ID NO: 62526

SEQ ID NO: 567632 - RNA, 64 nt, hsa; identical to SEQ ID NO: 62527

SEQ ID NO: 567633 - RNA, 64 nt, hsa; identical to SEQ ID NO: 62528

SEQ ID NO: 567634 - RNA, 64 nt, hsa; identical to SEQ ID NO: 62529

SEQ ID NO: 567635 - RNA, 64 nt, hsa; identical to SEQ ID NO: 62530

SEQ ID NO: 567636 - RNA, 64 nt, hsa; identical to SEQ ID NO: 62531

SEQ ID NO: 567637 - RNA, 64 nt, hsa; identical to SEQ ID NO: 62532

SEQ ID NO: 567638 - RNA, 64 nt, hsa; identical to SEQ ID NO: 62533

SEQ ID NO: 567639 - RNA, 64 nt, hsa; identical to SEQ ID NO: 62534

SEQ ID NO: 567640 - RNA, 64 nt, hsa; identical to SEQ ID NO: 62535

SEQ ID NO: 567641 - RNA, 64 nt, hsa; identical to SEQ ID NO: 62536

SEQ ID NO: 567642 - RNA, 64 nt, hsa; identical to SEQ ID NO: 62537

SEQ ID NO: 567643 - RNA, 64 nt, hsa; identical to SEQ ID NO: 62538

SEQ ID NO: 567644 - RNA, 64 nt, hsa; identical to SEQ ID NO: 62539

SEQ ID NO: 567645 - RNA, 64 nt, hsa; identical to SEQ ID NO: 62540

SEQ ID NO: 567646 - RNA, 64 nt, hsa; identical to SEQ ID NO: 62541

SEQ ID NO: 567647 - RNA, 64 nt, hsa; identical to SEQ ID NO: 62542

SEQ ID NO: 567648 - RNA, 64 nt, hsa; identical to SEQ ID NO: 62543

SEQ ID NO: 567649 - RNA, 64 nt, hsa; identical to SEQ ID NO: 62544

SEQ ID NO: 567650 - RNA, 64 nt, hsa; identical to SEQ ID NO: 62545

SEQ ID NO: 567651 - RNA, 64 nt, hsa; identical to SEQ ID NO: 62546

SEQ ID NO: 567652 - RNA, 64 nt, hsa; identical to SEQ ID NO: 62547

SEQ ID NO: 567653 - RNA, 64 nt, hsa; identical to SEQ ID NO: 62548

SEQ ID NO: 567654 - RNA, 64 nt, hsa; identical to SEQ ID NO: 62549

SEQ ID NO: 567655 - RNA, 64 nt, hsa; identical to SEQ ID NO: 62550

SEQ ID NO: 567656 - RNA, 64 nt, hsa; identical to SEQ ID NO: 62551

SEQ ID NO: 567657 - RNA, 64 nt, hsa; identical to SEQ ID NO: 62552

SEQ ID NO: 567658 - RNA, 64 nt, hsa; identical to SEQ ID NO: 62553

SEQ ID NO: 567659 - RNA, 64 nt, hsa; identical to SEQ ID NO: 62554

SEQ ID NO: 567660 - RNA, 64 nt, hsa; identical to SEQ ID NO: 62555

SEQ ID NO: 567661 - RNA, 64 nt, hsa; identical to SEQ ID NO: 62556

SEQ ID NO: 567662 - RNA, 64 nt, hsa; identical to SEQ ID NO: 62557

SEQ ID NO: 567663 - RNA, 64 nt, hsa; identical to SEQ ID NO: 62558

SEQ ID NO: 567664 - RNA, 64 nt, hsa; identical to SEQ ID NO: 62559

SEQ ID NO: 567665 - RNA, 64 nt, hsa; identical to SEQ ID NO: 62560

SEQ ID NO: 567666 - RNA, 64 nt, hsa; identical to SEQ ID NO: 62561

SEQ ID NO: 567667 - RNA, 64 nt, hsa; identical to SEQ ID NO: 62562

SEQ ID NO: 567668 - RNA, 64 nt, hsa; identical to SEQ ID NO: 62563

SEQ ID NO: 567669 - RNA, 64 nt, hsa; identical to SEQ ID NO: 62564

SEQ ID NO: 567670 - RNA, 64 nt, hsa; identical to SEQ ID NO: 62565

SEQ ID NO: 567671 - RNA, 64 nt, hsa; identical to SEQ ID NO: 62566

SEQ ID NO: 567672 - RNA, 64 nt, hsa; identical to SEQ ID NO: 62567

SEQ ID NO: 567673 - RNA, 64 nt, hsa; identical to SEQ ID NO: 62568

SEQ ID NO: 567674 - RNA, 64 nt, hsa; identical to SEQ ID NO: 62569

SEQ ID NO: 567675 - RNA, 64 nt, hsa; identical to SEQ ID NO: 62570

SEQ ID NO: 567676 - RNA, 64 nt, hsa; identical to SEQ ID NO: 62571

SEQ ID NO: 567677 - RNA, 64 nt, hsa; identical to SEQ ID NO: 62572

SEQ ID NO: 567678 - RNA, 64 nt, hsa; identical to SEQ ID NO: 62573

SEQ ID NO: 567679 - RNA, 64 nt, hsa; identical to SEQ ID NO: 62574

SEQ ID NO: 567680 - RNA, 64 nt, hsa; identical to SEQ ID NO: 62575

SEQ ID NO: 567681 - RNA, 64 nt, hsa; identical to SEQ ID NO: 62576

SEQ ID NO: 567682 - RNA, 64 nt, hsa; identical to SEQ ID NO: 62577

SEQ ID NO: 567683 - RNA, 64 nt, hsa; identical to SEQ ID NO: 62578

SEQ ID NO: 567684 - RNA, 64 nt, hsa; identical to SEQ ID NO: 62579

SEQ ID NO: 567685 - RNA, 64 nt, hsa; identical to SEQ ID NO: 62580

SEQ ID NO: 567686 - RNA, 64 nt, hsa; identical to SEQ ID NO: 62581

SEQ ID NO: 567687 - RNA, 64 nt, hsa; identical to SEQ ID NO: 62582

SEQ ID NO: 567688 - RNA, 64 nt, hsa; identical to SEQ ID NO: 62583

SEQ ID NO: 567689 - RNA, 64 nt, hsa; identical to SEQ ID NO: 62584

SEQ ID NO: 567690 - RNA, 64 nt, hsa; identical to SEQ ID NO: 62585

SEQ ID NO: 567691 - RNA, 64 nt, hsa; identical to SEQ ID NO: 62586

SEQ ID NO: 567692 - RNA, 64 nt, hsa; identical to SEQ ID NO: 62587

SEQ ID NO: 567693 - RNA, 64 nt, hsa; identical to SEQ ID NO: 62588

SEQ ID NO: 567694 - RNA, 64 nt, hsa; identical to SEQ ID NO: 62589

SEQ ID NO: 567695 - RNA, 64 nt, hsa; identical to SEQ ID NO: 62590

SEQ ID NO: 567696 - RNA, 64 nt, hsa; identical to SEQ ID NO: 62591

SEQ ID NO: 567697 - RNA, 64 nt, hsa; identical to SEQ ID NO: 62592

SEQ ID NO: 567698 - RNA, 64 nt, hsa; identical to SEQ ID NO: 62593

SEQ ID NO: 567699 - RNA, 64 nt, hsa; identical to SEQ ID NO: 62594

SEQ ID NO: 567700 - RNA, 64 nt, hsa; identical to SEQ ID NO: 62595

SEQ ID NO: 567701 - RNA, 64 nt, hsa; identical to SEQ ID NO: 62596

SEQ ID NO: 567702 - RNA, 64 nt, hsa; identical to SEQ ID NO: 62597

SEQ ID NO: 567703 - RNA, 64 nt, hsa; identical to SEQ ID NO: 62598

SEQ ID NO: 567704 - RNA, 64 nt, hsa; identical to SEQ ID NO: 62599

SEQ ID NO: 567705 - RNA, 64 nt, hsa; identical to SEQ ID NO: 62600

SEQ ID NO: 567706 - RNA, 64 nt, hsa; identical to SEQ ID NO: 62601

SEQ ID NO: 567707 - RNA, 64 nt, hsa; identical to SEQ ID NO: 62602

SEQ ID NO: 567708 - RNA, 64 nt, hsa; identical to SEQ ID NO: 62603

SEQ ID NO: 567709 - RNA, 64 nt, hsa; identical to SEQ ID NO: 62604

SEQ ID NO: 567710 - RNA, 64 nt, hsa; identical to SEQ ID NO: 62605

SEQ ID NO: 567711 - RNA, 64 nt, hsa; identical to SEQ ID NO: 62606

SEQ ID NO: 567712 - RNA, 64 nt, hsa; identical to SEQ ID NO: 62607

SEQ ID NO: 567713 - RNA, 64 nt, hsa; identical to SEQ ID NO: 62608

SEQ ID NO: 567714 - RNA, 64 nt, hsa; identical to SEQ ID NO: 62609

SEQ ID NO: 567715 - RNA, 64 nt, hsa; identical to SEQ ID NO: 62610

SEQ ID NO: 567716 - RNA, 64 nt, hsa; identical to SEQ ID NO: 62611

SEQ ID NO: 567717 - RNA, 64 nt, hsa; identical to SEQ ID NO: 62612

SEQ ID NO: 567718 - RNA, 64 nt, hsa; identical to SEQ ID NO: 62613

SEQ ID NO: 567719 - RNA, 64 nt, hsa; identical to SEQ ID NO: 62614

SEQ ID NO: 567720 - RNA, 64 nt, hsa; identical to SEQ ID NO: 62615

SEQ ID NO: 567721 - RNA, 64 nt, hsa; identical to SEQ ID NO: 62616

SEQ ID NO: 567722 - RNA, 64 nt, hsa; identical to SEQ ID NO: 62617

SEQ ID NO: 567723 - RNA, 64 nt, hsa; identical to SEQ ID NO: 62618

SEQ ID NO: 567724 - RNA, 64 nt, hsa; identical to SEQ ID NO: 62619

SEQ ID NO: 567725 - RNA, 64 nt, hsa; identical to SEQ ID NO: 62620

SEQ ID NO: 567726 - RNA, 64 nt, hsa; identical to SEQ ID NO: 62621

SEQ ID NO: 567727 - RNA, 64 nt, hsa; identical to SEQ ID NO: 62622

SEQ ID NO: 567728 - RNA, 64 nt, hsa; identical to SEQ ID NO: 62623

SEQ ID NO: 567729 - RNA, 64 nt, hsa; identical to SEQ ID NO: 62624

SEQ ID NO: 567730 - RNA, 64 nt, hsa; identical to SEQ ID NO: 62625

SEQ ID NO: 567731 - RNA, 64 nt, hsa; identical to SEQ ID NO: 62626

SEQ ID NO: 567732 - RNA, 64 nt, hsa; identical to SEQ ID NO: 62627

SEQ ID NO: 567733 - RNA, 64 nt, hsa; identical to SEQ ID NO: 62628

SEQ ID NO: 567734 - RNA, 64 nt, hsa; identical to SEQ ID NO: 62629

SEQ ID NO: 567735 - RNA, 63 nt, hsa; identical to SEQ ID NO: 62630

SEQ ID NO: 567736 - RNA, 64 nt, hsa; identical to SEQ ID NO: 62631

SEQ ID NO: 567737 - RNA, 64 nt, hsa; identical to SEQ ID NO: 62632

SEQ ID NO: 567738 - RNA, 64 nt, hsa; identical to SEQ ID NO: 62633

SEQ ID NO: 567739 - RNA, 64 nt, hsa; identical to SEQ ID NO: 62634

SEQ ID NO: 567740 - RNA, 64 nt, hsa; identical to SEQ ID NO: 62635

SEQ ID NO: 567741 - RNA, 64 nt, hsa; identical to SEQ ID NO: 62636

SEQ ID NO: 567742 - RNA, 64 nt, hsa; identical to SEQ ID NO: 62637

SEQ ID NO: 567743 - RNA, 64 nt, hsa; identical to SEQ ID NO: 62638

SEQ ID NO: 567744 - RNA, 64 nt, hsa; identical to SEQ ID NO: 62639

SEQ ID NO: 567745 - RNA, 64 nt, hsa; identical to SEQ ID NO: 62640

SEQ ID NO: 567746 - RNA, 64 nt, hsa; identical to SEQ ID NO: 62641

SEQ ID NO: 567747 - RNA, 64 nt, hsa; identical to SEQ ID NO: 62642

SEQ ID NO: 567748 - RNA, 64 nt, hsa; identical to SEQ ID NO: 62643

SEQ ID NO: 567749 - RNA, 64 nt, hsa; identical to SEQ ID NO: 62644

SEQ ID NO: 567750 - RNA, 64 nt, hsa; identical to SEQ ID NO: 62645

SEQ ID NO: 567751 - RNA, 64 nt, hsa; identical to SEQ ID NO: 62646

SEQ ID NO: 567752 - RNA, 64 nt, hsa; identical to SEQ ID NO: 62647

SEQ ID NO: 567753 - RNA, 64 nt, hsa; identical to SEQ ID NO: 62648

SEQ ID NO: 567754 - RNA, 64 nt, hsa; identical to SEQ ID NO: 62649

SEQ ID NO: 567755 - RNA, 64 nt, hsa; identical to SEQ ID NO: 62650

SEQ ID NO: 567756 - RNA, 64 nt, hsa; identical to SEQ ID NO: 62651

SEQ ID NO: 567757 - RNA, 64 nt, hsa; identical to SEQ ID NO: 62652

SEQ ID NO: 567758 - RNA, 64 nt, hsa; identical to SEQ ID NO: 62653

SEQ ID NO: 567759 - RNA, 64 nt, hsa; identical to SEQ ID NO: 62654

SEQ ID NO: 567760 - RNA, 64 nt, hsa; identical to SEQ ID NO: 62655

SEQ ID NO: 567761 - RNA, 64 nt, hsa; identical to SEQ ID NO: 62656

SEQ ID NO: 567762 - RNA, 64 nt, hsa; identical to SEQ ID NO: 62657

SEQ ID NO: 567763 - RNA, 64 nt, hsa; identical to SEQ ID NO: 62658

SEQ ID NO: 567764 - RNA, 64 nt, hsa; identical to SEQ ID NO: 62659

SEQ ID NO: 567765 - RNA, 64 nt, hsa; identical to SEQ ID NO: 62660

SEQ ID NO: 567766 - RNA, 64 nt, hsa; identical to SEQ ID NO: 62661

SEQ ID NO: 567767 - RNA, 64 nt, hsa; identical to SEQ ID NO: 62662

SEQ ID NO: 567768 - RNA, 64 nt, hsa; identical to SEQ ID NO: 62663

SEQ ID NO: 567769 - RNA, 64 nt, hsa; identical to SEQ ID NO: 62664

SEQ ID NO: 567770 - RNA, 64 nt, hsa; identical to SEQ ID NO: 62665

SEQ ID NO: 567771 - RNA, 64 nt, hsa; identical to SEQ ID NO: 62666

SEQ ID NO: 567772 - RNA, 64 nt, hsa; identical to SEQ ID NO: 62667

SEQ ID NO: 567773 - RNA, 64 nt, hsa; identical to SEQ ID NO: 62668

SEQ ID NO: 567774 - RNA, 64 nt, hsa; identical to SEQ ID NO: 62669

SEQ ID NO: 567775 - RNA, 64 nt, hsa; identical to SEQ ID NO: 62670

SEQ ID NO: 567776 - RNA, 64 nt, hsa; identical to SEQ ID NO: 62671

SEQ ID NO: 567777 - RNA, 64 nt, hsa; identical to SEQ ID NO: 62672

SEQ ID NO: 567778 - RNA, 64 nt, hsa; identical to SEQ ID NO: 62673

SEQ ID NO: 567779 - RNA, 64 nt, hsa; identical to SEQ ID NO: 62674

SEQ ID NO: 567780 - RNA, 64 nt, hsa; identical to SEQ ID NO: 62675

SEQ ID NO: 567781 - RNA, 64 nt, hsa; identical to SEQ ID NO: 62676

SEQ ID NO: 567782 - RNA, 64 nt, hsa; identical to SEQ ID NO: 62677

SEQ ID NO: 567783 - RNA, 64 nt, hsa; identical to SEQ ID NO: 62678

SEQ ID NO: 567784 - RNA, 64 nt, hsa; identical to SEQ ID NO: 62679

SEQ ID NO: 567785 - RNA, 64 nt, hsa; identical to SEQ ID NO: 62680

SEQ ID NO: 567786 - RNA, 64 nt, hsa; identical to SEQ ID NO: 62681

SEQ ID NO: 567787 - RNA, 64 nt, hsa; identical to SEQ ID NO: 62682

SEQ ID NO: 567788 - RNA, 64 nt, hsa; identical to SEQ ID NO: 62683

SEQ ID NO: 567789 - RNA, 64 nt, hsa; identical to SEQ ID NO: 62684

SEQ ID NO: 567790 - RNA, 64 nt, hsa; identical to SEQ ID NO: 62685

SEQ ID NO: 567791 - RNA, 64 nt, hsa; identical to SEQ ID NO: 62686

SEQ ID NO: 567792 - RNA, 64 nt, hsa; identical to SEQ ID NO: 62687

SEQ ID NO: 567793 - RNA, 64 nt, hsa; identical to SEQ ID NO: 62688

SEQ ID NO: 567794 - RNA, 64 nt, hsa; identical to SEQ ID NO: 62689

SEQ ID NO: 567795 - RNA, 64 nt, hsa; identical to SEQ ID NO: 62690

SEQ ID NO: 567796 - RNA, 64 nt, hsa; identical to SEQ ID NO: 62691

SEQ ID NO: 567797 - RNA, 64 nt, hsa; identical to SEQ ID NO: 62692

SEQ ID NO: 567798 - RNA, 64 nt, hsa; identical to SEQ ID NO: 62693

SEQ ID NO: 567799 - RNA, 64 nt, hsa; identical to SEQ ID NO: 62694

SEQ ID NO: 567800 - RNA, 64 nt, hsa; identical to SEQ ID NO: 62695

SEQ ID NO: 567801 - RNA, 64 nt, hsa; identical to SEQ ID NO: 62696

SEQ ID NO: 567802 - RNA, 64 nt, hsa; identical to SEQ ID NO: 62697

SEQ ID NO: 567803 - RNA, 64 nt, hsa; identical to SEQ ID NO: 62698

SEQ ID NO: 567804 - RNA, 64 nt, hsa; identical to SEQ ID NO: 62699

SEQ ID NO: 567805 - RNA, 64 nt, hsa; identical to SEQ ID NO: 62700

SEQ ID NO: 567806 - RNA, 64 nt, hsa; identical to SEQ ID NO: 62701

SEQ ID NO: 567807 - RNA, 64 nt, hsa; identical to SEQ ID NO: 62702

SEQ ID NO: 567808 - RNA, 64 nt, hsa; identical to SEQ ID NO: 62703

SEQ ID NO: 567809 - RNA, 64 nt, hsa; identical to SEQ ID NO: 62704

SEQ ID NO: 567810 - RNA, 64 nt, hsa; identical to SEQ ID NO: 62705

SEQ ID NO: 567811 - RNA, 64 nt, hsa; identical to SEQ ID NO: 62706

SEQ ID NO: 567812 - RNA, 64 nt, hsa; identical to SEQ ID NO: 62707

SEQ ID NO: 567813 - RNA, 64 nt, hsa; identical to SEQ ID NO: 62708

SEQ ID NO: 567814 - RNA, 64 nt, hsa; identical to SEQ ID NO: 62709

SEQ ID NO: 567815 - RNA, 64 nt, hsa; identical to SEQ ID NO: 62710

SEQ ID NO: 567816 - RNA, 64 nt, hsa; identical to SEQ ID NO: 62711

SEQ ID NO: 567817 - RNA, 64 nt, hsa; identical to SEQ ID NO: 62712

SEQ ID NO: 567818 - RNA, 64 nt, hsa; identical to SEQ ID NO: 62713

SEQ ID NO: 567819 - RNA, 64 nt, hsa; identical to SEQ ID NO: 62714

SEQ ID NO: 567820 - RNA, 64 nt, hsa; identical to SEQ ID NO: 62715

SEQ ID NO: 567821 - RNA, 64 nt, hsa; identical to SEQ ID NO: 62716

SEQ ID NO: 567822 - RNA, 64 nt, hsa; identical to SEQ ID NO: 62717

SEQ ID NO: 567823 - RNA, 64 nt, hsa; identical to SEQ ID NO: 62718

SEQ ID NO: 567824 - RNA, 64 nt, hsa; identical to SEQ ID NO: 62719

SEQ ID NO: 567825 - RNA, 64 nt, hsa; identical to SEQ ID NO: 62720

SEQ ID NO: 567826 - RNA, 64 nt, hsa; identical to SEQ ID NO: 62721

SEQ ID NO: 567827 - RNA, 64 nt, hsa; identical to SEQ ID NO: 62722

SEQ ID NO: 567828 - RNA, 64 nt, hsa; identical to SEQ ID NO: 62723

SEQ ID NO: 567829 - RNA, 64 nt, hsa; identical to SEQ ID NO: 62724

SEQ ID NO: 567830 - RNA, 64 nt, hsa; identical to SEQ ID NO: 62725

SEQ ID NO: 567831 - RNA, 64 nt, hsa; identical to SEQ ID NO: 62726

SEQ ID NO: 567832 - RNA, 62 nt, hsa; identical to SEQ ID NO: 62727

SEQ ID NO: 567833 - RNA, 64 nt, hsa; identical to SEQ ID NO: 62728

SEQ ID NO: 567834 - RNA, 64 nt, hsa; identical to SEQ ID NO: 62729

SEQ ID NO: 567835 - RNA, 64 nt, hsa; identical to SEQ ID NO: 62730

SEQ ID NO: 567836 - RNA, 64 nt, hsa; identical to SEQ ID NO: 62731

SEQ ID NO: 567837 - RNA, 64 nt, hsa; identical to SEQ ID NO: 62732

SEQ ID NO: 567838 - RNA, 64 nt, hsa; identical to SEQ ID NO: 62733

SEQ ID NO: 567839 - RNA, 64 nt, hsa; identical to SEQ ID NO: 62734

SEQ ID NO: 567840 - RNA, 64 nt, hsa; identical to SEQ ID NO: 62735

SEQ ID NO: 567841 - RNA, 64 nt, hsa; identical to SEQ ID NO: 62736

SEQ ID NO: 567842 - RNA, 64 nt, hsa; identical to SEQ ID NO: 62737

SEQ ID NO: 567843 - RNA, 64 nt, hsa; identical to SEQ ID NO: 62738

SEQ ID NO: 567844 - RNA, 64 nt, hsa; identical to SEQ ID NO: 62739

SEQ ID NO: 567845 - RNA, 64 nt, hsa; identical to SEQ ID NO: 62740

SEQ ID NO: 567846 - RNA, 64 nt, hsa; identical to SEQ ID NO: 62741

SEQ ID NO: 567847 - RNA, 64 nt, hsa; identical to SEQ ID NO: 62742

SEQ ID NO: 567848 - RNA, 64 nt, hsa; identical to SEQ ID NO: 62743

SEQ ID NO: 567849 - RNA, 64 nt, hsa; identical to SEQ ID NO: 62744

SEQ ID NO: 567850 - RNA, 64 nt, hsa; identical to SEQ ID NO: 62745

SEQ ID NO: 567851 - RNA, 64 nt, hsa; identical to SEQ ID NO: 62746

SEQ ID NO: 567852 - RNA, 64 nt, hsa; identical to SEQ ID NO: 62747

SEQ ID NO: 567853 - RNA, 64 nt, hsa; identical to SEQ ID NO: 62748

SEQ ID NO: 567854 - RNA, 64 nt, hsa; identical to SEQ ID NO: 62749

SEQ ID NO: 567855 - RNA, 64 nt, hsa; identical to SEQ ID NO: 62750

SEQ ID NO: 567856 - RNA, 64 nt, hsa; identical to SEQ ID NO: 62751

SEQ ID NO: 567857 - RNA, 64 nt, hsa; identical to SEQ ID NO: 62752

SEQ ID NO: 567858 - RNA, 64 nt, hsa; identical to SEQ ID NO: 62753

SEQ ID NO: 567859 - RNA, 64 nt, hsa; identical to SEQ ID NO: 62754

SEQ ID NO: 567860 - RNA, 64 nt, hsa; identical to SEQ ID NO: 62755

SEQ ID NO: 567861 - RNA, 64 nt, hsa; identical to SEQ ID NO: 62756

SEQ ID NO: 567862 - RNA, 64 nt, hsa; identical to SEQ ID NO: 62757

SEQ ID NO: 567863 - RNA, 64 nt, hsa; identical to SEQ ID NO: 62758

SEQ ID NO: 567864 - RNA, 64 nt, hsa; identical to SEQ ID NO: 62759

SEQ ID NO: 567865 - RNA, 64 nt, hsa; identical to SEQ ID NO: 62760

SEQ ID NO: 567866 - RNA, 64 nt, hsa; identical to SEQ ID NO: 62761

SEQ ID NO: 567867 - RNA, 64 nt, hsa; identical to SEQ ID NO: 62762

SEQ ID NO: 567868 - RNA, 64 nt, hsa; identical to SEQ ID NO: 62763

SEQ ID NO: 567869 - RNA, 64 nt, hsa; identical to SEQ ID NO: 62764

SEQ ID NO: 567870 - RNA, 64 nt, hsa; identical to SEQ ID NO: 62765

SEQ ID NO: 567871 - RNA, 64 nt, hsa; identical to SEQ ID NO: 62766

SEQ ID NO: 567872 - RNA, 64 nt, hsa; identical to SEQ ID NO: 62767

SEQ ID NO: 567873 - RNA, 64 nt, hsa; identical to SEQ ID NO: 62768

SEQ ID NO: 567874 - RNA, 64 nt, hsa; identical to SEQ ID NO: 62769

SEQ ID NO: 567875 - RNA, 64 nt, hsa; identical to SEQ ID NO: 62770

SEQ ID NO: 567876 - RNA, 64 nt, hsa; identical to SEQ ID NO: 62771

SEQ ID NO: 567877 - RNA, 64 nt, hsa; identical to SEQ ID NO: 62772

SEQ ID NO: 567878 - RNA, 64 nt, hsa; identical to SEQ ID NO: 62773

SEQ ID NO: 567879 - RNA, 64 nt, hsa; identical to SEQ ID NO: 62774

SEQ ID NO: 567880 - RNA, 64 nt, hsa; identical to SEQ ID NO: 62775

SEQ ID NO: 567881 - RNA, 64 nt, hsa; identical to SEQ ID NO: 62776

SEQ ID NO: 567882 - RNA, 64 nt, hsa; identical to SEQ ID NO: 62777

SEQ ID NO: 567883 - RNA, 64 nt, hsa; identical to SEQ ID NO: 62778

SEQ ID NO: 567884 - RNA, 64 nt, hsa; identical to SEQ ID NO: 62779

SEQ ID NO: 567885 - RNA, 64 nt, hsa; identical to SEQ ID NO: 62780

SEQ ID NO: 567886 - RNA, 64 nt, hsa; identical to SEQ ID NO: 62781

SEQ ID NO: 567887 - RNA, 64 nt, hsa; identical to SEQ ID NO: 62782

SEQ ID NO: 567888 - RNA, 64 nt, hsa; identical to SEQ ID NO: 62783

SEQ ID NO: 567889 - RNA, 64 nt, hsa; identical to SEQ ID NO: 62784

SEQ ID NO: 567890 - RNA, 64 nt, hsa; identical to SEQ ID NO: 62785

SEQ ID NO: 567891 - RNA, 64 nt, hsa; identical to SEQ ID NO: 62786

SEQ ID NO: 567892 - RNA, 64 nt, hsa; identical to SEQ ID NO: 62787

SEQ ID NO: 567893 - RNA, 64 nt, hsa; identical to SEQ ID NO: 62788

SEQ ID NO: 567894 - RNA, 64 nt, hsa; identical to SEQ ID NO: 62789

SEQ ID NO: 567895 - RNA, 64 nt, hsa; identical to SEQ ID NO: 62790

SEQ ID NO: 567896 - RNA, 64 nt, hsa; identical to SEQ ID NO: 62791

SEQ ID NO: 567897 - RNA, 64 nt, hsa; identical to SEQ ID NO: 62792

SEQ ID NO: 567898 - RNA, 64 nt, hsa; identical to SEQ ID NO: 62793

SEQ ID NO: 567899 - RNA, 64 nt, hsa; identical to SEQ ID NO: 62794

SEQ ID NO: 567900 - RNA, 64 nt, hsa; identical to SEQ ID NO: 62795

SEQ ID NO: 567901 - RNA, 64 nt, hsa; identical to SEQ ID NO: 62796

SEQ ID NO: 567902 - RNA, 64 nt, hsa; identical to SEQ ID NO: 62797

SEQ ID NO: 567903 - RNA, 64 nt, hsa; identical to SEQ ID NO: 62798

SEQ ID NO: 567904 - RNA, 64 nt, hsa; identical to SEQ ID NO: 62799

SEQ ID NO: 567905 - RNA, 64 nt, hsa; identical to SEQ ID NO: 62800

SEQ ID NO: 567906 - RNA, 64 nt, hsa; identical to SEQ ID NO: 62801

SEQ ID NO: 567907 - RNA, 64 nt, hsa; identical to SEQ ID NO: 62802

SEQ ID NO: 567908 - RNA, 64 nt, hsa; identical to SEQ ID NO: 62803

SEQ ID NO: 567909 - RNA, 64 nt, hsa; identical to SEQ ID NO: 62804

SEQ ID NO: 567910 - RNA, 64 nt, hsa; identical to SEQ ID NO: 62805

SEQ ID NO: 567911 - RNA, 64 nt, hsa; identical to SEQ ID NO: 62806

SEQ ID NO: 567912 - RNA, 64 nt, hsa; identical to SEQ ID NO: 62807

SEQ ID NO: 567913 - RNA, 64 nt, hsa; identical to SEQ ID NO: 62808

SEQ ID NO: 567914 - RNA, 64 nt, hsa; identical to SEQ ID NO: 62809

SEQ ID NO: 567915 - RNA, 64 nt, hsa; identical to SEQ ID NO: 62810

SEQ ID NO: 567916 - RNA, 64 nt, hsa; identical to SEQ ID NO: 62811

SEQ ID NO: 567917 - RNA, 64 nt, hsa; identical to SEQ ID NO: 62812

SEQ ID NO: 567918 - RNA, 64 nt, hsa; identical to SEQ ID NO: 62813

SEQ ID NO: 567919 - RNA, 64 nt, hsa; identical to SEQ ID NO: 62814

SEQ ID NO: 567920 - RNA, 64 nt, hsa; identical to SEQ ID NO: 62815

SEQ ID NO: 567921 - RNA, 64 nt, hsa; identical to SEQ ID NO: 62816

SEQ ID NO: 567922 - RNA, 64 nt, hsa; identical to SEQ ID NO: 62817

SEQ ID NO: 567923 - RNA, 64 nt, hsa; identical to SEQ ID NO: 62818

SEQ ID NO: 567924 - RNA, 64 nt, hsa; identical to SEQ ID NO: 62819

SEQ ID NO: 567925 - RNA, 64 nt, hsa; identical to SEQ ID NO: 62820

SEQ ID NO: 567926 - RNA, 64 nt, hsa; identical to SEQ ID NO: 62821

SEQ ID NO: 567927 - RNA, 64 nt, hsa; identical to SEQ ID NO: 62822

SEQ ID NO: 567928 - RNA, 64 nt, hsa; identical to SEQ ID NO: 62823

SEQ ID NO: 567929 - RNA, 64 nt, hsa; identical to SEQ ID NO: 62824

SEQ ID NO: 567930 - RNA, 64 nt, hsa; identical to SEQ ID NO: 62825

SEQ ID NO: 567931 - RNA, 64 nt, hsa; identical to SEQ ID NO: 62826

SEQ ID NO: 567932 - RNA, 64 nt, hsa; identical to SEQ ID NO: 62827

SEQ ID NO: 567933 - RNA, 64 nt, hsa; identical to SEQ ID NO: 62828

SEQ ID NO: 567934 - RNA, 64 nt, hsa; identical to SEQ ID NO: 62829

SEQ ID NO: 567935 - RNA, 64 nt, hsa; identical to SEQ ID NO: 62830

SEQ ID NO: 567936 - RNA, 64 nt, hsa; identical to SEQ ID NO: 62831

SEQ ID NO: 567937 - RNA, 64 nt, hsa; identical to SEQ ID NO: 62832

SEQ ID NO: 567938 - RNA, 64 nt, hsa; identical to SEQ ID NO: 62833

SEQ ID NO: 567939 - RNA, 64 nt, hsa; identical to SEQ ID NO: 62834

SEQ ID NO: 567940 - RNA, 64 nt, hsa; identical to SEQ ID NO: 62835

SEQ ID NO: 567941 - RNA, 64 nt, hsa; identical to SEQ ID NO: 62836

SEQ ID NO: 567942 - RNA, 64 nt, hsa; identical to SEQ ID NO: 62837

SEQ ID NO: 567943 - RNA, 64 nt, hsa; identical to SEQ ID NO: 62838

SEQ ID NO: 567944 - RNA, 64 nt, hsa; identical to SEQ ID NO: 62839

SEQ ID NO: 567945 - RNA, 64 nt, hsa; identical to SEQ ID NO: 62840

SEQ ID NO: 567946 - RNA, 64 nt, hsa; identical to SEQ ID NO: 62841

SEQ ID NO: 567947 - RNA, 64 nt, hsa; identical to SEQ ID NO: 62842

SEQ ID NO: 567948 - RNA, 64 nt, hsa; identical to SEQ ID NO: 62843

SEQ ID NO: 567949 - RNA, 64 nt, hsa; identical to SEQ ID NO: 62844

SEQ ID NO: 567950 - RNA, 64 nt, hsa; identical to SEQ ID NO: 62845

SEQ ID NO: 567951 - RNA, 64 nt, hsa; identical to SEQ ID NO: 62846

SEQ ID NO: 567952 - RNA, 64 nt, hsa; identical to SEQ ID NO: 62847

SEQ ID NO: 567953 - RNA, 64 nt, hsa; identical to SEQ ID NO: 62848

SEQ ID NO: 567954 - RNA, 64 nt, hsa; identical to SEQ ID NO: 62849

SEQ ID NO: 567955 - RNA, 64 nt, hsa; identical to SEQ ID NO: 62850

SEQ ID NO: 567956 - RNA, 64 nt, hsa; identical to SEQ ID NO: 62851

SEQ ID NO: 567957 - RNA, 64 nt, hsa; identical to SEQ ID NO: 62852

SEQ ID NO: 567958 - RNA, 64 nt, hsa; identical to SEQ ID NO: 62853

SEQ ID NO: 567959 - RNA, 64 nt, hsa; identical to SEQ ID NO: 62854

SEQ ID NO: 567960 - RNA, 64 nt, hsa; identical to SEQ ID NO: 62855

SEQ ID NO: 567961 - RNA, 64 nt, hsa; identical to SEQ ID NO: 62856

SEQ ID NO: 567962 - RNA, 64 nt, hsa; identical to SEQ ID NO: 62857

SEQ ID NO: 567963 - RNA, 64 nt, hsa; identical to SEQ ID NO: 62858

SEQ ID NO: 567964 - RNA, 64 nt, hsa; identical to SEQ ID NO: 62859

SEQ ID NO: 567965 - RNA, 64 nt, hsa; identical to SEQ ID NO: 62860

SEQ ID NO: 567966 - RNA, 64 nt, hsa; identical to SEQ ID NO: 62861

SEQ ID NO: 567967 - RNA, 64 nt, hsa; identical to SEQ ID NO: 62862

SEQ ID NO: 567968 - RNA, 64 nt, hsa; identical to SEQ ID NO: 62863

SEQ ID NO: 567969 - RNA, 64 nt, hsa; identical to SEQ ID NO: 62864

SEQ ID NO: 567970 - RNA, 64 nt, hsa; identical to SEQ ID NO: 62865

SEQ ID NO: 567971 - RNA, 64 nt, hsa; identical to SEQ ID NO: 62866

SEQ ID NO: 567972 - RNA, 64 nt, hsa; identical to SEQ ID NO: 62867

SEQ ID NO: 567973 - RNA, 64 nt, hsa; identical to SEQ ID NO: 62868

SEQ ID NO: 567974 - RNA, 64 nt, hsa; identical to SEQ ID NO: 62869

SEQ ID NO: 567975 - RNA, 64 nt, hsa; identical to SEQ ID NO: 62870

SEQ ID NO: 567976 - RNA, 64 nt, hsa; identical to SEQ ID NO: 62871

SEQ ID NO: 567977 - RNA, 64 nt, hsa; identical to SEQ ID NO: 62872

SEQ ID NO: 567978 - RNA, 64 nt, hsa; identical to SEQ ID NO: 62873

SEQ ID NO: 567979 - RNA, 64 nt, hsa; identical to SEQ ID NO: 62874

SEQ ID NO: 567980 - RNA, 64 nt, hsa; identical to SEQ ID NO: 62875

SEQ ID NO: 567981 - RNA, 64 nt, hsa; identical to SEQ ID NO: 62876

SEQ ID NO: 567982 - RNA, 64 nt, hsa; identical to SEQ ID NO: 62877

SEQ ID NO: 567983 - RNA, 64 nt, hsa; identical to SEQ ID NO: 62878

SEQ ID NO: 567984 - RNA, 64 nt, hsa; identical to SEQ ID NO: 62879

SEQ ID NO: 567985 - RNA, 64 nt, hsa; identical to SEQ ID NO: 62880

SEQ ID NO: 567986 - RNA, 64 nt, hsa; identical to SEQ ID NO: 62881

SEQ ID NO: 567987 - RNA, 64 nt, hsa; identical to SEQ ID NO: 62882

SEQ ID NO: 567988 - RNA, 64 nt, hsa; identical to SEQ ID NO: 62883

SEQ ID NO: 567989 - RNA, 64 nt, hsa; identical to SEQ ID NO: 62884

SEQ ID NO: 567990 - RNA, 64 nt, hsa; identical to SEQ ID NO: 62885

SEQ ID NO: 567991 - RNA, 64 nt, hsa; identical to SEQ ID NO: 62886

SEQ ID NO: 567992 - RNA, 64 nt, hsa; identical to SEQ ID NO: 62887

SEQ ID NO: 567993 - RNA, 64 nt, hsa; identical to SEQ ID NO: 62888

SEQ ID NO: 567994 - RNA, 64 nt, hsa; identical to SEQ ID NO: 62889

SEQ ID NO: 567995 - RNA, 64 nt, hsa; identical to SEQ ID NO: 62890

SEQ ID NO: 567996 - RNA, 64 nt, hsa; identical to SEQ ID NO: 62891

SEQ ID NO: 567997 - RNA, 64 nt, hsa; identical to SEQ ID NO: 62892

SEQ ID NO: 567998 - RNA, 64 nt, hsa; identical to SEQ ID NO: 62893

SEQ ID NO: 567999 - RNA, 64 nt, hsa; identical to SEQ ID NO: 62894

SEQ ID NO: 568000 - RNA, 64 nt, hsa; identical to SEQ ID NO: 62895

SEQ ID NO: 568001 - RNA, 64 nt, hsa; identical to SEQ ID NO: 62896

SEQ ID NO: 568002 - RNA, 64 nt, hsa; identical to SEQ ID NO: 62897

SEQ ID NO: 568003 - RNA, 64 nt, hsa; identical to SEQ ID NO: 62898

SEQ ID NO: 568004 - RNA, 64 nt, hsa; identical to SEQ ID NO: 62899

SEQ ID NO: 568005 - RNA, 64 nt, hsa; identical to SEQ ID NO: 62900

SEQ ID NO: 568006 - RNA, 64 nt, hsa; identical to SEQ ID NO: 62901

SEQ ID NO: 568007 - RNA, 64 nt, hsa; identical to SEQ ID NO: 62902

SEQ ID NO: 568008 - RNA, 64 nt, hsa; identical to SEQ ID NO: 62903

SEQ ID NO: 568009 - RNA, 64 nt, hsa; identical to SEQ ID NO: 62904

SEQ ID NO: 568010 - RNA, 64 nt, hsa; identical to SEQ ID NO: 62905

SEQ ID NO: 568011 - RNA, 64 nt, hsa; identical to SEQ ID NO: 62906

SEQ ID NO: 568012 - RNA, 64 nt, hsa; identical to SEQ ID NO: 62907

SEQ ID NO: 568013 - RNA, 64 nt, hsa; identical to SEQ ID NO: 62908

SEQ ID NO: 568014 - RNA, 64 nt, hsa; identical to SEQ ID NO: 62909

SEQ ID NO: 568015 - RNA, 64 nt, hsa; identical to SEQ ID NO: 62910

SEQ ID NO: 568016 - RNA, 64 nt, hsa; identical to SEQ ID NO: 62911

SEQ ID NO: 568017 - RNA, 64 nt, hsa; identical to SEQ ID NO: 62912

SEQ ID NO: 568018 - RNA, 64 nt, hsa; identical to SEQ ID NO: 62913

SEQ ID NO: 568019 - RNA, 64 nt, hsa; identical to SEQ ID NO: 62914

SEQ ID NO: 568020 - RNA, 64 nt, hsa; identical to SEQ ID NO: 62915

SEQ ID NO: 568021 - RNA, 64 nt, hsa; identical to SEQ ID NO: 62916

SEQ ID NO: 568022 - RNA, 64 nt, hsa; identical to SEQ ID NO: 62917

SEQ ID NO: 568023 - RNA, 64 nt, hsa; identical to SEQ ID NO: 62918

SEQ ID NO: 568024 - RNA, 64 nt, hsa; identical to SEQ ID NO: 62919

SEQ ID NO: 568025 - RNA, 64 nt, hsa; identical to SEQ ID NO: 62920

SEQ ID NO: 568026 - RNA, 64 nt, hsa; identical to SEQ ID NO: 62921

SEQ ID NO: 568027 - RNA, 64 nt, hsa; identical to SEQ ID NO: 62922

SEQ ID NO: 568028 - RNA, 64 nt, hsa; identical to SEQ ID NO: 62923

SEQ ID NO: 568029 - RNA, 64 nt, hsa; identical to SEQ ID NO: 62924

SEQ ID NO: 568030 - RNA, 64 nt, hsa; identical to SEQ ID NO: 62925

SEQ ID NO: 568031 - RNA, 64 nt, hsa; identical to SEQ ID NO: 62926

SEQ ID NO: 568032 - RNA, 64 nt, hsa; identical to SEQ ID NO: 62927

SEQ ID NO: 568033 - RNA, 64 nt, hsa; identical to SEQ ID NO: 62928

SEQ ID NO: 568034 - RNA, 64 nt, hsa; identical to SEQ ID NO: 62929

SEQ ID NO: 568035 - RNA, 64 nt, hsa; identical to SEQ ID NO: 62930

SEQ ID NO: 568036 - RNA, 64 nt, hsa; identical to SEQ ID NO: 62931

SEQ ID NO: 568037 - RNA, 64 nt, hsa; identical to SEQ ID NO: 62930

SEQ ID NO: 568038 - RNA, 64 nt, hsa; identical to SEQ ID NO: 62931

SEQ ID NO: 568039 - RNA, 64 nt, hsa; identical to SEQ ID NO: 62934

SEQ ID NO: 568040 - RNA, 64 nt, hsa; identical to SEQ ID NO: 62935

SEQ ID NO: 568041 - RNA, 64 nt, hsa
gaaacuaauauaccucaguauuccaucauggucugaaagucaaacuucggcaaggcacggacga

SEQ ID NO: 568042 - RNA, 64 nt, hsa
ugggguccuguuaaaccacagacaguuaugaacugaaagucauaacggggagaggugccuggcu

SEQ ID NO: 568043 - RNA, 64 nt, hsa
auucggagcuagaggacauggaaaauaaagccaggaaagucaaaaaaacgaaagagaaggagaa

SEQ ID NO: 568044 - RNA, 64 nt, hsa
aagagaaggagaagaaaaaggaaaagggcaaauugaaagucaaggagaaaaagcgcaaagagga

SEQ ID NO: 568045 - RNA, 64 nt, hsa
gaaauaguuuucuuagauuaaucucaggauaugagaaagucaauuaagugugaguaaaguuagu

SEQ ID NO: 568046 - RNA, 64 nt, hsa
uuauuuuguguaagcagagauuuaauuuuauauugaaagucagugcaaaauuaugaauaggaua

SEQ ID NO: 568047 - RNA, 64 nt, hsa
uuaugaucccagcaauacacuuuuuaaaaaaugugaaagucaaagaauuaaguucuaguucuga

SEQ ID NO: 568048 - RNA, 64 nt, hsa
aaauuaccuacuaaacagugguagccaugacauggaaagucaacugauucuacaauuggacauu

SEQ ID NO: 568049 - RNA, 64 nt, hsa
acacucuccuaauaagcagauguuuggccuuucagaaagucaacaagcaaaaugccuugagugu

SEQ ID NO: 568050 - RNA, 64 nt, hsa
accacauugcaaucacacuagaccucaggauugagaaagucacucaaaaccgcucaacugcaug

SEQ ID NO: 568051 - RNA, 64 nt, hsa
ugggcugagcuggggaacaugucggugcacagcugaaagucagcgauuaugccggcgguuagaa

SEQ ID NO: 568052 - RNA, 64 nt, hsa
ugaggcauagccagcuucaaaagcgaucugacaugaaagucauuaacaaagccagccgugaaaa

SEQ ID NO: 568053 - RNA, 64 nt, hsa
cauauuccauagugugugguuuaugaguuguggguuucaucacuaacccaguaaccauaagaaa

SEQ ID NO: 568054 - RNA, 64 nt, hsa
uguuuaaagaaguacuccaagaacaaucugcuuuuuucaucauuuguuuuaugaauuuauccau

SEQ ID NO: 568055 - RNA, 64 nt, hsa
gccuccaaccuaauuugaguuucauuuguauuuuuuucaucaccuuacauguguuaacagcugu

SEQ ID NO: 568056 - RNA, 64 nt, hsa
aggaugcacuauauucauggguaggaaagauuaguuucaucaagauuucaauuuuuaucaauuc

SEQ ID NO: 568057 - RNA, 64 nt, hsa
guucugaguugucagaucucuugaagacaauauuuuucaucacuuauuguuuacuaaagcuaca

SEQ ID NO: 568058 - RNA, 64 nt, hsa
guaaagaagaggggaaacccagccagcuacuuuuuuucaucacuuuuuauucauaacuucagau

SEQ ID NO: 568059 - RNA, 64 nt, hsa
ugguuucugcuuucauugacuauuuucaucauaauuucaucauugauuaaaaaaagaaaaccac

SEQ ID NO: 568060 - RNA, 64 nt, hsa
aguaguaaaguugguuucugcuuucauugacuauuuucaucauaauuucaucauugauuaaaaa

SEQ ID NO: 568061 - RNA, 64 nt, hsa
caaaauauugaaguucaucugaaaugcaaggugcuuucaucaaugaaccuuuucaaacuuuucu

SEQ ID NO: 568062 - RNA, 64 nt, hsa
ugauggugcacuacucugaggccuguauggccccuuucaucaauaucuauucaaauauacaggu

SEQ ID NO: 568063 - RNA, 64 nt, hsa
guuaauaaucuauauuuauuugacucagcacuguuuucaucacaacuuguuuucccagcaucau

SEQ ID NO: 568064 - RNA, 64 nt, hsa
gccauguagaggaaaagauauggaguuauguggauuucaucacuaguaugugugcgugagcugg

SEQ ID NO: 568065 - RNA, 64 nt, hsa
aguaucuguuacacauuagaaguaguugucacuauuucaucaucuugguuuuucauuuguuuua

SEQ ID NO: 568066 - RNA, 64 nt, hsa
guauuuuugaauuauuuauauaaaauaucuaucuuuucaucaugucuauaguuccugagauuuu

SEQ ID NO: 568067 - RNA, 64 nt, hsa
cuggcaucagugugcagcaaauuuguucuuuugguuucaucacuaacaaaagugccucaucaua

SEQ ID NO: 568068 - RNA, 64 nt, hsa
agaauuguuauuaugcagccuucauuugggcugguuucaucauuuugcacugugaaauagcuuu

SEQ ID NO: 568069 - RNA, 64 nt, hsa
acaggugacugugaaacagaugcccuggucuugcuuucaucacucuaggaucaugaagugcuau

SEQ ID NO: 568070 - RNA, 64 nt, hsa
caugaagcuggcagauagucggcaggacucauuuuuucaucauggcuggcugauuucuccauag

SEQ ID NO: 568071 - RNA, 64 nt, hsa
ggccuguagguagcaaaugcaggauuuuguuuacuuucaucaugucaugugguggucagacugc

SEQ ID NO: 568072 - RNA, 64 nt, hsa
cagacugcucgcugguggccucgcuuuagaagguuuucaucaagccccgcccuuucucucucau

SEQ ID NO: 568073 - RNA, 64 nt, hsa
acucucaauugaguuaaaucaguaaucugucgcauuucaucaagauuaauuaaaauuugggacc

SEQ ID NO: 568074 - RNA, 64 nt, hsa
gcugugaaucuguugauggagauccaacuauuucuuucaucagaaaaaguccgaaaagcaaacc

SEQ ID NO: 568075 - RNA, 64 nt, hsa
caaaagugaguguuucuauuugagaaggacacuuuuucaucaucuaaacugauucgcauaggug

SEQ ID NO: 568076 - RNA, 64 nt, hsa
aucauugcuuuauaguagcuuauaucaauuuagauuucaucauuacuauuuugcauacuggaau

SEQ ID NO: 568077 - RNA, 64 nt, hsa
uuaagugaauuaauuauugauguuuuagaaugguuuucaucaguugggaucagcuauauggcaa

SEQ ID NO: 568078 - RNA, 64 nt, hsa
ccggcuacuuuuuuauauuuuuaguagagacggguuucaucauguuagccaggauggucuugau

SEQ ID NO: 568079 - RNA, 64 nt, hsa
agccuuggaaugggcauaaguuguauguccuacauuucaucauugucccgggccugcauugcac

SEQ ID NO: 568080 - RNA, 64 nt, hsa
cagguaaguguauaaaagagauuaagugcuuuuuuuucaucacuugauuauuuucuuuaaaauc

SEQ ID NO: 568081 - RNA, 64 nt, hsa
ucugaaaacaucuagcccaaagguaaguugcuauuuucaucacaguugccuaugcccagggaau

SEQ ID NO: 568082 - RNA, 64 nt, hsa
uaguuuuuggaaaaaccuuguggauaaguggcuguuucaucaguaagcagccuuugugguuuag

SEQ ID NO: 568083 - RNA, 64 nt, hsa
ccuuuuuauuuugguguugcaaaaaguaacauauuuucaucauugcuucauacgacauggaguu

SEQ ID NO: 568084 - RNA, 64 nt, hsa
gguuucagcccauuccuuggaauacuaacagguauuucaucagucauuguagguugggaagggu

SEQ ID NO: 568085 - RNA, 64 nt, hsa
aacucugccaaccacuuuucuccuaucaguauaauuucaucauuucaugaauaugauaaaaaua

SEQ ID NO: 568086 - RNA, 64 nt, hsa
agucuucuguggaaagauagacuuuauuaucagguuucaucauagauuucaacguaagugagcu

SEQ ID NO: 568087 - RNA, 64 nt, hsa
ccacagccuggucaggagggaaggaccucacuuguuucaucaaauggagugguuuaaaacugau

SEQ ID NO: 568088 - RNA, 64 nt, hsa
uaaaaaaacaaaaagacauauucagguacugauuuuucaucaagagauugacauaccaaugauc

SEQ ID NO: 568089 - RNA, 64 nt, hsa
aaagcuugaaaacauuuagcauuugaauaguaaguuucaucacaaaucaugucuuuugccucuu

SEQ ID NO: 568090 - RNA, 64 nt, hsa
uucuaaacuggcaaaaauuuucagggugcacuucuuucaucaaaaugaucauccaucuuuugua

SEQ ID NO: 568091 - RNA, 64 nt, hsa
acacuguggguuuauauugauguguaacaaguugauuuggaacacuggacucucauucuguuau

SEQ ID NO: 568092 - RNA, 64 nt, hsa
ccaauugguauauacaacuuucagagccucuuguauuuggaaggcuggaagggcccagacuuug

SEQ ID NO: 568093 - RNA, 64 nt, hsa
uagaaaagguccuaguuagguuccuauauaaagcauuuggaagaugaccuuguugcccuugaaa

SEQ ID NO: 568094 - RNA, 64 nt, hsa
cccucaucuccauucucaguuucuuccccacaaaauuuggaaucaaagcuuuuaugacguuugc

SEQ ID NO: 568095 - RNA, 64 nt, hsa
aaugcuaccuugcuguacauacuuauaaccuuguauuuggaaaugagaaauagguuuauauuuu

SEQ ID NO: 568096 - RNA, 64 nt, hsa
uuaucaaauuuuuaaaauacaaguuugguaugugauuuggaaaagaugccuucuggaucuuaag

SEQ ID NO: 568097 - RNA, 64 nt, hsa
ugauaacacucagaaaaccacaguguguuuucauauuuggaacuuuguaauagcgggaguagca

SEQ ID NO: 568098 - RNA, 64 nt, hsa
aagaacugguuuauuuuauagucagucaaaaugcauuuggaauguaccuugcuuccauaacaga

SEQ ID NO: 568099 - RNA, 64 nt, hsa
uucucguauuuaauaugggugaacaccaacuuuuauuuggaauaauaauuuuccuccuaaacaa

SEQ ID NO: 568100 - RNA, 64 nt, hsa
gugucagcaugcauagugcuaagaaagcaagccaauuuggaaacuuagguuagugacaaaauug

SEQ ID NO: 568101 - RNA, 64 nt, hsa
ggagaaggucccaggugaauuggcucucauggaaauuuggaauuacaaaauaaacguccugggg

SEQ ID NO: 568102 - RNA, 64 nt, hsa
gugcuacccguugcugggggaggagucaugguuuauuuggaaaugucaguugcaaucaugguuc

SEQ ID NO: 568103 - RNA, 64 nt, hsa
cuaagcaguuucucuguuugcuugucauagcagcauuuggaaacucaaacaugcuuucauuuac

SEQ ID NO: 568104 - RNA, 64 nt, hsa
aaugugugaaccuuaagaaauccccauuuguggaauuuggaaacguguguugacuccugguggu

SEQ ID NO: 568105 - RNA, 64 nt, hsa
ggaaccuauauuugugcuugaagguguuuuugauauuuggaaacaguauaagccauuuggaguc

SEQ ID NO: 568106 - RNA, 64 nt, hsa
ugagaaguucuuugcagauuuggggcgaggggugauuuggaaaagaagaccuggguggaaagcg

SEQ ID NO: 568107 - RNA, 64 nt, hsa
cucccguacugcuuucaggucuuguaaaauaagcauuuggaagucuugggaggccugccugcua

SEQ ID NO: 568108 - RNA, 64 nt, hsa
uaaugugcauuguuauugaguuguacuguaccuuauuuggaaggaugaaggaaugaaucuuuuu

SEQ ID NO: 568109 - RNA, 64 nt, hsa
aguggauagcucaucccuaggaauuuucauuaaaauuuggaaacagaguaaugaagaaauaaua

SEQ ID NO: 568110 - RNA, 64 nt, hsa
ccagccuagaaagcacaggaacaauacgucauauauuuggaacaguuauugucugugccaugac

SEQ ID NO: 568111 - RNA, 64 nt, hsa
cuucuugcuggaaugaacagugugcucagggacuauuuggaacuggauguuuuugaauuauuuu

SEQ ID NO: 568112 - RNA, 64 nt, hsa
uuacaugguagaacugcccaugccacaaauauuuauuuggaaaaguagucauuaaaugaaccca

SEQ ID NO: 568113 - RNA, 64 nt, hsa
aaccaugcccccuucguuggcaucacagggccuuauuuggaagagcgggcaaagaggauggaaa

SEQ ID NO: 568114 - RNA, 64 nt, hsa
gagcaauacccaagccucauuuggaaggcucaacauuuggaauugcacuuuaauugauuaaucc

SEQ ID NO: 568115 - RNA, 64 nt, hsa
gccucugguggcugcagagcaauacccaagccucauuuggaaggcucaacauuuggaauugcac

SEQ ID NO: 568116 - RNA, 64 nt, hsa
uuuuaggauugcuaucaauuuucagcauugugcuauuuggaaauaaguguuuugcuuuugucug

SEQ ID NO: 568117 - RNA, 64 nt, hsa
aaaaugguuuuuacuccugugauuauguuggaauauuuggaauuuuaaaggaguaaagacuguc

SEQ ID NO: 568118 - RNA, 64 nt, hsa
augcauucacuugaaaaacuaaaaaaaaacaauaauuuggaaaaacccaugaagguaacuaacg

SEQ ID NO: 568119 - RNA, 64 nt, hsa
cuuaaaaauaauaacuuauugccagauuuggggcauuuggaaagaaguucauugaagauaaagc

SEQ ID NO: 568120 - RNA, 64 nt, hsa
uuguuuaaaaacuugcuuaagacaauugcaucagauuuggaaguuuugccaucaaaauucuuug

SEQ ID NO: 568121 - RNA, 64 nt, hsa
uuucuaugaaaucuacuuggaucccaugccugaaauuuggaagcauauguacaaaaaucauuuu

SEQ ID NO: 568122 - RNA, 64 nt, hsa
ucccuuuuauaauuuguuuuaaugauuuugcuacauuuggaauucaauaaaaaaugugaacaau

SEQ ID NO: 568123 - RNA, 64 nt, hsa
gcaaggagauaggauuauagauaauuucacggacauuuggaaauaacauuggugauuauacaga

SEQ ID NO: 568124 - RNA, 64 nt, hsa
gucuguucuucuuuucuucuuucauuucaguggcauuuggaagcaaagagugcuaggcaccugc

SEQ ID NO: 568125 - RNA, 64 nt, hsa
uaucugcuggcguuggguuccaaauuugcauuuuauuuggaaacagacaaguagaagaugcuac

SEQ ID NO: 568126 - RNA, 64 nt, hsa
caaguuauuaaggagaaggcaugccucauugguaauuuggaagacaccaacacuuacccagaau

SEQ ID NO: 568127 - RNA, 64 nt, hsa
uggaucuuguuugauucuguaguuaaauuuccacauuuggaaugggaaggcaucuccaugccag

SEQ ID NO: 568128 - RNA, 64 nt, hsa
gacuuugugaccaaauagucuacaggaggcagccauuuggaaggaaaacugcugugguugcugc

SEQ ID NO: 568129 - RNA, 64 nt, hsa
auugcucgaugccacucaugguguccuaccuccuauuuggaaaccaucucuauuuuuuucuuac

SEQ ID NO: 568130 - RNA, 64 nt, hsa
cagaaaucuuuaugaauaaaugaaaagauaagggauuuggaagccacagguuguuuuuuguuug

SEQ ID NO: 568131 - RNA, 64 nt, hsa
cauuguuaaaaugcaaucauagugacuucagaaaauuuggaaaauacagaaaauauagggaaga

SEQ ID NO: 568132 - RNA, 64 nt, hsa
ucccuccccaaacaaguaaacuugugaaaguuuaauuuggaauuaguggaagcuguuccuuuga

SEQ ID NO: 568133 - RNA, 64 nt, hsa
cacagccugaauggacguagcacugucauguggcauuuggaaaaucuuuaauuauccuaauguu

SEQ ID NO: 568134 - RNA, 64 nt, hsa
uccgacgaugacucuugggugagcaacggcaccuauuuggaacuuagaaaagaucuugguuuuu

SEQ ID NO: 568135 - RNA, 64 nt, hsa
guccagugagcaguguugcguuuuuccuuguagcauuuggaaaugauuuacuggaauuacaaaa

SEQ ID NO: 568136 - RNA, 64 nt, hsa
uuggagauuggcuugucucacgcagccagugcacauuuggaauugacggaaacaacguugcuau

SEQ ID NO: 568137 - RNA, 64 nt, hsa
uaauagguguacuaaaauuguguugggagcagggauuuggaaauuucugagagauguguaguua

SEQ ID NO: 568138 - RNA, 64 nt, hsa
auauugucauaccauaguaggaagaaaaaccuuuauuuggaauauacacuacuguaaguuugua

SEQ ID NO: 568139 - RNA, 64 nt, hsa
cuaaugguuaagacaccaguaacaaaaacacaugauuuggaaauacuuuggcuuuuucauauac

SEQ ID NO: 568140 - RNA, 64 nt, hsa
cuguguuagagcacagauuuaccuaggcuugaagauuuggaagaaauaauauguaagaauggcc

SEQ ID NO: 568141 - RNA, 64 nt, hsa
auucuguccacuccucaccucgcaucagcuauaaauuuggaaguacuuguccaggcacucaagu

SEQ ID NO: 568142 - RNA, 64 nt, hsa
gugcagagggauuaaauuagaccugugagauuauauuuggaaaaauucaugucuguaacuaacc

SEQ ID NO: 568143 - RNA, 64 nt, hsa
uguaugguuuuuccccagauuagucauacaguucauuuggaauucagguacauuaagcuuuagu

SEQ ID NO: 568144 - RNA, 64 nt, hsa
aggcccucucagggaggagacauccaagcaaaucauuuggaaaaguuaggaaaccuuuaggauu

SEQ ID NO: 568145 - RNA, 64 nt, hsa
gacugguguguacugaauaggaaagggaaguuuuauuuggaaccuucuaagaggaaaucaacca

SEQ ID NO: 568146 - RNA, 64 nt, hsa
agaaaagcccuuauuuggaaagugugaaauuuguauuuggaaaagcugccuggagagaagaacu

SEQ ID NO: 568147 - RNA, 64 nt, hsa
acccauaaucaguaaccuaucaagaaaagcccuuauuuggaaagugugaaauuuguauuuggaa

SEQ ID NO: 568148 - RNA, 64 nt, hsa
augagccugggacuccaugucacguuuccuucugauuuggaaucucuccaucuguaauuccuca

SEQ ID NO: 568149 - RNA, 64 nt, hsa
aggcguaagauaaggauggaaggcuguccaaguuauuuggaaggccucggcagcuugggauuag

SEQ ID NO: 568150 - RNA, 64 nt, hsa
aaaugucacauuuguaaaggggaaggcggacaagauuuggaaguuuagucaccucugagccacc

SEQ ID NO: 568151 - RNA, 64 nt, hsa
gagcccucccacugccagcucagguuguucacagauuuggaaugggaccagaggcccuugaaaa

SEQ ID NO: 568152 - RNA, 64 nt, hsa
agucaaccaaagauggcaugacuuaccugcgcagauuuggaagcauugaacuuagagugcuggc

SEQ ID NO: 568153 - RNA, 64 nt, hsa
gcuuacauugauuuuguagacacauuaagucaagauuuggaauuuaagucacuggcagguaucu

SEQ ID NO: 568154 - RNA, 64 nt, hsa
cuucuuggaucuguggguuuauuguuuccauaaaauuuggaaauuuuuacaaucuucuucaaau

SEQ ID NO: 568155 - RNA, 64 nt, hsa
aaguauucuggagcuuuguuaugaguugcagguuauuuggaagcaguuuccuuuuucaggucuu

SEQ ID NO: 568156 - RNA, 64 nt, hsa
gaaccuagcgcaucaaauuuuguuuucuucauucauuuggaaccuuauuuucgcaaaaaaccua

SEQ ID NO: 568157 - RNA, 64 nt, hsa
ggaaagaaaucgggaugccgcggagcacagagugauuuggaacuccauuccaccugacccugug

SEQ ID NO: 568158 - RNA, 64 nt, hsa
gaagaggcccucugggugaugaagugaccaucacauuuggaaagugaucaaccacuguuccuuc

SEQ ID NO: 568159 - RNA, 64 nt, hsa
caguugccgaaccaggccgccucacagccaggaaauuuggaaauccuagccaaggggauuucgu

SEQ ID NO: 568160 - RNA, 64 nt, hsa
agcaaguuugaccuugguucuguugcugaagcaaauuuggaacuuuucugucucagugugaucc

SEQ ID NO: 568161 - RNA, 64 nt, hsa
ucugucucagugugauccacuaacccacaggaucauuuggaaccuugaauagcucugcuuggac

SEQ ID NO: 568162 - RNA, 64 nt, hsa
gaagaaacaauacaugcuugcuauuaauauuucaauuuggaauguucugaauugaccaaauuua

SEQ ID NO: 568163 - RNA, 64 nt, hsa
uuucagagcccuccugcucacuugaccacgugagauuuggaauaacuguaggacuucuguuucc

SEQ ID NO: 568164 - RNA, 64 nt, hsa
uauaaagguuaccacaugacuaggguacagccagauuuggaaaccauagcuugaaggcagugag

SEQ ID NO: 568165 - RNA, 64 nt, hsa
ggccccuaaaacauucauuaagucuggggugaagauuuggaaucuugaaugcuuauaaagguua

SEQ ID NO: 568166 - RNA, 64 nt, hsa
ccuguacuauuauuaauguuuauauuguaccuugauuuggaaaaguauuggaguuaaucuguau

SEQ ID NO: 568167 - RNA, 64 nt, hsa
gcauauaugcagugcuuuuucuuaaacuuggccaauuuggaaagggggaaggagccaccccaaa

SEQ ID NO: 568168 - RNA, 64 nt, hsa
aagauaaaaguacauaaugaaaauccauggccuuauuuggaauauauaucacuuuccaaauuuu

SEQ ID NO: 568169 - RNA, 64 nt, hsa
uuagguuccuuaauuuggcuguugguaccuguguauuuggaauauuuuaggggauucgaauuuu

SEQ ID NO: 568170 - RNA, 64 nt, hsa; identical to SEQ ID NO: 265126

SEQ ID NO: 568171 - RNA, 64 nt, hsa; identical to SEQ ID NO: 265127

SEQ ID NO: 568172 - RNA, 64 nt, hsa; identical to SEQ ID NO: 265128

SEQ ID NO: 568173 - RNA, 64 nt, hsa; identical to SEQ ID NO: 265129

SEQ ID NO: 568174 - RNA, 64 nt, hsa; identical to SEQ ID NO: 265130

SEQ ID NO: 568175 - RNA, 64 nt, hsa; identical to SEQ ID NO: 265131

SEQ ID NO: 568176 - RNA, 64 nt, hsa; identical to SEQ ID NO: 265132

SEQ ID NO: 568177 - RNA, 64 nt, hsa; identical to SEQ ID NO: 265133

SEQ ID NO: 568178 - RNA, 64 nt, hsa; identical to SEQ ID NO: 265134

SEQ ID NO: 568179 - RNA, 64 nt, hsa; identical to SEQ ID NO: 265135

SEQ ID NO: 568180 - RNA, 64 nt, hsa; identical to SEQ ID NO: 265136

SEQ ID NO: 568181 - RNA, 64 nt, hsa; identical to SEQ ID NO: 265137

SEQ ID NO: 568182 - RNA, 64 nt, hsa; identical to SEQ ID NO: 265138

SEQ ID NO: 568183 - RNA, 64 nt, hsa; identical to SEQ ID NO: 265139

SEQ ID NO: 568184 - RNA, 64 nt, hsa; identical to SEQ ID NO: 265140

SEQ ID NO: 568185 - RNA, 64 nt, hsa; identical to SEQ ID NO: 265141

SEQ ID NO: 568186 - RNA, 64 nt, hsa; identical to SEQ ID NO: 265142

SEQ ID NO: 568187 - RNA, 64 nt, hsa; identical to SEQ ID NO: 265143

SEQ ID NO: 568188 - RNA, 64 nt, hsa; identical to SEQ ID NO: 265144

SEQ ID NO: 568189 - RNA, 64 nt, hsa; identical to SEQ ID NO: 265145

SEQ ID NO: 568190 - RNA, 64 nt, hsa; identical to SEQ ID NO: 265146

SEQ ID NO: 568191 - RNA, 64 nt, hsa; identical to SEQ ID NO: 265147

SEQ ID NO: 568192 - RNA, 64 nt, hsa; identical to SEQ ID NO: 265148

SEQ ID NO: 568193 - RNA, 64 nt, hsa; identical to SEQ ID NO: 265149

SEQ ID NO: 568194 - RNA, 63 nt, hsa; identical to SEQ ID NO: 265150

SEQ ID NO: 568195 - RNA, 64 nt, hsa; identical to SEQ ID NO: 265151

SEQ ID NO: 568196 - RNA, 64 nt, hsa; identical to SEQ ID NO: 265152

SEQ ID NO: 568197 - RNA, 64 nt, hsa; identical to SEQ ID NO: 265153

SEQ ID NO: 568198 - RNA, 64 nt, hsa; identical to SEQ ID NO: 265154

SEQ ID NO: 568199 - RNA, 64 nt, hsa; identical to SEQ ID NO: 265155

SEQ ID NO: 568200 - RNA, 64 nt, hsa; identical to SEQ ID NO: 265156

SEQ ID NO: 568201 - RNA, 64 nt, hsa; identical to SEQ ID NO: 265157

SEQ ID NO: 568202 - RNA, 64 nt, hsa; identical to SEQ ID NO: 265158

SEQ ID NO: 568203 - RNA, 64 nt, hsa; identical to SEQ ID NO: 265159

SEQ ID NO: 568204 - RNA, 64 nt, hsa; identical to SEQ ID NO: 265160

SEQ ID NO: 568205 - RNA, 64 nt, hsa; identical to SEQ ID NO: 265161

SEQ ID NO: 568206 - RNA, 64 nt, hsa; identical to SEQ ID NO: 265162

SEQ ID NO: 568207 - RNA, 64 nt, hsa; identical to SEQ ID NO: 265163

SEQ ID NO: 568208 - RNA, 64 nt, hsa; identical to SEQ ID NO: 265164

SEQ ID NO: 568209 - RNA, 64 nt, hsa; identical to SEQ ID NO: 265165

SEQ ID NO: 568210 - RNA, 64 nt, hsa; identical to SEQ ID NO: 265166

SEQ ID NO: 568211 - RNA, 64 nt, hsa; identical to SEQ ID NO: 265167

SEQ ID NO: 568212 - RNA, 64 nt, hsa; identical to SEQ ID NO: 265168

SEQ ID NO: 568213 - RNA, 64 nt, hsa; identical to SEQ ID NO: 265169

SEQ ID NO: 568214 - RNA, 64 nt, hsa; identical to SEQ ID NO: 265170

SEQ ID NO: 568215 - RNA, 64 nt, hsa; identical to SEQ ID NO: 265171

SEQ ID NO: 568216 - RNA, 64 nt, hsa; identical to SEQ ID NO: 265172

SEQ ID NO: 568217 - RNA, 64 nt, hsa; identical to SEQ ID NO: 265173

SEQ ID NO: 568218 - RNA, 64 nt, hsa; identical to SEQ ID NO: 265174

SEQ ID NO: 568219 - RNA, 64 nt, hsa; identical to SEQ ID NO: 265175

SEQ ID NO: 568220 - RNA, 64 nt, hsa; identical to SEQ ID NO: 265176

SEQ ID NO: 568221 - RNA, 64 nt, hsa; identical to SEQ ID NO: 265177

SEQ ID NO: 568222 - RNA, 64 nt, hsa; identical to SEQ ID NO: 265178

SEQ ID NO: 568223 - RNA, 64 nt, hsa; identical to SEQ ID NO: 265179

SEQ ID NO: 568224 - RNA, 64 nt, hsa; identical to SEQ ID NO: 533739

SEQ ID NO: 568225 - RNA, 64 nt, hsa; identical to SEQ ID NO: 533740

SEQ ID NO: 568226 - RNA, 64 nt, hsa; identical to SEQ ID NO: 533741

SEQ ID NO: 568227 - RNA, 64 nt, hsa; identical to SEQ ID NO: 533742

SEQ ID NO: 568228 - RNA, 64 nt, hsa; identical to SEQ ID NO: 533743

SEQ ID NO: 568229 - RNA, 64 nt, hsa; identical to SEQ ID NO: 533744

SEQ ID NO: 568230 - RNA, 64 nt, hsa; identical to SEQ ID NO: 533745

SEQ ID NO: 568231 - RNA, 64 nt, hsa; identical to SEQ ID NO: 533746

SEQ ID NO: 568232 - RNA, 64 nt, hsa; identical to SEQ ID NO: 533747

SEQ ID NO: 568233 - RNA, 64 nt, hsa; identical to SEQ ID NO: 533748

SEQ ID NO: 568234 - RNA, 64 nt, hsa; identical to SEQ ID NO: 533749

SEQ ID NO: 568235 - RNA, 64 nt, hsa; identical to SEQ ID NO: 533750

SEQ ID NO: 568236 - RNA, 64 nt, hsa; identical to SEQ ID NO: 533751

SEQ ID NO: 568237 - RNA, 64 nt, hsa; identical to SEQ ID NO: 533752

SEQ ID NO: 568238 - RNA, 64 nt, hsa; identical to SEQ ID NO: 533753

SEQ ID NO: 568239 - RNA, 64 nt, hsa; identical to SEQ ID NO: 533754

SEQ ID NO: 568240 - RNA, 64 nt, hsa
aagggaggagacaucuggccuuuuuagaaccugagaggaaaaaaagagucuuuuuuuccccucu

SEQ ID NO: 568241 - RNA, 64 nt, hsa
ccagcuucgcuccuuaucacugcauugugaagaggaggaaaagugaaucacggagagagaaagg

SEQ ID NO: 568242 - RNA, 64 nt, hsa
gagggcaguuaaacagugacauguugagcaccuggaggaaaaaaaaggugcaguuuuuaauaag

SEQ ID NO: 568243 - RNA, 64 nt, hsa
cuuaggcagcauugauuuaggucacuuucccagugaggaaaauuucuguguuuucagaauuucc

SEQ ID NO: 568244 - RNA, 64 nt, hsa
uuaggucaugaacauggucagaaccuuuggacaagaggaaaaauacuaagagauuugcuuuuuc

SEQ ID NO: 568245 - RNA, 64 nt, hsa
accuagauaggucaugcaagugagaaagacaucugaggaaaauggaagaccuaaggcagacagg

SEQ ID NO: 568246 - RNA, 64 nt, hsa
agcuauuuauauauauuauuuuuuuuuaagaaaggaggaaaagaaaccaaaaguuuuuuuuaag

SEQ ID NO: 568247 - RNA, 64 nt, hsa
gugcaauaugcccccugggucccaggagggucuggaggaaaacuggcuaucagaaccuccugau

SEQ ID NO: 568248 - RNA, 64 nt, hsa
augaauaucaaaucuuuugaugcuggacccaagagaggaaaaguuguagcuaaauguugauuua

SEQ ID NO: 568249 - RNA, 64 nt, hsa
uaccuuccccagccacagguauguggaauacggugaggaaaaaaaaaauuaaaaaaaaaaugca

SEQ ID NO: 568250 - RNA, 64 nt, hsa
cuuuucaaacaaugguuucucugcguuaauuauugaggaaaaaaaaagaugggguaagaaaacu

SEQ ID NO: 568251 - RNA, 64 nt, hsa
gcauugucuacuggagcuuuagucuucugagacggaggaaaacugcugaauacucuggauucau

SEQ ID NO: 568252 - RNA, 64 nt, hsa
cuccaccuggggcagcagcaggaggccuggggaggaggaaaaucaggcagucggccuggagucu

SEQ ID NO: 568253 - RNA, 64 nt, hsa
ugggcugaaggacugucuucacgaagucaguccugaggaaaaauauuggggacuccaaaugucc

SEQ ID NO: 568254 - RNA, 64 nt, hsa
aaaaauucuauuggacaauggcaauaucaacaaugaggaaaauuacugaagaauaaguuuccau

SEQ ID NO: 568255 - RNA, 64 nt, hsa
caaagauuuuaucucuucuucuaacuuuuaguaagaggaaaaagggauuauaaaacccuucaua

SEQ ID NO: 568256 - RNA, 64 nt, hsa
aaaugauuccucuucccaugaccuaaaacacugugaggaaaaaucauucaaguggcaugccaag

SEQ ID NO: 568257 - RNA, 64 nt, hsa
aguucuaagauaguuccagggauuaaaagguuaagaggaaaacacaaaucaccaaauuucugau

SEQ ID NO: 568258 - RNA, 64 nt, hsa
guuacauuuuuaauaugcaaccacuucuucaccugaggaaaacuagaaugaaaugcagucuaaa

SEQ ID NO: 568259 - RNA, 64 nt, hsa
ucuguuuuaauguguuuuuuaaaugcuguauguagaggaaaaucugcagaccacuggaauacau

SEQ ID NO: 568260 - RNA, 64 nt, hsa
ccauguguuacuuggucaggacagagacaaaaaugaggaaaacuaggggaccccacacacaugu

SEQ ID NO: 568261 - RNA, 64 nt, hsa
auguucaaggcccaggcugggguucagaccugcagaggaaaacaucagcuggcugggucaaggc

SEQ ID NO: 568262 - RNA, 64 nt, hsa
uugaggggcacucuaccuugguuaugauucaguagaggaaaaagaccaccuuucuucaauuuac

SEQ ID NO: 568263 - RNA, 64 nt, hsa
guuuguacaagaaaguuuguuugaauguguagaagaggaaaaagcaacaacagcaacaacacga

SEQ ID NO: 568264 - RNA, 64 nt, hsa
uuauauugaagauucugaaaaccuaucuuuauuagaggaaaaucucaaucuucaguuuuggccu

SEQ ID NO: 568265 - RNA, 64 nt, hsa
augcacauggaaacccaugagcuaggauucuaccgaggaaaacaucuagugggauuagcaaggu

SEQ ID NO: 568266 - RNA, 64 nt, hsa
aucugcagcaugcuauagaaaguggggaggaagggaggaaaaauaauuacagucaaaauauuug

SEQ ID NO: 568267 - RNA, 64 nt, hsa
uauaauauuuugugccuugaagggaaugucacaggaggaaaaggaagacuaaagccugcauacu

SEQ ID NO: 568268 - RNA, 64 nt, hsa
uuauaggaauuugcuuccuaagucuacuuuugaagaggaaaacaggaacguaccauauauuuug

SEQ ID NO: 568269 - RNA, 64 nt, hsa
cuuuauacuaaaaauauaggcucuugggauuggagaggaaaaauuagaggugauuuucagauuu

SEQ ID NO: 568270 - RNA, 64 nt, hsa
aauucucggcuguaguugcauaagcauugcucaagaggaaaauccaaaagugcagcaggagaac

SEQ ID NO: 568271 - RNA, 64 nt, hsa
aggguauagcugaauaggcaguuucuuuuguccugaggaaaaucaggacaugccugcuuucuaa

SEQ ID NO: 568272 - RNA, 64 nt, hsa
uauaauauauaauaaugaaaugacuaaguuaugugaggaaaaaaacagaagacauugcuaaaag

SEQ ID NO: 568273 - RNA, 64 nt, hsa
cccuaaauaugguaacuacucugggacaauaugggaggaaaagugaagauugugaugguguaag

SEQ ID NO: 568274 - RNA, 57 nt, hsa
uggauggauuucaacuuuaacuuacuggaggaaaaaaaauuuauggcuaaaaagggu

SEQ ID NO: 568275 - RNA, 64 nt, hsa
gaaugaugaggacacagcagccauauuaugccaagaggaaaaauaucaugaucauauugaaaga

SEQ ID NO: 568276 - RNA, 64 nt, hsa
aaagaaaugguugcugaacccaaaacauguuuaggaggaaaaccagaagaacagagcaguggca

SEQ ID NO: 568277 - RNA, 64 nt, hsa
acugcuuaauuggcaugagguuuccuuuugagaugaggaaaauguucugaaaauauggugaugg

SEQ ID NO: 568278 - RNA, 64 nt, hsa
uuaugauagaucuuauuguacacauuuuguaccagaggaaaacccuaaagcauuaguugcucaa

SEQ ID NO: 568279 - RNA, 64 nt, hsa
uggaagaguaagaaaauuaaaauacaagaugcaugaggaaaauguagagaugcucuuugugauu

SEQ ID NO: 568280 - RNA, 64 nt, hsa
guccuugaagcagcuauuugaagauguguuuucugaggaaaacaggcuacaacuguuuauuaaa

SEQ ID NO: 568281 - RNA, 64 nt, hsa
uauacuguaaauaaacuugaugaauauuauaugugaggaaaacuuucauguauagcacucauug

SEQ ID NO: 568282 - RNA, 64 nt, hsa
gugcuuugugaacucugcuuuaaagugaggggccgaggaaaacuuagaaacaggcagaguugga

SEQ ID NO: 568283 - RNA, 64 nt, hsa
ugugguuguggcaugugugagcagaagggaggaugaggaaaaagagaagaaaccccgguacuga

SEQ ID NO: 568284 - RNA, 64 nt, hsa
uccuuagccuucagugccauggaacuaaucaagggaggaaaaggucaccagggagaacuggaca

SEQ ID NO: 568285 - RNA, 64 nt, hsa
ccacuuaaggaucugcucuaugaaggagaagaaagaggaaaaagaaguaaaggaguuaggagga

SEQ ID NO: 568286 - RNA, 64 nt, hsa
caagcaggagauaacauuuucuucugcaucaagugaggaaaaaugugcuuuuggccaugucuca

SEQ ID NO: 568287 - RNA, 64 nt, hsa
aucucucucuagagcgagcaagagagggagagaggaggaaaaaauacacauaauacaaacauac

SEQ ID NO: 568288 - RNA, 64 nt, hsa
uuuccugcuuuuguacugcauggguggcaguugugaggaaaagccagucaaaugaccuuuuuac

SEQ ID NO: 568289 - RNA, 64 nt, hsa
aauacccaaguacauucuaauuaccaguauaucagaggaaaauuuucguagucuuuguaaaaua

SEQ ID NO: 568290 - RNA, 64 nt, hsa
auuuucuaaaaacacacacagaaaucgcuugagugaggaaaaguccacauggcagagacaggua

SEQ ID NO: 568291 - RNA, 64 nt, hsa
cuccaacaguucugaagccaacccacaaaucuuugaggaaaaggggucacuuuguuuacuauuc

SEQ ID NO: 568292 - RNA, 64 nt, hsa
aaaaucauccguaugucaguguaucuggauacacgaggaaaaggaaagagucucagaguggaac

SEQ ID NO: 568293 - RNA, 51 nt, hsa
aggaggaggaggaagaauaaggaggaaaaccaaaaccccaagcacccauua

SEQ ID NO: 568294 - RNA, 64 nt, hsa
ucaaauccacugacagauauaaaauaggcuuagagaggaaaagcugccucuggucaaguagauc

SEQ ID NO: 568295 - RNA, 64 nt, hsa
uuuuagacacugggagaagagaaccucaaacuaggaggaaaagacagagccuccacuuaguuuu

SEQ ID NO: 568296 - RNA, 64 nt, hsa
ggaguuuuagaggaaaagucaacaucuaacuagugaggaaaagugccuaauacaauuagaaucu

SEQ ID NO: 568297 - RNA, 64 nt, hsa
ugguugugagggggaaucugaaaauggaguuuuagaggaaaagucaacaucuaacuagugagga

SEQ ID NO: 568298 - RNA, 64 nt, hsa
ugaaggcaaaggaaacuaaggaaggagguucagugaggaaaauaagguuguccaugagauuuga

SEQ ID NO: 568299 - RNA, 64 nt, hsa
uaggccacuccuccaaaggaagucuaggagcugggaggaaaagaaaagaggggaaaaugaguuu

SEQ ID NO: 568300 - RNA, 64 nt, hsa
accaggcacgaacccaccugcugagagacccaaggaggaaaaacagacaaaaacagccucacag

SEQ ID NO: 568301 - RNA, 64 nt, hsa
aggaacuguagccauuucauugccuuaauuuuaagaggaaaauacaaaaacagcugauuuguuu

SEQ ID NO: 568302 - RNA, 64 nt, hsa
agucacuaaucauacucugaugccugaacuugaggaggaaaauacauguauauuuuuguuccgu

SEQ ID NO: 568303 - RNA, 64 nt, hsa
aggaguuuucuccauaucaaaacgagggcugauggaggaaaaaggucaauaaggucaagggaaa

SEQ ID NO: 568304 - RNA, 64 nt, hsa
ucgggaguccucuagcaggccuaagacaugugaggaggaaaaggaaaaaaagcaaaaagcaagg

SEQ ID NO: 568305 - RNA, 64 nt, hsa
accuugaauagaaguuuuccugauaagaauaaacgaggaaaagguccuugccuccuggaagaac

SEQ ID NO: 568306 - RNA, 64 nt, hsa
guguggcuuggaggaaaugguacugcccaaauaggaggaaaacacagccucccugagccugcau

SEQ ID NO: 568307 - RNA, 64 nt, hsa
cuccauacacugaggcagaaacuugugucaguuggaggaaaauagacuugaguagucuuugguc

SEQ ID NO: 568308 - RNA, 64 nt, hsa
aaauguugacuaauuuuuccaguuuccuauuacugaggaaaaccuccauacacugaggcagaaa

SEQ ID NO: 568309 - RNA, 64 nt, hsa
aauauuuguaagaaaaaacuuucauuuuccuacagaggaaaauagaacaauuuuagaagcaagg

SEQ ID NO: 568310 - RNA, 64 nt, hsa
gugauucucccagcccuugcaguccgcuaggugagaggaaaagcucuuuacuuccgccccuggc

SEQ ID NO: 568311 - RNA, 64 nt, hsa
cuucuggguuaugggagaaaccagagaugggaaugaggaaaauaugaacuacagcagaagcccc

SEQ ID NO: 568312 - RNA, 64 nt, hsa
uccaacgacuguaggaggaaaaauuaaggggagagaggaaaacaaaaccaaccaaccccuaaaa

SEQ ID NO: 568313 - RNA, 64 nt, hsa
gcaacugaagcugugauauuuccaacgacuguaggaggaaaaauuaaggggagagaggaaaaca

SEQ ID NO: 568314 - RNA, 64 nt, hsa
uguccggguccuuuaucauccuauucauccuggagaggaaaagugucgggcaaagggggaucug

SEQ ID NO: 568315 - RNA, 64 nt, hsa
aaggagccagugcugagaugcugcuguguugguugaggaaaaccucgggccugagggccaggcc

SEQ ID NO: 568316 - RNA, 64 nt, hsa
ucacccacccucagcuucccuuuuccuaaauuaagaggaaaaguggucaaagaaaaacucuuca

SEQ ID NO: 568317 - RNA, 64 nt, hsa
gcgucaacggccacuguguguggcugcucugagugaggaaaaaauuaaaaagaaaaacugguuc

SEQ ID NO: 568318 - RNA, 64 nt, hsa
acaaaggcucagcuggggaugguguuugacuucggaggaaaaaaguugcuauugcccguuaaag

SEQ ID NO: 568319 - RNA, 64 nt, hsa
aaucuucagggcacugcugcugccuuuagucgcugaggaaaaauaaagacaaaugcugcgcccu

SEQ ID NO: 568320 - RNA, 64 nt, hsa
gggaacugugccuuugaguuuccucaggcugcuggaggaaaacugagacucagacaggaaaggg

SEQ ID NO: 568321 - RNA, 64 nt, hsa
gcuuggcugccugucuuucuaggcagucccccuagaggaaaaauguaggaauuuauuuuuucuu

SEQ ID NO: 568322 - RNA, 64 nt, hsa
aggaagaggggaaggugcguauuuauucagggaggaggaaaaguggugcagggacagggagaug

SEQ ID NO: 568323 - RNA, 64 nt, hsa
ucccuuuuagaauacauuaaaugguugauuuggggaggaaaacuuauucugaauauuaacggug

SEQ ID NO: 568324 - RNA, 64 nt, hsa
gcacuuuugcucauggugaauauagaugaacagagaggaaaauguauuuaaaagaaauacgaga

SEQ ID NO: 568325 - RNA, 64 nt, hsa
auucuguguuugguaaccccuauaaacuggggcagaggaaaagaaugaugguucaaggccauac

SEQ ID NO: 568326 - RNA, 64 nt, hsa
cagggaagguagauaacuuuuaggaccuugaugugaggaaaagauaaaauuuaaacaauaaauu

SEQ ID NO: 568327 - RNA, 64 nt, hsa
ucccugccugucaaucaccaccuuuccuccagaggaggaaaauuaucuccccugcaaagcccgg

SEQ ID NO: 568328 - RNA, 64 nt, hsa
cuauuaaaaaaaaaaguuguuuucugaacuagaagaggaaaaaaauggcaauuuuugagugcca

SEQ ID NO: 568329 - RNA, 64 nt, hsa
cagugaggaaaaaacauucagacaaauguucagugaggaaaaaaaggggaaguuggggauaggc

SEQ ID NO: 568330 - RNA, 64 nt, hsa
aauguucagugugagugaggaaaacauguucagugaggaaaaaacauucagacaaauguucagu

SEQ ID NO: 568331 - RNA, 64 nt, hsa
cagccacaguuucagacaaauguucagugugagugaggaaaacauguucagugaggaaaaaaca

SEQ ID NO: 568332 - RNA, 64 nt, hsa
ugacaccgcuguggcuuagcccaagacacucccagaggaaaacacugcagaaggaacugguuug

SEQ ID NO: 568333 - RNA, 64 nt, hsa
accacagaaaagagaaaggaaaggccaaaaaaaagaggaaaagaaaaauguacaaaaagauuuu

SEQ ID NO: 568334 - RNA, 64 nt, hsa
augcucucugcucacugguuuucaauaccaccaagaggaaaauauugacaaguuuaaaggcugu

SEQ ID NO: 568335 - RNA, 64 nt, hsa
ugcugugacuuaugugcagcuuuccaguugagcagaggaaaauaguggcaggacugucccccag

SEQ ID NO: 568336 - RNA, 62 nt, hsa
cuuuccugucuguauuugaugcaggauuaaacacuucccagagaggauucuagucugguaaa

SEQ ID NO: 568337 - RNA, 62 nt, hsa
uugagcccagcaccuaaaaguacaggaauuucacuucccaccaggacuugagcacauaacuc

SEQ ID NO: 568338 - RNA, 62 nt, hsa
cucugaggcugcagggcuggaaguccuugcccacuucccacucuccugccccaaucuaucua

SEQ ID NO: 568339 - RNA, 62 nt, hsa
acuucccacucuccugccccaaucuaucuaguacuucccaggcaaauaggccccuuugaggc

SEQ ID NO: 568340 - RNA, 62 nt, hsa
auuuaaagagaucuguguacuguuuacuucccacuucccagaaucccuuguaucuccuuucu

SEQ ID NO: 568341 - RNA, 62 nt, hsa
gcuccugauuuaaagagaucuguguacuguuuacuucccacuucccagaaucccuuguaucu

SEQ ID NO: 568342 - RNA, 62 nt, hsa
cauuccacuagacugcccccugccacccuggcacuucccagggccuggcaguauggucugau

SEQ ID NO: 568343 - RNA, 62 nt, hsa
augguacaugcauuuucuagaauagagcugggacuucccauguggcccacaucugaccuggc

SEQ ID NO: 568344 - RNA, 62 nt, hsa
acucagcuguuccagccggugccaaccugugaacuucccaccauaucccagaaucugcuauu

SEQ ID NO: 568345 - RNA, 62 nt, hsa
accauaucccagaaucugcuauuccccaaaccacuucccaguuuccuuucaguaaucuuucu

SEQ ID NO: 568346 - RNA, 62 nt, hsa
gccuaauaaauaugacauggauguucaguggaacuucccaucuauuacgccucauacugaau

SEQ ID NO: 568347 - RNA, 62 nt, hsa
uagggaccuugauuuuggggacacacauugcaacuucccacuucugacgaaaggucuccaug

SEQ ID NO: 568348 - RNA, 62 nt, hsa
gguugcauggcggcugggcaaaggugcuccccacuucccagauggugcggcggcuggccaga

SEQ ID NO: 568349 - RNA, 62 nt, hsa
gauggugcggcggcuggccagaggcacucuucacuucccagacagaggggcggccgggcaga

SEQ ID NO: 568350 - RNA, 62 nt, hsa
gacagaggggcggccgggcagaggugcuccucacuucccagagggugcaggagccagcucug

SEQ ID NO: 568351 - RNA, 62 nt, hsa
cuccaguggucacuucccaccauugcaggcagacuucccaccauugcaggcagcugggccca

SEQ ID NO: 568352 - RNA, 62 nt, hsa
auugccauagaggagcccucccuccaguggucacuucccaccauugcaggcagacuucccac

SEQ ID NO: 568353 - RNA, 62 nt, hsa
uagccuuucucaguguccguggcauuuuugugacuucccagcacuagaauaaguuuuccugc

SEQ ID NO: 568354 - RNA, 62 nt, hsa
agugaggcgcuuggugcccucuggacuuucccacuucccaacaugggagaauugugaacuuu

SEQ ID NO: 568355 - RNA, 62 nt, hsa
acccacagaccuucccuuuagcuguugacacaacuucccagcucugcaagugugcccccugg

SEQ ID NO: 568356 - RNA, 62 nt, hsa
cugcccugcccugccuagccucugcuacucccacuucccaacuccagggaaugcauuacuuu

SEQ ID NO: 568357 - RNA, 62 nt, hsa
caucccugugugcugcagcaucaccacggccuacuucccaauauccacaaagcuucgccuuu

SEQ ID NO: 568358 - RNA, 62 nt, hsa
agcaaauggaggaaauuaagcaccgauguagcacuucccacugccuggagagaaauaaaccu

SEQ ID NO: 568359 - RNA, 62 nt, hsa
uuuuuucucugcauuuaaaaaaaucccccagcacuucccacagugccuauugauacuugggg

SEQ ID NO: 568360 - RNA, 62 nt, hsa
cuuguugcuguacaaaagcaaugguugaugauacuucccacaccacaaaugggacacauggu

SEQ ID NO: 568361 - RNA, 62 nt, hsa
uaacuccugggcucagugauccucccguuucgacuucccaaagugcugggauuacaggugug

SEQ ID NO: 568362 - RNA, 62 nt, hsa
acaagcaaaaucagccagcacuuugaucacggacuucccagccucuaggacugugagcaaua

SEQ ID NO: 568363 - RNA, 62 nt, hsa
uaucuucucccccacgguauccuaaacuuuagacuucccacuguucugaaaggagacauugc

SEQ ID NO: 568364 - RNA, 62 nt, hsa
ggacucaagaggaaucuguuucucugcugucaacuucccaucuggcucagcauagggucacu

SEQ ID NO: 568365 - RNA, 64 nt, hsa; identical to SEQ ID NO: 334708

SEQ ID NO: 568366 - RNA, 64 nt, hsa; identical to SEQ ID NO: 334709

SEQ ID NO: 568367 - RNA, 64 nt, hsa; identical to SEQ ID NO: 334710

SEQ ID NO: 568368 - RNA, 64 nt, hsa; identical to SEQ ID NO: 334711

SEQ ID NO: 568369 - RNA, 64 nt, hsa; identical to SEQ ID NO: 334712

SEQ ID NO: 568370 - RNA, 64 nt, hsa; identical to SEQ ID NO: 334713

SEQ ID NO: 568371 - RNA, 64 nt, hsa; identical to SEQ ID NO: 334714

SEQ ID NO: 568372 - RNA, 64 nt, hsa; identical to SEQ ID NO: 334715

SEQ ID NO: 568373 - RNA, 64 nt, hsa; identical to SEQ ID NO: 334716

SEQ ID NO: 568374 - RNA, 64 nt, hsa; identical to SEQ ID NO: 334717

SEQ ID NO: 568375 - RNA, 64 nt, hsa; identical to SEQ ID NO: 334718

SEQ ID NO: 568376 - RNA, 64 nt, hsa; identical to SEQ ID NO: 334719

SEQ ID NO: 568377 - RNA, 64 nt, hsa; identical to SEQ ID NO: 334720

SEQ ID NO: 568378 - RNA, 64 nt, hsa; identical to SEQ ID NO: 334721

SEQ ID NO: 568379 - RNA, 64 nt, hsa; identical to SEQ ID NO: 334722

SEQ ID NO: 568380 - RNA, 64 nt, hsa; identical to SEQ ID NO: 334723

SEQ ID NO: 568381 - RNA, 64 nt, hsa; identical to SEQ ID NO: 334724

SEQ ID NO: 568382 - RNA, 64 nt, hsa; identical to SEQ ID NO: 334725

SEQ ID NO: 568383 - RNA, 64 nt, hsa; identical to SEQ ID NO: 334726

SEQ ID NO: 568384 - RNA, 64 nt, hsa; identical to SEQ ID NO: 334727

SEQ ID NO: 568385 - RNA, 64 nt, hsa; identical to SEQ ID NO: 334728

SEQ ID NO: 568386 - RNA, 64 nt, hsa; identical to SEQ ID NO: 334729

SEQ ID NO: 568387 - RNA, 64 nt, hsa; identical to SEQ ID NO: 334730

SEQ ID NO: 568388 - RNA, 64 nt, hsa; identical to SEQ ID NO: 334731

SEQ ID NO: 568389 - RNA, 64 nt, hsa; identical to SEQ ID NO: 334732

SEQ ID NO: 568390 - RNA, 64 nt, hsa; identical to SEQ ID NO: 334733

SEQ ID NO: 568391 - RNA, 64 nt, hsa; identical to SEQ ID NO: 334734

SEQ ID NO: 568392 - RNA, 64 nt, hsa; identical to SEQ ID NO: 334735

SEQ ID NO: 568393 - RNA, 64 nt, hsa; identical to SEQ ID NO: 334736

SEQ ID NO: 568394 - RNA, 64 nt, hsa; identical to SEQ ID NO: 334737

SEQ ID NO: 568395 - RNA, 64 nt, hsa; identical to SEQ ID NO: 334738

SEQ ID NO: 568396 - RNA, 64 nt, hsa; identical to SEQ ID NO: 334739

SEQ ID NO: 568397 - RNA, 64 nt, hsa; identical to SEQ ID NO: 334740

SEQ ID NO: 568398 - RNA, 64 nt, hsa; identical to SEQ ID NO: 334741

SEQ ID NO: 568399 - RNA, 64 nt, hsa; identical to SEQ ID NO: 334742

SEQ ID NO: 568400 - RNA, 64 nt, hsa; identical to SEQ ID NO: 334743

SEQ ID NO: 568401 - RNA, 64 nt, hsa; identical to SEQ ID NO: 334744

SEQ ID NO: 568402 - RNA, 64 nt, hsa; identical to SEQ ID NO: 334745

SEQ ID NO: 568403 - RNA, 64 nt, hsa; identical to SEQ ID NO: 334746

SEQ ID NO: 568404 - RNA, 64 nt, hsa; identical to SEQ ID NO: 334747

SEQ ID NO: 568405 - RNA, 64 nt, hsa; identical to SEQ ID NO: 334748

SEQ ID NO: 568406 - RNA, 64 nt, hsa; identical to SEQ ID NO: 334749

SEQ ID NO: 568407 - RNA, 64 nt, hsa; identical to SEQ ID NO: 334750

SEQ ID NO: 568408 - RNA, 64 nt, hsa; identical to SEQ ID NO: 334751

SEQ ID NO: 568409 - RNA, 64 nt, hsa; identical to SEQ ID NO: 334752

SEQ ID NO: 568410 - RNA, 64 nt, hsa; identical to SEQ ID NO: 334753

SEQ ID NO: 568411 - RNA, 64 nt, hsa; identical to SEQ ID NO: 334754

SEQ ID NO: 568412 - RNA, 64 nt, hsa; identical to SEQ ID NO: 334755

SEQ ID NO: 568413 - RNA, 64 nt, hsa; identical to SEQ ID NO: 334756

SEQ ID NO: 568414 - RNA, 64 nt, hsa; identical to SEQ ID NO: 334757

SEQ ID NO: 568415 - RNA, 64 nt, hsa; identical to SEQ ID NO: 334758

SEQ ID NO: 568416 - RNA, 64 nt, hsa; identical to SEQ ID NO: 334759

SEQ ID NO: 568417 - RNA, 64 nt, hsa; identical to SEQ ID NO: 334760

SEQ ID NO: 568418 - RNA, 64 nt, hsa; identical to SEQ ID NO: 334761

SEQ ID NO: 568419 - RNA, 64 nt, hsa; identical to SEQ ID NO: 334762

SEQ ID NO: 568420 - RNA, 64 nt, hsa; identical to SEQ ID NO: 334763

SEQ ID NO: 568421 - RNA, 64 nt, hsa; identical to SEQ ID NO: 334764

SEQ ID NO: 568422 - RNA, 64 nt, hsa; identical to SEQ ID NO: 334765

SEQ ID NO: 568423 - RNA, 64 nt, hsa; identical to SEQ ID NO: 334766

SEQ ID NO: 568424 - RNA, 64 nt, hsa; identical to SEQ ID NO: 334767

SEQ ID NO: 568425 - RNA, 64 nt, hsa; identical to SEQ ID NO: 334768

SEQ ID NO: 568426 - RNA, 64 nt, hsa; identical to SEQ ID NO: 334769

SEQ ID NO: 568427 - RNA, 64 nt, hsa; identical to SEQ ID NO: 334770

SEQ ID NO: 568428 - RNA, 64 nt, hsa; identical to SEQ ID NO: 334771

SEQ ID NO: 568429 - RNA, 64 nt, hsa; identical to SEQ ID NO: 334772

SEQ ID NO: 568430 - RNA, 64 nt, hsa; identical to SEQ ID NO: 348598

SEQ ID NO: 568431 - RNA, 64 nt, hsa; identical to SEQ ID NO: 348599

SEQ ID NO: 568432 - RNA, 64 nt, hsa; identical to SEQ ID NO: 348600

SEQ ID NO: 568433 - RNA, 64 nt, hsa; identical to SEQ ID NO: 348601

SEQ ID NO: 568434 - RNA, 64 nt, hsa; identical to SEQ ID NO: 348602

SEQ ID NO: 568435 - RNA, 64 nt, hsa; identical to SEQ ID NO: 348603

SEQ ID NO: 568436 - RNA, 64 nt, hsa; identical to SEQ ID NO: 348604

SEQ ID NO: 568437 - RNA, 64 nt, hsa; identical to SEQ ID NO: 348605

SEQ ID NO: 568438 - RNA, 64 nt, hsa; identical to SEQ ID NO: 348606

SEQ ID NO: 568439 - RNA, 64 nt, hsa; identical to SEQ ID NO: 348607

SEQ ID NO: 568440 - RNA, 64 nt, hsa; identical to SEQ ID NO: 348608

SEQ ID NO: 568441 - RNA, 64 nt, hsa; identical to SEQ ID NO: 348609

SEQ ID NO: 568442 - RNA, 64 nt, hsa; identical to SEQ ID NO: 348610

SEQ ID NO: 568443 - RNA, 64 nt, hsa; identical to SEQ ID NO: 348611

SEQ ID NO: 568444 - RNA, 64 nt, hsa; identical to SEQ ID NO: 348612

SEQ ID NO: 568445 - RNA, 64 nt, hsa; identical to SEQ ID NO: 348613

SEQ ID NO: 568446 - RNA, 64 nt, hsa; identical to SEQ ID NO: 348614

SEQ ID NO: 568447 - RNA, 64 nt, hsa; identical to SEQ ID NO: 348615

SEQ ID NO: 568448 - RNA, 64 nt, hsa; identical to SEQ ID NO: 348616

SEQ ID NO: 568449 - RNA, 64 nt, hsa; identical to SEQ ID NO: 348617

SEQ ID NO: 568450 - RNA, 64 nt, hsa; identical to SEQ ID NO: 334277

SEQ ID NO: 568451 - RNA, 64 nt, hsa; identical to SEQ ID NO: 334278

SEQ ID NO: 568452 - RNA, 64 nt, hsa; identical to SEQ ID NO: 334279

SEQ ID NO: 568453 - RNA, 64 nt, hsa; identical to SEQ ID NO: 334280

SEQ ID NO: 568454 - RNA, 64 nt, hsa; identical to SEQ ID NO: 334281

SEQ ID NO: 568455 - RNA, 64 nt, hsa; identical to SEQ ID NO: 334282

SEQ ID NO: 568456 - RNA, 64 nt, hsa; identical to SEQ ID NO: 334283

SEQ ID NO: 568457 - RNA, 64 nt, hsa; identical to SEQ ID NO: 334284

SEQ ID NO: 568458 - RNA, 64 nt, hsa; identical to SEQ ID NO: 334285

SEQ ID NO: 568459 - RNA, 64 nt, hsa; identical to SEQ ID NO: 334286

SEQ ID NO: 568460 - RNA, 64 nt, hsa; identical to SEQ ID NO: 334287

SEQ ID NO: 568461 - RNA, 64 nt, hsa; identical to SEQ ID NO: 334288

SEQ ID NO: 568462 - RNA, 62 nt, hsa
aguccaguuuuccuucuccagcuucuugcuugggcagguagaggaaguucuuucuacuucca

SEQ ID NO: 568463 - RNA, 62 nt, hsa
ccaccuccucaguuccuguggauagccugggaggcagguagaacagaacucacaaaauagca

SEQ ID NO: 568464 - RNA, 62 nt, hsa
uuaucugcucuuccccucccugccgccuucugggcagguagcagucccuggccucucccccu

SEQ ID NO: 568465 - RNA, 62 nt, hsa
cacccagcccaucaccacucccugggcuggcuggcagguauggcacccugggagcccggcau

SEQ ID NO: 568466 - RNA, 62 nt, hsa
gcugagggacacgagggcaacccugugacaauggcagguagugugcauccgugaauagccca

SEQ ID NO: 568467 - RNA, 64 nt, hsa; identical to SEQ ID NO: 238461

SEQ ID NO: 568468 - RNA, 64 nt, hsa; identical to SEQ ID NO: 238462

SEQ ID NO: 568469 - RNA, 64 nt, hsa; identical to SEQ ID NO: 238463

SEQ ID NO: 568470 - RNA, 64 nt, hsa; identical to SEQ ID NO: 238464

SEQ ID NO: 568471 - RNA, 64 nt, hsa; identical to SEQ ID NO: 238465

SEQ ID NO: 568472 - RNA, 64 nt, hsa; identical to SEQ ID NO: 238466

SEQ ID NO: 568473 - RNA, 64 nt, hsa; identical to SEQ ID NO: 238467

SEQ ID NO: 568474 - RNA, 64 nt, hsa; identical to SEQ ID NO: 238468

SEQ ID NO: 568475 - RNA, 64 nt, hsa
gccuucauggccaucuagccccaguucagggcagcauccauagcccacaagccagcgugggugg

SEQ ID NO: 568476 - RNA, 64 nt, hsa
gggagggacccauguccauggcuucguugagggccauccauaugccagcugggggccagcccac

SEQ ID NO: 568477 - RNA, 64 nt, hsa
aggugacaaguucuuggacuuugccccgaaagcacauccauaaaagacaaaaucugauauauug

SEQ ID NO: 568478 - RNA, 64 nt, hsa
agauguccuacaacagguacaugguuaaacaaaccauccauaacuuggaauacugcucuggaau

SEQ ID NO: 568479 - RNA, 64 nt, hsa; identical to SEQ ID NO: 277422

SEQ ID NO: 568480 - RNA, 64 nt, hsa; identical to SEQ ID NO: 277423

SEQ ID NO: 568481 - RNA, 64 nt, hsa; identical to SEQ ID NO: 277424

SEQ ID NO: 568482 - RNA, 64 nt, hsa; identical to SEQ ID NO: 277425

SEQ ID NO: 568483 - RNA, 64 nt, hsa; identical to SEQ ID NO: 277426

SEQ ID NO: 568484 - RNA, 64 nt, hsa; identical to SEQ ID NO: 277427

SEQ ID NO: 568485 - RNA, 64 nt, hsa; identical to SEQ ID NO: 277428

SEQ ID NO: 568486 - RNA, 64 nt, hsa; identical to SEQ ID NO: 277429

SEQ ID NO: 568487 - RNA, 64 nt, hsa; identical to SEQ ID NO: 277430

SEQ ID NO: 568488 - RNA, 64 nt, hsa; identical to SEQ ID NO: 277431

SEQ ID NO: 568489 - RNA, 64 nt, hsa; identical to SEQ ID NO: 277432

SEQ ID NO: 568490 - RNA, 64 nt, hsa; identical to SEQ ID NO: 277433

SEQ ID NO: 568491 - RNA, 64 nt, hsa; identical to SEQ ID NO: 277434

SEQ ID NO: 568492 - RNA, 64 nt, hsa; identical to SEQ ID NO: 277435

SEQ ID NO: 568493 - RNA, 64 nt, hsa; identical to SEQ ID NO: 277436

SEQ ID NO: 568494 - RNA, 64 nt, hsa; identical to SEQ ID NO: 277437

SEQ ID NO: 568495 - RNA, 64 nt, hsa; identical to SEQ ID NO: 277438

SEQ ID NO: 568496 - RNA, 64 nt, hsa; identical to SEQ ID NO: 277439

SEQ ID NO: 568497 - RNA, 64 nt, hsa; identical to SEQ ID NO: 277440

SEQ ID NO: 568498 - RNA, 64 nt, hsa; identical to SEQ ID NO: 277441

SEQ ID NO: 568499 - RNA, 64 nt, hsa; identical to SEQ ID NO: 277442

SEQ ID NO: 568500 - RNA, 64 nt, hsa; identical to SEQ ID NO: 277443

SEQ ID NO: 568501 - RNA, 64 nt, hsa; identical to SEQ ID NO: 277444

SEQ ID NO: 568502 - RNA, 64 nt, hsa; identical to SEQ ID NO: 277445

SEQ ID NO: 568503 - RNA, 64 nt, hsa; identical to SEQ ID NO: 277446

SEQ ID NO: 568504 - RNA, 64 nt, hsa; identical to SEQ ID NO: 277447

SEQ ID NO: 568505 - RNA, 64 nt, hsa; identical to SEQ ID NO: 277448

SEQ ID NO: 568506 - RNA, 62 nt, hsa
ccgaguuccuuaaaucucagcugggauccuggaccugggaggccccugugagggccagcucu

SEQ ID NO: 568507 - RNA, 62 nt, hsa
gggaggccccugugagggccagcucuggaaaaaccugggaguugaugccggaggcuguggaa

SEQ ID NO: 568508 - RNA, 62 nt, hsa
acuugggagacugaggcaggagaaucgcuugaaccugggaguuagagguugcagugagcuga

SEQ ID NO: 568509 - RNA, 62 nt, hsa
ucagugguucccaaaucuggcuggucgggaauaccugggaaguuuguuaaaauuuuuuaaaa

SEQ ID NO: 568510 - RNA, 62 nt, hsa
ucaagcaauucugcugcaucagccucccgaguaccugggauuacaggcaugugccaccacgc

SEQ ID NO: 568511 - RNA, 62 nt, hsa
uuuauugaguaccuacugugugcuaggcauugaccugggaacuagagauacuucacagaaua

SEQ ID NO: 568512 - RNA, 62 nt, hsa
ucaguguccccaccuugcagcgcauuccaaccaccugggagcauuuaaaacuccagaugccc

SEQ ID NO: 568513 - RNA, 62 nt, hsa
cacucacagucaccgucuuacaacucagggccaccugggaucagucaucagucagggugcgu

SEQ ID NO: 568514 - RNA, 62 nt, hsa
uugcacagauaucuuugaagacacaaacacucaccugggacguuggccggagaugucuuuuu

SEQ ID NO: 568515 - RNA, 62 nt, hsa
ugaugccagccuugagcaugaagcugagauggaccugggaacuccaacauaugaugaaaacc

SEQ ID NO: 568516 - RNA, 62 nt, hsa
ggaggcucagaaacaacagcaacagaugcagaaccugggaaugacaucaccacugcccuaug

SEQ ID NO: 568517 - RNA, 62 nt, hsa
cagaggagaugggggcuucugaagauggacuuaccugggaccugccccccaugagccaggac

SEQ ID NO: 568518 - RNA, 62 nt, hsa
ggagcagggcuggggaaugaugggacuggaggaccugggaauuucaucuuucugccuccacc

SEQ ID NO: 568519 - RNA, 62 nt, hsa
acuagggaggcugaggcaggagaauugcuugaaccugggagacggagguugcggugagcugc

SEQ ID NO: 568520 - RNA, 62 nt, hsa
acuugagaggcugaggcaggagaaucgcuugaaccugggaggcagagguugcagugagcuga

SEQ ID NO: 568521 - RNA, 62 nt, hsa
gguggcuaagucccaccauaacagcuaaggggaccugggagaugauggcucauuuccaccca

SEQ ID NO: 568522 - RNA, 62 nt, hsa
aggauuuccagagcgcacauccacaggccuggaccugggaugaagaugaaugaagaacaugg

SEQ ID NO: 568523 - RNA, 62 nt, hsa
gggcaugguggcaugcaccuguagucccagcuaccugggaggcugaggcaggagaauugcuu

SEQ ID NO: 568524 - RNA, 62 nt, hsa
accugggaggcugaggcaggagaauugcuugaaccugggaggcagagguugcagugagccaa

SEQ ID NO: 568525 - RNA, 62 nt, hsa
uuguuguuguugucauuguuguuguuguuuuaaccugggaaguguucuuccugccuuucugc

SEQ ID NO: 568526 - RNA, 62 nt, hsa
ucaggugauccucacaccuuagccucccaaguaccugggacuacaggcacgcaccaccaugc

SEQ ID NO: 568527 - RNA, 62 nt, hsa
acaaacccaccucuguugggagcuauugagccaccugggaugagaugacacaaggcacuccu

SEQ ID NO: 568528 - RNA, 62 nt, hsa
ucagcauuauccugccagaccucggggaggauaccugggagacagaagccucugcaccuacu

SEQ ID NO: 568529 - RNA, 62 nt, hsa
aaaaccuccacgugacuguuuggugcaucuugaccugggaagacgccucaugggaacgaacu

SEQ ID NO: 568530 - RNA, 62 nt, hsa
cucuguguucuguguauuugucugaauuaaugaccugggauauaaagcuaugcuagcuuuca

SEQ ID NO: 568531 - RNA, 62 nt, hsa
gggccuaggcugauagucagagccuguggcacaccugggaugggccagggcccugggugggg

SEQ ID NO: 568532 - RNA, 62 nt, hsa
gccccuagaaaugcugccuuugugugugggguaccugggaaaggguguggcugaggcaguca

SEQ ID NO: 568533 - RNA, 62 nt, hsa
ucucacuuuuuguuaauguugcugccucauugaccugggaaaaaugaaaaaaaaaaauaaag

SEQ ID NO: 568534 - RNA, 62 nt, hsa
agcugaugggagugagagaacucagcaagccaaccugggaaucagagagagaaggagaagga

SEQ ID NO: 568535 - RNA, 62 nt, hsa
cucggguccucuugagcaguggagcaagggagaccugggagcgugggagccaggaucagcgc

SEQ ID NO: 568536 - RNA, 62 nt, hsa
auuugggaggcugaggcaggagaaucacuugaaccugggaggcggagguugcagugagccga

SEQ ID NO: 568537 - RNA, 62 nt, hsa
gagcacagugaagacccugagagcauccuggcaccugggagcgcagguuggccccugaacug

SEQ ID NO: 568538 - RNA, 62 nt, hsa
gagcacagugaagaccaugggagcacccuggcaccugggagcacagugaagacccugagagc

SEQ ID NO: 568539 - RNA, 62 nt, hsa
acuggggaggcugaggcaggagaaucgcuugaaccugggaggcagagguugcagugagccgg

SEQ ID NO: 568540 - RNA, 62 nt, hsa
cucucucaauuacugggaccaccaagcuaggaaccugggagucauccuugauacuuucucuu

SEQ ID NO: 568541 - RNA, 62 nt, hsa
ccucaggaggcugaggcaggagaaucgcuugaaccugggaggcagagguugcagugagccaa

SEQ ID NO: 568542 - RNA, 62 nt, hsa
acuugggaggcugaggcaggagaaucgcuugaaccugggaggcggaaguugcagugagccga

SEQ ID NO: 568543 - RNA, 62 nt, hsa
uugaugucucuagaccugcagauacgaagcaaaccugggauugcuucuuccagguaugggca

SEQ ID NO: 568544 - RNA, 62 nt, hsa
agcccucagguccccagcuccuugagggaugaaccugggagcccaagagccaguggcugagc

SEQ ID NO: 568545 - RNA, 62 nt, hsa
gccccccuacagucacugccacacugguggggaccugggacccagacccggaaccagcccag

SEQ ID NO: 568546 - RNA, 62 nt, hsa
ugaggacagaaggcaggagacuuuggucaguuaccugggaauucugggcugccaggaaacga

SEQ ID NO: 568547 - RNA, 62 nt, hsa
uaccugggagcacacuuuucccuuccccgaugaccugggaugguggccaggccgugcccuug

SEQ ID NO: 568548 - RNA, 62 nt, hsa
gugaggcucuugggggugguuugacccugcuuaccugggagcacacuuuucccuuccccgau

SEQ ID NO: 568549 - RNA, 62 nt, hsa
acucaggauccugaggcaugagaauugcuugaaccugggaggcagaggcugcagugagccaa

SEQ ID NO: 568550 - RNA, 62 nt, hsa
uuaagcgauccuccucccucagccuugugaauaccugggacuucaggcacgcgccacuacac

SEQ ID NO: 568551 - RNA, 62 nt, hsa
acucaggagacugaggcagaaggaucgcuugaaccugggaggcagagguugcagugagccga

SEQ ID NO: 568552 - RNA, 62 nt, hsa
acuggggaggcugagucaggagaaucgcuugaaccugggaggcggagguugcggucagcuga

SEQ ID NO: 568553 - RNA, 62 nt, hsa
gggugagcugaagcaggguggggcguaaccucaccugggaagugcaaggagucggggaucuc

SEQ ID NO: 568554 - RNA, 62 nt, hsa
auucucccugccagcacagcagucugaagucaaccugggaugaucaagcuugguggggggag

SEQ ID NO: 568555 - RNA, 62 nt, hsa
acucgggaggcagaggcaggagaauggcuugaaccugggaagcgguugcagugagccaagau

SEQ ID NO: 568556 - RNA, 62 nt, hsa
acagugaugaggagguggacagcgagcugggcaccugggagcaccagcugcggcgcauggag

SEQ ID NO: 568557 - RNA, 62 nt, hsa
gcagccucccagaagcucucuucugcuucaaaaccugggaucucuggcauuacccuauuggg

SEQ ID NO: 568558 - RNA, 62 nt, hsa
guggguaaguccugccauucaagacuggagacaccugggaaauaaaaagagcagggcacugc

SEQ ID NO: 568559 - RNA, 62 nt, hsa
agucaucuucucuuuuuucuugcucagaguuuaccugggagauuucaccaguuugacucacc

SEQ ID NO: 568560 - RNA, 62 nt, hsa
ccacaugccguucccaugcccggcugcugggcaccugggagagcuuccagaauccucgcaga

SEQ ID NO: 568561 - RNA, 62 nt, hsa
cacacagcugcucagcaccacuuucauucuggaccugggaccuuaggagccgggugacagca

SEQ ID NO: 568562 - RNA, 62 nt, hsa
auaaacacgacauauuuaaagaagguucuuucaccugggagcaaaugaacaauagcuaagug

SEQ ID NO: 568563 - RNA, 62 nt, hsa
ggcccuccugccacuucagcacaccuugccccaccugggaccaucacacgugaagcaccagg

SEQ ID NO: 568564 - RNA, 62 nt, hsa
cgaauggacaggaaagggagccagagcuguauaccugggacaggccagggagccuuuagugc

SEQ ID NO: 568565 - RNA, 62 nt, hsa
uggagccuaccucugucugagacaggugccuaaccugggaccuguggucaugugagucuggg

SEQ ID NO: 568566 - RNA, 62 nt, hsa
agccugguuucugggugcuagauccagcccaaaccugggaaggccagccuuguacagucugc

SEQ ID NO: 568567 - RNA, 62 nt, hsa
gagugugguuucuuuuugaaucuuuaauuaaaaccugggauuauauaucccugauaaauauu

SEQ ID NO: 568568 - RNA, 62 nt, hsa
uauuuggaauuagaacccuugcacagcacugaaccugggaaagagauuuaaacucugaauuu

SEQ ID NO: 568569 - RNA, 64 nt, hsa; identical to SEQ ID NO: 75114

SEQ ID NO: 568570 - RNA, 64 nt, hsa; identical to SEQ ID NO: 75115

SEQ ID NO: 568571 - RNA, 64 nt, hsa; identical to SEQ ID NO: 75116

SEQ ID NO: 568572 - RNA, 64 nt, hsa; identical to SEQ ID NO: 75117

SEQ ID NO: 568573 - RNA, 64 nt, hsa; identical to SEQ ID NO: 75118

SEQ ID NO: 568574 - RNA, 64 nt, hsa; identical to SEQ ID NO: 75119

SEQ ID NO: 568575 - RNA, 64 nt, hsa; identical to SEQ ID NO: 75120

SEQ ID NO: 568576 - RNA, 64 nt, hsa; identical to SEQ ID NO: 75121

SEQ ID NO: 568577 - RNA, 64 nt, hsa; identical to SEQ ID NO: 75122

SEQ ID NO: 568578 - RNA, 64 nt, hsa; identical to SEQ ID NO: 75123

SEQ ID NO: 568579 - RNA, 64 nt, hsa; identical to SEQ ID NO: 75124

SEQ ID NO: 568580 - RNA, 64 nt, hsa; identical to SEQ ID NO: 75125

SEQ ID NO: 568581 - RNA, 64 nt, hsa; identical to SEQ ID NO: 75126

SEQ ID NO: 568582 - RNA, 64 nt, hsa; identical to SEQ ID NO: 75127

SEQ ID NO: 568583 - RNA, 64 nt, hsa; identical to SEQ ID NO: 75128

SEQ ID NO: 568584 - RNA, 64 nt, hsa; identical to SEQ ID NO: 75129

SEQ ID NO: 568585 - RNA, 64 nt, hsa; identical to SEQ ID NO: 75130

SEQ ID NO: 568586 - RNA, 64 nt, hsa; identical to SEQ ID NO: 75131

SEQ ID NO: 568587 - RNA, 64 nt, hsa; identical to SEQ ID NO: 75132

SEQ ID NO: 568588 - RNA, 64 nt, hsa; identical to SEQ ID NO: 75133

SEQ ID NO: 568589 - RNA, 64 nt, hsa; identical to SEQ ID NO: 75134

SEQ ID NO: 568590 - RNA, 64 nt, hsa
uguuuaaccaaagcuuugaaaugugaugaagccaccaacauaagcacuugccuaacagaaauca

SEQ ID NO: 568591 - RNA, 64 nt, hsa
ugcagaggagcucaaugucgcgggacuagcuacaccaacauaugcacuuuuuacauuuagaaac

SEQ ID NO: 568592 - RNA, 64 nt, hsa
uccaucuuuccauccauuaccuccauccauccuuccaacauauauuuauugaguaccuacugug

SEQ ID NO: 568593 - RNA, 64 nt, hsa
uaaacauugaacucaguucuucaagguuucaucaccaacauaaggaaugaaguuggaaccacag

SEQ ID NO: 568594 - RNA, 64 nt, hsa
aucaccugaggucaggaguucaagaccagccuggccaacauagugaaaccccuuguuuacucaa

SEQ ID NO: 568595 - RNA, 64 nt, hsa
ugcaauguuauuuacuguuguaauuacuguaauaccaacauaugggccccaucugcacacuccu

SEQ ID NO: 568596 - RNA, 64 nt, hsa
ugcugggauuacaggcaugagccacugugccuggccaacauaauguuuucacaguuccucuuug

SEQ ID NO: 568597 - RNA, 64 nt, hsa
uucgaaggacucauucuuuccucccacuuccaccccaacauagaguaguauuugcuuuuuaguc

SEQ ID NO: 568598 - RNA, 64 nt, hsa
aaaaaaccuucaacugaagguauuuuguuucuuaccaacauaauuuaggcuucagcaucucacc

SEQ ID NO: 568599 - RNA, 64 nt, hsa
uuuaucuuuuguuaaaauguguauaccccguggaccaacauaauauuaaaguauguauauauua

SEQ ID NO: 568600 - RNA, 64 nt, hsa
gucaccuaugacccggcuggccgcgcuggcguguccaacauaguggcggugcaugccgcgguga

SEQ ID NO: 568601 - RNA, 64 nt, hsa
gguggaaggggggucuggggcagccucucuucccccaacauacucacuagaguggcuccuguga

SEQ ID NO: 568602 - RNA, 64 nt, hsa
aucgccugaggucaggaguucaagaucaaccuggccaacauacugaaaccccgucucuacuaaa

SEQ ID NO: 568603 - RNA, 64 nt, hsa
cuuucacaacagucacucuguguccuaaaauuuuccaacauagaugugauuuauauaacuuugu

SEQ ID NO: 568604 - RNA, 64 nt, hsa
ucaacuuagaaacuccaaggagguuacauguuuuccaacauauccuaaaaacugugauauaagc

SEQ ID NO: 568605 - RNA, 64 nt, hsa
ccuguucuuugguagacugggaauguagagcuagccaacauaucacauucugaaugaauaaaua

SEQ ID NO: 568606 - RNA, 64 nt, hsa
auuacuugaggccaggagauugagaccaguguggccaacauagcaaaaacccgucucgacgaaa

SEQ ID NO: 568607 - RNA, 64 nt, hsa
ugcaugcuugggggugccaagggauucgagaccuccaacauacuugucugaagguggugauucu

SEQ ID NO: 568608 - RNA, 64 nt, hsa
aucaccugaggugaggaguucaagaccagccugcccaacauagugaaacuccgucucuaccaau

SEQ ID NO: 568609 - RNA, 64 nt, hsa
cuugggcuccuuuucaaggacauuaauaaccucaccaacauagcucaugcccuucagcuuugac

SEQ ID NO: 568610 - RNA, 64 nt, hsa
guccuaauauuuagauguccaaacaagaauacuuccaacauaaaaauuauaauaggaauaauuu

SEQ ID NO: 568611 - RNA, 64 nt, hsa
aucacugauaaaugcucccuggccuuaaaaacuaccaacauauaauauauaugcugucuuaaaa

SEQ ID NO: 568612 - RNA, 64 nt, hsa
auuauccuucagaaaucuguaccaauuuaauguaccaacauaagcauaagugagugccaaugaa

SEQ ID NO: 568613 - RNA, 64 nt, hsa
uuccagucauuucccauaaaauacagacauuuuaccaacauaauaugcuuugauugaugcagca

SEQ ID NO: 568614 - RNA, 64 nt, hsa
gcacaagcuuguauauacauauuauaaauaaaugccaacauacccuucuuuaaaucaaaagcug

SEQ ID NO: 568615 - RNA, 64 nt, hsa
auucuuagagcauauucuuuauuauaaugauuauccaacauauuucuuuaauuuuaauacaaaa

SEQ ID NO: 568616 - RNA, 64 nt, hsa
agaucacaaggucaggaguucaagaccagccuggccaacauagugaaaccccaucucuacugaa

SEQ ID NO: 568617 - RNA, 64 nt, hsa
aaguguuguaucaaagugugauauacaaaguguaccaacauaaguguugguagcacuuaagacu

SEQ ID NO: 568618 - RNA, 64 nt, hsa
ccaagcccucucgacugccccuauccccuggaccccaacauaccuacaaugcuggggaggcccu

SEQ ID NO: 568619 - RNA, 64 nt, hsa
uuugaucugggcucugagcacaagucaggaaacaccaacauauucacacucucccaguagguuc

SEQ ID NO: 568620 - RNA, 64 nt, hsa
ccagugcccucaggcguccaucugaugcaugggaccaacauaaggcaggcagggauacaaggca

SEQ ID NO: 568621 - RNA, 64 nt, hsa
cucagccaucggucuagcauaucagucacugggcccaacauauccauuuuuaaacccuuucccc

SEQ ID NO: 568622 - RNA, 64 nt, hsa
agcuuguuucagaaauucucacuuuuguugacugccaacauacaaaguaagggaaacucaagau

SEQ ID NO: 568623 - RNA, 64 nt, hsa
aucacuugaggucgggaguucgagaccagccuggccaacauagcaaaacccugucucuacuaaa

SEQ ID NO: 568624 - RNA, 64 nt, hsa
cuauauuugaacacacuguacaauaguacaaaaaccaacauaguugguuuucuaguaugaaaga

SEQ ID NO: 568625 - RNA, 64 nt, hsa
gcuaaugugguucucagaaauuggucaguauggcccaacauagcuucugcucugucuuacugac

SEQ ID NO: 568626 - RNA, 64 nt, hsa
auccuauggaauucagguucuagaacagugucauccaacauaaauaugaagcaagcuacaugag

SEQ ID NO: 568627 - RNA, 64 nt, hsa
ccuugagcaugaagcugagauggaccugggaacuccaacauaugaugaaaaccccaugaaggug

SEQ ID NO: 568628 - RNA, 64 nt, hsa
ccaagaaugcauuauuccacaaaaaaacagcagaccaacauauagaguguuuaaaauagcauuu

SEQ ID NO: 568629 - RNA, 64 nt, hsa
cuauauucucaguguagggcagagaggucuaacaccaacauaagguacuagcaguguuucccgu

SEQ ID NO: 568630 - RNA, 64 nt, hsa
guaucuuauugcuaacccucaaaacaagcccuucccaacauaagcgcuuuugugccaaacccau

SEQ ID NO: 568631 - RNA, 64 nt, hsa
uuguaaaaggcugccauuauggacauuagguaucccaacauaaccaucuggaguguguccaguu

SEQ ID NO: 568632 - RNA, 64 nt, hsa
agaucacgagaucaagagaucaagaccauagugaccaacauagugaaaccccaucucuacugaa

SEQ ID NO: 568633 - RNA, 64 nt, hsa
gauauauucaguauuguagauacuacacuaauuuccaacauaagaggcaggaagaguuuugauu

SEQ ID NO: 568634 - RNA, 64 nt, hsa
aaaccugacuucuaaguguggguuuuucuucucuccaacauaauuauguuaauaugguccucau

SEQ ID NO: 568635 - RNA, 64 nt, hsa
uaaagcugaaacacugaaacagccauugccuugaccaacauauuccuuugucacauuauguaaa

SEQ ID NO: 568636 - RNA, 64 nt, hsa
uagcuagaccuuugcuuccuucuugccagcucucccaacauacccaauccuggugaucagggaa

SEQ ID NO: 568637 - RNA, 64 nt, hsa
cuguucauccuaucccuuccaagguugguccaugccaacauaaccucugggcaucagacaucag

SEQ ID NO: 568638 - RNA, 64 nt, hsa
uaggcauagguuugcaauccagaucugauuuucuccaacauaaauaucagcucauguucuuauu

SEQ ID NO: 568639 - RNA, 64 nt, hsa
cacaacauacacugucaaacuuuacaucagggauccaacauaacucagacauagcccagguagc

SEQ ID NO: 568640 - RNA, 64 nt, hsa
cuggagcuaguuuugagggugaaccacacuuuauccaacauacaaacuuucccaugcagcuucu

SEQ ID NO: 568641 - RNA, 64 nt, hsa
ugauaaggugguucuuucauaacucuaaugccauccaacauagcccugggagaggcauguuagg

SEQ ID NO: 568642 - RNA, 64 nt, hsa
aucagggccuacaguaacaugccaaaaguugcuuccaacauauuucucugcuuuggauggggca

SEQ ID NO: 568643 - RNA, 64 nt, hsa
uauaaaggagauggcuuauucaaccauagccccuccaacauaucuacuggaaauucugcugguu

SEQ ID NO: 568644 - RNA, 64 nt, hsa
aucaccugaggucaggaguucaagaccagccuggccaacauagugaaaccccgucucuacuaaa

SEQ ID NO: 568645 - RNA, 64 nt, hsa
aaauguuuuacacgaauguaagagcauguagaagccaacauauaaauaaauuguuuaaaaaaac

SEQ ID NO: 568646 - RNA, 64 nt, hsa
ggaaaguuaaccauuuaaaagaacauuuuucucuccaacauauuuuacaauaaaagcaacuuuu

SEQ ID NO: 568647 - RNA, 64 nt, hsa
uuccccucauucauguggcuguacuuaaccuucuccaacauacauccugcauuacaugaaugga

SEQ ID NO: 568648 - RNA, 64 nt, hsa
cucagaucuagauaacucaugacauuuuauuugaccaacauagcacaugaugagauaucaaggu

SEQ ID NO: 568649 - RNA, 64 nt, hsa
ggaucacgaggucaggaguucgagggcagccugaccaacauagugaaaccccaucucuacuaaa

SEQ ID NO: 568650 - RNA, 64 nt, hsa
ugacaaauagcuauaauaggaacacucccuaucaccaacauauuuugguuaguauauuccuuca

SEQ ID NO: 568651 - RNA, 64 nt, hsa
uuuuguuuuuuaauuuggggucucuuuguuuuccccaacauaauguucauaauguuucugcauu

SEQ ID NO: 568652 - RNA, 64 nt, hsa
aucaccugagggcaggagucugagaccagccuggccaacauagcaaaaccccaucucuauuaaa

SEQ ID NO: 568653 - RNA, 64 nt, hsa
uauuauuccaguuagccuuggauuauuucaguggccaacauaugcagacauuuguacuccucaa

SEQ ID NO: 568654 - RNA, 64 nt, hsa
cccauuucucauuuuacauuuuaaagucguuccuccaacauaguguguauuggucugaaggggg

SEQ ID NO: 568655 - RNA, 64 nt, hsa
uagaaccacuauuacgugaaaaggcuugaaacaaccaacauauacaaauaaaacccugccuugu

SEQ ID NO: 568656 - RNA, 64 nt, hsa
caagagugaaacucucaaaagcagaaacaaaaacccaacauauaugggcuguuagauaguaauu

SEQ ID NO: 568657 - RNA, 64 nt, hsa
gucaucaauuaggagaaaucccaaauuauaaaagccaacauaugccgugaccuacguaggaaaa

SEQ ID NO: 568658 - RNA, 64 nt, hsa
ggaaaaagaaagccuaugggaaauggcugugcucccaacauagcuuugcagaugauguggguuu

SEQ ID NO: 568659 - RNA, 64 nt, hsa
uuuuuguuucuaagcaauauauacauaaaaucaaccaacauaucugaaaaggaucaugaaaccu

SEQ ID NO: 568660 - RNA, 64 nt, hsa
aagucagaagaagacagcaaaaaaagcaacuuuuccaacauacaauuuacuuuuaauaaaguau

SEQ ID NO: 568661 - RNA, 64 nt, hsa
guaucagauugauuuuuguagccucucacugaauccaacauauccacaagcaaguuaucugucu

SEQ ID NO: 568662 - RNA, 64 nt, hsa
uagaagggccagcuuacuguugguggcaaaauugccaacauaaguuaauagaaaguuggccaau

SEQ ID NO: 568663 - RNA, 64 nt, hsa
ugaauaauuauaggcuuuuccucacauuagacaaccaacauaaucuucuuaaaggucuaauuaa

SEQ ID NO: 568664 - RNA, 64 nt, hsa
auccuaucauuuaaaaagaaauuaugucugcaccccaacauaggcauacuuaaguaauauacau

SEQ ID NO: 568665 - RNA, 64 nt, hsa
agugguacauaaauuuaucucgcccugcauauucccaacauacuuaacacagauguuuuuuacc

SEQ ID NO: 568666 - RNA, 64 nt, hsa
auccccccuuuuuaaguagugugaauugcaaaacccaacauauuuuuuuuacugucaguugcgg

SEQ ID NO: 568667 - RNA, 64 nt, hsa
aucaccugaggucaggaguuugugaccagccuggccaacauagugaaauccuguuucuacuaaa

SEQ ID NO: 568668 - RNA, 64 nt, hsa
auucugcaggaaaccccagcagugugaacgcaucccaacauagguuaagagcaaguugaaaaca

SEQ ID NO: 568669 - RNA, 64 nt, hsa
ccuaagaucuucaccucucugccucccuacugccccaacauagccuugaggaggcuucucagcc

SEQ ID NO: 568670 - RNA, 64 nt, hsa
augggugauggaacuuggaagauauuugaguuuaccaacauacuuuaaaaguccuuacauccca

SEQ ID NO: 568671 - RNA, 64 nt, hsa
agaauauauuaguuuucaagggagugggaggcuuccaacauaguauugaaucucaggaaaaacu

SEQ ID NO: 568672 - RNA, 64 nt, hsa
aagggcccgugcgcuccaacccugcaucgaacugccaacauaguacaccuuuuagaaaaagauu

SEQ ID NO: 568673 - RNA, 61 nt, hsa
gauggcgugggauguacugaaagcaaaaacaccaacauacaagucuugacaacagcaucug

SEQ ID NO: 568674 - RNA, 64 nt, hsa
uggguacauuuuaucauuuauuagcgcugaagagccaacauauuuguagauuuuuaauaucuca

SEQ ID NO: 568675 - RNA, 64 nt, hsa
gaaugagaauggauucuguacaauacacuagaaaccaacauaauguauuucuuuaaaaccugug

SEQ ID NO: 568676 - RNA, 64 nt, hsa
aaaaaauggcagugaugaauuuuaaggguuucccccaacauauaaaauaaugcaaagaaucccu

SEQ ID NO: 568677 - RNA, 64 nt, hsa
agaucaugaggucaggagaucgagaccauucuggccaacauagugaaaccccaucucuacuaaa

SEQ ID NO: 568678 - RNA, 64 nt, hsa
ugaggacauagcaucugcccuggaaaucguuauuccaacauaauauuauuuucuagaaugcccu

SEQ ID NO: 568679 - RNA, 64 nt, hsa
agccuuuauacaaauguauuuaguucucuuuuuuccaacauaaaauucuuguuuuaagauacaa

SEQ ID NO: 568680 - RNA, 64 nt, hsa
agaucacgaagucaguaguuugagaccagccuggccaacauagugaaaccccgucucuacuaaa

SEQ ID NO: 568681 - RNA, 64 nt, hsa
uauaccaagaaguccaaacccagcacgcaacagcccaacauaaccuagaaugucaagacacuca

SEQ ID NO: 568682 - RNA, 64 nt, hsa
auggauaccgacuguuuuuauguuggaauuuguuccaacauaauuagaaucuguuuggugaguu

SEQ ID NO: 568683 - RNA, 64 nt, hsa
aucacuugaggucaggaguuggagaccagccuggccaacauagugaaaccccgucucuacuaaa

SEQ ID NO: 568684 - RNA, 64 nt, hsa
cuccagguucacuuuggauaugaucuuucuuuucccaacauaugcccucagaaaagugacagug

SEQ ID NO: 568685 - RNA, 64 nt, hsa
gagaaaaagggaucuaggaaugcugaaagauuacccaacauaccauuauagucucuucuuucug

SEQ ID NO: 568686 - RNA, 64 nt, hsa
uaaauaugcaguuuaugugucaucaauguacaugccaacauaaauauggcgauuguauagcugu

SEQ ID NO: 568687 - RNA, 64 nt, hsa
ugcuucugagaaagcauuugccuuucuuccucucccaacauaacaaucgugguaacagaaugcg

SEQ ID NO: 568688 - RNA, 64 nt, hsa
auuaccugaggcaaggaguuugagaccagcuuagccaacauaguaagacccccaucucuuuaaa

SEQ ID NO: 568689 - RNA, 64 nt, hsa
ccaucauuucuagcuaaaacuccauuuggugaaaccaacauauccauuucuuuuccuaguuacg

SEQ ID NO: 568690 - RNA, 64 nt, hsa
aaaacaggcuagcaauugcaaagucaggcuuugaccaacauauuucuuugcacugaggccuugc

SEQ ID NO: 568691 - RNA, 64 nt, hsa
uccccuucaugaagguagagagaaggggucucucccaacauauuucucuuccuugugccucucc

SEQ ID NO: 568692 - RNA, 64 nt, hsa
ugcuucucuucuuguucccuguuaucauuccuccccaacauaauaauacauaaaguggcauggu

SEQ ID NO: 568693 - RNA, 64 nt, hsa
ucguuuaaaugauauuuuaauguaaaagucauaaccaacauaugaacagacagauuuaugucuu

SEQ ID NO: 568694 - RNA, 64 nt, hsa
uuuauauguucuuugcuuccuacuucccugucuuccaacauacuguucacuuacucuggcaguc

SEQ ID NO: 568695 - RNA, 64 nt, hsa
agaagcaaauucaccagaagggaaacaucucaggccaacauaggcaaaugaaaagggcuauuaa

SEQ ID NO: 568696 - RNA, 64 nt, hsa
aucauuugagcccaggaauuggaaagcagccuggccaacauagugggacccugucucuacaaaa

SEQ ID NO: 568697 - RNA, 64 nt, hsa
agccaucacaaauagccacauucugcucuacucuccaacauaccagauucuacacuguuguuau

SEQ ID NO: 568698 - RNA, 64 nt, hsa
aucacucaaggucaggcauuugagaccagccuggccaacauagugaaaccccgucucuauuaaa

SEQ ID NO: 568699 - RNA, 64 nt, hsa
uuaacaacaggaaacacuuguaggacuuccuuuaccaacauacuuuuuaaauguuuugcuauug

SEQ ID NO: 568700 - RNA, 64 nt, hsa
uuaucuucucugaaagaacuucaaaucuuaccugccaacauauucaccauaauuuuuuuauuuu

SEQ ID NO: 568701 - RNA, 64 nt, hsa
gaaaaaucuaauucaauaaacucuguaucagcccccaacauauuauuuuucauuauuuggggga

SEQ ID NO: 568702 - RNA, 64 nt, hsa
ggggaaguggggcuugaagaagcagccuaaugaaccaacauaccguuuugugugugguuuuuuu

SEQ ID NO: 568703 - RNA, 64 nt, hsa
gcuggguucugauccuaguuccaccaucaagccaccaacauacucccaucugugaaaggaaaga

SEQ ID NO: 568704 - RNA, 64 nt, hsa
aguugaggcccgggcagggcccccacaccagaccccaacauagcuuccccacccaggcaccccc

SEQ ID NO: 568705 - RNA, 64 nt, hsa
aucaccugaggucaggaguucgaaaccagccuggccaacauagugaaacccccucucuacuaaa

SEQ ID NO: 568706 - RNA, 64 nt, hsa
ucuuuuauuaaccagucauuacacugcggaacagccaacauagaguacuugcucucguccugug

SEQ ID NO: 568707 - RNA, 64 nt, hsa
uucaucuaaggucuggaguucgagaccagccuggccaacauagcgagagcagcuccgguggcgg

SEQ ID NO: 568708 - RNA, 64 nt, hsa
ggaucaugaggucaggaguucgagaccagccuggccaacauagugaaaccccaucucugcuaaa

SEQ ID NO: 568709 - RNA, 64 nt, hsa
aucaccugaagucagaaguuugagaccagccuggccaacauaauuaaaaugucucuacuaaaaa

SEQ ID NO: 568710 - RNA, 64 nt, hsa
guaauaaaagcaaacagccuggcuuagcaaggagccaacauaacagaugggcuggaaguaagga

SEQ ID NO: 568711 - RNA, 64 nt, hsa
agcuaucuuagguggagcuacuccccaccucccaccaacauauacauuuuguugcaggaaaugu

SEQ ID NO: 568712 - RNA, 64 nt, hsa
auggaagcacggggcuagaguuuccacauaggccccaacauaaaggccuucccucgcuguugag

SEQ ID NO: 568713 - RNA, 64 nt, hsa
ccaucugcaguuaugugcugaggugauaauucauccaacauauuuguuagcauaaauauuaugc

SEQ ID NO: 568714 - RNA, 64 nt, hsa
uuguuuuccaguggguccagagucuucucuauacccaacauauguuuacuuuaugaacuuaaau

SEQ ID NO: 568715 - RNA, 64 nt, hsa
aguuaggacuugauuguagaagggacuaaauguuccaacauaaucuuuacccuucuccccaaac

SEQ ID NO: 568716 - RNA, 64 nt, hsa
acaaguuuuugucuggagccaaccaagcuugccaccaacauauugagaguaauacacuauugaa

SEQ ID NO: 568717 - RNA, 64 nt, hsa
ccauuauagugugaguggagacugcccccccuccccaacauauuccuucccauaucucucauga

SEQ ID NO: 568718 - RNA, 64 nt, hsa
gaaggggacccuccgcucuguagugcuacaggguccaacauagagccggguguccccaacagcg

SEQ ID NO: 568719 - RNA, 64 nt, hsa
aaccauuggcaucaucguuucuuuugaauuaaaaccaacauaucagcaauagucugcucucccc

SEQ ID NO: 568720 - RNA, 64 nt, hsa
aucaccugaggccaggaguucgagaccagccuggccaacauagcgaaacccgaucucuacuaaa

SEQ ID NO: 568721 - RNA, 64 nt, hsa
cucccuguccccaugucccgggcuccacugggcaccaacauaaccuuguucucuguccuuucuc

SEQ ID NO: 568722 - RNA, 64 nt, hsa
augggaguucugaagcagaaaccaugggcuaaaaccaacauacaucuuaauaccagauacccua

SEQ ID NO: 568723 - RNA, 64 nt, hsa
augaaugcaguggauaugggaaagccuucagucaccaacauauuguggcuggacagcaggcagu

SEQ ID NO: 568724 - RNA, 64 nt, hsa
gacaccacacucgugugaccccacaggguuguguccaacauacacggaaguggcuauggaaugg

SEQ ID NO: 568725 - RNA, 64 nt, hsa
cauccaccgcugcugagucucagaaacacuuggcccaacauagcccuguccagcccagugccug

SEQ ID NO: 568726 - RNA, 64 nt, hsa
gaaaacuugaugugauugccauagguggaauaauccaacauaaauugccauagauagaagguau

SEQ ID NO: 568727 - RNA, 64 nt, hsa
ggaucacgaggucaggaguucgagaccagccuggccaacauagugaaaccccaucucuacuaaa

SEQ ID NO: 568728 - RNA, 64 nt, hsa
caguaaccuucugagauauugagauuuaggacuuccaacauaugaauuuuagaagggaacaauu

SEQ ID NO: 568729 - RNA, 64 nt, hsa
gguuuuucucuaugaaugaaucacauucuuucugccaacauaguuuuauccugucucaguagga

SEQ ID NO: 568730 - RNA, 64 nt, hsa
caaaagcacuuuuccaucuuguacacgagauacaccaacauagcuacaaucaaacaggccuggg

SEQ ID NO: 568731 - RNA, 64 nt, hsa
cugcuagaaucuggccccuggccaucuuaaagugccaacauaugccugcaggguuuauaaaaaa

SEQ ID NO: 568732 - RNA, 64 nt, hsa
uuucaagacuucugaugggucaaggaaaaagaugccaacauacccguauuuaccaaguacuaug

SEQ ID NO: 568733 - RNA, 64 nt, hsa
cugaggagugugaacuguuggggucaguuaagacccaacauaacucuaucagaagaaaacuguu

SEQ ID NO: 568734 - RNA, 64 nt, hsa
cugaauuggcugccaagaguccaagccaucuggcccaacauacgcacugggcauuggguaaggg

SEQ ID NO: 568735 - RNA, 64 nt, hsa
ugaaccuuuucuggccaugaaccauuauaaaaucccaacauauauacugaaaauacugaaacug

SEQ ID NO: 568736 - RNA, 64 nt, hsa
gaaguguuaaacuaauucacaugguaguguagggccaacauacaagcuaccagucuaaugugua

SEQ ID NO: 568737 - RNA, 64 nt, hsa
caauccccgccaagagacuggcauagcuggacauccaacauaccaauuuucugcuaauacaggu

SEQ ID NO: 568738 - RNA, 64 nt, hsa
gggguucguuaugccaaagugucuacaugugccaccaacauaaaacaaaaccaagccuuggcuc

SEQ ID NO: 568739 - RNA, 64 nt, hsa
ugaguggugaauuagcaacaguaacacugauuauccaacauauauuuuggaauaucuacuaugu

SEQ ID NO: 568740 - RNA, 64 nt, hsa
ggcagcggaaggggcugacugggucugguccuuaccaacauagacggugcaaacacucuuaaca

SEQ ID NO: 568741 - RNA, 64 nt, hsa
ggaugacaaggucaggaguucaagaccagcuuggccaacauagugaaaccccgucucugcugaa

SEQ ID NO: 568742 - RNA, 64 nt, hsa
aucaccugaggucaggaguucaagaccagucuggccaacauagcaaaacccugucucuacuaaa

SEQ ID NO: 568743 - RNA, 64 nt, hsa
uagcugguauguuucauaaaugucaagcuguggaccaacauauauagccuuuuauuauuuuucu

SEQ ID NO: 568744 - RNA, 64 nt, hsa
acauuggggauugaaaaucauauugguauuugcaccaacauagucauaaaauaguauguuaaua

SEQ ID NO: 568745 - RNA, 64 nt, hsa
aucaccggaggucaggaguucgagaccagccuugccaacauagugaaacccugucucuacuaaa

SEQ ID NO: 568746 - RNA, 64 nt, hsa
guucacauugaugauucccaagucaauaagcuugccaacauaauggacuugaacaaagauggaa

SEQ ID NO: 568747 - RNA, 64 nt, hsa
cuuggagcagagagaacaggcuguaaauggguugccaacauaagcuggcugagaaauaaaagaa

SEQ ID NO: 568748 - RNA, 64 nt, hsa
acaggaaagugucaauaaaaaaacuugagcaacaccaacauauuuuuucuuaaaaugucacguu

SEQ ID NO: 568749 - RNA, 64 nt, hsa
acuucuaaaaagacaagaaacauggccuaaauaaccaacauagauuuacauaguaaguuucaca

SEQ ID NO: 568750 - RNA, 64 nt, hsa
agucauuuguaaccuugcuuaaguauuucuuaguccaacauagauauuuucuuucuccugacca

SEQ ID NO: 568751 - RNA, 64 nt, hsa
ucuaaccucagauaagugcagugucuuugcaaugccaacauaagggagaucuuggccaacguga

SEQ ID NO: 568752 - RNA, 64 nt, hsa
ucacuugagguuaggaguuugagaacuggccuggccaacauagcaaaaccucaucucuacuaaa

SEQ ID NO: 568753 - RNA, 64 nt, hsa
caugcuuagaacugagaaaacugcuuuuugugagccaacauaguaacaaacacaccaaacaaag

SEQ ID NO: 568754 - RNA, 64 nt, hsa
ccccauuuaucuuuugucuauuaauauucacuagccaacauaguauuuuugcagccuaagaguu

SEQ ID NO: 568755 - RNA, 64 nt, hsa
aggccuuuugggagccacaggcugggggcuggggccaacauaccccagcucugggaccaaaagc

SEQ ID NO: 568756 - RNA, 64 nt, hsa
agggaaagcagcugucaccugacuucuggcggguccaacauagcccucagcuuaccucugcagg

SEQ ID NO: 568757 - RNA, 64 nt, hsa
cuuugugccucgguuauuaaggaaaaaaaaauguccaacauacaguuuuuaaaguguggcaguu

SEQ ID NO: 568758 - RNA, 64 nt, hsa; identical to SEQ ID NO: 165047

SEQ ID NO: 568759 - RNA, 64 nt, hsa; identical to SEQ ID NO: 165048

SEQ ID NO: 568760 - RNA, 64 nt, hsa; identical to SEQ ID NO: 165049

SEQ ID NO: 568761 - RNA, 64 nt, hsa; identical to SEQ ID NO: 165050

SEQ ID NO: 568762 - RNA, 64 nt, hsa; identical to SEQ ID NO: 165051

SEQ ID NO: 568763 - RNA, 64 nt, hsa; identical to SEQ ID NO: 165052

SEQ ID NO: 568764 - RNA, 64 nt, hsa; identical to SEQ ID NO: 165053

SEQ ID NO: 568765 - RNA, 64 nt, hsa; identical to SEQ ID NO: 165054

SEQ ID NO: 568766 - RNA, 64 nt, hsa; identical to SEQ ID NO: 165055

SEQ ID NO: 568767 - RNA, 64 nt, hsa; identical to SEQ ID NO: 165056

SEQ ID NO: 568768 - RNA, 64 nt, hsa; identical to SEQ ID NO: 165057

SEQ ID NO: 568769 - RNA, 64 nt, hsa; identical to SEQ ID NO: 165058

SEQ ID NO: 568770 - RNA, 64 nt, hsa; identical to SEQ ID NO: 165059

SEQ ID NO: 568771 - RNA, 64 nt, hsa; identical to SEQ ID NO: 165060

SEQ ID NO: 568772 - RNA, 64 nt, hsa; identical to SEQ ID NO: 165061

SEQ ID NO: 568773 - RNA, 64 nt, hsa; identical to SEQ ID NO: 165062

SEQ ID NO: 568774 - RNA, 64 nt, hsa; identical to SEQ ID NO: 236262

SEQ ID NO: 568775 - RNA, 64 nt, hsa; identical to SEQ ID NO: 236263

SEQ ID NO: 568776 - RNA, 64 nt, hsa; identical to SEQ ID NO: 236264

SEQ ID NO: 568777 - RNA, 64 nt, hsa; identical to SEQ ID NO: 236265

SEQ ID NO: 568778 - RNA, 64 nt, hsa; identical to SEQ ID NO: 236266

SEQ ID NO: 568779 - RNA, 64 nt, hsa; identical to SEQ ID NO: 236267

SEQ ID NO: 568780 - RNA, 64 nt, hsa; identical to SEQ ID NO: 236268

SEQ ID NO: 568781 - RNA, 64 nt, hsa; identical to SEQ ID NO: 236269

SEQ ID NO: 568782 - RNA, 64 nt, hsa; identical to SEQ ID NO: 167990

SEQ ID NO: 568783 - RNA, 64 nt, hsa; identical to SEQ ID NO: 167991

SEQ ID NO: 568784 - RNA, 64 nt, hsa; identical to SEQ ID NO: 167992

SEQ ID NO: 568785 - RNA, 64 nt, hsa; identical to SEQ ID NO: 167993

SEQ ID NO: 568786 - RNA, 64 nt, hsa; identical to SEQ ID NO: 167994

SEQ ID NO: 568787 - RNA, 64 nt, hsa; identical to SEQ ID NO: 167995

SEQ ID NO: 568788 - RNA, 64 nt, hsa; identical to SEQ ID NO: 167996

SEQ ID NO: 568789 - RNA, 64 nt, hsa; identical to SEQ ID NO: 167997

SEQ ID NO: 568790 - RNA, 64 nt, hsa; identical to SEQ ID NO: 167998

SEQ ID NO: 568791 - RNA, 64 nt, hsa; identical to SEQ ID NO: 167999

SEQ ID NO: 568792 - RNA, 64 nt, hsa; identical to SEQ ID NO: 168000

SEQ ID NO: 568793 - RNA, 64 nt, hsa; identical to SEQ ID NO: 168001

SEQ ID NO: 568794 - RNA, 64 nt, hsa; identical to SEQ ID NO: 168002

SEQ ID NO: 568795 - RNA, 64 nt, hsa; identical to SEQ ID NO: 168003

SEQ ID NO: 568796 - RNA, 64 nt, hsa; identical to SEQ ID NO: 168004

SEQ ID NO: 568797 - RNA, 64 nt, hsa; identical to SEQ ID NO: 168005

SEQ ID NO: 568798 - RNA, 64 nt, hsa; identical to SEQ ID NO: 168006

SEQ ID NO: 568799 - RNA, 64 nt, hsa; identical to SEQ ID NO: 168007

SEQ ID NO: 568800 - RNA, 64 nt, hsa; identical to SEQ ID NO: 168008

SEQ ID NO: 568801 - RNA, 64 nt, hsa; identical to SEQ ID NO: 168009

SEQ ID NO: 568802 - RNA, 64 nt, hsa; identical to SEQ ID NO: 168010

SEQ ID NO: 568803 - RNA, 64 nt, hsa; identical to SEQ ID NO: 168011

SEQ ID NO: 568804 - RNA, 64 nt, hsa; identical to SEQ ID NO: 168012

SEQ ID NO: 568805 - RNA, 64 nt, hsa; identical to SEQ ID NO: 168013

SEQ ID NO: 568806 - RNA, 64 nt, hsa; identical to SEQ ID NO: 168014

SEQ ID NO: 568807 - RNA, 64 nt, hsa; identical to SEQ ID NO: 168015

SEQ ID NO: 568808 - RNA, 64 nt, hsa; identical to SEQ ID NO: 168016

SEQ ID NO: 568809 - RNA, 64 nt, hsa; identical to SEQ ID NO: 168017

SEQ ID NO: 568810 - RNA, 64 nt, hsa; identical to SEQ ID NO: 168018

SEQ ID NO: 568811 - RNA, 64 nt, hsa; identical to SEQ ID NO: 168018

SEQ ID NO: 568812 - RNA, 64 nt, hsa; identical to SEQ ID NO: 168020

SEQ ID NO: 568813 - RNA, 64 nt, hsa; identical to SEQ ID NO: 168021

SEQ ID NO: 568814 - RNA, 64 nt, hsa; identical to SEQ ID NO: 168022

SEQ ID NO: 568815 - RNA, 64 nt, hsa; identical to SEQ ID NO: 168023

SEQ ID NO: 568816 - RNA, 64 nt, hsa; identical to SEQ ID NO: 168024

SEQ ID NO: 568817 - RNA, 64 nt, hsa; identical to SEQ ID NO: 168025

SEQ ID NO: 568818 - RNA, 64 nt, hsa; identical to SEQ ID NO: 168026

SEQ ID NO: 568819 - RNA, 64 nt, hsa; identical to SEQ ID NO: 176114

SEQ ID NO: 568820 - RNA, 64 nt, hsa; identical to SEQ ID NO: 176115

SEQ ID NO: 568821 - RNA, 64 nt, hsa; identical to SEQ ID NO: 176116

SEQ ID NO: 568822 - RNA, 64 nt, hsa; identical to SEQ ID NO: 176117

SEQ ID NO: 568823 - RNA, 64 nt, hsa; identical to SEQ ID NO: 176118

SEQ ID NO: 568824 - RNA, 64 nt, hsa; identical to SEQ ID NO: 176119

SEQ ID NO: 568825 - RNA, 64 nt, hsa; identical to SEQ ID NO: 176120

SEQ ID NO: 568826 - RNA, 64 nt, hsa; identical to SEQ ID NO: 176121

SEQ ID NO: 568827 - RNA, 64 nt, hsa; identical to SEQ ID NO: 176122

SEQ ID NO: 568828 - RNA, 64 nt, hsa; identical to SEQ ID NO: 176123

SEQ ID NO: 568829 - RNA, 64 nt, hsa; identical to SEQ ID NO: 176124

SEQ ID NO: 568830 - RNA, 64 nt, hsa; identical to SEQ ID NO: 176125

SEQ ID NO: 568831 - RNA, 64 nt, hsa; identical to SEQ ID NO: 176126

SEQ ID NO: 568832 - RNA, 64 nt, hsa; identical to SEQ ID NO: 176127

SEQ ID NO: 568833 - RNA, 64 nt, hsa; identical to SEQ ID NO: 176128

SEQ ID NO: 568834 - RNA, 64 nt, hsa; identical to SEQ ID NO: 176129

SEQ ID NO: 568835 - RNA, 64 nt, hsa; identical to SEQ ID NO: 176130

SEQ ID NO: 568836 - RNA, 64 nt, hsa; identical to SEQ ID NO: 176131

SEQ ID NO: 568837 - RNA, 64 nt, hsa; identical to SEQ ID NO: 176132

SEQ ID NO: 568838 - RNA, 64 nt, hsa; identical to SEQ ID NO: 176133

SEQ ID NO: 568839 - RNA, 64 nt, hsa; identical to SEQ ID NO: 176134

SEQ ID NO: 568840 - RNA, 64 nt, hsa; identical to SEQ ID NO: 176135

SEQ ID NO: 568841 - RNA, 64 nt, hsa; identical to SEQ ID NO: 176136

SEQ ID NO: 568842 - RNA, 64 nt, hsa; identical to SEQ ID NO: 176137

SEQ ID NO: 568843 - RNA, 64 nt, hsa; identical to SEQ ID NO: 176138

SEQ ID NO: 568844 - RNA, 64 nt, hsa; identical to SEQ ID NO: 176139

SEQ ID NO: 568845 - RNA, 64 nt, hsa; identical to SEQ ID NO: 176140

SEQ ID NO: 568846 - RNA, 64 nt, hsa; identical to SEQ ID NO: 176141

SEQ ID NO: 568847 - RNA, 64 nt, hsa; identical to SEQ ID NO: 176142

SEQ ID NO: 568848 - RNA, 64 nt, hsa; identical to SEQ ID NO: 176143

SEQ ID NO: 568849 - RNA, 64 nt, hsa; identical to SEQ ID NO: 176144

SEQ ID NO: 568850 - RNA, 64 nt, hsa; identical to SEQ ID NO: 176145

SEQ ID NO: 568851 - RNA, 64 nt, hsa; identical to SEQ ID NO: 176146

SEQ ID NO: 568852 - RNA, 64 nt, hsa; identical to SEQ ID NO: 176147

SEQ ID NO: 568853 - RNA, 64 nt, hsa; identical to SEQ ID NO: 176148

SEQ ID NO: 568854 - RNA, 64 nt, hsa; identical to SEQ ID NO: 176149

SEQ ID NO: 568855 - RNA, 64 nt, hsa; identical to SEQ ID NO: 176150

SEQ ID NO: 568856 - RNA, 64 nt, hsa; identical to SEQ ID NO: 176151

SEQ ID NO: 568857 - RNA, 64 nt, hsa; identical to SEQ ID NO: 176152

SEQ ID NO: 568858 - RNA, 64 nt, hsa; identical to SEQ ID NO: 176153

SEQ ID NO: 568859 - RNA, 64 nt, hsa; identical to SEQ ID NO: 176154

SEQ ID NO: 568860 - RNA, 64 nt, hsa; identical to SEQ ID NO: 176155

SEQ ID NO: 568861 - RNA, 64 nt, hsa; identical to SEQ ID NO: 176156

SEQ ID NO: 568862 - RNA, 57 nt, hsa; identical to SEQ ID NO: 176157

SEQ ID NO: 568863 - RNA, 64 nt, hsa; identical to SEQ ID NO: 176158

SEQ ID NO: 568864 - RNA, 64 nt, hsa; identical to SEQ ID NO: 176159

SEQ ID NO: 568865 - RNA, 64 nt, hsa; identical to SEQ ID NO: 176160

SEQ ID NO: 568866 - RNA, 64 nt, hsa; identical to SEQ ID NO: 176161

SEQ ID NO: 568867 - RNA, 64 nt, hsa; identical to SEQ ID NO: 176162

SEQ ID NO: 568868 - RNA, 64 nt, hsa; identical to SEQ ID NO: 176163

SEQ ID NO: 568869 - RNA, 64 nt, hsa; identical to SEQ ID NO: 176164

SEQ ID NO: 568870 - RNA, 64 nt, hsa; identical to SEQ ID NO: 176165

SEQ ID NO: 568871 - RNA, 64 nt, hsa; identical to SEQ ID NO: 176166

SEQ ID NO: 568872 - RNA, 64 nt, hsa; identical to SEQ ID NO: 176167

SEQ ID NO: 568873 - RNA, 64 nt, hsa; identical to SEQ ID NO: 176168

SEQ ID NO: 568874 - RNA, 64 nt, hsa; identical to SEQ ID NO: 176169

SEQ ID NO: 568875 - RNA, 64 nt, hsa; identical to SEQ ID NO: 176170

SEQ ID NO: 568876 - RNA, 64 nt, hsa; identical to SEQ ID NO: 176171

SEQ ID NO: 568877 - RNA, 64 nt, hsa; identical to SEQ ID NO: 176172

SEQ ID NO: 568878 - RNA, 64 nt, hsa; identical to SEQ ID NO: 176173

SEQ ID NO: 568879 - RNA, 64 nt, hsa; identical to SEQ ID NO: 176174

SEQ ID NO: 568880 - RNA, 64 nt, hsa; identical to SEQ ID NO: 176175

SEQ ID NO: 568881 - RNA, 64 nt, hsa; identical to SEQ ID NO: 176176

SEQ ID NO: 568882 - RNA, 64 nt, hsa; identical to SEQ ID NO: 176177

SEQ ID NO: 568883 - RNA, 64 nt, hsa; identical to SEQ ID NO: 176178

SEQ ID NO: 568884 - RNA, 64 nt, hsa; identical to SEQ ID NO: 176179

SEQ ID NO: 568885 - RNA, 64 nt, hsa; identical to SEQ ID NO: 176180

SEQ ID NO: 568886 - RNA, 64 nt, hsa; identical to SEQ ID NO: 176181

SEQ ID NO: 568887 - RNA, 64 nt, hsa; identical to SEQ ID NO: 176182

SEQ ID NO: 568888 - RNA, 64 nt, hsa; identical to SEQ ID NO: 176183

SEQ ID NO: 568889 - RNA, 64 nt, hsa; identical to SEQ ID NO: 176184

SEQ ID NO: 568890 - RNA, 64 nt, hsa; identical to SEQ ID NO: 176185

SEQ ID NO: 568891 - RNA, 64 nt, hsa; identical to SEQ ID NO: 176186

SEQ ID NO: 568892 - RNA, 64 nt, hsa; identical to SEQ ID NO: 176187

SEQ ID NO: 568893 - RNA, 64 nt, hsa; identical to SEQ ID NO: 176188

SEQ ID NO: 568894 - RNA, 64 nt, hsa; identical to SEQ ID NO: 176189

SEQ ID NO: 568895 - RNA, 64 nt, hsa; identical to SEQ ID NO: 176190

SEQ ID NO: 568896 - RNA, 64 nt, hsa; identical to SEQ ID NO: 176191

SEQ ID NO: 568897 - RNA, 64 nt, hsa; identical to SEQ ID NO: 176192

SEQ ID NO: 568898 - RNA, 64 nt, hsa; identical to SEQ ID NO: 176193

SEQ ID NO: 568899 - RNA, 53 nt, hsa; identical to SEQ ID NO: 176194

SEQ ID NO: 568900 - RNA, 64 nt, hsa; identical to SEQ ID NO: 176195

SEQ ID NO: 568901 - RNA, 64 nt, hsa; identical to SEQ ID NO: 176196

SEQ ID NO: 568902 - RNA, 64 nt, hsa; identical to SEQ ID NO: 176197

SEQ ID NO: 568903 - RNA, 64 nt, hsa; identical to SEQ ID NO: 176198

SEQ ID NO: 568904 - RNA, 64 nt, hsa; identical to SEQ ID NO: 176199

SEQ ID NO: 568905 - RNA, 64 nt, hsa; identical to SEQ ID NO: 176200

SEQ ID NO: 568906 - RNA, 64 nt, hsa; identical to SEQ ID NO: 176201

SEQ ID NO: 568907 - RNA, 64 nt, hsa; identical to SEQ ID NO: 176202

SEQ ID NO: 568908 - RNA, 64 nt, hsa; identical to SEQ ID NO: 176203

SEQ ID NO: 568909 - RNA, 64 nt, hsa; identical to SEQ ID NO: 176204

SEQ ID NO: 568910 - RNA, 64 nt, hsa; identical to SEQ ID NO: 176205

SEQ ID NO: 568911 - RNA, 64 nt, hsa; identical to SEQ ID NO: 176206

SEQ ID NO: 568912 - RNA, 64 nt, hsa; identical to SEQ ID NO: 176207

SEQ ID NO: 568913 - RNA, 64 nt, hsa; identical to SEQ ID NO: 176208

SEQ ID NO: 568914 - RNA, 64 nt, hsa; identical to SEQ ID NO: 176209

SEQ ID NO: 568915 - RNA, 64 nt, hsa; identical to SEQ ID NO: 176210

SEQ ID NO: 568916 - RNA, 64 nt, hsa; identical to SEQ ID NO: 176211

SEQ ID NO: 568917 - RNA, 64 nt, hsa; identical to SEQ ID NO: 176212

SEQ ID NO: 568918 - RNA, 64 nt, hsa; identical to SEQ ID NO: 176213

SEQ ID NO: 568919 - RNA, 64 nt, hsa; identical to SEQ ID NO: 176214

SEQ ID NO: 568920 - RNA, 64 nt, hsa; identical to SEQ ID NO: 176215

SEQ ID NO: 568921 - RNA, 64 nt, hsa; identical to SEQ ID NO: 176216

SEQ ID NO: 568922 - RNA, 64 nt, hsa; identical to SEQ ID NO: 176217

SEQ ID NO: 568923 - RNA, 64 nt, hsa; identical to SEQ ID NO: 176218

SEQ ID NO: 568924 - RNA, 64 nt, hsa; identical to SEQ ID NO: 176219

SEQ ID NO: 568925 - RNA, 64 nt, hsa; identical to SEQ ID NO: 176220

SEQ ID NO: 568926 - RNA, 64 nt, hsa; identical to SEQ ID NO: 176221

SEQ ID NO: 568927 - RNA, 64 nt, hsa; identical to SEQ ID NO: 176222

SEQ ID NO: 568928 - RNA, 64 nt, hsa; identical to SEQ ID NO: 176223

SEQ ID NO: 568929 - RNA, 64 nt, hsa; identical to SEQ ID NO: 176220

SEQ ID NO: 568930 - RNA, 64 nt, hsa; identical to SEQ ID NO: 176225

SEQ ID NO: 568931 - RNA, 64 nt, hsa; identical to SEQ ID NO: 176226

SEQ ID NO: 568932 - RNA, 64 nt, hsa; identical to SEQ ID NO: 176227

SEQ ID NO: 568933 - RNA, 64 nt, hsa; identical to SEQ ID NO: 176228

SEQ ID NO: 568934 - RNA, 64 nt, hsa; identical to SEQ ID NO: 176229

SEQ ID NO: 568935 - RNA, 64 nt, hsa; identical to SEQ ID NO: 176230

SEQ ID NO: 568936 - RNA, 64 nt, hsa; identical to SEQ ID NO: 176231

SEQ ID NO: 568937 - RNA, 64 nt, hsa; identical to SEQ ID NO: 176232

SEQ ID NO: 568938 - RNA, 64 nt, hsa; identical to SEQ ID NO: 176233

SEQ ID NO: 568939 - RNA, 64 nt, hsa; identical to SEQ ID NO: 176234

SEQ ID NO: 568940 - RNA, 64 nt, hsa; identical to SEQ ID NO: 176235

SEQ ID NO: 568941 - RNA, 64 nt, hsa; identical to SEQ ID NO: 176236

SEQ ID NO: 568942 - RNA, 64 nt, hsa; identical to SEQ ID NO: 176237

SEQ ID NO: 568943 - RNA, 64 nt, hsa; identical to SEQ ID NO: 176238

SEQ ID NO: 568944 - RNA, 51 nt, hsa; identical to SEQ ID NO: 176239

SEQ ID NO: 568945 - RNA, 64 nt, hsa; identical to SEQ ID NO: 176240

SEQ ID NO: 568946 - RNA, 64 nt, hsa; identical to SEQ ID NO: 176241

SEQ ID NO: 568947 - RNA, 64 nt, hsa; identical to SEQ ID NO: 176242

SEQ ID NO: 568948 - RNA, 64 nt, hsa; identical to SEQ ID NO: 176243

SEQ ID NO: 568949 - RNA, 64 nt, hsa; identical to SEQ ID NO: 176244

SEQ ID NO: 568950 - RNA, 64 nt, hsa; identical to SEQ ID NO: 176245

SEQ ID NO: 568951 - RNA, 64 nt, hsa; identical to SEQ ID NO: 176246

SEQ ID NO: 568952 - RNA, 64 nt, hsa; identical to SEQ ID NO: 176247

SEQ ID NO: 568953 - RNA, 64 nt, hsa; identical to SEQ ID NO: 176248

SEQ ID NO: 568954 - RNA, 64 nt, hsa; identical to SEQ ID NO: 176249

SEQ ID NO: 568955 - RNA, 64 nt, hsa; identical to SEQ ID NO: 176250

SEQ ID NO: 568956 - RNA, 64 nt, hsa; identical to SEQ ID NO: 176251

SEQ ID NO: 568957 - RNA, 64 nt, hsa; identical to SEQ ID NO: 176252

SEQ ID NO: 568958 - RNA, 64 nt, hsa; identical to SEQ ID NO: 176253

SEQ ID NO: 568959 - RNA, 64 nt, hsa; identical to SEQ ID NO: 176254

SEQ ID NO: 568960 - RNA, 64 nt, hsa; identical to SEQ ID NO: 176255

SEQ ID NO: 568961 - RNA, 64 nt, hsa; identical to SEQ ID NO: 176256

SEQ ID NO: 568962 - RNA, 64 nt, hsa; identical to SEQ ID NO: 176257

SEQ ID NO: 568963 - RNA, 64 nt, hsa; identical to SEQ ID NO: 176258

SEQ ID NO: 568964 - RNA, 64 nt, hsa; identical to SEQ ID NO: 176259

SEQ ID NO: 568965 - RNA, 64 nt, hsa; identical to SEQ ID NO: 176260

SEQ ID NO: 568966 - RNA, 64 nt, hsa; identical to SEQ ID NO: 176261

SEQ ID NO: 568967 - RNA, 64 nt, hsa; identical to SEQ ID NO: 176262

SEQ ID NO: 568968 - RNA, 64 nt, hsa; identical to SEQ ID NO: 176263

SEQ ID NO: 568969 - RNA, 64 nt, hsa; identical to SEQ ID NO: 176264

SEQ ID NO: 568970 - RNA, 64 nt, hsa; identical to SEQ ID NO: 176265

SEQ ID NO: 568971 - RNA, 64 nt, hsa; identical to SEQ ID NO: 176266

SEQ ID NO: 568972 - RNA, 64 nt, hsa; identical to SEQ ID NO: 176267

SEQ ID NO: 568973 - RNA, 64 nt, hsa; identical to SEQ ID NO: 176268

SEQ ID NO: 568974 - RNA, 64 nt, hsa; identical to SEQ ID NO: 176269

SEQ ID NO: 568975 - RNA, 53 nt, hsa; identical to SEQ ID NO: 176270

SEQ ID NO: 568976 - RNA, 64 nt, hsa; identical to SEQ ID NO: 176271

SEQ ID NO: 568977 - RNA, 64 nt, hsa; identical to SEQ ID NO: 176272

SEQ ID NO: 568978 - RNA, 64 nt, hsa
caugucccaggcacuguacuaaccuacagagaugcuaagagaaaaaaaagacuuguuucugauc

SEQ ID NO: 568979 - RNA, 64 nt, hsa
ggaaacucagggcuucuaguuucucuuagaaaagcuaagagaagauaaggucugaauaauagca

SEQ ID NO: 568980 - RNA, 64 nt, hsa
gcuuuuuuuuuuuuuuugguuaaguuuguuuuuucuaagagauuugcaaugcaaggucuccuug

SEQ ID NO: 568981 - RNA, 64 nt, hsa
guuuugcuucaagaugucagaaagucaaguucagcuaagagacacccagguccccagcuugccc

SEQ ID NO: 568982 - RNA, 64 nt, hsa
gcauucaauacuagcagauucauaacugaugccuguucaaaaacacuguugguggaaucuuuua

SEQ ID NO: 568983 - RNA, 64 nt, hsa
ugcaacuauaucuauaugugggaaccauucugaaguucaaaacuauggaaaauugaauuuucuu

SEQ ID NO: 568984 - RNA, 64 nt, hsa
uugcaagaaagucagaccuguuucuuguaacuggguucaaaaagaaaaaaauaauaaaaauaaa

SEQ ID NO: 568985 - RNA, 64 nt, hsa
auucucacucugcuuugcaucccccaaacuucuuguucaaaacggggggaguuuaggagacuuu

SEQ ID NO: 568986 - RNA, 64 nt, hsa
uuuucacagcaucagcagucaucucacuaguuauguucaaaaaaguaagugaaauuuuaugucu

SEQ ID NO: 568987 - RNA, 64 nt, hsa
uucuccaguuacuguauucuacaaauauuuuuauguucaaaacacacaguacagacagcaugga

SEQ ID NO: 568988 - RNA, 64 nt, hsa
uucauuaggcaaacuuugguuuaaguaaacauauguucaaaaucagauuaacagauacagguuu

SEQ ID NO: 568989 - RNA, 64 nt, hsa
ugaagggcaugcuguaauuucacacaauuuuccaguucaaaaauggagaauacuucgccuaaaa

SEQ ID NO: 568990 - RNA, 64 nt, hsa
ucaaacuuuauugacaagugauuuucaagucuguguucaaaaauauauucauguaccugugauc

SEQ ID NO: 568991 - RNA, 64 nt, hsa
guguuuuguuuauuaaauaguuaauauagucacaguucaaaauucuaaauguacguaagguaaa

SEQ ID NO: 568992 - RNA, 64 nt, hsa
aggaaucaaguccacucuucugccugcaacauuuguucaaaaacuaaccaagguaaaauauuua

SEQ ID NO: 568993 - RNA, 64 nt, hsa
aaaaagauacaaaguucauaauaucaaaauauguguucaaaauugguauuuuaauuuuaauauu

SEQ ID NO: 568994 - RNA, 64 nt, hsa
auccagugaagcauaaauuagaauuuaauuugauguucaaaaacaguuccauuuuuaaggguua

SEQ ID NO: 568995 - RNA, 64 nt, hsa
agaaaagggagauaacuaaugagcuucuagugauguucaaaauugcuguuaauaggcauuauac

SEQ ID NO: 568996 - RNA, 64 nt, hsa
uugagcuaucugaaaacuguuauuccuaaguaauguucaaaaaugauaaguaaucuggauaccu

SEQ ID NO: 568997 - RNA, 64 nt, hsa
auuucuuaauguguguguuuuuacuugcauaucuguucaaaacacuuuuaacaaaauuaauuca

SEQ ID NO: 568998 - RNA, 64 nt, hsa
guuuuuccccccuccuucugcuguguaucaugguguucaaaacagaaauguuuuuuggcauucc

SEQ ID NO: 568999 - RNA, 64 nt, hsa
gacaauuaugaguuugcccucuuuccccuaccaaguucaaaauauaucuaagaaagauuguaaa

SEQ ID NO: 569000 - RNA, 64 nt, hsa; identical to SEQ ID NO: 378451

SEQ ID NO: 569001 - RNA, 64 nt, hsa; identical to SEQ ID NO: 378452

SEQ ID NO: 569002 - RNA, 64 nt, hsa; identical to SEQ ID NO: 378453

SEQ ID NO: 569003 - RNA, 64 nt, hsa; identical to SEQ ID NO: 378454

SEQ ID NO: 569004 - RNA, 64 nt, hsa; identical to SEQ ID NO: 378455

SEQ ID NO: 569005 - RNA, 64 nt, hsa; identical to SEQ ID NO: 378456

SEQ ID NO: 569006 - RNA, 64 nt, hsa; identical to SEQ ID NO: 378457

SEQ ID NO: 569007 - RNA, 64 nt, hsa; identical to SEQ ID NO: 378458

SEQ ID NO: 569008 - RNA, 61 nt, hsa; identical to SEQ ID NO: 378459

SEQ ID NO: 569009 - RNA, 64 nt, hsa; identical to SEQ ID NO: 378460

SEQ ID NO: 569010 - RNA, 64 nt, hsa; identical to SEQ ID NO: 378461

SEQ ID NO: 569011 - RNA, 64 nt, hsa; identical to SEQ ID NO: 378462

SEQ ID NO: 569012 - RNA, 64 nt, hsa; identical to SEQ ID NO: 378463

SEQ ID NO: 569013 - RNA, 64 nt, hsa; identical to SEQ ID NO: 378464

SEQ ID NO: 569014 - RNA, 64 nt, hsa; identical to SEQ ID NO: 378465

SEQ ID NO: 569015 - RNA, 64 nt, hsa; identical to SEQ ID NO: 378466

SEQ ID NO: 569016 - RNA, 64 nt, hsa; identical to SEQ ID NO: 378467

SEQ ID NO: 569017 - RNA, 64 nt, hsa; identical to SEQ ID NO: 378468

SEQ ID NO: 569018 - RNA, 64 nt, hsa; identical to SEQ ID NO: 378469

SEQ ID NO: 569019 - RNA, 64 nt, hsa; identical to SEQ ID NO: 378470

SEQ ID NO: 569020 - RNA, 64 nt, hsa; identical to SEQ ID NO: 378471

SEQ ID NO: 569021 - RNA, 64 nt, hsa; identical to SEQ ID NO: 378472

SEQ ID NO: 569022 - RNA, 64 nt, hsa; identical to SEQ ID NO: 378473

SEQ ID NO: 569023 - RNA, 64 nt, hsa; identical to SEQ ID NO: 378474

SEQ ID NO: 569024 - RNA, 64 nt, hsa; identical to SEQ ID NO: 378475

SEQ ID NO: 569025 - RNA, 64 nt, hsa; identical to SEQ ID NO: 378476

SEQ ID NO: 569026 - RNA, 64 nt, hsa; identical to SEQ ID NO: 378477

SEQ ID NO: 569027 - RNA, 64 nt, hsa; identical to SEQ ID NO: 378478

SEQ ID NO: 569028 - RNA, 64 nt, hsa; identical to SEQ ID NO: 378479

SEQ ID NO: 569029 - RNA, 64 nt, hsa; identical to SEQ ID NO: 378480

SEQ ID NO: 569030 - RNA, 64 nt, hsa; identical to SEQ ID NO: 378481

SEQ ID NO: 569031 - RNA, 64 nt, hsa; identical to SEQ ID NO: 378482

SEQ ID NO: 569032 - RNA, 64 nt, hsa; identical to SEQ ID NO: 378483

SEQ ID NO: 569033 - RNA, 64 nt, hsa; identical to SEQ ID NO: 378484

SEQ ID NO: 569034 - RNA, 64 nt, hsa; identical to SEQ ID NO: 378485

SEQ ID NO: 569035 - RNA, 64 nt, hsa; identical to SEQ ID NO: 378486

SEQ ID NO: 569036 - RNA, 64 nt, hsa; identical to SEQ ID NO: 378487

SEQ ID NO: 569037 - RNA, 64 nt, hsa; identical to SEQ ID NO: 378488

SEQ ID NO: 569038 - RNA, 64 nt, hsa; identical to SEQ ID NO: 378489

SEQ ID NO: 569039 - RNA, 64 nt, hsa; identical to SEQ ID NO: 378490

SEQ ID NO: 569040 - RNA, 64 nt, hsa; identical to SEQ ID NO: 378491

SEQ ID NO: 569041 - RNA, 64 nt, hsa; identical to SEQ ID NO: 378492

SEQ ID NO: 569042 - RNA, 64 nt, hsa; identical to SEQ ID NO: 378493

SEQ ID NO: 569043 - RNA, 64 nt, hsa; identical to SEQ ID NO: 378494

SEQ ID NO: 569044 - RNA, 64 nt, hsa; identical to SEQ ID NO: 378495

SEQ ID NO: 569045 - RNA, 64 nt, hsa; identical to SEQ ID NO: 378496

SEQ ID NO: 569046 - RNA, 64 nt, hsa; identical to SEQ ID NO: 378497

SEQ ID NO: 569047 - RNA, 64 nt, hsa; identical to SEQ ID NO: 378498

SEQ ID NO: 569048 - RNA, 64 nt, hsa; identical to SEQ ID NO: 378499

SEQ ID NO: 569049 - RNA, 64 nt, hsa; identical to SEQ ID NO: 378500

SEQ ID NO: 569050 - RNA, 64 nt, hsa; identical to SEQ ID NO: 378501

SEQ ID NO: 569051 - RNA, 64 nt, hsa; identical to SEQ ID NO: 378502

SEQ ID NO: 569052 - RNA, 64 nt, hsa; identical to SEQ ID NO: 378503

SEQ ID NO: 569053 - RNA, 64 nt, hsa; identical to SEQ ID NO: 378504

SEQ ID NO: 569054 - RNA, 64 nt, hsa; identical to SEQ ID NO: 378505

SEQ ID NO: 569055 - RNA, 64 nt, hsa; identical to SEQ ID NO: 378506

SEQ ID NO: 569056 - RNA, 64 nt, hsa; identical to SEQ ID NO: 378507

SEQ ID NO: 569057 - RNA, 64 nt, hsa; identical to SEQ ID NO: 386331

SEQ ID NO: 569058 - RNA, 64 nt, hsa; identical to SEQ ID NO: 386332

SEQ ID NO: 569059 - RNA, 64 nt, hsa; identical to SEQ ID NO: 386353

SEQ ID NO: 569060 - RNA, 64 nt, hsa; identical to SEQ ID NO: 386354

SEQ ID NO: 569061 - RNA, 64 nt, hsa; identical to SEQ ID NO: 386357

SEQ ID NO: 569062 - RNA, 64 nt, hsa; identical to SEQ ID NO: 386358

SEQ ID NO: 569063 - RNA, 64 nt, hsa; identical to SEQ ID NO: 386377

SEQ ID NO: 569064 - RNA, 64 nt, hsa; identical to SEQ ID NO: 386378

SEQ ID NO: 569065 - RNA, 64 nt, hsa; identical to SEQ ID NO: 386418

SEQ ID NO: 569066 - RNA, 64 nt, hsa; identical to SEQ ID NO: 386419

SEQ ID NO: 569067 - RNA, 64 nt, hsa; identical to SEQ ID NO: 386420

SEQ ID NO: 569068 - RNA, 64 nt, hsa; identical to SEQ ID NO: 386421

SEQ ID NO: 569069 - RNA, 64 nt, hsa; identical to SEQ ID NO: 294262

SEQ ID NO: 569070 - RNA, 64 nt, hsa; identical to SEQ ID NO: 294263

SEQ ID NO: 569071 - RNA, 64 nt, hsa; identical to SEQ ID NO: 294264

SEQ ID NO: 569072 - RNA, 64 nt, hsa; identical to SEQ ID NO: 294265

SEQ ID NO: 569073 - RNA, 64 nt, hsa; identical to SEQ ID NO: 294266

SEQ ID NO: 569074 - RNA, 64 nt, hsa; identical to SEQ ID NO: 294267

SEQ ID NO: 569075 - RNA, 64 nt, hsa; identical to SEQ ID NO: 294268

SEQ ID NO: 569076 - RNA, 64 nt, hsa; identical to SEQ ID NO: 294269

SEQ ID NO: 569077 - RNA, 64 nt, hsa; identical to SEQ ID NO: 294270

SEQ ID NO: 569078 - RNA, 64 nt, hsa; identical to SEQ ID NO: 294271

SEQ ID NO: 569079 - RNA, 64 nt, hsa; identical to SEQ ID NO: 294272

SEQ ID NO: 569080 - RNA, 64 nt, hsa; identical to SEQ ID NO: 294273

SEQ ID NO: 569081 - RNA, 64 nt, hsa; identical to SEQ ID NO: 294274

SEQ ID NO: 569082 - RNA, 64 nt, hsa; identical to SEQ ID NO: 294275

SEQ ID NO: 569083 - RNA, 64 nt, hsa; identical to SEQ ID NO: 294276

SEQ ID NO: 569084 - RNA, 64 nt, hsa; identical to SEQ ID NO: 294277

SEQ ID NO: 569085 - RNA, 64 nt, hsa; identical to SEQ ID NO: 294278

SEQ ID NO: 569086 - RNA, 64 nt, hsa; identical to SEQ ID NO: 294279

SEQ ID NO: 569087 - RNA, 64 nt, hsa; identical to SEQ ID NO: 294280

SEQ ID NO: 569088 - RNA, 64 nt, hsa; identical to SEQ ID NO: 294281

SEQ ID NO: 569089 - RNA, 64 nt, hsa; identical to SEQ ID NO: 294282

SEQ ID NO: 569090 - RNA, 64 nt, hsa; identical to SEQ ID NO: 294283

SEQ ID NO: 569091 - RNA, 64 nt, hsa; identical to SEQ ID NO: 294284

SEQ ID NO: 569092 - RNA, 64 nt, hsa; identical to SEQ ID NO: 294285

SEQ ID NO: 569093 - RNA, 64 nt, hsa; identical to SEQ ID NO: 294286

SEQ ID NO: 569094 - RNA, 64 nt, hsa; identical to SEQ ID NO: 294287

SEQ ID NO: 569095 - RNA, 64 nt, hsa; identical to SEQ ID NO: 294288

SEQ ID NO: 569096 - RNA, 64 nt, hsa; identical to SEQ ID NO: 294289

SEQ ID NO: 569097 - RNA, 64 nt, hsa; identical to SEQ ID NO: 294290

SEQ ID NO: 569098 - RNA, 64 nt, hsa; identical to SEQ ID NO: 294291

SEQ ID NO: 569099 - RNA, 64 nt, hsa; identical to SEQ ID NO: 294292

SEQ ID NO: 569100 - RNA, 64 nt, hsa; identical to SEQ ID NO: 294293

SEQ ID NO: 569101 - RNA, 64 nt, hsa; identical to SEQ ID NO: 294294

SEQ ID NO: 569102 - RNA, 64 nt, hsa; identical to SEQ ID NO: 294295

SEQ ID NO: 569103 - RNA, 64 nt, hsa; identical to SEQ ID NO: 294296

SEQ ID NO: 569104 - RNA, 64 nt, hsa; identical to SEQ ID NO: 294297

SEQ ID NO: 569105 - RNA, 64 nt, hsa; identical to SEQ ID NO: 294298

SEQ ID NO: 569106 - RNA, 64 nt, hsa; identical to SEQ ID NO: 294299

SEQ ID NO: 569107 - RNA, 64 nt, hsa; identical to SEQ ID NO: 142269

SEQ ID NO: 569108 - RNA, 64 nt, hsa; identical to SEQ ID NO: 142270

SEQ ID NO: 569109 - RNA, 64 nt, hsa; identical to SEQ ID NO: 142271

SEQ ID NO: 569110 - RNA, 64 nt, hsa; identical to SEQ ID NO: 142272

SEQ ID NO: 569111 - RNA, 64 nt, hsa; identical to SEQ ID NO: 142273

SEQ ID NO: 569112 - RNA, 64 nt, hsa; identical to SEQ ID NO: 142274

SEQ ID NO: 569113 - RNA, 64 nt, hsa; identical to SEQ ID NO: 142275

SEQ ID NO: 569114 - RNA, 64 nt, hsa; identical to SEQ ID NO: 142276

SEQ ID NO: 569115 - RNA, 64 nt, hsa; identical to SEQ ID NO: 142277

SEQ ID NO: 569116 - RNA, 64 nt, hsa; identical to SEQ ID NO: 142278

SEQ ID NO: 569117 - RNA, 64 nt, hsa; identical to SEQ ID NO: 142279

SEQ ID NO: 569118 - RNA, 64 nt, hsa; identical to SEQ ID NO: 142280

SEQ ID NO: 569119 - RNA, 64 nt, hsa; identical to SEQ ID NO: 142281

SEQ ID NO: 569120 - RNA, 64 nt, hsa; identical to SEQ ID NO: 142282

SEQ ID NO: 569121 - RNA, 64 nt, hsa; identical to SEQ ID NO: 142283

SEQ ID NO: 569122 - RNA, 64 nt, hsa; identical to SEQ ID NO: 142284

SEQ ID NO: 569123 - RNA, 64 nt, hsa; identical to SEQ ID NO: 142285

SEQ ID NO: 569124 - RNA, 64 nt, hsa; identical to SEQ ID NO: 142286

SEQ ID NO: 569125 - RNA, 64 nt, hsa; identical to SEQ ID NO: 142287

SEQ ID NO: 569126 - RNA, 64 nt, hsa; identical to SEQ ID NO: 142288

SEQ ID NO: 569127 - RNA, 64 nt, hsa; identical to SEQ ID NO: 142289

SEQ ID NO: 569128 - RNA, 64 nt, hsa; identical to SEQ ID NO: 142290

SEQ ID NO: 569129 - RNA, 64 nt, hsa; identical to SEQ ID NO: 142291

SEQ ID NO: 569130 - RNA, 64 nt, hsa; identical to SEQ ID NO: 142292

SEQ ID NO: 569131 - RNA, 64 nt, hsa; identical to SEQ ID NO: 142293

SEQ ID NO: 569132 - RNA, 64 nt, hsa; identical to SEQ ID NO: 142294

SEQ ID NO: 569133 - RNA, 64 nt, hsa; identical to SEQ ID NO: 142295

SEQ ID NO: 569134 - RNA, 64 nt, hsa; identical to SEQ ID NO: 142296

SEQ ID NO: 569135 - RNA, 64 nt, hsa; identical to SEQ ID NO: 142297

SEQ ID NO: 569136 - RNA, 64 nt, hsa; identical to SEQ ID NO: 142298

SEQ ID NO: 569137 - RNA, 64 nt, hsa; identical to SEQ ID NO: 142299

SEQ ID NO: 569138 - RNA, 64 nt, hsa; identical to SEQ ID NO: 142300

SEQ ID NO: 569139 - RNA, 64 nt, hsa; identical to SEQ ID NO: 142301

SEQ ID NO: 569140 - RNA, 64 nt, hsa; identical to SEQ ID NO: 142302

SEQ ID NO: 569141 - RNA, 64 nt, hsa; identical to SEQ ID NO: 142303

SEQ ID NO: 569142 - RNA, 64 nt, hsa; identical to SEQ ID NO: 142304

SEQ ID NO: 569143 - RNA, 64 nt, hsa; identical to SEQ ID NO: 142305

SEQ ID NO: 569144 - RNA, 64 nt, hsa; identical to SEQ ID NO: 142306

SEQ ID NO: 569145 - RNA, 64 nt, hsa; identical to SEQ ID NO: 142307

SEQ ID NO: 569146 - RNA, 64 nt, hsa; identical to SEQ ID NO: 142308

SEQ ID NO: 569147 - RNA, 64 nt, hsa; identical to SEQ ID NO: 142309

SEQ ID NO: 569148 - RNA, 64 nt, hsa; identical to SEQ ID NO: 142310

SEQ ID NO: 569149 - RNA, 64 nt, hsa; identical to SEQ ID NO: 142311

SEQ ID NO: 569150 - RNA, 64 nt, hsa; identical to SEQ ID NO: 142312

SEQ ID NO: 569151 - RNA, 64 nt, hsa; identical to SEQ ID NO: 142313

SEQ ID NO: 569152 - RNA, 64 nt, hsa; identical to SEQ ID NO: 142314

SEQ ID NO: 569153 - RNA, 64 nt, hsa; identical to SEQ ID NO: 142315

SEQ ID NO: 569154 - RNA, 64 nt, hsa; identical to SEQ ID NO: 142316

SEQ ID NO: 569155 - RNA, 64 nt, hsa; identical to SEQ ID NO: 142317

SEQ ID NO: 569156 - RNA, 64 nt, hsa; identical to SEQ ID NO: 142318

SEQ ID NO: 569157 - RNA, 64 nt, hsa; identical to SEQ ID NO: 142319

SEQ ID NO: 569158 - RNA, 64 nt, hsa; identical to SEQ ID NO: 142320

SEQ ID NO: 569159 - RNA, 64 nt, hsa; identical to SEQ ID NO: 142321

SEQ ID NO: 569160 - RNA, 64 nt, hsa; identical to SEQ ID NO: 142322

SEQ ID NO: 569161 - RNA, 64 nt, hsa; identical to SEQ ID NO: 142323

SEQ ID NO: 569162 - RNA, 64 nt, hsa; identical to SEQ ID NO: 142324

SEQ ID NO: 569163 - RNA, 64 nt, hsa; identical to SEQ ID NO: 142325

SEQ ID NO: 569164 - RNA, 64 nt, hsa; identical to SEQ ID NO: 142326

SEQ ID NO: 569165 - RNA, 64 nt, hsa; identical to SEQ ID NO: 142327

SEQ ID NO: 569166 - RNA, 64 nt, hsa; identical to SEQ ID NO: 142328

SEQ ID NO: 569167 - RNA, 64 nt, hsa; identical to SEQ ID NO: 142329

SEQ ID NO: 569168 - RNA, 64 nt, hsa; identical to SEQ ID NO: 142330

SEQ ID NO: 569169 - RNA, 64 nt, hsa; identical to SEQ ID NO: 142331

SEQ ID NO: 569170 - RNA, 64 nt, hsa; identical to SEQ ID NO: 142332

SEQ ID NO: 569171 - RNA, 64 nt, hsa; identical to SEQ ID NO: 142333

SEQ ID NO: 569172 - RNA, 64 nt, hsa; identical to SEQ ID NO: 142334

SEQ ID NO: 569173 - RNA, 64 nt, hsa; identical to SEQ ID NO: 142335

SEQ ID NO: 569174 - RNA, 64 nt, hsa; identical to SEQ ID NO: 142336

SEQ ID NO: 569175 - RNA, 64 nt, hsa; identical to SEQ ID NO: 142337

SEQ ID NO: 569176 - RNA, 64 nt, hsa; identical to SEQ ID NO: 142338

SEQ ID NO: 569177 - RNA, 64 nt, hsa; identical to SEQ ID NO: 142339

SEQ ID NO: 569178 - RNA, 64 nt, hsa; identical to SEQ ID NO: 142340

SEQ ID NO: 569179 - RNA, 64 nt, hsa; identical to SEQ ID NO: 142341

SEQ ID NO: 569180 - RNA, 64 nt, hsa; identical to SEQ ID NO: 142342

SEQ ID NO: 569181 - RNA, 64 nt, hsa; identical to SEQ ID NO: 142343

SEQ ID NO: 569182 - RNA, 64 nt, hsa; identical to SEQ ID NO: 142344

SEQ ID NO: 569183 - RNA, 64 nt, hsa; identical to SEQ ID NO: 142345

SEQ ID NO: 569184 - RNA, 64 nt, hsa; identical to SEQ ID NO: 142346

SEQ ID NO: 569185 - RNA, 64 nt, hsa; identical to SEQ ID NO: 142347

SEQ ID NO: 569186 - RNA, 64 nt, hsa; identical to SEQ ID NO: 142348

SEQ ID NO: 569187 - RNA, 64 nt, hsa; identical to SEQ ID NO: 142349

SEQ ID NO: 569188 - RNA, 64 nt, hsa; identical to SEQ ID NO: 142350

SEQ ID NO: 569189 - RNA, 64 nt, hsa; identical to SEQ ID NO: 142351

SEQ ID NO: 569190 - RNA, 64 nt, hsa; identical to SEQ ID NO: 142352

SEQ ID NO: 569191 - RNA, 64 nt, hsa; identical to SEQ ID NO: 142353

SEQ ID NO: 569192 - RNA, 64 nt, hsa; identical to SEQ ID NO: 142354

SEQ ID NO: 569193 - RNA, 64 nt, hsa; identical to SEQ ID NO: 142355

SEQ ID NO: 569194 - RNA, 64 nt, hsa; identical to SEQ ID NO: 142356

SEQ ID NO: 569195 - RNA, 64 nt, hsa; identical to SEQ ID NO: 142357

SEQ ID NO: 569196 - RNA, 64 nt, hsa; identical to SEQ ID NO: 142358

SEQ ID NO: 569197 - RNA, 64 nt, hsa; identical to SEQ ID NO: 142359

SEQ ID NO: 569198 - RNA, 64 nt, hsa; identical to SEQ ID NO: 142360

SEQ ID NO: 569199 - RNA, 64 nt, hsa; identical to SEQ ID NO: 142361

SEQ ID NO: 569200 - RNA, 64 nt, hsa; identical to SEQ ID NO: 142362

SEQ ID NO: 569201 - RNA, 64 nt, hsa; identical to SEQ ID NO: 142363

SEQ ID NO: 569202 - RNA, 64 nt, hsa; identical to SEQ ID NO: 142364

SEQ ID NO: 569203 - RNA, 64 nt, hsa; identical to SEQ ID NO: 142365

SEQ ID NO: 569204 - RNA, 64 nt, hsa; identical to SEQ ID NO: 142366

SEQ ID NO: 569205 - RNA, 64 nt, hsa; identical to SEQ ID NO: 142367

SEQ ID NO: 569206 - RNA, 64 nt, hsa; identical to SEQ ID NO: 142368

SEQ ID NO: 569207 - RNA, 64 nt, hsa; identical to SEQ ID NO: 142369

SEQ ID NO: 569208 - RNA, 64 nt, hsa; identical to SEQ ID NO: 142370

SEQ ID NO: 569209 - RNA, 64 nt, hsa; identical to SEQ ID NO: 142371

SEQ ID NO: 569210 - RNA, 64 nt, hsa; identical to SEQ ID NO: 142372

SEQ ID NO: 569211 - RNA, 64 nt, hsa; identical to SEQ ID NO: 142373

SEQ ID NO: 569212 - RNA, 64 nt, hsa; identical to SEQ ID NO: 142374

SEQ ID NO: 569213 - RNA, 64 nt, hsa; identical to SEQ ID NO: 142375

SEQ ID NO: 569214 - RNA, 64 nt, hsa; identical to SEQ ID NO: 142376

SEQ ID NO: 569215 - RNA, 64 nt, hsa; identical to SEQ ID NO: 142377

SEQ ID NO: 569216 - RNA, 64 nt, hsa; identical to SEQ ID NO: 142378

SEQ ID NO: 569217 - RNA, 64 nt, hsa; identical to SEQ ID NO: 142379

SEQ ID NO: 569218 - RNA, 64 nt, hsa; identical to SEQ ID NO: 142380

SEQ ID NO: 569219 - RNA, 64 nt, hsa; identical to SEQ ID NO: 142381

SEQ ID NO: 569220 - RNA, 64 nt, hsa; identical to SEQ ID NO: 142382

SEQ ID NO: 569221 - RNA, 64 nt, hsa; identical to SEQ ID NO: 142383

SEQ ID NO: 569222 - RNA, 64 nt, hsa; identical to SEQ ID NO: 142384

SEQ ID NO: 569223 - RNA, 64 nt, hsa; identical to SEQ ID NO: 142385

SEQ ID NO: 569224 - RNA, 64 nt, hsa; identical to SEQ ID NO: 142386

SEQ ID NO: 569225 - RNA, 64 nt, hsa; identical to SEQ ID NO: 142387

SEQ ID NO: 569226 - RNA, 64 nt, hsa; identical to SEQ ID NO: 142388

SEQ ID NO: 569227 - RNA, 64 nt, hsa; identical to SEQ ID NO: 142389

SEQ ID NO: 569228 - RNA, 64 nt, hsa; identical to SEQ ID NO: 142390

SEQ ID NO: 569229 - RNA, 64 nt, hsa; identical to SEQ ID NO: 142391

SEQ ID NO: 569230 - RNA, 64 nt, hsa; identical to SEQ ID NO: 142392

SEQ ID NO: 569231 - RNA, 64 nt, hsa; identical to SEQ ID NO: 142393

SEQ ID NO: 569232 - RNA, 64 nt, hsa; identical to SEQ ID NO: 142394

SEQ ID NO: 569233 - RNA, 61 nt, hsa; identical to SEQ ID NO: 142395

SEQ ID NO: 569234 - RNA, 64 nt, hsa; identical to SEQ ID NO: 142396

SEQ ID NO: 569235 - RNA, 64 nt, hsa; identical to SEQ ID NO: 142397

SEQ ID NO: 569236 - RNA, 64 nt, hsa; identical to SEQ ID NO: 142398

SEQ ID NO: 569237 - RNA, 64 nt, hsa; identical to SEQ ID NO: 142399

SEQ ID NO: 569238 - RNA, 64 nt, hsa; identical to SEQ ID NO: 142400

SEQ ID NO: 569239 - RNA, 64 nt, hsa; identical to SEQ ID NO: 142401

SEQ ID NO: 569240 - RNA, 64 nt, hsa; identical to SEQ ID NO: 142402

SEQ ID NO: 569241 - RNA, 64 nt, hsa; identical to SEQ ID NO: 142403

SEQ ID NO: 569242 - RNA, 64 nt, hsa; identical to SEQ ID NO: 142404

SEQ ID NO: 569243 - RNA, 64 nt, hsa; identical to SEQ ID NO: 142405

SEQ ID NO: 569244 - RNA, 64 nt, hsa; identical to SEQ ID NO: 142406

SEQ ID NO: 569245 - RNA, 64 nt, hsa; identical to SEQ ID NO: 142407

SEQ ID NO: 569246 - RNA, 64 nt, hsa; identical to SEQ ID NO: 142408

SEQ ID NO: 569247 - RNA, 64 nt, hsa; identical to SEQ ID NO: 142409

SEQ ID NO: 569248 - RNA, 64 nt, hsa; identical to SEQ ID NO: 142410

SEQ ID NO: 569249 - RNA, 64 nt, hsa; identical to SEQ ID NO: 142411

SEQ ID NO: 569250 - RNA, 64 nt, hsa; identical to SEQ ID NO: 142412

SEQ ID NO: 569251 - RNA, 64 nt, hsa; identical to SEQ ID NO: 142413

SEQ ID NO: 569252 - RNA, 64 nt, hsa; identical to SEQ ID NO: 142414

SEQ ID NO: 569253 - RNA, 64 nt, hsa; identical to SEQ ID NO: 142415

SEQ ID NO: 569254 - RNA, 64 nt, hsa; identical to SEQ ID NO: 142416

SEQ ID NO: 569255 - RNA, 64 nt, hsa; identical to SEQ ID NO: 142417

SEQ ID NO: 569256 - RNA, 64 nt, hsa; identical to SEQ ID NO: 142418

SEQ ID NO: 569257 - RNA, 64 nt, hsa; identical to SEQ ID NO: 142419

SEQ ID NO: 569258 - RNA, 64 nt, hsa; identical to SEQ ID NO: 142420

SEQ ID NO: 569259 - RNA, 64 nt, hsa; identical to SEQ ID NO: 142421

SEQ ID NO: 569260 - RNA, 64 nt, hsa; identical to SEQ ID NO: 142422

SEQ ID NO: 569261 - RNA, 64 nt, hsa; identical to SEQ ID NO: 142423

SEQ ID NO: 569262 - RNA, 64 nt, hsa; identical to SEQ ID NO: 142424

SEQ ID NO: 569263 - RNA, 64 nt, hsa; identical to SEQ ID NO: 142425

SEQ ID NO: 569264 - RNA, 64 nt, hsa; identical to SEQ ID NO: 142426

SEQ ID NO: 569265 - RNA, 64 nt, hsa; identical to SEQ ID NO: 142427

SEQ ID NO: 569266 - RNA, 64 nt, hsa; identical to SEQ ID NO: 142428

SEQ ID NO: 569267 - RNA, 64 nt, hsa; identical to SEQ ID NO: 142429

SEQ ID NO: 569268 - RNA, 64 nt, hsa; identical to SEQ ID NO: 142430

SEQ ID NO: 569269 - RNA, 64 nt, hsa; identical to SEQ ID NO: 142431

SEQ ID NO: 569270 - RNA, 64 nt, hsa; identical to SEQ ID NO: 142432

SEQ ID NO: 569271 - RNA, 64 nt, hsa; identical to SEQ ID NO: 142433

SEQ ID NO: 569272 - RNA, 64 nt, hsa; identical to SEQ ID NO: 142434

SEQ ID NO: 569273 - RNA, 64 nt, hsa; identical to SEQ ID NO: 142435

SEQ ID NO: 569274 - RNA, 64 nt, hsa; identical to SEQ ID NO: 142436

SEQ ID NO: 569275 - RNA, 64 nt, hsa; identical to SEQ ID NO: 142437

SEQ ID NO: 569276 - RNA, 64 nt, hsa; identical to SEQ ID NO: 142438

SEQ ID NO: 569277 - RNA, 64 nt, hsa; identical to SEQ ID NO: 142439

SEQ ID NO: 569278 - RNA, 64 nt, hsa; identical to SEQ ID NO: 142440

SEQ ID NO: 569279 - RNA, 64 nt, hsa; identical to SEQ ID NO: 142441

SEQ ID NO: 569280 - RNA, 64 nt, hsa; identical to SEQ ID NO: 142442

SEQ ID NO: 569281 - RNA, 64 nt, hsa; identical to SEQ ID NO: 142443

SEQ ID NO: 569282 - RNA, 64 nt, hsa; identical to SEQ ID NO: 142444

SEQ ID NO: 569283 - RNA, 64 nt, hsa; identical to SEQ ID NO: 142445

SEQ ID NO: 569284 - RNA, 64 nt, hsa; identical to SEQ ID NO: 142446

SEQ ID NO: 569285 - RNA, 56 nt, hsa; identical to SEQ ID NO: 142447

SEQ ID NO: 569286 - RNA, 64 nt, hsa; identical to SEQ ID NO: 142448

SEQ ID NO: 569287 - RNA, 64 nt, hsa; identical to SEQ ID NO: 142449

SEQ ID NO: 569288 - RNA, 64 nt, hsa; identical to SEQ ID NO: 142450

SEQ ID NO: 569289 - RNA, 64 nt, hsa; identical to SEQ ID NO: 142451

SEQ ID NO: 569290 - RNA, 64 nt, hsa; identical to SEQ ID NO: 142452

SEQ ID NO: 569291 - RNA, 64 nt, hsa; identical to SEQ ID NO: 142453

SEQ ID NO: 569292 - RNA, 64 nt, hsa; identical to SEQ ID NO: 142454

SEQ ID NO: 569293 - RNA, 64 nt, hsa; identical to SEQ ID NO: 142455

SEQ ID NO: 569294 - RNA, 64 nt, hsa; identical to SEQ ID NO: 142456

SEQ ID NO: 569295 - RNA, 64 nt, hsa; identical to SEQ ID NO: 142457

SEQ ID NO: 569296 - RNA, 64 nt, hsa; identical to SEQ ID NO: 142458

SEQ ID NO: 569297 - RNA, 64 nt, hsa; identical to SEQ ID NO: 142459

SEQ ID NO: 569298 - RNA, 64 nt, hsa; identical to SEQ ID NO: 142460

SEQ ID NO: 569299 - RNA, 64 nt, hsa; identical to SEQ ID NO: 142461

SEQ ID NO: 569300 - RNA, 64 nt, hsa; identical to SEQ ID NO: 142462

SEQ ID NO: 569301 - RNA, 64 nt, hsa; identical to SEQ ID NO: 142463

SEQ ID NO: 569302 - RNA, 64 nt, hsa; identical to SEQ ID NO: 142464

SEQ ID NO: 569303 - RNA, 64 nt, hsa; identical to SEQ ID NO: 142465

SEQ ID NO: 569304 - RNA, 64 nt, hsa; identical to SEQ ID NO: 142466

SEQ ID NO: 569305 - RNA, 64 nt, hsa; identical to SEQ ID NO: 142467

SEQ ID NO: 569306 - RNA, 64 nt, hsa; identical to SEQ ID NO: 142468

SEQ ID NO: 569307 - RNA, 64 nt, hsa; identical to SEQ ID NO: 142469

SEQ ID NO: 569308 - RNA, 64 nt, hsa; identical to SEQ ID NO: 142470

SEQ ID NO: 569309 - RNA, 64 nt, hsa; identical to SEQ ID NO: 142471

SEQ ID NO: 569310 - RNA, 64 nt, hsa; identical to SEQ ID NO: 142472

SEQ ID NO: 569311 - RNA, 64 nt, hsa; identical to SEQ ID NO: 142473

SEQ ID NO: 569312 - RNA, 64 nt, hsa; identical to SEQ ID NO: 142474

SEQ ID NO: 569313 - RNA, 64 nt, hsa; identical to SEQ ID NO: 142475

SEQ ID NO: 569314 - RNA, 64 nt, hsa; identical to SEQ ID NO: 142476

SEQ ID NO: 569315 - RNA, 64 nt, hsa; identical to SEQ ID NO: 142477

SEQ ID NO: 569316 - RNA, 64 nt, hsa; identical to SEQ ID NO: 142478

SEQ ID NO: 569317 - RNA, 64 nt, hsa; identical to SEQ ID NO: 142479

SEQ ID NO: 569318 - RNA, 64 nt, hsa; identical to SEQ ID NO: 142480

SEQ ID NO: 569319 - RNA, 64 nt, hsa; identical to SEQ ID NO: 142481

SEQ ID NO: 569320 - RNA, 64 nt, hsa; identical to SEQ ID NO: 142482

SEQ ID NO: 569321 - RNA, 64 nt, hsa; identical to SEQ ID NO: 142483

SEQ ID NO: 569322 - RNA, 64 nt, hsa; identical to SEQ ID NO: 142484

SEQ ID NO: 569323 - RNA, 64 nt, hsa; identical to SEQ ID NO: 142485

SEQ ID NO: 569324 - RNA, 64 nt, hsa; identical to SEQ ID NO: 142486

SEQ ID NO: 569325 - RNA, 64 nt, hsa; identical to SEQ ID NO: 142487

SEQ ID NO: 569326 - RNA, 64 nt, hsa; identical to SEQ ID NO: 142488

SEQ ID NO: 569327 - RNA, 64 nt, hsa; identical to SEQ ID NO: 142489

SEQ ID NO: 569328 - RNA, 64 nt, hsa; identical to SEQ ID NO: 142490

SEQ ID NO: 569329 - RNA, 64 nt, hsa; identical to SEQ ID NO: 142491

SEQ ID NO: 569330 - RNA, 64 nt, hsa; identical to SEQ ID NO: 142492

SEQ ID NO: 569331 - RNA, 64 nt, hsa; identical to SEQ ID NO: 142493

SEQ ID NO: 569332 - RNA, 64 nt, hsa; identical to SEQ ID NO: 142494

SEQ ID NO: 569333 - RNA, 64 nt, hsa; identical to SEQ ID NO: 142495

SEQ ID NO: 569334 - RNA, 64 nt, hsa; identical to SEQ ID NO: 142496

SEQ ID NO: 569335 - RNA, 64 nt, hsa; identical to SEQ ID NO: 142497

SEQ ID NO: 569336 - RNA, 64 nt, hsa; identical to SEQ ID NO: 142498

SEQ ID NO: 569337 - RNA, 64 nt, hsa; identical to SEQ ID NO: 142499

SEQ ID NO: 569338 - RNA, 64 nt, hsa; identical to SEQ ID NO: 142500

SEQ ID NO: 569339 - RNA, 64 nt, hsa; identical to SEQ ID NO: 142501

SEQ ID NO: 569340 - RNA, 64 nt, hsa; identical to SEQ ID NO: 142502

SEQ ID NO: 569341 - RNA, 64 nt, hsa; identical to SEQ ID NO: 142503

SEQ ID NO: 569342 - RNA, 64 nt, hsa; identical to SEQ ID NO: 142504

SEQ ID NO: 569343 - RNA, 64 nt, hsa; identical to SEQ ID NO: 142505

SEQ ID NO: 569344 - RNA, 64 nt, hsa; identical to SEQ ID NO: 142506

SEQ ID NO: 569345 - RNA, 64 nt, hsa; identical to SEQ ID NO: 142507

SEQ ID NO: 569346 - RNA, 64 nt, hsa; identical to SEQ ID NO: 142508

SEQ ID NO: 569347 - RNA, 64 nt, hsa; identical to SEQ ID NO: 142509

SEQ ID NO: 569348 - RNA, 64 nt, hsa; identical to SEQ ID NO: 142510

SEQ ID NO: 569349 - RNA, 64 nt, hsa; identical to SEQ ID NO: 142511

SEQ ID NO: 569350 - RNA, 64 nt, hsa; identical to SEQ ID NO: 142512

SEQ ID NO: 569351 - RNA, 64 nt, hsa; identical to SEQ ID NO: 142513

SEQ ID NO: 569352 - RNA, 64 nt, hsa; identical to SEQ ID NO: 142514

SEQ ID NO: 569353 - RNA, 64 nt, hsa; identical to SEQ ID NO: 142515

SEQ ID NO: 569354 - RNA, 64 nt, hsa; identical to SEQ ID NO: 142516

SEQ ID NO: 569355 - RNA, 64 nt, hsa; identical to SEQ ID NO: 142517

SEQ ID NO: 569356 - RNA, 64 nt, hsa; identical to SEQ ID NO: 142518

SEQ ID NO: 569357 - RNA, 64 nt, hsa; identical to SEQ ID NO: 142519

SEQ ID NO: 569358 - RNA, 64 nt, hsa; identical to SEQ ID NO: 142520

SEQ ID NO: 569359 - RNA, 64 nt, hsa; identical to SEQ ID NO: 142521

SEQ ID NO: 569360 - RNA, 64 nt, hsa; identical to SEQ ID NO: 142522

SEQ ID NO: 569361 - RNA, 64 nt, hsa; identical to SEQ ID NO: 142523

SEQ ID NO: 569362 - RNA, 64 nt, hsa; identical to SEQ ID NO: 142524

SEQ ID NO: 569363 - RNA, 64 nt, hsa; identical to SEQ ID NO: 142525

SEQ ID NO: 569364 - RNA, 64 nt, hsa; identical to SEQ ID NO: 142526

SEQ ID NO: 569365 - RNA, 64 nt, hsa; identical to SEQ ID NO: 142527

SEQ ID NO: 569366 - RNA, 64 nt, hsa; identical to SEQ ID NO: 142528

SEQ ID NO: 569367 - RNA, 64 nt, hsa; identical to SEQ ID NO: 142529

SEQ ID NO: 569368 - RNA, 64 nt, hsa; identical to SEQ ID NO: 142530

SEQ ID NO: 569369 - RNA, 64 nt, hsa; identical to SEQ ID NO: 142531

SEQ ID NO: 569370 - RNA, 64 nt, hsa; identical to SEQ ID NO: 142532

SEQ ID NO: 569371 - RNA, 64 nt, hsa; identical to SEQ ID NO: 142533

SEQ ID NO: 569372 - RNA, 64 nt, hsa; identical to SEQ ID NO: 142534

SEQ ID NO: 569373 - RNA, 64 nt, hsa; identical to SEQ ID NO: 142535

SEQ ID NO: 569374 - RNA, 64 nt, hsa; identical to SEQ ID NO: 142536

SEQ ID NO: 569375 - RNA, 64 nt, hsa; identical to SEQ ID NO: 142537

SEQ ID NO: 569376 - RNA, 64 nt, hsa; identical to SEQ ID NO: 142538

SEQ ID NO: 569377 - RNA, 64 nt, hsa; identical to SEQ ID NO: 142539

SEQ ID NO: 569378 - RNA, 64 nt, hsa; identical to SEQ ID NO: 142540

SEQ ID NO: 569379 - RNA, 64 nt, hsa; identical to SEQ ID NO: 142541

SEQ ID NO: 569380 - RNA, 59 nt, hsa; identical to SEQ ID NO: 142542

SEQ ID NO: 569381 - RNA, 64 nt, hsa; identical to SEQ ID NO: 142543

SEQ ID NO: 569382 - RNA, 64 nt, hsa; identical to SEQ ID NO: 142544

SEQ ID NO: 569383 - RNA, 64 nt, hsa; identical to SEQ ID NO: 142545

SEQ ID NO: 569384 - RNA, 64 nt, hsa; identical to SEQ ID NO: 142546

SEQ ID NO: 569385 - RNA, 64 nt, hsa; identical to SEQ ID NO: 142547

SEQ ID NO: 569386 - RNA, 64 nt, hsa; identical to SEQ ID NO: 142548

SEQ ID NO: 569387 - RNA, 64 nt, hsa; identical to SEQ ID NO: 142549

SEQ ID NO: 569388 - RNA, 64 nt, hsa; identical to SEQ ID NO: 142550

SEQ ID NO: 569389 - RNA, 64 nt, hsa; identical to SEQ ID NO: 142551

SEQ ID NO: 569390 - RNA, 64 nt, hsa; identical to SEQ ID NO: 142552

SEQ ID NO: 569391 - RNA, 64 nt, hsa; identical to SEQ ID NO: 142553

SEQ ID NO: 569392 - RNA, 64 nt, hsa; identical to SEQ ID NO: 142554

SEQ ID NO: 569393 - RNA, 64 nt, hsa; identical to SEQ ID NO: 142555

SEQ ID NO: 569394 - RNA, 64 nt, hsa; identical to SEQ ID NO: 142556

SEQ ID NO: 569395 - RNA, 64 nt, hsa; identical to SEQ ID NO: 142557

SEQ ID NO: 569396 - RNA, 64 nt, hsa; identical to SEQ ID NO: 142558

SEQ ID NO: 569397 - RNA, 64 nt, hsa; identical to SEQ ID NO: 142559

SEQ ID NO: 569398 - RNA, 64 nt, hsa; identical to SEQ ID NO: 142560

SEQ ID NO: 569399 - RNA, 64 nt, hsa; identical to SEQ ID NO: 142561

SEQ ID NO: 569400 - RNA, 64 nt, hsa; identical to SEQ ID NO: 142562

SEQ ID NO: 569401 - RNA, 64 nt, hsa; identical to SEQ ID NO: 142563

SEQ ID NO: 569402 - RNA, 64 nt, hsa; identical to SEQ ID NO: 142564

SEQ ID NO: 569403 - RNA, 64 nt, hsa; identical to SEQ ID NO: 142565

SEQ ID NO: 569404 - RNA, 64 nt, hsa; identical to SEQ ID NO: 142566

SEQ ID NO: 569405 - RNA, 64 nt, hsa; identical to SEQ ID NO: 142567

SEQ ID NO: 569406 - RNA, 64 nt, hsa; identical to SEQ ID NO: 142568

SEQ ID NO: 569407 - RNA, 64 nt, hsa; identical to SEQ ID NO: 142569

SEQ ID NO: 569408 - RNA, 64 nt, hsa; identical to SEQ ID NO: 142570

SEQ ID NO: 569409 - RNA, 64 nt, hsa; identical to SEQ ID NO: 142571

SEQ ID NO: 569410 - RNA, 64 nt, hsa; identical to SEQ ID NO: 142572

SEQ ID NO: 569411 - RNA, 64 nt, hsa; identical to SEQ ID NO: 142573

SEQ ID NO: 569412 - RNA, 64 nt, hsa; identical to SEQ ID NO: 142574

SEQ ID NO: 569413 - RNA, 64 nt, hsa; identical to SEQ ID NO: 142575

SEQ ID NO: 569414 - RNA, 64 nt, hsa; identical to SEQ ID NO: 142576

SEQ ID NO: 569415 - RNA, 64 nt, hsa; identical to SEQ ID NO: 142577

SEQ ID NO: 569416 - RNA, 64 nt, hsa; identical to SEQ ID NO: 142578

SEQ ID NO: 569417 - RNA, 64 nt, hsa; identical to SEQ ID NO: 142579

SEQ ID NO: 569418 - RNA, 64 nt, hsa; identical to SEQ ID NO: 142580

SEQ ID NO: 569419 - RNA, 64 nt, hsa; identical to SEQ ID NO: 142581

SEQ ID NO: 569420 - RNA, 64 nt, hsa; identical to SEQ ID NO: 142582

SEQ ID NO: 569421 - RNA, 64 nt, hsa; identical to SEQ ID NO: 142583

SEQ ID NO: 569422 - RNA, 55 nt, hsa; identical to SEQ ID NO: 142584

SEQ ID NO: 569423 - RNA, 64 nt, hsa; identical to SEQ ID NO: 142585

SEQ ID NO: 569424 - RNA, 64 nt, hsa; identical to SEQ ID NO: 142586

SEQ ID NO: 569425 - RNA, 64 nt, hsa; identical to SEQ ID NO: 142587

SEQ ID NO: 569426 - RNA, 64 nt, hsa; identical to SEQ ID NO: 142588

SEQ ID NO: 569427 - RNA, 64 nt, hsa; identical to SEQ ID NO: 142589

SEQ ID NO: 569428 - RNA, 64 nt, hsa; identical to SEQ ID NO: 142590

SEQ ID NO: 569429 - RNA, 64 nt, hsa; identical to SEQ ID NO: 142591

SEQ ID NO: 569430 - RNA, 64 nt, hsa; identical to SEQ ID NO: 142592

SEQ ID NO: 569431 - RNA, 64 nt, hsa; identical to SEQ ID NO: 142593

SEQ ID NO: 569432 - RNA, 64 nt, hsa; identical to SEQ ID NO: 142594

SEQ ID NO: 569433 - RNA, 64 nt, hsa; identical to SEQ ID NO: 142595

SEQ ID NO: 569434 - RNA, 64 nt, hsa; identical to SEQ ID NO: 142596

SEQ ID NO: 569435 - RNA, 64 nt, hsa; identical to SEQ ID NO: 142597

SEQ ID NO: 569436 - RNA, 64 nt, hsa; identical to SEQ ID NO: 142598

SEQ ID NO: 569437 - RNA, 64 nt, hsa; identical to SEQ ID NO: 142599

SEQ ID NO: 569438 - RNA, 64 nt, hsa; identical to SEQ ID NO: 142600

SEQ ID NO: 569439 - RNA, 64 nt, hsa; identical to SEQ ID NO: 142601

SEQ ID NO: 569440 - RNA, 64 nt, hsa; identical to SEQ ID NO: 142602

SEQ ID NO: 569441 - RNA, 64 nt, hsa; identical to SEQ ID NO: 142603

SEQ ID NO: 569442 - RNA, 64 nt, hsa; identical to SEQ ID NO: 142604

SEQ ID NO: 569443 - RNA, 64 nt, hsa; identical to SEQ ID NO: 142605

SEQ ID NO: 569444 - RNA, 64 nt, hsa; identical to SEQ ID NO: 142606

SEQ ID NO: 569445 - RNA, 64 nt, hsa; identical to SEQ ID NO: 142607

SEQ ID NO: 569446 - RNA, 64 nt, hsa; identical to SEQ ID NO: 142608

SEQ ID NO: 569447 - RNA, 64 nt, hsa; identical to SEQ ID NO: 142609

SEQ ID NO: 569448 - RNA, 64 nt, hsa; identical to SEQ ID NO: 142610

SEQ ID NO: 569449 - RNA, 64 nt, hsa; identical to SEQ ID NO: 142611

SEQ ID NO: 569450 - RNA, 64 nt, hsa; identical to SEQ ID NO: 142612

SEQ ID NO: 569451 - RNA, 64 nt, hsa; identical to SEQ ID NO: 142613

SEQ ID NO: 569452 - RNA, 64 nt, hsa; identical to SEQ ID NO: 142614

SEQ ID NO: 569453 - RNA, 64 nt, hsa; identical to SEQ ID NO: 142615

SEQ ID NO: 569454 - RNA, 64 nt, hsa; identical to SEQ ID NO: 142616

SEQ ID NO: 569455 - RNA, 64 nt, hsa; identical to SEQ ID NO: 142617

SEQ ID NO: 569456 - RNA, 64 nt, hsa; identical to SEQ ID NO: 142618

SEQ ID NO: 569457 - RNA, 64 nt, hsa; identical to SEQ ID NO: 142619

SEQ ID NO: 569458 - RNA, 64 nt, hsa; identical to SEQ ID NO: 142620

SEQ ID NO: 569459 - RNA, 64 nt, hsa; identical to SEQ ID NO: 142621

SEQ ID NO: 569460 - RNA, 64 nt, hsa; identical to SEQ ID NO: 142622

SEQ ID NO: 569461 - RNA, 64 nt, hsa; identical to SEQ ID NO: 142623

SEQ ID NO: 569462 - RNA, 64 nt, hsa; identical to SEQ ID NO: 142624

SEQ ID NO: 569463 - RNA, 64 nt, hsa; identical to SEQ ID NO: 142625

SEQ ID NO: 569464 - RNA, 64 nt, hsa; identical to SEQ ID NO: 142626

SEQ ID NO: 569465 - RNA, 64 nt, hsa; identical to SEQ ID NO: 142627

SEQ ID NO: 569466 - RNA, 64 nt, hsa; identical to SEQ ID NO: 142628

SEQ ID NO: 569467 - RNA, 64 nt, hsa; identical to SEQ ID NO: 142629

SEQ ID NO: 569468 - RNA, 64 nt, hsa; identical to SEQ ID NO: 142630

SEQ ID NO: 569469 - RNA, 64 nt, hsa; identical to SEQ ID NO: 142631

SEQ ID NO: 569470 - RNA, 64 nt, hsa; identical to SEQ ID NO: 142632

SEQ ID NO: 569471 - RNA, 64 nt, hsa; identical to SEQ ID NO: 142633

SEQ ID NO: 569472 - RNA, 64 nt, hsa; identical to SEQ ID NO: 142634

SEQ ID NO: 569473 - RNA, 64 nt, hsa; identical to SEQ ID NO: 142635

SEQ ID NO: 569474 - RNA, 64 nt, hsa; identical to SEQ ID NO: 142636

SEQ ID NO: 569475 - RNA, 64 nt, hsa; identical to SEQ ID NO: 142637

SEQ ID NO: 569476 - RNA, 64 nt, hsa; identical to SEQ ID NO: 142638

SEQ ID NO: 569477 - RNA, 64 nt, hsa; identical to SEQ ID NO: 142639

SEQ ID NO: 569478 - RNA, 64 nt, hsa; identical to SEQ ID NO: 142640

SEQ ID NO: 569479 - RNA, 64 nt, hsa; identical to SEQ ID NO: 142641

SEQ ID NO: 569480 - RNA, 64 nt, hsa; identical to SEQ ID NO: 142642

SEQ ID NO: 569481 - RNA, 64 nt, hsa; identical to SEQ ID NO: 142643

SEQ ID NO: 569482 - RNA, 64 nt, hsa; identical to SEQ ID NO: 142644

SEQ ID NO: 569483 - RNA, 64 nt, hsa; identical to SEQ ID NO: 142645

SEQ ID NO: 569484 - RNA, 64 nt, hsa; identical to SEQ ID NO: 142646

SEQ ID NO: 569485 - RNA, 64 nt, hsa; identical to SEQ ID NO: 142647

SEQ ID NO: 569486 - RNA, 64 nt, hsa; identical to SEQ ID NO: 142648

SEQ ID NO: 569487 - RNA, 64 nt, hsa; identical to SEQ ID NO: 142649

SEQ ID NO: 569488 - RNA, 64 nt, hsa; identical to SEQ ID NO: 142650

SEQ ID NO: 569489 - RNA, 64 nt, hsa; identical to SEQ ID NO: 142651

SEQ ID NO: 569490 - RNA, 64 nt, hsa; identical to SEQ ID NO: 142652

SEQ ID NO: 569491 - RNA, 64 nt, hsa; identical to SEQ ID NO: 142653

SEQ ID NO: 569492 - RNA, 64 nt, hsa; identical to SEQ ID NO: 142654

SEQ ID NO: 569493 - RNA, 64 nt, hsa; identical to SEQ ID NO: 142655

SEQ ID NO: 569494 - RNA, 64 nt, hsa; identical to SEQ ID NO: 142656

SEQ ID NO: 569495 - RNA, 64 nt, hsa; identical to SEQ ID NO: 142657

SEQ ID NO: 569496 - RNA, 64 nt, hsa; identical to SEQ ID NO: 142658

SEQ ID NO: 569497 - RNA, 64 nt, hsa; identical to SEQ ID NO: 142659

SEQ ID NO: 569498 - RNA, 64 nt, hsa; identical to SEQ ID NO: 142660

SEQ ID NO: 569499 - RNA, 64 nt, hsa; identical to SEQ ID NO: 142661

SEQ ID NO: 569500 - RNA, 64 nt, hsa; identical to SEQ ID NO: 142662

SEQ ID NO: 569501 - RNA, 64 nt, hsa; identical to SEQ ID NO: 142663

SEQ ID NO: 569502 - RNA, 64 nt, hsa; identical to SEQ ID NO: 142664

SEQ ID NO: 569503 - RNA, 64 nt, hsa; identical to SEQ ID NO: 142665

SEQ ID NO: 569504 - RNA, 64 nt, hsa; identical to SEQ ID NO: 142666

SEQ ID NO: 569505 - RNA, 64 nt, hsa; identical to SEQ ID NO: 142667

SEQ ID NO: 569506 - RNA, 64 nt, hsa; identical to SEQ ID NO: 142668

SEQ ID NO: 569507 - RNA, 64 nt, hsa; identical to SEQ ID NO: 142669

SEQ ID NO: 569508 - RNA, 64 nt, hsa; identical to SEQ ID NO: 142670

SEQ ID NO: 569509 - RNA, 64 nt, hsa; identical to SEQ ID NO: 142671

SEQ ID NO: 569510 - RNA, 64 nt, hsa; identical to SEQ ID NO: 142672

SEQ ID NO: 569511 - RNA, 64 nt, hsa; identical to SEQ ID NO: 142673

SEQ ID NO: 569512 - RNA, 64 nt, hsa; identical to SEQ ID NO: 142674

SEQ ID NO: 569513 - RNA, 64 nt, hsa; identical to SEQ ID NO: 142675

SEQ ID NO: 569514 - RNA, 64 nt, hsa; identical to SEQ ID NO: 142676

SEQ ID NO: 569515 - RNA, 64 nt, hsa; identical to SEQ ID NO: 142677

SEQ ID NO: 569516 - RNA, 64 nt, hsa; identical to SEQ ID NO: 142678

SEQ ID NO: 569517 - RNA, 64 nt, hsa; identical to SEQ ID NO: 142679

SEQ ID NO: 569518 - RNA, 64 nt, hsa; identical to SEQ ID NO: 142680

SEQ ID NO: 569519 - RNA, 64 nt, hsa; identical to SEQ ID NO: 142681

SEQ ID NO: 569520 - RNA, 64 nt, hsa; identical to SEQ ID NO: 142682

SEQ ID NO: 569521 - RNA, 64 nt, hsa; identical to SEQ ID NO: 142683

SEQ ID NO: 569522 - RNA, 64 nt, hsa; identical to SEQ ID NO: 142684

SEQ ID NO: 569523 - RNA, 64 nt, hsa; identical to SEQ ID NO: 142685

SEQ ID NO: 569524 - RNA, 64 nt, hsa; identical to SEQ ID NO: 142686

SEQ ID NO: 569525 - RNA, 64 nt, hsa; identical to SEQ ID NO: 142687

SEQ ID NO: 569526 - RNA, 64 nt, hsa; identical to SEQ ID NO: 142688

SEQ ID NO: 569527 - RNA, 64 nt, hsa; identical to SEQ ID NO: 142689

SEQ ID NO: 569528 - RNA, 64 nt, hsa; identical to SEQ ID NO: 142690

SEQ ID NO: 569529 - RNA, 64 nt, hsa; identical to SEQ ID NO: 142691

SEQ ID NO: 569530 - RNA, 64 nt, hsa; identical to SEQ ID NO: 142692

SEQ ID NO: 569531 - RNA, 64 nt, hsa; identical to SEQ ID NO: 142693

SEQ ID NO: 569532 - RNA, 64 nt, hsa; identical to SEQ ID NO: 142694

SEQ ID NO: 569533 - RNA, 64 nt, hsa; identical to SEQ ID NO: 142695

SEQ ID NO: 569534 - RNA, 64 nt, hsa; identical to SEQ ID NO: 142696

SEQ ID NO: 569535 - RNA, 64 nt, hsa; identical to SEQ ID NO: 142697

SEQ ID NO: 569536 - RNA, 64 nt, hsa; identical to SEQ ID NO: 142698

SEQ ID NO: 569537 - RNA, 64 nt, hsa; identical to SEQ ID NO: 142699

SEQ ID NO: 569538 - RNA, 64 nt, hsa; identical to SEQ ID NO: 142700

SEQ ID NO: 569539 - RNA, 64 nt, hsa; identical to SEQ ID NO: 142701

SEQ ID NO: 569540 - RNA, 64 nt, hsa; identical to SEQ ID NO: 142702

SEQ ID NO: 569541 - RNA, 64 nt, hsa; identical to SEQ ID NO: 142703

SEQ ID NO: 569542 - RNA, 64 nt, hsa; identical to SEQ ID NO: 142704

SEQ ID NO: 569543 - RNA, 64 nt, hsa; identical to SEQ ID NO: 142705

SEQ ID NO: 569544 - RNA, 64 nt, hsa; identical to SEQ ID NO: 142706

SEQ ID NO: 569545 - RNA, 64 nt, hsa; identical to SEQ ID NO: 142707

SEQ ID NO: 569546 - RNA, 64 nt, hsa; identical to SEQ ID NO: 142708

SEQ ID NO: 569547 - RNA, 64 nt, hsa; identical to SEQ ID NO: 142709

SEQ ID NO: 569548 - RNA, 64 nt, hsa; identical to SEQ ID NO: 142710

SEQ ID NO: 569549 - RNA, 64 nt, hsa; identical to SEQ ID NO: 142711

SEQ ID NO: 569550 - RNA, 64 nt, hsa; identical to SEQ ID NO: 142712

SEQ ID NO: 569551 - RNA, 64 nt, hsa; identical to SEQ ID NO: 142713

SEQ ID NO: 569552 - RNA, 64 nt, hsa; identical to SEQ ID NO: 142714

SEQ ID NO: 569553 - RNA, 64 nt, hsa; identical to SEQ ID NO: 142715

SEQ ID NO: 569554 - RNA, 64 nt, hsa; identical to SEQ ID NO: 142716

SEQ ID NO: 569555 - RNA, 64 nt, hsa; identical to SEQ ID NO: 142717

SEQ ID NO: 569556 - RNA, 64 nt, hsa; identical to SEQ ID NO: 142718

SEQ ID NO: 569557 - RNA, 64 nt, hsa; identical to SEQ ID NO: 142719

SEQ ID NO: 569558 - RNA, 64 nt, hsa; identical to SEQ ID NO: 142720

SEQ ID NO: 569559 - RNA, 64 nt, hsa; identical to SEQ ID NO: 142721

SEQ ID NO: 569560 - RNA, 64 nt, hsa; identical to SEQ ID NO: 142722

SEQ ID NO: 569561 - RNA, 64 nt, hsa; identical to SEQ ID NO: 142723

SEQ ID NO: 569562 - RNA, 64 nt, hsa; identical to SEQ ID NO: 142724

SEQ ID NO: 569563 - RNA, 64 nt, hsa; identical to SEQ ID NO: 142725

SEQ ID NO: 569564 - RNA, 64 nt, hsa; identical to SEQ ID NO: 142726

SEQ ID NO: 569565 - RNA, 64 nt, hsa; identical to SEQ ID NO: 142727

SEQ ID NO: 569566 - RNA, 64 nt, hsa; identical to SEQ ID NO: 142728

SEQ ID NO: 569567 - RNA, 64 nt, hsa; identical to SEQ ID NO: 142729

SEQ ID NO: 569568 - RNA, 64 nt, hsa; identical to SEQ ID NO: 142730

SEQ ID NO: 569569 - RNA, 64 nt, hsa; identical to SEQ ID NO: 142731

SEQ ID NO: 569570 - RNA, 64 nt, hsa; identical to SEQ ID NO: 142732

SEQ ID NO: 569571 - RNA, 64 nt, hsa; identical to SEQ ID NO: 142733

SEQ ID NO: 569572 - RNA, 64 nt, hsa; identical to SEQ ID NO: 142734

SEQ ID NO: 569573 - RNA, 64 nt, hsa; identical to SEQ ID NO: 142735

SEQ ID NO: 569574 - RNA, 64 nt, hsa; identical to SEQ ID NO: 142736

SEQ ID NO: 569575 - RNA, 64 nt, hsa; identical to SEQ ID NO: 142737

SEQ ID NO: 569576 - RNA, 64 nt, hsa; identical to SEQ ID NO: 142738

SEQ ID NO: 569577 - RNA, 64 nt, hsa; identical to SEQ ID NO: 142739

SEQ ID NO: 569578 - RNA, 64 nt, hsa; identical to SEQ ID NO: 142740

SEQ ID NO: 569579 - RNA, 64 nt, hsa; identical to SEQ ID NO: 142741

SEQ ID NO: 569580 - RNA, 64 nt, hsa; identical to SEQ ID NO: 142742

SEQ ID NO: 569581 - RNA, 64 nt, hsa; identical to SEQ ID NO: 142743

SEQ ID NO: 569582 - RNA, 64 nt, hsa; identical to SEQ ID NO: 142744

SEQ ID NO: 569583 - RNA, 64 nt, hsa; identical to SEQ ID NO: 142745

SEQ ID NO: 569584 - RNA, 64 nt, hsa; identical to SEQ ID NO: 142746

SEQ ID NO: 569585 - RNA, 64 nt, hsa; identical to SEQ ID NO: 142747

SEQ ID NO: 569586 - RNA, 64 nt, hsa; identical to SEQ ID NO: 142748

SEQ ID NO: 569587 - RNA, 64 nt, hsa; identical to SEQ ID NO: 142749

SEQ ID NO: 569588 - RNA, 64 nt, hsa; identical to SEQ ID NO: 142750

SEQ ID NO: 569589 - RNA, 64 nt, hsa; identical to SEQ ID NO: 142751

SEQ ID NO: 569590 - RNA, 64 nt, hsa; identical to SEQ ID NO: 142752

SEQ ID NO: 569591 - RNA, 64 nt, hsa; identical to SEQ ID NO: 142753

SEQ ID NO: 569592 - RNA, 64 nt, hsa; identical to SEQ ID NO: 142754

SEQ ID NO: 569593 - RNA, 64 nt, hsa; identical to SEQ ID NO: 142755

SEQ ID NO: 569594 - RNA, 64 nt, hsa; identical to SEQ ID NO: 142756

SEQ ID NO: 569595 - RNA, 64 nt, hsa; identical to SEQ ID NO: 142757

SEQ ID NO: 569596 - RNA, 64 nt, hsa; identical to SEQ ID NO: 142758

SEQ ID NO: 569597 - RNA, 64 nt, hsa; identical to SEQ ID NO: 142759

SEQ ID NO: 569598 - RNA, 64 nt, hsa; identical to SEQ ID NO: 142760

SEQ ID NO: 569599 - RNA, 64 nt, hsa; identical to SEQ ID NO: 142761

SEQ ID NO: 569600 - RNA, 64 nt, hsa; identical to SEQ ID NO: 142762

SEQ ID NO: 569601 - RNA, 64 nt, hsa; identical to SEQ ID NO: 142763

SEQ ID NO: 569602 - RNA, 64 nt, hsa; identical to SEQ ID NO: 142764

SEQ ID NO: 569603 - RNA, 64 nt, hsa; identical to SEQ ID NO: 142765

SEQ ID NO: 569604 - RNA, 64 nt, hsa; identical to SEQ ID NO: 142766

SEQ ID NO: 569605 - RNA, 64 nt, hsa; identical to SEQ ID NO: 142767

SEQ ID NO: 569606 - RNA, 64 nt, hsa; identical to SEQ ID NO: 142768

SEQ ID NO: 569607 - RNA, 64 nt, hsa; identical to SEQ ID NO: 142769

SEQ ID NO: 569608 - RNA, 64 nt, hsa; identical to SEQ ID NO: 142770

SEQ ID NO: 569609 - RNA, 64 nt, hsa; identical to SEQ ID NO: 142771

SEQ ID NO: 569610 - RNA, 64 nt, hsa; identical to SEQ ID NO: 142772

SEQ ID NO: 569611 - RNA, 64 nt, hsa; identical to SEQ ID NO: 142773

SEQ ID NO: 569612 - RNA, 64 nt, hsa; identical to SEQ ID NO: 142774

SEQ ID NO: 569613 - RNA, 64 nt, hsa; identical to SEQ ID NO: 142775

SEQ ID NO: 569614 - RNA, 64 nt, hsa; identical to SEQ ID NO: 142776

SEQ ID NO: 569615 - RNA, 64 nt, hsa; identical to SEQ ID NO: 142777

SEQ ID NO: 569616 - RNA, 64 nt, hsa; identical to SEQ ID NO: 142778

SEQ ID NO: 569617 - RNA, 64 nt, hsa; identical to SEQ ID NO: 142779

SEQ ID NO: 569618 - RNA, 64 nt, hsa; identical to SEQ ID NO: 142780

SEQ ID NO: 569619 - RNA, 64 nt, hsa; identical to SEQ ID NO: 142781

SEQ ID NO: 569620 - RNA, 64 nt, hsa; identical to SEQ ID NO: 142782

SEQ ID NO: 569621 - RNA, 64 nt, hsa; identical to SEQ ID NO: 142783

SEQ ID NO: 569622 - RNA, 64 nt, hsa; identical to SEQ ID NO: 142784

SEQ ID NO: 569623 - RNA, 64 nt, hsa; identical to SEQ ID NO: 142785

SEQ ID NO: 569624 - RNA, 64 nt, hsa; identical to SEQ ID NO: 142786

SEQ ID NO: 569625 - RNA, 64 nt, hsa; identical to SEQ ID NO: 142787

SEQ ID NO: 569626 - RNA, 64 nt, hsa; identical to SEQ ID NO: 142788

SEQ ID NO: 569627 - RNA, 64 nt, hsa; identical to SEQ ID NO: 142789

SEQ ID NO: 569628 - RNA, 64 nt, hsa; identical to SEQ ID NO: 142790

SEQ ID NO: 569629 - RNA, 64 nt, hsa; identical to SEQ ID NO: 142791

SEQ ID NO: 569630 - RNA, 64 nt, hsa; identical to SEQ ID NO: 142792

SEQ ID NO: 569631 - RNA, 64 nt, hsa; identical to SEQ ID NO: 142793

SEQ ID NO: 569632 - RNA, 64 nt, hsa; identical to SEQ ID NO: 142794

SEQ ID NO: 569633 - RNA, 64 nt, hsa; identical to SEQ ID NO: 142795

SEQ ID NO: 569634 - RNA, 64 nt, hsa; identical to SEQ ID NO: 142796

SEQ ID NO: 569635 - RNA, 64 nt, hsa; identical to SEQ ID NO: 142797

SEQ ID NO: 569636 - RNA, 64 nt, hsa; identical to SEQ ID NO: 142798

SEQ ID NO: 569637 - RNA, 64 nt, hsa; identical to SEQ ID NO: 142799

SEQ ID NO: 569638 - RNA, 64 nt, hsa; identical to SEQ ID NO: 142800

SEQ ID NO: 569639 - RNA, 64 nt, hsa; identical to SEQ ID NO: 142801

SEQ ID NO: 569640 - RNA, 64 nt, hsa; identical to SEQ ID NO: 142802

SEQ ID NO: 569641 - RNA, 64 nt, hsa; identical to SEQ ID NO: 142803

SEQ ID NO: 569642 - RNA, 64 nt, hsa; identical to SEQ ID NO: 142804

SEQ ID NO: 569643 - RNA, 64 nt, hsa; identical to SEQ ID NO: 142805

SEQ ID NO: 569644 - RNA, 64 nt, hsa; identical to SEQ ID NO: 142806

SEQ ID NO: 569645 - RNA, 64 nt, hsa; identical to SEQ ID NO: 142807

SEQ ID NO: 569646 - RNA, 64 nt, hsa; identical to SEQ ID NO: 142808

SEQ ID NO: 569647 - RNA, 64 nt, hsa; identical to SEQ ID NO: 142809

SEQ ID NO: 569648 - RNA, 64 nt, hsa; identical to SEQ ID NO: 142810

SEQ ID NO: 569649 - RNA, 64 nt, hsa; identical to SEQ ID NO: 142811

SEQ ID NO: 569650 - RNA, 64 nt, hsa; identical to SEQ ID NO: 142812

SEQ ID NO: 569651 - RNA, 64 nt, hsa; identical to SEQ ID NO: 142813

SEQ ID NO: 569652 - RNA, 64 nt, hsa; identical to SEQ ID NO: 142814

SEQ ID NO: 569653 - RNA, 64 nt, hsa; identical to SEQ ID NO: 142815

SEQ ID NO: 569654 - RNA, 64 nt, hsa; identical to SEQ ID NO: 142816

SEQ ID NO: 569655 - RNA, 64 nt, hsa; identical to SEQ ID NO: 142817

SEQ ID NO: 569656 - RNA, 64 nt, hsa; identical to SEQ ID NO: 142818

SEQ ID NO: 569657 - RNA, 64 nt, hsa; identical to SEQ ID NO: 142819

SEQ ID NO: 569658 - RNA, 64 nt, hsa; identical to SEQ ID NO: 142820

SEQ ID NO: 569659 - RNA, 64 nt, hsa; identical to SEQ ID NO: 142821

SEQ ID NO: 569660 - RNA, 64 nt, hsa; identical to SEQ ID NO: 142822

SEQ ID NO: 569661 - RNA, 64 nt, hsa; identical to SEQ ID NO: 142823

SEQ ID NO: 569662 - RNA, 64 nt, hsa; identical to SEQ ID NO: 142824

SEQ ID NO: 569663 - RNA, 64 nt, hsa; identical to SEQ ID NO: 142825

SEQ ID NO: 569664 - RNA, 64 nt, hsa; identical to SEQ ID NO: 142826

SEQ ID NO: 569665 - RNA, 64 nt, hsa; identical to SEQ ID NO: 142827

SEQ ID NO: 569666 - RNA, 64 nt, hsa; identical to SEQ ID NO: 142828

SEQ ID NO: 569667 - RNA, 64 nt, hsa; identical to SEQ ID NO: 142829

SEQ ID NO: 569668 - RNA, 64 nt, hsa; identical to SEQ ID NO: 142830

SEQ ID NO: 569669 - RNA, 64 nt, hsa; identical to SEQ ID NO: 142831

SEQ ID NO: 569670 - RNA, 64 nt, hsa; identical to SEQ ID NO: 142832

SEQ ID NO: 569671 - RNA, 64 nt, hsa; identical to SEQ ID NO: 142833

SEQ ID NO: 569672 - RNA, 64 nt, hsa; identical to SEQ ID NO: 142834

SEQ ID NO: 569673 - RNA, 64 nt, hsa; identical to SEQ ID NO: 142835

SEQ ID NO: 569674 - RNA, 64 nt, hsa; identical to SEQ ID NO: 142836

SEQ ID NO: 569675 - RNA, 64 nt, hsa; identical to SEQ ID NO: 142837

SEQ ID NO: 569676 - RNA, 64 nt, hsa; identical to SEQ ID NO: 142838

SEQ ID NO: 569677 - RNA, 64 nt, hsa; identical to SEQ ID NO: 142839

SEQ ID NO: 569678 - RNA, 64 nt, hsa; identical to SEQ ID NO: 142840

SEQ ID NO: 569679 - RNA, 64 nt, hsa; identical to SEQ ID NO: 142841

SEQ ID NO: 569680 - RNA, 64 nt, hsa; identical to SEQ ID NO: 142842

SEQ ID NO: 569681 - RNA, 64 nt, hsa; identical to SEQ ID NO: 142843

SEQ ID NO: 569682 - RNA, 64 nt, hsa; identical to SEQ ID NO: 142844

SEQ ID NO: 569683 - RNA, 64 nt, hsa; identical to SEQ ID NO: 142845

SEQ ID NO: 569684 - RNA, 64 nt, hsa; identical to SEQ ID NO: 142846

SEQ ID NO: 569685 - RNA, 64 nt, hsa; identical to SEQ ID NO: 142847

SEQ ID NO: 569686 - RNA, 64 nt, hsa; identical to SEQ ID NO: 142848

SEQ ID NO: 569687 - RNA, 64 nt, hsa; identical to SEQ ID NO: 142849

SEQ ID NO: 569688 - RNA, 64 nt, hsa; identical to SEQ ID NO: 142850

SEQ ID NO: 569689 - RNA, 64 nt, hsa; identical to SEQ ID NO: 142851

SEQ ID NO: 569690 - RNA, 64 nt, hsa; identical to SEQ ID NO: 142852

SEQ ID NO: 569691 - RNA, 64 nt, hsa; identical to SEQ ID NO: 142853

SEQ ID NO: 569692 - RNA, 64 nt, hsa; identical to SEQ ID NO: 142854

SEQ ID NO: 569693 - RNA, 64 nt, hsa; identical to SEQ ID NO: 142855

SEQ ID NO: 569694 - RNA, 64 nt, hsa; identical to SEQ ID NO: 142856

SEQ ID NO: 569695 - RNA, 64 nt, hsa; identical to SEQ ID NO: 142857

SEQ ID NO: 569696 - RNA, 64 nt, hsa; identical to SEQ ID NO: 142858

SEQ ID NO: 569697 - RNA, 64 nt, hsa; identical to SEQ ID NO: 142859

SEQ ID NO: 569698 - RNA, 64 nt, hsa; identical to SEQ ID NO: 142860

SEQ ID NO: 569699 - RNA, 64 nt, hsa; identical to SEQ ID NO: 142861

SEQ ID NO: 569700 - RNA, 64 nt, hsa; identical to SEQ ID NO: 142862

SEQ ID NO: 569701 - RNA, 64 nt, hsa; identical to SEQ ID NO: 142863

SEQ ID NO: 569702 - RNA, 64 nt, hsa; identical to SEQ ID NO: 142864

SEQ ID NO: 569703 - RNA, 64 nt, hsa; identical to SEQ ID NO: 142865

SEQ ID NO: 569704 - RNA, 64 nt, hsa; identical to SEQ ID NO: 142866

SEQ ID NO: 569705 - RNA, 64 nt, hsa; identical to SEQ ID NO: 142867

SEQ ID NO: 569706 - RNA, 64 nt, hsa; identical to SEQ ID NO: 142868

SEQ ID NO: 569707 - RNA, 64 nt, hsa; identical to SEQ ID NO: 142869

SEQ ID NO: 569708 - RNA, 64 nt, hsa; identical to SEQ ID NO: 142870

SEQ ID NO: 569709 - RNA, 64 nt, hsa; identical to SEQ ID NO: 142871

SEQ ID NO: 569710 - RNA, 64 nt, hsa; identical to SEQ ID NO: 142872

SEQ ID NO: 569711 - RNA, 64 nt, hsa; identical to SEQ ID NO: 142873

SEQ ID NO: 569712 - RNA, 64 nt, hsa; identical to SEQ ID NO: 142874

SEQ ID NO: 569713 - RNA, 64 nt, hsa; identical to SEQ ID NO: 142875

SEQ ID NO: 569714 - RNA, 64 nt, hsa; identical to SEQ ID NO: 142876

SEQ ID NO: 569715 - RNA, 64 nt, hsa; identical to SEQ ID NO: 142877

SEQ ID NO: 569716 - RNA, 64 nt, hsa; identical to SEQ ID NO: 142878

SEQ ID NO: 569717 - RNA, 64 nt, hsa; identical to SEQ ID NO: 142879

SEQ ID NO: 569718 - RNA, 64 nt, hsa; identical to SEQ ID NO: 142880

SEQ ID NO: 569719 - RNA, 64 nt, hsa; identical to SEQ ID NO: 142881

SEQ ID NO: 569720 - RNA, 64 nt, hsa; identical to SEQ ID NO: 142882

SEQ ID NO: 569721 - RNA, 64 nt, hsa; identical to SEQ ID NO: 142883

SEQ ID NO: 569722 - RNA, 64 nt, hsa; identical to SEQ ID NO: 142884

SEQ ID NO: 569723 - RNA, 64 nt, hsa; identical to SEQ ID NO: 142885

SEQ ID NO: 569724 - RNA, 64 nt, hsa; identical to SEQ ID NO: 142886

SEQ ID NO: 569725 - RNA, 64 nt, hsa; identical to SEQ ID NO: 142887

SEQ ID NO: 569726 - RNA, 64 nt, hsa; identical to SEQ ID NO: 142888

SEQ ID NO: 569727 - RNA, 64 nt, hsa; identical to SEQ ID NO: 142889

SEQ ID NO: 569728 - RNA, 64 nt, hsa; identical to SEQ ID NO: 142890

SEQ ID NO: 569729 - RNA, 64 nt, hsa; identical to SEQ ID NO: 142891

SEQ ID NO: 569730 - RNA, 64 nt, hsa; identical to SEQ ID NO: 142892

SEQ ID NO: 569731 - RNA, 64 nt, hsa; identical to SEQ ID NO: 142893

SEQ ID NO: 569732 - RNA, 64 nt, hsa; identical to SEQ ID NO: 142894

SEQ ID NO: 569733 - RNA, 64 nt, hsa; identical to SEQ ID NO: 142895

SEQ ID NO: 569734 - RNA, 64 nt, hsa; identical to SEQ ID NO: 142896

SEQ ID NO: 569735 - RNA, 64 nt, hsa; identical to SEQ ID NO: 142897

SEQ ID NO: 569736 - RNA, 64 nt, hsa; identical to SEQ ID NO: 142898

SEQ ID NO: 569737 - RNA, 64 nt, hsa; identical to SEQ ID NO: 142899

SEQ ID NO: 569738 - RNA, 64 nt, hsa; identical to SEQ ID NO: 142900

SEQ ID NO: 569739 - RNA, 64 nt, hsa; identical to SEQ ID NO: 142901

SEQ ID NO: 569740 - RNA, 64 nt, hsa; identical to SEQ ID NO: 142902

SEQ ID NO: 569741 - RNA, 64 nt, hsa; identical to SEQ ID NO: 142903

SEQ ID NO: 569742 - RNA, 64 nt, hsa; identical to SEQ ID NO: 142904

SEQ ID NO: 569743 - RNA, 64 nt, hsa; identical to SEQ ID NO: 142905

SEQ ID NO: 569744 - RNA, 64 nt, hsa; identical to SEQ ID NO: 142906

SEQ ID NO: 569745 - RNA, 64 nt, hsa; identical to SEQ ID NO: 142907

SEQ ID NO: 569746 - RNA, 64 nt, hsa; identical to SEQ ID NO: 142908

SEQ ID NO: 569747 - RNA, 64 nt, hsa; identical to SEQ ID NO: 142909

SEQ ID NO: 569748 - RNA, 64 nt, hsa; identical to SEQ ID NO: 142910

SEQ ID NO: 569749 - RNA, 64 nt, hsa; identical to SEQ ID NO: 142911

SEQ ID NO: 569750 - RNA, 64 nt, hsa; identical to SEQ ID NO: 142912

SEQ ID NO: 569751 - RNA, 64 nt, hsa; identical to SEQ ID NO: 142913

SEQ ID NO: 569752 - RNA, 64 nt, hsa; identical to SEQ ID NO: 142914

SEQ ID NO: 569753 - RNA, 64 nt, hsa; identical to SEQ ID NO: 142915

SEQ ID NO: 569754 - RNA, 64 nt, hsa; identical to SEQ ID NO: 142916

SEQ ID NO: 569755 - RNA, 64 nt, hsa; identical to SEQ ID NO: 142917

SEQ ID NO: 569756 - RNA, 64 nt, hsa; identical to SEQ ID NO: 142918

SEQ ID NO: 569757 - RNA, 64 nt, hsa; identical to SEQ ID NO: 142919

SEQ ID NO: 569758 - RNA, 64 nt, hsa; identical to SEQ ID NO: 142920

SEQ ID NO: 569759 - RNA, 64 nt, hsa; identical to SEQ ID NO: 142921

SEQ ID NO: 569760 - RNA, 64 nt, hsa; identical to SEQ ID NO: 142922

SEQ ID NO: 569761 - RNA, 64 nt, hsa; identical to SEQ ID NO: 142923

SEQ ID NO: 569762 - RNA, 64 nt, hsa; identical to SEQ ID NO: 142924

SEQ ID NO: 569763 - RNA, 64 nt, hsa; identical to SEQ ID NO: 142925

SEQ ID NO: 569764 - RNA, 64 nt, hsa; identical to SEQ ID NO: 142926

SEQ ID NO: 569765 - RNA, 64 nt, hsa; identical to SEQ ID NO: 142927

SEQ ID NO: 569766 - RNA, 64 nt, hsa; identical to SEQ ID NO: 142928

SEQ ID NO: 569767 - RNA, 64 nt, hsa; identical to SEQ ID NO: 142929

SEQ ID NO: 569768 - RNA, 64 nt, hsa; identical to SEQ ID NO: 142930

SEQ ID NO: 569769 - RNA, 64 nt, hsa; identical to SEQ ID NO: 142931

SEQ ID NO: 569770 - RNA, 64 nt, hsa; identical to SEQ ID NO: 142932

SEQ ID NO: 569771 - RNA, 64 nt, hsa; identical to SEQ ID NO: 142933

SEQ ID NO: 569772 - RNA, 64 nt, hsa; identical to SEQ ID NO: 142934

SEQ ID NO: 569773 - RNA, 64 nt, hsa; identical to SEQ ID NO: 142935

SEQ ID NO: 569774 - RNA, 64 nt, hsa; identical to SEQ ID NO: 142936

SEQ ID NO: 569775 - RNA, 64 nt, hsa; identical to SEQ ID NO: 142937

SEQ ID NO: 569776 - RNA, 64 nt, hsa; identical to SEQ ID NO: 142938

SEQ ID NO: 569777 - RNA, 64 nt, hsa; identical to SEQ ID NO: 142939

SEQ ID NO: 569778 - RNA, 64 nt, hsa; identical to SEQ ID NO: 142940

SEQ ID NO: 569779 - RNA, 64 nt, hsa; identical to SEQ ID NO: 142941

SEQ ID NO: 569780 - RNA, 64 nt, hsa; identical to SEQ ID NO: 142942

SEQ ID NO: 569781 - RNA, 64 nt, hsa; identical to SEQ ID NO: 142943

SEQ ID NO: 569782 - RNA, 64 nt, hsa; identical to SEQ ID NO: 142944

SEQ ID NO: 569783 - RNA, 64 nt, hsa; identical to SEQ ID NO: 142945

SEQ ID NO: 569784 - RNA, 64 nt, hsa; identical to SEQ ID NO: 142946

SEQ ID NO: 569785 - RNA, 64 nt, hsa; identical to SEQ ID NO: 142947

SEQ ID NO: 569786 - RNA, 64 nt, hsa; identical to SEQ ID NO: 142948

SEQ ID NO: 569787 - RNA, 64 nt, hsa; identical to SEQ ID NO: 142949

SEQ ID NO: 569788 - RNA, 64 nt, hsa; identical to SEQ ID NO: 142950

SEQ ID NO: 569789 - RNA, 64 nt, hsa; identical to SEQ ID NO: 142951

SEQ ID NO: 569790 - RNA, 64 nt, hsa; identical to SEQ ID NO: 142952

SEQ ID NO: 569791 - RNA, 64 nt, hsa; identical to SEQ ID NO: 142953

SEQ ID NO: 569792 - RNA, 64 nt, hsa; identical to SEQ ID NO: 142954

SEQ ID NO: 569793 - RNA, 64 nt, hsa; identical to SEQ ID NO: 142955

SEQ ID NO: 569794 - RNA, 64 nt, hsa; identical to SEQ ID NO: 142956

SEQ ID NO: 569795 - RNA, 64 nt, hsa; identical to SEQ ID NO: 142957

SEQ ID NO: 569796 - RNA, 64 nt, hsa; identical to SEQ ID NO: 142958

SEQ ID NO: 569797 - RNA, 64 nt, hsa; identical to SEQ ID NO: 142959

SEQ ID NO: 569798 - RNA, 64 nt, hsa; identical to SEQ ID NO: 142960

SEQ ID NO: 569799 - RNA, 64 nt, hsa; identical to SEQ ID NO: 142961

SEQ ID NO: 569800 - RNA, 64 nt, hsa; identical to SEQ ID NO: 142962

SEQ ID NO: 569801 - RNA, 64 nt, hsa; identical to SEQ ID NO: 142963

SEQ ID NO: 569802 - RNA, 64 nt, hsa; identical to SEQ ID NO: 142964

SEQ ID NO: 569803 - RNA, 64 nt, hsa; identical to SEQ ID NO: 142965

SEQ ID NO: 569804 - RNA, 64 nt, hsa; identical to SEQ ID NO: 142966

SEQ ID NO: 569805 - RNA, 64 nt, hsa; identical to SEQ ID NO: 142967

SEQ ID NO: 569806 - RNA, 64 nt, hsa; identical to SEQ ID NO: 142968

SEQ ID NO: 569807 - RNA, 64 nt, hsa; identical to SEQ ID NO: 142969

SEQ ID NO: 569808 - RNA, 64 nt, hsa; identical to SEQ ID NO: 142970

SEQ ID NO: 569809 - RNA, 64 nt, hsa; identical to SEQ ID NO: 142971

SEQ ID NO: 569810 - RNA, 64 nt, hsa; identical to SEQ ID NO: 142972

SEQ ID NO: 569811 - RNA, 64 nt, hsa; identical to SEQ ID NO: 142973

SEQ ID NO: 569812 - RNA, 64 nt, hsa; identical to SEQ ID NO: 142974

SEQ ID NO: 569813 - RNA, 64 nt, hsa; identical to SEQ ID NO: 142975

SEQ ID NO: 569814 - RNA, 64 nt, hsa; identical to SEQ ID NO: 142976

SEQ ID NO: 569815 - RNA, 64 nt, hsa; identical to SEQ ID NO: 142977

SEQ ID NO: 569816 - RNA, 64 nt, hsa; identical to SEQ ID NO: 142978

SEQ ID NO: 569817 - RNA, 64 nt, hsa; identical to SEQ ID NO: 142979

SEQ ID NO: 569818 - RNA, 64 nt, hsa; identical to SEQ ID NO: 142980

SEQ ID NO: 569819 - RNA, 64 nt, hsa; identical to SEQ ID NO: 142981

SEQ ID NO: 569820 - RNA, 64 nt, hsa; identical to SEQ ID NO: 142982

SEQ ID NO: 569821 - RNA, 64 nt, hsa; identical to SEQ ID NO: 142983

SEQ ID NO: 569822 - RNA, 64 nt, hsa; identical to SEQ ID NO: 142984

SEQ ID NO: 569823 - RNA, 64 nt, hsa; identical to SEQ ID NO: 142985

SEQ ID NO: 569824 - RNA, 64 nt, hsa; identical to SEQ ID NO: 142986

SEQ ID NO: 569825 - RNA, 64 nt, hsa; identical to SEQ ID NO: 142987

SEQ ID NO: 569826 - RNA, 64 nt, hsa; identical to SEQ ID NO: 142988

SEQ ID NO: 569827 - RNA, 64 nt, hsa; identical to SEQ ID NO: 142989

SEQ ID NO: 569828 - RNA, 64 nt, hsa; identical to SEQ ID NO: 142990

SEQ ID NO: 569829 - RNA, 64 nt, hsa; identical to SEQ ID NO: 142991

SEQ ID NO: 569830 - RNA, 64 nt, hsa; identical to SEQ ID NO: 142992

SEQ ID NO: 569831 - RNA, 64 nt, hsa; identical to SEQ ID NO: 142993

SEQ ID NO: 569832 - RNA, 64 nt, hsa; identical to SEQ ID NO: 142994

SEQ ID NO: 569833 - RNA, 64 nt, hsa; identical to SEQ ID NO: 142995

SEQ ID NO: 569834 - RNA, 64 nt, hsa; identical to SEQ ID NO: 142996

SEQ ID NO: 569835 - RNA, 64 nt, hsa; identical to SEQ ID NO: 142997

SEQ ID NO: 569836 - RNA, 64 nt, hsa; identical to SEQ ID NO: 142998

SEQ ID NO: 569837 - RNA, 64 nt, hsa; identical to SEQ ID NO: 142999

SEQ ID NO: 569838 - RNA, 64 nt, hsa; identical to SEQ ID NO: 143000

SEQ ID NO: 569839 - RNA, 64 nt, hsa; identical to SEQ ID NO: 143001

SEQ ID NO: 569840 - RNA, 64 nt, hsa; identical to SEQ ID NO: 143002

SEQ ID NO: 569841 - RNA, 64 nt, hsa; identical to SEQ ID NO: 143003

SEQ ID NO: 569842 - RNA, 64 nt, hsa; identical to SEQ ID NO: 143004

SEQ ID NO: 569843 - RNA, 64 nt, hsa; identical to SEQ ID NO: 143005

SEQ ID NO: 569844 - RNA, 64 nt, hsa; identical to SEQ ID NO: 143006

SEQ ID NO: 569845 - RNA, 64 nt, hsa; identical to SEQ ID NO: 143007

SEQ ID NO: 569846 - RNA, 64 nt, hsa; identical to SEQ ID NO: 143008

SEQ ID NO: 569847 - RNA, 64 nt, hsa; identical to SEQ ID NO: 143009

SEQ ID NO: 569848 - RNA, 64 nt, hsa; identical to SEQ ID NO: 143010

SEQ ID NO: 569849 - RNA, 64 nt, hsa; identical to SEQ ID NO: 143011

SEQ ID NO: 569850 - RNA, 64 nt, hsa; identical to SEQ ID NO: 143012

SEQ ID NO: 569851 - RNA, 64 nt, hsa; identical to SEQ ID NO: 143013

SEQ ID NO: 569852 - RNA, 64 nt, hsa; identical to SEQ ID NO: 143014

SEQ ID NO: 569853 - RNA, 64 nt, hsa; identical to SEQ ID NO: 143015

SEQ ID NO: 569854 - RNA, 64 nt, hsa; identical to SEQ ID NO: 143016

SEQ ID NO: 569855 - RNA, 64 nt, hsa; identical to SEQ ID NO: 143017

SEQ ID NO: 569856 - RNA, 64 nt, hsa; identical to SEQ ID NO: 143018

SEQ ID NO: 569857 - RNA, 64 nt, hsa; identical to SEQ ID NO: 143019

SEQ ID NO: 569858 - RNA, 64 nt, hsa; identical to SEQ ID NO: 143020

SEQ ID NO: 569859 - RNA, 64 nt, hsa; identical to SEQ ID NO: 143021

SEQ ID NO: 569860 - RNA, 64 nt, hsa; identical to SEQ ID NO: 143022

SEQ ID NO: 569861 - RNA, 64 nt, hsa; identical to SEQ ID NO: 143023

SEQ ID NO: 569862 - RNA, 64 nt, hsa; identical to SEQ ID NO: 143024

SEQ ID NO: 569863 - RNA, 64 nt, hsa; identical to SEQ ID NO: 143025

SEQ ID NO: 569864 - RNA, 64 nt, hsa; identical to SEQ ID NO: 143026

SEQ ID NO: 569865 - RNA, 64 nt, hsa; identical to SEQ ID NO: 143027

SEQ ID NO: 569866 - RNA, 64 nt, hsa; identical to SEQ ID NO: 143028

SEQ ID NO: 569867 - RNA, 64 nt, hsa; identical to SEQ ID NO: 143029

SEQ ID NO: 569868 - RNA, 64 nt, hsa; identical to SEQ ID NO: 143030

SEQ ID NO: 569869 - RNA, 64 nt, hsa; identical to SEQ ID NO: 143031

SEQ ID NO: 569870 - RNA, 64 nt, hsa; identical to SEQ ID NO: 143032

SEQ ID NO: 569871 - RNA, 64 nt, hsa; identical to SEQ ID NO: 143033

SEQ ID NO: 569872 - RNA, 64 nt, hsa; identical to SEQ ID NO: 143034

SEQ ID NO: 569873 - RNA, 64 nt, hsa; identical to SEQ ID NO: 143035

SEQ ID NO: 569874 - RNA, 64 nt, hsa; identical to SEQ ID NO: 143036

SEQ ID NO: 569875 - RNA, 64 nt, hsa; identical to SEQ ID NO: 143037

SEQ ID NO: 569876 - RNA, 64 nt, hsa; identical to SEQ ID NO: 143038

SEQ ID NO: 569877 - RNA, 64 nt, hsa; identical to SEQ ID NO: 143039

SEQ ID NO: 569878 - RNA, 64 nt, hsa; identical to SEQ ID NO: 143040

SEQ ID NO: 569879 - RNA, 64 nt, hsa; identical to SEQ ID NO: 143041

SEQ ID NO: 569880 - RNA, 64 nt, hsa; identical to SEQ ID NO: 143042

SEQ ID NO: 569881 - RNA, 64 nt, hsa; identical to SEQ ID NO: 143043

SEQ ID NO: 569882 - RNA, 64 nt, hsa; identical to SEQ ID NO: 143044

SEQ ID NO: 569883 - RNA, 64 nt, hsa; identical to SEQ ID NO: 143045

SEQ ID NO: 569884 - RNA, 64 nt, hsa; identical to SEQ ID NO: 143046

SEQ ID NO: 569885 - RNA, 64 nt, hsa; identical to SEQ ID NO: 143047

SEQ ID NO: 569886 - RNA, 64 nt, hsa; identical to SEQ ID NO: 143048

SEQ ID NO: 569887 - RNA, 64 nt, hsa; identical to SEQ ID NO: 143049

SEQ ID NO: 569888 - RNA, 64 nt, hsa; identical to SEQ ID NO: 143050

SEQ ID NO: 569889 - RNA, 64 nt, hsa; identical to SEQ ID NO: 143051

SEQ ID NO: 569890 - RNA, 64 nt, hsa; identical to SEQ ID NO: 143052

SEQ ID NO: 569891 - RNA, 64 nt, hsa; identical to SEQ ID NO: 143053

SEQ ID NO: 569892 - RNA, 64 nt, hsa; identical to SEQ ID NO: 143054

SEQ ID NO: 569893 - RNA, 64 nt, hsa; identical to SEQ ID NO: 143055

SEQ ID NO: 569894 - RNA, 64 nt, hsa; identical to SEQ ID NO: 143056

SEQ ID NO: 569895 - RNA, 64 nt, hsa; identical to SEQ ID NO: 143057

SEQ ID NO: 569896 - RNA, 64 nt, hsa; identical to SEQ ID NO: 143058

SEQ ID NO: 569897 - RNA, 64 nt, hsa; identical to SEQ ID NO: 143059

SEQ ID NO: 569898 - RNA, 64 nt, hsa; identical to SEQ ID NO: 143060

SEQ ID NO: 569899 - RNA, 64 nt, hsa; identical to SEQ ID NO: 143061

SEQ ID NO: 569900 - RNA, 64 nt, hsa; identical to SEQ ID NO: 143062

SEQ ID NO: 569901 - RNA, 64 nt, hsa; identical to SEQ ID NO: 143063

SEQ ID NO: 569902 - RNA, 64 nt, hsa; identical to SEQ ID NO: 143064

SEQ ID NO: 569903 - RNA, 64 nt, hsa; identical to SEQ ID NO: 143065

SEQ ID NO: 569904 - RNA, 64 nt, hsa; identical to SEQ ID NO: 143066

SEQ ID NO: 569905 - RNA, 64 nt, hsa; identical to SEQ ID NO: 143067

SEQ ID NO: 569906 - RNA, 64 nt, hsa; identical to SEQ ID NO: 143068

SEQ ID NO: 569907 - RNA, 64 nt, hsa; identical to SEQ ID NO: 143069

SEQ ID NO: 569908 - RNA, 64 nt, hsa; identical to SEQ ID NO: 143070

SEQ ID NO: 569909 - RNA, 64 nt, hsa; identical to SEQ ID NO: 143071

SEQ ID NO: 569910 - RNA, 64 nt, hsa; identical to SEQ ID NO: 143072

SEQ ID NO: 569911 - RNA, 64 nt, hsa; identical to SEQ ID NO: 143073

SEQ ID NO: 569912 - RNA, 64 nt, hsa; identical to SEQ ID NO: 143074

SEQ ID NO: 569913 - RNA, 64 nt, hsa; identical to SEQ ID NO: 143075

SEQ ID NO: 569914 - RNA, 64 nt, hsa; identical to SEQ ID NO: 143076

SEQ ID NO: 569915 - RNA, 64 nt, hsa; identical to SEQ ID NO: 143077

SEQ ID NO: 569916 - RNA, 64 nt, hsa; identical to SEQ ID NO: 143078

SEQ ID NO: 569917 - RNA, 64 nt, hsa; identical to SEQ ID NO: 143079

SEQ ID NO: 569918 - RNA, 64 nt, hsa; identical to SEQ ID NO: 143080

SEQ ID NO: 569919 - RNA, 64 nt, hsa; identical to SEQ ID NO: 143081

SEQ ID NO: 569920 - RNA, 64 nt, hsa; identical to SEQ ID NO: 143082

SEQ ID NO: 569921 - RNA, 64 nt, hsa; identical to SEQ ID NO: 143083

SEQ ID NO: 569922 - RNA, 64 nt, hsa; identical to SEQ ID NO: 143084

SEQ ID NO: 569923 - RNA, 64 nt, hsa; identical to SEQ ID NO: 143085

SEQ ID NO: 569924 - RNA, 64 nt, hsa; identical to SEQ ID NO: 143086

SEQ ID NO: 569925 - RNA, 64 nt, hsa; identical to SEQ ID NO: 143087

SEQ ID NO: 569926 - RNA, 64 nt, hsa; identical to SEQ ID NO: 143088

SEQ ID NO: 569927 - RNA, 64 nt, hsa; identical to SEQ ID NO: 143089

SEQ ID NO: 569928 - RNA, 64 nt, hsa; identical to SEQ ID NO: 143090

SEQ ID NO: 569929 - RNA, 64 nt, hsa; identical to SEQ ID NO: 143091

SEQ ID NO: 569930 - RNA, 64 nt, hsa; identical to SEQ ID NO: 143092

SEQ ID NO: 569931 - RNA, 64 nt, hsa; identical to SEQ ID NO: 143093

SEQ ID NO: 569932 - RNA, 64 nt, hsa; identical to SEQ ID NO: 143094

SEQ ID NO: 569933 - RNA, 64 nt, hsa; identical to SEQ ID NO: 143095

SEQ ID NO: 569934 - RNA, 64 nt, hsa; identical to SEQ ID NO: 143096

SEQ ID NO: 569935 - RNA, 64 nt, hsa; identical to SEQ ID NO: 143097

SEQ ID NO: 569936 - RNA, 64 nt, hsa; identical to SEQ ID NO: 143098

SEQ ID NO: 569937 - RNA, 64 nt, hsa; identical to SEQ ID NO: 143099

SEQ ID NO: 569938 - RNA, 64 nt, hsa; identical to SEQ ID NO: 143100

SEQ ID NO: 569939 - RNA, 64 nt, hsa; identical to SEQ ID NO: 143101

SEQ ID NO: 569940 - RNA, 64 nt, hsa; identical to SEQ ID NO: 143102

SEQ ID NO: 569941 - RNA, 64 nt, hsa; identical to SEQ ID NO: 143103

SEQ ID NO: 569942 - RNA, 64 nt, hsa; identical to SEQ ID NO: 143104

SEQ ID NO: 569943 - RNA, 64 nt, hsa; identical to SEQ ID NO: 143105

SEQ ID NO: 569944 - RNA, 64 nt, hsa; identical to SEQ ID NO: 143106

SEQ ID NO: 569945 - RNA, 64 nt, hsa; identical to SEQ ID NO: 143107

SEQ ID NO: 569946 - RNA, 64 nt, hsa; identical to SEQ ID NO: 143108

SEQ ID NO: 569947 - RNA, 64 nt, hsa; identical to SEQ ID NO: 143109

SEQ ID NO: 569948 - RNA, 64 nt, hsa; identical to SEQ ID NO: 143110

SEQ ID NO: 569949 - RNA, 64 nt, hsa; identical to SEQ ID NO: 143111

SEQ ID NO: 569950 - RNA, 64 nt, hsa; identical to SEQ ID NO: 143112

SEQ ID NO: 569951 - RNA, 64 nt, hsa; identical to SEQ ID NO: 143113

SEQ ID NO: 569952 - RNA, 64 nt, hsa; identical to SEQ ID NO: 143114

SEQ ID NO: 569953 - RNA, 64 nt, hsa; identical to SEQ ID NO: 143115

SEQ ID NO: 569954 - RNA, 64 nt, hsa; identical to SEQ ID NO: 143116

SEQ ID NO: 569955 - RNA, 64 nt, hsa; identical to SEQ ID NO: 143117

SEQ ID NO: 569956 - RNA, 64 nt, hsa; identical to SEQ ID NO: 143118

SEQ ID NO: 569957 - RNA, 64 nt, hsa; identical to SEQ ID NO: 143119

SEQ ID NO: 569958 - RNA, 64 nt, hsa; identical to SEQ ID NO: 143120

SEQ ID NO: 569959 - RNA, 64 nt, hsa; identical to SEQ ID NO: 143121

SEQ ID NO: 569960 - RNA, 64 nt, hsa; identical to SEQ ID NO: 143122

SEQ ID NO: 569961 - RNA, 64 nt, hsa; identical to SEQ ID NO: 143123

SEQ ID NO: 569962 - RNA, 64 nt, hsa; identical to SEQ ID NO: 143124

SEQ ID NO: 569963 - RNA, 64 nt, hsa; identical to SEQ ID NO: 143125

SEQ ID NO: 569964 - RNA, 64 nt, hsa; identical to SEQ ID NO: 143126

SEQ ID NO: 569965 - RNA, 64 nt, hsa; identical to SEQ ID NO: 143127

SEQ ID NO: 569966 - RNA, 64 nt, hsa; identical to SEQ ID NO: 143128

SEQ ID NO: 569967 - RNA, 64 nt, hsa; identical to SEQ ID NO: 143129

SEQ ID NO: 569968 - RNA, 64 nt, hsa; identical to SEQ ID NO: 143130

SEQ ID NO: 569969 - RNA, 64 nt, hsa; identical to SEQ ID NO: 143131

SEQ ID NO: 569970 - RNA, 64 nt, hsa; identical to SEQ ID NO: 143132

SEQ ID NO: 569971 - RNA, 64 nt, hsa; identical to SEQ ID NO: 143133

SEQ ID NO: 569972 - RNA, 64 nt, hsa; identical to SEQ ID NO: 143134

SEQ ID NO: 569973 - RNA, 64 nt, hsa; identical to SEQ ID NO: 143135

SEQ ID NO: 569974 - RNA, 64 nt, hsa; identical to SEQ ID NO: 143136

SEQ ID NO: 569975 - RNA, 64 nt, hsa; identical to SEQ ID NO: 143137

SEQ ID NO: 569976 - RNA, 64 nt, hsa; identical to SEQ ID NO: 143138

SEQ ID NO: 569977 - RNA, 64 nt, hsa; identical to SEQ ID NO: 143139

SEQ ID NO: 569978 - RNA, 64 nt, hsa; identical to SEQ ID NO: 143140

SEQ ID NO: 569979 - RNA, 64 nt, hsa; identical to SEQ ID NO: 143141

SEQ ID NO: 569980 - RNA, 64 nt, hsa; identical to SEQ ID NO: 143142

SEQ ID NO: 569981 - RNA, 64 nt, hsa; identical to SEQ ID NO: 143143

SEQ ID NO: 569982 - RNA, 64 nt, hsa; identical to SEQ ID NO: 143144

SEQ ID NO: 569983 - RNA, 64 nt, hsa; identical to SEQ ID NO: 143145

SEQ ID NO: 569984 - RNA, 64 nt, hsa; identical to SEQ ID NO: 143146

SEQ ID NO: 569985 - RNA, 64 nt, hsa; identical to SEQ ID NO: 143147

SEQ ID NO: 569986 - RNA, 64 nt, hsa; identical to SEQ ID NO: 143148

SEQ ID NO: 569987 - RNA, 64 nt, hsa; identical to SEQ ID NO: 143149

SEQ ID NO: 569988 - RNA, 64 nt, hsa; identical to SEQ ID NO: 143150

SEQ ID NO: 569989 - RNA, 64 nt, hsa; identical to SEQ ID NO: 143151

SEQ ID NO: 569990 - RNA, 64 nt, hsa; identical to SEQ ID NO: 143152

SEQ ID NO: 569991 - RNA, 64 nt, hsa; identical to SEQ ID NO: 143153

SEQ ID NO: 569992 - RNA, 64 nt, hsa; identical to SEQ ID NO: 143154

SEQ ID NO: 569993 - RNA, 64 nt, hsa; identical to SEQ ID NO: 143155

SEQ ID NO: 569994 - RNA, 64 nt, hsa; identical to SEQ ID NO: 143156

SEQ ID NO: 569995 - RNA, 64 nt, hsa; identical to SEQ ID NO: 143157

SEQ ID NO: 569996 - RNA, 64 nt, hsa; identical to SEQ ID NO: 143158

SEQ ID NO: 569997 - RNA, 64 nt, hsa; identical to SEQ ID NO: 143159

SEQ ID NO: 569998 - RNA, 64 nt, hsa; identical to SEQ ID NO: 143160

SEQ ID NO: 569999 - RNA, 64 nt, hsa; identical to SEQ ID NO: 143161

SEQ ID NO: 570000 - RNA, 64 nt, hsa; identical to SEQ ID NO: 143162

SEQ ID NO: 570001 - RNA, 64 nt, hsa; identical to SEQ ID NO: 143163

SEQ ID NO: 570002 - RNA, 64 nt, hsa; identical to SEQ ID NO: 143164

SEQ ID NO: 570003 - RNA, 64 nt, hsa; identical to SEQ ID NO: 143165

SEQ ID NO: 570004 - RNA, 64 nt, hsa; identical to SEQ ID NO: 143166

SEQ ID NO: 570005 - RNA, 64 nt, hsa; identical to SEQ ID NO: 143167

SEQ ID NO: 570006 - RNA, 64 nt, hsa; identical to SEQ ID NO: 143168

SEQ ID NO: 570007 - RNA, 64 nt, hsa; identical to SEQ ID NO: 143169

SEQ ID NO: 570008 - RNA, 64 nt, hsa; identical to SEQ ID NO: 143170

SEQ ID NO: 570009 - RNA, 64 nt, hsa; identical to SEQ ID NO: 143171

SEQ ID NO: 570010 - RNA, 64 nt, hsa; identical to SEQ ID NO: 143172

SEQ ID NO: 570011 - RNA, 64 nt, hsa; identical to SEQ ID NO: 143173

SEQ ID NO: 570012 - RNA, 64 nt, hsa; identical to SEQ ID NO: 143174

SEQ ID NO: 570013 - RNA, 64 nt, hsa; identical to SEQ ID NO: 143175

SEQ ID NO: 570014 - RNA, 64 nt, hsa; identical to SEQ ID NO: 143176

SEQ ID NO: 570015 - RNA, 64 nt, hsa; identical to SEQ ID NO: 143177

SEQ ID NO: 570016 - RNA, 64 nt, hsa; identical to SEQ ID NO: 143178

SEQ ID NO: 570017 - RNA, 64 nt, hsa; identical to SEQ ID NO: 143179

SEQ ID NO: 570018 - RNA, 64 nt, hsa; identical to SEQ ID NO: 143180

SEQ ID NO: 570019 - RNA, 64 nt, hsa; identical to SEQ ID NO: 143181

SEQ ID NO: 570020 - RNA, 64 nt, hsa; identical to SEQ ID NO: 143182

SEQ ID NO: 570021 - RNA, 64 nt, hsa; identical to SEQ ID NO: 143183

SEQ ID NO: 570022 - RNA, 64 nt, hsa; identical to SEQ ID NO: 143184

SEQ ID NO: 570023 - RNA, 64 nt, hsa; identical to SEQ ID NO: 143185

SEQ ID NO: 570024 - RNA, 64 nt, hsa; identical to SEQ ID NO: 143186

SEQ ID NO: 570025 - RNA, 64 nt, hsa; identical to SEQ ID NO: 143187

SEQ ID NO: 570026 - RNA, 64 nt, hsa; identical to SEQ ID NO: 143188

SEQ ID NO: 570027 - RNA, 64 nt, hsa; identical to SEQ ID NO: 143189

SEQ ID NO: 570028 - RNA, 64 nt, hsa; identical to SEQ ID NO: 143190

SEQ ID NO: 570029 - RNA, 64 nt, hsa; identical to SEQ ID NO: 143191

SEQ ID NO: 570030 - RNA, 64 nt, hsa; identical to SEQ ID NO: 143192

SEQ ID NO: 570031 - RNA, 64 nt, hsa; identical to SEQ ID NO: 143193

SEQ ID NO: 570032 - RNA, 64 nt, hsa; identical to SEQ ID NO: 143194

SEQ ID NO: 570033 - RNA, 64 nt, hsa; identical to SEQ ID NO: 143195

SEQ ID NO: 570034 - RNA, 64 nt, hsa; identical to SEQ ID NO: 143196

SEQ ID NO: 570035 - RNA, 64 nt, hsa; identical to SEQ ID NO: 143197

SEQ ID NO: 570036 - RNA, 64 nt, hsa; identical to SEQ ID NO: 143198

SEQ ID NO: 570037 - RNA, 64 nt, hsa; identical to SEQ ID NO: 143199

SEQ ID NO: 570038 - RNA, 64 nt, hsa; identical to SEQ ID NO: 143200

SEQ ID NO: 570039 - RNA, 64 nt, hsa; identical to SEQ ID NO: 143201

SEQ ID NO: 570040 - RNA, 64 nt, hsa; identical to SEQ ID NO: 143202

SEQ ID NO: 570041 - RNA, 64 nt, hsa; identical to SEQ ID NO: 143203

SEQ ID NO: 570042 - RNA, 64 nt, hsa; identical to SEQ ID NO: 143204

SEQ ID NO: 570043 - RNA, 64 nt, hsa; identical to SEQ ID NO: 143205

SEQ ID NO: 570044 - RNA, 64 nt, hsa; identical to SEQ ID NO: 143206

SEQ ID NO: 570045 - RNA, 64 nt, hsa; identical to SEQ ID NO: 143207

SEQ ID NO: 570046 - RNA, 64 nt, hsa; identical to SEQ ID NO: 143208

SEQ ID NO: 570047 - RNA, 64 nt, hsa; identical to SEQ ID NO: 23360

SEQ ID NO: 570048 - RNA, 64 nt, hsa; identical to SEQ ID NO: 23361

SEQ ID NO: 570049 - RNA, 64 nt, hsa; identical to SEQ ID NO: 23362

SEQ ID NO: 570050 - RNA, 64 nt, hsa; identical to SEQ ID NO: 23363

SEQ ID NO: 570051 - RNA, 64 nt, hsa; identical to SEQ ID NO: 23364

SEQ ID NO: 570052 - RNA, 64 nt, hsa; identical to SEQ ID NO: 23365

SEQ ID NO: 570053 - RNA, 64 nt, hsa; identical to SEQ ID NO: 23366

SEQ ID NO: 570054 - RNA, 64 nt, hsa; identical to SEQ ID NO: 23367

SEQ ID NO: 570055 - RNA, 64 nt, hsa; identical to SEQ ID NO: 23368

SEQ ID NO: 570056 - RNA, 64 nt, hsa; identical to SEQ ID NO: 23369

SEQ ID NO: 570057 - RNA, 64 nt, hsa; identical to SEQ ID NO: 23370

SEQ ID NO: 570058 - RNA, 64 nt, hsa; identical to SEQ ID NO: 23371

SEQ ID NO: 570059 - RNA, 64 nt, hsa; identical to SEQ ID NO: 23372

SEQ ID NO: 570060 - RNA, 64 nt, hsa; identical to SEQ ID NO: 23373

SEQ ID NO: 570061 - RNA, 64 nt, hsa; identical to SEQ ID NO: 23374

SEQ ID NO: 570062 - RNA, 64 nt, hsa; identical to SEQ ID NO: 23375

SEQ ID NO: 570063 - RNA, 64 nt, hsa; identical to SEQ ID NO: 23376

SEQ ID NO: 570064 - RNA, 64 nt, hsa; identical to SEQ ID NO: 23377

SEQ ID NO: 570065 - RNA, 64 nt, hsa; identical to SEQ ID NO: 23378

SEQ ID NO: 570066 - RNA, 64 nt, hsa; identical to SEQ ID NO: 23379

SEQ ID NO: 570067 - RNA, 64 nt, hsa; identical to SEQ ID NO: 23380

SEQ ID NO: 570068 - RNA, 64 nt, hsa; identical to SEQ ID NO: 23381

SEQ ID NO: 570069 - RNA, 64 nt, hsa; identical to SEQ ID NO: 23382

SEQ ID NO: 570070 - RNA, 64 nt, hsa; identical to SEQ ID NO: 23383

SEQ ID NO: 570071 - RNA, 64 nt, hsa; identical to SEQ ID NO: 23384

SEQ ID NO: 570072 - RNA, 64 nt, hsa; identical to SEQ ID NO: 23385

SEQ ID NO: 570073 - RNA, 64 nt, hsa; identical to SEQ ID NO: 23386

SEQ ID NO: 570074 - RNA, 64 nt, hsa; identical to SEQ ID NO: 23387

SEQ ID NO: 570075 - RNA, 64 nt, hsa; identical to SEQ ID NO: 23388

SEQ ID NO: 570076 - RNA, 64 nt, hsa; identical to SEQ ID NO: 23389

SEQ ID NO: 570077 - RNA, 64 nt, hsa; identical to SEQ ID NO: 23390

SEQ ID NO: 570078 - RNA, 64 nt, hsa; identical to SEQ ID NO: 23391

SEQ ID NO: 570079 - RNA, 64 nt, hsa; identical to SEQ ID NO: 23392

SEQ ID NO: 570080 - RNA, 64 nt, hsa; identical to SEQ ID NO: 23393

SEQ ID NO: 570081 - RNA, 64 nt, hsa; identical to SEQ ID NO: 23394

SEQ ID NO: 570082 - RNA, 64 nt, hsa; identical to SEQ ID NO: 23395

SEQ ID NO: 570083 - RNA, 64 nt, hsa; identical to SEQ ID NO: 23396

SEQ ID NO: 570084 - RNA, 64 nt, hsa; identical to SEQ ID NO: 23397

SEQ ID NO: 570085 - RNA, 64 nt, hsa; identical to SEQ ID NO: 23398

SEQ ID NO: 570086 - RNA, 64 nt, hsa; identical to SEQ ID NO: 23399

SEQ ID NO: 570087 - RNA, 64 nt, hsa; identical to SEQ ID NO: 23400

SEQ ID NO: 570088 - RNA, 64 nt, hsa; identical to SEQ ID NO: 23401

SEQ ID NO: 570089 - RNA, 64 nt, hsa; identical to SEQ ID NO: 23402

SEQ ID NO: 570090 - RNA, 64 nt, hsa; identical to SEQ ID NO: 23403

SEQ ID NO: 570091 - RNA, 64 nt, hsa; identical to SEQ ID NO: 23404

SEQ ID NO: 570092 - RNA, 64 nt, hsa; identical to SEQ ID NO: 23405

SEQ ID NO: 570093 - RNA, 64 nt, hsa; identical to SEQ ID NO: 23406

SEQ ID NO: 570094 - RNA, 64 nt, hsa; identical to SEQ ID NO: 23407

SEQ ID NO: 570095 - RNA, 64 nt, hsa; identical to SEQ ID NO: 23408

SEQ ID NO: 570096 - RNA, 64 nt, hsa; identical to SEQ ID NO: 23409

SEQ ID NO: 570097 - RNA, 64 nt, hsa; identical to SEQ ID NO: 23410

SEQ ID NO: 570098 - RNA, 64 nt, hsa; identical to SEQ ID NO: 23411

SEQ ID NO: 570099 - RNA, 64 nt, hsa; identical to SEQ ID NO: 23412

SEQ ID NO: 570100 - RNA, 64 nt, hsa; identical to SEQ ID NO: 23413

SEQ ID NO: 570101 - RNA, 64 nt, hsa; identical to SEQ ID NO: 23414

SEQ ID NO: 570102 - RNA, 64 nt, hsa; identical to SEQ ID NO: 23415

SEQ ID NO: 570103 - RNA, 64 nt, hsa; identical to SEQ ID NO: 23416

SEQ ID NO: 570104 - RNA, 64 nt, hsa; identical to SEQ ID NO: 23417

SEQ ID NO: 570105 - RNA, 64 nt, hsa; identical to SEQ ID NO: 23418

SEQ ID NO: 570106 - RNA, 64 nt, hsa; identical to SEQ ID NO: 23419

SEQ ID NO: 570107 - RNA, 64 nt, hsa; identical to SEQ ID NO: 23420

SEQ ID NO: 570108 - RNA, 64 nt, hsa; identical to SEQ ID NO: 23421

SEQ ID NO: 570109 - RNA, 64 nt, hsa; identical to SEQ ID NO: 23422

SEQ ID NO: 570110 - RNA, 64 nt, hsa; identical to SEQ ID NO: 23423

SEQ ID NO: 570111 - RNA, 64 nt, hsa; identical to SEQ ID NO: 23424

SEQ ID NO: 570112 - RNA, 64 nt, hsa; identical to SEQ ID NO: 23425

SEQ ID NO: 570113 - RNA, 64 nt, hsa; identical to SEQ ID NO: 23426

SEQ ID NO: 570114 - RNA, 64 nt, hsa; identical to SEQ ID NO: 23427

SEQ ID NO: 570115 - RNA, 64 nt, hsa; identical to SEQ ID NO: 23428

SEQ ID NO: 570116 - RNA, 64 nt, hsa; identical to SEQ ID NO: 23429

SEQ ID NO: 570117 - RNA, 64 nt, hsa; identical to SEQ ID NO: 23430

SEQ ID NO: 570118 - RNA, 64 nt, hsa; identical to SEQ ID NO: 23431

SEQ ID NO: 570119 - RNA, 64 nt, hsa; identical to SEQ ID NO: 23432

SEQ ID NO: 570120 - RNA, 64 nt, hsa; identical to SEQ ID NO: 23433

SEQ ID NO: 570121 - RNA, 64 nt, hsa; identical to SEQ ID NO: 23434

SEQ ID NO: 570122 - RNA, 64 nt, hsa; identical to SEQ ID NO: 23435

SEQ ID NO: 570123 - RNA, 64 nt, hsa; identical to SEQ ID NO: 23436

SEQ ID NO: 570124 - RNA, 64 nt, hsa; identical to SEQ ID NO: 23437

SEQ ID NO: 570125 - RNA, 64 nt, hsa; identical to SEQ ID NO: 23438

SEQ ID NO: 570126 - RNA, 64 nt, hsa; identical to SEQ ID NO: 23439

SEQ ID NO: 570127 - RNA, 64 nt, hsa; identical to SEQ ID NO: 23440

SEQ ID NO: 570128 - RNA, 64 nt, hsa; identical to SEQ ID NO: 23441

SEQ ID NO: 570129 - RNA, 64 nt, hsa; identical to SEQ ID NO: 23442

SEQ ID NO: 570130 - RNA, 64 nt, hsa; identical to SEQ ID NO: 23443

SEQ ID NO: 570131 - RNA, 64 nt, hsa; identical to SEQ ID NO: 23444

SEQ ID NO: 570132 - RNA, 64 nt, hsa; identical to SEQ ID NO: 23445

SEQ ID NO: 570133 - RNA, 64 nt, hsa; identical to SEQ ID NO: 23446

SEQ ID NO: 570134 - RNA, 64 nt, hsa; identical to SEQ ID NO: 23447

SEQ ID NO: 570135 - RNA, 64 nt, hsa; identical to SEQ ID NO: 23448

SEQ ID NO: 570136 - RNA, 64 nt, hsa; identical to SEQ ID NO: 23449

SEQ ID NO: 570137 - RNA, 64 nt, hsa; identical to SEQ ID NO: 23450

SEQ ID NO: 570138 - RNA, 64 nt, hsa; identical to SEQ ID NO: 23451

SEQ ID NO: 570139 - RNA, 64 nt, hsa; identical to SEQ ID NO: 23452

SEQ ID NO: 570140 - RNA, 64 nt, hsa
cugugaauguuccaacaccugccuccacuucuccccucaagaaauuuucaacgccaggaaucau

SEQ ID NO: 570141 - RNA, 64 nt, hsa
caugaagagacuucugcuuuucaacccccacccuccucaagaaguaauaauuuguuuacuugua

SEQ ID NO: 570142 - RNA, 64 nt, hsa
cuucucuuuuguuagggaggccucauucuaaguuccucaagagaguccuuggcuuaaagcugua

SEQ ID NO: 570143 - RNA, 64 nt, hsa
ugucagccccaguuggcuuccuggucaacaaggaccucaagaacugccuguggaccgaggcccc

SEQ ID NO: 570144 - RNA, 64 nt, hsa
aauuugggugagcugcaccugauuaguugaaaggccucaagaacaaacacugcaguuuccugga

SEQ ID NO: 570145 - RNA, 64 nt, hsa
aacacugcaguuuccuggaaaagaagaaacuuugccucaagacuauagccaucgacuccugccu

SEQ ID NO: 570146 - RNA, 64 nt, hsa
cagguugaguccagaugcuucucaccuucuuucuccucaagaaagaugcuuuuugggaaacguu

SEQ ID NO: 570147 - RNA, 64 nt, hsa
aggacugcuggcuguaaccagggcacaucacccaccucaagacaagcccacgcccuugucagcu

SEQ ID NO: 570148 - RNA, 64 nt, hsa
uccacuaagaaggccugucuacacugcaggggaaccucaagaacuuuucauugcacuucuaaaa

SEQ ID NO: 570149 - RNA, 64 nt, hsa
ucaaaaggaagagccuuuuaaaaacauuugccaaccucaagaauaaauacugaaagucuugaaa

SEQ ID NO: 570150 - RNA, 64 nt, hsa
uacaggaccccccaagucuuccuacccucugcacccucaagaaacccccagugccuuguaugaa

SEQ ID NO: 570151 - RNA, 64 nt, hsa
acuuccuucauuaacaaagacccuuguucuuaucccucaagaagaaacccaccauaaccagccc

SEQ ID NO: 570152 - RNA, 64 nt, hsa
caaaacacuugccugaauacauaucacguauuuuagacucgaagccucaaagcacuggauugug

SEQ ID NO: 570153 - RNA, 64 nt, hsa
aauaggcauagcuacguggcacuauauucuggccagacucgauguguacucuaacuuaagaaau

SEQ ID NO: 570154 - RNA, 64 nt, hsa
gagggugccacagggaaagcuguagaaggcaagaagacucgagaaucccccagaguuauuuuuc

SEQ ID NO: 570155 - RNA, 64 nt, hsa
acagucacugagccagacggucgguuggaacaugagacucgaggcugagcguggaucugaacac

SEQ ID NO: 570156 - RNA, 64 nt, hsa
guuuugguuuccaccuauuuaaagucagauuuauagacucgaggagacagaaacugaaucccac

SEQ ID NO: 570157 - RNA, 64 nt, hsa
ugucucagaugaggagggagagaaggaggccgccagacucgagaggugggaggaacuccuugca

SEQ ID NO: 570158 - RNA, 64 nt, hsa
acaacccuucucuguuggucugccuucugcugaaagacucgagaaccaaccagggaagcugucc

SEQ ID NO: 570159 - RNA, 64 nt, hsa
ucaaagucagggcccaccccaucugaggcagagaagacucgaguccagcccccaggaagccugc

SEQ ID NO: 570160 - RNA, 64 nt, hsa
caucgcuucuuuuucaaaacuaguucuuaggaacagacucgaugcaaguguuucuguucuggga

SEQ ID NO: 570161 - RNA, 64 nt, hsa
cuauccccucccuugcuccugaggccaaagccagagacucgaacagccuccccaccaccaccag

SEQ ID NO: 570162 - RNA, 64 nt, hsa
ggggcaaguguuuucugaaaugaugcauauuuuaagacucgauucauauugccacugugcuauc

SEQ ID NO: 570163 - RNA, 64 nt, hsa
gccuagcaccucuugaaauccagauguucauauuagacucgaaaaaauaggcuccaggccuagg

SEQ ID NO: 570164 - RNA, 64 nt, hsa
auuucuaaagaauauuugcuucccuuagaacuacagacucgaaaucuuuaaagauggugccuaa

SEQ ID NO: 570165 - RNA, 64 nt, hsa
ucugucaggccuucaggguucagcaguacagccgagacucgacucugugccucccuccccagug

SEQ ID NO: 570166 - RNA, 64 nt, hsa
ccccaucuucaaguuucacauccuggucaucaaaagacucgacagcaagacuuagaaugaaaaa

SEQ ID NO: 570167 - RNA, 64 nt, hsa
ucuaaugaagagaaaaaaaggaaaagaaguugcaagacucgaauaaaaucugcugcaccuugua

SEQ ID NO: 570168 - RNA, 64 nt, hsa
guagacaugauaaaagaaacauuuguauguucuuagacucgaaguuugauaaaaguaccuuuuc

SEQ ID NO: 570169 - RNA, 64 nt, hsa
gaauuuucuugucgcuuccuaucaaaauauucagagacucgagcacagcacccagacuucaugc

SEQ ID NO: 570170 - RNA, 64 nt, hsa
uguuucccccacgucucccucuauacccccucgaagacucgagagggggaggggguaaggagcg

SEQ ID NO: 570171 - RNA, 64 nt, hsa
gcauggugcuuuucugagcagaucaauacucugcagacucgaaaaaacaucacauacauucuug

SEQ ID NO: 570172 - RNA, 50 nt, hsa
gauccugugcuuuacucugaagacucgagagaaguuugcugaggaaugcc

SEQ ID NO: 570173 - RNA, 64 nt, hsa
cugugaugugugguccccauauguggcucagcaaagacucgagagaucaucccuuugucugcau

SEQ ID NO: 570174 - RNA, 64 nt, hsa
gcagcgccucccgccgccucgggccgccuccuccagacucgagagggcugagccccuccucucc

SEQ ID NO: 570175 - RNA, 64 nt, hsa
auacugcaugugacuuuccuaagcggcagcugaaagacucgagcccgugcugucuccuuugguu

SEQ ID NO: 570176 - RNA, 64 nt, hsa
auacucguguauuuuaagauaugaaugugacucaagacucgaggccgauacgaggcugugauuc

SEQ ID NO: 570177 - RNA, 64 nt, hsa
ggaucaccugcagauuuaaagccuacucugccacagacucgaguaagaaaauguucucuugaug

SEQ ID NO: 570178 - RNA, 64 nt, hsa
uuuccuaacaguuauuuccccggguccagcuuaaagacucgauggaaggagguagaaccucugc

SEQ ID NO: 570179 - RNA, 64 nt, hsa
cgccugugcagcccucccagguggaguacacggcagacucgaccguggcagccauguauuacag

SEQ ID NO: 570180 - RNA, 64 nt, hsa
auauaagccaaaaaaugcuugcuucaaccccaugagacucgauagugguggugaacagaacaaa

SEQ ID NO: 570181 - RNA, 64 nt, hsa
uucaaaucuagaagaugcaguucaaaaacaagacagacucgaguuguuagggcugaggaaccaa

SEQ ID NO: 570182 - RNA, 64 nt, hsa
gccuggaaacgagagucuuaauugaggagaugggagacucgaacucuagcccuggaucugccuu

SEQ ID NO: 570183 - RNA, 64 nt, hsa
uauuuaacuauguguggaacaacccaguaauaucagacucgaauuacuauuucauucuauuuca

SEQ ID NO: 570184 - RNA, 64 nt, hsa
aguaauggauuuuuuuuuacucaucuuugaauauagacucgagucuuugggaaacucauuauau

SEQ ID NO: 570185 - RNA, 64 nt, hsa
ucugcuuuguuugcauacuggucuucagauuaugagacucgaugauaacaguaugguacugcuu

SEQ ID NO: 570186 - RNA, 64 nt, hsa
uggcccugccuccuguccuccccgggguuuuugcagacucgaagucucacugcaccagugucuu

SEQ ID NO: 570187 - RNA, 64 nt, hsa
aagacagugauuuuuguguaagguuguauuucaaagacucgaauucauuuucucagucauuucc

SEQ ID NO: 570188 - RNA, 64 nt, hsa
augaacucuuugaugaggauuuguaaacgaaaacagacucgaacuauuguguaccaccacauag

SEQ ID NO: 570189 - RNA, 64 nt, hsa
ucugacaggcuuaagcuuucguccccuugcacuuagacucgaaguuaguaaauccuuaaaggcu

SEQ ID NO: 570190 - RNA, 64 nt, hsa
cagggccugggccagccuuacaggucaguagacuagacucgacuacuuggggucagugauucuu

SEQ ID NO: 570191 - RNA, 64 nt, hsa
gacugcaauagaaaacucccaaacccagcacuccagacucgagggaagccagcuuccaagaacu

SEQ ID NO: 570192 - RNA, 64 nt, hsa
uugcuuuucuccuccuccccuucccaguuaccaaagacucgaacuuccagacagggacccaggg

SEQ ID NO: 570193 - RNA, 64 nt, hsa
aagugugcauagaucugagaggagucgggagucgagacucgagauuccaucauagcguaggugu

SEQ ID NO: 570194 - RNA, 64 nt, hsa
uucucucucuuagcuccacgucagcacugagaccagacucgagcaccccuguccuguaagcgag

SEQ ID NO: 570195 - RNA, 64 nt, hsa
agagccgccccguguccccccaggugcuggaggcagacucgagggccgaauuguuucuaguuag

SEQ ID NO: 570196 - RNA, 64 nt, hsa
acuuuuuuuuguauguuuuuuuucugcuggaaacagacucgauucauauugaauauaauauauu

SEQ ID NO: 570197 - RNA, 64 nt, hsa
cgcagagcuggccgcgccaaauaaugucucugugagacucgagaacuuucauuuuuuuccaggc

SEQ ID NO: 570198 - RNA, 64 nt, hsa
cauuuauaacggaaucaggcacaccuuuuccacgagacucgagugugcuggcauuucucacccu

SEQ ID NO: 570199 - RNA, 64 nt, hsa
aaggcgagaguagcgcacgccagcgccgccuccuagacucgagcagagccggagagagagacga

SEQ ID NO: 570200 - RNA, 64 nt, hsa
agccccuaguccccucugugugcuuugagccuccagacucgaggcuggucacugcaggucccag

SEQ ID NO: 570201 - RNA, 64 nt, hsa
aggacauuuggggacuguguacaaugaguuauggagacucgaggguucaugcagucaguguuau

SEQ ID NO: 570202 - RNA, 64 nt, hsa
auuuuuaucacucuaaucaguaaggcuacuaucuagacucgaaugcuuucauacaagugauuuu

SEQ ID NO: 570203 - RNA, 64 nt, hsa
aauaagacuugucucggucaccugugcccuguccagacucgaggcagugguaacacugcacagu

SEQ ID NO: 570204 - RNA, 64 nt, hsa
acagccccuggcacugcagguggccucccuccagagacucgaguccccaugauucccuccucgu

SEQ ID NO: 570205 - RNA, 64 nt, hsa
ccaaguugacccaguuugucuuuuagguuaaguaagacucgagaguaaaggcaaggaggggggc

SEQ ID NO: 570206 - RNA, 64 nt, hsa
cacaucguguuucuuccagaaauucagacgcaacagagguuaggccaguuugguggguuccagu

SEQ ID NO: 570207 - RNA, 64 nt, hsa
guugaggcuucacgcucagggaaacuucugggucagagguuaauaaccacgcuccuuggagcaa

SEQ ID NO: 570208 - RNA, 64 nt, hsa
uucccugcacccuggaaaggggaguugagucacaagagguuaagguggguccaggaaggcagcu

SEQ ID NO: 570209 - RNA, 64 nt, hsa
gccagcugccuuccucauccccucguccugucccagagguuaucugccuggccuggcuccccac

SEQ ID NO: 570210 - RNA, 64 nt, hsa
auuuaaauuuaugccacaauuuaaaaauaaaaccagagguuauauacaauuuaaauugggcuaa

SEQ ID NO: 570211 - RNA, 64 nt, hsa
cuuucuagcccauccaaauuugauaaauggaaccagagguuauauacaacuacaaggaaaaaaa

SEQ ID NO: 570212 - RNA, 64 nt, hsa
uucaauaugaucacuuuuuccuucuuugccugggagagguuaagaggagguuucgaagguauag

SEQ ID NO: 570213 - RNA, 64 nt, hsa
uuuuuuaaauuuuuucagugagcguggugacugcagagguuagugcugugaaaagcugggcuaa

SEQ ID NO: 570214 - RNA, 64 nt, hsa
gucuggaaccaagacuauucaguugguuaaauaaagagguuagucuagacugggccugcucauu

SEQ ID NO: 570215 - RNA, 64 nt, hsa
uuuauguauuugcuaguucagccugauuucuagaagagguuauagugugagacuuguaguauuc

SEQ ID NO: 570216 - RNA, 64 nt, hsa
aagagagguuauagaguagaagauuugaugcuggagagguuaaggugcaauaagaauuuaggga

SEQ ID NO: 570217 - RNA, 64 nt, hsa
gaaggaaauugagauuagagggagguguuuaaagagagguuauagaguagaagauuugaugcug

SEQ ID NO: 570218 - RNA, 64 nt, hsa; identical to SEQ ID NO: 71859

SEQ ID NO: 570219 - RNA, 64 nt, hsa; identical to SEQ ID NO: 71860

SEQ ID NO: 570220 - RNA, 64 nt, hsa; identical to SEQ ID NO: 71861

SEQ ID NO: 570221 - RNA, 64 nt, hsa; identical to SEQ ID NO: 71862

SEQ ID NO: 570222 - RNA, 64 nt, hsa; identical to SEQ ID NO: 71863

SEQ ID NO: 570223 - RNA, 64 nt, hsa; identical to SEQ ID NO: 71864

SEQ ID NO: 570224 - RNA, 64 nt, hsa; identical to SEQ ID NO: 71865

SEQ ID NO: 570225 - RNA, 64 nt, hsa; identical to SEQ ID NO: 71866

SEQ ID NO: 570226 - RNA, 64 nt, hsa; identical to SEQ ID NO: 71867

SEQ ID NO: 570227 - RNA, 64 nt, hsa; identical to SEQ ID NO: 71868

SEQ ID NO: 570228 - RNA, 64 nt, hsa; identical to SEQ ID NO: 71869

SEQ ID NO: 570229 - RNA, 64 nt, hsa; identical to SEQ ID NO: 71870

SEQ ID NO: 570230 - RNA, 64 nt, hsa; identical to SEQ ID NO: 71871

SEQ ID NO: 570231 - RNA, 64 nt, hsa; identical to SEQ ID NO: 71872

SEQ ID NO: 570232 - RNA, 64 nt, hsa; identical to SEQ ID NO: 71873

SEQ ID NO: 570233 - RNA, 64 nt, hsa; identical to SEQ ID NO: 71874

SEQ ID NO: 570234 - RNA, 64 nt, hsa; identical to SEQ ID NO: 71875

SEQ ID NO: 570235 - RNA, 64 nt, hsa; identical to SEQ ID NO: 71876

SEQ ID NO: 570236 - RNA, 64 nt, hsa; identical to SEQ ID NO: 71877

SEQ ID NO: 570237 - RNA, 64 nt, hsa; identical to SEQ ID NO: 71878

SEQ ID NO: 570238 - RNA, 64 nt, hsa; identical to SEQ ID NO: 71879

SEQ ID NO: 570239 - RNA, 64 nt, hsa
cauuucccaguuaaaugauauuuaacaccugggaaaacaggacagcucagauugucgaguuagu

SEQ ID NO: 570240 - RNA, 64 nt, hsa
gaaugugcugcguuuuguuuucuuuacuguaugaaaacaggaaaauaaaagagaaauuuagaaa

SEQ ID NO: 570241 - RNA, 64 nt, hsa
ucaccugagaggcagacagaucaaaccaaacaggaaacaggaaaugcauguuugaucuguuguc

SEQ ID NO: 570242 - RNA, 64 nt, hsa
uuauaagucaccugagaggcagacagaucaaaccaaacaggaaacaggaaaugcauguuugauc

SEQ ID NO: 570243 - RNA, 64 nt, hsa
uauggcaacggaacauccucaagcagagguaguaaaacaggaaagcagcauguccgaaaguaaa

SEQ ID NO: 570244 - RNA, 64 nt, hsa
cauguccgaaaguaaaguguugggugaaguggggaaacaggacagcagcucugcuagcuuggcu

SEQ ID NO: 570245 - RNA, 64 nt, hsa
aaguucuucucauuucauuauguuucuuccaaggaaacaggagagacugaauuaauaauucucu

SEQ ID NO: 570246 - RNA, 64 nt, hsa
uaagaggucauuucuggaauggacucagaccuuuaaacaggagaguugagcacuuccagucagu

SEQ ID NO: 570247 - RNA, 64 nt, hsa
aacagagcaagauccugucucaaaaggaaaaagaaaacaggaccuagguguuugggguacacug

SEQ ID NO: 570248 - RNA, 64 nt, hsa
acaggaaagauuuguaagugagcucucucuuugaaaacaggacccaggcugggcacagcagcuc

SEQ ID NO: 570249 - RNA, 64 nt, hsa
cugcgcagggccagccgcuaccaggacggcccugaaacaggacacaucuguuuuuugucccuca

SEQ ID NO: 570250 - RNA, 64 nt, hsa
auuaaccguucuagaaagccacuguuuuauagcaaaacaggaaaggaaaagcuaccaguuuuuu

SEQ ID NO: 570251 - RNA, 64 nt, hsa
uauuuauauacccuggggacagaaagucagguugaaacaggaaaaccaccagacucuaaucuca

SEQ ID NO: 570252 - RNA, 64 nt, hsa
aaguucaacccgugugugaaagcaaaacaauggaaaacaggauuggcuucuucaaaggcuccuc

SEQ ID NO: 570253 - RNA, 64 nt, hsa
gaacacgaauuuccauuuaccuggugggaacacgaaacaggagucucuucuguucugcaaguuu

SEQ ID NO: 570254 - RNA, 64 nt, hsa
ucaggggguagcugauccugucauucuggucaccaaacaggaggguccuggcacuacccagauu

SEQ ID NO: 570255 - RNA, 64 nt, hsa
uaccuagcaguugugcccucagaguagaacuuugaaacaggacugaagcccuuuuuaccuagaa

SEQ ID NO: 570256 - RNA, 64 nt, hsa
agguaauuuccauagcaacuaaucauagugacccaaacaggauuauaaagucaagugaggaaua

SEQ ID NO: 570257 - RNA, 64 nt, hsa
cuuccuuucuuuuuuuucuuucguuccuuuuuugaaacaggagagcaaagcaguuagaguucag

SEQ ID NO: 570258 - RNA, 64 nt, hsa
auguuugcuuguaugaccaagucaccaaggaaauaaacaggaaggaaauccauguucuccaucu

SEQ ID NO: 570259 - RNA, 64 nt, hsa
gcacugccauugucuuuugguugccauggucaccaaacaggaaguggacauucuaagggaggag

SEQ ID NO: 570260 - RNA, 64 nt, hsa
auggggaucuucagggaaggaacucuggccacccaaacaggacaagagcagccuggggccaagc

SEQ ID NO: 570261 - RNA, 64 nt, hsa
ggaaaaagcccgagucugaugcuaagaagaacauaaacaggaugcugagguaagagaauaacug

SEQ ID NO: 570262 - RNA, 64 nt, hsa
cacauggaucuuucaggaaaacgaaguagguaauaaacaggaaaaagcccgagucugaugcuaa

SEQ ID NO: 570263 - RNA, 64 nt, hsa
cuucaccaagaaaacccaaacaggacacuuuugaaaacaggacucagcaucgcuuucaauaggc

SEQ ID NO: 570264 - RNA, 64 nt, hsa
ucacuugaaauucugcucuucaccaagaaaacccaaacaggacacuuuugaaaacaggacucag

SEQ ID NO: 570265 - RNA, 64 nt, hsa
cauggugggagcugguugaauugucuuuauuaacaaacaggauauccaaggccacuacauugag

SEQ ID NO: 570266 - RNA, 64 nt, hsa
uugugagcuaucuaucuauauucauuucauagccaaacaggagaccccuuugcaggacuugcac

SEQ ID NO: 570267 - RNA, 64 nt, hsa
uagaaguaauuguuuuaucaauucauuguauaauaaacaggagugagacuucauuguaugacuu

SEQ ID NO: 570268 - RNA, 64 nt, hsa
aaucagaaauuccuuuuagcugacaacauugcuuaaacaggauaguaguuggcaagaugaaaug

SEQ ID NO: 570269 - RNA, 64 nt, hsa
uuaaaacaggagccuagagcccccugcccaaacaaaacaggacaucugugaccgcccuaccccc

SEQ ID NO: 570270 - RNA, 64 nt, hsa
auaauugggacccagagcccuuucccagcacuuaaaacaggagccuagagcccccugcccaaac

SEQ ID NO: 570271 - RNA, 64 nt, hsa
ucagcacugucuccaugcagcaguugcugggucccauguccagcugccucuuuggcuucauggg

SEQ ID NO: 570272 - RNA, 64 nt, hsa
aauuguuuucagggccuuguccagcugagagcuucauguccaccagauucugagaggugucagc

SEQ ID NO: 570273 - RNA, 64 nt, hsa
ugacauauuuauuuuugucuauucuguaggcuuccauguccagaauccugcuuaagguuuuagg

SEQ ID NO: 570274 - RNA, 64 nt, hsa
ccaggcagacgggcugaaguggggucccaaauuccauguccagagguguggggagccugccucc

SEQ ID NO: 570275 - RNA, 64 nt, hsa
auugagagaacuguguuuuuccgacaaacggucacauguccaucguuauggcaugugcagaaaa

SEQ ID NO: 570276 - RNA, 64 nt, hsa
ucuugucugugcuaauauaaauacugaguaccagcauguccauuugaacaugcagaggguuaau

SEQ ID NO: 570277 - RNA, 64 nt, hsa
uauuggcaaguaugcagagccgugaacgucauggcauguccaaggaauuaaaugggaguucauu

SEQ ID NO: 570278 - RNA, 64 nt, hsa
aaugaauauauugccuguuuugugaauacugacacauguccauaccuaaaacacuccugaguca

SEQ ID NO: 570279 - RNA, 64 nt, hsa
ucuaagugcaaccgccuagacuuucuuucagauacauguccacauguccauuuuucagguucuc

SEQ ID NO: 570280 - RNA, 64 nt, hsa
caaccgccuagacuuucuuucagauacauguccacauguccauuuuucagguucucuaaguugg

SEQ ID NO: 570281 - RNA, 64 nt, hsa; identical to SEQ ID NO: 193284

SEQ ID NO: 570282 - RNA, 64 nt, hsa; identical to SEQ ID NO: 193285

SEQ ID NO: 570283 - RNA, 64 nt, hsa; identical to SEQ ID NO: 193286

SEQ ID NO: 570284 - RNA, 64 nt, hsa; identical to SEQ ID NO: 193287

SEQ ID NO: 570285 - RNA, 64 nt, hsa; identical to SEQ ID NO: 193288

SEQ ID NO: 570286 - RNA, 64 nt, hsa; identical to SEQ ID NO: 193289

SEQ ID NO: 570287 - RNA, 64 nt, hsa; identical to SEQ ID NO: 193290

SEQ ID NO: 570288 - RNA, 64 nt, hsa; identical to SEQ ID NO: 193291

SEQ ID NO: 570289 - RNA, 64 nt, hsa; identical to SEQ ID NO: 193292

SEQ ID NO: 570290 - RNA, 64 nt, hsa; identical to SEQ ID NO: 193293

SEQ ID NO: 570291 - RNA, 64 nt, hsa; identical to SEQ ID NO: 193294

SEQ ID NO: 570292 - RNA, 64 nt, hsa; identical to SEQ ID NO: 193295

SEQ ID NO: 570293 - RNA, 64 nt, hsa; identical to SEQ ID NO: 193296

SEQ ID NO: 570294 - RNA, 64 nt, hsa; identical to SEQ ID NO: 193297

SEQ ID NO: 570295 - RNA, 64 nt, hsa; identical to SEQ ID NO: 193298

SEQ ID NO: 570296 - RNA, 64 nt, hsa; identical to SEQ ID NO: 193299

SEQ ID NO: 570297 - RNA, 64 nt, hsa; identical to SEQ ID NO: 193300

SEQ ID NO: 570298 - RNA, 64 nt, hsa; identical to SEQ ID NO: 193301

SEQ ID NO: 570299 - RNA, 64 nt, hsa; identical to SEQ ID NO: 193302

SEQ ID NO: 570300 - RNA, 64 nt, hsa; identical to SEQ ID NO: 193303

SEQ ID NO: 570301 - RNA, 64 nt, hsa; identical to SEQ ID NO: 193304

SEQ ID NO: 570302 - RNA, 64 nt, hsa; identical to SEQ ID NO: 193305

SEQ ID NO: 570303 - RNA, 64 nt, hsa; identical to SEQ ID NO: 193306

SEQ ID NO: 570304 - RNA, 64 nt, hsa; identical to SEQ ID NO: 193307

SEQ ID NO: 570305 - RNA, 64 nt, hsa; identical to SEQ ID NO: 193308

SEQ ID NO: 570306 - RNA, 64 nt, hsa; identical to SEQ ID NO: 193309

SEQ ID NO: 570307 - RNA, 64 nt, hsa; identical to SEQ ID NO: 193310

SEQ ID NO: 570308 - RNA, 64 nt, hsa; identical to SEQ ID NO: 193311

SEQ ID NO: 570309 - RNA, 64 nt, hsa; identical to SEQ ID NO: 193312

SEQ ID NO: 570310 - RNA, 64 nt, hsa; identical to SEQ ID NO: 193313

SEQ ID NO: 570311 - RNA, 64 nt, hsa
cugaaagggcucuaaagaaggaacuaccaaaaccugacuugaaaugccauuucuuuuaaccuuc

SEQ ID NO: 570312 - RNA, 64 nt, hsa
uauuuacauuagaguauaccuuuuaguaauaaaaugacuugaaaucauauuauuuuuaaaagcc

SEQ ID NO: 570313 - RNA, 64 nt, hsa
auggaagccauugucuaaucaacucuaucauuagugacuugaugucucauaccuuaauuuugua

SEQ ID NO: 570314 - RNA, 64 nt, hsa
uuaauguuuugcuuugcauuuuagguucagauuaugacuugauugaaauaaaugugccuauaca

SEQ ID NO: 570315 - RNA, 56 nt, hsa
uuaagaagaaaucuaagugaacuggcugacuugauggaaucauguucaaguggcau

SEQ ID NO: 570316 - RNA, 64 nt, hsa
aauggguuuuuaaguagaaccuaggguuucuaauugacuugauuucuggaaaugaaaacccgcg

SEQ ID NO: 570317 - RNA, 64 nt, hsa
uuccuuuucaaaauaaaagugacaauuguagcauugacuugaagugagacaugguuauagauaa

SEQ ID NO: 570318 - RNA, 64 nt, hsa
aagcaggugaaaccuuaggagaugauccagucacugacuugauugagggauaagugugauuuag

SEQ ID NO: 570319 - RNA, 64 nt, hsa
ucgacucauucuccauuuugcuuugguuuugucuugacuugacuugacuuuggggguaaagucu

SEQ ID NO: 570320 - RNA, 64 nt, hsa
ucauucuccauuuugcuuugguuuugucuugacuugacuugacuuuggggguaaagucuuucac

SEQ ID NO: 570321 - RNA, 64 nt, hsa
uaauuuauugaauuuuacuguuacacauaguuuuugacuugaauuaaaauacuagacaaagcag

SEQ ID NO: 570322 - RNA, 64 nt, hsa
gaaauucauagagaagagaauagaguggaugaugugacuugaaguuuuugcagcuuauuuuuuc

SEQ ID NO: 570323 - RNA, 64 nt, hsa
agagaauuguaacauagcaugacaaauuuuguguugacuugaaaggaaucacaccauuauuccu

SEQ ID NO: 570324 - RNA, 64 nt, hsa
ucuugugugcuagauuaaaagugagacagagacuugacuugauccucugagcucaagcuauuga

SEQ ID NO: 570325 - RNA, 64 nt, hsa; identical to SEQ ID NO: 311803

SEQ ID NO: 570326 - RNA, 64 nt, hsa; identical to SEQ ID NO: 311804

SEQ ID NO: 570327 - RNA, 64 nt, hsa; identical to SEQ ID NO: 311805

SEQ ID NO: 570328 - RNA, 64 nt, hsa; identical to SEQ ID NO: 311806

SEQ ID NO: 570329 - RNA, 64 nt, hsa; identical to SEQ ID NO: 311807

SEQ ID NO: 570330 - RNA, 64 nt, hsa; identical to SEQ ID NO: 311808

SEQ ID NO: 570331 - RNA, 64 nt, hsa; identical to SEQ ID NO: 311809

SEQ ID NO: 570332 - RNA, 64 nt, hsa; identical to SEQ ID NO: 311810

SEQ ID NO: 570333 - RNA, 64 nt, hsa; identical to SEQ ID NO: 311811

SEQ ID NO: 570334 - RNA, 64 nt, hsa; identical to SEQ ID NO: 311812

SEQ ID NO: 570335 - RNA, 64 nt, hsa; identical to SEQ ID NO: 311813

SEQ ID NO: 570336 - RNA, 64 nt, hsa; identical to SEQ ID NO: 311814

SEQ ID NO: 570337 - RNA, 64 nt, hsa; identical to SEQ ID NO: 311815

SEQ ID NO: 570338 - RNA, 64 nt, hsa; identical to SEQ ID NO: 311816

SEQ ID NO: 570339 - RNA, 64 nt, hsa; identical to SEQ ID NO: 311817

SEQ ID NO: 570340 - RNA, 64 nt, hsa; identical to SEQ ID NO: 311818

SEQ ID NO: 570341 - RNA, 64 nt, hsa; identical to SEQ ID NO: 311819

SEQ ID NO: 570342 - RNA, 64 nt, hsa; identical to SEQ ID NO: 311820

SEQ ID NO: 570343 - RNA, 64 nt, hsa; identical to SEQ ID NO: 311821

SEQ ID NO: 570344 - RNA, 64 nt, hsa; identical to SEQ ID NO: 311822

SEQ ID NO: 570345 - RNA, 64 nt, hsa; identical to SEQ ID NO: 311823

SEQ ID NO: 570346 - RNA, 64 nt, hsa; identical to SEQ ID NO: 311824

SEQ ID NO: 570347 - RNA, 64 nt, hsa; identical to SEQ ID NO: 311825

SEQ ID NO: 570348 - RNA, 64 nt, hsa; identical to SEQ ID NO: 311824

SEQ ID NO: 570349 - RNA, 64 nt, hsa; identical to SEQ ID NO: 311824

SEQ ID NO: 570350 - RNA, 64 nt, hsa; identical to SEQ ID NO: 311828

SEQ ID NO: 570351 - RNA, 64 nt, hsa; identical to SEQ ID NO: 311829

SEQ ID NO: 570352 - RNA, 64 nt, hsa; identical to SEQ ID NO: 311830

SEQ ID NO: 570353 - RNA, 64 nt, hsa; identical to SEQ ID NO: 311831

SEQ ID NO: 570354 - RNA, 64 nt, hsa; identical to SEQ ID NO: 311832

SEQ ID NO: 570355 - RNA, 64 nt, hsa; identical to SEQ ID NO: 311833

SEQ ID NO: 570356 - RNA, 64 nt, hsa; identical to SEQ ID NO: 311834

SEQ ID NO: 570357 - RNA, 64 nt, hsa; identical to SEQ ID NO: 311835

SEQ ID NO: 570358 - RNA, 64 nt, hsa; identical to SEQ ID NO: 311836

SEQ ID NO: 570359 - RNA, 64 nt, hsa; identical to SEQ ID NO: 311837

SEQ ID NO: 570360 - RNA, 64 nt, hsa; identical to SEQ ID NO: 311838

SEQ ID NO: 570361 - RNA, 64 nt, hsa; identical to SEQ ID NO: 311839

SEQ ID NO: 570362 - RNA, 64 nt, hsa; identical to SEQ ID NO: 311840

SEQ ID NO: 570363 - RNA, 64 nt, hsa; identical to SEQ ID NO: 311841

SEQ ID NO: 570364 - RNA, 64 nt, hsa; identical to SEQ ID NO: 311842

SEQ ID NO: 570365 - RNA, 64 nt, hsa; identical to SEQ ID NO: 311843

SEQ ID NO: 570366 - RNA, 64 nt, hsa; identical to SEQ ID NO: 311844

SEQ ID NO: 570367 - RNA, 64 nt, hsa; identical to SEQ ID NO: 311845

SEQ ID NO: 570368 - RNA, 64 nt, hsa; identical to SEQ ID NO: 311846

SEQ ID NO: 570369 - RNA, 64 nt, hsa; identical to SEQ ID NO: 58312

SEQ ID NO: 570370 - RNA, 64 nt, hsa; identical to SEQ ID NO: 58313

SEQ ID NO: 570371 - RNA, 64 nt, hsa; identical to SEQ ID NO: 58314

SEQ ID NO: 570372 - RNA, 64 nt, hsa; identical to SEQ ID NO: 58315

SEQ ID NO: 570373 - RNA, 64 nt, hsa; identical to SEQ ID NO: 58316

SEQ ID NO: 570374 - RNA, 64 nt, hsa; identical to SEQ ID NO: 58317

SEQ ID NO: 570375 - RNA, 64 nt, hsa; identical to SEQ ID NO: 58318

SEQ ID NO: 570376 - RNA, 64 nt, hsa; identical to SEQ ID NO: 58319

SEQ ID NO: 570377 - RNA, 64 nt, hsa; identical to SEQ ID NO: 58320

SEQ ID NO: 570378 - RNA, 64 nt, hsa; identical to SEQ ID NO: 58321

SEQ ID NO: 570379 - RNA, 64 nt, hsa; identical to SEQ ID NO: 58322

SEQ ID NO: 570380 - RNA, 64 nt, hsa; identical to SEQ ID NO: 58323

SEQ ID NO: 570381 - RNA, 64 nt, hsa; identical to SEQ ID NO: 58324

SEQ ID NO: 570382 - RNA, 64 nt, hsa; identical to SEQ ID NO: 58325

SEQ ID NO: 570383 - RNA, 64 nt, hsa; identical to SEQ ID NO: 58326

SEQ ID NO: 570384 - RNA, 64 nt, hsa; identical to SEQ ID NO: 58327

SEQ ID NO: 570385 - RNA, 64 nt, hsa; identical to SEQ ID NO: 58328

SEQ ID NO: 570386 - RNA, 64 nt, hsa; identical to SEQ ID NO: 58329

SEQ ID NO: 570387 - RNA, 64 nt, hsa; identical to SEQ ID NO: 58330

SEQ ID NO: 570388 - RNA, 64 nt, hsa; identical to SEQ ID NO: 58331

SEQ ID NO: 570389 - RNA, 64 nt, hsa; identical to SEQ ID NO: 58332

SEQ ID NO: 570390 - RNA, 64 nt, hsa; identical to SEQ ID NO: 58333

SEQ ID NO: 570391 - RNA, 64 nt, hsa; identical to SEQ ID NO: 58334

SEQ ID NO: 570392 - RNA, 64 nt, hsa; identical to SEQ ID NO: 58335

SEQ ID NO: 570393 - RNA, 64 nt, hsa; identical to SEQ ID NO: 58336

SEQ ID NO: 570394 - RNA, 64 nt, hsa; identical to SEQ ID NO: 58337

SEQ ID NO: 570395 - RNA, 64 nt, hsa; identical to SEQ ID NO: 58338

SEQ ID NO: 570396 - RNA, 64 nt, hsa; identical to SEQ ID NO: 58339

SEQ ID NO: 570397 - RNA, 64 nt, hsa; identical to SEQ ID NO: 58340

SEQ ID NO: 570398 - RNA, 64 nt, hsa; identical to SEQ ID NO: 58341

SEQ ID NO: 570399 - RNA, 64 nt, hsa; identical to SEQ ID NO: 58342

SEQ ID NO: 570400 - RNA, 64 nt, hsa; identical to SEQ ID NO: 58343

SEQ ID NO: 570401 - RNA, 64 nt, hsa; identical to SEQ ID NO: 58344

SEQ ID NO: 570402 - RNA, 64 nt, hsa; identical to SEQ ID NO: 58345

SEQ ID NO: 570403 - RNA, 64 nt, hsa; identical to SEQ ID NO: 58346

SEQ ID NO: 570404 - RNA, 64 nt, hsa; identical to SEQ ID NO: 58347

SEQ ID NO: 570405 - RNA, 64 nt, hsa; identical to SEQ ID NO: 58348

SEQ ID NO: 570406 - RNA, 64 nt, hsa; identical to SEQ ID NO: 58349

SEQ ID NO: 570407 - RNA, 64 nt, hsa; identical to SEQ ID NO: 58350

SEQ ID NO: 570408 - RNA, 64 nt, hsa; identical to SEQ ID NO: 58351

SEQ ID NO: 570409 - RNA, 64 nt, hsa; identical to SEQ ID NO: 58352

SEQ ID NO: 570410 - RNA, 64 nt, hsa; identical to SEQ ID NO: 58353

SEQ ID NO: 570411 - RNA, 64 nt, hsa; identical to SEQ ID NO: 58354

SEQ ID NO: 570412 - RNA, 64 nt, hsa; identical to SEQ ID NO: 58355

SEQ ID NO: 570413 - RNA, 64 nt, hsa; identical to SEQ ID NO: 58356

SEQ ID NO: 570414 - RNA, 64 nt, hsa; identical to SEQ ID NO: 58357

SEQ ID NO: 570415 - RNA, 64 nt, hsa; identical to SEQ ID NO: 58358

SEQ ID NO: 570416 - RNA, 64 nt, hsa; identical to SEQ ID NO: 58359

SEQ ID NO: 570417 - RNA, 64 nt, hsa; identical to SEQ ID NO: 58360

SEQ ID NO: 570418 - RNA, 64 nt, hsa; identical to SEQ ID NO: 58361

SEQ ID NO: 570419 - RNA, 64 nt, hsa; identical to SEQ ID NO: 58362

SEQ ID NO: 570420 - RNA, 64 nt, hsa; identical to SEQ ID NO: 58363

SEQ ID NO: 570421 - RNA, 64 nt, hsa; identical to SEQ ID NO: 58364

SEQ ID NO: 570422 - RNA, 64 nt, hsa; identical to SEQ ID NO: 58365

SEQ ID NO: 570423 - RNA, 64 nt, hsa; identical to SEQ ID NO: 58366

SEQ ID NO: 570424 - RNA, 64 nt, hsa; identical to SEQ ID NO: 58367

SEQ ID NO: 570425 - RNA, 64 nt, hsa; identical to SEQ ID NO: 58368

SEQ ID NO: 570426 - RNA, 64 nt, hsa; identical to SEQ ID NO: 58369

SEQ ID NO: 570427 - RNA, 64 nt, hsa; identical to SEQ ID NO: 58370

SEQ ID NO: 570428 - RNA, 64 nt, hsa; identical to SEQ ID NO: 58371

SEQ ID NO: 570429 - RNA, 64 nt, hsa; identical to SEQ ID NO: 58372

SEQ ID NO: 570430 - RNA, 64 nt, hsa; identical to SEQ ID NO: 58373

SEQ ID NO: 570431 - RNA, 64 nt, hsa; identical to SEQ ID NO: 58374

SEQ ID NO: 570432 - RNA, 64 nt, hsa; identical to SEQ ID NO: 58375

SEQ ID NO: 570433 - RNA, 64 nt, hsa; identical to SEQ ID NO: 58376

SEQ ID NO: 570434 - RNA, 64 nt, hsa; identical to SEQ ID NO: 58377

SEQ ID NO: 570435 - RNA, 64 nt, hsa; identical to SEQ ID NO: 58378

SEQ ID NO: 570436 - RNA, 64 nt, hsa; identical to SEQ ID NO: 58379

SEQ ID NO: 570437 - RNA, 64 nt, hsa; identical to SEQ ID NO: 58380

SEQ ID NO: 570438 - RNA, 64 nt, hsa; identical to SEQ ID NO: 58381

SEQ ID NO: 570439 - RNA, 64 nt, hsa; identical to SEQ ID NO: 58382

SEQ ID NO: 570440 - RNA, 64 nt, hsa; identical to SEQ ID NO: 58383

SEQ ID NO: 570441 - RNA, 64 nt, hsa; identical to SEQ ID NO: 58384

SEQ ID NO: 570442 - RNA, 64 nt, hsa; identical to SEQ ID NO: 58385

SEQ ID NO: 570443 - RNA, 64 nt, hsa; identical to SEQ ID NO: 58386

SEQ ID NO: 570444 - RNA, 64 nt, hsa; identical to SEQ ID NO: 58387

SEQ ID NO: 570445 - RNA, 64 nt, hsa; identical to SEQ ID NO: 58388

SEQ ID NO: 570446 - RNA, 64 nt, hsa; identical to SEQ ID NO: 58389

SEQ ID NO: 570447 - RNA, 64 nt, hsa; identical to SEQ ID NO: 58390

SEQ ID NO: 570448 - RNA, 64 nt, hsa; identical to SEQ ID NO: 58391

SEQ ID NO: 570449 - RNA, 64 nt, hsa; identical to SEQ ID NO: 58392

SEQ ID NO: 570450 - RNA, 64 nt, hsa; identical to SEQ ID NO: 58393

SEQ ID NO: 570451 - RNA, 64 nt, hsa; identical to SEQ ID NO: 58394

SEQ ID NO: 570452 - RNA, 64 nt, hsa; identical to SEQ ID NO: 58395

SEQ ID NO: 570453 - RNA, 64 nt, hsa; identical to SEQ ID NO: 58396

SEQ ID NO: 570454 - RNA, 64 nt, hsa; identical to SEQ ID NO: 58397

SEQ ID NO: 570455 - RNA, 64 nt, hsa; identical to SEQ ID NO: 58398

SEQ ID NO: 570456 - RNA, 64 nt, hsa; identical to SEQ ID NO: 58399

SEQ ID NO: 570457 - RNA, 64 nt, hsa; identical to SEQ ID NO: 58400

SEQ ID NO: 570458 - RNA, 64 nt, hsa; identical to SEQ ID NO: 58401

SEQ ID NO: 570459 - RNA, 64 nt, hsa; identical to SEQ ID NO: 58402

SEQ ID NO: 570460 - RNA, 64 nt, hsa; identical to SEQ ID NO: 58403

SEQ ID NO: 570461 - RNA, 64 nt, hsa; identical to SEQ ID NO: 58404

SEQ ID NO: 570462 - RNA, 64 nt, hsa; identical to SEQ ID NO: 58405

SEQ ID NO: 570463 - RNA, 64 nt, hsa; identical to SEQ ID NO: 58406

SEQ ID NO: 570464 - RNA, 64 nt, hsa; identical to SEQ ID NO: 58407

SEQ ID NO: 570465 - RNA, 64 nt, hsa; identical to SEQ ID NO: 58408

SEQ ID NO: 570466 - RNA, 64 nt, hsa; identical to SEQ ID NO: 58409

SEQ ID NO: 570467 - RNA, 64 nt, hsa; identical to SEQ ID NO: 58410

SEQ ID NO: 570468 - RNA, 64 nt, hsa; identical to SEQ ID NO: 58411

SEQ ID NO: 570469 - RNA, 64 nt, hsa; identical to SEQ ID NO: 58412

SEQ ID NO: 570470 - RNA, 64 nt, hsa; identical to SEQ ID NO: 58413

SEQ ID NO: 570471 - RNA, 64 nt, hsa; identical to SEQ ID NO: 58414

SEQ ID NO: 570472 - RNA, 64 nt, hsa; identical to SEQ ID NO: 58415

SEQ ID NO: 570473 - RNA, 64 nt, hsa; identical to SEQ ID NO: 58416

SEQ ID NO: 570474 - RNA, 64 nt, hsa; identical to SEQ ID NO: 58417

SEQ ID NO: 570475 - RNA, 64 nt, hsa; identical to SEQ ID NO: 58418

SEQ ID NO: 570476 - RNA, 64 nt, hsa; identical to SEQ ID NO: 58419

SEQ ID NO: 570477 - RNA, 64 nt, hsa; identical to SEQ ID NO: 58420

SEQ ID NO: 570478 - RNA, 64 nt, hsa; identical to SEQ ID NO: 58421

SEQ ID NO: 570479 - RNA, 64 nt, hsa; identical to SEQ ID NO: 58422

SEQ ID NO: 570480 - RNA, 64 nt, hsa; identical to SEQ ID NO: 58423

SEQ ID NO: 570481 - RNA, 64 nt, hsa; identical to SEQ ID NO: 58424

SEQ ID NO: 570482 - RNA, 64 nt, hsa; identical to SEQ ID NO: 58425

SEQ ID NO: 570483 - RNA, 64 nt, hsa; identical to SEQ ID NO: 58426

SEQ ID NO: 570484 - RNA, 64 nt, hsa; identical to SEQ ID NO: 58427

SEQ ID NO: 570485 - RNA, 64 nt, hsa; identical to SEQ ID NO: 58428

SEQ ID NO: 570486 - RNA, 64 nt, hsa; identical to SEQ ID NO: 58429

SEQ ID NO: 570487 - RNA, 64 nt, hsa; identical to SEQ ID NO: 58430

SEQ ID NO: 570488 - RNA, 64 nt, hsa; identical to SEQ ID NO: 58431

SEQ ID NO: 570489 - RNA, 64 nt, hsa; identical to SEQ ID NO: 58432

SEQ ID NO: 570490 - RNA, 64 nt, hsa; identical to SEQ ID NO: 58433

SEQ ID NO: 570491 - RNA, 64 nt, hsa; identical to SEQ ID NO: 58434

SEQ ID NO: 570492 - RNA, 64 nt, hsa; identical to SEQ ID NO: 58435

SEQ ID NO: 570493 - RNA, 50 nt, hsa; identical to SEQ ID NO: 58436

SEQ ID NO: 570494 - RNA, 64 nt, hsa; identical to SEQ ID NO: 58437

SEQ ID NO: 570495 - RNA, 64 nt, hsa; identical to SEQ ID NO: 58438

SEQ ID NO: 570496 - RNA, 64 nt, hsa; identical to SEQ ID NO: 58439

SEQ ID NO: 570497 - RNA, 64 nt, hsa; identical to SEQ ID NO: 58440

SEQ ID NO: 570498 - RNA, 64 nt, hsa; identical to SEQ ID NO: 58441

SEQ ID NO: 570499 - RNA, 64 nt, hsa; identical to SEQ ID NO: 58442

SEQ ID NO: 570500 - RNA, 64 nt, hsa; identical to SEQ ID NO: 58443

SEQ ID NO: 570501 - RNA, 64 nt, hsa; identical to SEQ ID NO: 58444

SEQ ID NO: 570502 - RNA, 64 nt, hsa; identical to SEQ ID NO: 58445

SEQ ID NO: 570503 - RNA, 64 nt, hsa; identical to SEQ ID NO: 58446

SEQ ID NO: 570504 - RNA, 64 nt, hsa; identical to SEQ ID NO: 58447

SEQ ID NO: 570505 - RNA, 64 nt, hsa; identical to SEQ ID NO: 58448

SEQ ID NO: 570506 - RNA, 64 nt, hsa; identical to SEQ ID NO: 58449

SEQ ID NO: 570507 - RNA, 64 nt, hsa; identical to SEQ ID NO: 58450

SEQ ID NO: 570508 - RNA, 64 nt, hsa; identical to SEQ ID NO: 58451

SEQ ID NO: 570509 - RNA, 64 nt, hsa; identical to SEQ ID NO: 58452

SEQ ID NO: 570510 - RNA, 64 nt, hsa; identical to SEQ ID NO: 58453

SEQ ID NO: 570511 - RNA, 64 nt, hsa; identical to SEQ ID NO: 58454

SEQ ID NO: 570512 - RNA, 64 nt, hsa; identical to SEQ ID NO: 58455

SEQ ID NO: 570513 - RNA, 64 nt, hsa; identical to SEQ ID NO: 58456

SEQ ID NO: 570514 - RNA, 64 nt, hsa; identical to SEQ ID NO: 58457

SEQ ID NO: 570515 - RNA, 64 nt, hsa; identical to SEQ ID NO: 58458

SEQ ID NO: 570516 - RNA, 64 nt, hsa; identical to SEQ ID NO: 58459

SEQ ID NO: 570517 - RNA, 64 nt, hsa; identical to SEQ ID NO: 58460

SEQ ID NO: 570518 - RNA, 64 nt, hsa; identical to SEQ ID NO: 58461

SEQ ID NO: 570519 - RNA, 64 nt, hsa; identical to SEQ ID NO: 58462

SEQ ID NO: 570520 - RNA, 64 nt, hsa; identical to SEQ ID NO: 58463

SEQ ID NO: 570521 - RNA, 64 nt, hsa; identical to SEQ ID NO: 58464

SEQ ID NO: 570522 - RNA, 64 nt, hsa; identical to SEQ ID NO: 58465

SEQ ID NO: 570523 - RNA, 64 nt, hsa; identical to SEQ ID NO: 58466

SEQ ID NO: 570524 - RNA, 64 nt, hsa; identical to SEQ ID NO: 58467

SEQ ID NO: 570525 - RNA, 64 nt, hsa
ggagagagaaggacagugcacggagagguuuccagagcacaaauuguugguuccuagcacaaau

SEQ ID NO: 570526 - RNA, 64 nt, hsa
aauuguugguuccuagcacaaauuagaugguuuggagcacaauggugaagcacacuccccuccc

SEQ ID NO: 570527 - RNA, 64 nt, hsa
ggaugggacgaugugcccagggagggacccaccagagcacaagagaagguggcuaccugggggu

SEQ ID NO: 570528 - RNA, 64 nt, hsa
gcaaggagcuaggacccccaguccugccccccaggagcacaagcaggguccccucagucaaggc

SEQ ID NO: 570529 - RNA, 64 nt, hsa
agauuugagcauuugaagauucaaaguugcgaaagagcacaaaccauauuagguaaaauauugg

SEQ ID NO: 570530 - RNA, 64 nt, hsa
aacaauguuuucuuucugguagcgcauaauaacagagcacaagcaucuuuuagauuugagcauu

SEQ ID NO: 570531 - RNA, 64 nt, hsa; identical to SEQ ID NO: 21124

SEQ ID NO: 570532 - RNA, 64 nt, hsa; identical to SEQ ID NO: 21125

SEQ ID NO: 570533 - RNA, 64 nt, hsa; identical to SEQ ID NO: 21126

SEQ ID NO: 570534 - RNA, 64 nt, hsa; identical to SEQ ID NO: 21127

SEQ ID NO: 570535 - RNA, 64 nt, hsa; identical to SEQ ID NO: 21128

SEQ ID NO: 570536 - RNA, 64 nt, hsa; identical to SEQ ID NO: 21129

SEQ ID NO: 570537 - RNA, 64 nt, hsa; identical to SEQ ID NO: 21130

SEQ ID NO: 570538 - RNA, 64 nt, hsa; identical to SEQ ID NO: 21131

SEQ ID NO: 570539 - RNA, 64 nt, hsa; identical to SEQ ID NO: 21132

SEQ ID NO: 570540 - RNA, 64 nt, hsa; identical to SEQ ID NO: 21133

SEQ ID NO: 570541 - RNA, 64 nt, hsa; identical to SEQ ID NO: 21134

SEQ ID NO: 570542 - RNA, 64 nt, hsa; identical to SEQ ID NO: 21135

SEQ ID NO: 570543 - RNA, 64 nt, hsa; identical to SEQ ID NO: 21136

SEQ ID NO: 570544 - RNA, 64 nt, hsa; identical to SEQ ID NO: 21137

SEQ ID NO: 570545 - RNA, 64 nt, hsa; identical to SEQ ID NO: 21138

SEQ ID NO: 570546 - RNA, 64 nt, hsa; identical to SEQ ID NO: 21139

SEQ ID NO: 570547 - RNA, 64 nt, hsa; identical to SEQ ID NO: 21140

SEQ ID NO: 570548 - RNA, 64 nt, hsa; identical to SEQ ID NO: 21141

SEQ ID NO: 570549 - RNA, 64 nt, hsa
gucugucauggggaaacuauauuuuugagcacauggaacaaauuauacuuccucauucauauua

SEQ ID NO: 570550 - RNA, 64 nt, hsa
uaguccuauaauuuucagcuuaauuauaaacaaaggaacaaauaaguggaagggcagcuauuac

SEQ ID NO: 570551 - RNA, 64 nt, hsa
uugauucgaaggaugaagacgaagaagcaagggaggaacaaaugaagaaccaucuuuguucaug

SEQ ID NO: 570552 - RNA, 64 nt, hsa
gugucauggugcagagguaggcauucugagcaggggaacaaaauaagggccuagaaacucaccc

SEQ ID NO: 570553 - RNA, 64 nt, hsa
cugagccaccccacccggccuauuuucuuaaaggggaacaaaugaucuugacaacauauuauuc

SEQ ID NO: 570554 - RNA, 64 nt, hsa
gggauuaugacagguauuaccaaaaacaccaaaaggaacaaaggggccugcguuaaaaccuaau

SEQ ID NO: 570555 - RNA, 64 nt, hsa
uuuacuguuagacuaaucaaaaauaacuuuaaaaggaacaaagaaacuccaacauuucacauua

SEQ ID NO: 570556 - RNA, 64 nt, hsa
ggaaucaagaccaauaccaaggagaaauuccuagggaacaaaaauuccaaugaggaauugaccu

SEQ ID NO: 570557 - RNA, 64 nt, hsa
aguuauuuccuuuuauaauacuuuucuuccccauggaacaaaugggaucaauuugugaguuuuu

SEQ ID NO: 570558 - RNA, 64 nt, hsa
guucacugagggguggcacgggaccacuccagguggaacaaacagaaaugacugugguguggag

SEQ ID NO: 570559 - RNA, 64 nt, hsa
gggauguaauccuuacauugcuuuuccaaggaagggaacaaaagucuagugauuaguaugccaa

SEQ ID NO: 570560 - RNA, 64 nt, hsa
ugauuaaaaucgaacuuuauuacauacugauucuggaacaaaacaguuagaaaaacuuuaaaaa

SEQ ID NO: 570561 - RNA, 64 nt, hsa
ugggauuauaggugugagccaccgcacccaguugggaacaaagccuuuuuaacacacguaaggg

SEQ ID NO: 570562 - RNA, 64 nt, hsa
uaauaauuuuggaucauuuucuuuccuuuaaaggggaacaaagccuuuuuuuuuuuugagacgg

SEQ ID NO: 570563 - RNA, 64 nt, hsa
uauuuguaccuccagaauggcagaucccucagcaggaacaaaggcauauugacgguucucucag

SEQ ID NO: 570564 - RNA, 64 nt, hsa
auagauccccuuaaagaaaaaauacaggcuuuagggaacaaagggacaagcagaacaggugugg

SEQ ID NO: 570565 - RNA, 64 nt, hsa
uggauacacgaggaaaaggaaagagucucagaguggaacaaagagugggaagaggugaucugua

SEQ ID NO: 570566 - RNA, 64 nt, hsa
agcacccauuaaacaaguccuggcaggacucacaggaacaaacgaggucccuguuaggguucua

SEQ ID NO: 570567 - RNA, 64 nt, hsa
acuuuauuuuuauugguuccugaagacgggacaaggaacaaauacauacguuaauaugagagau

SEQ ID NO: 570568 - RNA, 64 nt, hsa
gaacuacuacucacaguuaccacuuggggucaguggaacaaaaugcauauaugguuuugacauu

SEQ ID NO: 570569 - RNA, 64 nt, hsa
ccaauccuuccacauacuguuaagauguagacuuggaacaaagcuguugggacccagagcaaug

SEQ ID NO: 570570 - RNA, 64 nt, hsa
auacucugcaaguugaccuggccucucccccacaggaacaaaacacugccuccagagucuuuaa

SEQ ID NO: 570571 - RNA, 64 nt, hsa
ucugugcaaacuggaggacuccuuccaacuuccuggaacaaagcgacaucgccagcagcaggcu

SEQ ID NO: 570572 - RNA, 64 nt, hsa
acagugugcucacucucagagccauggauuaccuggaacaaagugcagauuagugcccacgguc

SEQ ID NO: 570573 - RNA, 64 nt, hsa
aguuggaaguaaagcacuccucagcaaauguaaaggaacaaaaauuauaacaaacugucucuca

SEQ ID NO: 570574 - RNA, 64 nt, hsa
uccagaaucuacaaugaacucaaacaaauuuacaggaacaaacaaccccaucaaaaagucggca

SEQ ID NO: 570575 - RNA, 64 nt, hsa; identical to SEQ ID NO: 336334

SEQ ID NO: 570576 - RNA, 64 nt, hsa; identical to SEQ ID NO: 336335

SEQ ID NO: 570577 - RNA, 64 nt, hsa; identical to SEQ ID NO: 336336

SEQ ID NO: 570578 - RNA, 64 nt, hsa; identical to SEQ ID NO: 336337

SEQ ID NO: 570579 - RNA, 64 nt, hsa; identical to SEQ ID NO: 336338

SEQ ID NO: 570580 - RNA, 64 nt, hsa; identical to SEQ ID NO: 336339

SEQ ID NO: 570581 - RNA, 64 nt, hsa; identical to SEQ ID NO: 336340

SEQ ID NO: 570582 - RNA, 64 nt, hsa; identical to SEQ ID NO: 336341

SEQ ID NO: 570583 - RNA, 64 nt, hsa; identical to SEQ ID NO: 336342

SEQ ID NO: 570584 - RNA, 64 nt, hsa; identical to SEQ ID NO: 336343

SEQ ID NO: 570585 - RNA, 64 nt, hsa
ucugagaacacagaauaauccaucauuuuuaauuucaagauauugguacauuuuauagguauca

SEQ ID NO: 570586 - RNA, 64 nt, hsa
aguccuauuacagcuaaucucguuuuaaaucugcucaagauaaaauguaacuuggaaagcgagg

SEQ ID NO: 570587 - RNA, 64 nt, hsa
gaaaaauaguuuuugaaaacaucagauuauaaaaucaagauaguccggacgcgguggcacaugc

SEQ ID NO: 570588 - RNA, 64 nt, hsa
gcgacagagcgagacuccaccucaaaaaauaaaaucaagauaaccucuugaauguaauagcuca

SEQ ID NO: 570589 - RNA, 64 nt, hsa
agaguauggauaaucuuuggauuuggagagccguucaagauacuuccagcuucuuggcucagcc

SEQ ID NO: 570590 - RNA, 64 nt, hsa
uucccaugcagauugugaaauguaaugagauguaucaagauauccuagaaauaaaaaccagaug

SEQ ID NO: 570591 - RNA, 64 nt, hsa
uuuucacuguaggcuauuacaggauacuucaggaucaagauacagaaccuuuuauuuaaagagu

SEQ ID NO: 570592 - RNA, 64 nt, hsa
gucaauguguuuguuugugucucugagauugacuucaagauaauaagcugcuaauuguaaacaa

SEQ ID NO: 570593 - RNA, 64 nt, hsa
aaccuguguucuccucauaauaguauagaauaauucaagauaggcaagaaggacagcaguaaau

SEQ ID NO: 570594 - RNA, 64 nt, hsa; identical to SEQ ID NO: 48032

SEQ ID NO: 570595 - RNA, 64 nt, hsa; identical to SEQ ID NO: 48033

SEQ ID NO: 570596 - RNA, 64 nt, hsa; identical to SEQ ID NO: 48034

SEQ ID NO: 570597 - RNA, 64 nt, hsa; identical to SEQ ID NO: 48035

SEQ ID NO: 570598 - RNA, 64 nt, hsa; identical to SEQ ID NO: 48036

SEQ ID NO: 570599 - RNA, 64 nt, hsa; identical to SEQ ID NO: 48037

SEQ ID NO: 570600 - RNA, 64 nt, hsa; identical to SEQ ID NO: 48038

SEQ ID NO: 570601 - RNA, 64 nt, hsa; identical to SEQ ID NO: 48039

SEQ ID NO: 570602 - RNA, 64 nt, hsa; identical to SEQ ID NO: 48040

SEQ ID NO: 570603 - RNA, 64 nt, hsa; identical to SEQ ID NO: 48041

SEQ ID NO: 570604 - RNA, 64 nt, hsa; identical to SEQ ID NO: 48042

SEQ ID NO: 570605 - RNA, 64 nt, hsa; identical to SEQ ID NO: 48043

SEQ ID NO: 570606 - RNA, 64 nt, hsa; identical to SEQ ID NO: 48044

SEQ ID NO: 570607 - RNA, 64 nt, hsa; identical to SEQ ID NO: 48045

SEQ ID NO: 570608 - RNA, 64 nt, hsa; identical to SEQ ID NO: 48046

SEQ ID NO: 570609 - RNA, 64 nt, hsa; identical to SEQ ID NO: 48047

SEQ ID NO: 570610 - RNA, 64 nt, hsa; identical to SEQ ID NO: 21683

SEQ ID NO: 570611 - RNA, 64 nt, hsa; identical to SEQ ID NO: 21684

SEQ ID NO: 570612 - RNA, 64 nt, hsa; identical to SEQ ID NO: 21685

SEQ ID NO: 570613 - RNA, 64 nt, hsa; identical to SEQ ID NO: 21686

SEQ ID NO: 570614 - RNA, 64 nt, hsa; identical to SEQ ID NO: 21687

SEQ ID NO: 570615 - RNA, 64 nt, hsa; identical to SEQ ID NO: 21688

SEQ ID NO: 570616 - RNA, 64 nt, hsa; identical to SEQ ID NO: 21689

SEQ ID NO: 570617 - RNA, 64 nt, hsa; identical to SEQ ID NO: 21690

SEQ ID NO: 570618 - RNA, 64 nt, hsa; identical to SEQ ID NO: 21691

SEQ ID NO: 570619 - RNA, 64 nt, hsa; identical to SEQ ID NO: 21692

SEQ ID NO: 570620 - RNA, 64 nt, hsa; identical to SEQ ID NO: 21693

SEQ ID NO: 570621 - RNA, 64 nt, hsa; identical to SEQ ID NO: 21694

SEQ ID NO: 570622 - RNA, 52 nt, hsa; identical to SEQ ID NO: 21695

SEQ ID NO: 570623 - RNA, 64 nt, hsa; identical to SEQ ID NO: 21696

SEQ ID NO: 570624 - RNA, 64 nt, hsa; identical to SEQ ID NO: 21697

SEQ ID NO: 570625 - RNA, 64 nt, hsa; identical to SEQ ID NO: 21698

SEQ ID NO: 570626 - RNA, 64 nt, hsa; identical to SEQ ID NO: 21699

SEQ ID NO: 570627 - RNA, 64 nt, hsa; identical to SEQ ID NO: 21700

SEQ ID NO: 570628 - RNA, 64 nt, hsa; identical to SEQ ID NO: 21701

SEQ ID NO: 570629 - RNA, 64 nt, hsa; identical to SEQ ID NO: 21702

SEQ ID NO: 570630 - RNA, 64 nt, hsa; identical to SEQ ID NO: 21703

SEQ ID NO: 570631 - RNA, 64 nt, hsa; identical to SEQ ID NO: 21704

SEQ ID NO: 570632 - RNA, 64 nt, hsa; identical to SEQ ID NO: 21705

SEQ ID NO: 570633 - RNA, 64 nt, hsa; identical to SEQ ID NO: 21706

SEQ ID NO: 570634 - RNA, 64 nt, hsa; identical to SEQ ID NO: 21707

SEQ ID NO: 570635 - RNA, 64 nt, hsa; identical to SEQ ID NO: 21708

SEQ ID NO: 570636 - RNA, 64 nt, hsa; identical to SEQ ID NO: 21709

SEQ ID NO: 570637 - RNA, 64 nt, hsa; identical to SEQ ID NO: 21710

SEQ ID NO: 570638 - RNA, 64 nt, hsa; identical to SEQ ID NO: 21711

SEQ ID NO: 570639 - RNA, 64 nt, hsa; identical to SEQ ID NO: 21712

SEQ ID NO: 570640 - RNA, 64 nt, hsa; identical to SEQ ID NO: 21713

SEQ ID NO: 570641 - RNA, 64 nt, hsa; identical to SEQ ID NO: 21714

SEQ ID NO: 570642 - RNA, 64 nt, hsa; identical to SEQ ID NO: 21715

SEQ ID NO: 570643 - RNA, 64 nt, hsa; identical to SEQ ID NO: 21716

SEQ ID NO: 570644 - RNA, 64 nt, hsa; identical to SEQ ID NO: 21717

SEQ ID NO: 570645 - RNA, 64 nt, hsa; identical to SEQ ID NO: 21718

SEQ ID NO: 570646 - RNA, 64 nt, hsa; identical to SEQ ID NO: 21719

SEQ ID NO: 570647 - RNA, 64 nt, hsa; identical to SEQ ID NO: 21720

SEQ ID NO: 570648 - RNA, 64 nt, hsa; identical to SEQ ID NO: 21721

SEQ ID NO: 570649 - RNA, 64 nt, hsa; identical to SEQ ID NO: 21722

SEQ ID NO: 570650 - RNA, 64 nt, hsa; identical to SEQ ID NO: 21723

SEQ ID NO: 570651 - RNA, 64 nt, hsa; identical to SEQ ID NO: 21724

SEQ ID NO: 570652 - RNA, 64 nt, hsa; identical to SEQ ID NO: 21725

SEQ ID NO: 570653 - RNA, 64 nt, hsa; identical to SEQ ID NO: 21726

SEQ ID NO: 570654 - RNA, 64 nt, hsa; identical to SEQ ID NO: 21727

SEQ ID NO: 570655 - RNA, 64 nt, hsa; identical to SEQ ID NO: 21728

SEQ ID NO: 570656 - RNA, 64 nt, hsa; identical to SEQ ID NO: 21729

SEQ ID NO: 570657 - RNA, 64 nt, hsa; identical to SEQ ID NO: 21730

SEQ ID NO: 570658 - RNA, 64 nt, hsa; identical to SEQ ID NO: 21731

SEQ ID NO: 570659 - RNA, 64 nt, hsa; identical to SEQ ID NO: 21732

SEQ ID NO: 570660 - RNA, 64 nt, hsa; identical to SEQ ID NO: 21733

SEQ ID NO: 570661 - RNA, 64 nt, hsa; identical to SEQ ID NO: 21734

SEQ ID NO: 570662 - RNA, 64 nt, hsa; identical to SEQ ID NO: 21735

SEQ ID NO: 570663 - RNA, 64 nt, hsa; identical to SEQ ID NO: 21736

SEQ ID NO: 570664 - RNA, 64 nt, hsa; identical to SEQ ID NO: 21737

SEQ ID NO: 570665 - RNA, 64 nt, hsa; identical to SEQ ID NO: 21738

SEQ ID NO: 570666 - RNA, 64 nt, hsa; identical to SEQ ID NO: 21739

SEQ ID NO: 570667 - RNA, 64 nt, hsa; identical to SEQ ID NO: 21740

SEQ ID NO: 570668 - RNA, 64 nt, hsa; identical to SEQ ID NO: 21741

SEQ ID NO: 570669 - RNA, 64 nt, hsa; identical to SEQ ID NO: 21742

SEQ ID NO: 570670 - RNA, 64 nt, hsa; identical to SEQ ID NO: 21743

SEQ ID NO: 570671 - RNA, 64 nt, hsa; identical to SEQ ID NO: 21744

SEQ ID NO: 570672 - RNA, 64 nt, hsa; identical to SEQ ID NO: 21745

SEQ ID NO: 570673 - RNA, 64 nt, hsa; identical to SEQ ID NO: 21746

SEQ ID NO: 570674 - RNA, 64 nt, hsa; identical to SEQ ID NO: 21747

SEQ ID NO: 570675 - RNA, 64 nt, hsa; identical to SEQ ID NO: 293071

SEQ ID NO: 570676 - RNA, 64 nt, hsa; identical to SEQ ID NO: 293072

SEQ ID NO: 570677 - RNA, 64 nt, hsa; identical to SEQ ID NO: 293073

SEQ ID NO: 570678 - RNA, 64 nt, hsa; identical to SEQ ID NO: 293074

SEQ ID NO: 570679 - RNA, 64 nt, hsa; identical to SEQ ID NO: 293075

SEQ ID NO: 570680 - RNA, 64 nt, hsa; identical to SEQ ID NO: 293076

SEQ ID NO: 570681 - RNA, 64 nt, hsa; identical to SEQ ID NO: 293077

SEQ ID NO: 570682 - RNA, 64 nt, hsa; identical to SEQ ID NO: 293078

SEQ ID NO: 570683 - RNA, 64 nt, hsa; identical to SEQ ID NO: 293079

SEQ ID NO: 570684 - RNA, 64 nt, hsa; identical to SEQ ID NO: 293080

SEQ ID NO: 570685 - RNA, 64 nt, hsa; identical to SEQ ID NO: 293081

SEQ ID NO: 570686 - RNA, 64 nt, hsa; identical to SEQ ID NO: 293082

SEQ ID NO: 570687 - RNA, 64 nt, hsa; identical to SEQ ID NO: 293083

SEQ ID NO: 570688 - RNA, 64 nt, hsa; identical to SEQ ID NO: 293084

SEQ ID NO: 570689 - RNA, 64 nt, hsa; identical to SEQ ID NO: 293085

SEQ ID NO: 570690 - RNA, 64 nt, hsa; identical to SEQ ID NO: 293086

SEQ ID NO: 570691 - RNA, 64 nt, hsa; identical to SEQ ID NO: 293087

SEQ ID NO: 570692 - RNA, 64 nt, hsa; identical to SEQ ID NO: 293088

SEQ ID NO: 570693 - RNA, 64 nt, hsa; identical to SEQ ID NO: 293089

SEQ ID NO: 570694 - RNA, 64 nt, hsa; identical to SEQ ID NO: 293090

SEQ ID NO: 570695 - RNA, 64 nt, hsa; identical to SEQ ID NO: 293091

SEQ ID NO: 570696 - RNA, 64 nt, hsa; identical to SEQ ID NO: 293092

SEQ ID NO: 570697 - RNA, 64 nt, hsa; identical to SEQ ID NO: 293093

SEQ ID NO: 570698 - RNA, 64 nt, hsa; identical to SEQ ID NO: 293094

SEQ ID NO: 570699 - RNA, 64 nt, hsa; identical to SEQ ID NO: 293095

SEQ ID NO: 570700 - RNA, 64 nt, hsa; identical to SEQ ID NO: 293096

SEQ ID NO: 570701 - RNA, 64 nt, hsa; identical to SEQ ID NO: 293097

SEQ ID NO: 570702 - RNA, 64 nt, hsa; identical to SEQ ID NO: 293098

SEQ ID NO: 570703 - RNA, 64 nt, hsa; identical to SEQ ID NO: 293099

SEQ ID NO: 570704 - RNA, 64 nt, hsa; identical to SEQ ID NO: 293100

SEQ ID NO: 570705 - RNA, 64 nt, hsa; identical to SEQ ID NO: 293101

SEQ ID NO: 570706 - RNA, 64 nt, hsa; identical to SEQ ID NO: 293102

SEQ ID NO: 570707 - RNA, 57 nt, hsa
uaaaauauaaagcuacauccaaagaaaugccaauaugugacauuaguaugaaauuua

SEQ ID NO: 570708 - RNA, 57 nt, hsa
ggugguaggaauagcaacuaauacaaaugccaauaugauaauaaaauacauuugucu

SEQ ID NO: 570709 - RNA, 57 nt, hsa
cacaaagauuaaaaguuacuuuaaauuugccaauauuuugggagaacaauaaaacua

SEQ ID NO: 570710 - RNA, 57 nt, hsa
augguugaaggaaugcucaguuucauuugccaauaaauugguuucucauaacuugca

SEQ ID NO: 570711 - RNA, 57 nt, hsa
auuccuuuguuuaauuuuuaagcucuuugccaauauuccauuucucuagaauguuua

SEQ ID NO: 570712 - RNA, 64 nt, hsa; identical to SEQ ID NO: 47689

SEQ ID NO: 570713 - RNA, 64 nt, hsa; identical to SEQ ID NO: 47690

SEQ ID NO: 570714 - RNA, 64 nt, hsa; identical to SEQ ID NO: 47691

SEQ ID NO: 570715 - RNA, 64 nt, hsa; identical to SEQ ID NO: 47692

SEQ ID NO: 570716 - RNA, 64 nt, hsa; identical to SEQ ID NO: 47693

SEQ ID NO: 570717 - RNA, 64 nt, hsa; identical to SEQ ID NO: 47694

SEQ ID NO: 570718 - RNA, 64 nt, hsa; identical to SEQ ID NO: 47695

SEQ ID NO: 570719 - RNA, 64 nt, hsa; identical to SEQ ID NO: 47696

SEQ ID NO: 570720 - RNA, 64 nt, hsa; identical to SEQ ID NO: 47697

SEQ ID NO: 570721 - RNA, 64 nt, hsa; identical to SEQ ID NO: 47698

SEQ ID NO: 570722 - RNA, 64 nt, hsa; identical to SEQ ID NO: 47699

SEQ ID NO: 570723 - RNA, 64 nt, hsa; identical to SEQ ID NO: 47700

SEQ ID NO: 570724 - RNA, 64 nt, hsa; identical to SEQ ID NO: 47701

SEQ ID NO: 570725 - RNA, 64 nt, hsa; identical to SEQ ID NO: 47702

SEQ ID NO: 570726 - RNA, 64 nt, hsa; identical to SEQ ID NO: 47703

SEQ ID NO: 570727 - RNA, 64 nt, hsa; identical to SEQ ID NO: 47704

SEQ ID NO: 570728 - RNA, 64 nt, hsa; identical to SEQ ID NO: 255688

SEQ ID NO: 570729 - RNA, 64 nt, hsa; identical to SEQ ID NO: 255689

SEQ ID NO: 570730 - RNA, 64 nt, hsa; identical to SEQ ID NO: 255690

SEQ ID NO: 570731 - RNA, 64 nt, hsa; identical to SEQ ID NO: 255691

SEQ ID NO: 570732 - RNA, 64 nt, hsa; identical to SEQ ID NO: 255692

SEQ ID NO: 570733 - RNA, 64 nt, hsa; identical to SEQ ID NO: 255693

SEQ ID NO: 570734 - RNA, 64 nt, hsa; identical to SEQ ID NO: 255694

SEQ ID NO: 570735 - RNA, 64 nt, hsa; identical to SEQ ID NO: 255695

SEQ ID NO: 570736 - RNA, 64 nt, hsa; identical to SEQ ID NO: 511695

SEQ ID NO: 570737 - RNA, 64 nt, hsa; identical to SEQ ID NO: 511696

SEQ ID NO: 570738 - RNA, 64 nt, hsa; identical to SEQ ID NO: 511697

SEQ ID NO: 570739 - RNA, 64 nt, hsa; identical to SEQ ID NO: 511698

SEQ ID NO: 570740 - RNA, 64 nt, hsa; identical to SEQ ID NO: 511699

SEQ ID NO: 570741 - RNA, 64 nt, hsa; identical to SEQ ID NO: 511700

SEQ ID NO: 570742 - RNA, 64 nt, hsa; identical to SEQ ID NO: 511701

SEQ ID NO: 570743 - RNA, 64 nt, hsa; identical to SEQ ID NO: 511702

SEQ ID NO: 570744 - RNA, 64 nt, hsa; identical to SEQ ID NO: 511703

SEQ ID NO: 570745 - RNA, 64 nt, hsa; identical to SEQ ID NO: 511704

SEQ ID NO: 570746 - RNA, 64 nt, hsa; identical to SEQ ID NO: 511705

SEQ ID NO: 570747 - RNA, 64 nt, hsa; identical to SEQ ID NO: 511706

SEQ ID NO: 570748 - RNA, 64 nt, hsa; identical to SEQ ID NO: 511707

SEQ ID NO: 570749 - RNA, 64 nt, hsa; identical to SEQ ID NO: 511708

SEQ ID NO: 570750 - RNA, 64 nt, hsa; identical to SEQ ID NO: 511709

SEQ ID NO: 570751 - RNA, 64 nt, hsa; identical to SEQ ID NO: 511710

SEQ ID NO: 570752 - RNA, 64 nt, hsa; identical to SEQ ID NO: 511711

SEQ ID NO: 570753 - RNA, 64 nt, hsa; identical to SEQ ID NO: 511712

SEQ ID NO: 570754 - RNA, 64 nt, hsa; identical to SEQ ID NO: 511713

SEQ ID NO: 570755 - RNA, 64 nt, hsa; identical to SEQ ID NO: 511714

SEQ ID NO: 570756 - RNA, 64 nt, hsa; identical to SEQ ID NO: 511715

SEQ ID NO: 570757 - RNA, 64 nt, hsa; identical to SEQ ID NO: 511716

SEQ ID NO: 570758 - RNA, 64 nt, hsa
agguuuuuuuuucucacagaagaugaagcacacaggaaccuaaugggccaacugggaugaggug

SEQ ID NO: 570759 - RNA, 64 nt, hsa
uuguacuacucagcugaucacaagcugcuugaugggaaccuacuagauggacaggcugaggugu

SEQ ID NO: 570760 - RNA, 64 nt, hsa
ggagggagagugaggagggaguguuauuuccuugggaaccuagggaggagagguuccuuuguug

SEQ ID NO: 570761 - RNA, 64 nt, hsa
gaacugcucuuggacuuguuuuccuguuguuuguggaaccuacgcguuugaauggcuugaacgu

SEQ ID NO: 570762 - RNA, 64 nt, hsa; identical to SEQ ID NO: 44795

SEQ ID NO: 570763 - RNA, 64 nt, hsa; identical to SEQ ID NO: 44796

SEQ ID NO: 570764 - RNA, 64 nt, hsa; identical to SEQ ID NO: 44797

SEQ ID NO: 570765 - RNA, 64 nt, hsa; identical to SEQ ID NO: 44798

SEQ ID NO: 570766 - RNA, 64 nt, hsa; identical to SEQ ID NO: 44799

SEQ ID NO: 570767 - RNA, 64 nt, hsa; identical to SEQ ID NO: 44800

SEQ ID NO: 570768 - RNA, 64 nt, hsa; identical to SEQ ID NO: 44801

SEQ ID NO: 570769 - RNA, 64 nt, hsa; identical to SEQ ID NO: 44802

SEQ ID NO: 570770 - RNA, 64 nt, hsa; identical to SEQ ID NO: 44803

SEQ ID NO: 570771 - RNA, 64 nt, hsa; identical to SEQ ID NO: 44804

SEQ ID NO: 570772 - RNA, 64 nt, hsa; identical to SEQ ID NO: 44805

SEQ ID NO: 570773 - RNA, 64 nt, hsa; identical to SEQ ID NO: 44806

SEQ ID NO: 570774 - RNA, 64 nt, hsa; identical to SEQ ID NO: 44807

SEQ ID NO: 570775 - RNA, 64 nt, hsa; identical to SEQ ID NO: 44808

SEQ ID NO: 570776 - RNA, 64 nt, hsa; identical to SEQ ID NO: 44809

SEQ ID NO: 570777 - RNA, 64 nt, hsa; identical to SEQ ID NO: 44810

SEQ ID NO: 570778 - RNA, 64 nt, hsa; identical to SEQ ID NO: 44811

SEQ ID NO: 570779 - RNA, 64 nt, hsa; identical to SEQ ID NO: 44812

SEQ ID NO: 570780 - RNA, 64 nt, hsa; identical to SEQ ID NO: 44813

SEQ ID NO: 570781 - RNA, 64 nt, hsa; identical to SEQ ID NO: 44814

SEQ ID NO: 570782 - RNA, 64 nt, hsa; identical to SEQ ID NO: 44815

SEQ ID NO: 570783 - RNA, 64 nt, hsa; identical to SEQ ID NO: 44816

SEQ ID NO: 570784 - RNA, 64 nt, hsa; identical to SEQ ID NO: 44817

SEQ ID NO: 570785 - RNA, 64 nt, hsa; identical to SEQ ID NO: 44818

SEQ ID NO: 570786 - RNA, 64 nt, hsa; identical to SEQ ID NO: 44819

SEQ ID NO: 570787 - RNA, 64 nt, hsa; identical to SEQ ID NO: 44820

SEQ ID NO: 570788 - RNA, 64 nt, hsa; identical to SEQ ID NO: 44821

SEQ ID NO: 570789 - RNA, 64 nt, hsa; identical to SEQ ID NO: 44822

SEQ ID NO: 570790 - RNA, 64 nt, hsa; identical to SEQ ID NO: 44823

SEQ ID NO: 570791 - RNA, 64 nt, hsa; identical to SEQ ID NO: 44824

SEQ ID NO: 570792 - RNA, 64 nt, hsa; identical to SEQ ID NO: 44825

SEQ ID NO: 570793 - RNA, 64 nt, hsa; identical to SEQ ID NO: 44826

SEQ ID NO: 570794 - RNA, 64 nt, hsa; identical to SEQ ID NO: 44827

SEQ ID NO: 570795 - RNA, 64 nt, hsa; identical to SEQ ID NO: 44828

SEQ ID NO: 570796 - RNA, 64 nt, hsa; identical to SEQ ID NO: 44829

SEQ ID NO: 570797 - RNA, 64 nt, hsa; identical to SEQ ID NO: 44830

SEQ ID NO: 570798 - RNA, 64 nt, hsa; identical to SEQ ID NO: 44831

SEQ ID NO: 570799 - RNA, 64 nt, hsa; identical to SEQ ID NO: 44832

SEQ ID NO: 570800 - RNA, 64 nt, hsa; identical to SEQ ID NO: 44833

SEQ ID NO: 570801 - RNA, 64 nt, hsa; identical to SEQ ID NO: 44834

SEQ ID NO: 570802 - RNA, 64 nt, hsa; identical to SEQ ID NO: 44835

SEQ ID NO: 570803 - RNA, 64 nt, hsa; identical to SEQ ID NO: 44836

SEQ ID NO: 570804 - RNA, 64 nt, hsa; identical to SEQ ID NO: 44837

SEQ ID NO: 570805 - RNA, 64 nt, hsa; identical to SEQ ID NO: 44838

SEQ ID NO: 570806 - RNA, 64 nt, hsa; identical to SEQ ID NO: 44839

SEQ ID NO: 570807 - RNA, 64 nt, hsa; identical to SEQ ID NO: 44840

SEQ ID NO: 570808 - RNA, 59 nt, hsa; identical to SEQ ID NO: 44841

SEQ ID NO: 570809 - RNA, 64 nt, hsa; identical to SEQ ID NO: 44842

SEQ ID NO: 570810 - RNA, 64 nt, hsa; identical to SEQ ID NO: 44843

SEQ ID NO: 570811 - RNA, 64 nt, hsa; identical to SEQ ID NO: 44844

SEQ ID NO: 570812 - RNA, 64 nt, hsa; identical to SEQ ID NO: 44845

SEQ ID NO: 570813 - RNA, 64 nt, hsa; identical to SEQ ID NO: 44846

SEQ ID NO: 570814 - RNA, 64 nt, hsa; identical to SEQ ID NO: 44847

SEQ ID NO: 570815 - RNA, 64 nt, hsa; identical to SEQ ID NO: 44848

SEQ ID NO: 570816 - RNA, 64 nt, hsa; identical to SEQ ID NO: 44849

SEQ ID NO: 570817 - RNA, 64 nt, hsa; identical to SEQ ID NO: 44850

SEQ ID NO: 570818 - RNA, 64 nt, hsa; identical to SEQ ID NO: 44851

SEQ ID NO: 570819 - RNA, 64 nt, hsa; identical to SEQ ID NO: 44852

SEQ ID NO: 570820 - RNA, 64 nt, hsa; identical to SEQ ID NO: 44853

SEQ ID NO: 570821 - RNA, 64 nt, hsa; identical to SEQ ID NO: 44854

SEQ ID NO: 570822 - RNA, 64 nt, hsa; identical to SEQ ID NO: 44855

SEQ ID NO: 570823 - RNA, 64 nt, hsa; identical to SEQ ID NO: 44856

SEQ ID NO: 570824 - RNA, 64 nt, hsa; identical to SEQ ID NO: 44857

SEQ ID NO: 570825 - RNA, 64 nt, hsa; identical to SEQ ID NO: 44858

SEQ ID NO: 570826 - RNA, 64 nt, hsa; identical to SEQ ID NO: 44859

SEQ ID NO: 570827 - RNA, 64 nt, hsa; identical to SEQ ID NO: 44860

SEQ ID NO: 570828 - RNA, 64 nt, hsa; identical to SEQ ID NO: 44861

SEQ ID NO: 570829 - RNA, 64 nt, hsa; identical to SEQ ID NO: 44862

SEQ ID NO: 570830 - RNA, 64 nt, hsa; identical to SEQ ID NO: 44863

SEQ ID NO: 570831 - RNA, 64 nt, hsa; identical to SEQ ID NO: 44864

SEQ ID NO: 570832 - RNA, 64 nt, hsa; identical to SEQ ID NO: 130466

SEQ ID NO: 570833 - RNA, 64 nt, hsa; identical to SEQ ID NO: 130467

SEQ ID NO: 570834 - RNA, 64 nt, hsa; identical to SEQ ID NO: 130468

SEQ ID NO: 570835 - RNA, 64 nt, hsa; identical to SEQ ID NO: 130469

SEQ ID NO: 570836 - RNA, 64 nt, hsa; identical to SEQ ID NO: 130470

SEQ ID NO: 570837 - RNA, 64 nt, hsa; identical to SEQ ID NO: 130471

SEQ ID NO: 570838 - RNA, 64 nt, hsa; identical to SEQ ID NO: 130472

SEQ ID NO: 570839 - RNA, 64 nt, hsa; identical to SEQ ID NO: 130473

SEQ ID NO: 570840 - RNA, 64 nt, hsa; identical to SEQ ID NO: 130474

SEQ ID NO: 570841 - RNA, 64 nt, hsa; identical to SEQ ID NO: 130475

SEQ ID NO: 570842 - RNA, 64 nt, hsa; identical to SEQ ID NO: 130476

SEQ ID NO: 570843 - RNA, 64 nt, hsa; identical to SEQ ID NO: 130477

SEQ ID NO: 570844 - RNA, 64 nt, hsa; identical to SEQ ID NO: 130478

SEQ ID NO: 570845 - RNA, 64 nt, hsa; identical to SEQ ID NO: 130479

SEQ ID NO: 570846 - RNA, 64 nt, hsa; identical to SEQ ID NO: 130480

SEQ ID NO: 570847 - RNA, 64 nt, hsa; identical to SEQ ID NO: 130481

SEQ ID NO: 570848 - RNA, 64 nt, hsa; identical to SEQ ID NO: 130482

SEQ ID NO: 570849 - RNA, 64 nt, hsa; identical to SEQ ID NO: 130483

SEQ ID NO: 570850 - RNA, 64 nt, hsa; identical to SEQ ID NO: 130484

SEQ ID NO: 570851 - RNA, 64 nt, hsa; identical to SEQ ID NO: 130485

SEQ ID NO: 570852 - RNA, 64 nt, hsa; identical to SEQ ID NO: 130486

SEQ ID NO: 570853 - RNA, 64 nt, hsa; identical to SEQ ID NO: 130487

SEQ ID NO: 570854 - RNA, 64 nt, hsa; identical to SEQ ID NO: 130488

SEQ ID NO: 570855 - RNA, 64 nt, hsa; identical to SEQ ID NO: 130489

SEQ ID NO: 570856 - RNA, 64 nt, hsa; identical to SEQ ID NO: 130490

SEQ ID NO: 570857 - RNA, 64 nt, hsa; identical to SEQ ID NO: 130491

SEQ ID NO: 570858 - RNA, 64 nt, hsa; identical to SEQ ID NO: 91216

SEQ ID NO: 570859 - RNA, 64 nt, hsa; identical to SEQ ID NO: 91217

SEQ ID NO: 570860 - RNA, 64 nt, hsa; identical to SEQ ID NO: 91218

SEQ ID NO: 570861 - RNA, 64 nt, hsa; identical to SEQ ID NO: 91219

SEQ ID NO: 570862 - RNA, 64 nt, hsa; identical to SEQ ID NO: 91220

SEQ ID NO: 570863 - RNA, 64 nt, hsa; identical to SEQ ID NO: 91221

SEQ ID NO: 570864 - RNA, 64 nt, hsa; identical to SEQ ID NO: 91222

SEQ ID NO: 570865 - RNA, 64 nt, hsa; identical to SEQ ID NO: 91223

SEQ ID NO: 570866 - RNA, 64 nt, hsa; identical to SEQ ID NO: 91224

SEQ ID NO: 570867 - RNA, 55 nt, hsa; identical to SEQ ID NO: 91225

SEQ ID NO: 570868 - RNA, 64 nt, hsa; identical to SEQ ID NO: 91226

SEQ ID NO: 570869 - RNA, 64 nt, hsa; identical to SEQ ID NO: 91227

SEQ ID NO: 570870 - RNA, 64 nt, hsa; identical to SEQ ID NO: 91228

SEQ ID NO: 570871 - RNA, 64 nt, hsa; identical to SEQ ID NO: 91229

SEQ ID NO: 570872 - RNA, 64 nt, hsa; identical to SEQ ID NO: 91230

SEQ ID NO: 570873 - RNA, 64 nt, hsa; identical to SEQ ID NO: 91231

SEQ ID NO: 570874 - RNA, 64 nt, hsa; identical to SEQ ID NO: 91232

SEQ ID NO: 570875 - RNA, 64 nt, hsa; identical to SEQ ID NO: 91233

SEQ ID NO: 570876 - RNA, 64 nt, hsa; identical to SEQ ID NO: 91234

SEQ ID NO: 570877 - RNA, 64 nt, hsa; identical to SEQ ID NO: 91235

SEQ ID NO: 570878 - RNA, 64 nt, hsa; identical to SEQ ID NO: 91236

SEQ ID NO: 570879 - RNA, 64 nt, hsa; identical to SEQ ID NO: 91237

SEQ ID NO: 570880 - RNA, 64 nt, hsa; identical to SEQ ID NO: 91238

SEQ ID NO: 570881 - RNA, 55 nt, hsa; identical to SEQ ID NO: 91239

SEQ ID NO: 570882 - RNA, 64 nt, hsa; identical to SEQ ID NO: 91240

SEQ ID NO: 570883 - RNA, 64 nt, hsa; identical to SEQ ID NO: 91241

SEQ ID NO: 570884 - RNA, 64 nt, hsa; identical to SEQ ID NO: 91242

SEQ ID NO: 570885 - RNA, 64 nt, hsa; identical to SEQ ID NO: 91243

SEQ ID NO: 570886 - RNA, 64 nt, hsa; identical to SEQ ID NO: 91244

SEQ ID NO: 570887 - RNA, 64 nt, hsa; identical to SEQ ID NO: 91245

SEQ ID NO: 570888 - RNA, 64 nt, hsa; identical to SEQ ID NO: 91246

SEQ ID NO: 570889 - RNA, 64 nt, hsa; identical to SEQ ID NO: 91247

SEQ ID NO: 570890 - RNA, 64 nt, hsa; identical to SEQ ID NO: 91248

SEQ ID NO: 570891 - RNA, 64 nt, hsa; identical to SEQ ID NO: 91249

SEQ ID NO: 570892 - RNA, 64 nt, hsa; identical to SEQ ID NO: 91250

SEQ ID NO: 570893 - RNA, 64 nt, hsa; identical to SEQ ID NO: 91251

SEQ ID NO: 570894 - RNA, 64 nt, hsa; identical to SEQ ID NO: 91252

SEQ ID NO: 570895 - RNA, 64 nt, hsa; identical to SEQ ID NO: 91253

SEQ ID NO: 570896 - RNA, 64 nt, hsa; identical to SEQ ID NO: 91254

SEQ ID NO: 570897 - RNA, 64 nt, hsa; identical to SEQ ID NO: 91255

SEQ ID NO: 570898 - RNA, 64 nt, hsa; identical to SEQ ID NO: 91256

SEQ ID NO: 570899 - RNA, 64 nt, hsa; identical to SEQ ID NO: 91257

SEQ ID NO: 570900 - RNA, 64 nt, hsa; identical to SEQ ID NO: 91258

SEQ ID NO: 570901 - RNA, 64 nt, hsa; identical to SEQ ID NO: 91259

SEQ ID NO: 570902 - RNA, 64 nt, hsa; identical to SEQ ID NO: 91260

SEQ ID NO: 570903 - RNA, 64 nt, hsa; identical to SEQ ID NO: 91261

SEQ ID NO: 570904 - RNA, 60 nt, hsa
ccuuuuuggguaacacaguuaauuuaccaacugauacagauaauagaauauauucauaau

SEQ ID NO: 570905 - RNA, 60 nt, hsa
cauguguaacacuuuucagucuguggauaucugauacauuaagauuucuuuuuauaagua

SEQ ID NO: 570906 - RNA, 60 nt, hsa
uguuuacugaggcacuggcgagucccagggcugauacagaaccuucccuagagggaauac

SEQ ID NO: 570907 - RNA, 60 nt, hsa
cuacccauuuucagcuucucugccucucuucugauacaaggacagaagaauuggguagau

SEQ ID NO: 570908 - RNA, 60 nt, hsa
cggguuguacagaaacugguauuuuuggugcugauacaagagaaauguauuuuuaaauau

SEQ ID NO: 570909 - RNA, 60 nt, hsa
ucagaacuuaauuuaaaagucuuaaauauucugauacaauucagcugucuucucuaccuu

SEQ ID NO: 570910 - RNA, 64 nt, hsa; identical to SEQ ID NO: 334526

SEQ ID NO: 570911 - RNA, 64 nt, hsa; identical to SEQ ID NO: 334527

SEQ ID NO: 570912 - RNA, 64 nt, hsa; identical to SEQ ID NO: 334528

SEQ ID NO: 570913 - RNA, 64 nt, hsa; identical to SEQ ID NO: 334529

SEQ ID NO: 570914 - RNA, 64 nt, hsa; identical to SEQ ID NO: 334530

SEQ ID NO: 570915 - RNA, 64 nt, hsa; identical to SEQ ID NO: 334531

SEQ ID NO: 570916 - RNA, 64 nt, hsa; identical to SEQ ID NO: 334532

SEQ ID NO: 570917 - RNA, 64 nt, hsa; identical to SEQ ID NO: 334533

SEQ ID NO: 570918 - RNA, 64 nt, hsa; identical to SEQ ID NO: 334534

SEQ ID NO: 570919 - RNA, 64 nt, hsa; identical to SEQ ID NO: 334535

SEQ ID NO: 570920 - RNA, 64 nt, hsa; identical to SEQ ID NO: 334536

SEQ ID NO: 570921 - RNA, 64 nt, hsa; identical to SEQ ID NO: 334537

SEQ ID NO: 570922 - RNA, 64 nt, hsa; identical to SEQ ID NO: 334538

SEQ ID NO: 570923 - RNA, 64 nt, hsa; identical to SEQ ID NO: 334539

SEQ ID NO: 570924 - RNA, 64 nt, hsa; identical to SEQ ID NO: 334540

SEQ ID NO: 570925 - RNA, 64 nt, hsa; identical to SEQ ID NO: 334541

SEQ ID NO: 570926 - RNA, 64 nt, hsa; identical to SEQ ID NO: 334542

SEQ ID NO: 570927 - RNA, 64 nt, hsa; identical to SEQ ID NO: 334543

SEQ ID NO: 570928 - RNA, 64 nt, hsa; identical to SEQ ID NO: 334544

SEQ ID NO: 570929 - RNA, 64 nt, hsa; identical to SEQ ID NO: 334545

SEQ ID NO: 570930 - RNA, 64 nt, hsa; identical to SEQ ID NO: 334546

SEQ ID NO: 570931 - RNA, 64 nt, hsa; identical to SEQ ID NO: 334547

SEQ ID NO: 570932 - RNA, 64 nt, hsa; identical to SEQ ID NO: 334548

SEQ ID NO: 570933 - RNA, 64 nt, hsa; identical to SEQ ID NO: 334549

SEQ ID NO: 570934 - RNA, 64 nt, hsa; identical to SEQ ID NO: 334550

SEQ ID NO: 570935 - RNA, 64 nt, hsa; identical to SEQ ID NO: 334550

SEQ ID NO: 570936 - RNA, 64 nt, hsa; identical to SEQ ID NO: 334550

SEQ ID NO: 570937 - RNA, 64 nt, hsa; identical to SEQ ID NO: 334553

SEQ ID NO: 570938 - RNA, 64 nt, hsa; identical to SEQ ID NO: 334554

SEQ ID NO: 570939 - RNA, 64 nt, hsa; identical to SEQ ID NO: 334555

SEQ ID NO: 570940 - RNA, 64 nt, hsa; identical to SEQ ID NO: 64824

SEQ ID NO: 570941 - RNA, 64 nt, hsa; identical to SEQ ID NO: 64825

SEQ ID NO: 570942 - RNA, 64 nt, hsa; identical to SEQ ID NO: 64826

SEQ ID NO: 570943 - RNA, 64 nt, hsa; identical to SEQ ID NO: 64827

SEQ ID NO: 570944 - RNA, 64 nt, hsa; identical to SEQ ID NO: 64828

SEQ ID NO: 570945 - RNA, 64 nt, hsa; identical to SEQ ID NO: 64829

SEQ ID NO: 570946 - RNA, 64 nt, hsa; identical to SEQ ID NO: 64830

SEQ ID NO: 570947 - RNA, 64 nt, hsa; identical to SEQ ID NO: 64831

SEQ ID NO: 570948 - RNA, 64 nt, hsa; identical to SEQ ID NO: 64832

SEQ ID NO: 570949 - RNA, 64 nt, hsa; identical to SEQ ID NO: 64833

SEQ ID NO: 570950 - RNA, 64 nt, hsa; identical to SEQ ID NO: 64834

SEQ ID NO: 570951 - RNA, 64 nt, hsa; identical to SEQ ID NO: 64835

SEQ ID NO: 570952 - RNA, 64 nt, hsa; identical to SEQ ID NO: 64836

SEQ ID NO: 570953 - RNA, 64 nt, hsa; identical to SEQ ID NO: 64837

SEQ ID NO: 570954 - RNA, 64 nt, hsa; identical to SEQ ID NO: 64838

SEQ ID NO: 570955 - RNA, 64 nt, hsa; identical to SEQ ID NO: 64839

SEQ ID NO: 570956 - RNA, 64 nt, hsa; identical to SEQ ID NO: 64840

SEQ ID NO: 570957 - RNA, 64 nt, hsa; identical to SEQ ID NO: 64841

SEQ ID NO: 570958 - RNA, 64 nt, hsa; identical to SEQ ID NO: 64842

SEQ ID NO: 570959 - RNA, 64 nt, hsa; identical to SEQ ID NO: 64843

SEQ ID NO: 570960 - RNA, 64 nt, hsa; identical to SEQ ID NO: 64844

SEQ ID NO: 570961 - RNA, 64 nt, hsa; identical to SEQ ID NO: 64845

SEQ ID NO: 570962 - RNA, 64 nt, hsa; identical to SEQ ID NO: 64846

SEQ ID NO: 570963 - RNA, 64 nt, hsa; identical to SEQ ID NO: 64847

SEQ ID NO: 570964 - RNA, 64 nt, hsa; identical to SEQ ID NO: 64848

SEQ ID NO: 570965 - RNA, 64 nt, hsa; identical to SEQ ID NO: 64849

SEQ ID NO: 570966 - RNA, 64 nt, hsa; identical to SEQ ID NO: 64850

SEQ ID NO: 570967 - RNA, 64 nt, hsa; identical to SEQ ID NO: 64851

SEQ ID NO: 570968 - RNA, 64 nt, hsa; identical to SEQ ID NO: 64852

SEQ ID NO: 570969 - RNA, 64 nt, hsa; identical to SEQ ID NO: 64853

SEQ ID NO: 570970 - RNA, 64 nt, hsa; identical to SEQ ID NO: 64854

SEQ ID NO: 570971 - RNA, 64 nt, hsa; identical to SEQ ID NO: 64855

SEQ ID NO: 570972 - RNA, 64 nt, hsa; identical to SEQ ID NO: 64856

SEQ ID NO: 570973 - RNA, 64 nt, hsa; identical to SEQ ID NO: 531886

SEQ ID NO: 570974 - RNA, 64 nt, hsa; identical to SEQ ID NO: 531887

SEQ ID NO: 570975 - RNA, 64 nt, hsa; identical to SEQ ID NO: 531888

SEQ ID NO: 570976 - RNA, 64 nt, hsa; identical to SEQ ID NO: 531889

SEQ ID NO: 570977 - RNA, 64 nt, hsa; identical to SEQ ID NO: 531890

SEQ ID NO: 570978 - RNA, 64 nt, hsa; identical to SEQ ID NO: 531891

SEQ ID NO: 570979 - RNA, 64 nt, hsa; identical to SEQ ID NO: 531892

SEQ ID NO: 570980 - RNA, 64 nt, hsa; identical to SEQ ID NO: 531893

SEQ ID NO: 570981 - RNA, 64 nt, hsa; identical to SEQ ID NO: 531894

SEQ ID NO: 570982 - RNA, 64 nt, hsa; identical to SEQ ID NO: 531895

SEQ ID NO: 570983 - RNA, 64 nt, hsa; identical to SEQ ID NO: 531896

SEQ ID NO: 570984 - RNA, 64 nt, hsa; identical to SEQ ID NO: 531897

SEQ ID NO: 570985 - RNA, 64 nt, hsa; identical to SEQ ID NO: 531898

SEQ ID NO: 570986 - RNA, 64 nt, hsa; identical to SEQ ID NO: 531899

SEQ ID NO: 570987 - RNA, 64 nt, hsa; identical to SEQ ID NO: 531900

SEQ ID NO: 570988 - RNA, 64 nt, hsa; identical to SEQ ID NO: 531901

SEQ ID NO: 570989 - RNA, 64 nt, hsa; identical to SEQ ID NO: 531902

SEQ ID NO: 570990 - RNA, 64 nt, hsa; identical to SEQ ID NO: 531903

SEQ ID NO: 570991 - RNA, 64 nt, hsa; identical to SEQ ID NO: 531904

SEQ ID NO: 570992 - RNA, 64 nt, hsa; identical to SEQ ID NO: 531905

SEQ ID NO: 570993 - RNA, 64 nt, hsa; identical to SEQ ID NO: 531906

SEQ ID NO: 570994 - RNA, 64 nt, hsa; identical to SEQ ID NO: 531907

SEQ ID NO: 570995 - RNA, 64 nt, hsa; identical to SEQ ID NO: 531908

SEQ ID NO: 570996 - RNA, 64 nt, hsa; identical to SEQ ID NO: 531909

SEQ ID NO: 570997 - RNA, 64 nt, hsa; identical to SEQ ID NO: 531910

SEQ ID NO: 570998 - RNA, 64 nt, hsa; identical to SEQ ID NO: 531911

SEQ ID NO: 570999 - RNA, 64 nt, hsa; identical to SEQ ID NO: 531912

SEQ ID NO: 571000 - RNA, 64 nt, hsa; identical to SEQ ID NO: 531913

SEQ ID NO: 571001 - RNA, 64 nt, hsa; identical to SEQ ID NO: 531914

SEQ ID NO: 571002 - RNA, 64 nt, hsa; identical to SEQ ID NO: 531915

SEQ ID NO: 571003 - RNA, 64 nt, hsa; identical to SEQ ID NO: 531916

SEQ ID NO: 571004 - RNA, 64 nt, hsa; identical to SEQ ID NO: 531917

SEQ ID NO: 571005 - RNA, 64 nt, hsa; identical to SEQ ID NO: 531918

SEQ ID NO: 571006 - RNA, 64 nt, hsa; identical to SEQ ID NO: 531919

SEQ ID NO: 571007 - RNA, 64 nt, hsa; identical to SEQ ID NO: 531920

SEQ ID NO: 571008 - RNA, 64 nt, hsa; identical to SEQ ID NO: 531921

SEQ ID NO: 571009 - RNA, 64 nt, hsa; identical to SEQ ID NO: 531922

SEQ ID NO: 571010 - RNA, 64 nt, hsa; identical to SEQ ID NO: 211201

SEQ ID NO: 571011 - RNA, 64 nt, hsa; identical to SEQ ID NO: 211202

SEQ ID NO: 571012 - RNA, 64 nt, hsa; identical to SEQ ID NO: 211203

SEQ ID NO: 571013 - RNA, 64 nt, hsa; identical to SEQ ID NO: 211204

SEQ ID NO: 571014 - RNA, 64 nt, hsa; identical to SEQ ID NO: 211205

SEQ ID NO: 571015 - RNA, 64 nt, hsa; identical to SEQ ID NO: 211206

SEQ ID NO: 571016 - RNA, 64 nt, hsa; identical to SEQ ID NO: 61390

SEQ ID NO: 571017 - RNA, 64 nt, hsa; identical to SEQ ID NO: 61391

SEQ ID NO: 571018 - RNA, 64 nt, hsa; identical to SEQ ID NO: 61392

SEQ ID NO: 571019 - RNA, 64 nt, hsa; identical to SEQ ID NO: 61393

SEQ ID NO: 571020 - RNA, 64 nt, hsa; identical to SEQ ID NO: 61394

SEQ ID NO: 571021 - RNA, 64 nt, hsa; identical to SEQ ID NO: 61395

SEQ ID NO: 571022 - RNA, 64 nt, hsa; identical to SEQ ID NO: 61396

SEQ ID NO: 571023 - RNA, 64 nt, hsa; identical to SEQ ID NO: 61397

SEQ ID NO: 571024 - RNA, 64 nt, hsa; identical to SEQ ID NO: 61398

SEQ ID NO: 571025 - RNA, 64 nt, hsa; identical to SEQ ID NO: 61399

SEQ ID NO: 571026 - RNA, 64 nt, hsa; identical to SEQ ID NO: 61400

SEQ ID NO: 571027 - RNA, 64 nt, hsa; identical to SEQ ID NO: 61401

SEQ ID NO: 571028 - RNA, 64 nt, hsa; identical to SEQ ID NO: 61402

SEQ ID NO: 571029 - RNA, 64 nt, hsa; identical to SEQ ID NO: 61403

SEQ ID NO: 571030 - RNA, 64 nt, hsa; identical to SEQ ID NO: 61404

SEQ ID NO: 571031 - RNA, 64 nt, hsa; identical to SEQ ID NO: 61405

SEQ ID NO: 571032 - RNA, 64 nt, hsa; identical to SEQ ID NO: 61406

SEQ ID NO: 571033 - RNA, 64 nt, hsa; identical to SEQ ID NO: 61407

SEQ ID NO: 571034 - RNA, 64 nt, hsa; identical to SEQ ID NO: 61406

SEQ ID NO: 571035 - RNA, 64 nt, hsa; identical to SEQ ID NO: 61409

SEQ ID NO: 571036 - RNA, 64 nt, hsa; identical to SEQ ID NO: 61410

SEQ ID NO: 571037 - RNA, 64 nt, hsa; identical to SEQ ID NO: 61411

SEQ ID NO: 571038 - RNA, 64 nt, hsa; identical to SEQ ID NO: 61412

SEQ ID NO: 571039 - RNA, 64 nt, hsa; identical to SEQ ID NO: 61413

SEQ ID NO: 571040 - RNA, 64 nt, hsa; identical to SEQ ID NO: 61414

SEQ ID NO: 571041 - RNA, 64 nt, hsa; identical to SEQ ID NO: 61415

SEQ ID NO: 571042 - RNA, 64 nt, hsa; identical to SEQ ID NO: 61416

SEQ ID NO: 571043 - RNA, 64 nt, hsa; identical to SEQ ID NO: 189185

SEQ ID NO: 571044 - RNA, 64 nt, hsa; identical to SEQ ID NO: 189186

SEQ ID NO: 571045 - RNA, 64 nt, hsa; identical to SEQ ID NO: 189187

SEQ ID NO: 571046 - RNA, 64 nt, hsa; identical to SEQ ID NO: 189188

SEQ ID NO: 571047 - RNA, 64 nt, hsa; identical to SEQ ID NO: 189189

SEQ ID NO: 571048 - RNA, 64 nt, hsa; identical to SEQ ID NO: 189190

SEQ ID NO: 571049 - RNA, 64 nt, hsa; identical to SEQ ID NO: 189191

SEQ ID NO: 571050 - RNA, 64 nt, hsa; identical to SEQ ID NO: 189192

SEQ ID NO: 571051 - RNA, 64 nt, hsa; identical to SEQ ID NO: 189193

SEQ ID NO: 571052 - RNA, 64 nt, hsa; identical to SEQ ID NO: 189194

SEQ ID NO: 571053 - RNA, 64 nt, hsa; identical to SEQ ID NO: 189195

SEQ ID NO: 571054 - RNA, 64 nt, hsa; identical to SEQ ID NO: 189196

SEQ ID NO: 571055 - RNA, 64 nt, hsa; identical to SEQ ID NO: 189197

SEQ ID NO: 571056 - RNA, 64 nt, hsa; identical to SEQ ID NO: 189198

SEQ ID NO: 571057 - RNA, 64 nt, hsa; identical to SEQ ID NO: 189199

SEQ ID NO: 571058 - RNA, 64 nt, hsa; identical to SEQ ID NO: 189200

SEQ ID NO: 571059 - RNA, 64 nt, hsa; identical to SEQ ID NO: 189201

SEQ ID NO: 571060 - RNA, 64 nt, hsa; identical to SEQ ID NO: 189202

SEQ ID NO: 571061 - RNA, 64 nt, hsa; identical to SEQ ID NO: 189203

SEQ ID NO: 571062 - RNA, 64 nt, hsa; identical to SEQ ID NO: 189204

SEQ ID NO: 571063 - RNA, 64 nt, hsa; identical to SEQ ID NO: 189205

SEQ ID NO: 571064 - RNA, 64 nt, hsa; identical to SEQ ID NO: 189206

SEQ ID NO: 571065 - RNA, 64 nt, hsa; identical to SEQ ID NO: 189207

SEQ ID NO: 571066 - RNA, 64 nt, hsa; identical to SEQ ID NO: 189208

SEQ ID NO: 571067 - RNA, 64 nt, hsa; identical to SEQ ID NO: 189209

SEQ ID NO: 571068 - RNA, 64 nt, hsa; identical to SEQ ID NO: 189210

SEQ ID NO: 571069 - RNA, 64 nt, hsa; identical to SEQ ID NO: 189211

SEQ ID NO: 571070 - RNA, 64 nt, hsa; identical to SEQ ID NO: 189212

SEQ ID NO: 571071 - RNA, 64 nt, hsa; identical to SEQ ID NO: 189213

SEQ ID NO: 571072 - RNA, 50 nt, hsa; identical to SEQ ID NO: 189214

SEQ ID NO: 571073 - RNA, 64 nt, hsa; identical to SEQ ID NO: 189215

SEQ ID NO: 571074 - RNA, 64 nt, hsa; identical to SEQ ID NO: 189216

SEQ ID NO: 571075 - RNA, 64 nt, hsa; identical to SEQ ID NO: 189217

SEQ ID NO: 571076 - RNA, 64 nt, hsa; identical to SEQ ID NO: 189218

SEQ ID NO: 571077 - RNA, 64 nt, hsa; identical to SEQ ID NO: 189219

SEQ ID NO: 571078 - RNA, 64 nt, hsa; identical to SEQ ID NO: 189220

SEQ ID NO: 571079 - RNA, 64 nt, hsa; identical to SEQ ID NO: 189221

SEQ ID NO: 571080 - RNA, 64 nt, hsa; identical to SEQ ID NO: 189222

SEQ ID NO: 571081 - RNA, 64 nt, hsa; identical to SEQ ID NO: 189223

SEQ ID NO: 571082 - RNA, 64 nt, hsa; identical to SEQ ID NO: 189224

SEQ ID NO: 571083 - RNA, 64 nt, hsa; identical to SEQ ID NO: 189225

SEQ ID NO: 571084 - RNA, 64 nt, hsa; identical to SEQ ID NO: 189226

SEQ ID NO: 571085 - RNA, 64 nt, hsa; identical to SEQ ID NO: 189227

SEQ ID NO: 571086 - RNA, 64 nt, hsa; identical to SEQ ID NO: 189228

SEQ ID NO: 571087 - RNA, 64 nt, hsa; identical to SEQ ID NO: 189229

SEQ ID NO: 571088 - RNA, 64 nt, hsa; identical to SEQ ID NO: 189230

SEQ ID NO: 571089 - RNA, 64 nt, hsa; identical to SEQ ID NO: 189231

SEQ ID NO: 571090 - RNA, 64 nt, hsa; identical to SEQ ID NO: 189232

SEQ ID NO: 571091 - RNA, 64 nt, hsa; identical to SEQ ID NO: 189233

SEQ ID NO: 571092 - RNA, 64 nt, hsa; identical to SEQ ID NO: 189234

SEQ ID NO: 571093 - RNA, 64 nt, hsa; identical to SEQ ID NO: 189235

SEQ ID NO: 571094 - RNA, 64 nt, hsa; identical to SEQ ID NO: 189236

SEQ ID NO: 571095 - RNA, 64 nt, hsa; identical to SEQ ID NO: 189237

SEQ ID NO: 571096 - RNA, 64 nt, hsa; identical to SEQ ID NO: 189238

SEQ ID NO: 571097 - RNA, 64 nt, hsa; identical to SEQ ID NO: 189239

SEQ ID NO: 571098 - RNA, 64 nt, hsa; identical to SEQ ID NO: 189240

SEQ ID NO: 571099 - RNA, 64 nt, hsa; identical to SEQ ID NO: 189241

SEQ ID NO: 571100 - RNA, 64 nt, hsa; identical to SEQ ID NO: 189242

SEQ ID NO: 571101 - RNA, 64 nt, hsa; identical to SEQ ID NO: 189243

SEQ ID NO: 571102 - RNA, 64 nt, hsa; identical to SEQ ID NO: 189244

SEQ ID NO: 571103 - RNA, 64 nt, hsa; identical to SEQ ID NO: 189245

SEQ ID NO: 571104 - RNA, 64 nt, hsa; identical to SEQ ID NO: 189246

SEQ ID NO: 571105 - RNA, 64 nt, hsa; identical to SEQ ID NO: 189247

SEQ ID NO: 571106 - RNA, 64 nt, hsa; identical to SEQ ID NO: 189248

SEQ ID NO: 571107 - RNA, 64 nt, hsa; identical to SEQ ID NO: 189249

SEQ ID NO: 571108 - RNA, 64 nt, hsa; identical to SEQ ID NO: 189250

SEQ ID NO: 571109 - RNA, 64 nt, hsa; identical to SEQ ID NO: 189251

SEQ ID NO: 571110 - RNA, 64 nt, hsa; identical to SEQ ID NO: 189252

SEQ ID NO: 571111 - RNA, 64 nt, hsa; identical to SEQ ID NO: 189253

SEQ ID NO: 571112 - RNA, 64 nt, hsa; identical to SEQ ID NO: 189254

SEQ ID NO: 571113 - RNA, 64 nt, hsa; identical to SEQ ID NO: 189255

SEQ ID NO: 571114 - RNA, 64 nt, hsa; identical to SEQ ID NO: 189256

SEQ ID NO: 571115 - RNA, 64 nt, hsa; identical to SEQ ID NO: 189257

SEQ ID NO: 571116 - RNA, 64 nt, hsa; identical to SEQ ID NO: 189258

SEQ ID NO: 571117 - RNA, 64 nt, hsa; identical to SEQ ID NO: 83829

SEQ ID NO: 571118 - RNA, 64 nt, hsa; identical to SEQ ID NO: 83830

SEQ ID NO: 571119 - RNA, 64 nt, hsa; identical to SEQ ID NO: 83831

SEQ ID NO: 571120 - RNA, 64 nt, hsa; identical to SEQ ID NO: 83832

SEQ ID NO: 571121 - RNA, 64 nt, hsa; identical to SEQ ID NO: 83833

SEQ ID NO: 571122 - RNA, 64 nt, hsa; identical to SEQ ID NO: 83834

SEQ ID NO: 571123 - RNA, 64 nt, hsa; identical to SEQ ID NO: 83835

SEQ ID NO: 571124 - RNA, 64 nt, hsa; identical to SEQ ID NO: 83836

SEQ ID NO: 571125 - RNA, 64 nt, hsa; identical to SEQ ID NO: 83837

SEQ ID NO: 571126 - RNA, 64 nt, hsa; identical to SEQ ID NO: 83838

SEQ ID NO: 571127 - RNA, 64 nt, hsa; identical to SEQ ID NO: 83839

SEQ ID NO: 571128 - RNA, 64 nt, hsa; identical to SEQ ID NO: 83840

SEQ ID NO: 571129 - RNA, 64 nt, hsa; identical to SEQ ID NO: 83841

SEQ ID NO: 571130 - RNA, 64 nt, hsa; identical to SEQ ID NO: 83842

SEQ ID NO: 571131 - RNA, 64 nt, hsa; identical to SEQ ID NO: 83843

SEQ ID NO: 571132 - RNA, 64 nt, hsa; identical to SEQ ID NO: 83844

SEQ ID NO: 571133 - RNA, 64 nt, hsa; identical to SEQ ID NO: 83845

SEQ ID NO: 571134 - RNA, 64 nt, hsa; identical to SEQ ID NO: 83846

SEQ ID NO: 571135 - RNA, 64 nt, hsa; identical to SEQ ID NO: 83847

SEQ ID NO: 571136 - RNA, 64 nt, hsa; identical to SEQ ID NO: 83848

SEQ ID NO: 571137 - RNA, 64 nt, hsa; identical to SEQ ID NO: 83849

SEQ ID NO: 571138 - RNA, 64 nt, hsa; identical to SEQ ID NO: 83850

SEQ ID NO: 571139 - RNA, 64 nt, hsa; identical to SEQ ID NO: 83851

SEQ ID NO: 571140 - RNA, 64 nt, hsa; identical to SEQ ID NO: 83852

SEQ ID NO: 571141 - RNA, 64 nt, hsa; identical to SEQ ID NO: 83853

SEQ ID NO: 571142 - RNA, 64 nt, hsa; identical to SEQ ID NO: 83854

SEQ ID NO: 571143 - RNA, 64 nt, hsa; identical to SEQ ID NO: 83855

SEQ ID NO: 571144 - RNA, 64 nt, hsa; identical to SEQ ID NO: 83856

SEQ ID NO: 571145 - RNA, 64 nt, hsa; identical to SEQ ID NO: 83857

SEQ ID NO: 571146 - RNA, 64 nt, hsa; identical to SEQ ID NO: 83858

SEQ ID NO: 571147 - RNA, 64 nt, hsa; identical to SEQ ID NO: 83859

SEQ ID NO: 571148 - RNA, 64 nt, hsa; identical to SEQ ID NO: 83860

SEQ ID NO: 571149 - RNA, 64 nt, hsa; identical to SEQ ID NO: 83861

SEQ ID NO: 571150 - RNA, 64 nt, hsa; identical to SEQ ID NO: 83862

SEQ ID NO: 571151 - RNA, 64 nt, hsa; identical to SEQ ID NO: 83863

SEQ ID NO: 571152 - RNA, 64 nt, hsa; identical to SEQ ID NO: 83864

SEQ ID NO: 571153 - RNA, 64 nt, hsa; identical to SEQ ID NO: 83865

SEQ ID NO: 571154 - RNA, 64 nt, hsa; identical to SEQ ID NO: 83866

SEQ ID NO: 571155 - RNA, 64 nt, hsa; identical to SEQ ID NO: 83867

SEQ ID NO: 571156 - RNA, 64 nt, hsa; identical to SEQ ID NO: 83868

SEQ ID NO: 571157 - RNA, 64 nt, hsa; identical to SEQ ID NO: 83869

SEQ ID NO: 571158 - RNA, 64 nt, hsa; identical to SEQ ID NO: 83870

SEQ ID NO: 571159 - RNA, 64 nt, hsa; identical to SEQ ID NO: 83871

SEQ ID NO: 571160 - RNA, 64 nt, hsa; identical to SEQ ID NO: 83872

SEQ ID NO: 571161 - RNA, 64 nt, hsa; identical to SEQ ID NO: 83873

SEQ ID NO: 571162 - RNA, 64 nt, hsa; identical to SEQ ID NO: 83874

SEQ ID NO: 571163 - RNA, 64 nt, hsa; identical to SEQ ID NO: 83875

SEQ ID NO: 571164 - RNA, 64 nt, hsa; identical to SEQ ID NO: 83876

SEQ ID NO: 571165 - RNA, 64 nt, hsa; identical to SEQ ID NO: 83877

SEQ ID NO: 571166 - RNA, 64 nt, hsa; identical to SEQ ID NO: 83878

SEQ ID NO: 571167 - RNA, 64 nt, hsa; identical to SEQ ID NO: 83879

SEQ ID NO: 571168 - RNA, 64 nt, hsa; identical to SEQ ID NO: 83880

SEQ ID NO: 571169 - RNA, 64 nt, hsa; identical to SEQ ID NO: 83881

SEQ ID NO: 571170 - RNA, 64 nt, hsa; identical to SEQ ID NO: 284290

SEQ ID NO: 571171 - RNA, 64 nt, hsa; identical to SEQ ID NO: 284291

SEQ ID NO: 571172 - RNA, 64 nt, hsa; identical to SEQ ID NO: 284292

SEQ ID NO: 571173 - RNA, 64 nt, hsa; identical to SEQ ID NO: 284293

SEQ ID NO: 571174 - RNA, 64 nt, hsa; identical to SEQ ID NO: 284294

SEQ ID NO: 571175 - RNA, 64 nt, hsa; identical to SEQ ID NO: 284295

SEQ ID NO: 571176 - RNA, 64 nt, hsa; identical to SEQ ID NO: 284296

SEQ ID NO: 571177 - RNA, 64 nt, hsa; identical to SEQ ID NO: 284297

SEQ ID NO: 571178 - RNA, 64 nt, hsa; identical to SEQ ID NO: 284298

SEQ ID NO: 571179 - RNA, 64 nt, hsa; identical to SEQ ID NO: 284299

SEQ ID NO: 571180 - RNA, 64 nt, hsa; identical to SEQ ID NO: 284300

SEQ ID NO: 571181 - RNA, 64 nt, hsa; identical to SEQ ID NO: 284301

SEQ ID NO: 571182 - RNA, 64 nt, hsa; identical to SEQ ID NO: 284302

SEQ ID NO: 571183 - RNA, 64 nt, hsa; identical to SEQ ID NO: 284303

SEQ ID NO: 571184 - RNA, 64 nt, hsa; identical to SEQ ID NO: 284304

SEQ ID NO: 571185 - RNA, 64 nt, hsa; identical to SEQ ID NO: 284305

SEQ ID NO: 571186 - RNA, 64 nt, hsa; identical to SEQ ID NO: 284306

SEQ ID NO: 571187 - RNA, 64 nt, hsa; identical to SEQ ID NO: 284307

SEQ ID NO: 571188 - RNA, 64 nt, hsa; identical to SEQ ID NO: 284308

SEQ ID NO: 571189 - RNA, 64 nt, hsa; identical to SEQ ID NO: 284309

SEQ ID NO: 571190 - RNA, 64 nt, hsa; identical to SEQ ID NO: 284310

SEQ ID NO: 571191 - RNA, 64 nt, hsa; identical to SEQ ID NO: 284311

SEQ ID NO: 571192 - RNA, 64 nt, hsa; identical to SEQ ID NO: 284312

SEQ ID NO: 571193 - RNA, 64 nt, hsa; identical to SEQ ID NO: 284313

SEQ ID NO: 571194 - RNA, 64 nt, hsa; identical to SEQ ID NO: 284314

SEQ ID NO: 571195 - RNA, 64 nt, hsa; identical to SEQ ID NO: 284315

SEQ ID NO: 571196 - RNA, 64 nt, hsa; identical to SEQ ID NO: 284316

SEQ ID NO: 571197 - RNA, 64 nt, hsa; identical to SEQ ID NO: 284317

SEQ ID NO: 571198 - RNA, 64 nt, hsa; identical to SEQ ID NO: 284318

SEQ ID NO: 571199 - RNA, 64 nt, hsa; identical to SEQ ID NO: 284319

SEQ ID NO: 571200 - RNA, 64 nt, hsa; identical to SEQ ID NO: 284320

SEQ ID NO: 571201 - RNA, 64 nt, hsa; identical to SEQ ID NO: 284321

SEQ ID NO: 571202 - RNA, 64 nt, hsa; identical to SEQ ID NO: 284322

SEQ ID NO: 571203 - RNA, 64 nt, hsa; identical to SEQ ID NO: 284323

SEQ ID NO: 571204 - RNA, 64 nt, hsa; identical to SEQ ID NO: 284324

SEQ ID NO: 571205 - RNA, 64 nt, hsa; identical to SEQ ID NO: 284325

SEQ ID NO: 571206 - RNA, 64 nt, hsa; identical to SEQ ID NO: 284326

SEQ ID NO: 571207 - RNA, 64 nt, hsa; identical to SEQ ID NO: 284327

SEQ ID NO: 571208 - RNA, 64 nt, hsa; identical to SEQ ID NO: 284328

SEQ ID NO: 571209 - RNA, 64 nt, hsa; identical to SEQ ID NO: 284329

SEQ ID NO: 571210 - RNA, 64 nt, hsa; identical to SEQ ID NO: 284330

SEQ ID NO: 571211 - RNA, 64 nt, hsa; identical to SEQ ID NO: 284331

SEQ ID NO: 571212 - RNA, 64 nt, hsa; identical to SEQ ID NO: 284332

SEQ ID NO: 571213 - RNA, 64 nt, hsa; identical to SEQ ID NO: 284333

SEQ ID NO: 571214 - RNA, 50 nt, hsa; identical to SEQ ID NO: 284334

SEQ ID NO: 571215 - RNA, 64 nt, hsa; identical to SEQ ID NO: 284335

SEQ ID NO: 571216 - RNA, 64 nt, hsa; identical to SEQ ID NO: 284336

SEQ ID NO: 571217 - RNA, 64 nt, hsa; identical to SEQ ID NO: 284337

SEQ ID NO: 571218 - RNA, 64 nt, hsa; identical to SEQ ID NO: 284338

SEQ ID NO: 571219 - RNA, 64 nt, hsa; identical to SEQ ID NO: 284339

SEQ ID NO: 571220 - RNA, 64 nt, hsa; identical to SEQ ID NO: 284340

SEQ ID NO: 571221 - RNA, 64 nt, hsa; identical to SEQ ID NO: 284341

SEQ ID NO: 571222 - RNA, 64 nt, hsa; identical to SEQ ID NO: 284342

SEQ ID NO: 571223 - RNA, 64 nt, hsa; identical to SEQ ID NO: 284343

SEQ ID NO: 571224 - RNA, 64 nt, hsa; identical to SEQ ID NO: 284344

SEQ ID NO: 571225 - RNA, 64 nt, hsa; identical to SEQ ID NO: 284345

SEQ ID NO: 571226 - RNA, 64 nt, hsa; identical to SEQ ID NO: 284346

SEQ ID NO: 571227 - RNA, 64 nt, hsa; identical to SEQ ID NO: 284347

SEQ ID NO: 571228 - RNA, 64 nt, hsa; identical to SEQ ID NO: 284348

SEQ ID NO: 571229 - RNA, 64 nt, hsa; identical to SEQ ID NO: 284349

SEQ ID NO: 571230 - RNA, 64 nt, hsa; identical to SEQ ID NO: 284350

SEQ ID NO: 571231 - RNA, 64 nt, hsa; identical to SEQ ID NO: 284351

SEQ ID NO: 571232 - RNA, 64 nt, hsa; identical to SEQ ID NO: 284352

SEQ ID NO: 571233 - RNA, 64 nt, hsa; identical to SEQ ID NO: 284353

SEQ ID NO: 571234 - RNA, 65 nt, hsa
uguucuuaaugcagccacuauaacuugauaagucauugcacuauuuaaaaaguuuuaguaauauc

SEQ ID NO: 571235 - RNA, 65 nt, hsa
auauacacagucuguuucuucuauuccuagacauauugcacuacuuuuucagugguucuuggucc

SEQ ID NO: 571236 - RNA, 65 nt, hsa
ggauuauuuuuauauuugaaaagaaaauguuuuauuugcacuacugaguaggaagaguuaauugu

SEQ ID NO: 571237 - RNA, 65 nt, hsa
agugcuuuccuuaucaguaacuggaguucuccugcuugcacuagagaagguaaagagagaaucag

SEQ ID NO: 571238 - RNA, 65 nt, hsa
ccuggacuauauaacuuaaaagaaguaaaacguaauugcacuacuguuuuccagacuggaaaaaa

SEQ ID NO: 571239 - RNA, 65 nt, hsa
uaagggcaaaaacggauugaaaugaacauagcguuuugcacuaaugauaagauaaccugagaggu

SEQ ID NO: 571240 - RNA, 65 nt, hsa
gggcugucaacauucaaagcagcagagagggaacuuugcacuauugggguaugauguuuggguca

SEQ ID NO: 571241 - RNA, 65 nt, hsa
gggaaauucagcuuuugcagaagcaguguuucuacuugcacuagcauggccucugacgugaccau

SEQ ID NO: 571242 - RNA, 65 nt, hsa
uauuuuauucuuauucaaagaaauaucugagcucuuugcacuaccuguuaucaguagugccuuua

SEQ ID NO: 571243 - RNA, 65 nt, hsa
uaaguaacuuuaaauuaugccguuacuuuucauauuugcacuaagauauuuccaggcugcauuug

SEQ ID NO: 571244 - RNA, 64 nt, hsa; identical to SEQ ID NO: 217362

SEQ ID NO: 571245 - RNA, 64 nt, hsa; identical to SEQ ID NO: 217363

SEQ ID NO: 571246 - RNA, 64 nt, hsa; identical to SEQ ID NO: 217364

SEQ ID NO: 571247 - RNA, 64 nt, hsa; identical to SEQ ID NO: 217365

SEQ ID NO: 571248 - RNA, 64 nt, hsa; identical to SEQ ID NO: 217366

SEQ ID NO: 571249 - RNA, 64 nt, hsa; identical to SEQ ID NO: 217367

SEQ ID NO: 571250 - RNA, 64 nt, hsa; identical to SEQ ID NO: 217368

SEQ ID NO: 571251 - RNA, 64 nt, hsa; identical to SEQ ID NO: 217369

SEQ ID NO: 571252 - RNA, 64 nt, hsa; identical to SEQ ID NO: 217370

SEQ ID NO: 571253 - RNA, 64 nt, hsa; identical to SEQ ID NO: 217371

SEQ ID NO: 571254 - RNA, 64 nt, hsa; identical to SEQ ID NO: 217372

SEQ ID NO: 571255 - RNA, 64 nt, hsa; identical to SEQ ID NO: 217373

SEQ ID NO: 571256 - RNA, 64 nt, hsa; identical to SEQ ID NO: 217374

SEQ ID NO: 571257 - RNA, 64 nt, hsa; identical to SEQ ID NO: 217375

SEQ ID NO: 571258 - RNA, 64 nt, hsa; identical to SEQ ID NO: 217376

SEQ ID NO: 571259 - RNA, 64 nt, hsa; identical to SEQ ID NO: 217377

SEQ ID NO: 571260 - RNA, 64 nt, hsa; identical to SEQ ID NO: 217378

SEQ ID NO: 571261 - RNA, 64 nt, hsa; identical to SEQ ID NO: 217379

SEQ ID NO: 571262 - RNA, 64 nt, hsa; identical to SEQ ID NO: 217380

SEQ ID NO: 571263 - RNA, 64 nt, hsa; identical to SEQ ID NO: 217381

SEQ ID NO: 571264 - RNA, 64 nt, hsa; identical to SEQ ID NO: 217382

SEQ ID NO: 571265 - RNA, 64 nt, hsa; identical to SEQ ID NO: 217383

SEQ ID NO: 571266 - RNA, 64 nt, hsa; identical to SEQ ID NO: 217384

SEQ ID NO: 571267 - RNA, 64 nt, hsa; identical to SEQ ID NO: 217385

SEQ ID NO: 571268 - RNA, 55 nt, hsa; identical to SEQ ID NO: 217386

SEQ ID NO: 571269 - RNA, 64 nt, hsa; identical to SEQ ID NO: 217387

SEQ ID NO: 571270 - RNA, 64 nt, hsa; identical to SEQ ID NO: 217388

SEQ ID NO: 571271 - RNA, 64 nt, hsa; identical to SEQ ID NO: 217389

SEQ ID NO: 571272 - RNA, 64 nt, hsa; identical to SEQ ID NO: 217390

SEQ ID NO: 571273 - RNA, 64 nt, hsa; identical to SEQ ID NO: 217391

SEQ ID NO: 571274 - RNA, 64 nt, hsa; identical to SEQ ID NO: 217392

SEQ ID NO: 571275 - RNA, 64 nt, hsa; identical to SEQ ID NO: 217393

SEQ ID NO: 571276 - RNA, 64 nt, hsa; identical to SEQ ID NO: 217394

SEQ ID NO: 571277 - RNA, 64 nt, hsa; identical to SEQ ID NO: 496535

SEQ ID NO: 571278 - RNA, 64 nt, hsa; identical to SEQ ID NO: 496536

SEQ ID NO: 571279 - RNA, 64 nt, hsa; identical to SEQ ID NO: 496537

SEQ ID NO: 571280 - RNA, 64 nt, hsa; identical to SEQ ID NO: 496538

SEQ ID NO: 571281 - RNA, 64 nt, hsa; identical to SEQ ID NO: 496539

SEQ ID NO: 571282 - RNA, 64 nt, hsa; identical to SEQ ID NO: 130383

SEQ ID NO: 571283 - RNA, 64 nt, hsa; identical to SEQ ID NO: 130384

SEQ ID NO: 571284 - RNA, 64 nt, hsa; identical to SEQ ID NO: 130385

SEQ ID NO: 571285 - RNA, 64 nt, hsa; identical to SEQ ID NO: 130386

SEQ ID NO: 571286 - RNA, 64 nt, hsa; identical to SEQ ID NO: 130387

SEQ ID NO: 571287 - RNA, 64 nt, hsa; identical to SEQ ID NO: 130388

SEQ ID NO: 571288 - RNA, 64 nt, hsa; identical to SEQ ID NO: 130389

SEQ ID NO: 571289 - RNA, 64 nt, hsa; identical to SEQ ID NO: 130390

SEQ ID NO: 571290 - RNA, 64 nt, hsa; identical to SEQ ID NO: 130391

SEQ ID NO: 571291 - RNA, 64 nt, hsa; identical to SEQ ID NO: 130392

SEQ ID NO: 571292 - RNA, 64 nt, hsa; identical to SEQ ID NO: 130393

SEQ ID NO: 571293 - RNA, 64 nt, hsa; identical to SEQ ID NO: 130394

SEQ ID NO: 571294 - RNA, 64 nt, hsa; identical to SEQ ID NO: 130395

SEQ ID NO: 571295 - RNA, 64 nt, hsa; identical to SEQ ID NO: 130396

SEQ ID NO: 571296 - RNA, 64 nt, hsa; identical to SEQ ID NO: 156143

SEQ ID NO: 571297 - RNA, 64 nt, hsa; identical to SEQ ID NO: 156144

SEQ ID NO: 571298 - RNA, 64 nt, hsa; identical to SEQ ID NO: 156145

SEQ ID NO: 571299 - RNA, 64 nt, hsa; identical to SEQ ID NO: 156146

SEQ ID NO: 571300 - RNA, 64 nt, hsa; identical to SEQ ID NO: 156147

SEQ ID NO: 571301 - RNA, 64 nt, hsa; identical to SEQ ID NO: 156148

SEQ ID NO: 571302 - RNA, 64 nt, hsa; identical to SEQ ID NO: 156149

SEQ ID NO: 571303 - RNA, 64 nt, hsa; identical to SEQ ID NO: 156150

SEQ ID NO: 571304 - RNA, 64 nt, hsa; identical to SEQ ID NO: 156151

SEQ ID NO: 571305 - RNA, 64 nt, hsa; identical to SEQ ID NO: 156152

SEQ ID NO: 571306 - RNA, 64 nt, hsa; identical to SEQ ID NO: 156153

SEQ ID NO: 571307 - RNA, 64 nt, hsa; identical to SEQ ID NO: 156154

SEQ ID NO: 571308 - RNA, 64 nt, hsa; identical to SEQ ID NO: 156155

SEQ ID NO: 571309 - RNA, 64 nt, hsa; identical to SEQ ID NO: 156156

SEQ ID NO: 571310 - RNA, 64 nt, hsa; identical to SEQ ID NO: 156157

SEQ ID NO: 571311 - RNA, 64 nt, hsa; identical to SEQ ID NO: 156158

SEQ ID NO: 571312 - RNA, 64 nt, hsa; identical to SEQ ID NO: 156159

SEQ ID NO: 571313 - RNA, 64 nt, hsa; identical to SEQ ID NO: 156160

SEQ ID NO: 571314 - RNA, 64 nt, hsa; identical to SEQ ID NO: 156161

SEQ ID NO: 571315 - RNA, 64 nt, hsa; identical to SEQ ID NO: 156162

SEQ ID NO: 571316 - RNA, 64 nt, hsa; identical to SEQ ID NO: 156163

SEQ ID NO: 571317 - RNA, 64 nt, hsa; identical to SEQ ID NO: 156164

SEQ ID NO: 571318 - RNA, 64 nt, hsa; identical to SEQ ID NO: 156165

SEQ ID NO: 571319 - RNA, 64 nt, hsa; identical to SEQ ID NO: 156166

SEQ ID NO: 571320 - RNA, 64 nt, hsa; identical to SEQ ID NO: 156167

SEQ ID NO: 571321 - RNA, 64 nt, hsa; identical to SEQ ID NO: 156168

SEQ ID NO: 571322 - RNA, 64 nt, hsa; identical to SEQ ID NO: 156169

SEQ ID NO: 571323 - RNA, 64 nt, hsa; identical to SEQ ID NO: 156170

SEQ ID NO: 571324 - RNA, 64 nt, hsa; identical to SEQ ID NO: 156171

SEQ ID NO: 571325 - RNA, 64 nt, hsa; identical to SEQ ID NO: 156172

SEQ ID NO: 571326 - RNA, 64 nt, hsa; identical to SEQ ID NO: 156173

SEQ ID NO: 571327 - RNA, 64 nt, hsa; identical to SEQ ID NO: 156174

SEQ ID NO: 571328 - RNA, 64 nt, hsa; identical to SEQ ID NO: 156175

SEQ ID NO: 571329 - RNA, 64 nt, hsa; identical to SEQ ID NO: 156176

SEQ ID NO: 571330 - RNA, 64 nt, hsa; identical to SEQ ID NO: 156177

SEQ ID NO: 571331 - RNA, 64 nt, hsa; identical to SEQ ID NO: 156178

SEQ ID NO: 571332 - RNA, 64 nt, hsa; identical to SEQ ID NO: 156179

SEQ ID NO: 571333 - RNA, 64 nt, hsa; identical to SEQ ID NO: 156180

SEQ ID NO: 571334 - RNA, 64 nt, hsa; identical to SEQ ID NO: 156181

SEQ ID NO: 571335 - RNA, 64 nt, hsa; identical to SEQ ID NO: 156182

SEQ ID NO: 571336 - RNA, 64 nt, hsa; identical to SEQ ID NO: 156183

SEQ ID NO: 571337 - RNA, 64 nt, hsa; identical to SEQ ID NO: 156184

SEQ ID NO: 571338 - RNA, 64 nt, hsa; identical to SEQ ID NO: 156185

SEQ ID NO: 571339 - RNA, 64 nt, hsa; identical to SEQ ID NO: 156186

SEQ ID NO: 571340 - RNA, 64 nt, hsa; identical to SEQ ID NO: 156187

SEQ ID NO: 571341 - RNA, 64 nt, hsa; identical to SEQ ID NO: 156188

SEQ ID NO: 571342 - RNA, 64 nt, hsa; identical to SEQ ID NO: 156189

SEQ ID NO: 571343 - RNA, 64 nt, hsa; identical to SEQ ID NO: 156190

SEQ ID NO: 571344 - RNA, 64 nt, hsa; identical to SEQ ID NO: 156191

SEQ ID NO: 571345 - RNA, 64 nt, hsa; identical to SEQ ID NO: 156192

SEQ ID NO: 571346 - RNA, 64 nt, hsa; identical to SEQ ID NO: 156193

SEQ ID NO: 571347 - RNA, 64 nt, hsa; identical to SEQ ID NO: 156194

SEQ ID NO: 571348 - RNA, 64 nt, hsa; identical to SEQ ID NO: 156195

SEQ ID NO: 571349 - RNA, 64 nt, hsa; identical to SEQ ID NO: 156196

SEQ ID NO: 571350 - RNA, 64 nt, hsa; identical to SEQ ID NO: 156197

SEQ ID NO: 571351 - RNA, 64 nt, hsa; identical to SEQ ID NO: 156198

SEQ ID NO: 571352 - RNA, 64 nt, hsa; identical to SEQ ID NO: 156199

SEQ ID NO: 571353 - RNA, 64 nt, hsa; identical to SEQ ID NO: 156200

SEQ ID NO: 571354 - RNA, 64 nt, hsa; identical to SEQ ID NO: 156201

SEQ ID NO: 571355 - RNA, 64 nt, hsa; identical to SEQ ID NO: 156202

SEQ ID NO: 571356 - RNA, 64 nt, hsa; identical to SEQ ID NO: 156203

SEQ ID NO: 571357 - RNA, 64 nt, hsa; identical to SEQ ID NO: 156204

SEQ ID NO: 571358 - RNA, 64 nt, hsa; identical to SEQ ID NO: 156205

SEQ ID NO: 571359 - RNA, 64 nt, hsa; identical to SEQ ID NO: 156206

SEQ ID NO: 571360 - RNA, 64 nt, hsa; identical to SEQ ID NO: 156207

SEQ ID NO: 571361 - RNA, 64 nt, hsa; identical to SEQ ID NO: 156208

SEQ ID NO: 571362 - RNA, 64 nt, hsa; identical to SEQ ID NO: 156209

SEQ ID NO: 571363 - RNA, 53 nt, hsa; identical to SEQ ID NO: 156210

SEQ ID NO: 571364 - RNA, 64 nt, hsa; identical to SEQ ID NO: 156211

SEQ ID NO: 571365 - RNA, 64 nt, hsa; identical to SEQ ID NO: 156212

SEQ ID NO: 571366 - RNA, 64 nt, hsa; identical to SEQ ID NO: 156213

SEQ ID NO: 571367 - RNA, 64 nt, hsa; identical to SEQ ID NO: 156214

SEQ ID NO: 571368 - RNA, 64 nt, hsa; identical to SEQ ID NO: 156215

SEQ ID NO: 571369 - RNA, 64 nt, hsa; identical to SEQ ID NO: 156216

SEQ ID NO: 571370 - RNA, 64 nt, hsa; identical to SEQ ID NO: 156217

SEQ ID NO: 571371 - RNA, 64 nt, hsa; identical to SEQ ID NO: 156218

SEQ ID NO: 571372 - RNA, 64 nt, hsa; identical to SEQ ID NO: 156219

SEQ ID NO: 571373 - RNA, 64 nt, hsa; identical to SEQ ID NO: 156220

SEQ ID NO: 571374 - RNA, 64 nt, hsa; identical to SEQ ID NO: 156221

SEQ ID NO: 571375 - RNA, 64 nt, hsa; identical to SEQ ID NO: 156222

SEQ ID NO: 571376 - RNA, 64 nt, hsa; identical to SEQ ID NO: 156223

SEQ ID NO: 571377 - RNA, 64 nt, hsa; identical to SEQ ID NO: 156224

SEQ ID NO: 571378 - RNA, 64 nt, hsa; identical to SEQ ID NO: 156225

SEQ ID NO: 571379 - RNA, 64 nt, hsa; identical to SEQ ID NO: 156226

SEQ ID NO: 571380 - RNA, 64 nt, hsa; identical to SEQ ID NO: 156227

SEQ ID NO: 571381 - RNA, 64 nt, hsa; identical to SEQ ID NO: 156228

SEQ ID NO: 571382 - RNA, 64 nt, hsa; identical to SEQ ID NO: 156229

SEQ ID NO: 571383 - RNA, 64 nt, hsa; identical to SEQ ID NO: 156230

SEQ ID NO: 571384 - RNA, 64 nt, hsa; identical to SEQ ID NO: 156231

SEQ ID NO: 571385 - RNA, 64 nt, hsa; identical to SEQ ID NO: 156232

SEQ ID NO: 571386 - RNA, 64 nt, hsa; identical to SEQ ID NO: 156233

SEQ ID NO: 571387 - RNA, 64 nt, hsa; identical to SEQ ID NO: 156234

SEQ ID NO: 571388 - RNA, 64 nt, hsa; identical to SEQ ID NO: 156235

SEQ ID NO: 571389 - RNA, 64 nt, hsa; identical to SEQ ID NO: 156236

SEQ ID NO: 571390 - RNA, 64 nt, hsa; identical to SEQ ID NO: 156237

SEQ ID NO: 571391 - RNA, 64 nt, hsa; identical to SEQ ID NO: 156238

SEQ ID NO: 571392 - RNA, 64 nt, hsa; identical to SEQ ID NO: 156239

SEQ ID NO: 571393 - RNA, 64 nt, hsa; identical to SEQ ID NO: 156240

SEQ ID NO: 571394 - RNA, 64 nt, hsa; identical to SEQ ID NO: 156241

SEQ ID NO: 571395 - RNA, 64 nt, hsa; identical to SEQ ID NO: 156242

SEQ ID NO: 571396 - RNA, 64 nt, hsa; identical to SEQ ID NO: 156243

SEQ ID NO: 571397 - RNA, 64 nt, hsa; identical to SEQ ID NO: 156244

SEQ ID NO: 571398 - RNA, 64 nt, hsa; identical to SEQ ID NO: 156245

SEQ ID NO: 571399 - RNA, 64 nt, hsa; identical to SEQ ID NO: 156246

SEQ ID NO: 571400 - RNA, 64 nt, hsa; identical to SEQ ID NO: 156247

SEQ ID NO: 571401 - RNA, 64 nt, hsa; identical to SEQ ID NO: 156248

SEQ ID NO: 571402 - RNA, 64 nt, hsa; identical to SEQ ID NO: 156249

SEQ ID NO: 571403 - RNA, 64 nt, hsa; identical to SEQ ID NO: 156250

SEQ ID NO: 571404 - RNA, 64 nt, hsa; identical to SEQ ID NO: 156251

SEQ ID NO: 571405 - RNA, 64 nt, hsa; identical to SEQ ID NO: 156252

SEQ ID NO: 571406 - RNA, 64 nt, hsa; identical to SEQ ID NO: 156253

SEQ ID NO: 571407 - RNA, 64 nt, hsa; identical to SEQ ID NO: 156254

SEQ ID NO: 571408 - RNA, 64 nt, hsa; identical to SEQ ID NO: 156255

SEQ ID NO: 571409 - RNA, 64 nt, hsa; identical to SEQ ID NO: 156256

SEQ ID NO: 571410 - RNA, 64 nt, hsa; identical to SEQ ID NO: 156257

SEQ ID NO: 571411 - RNA, 64 nt, hsa; identical to SEQ ID NO: 156258

SEQ ID NO: 571412 - RNA, 64 nt, hsa; identical to SEQ ID NO: 156259

SEQ ID NO: 571413 - RNA, 64 nt, hsa; identical to SEQ ID NO: 156260

SEQ ID NO: 571414 - RNA, 64 nt, hsa; identical to SEQ ID NO: 156261

SEQ ID NO: 571415 - RNA, 64 nt, hsa; identical to SEQ ID NO: 156262

SEQ ID NO: 571416 - RNA, 64 nt, hsa; identical to SEQ ID NO: 156263

SEQ ID NO: 571417 - RNA, 64 nt, hsa; identical to SEQ ID NO: 156264

SEQ ID NO: 571418 - RNA, 64 nt, hsa; identical to SEQ ID NO: 156265

SEQ ID NO: 571419 - RNA, 64 nt, hsa; identical to SEQ ID NO: 156266

SEQ ID NO: 571420 - RNA, 64 nt, hsa; identical to SEQ ID NO: 156267

SEQ ID NO: 571421 - RNA, 64 nt, hsa; identical to SEQ ID NO: 156268

SEQ ID NO: 571422 - RNA, 64 nt, hsa; identical to SEQ ID NO: 156269

SEQ ID NO: 571423 - RNA, 64 nt, hsa; identical to SEQ ID NO: 156270

SEQ ID NO: 571424 - RNA, 64 nt, hsa; identical to SEQ ID NO: 156271

SEQ ID NO: 571425 - RNA, 64 nt, hsa; identical to SEQ ID NO: 156272

SEQ ID NO: 571426 - RNA, 64 nt, hsa; identical to SEQ ID NO: 156273

SEQ ID NO: 571427 - RNA, 64 nt, hsa; identical to SEQ ID NO: 156274

SEQ ID NO: 571428 - RNA, 64 nt, hsa; identical to SEQ ID NO: 156275

SEQ ID NO: 571429 - RNA, 64 nt, hsa; identical to SEQ ID NO: 156276

SEQ ID NO: 571430 - RNA, 64 nt, hsa; identical to SEQ ID NO: 156277

SEQ ID NO: 571431 - RNA, 64 nt, hsa; identical to SEQ ID NO: 156278

SEQ ID NO: 571432 - RNA, 64 nt, hsa; identical to SEQ ID NO: 156279

SEQ ID NO: 571433 - RNA, 64 nt, hsa; identical to SEQ ID NO: 156280

SEQ ID NO: 571434 - RNA, 64 nt, hsa; identical to SEQ ID NO: 156281

SEQ ID NO: 571435 - RNA, 64 nt, hsa; identical to SEQ ID NO: 156282

SEQ ID NO: 571436 - RNA, 64 nt, hsa; identical to SEQ ID NO: 156283

SEQ ID NO: 571437 - RNA, 64 nt, hsa; identical to SEQ ID NO: 156284

SEQ ID NO: 571438 - RNA, 64 nt, hsa; identical to SEQ ID NO: 156285

SEQ ID NO: 571439 - RNA, 64 nt, hsa; identical to SEQ ID NO: 156286

SEQ ID NO: 571440 - RNA, 64 nt, hsa; identical to SEQ ID NO: 156287

SEQ ID NO: 571441 - RNA, 64 nt, hsa; identical to SEQ ID NO: 120128

SEQ ID NO: 571442 - RNA, 64 nt, hsa; identical to SEQ ID NO: 120129

SEQ ID NO: 571443 - RNA, 64 nt, hsa; identical to SEQ ID NO: 120130

SEQ ID NO: 571444 - RNA, 64 nt, hsa; identical to SEQ ID NO: 120131

SEQ ID NO: 571445 - RNA, 64 nt, hsa; identical to SEQ ID NO: 120132

SEQ ID NO: 571446 - RNA, 64 nt, hsa; identical to SEQ ID NO: 120133

SEQ ID NO: 571447 - RNA, 64 nt, hsa; identical to SEQ ID NO: 120134

SEQ ID NO: 571448 - RNA, 64 nt, hsa; identical to SEQ ID NO: 120135

SEQ ID NO: 571449 - RNA, 64 nt, hsa; identical to SEQ ID NO: 120136

SEQ ID NO: 571450 - RNA, 64 nt, hsa; identical to SEQ ID NO: 120137

SEQ ID NO: 571451 - RNA, 64 nt, hsa; identical to SEQ ID NO: 120138

SEQ ID NO: 571452 - RNA, 64 nt, hsa; identical to SEQ ID NO: 120139

SEQ ID NO: 571453 - RNA, 64 nt, hsa; identical to SEQ ID NO: 120140

SEQ ID NO: 571454 - RNA, 64 nt, hsa; identical to SEQ ID NO: 120141

SEQ ID NO: 571455 - RNA, 64 nt, hsa; identical to SEQ ID NO: 120142

SEQ ID NO: 571456 - RNA, 64 nt, hsa; identical to SEQ ID NO: 120143

SEQ ID NO: 571457 - RNA, 64 nt, hsa; identical to SEQ ID NO: 120144

SEQ ID NO: 571458 - RNA, 64 nt, hsa; identical to SEQ ID NO: 120145

SEQ ID NO: 571459 - RNA, 64 nt, hsa; identical to SEQ ID NO: 120146

SEQ ID NO: 571460 - RNA, 64 nt, hsa; identical to SEQ ID NO: 120147

SEQ ID NO: 571461 - RNA, 64 nt, hsa; identical to SEQ ID NO: 120148

SEQ ID NO: 571462 - RNA, 64 nt, hsa; identical to SEQ ID NO: 120149

SEQ ID NO: 571463 - RNA, 64 nt, hsa; identical to SEQ ID NO: 120150

SEQ ID NO: 571464 - RNA, 64 nt, hsa; identical to SEQ ID NO: 120151

SEQ ID NO: 571465 - RNA, 64 nt, hsa; identical to SEQ ID NO: 120152

SEQ ID NO: 571466 - RNA, 64 nt, hsa; identical to SEQ ID NO: 120153

SEQ ID NO: 571467 - RNA, 64 nt, hsa; identical to SEQ ID NO: 120154

SEQ ID NO: 571468 - RNA, 64 nt, hsa; identical to SEQ ID NO: 120155

SEQ ID NO: 571469 - RNA, 64 nt, hsa; identical to SEQ ID NO: 120156

SEQ ID NO: 571470 - RNA, 64 nt, hsa; identical to SEQ ID NO: 120157

SEQ ID NO: 571471 - RNA, 64 nt, hsa; identical to SEQ ID NO: 120158

SEQ ID NO: 571472 - RNA, 64 nt, hsa
ucuuggacauaauuaauauuauaguaagcugcaucuaaauuaaaaauaaacuauucaucauaua

SEQ ID NO: 571473 - RNA, 64 nt, hsa
uugaaaguuuaaguuuuagacacuccccaaauuucuaaauuaaucuuuuucagaaauaucgaag

SEQ ID NO: 571474 - RNA, 64 nt, hsa
gaguaacugaaccaaaggaaaaagaagcucuuugcuaaauuaaggucuuuuauaaauuuaguaa

SEQ ID NO: 571475 - RNA, 64 nt, hsa
augauguugagauuauuauauacuguauuuucuucuaaauuaacccuaauguuuaaaaacucac

SEQ ID NO: 571476 - RNA, 64 nt, hsa
augaaauauauaugaugaaaagaauugagaaguucuaaauuaagacauuucaguuaagcucaua

SEQ ID NO: 571477 - RNA, 64 nt, hsa
ugcucuucauguuaauauggcagaguuuuguaaacuaaauuaaaacuuacugauauauuggacu

SEQ ID NO: 571478 - RNA, 64 nt, hsa
ucaguuugguaguucauuauuuuagaacaaauuucuaaauuaauuuauucccauaaccuacaau

SEQ ID NO: 571479 - RNA, 64 nt, hsa
uauagauaaaaaccuucuucuguauuccucaccucuaaauuauauguuauuugcuauuugaaaa

SEQ ID NO: 571480 - RNA, 64 nt, hsa
guggucauuuacugcugcucuuuuacaguuagcucuaaauuacuuguuugaacuauuuauuucu

SEQ ID NO: 571481 - RNA, 64 nt, hsa
uuuccucagaguuuuuguuuucuauauauuaagucuaaauuaaguuuucuacucauuaagacua

SEQ ID NO: 571482 - RNA, 64 nt, hsa
uugaaaaguugaaauuuaugagcuuugaagauugcuaaauuaaauaauuuauagcuccaaaaac

SEQ ID NO: 571483 - RNA, 64 nt, hsa
uaauuuuaaguauaauguuuugccuuugguacaacuaaauuaaaacucuugguggucacauauu

SEQ ID NO: 571484 - RNA, 64 nt, hsa
uuugaauaugcagacaaccuuugaauugugccuacuaaauuauagcaggggacuuuggcaccca

SEQ ID NO: 571485 - RNA, 64 nt, hsa
ucuuuuaaaaauaaaauccuuccuucccauguuacuaaauuaauuuauguuuuugagagguuga

SEQ ID NO: 571486 - RNA, 64 nt, hsa
gaggcuacaucacccaaaguagauguuagaaaaccuaaauuaaugaaccauauuuuuaaaaucc

SEQ ID NO: 571487 - RNA, 64 nt, hsa
ccaaccucuuugggagaaguaugaaugcgugugucuaaauuaaaagaaaaaaauauuuaaacgu

SEQ ID NO: 571488 - RNA, 64 nt, hsa
gccugaccucaaccccgcucuccucauccuauuccuaaauuaggcuaauaaagugaaauuggua

SEQ ID NO: 571489 - RNA, 64 nt, hsa
aaagcaauuaggaguauguuccugauuuuauucucuaaauuauacucaauuucaugguaauuac

SEQ ID NO: 571490 - RNA, 64 nt, hsa
ugagagauaaucuauuuucauaaucaauaugugccuaaauuauauuuaaaucauuucacucugu

SEQ ID NO: 571491 - RNA, 64 nt, hsa
uuuauaauguuuacuuuuuaggacagaacaguagcuaaauuaaaguaauauccaguucuuacug

SEQ ID NO: 571492 - RNA, 64 nt, hsa
aaauguuuagugaaacauuugugaaaaaagaagacuaaauuaagaccugagcugaaauaaagug

SEQ ID NO: 571493 - RNA, 64 nt, hsa
aaaucugaaaaguggaggaagaguacaaauagaccuaaauuaagcucauuuuuaggcuuugauu

SEQ ID NO: 571494 - RNA, 64 nt, hsa
augguuaaaacaggaguuguguucucugucgcugcuaaauuauucuucacuugagugaagcaaa

SEQ ID NO: 571495 - RNA, 64 nt, hsa
uugugcuugaaguauuucuucucugguuguaauucuaaauuacagagucauuugagcuuucucc

SEQ ID NO: 571496 - RNA, 64 nt, hsa
guuuucuauuuuaucuaaaaucuuuccauuauaucuaaauuagaaugaucauccugcgcaaauu

SEQ ID NO: 571497 - RNA, 64 nt, hsa
acaaaaauccuuguugaaguuuuuuuaaaaaaagcuaaauuacauagacuuaggcauuaacaug

SEQ ID NO: 571498 - RNA, 64 nt, hsa
auacuaguacaagugguaauuuuuguacauuacacuaaauuauuagcauuuguuuuagcauuac

SEQ ID NO: 571499 - RNA, 64 nt, hsa
aagguuugaagaauuuuuuuuuacaagacuaguucuaaauuaacagcuuauaaaaaauuugucu

SEQ ID NO: 571500 - RNA, 64 nt, hsa
aauuucuaguaaaucuauaaaaauggguaagucccuaaauuacaaaugagaaaauugaagcaca

SEQ ID NO: 571501 - RNA, 64 nt, hsa
ugccaugaaucauugcagggcaggcuguuacuggcuaaauuaaaacccuuggcagggcaucgac

SEQ ID NO: 571502 - RNA, 60 nt, hsa
ugcacauuuucaacauguaguugaagaagccuaaauuagguacuagaaaaaaaaaaagga

SEQ ID NO: 571503 - RNA, 64 nt, hsa
uccaugccccuaggauuuugcuuccuccccggugcuaaauuagcaagcuccuagagaagccaug

SEQ ID NO: 571504 - RNA, 64 nt, hsa
guucucaaggaggaaaauuggucuaggaagccuucuaaauuaaacucugggaaauauaguaaug

SEQ ID NO: 571505 - RNA, 64 nt, hsa
guuuugccuaaauuaguauauaaaaacaaaaaugcuaaauuauaucugugaauugcagguauug

SEQ ID NO: 571506 - RNA, 64 nt, hsa
uuuguuggacgauucaguggcggggggguuuugccuaaauuaguauauaaaaacaaaaaugcua

SEQ ID NO: 571507 - RNA, 64 nt, hsa
acuuguaauuagagauugacuucagaaacuuuuucuaaauuauaaagacggaaugaccagaaaa

SEQ ID NO: 571508 - RNA, 64 nt, hsa
uuuauagaguucauagaaauacaucaauaagcuccuaaauuauagagccucaauuuugguuuuu

SEQ ID NO: 571509 - RNA, 64 nt, hsa; identical to SEQ ID NO: 169421

SEQ ID NO: 571510 - RNA, 64 nt, hsa; identical to SEQ ID NO: 169422

SEQ ID NO: 571511 - RNA, 64 nt, hsa; identical to SEQ ID NO: 169423

SEQ ID NO: 571512 - RNA, 64 nt, hsa; identical to SEQ ID NO: 169424

SEQ ID NO: 571513 - RNA, 64 nt, hsa; identical to SEQ ID NO: 169425

SEQ ID NO: 571514 - RNA, 64 nt, hsa; identical to SEQ ID NO: 169426

SEQ ID NO: 571515 - RNA, 64 nt, hsa; identical to SEQ ID NO: 169427

SEQ ID NO: 571516 - RNA, 64 nt, hsa; identical to SEQ ID NO: 169428

SEQ ID NO: 571517 - RNA, 64 nt, hsa; identical to SEQ ID NO: 169429

SEQ ID NO: 571518 - RNA, 64 nt, hsa; identical to SEQ ID NO: 169430

SEQ ID NO: 571519 - RNA, 64 nt, hsa; identical to SEQ ID NO: 169431

SEQ ID NO: 571520 - RNA, 64 nt, hsa; identical to SEQ ID NO: 169432

SEQ ID NO: 571521 - RNA, 64 nt, hsa; identical to SEQ ID NO: 169433

SEQ ID NO: 571522 - RNA, 64 nt, hsa; identical to SEQ ID NO: 169434

SEQ ID NO: 571523 - RNA, 64 nt, hsa; identical to SEQ ID NO: 169435

SEQ ID NO: 571524 - RNA, 64 nt, hsa; identical to SEQ ID NO: 169436

SEQ ID NO: 571525 - RNA, 64 nt, hsa; identical to SEQ ID NO: 169437

SEQ ID NO: 571526 - RNA, 64 nt, hsa; identical to SEQ ID NO: 169438

SEQ ID NO: 571527 - RNA, 64 nt, hsa; identical to SEQ ID NO: 169439

SEQ ID NO: 571528 - RNA, 64 nt, hsa; identical to SEQ ID NO: 169440

SEQ ID NO: 571529 - RNA, 64 nt, hsa; identical to SEQ ID NO: 169441

SEQ ID NO: 571530 - RNA, 64 nt, hsa; identical to SEQ ID NO: 169442

SEQ ID NO: 571531 - RNA, 64 nt, hsa; identical to SEQ ID NO: 169443

SEQ ID NO: 571532 - RNA, 64 nt, hsa; identical to SEQ ID NO: 169442

SEQ ID NO: 571533 - RNA, 64 nt, hsa; identical to SEQ ID NO: 169443

SEQ ID NO: 571534 - RNA, 64 nt, hsa; identical to SEQ ID NO: 289444

SEQ ID NO: 571535 - RNA, 64 nt, hsa; identical to SEQ ID NO: 289445

SEQ ID NO: 571536 - RNA, 64 nt, hsa; identical to SEQ ID NO: 289446

SEQ ID NO: 571537 - RNA, 64 nt, hsa; identical to SEQ ID NO: 289447

SEQ ID NO: 571538 - RNA, 64 nt, hsa; identical to SEQ ID NO: 289448

SEQ ID NO: 571539 - RNA, 64 nt, hsa; identical to SEQ ID NO: 289449

SEQ ID NO: 571540 - RNA, 64 nt, hsa; identical to SEQ ID NO: 289450

SEQ ID NO: 571541 - RNA, 64 nt, hsa; identical to SEQ ID NO: 289451

SEQ ID NO: 571542 - RNA, 64 nt, hsa; identical to SEQ ID NO: 289452

SEQ ID NO: 571543 - RNA, 64 nt, hsa; identical to SEQ ID NO: 289453

SEQ ID NO: 571544 - RNA, 64 nt, hsa; identical to SEQ ID NO: 289454

SEQ ID NO: 571545 - RNA, 64 nt, hsa; identical to SEQ ID NO: 289455

SEQ ID NO: 571546 - RNA, 64 nt, hsa; identical to SEQ ID NO: 289456

SEQ ID NO: 571547 - RNA, 64 nt, hsa; identical to SEQ ID NO: 289457

SEQ ID NO: 571548 - RNA, 64 nt, hsa; identical to SEQ ID NO: 289458

SEQ ID NO: 571549 - RNA, 64 nt, hsa; identical to SEQ ID NO: 289459

SEQ ID NO: 571550 - RNA, 64 nt, hsa; identical to SEQ ID NO: 289460

SEQ ID NO: 571551 - RNA, 64 nt, hsa; identical to SEQ ID NO: 289461

SEQ ID NO: 571552 - RNA, 64 nt, hsa; identical to SEQ ID NO: 289462

SEQ ID NO: 571553 - RNA, 64 nt, hsa; identical to SEQ ID NO: 289463

SEQ ID NO: 571554 - RNA, 64 nt, hsa; identical to SEQ ID NO: 289464

SEQ ID NO: 571555 - RNA, 64 nt, hsa; identical to SEQ ID NO: 289465

SEQ ID NO: 571556 - RNA, 64 nt, hsa; identical to SEQ ID NO: 289466

SEQ ID NO: 571557 - RNA, 64 nt, hsa; identical to SEQ ID NO: 289467

SEQ ID NO: 571558 - RNA, 64 nt, hsa; identical to SEQ ID NO: 84166

SEQ ID NO: 571559 - RNA, 64 nt, hsa; identical to SEQ ID NO: 84167

SEQ ID NO: 571560 - RNA, 64 nt, hsa; identical to SEQ ID NO: 84168

SEQ ID NO: 571561 - RNA, 64 nt, hsa; identical to SEQ ID NO: 84169

SEQ ID NO: 571562 - RNA, 64 nt, hsa; identical to SEQ ID NO: 84170

SEQ ID NO: 571563 - RNA, 64 nt, hsa; identical to SEQ ID NO: 84171

SEQ ID NO: 571564 - RNA, 64 nt, hsa; identical to SEQ ID NO: 84172

SEQ ID NO: 571565 - RNA, 64 nt, hsa; identical to SEQ ID NO: 84173

SEQ ID NO: 571566 - RNA, 64 nt, hsa; identical to SEQ ID NO: 84174

SEQ ID NO: 571567 - RNA, 64 nt, hsa; identical to SEQ ID NO: 84175

SEQ ID NO: 571568 - RNA, 64 nt, hsa; identical to SEQ ID NO: 84176

SEQ ID NO: 571569 - RNA, 64 nt, hsa; identical to SEQ ID NO: 84177

SEQ ID NO: 571570 - RNA, 64 nt, hsa; identical to SEQ ID NO: 84178

SEQ ID NO: 571571 - RNA, 64 nt, hsa; identical to SEQ ID NO: 84179

SEQ ID NO: 571572 - RNA, 64 nt, hsa; identical to SEQ ID NO: 84180

SEQ ID NO: 571573 - RNA, 64 nt, hsa; identical to SEQ ID NO: 84181

SEQ ID NO: 571574 - RNA, 64 nt, hsa; identical to SEQ ID NO: 84182

SEQ ID NO: 571575 - RNA, 64 nt, hsa; identical to SEQ ID NO: 84183

SEQ ID NO: 571576 - RNA, 64 nt, hsa; identical to SEQ ID NO: 84184

SEQ ID NO: 571577 - RNA, 64 nt, hsa; identical to SEQ ID NO: 84185

SEQ ID NO: 571578 - RNA, 64 nt, hsa; identical to SEQ ID NO: 84186

SEQ ID NO: 571579 - RNA, 64 nt, hsa; identical to SEQ ID NO: 84187

SEQ ID NO: 571580 - RNA, 64 nt, hsa; identical to SEQ ID NO: 84188

SEQ ID NO: 571581 - RNA, 64 nt, hsa; identical to SEQ ID NO: 84189

SEQ ID NO: 571582 - RNA, 64 nt, hsa; identical to SEQ ID NO: 84190

SEQ ID NO: 571583 - RNA, 64 nt, hsa; identical to SEQ ID NO: 84191

SEQ ID NO: 571584 - RNA, 64 nt, hsa; identical to SEQ ID NO: 84192

SEQ ID NO: 571585 - RNA, 64 nt, hsa; identical to SEQ ID NO: 84193

SEQ ID NO: 571586 - RNA, 64 nt, hsa; identical to SEQ ID NO: 84194

SEQ ID NO: 571587 - RNA, 64 nt, hsa; identical to SEQ ID NO: 84195

SEQ ID NO: 571588 - RNA, 64 nt, hsa; identical to SEQ ID NO: 84196

SEQ ID NO: 571589 - RNA, 64 nt, hsa; identical to SEQ ID NO: 84197

SEQ ID NO: 571590 - RNA, 64 nt, hsa; identical to SEQ ID NO: 84198

SEQ ID NO: 571591 - RNA, 64 nt, hsa; identical to SEQ ID NO: 84199

SEQ ID NO: 571592 - RNA, 64 nt, hsa; identical to SEQ ID NO: 84200

SEQ ID NO: 571593 - RNA, 64 nt, hsa; identical to SEQ ID NO: 84201

SEQ ID NO: 571594 - RNA, 64 nt, hsa; identical to SEQ ID NO: 84202

SEQ ID NO: 571595 - RNA, 64 nt, hsa; identical to SEQ ID NO: 84203

SEQ ID NO: 571596 - RNA, 64 nt, hsa; identical to SEQ ID NO: 84204

SEQ ID NO: 571597 - RNA, 64 nt, hsa; identical to SEQ ID NO: 84205

SEQ ID NO: 571598 - RNA, 64 nt, hsa; identical to SEQ ID NO: 84206

SEQ ID NO: 571599 - RNA, 64 nt, hsa; identical to SEQ ID NO: 84207

SEQ ID NO: 571600 - RNA, 64 nt, hsa; identical to SEQ ID NO: 84208

SEQ ID NO: 571601 - RNA, 64 nt, hsa; identical to SEQ ID NO: 84209

SEQ ID NO: 571602 - RNA, 64 nt, hsa; identical to SEQ ID NO: 84210

SEQ ID NO: 571603 - RNA, 64 nt, hsa; identical to SEQ ID NO: 84211

SEQ ID NO: 571604 - RNA, 64 nt, hsa; identical to SEQ ID NO: 84212

SEQ ID NO: 571605 - RNA, 64 nt, hsa; identical to SEQ ID NO: 84213

SEQ ID NO: 571606 - RNA, 64 nt, hsa; identical to SEQ ID NO: 84214

SEQ ID NO: 571607 - RNA, 64 nt, hsa; identical to SEQ ID NO: 84215

SEQ ID NO: 571608 - RNA, 64 nt, hsa; identical to SEQ ID NO: 84216

SEQ ID NO: 571609 - RNA, 64 nt, hsa; identical to SEQ ID NO: 84217

SEQ ID NO: 571610 - RNA, 64 nt, hsa; identical to SEQ ID NO: 84218

SEQ ID NO: 571611 - RNA, 64 nt, hsa; identical to SEQ ID NO: 84219

SEQ ID NO: 571612 - RNA, 64 nt, hsa; identical to SEQ ID NO: 84220

SEQ ID NO: 571613 - RNA, 64 nt, hsa; identical to SEQ ID NO: 84221

SEQ ID NO: 571614 - RNA, 64 nt, hsa; identical to SEQ ID NO: 84222

SEQ ID NO: 571615 - RNA, 64 nt, hsa; identical to SEQ ID NO: 84223

SEQ ID NO: 571616 - RNA, 64 nt, hsa; identical to SEQ ID NO: 84224

SEQ ID NO: 571617 - RNA, 64 nt, hsa; identical to SEQ ID NO: 84225

SEQ ID NO: 571618 - RNA, 64 nt, hsa; identical to SEQ ID NO: 84226

SEQ ID NO: 571619 - RNA, 64 nt, hsa; identical to SEQ ID NO: 84227

SEQ ID NO: 571620 - RNA, 64 nt, hsa; identical to SEQ ID NO: 84228

SEQ ID NO: 571621 - RNA, 64 nt, hsa; identical to SEQ ID NO: 84229

SEQ ID NO: 571622 - RNA, 64 nt, hsa; identical to SEQ ID NO: 84230

SEQ ID NO: 571623 - RNA, 64 nt, hsa; identical to SEQ ID NO: 84231

SEQ ID NO: 571624 - RNA, 64 nt, hsa; identical to SEQ ID NO: 84232

SEQ ID NO: 571625 - RNA, 64 nt, hsa; identical to SEQ ID NO: 84233

SEQ ID NO: 571626 - RNA, 64 nt, hsa
uacuuuguuuuugugagucaugucucaugaaauuuauuggaauguuuaaucauauuugcuaaga

SEQ ID NO: 571627 - RNA, 64 nt, hsa
ccuauaaucuguugcuuuuucucaauauguguccuauuggaaauuccucaaaucguuggugcca

SEQ ID NO: 571628 - RNA, 64 nt, hsa
accugcuguuacuuauucagauaaacauggugccuauuggaacaauagcggauagagcuacagg

SEQ ID NO: 571629 - RNA, 64 nt, hsa
aaaccucuugagaaaaagaaaaguucauacugauuauuggaaaaggacuauauaugugagcaag

SEQ ID NO: 571630 - RNA, 64 nt, hsa
auucuuguuaacccauuuaugccuaguguuccauuauuggaaugcuaagcuugugggagucauu

SEQ ID NO: 571631 - RNA, 64 nt, hsa
auuaucuccuguuuagcaccaaaagagcuaauauuauuggaaacugaccuuuuaaaggccacug

SEQ ID NO: 571632 - RNA, 64 nt, hsa
cacagcucucuuggucacaaaaacaugcuauuuuuauuggaacuucaaaccaaauccccacuga

SEQ ID NO: 571633 - RNA, 64 nt, hsa
ugucuuauuaacaucugaaaaaauauauauuuuuuauuggaaaauucuaauuuguuaggccuug

SEQ ID NO: 571634 - RNA, 64 nt, hsa
uucaugucuugggcaggaguuguugaaaauagguuauuggaauauauaaguuaucucacugcuc

SEQ ID NO: 571635 - RNA, 64 nt, hsa
ugauauuuuccugguacucguacugauaagggauuauuggaagucagucacagaauuuggaaau

SEQ ID NO: 571636 - RNA, 64 nt, hsa
aaaacaauaugcuuuguugaaggaaaauuuucuuuauuggaaugugguuguaauccuuguucag

SEQ ID NO: 571637 - RNA, 64 nt, hsa
cacuuuauagcuauggaaacaugagauucuccucuauuggaagcuaauuagcccacaaaggugg

SEQ ID NO: 571638 - RNA, 64 nt, hsa
uuuuuaaaaagaaauuauucucauugcuguauuauauuggaaaaguuuuaaacaaccaagcuaa

SEQ ID NO: 571639 - RNA, 64 nt, hsa
cucauagaaucccagucaccuuuauauaucauauuauuggaagagauucaucuucauaaucucc

SEQ ID NO: 571640 - RNA, 64 nt, hsa
cauagaaucacaauuaccuuuauauaucauauguuauuggaagagauuccucaguaaucuccaa

SEQ ID NO: 571641 - RNA, 64 nt, hsa
uucucuggggaguuauauaauaauuuauugaauuuauuggaacuugauuuuccuggaugcuuuc

SEQ ID NO: 571642 - RNA, 64 nt, hsa
ugguuagugaaugucuggcaugauuauacacguguauuggaaauaucuaguuuuuuaaauuuuu

SEQ ID NO: 571643 - RNA, 64 nt, hsa
auguagcagcuucauugcuauuggaaaaaucaguuauuggaauuuccacuuaaauggcuauaca

SEQ ID NO: 571644 - RNA, 64 nt, hsa
uacagaacaaaauaauauguagcagcuucauugcuauuggaaaaaucaguuauuggaauuucca

SEQ ID NO: 571645 - RNA, 64 nt, hsa
uguggacaaaaaaagcggggaagacagcaagauuuauuggaagauacuuacaggggaaauuaau

SEQ ID NO: 571646 - RNA, 64 nt, hsa
aagaggaguauuauagccaaguuuucuuugaaaguauuggaaaacuaaaauuaaaugacaagga

SEQ ID NO: 571647 - RNA, 64 nt, hsa
cuccccaccuccugcaauacgccuuuccaaucuuuauuggaagucucucccugccuacuuccua

SEQ ID NO: 571648 - RNA, 64 nt, hsa
gucucaaagcccaggcagaaaaggacuuuucuuuuauuggaagaaguaaacauggcuagaaaga

SEQ ID NO: 571649 - RNA, 64 nt, hsa
guaugaaugauguuuuagaaugauucccucuugcuauuggaaugugguccagacgucaaccagg

SEQ ID NO: 571650 - RNA, 64 nt, hsa
uaauucggaagggaaaacagucgaucaagggauguauuggaacaugucggaguagaaauuguuc

SEQ ID NO: 571651 - RNA, 64 nt, hsa
auacauguguggauguguaaauggagcuuguacauauuggaaaggucauuguggcuaucugcau

SEQ ID NO: 571652 - RNA, 64 nt, hsa
auaaugcuuauguaucugaagaaaaggucagaucuauuggaaaugacagcccgauacuugagcc

SEQ ID NO: 571653 - RNA, 64 nt, hsa
uuucugcugaucaaagaugaucaagcuuucuguguauuggaacagaaaguaacaaagaggaaug

SEQ ID NO: 571654 - RNA, 64 nt, hsa
gggcaauuggaacaaagugaaggacauagagguauauuggaagaggcagagccugaggugguag

SEQ ID NO: 571655 - RNA, 64 nt, hsa
uccagucccaaugguccugacuuugggcgcuggguauuggaaauggaugcaaaguacaaugugu

SEQ ID NO: 571656 - RNA, 64 nt, hsa
uuuauuuauaacuucuaccaugugauuuccagacuauuggaagugauuuacuguaucuugugau

SEQ ID NO: 571657 - RNA, 64 nt, hsa
ucaccuuguucauuucacauagugguuuauuagauauuggaaccuaaagaauucuguccacuug

SEQ ID NO: 571658 - RNA, 64 nt, hsa
aggaggcuuacaaacagcaaaucaaagaagauaauauuggaaaucagcugcugagaaagauggg

SEQ ID NO: 571659 - RNA, 64 nt, hsa; identical to SEQ ID NO: 145890

SEQ ID NO: 571660 - RNA, 64 nt, hsa; identical to SEQ ID NO: 145891

SEQ ID NO: 571661 - RNA, 64 nt, hsa; identical to SEQ ID NO: 145892

SEQ ID NO: 571662 - RNA, 64 nt, hsa; identical to SEQ ID NO: 145893

SEQ ID NO: 571663 - RNA, 64 nt, hsa; identical to SEQ ID NO: 145894

SEQ ID NO: 571664 - RNA, 64 nt, hsa; identical to SEQ ID NO: 145895

SEQ ID NO: 571665 - RNA, 64 nt, hsa; identical to SEQ ID NO: 145896

SEQ ID NO: 571666 - RNA, 64 nt, hsa; identical to SEQ ID NO: 145897

SEQ ID NO: 571667 - RNA, 64 nt, hsa; identical to SEQ ID NO: 145898

SEQ ID NO: 571668 - RNA, 64 nt, hsa; identical to SEQ ID NO: 145899

SEQ ID NO: 571669 - RNA, 64 nt, hsa; identical to SEQ ID NO: 145900

SEQ ID NO: 571670 - RNA, 64 nt, hsa; identical to SEQ ID NO: 145901

SEQ ID NO: 571671 - RNA, 64 nt, hsa; identical to SEQ ID NO: 145902

SEQ ID NO: 571672 - RNA, 64 nt, hsa; identical to SEQ ID NO: 145903

SEQ ID NO: 571673 - RNA, 64 nt, hsa; identical to SEQ ID NO: 145904

SEQ ID NO: 571674 - RNA, 64 nt, hsa; identical to SEQ ID NO: 145905

SEQ ID NO: 571675 - RNA, 64 nt, hsa; identical to SEQ ID NO: 145906

SEQ ID NO: 571676 - RNA, 64 nt, hsa; identical to SEQ ID NO: 145907

SEQ ID NO: 571677 - RNA, 62 nt, hsa; identical to SEQ ID NO: 145908

SEQ ID NO: 571678 - RNA, 64 nt, hsa; identical to SEQ ID NO: 145909

SEQ ID NO: 571679 - RNA, 64 nt, hsa; identical to SEQ ID NO: 145910

SEQ ID NO: 571680 - RNA, 64 nt, hsa; identical to SEQ ID NO: 145911

SEQ ID NO: 571681 - RNA, 64 nt, hsa; identical to SEQ ID NO: 145912

SEQ ID NO: 571682 - RNA, 64 nt, hsa; identical to SEQ ID NO: 145913

SEQ ID NO: 571683 - RNA, 64 nt, hsa; identical to SEQ ID NO: 145914

SEQ ID NO: 571684 - RNA, 64 nt, hsa; identical to SEQ ID NO: 145915

SEQ ID NO: 571685 - RNA, 64 nt, hsa; identical to SEQ ID NO: 145916

SEQ ID NO: 571686 - RNA, 64 nt, hsa; identical to SEQ ID NO: 145917

SEQ ID NO: 571687 - RNA, 64 nt, hsa; identical to SEQ ID NO: 145918

SEQ ID NO: 571688 - RNA, 64 nt, hsa; identical to SEQ ID NO: 145919

SEQ ID NO: 571689 - RNA, 64 nt, hsa; identical to SEQ ID NO: 145920

SEQ ID NO: 571690 - RNA, 64 nt, hsa; identical to SEQ ID NO: 145921

SEQ ID NO: 571691 - RNA, 64 nt, hsa; identical to SEQ ID NO: 145922

SEQ ID NO: 571692 - RNA, 64 nt, hsa; identical to SEQ ID NO: 145923

SEQ ID NO: 571693 - RNA, 64 nt, hsa; identical to SEQ ID NO: 145924

SEQ ID NO: 571694 - RNA, 64 nt, hsa; identical to SEQ ID NO: 145925

SEQ ID NO: 571695 - RNA, 64 nt, hsa; identical to SEQ ID NO: 145926

SEQ ID NO: 571696 - RNA, 64 nt, hsa; identical to SEQ ID NO: 145927

SEQ ID NO: 571697 - RNA, 64 nt, hsa; identical to SEQ ID NO: 145928

SEQ ID NO: 571698 - RNA, 64 nt, hsa; identical to SEQ ID NO: 145929

SEQ ID NO: 571699 - RNA, 64 nt, hsa; identical to SEQ ID NO: 145930

SEQ ID NO: 571700 - RNA, 64 nt, hsa; identical to SEQ ID NO: 145931

SEQ ID NO: 571701 - RNA, 64 nt, hsa; identical to SEQ ID NO: 145932

SEQ ID NO: 571702 - RNA, 64 nt, hsa; identical to SEQ ID NO: 145933

SEQ ID NO: 571703 - RNA, 64 nt, hsa; identical to SEQ ID NO: 145934

SEQ ID NO: 571704 - RNA, 64 nt, hsa; identical to SEQ ID NO: 145935

SEQ ID NO: 571705 - RNA, 64 nt, hsa; identical to SEQ ID NO: 145936

SEQ ID NO: 571706 - RNA, 64 nt, hsa; identical to SEQ ID NO: 145937

SEQ ID NO: 571707 - RNA, 64 nt, hsa; identical to SEQ ID NO: 145938

SEQ ID NO: 571708 - RNA, 64 nt, hsa; identical to SEQ ID NO: 145939

SEQ ID NO: 571709 - RNA, 64 nt, hsa; identical to SEQ ID NO: 145940

SEQ ID NO: 571710 - RNA, 64 nt, hsa; identical to SEQ ID NO: 145941

SEQ ID NO: 571711 - RNA, 64 nt, hsa; identical to SEQ ID NO: 145942

SEQ ID NO: 571712 - RNA, 64 nt, hsa; identical to SEQ ID NO: 145943

SEQ ID NO: 571713 - RNA, 64 nt, hsa; identical to SEQ ID NO: 145944

SEQ ID NO: 571714 - RNA, 64 nt, hsa; identical to SEQ ID NO: 145945

SEQ ID NO: 571715 - RNA, 64 nt, hsa; identical to SEQ ID NO: 145946

SEQ ID NO: 571716 - RNA, 64 nt, hsa; identical to SEQ ID NO: 145947

SEQ ID NO: 571717 - RNA, 64 nt, hsa; identical to SEQ ID NO: 145948

SEQ ID NO: 571718 - RNA, 64 nt, hsa; identical to SEQ ID NO: 145949

SEQ ID NO: 571719 - RNA, 64 nt, hsa; identical to SEQ ID NO: 145950

SEQ ID NO: 571720 - RNA, 64 nt, hsa; identical to SEQ ID NO: 145951

SEQ ID NO: 571721 - RNA, 64 nt, hsa; identical to SEQ ID NO: 145952

SEQ ID NO: 571722 - RNA, 64 nt, hsa; identical to SEQ ID NO: 145953

SEQ ID NO: 571723 - RNA, 64 nt, hsa; identical to SEQ ID NO: 145954

SEQ ID NO: 571724 - RNA, 64 nt, hsa; identical to SEQ ID NO: 145955

SEQ ID NO: 571725 - RNA, 64 nt, hsa; identical to SEQ ID NO: 145956

SEQ ID NO: 571726 - RNA, 64 nt, hsa; identical to SEQ ID NO: 145957

SEQ ID NO: 571727 - RNA, 64 nt, hsa; identical to SEQ ID NO: 145958

SEQ ID NO: 571728 - RNA, 64 nt, hsa; identical to SEQ ID NO: 145959

SEQ ID NO: 571729 - RNA, 64 nt, hsa; identical to SEQ ID NO: 145960

SEQ ID NO: 571730 - RNA, 64 nt, hsa; identical to SEQ ID NO: 145961

SEQ ID NO: 571731 - RNA, 64 nt, hsa; identical to SEQ ID NO: 145962

SEQ ID NO: 571732 - RNA, 64 nt, hsa; identical to SEQ ID NO: 145963

SEQ ID NO: 571733 - RNA, 64 nt, hsa; identical to SEQ ID NO: 145964

SEQ ID NO: 571734 - RNA, 64 nt, hsa; identical to SEQ ID NO: 145965

SEQ ID NO: 571735 - RNA, 64 nt, hsa; identical to SEQ ID NO: 145966

SEQ ID NO: 571736 - RNA, 64 nt, hsa; identical to SEQ ID NO: 145967

SEQ ID NO: 571737 - RNA, 64 nt, hsa; identical to SEQ ID NO: 145968

SEQ ID NO: 571738 - RNA, 64 nt, hsa; identical to SEQ ID NO: 145969

SEQ ID NO: 571739 - RNA, 64 nt, hsa; identical to SEQ ID NO: 145970

SEQ ID NO: 571740 - RNA, 64 nt, hsa; identical to SEQ ID NO: 145971

SEQ ID NO: 571741 - RNA, 64 nt, hsa; identical to SEQ ID NO: 145972

SEQ ID NO: 571742 - RNA, 64 nt, hsa; identical to SEQ ID NO: 145973

SEQ ID NO: 571743 - RNA, 64 nt, hsa; identical to SEQ ID NO: 145974

SEQ ID NO: 571744 - RNA, 64 nt, hsa; identical to SEQ ID NO: 145975

SEQ ID NO: 571745 - RNA, 64 nt, hsa; identical to SEQ ID NO: 145976

SEQ ID NO: 571746 - RNA, 64 nt, hsa; identical to SEQ ID NO: 145977

SEQ ID NO: 571747 - RNA, 64 nt, hsa; identical to SEQ ID NO: 145978

SEQ ID NO: 571748 - RNA, 64 nt, hsa; identical to SEQ ID NO: 145979

SEQ ID NO: 571749 - RNA, 64 nt, hsa; identical to SEQ ID NO: 145980

SEQ ID NO: 571750 - RNA, 64 nt, hsa; identical to SEQ ID NO: 145981

SEQ ID NO: 571751 - RNA, 64 nt, hsa; identical to SEQ ID NO: 145982

SEQ ID NO: 571752 - RNA, 64 nt, hsa; identical to SEQ ID NO: 145983

SEQ ID NO: 571753 - RNA, 64 nt, hsa; identical to SEQ ID NO: 145984

SEQ ID NO: 571754 - RNA, 64 nt, hsa; identical to SEQ ID NO: 145985

SEQ ID NO: 571755 - RNA, 64 nt, hsa; identical to SEQ ID NO: 145986

SEQ ID NO: 571756 - RNA, 64 nt, hsa; identical to SEQ ID NO: 145987

SEQ ID NO: 571757 - RNA, 64 nt, hsa; identical to SEQ ID NO: 145988

SEQ ID NO: 571758 - RNA, 64 nt, hsa; identical to SEQ ID NO: 145989

SEQ ID NO: 571759 - RNA, 64 nt, hsa; identical to SEQ ID NO: 145990

SEQ ID NO: 571760 - RNA, 64 nt, hsa; identical to SEQ ID NO: 145991

SEQ ID NO: 571761 - RNA, 64 nt, hsa; identical to SEQ ID NO: 145992

SEQ ID NO: 571762 - RNA, 64 nt, hsa; identical to SEQ ID NO: 145993

SEQ ID NO: 571763 - RNA, 64 nt, hsa; identical to SEQ ID NO: 145994

SEQ ID NO: 571764 - RNA, 64 nt, hsa; identical to SEQ ID NO: 145995

SEQ ID NO: 571765 - RNA, 64 nt, hsa; identical to SEQ ID NO: 145996

SEQ ID NO: 571766 - RNA, 64 nt, hsa; identical to SEQ ID NO: 145997

SEQ ID NO: 571767 - RNA, 64 nt, hsa; identical to SEQ ID NO: 145998

SEQ ID NO: 571768 - RNA, 64 nt, hsa
gggagauggaaaggggauaucagauugguuucccccgguggagccuuagguuagugcccagugc

SEQ ID NO: 571769 - RNA, 64 nt, hsa
acccagugcuuugcuuaugggugcucgcugggguccgguggagacugaccacccugcuugagcc

SEQ ID NO: 571770 - RNA, 64 nt, hsa
gguuuuauucuauauugcuuaccugaucucauguuaggccuaagaggcuuucuccaggaggauu

SEQ ID NO: 571771 - RNA, 64 nt, hsa
gggaaauggggcugugaggaggaggauuauaacuuaggccuagccucuuuuaacagccucugaa

SEQ ID NO: 571772 - RNA, 64 nt, hsa
uccuacccaauugucaugauuguccuuaguacccuaggccuagauucugagaucuucccauucu

SEQ ID NO: 571773 - RNA, 64 nt, hsa
uacccuaggccuagauucugagaucuucccauucuaggccuacaagcacuacuugcuguagcug

SEQ ID NO: 571774 - RNA, 64 nt, hsa; identical to SEQ ID NO: 571768

SEQ ID NO: 571775 - RNA, 64 nt, hsa; identical to SEQ ID NO: 571769

SEQ ID NO: 571776 - RNA, 64 nt, hsa; identical to SEQ ID NO: 571770

SEQ ID NO: 571777 - RNA, 64 nt, hsa; identical to SEQ ID NO: 571771

SEQ ID NO: 571778 - RNA, 64 nt, hsa; identical to SEQ ID NO: 571772

SEQ ID NO: 571779 - RNA, 64 nt, hsa; identical to SEQ ID NO: 571773

SEQ ID NO: 571780 - RNA, 64 nt, hsa; identical to SEQ ID NO: 161149

SEQ ID NO: 571781 - RNA, 64 nt, hsa; identical to SEQ ID NO: 161150

SEQ ID NO: 571782 - RNA, 64 nt, hsa; identical to SEQ ID NO: 161151

SEQ ID NO: 571783 - RNA, 64 nt, hsa; identical to SEQ ID NO: 161152

SEQ ID NO: 571784 - RNA, 64 nt, hsa; identical to SEQ ID NO: 161153

SEQ ID NO: 571785 - RNA, 64 nt, hsa; identical to SEQ ID NO: 161154

SEQ ID NO: 571786 - RNA, 64 nt, hsa; identical to SEQ ID NO: 161155

SEQ ID NO: 571787 - RNA, 64 nt, hsa; identical to SEQ ID NO: 161156

SEQ ID NO: 571788 - RNA, 64 nt, hsa; identical to SEQ ID NO: 161157

SEQ ID NO: 571789 - RNA, 64 nt, hsa; identical to SEQ ID NO: 161158

SEQ ID NO: 571790 - RNA, 64 nt, hsa; identical to SEQ ID NO: 161159

SEQ ID NO: 571791 - RNA, 64 nt, hsa; identical to SEQ ID NO: 161160

SEQ ID NO: 571792 - RNA, 64 nt, hsa; identical to SEQ ID NO: 161161

SEQ ID NO: 571793 - RNA, 64 nt, hsa; identical to SEQ ID NO: 161162

SEQ ID NO: 571794 - RNA, 64 nt, hsa; identical to SEQ ID NO: 161163

SEQ ID NO: 571795 - RNA, 64 nt, hsa; identical to SEQ ID NO: 161164

SEQ ID NO: 571796 - RNA, 64 nt, hsa; identical to SEQ ID NO: 161165

SEQ ID NO: 571797 - RNA, 64 nt, hsa; identical to SEQ ID NO: 161166

SEQ ID NO: 571798 - RNA, 64 nt, hsa; identical to SEQ ID NO: 161167

SEQ ID NO: 571799 - RNA, 64 nt, hsa; identical to SEQ ID NO: 161168

SEQ ID NO: 571800 - RNA, 64 nt, hsa; identical to SEQ ID NO: 161169

SEQ ID NO: 571801 - RNA, 64 nt, hsa; identical to SEQ ID NO: 161170

SEQ ID NO: 571802 - RNA, 64 nt, hsa; identical to SEQ ID NO: 161171

SEQ ID NO: 571803 - RNA, 64 nt, hsa; identical to SEQ ID NO: 161172

SEQ ID NO: 571804 - RNA, 64 nt, hsa; identical to SEQ ID NO: 161173

SEQ ID NO: 571805 - RNA, 64 nt, hsa; identical to SEQ ID NO: 161174

SEQ ID NO: 571806 - RNA, 64 nt, hsa; identical to SEQ ID NO: 161175

SEQ ID NO: 571807 - RNA, 64 nt, hsa; identical to SEQ ID NO: 161176

SEQ ID NO: 571808 - RNA, 64 nt, hsa; identical to SEQ ID NO: 161177

SEQ ID NO: 571809 - RNA, 64 nt, hsa; identical to SEQ ID NO: 161178

SEQ ID NO: 571810 - RNA, 64 nt, hsa; identical to SEQ ID NO: 161179

SEQ ID NO: 571811 - RNA, 64 nt, hsa; identical to SEQ ID NO: 161180

SEQ ID NO: 571812 - RNA, 64 nt, hsa; identical to SEQ ID NO: 161181

SEQ ID NO: 571813 - RNA, 64 nt, hsa; identical to SEQ ID NO: 161182

SEQ ID NO: 571814 - RNA, 64 nt, hsa; identical to SEQ ID NO: 161183

SEQ ID NO: 571815 - RNA, 63 nt, hsa
gaaucacuugaccccaggugguggagguugcagugagccaagauugcaccauugcacuccagc

SEQ ID NO: 571816 - RNA, 63 nt, hsa
gaaucgcuugaacccgggaggcacagguuccagugagccaagguugugccacugcacuccagc

SEQ ID NO: 571817 - RNA, 63 nt, hsa
accugggaggcggagguugugaugagccaagauugagccaaaaaaaaauuagcagaauuggug

SEQ ID NO: 571818 - RNA, 63 nt, hsa
gaauccguugaaccugggaggcggagguugugaugagccaagauugagccaaaaaaaaauuag

SEQ ID NO: 571819 - RNA, 63 nt, hsa
uauccugaggcuuuccacaauguuccccuccugugagccaaggaggcaaacugcacaagcuug

SEQ ID NO: 571820 - RNA, 63 nt, hsa
ggauuaauuaggaaaaccaauaguaaucacgucugagccaaggagcuggcccauuggucauuc

SEQ ID NO: 571821 - RNA, 63 nt, hsa
gaaucgcuugaacccaggagguggagguuccagugagccaaaaucaugccaauguauuccagu

SEQ ID NO: 571822 - RNA, 63 nt, hsa
ggaagaggaugguauuacaucagcuccauuguuugagccaagaaucuaagucaucccugacuc

SEQ ID NO: 571823 - RNA, 63 nt, hsa
gaaucaccuggaguuaggagguggugguugcagugagccaaucucaccauugcacuucagccu

SEQ ID NO: 571824 - RNA, 63 nt, hsa
agaauugccucaaccgggaggcggagguugcagugagccaagaucgcaccacugcacuccagc

SEQ ID NO: 571825 - RNA, 63 nt, hsa
ggauugcuugaacccaagaggucgaggcugcagugagccaagauugugccacugcacuccagc

SEQ ID NO: 571826 - RNA, 63 nt, hsa
ggagaaucuccugagccuggaagguccaggcagugagccaagauugugccaccacacuccagc

SEQ ID NO: 571827 - RNA, 63 nt, hsa
uaacauacccuaguugccguuuuuuaauugccaugagccaaauacuucuugguauacaauuga

SEQ ID NO: 571828 - RNA, 63 nt, hsa
uggaaaucgccccuuuugaaggugccauucuuaugagccaaaaguuugucauuuaaaaguuca

SEQ ID NO: 571829 - RNA, 63 nt, hsa
gauuuccgucaugcucccaaaugcagcuucaggugagccaaggggucugcuccuguggcggug

SEQ ID NO: 571830 - RNA, 63 nt, hsa
ggggugccaugguguuggaggggcaggccuuuuugagccaaucccaccauaaugugaauaugc

SEQ ID NO: 571831 - RNA, 63 nt, hsa
ggaucacuugagccccggaggucgaggcuacagugagccaagagugcacuacuguacuccagc

SEQ ID NO: 571832 - RNA, 63 nt, hsa
ccauuuucuaugcuuguaacugucuucuagcagugagccaaauguaaaauagugaauaaaguc

SEQ ID NO: 571833 - RNA, 63 nt, hsa
uauuagcuacaaaacuggauaaacuucagaauaugagccaaugaguaggaaggaacuugaaga

SEQ ID NO: 571834 - RNA, 63 nt, hsa
gaauggcaugaacccaggaggcagagauugcagugagccaagaucacgccccugcacuccagc

SEQ ID NO: 571835 - RNA, 63 nt, hsa
ugaaaaccacuggucuagcuuuagauaggauauugagccaauuuaaauaaagcaauauacugg

SEQ ID NO: 571836 - RNA, 63 nt, hsa
uuacaagaauaaagauuucuuuagauagguuguugagccaauuuaaguaaagcaauguuauug

SEQ ID NO: 571837 - RNA, 63 nt, hsa
gaauugcuugaacccaggaggcggagguugcagugagccaagaucgcaccacugcacuccagc

SEQ ID NO: 571838 - RNA, 63 nt, hsa
aucuaagaaaagggaauuuuaacuuuucuaccuugagccaagccaaugaagggaaaauuaauu

SEQ ID NO: 571839 - RNA, 63 nt, hsa
gaaucacuugaaccuaggaggcggagguugcagugagccaagauggcgccauugcacuccagc

SEQ ID NO: 571840 - RNA, 63 nt, hsa
gaaucgcuugaacccaggaggcggagguugcagugagccaagauggcgccauugcacuccagc

SEQ ID NO: 571841 - RNA, 63 nt, hsa
gaauugcuugaaccugggaggcagaggcugcagugagccaagacaaugccacuacacuccagc

SEQ ID NO: 571842 - RNA, 63 nt, hsa
gaauuguuugaaccuggaaggcggagguugcagugagccaagaucacagcacugcacugcugc

SEQ ID NO: 571843 - RNA, 63 nt, hsa
uaaucacuugaauccgggaggcggagguugcggugagccaagaucgcgccacugcacuccagc

SEQ ID NO: 571844 - RNA, 63 nt, hsa
agaucucuugagcccaagggguggggguugcagugagccaagaugcacugcaccccagccugg

SEQ ID NO: 571845 - RNA, 63 nt, hsa
cuggaagcauucccaugugggugucugaguccaugagccaagccugaggggacagugagucuc

SEQ ID NO: 571846 - RNA, 63 nt, hsa
gucaccagaaagcugcuguuuuggguucugcauugagccaaauauguagaggaccuaccaagc

SEQ ID NO: 571847 - RNA, 63 nt, hsa
ucuaucuuccacuguggcccugcagagauccccugagccaagccgaggcaguuuccacauaag

SEQ ID NO: 571848 - RNA, 63 nt, hsa
caggguccacuagaaauuggcuguaauacucauugagccaaguugucauaucaaauucaaccc

SEQ ID NO: 571849 - RNA, 64 nt, hsa; identical to SEQ ID NO: 179815

SEQ ID NO: 571850 - RNA, 64 nt, hsa; identical to SEQ ID NO: 179816

SEQ ID NO: 571851 - RNA, 64 nt, hsa; identical to SEQ ID NO: 179817

SEQ ID NO: 571852 - RNA, 64 nt, hsa; identical to SEQ ID NO: 179818

SEQ ID NO: 571853 - RNA, 64 nt, hsa; identical to SEQ ID NO: 179819

SEQ ID NO: 571854 - RNA, 64 nt, hsa; identical to SEQ ID NO: 179820

SEQ ID NO: 571855 - RNA, 64 nt, hsa; identical to SEQ ID NO: 179821

SEQ ID NO: 571856 - RNA, 64 nt, hsa; identical to SEQ ID NO: 179822

SEQ ID NO: 571857 - RNA, 64 nt, hsa; identical to SEQ ID NO: 179823

SEQ ID NO: 571858 - RNA, 64 nt, hsa; identical to SEQ ID NO: 179824

SEQ ID NO: 571859 - RNA, 64 nt, hsa; identical to SEQ ID NO: 179825

SEQ ID NO: 571860 - RNA, 64 nt, hsa; identical to SEQ ID NO: 179826

SEQ ID NO: 571861 - RNA, 64 nt, hsa; identical to SEQ ID NO: 179827

SEQ ID NO: 571862 - RNA, 64 nt, hsa; identical to SEQ ID NO: 179828

SEQ ID NO: 571863 - RNA, 64 nt, hsa; identical to SEQ ID NO: 179829

SEQ ID NO: 571864 - RNA, 64 nt, hsa; identical to SEQ ID NO: 179830

SEQ ID NO: 571865 - RNA, 64 nt, hsa; identical to SEQ ID NO: 179831

SEQ ID NO: 571866 - RNA, 64 nt, hsa; identical to SEQ ID NO: 179832

SEQ ID NO: 571867 - RNA, 64 nt, hsa; identical to SEQ ID NO: 179833

SEQ ID NO: 571868 - RNA, 64 nt, hsa; identical to SEQ ID NO: 179834

SEQ ID NO: 571869 - RNA, 64 nt, hsa; identical to SEQ ID NO: 179835

SEQ ID NO: 571870 - RNA, 64 nt, hsa; identical to SEQ ID NO: 179836

SEQ ID NO: 571871 - RNA, 64 nt, hsa; identical to SEQ ID NO: 179837

SEQ ID NO: 571872 - RNA, 53 nt, hsa; identical to SEQ ID NO: 86549

SEQ ID NO: 571873 - RNA, 64 nt, hsa; identical to SEQ ID NO: 179839

SEQ ID NO: 571874 - RNA, 64 nt, hsa; identical to SEQ ID NO: 179840

SEQ ID NO: 571875 - RNA, 64 nt, hsa; identical to SEQ ID NO: 179841

SEQ ID NO: 571876 - RNA, 64 nt, hsa; identical to SEQ ID NO: 179842

SEQ ID NO: 571877 - RNA, 64 nt, hsa; identical to SEQ ID NO: 179843

SEQ ID NO: 571878 - RNA, 64 nt, hsa; identical to SEQ ID NO: 179844

SEQ ID NO: 571879 - RNA, 64 nt, hsa; identical to SEQ ID NO: 179845

SEQ ID NO: 571880 - RNA, 64 nt, hsa; identical to SEQ ID NO: 179846

SEQ ID NO: 571881 - RNA, 64 nt, hsa; identical to SEQ ID NO: 179847

SEQ ID NO: 571882 - RNA, 64 nt, hsa; identical to SEQ ID NO: 179848

SEQ ID NO: 571883 - RNA, 64 nt, hsa; identical to SEQ ID NO: 179849

SEQ ID NO: 571884 - RNA, 64 nt, hsa; identical to SEQ ID NO: 179850

SEQ ID NO: 571885 - RNA, 64 nt, hsa; identical to SEQ ID NO: 179851

SEQ ID NO: 571886 - RNA, 64 nt, hsa; identical to SEQ ID NO: 179852

SEQ ID NO: 571887 - RNA, 64 nt, hsa; identical to SEQ ID NO: 179853

SEQ ID NO: 571888 - RNA, 64 nt, hsa; identical to SEQ ID NO: 179854

SEQ ID NO: 571889 - RNA, 64 nt, hsa; identical to SEQ ID NO: 179855

SEQ ID NO: 571890 - RNA, 64 nt, hsa; identical to SEQ ID NO: 179856

SEQ ID NO: 571891 - RNA, 64 nt, hsa; identical to SEQ ID NO: 179857

SEQ ID NO: 571892 - RNA, 64 nt, hsa; identical to SEQ ID NO: 179858

SEQ ID NO: 571893 - RNA, 64 nt, hsa; identical to SEQ ID NO: 179859

SEQ ID NO: 571894 - RNA, 64 nt, hsa; identical to SEQ ID NO: 179860

SEQ ID NO: 571895 - RNA, 64 nt, hsa; identical to SEQ ID NO: 179861

SEQ ID NO: 571896 - RNA, 64 nt, hsa; identical to SEQ ID NO: 179862

SEQ ID NO: 571897 - RNA, 64 nt, hsa; identical to SEQ ID NO: 179863

SEQ ID NO: 571898 - RNA, 64 nt, hsa; identical to SEQ ID NO: 179864

SEQ ID NO: 571899 - RNA, 64 nt, hsa; identical to SEQ ID NO: 179865

SEQ ID NO: 571900 - RNA, 64 nt, hsa; identical to SEQ ID NO: 179866

SEQ ID NO: 571901 - RNA, 64 nt, hsa; identical to SEQ ID NO: 179867

SEQ ID NO: 571902 - RNA, 64 nt, hsa; identical to SEQ ID NO: 179868

SEQ ID NO: 571903 - RNA, 64 nt, hsa; identical to SEQ ID NO: 179869

SEQ ID NO: 571904 - RNA, 64 nt, hsa; identical to SEQ ID NO: 485635

SEQ ID NO: 571905 - RNA, 64 nt, hsa; identical to SEQ ID NO: 485636

SEQ ID NO: 571906 - RNA, 64 nt, hsa; identical to SEQ ID NO: 485637

SEQ ID NO: 571907 - RNA, 64 nt, hsa; identical to SEQ ID NO: 485638

SEQ ID NO: 571908 - RNA, 64 nt, hsa; identical to SEQ ID NO: 485639

SEQ ID NO: 571909 - RNA, 64 nt, hsa; identical to SEQ ID NO: 485640

SEQ ID NO: 571910 - RNA, 64 nt, hsa; identical to SEQ ID NO: 485641

SEQ ID NO: 571911 - RNA, 64 nt, hsa; identical to SEQ ID NO: 485642

SEQ ID NO: 571912 - RNA, 64 nt, hsa; identical to SEQ ID NO: 485643

SEQ ID NO: 571913 - RNA, 64 nt, hsa; identical to SEQ ID NO: 485644

SEQ ID NO: 571914 - RNA, 64 nt, hsa; identical to SEQ ID NO: 485645

SEQ ID NO: 571915 - RNA, 64 nt, hsa; identical to SEQ ID NO: 485646

SEQ ID NO: 571916 - RNA, 64 nt, hsa; identical to SEQ ID NO: 485647

SEQ ID NO: 571917 - RNA, 64 nt, hsa; identical to SEQ ID NO: 485648

SEQ ID NO: 571918 - RNA, 64 nt, hsa; identical to SEQ ID NO: 485649

SEQ ID NO: 571919 - RNA, 64 nt, hsa; identical to SEQ ID NO: 485650

SEQ ID NO: 571920 - RNA, 64 nt, hsa; identical to SEQ ID NO: 485651

SEQ ID NO: 571921 - RNA, 64 nt, hsa; identical to SEQ ID NO: 485652

SEQ ID NO: 571922 - RNA, 64 nt, hsa; identical to SEQ ID NO: 485653

SEQ ID NO: 571923 - RNA, 64 nt, hsa; identical to SEQ ID NO: 485654

SEQ ID NO: 571924 - RNA, 64 nt, hsa; identical to SEQ ID NO: 485655

SEQ ID NO: 571925 - RNA, 64 nt, hsa; identical to SEQ ID NO: 485656

SEQ ID NO: 571926 - RNA, 64 nt, hsa; identical to SEQ ID NO: 485657

SEQ ID NO: 571927 - RNA, 64 nt, hsa; identical to SEQ ID NO: 485658

SEQ ID NO: 571928 - RNA, 64 nt, hsa; identical to SEQ ID NO: 485659

SEQ ID NO: 571929 - RNA, 64 nt, hsa; identical to SEQ ID NO: 485660

SEQ ID NO: 571930 - RNA, 64 nt, hsa; identical to SEQ ID NO: 485661

SEQ ID NO: 571931 - RNA, 64 nt, hsa; identical to SEQ ID NO: 485662

SEQ ID NO: 571932 - RNA, 64 nt, hsa; identical to SEQ ID NO: 485663

SEQ ID NO: 571933 - RNA, 64 nt, hsa; identical to SEQ ID NO: 485664

SEQ ID NO: 571934 - RNA, 64 nt, hsa; identical to SEQ ID NO: 485665

SEQ ID NO: 571935 - RNA, 64 nt, hsa; identical to SEQ ID NO: 485666

SEQ ID NO: 571936 - RNA, 64 nt, hsa; identical to SEQ ID NO: 485667

SEQ ID NO: 571937 - RNA, 64 nt, hsa
accaucuuccuguccugccugacaguucgcucauuccaacuaaucaucaucuucaaguuuucca

SEQ ID NO: 571938 - RNA, 64 nt, hsa
ccggauuguguuaguaguagccaucaggagggucuccaacuaaaacacuuguuccugcuugcuc

SEQ ID NO: 571939 - RNA, 64 nt, hsa
ugacagcaacgauuccaaccacggcaagcuggcuuccaacuauaacauuuuacucucaaagguc

SEQ ID NO: 571940 - RNA, 64 nt, hsa
uuuaaacacagagaccugccaagacgcccucucguccaacuaugcccaggcugaaguccucacc

SEQ ID NO: 571941 - RNA, 64 nt, hsa
uguaagaaaccccuguccccagucagagauaacauccaacuaacuccagaagcggaagaggaua

SEQ ID NO: 571942 - RNA, 64 nt, hsa
auuauaguuuaaauucaauuacauaguccagugguccaacuauaauuauaaucaaaaucaaugc

SEQ ID NO: 571943 - RNA, 64 nt, hsa
aaugauagacaaauacccaguguuuguuacuuuuuccaacuaccacuguaaugauaaucuuucu

SEQ ID NO: 571944 - RNA, 64 nt, hsa
ugugccuucauacaauaauauuuuucucuuugucuccaacuaauauaaaauguuuugcuaaauc

SEQ ID NO: 571945 - RNA, 64 nt, hsa
ccaauaaacaauaaauuuuccagaagaaaugaaauccaacuagacaaauaaaguagagcuuaug

SEQ ID NO: 571946 - RNA, 64 nt, hsa
agcauuauuucauaaaaugcuaucuuauacauaauccaacuaauugacauguagcucauguaug

SEQ ID NO: 571947 - RNA, 64 nt, hsa
guucucaugccaucaguuguguggaaauguaugauccaacuagaaaugaauggaagaugauggg

SEQ ID NO: 571948 - RNA, 64 nt, hsa
uuacugaacugauuuagcagggaauggaauccauuccaacuauugcacguggauuucccagcug

SEQ ID NO: 571949 - RNA, 64 nt, hsa
ccuccuggguucaagggauucuccugccucagccuccaacuagcugggauuacaggcacaagcc

SEQ ID NO: 571950 - RNA, 64 nt, hsa
gaggucuuaaaguccagggaaaaaaagucuggguuccaacuagaauucuagaaauauuucuaga

SEQ ID NO: 571951 - RNA, 64 nt, hsa
guuugaaauggcaauuaucaguguuggauuuaguuccaacuacuugauuuacaaaaauguacau

SEQ ID NO: 571952 - RNA, 64 nt, hsa
gauugaacacuuuaguaaugcaaaauaacucauuuccaacuacugcugcagcauuuugguaaaa

SEQ ID NO: 571953 - RNA, 64 nt, hsa
cuugggcacagaccugcauuuguugaccuugcacuccaacuauagugccuugcaagugcucaac

SEQ ID NO: 571954 - RNA, 64 nt, hsa
aaaauuagccagacgugguggugggugccuguaauccaacuacccaggaggcugaggcaugaga

SEQ ID NO: 571955 - RNA, 64 nt, hsa
uccacccauucucccuuugcaucuugagcaguuauccaacuaggaucugccaaguggauacugg

SEQ ID NO: 571956 - RNA, 64 nt, hsa
guaucuaaugucucccuaauaagucuucuuuccuuccaacuaaaugaccuacacggacuuuuau

SEQ ID NO: 571957 - RNA, 64 nt, hsa
uaaauauucuaugguacauucucagaaauuggcuuccaacuaaaauacguuugacccauuuuga

SEQ ID NO: 571958 - RNA, 64 nt, hsa
uaauuuuaguacuugaauaaguaugcagcagaacuccaacuaucuuuuuuccuguuuuuuuuaa

SEQ ID NO: 571959 - RNA, 64 nt, hsa
cucauaauccaguuuaauccuuuuauuugcuuccuccaacuauuuaaagugguccaaaaacacu

SEQ ID NO: 571960 - RNA, 64 nt, hsa
cugacuaaacuuuuuuucuguaccaguuaauuuuuccaacuacuaauagaauaaaggcaguuuu

SEQ ID NO: 571961 - RNA, 64 nt, hsa
caugaaguguguuuuucuuugguuucuucuguuuuccaacuaaauauuuuuuucuaaauaaaua

SEQ ID NO: 571962 - RNA, 64 nt, hsa
ucugauuuugcuuugcugucaaaguuuaacaccuuccaacuacuuauguguguccuguaacaca

SEQ ID NO: 571963 - RNA, 64 nt, hsa
uaacacaaaauuaaaaacaugauuucucuaauuuuccaacuagaggaagagaaacuuguggaaa

SEQ ID NO: 571964 - RNA, 64 nt, hsa
aucugcuuuacaugauacuaugcaaugcuuguuuuccaacuauguugaauaaauaguaauauuu

SEQ ID NO: 571965 - RNA, 64 nt, hsa
cgcccuagagaaaaagauucugaaggaacucacuuccaacuauaucccuucuuaccugaacaac

SEQ ID NO: 571966 - RNA, 64 nt, hsa
aauagaauggaauuaaaacuguucagaaugauuuuccaacuagcaaauauaaguaugccugguu

SEQ ID NO: 571967 - RNA, 64 nt, hsa
guccauaccuacuucuaggauugcaaaggagucuuccaacuagagaaaaauuguccacugacau

SEQ ID NO: 571968 - RNA, 64 nt, hsa
uguuuugauguagguauuaacaaucuuuucugccuccaacuacuaugaaguuggcagcaacaga

SEQ ID NO: 571969 - RNA, 64 nt, hsa
uagggaauaauaaaggccugauuuuuugucuuauuccaacuaaguagaucauuaucucuuuccu

SEQ ID NO: 571970 - RNA, 64 nt, hsa
uagaagacauugcguuaucuuauuuccaaaacguuccaacuaaaaaacauuuuccuauuaaaau

SEQ ID NO: 571971 - RNA, 64 nt, hsa
cuuccuuuaacgaagugccuuuaauucagccuuauccaacuagggaaaauaauguuggacaagu

SEQ ID NO: 571972 - RNA, 64 nt, hsa
augggucuaacuacauugaugaugagaguuuaauuccaacuagaguauauuuuuuguuuauuaa

SEQ ID NO: 571973 - RNA, 64 nt, hsa
aaaaccagaaaaaaguccagaacucuuuggugacuccaacuauggauagcuuauuuugaaaaag

SEQ ID NO: 571974 - RNA, 64 nt, hsa
cagacauaaaugcuaaguaacauuuuuuucuuccuccaacuacauaauuuguagcucaucauuu

SEQ ID NO: 571975 - RNA, 64 nt, hsa
cauuuugccuugcuguguauguauucaagagacuuccaacuagacaaagaaaaaauuguuguuu

SEQ ID NO: 571976 - RNA, 64 nt, hsa
guuuagauguauguguaaaucgauuagcuauuuauccaacuacuguauauuuagguaacuagaa

SEQ ID NO: 571977 - RNA, 64 nt, hsa
caaaugcuaguaagcagaaagaugcucuccgagguccaacuauauccuucccugccuuaggccg

SEQ ID NO: 571978 - RNA, 64 nt, hsa
uuguauuacaaaggaaccaugaaaaaaaacacuuuccaacuauuauauaauacauuucgaucuu

SEQ ID NO: 571979 - RNA, 64 nt, hsa
aucccacuuccugcccccagaaagggccuuuauuuccaacuaggaggauaaugccuaguccagg

SEQ ID NO: 571980 - RNA, 64 nt, hsa
cauauuuaugaagcaagaauagguacagucauuuuccaacuaacaucuagugagacugggauuc

SEQ ID NO: 571981 - RNA, 64 nt, hsa
ucuccagcaauaggaugauuuacuauaaauuucauccaacuacuugugaucucucucaccuaca

SEQ ID NO: 571982 - RNA, 64 nt, hsa
auagggaacacguagauuugacccugguucugcauccaacuagcuguuucuugaaagagccugg

SEQ ID NO: 571983 - RNA, 64 nt, hsa
uaaauuuuugauagaauuaaauuuaaauuuauccuccaacuaaauuuuugauagaauuaaauuu

SEQ ID NO: 571984 - RNA, 58 nt, hsa
uuguaccagcggaaagcugagucucgucuccaacuagaaguuuggcccggccacuggc

SEQ ID NO: 571985 - RNA, 64 nt, hsa
uacaauuggacauucauuugugugcccuggaauuuccaacuaguaauaaacaacuacuguugau

SEQ ID NO: 571986 - RNA, 52 nt, hsa
ugugauuuucaguggcuugaucuccaacuacugcaggaauccggauuguucg

SEQ ID NO: 571987 - RNA, 64 nt, hsa
gcgcgcacacacacucuucaaguuuuuuucaaaguccaacuacagccaaauugcagaagaaacu

SEQ ID NO: 571988 - RNA, 64 nt, hsa
cauucacgguauggaaauacaguaaaugaaagauuccaacuaguugucagugcuucuugaaauu

SEQ ID NO: 571989 - RNA, 64 nt, hsa
augguuuaauuuuauguggacguauguuaaauuauccaacuacccuauuguuaagcauuugguu

SEQ ID NO: 571990 - RNA, 64 nt, hsa
aaguuagaaaacauaaucuucugccuucucaugauccaacuaaugccuuacucuucuugaaauu

SEQ ID NO: 571991 - RNA, 64 nt, hsa
guuuagaaacacaacuauauuguuugcuaagcauuccaacuaucucauuuccaagcaaguauua

SEQ ID NO: 571992 - RNA, 64 nt, hsa
aacacagcucuuagcugggagcuccuucugccauuccaacuaguuucuuccuggggccaguuuu

SEQ ID NO: 571993 - RNA, 64 nt, hsa
guuccaaauguauuucauuacuauagucacaauauccaacuaaaaauuacgcuaucuagaauug

SEQ ID NO: 571994 - RNA, 64 nt, hsa
guaauuuauuuuugauucuuuguuuucuuuuucguccaacuaaaacaacuguaauguacuugau

SEQ ID NO: 571995 - RNA, 64 nt, hsa
uuucuaagacauauuuaauguagguuacauacacuccaacuauuacuuugcuuuugcauaugaa

SEQ ID NO: 571996 - RNA, 64 nt, hsa
aauccacacauauuguuuuaaaauaagaauguuauccaacuauuaagauaucucaaugugcaau

SEQ ID NO: 571997 - RNA, 64 nt, hsa
cuccugggcucaagcaauccuccugccucagccuuccaacuagcugggacuacaggugcgcgcc

SEQ ID NO: 571998 - RNA, 64 nt, hsa
cgaacuucgaccuacugaaaaggugguguugguauccaacuauacacaaaccuugaacauuuua

SEQ ID NO: 571999 - RNA, 64 nt, hsa
uuuucucugaguuggaaacaaaaacaugaaggacuccaacuagaagacagauauuuacauuuaa

SEQ ID NO: 572000 - RNA, 64 nt, hsa
gacacaaugguucaugcccaaaaggaacagaaguuccaacuauugccugggaucuugcgaaaag

SEQ ID NO: 572001 - RNA, 64 nt, hsa
acaacauguuuuagagcauccaaguaccauauaauccaacuaucaugguaaggccagaaaucuu

SEQ ID NO: 572002 - RNA, 64 nt, hsa
auggaguccauuggcgaacccuauugcaauuugguccaacuauaucuucuggugaaggaaauua

SEQ ID NO: 572003 - RNA, 64 nt, hsa
ucacuaucagagccacaaaucugggaccugucuuuccaacuaaauuggaggcuuuggaagggca

SEQ ID NO: 572004 - RNA, 64 nt, hsa
aaaaaacccuacagcuaacauuauccuugauguuuccaacuagacacuuuccuacuaagaucag

SEQ ID NO: 572005 - RNA, 64 nt, hsa
gccagggccugccggcgcggggaggaaagcaaaauccaacuaaugguauauauuguaggguaca

SEQ ID NO: 572006 - RNA, 64 nt, hsa
ugcaaugaaucuagaugcaauuaauuuuauuccuuccaacuaaaauuacaauauuuuuagguua

SEQ ID NO: 572007 - RNA, 64 nt, hsa
uuugucuccuccuuuaacugagucaucaucuuaguccaacuaaugcagucgauacaaugcguag

SEQ ID NO: 572008 - RNA, 64 nt, hsa
cagccaugguucuuucugguggaaaacagaauucuccaacuaaaaauauuuuaauggcagacug

SEQ ID NO: 572009 - RNA, 64 nt, hsa
aaaaaacccuacaucuagcaucauccuugauguuuccaacuaaaugcuuuccuacuaagaucag

SEQ ID NO: 572010 - RNA, 64 nt, hsa
gcuguggugggcagagccccaaaacaagcagccuuccaacuagagacucgggggugucugaagg

SEQ ID NO: 572011 - RNA, 64 nt, hsa
uaccuaccguagcuuuuuaccguucacuuccccuuccaacuauguccagaugugcaggcuccuc

SEQ ID NO: 572012 - RNA, 64 nt, hsa
ccaauuucuauuaaagguuccuuuguucccuaaguccaacuacuaaacugggggauauuaugaa

SEQ ID NO: 572013 - RNA, 64 nt, hsa
auuugguugagcucauauaauccaaaccuaauuguccaacuauuguauugccacuauuguuaau

SEQ ID NO: 572014 - RNA, 64 nt, hsa
uuucaguuuuauaaagggaacugaggacagcuaauccaacuacuuggugcguaauuguuuccua

SEQ ID NO: 572015 - RNA, 64 nt, hsa
cgaauuucugugcccuccugacccauugcuguuguccaacuauuuauugacucuggguccuucc

SEQ ID NO: 572016 - RNA, 64 nt, hsa
uuggucacaacuauucaugcuuccugugauuucauccaacuacuuaccuugccuacgauauccc

SEQ ID NO: 572017 - RNA, 64 nt, hsa
auugcuuaagauacgcagccauuccauauucaucuccaacuacacaggggaacggagcagauag

SEQ ID NO: 572018 - RNA, 64 nt, hsa
aaacauuucauuaugaggucagacuaggauaauguccaacuaaaaacaaacccuuuucauccug

SEQ ID NO: 572019 - RNA, 64 nt, hsa
uuuuugucacauaucuuuuucuuggaaaaauuuauccaacuauagacaucuuaaacccuacaaa

SEQ ID NO: 572020 - RNA, 64 nt, hsa
acuaagcauuguaaauuuauuuauaacugccaucuccaacuacauccuuaugauguuuuuaaca

SEQ ID NO: 572021 - RNA, 64 nt, hsa
uguggucugucagcugugaaucuguugauggagauccaacuauuucuuucaucagaaaaagucc

SEQ ID NO: 572022 - RNA, 64 nt, hsa
gccacuccccgcuuacauuuaugugucaguguuuuccaacuacuuagaguuuauguaccucgug

SEQ ID NO: 572023 - RNA, 64 nt, hsa
auuuguaauaaaaucaacuucauauuuuaaaaauuccaacuaucugcuugcauuggugaauaua

SEQ ID NO: 572024 - RNA, 64 nt, hsa
cuuaaaccacauaaccaagcauugugaacugcuauccaacuauuuagugguagaacuaggauuu

SEQ ID NO: 572025 - RNA, 64 nt, hsa
uuauuuggcuauaaaaagucagcauaaaauaugauccaacuaaaagggauuaauuuuuggcauu

SEQ ID NO: 572026 - RNA, 64 nt, hsa
gcucgagggaggggagugcuuucugccccaugccuccaacuacuguaugcaggccuggcucucu

SEQ ID NO: 572027 - RNA, 64 nt, hsa
acugauacuaauuauauaaugagaaaaaaauguauccaacuaggacacauaucuuuugaguuau

SEQ ID NO: 572028 - RNA, 64 nt, hsa
uuuauuucuguaucugacauauuucauaagcacauccaacuacuccuagacugacuaggauucu

SEQ ID NO: 572029 - RNA, 64 nt, hsa
cacaccagguacuuaaagaugugcucugcuuuuuuccaacuacggagugucacugcuuucuagg

SEQ ID NO: 572030 - RNA, 64 nt, hsa
aaaauugaaauuguuucccaugcugccagggacuuccaacuagauagccaugugacguccuggu

SEQ ID NO: 572031 - RNA, 64 nt, hsa
uaccgagauuugggcaauagcauugugaguggcuuccaacuagcaacccucucuggccccaugu

SEQ ID NO: 572032 - RNA, 64 nt, hsa
uuguggccacgcccccacccggcugccacaagaauccaacuacauagaacaugagcguggacuu

SEQ ID NO: 572033 - RNA, 64 nt, hsa
guuggaccacguggcaucagaggucccauccagauccaacuauagguccaagaguccacguaag

SEQ ID NO: 572034 - RNA, 64 nt, hsa
uuaagacuuggauucucuucugcccuuguuaaucuccaacuaauuacuacagauugacacguuu

SEQ ID NO: 572035 - RNA, 64 nt, hsa
acccaagacacaguacccagucaugguuuccccauccaacuauuaguuucauacuuugaaaacu

SEQ ID NO: 572036 - RNA, 64 nt, hsa
guuaugugcaaugaccuauuuaagguaaacccauuccaacuacagcaguucagggcugauccaa

SEQ ID NO: 572037 - RNA, 64 nt, hsa
ccugccagacggcacccacccagcacccagcaacuccaacuaacaagaaacucacccccaaggg

SEQ ID NO: 572038 - RNA, 64 nt, hsa
guauguugacuaaauuuacaaauaaacuuguuuauccaacuaaguguccaaaaccuaaauugaa

SEQ ID NO: 572039 - RNA, 64 nt, hsa
acugcugcuacuagaaaugucuaaacuauaagcuuccaacuauuaccugcuugaauguaaauau

SEQ ID NO: 572040 - RNA, 64 nt, hsa
aacuuucuuccuuggaggccaaguucucacccuguccaacuauucgcaggacaccaggucccuu

SEQ ID NO: 572041 - RNA, 64 nt, hsa
ugagggcagcaggaugguggccuggguggggucguccaacuagguuugcuaaccugagggguca

SEQ ID NO: 572042 - RNA, 64 nt, hsa
gagauggggucuugcuacguugcccacacugcucuccaacuacuggccucaaacgauccuccug

SEQ ID NO: 572043 - RNA, 64 nt, hsa
agcuuucuacuuuauaucauauacaaaaauaaaauccaacuaaagaccagaauauaaaaagcaa

SEQ ID NO: 572044 - RNA, 64 nt, hsa
cucuugagagcaagugagauuguuagaauuaaguuccaacuauacaguuuucuaacauagcuau

SEQ ID NO: 572045 - RNA, 64 nt, hsa
aaacggauggccucuacgcuguuccaucacagucuccaacuaaggcuuaugguauuucauuaaa

SEQ ID NO: 572046 - RNA, 64 nt, hsa
gguggugcuucccuacccccuagaaaugcugccuuccaacuaccacucucccagaugugacccu

SEQ ID NO: 572047 - RNA, 64 nt, hsa
ucuuguaucugguucuacucccaggaugaaauuauccaacuacauauauauuuagaggaagaaa

SEQ ID NO: 572048 - RNA, 64 nt, hsa
ggugagaaaauagagcauugugggaaaaacugaguccaacuagauuagcaaauguuaauuccua

SEQ ID NO: 572049 - RNA, 64 nt, hsa
ccaccccaauaucaucaggcaccuuucccccuuauccaacuagcccuagccuauacccucugcu

SEQ ID NO: 572050 - RNA, 64 nt, hsa
aaucauaguuauuuuuaacucccugucugauaguuccaacuacuaggucaacugagucuagguc

SEQ ID NO: 572051 - RNA, 64 nt, hsa
guguuacauuucauguaauuuagccaacucccauuccaacuaggcuuuggcuaaaucugacaau

SEQ ID NO: 572052 - RNA, 64 nt, hsa
uuuuggauaaaauuggguuuuaacauaccucgaguccaacuaaucucauuaaacaaauauucuc

SEQ ID NO: 572053 - RNA, 64 nt, hsa
auguguauauauuucuaucucuugcuacaauaauuccaacuaagugaacuucucaauuaucauc

SEQ ID NO: 572054 - RNA, 64 nt, hsa
uagucuuguuggagaagcccagagagaaugggacuccaacuaagggaaccugaaaucaacucaa

SEQ ID NO: 572055 - RNA, 64 nt, hsa
auuuuuauguauuuuucaaaacuacaaacuggaauccaacuauaaaguguuuaagaaucuacac

SEQ ID NO: 572056 - RNA, 64 nt, hsa
uccacccgccuugcuuuaagacaaacagggcugcuccaacuaguuuugugucagcuuccagcuc

SEQ ID NO: 572057 - RNA, 59 nt, hsa
accaaaauuucaaaccuaggacacuggaaugacugcagggaucagugguucucccauau

SEQ ID NO: 572058 - RNA, 59 nt, hsa
gguuuuuuaaauuuuuucagugagcguggugacugcagagguuagugcugugaaaagcu

SEQ ID NO: 572059 - RNA, 59 nt, hsa
gcuaacauuauuuguguauuaaauguauuugacugcaggaauuugugcguauccguuuu

SEQ ID NO: 572060 - RNA, 59 nt, hsa
guuugcccguaucaucaugauugguacccugacugcacuacagugguuuaucuaugacu

SEQ ID NO: 572061 - RNA, 59 nt, hsa
aaugccuuuggcuggucgccagcugugcaugacugcaguuccuagacucuaacuuaacc

SEQ ID NO: 572062 - RNA, 59 nt, hsa
gagcauaggcgggaaaucugaguagagucugacugcaguuuuugcuuaugauuuguaaa

SEQ ID NO: 572063 - RNA, 59 nt, hsa
ggaguguuuuuauuguuagcuaauugcugugacugcaggaagugggaguguuucuguug

SEQ ID NO: 572064 - RNA, 59 nt, hsa
guagucugccuugaaaagucuuucagcugugacugcaggaagugggaguguuuuuauug

SEQ ID NO: 572065 - RNA, 59 nt, hsa
uucuucacagugcagugaauuggaagacuugacugcaaauacaaacacccaggauccuu

SEQ ID NO: 572066 - RNA, 59 nt, hsa
aauuuauuaucauugaagaauagcuuaaaugacugcaguaaccagguaauauuggcaaa

SEQ ID NO: 572067 - RNA, 64 nt, hsa
cuaacuauaucuugaaaacaaagacccuucgguguccaucuacaguaaaccccaccauuaccuu

SEQ ID NO: 572068 - RNA, 64 nt, hsa
ggugacuugaggcuggagcucccucuguuaccuuuccaucuagcaaguucccaaaggcaagacu

SEQ ID NO: 572069 - RNA, 64 nt, hsa
auuuaucccgaucuccuggaaggcuguugugauuuccaucuaagaaaugagggucuugagaauc

SEQ ID NO: 572070 - RNA, 64 nt, hsa
gaucccuuccccugcuuugacccccagacuuugcuccaucuauuauugcuucuccauccuggau

SEQ ID NO: 572071 - RNA, 64 nt, hsa
ccccacaugccagaaaagugaaguccuagguguuuccaucuauguuucaaucuguccaucuacc

SEQ ID NO: 572072 - RNA, 64 nt, hsa
aaguccuagguguuuccaucuauguuucaaucuguccaucuaccaggccucgcgauaaaaacaa

SEQ ID NO: 572073 - RNA, 64 nt, hsa
uucuuagcugcugaaaucagugcucuuucacuucuucagagaagcagggaugguaccuacccgg

SEQ ID NO: 572074 - RNA, 64 nt, hsa
agcccuguuuccugcguaaaggugguauguccaguucagagauguguauaaugagcauggcuug

SEQ ID NO: 572075 - RNA, 64 nt, hsa
uguaagauguugcacuaaaacauuuuauauacacuucagagaccuguaguaaauuauguugaaa

SEQ ID NO: 572076 - RNA, 64 nt, hsa
ugaaaaaagaaggucuuuugccccauuucuuuauuucagagaugugggcuuucagugggaauuu

SEQ ID NO: 572077 - RNA, 64 nt, hsa
aaugguucaaaugucuuacagaacuaagaucuuuuucagagaaauugcucacaaaaguuaguga

SEQ ID NO: 572078 - RNA, 64 nt, hsa
gcacuuaaacuugugauaaggaagaugaagggucuucagagaagaaccucuuaaaaggcccacg

SEQ ID NO: 572079 - RNA, 64 nt, hsa
uccuauuagaaugguagcuuugaaguguuuuuacuucagagauccugcauagcauuuauugggg

SEQ ID NO: 572080 - RNA, 64 nt, hsa
auuacuaaaucaguuauuauuuuacuuuuccaaauucagagaaagaaaacagauuaccugaauu

SEQ ID NO: 572081 - RNA, 64 nt, hsa
uucuggaggaaugcaugucacaggcgggacuuucuucagagaguggugcagcgccagacauuuu

SEQ ID NO: 572082 - RNA, 64 nt, hsa
ucugcucccuuucuccagaggcagaacacauguuuucagagaagcugcugcuaaggaccuucua

SEQ ID NO: 572083 - RNA, 64 nt, hsa
ugaucacugagacagccacuugguuuuuggcucuuucagagaggucucagguucuuuccaugca

SEQ ID NO: 572084 - RNA, 64 nt, hsa
acaaaucacuguauuuaucuccgcaggcuauuuguucagagaggccuuuuguuuaaauauaaau

SEQ ID NO: 572085 - RNA, 64 nt, hsa
aaugcguggcagagacugcaacagggauuguguguucagagaucauaugcauauguguagggcu

SEQ ID NO: 572086 - RNA, 64 nt, hsa
ugugauggguuguagaagcguguguuugagagaauucagagacauuugaaggcugcugugugca

SEQ ID NO: 572087 - RNA, 64 nt, hsa
gcagguuuuccauuuuaguggguucugcuuuuauuucagagacagacaugugucuucucugucc

SEQ ID NO: 572088 - RNA, 64 nt, hsa
gucccagugugcgagccccacuuggacacaaguguucagagaggucccccucugccacuugaca

SEQ ID NO: 572089 - RNA, 64 nt, hsa
agacuuguauauuucaguggaaauacaaaaccacuucagagaccaggguaucuccucuggaagg

SEQ ID NO: 572090 - RNA, 64 nt, hsa
aauguucuuagaggaggaaauauccuuuguccuguucagagagaccagggcccuaccauuaggc

SEQ ID NO: 572091 - RNA, 64 nt, hsa
uuccaaacuaauaaacugaugaauucuaaauaaguucagagauauagucauauuuaaaguuguc

SEQ ID NO: 572092 - RNA, 64 nt, hsa
cauaauuaccuagaugccucuuaaaaaugaagauuucagagacccauucuaaacaagggcauuc

SEQ ID NO: 572093 - RNA, 64 nt, hsa
ccaccuuuacuggguucuaaaugcucucugauaauucagagagcauugggucugggaagaggua

SEQ ID NO: 572094 - RNA, 64 nt, hsa
aggccuucccggggccccccaucagcgaugugucuucagagacaauccauuaaagcagccagga

SEQ ID NO: 572095 - RNA, 64 nt, hsa
auccaugcuuuacaccuggacaguagacagggacuucagagauugcacguuugaauacauucuc

SEQ ID NO: 572096 - RNA, 64 nt, hsa
aucucggcugaauucaggaccugggaauacaggguucagagaggagaggaggaagauggugaca

SEQ ID NO: 572097 - RNA, 64 nt, hsa
ucccagugagagagcuguccauugaccuacaugguucagagaacaccccacggggcuguuuguc

SEQ ID NO: 572098 - RNA, 64 nt, hsa
auucaacucgugauacaccaaaagaagaguugacuucagagauguguuccaugcucucuagcac

SEQ ID NO: 572099 - RNA, 64 nt, hsa
aacuuccuucuugcugaacauauuuuauucucuuuucagagaaggaaaauaaaaaggauucuaa

SEQ ID NO: 572100 - RNA, 64 nt, hsa
gagcucaucaucagucuuaauauucagagaaaacuucagagaaauuauguuuucauccauuaaa

SEQ ID NO: 572101 - RNA, 64 nt, hsa
ucugaacaaagagagcucaucaucagucuuaauauucagagaaaacuucagagaaauuauguuu

SEQ ID NO: 572102 - RNA, 64 nt, hsa
acauucaacucaggaagcauuugacucguuguacuucagagaccauaaaugacaagguuuugac

SEQ ID NO: 572103 - RNA, 64 nt, hsa
cauguguaaaauuauacuuucaguaauuggagaauucagagauugcauuucuagcagagaauuc

SEQ ID NO: 572104 - RNA, 64 nt, hsa
guauuacuuuuccuacaacagaaccuggugaaacuucagagagcugucuagaacucgagaauca

SEQ ID NO: 572105 - RNA, 64 nt, hsa
uuauauuucacuagaacuguguacuugauugauuuucagagaaauaucacaaauuagaaauauu

SEQ ID NO: 572106 - RNA, 64 nt, hsa
auuuuuguuuuuguuggauagcuuuuaauuacauuucagagagguguaauuuuggguagaugcu

SEQ ID NO: 572107 - RNA, 64 nt, hsa
uuuauaugacuggugauacuggcuuuacagaaauuucagagaacuaauuuuuaaaaucuuuagc

SEQ ID NO: 572108 - RNA, 64 nt, hsa
cuguccucauuggucgucccuaugaauuguacguuucagagaaauuuuuuuuccuaugugcaac

SEQ ID NO: 572109 - RNA, 64 nt, hsa
agcuucguuucaggggucugccguuccauccugguucagagaaggccgagcguggcuuucucua

SEQ ID NO: 572110 - RNA, 55 nt, hsa
gucuuccaaugccaaucugaggaccuucagagacagucuacgccuuaacaagcac

SEQ ID NO: 572111 - RNA, 64 nt, hsa
acaaaaacuguuuuaagacgucuacguugaauuauucagagaauuaagcaauaaaagcucacac

SEQ ID NO: 572112 - RNA, 64 nt, hsa
gggaggugcuguuaguugggcagcccuucuggguuucagagaccgguguuggcucuagacuggu

SEQ ID NO: 572113 - RNA, 64 nt, hsa
ucugcacagggcaguuagccagcucaaguucuuuuucagagaaagggacuuggccagugguuua

SEQ ID NO: 572114 - RNA, 64 nt, hsa
cccagucacccacucacucagaaagccgggagucaucggacaccuugcuggucagagguccugg

SEQ ID NO: 572115 - RNA, 64 nt, hsa
aaguuggugcugcuaagaccgagaaauuuaaagaaucggacagauggacgcagagaaccagagg

SEQ ID NO: 572116 - RNA, 64 nt, hsa
ccagggccugagcagcuggaucugguacaaagcaaucggacauagaguuggagggggaggcccc

SEQ ID NO: 572117 - RNA, 64 nt, hsa
gggagcagggaaccugagacagggccacugcgggaucggacaaagccccgcuuuggagaggcug

SEQ ID NO: 572118 - RNA, 64 nt, hsa
gaaagaaagcaaacaagaagacuccggcucugcuaucggacacagauccugaucccucuugcuu

SEQ ID NO: 572119 - RNA, 64 nt, hsa
aaguggguaagaaaaugcaaaccuguuauaaguuaucggacagaaagcuaggugcucugucacc

SEQ ID NO: 572120 - RNA, 64 nt, hsa
aacaggaaacaaagauaaugacucaguucagaggaucggacaaaugugucuaguccggguggac

SEQ ID NO: 572121 - RNA, 55 nt, hsa
ucacagacaacagcuacuaagcagcaucggacaagacccccagcacuuggggguu

SEQ ID NO: 572122 - RNA, 64 nt, hsa
ucucaugggacucaaugguggugaagaaaucucaaucggacaccagaggugggggcaacucugc

SEQ ID NO: 572123 - RNA, 64 nt, hsa
uucacugcaguauacauuuaucuacacauuauauaucggacauauaauauguaaauaaaugacu

SEQ ID NO: 572124 - RNA, 64 nt, hsa
ugccuuccaaaucaugccauaauuguaauguugaaucggacagagccuuacgugcccgagggcg

SEQ ID NO: 572125 - RNA, 64 nt, hsa
acagaaagaauauaagcaaucucacaggccugcaaucggacacugucucugugugguucauagg

SEQ ID NO: 572126 - RNA, 64 nt, hsa
uuagcuuuugaaaguguuuuaaaagauuuccuuuaucggacaggaccaucuuuaugaccugcuu

SEQ ID NO: 572127 - RNA, 64 nt, hsa
aagaagcaaagccuucagcaagaucauacgacucaucggacacuaauuuauauaggagugaagu

SEQ ID NO: 572128 - RNA, 64 nt, hsa
ugcuccuccaucgauggacacugcauugcuucucaucggacacuuguggagcgcaggggccugg

SEQ ID NO: 572129 - RNA, 64 nt, hsa
uaguucauuuccaaucccagaacacauggagggaaucggacaggugaugccagcaguuccugcu

SEQ ID NO: 572130 - RNA, 64 nt, hsa
cacucaaaagcaaagcauucucuucccagugccuaucggacagugcggcggucgaggugggugu

SEQ ID NO: 572131 - RNA, 64 nt, hsa
ggaaaauacuacauucacccacguugugauucauaucggacaguuucuuacucaaagauaacac

SEQ ID NO: 572132 - RNA, 64 nt, hsa
acugcuccucuguguguacuucauagaagguggaaucggacagaggcagguuagugacaguuau

SEQ ID NO: 572133 - RNA, 64 nt, hsa
gcuccccugcgaccgcccugccccccgucaccgaaucggacacucauccuuucucacacuuccc

SEQ ID NO: 572134 - RNA, 64 nt, hsa
augauccucuuaaagaauaaaagcacauccguggaucggacauggcugcaugugccugcuuaac

SEQ ID NO: 572135 - RNA, 64 nt, hsa
uuuaaccuuaauuuuacagcccuuggcuuguguuaucggacauucuaaugcauauuuauaagag

SEQ ID NO: 572136 - RNA, 64 nt, hsa
acugguagcuaugcuuugauguccuguugaggccaucggacagagacuggagcccaggugacag

SEQ ID NO: 572137 - RNA, 64 nt, hsa
uucccuccaugcaccaucacuguggcuggcaggcaucggacagccucauccagacccccugccc

SEQ ID NO: 572138 - RNA, 64 nt, hsa
gaagcuugcggagcccaggugaacaagcucagcaaucggacaucucuggggaaaggaagguggc

SEQ ID NO: 572139 - RNA, 64 nt, hsa
ccgucugacccucugcggccacugcgccacugccaucggacaggaggauuccuuguguuuuguc

SEQ ID NO: 572140 - RNA, 64 nt, hsa
cagccucccaagcauauaacccccuaaggaauccaucggacaagaccccgucuaacacugcauc

SEQ ID NO: 572141 - RNA, 64 nt, hsa
cugcaucccgcgcgcugcagccucaugugacccgaucggacagugccauccaugggccccaccu

SEQ ID NO: 572142 - RNA, 64 nt, hsa
uaucugcugucguacagcacauuagcaaauugucaucggacaaugaccgcuucuucauguagau

SEQ ID NO: 572143 - RNA, 64 nt, hsa; identical to SEQ ID NO: 121134

SEQ ID NO: 572144 - RNA, 64 nt, hsa; identical to SEQ ID NO: 121135

SEQ ID NO: 572145 - RNA, 64 nt, hsa; identical to SEQ ID NO: 121136

SEQ ID NO: 572146 - RNA, 64 nt, hsa; identical to SEQ ID NO: 121137

SEQ ID NO: 572147 - RNA, 64 nt, hsa; identical to SEQ ID NO: 121138

SEQ ID NO: 572148 - RNA, 64 nt, hsa; identical to SEQ ID NO: 121139

SEQ ID NO: 572149 - RNA, 64 nt, hsa; identical to SEQ ID NO: 121140

SEQ ID NO: 572150 - RNA, 64 nt, hsa; identical to SEQ ID NO: 121141

SEQ ID NO: 572151 - RNA, 64 nt, hsa; identical to SEQ ID NO: 121142

SEQ ID NO: 572152 - RNA, 64 nt, hsa; identical to SEQ ID NO: 121143

SEQ ID NO: 572153 - RNA, 64 nt, hsa; identical to SEQ ID NO: 121144

SEQ ID NO: 572154 - RNA, 64 nt, hsa; identical to SEQ ID NO: 121145

SEQ ID NO: 572155 - RNA, 64 nt, hsa; identical to SEQ ID NO: 121146

SEQ ID NO: 572156 - RNA, 64 nt, hsa; identical to SEQ ID NO: 121147

SEQ ID NO: 572157 - RNA, 64 nt, hsa; identical to SEQ ID NO: 526825

SEQ ID NO: 572158 - RNA, 64 nt, hsa; identical to SEQ ID NO: 526826

SEQ ID NO: 572159 - RNA, 64 nt, hsa; identical to SEQ ID NO: 526891

SEQ ID NO: 572160 - RNA, 64 nt, hsa; identical to SEQ ID NO: 526892

SEQ ID NO: 572161 - RNA, 64 nt, hsa; identical to SEQ ID NO: 526922

SEQ ID NO: 572162 - RNA, 64 nt, hsa; identical to SEQ ID NO: 526923

SEQ ID NO: 572163 - RNA, 64 nt, hsa; identical to SEQ ID NO: 526945

SEQ ID NO: 572164 - RNA, 64 nt, hsa; identical to SEQ ID NO: 526946

SEQ ID NO: 572165 - RNA, 64 nt, hsa; identical to SEQ ID NO: 526947

SEQ ID NO: 572166 - RNA, 64 nt, hsa; identical to SEQ ID NO: 526953

SEQ ID NO: 572167 - RNA, 64 nt, hsa; identical to SEQ ID NO: 526954

SEQ ID NO: 572168 - RNA, 64 nt, hsa; identical to SEQ ID NO: 526955

SEQ ID NO: 572169 - RNA, 64 nt, hsa; identical to SEQ ID NO: 526986

SEQ ID NO: 572170 - RNA, 64 nt, hsa; identical to SEQ ID NO: 526987

SEQ ID NO: 572171 - RNA, 64 nt, hsa; identical to SEQ ID NO: 526988

SEQ ID NO: 572172 - RNA, 64 nt, hsa; identical to SEQ ID NO: 48305

SEQ ID NO: 572173 - RNA, 64 nt, hsa; identical to SEQ ID NO: 48306

SEQ ID NO: 572174 - RNA, 64 nt, hsa; identical to SEQ ID NO: 48307

SEQ ID NO: 572175 - RNA, 64 nt, hsa; identical to SEQ ID NO: 48308

SEQ ID NO: 572176 - RNA, 64 nt, hsa; identical to SEQ ID NO: 48309

SEQ ID NO: 572177 - RNA, 64 nt, hsa; identical to SEQ ID NO: 48310

SEQ ID NO: 572178 - RNA, 64 nt, hsa; identical to SEQ ID NO: 48311

SEQ ID NO: 572179 - RNA, 64 nt, hsa; identical to SEQ ID NO: 48312

SEQ ID NO: 572180 - RNA, 64 nt, hsa; identical to SEQ ID NO: 48313

SEQ ID NO: 572181 - RNA, 64 nt, hsa; identical to SEQ ID NO: 48314

SEQ ID NO: 572182 - RNA, 64 nt, hsa; identical to SEQ ID NO: 48315

SEQ ID NO: 572183 - RNA, 64 nt, hsa; identical to SEQ ID NO: 48316

SEQ ID NO: 572184 - RNA, 64 nt, hsa; identical to SEQ ID NO: 48317

SEQ ID NO: 572185 - RNA, 64 nt, hsa; identical to SEQ ID NO: 48318

SEQ ID NO: 572186 - RNA, 64 nt, hsa; identical to SEQ ID NO: 48319

SEQ ID NO: 572187 - RNA, 64 nt, hsa; identical to SEQ ID NO: 48320

SEQ ID NO: 572188 - RNA, 64 nt, hsa; identical to SEQ ID NO: 48321

SEQ ID NO: 572189 - RNA, 64 nt, hsa; identical to SEQ ID NO: 48322

SEQ ID NO: 572190 - RNA, 64 nt, hsa; identical to SEQ ID NO: 48323

SEQ ID NO: 572191 - RNA, 64 nt, hsa; identical to SEQ ID NO: 48324

SEQ ID NO: 572192 - RNA, 64 nt, hsa; identical to SEQ ID NO: 48325

SEQ ID NO: 572193 - RNA, 64 nt, hsa; identical to SEQ ID NO: 48326

SEQ ID NO: 572194 - RNA, 64 nt, hsa; identical to SEQ ID NO: 48327

SEQ ID NO: 572195 - RNA, 64 nt, hsa; identical to SEQ ID NO: 48328

SEQ ID NO: 572196 - RNA, 64 nt, hsa; identical to SEQ ID NO: 48329

SEQ ID NO: 572197 - RNA, 51 nt, hsa; identical to SEQ ID NO: 48330

SEQ ID NO: 572198 - RNA, 64 nt, hsa; identical to SEQ ID NO: 48331

SEQ ID NO: 572199 - RNA, 64 nt, hsa; identical to SEQ ID NO: 48332

SEQ ID NO: 572200 - RNA, 64 nt, hsa; identical to SEQ ID NO: 48333

SEQ ID NO: 572201 - RNA, 64 nt, hsa; identical to SEQ ID NO: 48334

SEQ ID NO: 572202 - RNA, 64 nt, hsa; identical to SEQ ID NO: 48335

SEQ ID NO: 572203 - RNA, 64 nt, hsa; identical to SEQ ID NO: 48336

SEQ ID NO: 572204 - RNA, 64 nt, hsa; identical to SEQ ID NO: 48337

SEQ ID NO: 572205 - RNA, 64 nt, hsa; identical to SEQ ID NO: 48338

SEQ ID NO: 572206 - RNA, 64 nt, hsa; identical to SEQ ID NO: 48339

SEQ ID NO: 572207 - RNA, 64 nt, hsa; identical to SEQ ID NO: 48340

SEQ ID NO: 572208 - RNA, 64 nt, hsa; identical to SEQ ID NO: 48341

SEQ ID NO: 572209 - RNA, 64 nt, hsa; identical to SEQ ID NO: 48342

SEQ ID NO: 572210 - RNA, 64 nt, hsa; identical to SEQ ID NO: 48343

SEQ ID NO: 572211 - RNA, 64 nt, hsa; identical to SEQ ID NO: 48344

SEQ ID NO: 572212 - RNA, 64 nt, hsa; identical to SEQ ID NO: 48345

SEQ ID NO: 572213 - RNA, 64 nt, hsa; identical to SEQ ID NO: 48346

SEQ ID NO: 572214 - RNA, 64 nt, hsa; identical to SEQ ID NO: 48347

SEQ ID NO: 572215 - RNA, 64 nt, hsa; identical to SEQ ID NO: 48348

SEQ ID NO: 572216 - RNA, 64 nt, hsa; identical to SEQ ID NO: 48349

SEQ ID NO: 572217 - RNA, 64 nt, hsa; identical to SEQ ID NO: 211563

SEQ ID NO: 572218 - RNA, 64 nt, hsa; identical to SEQ ID NO: 211564

SEQ ID NO: 572219 - RNA, 64 nt, hsa; identical to SEQ ID NO: 211565

SEQ ID NO: 572220 - RNA, 64 nt, hsa; identical to SEQ ID NO: 211566

SEQ ID NO: 572221 - RNA, 64 nt, hsa; identical to SEQ ID NO: 211567

SEQ ID NO: 572222 - RNA, 64 nt, hsa; identical to SEQ ID NO: 211568

SEQ ID NO: 572223 - RNA, 64 nt, hsa; identical to SEQ ID NO: 211569

SEQ ID NO: 572224 - RNA, 64 nt, hsa; identical to SEQ ID NO: 211570

SEQ ID NO: 572225 - RNA, 64 nt, hsa; identical to SEQ ID NO: 211571

SEQ ID NO: 572226 - RNA, 64 nt, hsa; identical to SEQ ID NO: 211572

SEQ ID NO: 572227 - RNA, 64 nt, hsa; identical to SEQ ID NO: 211573

SEQ ID NO: 572228 - RNA, 64 nt, hsa; identical to SEQ ID NO: 211574

SEQ ID NO: 572229 - RNA, 64 nt, hsa; identical to SEQ ID NO: 211575

SEQ ID NO: 572230 - RNA, 64 nt, hsa; identical to SEQ ID NO: 211576

SEQ ID NO: 572231 - RNA, 64 nt, hsa; identical to SEQ ID NO: 211577

SEQ ID NO: 572232 - RNA, 64 nt, hsa; identical to SEQ ID NO: 211578

SEQ ID NO: 572233 - RNA, 64 nt, hsa; identical to SEQ ID NO: 211579

SEQ ID NO: 572234 - RNA, 64 nt, hsa; identical to SEQ ID NO: 211580

SEQ ID NO: 572235 - RNA, 64 nt, hsa; identical to SEQ ID NO: 211581

SEQ ID NO: 572236 - RNA, 64 nt, hsa; identical to SEQ ID NO: 211582

SEQ ID NO: 572237 - RNA, 64 nt, hsa; identical to SEQ ID NO: 211583

SEQ ID NO: 572238 - RNA, 64 nt, hsa; identical to SEQ ID NO: 211584

SEQ ID NO: 572239 - RNA, 64 nt, hsa; identical to SEQ ID NO: 211585

SEQ ID NO: 572240 - RNA, 64 nt, hsa; identical to SEQ ID NO: 211586

SEQ ID NO: 572241 - RNA, 64 nt, hsa; identical to SEQ ID NO: 211587

SEQ ID NO: 572242 - RNA, 64 nt, hsa; identical to SEQ ID NO: 211588

SEQ ID NO: 572243 - RNA, 64 nt, hsa; identical to SEQ ID NO: 211589

SEQ ID NO: 572244 - RNA, 64 nt, hsa; identical to SEQ ID NO: 211590

SEQ ID NO: 572245 - RNA, 64 nt, hsa; identical to SEQ ID NO: 211591

SEQ ID NO: 572246 - RNA, 64 nt, hsa; identical to SEQ ID NO: 211592

SEQ ID NO: 572247 - RNA, 64 nt, hsa; identical to SEQ ID NO: 211593

SEQ ID NO: 572248 - RNA, 64 nt, hsa; identical to SEQ ID NO: 211594

SEQ ID NO: 572249 - RNA, 64 nt, hsa; identical to SEQ ID NO: 211595

SEQ ID NO: 572250 - RNA, 64 nt, hsa; identical to SEQ ID NO: 211596

SEQ ID NO: 572251 - RNA, 64 nt, hsa; identical to SEQ ID NO: 211597

SEQ ID NO: 572252 - RNA, 64 nt, hsa; identical to SEQ ID NO: 211598

SEQ ID NO: 572253 - RNA, 64 nt, hsa; identical to SEQ ID NO: 211599

SEQ ID NO: 572254 - RNA, 64 nt, hsa; identical to SEQ ID NO: 211600

SEQ ID NO: 572255 - RNA, 64 nt, hsa; identical to SEQ ID NO: 211601

SEQ ID NO: 572256 - RNA, 64 nt, hsa; identical to SEQ ID NO: 211602

SEQ ID NO: 572257 - RNA, 64 nt, hsa; identical to SEQ ID NO: 211603

SEQ ID NO: 572258 - RNA, 64 nt, hsa; identical to SEQ ID NO: 211604

SEQ ID NO: 572259 - RNA, 64 nt, hsa; identical to SEQ ID NO: 211605

SEQ ID NO: 572260 - RNA, 64 nt, hsa; identical to SEQ ID NO: 211606

SEQ ID NO: 572261 - RNA, 64 nt, hsa; identical to SEQ ID NO: 211604

SEQ ID NO: 572262 - RNA, 64 nt, hsa; identical to SEQ ID NO: 211608

SEQ ID NO: 572263 - RNA, 64 nt, hsa; identical to SEQ ID NO: 211609

SEQ ID NO: 572264 - RNA, 64 nt, hsa; identical to SEQ ID NO: 211610

SEQ ID NO: 572265 - RNA, 64 nt, hsa; identical to SEQ ID NO: 211611

SEQ ID NO: 572266 - RNA, 64 nt, hsa; identical to SEQ ID NO: 211612

SEQ ID NO: 572267 - RNA, 64 nt, hsa; identical to SEQ ID NO: 211613

SEQ ID NO: 572268 - RNA, 64 nt, hsa; identical to SEQ ID NO: 211614

SEQ ID NO: 572269 - RNA, 64 nt, hsa; identical to SEQ ID NO: 211615

SEQ ID NO: 572270 - RNA, 64 nt, hsa; identical to SEQ ID NO: 211616

SEQ ID NO: 572271 - RNA, 64 nt, hsa; identical to SEQ ID NO: 211617

SEQ ID NO: 572272 - RNA, 64 nt, hsa; identical to SEQ ID NO: 211618

SEQ ID NO: 572273 - RNA, 64 nt, hsa; identical to SEQ ID NO: 211619

SEQ ID NO: 572274 - RNA, 64 nt, hsa
uagaaagucggcuguugauacgauugucuguuaucgaacacauucagugauaaagcuggguuac

SEQ ID NO: 572275 - RNA, 64 nt, hsa
aacccaaaagaccuaccaucgcaucagugaaguccgaacacaucuuuguuugaaaggcuuguca

SEQ ID NO: 572276 - RNA, 64 nt, hsa
ucaucuagagguaaucuggcagucuugugaaaaccgaacacaacucagaaacuuggaaucguuu

SEQ ID NO: 572277 - RNA, 64 nt, hsa
ugcccuguuccccguccugagccgccacuuccagcgaacacacacagguguccugccguuggac

SEQ ID NO: 572278 - RNA, 64 nt, hsa
cccucugggcccaacgcaggaggcccucagcacccgaacacaucuuccuccuccccacccgagc

SEQ ID NO: 572279 - RNA, 64 nt, hsa
auucuugucuuaugucuugaccuguuucugagugcgaacacaaaccagguguuucugucucuuu

SEQ ID NO: 572280 - RNA, 64 nt, hsa
auacauaaaccuaaaagcauuugaacaugacacccgaacacauacauauauguucacuuauuug

SEQ ID NO: 572281 - RNA, 64 nt, hsa
auucagucaccuguucagccggcacugagaagaacgaacacaagaaaaagauaagaaauacuag

SEQ ID NO: 572282 - RNA, 64 nt, hsa
ggggcugugaggggugucuccaggcacaaaggcccgaacacaggaagccugugaccauggcagc

SEQ ID NO: 572283 - RNA, 64 nt, hsa
ucuaaaaucuaaaauccauuucaagaaauaaagacgaacacauuugcaggaagguaacuguuau

SEQ ID NO: 572284 - RNA, 64 nt, hsa
uguggaauccguaauugcaucugugugccgccuccgaacacagaacauuguuuggacggcagcc

SEQ ID NO: 572285 - RNA, 64 nt, hsa
cacacacacacgagcacacacacacacacacacacgaacacacacacacacacacacacgcaca

SEQ ID NO: 572286 - RNA, 64 nt, hsa
acgcuaauugauaaccgagucauuuacauguuuucgaacacagaauagcucuuuucucagcauc

SEQ ID NO: 572287 - RNA, 64 nt, hsa
agaauucaacauuaaagauuaauguuuauuuaaacgaacacauuccugcauucaggaugugagg

SEQ ID NO: 572288 - RNA, 64 nt, hsa
ucaaaaagcuuauuucuuuuaaucucuuacucaacgaacacaucuucugaugauuucccaaaau

SEQ ID NO: 572289 - RNA, 64 nt, hsa
cacagcugugaacugcaugaaauguauugugaaacgaacacaagauuaagcuuugucagguuaa

SEQ ID NO: 572290 - RNA, 64 nt, hsa
uuaaagcauccuccuccuggacuccccucccugccgaacacacaucccaggagucugggaagga

SEQ ID NO: 572291 - RNA, 59 nt, hsa
aucuuuacagauucauuuaagccaucagacgaacacaagagaggcucaaacaagaaauu

SEQ ID NO: 572292 - RNA, 64 nt, hsa
guucagaggaagcacauaauguccagaucuauggcgaacacagguguuggaagccaggacugug

SEQ ID NO: 572293 - RNA, 64 nt, hsa
ccaaauuuuaggcaaauuauuauuucucaauaugcgaacacaguauuuagaacacaauauuaga

SEQ ID NO: 572294 - RNA, 64 nt, hsa
guggcauuggaaaaauaccugcuuguaagauaugcgaacacacguuucaagguuguuugugcau

SEQ ID NO: 572295 - RNA, 64 nt, hsa
acaaaauggcuaaauaguuuaaaauagguuaauucgaacacaggaaaggaucuauuuguuguuu

SEQ ID NO: 572296 - RNA, 64 nt, hsa
uggucauuuucuggagagggguccccuccccuuacgaacacagaaacccagcccacaugacuag

SEQ ID NO: 572297 - RNA, 64 nt, hsa
cagguaguucugggggcgauacugccgaaaggcccgaacacauguauuuuggcugcaauugagg

SEQ ID NO: 572298 - RNA, 64 nt, hsa
ucacuuggaguggauccagcuucacugucaugugcgaacacagugacacguuuggccagugaca

SEQ ID NO: 572299 - RNA, 64 nt, hsa
uuugcugcccagccauaacccacucagugacagacgaacacagcuaaggccucgcugccagccu

SEQ ID NO: 572300 - RNA, 64 nt, hsa
ccucuacuguaaacuuucugguccgagaacgagccgaacacagcgcgacgcagggacuaggacg

SEQ ID NO: 572301 - RNA, 64 nt, hsa
ggagaccuggacacaacagacacacaucacaaggcgaacacaaauggacacacauaccuggcca

SEQ ID NO: 572302 - RNA, 64 nt, hsa
uugaaagacaggacauggagagcugcuggguuggcgaacacauccaugugccgggaggauggug

SEQ ID NO: 572303 - RNA, 64 nt, hsa
uggucaccccaugggacaggcacagcuacuuacgcgaacacagcagguugguguggcuggcuaa

SEQ ID NO: 572304 - RNA, 64 nt, hsa
ucuccuggacccccagcggucuccuuggcgcccacgaacacaggcgugcacacgcagcgcacau

SEQ ID NO: 572305 - RNA, 64 nt, hsa
cagcuacucuggaggcugaggcaggggaauggcucgaacacaggagacggagauugcagugagc

SEQ ID NO: 572306 - RNA, 64 nt, hsa
guggaucuuuggggaauggcuucaaaauaagucacgaacacaaauucuuuguaaauuauguaaa

SEQ ID NO: 572307 - RNA, 64 nt, hsa
gcacugagagcuggagaguuggugauaagcgagacgaacacauuuccugcccucauacacacau

SEQ ID NO: 572308 - RNA, 60 nt, hsa
uggaaaccccugccccauaaacggcccucucgaacacaaugggacggaauccacccacaa

SEQ ID NO: 572309 - RNA, 64 nt, hsa
aaaaaugagacacagguuuggggaccaaggacccaucaaugauggugacuuuagcagaagaugc

SEQ ID NO: 572310 - RNA, 64 nt, hsa
aaaugauucauuugaagauacaauuuuauuugauaucaaugaacgcccucaagacugagcugcu

SEQ ID NO: 572311 - RNA, 64 nt, hsa
uccaccugcccauagucaccaaauucuguuuuaaaucaaugaccuaagaucaacaaugaaguau

SEQ ID NO: 572312 - RNA, 64 nt, hsa
ccuaaggcaaagaaauauaagacaagacuaugauaucaaugaauguggguuaaguaauagauuu

SEQ ID NO: 572313 - RNA, 52 nt, hsa
gcguagacuacauuuugugaggaucaaugaagacuaaauauaaaaaacauuu

SEQ ID NO: 572314 - RNA, 64 nt, hsa
guaggcuggaagaaguggauauugaaguuuugacaucaaugaugaggcuccaguugucuauuca

SEQ ID NO: 572315 - RNA, 64 nt, hsa
aguaaguguaagaaaaugauugcuuaucaguaguaucaaugauuuacucaauaucugaaucacc

SEQ ID NO: 572316 - RNA, 64 nt, hsa
uugaaacauuugccuuuaggcuguucuuugagguaucaaugaagugauugaauuucaauaccuu

SEQ ID NO: 572317 - RNA, 64 nt, hsa
aaaccauaaucaucucuuggaagaaaaugcugagaucaaugaauuauucugugugccuauauug

SEQ ID NO: 572318 - RNA, 64 nt, hsa
ucauuaauuuuuaauugaaacuaguuauuuuauaaucaaugaauuuguucuuucugauuuuaag

SEQ ID NO: 572319 - RNA, 64 nt, hsa
uagcuuaaguaguuucuccaaguacuuuugugcuaucaaugaguucuucucaaaaaauaauuag

SEQ ID NO: 572320 - RNA, 64 nt, hsa
uaucaaccagacugaccacaagaacugucaucucaucaaugaaggaguaacugaucaaugaagc

SEQ ID NO: 572321 - RNA, 64 nt, hsa
aagaacugucaucucaucaaugaaggaguaacugaucaaugaagccagcaaugcuuuuuucuug

SEQ ID NO: 572322 - RNA, 64 nt, hsa
ugggucaguccagcccccuccacaucacugagccaucaaugagcugagagaucaaugacuuuuu

SEQ ID NO: 572323 - RNA, 64 nt, hsa
ccuccacaucacugagccaucaaugagcugagagaucaaugacuuuuuaggcagcuguguuuuu

SEQ ID NO: 572324 - RNA, 64 nt, hsa
ucuuuuuauucauugcccucaggaaaguuaagguaucaaugagacccuuaagccaaucauguaa

SEQ ID NO: 572325 - RNA, 64 nt, hsa
cuguguaggggagccacauuuacauaggaaccaaaucaaugaauuuagggguuacgauuauagc

SEQ ID NO: 572326 - RNA, 64 nt, hsa
gggaauuccaccugagaacaagucccgcaaaccggggacggaaggacauuugacuuuuauuuuu

SEQ ID NO: 572327 - RNA, 64 nt, hsa
cucacguucacaccugguggcaggcuucacuguagggacggacauugcaguuacaccacgauuc

SEQ ID NO: 572328 - RNA, 64 nt, hsa
aauggacgguuuaggugaaaauaaucaacugcauaguucccaugcacgcugggcaaugagaauc

SEQ ID NO: 572329 - RNA, 64 nt, hsa
uauagcuuuauuucuuaaggggguagggaaaauuaguucccauucuuucaacccccuuaacugu

SEQ ID NO: 572330 - RNA, 64 nt, hsa
caaggagaaggaugccagccacccauccucccccaguucccagccuuuccccuguuggucacag

SEQ ID NO: 572331 - RNA, 64 nt, hsa
ugcccugcaugauucuguguugccgcugcugcauaguucccagccccauccuguccugcucacu

SEQ ID NO: 572332 - RNA, 64 nt, hsa
cccaauuaauaaucagcaagaauuugaucguuccaguucccacuuggaggccuuucaucccucg

SEQ ID NO: 572333 - RNA, 64 nt, hsa
gagacucuucuaagucuucaucucagagacccugaguucccacucagacccacucagccaaauc

SEQ ID NO: 572334 - RNA, 64 nt, hsa
cuuguuuuuggaaaaacaaaauuucuacaauuacaguucccaaagucaguuauucauguuuuca

SEQ ID NO: 572335 - RNA, 64 nt, hsa
cuuguucuuggauaaagaaaauuucuacaauuacaguucccaaagacacaguuguucauguuau

SEQ ID NO: 572336 - RNA, 64 nt, hsa
cgggcagggagaaugccugggggucccucaccuggcuagggagauaccgaagccuacuguggua

SEQ ID NO: 572337 - RNA, 64 nt, hsa
uauggauguguggguacuugguggggacggaggagcuagggacuaacuguugcucuuggugggc

SEQ ID NO: 572338 - RNA, 64 nt, hsa; identical to SEQ ID NO: 128175

SEQ ID NO: 572339 - RNA, 64 nt, hsa; identical to SEQ ID NO: 128176

SEQ ID NO: 572340 - RNA, 64 nt, hsa; identical to SEQ ID NO: 128177

SEQ ID NO: 572341 - RNA, 64 nt, hsa; identical to SEQ ID NO: 128178

SEQ ID NO: 572342 - RNA, 64 nt, hsa; identical to SEQ ID NO: 128179

SEQ ID NO: 572343 - RNA, 64 nt, hsa; identical to SEQ ID NO: 128180

SEQ ID NO: 572344 - RNA, 64 nt, hsa; identical to SEQ ID NO: 128181

SEQ ID NO: 572345 - RNA, 64 nt, hsa; identical to SEQ ID NO: 128182

SEQ ID NO: 572346 - RNA, 64 nt, hsa; identical to SEQ ID NO: 128183

SEQ ID NO: 572347 - RNA, 64 nt, hsa; identical to SEQ ID NO: 128184

SEQ ID NO: 572348 - RNA, 64 nt, hsa; identical to SEQ ID NO: 128185

SEQ ID NO: 572349 - RNA, 64 nt, hsa; identical to SEQ ID NO: 128186

SEQ ID NO: 572350 - RNA, 64 nt, hsa; identical to SEQ ID NO: 128187

SEQ ID NO: 572351 - RNA, 64 nt, hsa; identical to SEQ ID NO: 128188

SEQ ID NO: 572352 - RNA, 64 nt, hsa; identical to SEQ ID NO: 128189

SEQ ID NO: 572353 - RNA, 64 nt, hsa; identical to SEQ ID NO: 128190

SEQ ID NO: 572354 - RNA, 64 nt, hsa; identical to SEQ ID NO: 128191

SEQ ID NO: 572355 - RNA, 64 nt, hsa; identical to SEQ ID NO: 128192

SEQ ID NO: 572356 - RNA, 64 nt, hsa; identical to SEQ ID NO: 128193

SEQ ID NO: 572357 - RNA, 64 nt, hsa; identical to SEQ ID NO: 128194

SEQ ID NO: 572358 - RNA, 64 nt, hsa; identical to SEQ ID NO: 128195

SEQ ID NO: 572359 - RNA, 64 nt, hsa; identical to SEQ ID NO: 128196

SEQ ID NO: 572360 - RNA, 64 nt, hsa; identical to SEQ ID NO: 128197

SEQ ID NO: 572361 - RNA, 64 nt, hsa; identical to SEQ ID NO: 128198

SEQ ID NO: 572362 - RNA, 64 nt, hsa; identical to SEQ ID NO: 128199

SEQ ID NO: 572363 - RNA, 64 nt, hsa; identical to SEQ ID NO: 128200

SEQ ID NO: 572364 - RNA, 64 nt, hsa; identical to SEQ ID NO: 128201

SEQ ID NO: 572365 - RNA, 64 nt, hsa; identical to SEQ ID NO: 128202

SEQ ID NO: 572366 - RNA, 64 nt, hsa; identical to SEQ ID NO: 128203

SEQ ID NO: 572367 - RNA, 64 nt, hsa; identical to SEQ ID NO: 128204

SEQ ID NO: 572368 - RNA, 64 nt, hsa; identical to SEQ ID NO: 128205

SEQ ID NO: 572369 - RNA, 64 nt, hsa; identical to SEQ ID NO: 128206

SEQ ID NO: 572370 - RNA, 64 nt, hsa; identical to SEQ ID NO: 23238

SEQ ID NO: 572371 - RNA, 64 nt, hsa; identical to SEQ ID NO: 23239

SEQ ID NO: 572372 - RNA, 64 nt, hsa; identical to SEQ ID NO: 23240

SEQ ID NO: 572373 - RNA, 64 nt, hsa; identical to SEQ ID NO: 23241

SEQ ID NO: 572374 - RNA, 64 nt, hsa; identical to SEQ ID NO: 111122

SEQ ID NO: 572375 - RNA, 64 nt, hsa; identical to SEQ ID NO: 111123

SEQ ID NO: 572376 - RNA, 64 nt, hsa; identical to SEQ ID NO: 111124

SEQ ID NO: 572377 - RNA, 64 nt, hsa; identical to SEQ ID NO: 111125

SEQ ID NO: 572378 - RNA, 64 nt, hsa; identical to SEQ ID NO: 111126

SEQ ID NO: 572379 - RNA, 64 nt, hsa; identical to SEQ ID NO: 111127

SEQ ID NO: 572380 - RNA, 64 nt, hsa; identical to SEQ ID NO: 111128

SEQ ID NO: 572381 - RNA, 64 nt, hsa; identical to SEQ ID NO: 111129

SEQ ID NO: 572382 - RNA, 64 nt, hsa; identical to SEQ ID NO: 111130

SEQ ID NO: 572383 - RNA, 64 nt, hsa; identical to SEQ ID NO: 111131

SEQ ID NO: 572384 - RNA, 64 nt, hsa; identical to SEQ ID NO: 111132

SEQ ID NO: 572385 - RNA, 64 nt, hsa; identical to SEQ ID NO: 111133

SEQ ID NO: 572386 - RNA, 64 nt, hsa; identical to SEQ ID NO: 111134

SEQ ID NO: 572387 - RNA, 64 nt, hsa; identical to SEQ ID NO: 111135

SEQ ID NO: 572388 - RNA, 64 nt, hsa; identical to SEQ ID NO: 111136

SEQ ID NO: 572389 - RNA, 64 nt, hsa; identical to SEQ ID NO: 111137

SEQ ID NO: 572390 - RNA, 64 nt, hsa; identical to SEQ ID NO: 111138

SEQ ID NO: 572391 - RNA, 64 nt, hsa; identical to SEQ ID NO: 111139

SEQ ID NO: 572392 - RNA, 64 nt, hsa; identical to SEQ ID NO: 111140

SEQ ID NO: 572393 - RNA, 64 nt, hsa; identical to SEQ ID NO: 111141

SEQ ID NO: 572394 - RNA, 64 nt, hsa; identical to SEQ ID NO: 111142

SEQ ID NO: 572395 - RNA, 64 nt, hsa; identical to SEQ ID NO: 111143

SEQ ID NO: 572396 - RNA, 64 nt, hsa; identical to SEQ ID NO: 111144

SEQ ID NO: 572397 - RNA, 64 nt, hsa; identical to SEQ ID NO: 111145

SEQ ID NO: 572398 - RNA, 64 nt, hsa; identical to SEQ ID NO: 111146

SEQ ID NO: 572399 - RNA, 64 nt, hsa; identical to SEQ ID NO: 111147

SEQ ID NO: 572400 - RNA, 64 nt, hsa; identical to SEQ ID NO: 111148

SEQ ID NO: 572401 - RNA, 64 nt, hsa; identical to SEQ ID NO: 111149

SEQ ID NO: 572402 - RNA, 64 nt, hsa; identical to SEQ ID NO: 111150

SEQ ID NO: 572403 - RNA, 64 nt, hsa; identical to SEQ ID NO: 111151

SEQ ID NO: 572404 - RNA, 64 nt, hsa; identical to SEQ ID NO: 111152

SEQ ID NO: 572405 - RNA, 64 nt, hsa; identical to SEQ ID NO: 111153

SEQ ID NO: 572406 - RNA, 64 nt, hsa; identical to SEQ ID NO: 111154

SEQ ID NO: 572407 - RNA, 64 nt, hsa; identical to SEQ ID NO: 111155

SEQ ID NO: 572408 - RNA, 64 nt, hsa; identical to SEQ ID NO: 111156

SEQ ID NO: 572409 - RNA, 64 nt, hsa; identical to SEQ ID NO: 111157

SEQ ID NO: 572410 - RNA, 64 nt, hsa; identical to SEQ ID NO: 111158

SEQ ID NO: 572411 - RNA, 64 nt, hsa; identical to SEQ ID NO: 111159

SEQ ID NO: 572412 - RNA, 64 nt, hsa; identical to SEQ ID NO: 111160

SEQ ID NO: 572413 - RNA, 64 nt, hsa; identical to SEQ ID NO: 111161

SEQ ID NO: 572414 - RNA, 64 nt, hsa; identical to SEQ ID NO: 111162

SEQ ID NO: 572415 - RNA, 64 nt, hsa; identical to SEQ ID NO: 111163

SEQ ID NO: 572416 - RNA, 64 nt, hsa; identical to SEQ ID NO: 111164

SEQ ID NO: 572417 - RNA, 64 nt, hsa; identical to SEQ ID NO: 111165

SEQ ID NO: 572418 - RNA, 64 nt, hsa; identical to SEQ ID NO: 111166

SEQ ID NO: 572419 - RNA, 64 nt, hsa; identical to SEQ ID NO: 111167

SEQ ID NO: 572420 - RNA, 64 nt, hsa; identical to SEQ ID NO: 111168

SEQ ID NO: 572421 - RNA, 64 nt, hsa; identical to SEQ ID NO: 111169

SEQ ID NO: 572422 - RNA, 64 nt, hsa; identical to SEQ ID NO: 111170

SEQ ID NO: 572423 - RNA, 64 nt, hsa; identical to SEQ ID NO: 111171

SEQ ID NO: 572424 - RNA, 64 nt, hsa; identical to SEQ ID NO: 111172

SEQ ID NO: 572425 - RNA, 64 nt, hsa; identical to SEQ ID NO: 111173

SEQ ID NO: 572426 - RNA, 64 nt, hsa; identical to SEQ ID NO: 111174

SEQ ID NO: 572427 - RNA, 64 nt, hsa; identical to SEQ ID NO: 111175

SEQ ID NO: 572428 - RNA, 64 nt, hsa; identical to SEQ ID NO: 111176

SEQ ID NO: 572429 - RNA, 64 nt, hsa; identical to SEQ ID NO: 111177

SEQ ID NO: 572430 - RNA, 64 nt, hsa; identical to SEQ ID NO: 111178

SEQ ID NO: 572431 - RNA, 64 nt, hsa; identical to SEQ ID NO: 111179

SEQ ID NO: 572432 - RNA, 64 nt, hsa; identical to SEQ ID NO: 111180

SEQ ID NO: 572433 - RNA, 64 nt, hsa; identical to SEQ ID NO: 111181

SEQ ID NO: 572434 - RNA, 64 nt, hsa; identical to SEQ ID NO: 111182

SEQ ID NO: 572435 - RNA, 64 nt, hsa; identical to SEQ ID NO: 111183

SEQ ID NO: 572436 - RNA, 64 nt, hsa; identical to SEQ ID NO: 111184

SEQ ID NO: 572437 - RNA, 64 nt, hsa; identical to SEQ ID NO: 111185

SEQ ID NO: 572438 - RNA, 64 nt, hsa; identical to SEQ ID NO: 111186

SEQ ID NO: 572439 - RNA, 64 nt, hsa; identical to SEQ ID NO: 111187

SEQ ID NO: 572440 - RNA, 64 nt, hsa; identical to SEQ ID NO: 111188

SEQ ID NO: 572441 - RNA, 64 nt, hsa; identical to SEQ ID NO: 111189

SEQ ID NO: 572442 - RNA, 64 nt, hsa; identical to SEQ ID NO: 111190

SEQ ID NO: 572443 - RNA, 64 nt, hsa; identical to SEQ ID NO: 111191

SEQ ID NO: 572444 - RNA, 64 nt, hsa; identical to SEQ ID NO: 111192

SEQ ID NO: 572445 - RNA, 64 nt, hsa; identical to SEQ ID NO: 111193

SEQ ID NO: 572446 - RNA, 64 nt, hsa; identical to SEQ ID NO: 111194

SEQ ID NO: 572447 - RNA, 64 nt, hsa; identical to SEQ ID NO: 111195

SEQ ID NO: 572448 - RNA, 64 nt, hsa; identical to SEQ ID NO: 111196

SEQ ID NO: 572449 - RNA, 64 nt, hsa; identical to SEQ ID NO: 111197

SEQ ID NO: 572450 - RNA, 64 nt, hsa; identical to SEQ ID NO: 111198

SEQ ID NO: 572451 - RNA, 64 nt, hsa; identical to SEQ ID NO: 111199

SEQ ID NO: 572452 - RNA, 64 nt, hsa; identical to SEQ ID NO: 111200

SEQ ID NO: 572453 - RNA, 64 nt, hsa; identical to SEQ ID NO: 111201

SEQ ID NO: 572454 - RNA, 64 nt, hsa; identical to SEQ ID NO: 111202

SEQ ID NO: 572455 - RNA, 64 nt, hsa; identical to SEQ ID NO: 111203

SEQ ID NO: 572456 - RNA, 64 nt, hsa; identical to SEQ ID NO: 111204

SEQ ID NO: 572457 - RNA, 64 nt, hsa; identical to SEQ ID NO: 111205

SEQ ID NO: 572458 - RNA, 64 nt, hsa; identical to SEQ ID NO: 111206

SEQ ID NO: 572459 - RNA, 64 nt, hsa; identical to SEQ ID NO: 111207

SEQ ID NO: 572460 - RNA, 64 nt, hsa; identical to SEQ ID NO: 111208

SEQ ID NO: 572461 - RNA, 64 nt, hsa; identical to SEQ ID NO: 111209

SEQ ID NO: 572462 - RNA, 64 nt, hsa; identical to SEQ ID NO: 111210

SEQ ID NO: 572463 - RNA, 64 nt, hsa; identical to SEQ ID NO: 111211

SEQ ID NO: 572464 - RNA, 64 nt, hsa; identical to SEQ ID NO: 111212

SEQ ID NO: 572465 - RNA, 64 nt, hsa; identical to SEQ ID NO: 111213

SEQ ID NO: 572466 - RNA, 64 nt, hsa; identical to SEQ ID NO: 111214

SEQ ID NO: 572467 - RNA, 64 nt, hsa; identical to SEQ ID NO: 111215

SEQ ID NO: 572468 - RNA, 64 nt, hsa; identical to SEQ ID NO: 111216

SEQ ID NO: 572469 - RNA, 64 nt, hsa; identical to SEQ ID NO: 111217

SEQ ID NO: 572470 - RNA, 64 nt, hsa; identical to SEQ ID NO: 111218

SEQ ID NO: 572471 - RNA, 64 nt, hsa; identical to SEQ ID NO: 111219

SEQ ID NO: 572472 - RNA, 64 nt, hsa; identical to SEQ ID NO: 111220

SEQ ID NO: 572473 - RNA, 64 nt, hsa; identical to SEQ ID NO: 111221

SEQ ID NO: 572474 - RNA, 64 nt, hsa; identical to SEQ ID NO: 111222

SEQ ID NO: 572475 - RNA, 64 nt, hsa; identical to SEQ ID NO: 111223

SEQ ID NO: 572476 - RNA, 64 nt, hsa; identical to SEQ ID NO: 111224

SEQ ID NO: 572477 - RNA, 64 nt, hsa; identical to SEQ ID NO: 111225

SEQ ID NO: 572478 - RNA, 64 nt, hsa; identical to SEQ ID NO: 111226

SEQ ID NO: 572479 - RNA, 64 nt, hsa; identical to SEQ ID NO: 111227

SEQ ID NO: 572480 - RNA, 64 nt, hsa; identical to SEQ ID NO: 111228

SEQ ID NO: 572481 - RNA, 64 nt, hsa; identical to SEQ ID NO: 111229

SEQ ID NO: 572482 - RNA, 64 nt, hsa; identical to SEQ ID NO: 111230

SEQ ID NO: 572483 - RNA, 64 nt, hsa; identical to SEQ ID NO: 111231

SEQ ID NO: 572484 - RNA, 64 nt, hsa; identical to SEQ ID NO: 111232

SEQ ID NO: 572485 - RNA, 64 nt, hsa; identical to SEQ ID NO: 111233

SEQ ID NO: 572486 - RNA, 64 nt, hsa; identical to SEQ ID NO: 111234

SEQ ID NO: 572487 - RNA, 64 nt, hsa; identical to SEQ ID NO: 111235

SEQ ID NO: 572488 - RNA, 64 nt, hsa; identical to SEQ ID NO: 111236

SEQ ID NO: 572489 - RNA, 64 nt, hsa; identical to SEQ ID NO: 111237

SEQ ID NO: 572490 - RNA, 64 nt, hsa; identical to SEQ ID NO: 111238

SEQ ID NO: 572491 - RNA, 64 nt, hsa; identical to SEQ ID NO: 111239

SEQ ID NO: 572492 - RNA, 64 nt, hsa; identical to SEQ ID NO: 111240

SEQ ID NO: 572493 - RNA, 64 nt, hsa; identical to SEQ ID NO: 111241

SEQ ID NO: 572494 - RNA, 64 nt, hsa; identical to SEQ ID NO: 111242

SEQ ID NO: 572495 - RNA, 64 nt, hsa; identical to SEQ ID NO: 111243

SEQ ID NO: 572496 - RNA, 64 nt, hsa; identical to SEQ ID NO: 111244

SEQ ID NO: 572497 - RNA, 64 nt, hsa; identical to SEQ ID NO: 111245

SEQ ID NO: 572498 - RNA, 64 nt, hsa; identical to SEQ ID NO: 111246

SEQ ID NO: 572499 - RNA, 64 nt, hsa; identical to SEQ ID NO: 111247

SEQ ID NO: 572500 - RNA, 64 nt, hsa; identical to SEQ ID NO: 111248

SEQ ID NO: 572501 - RNA, 64 nt, hsa; identical to SEQ ID NO: 111249

SEQ ID NO: 572502 - RNA, 64 nt, hsa; identical to SEQ ID NO: 111250

SEQ ID NO: 572503 - RNA, 64 nt, hsa; identical to SEQ ID NO: 111251

SEQ ID NO: 572504 - RNA, 64 nt, hsa; identical to SEQ ID NO: 111252

SEQ ID NO: 572505 - RNA, 64 nt, hsa; identical to SEQ ID NO: 111253

SEQ ID NO: 572506 - RNA, 64 nt, hsa; identical to SEQ ID NO: 111254

SEQ ID NO: 572507 - RNA, 64 nt, hsa; identical to SEQ ID NO: 111255

SEQ ID NO: 572508 - RNA, 64 nt, hsa; identical to SEQ ID NO: 111256

SEQ ID NO: 572509 - RNA, 64 nt, hsa; identical to SEQ ID NO: 111257

SEQ ID NO: 572510 - RNA, 64 nt, hsa; identical to SEQ ID NO: 111258

SEQ ID NO: 572511 - RNA, 64 nt, hsa; identical to SEQ ID NO: 111259

SEQ ID NO: 572512 - RNA, 64 nt, hsa; identical to SEQ ID NO: 111260

SEQ ID NO: 572513 - RNA, 64 nt, hsa; identical to SEQ ID NO: 111261

SEQ ID NO: 572514 - RNA, 64 nt, hsa; identical to SEQ ID NO: 111262

SEQ ID NO: 572515 - RNA, 64 nt, hsa; identical to SEQ ID NO: 111263

SEQ ID NO: 572516 - RNA, 64 nt, hsa; identical to SEQ ID NO: 111264

SEQ ID NO: 572517 - RNA, 64 nt, hsa; identical to SEQ ID NO: 111265

SEQ ID NO: 572518 - RNA, 64 nt, hsa; identical to SEQ ID NO: 111266

SEQ ID NO: 572519 - RNA, 64 nt, hsa; identical to SEQ ID NO: 111267

SEQ ID NO: 572520 - RNA, 64 nt, hsa; identical to SEQ ID NO: 111268

SEQ ID NO: 572521 - RNA, 64 nt, hsa; identical to SEQ ID NO: 111269

SEQ ID NO: 572522 - RNA, 64 nt, hsa; identical to SEQ ID NO: 111270

SEQ ID NO: 572523 - RNA, 64 nt, hsa; identical to SEQ ID NO: 111271

SEQ ID NO: 572524 - RNA, 64 nt, hsa; identical to SEQ ID NO: 111272

SEQ ID NO: 572525 - RNA, 64 nt, hsa; identical to SEQ ID NO: 111273

SEQ ID NO: 572526 - RNA, 64 nt, hsa; identical to SEQ ID NO: 111274

SEQ ID NO: 572527 - RNA, 64 nt, hsa; identical to SEQ ID NO: 111275

SEQ ID NO: 572528 - RNA, 64 nt, hsa; identical to SEQ ID NO: 111276

SEQ ID NO: 572529 - RNA, 64 nt, hsa; identical to SEQ ID NO: 111277

SEQ ID NO: 572530 - RNA, 64 nt, hsa; identical to SEQ ID NO: 111278

SEQ ID NO: 572531 - RNA, 64 nt, hsa; identical to SEQ ID NO: 111279

SEQ ID NO: 572532 - RNA, 64 nt, hsa; identical to SEQ ID NO: 111280

SEQ ID NO: 572533 - RNA, 64 nt, hsa; identical to SEQ ID NO: 111281

SEQ ID NO: 572534 - RNA, 64 nt, hsa; identical to SEQ ID NO: 111282

SEQ ID NO: 572535 - RNA, 64 nt, hsa; identical to SEQ ID NO: 111283

SEQ ID NO: 572536 - RNA, 64 nt, hsa; identical to SEQ ID NO: 111284

SEQ ID NO: 572537 - RNA, 64 nt, hsa; identical to SEQ ID NO: 111285

SEQ ID NO: 572538 - RNA, 64 nt, hsa; identical to SEQ ID NO: 111286

SEQ ID NO: 572539 - RNA, 64 nt, hsa; identical to SEQ ID NO: 111287

SEQ ID NO: 572540 - RNA, 64 nt, hsa; identical to SEQ ID NO: 111288

SEQ ID NO: 572541 - RNA, 64 nt, hsa; identical to SEQ ID NO: 111289

SEQ ID NO: 572542 - RNA, 64 nt, hsa; identical to SEQ ID NO: 111290

SEQ ID NO: 572543 - RNA, 64 nt, hsa; identical to SEQ ID NO: 111291

SEQ ID NO: 572544 - RNA, 64 nt, hsa; identical to SEQ ID NO: 111292

SEQ ID NO: 572545 - RNA, 64 nt, hsa; identical to SEQ ID NO: 111293

SEQ ID NO: 572546 - RNA, 64 nt, hsa; identical to SEQ ID NO: 111294

SEQ ID NO: 572547 - RNA, 64 nt, hsa; identical to SEQ ID NO: 111295

SEQ ID NO: 572548 - RNA, 64 nt, hsa; identical to SEQ ID NO: 111296

SEQ ID NO: 572549 - RNA, 64 nt, hsa; identical to SEQ ID NO: 111297

SEQ ID NO: 572550 - RNA, 64 nt, hsa; identical to SEQ ID NO: 111298

SEQ ID NO: 572551 - RNA, 64 nt, hsa; identical to SEQ ID NO: 111299

SEQ ID NO: 572552 - RNA, 64 nt, hsa; identical to SEQ ID NO: 111300

SEQ ID NO: 572553 - RNA, 64 nt, hsa; identical to SEQ ID NO: 111301

SEQ ID NO: 572554 - RNA, 64 nt, hsa; identical to SEQ ID NO: 111302

SEQ ID NO: 572555 - RNA, 64 nt, hsa; identical to SEQ ID NO: 111303

SEQ ID NO: 572556 - RNA, 64 nt, hsa; identical to SEQ ID NO: 111304

SEQ ID NO: 572557 - RNA, 58 nt, hsa
guagaaaaaugucacguuuccauaucuccugcuggaaaucagaaaauauaauaaaauu

SEQ ID NO: 572558 - RNA, 58 nt, hsa
gaaucaauggaucuguugaagaacucagcugcuggaaaccaugcaaaauguuuugaau

SEQ ID NO: 572559 - RNA, 58 nt, hsa
aaacugcagcagccacgcacacagaagccugcuggaagacaggucucucuccguccac

SEQ ID NO: 572560 - RNA, 58 nt, hsa
uuacauaagaucugccuuccacacuucccugcuggaaggcauucucagagcuuuaugu

SEQ ID NO: 572561 - RNA, 58 nt, hsa
uuuccugcccucuguggucaucugccaccugcuggaucaagugcuuucucuuuuacac

SEQ ID NO: 572562 - RNA, 58 nt, hsa
uuccugguugucuguugaaucuuucuggcugcuggaauuggagauaggauguuuugcu

SEQ ID NO: 572563 - RNA, 58 nt, hsa
ucaggagcagcaaugggucucaccauagcugcuggaaucacaccugagaacugagaua

SEQ ID NO: 572564 - RNA, 58 nt, hsa
gcuguccucgugcgauugcccucuccugcugcuggacuucugccuuuguuggccugau

SEQ ID NO: 572565 - RNA, 58 nt, hsa
ccgcccucuggaccuguguagggccucacugcuggagcggggaaaccgcagcucagcc

SEQ ID NO: 572566 - RNA, 58 nt, hsa
gccucccagccccucaagacaccgcuggcugcuggacacccucuucacuugugugugu

SEQ ID NO: 572567 - RNA, 58 nt, hsa
ugggaguggcauguaugacgugacuggccugcuggauguggagggggcgcgugcaggc

SEQ ID NO: 572568 - RNA, 58 nt, hsa
uugccaugcuggccaggcuggucucgaacugcuggauucaagugauccgcccaucucc

SEQ ID NO: 572569 - RNA, 58 nt, hsa
ccaggccuacccuacugcccgcugcguccugcuggaggugcaagugccugcugcccuu

SEQ ID NO: 572570 - RNA, 58 nt, hsa
acugcaacugcugacccugcagagcuggcugcuggacgcaccgugcucgcugcccgca

SEQ ID NO: 572571 - RNA, 58 nt, hsa
cucacuuugggaggcugaggcaggaaggcugcuggaaacugagaguucaagaccagcc

SEQ ID NO: 572572 - RNA, 58 nt, hsa
gaagccuuagaugcuauaguuccuucugcugcuggauucucaggcuaacauccuggag

SEQ ID NO: 572573 - RNA, 58 nt, hsa
gcgcccauuuagaggauguggcuguaaccugcuggaugggacuccauagcuccuuccc

SEQ ID NO: 572574 - RNA, 58 nt, hsa
uuggcugggccucugguucugacacuuucugcuggaagcugucaggcugggacaggcu

SEQ ID NO: 572575 - RNA, 58 nt, hsa
cucacagacugaccauuccaucccacagcugcuggacauagagugauuugcagccccu

SEQ ID NO: 572576 - RNA, 58 nt, hsa
ugagugaccauccaggcagucaccauaacugcuggagugucugggauugguagcucuc

SEQ ID NO: 572577 - RNA, 58 nt, hsa
gcgcucuacggaggcuucuccauugucccugcuggagauugggucccucggucucccu

SEQ ID NO: 572578 - RNA, 58 nt, hsa
ccccuacaucgcugcugucguccacgcccugcuggaccggccuuaggggugaaggugg

SEQ ID NO: 572579 - RNA, 58 nt, hsa
gggacaaacaacucaagugucuuaacagcugcuggagugggauccuuguuaucucuua

SEQ ID NO: 572580 - RNA, 58 nt, hsa
uguuuuaguaaucauucuauaaaugauacugcuggauugauugccguggguugauagc

SEQ ID NO: 572581 - RNA, 58 nt, hsa
guguuggcaacacagcgugugcauggggcugcuggaggagagcauuccagagcaguac

SEQ ID NO: 572582 - RNA, 58 nt, hsa
ggguccgaugugccaagugaucaugauucugcuggaaagaggauuuuaaauauugugg

SEQ ID NO: 572583 - RNA, 58 nt, hsa
cgagggccuggccucgcuguugguggcccugcuggagaagaccacgugggucgaccgu

SEQ ID NO: 572584 - RNA, 58 nt, hsa
ggaggagaccgacuggucgcacucgcagcugcuggacuugggccccaucgacgcgcuc

SEQ ID NO: 572585 - RNA, 58 nt, hsa
ggaagccaagccauuauggcagaugaaccugcuggauuuguaaauaauuuaaaauccu

SEQ ID NO: 572586 - RNA, 58 nt, hsa
cccaaaaggacagagaacuaaaaaauugcugcuggagaaggugaaagucgcuuuggga

SEQ ID NO: 572587 - RNA, 58 nt, hsa
cucagucugcuugaauggugaugagauucugcuggaucucagcacgcugcaggugucu

SEQ ID NO: 572588 - RNA, 58 nt, hsa
auucaguuagcaaaccuugaugaagcaccugcuggacacugagggacccaaagcucaa

SEQ ID NO: 572589 - RNA, 58 nt, hsa
cccugcacccuccgggaagccauggagucugcuggaggcaccauaucagccugcggga

SEQ ID NO: 572590 - RNA, 58 nt, hsa
gcuagggguaccccagcugcugccacuccugcuggagggugaacuggggacccugcac

SEQ ID NO: 572591 - RNA, 58 nt, hsa
ggcauugcucggguaccacuugcuggagcugcuggaggcccugggguugguagggcag

SEQ ID NO: 572592 - RNA, 58 nt, hsa
ccagcuggugugccaauuccccaggccccugcuggauuggcaggcccuguccgaggag

SEQ ID NO: 572593 - RNA, 58 nt, hsa
ucaggacaaggaggagaugaaggugaagcugcuggagcugguguugcagcuugugggc

SEQ ID NO: 572594 - RNA, 58 nt, hsa
ggagaggaugcuggagcaagaggagaggcugcuggagcuugaguggaaagccgagccu

SEQ ID NO: 572595 - RNA, 58 nt, hsa
ucugcccagaccacacguagcccccaggcugcuggacacgucggacagcgaaguaucc

SEQ ID NO: 572596 - RNA, 58 nt, hsa
gacuucccgucgccugcgagccugcggccugcuggagccugcgcagcuuggauggaga

SEQ ID NO: 572597 - RNA, 58 nt, hsa
uacaaaaccucaugccuacugucugccacugcuggagaaggaaucaugguuucuagaa

SEQ ID NO: 572598 - RNA, 58 nt, hsa
gauccauguauguguccagcacagcggccugcuggacucugagaacugggaaagauca

SEQ ID NO: 572599 - RNA, 58 nt, hsa
ggaaugccuggucuugagcaaccucccacugcuggagugcgagugggaaucagagccu

SEQ ID NO: 572600 - RNA, 58 nt, hsa
ucagaaaugaagggaaccccucagugggcugcuggacccaucuuucccaagccuugcc

SEQ ID NO: 572601 - RNA, 58 nt, hsa
uggggaccucaccugcuggggaccuuggcugcuggaggcugcaccuacugaggauguc

SEQ ID NO: 572602 - RNA, 58 nt, hsa
cgggaaccucaucugccuggggccucaccugcuggaguccuuuguggccaacccucuc

SEQ ID NO: 572603 - RNA, 58 nt, hsa
cacagcaaguggauccuggcaacugcagcugcuggauuccagauucuggguccccaau

SEQ ID NO: 572604 - RNA, 58 nt, hsa
gccucgagcccuggaucuccaagcucagcugcuggauucuggaugucaacaaaccuca

SEQ ID NO: 572605 - RNA, 58 nt, hsa
uuuuggccagaagggcccagccuggguucugcuggaagcugauguggaaggcuucccu

SEQ ID NO: 572606 - RNA, 58 nt, hsa
uugcaggagcuccuuugcauguucuaaacugcuggaggccuuugccagaguuaaauca

SEQ ID NO: 572607 - RNA, 58 nt, hsa
ugcccuaugggccugccgggcugagggccugcuggaggccucaggugcuguccauggg

SEQ ID NO: 572608 - RNA, 58 nt, hsa
ggcaaggguuaaggccugaaucaugagccugcuggaagcccagccccuacugcuguga

SEQ ID NO: 572609 - RNA, 58 nt, hsa
gauucaaaacuuauuagaacaguagcuucugcuggaauuugcaaucacugaagucaua

SEQ ID NO: 572610 - RNA, 58 nt, hsa
uuguuugcugucugucuccccugccccacugcuggaacagaggcuccaagaaaacagg

SEQ ID NO: 572611 - RNA, 58 nt, hsa
uuucacuuguguuuugucuuaaacccuacugcuggaaacaauuuuauguaauaagcaa

SEQ ID NO: 572612 - RNA, 58 nt, hsa
gguaguggccaucuuacauucucauguccugcuggaagugccuaguugccugcaaagc

SEQ ID NO: 572613 - RNA, 58 nt, hsa
uuggccaagcucggaggcuuggccagcacugcuggauggcucagagcaagcugggcuc

SEQ ID NO: 572614 - RNA, 58 nt, hsa
gcgcuuuggaaaccacauccgcaaagcccugcuggacauugcugaucuuuuccaaguu

SEQ ID NO: 572615 - RNA, 58 nt, hsa
gcccccaacuggccucccugagaugaaccugcuggagauguacagccugaaggaugag

SEQ ID NO: 572616 - RNA, 58 nt, hsa
ugaccucuucuucuguuaccgcuggcugcugcuggaacucaagcgugaguucgccuuc

SEQ ID NO: 572617 - RNA, 58 nt, hsa
auucaugcuguuccucugccuggccauccugcuggagcaccgcgaccacaucaugcgc

SEQ ID NO: 572618 - RNA, 64 nt, hsa; identical to SEQ ID NO: 299632

SEQ ID NO: 572619 - RNA, 64 nt, hsa; identical to SEQ ID NO: 299633

SEQ ID NO: 572620 - RNA, 51 nt, hsa; identical to SEQ ID NO: 299634

SEQ ID NO: 572621 - RNA, 64 nt, hsa; identical to SEQ ID NO: 299635

SEQ ID NO: 572622 - RNA, 64 nt, hsa; identical to SEQ ID NO: 299636

SEQ ID NO: 572623 - RNA, 64 nt, hsa; identical to SEQ ID NO: 299637

SEQ ID NO: 572624 - RNA, 64 nt, hsa; identical to SEQ ID NO: 299638

SEQ ID NO: 572625 - RNA, 64 nt, hsa; identical to SEQ ID NO: 299639

SEQ ID NO: 572626 - RNA, 64 nt, hsa; identical to SEQ ID NO: 299640

SEQ ID NO: 572627 - RNA, 64 nt, hsa; identical to SEQ ID NO: 299641

SEQ ID NO: 572628 - RNA, 64 nt, hsa; identical to SEQ ID NO: 299642

SEQ ID NO: 572629 - RNA, 64 nt, hsa; identical to SEQ ID NO: 299643

SEQ ID NO: 572630 - RNA, 64 nt, hsa; identical to SEQ ID NO: 299644

SEQ ID NO: 572631 - RNA, 64 nt, hsa; identical to SEQ ID NO: 299645

SEQ ID NO: 572632 - RNA, 64 nt, hsa; identical to SEQ ID NO: 299646

SEQ ID NO: 572633 - RNA, 64 nt, hsa; identical to SEQ ID NO: 299647

SEQ ID NO: 572634 - RNA, 64 nt, hsa; identical to SEQ ID NO: 299648

SEQ ID NO: 572635 - RNA, 64 nt, hsa
agauacuauugucagauucagguuuugaaauuugucaaauaaacaggauaacuguacauuuuuc

SEQ ID NO: 572636 - RNA, 64 nt, hsa
ggaaguguuuuuucaugucauagauuagcaauuuucaaauaauuauuuuuucucugaaaauuuu

SEQ ID NO: 572637 - RNA, 64 nt, hsa
ggggguuagucucuuuuauuugauucuuaaauauucaaauaaauauuaacaguaaaacauaaac

SEQ ID NO: 572638 - RNA, 64 nt, hsa
uccuuagaagggacagaacuaagaaauacauugcucaaauaauauuuuacuuuauugauaauga

SEQ ID NO: 572639 - RNA, 64 nt, hsa
acaaaguggcaagucugcccugaaccuguaagcaucaaauaagcaugagagagaaaaaaacaug

SEQ ID NO: 572640 - RNA, 64 nt, hsa
uauuuuuuaaauuuuuaaaauuugauuuuaaauuucaaauaaauuuaaauaaauuuuaaauaaa

SEQ ID NO: 572641 - RNA, 64 nt, hsa
ccgcaguauuuauuaaaacauacuuuuuuuuucuucaaauaaaaaaguaaccaugucuuugucu

SEQ ID NO: 572642 - RNA, 64 nt, hsa
gugauuuuuugccaucguugauaaaaaugcaaagucaaauaaaaggugucuugguuugauguca

SEQ ID NO: 572643 - RNA, 64 nt, hsa
uggaguuuuuaaagggacauuuuccuguacuuuuucaaauaaugauguuuaaaaauuaucuuga

SEQ ID NO: 572644 - RNA, 64 nt, hsa
aaagaaguugcugcccaguuaaaggggcucccucucaaauaaaucuccauccuucccucuccca

SEQ ID NO: 572645 - RNA, 64 nt, hsa
ugaaaacaaucagggcacauuaaaaugauacaagucaaauaaaucuuaaagacacaaugcacac

SEQ ID NO: 572646 - RNA, 64 nt, hsa
cccaggaagauuucaaggcagggagaagaacauuucaaauaagauucuuguuaacccauuuaug

SEQ ID NO: 572647 - RNA, 64 nt, hsa
aacucuuuauuuaaauauguguguuuuucaguauucaaauaagaucaggaagccaauuuucuau

SEQ ID NO: 572648 - RNA, 64 nt, hsa
uaugauucauauauuuuaugaaucagaauaaccuucaaauaaaauaaaucuaagucgguuaaaa

SEQ ID NO: 572649 - RNA, 64 nt, hsa
aaauguagagcacaauggaauuaugcuggaagucucaaauaauauuuuuuuccuauuuuauacu

SEQ ID NO: 572650 - RNA, 64 nt, hsa
uuaaggaaauucauuucuuaaaaauauaguguccucaaauaauuaauuuuuuugcaaacuuuag

SEQ ID NO: 572651 - RNA, 64 nt, hsa
gcuaagcuaauuuuauauuugguauacaugcaugucaaauaaaguuaauuuuacauacuauucu

SEQ ID NO: 572652 - RNA, 64 nt, hsa
uggguccuugaggccugccaguguguaaagguguucaaauaaagggcuguuucuacagguaaca

SEQ ID NO: 572653 - RNA, 64 nt, hsa
gaccauuaauuuuauuuguuuuuguucuauguaaucaaauaaaauuugaguaacauguaauggu

SEQ ID NO: 572654 - RNA, 64 nt, hsa
ccuaggaauguauuuugcuucaggauuuuuaaauucaaauaaggauggcagugcccauuuuaag

SEQ ID NO: 572655 - RNA, 64 nt, hsa
uccuuauuaaggcuuuaguaauuuguauguaaugucaaauaaaaggaauucaaaucugaguaaa

SEQ ID NO: 572656 - RNA, 64 nt, hsa
uuuuuaaaaaauuuuugaauucccauccuaauuuucaaauaaguuucaaggagacuaucaggau

SEQ ID NO: 572657 - RNA, 64 nt, hsa
cuaucaggauuauuauuuuaaagauuagauuuagucaaauaagucuuagcaggcaauaaaguuu

SEQ ID NO: 572658 - RNA, 64 nt, hsa
gaagaauaucaaauaauaaaguagcaaaacaaauucaaauaauccauuccaaaauacaauguua

SEQ ID NO: 572659 - RNA, 64 nt, hsa
aauaacuucauaagaugaacacuggagaagaauaucaaauaauaaaguagcaaaacaaauucaa

SEQ ID NO: 572660 - RNA, 64 nt, hsa
agagacucacucaggaagugacaggcccaucauaucaaauaacuuauucacuuuucauguggca

SEQ ID NO: 572661 - RNA, 64 nt, hsa
uaacuggggugcaaaccucuucaagaagguaacaucaaauaaauaagucaagcagaggacuucc

SEQ ID NO: 572662 - RNA, 64 nt, hsa
aauucuuaaaagauacauguggggaaaaguagucucaaauaaaagcuaauuucuuugaaaaugg

SEQ ID NO: 572663 - RNA, 64 nt, hsa
uuuuuugcuuuuaccuagauaaacuucuagcuaaucaaauaaggaaagaaacugucuuuuuaaa

SEQ ID NO: 572664 - RNA, 64 nt, hsa
aucagucucacuguuggcugucauugugacaaagucaaauaaacccccaaggacgacacacagu

SEQ ID NO: 572665 - RNA, 64 nt, hsa
ucuggcuucaggaaagucuagaagcaauauuucuucaaauaaaagguguuuaaacuuuuuucug

SEQ ID NO: 572666 - RNA, 64 nt, hsa
aguuuguagugaugggaaguguauuuuacucugaucaaauaaauaaugcuggaauacucaagaa

SEQ ID NO: 572667 - RNA, 64 nt, hsa
ugucaaaaucugaauauaucuggauauguacuaaucaaauaauaaucaaucaaucagcauauac

SEQ ID NO: 572668 - RNA, 64 nt, hsa
cagaaugaacuuugguaaccagaaauguaaaauuucaaauaacggauaaaauaauguguuauuu

SEQ ID NO: 572669 - RNA, 64 nt, hsa
aaauguuuuaucacucaaaaauccauuagaaguuucaaauaaauugcuuucuugcuagcuguau

SEQ ID NO: 572670 - RNA, 64 nt, hsa
cuacaaauaguuuuuguagcaaaugaaaauuucuucaaauaagccuuuuguuucaaauaaaacu

SEQ ID NO: 572671 - RNA, 64 nt, hsa
gcaaaugaaaauuucuucaaauaagccuuuuguuucaaauaaaacuugucucaaaacaugcuuc

SEQ ID NO: 572672 - RNA, 64 nt, hsa
cuguacaaggcugcuuguuuuuuuauugccaaagucaaauaaacgggagacugucaugcucaug

SEQ ID NO: 572673 - RNA, 64 nt, hsa
gagacugucaugcucaugcaugaauagaauuuagucaaauaaaaaauuuuggucauuugguacu

SEQ ID NO: 572674 - RNA, 64 nt, hsa
aaaaacuaugcuuuaaaggaauuacaucuuaugaucaaauaacuuucaggauguauuuuaaaug

SEQ ID NO: 572675 - RNA, 64 nt, hsa
cugguauuuucuguaucauauaaaacauuaaaauucaaauaauuauaagcauuuggcaaaaaca

SEQ ID NO: 572676 - RNA, 64 nt, hsa
cauauuugccaaaauuuuuguaaacccugucuugucaaauaaguguauaauauuguauuauuaa

SEQ ID NO: 572677 - RNA, 64 nt, hsa
ugguugccuagauucucucuggaaacugacuuugucaaauaaauagcagauuguagugucuggu

SEQ ID NO: 572678 - RNA, 64 nt, hsa
aggugugagaauugugugugugaaaaagcuggguucaaauaaguugguuuguuagacauucaua

SEQ ID NO: 572679 - RNA, 64 nt, hsa
cuuaaccaaaacuauucaaaaugaaaaccggauuucaaauaaccagacaccaagaugcagggcc

SEQ ID NO: 572680 - RNA, 64 nt, hsa
cccaggaauucaagguugguucaacaucuaaaaaucaaauaagcuaauauacagucaguucuca

SEQ ID NO: 572681 - RNA, 64 nt, hsa
guuaggaauucaagguuuguucaacaucuaaaaaucaaauaagcuaauaaagaaaagagguuua

SEQ ID NO: 572682 - RNA, 64 nt, hsa
cuuuaucucaguaggaaauuaaauaauucaaacaucaaauaacuucaauuuaaggcuauggacu

SEQ ID NO: 572683 - RNA, 64 nt, hsa
gauguuuccacguggcuauuuccaagcuuugccuucaaauaaauucuguacuuaaucauauauu

SEQ ID NO: 572684 - RNA, 64 nt, hsa
uugcugacaugguuuuauuagauacuguagugauucaaauaaguuuucuauuugaaaaaaaaaa

SEQ ID NO: 572685 - RNA, 64 nt, hsa
gucuggguauucauugguuauuggccugaaaugaucaaauaacuacaaaugaucuguugaauaa

SEQ ID NO: 572686 - RNA, 64 nt, hsa
aaucauuaaggaacccauuacugccauuuggaauucaaauaaccuaaccaaccuccaccuccuc

SEQ ID NO: 572687 - RNA, 64 nt, hsa
aacaaacaaaaaacaaaaaauccccacaacuuugucaaauaauguacaggcaaacacuuucaaa

SEQ ID NO: 572688 - RNA, 64 nt, hsa
uccuuccgucuuuucucccauuuuacaguauuacucaaauaagggcacacagugaucauauuag

SEQ ID NO: 572689 - RNA, 64 nt, hsa
agaacucugcccuuccuucuguucuuuugugcuuucaaauaacuaacacgaacuuccagaaaau

SEQ ID NO: 572690 - RNA, 64 nt, hsa
auguacuguaacuuuaucagugaaagguaaaaucucaaauaacaaguacaaacauugaacaauu

SEQ ID NO: 572691 - RNA, 64 nt, hsa
auuagcuuuguggcuuugugaaauucuaaaggaaucaaauaauucaucaugauuuaaauuuucu

SEQ ID NO: 572692 - RNA, 64 nt, hsa
uguggcaauuuuaaauuuauauugugugugauguucaaauaaagugguaucuacauucauguga

SEQ ID NO: 572693 - RNA, 64 nt, hsa
caucuaguagacuucugcacauguaaaauugaauucaaauaaaaucauacacacuuucuaguuc

SEQ ID NO: 572694 - RNA, 64 nt, hsa
ccucuauccuuuuuuccuuuccugaucaaggugcucuucucauuuuuuccugagaaccuuagcc

SEQ ID NO: 572695 - RNA, 64 nt, hsa
ccugaauuauuaaugaaugcccaggaaguaauuuucuucucauucuucuaaaacuacugccuuu

SEQ ID NO: 572696 - RNA, 64 nt, hsa
uauauauaauuuuguacguuuucuucaucuccgaucuucucaaauucuguacuuuuuuucuuuu

SEQ ID NO: 572697 - RNA, 64 nt, hsa
uuauaggcagggaugaaaugggcaccuagucagaucuucucagcuugcuagccagaaaugacug

SEQ ID NO: 572698 - RNA, 64 nt, hsa
gagaaggaaggauucaccaccuccaggaaaagugucuucucagaaacaaccagcugagaaggua

SEQ ID NO: 572699 - RNA, 64 nt, hsa
agaaauaaaggagggaccaauaucugggacagugucuucucagaaacaaccagcugagaaggua

SEQ ID NO: 572700 - RNA, 64 nt, hsa
aagaauaauggguggugggaaaucuggaacagugucuucucagaaacaaccagccucaaaggua

SEQ ID NO: 572701 - RNA, 64 nt, hsa
agaaauaaaggauggacuacagugugggacagugucuucucagaaacaaccagccuugaaggua

SEQ ID NO: 572702 - RNA, 64 nt, hsa
agaaauaaaggauggagaaaaaucugggacagugucuucucagaaacaaccagccuugaaggua

SEQ ID NO: 572703 - RNA, 64 nt, hsa
agaaauaaaggauggagaaaaaucugggacagugucuucucagaaaccaccagccuugacggua

SEQ ID NO: 572704 - RNA, 64 nt, hsa
aggaaaaaaggauggagaaauaucuaggaaagugucuucucagaaaccaccaaccuugaaggua

SEQ ID NO: 572705 - RNA, 64 nt, hsa
agaaaaaaaggauggagaaauaucuaggaaagugucuucucagaaaccaccagccuugaaggua

SEQ ID NO: 572706 - RNA, 64 nt, hsa
aggcauuuuggucaggucauuuguaggcaguuucucuucucacaaaagauguacuuaagcaggc

SEQ ID NO: 572707 - RNA, 64 nt, hsa
ccucgguucuuugucauucagauugcauuugaccucuucucaucuauuuauuucuuuauacauc

SEQ ID NO: 572708 - RNA, 64 nt, hsa
ccaccuuuguuacguugaaaucccucauuuauuuucuucucaaaaugcccauuauccaaaugca

SEQ ID NO: 572709 - RNA, 64 nt, hsa
gccguuggccugucaucagugagauacaauccagucuucucaugcacgggaacacacacacccu

SEQ ID NO: 572710 - RNA, 64 nt, hsa
aauaaguggggucaggcauucgaguuuuugucuuucuucucagguguauuucuugguaccccca

SEQ ID NO: 572711 - RNA, 64 nt, hsa
cuaccucucucgccuuuguucuuguugaagggucucuucucagcuaauuaacucugaaucaugg

SEQ ID NO: 572712 - RNA, 64 nt, hsa
uguaucaguauaaucuacgauucuguuagaaguaucuucucagcccugcuacugucugcugcuc

SEQ ID NO: 572713 - RNA, 64 nt, hsa
guuuucacagccacugcaggauucaucuuccacaucuucucaccucuucuugaaacaagcuaua

SEQ ID NO: 572714 - RNA, 64 nt, hsa
aaggcagcacuaugcugcaaacccagacggccacucuucucaccccucguccguuugcuguucu

SEQ ID NO: 572715 - RNA, 64 nt, hsa
agaacgcuccaccccaaaucaacagaauauacauucuucucagcaccacaucacacuuauuucc

SEQ ID NO: 572716 - RNA, 64 nt, hsa
guuggucaaauuuugcugccuguuucuaggguuuucuucucaguuucaucccugccuucccuuu

SEQ ID NO: 572717 - RNA, 64 nt, hsa
uuuacuuuaccauaggaugugagagggcagucauucuucucacugaguuuuuguuuaaaaacca

SEQ ID NO: 572718 - RNA, 64 nt, hsa
gggcauguuucucaauggaguggucacaggauucucuucucagaacucugccugaaaccuuucc

SEQ ID NO: 572719 - RNA, 64 nt, hsa
cacaguuggaagcagagccagucuuccuccucagucuucucaguagaaaggaacagaaaacaaa

SEQ ID NO: 572720 - RNA, 64 nt, hsa
ucauucccaguagcuguccugggacuuugggauuucuucucagcuuucuccaccuuucaguuuc

SEQ ID NO: 572721 - RNA, 64 nt, hsa
cccaaguuuuucagaaaccagcagagcugucaacucuucucaaaaucccaggcuggaaauuacc

SEQ ID NO: 572722 - RNA, 64 nt, hsa
cacuucuuaccccagccuacccuuccugcauuucucuucucagcucuuccaugauggauucccc

SEQ ID NO: 572723 - RNA, 64 nt, hsa
aaaccaacauccagaucuauagcagaguccuuauucuucucauaaaucuuuuuacuuuggcuac

SEQ ID NO: 572724 - RNA, 64 nt, hsa
uuucuucuucucauugcugaagccccucugugucucuucucagggacaggcugguccaguggcu

SEQ ID NO: 572725 - RNA, 64 nt, hsa
ucucugcuaagaagccaaaagaaauugguuuucuucuucucauugcugaagccccucugugucu

SEQ ID NO: 572726 - RNA, 64 nt, hsa
cacuguuugacaagucuuucauguguggaguuacucuucucaugcccaauuuucauuugaguuu

SEQ ID NO: 572727 - RNA, 64 nt, hsa
ggaaaaggagacuggaaugaaaggucugaaauuaucuucucaauuggacuccuuccagaaaggu

SEQ ID NO: 572728 - RNA, 64 nt, hsa
gguuggcaagaaaacauacuugaauuuucauucaucuucucagcagcugaagaaugucccuacc

SEQ ID NO: 572729 - RNA, 64 nt, hsa
gccaucccgauccuugcucuaccuggcuagaguuucuucucaucagagcacugggacauuaaac

SEQ ID NO: 572730 - RNA, 64 nt, hsa
ucaaaucauggugagggcugggcuuuugcuguccucuucucacgcagaguucugccaggagggu

SEQ ID NO: 572731 - RNA, 64 nt, hsa
uuaucaaaguaagaauacucagauuuccauaagcucuucucaccuccucuuagcccaacucaaa

SEQ ID NO: 572732 - RNA, 64 nt, hsa
caccuccucuuagcccaacucaaacuccaucagaucuucucaccuugauuuugagcuggaaugu

SEQ ID NO: 572733 - RNA, 64 nt, hsa
uuuucaagcaucuccugaggaucagaaaguaauuucuucucaaaggguacuuccacugauggaa

SEQ ID NO: 572734 - RNA, 64 nt, hsa
cucguuagggaagagaaacaggguguugucagcaucuucucacucccuucuccuugauaacagc

SEQ ID NO: 572735 - RNA, 64 nt, hsa
ucuuuuuauuuuacagauauuugugucgucacugucuucucaaaucauguguaagaguuuggag

SEQ ID NO: 572736 - RNA, 64 nt, hsa
caaggggaacugaagaguggagcucaguuuccucucuucucacccuccaccuguuccucauuug

SEQ ID NO: 572737 - RNA, 64 nt, hsa
auauuuuacuuaagaguauaaaacuaugcuaaauaaauuguauuguauauggaauaugcuugcc

SEQ ID NO: 572738 - RNA, 64 nt, hsa
uuucaaguaauaaaucugaauucuauuaguuuaaaaauuguaaaauucaaguuaaaugacgugu

SEQ ID NO: 572739 - RNA, 64 nt, hsa
augaaggaagguaaauaaaaaugcuaaauagaagaaauuguagguaagguaagaggaaucaagu

SEQ ID NO: 572740 - RNA, 64 nt, hsa
uuuauaaacauaaauuuuugagauauguauuuuaaaauuguagcacauguuucccugacauuuu

SEQ ID NO: 572741 - RNA, 64 nt, hsa
uuauaauauaaaucaaucuuauuacugagagugcaaauuguacaagguauuuacacauacaacu

SEQ ID NO: 572742 - RNA, 64 nt, hsa
cauuaucuguauuaaugcuugaauauuacuggauaaauuguaugaagaucuucugcagaaucag

SEQ ID NO: 572743 - RNA, 64 nt, hsa
uagccuuuacuguuugauauaccaaauuaaaaaaaaauuguaucucauuacuuauacugggaca

SEQ ID NO: 572744 - RNA, 64 nt, hsa
augaguuaucaugaauuuuaaaguaugcauuauuaaauuguaaaacuccaaggugauguuguac

SEQ ID NO: 572745 - RNA, 64 nt, hsa
gagguucacuuuuaaucuuuccuuugaaauuauuaaauuguaaaaacugacccauugaugucug

SEQ ID NO: 572746 - RNA, 64 nt, hsa
agcuuugcuuuucacgugauuaagacccuacuccaaauuguagaagcuuuucaggaaccauauu

SEQ ID NO: 572747 - RNA, 64 nt, hsa
uguuuugucucuuugcaacugauuuugcaaaaaaaaauuguagcuuuaaaauaacagggucuaa

SEQ ID NO: 572748 - RNA, 64 nt, hsa
ccuaucaauuuaucugaacuuuggucuuuucacuaaauuguacaguauucuacuucuguuuaaa

SEQ ID NO: 572749 - RNA, 64 nt, hsa
aacuggcaugguucguauuuuaaaaaucuugcacaaauuguaaugugauacugugaaacaaauu

SEQ ID NO: 572750 - RNA, 64 nt, hsa
cuggacuggguauaacuauguuauaggaaaguagaaauuguauucuuuauuuuccaucuuuguu

SEQ ID NO: 572751 - RNA, 64 nt, hsa
ucauuuuuguauuuuuucuauguugugaaaaccaaaauuguaauuuuauaagucuuugauucac

SEQ ID NO: 572752 - RNA, 64 nt, hsa
ucaauacauacugcuccuuugaaauuuggguaaaaaauuguacaaccguauauauagucauuuu

SEQ ID NO: 572753 - RNA, 64 nt, hsa
augguugcucaacauuuugaauguuaaugccacuaaauuguacccauaaaaaugguuaaaaugg

SEQ ID NO: 572754 - RNA, 64 nt, hsa
aauguauguuaccauuaauuucuauuugaccucuaaauuguaaaaugccuccaaaaguuuauuu

SEQ ID NO: 572755 - RNA, 64 nt, hsa
gacuauuuaacuugaggguaauaaacuuagaauaaaauuguaaaauuguauagagauaugcaga

SEQ ID NO: 572756 - RNA, 64 nt, hsa
aacuugaggguaauaaacuuagaauaaaauuguaaaauuguauagagauaugcagaaggaaggg

SEQ ID NO: 572757 - RNA, 64 nt, hsa
acuugauauucaacagccacuugagccaaauauaaaauuguauuuacagcugauggacucaauu

SEQ ID NO: 572758 - RNA, 64 nt, hsa
agaaacaagcuacucugacauuaugggagcuucaaaauuguaucaugauacagaaacacuccuu

SEQ ID NO: 572759 - RNA, 64 nt, hsa
uuaaaagacacuaaauuguacucuaaaagacacuaaauuguacuaauuguacaaaggucaagcc

SEQ ID NO: 572760 - RNA, 64 nt, hsa
guuuuaaauauuuaggaagcuuuuaaaagacacuaaauuguacucuaaaagacacuaaauugua

SEQ ID NO: 572761 - RNA, 64 nt, hsa
aaaguaacacugugucaucuucuggaguuaucaaaaauuguauacaaucaagacaacacaagaa

SEQ ID NO: 572762 - RNA, 64 nt, hsa
gaaaccuggcccagcuugcuggaaagcagguuuuaaauuguaaauauuccuuagaggagcaaau

SEQ ID NO: 572763 - RNA, 64 nt, hsa
ucuguaauacuaauauuuauuuacuuuguuucauaaauuguacauuuuuucuuaauguugugga

SEQ ID NO: 572764 - RNA, 64 nt, hsa
auuugaaauuaaccuauugggucugguacuuuuaaaauuguacagauguuugugccuuuucuuu

SEQ ID NO: 572765 - RNA, 64 nt, hsa
uguauguacauauaaaaauaaauuuugcucaauaaaauuguaagcuuaauguauaccuuuuaua

SEQ ID NO: 572766 - RNA, 64 nt, hsa
guuaguuagaaaauguuagguuuuaacuuaaaaaaaauuguauugugauuuucaauuuuauguu

SEQ ID NO: 572767 - RNA, 64 nt, hsa
aucacaauuuaguggagaguauuuauuugagccuaaauuguagguagcccuuacuacacucaac

SEQ ID NO: 572768 - RNA, 64 nt, hsa
aaagauagaaauuauauugauaaguaaauauguaaaauuguaaauauguaaaaaaaagaauggu

SEQ ID NO: 572769 - RNA, 64 nt, hsa
aacauguaauaauuuuuaacauuaaugauuccauaaauuguauuauugggauuagaaugugcuu

SEQ ID NO: 572770 - RNA, 64 nt, hsa
uucaaccagagacacaacuuucuggcagacagacaaauuguacaacaccaacaauauccuggac

SEQ ID NO: 572771 - RNA, 64 nt, hsa
auauuugggaguaguauaauuuguggagaaauguaaauuguaauaauguaaaugggggcuucaa

SEQ ID NO: 572772 - RNA, 64 nt, hsa
aucuggcucauuaaaaaauuuagcaauagaauguaaauuguauaaaaaguuugugaauaacuca

SEQ ID NO: 572773 - RNA, 64 nt, hsa
cgugggaauuuuaauguuuguuccaaaauagcagaaauuguaaaaauuaugaauuauuggagaa

SEQ ID NO: 572774 - RNA, 64 nt, hsa
auccuaccauucaagguuaucauauaauuuaacaaaauuguacaaccuuaaggcucuucacagu

SEQ ID NO: 572775 - RNA, 64 nt, hsa
aaagguuuauguaaacuugaauuuuaucugaacuaaauuguaucuuaaaauucauacaauuauu

SEQ ID NO: 572776 - RNA, 64 nt, hsa
uuucuuuuucuuuuaauaaagccugcaaguuacuaaauuguaguuucauaaauucuguaguaaa

SEQ ID NO: 572777 - RNA, 64 nt, hsa
aacuguacugccaauagaauucuggaauugugagaaauuguaucauugaaguucaguaggaugu

SEQ ID NO: 572778 - RNA, 64 nt, hsa
ccucaaugcgauucugagauauuugaauuucauaaaauuguaacugaaauuuaaaauuuuuagu

SEQ ID NO: 572779 - RNA, 64 nt, hsa
uauuuuaaggagcucccaaaauguguuaccuauuaaauuguaacucagcaaguagaagaccauu

SEQ ID NO: 572780 - RNA, 64 nt, hsa
ccuucuucccuaauguguuuuguaugugguuauaaaauuguagacuuuugugauuuugccaaag

SEQ ID NO: 572781 - RNA, 64 nt, hsa
caugaaaugaaacuuuguaacuuauuguaguuagaaauuguaacuuugauauugaauucucuug

SEQ ID NO: 572782 - RNA, 64 nt, hsa
auccuuaacauauauaguauauuuaaaaaauauaaaauuguauuguacuaaugugaugauggau

SEQ ID NO: 572783 - RNA, 64 nt, hsa
aggcucaucaguuuuagcaucucugcuccccagaaaauuguaagcauccucaccagccugugga

SEQ ID NO: 572784 - RNA, 64 nt, hsa
uuaagauuuugggguauuauuugugacucuccugaaauuguaaacuugugcuucuguguccagu

SEQ ID NO: 572785 - RNA, 64 nt, hsa
uccuguuaucuccuuguuugaauuucaggucauuaaauuguauaaccaucauuugaauuguagu

SEQ ID NO: 572786 - RNA, 64 nt, hsa
cugcugcuauaacuuccaguuuuacaucuuuguaaaauuguaucucaaaggcagaaaaggccau

SEQ ID NO: 572787 - RNA, 64 nt, hsa
uucauuguuucuguuacuaacauuaaaagugugcaaauuguauaaaauuagguacuucgauuag

SEQ ID NO: 572788 - RNA, 64 nt, hsa
aaccaaauguauagagcuuuggguguaggauaugaaauuguacuuagauuuaagaaaaagagaa

SEQ ID NO: 572789 - RNA, 64 nt, hsa
uggacugcuugaauuacauuggcuuuuagaaccgaaauuguaacuauguauuguauuucauggg

SEQ ID NO: 572790 - RNA, 64 nt, hsa
uuugcagcuguaucucacacuaugauuuacaauaaaauuguaaagauugacaauagacuuaaga

SEQ ID NO: 572791 - RNA, 64 nt, hsa
auucuaaccaguuaaccagccuuaguaugcauuaaaauuguauuguucagaaaguuuguuucuc

SEQ ID NO: 572792 - RNA, 64 nt, hsa
uugguuuuugaguuguuuuuucuuaauguaagaaaaauuguauuuuuuuuacaaguaucuucaa

SEQ ID NO: 572793 - RNA, 64 nt, hsa
uucuaauaaaacaaagcaaaucacauuuagcuucaaauuguaacaauucaauugaauuuuaaaa

SEQ ID NO: 572794 - RNA, 64 nt, hsa
aucaguuauggcacaauaaagauuuucuguuuuuaaauuguauuucaucugcuuccuccccauu

SEQ ID NO: 572795 - RNA, 64 nt, hsa
cuguuguguuuuaagauagaaaggaacaagacuaaaauuguaaauacuuuguaaacaucagcau

SEQ ID NO: 572796 - RNA, 64 nt, hsa
caaauuguguacaaacacuaaaaaaaacuuguuuaaauuguauuugcaauaaacaacaucaaau

SEQ ID NO: 572797 - RNA, 64 nt, hsa
ccaaaauaauuuuuagagaaaaugauguaaugaaaaauuguaccaugaauuaggagcauaguuu

SEQ ID NO: 572798 - RNA, 64 nt, hsa
gauaaaauugaaguacuuaauugaagcuuuuuaaaaauuguaaaguaaaugaaagcuauugaga

SEQ ID NO: 572799 - RNA, 64 nt, hsa
aacccuuuuuuccgucaaaauuggauuuguaauuaaauuguaagccucguaggauguauguugg

SEQ ID NO: 572800 - RNA, 64 nt, hsa
auuacccucuagcucuaacacugaaaauaauaauaaauuguagaucucugcaacuaaguuuaaa

SEQ ID NO: 572801 - RNA, 64 nt, hsa
ugugauuugagacauauacauauguuuguauuauaaauuguaagcaaucaguuugagauacuag

SEQ ID NO: 572802 - RNA, 64 nt, hsa
uauguuaauuuaccaccauacauuuuauuaaucaaaauuguauagcaugugacucuuuuggcuu

SEQ ID NO: 572803 - RNA, 64 nt, hsa
cucauguauauuuauaguaaugaaaagacuuuuuaaauuguacacguuucagugccuuucuugu

SEQ ID NO: 572804 - RNA, 64 nt, hsa
uuuuuauguuuuauuauacuuuguuaaaaaggacaaauuguacauuuuuagaauguuuuuauga

SEQ ID NO: 572805 - RNA, 64 nt, hsa
acagcuauuuaggggaauguuacguugaucucuuaaauuguaaacacuacaaaaugucaaaaua

SEQ ID NO: 572806 - RNA, 64 nt, hsa
auuuuauaaaugaucuuuuguacuuuaggacauuaaauuguacaacuuuuguauauauaaaagc

SEQ ID NO: 572807 - RNA, 64 nt, hsa
uguuaguugcucacuagaguuuaugucuuauauuaaauuguauacaguuuuuauucuaaccacu

SEQ ID NO: 572808 - RNA, 64 nt, hsa
acuuggcacaaaauuucuucaguuuauuaucuguaaauuguacaguuuucuuuuugaaaguuuu

SEQ ID NO: 572809 - RNA, 64 nt, hsa
ggaaaaaaauaaaugccuuugaaugaaaauucugaaauuguaaaugucuauuuuaauauucacc

SEQ ID NO: 572810 - RNA, 64 nt, hsa
uuuuaaacucuucaaauaucaugaacaagauacuaaauuguaccuaaggauuuguauuucuuua

SEQ ID NO: 572811 - RNA, 64 nt, hsa
augcagguucuagcugaaaaauucaacuauaagaaaauuguauuuauauaacauuuacuauuuu

SEQ ID NO: 572812 - RNA, 64 nt, hsa
aaccauucugggauuugggaacuucuuuaaaggaaaauuguaguagaggucaucuugauggaau

SEQ ID NO: 572813 - RNA, 64 nt, hsa
gugccucuuuguuuuuccccaaaccaaagcccucaaauuguagucucugucggcuucugcagaa

SEQ ID NO: 572814 - RNA, 64 nt, hsa
ugagccauugcgcccagccuugaagucauguucuaaauuguauuugaauuugugccucuuuguu

SEQ ID NO: 572815 - RNA, 64 nt, hsa
auauuuuuauaugaauuguuucauguauuuauaaaaauuguauauugaacauuggaaauagaug

SEQ ID NO: 572816 - RNA, 64 nt, hsa
aauaaagguuauucuaacuguggggagaaaaaaaaaauuguaucaaguuccacagguagcagac

SEQ ID NO: 572817 - RNA, 64 nt, hsa
aacauguuuaucguauuugaugcuacaggauuugaaauuguauuacaaauccaaugaaaugagu

SEQ ID NO: 572818 - RNA, 64 nt, hsa
gguuuaauaauuuuuaauuauauggcuugaguuuaaauuguaauaggcguaacuaauuuuaacu

SEQ ID NO: 572819 - RNA, 64 nt, hsa
gucacaugcugaguaaaagugccuuacaauguaaaaauuguacaguacuuauguucccaaguag

SEQ ID NO: 572820 - RNA, 64 nt, hsa
auauuuuguuccuguuauauuggcuuuauuuucaaaauuguaguuuguaguauuaguuuccuuu

SEQ ID NO: 572821 - RNA, 64 nt, hsa
cagugcagaauuaaaccguguugaagaccaguggaaauuguauaauuuaacuuggauuuaggca

SEQ ID NO: 572822 - RNA, 64 nt, hsa
acuuuuccaaugcacuguuguaugaaugcauuaaaaauuguaaaguaccaugcuuagaacugag

SEQ ID NO: 572823 - RNA, 64 nt, hsa
gggaggaaaguauuaaaaaaucuauaucgcuaguaaauuguaauaaguucuauuaaaacuugua

SEQ ID NO: 572824 - RNA, 64 nt, hsa
ucaccauagugauagcccauaaauaauugcuggaaaauuguauuuuauaacaguagaaaacaua

SEQ ID NO: 572825 - RNA, 64 nt, hsa; identical to SEQ ID NO: 206029

SEQ ID NO: 572826 - RNA, 64 nt, hsa; identical to SEQ ID NO: 206030

SEQ ID NO: 572827 - RNA, 64 nt, hsa; identical to SEQ ID NO: 206031

SEQ ID NO: 572828 - RNA, 64 nt, hsa; identical to SEQ ID NO: 206032

SEQ ID NO: 572829 - RNA, 64 nt, hsa; identical to SEQ ID NO: 206033

SEQ ID NO: 572830 - RNA, 64 nt, hsa; identical to SEQ ID NO: 206034

SEQ ID NO: 572831 - RNA, 64 nt, hsa; identical to SEQ ID NO: 206035

SEQ ID NO: 572832 - RNA, 64 nt, hsa; identical to SEQ ID NO: 206036

SEQ ID NO: 572833 - RNA, 64 nt, hsa; identical to SEQ ID NO: 206037

SEQ ID NO: 572834 - RNA, 64 nt, hsa; identical to SEQ ID NO: 206038

SEQ ID NO: 572835 - RNA, 64 nt, hsa; identical to SEQ ID NO: 206039

SEQ ID NO: 572836 - RNA, 64 nt, hsa; identical to SEQ ID NO: 206040

SEQ ID NO: 572837 - RNA, 64 nt, hsa; identical to SEQ ID NO: 206041

SEQ ID NO: 572838 - RNA, 64 nt, hsa; identical to SEQ ID NO: 206042

SEQ ID NO: 572839 - RNA, 64 nt, hsa; identical to SEQ ID NO: 206043

SEQ ID NO: 572840 - RNA, 64 nt, hsa; identical to SEQ ID NO: 206044

SEQ ID NO: 572841 - RNA, 64 nt, hsa; identical to SEQ ID NO: 206045

SEQ ID NO: 572842 - RNA, 64 nt, hsa; identical to SEQ ID NO: 206046

SEQ ID NO: 572843 - RNA, 64 nt, hsa; identical to SEQ ID NO: 206047

SEQ ID NO: 572844 - RNA, 64 nt, hsa; identical to SEQ ID NO: 206048

SEQ ID NO: 572845 - RNA, 64 nt, hsa; identical to SEQ ID NO: 206049

SEQ ID NO: 572846 - RNA, 64 nt, hsa; identical to SEQ ID NO: 206050

SEQ ID NO: 572847 - RNA, 64 nt, hsa; identical to SEQ ID NO: 206051

SEQ ID NO: 572848 - RNA, 64 nt, hsa; identical to SEQ ID NO: 206052

SEQ ID NO: 572849 - RNA, 64 nt, hsa; identical to SEQ ID NO: 206053

SEQ ID NO: 572850 - RNA, 64 nt, hsa; identical to SEQ ID NO: 206054

SEQ ID NO: 572851 - RNA, 64 nt, hsa; identical to SEQ ID NO: 206055

SEQ ID NO: 572852 - RNA, 64 nt, hsa; identical to SEQ ID NO: 206056

SEQ ID NO: 572853 - RNA, 64 nt, hsa; identical to SEQ ID NO: 206057

SEQ ID NO: 572854 - RNA, 64 nt, hsa; identical to SEQ ID NO: 206058

SEQ ID NO: 572855 - RNA, 64 nt, hsa; identical to SEQ ID NO: 206059

SEQ ID NO: 572856 - RNA, 64 nt, hsa; identical to SEQ ID NO: 206060

SEQ ID NO: 572857 - RNA, 64 nt, hsa; identical to SEQ ID NO: 206061

SEQ ID NO: 572858 - RNA, 64 nt, hsa; identical to SEQ ID NO: 206062

SEQ ID NO: 572859 - RNA, 64 nt, hsa; identical to SEQ ID NO: 206063

SEQ ID NO: 572860 - RNA, 64 nt, hsa; identical to SEQ ID NO: 206064

SEQ ID NO: 572861 - RNA, 64 nt, hsa; identical to SEQ ID NO: 206065

SEQ ID NO: 572862 - RNA, 64 nt, hsa; identical to SEQ ID NO: 206066

SEQ ID NO: 572863 - RNA, 64 nt, hsa; identical to SEQ ID NO: 206067

SEQ ID NO: 572864 - RNA, 64 nt, hsa; identical to SEQ ID NO: 206068

SEQ ID NO: 572865 - RNA, 64 nt, hsa; identical to SEQ ID NO: 206069

SEQ ID NO: 572866 - RNA, 64 nt, hsa; identical to SEQ ID NO: 206070

SEQ ID NO: 572867 - RNA, 64 nt, hsa; identical to SEQ ID NO: 206071

SEQ ID NO: 572868 - RNA, 64 nt, hsa; identical to SEQ ID NO: 206072

SEQ ID NO: 572869 - RNA, 64 nt, hsa; identical to SEQ ID NO: 206073

SEQ ID NO: 572870 - RNA, 64 nt, hsa; identical to SEQ ID NO: 206074

SEQ ID NO: 572871 - RNA, 64 nt, hsa; identical to SEQ ID NO: 206075

SEQ ID NO: 572872 - RNA, 64 nt, hsa; identical to SEQ ID NO: 206076

SEQ ID NO: 572873 - RNA, 64 nt, hsa; identical to SEQ ID NO: 206077

SEQ ID NO: 572874 - RNA, 64 nt, hsa; identical to SEQ ID NO: 206078

SEQ ID NO: 572875 - RNA, 64 nt, hsa
ucguaucugaguguaacuuugccaauauuuuaaaagccaaaauauucucuggacaacaaauuug

SEQ ID NO: 572876 - RNA, 64 nt, hsa
auuugcucaaagucacagagaaaauuaguggcaaagccaaaaagauucagaucuucugacucga

SEQ ID NO: 572877 - RNA, 64 nt, hsa
cuuuuaugcugaugaugguauuuggagaugugaaagccaaaagccccuggcagugguggggaau

SEQ ID NO: 572878 - RNA, 64 nt, hsa
ggagcagcuguggcuguuacauaaauagagaugcagccaaaauuuuaggccuuuuauccugcuu

SEQ ID NO: 572879 - RNA, 64 nt, hsa
ccuuaauuuaaugauaaaauuuaagcuaaacacaagccaaaaaugaauagguuuuuuuaauuuu

SEQ ID NO: 572880 - RNA, 64 nt, hsa
gaggucaaacguuguuuccuuagguugaaauagcagccaaaacauucuucacgcaggggcuugg

SEQ ID NO: 572881 - RNA, 64 nt, hsa
uggaccaggaugaagagggaucaaagagauaauuagccaaaaacccaguagccuagaagauaca

SEQ ID NO: 572882 - RNA, 64 nt, hsa
uguugagaaugaguaccacucucaccauugguauagccaaaaaagcuuggaagugaccaaggcu

SEQ ID NO: 572883 - RNA, 64 nt, hsa
ugaguaauugugacauggaccauaggcccuaaagagccaaaauaaauauacuuuggcacuuuuu

SEQ ID NO: 572884 - RNA, 64 nt, hsa
gguuuguauaccacaagcccucuuagcacgcaaaagccaaaaucuaaagaucaaccauuuaucc

SEQ ID NO: 572885 - RNA, 64 nt, hsa
aauagcaaagaauugacuggggcaauaacguuuaagccaaaacaauguuuaaaccuuuuuuggg

SEQ ID NO: 572886 - RNA, 64 nt, hsa
uuacuauuucacaacagccugacaacauuucuauagccaaaaauagcuaaauaccucaaucagu

SEQ ID NO: 572887 - RNA, 64 nt, hsa
gaauaccugucugccauguauuucaaucuuagugagccaaaauuguuuguuuguuacuacagaa

SEQ ID NO: 572888 - RNA, 64 nt, hsa
ccggaaguaaaucuauaucuguuagaaauaauguagccaaaagaauguaaauuugaggauuuuu

SEQ ID NO: 572889 - RNA, 64 nt, hsa
cuacauucuuacugguuuacauuaaaauccuuuaagccaaaaggaagcuugcucuauggauuua

SEQ ID NO: 572890 - RNA, 64 nt, hsa
uugccauagugcuguauuugaaaaucgaugcuuuagccaaaagcugaaugaccaccguuuccgu

SEQ ID NO: 572891 - RNA, 64 nt, hsa
agagguuuuuuaaaagacugucgccaaauagcugagccaaaaggcugaucagaauucacuuuuu

SEQ ID NO: 572892 - RNA, 64 nt, hsa
aaacaaaaauauuuuucccccuaaaauaggagagagccaaaacugaccaaggcuauucagcagu

SEQ ID NO: 572893 - RNA, 64 nt, hsa
cucuuuucagacacagcgguuuuuguuuccaagaagccaaaauuguuuagaauuugcuucccau

SEQ ID NO: 572894 - RNA, 64 nt, hsa
ugagugcuuguaacaaaauaaacaacaaaaacaaagccaaaaacuaccuuuauccauaugugaa

SEQ ID NO: 572895 - RNA, 64 nt, hsa
uaaguucaucuuugaaauacaucuuugugcguagagccaaaaaaagagauaaaauuaauaauag

SEQ ID NO: 572896 - RNA, 64 nt, hsa
auagaacccaaggaaugccuuccugucauauuuuagccaaaacaacugguuauaugccucccuu

SEQ ID NO: 572897 - RNA, 64 nt, hsa
caguaagggaacaaguugagcuaugacuuaacauagccaaaaugugagugguugaauaugauua

SEQ ID NO: 572898 - RNA, 64 nt, hsa
uuuuuugaacucuucucauuacuuguugccuauaagccaaaauuaagguguuugaaaauaguuu

SEQ ID NO: 572899 - RNA, 64 nt, hsa
gccuucauggagggugguaacagcaccucaguccagccaaaauguuuagaaacacucagucucu

SEQ ID NO: 572900 - RNA, 64 nt, hsa
agggaucccugcacccaggaggccuccugacaccagccaaaauccugacagcagggucugcccu

SEQ ID NO: 572901 - RNA, 64 nt, hsa; identical to SEQ ID NO: 171556

SEQ ID NO: 572902 - RNA, 64 nt, hsa; identical to SEQ ID NO: 171557

SEQ ID NO: 572903 - RNA, 64 nt, hsa; identical to SEQ ID NO: 171558

SEQ ID NO: 572904 - RNA, 64 nt, hsa; identical to SEQ ID NO: 171559

SEQ ID NO: 572905 - RNA, 64 nt, hsa; identical to SEQ ID NO: 171560

SEQ ID NO: 572906 - RNA, 64 nt, hsa; identical to SEQ ID NO: 171561

SEQ ID NO: 572907 - RNA, 64 nt, hsa; identical to SEQ ID NO: 171562

SEQ ID NO: 572908 - RNA, 64 nt, hsa; identical to SEQ ID NO: 171563

SEQ ID NO: 572909 - RNA, 64 nt, hsa; identical to SEQ ID NO: 171564

SEQ ID NO: 572910 - RNA, 64 nt, hsa; identical to SEQ ID NO: 171565

SEQ ID NO: 572911 - RNA, 64 nt, hsa; identical to SEQ ID NO: 171566

SEQ ID NO: 572912 - RNA, 64 nt, hsa; identical to SEQ ID NO: 171567

SEQ ID NO: 572913 - RNA, 64 nt, hsa; identical to SEQ ID NO: 171568

SEQ ID NO: 572914 - RNA, 64 nt, hsa; identical to SEQ ID NO: 171569

SEQ ID NO: 572915 - RNA, 64 nt, hsa; identical to SEQ ID NO: 171570

SEQ ID NO: 572916 - RNA, 64 nt, hsa; identical to SEQ ID NO: 171571

SEQ ID NO: 572917 - RNA, 64 nt, hsa; identical to SEQ ID NO: 171572

SEQ ID NO: 572918 - RNA, 64 nt, hsa; identical to SEQ ID NO: 171573

SEQ ID NO: 572919 - RNA, 64 nt, hsa; identical to SEQ ID NO: 171574

SEQ ID NO: 572920 - RNA, 64 nt, hsa; identical to SEQ ID NO: 171575

SEQ ID NO: 572921 - RNA, 64 nt, hsa; identical to SEQ ID NO: 171576

SEQ ID NO: 572922 - RNA, 64 nt, hsa; identical to SEQ ID NO: 171577

SEQ ID NO: 572923 - RNA, 64 nt, hsa; identical to SEQ ID NO: 171578

SEQ ID NO: 572924 - RNA, 64 nt, hsa; identical to SEQ ID NO: 171579

SEQ ID NO: 572925 - RNA, 64 nt, hsa; identical to SEQ ID NO: 171580

SEQ ID NO: 572926 - RNA, 64 nt, hsa; identical to SEQ ID NO: 171581

SEQ ID NO: 572927 - RNA, 64 nt, hsa; identical to SEQ ID NO: 171582

SEQ ID NO: 572928 - RNA, 64 nt, hsa; identical to SEQ ID NO: 171583

SEQ ID NO: 572929 - RNA, 64 nt, hsa; identical to SEQ ID NO: 171584

SEQ ID NO: 572930 - RNA, 64 nt, hsa; identical to SEQ ID NO: 171585

SEQ ID NO: 572931 - RNA, 64 nt, hsa; identical to SEQ ID NO: 171586

SEQ ID NO: 572932 - RNA, 64 nt, hsa; identical to SEQ ID NO: 171587

SEQ ID NO: 572933 - RNA, 64 nt, hsa; identical to SEQ ID NO: 171588

SEQ ID NO: 572934 - RNA, 64 nt, hsa; identical to SEQ ID NO: 171589

SEQ ID NO: 572935 - RNA, 64 nt, hsa; identical to SEQ ID NO: 171590

SEQ ID NO: 572936 - RNA, 64 nt, hsa; identical to SEQ ID NO: 171591

SEQ ID NO: 572937 - RNA, 64 nt, hsa; identical to SEQ ID NO: 171592

SEQ ID NO: 572938 - RNA, 64 nt, hsa; identical to SEQ ID NO: 171593

SEQ ID NO: 572939 - RNA, 64 nt, hsa; identical to SEQ ID NO: 171594

SEQ ID NO: 572940 - RNA, 64 nt, hsa; identical to SEQ ID NO: 171595

SEQ ID NO: 572941 - RNA, 64 nt, hsa; identical to SEQ ID NO: 171596

SEQ ID NO: 572942 - RNA, 64 nt, hsa; identical to SEQ ID NO: 171597

SEQ ID NO: 572943 - RNA, 64 nt, hsa; identical to SEQ ID NO: 171598

SEQ ID NO: 572944 - RNA, 64 nt, hsa; identical to SEQ ID NO: 171599

SEQ ID NO: 572945 - RNA, 64 nt, hsa; identical to SEQ ID NO: 171600

SEQ ID NO: 572946 - RNA, 64 nt, hsa; identical to SEQ ID NO: 171601

SEQ ID NO: 572947 - RNA, 64 nt, hsa; identical to SEQ ID NO: 171602

SEQ ID NO: 572948 - RNA, 64 nt, hsa; identical to SEQ ID NO: 171603

SEQ ID NO: 572949 - RNA, 64 nt, hsa; identical to SEQ ID NO: 171604

SEQ ID NO: 572950 - RNA, 64 nt, hsa; identical to SEQ ID NO: 171605

SEQ ID NO: 572951 - RNA, 64 nt, hsa; identical to SEQ ID NO: 171606

SEQ ID NO: 572952 - RNA, 64 nt, hsa; identical to SEQ ID NO: 171607

SEQ ID NO: 572953 - RNA, 64 nt, hsa; identical to SEQ ID NO: 171608

SEQ ID NO: 572954 - RNA, 64 nt, hsa; identical to SEQ ID NO: 171609

SEQ ID NO: 572955 - RNA, 64 nt, hsa; identical to SEQ ID NO: 171610

SEQ ID NO: 572956 - RNA, 64 nt, hsa; identical to SEQ ID NO: 171611

SEQ ID NO: 572957 - RNA, 64 nt, hsa; identical to SEQ ID NO: 171612

SEQ ID NO: 572958 - RNA, 64 nt, hsa; identical to SEQ ID NO: 171613

SEQ ID NO: 572959 - RNA, 64 nt, hsa; identical to SEQ ID NO: 171614

SEQ ID NO: 572960 - RNA, 64 nt, hsa; identical to SEQ ID NO: 171615

SEQ ID NO: 572961 - RNA, 64 nt, hsa; identical to SEQ ID NO: 171616

SEQ ID NO: 572962 - RNA, 64 nt, hsa; identical to SEQ ID NO: 171617

SEQ ID NO: 572963 - RNA, 64 nt, hsa; identical to SEQ ID NO: 171618

SEQ ID NO: 572964 - RNA, 64 nt, hsa; identical to SEQ ID NO: 171619

SEQ ID NO: 572965 - RNA, 64 nt, hsa; identical to SEQ ID NO: 171620

SEQ ID NO: 572966 - RNA, 64 nt, hsa; identical to SEQ ID NO: 171621

SEQ ID NO: 572967 - RNA, 64 nt, hsa; identical to SEQ ID NO: 171622

SEQ ID NO: 572968 - RNA, 64 nt, hsa; identical to SEQ ID NO: 171623

SEQ ID NO: 572969 - RNA, 64 nt, hsa; identical to SEQ ID NO: 171624

SEQ ID NO: 572970 - RNA, 64 nt, hsa; identical to SEQ ID NO: 171625

SEQ ID NO: 572971 - RNA, 64 nt, hsa; identical to SEQ ID NO: 171626

SEQ ID NO: 572972 - RNA, 64 nt, hsa; identical to SEQ ID NO: 171627

SEQ ID NO: 572973 - RNA, 64 nt, hsa; identical to SEQ ID NO: 171628

SEQ ID NO: 572974 - RNA, 64 nt, hsa; identical to SEQ ID NO: 235822

SEQ ID NO: 572975 - RNA, 64 nt, hsa; identical to SEQ ID NO: 235823

SEQ ID NO: 572976 - RNA, 64 nt, hsa; identical to SEQ ID NO: 235824

SEQ ID NO: 572977 - RNA, 64 nt, hsa; identical to SEQ ID NO: 235825

SEQ ID NO: 572978 - RNA, 64 nt, hsa; identical to SEQ ID NO: 235826

SEQ ID NO: 572979 - RNA, 64 nt, hsa; identical to SEQ ID NO: 235827

SEQ ID NO: 572980 - RNA, 64 nt, hsa; identical to SEQ ID NO: 235828

SEQ ID NO: 572981 - RNA, 64 nt, hsa; identical to SEQ ID NO: 235829

SEQ ID NO: 572982 - RNA, 64 nt, hsa; identical to SEQ ID NO: 235830

SEQ ID NO: 572983 - RNA, 64 nt, hsa; identical to SEQ ID NO: 235831

SEQ ID NO: 572984 - RNA, 64 nt, hsa; identical to SEQ ID NO: 235832

SEQ ID NO: 572985 - RNA, 64 nt, hsa; identical to SEQ ID NO: 235833

SEQ ID NO: 572986 - RNA, 64 nt, hsa; identical to SEQ ID NO: 235834

SEQ ID NO: 572987 - RNA, 64 nt, hsa; identical to SEQ ID NO: 235835

SEQ ID NO: 572988 - RNA, 64 nt, hsa; identical to SEQ ID NO: 235836

SEQ ID NO: 572989 - RNA, 64 nt, hsa; identical to SEQ ID NO: 235837

SEQ ID NO: 572990 - RNA, 64 nt, hsa; identical to SEQ ID NO: 235838

SEQ ID NO: 572991 - RNA, 64 nt, hsa; identical to SEQ ID NO: 235839

SEQ ID NO: 572992 - RNA, 64 nt, hsa; identical to SEQ ID NO: 235840

SEQ ID NO: 572993 - RNA, 64 nt, hsa; identical to SEQ ID NO: 235841

SEQ ID NO: 572994 - RNA, 64 nt, hsa; identical to SEQ ID NO: 235842

SEQ ID NO: 572995 - RNA, 64 nt, hsa; identical to SEQ ID NO: 235843

SEQ ID NO: 572996 - RNA, 64 nt, hsa; identical to SEQ ID NO: 235844

SEQ ID NO: 572997 - RNA, 64 nt, hsa; identical to SEQ ID NO: 235845

SEQ ID NO: 572998 - RNA, 55 nt, hsa; identical to SEQ ID NO: 235846

SEQ ID NO: 572999 - RNA, 64 nt, hsa; identical to SEQ ID NO: 235847

SEQ ID NO: 573000 - RNA, 64 nt, hsa; identical to SEQ ID NO: 235848

SEQ ID NO: 573001 - RNA, 64 nt, hsa; identical to SEQ ID NO: 235849

SEQ ID NO: 573002 - RNA, 64 nt, hsa; identical to SEQ ID NO: 235850

SEQ ID NO: 573003 - RNA, 64 nt, hsa; identical to SEQ ID NO: 235851

SEQ ID NO: 573004 - RNA, 64 nt, hsa; identical to SEQ ID NO: 235852

SEQ ID NO: 573005 - RNA, 64 nt, hsa; identical to SEQ ID NO: 235853

SEQ ID NO: 573006 - RNA, 64 nt, hsa; identical to SEQ ID NO: 235854

SEQ ID NO: 573007 - RNA, 64 nt, hsa; identical to SEQ ID NO: 235855

SEQ ID NO: 573008 - RNA, 64 nt, hsa; identical to SEQ ID NO: 235856

SEQ ID NO: 573009 - RNA, 64 nt, hsa; identical to SEQ ID NO: 235857

SEQ ID NO: 573010 - RNA, 64 nt, hsa; identical to SEQ ID NO: 235858

SEQ ID NO: 573011 - RNA, 64 nt, hsa; identical to SEQ ID NO: 235859

SEQ ID NO: 573012 - RNA, 64 nt, hsa; identical to SEQ ID NO: 235860

SEQ ID NO: 573013 - RNA, 64 nt, hsa; identical to SEQ ID NO: 235861

SEQ ID NO: 573014 - RNA, 64 nt, hsa; identical to SEQ ID NO: 235862

SEQ ID NO: 573015 - RNA, 64 nt, hsa; identical to SEQ ID NO: 235863

SEQ ID NO: 573016 - RNA, 64 nt, hsa; identical to SEQ ID NO: 235864

SEQ ID NO: 573017 - RNA, 64 nt, hsa; identical to SEQ ID NO: 235865

SEQ ID NO: 573018 - RNA, 64 nt, hsa; identical to SEQ ID NO: 235866

SEQ ID NO: 573019 - RNA, 64 nt, hsa; identical to SEQ ID NO: 235867

SEQ ID NO: 573020 - RNA, 64 nt, hsa; identical to SEQ ID NO: 235868

SEQ ID NO: 573021 - RNA, 64 nt, hsa; identical to SEQ ID NO: 235869

SEQ ID NO: 573022 - RNA, 64 nt, hsa; identical to SEQ ID NO: 235870

SEQ ID NO: 573023 - RNA, 64 nt, hsa; identical to SEQ ID NO: 235871

SEQ ID NO: 573024 - RNA, 64 nt, hsa; identical to SEQ ID NO: 235872

SEQ ID NO: 573025 - RNA, 64 nt, hsa; identical to SEQ ID NO: 235873

SEQ ID NO: 573026 - RNA, 64 nt, hsa; identical to SEQ ID NO: 235874

SEQ ID NO: 573027 - RNA, 64 nt, hsa; identical to SEQ ID NO: 235875

SEQ ID NO: 573028 - RNA, 64 nt, hsa; identical to SEQ ID NO: 235876

SEQ ID NO: 573029 - RNA, 64 nt, hsa; identical to SEQ ID NO: 235877

SEQ ID NO: 573030 - RNA, 64 nt, hsa; identical to SEQ ID NO: 235878

SEQ ID NO: 573031 - RNA, 64 nt, hsa; identical to SEQ ID NO: 235879

SEQ ID NO: 573032 - RNA, 64 nt, hsa; identical to SEQ ID NO: 235880

SEQ ID NO: 573033 - RNA, 64 nt, hsa; identical to SEQ ID NO: 235881

SEQ ID NO: 573034 - RNA, 64 nt, hsa; identical to SEQ ID NO: 235882

SEQ ID NO: 573035 - RNA, 64 nt, hsa; identical to SEQ ID NO: 235883

SEQ ID NO: 573036 - RNA, 64 nt, hsa; identical to SEQ ID NO: 235884

SEQ ID NO: 573037 - RNA, 64 nt, hsa; identical to SEQ ID NO: 235885

SEQ ID NO: 573038 - RNA, 64 nt, hsa; identical to SEQ ID NO: 235886

SEQ ID NO: 573039 - RNA, 64 nt, hsa; identical to SEQ ID NO: 310683

SEQ ID NO: 573040 - RNA, 64 nt, hsa; identical to SEQ ID NO: 310684

SEQ ID NO: 573041 - RNA, 64 nt, hsa; identical to SEQ ID NO: 246269

SEQ ID NO: 573042 - RNA, 64 nt, hsa; identical to SEQ ID NO: 246270

SEQ ID NO: 573043 - RNA, 64 nt, hsa; identical to SEQ ID NO: 246271

SEQ ID NO: 573044 - RNA, 64 nt, hsa; identical to SEQ ID NO: 246272

SEQ ID NO: 573045 - RNA, 64 nt, hsa; identical to SEQ ID NO: 246273

SEQ ID NO: 573046 - RNA, 64 nt, hsa; identical to SEQ ID NO: 246274

SEQ ID NO: 573047 - RNA, 64 nt, hsa; identical to SEQ ID NO: 246275

SEQ ID NO: 573048 - RNA, 64 nt, hsa; identical to SEQ ID NO: 246276

SEQ ID NO: 573049 - RNA, 51 nt, hsa; identical to SEQ ID NO: 246277

SEQ ID NO: 573050 - RNA, 64 nt, hsa; identical to SEQ ID NO: 246278

SEQ ID NO: 573051 - RNA, 64 nt, hsa; identical to SEQ ID NO: 246279

SEQ ID NO: 573052 - RNA, 56 nt, hsa; identical to SEQ ID NO: 246280

SEQ ID NO: 573053 - RNA, 64 nt, hsa; identical to SEQ ID NO: 246281

SEQ ID NO: 573054 - RNA, 64 nt, hsa; identical to SEQ ID NO: 246282

SEQ ID NO: 573055 - RNA, 64 nt, hsa; identical to SEQ ID NO: 246283

SEQ ID NO: 573056 - RNA, 64 nt, hsa; identical to SEQ ID NO: 246284

SEQ ID NO: 573057 - RNA, 64 nt, hsa; identical to SEQ ID NO: 246285

SEQ ID NO: 573058 - RNA, 64 nt, hsa; identical to SEQ ID NO: 246286

SEQ ID NO: 573059 - RNA, 64 nt, hsa; identical to SEQ ID NO: 246287

SEQ ID NO: 573060 - RNA, 64 nt, hsa; identical to SEQ ID NO: 246288

SEQ ID NO: 573061 - RNA, 64 nt, hsa; identical to SEQ ID NO: 246289

SEQ ID NO: 573062 - RNA, 64 nt, hsa; identical to SEQ ID NO: 246290

SEQ ID NO: 573063 - RNA, 64 nt, hsa; identical to SEQ ID NO: 246291

SEQ ID NO: 573064 - RNA, 64 nt, hsa; identical to SEQ ID NO: 246292

SEQ ID NO: 573065 - RNA, 64 nt, hsa; identical to SEQ ID NO: 246293

SEQ ID NO: 573066 - RNA, 64 nt, hsa; identical to SEQ ID NO: 246294

SEQ ID NO: 573067 - RNA, 64 nt, hsa; identical to SEQ ID NO: 246295

SEQ ID NO: 573068 - RNA, 64 nt, hsa; identical to SEQ ID NO: 246296

SEQ ID NO: 573069 - RNA, 64 nt, hsa; identical to SEQ ID NO: 246297

SEQ ID NO: 573070 - RNA, 64 nt, hsa; identical to SEQ ID NO: 246298

SEQ ID NO: 573071 - RNA, 64 nt, hsa; identical to SEQ ID NO: 246299

SEQ ID NO: 573072 - RNA, 64 nt, hsa; identical to SEQ ID NO: 246300

SEQ ID NO: 573073 - RNA, 64 nt, hsa; identical to SEQ ID NO: 246301

SEQ ID NO: 573074 - RNA, 64 nt, hsa
cggacgggccugugccguggggaagcagacacaacccaaacauuugcuacuaacauaggaaaca

SEQ ID NO: 573075 - RNA, 64 nt, hsa
agcauauuguggauuggaaaggcugcgacagccccccaaacaggaaagacaaaaaacaaacaaa

SEQ ID NO: 573076 - RNA, 64 nt, hsa
acaccaagcagaauucugcauggugacagucucccccaaacauggccugcugggcccaagugag

SEQ ID NO: 573077 - RNA, 64 nt, hsa
agccagccaaggccgcuguggccuucagggucuccccaaacagugggcugcuagaagcacgauc

SEQ ID NO: 573078 - RNA, 64 nt, hsa
gugguagagaagaugaggguuaacuuuagccuuucccaaacacuggcaacaaccacuuccucaa

SEQ ID NO: 573079 - RNA, 64 nt, hsa
ccaguuuccaacacacucaagagagagccccaaccccaaacacagaguuucauggaaaccccac

SEQ ID NO: 573080 - RNA, 64 nt, hsa
ugugaauuuccaguuuuuuuuuaauuauuuuaaucccaaacaucuuccugaaaauaacauuccc

SEQ ID NO: 573081 - RNA, 64 nt, hsa
gcagccuccucgugauccucccuagcauaaauuucccaaacaguccacaggucccaugcccacu

SEQ ID NO: 573082 - RNA, 64 nt, hsa
auguggucuacaucucagccuuccugaccucugccccaaacacacgcugcaauuuugucuccuc

SEQ ID NO: 573083 - RNA, 64 nt, hsa
augaaaagauaggacggaugugauaugaaaaaaacccaaacauuuuggcauugaaugauggcua

SEQ ID NO: 573084 - RNA, 64 nt, hsa
aaucugaaaggccgggauaaaccuaaucacuguucccaaacauugacaaauccuaacccaacca

SEQ ID NO: 573085 - RNA, 64 nt, hsa
ggaacacaugagguuagggacccuuguucagcaccccaaacagccugccuguuuaaagcaggca

SEQ ID NO: 573086 - RNA, 64 nt, hsa
gcugcugucuauuucugugcacuuaacaauggaacccaaacagaagagaauaaagccuugauac

SEQ ID NO: 573087 - RNA, 64 nt, hsa
gaugauugcguagauguugccuggugcaaagugccccaaacagcaauagaaaggcauauguaua

SEQ ID NO: 573088 - RNA, 61 nt, hsa
cgagugauaauacaguuuuacugcaaaagaagcacuucaaaccuauuauguccuuagaacu

SEQ ID NO: 573089 - RNA, 61 nt, hsa
cgaaugucaaaaacaaaugcgacaaacaauggcacuucaucauuuaaaguaauguugccaa

SEQ ID NO: 573090 - RNA, 61 nt, hsa
cucguggccuagcacugguguugagcaaugugcacuucacuggagagaaagaacuggaauu

SEQ ID NO: 573091 - RNA, 61 nt, hsa
cuuacuauucccacuuucauucaaucaaccugcacuucauaucuagauuucuagaaaagcu

SEQ ID NO: 573092 - RNA, 61 nt, hsa
ccugggaaccuggucugauuccuuccaacgugcacuucagcuggagaaagaaaccaagaag

SEQ ID NO: 573093 - RNA, 61 nt, hsa
gcucuucuuuuuaggaaggcucuggugcagagcacuucaaauauguccucaggccagauac

SEQ ID NO: 573094 - RNA, 64 nt, hsa
ccuaggggcggaaagaagacccgguccugcccgagcucaacaaucccagggcgggagcccauac

SEQ ID NO: 573095 - RNA, 64 nt, hsa
accucccucuccccaacgaggcauggagaccccagcucaacacgcccccucuccauuguuucca

SEQ ID NO: 573096 - RNA, 64 nt, hsa
cacugccccucagcaaggaugacucagcacugccgcucaacagacaugacucagggauggcuua

SEQ ID NO: 573097 - RNA, 64 nt, hsa
cacugccccucagcaaggaugacucagcacugccgcucaacagggaugacucagggauggcuua

SEQ ID NO: 573098 - RNA, 64 nt, hsa; identical to SEQ ID NO: 573096

SEQ ID NO: 573099 - RNA, 64 nt, hsa
cacugccccucaccaaggaugacucagcacugccgcucaacagacaugacucagggauggcuua

SEQ ID NO: 573100 - RNA, 64 nt, hsa; identical to SEQ ID NO: 83678

SEQ ID NO: 573101 - RNA, 64 nt, hsa; identical to SEQ ID NO: 83679

SEQ ID NO: 573102 - RNA, 64 nt, hsa; identical to SEQ ID NO: 83680

SEQ ID NO: 573103 - RNA, 64 nt, hsa; identical to SEQ ID NO: 83681

SEQ ID NO: 573104 - RNA, 64 nt, hsa; identical to SEQ ID NO: 83682

SEQ ID NO: 573105 - RNA, 64 nt, hsa; identical to SEQ ID NO: 83683

SEQ ID NO: 573106 - RNA, 64 nt, hsa; identical to SEQ ID NO: 83684

SEQ ID NO: 573107 - RNA, 64 nt, hsa; identical to SEQ ID NO: 83685

SEQ ID NO: 573108 - RNA, 64 nt, hsa; identical to SEQ ID NO: 83686

SEQ ID NO: 573109 - RNA, 64 nt, hsa; identical to SEQ ID NO: 83687

SEQ ID NO: 573110 - RNA, 64 nt, hsa; identical to SEQ ID NO: 83688

SEQ ID NO: 573111 - RNA, 64 nt, hsa; identical to SEQ ID NO: 83689

SEQ ID NO: 573112 - RNA, 64 nt, hsa; identical to SEQ ID NO: 83690

SEQ ID NO: 573113 - RNA, 64 nt, hsa; identical to SEQ ID NO: 83691

SEQ ID NO: 573114 - RNA, 64 nt, hsa; identical to SEQ ID NO: 83692

SEQ ID NO: 573115 - RNA, 64 nt, hsa; identical to SEQ ID NO: 83693

SEQ ID NO: 573116 - RNA, 64 nt, hsa; identical to SEQ ID NO: 83694

SEQ ID NO: 573117 - RNA, 64 nt, hsa; identical to SEQ ID NO: 83695

SEQ ID NO: 573118 - RNA, 64 nt, hsa; identical to SEQ ID NO: 83696

SEQ ID NO: 573119 - RNA, 64 nt, hsa; identical to SEQ ID NO: 83697

SEQ ID NO: 573120 - RNA, 64 nt, hsa; identical to SEQ ID NO: 83698

SEQ ID NO: 573121 - RNA, 64 nt, hsa; identical to SEQ ID NO: 83699

SEQ ID NO: 573122 - RNA, 64 nt, hsa; identical to SEQ ID NO: 83700

SEQ ID NO: 573123 - RNA, 64 nt, hsa; identical to SEQ ID NO: 83701

SEQ ID NO: 573124 - RNA, 64 nt, hsa; identical to SEQ ID NO: 83702

SEQ ID NO: 573125 - RNA, 64 nt, hsa; identical to SEQ ID NO: 83703

SEQ ID NO: 573126 - RNA, 64 nt, hsa; identical to SEQ ID NO: 83704

SEQ ID NO: 573127 - RNA, 64 nt, hsa; identical to SEQ ID NO: 83705

SEQ ID NO: 573128 - RNA, 64 nt, hsa; identical to SEQ ID NO: 83706

SEQ ID NO: 573129 - RNA, 64 nt, hsa; identical to SEQ ID NO: 83707

SEQ ID NO: 573130 - RNA, 64 nt, hsa; identical to SEQ ID NO: 83708

SEQ ID NO: 573131 - RNA, 64 nt, hsa; identical to SEQ ID NO: 83709

SEQ ID NO: 573132 - RNA, 64 nt, hsa; identical to SEQ ID NO: 83710

SEQ ID NO: 573133 - RNA, 64 nt, hsa; identical to SEQ ID NO: 83711

SEQ ID NO: 573134 - RNA, 64 nt, hsa; identical to SEQ ID NO: 83712

SEQ ID NO: 573135 - RNA, 64 nt, hsa; identical to SEQ ID NO: 83713

SEQ ID NO: 573136 - RNA, 64 nt, hsa; identical to SEQ ID NO: 83714

SEQ ID NO: 573137 - RNA, 64 nt, hsa; identical to SEQ ID NO: 83715

SEQ ID NO: 573138 - RNA, 64 nt, hsa; identical to SEQ ID NO: 83716

SEQ ID NO: 573139 - RNA, 64 nt, hsa; identical to SEQ ID NO: 83717

SEQ ID NO: 573140 - RNA, 64 nt, hsa; identical to SEQ ID NO: 83718

SEQ ID NO: 573141 - RNA, 64 nt, hsa; identical to SEQ ID NO: 83719

SEQ ID NO: 573142 - RNA, 64 nt, hsa; identical to SEQ ID NO: 83720

SEQ ID NO: 573143 - RNA, 64 nt, hsa; identical to SEQ ID NO: 83721

SEQ ID NO: 573144 - RNA, 64 nt, hsa; identical to SEQ ID NO: 83722

SEQ ID NO: 573145 - RNA, 64 nt, hsa; identical to SEQ ID NO: 83723

SEQ ID NO: 573146 - RNA, 64 nt, hsa; identical to SEQ ID NO: 83724

SEQ ID NO: 573147 - RNA, 64 nt, hsa; identical to SEQ ID NO: 83725

SEQ ID NO: 573148 - RNA, 64 nt, hsa; identical to SEQ ID NO: 83726

SEQ ID NO: 573149 - RNA, 64 nt, hsa; identical to SEQ ID NO: 83727

SEQ ID NO: 573150 - RNA, 64 nt, hsa; identical to SEQ ID NO: 83728

SEQ ID NO: 573151 - RNA, 64 nt, hsa; identical to SEQ ID NO: 83729

SEQ ID NO: 573152 - RNA, 64 nt, hsa; identical to SEQ ID NO: 83730

SEQ ID NO: 573153 - RNA, 64 nt, hsa; identical to SEQ ID NO: 83731

SEQ ID NO: 573154 - RNA, 64 nt, hsa; identical to SEQ ID NO: 234346

SEQ ID NO: 573155 - RNA, 64 nt, hsa; identical to SEQ ID NO: 234347

SEQ ID NO: 573156 - RNA, 64 nt, hsa; identical to SEQ ID NO: 234348

SEQ ID NO: 573157 - RNA, 64 nt, hsa; identical to SEQ ID NO: 234349

SEQ ID NO: 573158 - RNA, 64 nt, hsa; identical to SEQ ID NO: 234350

SEQ ID NO: 573159 - RNA, 64 nt, hsa; identical to SEQ ID NO: 234351

SEQ ID NO: 573160 - RNA, 64 nt, hsa; identical to SEQ ID NO: 234352

SEQ ID NO: 573161 - RNA, 64 nt, hsa; identical to SEQ ID NO: 234353

SEQ ID NO: 573162 - RNA, 64 nt, hsa; identical to SEQ ID NO: 234354

SEQ ID NO: 573163 - RNA, 64 nt, hsa; identical to SEQ ID NO: 234355

SEQ ID NO: 573164 - RNA, 64 nt, hsa; identical to SEQ ID NO: 234356

SEQ ID NO: 573165 - RNA, 64 nt, hsa; identical to SEQ ID NO: 234357

SEQ ID NO: 573166 - RNA, 64 nt, hsa; identical to SEQ ID NO: 150696

SEQ ID NO: 573167 - RNA, 64 nt, hsa; identical to SEQ ID NO: 150697

SEQ ID NO: 573168 - RNA, 64 nt, hsa; identical to SEQ ID NO: 150698

SEQ ID NO: 573169 - RNA, 64 nt, hsa; identical to SEQ ID NO: 150699

SEQ ID NO: 573170 - RNA, 64 nt, hsa
gcaggcaggacuccuugugcucccagcagcucagacagggaaaggauaguccccacucacggug

SEQ ID NO: 573171 - RNA, 64 nt, hsa
gaaucucaucaaccagggaagaggaacugagaucacagggaaggagauuggaggugauaccagc

SEQ ID NO: 573172 - RNA, 64 nt, hsa
auucuucagcgugucugguaccuuggauguucaaacagggaacacugucagggcugaggagaac

SEQ ID NO: 573173 - RNA, 64 nt, hsa
uggauccagaacaugacaacagagagcugcguccacagggaacaaagcccugaccucucucucc

SEQ ID NO: 573174 - RNA, 64 nt, hsa
accuguuauguugcuuuuggaaggagacucuaagacagggaaagcaaguucaugguacauacgc

SEQ ID NO: 573175 - RNA, 64 nt, hsa
gaggccugcccagacuaggaggcagcggggauagacagggaauggggagaagaaagacccccau

SEQ ID NO: 573176 - RNA, 64 nt, hsa
gugcccagaauuuaccaucaucucugaaggaguuacagggaaguggucuccccaauucuccccu

SEQ ID NO: 573177 - RNA, 64 nt, hsa
ccuuuugcucucugugacccuaagagcacacugcacagggaaaauugccccauccagaccuggc

SEQ ID NO: 573178 - RNA, 64 nt, hsa
gaaacuugggucuugcugcccauccuuccucagcacagggaacccggaagcccguugcacugac

SEQ ID NO: 573179 - RNA, 64 nt, hsa
ucgugcauacaugcggggaccccagacugucagcacagggaagauggaucccauccuaauuuuu

SEQ ID NO: 573180 - RNA, 64 nt, hsa
ucuccccagcucugcccucuggguccacaugaggacagggaagcucgggaaggggaagggagac

SEQ ID NO: 573181 - RNA, 64 nt, hsa
ccccgcugggcacucucugucccaucccucuaggacagggaagcuggccugguccagggcacug

SEQ ID NO: 573182 - RNA, 64 nt, hsa
gccuucucuguggcuacaagggacccacagaauuacagggaaguuacagggaagcagguuucau

SEQ ID NO: 573183 - RNA, 64 nt, hsa
ggcuacaagggacccacagaauuacagggaaguuacagggaagcagguuucaucucaauauugg

SEQ ID NO: 573184 - RNA, 64 nt, hsa
auacaaacacuacagacaauaaauauuaggagacacagggaaguggggagagguggggaguaau

SEQ ID NO: 573185 - RNA, 64 nt, hsa
gggaaguggggagagguggggaguaauaguaaacacagggaagagcuccccuacggaccaggua

SEQ ID NO: 573186 - RNA, 64 nt, hsa
guguguguggcagcaggcagcggggaggggaggaacagggaagggggagcuggggagcuuggcu

SEQ ID NO: 573187 - RNA, 64 nt, hsa
gaguacaggcuuggagaaauggcuaggacagggaacagggaagcacuuacaauuauuccuugau

SEQ ID NO: 573188 - RNA, 64 nt, hsa
ggagccugaguacaggcuuggagaaauggcuaggacagggaacagggaagcacuuacaauuauu

SEQ ID NO: 573189 - RNA, 64 nt, hsa
agcuucguuguucucauagaaccaacagcaucugagcccucaacaccaacagcaccauccucug

SEQ ID NO: 573190 - RNA, 64 nt, hsa
cgcccagcacccuauugauggcuauaggacagguagcccucauuuccaugccugauaaccccuu

SEQ ID NO: 573191 - RNA, 64 nt, hsa
ggagcugaccaagccuuggcccggugacaccugcagcccucacuccugucaucccaggacacuu

SEQ ID NO: 573192 - RNA, 64 nt, hsa
cagcuggggaggacauggcgcccggugcccuaggagcccucaguguccccuaccugaccugucu

SEQ ID NO: 573193 - RNA, 64 nt, hsa
gcuggagcuaaggccagcuagagcuuccacugucagcccucacugucagucccacugcaccccc

SEQ ID NO: 573194 - RNA, 64 nt, hsa
ccaaaaccagagggcagucuaguccuggggguaaagcccucagaucccaggguacacucuucuc

SEQ ID NO: 573195 - RNA, 64 nt, hsa
accgugccccaugcaggggcucccuccagcacacagcccucaccccagcacagccagcaaggac

SEQ ID NO: 573196 - RNA, 64 nt, hsa
gcccagggugcugugaccgaugagaccucagcucagcccucaggugcaguggcccuacccagcc

SEQ ID NO: 573197 - RNA, 64 nt, hsa
ucuuucccuggucuuuuagucuaguccuuuggcaagcccucaaccucagauuaauccuauuuau

SEQ ID NO: 573198 - RNA, 64 nt, hsa
aaucacuacaagugucucacuucagccuuagaaaagcccucaauguaaaccuuauguuuguuac

SEQ ID NO: 573199 - RNA, 64 nt, hsa
guccagaccucggcugccacgccccaggaccugcagcccucaugggggcuggggauccccauca

SEQ ID NO: 573200 - RNA, 64 nt, hsa
ucauccuggccugcccucuagacuccaguccccaagcccucagccuagugggugucauggaugg

SEQ ID NO: 573201 - RNA, 64 nt, hsa
agccaucaaggcuguggggaggaaccauaaacccagcccucacagcucccagcacagggccucc

SEQ ID NO: 573202 - RNA, 64 nt, hsa
gagcucaaaccucuagucugggaugagcucacagagcccucaugaguuaagauccauccauauc

SEQ ID NO: 573203 - RNA, 64 nt, hsa
uuguguaacuaauuugugguaaaguaguugauucagcccucagaagaaaacuuuuguuuagagc

SEQ ID NO: 573204 - RNA, 64 nt, hsa
aaagaaaucuccuaacaaaagaacuaagaggcccagcccucagaaacccuucagugcuacauuu

SEQ ID NO: 573205 - RNA, 64 nt, hsa
guacuaaacccgcaccccagugcggacccuucccagcccucaucccacuuccuuuccuacuguc

SEQ ID NO: 573206 - RNA, 64 nt, hsa
ccaucgucucauccuccuuucaguucguugguagagcccucagaaccauuuaagagacucuuua

SEQ ID NO: 573207 - RNA, 54 nt, hsa
cuuuagauagugcugacugauucuagcccucagggaugaggaugaaaagcugga

SEQ ID NO: 573208 - RNA, 64 nt, hsa
gccacagacaaaccacccccacuccuacccagccagcccucaaaacacaaaggaacaaagacag

SEQ ID NO: 573209 - RNA, 64 nt, hsa
uccucucugagcagccuccuaccuccccugccugagcccucacuccacagcccucccagguacc

SEQ ID NO: 573210 - RNA, 64 nt, hsa
acucuuuggggccccuuucuggggguuccccaucagcccucauuucuuauaauacccugauccc

SEQ ID NO: 573211 - RNA, 64 nt, hsa
uaugcucucggucuuuccuggaggcugccaacccagcccucauccucccuugcucacaaaguua

SEQ ID NO: 573212 - RNA, 64 nt, hsa
ugugcucguccagcucaccaccacagccccucucagcccucaguaggugggaggggccagcugc

SEQ ID NO: 573213 - RNA, 64 nt, hsa
ccuccccaccucagccuggggaggagaagcuggcagcccucacugcaggaggaagguauuggcc

SEQ ID NO: 573214 - RNA, 64 nt, hsa
gaucagaagucgcagcucuggugggaggaaggcgagcccucaugugugucccugugccacuuug

SEQ ID NO: 573215 - RNA, 64 nt, hsa; identical to SEQ ID NO: 325163

SEQ ID NO: 573216 - RNA, 64 nt, hsa; identical to SEQ ID NO: 325164

SEQ ID NO: 573217 - RNA, 64 nt, hsa; identical to SEQ ID NO: 325165

SEQ ID NO: 573218 - RNA, 64 nt, hsa; identical to SEQ ID NO: 325166

SEQ ID NO: 573219 - RNA, 64 nt, hsa; identical to SEQ ID NO: 325167

SEQ ID NO: 573220 - RNA, 64 nt, hsa; identical to SEQ ID NO: 325168

SEQ ID NO: 573221 - RNA, 64 nt, hsa; identical to SEQ ID NO: 325169

SEQ ID NO: 573222 - RNA, 64 nt, hsa; identical to SEQ ID NO: 325170

SEQ ID NO: 573223 - RNA, 64 nt, hsa; identical to SEQ ID NO: 325171

SEQ ID NO: 573224 - RNA, 64 nt, hsa; identical to SEQ ID NO: 325172

SEQ ID NO: 573225 - RNA, 64 nt, hsa; identical to SEQ ID NO: 325173

SEQ ID NO: 573226 - RNA, 64 nt, hsa; identical to SEQ ID NO: 325174

SEQ ID NO: 573227 - RNA, 64 nt, hsa; identical to SEQ ID NO: 325175

SEQ ID NO: 573228 - RNA, 64 nt, hsa; identical to SEQ ID NO: 325176

SEQ ID NO: 573229 - RNA, 64 nt, hsa; identical to SEQ ID NO: 325177

SEQ ID NO: 573230 - RNA, 64 nt, hsa; identical to SEQ ID NO: 325178

SEQ ID NO: 573231 - RNA, 64 nt, hsa; identical to SEQ ID NO: 325179

SEQ ID NO: 573232 - RNA, 64 nt, hsa; identical to SEQ ID NO: 325180

SEQ ID NO: 573233 - RNA, 64 nt, hsa; identical to SEQ ID NO: 325181

SEQ ID NO: 573234 - RNA, 64 nt, hsa; identical to SEQ ID NO: 325182

SEQ ID NO: 573235 - RNA, 64 nt, hsa; identical to SEQ ID NO: 325183

SEQ ID NO: 573236 - RNA, 64 nt, hsa; identical to SEQ ID NO: 325184

SEQ ID NO: 573237 - RNA, 64 nt, hsa; identical to SEQ ID NO: 325185

SEQ ID NO: 573238 - RNA, 64 nt, hsa; identical to SEQ ID NO: 325186

SEQ ID NO: 573239 - RNA, 64 nt, hsa; identical to SEQ ID NO: 325187

SEQ ID NO: 573240 - RNA, 64 nt, hsa; identical to SEQ ID NO: 325188

SEQ ID NO: 573241 - RNA, 64 nt, hsa; identical to SEQ ID NO: 325189

SEQ ID NO: 573242 - RNA, 64 nt, hsa; identical to SEQ ID NO: 325190

SEQ ID NO: 573243 - RNA, 64 nt, hsa; identical to SEQ ID NO: 325191

SEQ ID NO: 573244 - RNA, 64 nt, hsa; identical to SEQ ID NO: 325192

SEQ ID NO: 573245 - RNA, 64 nt, hsa; identical to SEQ ID NO: 325193

SEQ ID NO: 573246 - RNA, 64 nt, hsa; identical to SEQ ID NO: 325194

SEQ ID NO: 573247 - RNA, 64 nt, hsa; identical to SEQ ID NO: 325195

SEQ ID NO: 573248 - RNA, 64 nt, hsa; identical to SEQ ID NO: 325196

SEQ ID NO: 573249 - RNA, 64 nt, hsa; identical to SEQ ID NO: 325197

SEQ ID NO: 573250 - RNA, 64 nt, hsa; identical to SEQ ID NO: 325198

SEQ ID NO: 573251 - RNA, 64 nt, hsa; identical to SEQ ID NO: 325199

SEQ ID NO: 573252 - RNA, 64 nt, hsa; identical to SEQ ID NO: 325200

SEQ ID NO: 573253 - RNA, 64 nt, hsa; identical to SEQ ID NO: 325201

SEQ ID NO: 573254 - RNA, 64 nt, hsa; identical to SEQ ID NO: 325202

SEQ ID NO: 573255 - RNA, 64 nt, hsa; identical to SEQ ID NO: 325203

SEQ ID NO: 573256 - RNA, 64 nt, hsa; identical to SEQ ID NO: 325204

SEQ ID NO: 573257 - RNA, 64 nt, hsa; identical to SEQ ID NO: 325205

SEQ ID NO: 573258 - RNA, 64 nt, hsa; identical to SEQ ID NO: 325206

SEQ ID NO: 573259 - RNA, 64 nt, hsa; identical to SEQ ID NO: 325207

SEQ ID NO: 573260 - RNA, 64 nt, hsa; identical to SEQ ID NO: 325208

SEQ ID NO: 573261 - RNA, 64 nt, hsa; identical to SEQ ID NO: 325209

SEQ ID NO: 573262 - RNA, 64 nt, hsa; identical to SEQ ID NO: 325210

SEQ ID NO: 573263 - RNA, 64 nt, hsa; identical to SEQ ID NO: 93499

SEQ ID NO: 573264 - RNA, 64 nt, hsa; identical to SEQ ID NO: 93500

SEQ ID NO: 573265 - RNA, 64 nt, hsa; identical to SEQ ID NO: 93501

SEQ ID NO: 573266 - RNA, 64 nt, hsa; identical to SEQ ID NO: 93502

SEQ ID NO: 573267 - RNA, 64 nt, hsa; identical to SEQ ID NO: 93503

SEQ ID NO: 573268 - RNA, 64 nt, hsa; identical to SEQ ID NO: 93504

SEQ ID NO: 573269 - RNA, 64 nt, hsa; identical to SEQ ID NO: 93505

SEQ ID NO: 573270 - RNA, 64 nt, hsa; identical to SEQ ID NO: 93506

SEQ ID NO: 573271 - RNA, 64 nt, hsa; identical to SEQ ID NO: 93507

SEQ ID NO: 573272 - RNA, 64 nt, hsa; identical to SEQ ID NO: 93508

SEQ ID NO: 573273 - RNA, 64 nt, hsa; identical to SEQ ID NO: 93509

SEQ ID NO: 573274 - RNA, 64 nt, hsa; identical to SEQ ID NO: 93510

SEQ ID NO: 573275 - RNA, 64 nt, hsa; identical to SEQ ID NO: 93511

SEQ ID NO: 573276 - RNA, 64 nt, hsa; identical to SEQ ID NO: 93512

SEQ ID NO: 573277 - RNA, 64 nt, hsa; identical to SEQ ID NO: 93513

SEQ ID NO: 573278 - RNA, 64 nt, hsa; identical to SEQ ID NO: 93514

SEQ ID NO: 573279 - RNA, 64 nt, hsa; identical to SEQ ID NO: 93515

SEQ ID NO: 573280 - RNA, 64 nt, hsa; identical to SEQ ID NO: 93516

SEQ ID NO: 573281 - RNA, 64 nt, hsa; identical to SEQ ID NO: 93517

SEQ ID NO: 573282 - RNA, 64 nt, hsa; identical to SEQ ID NO: 93518

SEQ ID NO: 573283 - RNA, 64 nt, hsa; identical to SEQ ID NO: 93519

SEQ ID NO: 573284 - RNA, 64 nt, hsa; identical to SEQ ID NO: 93520

SEQ ID NO: 573285 - RNA, 64 nt, hsa; identical to SEQ ID NO: 93521

SEQ ID NO: 573286 - RNA, 64 nt, hsa; identical to SEQ ID NO: 93522

SEQ ID NO: 573287 - RNA, 64 nt, hsa; identical to SEQ ID NO: 93523

SEQ ID NO: 573288 - RNA, 64 nt, hsa; identical to SEQ ID NO: 93524

SEQ ID NO: 573289 - RNA, 64 nt, hsa; identical to SEQ ID NO: 93525

SEQ ID NO: 573290 - RNA, 64 nt, hsa; identical to SEQ ID NO: 93526

SEQ ID NO: 573291 - RNA, 64 nt, hsa; identical to SEQ ID NO: 93527

SEQ ID NO: 573292 - RNA, 64 nt, hsa; identical to SEQ ID NO: 93528

SEQ ID NO: 573293 - RNA, 64 nt, hsa; identical to SEQ ID NO: 93529

SEQ ID NO: 573294 - RNA, 64 nt, hsa; identical to SEQ ID NO: 93530

SEQ ID NO: 573295 - RNA, 64 nt, hsa; identical to SEQ ID NO: 93531

SEQ ID NO: 573296 - RNA, 64 nt, hsa; identical to SEQ ID NO: 93532

SEQ ID NO: 573297 - RNA, 64 nt, hsa; identical to SEQ ID NO: 93533

SEQ ID NO: 573298 - RNA, 64 nt, hsa; identical to SEQ ID NO: 93534

SEQ ID NO: 573299 - RNA, 64 nt, hsa; identical to SEQ ID NO: 93535

SEQ ID NO: 573300 - RNA, 64 nt, hsa; identical to SEQ ID NO: 93536

SEQ ID NO: 573301 - RNA, 64 nt, hsa; identical to SEQ ID NO: 93537

SEQ ID NO: 573302 - RNA, 64 nt, hsa; identical to SEQ ID NO: 93538

SEQ ID NO: 573303 - RNA, 64 nt, hsa; identical to SEQ ID NO: 93539

SEQ ID NO: 573304 - RNA, 64 nt, hsa; identical to SEQ ID NO: 93540

SEQ ID NO: 573305 - RNA, 64 nt, hsa; identical to SEQ ID NO: 93541

SEQ ID NO: 573306 - RNA, 64 nt, hsa; identical to SEQ ID NO: 93542

SEQ ID NO: 573307 - RNA, 64 nt, hsa; identical to SEQ ID NO: 93543

SEQ ID NO: 573308 - RNA, 64 nt, hsa; identical to SEQ ID NO: 93544

SEQ ID NO: 573309 - RNA, 64 nt, hsa; identical to SEQ ID NO: 93545

SEQ ID NO: 573310 - RNA, 64 nt, hsa; identical to SEQ ID NO: 93546

SEQ ID NO: 573311 - RNA, 64 nt, hsa; identical to SEQ ID NO: 93547

SEQ ID NO: 573312 - RNA, 64 nt, hsa; identical to SEQ ID NO: 93548

SEQ ID NO: 573313 - RNA, 64 nt, hsa; identical to SEQ ID NO: 93549

SEQ ID NO: 573314 - RNA, 64 nt, hsa; identical to SEQ ID NO: 93550

SEQ ID NO: 573315 - RNA, 64 nt, hsa; identical to SEQ ID NO: 93551

SEQ ID NO: 573316 - RNA, 64 nt, hsa; identical to SEQ ID NO: 93552

SEQ ID NO: 573317 - RNA, 64 nt, hsa; identical to SEQ ID NO: 93553

SEQ ID NO: 573318 - RNA, 64 nt, hsa; identical to SEQ ID NO: 93554

SEQ ID NO: 573319 - RNA, 64 nt, hsa; identical to SEQ ID NO: 93555

SEQ ID NO: 573320 - RNA, 64 nt, hsa; identical to SEQ ID NO: 93556

SEQ ID NO: 573321 - RNA, 64 nt, hsa; identical to SEQ ID NO: 93557

SEQ ID NO: 573322 - RNA, 64 nt, hsa; identical to SEQ ID NO: 93558

SEQ ID NO: 573323 - RNA, 64 nt, hsa; identical to SEQ ID NO: 93559

SEQ ID NO: 573324 - RNA, 64 nt, hsa; identical to SEQ ID NO: 93560

SEQ ID NO: 573325 - RNA, 64 nt, hsa; identical to SEQ ID NO: 93561

SEQ ID NO: 573326 - RNA, 64 nt, hsa; identical to SEQ ID NO: 93562

SEQ ID NO: 573327 - RNA, 64 nt, hsa; identical to SEQ ID NO: 93563

SEQ ID NO: 573328 - RNA, 64 nt, hsa; identical to SEQ ID NO: 93564

SEQ ID NO: 573329 - RNA, 64 nt, hsa; identical to SEQ ID NO: 93565

SEQ ID NO: 573330 - RNA, 64 nt, hsa; identical to SEQ ID NO: 93566

SEQ ID NO: 573331 - RNA, 64 nt, hsa; identical to SEQ ID NO: 93567

SEQ ID NO: 573332 - RNA, 64 nt, hsa; identical to SEQ ID NO: 93568

SEQ ID NO: 573333 - RNA, 64 nt, hsa; identical to SEQ ID NO: 93569

SEQ ID NO: 573334 - RNA, 64 nt, hsa; identical to SEQ ID NO: 93570

SEQ ID NO: 573335 - RNA, 64 nt, hsa; identical to SEQ ID NO: 93571

SEQ ID NO: 573336 - RNA, 64 nt, hsa; identical to SEQ ID NO: 93572

SEQ ID NO: 573337 - RNA, 64 nt, hsa; identical to SEQ ID NO: 93573

SEQ ID NO: 573338 - RNA, 64 nt, hsa; identical to SEQ ID NO: 93574

SEQ ID NO: 573339 - RNA, 64 nt, hsa; identical to SEQ ID NO: 93575

SEQ ID NO: 573340 - RNA, 64 nt, hsa; identical to SEQ ID NO: 93576

SEQ ID NO: 573341 - RNA, 64 nt, hsa; identical to SEQ ID NO: 93577

SEQ ID NO: 573342 - RNA, 64 nt, hsa; identical to SEQ ID NO: 93578

SEQ ID NO: 573343 - RNA, 64 nt, hsa; identical to SEQ ID NO: 93579

SEQ ID NO: 573344 - RNA, 64 nt, hsa; identical to SEQ ID NO: 93580

SEQ ID NO: 573345 - RNA, 64 nt, hsa; identical to SEQ ID NO: 93581

SEQ ID NO: 573346 - RNA, 64 nt, hsa; identical to SEQ ID NO: 93582

SEQ ID NO: 573347 - RNA, 64 nt, hsa; identical to SEQ ID NO: 23612

SEQ ID NO: 573348 - RNA, 64 nt, hsa; identical to SEQ ID NO: 23613

SEQ ID NO: 573349 - RNA, 64 nt, hsa; identical to SEQ ID NO: 23614

SEQ ID NO: 573350 - RNA, 64 nt, hsa; identical to SEQ ID NO: 23615

SEQ ID NO: 573351 - RNA, 64 nt, hsa; identical to SEQ ID NO: 23616

SEQ ID NO: 573352 - RNA, 64 nt, hsa; identical to SEQ ID NO: 23617

SEQ ID NO: 573353 - RNA, 64 nt, hsa; identical to SEQ ID NO: 23618

SEQ ID NO: 573354 - RNA, 64 nt, hsa; identical to SEQ ID NO: 23619

SEQ ID NO: 573355 - RNA, 64 nt, hsa; identical to SEQ ID NO: 23620

SEQ ID NO: 573356 - RNA, 64 nt, hsa; identical to SEQ ID NO: 23621

SEQ ID NO: 573357 - RNA, 64 nt, hsa; identical to SEQ ID NO: 23622

SEQ ID NO: 573358 - RNA, 64 nt, hsa; identical to SEQ ID NO: 23623

SEQ ID NO: 573359 - RNA, 64 nt, hsa; identical to SEQ ID NO: 23624

SEQ ID NO: 573360 - RNA, 64 nt, hsa; identical to SEQ ID NO: 23625

SEQ ID NO: 573361 - RNA, 64 nt, hsa; identical to SEQ ID NO: 23626

SEQ ID NO: 573362 - RNA, 64 nt, hsa; identical to SEQ ID NO: 23627

SEQ ID NO: 573363 - RNA, 64 nt, hsa; identical to SEQ ID NO: 363943

SEQ ID NO: 573364 - RNA, 64 nt, hsa; identical to SEQ ID NO: 363944

SEQ ID NO: 573365 - RNA, 64 nt, hsa; identical to SEQ ID NO: 363945

SEQ ID NO: 573366 - RNA, 64 nt, hsa; identical to SEQ ID NO: 363946

SEQ ID NO: 573367 - RNA, 64 nt, hsa; identical to SEQ ID NO: 363947

SEQ ID NO: 573368 - RNA, 64 nt, hsa; identical to SEQ ID NO: 363948

SEQ ID NO: 573369 - RNA, 64 nt, hsa; identical to SEQ ID NO: 363949

SEQ ID NO: 573370 - RNA, 64 nt, hsa; identical to SEQ ID NO: 363950

SEQ ID NO: 573371 - RNA, 64 nt, hsa; identical to SEQ ID NO: 363951

SEQ ID NO: 573372 - RNA, 64 nt, hsa; identical to SEQ ID NO: 363952

SEQ ID NO: 573373 - RNA, 64 nt, hsa; identical to SEQ ID NO: 363953

SEQ ID NO: 573374 - RNA, 64 nt, hsa; identical to SEQ ID NO: 363954

SEQ ID NO: 573375 - RNA, 64 nt, hsa; identical to SEQ ID NO: 363955

SEQ ID NO: 573376 - RNA, 64 nt, hsa; identical to SEQ ID NO: 363956

SEQ ID NO: 573377 - RNA, 64 nt, hsa; identical to SEQ ID NO: 363957

SEQ ID NO: 573378 - RNA, 64 nt, hsa; identical to SEQ ID NO: 363958

SEQ ID NO: 573379 - RNA, 64 nt, hsa; identical to SEQ ID NO: 363959

SEQ ID NO: 573380 - RNA, 64 nt, hsa; identical to SEQ ID NO: 363960

SEQ ID NO: 573381 - RNA, 64 nt, hsa; identical to SEQ ID NO: 363961

SEQ ID NO: 573382 - RNA, 64 nt, hsa; identical to SEQ ID NO: 363962

SEQ ID NO: 573383 - RNA, 64 nt, hsa; identical to SEQ ID NO: 363963

SEQ ID NO: 573384 - RNA, 64 nt, hsa; identical to SEQ ID NO: 363964

SEQ ID NO: 573385 - RNA, 64 nt, hsa; identical to SEQ ID NO: 363965

SEQ ID NO: 573386 - RNA, 64 nt, hsa; identical to SEQ ID NO: 363966

SEQ ID NO: 573387 - RNA, 64 nt, hsa; identical to SEQ ID NO: 363967

SEQ ID NO: 573388 - RNA, 64 nt, hsa; identical to SEQ ID NO: 363968

SEQ ID NO: 573389 - RNA, 64 nt, hsa; identical to SEQ ID NO: 363969

SEQ ID NO: 573390 - RNA, 64 nt, hsa; identical to SEQ ID NO: 363970

SEQ ID NO: 573391 - RNA, 64 nt, hsa; identical to SEQ ID NO: 363971

SEQ ID NO: 573392 - RNA, 64 nt, hsa; identical to SEQ ID NO: 363972

SEQ ID NO: 573393 - RNA, 64 nt, hsa; identical to SEQ ID NO: 363973

SEQ ID NO: 573394 - RNA, 64 nt, hsa; identical to SEQ ID NO: 363974

SEQ ID NO: 573395 - RNA, 64 nt, hsa; identical to SEQ ID NO: 363975

SEQ ID NO: 573396 - RNA, 64 nt, hsa; identical to SEQ ID NO: 363976

SEQ ID NO: 573397 - RNA, 64 nt, hsa; identical to SEQ ID NO: 363977

SEQ ID NO: 573398 - RNA, 64 nt, hsa; identical to SEQ ID NO: 363978

SEQ ID NO: 573399 - RNA, 63 nt, hsa; identical to SEQ ID NO: 363979

SEQ ID NO: 573400 - RNA, 64 nt, hsa; identical to SEQ ID NO: 363980

SEQ ID NO: 573401 - RNA, 64 nt, hsa; identical to SEQ ID NO: 363981

SEQ ID NO: 573402 - RNA, 64 nt, hsa; identical to SEQ ID NO: 363982

SEQ ID NO: 573403 - RNA, 64 nt, hsa; identical to SEQ ID NO: 363983

SEQ ID NO: 573404 - RNA, 64 nt, hsa; identical to SEQ ID NO: 363984

SEQ ID NO: 573405 - RNA, 64 nt, hsa; identical to SEQ ID NO: 363985

SEQ ID NO: 573406 - RNA, 64 nt, hsa; identical to SEQ ID NO: 363986

SEQ ID NO: 573407 - RNA, 64 nt, hsa; identical to SEQ ID NO: 363987

SEQ ID NO: 573408 - RNA, 64 nt, hsa; identical to SEQ ID NO: 363988

SEQ ID NO: 573409 - RNA, 64 nt, hsa; identical to SEQ ID NO: 363989

SEQ ID NO: 573410 - RNA, 64 nt, hsa; identical to SEQ ID NO: 363990

SEQ ID NO: 573411 - RNA, 64 nt, hsa; identical to SEQ ID NO: 363991

SEQ ID NO: 573412 - RNA, 64 nt, hsa; identical to SEQ ID NO: 363992

SEQ ID NO: 573413 - RNA, 64 nt, hsa; identical to SEQ ID NO: 363993

SEQ ID NO: 573414 - RNA, 64 nt, hsa; identical to SEQ ID NO: 363994

SEQ ID NO: 573415 - RNA, 64 nt, hsa; identical to SEQ ID NO: 116925

SEQ ID NO: 573416 - RNA, 64 nt, hsa; identical to SEQ ID NO: 116926

SEQ ID NO: 573417 - RNA, 64 nt, hsa; identical to SEQ ID NO: 116927

SEQ ID NO: 573418 - RNA, 64 nt, hsa; identical to SEQ ID NO: 116928

SEQ ID NO: 573419 - RNA, 64 nt, hsa; identical to SEQ ID NO: 116929

SEQ ID NO: 573420 - RNA, 64 nt, hsa; identical to SEQ ID NO: 116930

SEQ ID NO: 573421 - RNA, 64 nt, hsa; identical to SEQ ID NO: 116931

SEQ ID NO: 573422 - RNA, 64 nt, hsa; identical to SEQ ID NO: 116932

SEQ ID NO: 573423 - RNA, 64 nt, hsa; identical to SEQ ID NO: 116933

SEQ ID NO: 573424 - RNA, 63 nt, hsa; identical to SEQ ID NO: 116934

SEQ ID NO: 573425 - RNA, 64 nt, hsa; identical to SEQ ID NO: 116935

SEQ ID NO: 573426 - RNA, 64 nt, hsa; identical to SEQ ID NO: 116936

SEQ ID NO: 573427 - RNA, 64 nt, hsa; identical to SEQ ID NO: 116937

SEQ ID NO: 573428 - RNA, 64 nt, hsa; identical to SEQ ID NO: 116938

SEQ ID NO: 573429 - RNA, 64 nt, hsa; identical to SEQ ID NO: 116939

SEQ ID NO: 573430 - RNA, 64 nt, hsa; identical to SEQ ID NO: 116940

SEQ ID NO: 573431 - RNA, 64 nt, hsa; identical to SEQ ID NO: 116941

SEQ ID NO: 573432 - RNA, 64 nt, hsa; identical to SEQ ID NO: 116942

SEQ ID NO: 573433 - RNA, 64 nt, hsa; identical to SEQ ID NO: 116943

SEQ ID NO: 573434 - RNA, 64 nt, hsa; identical to SEQ ID NO: 116944

SEQ ID NO: 573435 - RNA, 64 nt, hsa; identical to SEQ ID NO: 116945

SEQ ID NO: 573436 - RNA, 64 nt, hsa; identical to SEQ ID NO: 116946

SEQ ID NO: 573437 - RNA, 64 nt, hsa; identical to SEQ ID NO: 116947

SEQ ID NO: 573438 - RNA, 64 nt, hsa; identical to SEQ ID NO: 116948

SEQ ID NO: 573439 - RNA, 64 nt, hsa; identical to SEQ ID NO: 116949

SEQ ID NO: 573440 - RNA, 64 nt, hsa; identical to SEQ ID NO: 116950

SEQ ID NO: 573441 - RNA, 64 nt, hsa; identical to SEQ ID NO: 116951

SEQ ID NO: 573442 - RNA, 64 nt, hsa; identical to SEQ ID NO: 116952

SEQ ID NO: 573443 - RNA, 64 nt, hsa; identical to SEQ ID NO: 116953

SEQ ID NO: 573444 - RNA, 64 nt, hsa; identical to SEQ ID NO: 116954

SEQ ID NO: 573445 - RNA, 64 nt, hsa; identical to SEQ ID NO: 116955

SEQ ID NO: 573446 - RNA, 64 nt, hsa; identical to SEQ ID NO: 116956

SEQ ID NO: 573447 - RNA, 64 nt, hsa; identical to SEQ ID NO: 116957

SEQ ID NO: 573448 - RNA, 64 nt, hsa; identical to SEQ ID NO: 116958

SEQ ID NO: 573449 - RNA, 64 nt, hsa; identical to SEQ ID NO: 116959

SEQ ID NO: 573450 - RNA, 64 nt, hsa; identical to SEQ ID NO: 116960

SEQ ID NO: 573451 - RNA, 64 nt, hsa; identical to SEQ ID NO: 116961

SEQ ID NO: 573452 - RNA, 64 nt, hsa; identical to SEQ ID NO: 116962

SEQ ID NO: 573453 - RNA, 64 nt, hsa; identical to SEQ ID NO: 116963

SEQ ID NO: 573454 - RNA, 64 nt, hsa; identical to SEQ ID NO: 116964

SEQ ID NO: 573455 - RNA, 64 nt, hsa; identical to SEQ ID NO: 116965

SEQ ID NO: 573456 - RNA, 64 nt, hsa; identical to SEQ ID NO: 116966

SEQ ID NO: 573457 - RNA, 64 nt, hsa; identical to SEQ ID NO: 116967

SEQ ID NO: 573458 - RNA, 64 nt, hsa; identical to SEQ ID NO: 116968

SEQ ID NO: 573459 - RNA, 64 nt, hsa; identical to SEQ ID NO: 116969

SEQ ID NO: 573460 - RNA, 57 nt, hsa; identical to SEQ ID NO: 116970

SEQ ID NO: 573461 - RNA, 64 nt, hsa; identical to SEQ ID NO: 116971

SEQ ID NO: 573462 - RNA, 64 nt, hsa; identical to SEQ ID NO: 116972

SEQ ID NO: 573463 - RNA, 64 nt, hsa; identical to SEQ ID NO: 116973

SEQ ID NO: 573464 - RNA, 64 nt, hsa; identical to SEQ ID NO: 116971

SEQ ID NO: 573465 - RNA, 64 nt, hsa; identical to SEQ ID NO: 116975

SEQ ID NO: 573466 - RNA, 64 nt, hsa; identical to SEQ ID NO: 116976

SEQ ID NO: 573467 - RNA, 64 nt, hsa; identical to SEQ ID NO: 116977

SEQ ID NO: 573468 - RNA, 64 nt, hsa; identical to SEQ ID NO: 116978

SEQ ID NO: 573469 - RNA, 64 nt, hsa; identical to SEQ ID NO: 116979

SEQ ID NO: 573470 - RNA, 64 nt, hsa; identical to SEQ ID NO: 116980

SEQ ID NO: 573471 - RNA, 64 nt, hsa; identical to SEQ ID NO: 116981

SEQ ID NO: 573472 - RNA, 64 nt, hsa; identical to SEQ ID NO: 116982

SEQ ID NO: 573473 - RNA, 64 nt, hsa; identical to SEQ ID NO: 116983

SEQ ID NO: 573474 - RNA, 64 nt, hsa; identical to SEQ ID NO: 116984

SEQ ID NO: 573475 - RNA, 64 nt, hsa; identical to SEQ ID NO: 116985

SEQ ID NO: 573476 - RNA, 64 nt, hsa; identical to SEQ ID NO: 116986

SEQ ID NO: 573477 - RNA, 64 nt, hsa; identical to SEQ ID NO: 116987

SEQ ID NO: 573478 - RNA, 64 nt, hsa; identical to SEQ ID NO: 116988

SEQ ID NO: 573479 - RNA, 64 nt, hsa; identical to SEQ ID NO: 116989

SEQ ID NO: 573480 - RNA, 64 nt, hsa; identical to SEQ ID NO: 116990

SEQ ID NO: 573481 - RNA, 64 nt, hsa; identical to SEQ ID NO: 116991

SEQ ID NO: 573482 - RNA, 64 nt, hsa; identical to SEQ ID NO: 116992

SEQ ID NO: 573483 - RNA, 64 nt, hsa; identical to SEQ ID NO: 116993

SEQ ID NO: 573484 - RNA, 64 nt, hsa; identical to SEQ ID NO: 116994

SEQ ID NO: 573485 - RNA, 64 nt, hsa; identical to SEQ ID NO: 116995

SEQ ID NO: 573486 - RNA, 64 nt, hsa; identical to SEQ ID NO: 116996

SEQ ID NO: 573487 - RNA, 64 nt, hsa; identical to SEQ ID NO: 116997

SEQ ID NO: 573488 - RNA, 64 nt, hsa; identical to SEQ ID NO: 116998

SEQ ID NO: 573489 - RNA, 64 nt, hsa; identical to SEQ ID NO: 116999

SEQ ID NO: 573490 - RNA, 64 nt, hsa; identical to SEQ ID NO: 117000

SEQ ID NO: 573491 - RNA, 64 nt, hsa; identical to SEQ ID NO: 117001

SEQ ID NO: 573492 - RNA, 64 nt, hsa; identical to SEQ ID NO: 117002

SEQ ID NO: 573493 - RNA, 64 nt, hsa; identical to SEQ ID NO: 117003

SEQ ID NO: 573494 - RNA, 64 nt, hsa; identical to SEQ ID NO: 117004

SEQ ID NO: 573495 - RNA, 64 nt, hsa; identical to SEQ ID NO: 117005

SEQ ID NO: 573496 - RNA, 64 nt, hsa; identical to SEQ ID NO: 117006

SEQ ID NO: 573497 - RNA, 64 nt, hsa; identical to SEQ ID NO: 117007

SEQ ID NO: 573498 - RNA, 64 nt, hsa; identical to SEQ ID NO: 117008

SEQ ID NO: 573499 - RNA, 64 nt, hsa; identical to SEQ ID NO: 117009

SEQ ID NO: 573500 - RNA, 64 nt, hsa; identical to SEQ ID NO: 117010

SEQ ID NO: 573501 - RNA, 64 nt, hsa; identical to SEQ ID NO: 117011

SEQ ID NO: 573502 - RNA, 64 nt, hsa; identical to SEQ ID NO: 117012

SEQ ID NO: 573503 - RNA, 64 nt, hsa; identical to SEQ ID NO: 117013

SEQ ID NO: 573504 - RNA, 64 nt, hsa; identical to SEQ ID NO: 117014

SEQ ID NO: 573505 - RNA, 64 nt, hsa; identical to SEQ ID NO: 117015

SEQ ID NO: 573506 - RNA, 64 nt, hsa; identical to SEQ ID NO: 117016

SEQ ID NO: 573507 - RNA, 64 nt, hsa; identical to SEQ ID NO: 117017

SEQ ID NO: 573508 - RNA, 64 nt, hsa; identical to SEQ ID NO: 117018

SEQ ID NO: 573509 - RNA, 64 nt, hsa; identical to SEQ ID NO: 117019

SEQ ID NO: 573510 - RNA, 64 nt, hsa; identical to SEQ ID NO: 117020

SEQ ID NO: 573511 - RNA, 64 nt, hsa; identical to SEQ ID NO: 117021

SEQ ID NO: 573512 - RNA, 64 nt, hsa; identical to SEQ ID NO: 117022

SEQ ID NO: 573513 - RNA, 64 nt, hsa; identical to SEQ ID NO: 117023

SEQ ID NO: 573514 - RNA, 64 nt, hsa; identical to SEQ ID NO: 117024

SEQ ID NO: 573515 - RNA, 64 nt, hsa; identical to SEQ ID NO: 117025

SEQ ID NO: 573516 - RNA, 64 nt, hsa; identical to SEQ ID NO: 117026

SEQ ID NO: 573517 - RNA, 64 nt, hsa; identical to SEQ ID NO: 117027

SEQ ID NO: 573518 - RNA, 64 nt, hsa; identical to SEQ ID NO: 117028

SEQ ID NO: 573519 - RNA, 64 nt, hsa; identical to SEQ ID NO: 117029

SEQ ID NO: 573520 - RNA, 64 nt, hsa; identical to SEQ ID NO: 117030

SEQ ID NO: 573521 - RNA, 64 nt, hsa; identical to SEQ ID NO: 117031

SEQ ID NO: 573522 - RNA, 64 nt, hsa; identical to SEQ ID NO: 117032

SEQ ID NO: 573523 - RNA, 64 nt, hsa; identical to SEQ ID NO: 117033

SEQ ID NO: 573524 - RNA, 64 nt, hsa; identical to SEQ ID NO: 117034

SEQ ID NO: 573525 - RNA, 64 nt, hsa; identical to SEQ ID NO: 117035

SEQ ID NO: 573526 - RNA, 64 nt, hsa; identical to SEQ ID NO: 117036

SEQ ID NO: 573527 - RNA, 64 nt, hsa; identical to SEQ ID NO: 117037

SEQ ID NO: 573528 - RNA, 64 nt, hsa; identical to SEQ ID NO: 117038

SEQ ID NO: 573529 - RNA, 64 nt, hsa; identical to SEQ ID NO: 117039

SEQ ID NO: 573530 - RNA, 64 nt, hsa; identical to SEQ ID NO: 117040

SEQ ID NO: 573531 - RNA, 64 nt, hsa; identical to SEQ ID NO: 117041

SEQ ID NO: 573532 - RNA, 64 nt, hsa; identical to SEQ ID NO: 117042

SEQ ID NO: 573533 - RNA, 64 nt, hsa; identical to SEQ ID NO: 117043

SEQ ID NO: 573534 - RNA, 64 nt, hsa; identical to SEQ ID NO: 117044

SEQ ID NO: 573535 - RNA, 64 nt, hsa; identical to SEQ ID NO: 117045

SEQ ID NO: 573536 - RNA, 64 nt, hsa; identical to SEQ ID NO: 117046
